United States Patent 8,445,666 (RIBONUCLEIC ACID INTERFERENCE MOLECULES) - sequence listing, part 6

SEQ ID NO: 117418 - DNA, 23 bp, Homo sapiens
ttgggcactgcatgacttctcag

SEQ ID NO: 117419 - DNA, 21 bp, Homo sapiens
aacgaattcaacttggtcatg

SEQ ID NO: 117420 - DNA, 23 bp, Homo sapiens
ttattgctaggtttggtttgcta

SEQ ID NO: 117421 - DNA, 23 bp, Homo sapiens
tacatgtgcacaatgtgcaggtt

SEQ ID NO: 117422 - DNA, 23 bp, Homo sapiens
acaatcacaactccgtagaacct

SEQ ID NO: 117423 - DNA, 22 bp, Homo sapiens
tatgtatatatgtatatatgaa

SEQ ID NO: 117424 - DNA, 23 bp, Homo sapiens
tatgtatatgtatatgtgtgtgt

SEQ ID NO: 117425 - DNA, 19 bp, Homo sapiens
tgactctgacagctctggc

SEQ ID NO: 117426 - DNA, 23 bp, Homo sapiens
atttatctttggatgttgtctgt

SEQ ID NO: 117427 - DNA, 23 bp, Homo sapiens
gggtctcactctgtcacccaggc

SEQ ID NO: 117428 - DNA, 23 bp, Homo sapiens
tatacacatacacgtatacatat

SEQ ID NO: 117429 - DNA, 23 bp, Homo sapiens
ggttgaggttacagtgagccgtg

SEQ ID NO: 117430 - DNA, 21 bp, Homo sapiens
gtggacatgggtagttaatgg

SEQ ID NO: 117431 - DNA, 23 bp, Homo sapiens
gagacagtctcgctctgtcacca

SEQ ID NO: 117432 - DNA, 23 bp, Homo sapiens
ctgggtgactctctggctccctg

SEQ ID NO: 117433 - DNA, 23 bp, Homo sapiens
tgagttcattgtagattctggat

SEQ ID NO: 117434 - DNA, 23 bp, Homo sapiens
tgagttcattgtagattctggat

SEQ ID NO: 117435 - DNA, 23 bp, Homo sapiens
tgagttcattgtagattctggat

SEQ ID NO: 117436 - DNA, 23 bp, Homo sapiens
tgagttcattgtagattctggat

SEQ ID NO: 117437 - DNA, 18 bp, Homo sapiens
atggaggacagtagctct

SEQ ID NO: 117438 - DNA, 22 bp, Homo sapiens
agactaggactgatttggctct

SEQ ID NO: 117439 - DNA, 19 bp, Homo sapiens
cctgcagcagctgcatctg

SEQ ID NO: 117440 - DNA, 23 bp, Homo sapiens
tctgggtgtctcagggcctgttc

SEQ ID NO: 117441 - DNA, 23 bp, Homo sapiens
tcagtctgtatgtgtctccctgt

SEQ ID NO: 117442 - DNA, 18 bp, Homo sapiens
tatatgcagacacacata

SEQ ID NO: 117443 - DNA, 23 bp, Homo sapiens
ctcctctgtcacactgtggctct

SEQ ID NO: 117444 - DNA, 22 bp, Homo sapiens
atatgtgtatatgtatatatgt

SEQ ID NO: 117445 - DNA, 23 bp, Homo sapiens
taatgtatgtatgtatatgttgg

SEQ ID NO: 117446 - DNA, 23 bp, Homo sapiens
gtgtctctctgtctgattatcct

SEQ ID NO: 117447 - DNA, 19 bp, Homo sapiens
tgagttgtttccagtattc

SEQ ID NO: 117448 - DNA, 19 bp, Homo sapiens
gagtcttctgtggttctac

SEQ ID NO: 117449 - DNA, 23 bp, Homo sapiens
aatgtcattggaatttttgtagg

SEQ ID NO: 117450 - DNA, 22 bp, Homo sapiens
tagaatctttttctgtttccat

SEQ ID NO: 117451 - DNA, 20 bp, Homo sapiens
agttagtaagtaatttgtgg

SEQ ID NO: 117452 - DNA, 23 bp, Homo sapiens
ctgtgtctgttttggtaatttgt

SEQ ID NO: 117453 - DNA, 18 bp, Homo sapiens
ttcatttaagttgctgaa

SEQ ID NO: 117454 - DNA, 22 bp, Homo sapiens
tttgatgtcttaaaggatggtg

SEQ ID NO: 117455 - DNA, 21 bp, Homo sapiens
tgtgcctgtgtatgtgcgtgc

SEQ ID NO: 117456 - DNA, 23 bp, Homo sapiens
gcatgtgtgtgtgcatgtgcatg

SEQ ID NO: 117457 - DNA, 19 bp, Homo sapiens
tatgtgtgcatgtgtgtgc

SEQ ID NO: 117458 - DNA, 23 bp, Homo sapiens
ttgaagacaattctcttacttct

SEQ ID NO: 117459 - DNA, 22 bp, Homo sapiens
ttctctgatcattggtgtgtga

SEQ ID NO: 117460 - DNA, 23 bp, Homo sapiens
ggctctgcctcactgtgaccctg

SEQ ID NO: 117461 - DNA, 23 bp, Homo sapiens
attctgcctgcttcagtctagct

SEQ ID NO: 117462 - DNA, 19 bp, Homo sapiens
gaggagagaaacctcagag

SEQ ID NO: 117463 - DNA, 19 bp, Homo sapiens
tcccacggtctgtgtgtca

SEQ ID NO: 117464 - DNA, 23 bp, Homo sapiens
atagtgagactctgtctctgcaa

SEQ ID NO: 117465 - DNA, 23 bp, Homo sapiens
tgagacagagtctcgctctgttg

SEQ ID NO: 117466 - DNA, 19 bp, Homo sapiens
tctcgcagtctctgcggga

SEQ ID NO: 117467 - DNA, 18 bp, Homo sapiens
acacagagcacagagagg

SEQ ID NO: 117468 - DNA, 23 bp, Homo sapiens
ctgtgtgtctgagtgtctgagcc

SEQ ID NO: 117469 - DNA, 23 bp, Homo sapiens
ttggtagatacatgttggtcttg

SEQ ID NO: 117470 - DNA, 21 bp, Homo sapiens
tgagatggagtttcactcctg

SEQ ID NO: 117471 - DNA, 23 bp, Homo sapiens
gctttctcactcagtctttttgg

SEQ ID NO: 117472 - DNA, 23 bp, Homo sapiens
tgtggttatatagtgggtgtata

SEQ ID NO: 117473 - DNA, 23 bp, Homo sapiens
actctgtgaatggatattgtgtg

SEQ ID NO: 117474 - DNA, 23 bp, Homo sapiens
ttaagtcacacactcctaccctt

SEQ ID NO: 117475 - DNA, 20 bp, Homo sapiens
tgagaggtgacagtgtgctg

SEQ ID NO: 117476 - DNA, 20 bp, Homo sapiens
tggcgtgatcatggctcagt

SEQ ID NO: 117477 - DNA, 23 bp, Homo sapiens
agagtctcactctgtcacccagg

SEQ ID NO: 117478 - DNA, 22 bp, Homo sapiens
tatgactgggatactgaattct

SEQ ID NO: 117479 - DNA, 23 bp, Homo sapiens
tgacatcatctaggagtctcata

SEQ ID NO: 117480 - DNA, 19 bp, Homo sapiens
aggttcagattagggtttg

SEQ ID NO: 117481 - DNA, 22 bp, Homo sapiens
tttcagtgtttttattatagtg

SEQ ID NO: 117482 - DNA, 23 bp, Homo sapiens
acaggcttacagaatgaacttac

SEQ ID NO: 117483 - DNA, 23 bp, Homo sapiens
taatctcattttgtataaatgtg

SEQ ID NO: 117484 - DNA, 19 bp, Homo sapiens
aggtgttttttaatctgta

SEQ ID NO: 117485 - DNA, 23 bp, Homo sapiens
atatatgtgtatgtgtatatatg

SEQ ID NO: 117486 - DNA, 23 bp, Homo sapiens
atatgtgtgtatatatgtatgtg

SEQ ID NO: 117487 - DNA, 19 bp, Homo sapiens
ttatgcatatatatacaca

SEQ ID NO: 117488 - DNA, 22 bp, Homo sapiens
tatatgtatatatacacgtgtg

SEQ ID NO: 117489 - DNA, 23 bp, Homo sapiens
atggagtctcactctgtctaccc

SEQ ID NO: 117490 - DNA, 21 bp, Homo sapiens
acacagtctcactctatcgcc

SEQ ID NO: 117491 - DNA, 23 bp, Homo sapiens
tatgttgcccacgctgatttcag

SEQ ID NO: 117492 - DNA, 23 bp, Homo sapiens
ctgtcagcctgctaaccatgtgt

SEQ ID NO: 117493 - DNA, 23 bp, Homo sapiens
tttctgttcacggtggttaagct

SEQ ID NO: 117494 - DNA, 23 bp, Homo sapiens
tatataccacattttcttgatcc

SEQ ID NO: 117495 - DNA, 23 bp, Homo sapiens
tgagttcattgtagattctggat

SEQ ID NO: 117496 - DNA, 23 bp, Homo sapiens
tgagttcattgtagattctggat

SEQ ID NO: 117497 - DNA, 22 bp, Homo sapiens
ttatacagcaaggcatttatga

SEQ ID NO: 117498 - DNA, 23 bp, Homo sapiens
tttatagaatttgtagtatatgt

SEQ ID NO: 117499 - DNA, 23 bp, Homo sapiens
ggagactcagagtagtcactgac

SEQ ID NO: 117500 - DNA, 23 bp, Homo sapiens
aaagagaggaatgtatgactctt

SEQ ID NO: 117501 - DNA, 23 bp, Homo sapiens
attgtgctaaacctatagatcaa

SEQ ID NO: 117502 - DNA, 23 bp, Homo sapiens
tttgtggttttcttaggaatact

SEQ ID NO: 117503 - DNA, 23 bp, Homo sapiens
tgagttcattgtagattctggat

SEQ ID NO: 117504 - DNA, 23 bp, Homo sapiens
tgagttcattgtagattctggat

SEQ ID NO: 117505 - DNA, 18 bp, Homo sapiens
aaaacatttttctatttg

SEQ ID NO: 117506 - DNA, 23 bp, Homo sapiens
tatatgtatatacacatatgtgt

SEQ ID NO: 117507 - DNA, 23 bp, Homo sapiens
tatatgtatatatacatatgtgt

SEQ ID NO: 117508 - DNA, 23 bp, Homo sapiens
tatatgtatatatacctatatgt

SEQ ID NO: 117509 - DNA, 22 bp, Homo sapiens
tttcaatctgctttttttaact

SEQ ID NO: 117510 - DNA, 23 bp, Homo sapiens
atacagataagtatttttgatga

SEQ ID NO: 117511 - DNA, 19 bp, Homo sapiens
actctcagaggctgactgg

SEQ ID NO: 117512 - DNA, 23 bp, Homo sapiens
gacagagcccatggagaaggagg

SEQ ID NO: 117513 - DNA, 22 bp, Homo sapiens
tgagaaggagtctcactctgtt

SEQ ID NO: 117514 - DNA, 23 bp, Homo sapiens
ctctgtcacccaggctgagtaca

SEQ ID NO: 117515 - DNA, 20 bp, Homo sapiens
aagagagagagtccatctgg

SEQ ID NO: 117516 - DNA, 22 bp, Homo sapiens
tatgtatatatgtatatatgtg

SEQ ID NO: 117517 - DNA, 21 bp, Homo sapiens
atatacgtatatgtatgtgta

SEQ ID NO: 117518 - DNA, 23 bp, Homo sapiens
ggagtctcactctgtctcccagg

SEQ ID NO: 117519 - DNA, 23 bp, Homo sapiens
cattatttcacaactagttctag

SEQ ID NO: 117520 - DNA, 23 bp, Homo sapiens
cctgtggttctagctactcagga

SEQ ID NO: 117521 - DNA, 20 bp, Homo sapiens
tgaggtaggaggatcacttg

SEQ ID NO: 117522 - DNA, 23 bp, Homo sapiens
tgcaggagcagtctctgtgtgtg

SEQ ID NO: 117523 - DNA, 23 bp, Homo sapiens
aaaccctctggatgagatttcta

SEQ ID NO: 117524 - DNA, 23 bp, Homo sapiens
tgggagacttctcattttgttct

SEQ ID NO: 117525 - DNA, 23 bp, Homo sapiens
ctgtgtgtatgtgtgtctctatt

SEQ ID NO: 117526 - DNA, 23 bp, Homo sapiens
atatatgtatatgtatgtgtgtg

SEQ ID NO: 117527 - DNA, 23 bp, Homo sapiens
actctgagcctgtagagtctgct

SEQ ID NO: 117528 - DNA, 23 bp, Homo sapiens
agagtctcactctgtcacccagg

SEQ ID NO: 117529 - DNA, 23 bp, Homo sapiens
gacagtctcactcactctgtcgt

SEQ ID NO: 117530 - DNA, 23 bp, Homo sapiens
tgagacagagtctcaccctgtcg

SEQ ID NO: 117531 - DNA, 22 bp, Homo sapiens
taggaggatctgggtaaattga

SEQ ID NO: 117532 - DNA, 22 bp, Homo sapiens
tatatacacacacattttgggg

SEQ ID NO: 117533 - DNA, 23 bp, Homo sapiens
catggtctcactctgtcacccag

SEQ ID NO: 117534 - DNA, 23 bp, Homo sapiens
tgacaggcattcttgtcttgagt

SEQ ID NO: 117535 - DNA, 23 bp, Homo sapiens
tccctctgacagaatgctgcctg

SEQ ID NO: 117536 - DNA, 20 bp, Homo sapiens
cttttccttgtgcagtctct

SEQ ID NO: 117537 - DNA, 23 bp, Homo sapiens
ggaagacagtacagaaagagcag

SEQ ID NO: 117538 - DNA, 20 bp, Homo sapiens
atacacacacgtatatatat

SEQ ID NO: 117539 - DNA, 23 bp, Homo sapiens
atctgtctgccttactggactgt

SEQ ID NO: 117540 - DNA, 21 bp, Homo sapiens
tgtgtgtgtccttgcacatgt

SEQ ID NO: 117541 - DNA, 23 bp, Homo sapiens
atgtggctgtgcaagtgcatgtg

SEQ ID NO: 117542 - DNA, 23 bp, Homo sapiens
tctctctctctttctcttgacgg

SEQ ID NO: 117543 - DNA, 22 bp, Homo sapiens
tttcgctgcgacgtatccaggt

SEQ ID NO: 117544 - DNA, 23 bp, Homo sapiens
tgtctggttgtagtaagtgctat

SEQ ID NO: 117545 - DNA, 22 bp, Homo sapiens
acatatatatactaccatacac

SEQ ID NO: 117546 - DNA, 22 bp, Homo sapiens
tgtgtgtgtatataacatgtgt

SEQ ID NO: 117547 - DNA, 21 bp, Homo sapiens
ttgctagggctgcctctcttt

SEQ ID NO: 117548 - DNA, 19 bp, Homo sapiens
ttcctacaattcagattcc

SEQ ID NO: 117549 - DNA, 23 bp, Homo sapiens
tgtatagtctgcatatgtctgtg

SEQ ID NO: 117550 - DNA, 23 bp, Homo sapiens
tttgtatttttagtagagacggg

SEQ ID NO: 117551 - DNA, 23 bp, Homo sapiens
tggagtctcactctgtcacccag

SEQ ID NO: 117552 - DNA, 22 bp, Homo sapiens
actctgtgactgtgactttcaa

SEQ ID NO: 117553 - DNA, 23 bp, Homo sapiens
cggagtctcactctgtcacccag

SEQ ID NO: 117554 - DNA, 23 bp, Homo sapiens
atagcatttctcacacagcatct

SEQ ID NO: 117555 - DNA, 20 bp, Homo sapiens
tgaggtcttgctctgttgct

SEQ ID NO: 117556 - DNA, 23 bp, Homo sapiens
tgagttcattgtagattctggat

SEQ ID NO: 117557 - DNA, 23 bp, Homo sapiens
tgagttcattgtagattctggat

SEQ ID NO: 117558 - DNA, 23 bp, Homo sapiens
gcagtctcactctgtcacccagg

SEQ ID NO: 117559 - DNA, 18 bp, Homo sapiens
taccaggagaaggagcag

SEQ ID NO: 117560 - DNA, 23 bp, Homo sapiens
gcgatactgtctgtgtgtctccc

SEQ ID NO: 117561 - DNA, 23 bp, Homo sapiens
tgctgtctgtctttctccagctg

SEQ ID NO: 117562 - DNA, 19 bp, Homo sapiens
aatgctgtctatctgtctc

SEQ ID NO: 117563 - DNA, 22 bp, Homo sapiens
tgctgtctgtctgtctcctggg

SEQ ID NO: 117564 - DNA, 23 bp, Homo sapiens
tgagttcattgtagattctggat

SEQ ID NO: 117565 - DNA, 23 bp, Homo sapiens
tgagttcattgtagattctggat

SEQ ID NO: 117566 - DNA, 23 bp, Homo sapiens
atgtcagggtggtcatctccttt

SEQ ID NO: 117567 - DNA, 23 bp, Homo sapiens
agatggagtgtcgctctgttgac

SEQ ID NO: 117568 - DNA, 19 bp, Homo sapiens
cagaatcagggcttttctg

SEQ ID NO: 117569 - DNA, 23 bp, Homo sapiens
ttttactgtctgctctttctggc

SEQ ID NO: 117570 - DNA, 23 bp, Homo sapiens
cagtgtgtgtgtgtgactgtgtg

SEQ ID NO: 117571 - DNA, 21 bp, Homo sapiens
agttggtgctcagttaatttg

SEQ ID NO: 117572 - DNA, 20 bp, Homo sapiens
agagccggtgggataggtct

SEQ ID NO: 117573 - DNA, 22 bp, Homo sapiens
agtgagtgtgcaaagcatgaaa

SEQ ID NO: 117574 - DNA, 23 bp, Homo sapiens
tacatgtgcacaacgtgcaggtt

SEQ ID NO: 117575 - DNA, 23 bp, Homo sapiens
tgagttcattgtagattctggat

SEQ ID NO: 117576 - DNA, 23 bp, Homo sapiens
tgagttcattgtagattctggat

SEQ ID NO: 117577 - DNA, 21 bp, Homo sapiens
acatatatatacacacacata

SEQ ID NO: 117578 - DNA, 18 bp, Homo sapiens
acgtatatatatacgtgt

SEQ ID NO: 117579 - DNA, 23 bp, Homo sapiens
tatacgtgtatatatatatgtgt

SEQ ID NO: 117580 - DNA, 21 bp, Homo sapiens
gagaaatctccagactgcttt

SEQ ID NO: 117581 - DNA, 23 bp, Homo sapiens
agagagagtctcgctctgtcacc

SEQ ID NO: 117582 - DNA, 23 bp, Homo sapiens
tacagtggcaagatcttggctca

SEQ ID NO: 117583 - DNA, 23 bp, Homo sapiens
cactctgttgctcagtctggtct

SEQ ID NO: 117584 - DNA, 18 bp, Homo sapiens
tgagatgcagtctcactg

SEQ ID NO: 117585 - DNA, 23 bp, Homo sapiens
agagtctcaccctgtcacccagg

SEQ ID NO: 117586 - DNA, 19 bp, Homo sapiens
tgcctgtaatcccagcatt

SEQ ID NO: 117587 - DNA, 23 bp, Homo sapiens
tgaggacagaagtttgagaccag

SEQ ID NO: 117588 - DNA, 23 bp, Homo sapiens
gtactgtctgtctctcagccttg

SEQ ID NO: 117589 - DNA, 21 bp, Homo sapiens
ccatgacttccttttgtgtgt

SEQ ID NO: 117590 - DNA, 22 bp, Homo sapiens
tggagtctcactgtctcccagg

SEQ ID NO: 117591 - DNA, 23 bp, Homo sapiens
atggggtttcaccatattggcca

SEQ ID NO: 117592 - DNA, 23 bp, Homo sapiens
tgtccaagtcactgtcactgtgt

SEQ ID NO: 117593 - DNA, 20 bp, Homo sapiens
gggtgtctctgaccctcagt

SEQ ID NO: 117594 - DNA, 23 bp, Homo sapiens
tcacgctgagtgaactttgacag

SEQ ID NO: 117595 - DNA, 22 bp, Homo sapiens
aataaacatgctctgaaagtat

SEQ ID NO: 117596 - DNA, 23 bp, Homo sapiens
tcagagagagcaatcagagggcc

SEQ ID NO: 117597 - DNA, 23 bp, Homo sapiens
ttgagagtacttagaaatgtgtg

SEQ ID NO: 117598 - DNA, 23 bp, Homo sapiens
tgtatgtatgtatatatgtgtgt

SEQ ID NO: 117599 - DNA, 23 bp, Homo sapiens
ggagtctcactctgtcactcagg

SEQ ID NO: 117600 - DNA, 20 bp, Homo sapiens
agtggcgcagtctctgttca

SEQ ID NO: 117601 - DNA, 23 bp, Homo sapiens
tgcctcacatcagactcagcaga

SEQ ID NO: 117602 - DNA, 20 bp, Homo sapiens
tagactgagtttcgctgtgt

SEQ ID NO: 117603 - DNA, 23 bp, Homo sapiens
tgtcattctcactccttcagcag

SEQ ID NO: 117604 - DNA, 23 bp, Homo sapiens
agctctcactcactggcagtgac

SEQ ID NO: 117605 - DNA, 21 bp, Homo sapiens
aagtgtcaggtcattgtgctc

SEQ ID NO: 117606 - DNA, 22 bp, Homo sapiens
aatcacagcctatttgacacca

SEQ ID NO: 117607 - DNA, 21 bp, Homo sapiens
aaatattgtctggaaaggaag

SEQ ID NO: 117608 - DNA, 23 bp, Homo sapiens
tacagtgtctgtgtttgtgtgtg

SEQ ID NO: 117609 - DNA, 22 bp, Homo sapiens
attctgactccttcactgactc

SEQ ID NO: 117610 - DNA, 21 bp, Homo sapiens
atatgtacatagacatgggat

SEQ ID NO: 117611 - DNA, 23 bp, Homo sapiens
tgagttcattgtagattctggat

SEQ ID NO: 117612 - DNA, 23 bp, Homo sapiens
tgagttcattgtagattctggat

SEQ ID NO: 117613 - DNA, 21 bp, Homo sapiens
tgaccttgtaggtggtgtata

SEQ ID NO: 117614 - DNA, 23 bp, Homo sapiens
actctgtgtgtgtgtgtgtgtat

SEQ ID NO: 117615 - DNA, 23 bp, Homo sapiens
agagtctcactctgtcacccagg

SEQ ID NO: 117616 - DNA, 23 bp, Homo sapiens
agacagagtctcgctctgtcacc

SEQ ID NO: 117617 - DNA, 23 bp, Homo sapiens
gagatggtgtctcgctgtgtcac

SEQ ID NO: 117618 - DNA, 21 bp, Homo sapiens
acagccacacacagactacag

SEQ ID NO: 117619 - DNA, 23 bp, Homo sapiens
ttttggagacacagtcttgctct

SEQ ID NO: 117620 - DNA, 23 bp, Homo sapiens
caggctgagtcagtgagcttttg

SEQ ID NO: 117621 - DNA, 22 bp, Homo sapiens
cctgcttcagtctttttgtaaa

SEQ ID NO: 117622 - DNA, 22 bp, Homo sapiens
gaactgtccatattttaacctt

SEQ ID NO: 117623 - DNA, 23 bp, Homo sapiens
aatcagattgggaatgtactagt

SEQ ID NO: 117624 - DNA, 21 bp, Homo sapiens
tctgtcagtccctgagagcac

SEQ ID NO: 117625 - DNA, 21 bp, Homo sapiens
tcagaccttcccctatgtacc

SEQ ID NO: 117626 - DNA, 23 bp, Homo sapiens
cagagacagggtctcactgtgtc

SEQ ID NO: 117627 - DNA, 23 bp, Homo sapiens
tctgtgggtctctgtttctcatc

SEQ ID NO: 117628 - DNA, 23 bp, Homo sapiens
ggagtctcactcactctgtcgcc

SEQ ID NO: 117629 - DNA, 23 bp, Homo sapiens
tgtggttctttctgtctccctct

SEQ ID NO: 117630 - DNA, 18 bp, Homo sapiens
agactggtttgcgctctg

SEQ ID NO: 117631 - DNA, 23 bp, Homo sapiens
atacacactctcttagcctctgt

SEQ ID NO: 117632 - DNA, 23 bp, Homo sapiens
agacagagtctcgctctgtcacc

SEQ ID NO: 117633 - DNA, 19 bp, Homo sapiens
agacagtcttgctctgtca

SEQ ID NO: 117634 - DNA, 23 bp, Homo sapiens
agctcaagttcaggcagttctct

SEQ ID NO: 117635 - DNA, 23 bp, Homo sapiens
tctgagacggagtcttgctctgt

SEQ ID NO: 117636 - DNA, 22 bp, Homo sapiens
aaggttattattgttatgtgtg

SEQ ID NO: 117637 - DNA, 19 bp, Homo sapiens
atcattatgatgttagctg

SEQ ID NO: 117638 - DNA, 23 bp, Homo sapiens
tttttgtagagacagggtctcac

SEQ ID NO: 117639 - DNA, 23 bp, Homo sapiens
taatagtttttttggtggagtct

SEQ ID NO: 117640 - DNA, 19 bp, Homo sapiens
cctgagagtgggacttcat

SEQ ID NO: 117641 - DNA, 19 bp, Homo sapiens
cttctcctgggactcttcc

SEQ ID NO: 117642 - DNA, 23 bp, Homo sapiens
gtgtcactctgaggctcagagtg

SEQ ID NO: 117643 - DNA, 23 bp, Homo sapiens
cggagtctcactctgtcacccag

SEQ ID NO: 117644 - DNA, 23 bp, Homo sapiens
tttctctgtgattttttcattga

SEQ ID NO: 117645 - DNA, 23 bp, Homo sapiens
aaataaacacgttgttgtagaat

SEQ ID NO: 117646 - DNA, 23 bp, Homo sapiens
aagatcctgtgtgtgtgtgtata

SEQ ID NO: 117647 - DNA, 23 bp, Homo sapiens
aatgagaatgaaatagcttgctt

SEQ ID NO: 117648 - DNA, 23 bp, Homo sapiens
gacggagtctcactctgtcacca

SEQ ID NO: 117649 - DNA, 22 bp, Homo sapiens
acagagcttgctttatgtcagt

SEQ ID NO: 117650 - DNA, 18 bp, Homo sapiens
tggaactgtgagtcaatt

SEQ ID NO: 117651 - DNA, 23 bp, Homo sapiens
tctcactgcttgttgttggtctg

SEQ ID NO: 117652 - DNA, 23 bp, Homo sapiens
gacagagtctcgctctgtcaccc

SEQ ID NO: 117653 - DNA, 23 bp, Homo sapiens
acagagtctcgctctgtcaccca

SEQ ID NO: 117654 - DNA, 23 bp, Homo sapiens
tgttgagagtgagcatccttgtc

SEQ ID NO: 117655 - DNA, 23 bp, Homo sapiens
tctcaaggggaatgctttcagct

SEQ ID NO: 117656 - DNA, 23 bp, Homo sapiens
tctatctctctctatatatacag

SEQ ID NO: 117657 - DNA, 23 bp, Homo sapiens
tgagttcattgtagattctggat

SEQ ID NO: 117658 - DNA, 23 bp, Homo sapiens
tgagttcattgtagattctggat

SEQ ID NO: 117659 - DNA, 23 bp, Homo sapiens
tgagttcattgtagattctggat

SEQ ID NO: 117660 - DNA, 23 bp, Homo sapiens
tgagttcattgtagattctggat

SEQ ID NO: 117661 - DNA, 23 bp, Homo sapiens
tgagttcattgtagattctggat

SEQ ID NO: 117662 - DNA, 23 bp, Homo sapiens
tgagttcattgtagattctggat

SEQ ID NO: 117663 - DNA, 23 bp, Homo sapiens
caaagagtcactggatgtgctta

SEQ ID NO: 117664 - DNA, 23 bp, Homo sapiens
tctctcccactagactgtgagct

SEQ ID NO: 117665 - DNA, 19 bp, Homo sapiens
gagatctagcacctctgag

SEQ ID NO: 117666 - DNA, 23 bp, Homo sapiens
aggagctcacacactctcactca

SEQ ID NO: 117667 - DNA, 23 bp, Homo sapiens
tgagttcattgtagattctggat

SEQ ID NO: 117668 - DNA, 23 bp, Homo sapiens
tgagttcattgtagattctggat

SEQ ID NO: 117669 - DNA, 23 bp, Homo sapiens
tgagttcattgtagattctggat

SEQ ID NO: 117670 - DNA, 23 bp, Homo sapiens
tgagttcattgtagattctggat

SEQ ID NO: 117671 - DNA, 21 bp, Homo sapiens
aatgtggttattcttcagcaa

SEQ ID NO: 117672 - DNA, 23 bp, Homo sapiens
ttgagtgaagataatgaagtcat

SEQ ID NO: 117673 - DNA, 18 bp, Homo sapiens
tgtatatgtctatgtatg

SEQ ID NO: 117674 - DNA, 23 bp, Homo sapiens
tcagttgattgttaaagaaagca

SEQ ID NO: 117675 - DNA, 23 bp, Homo sapiens
agactgagtctcgctctgtcacc

SEQ ID NO: 117676 - DNA, 23 bp, Homo sapiens
gactgagtctcgctctgtcaccc

SEQ ID NO: 117677 - DNA, 20 bp, Homo sapiens
gtgaagcagtgggaatggag

SEQ ID NO: 117678 - DNA, 23 bp, Homo sapiens
aacacagaaatctgtaactggtt

SEQ ID NO: 117679 - DNA, 23 bp, Homo sapiens
atgctctgtgacaatatttgccc

SEQ ID NO: 117680 - DNA, 20 bp, Homo sapiens
gtctggggattacatctgta

SEQ ID NO: 117681 - DNA, 23 bp, Homo sapiens
tctgtgatagatgtagttttctt

SEQ ID NO: 117682 - DNA, 23 bp, Homo sapiens
tgagccagtgtctcactctgtcg

SEQ ID NO: 117683 - DNA, 23 bp, Homo sapiens
tgagatggagtctcactctctcg

SEQ ID NO: 117684 - DNA, 23 bp, Homo sapiens
actctgtgtgaggtacagatttt

SEQ ID NO: 117685 - DNA, 23 bp, Homo sapiens
ttttttggttccatatgaaattt

SEQ ID NO: 117686 - DNA, 18 bp, Homo sapiens
tctaatgtcagcactttg

SEQ ID NO: 117687 - DNA, 23 bp, Homo sapiens
aggtggaaggatcaattgtgagg

SEQ ID NO: 117688 - DNA, 23 bp, Homo sapiens
aagaaagggactctgtttcttat

SEQ ID NO: 117689 - DNA, 23 bp, Homo sapiens
tttgagacggagtctcactctgt

SEQ ID NO: 117690 - DNA, 23 bp, Homo sapiens
tttttttgagatggagtctcact

SEQ ID NO: 117691 - DNA, 23 bp, Homo sapiens
tagtgtatataaaatactgtacc

SEQ ID NO: 117692 - DNA, 23 bp, Homo sapiens
agagtctcactgtgtcacccagg

SEQ ID NO: 117693 - DNA, 23 bp, Homo sapiens
agttacttagtctctctgagtct

SEQ ID NO: 117694 - DNA, 23 bp, Homo sapiens
tgagttcattgtagattctggat

SEQ ID NO: 117695 - DNA, 23 bp, Homo sapiens
tgagttcattgtagattctggat

SEQ ID NO: 117696 - DNA, 19 bp, Homo sapiens
tgattcttttagcacagaa

SEQ ID NO: 117697 - DNA, 23 bp, Homo sapiens
agatggagtctggctctgttgac

SEQ ID NO: 117698 - DNA, 20 bp, Homo sapiens
attctcattttctttctctc

SEQ ID NO: 117699 - DNA, 19 bp, Homo sapiens
tatcttgaagatagtgttt

SEQ ID NO: 117700 - DNA, 19 bp, Homo sapiens
aagagctctttctgtggag

SEQ ID NO: 117701 - DNA, 23 bp, Homo sapiens
tatatggtatacaacatgatgtt

SEQ ID NO: 117702 - DNA, 22 bp, Homo sapiens
tctttcactccctgtccctcag

SEQ ID NO: 117703 - DNA, 23 bp, Homo sapiens
accatttcatctgattttcaagt

SEQ ID NO: 117704 - DNA, 23 bp, Homo sapiens
gtgaagaaagtcaggagagttca

SEQ ID NO: 117705 - DNA, 23 bp, Homo sapiens
ctgttggaggttctgccagggat

SEQ ID NO: 117706 - DNA, 18 bp, Homo sapiens
gtgtctcactcagactga

SEQ ID NO: 117707 - DNA, 23 bp, Homo sapiens
aaatgcaatcatatgatatgtgt

SEQ ID NO: 117708 - DNA, 23 bp, Homo sapiens
tagtttgacctaggagcttgatc

SEQ ID NO: 117709 - DNA, 23 bp, Homo sapiens
tcattgtgcctttgatttgcatt

SEQ ID NO: 117710 - DNA, 23 bp, Homo sapiens
tctatctgtatgtgtttgtgtgt

SEQ ID NO: 117711 - DNA, 23 bp, Homo sapiens
agacagagttttgttcttgtcat

SEQ ID NO: 117712 - DNA, 23 bp, Homo sapiens
atctatagacacatatgtgtctg

SEQ ID NO: 117713 - DNA, 23 bp, Homo sapiens
tctatagacacatatgtgtctgt

SEQ ID NO: 117714 - DNA, 20 bp, Homo sapiens
atctatagacacatatgtct

SEQ ID NO: 117715 - DNA, 23 bp, Homo sapiens
atatgtatatgtatatgtataca

SEQ ID NO: 117716 - DNA, 19 bp, Homo sapiens
tatcccgtttggtaatctg

SEQ ID NO: 117717 - DNA, 22 bp, Homo sapiens
agatatattacctagtattttg

SEQ ID NO: 117718 - DNA, 23 bp, Homo sapiens
attcaaggtcatactgctagttc

SEQ ID NO: 117719 - DNA, 20 bp, Homo sapiens
tgaggagaagtacatacctt

SEQ ID NO: 117720 - DNA, 21 bp, Homo sapiens
tgaggtaggaggatcacttga

SEQ ID NO: 117721 - DNA, 19 bp, Homo sapiens
acgtatatatatgtgtgtg

SEQ ID NO: 117722 - DNA, 19 bp, Homo sapiens
tagatatatgtagctatgt

SEQ ID NO: 117723 - DNA, 22 bp, Homo sapiens
aaaaaaggagctgaaaagactg

SEQ ID NO: 117724 - DNA, 21 bp, Homo sapiens
ttttagtgtcttttccttgtg

SEQ ID NO: 117725 - DNA, 23 bp, Homo sapiens
atttctattgtattgttcatgtt

SEQ ID NO: 117726 - DNA, 23 bp, Homo sapiens
tgagttcattgtagattctggat

SEQ ID NO: 117727 - DNA, 23 bp, Homo sapiens
tgagttcattgtagattctggat

SEQ ID NO: 117728 - DNA, 23 bp, Homo sapiens
ttttctgtgtgactcacagattt

SEQ ID NO: 117729 - DNA, 23 bp, Homo sapiens
acgtatatacacacacatataca

SEQ ID NO: 117730 - DNA, 20 bp, Homo sapiens
agcctagttttcacatttct

SEQ ID NO: 117731 - DNA, 23 bp, Homo sapiens
tatgtgcaagagcatctgctttg

SEQ ID NO: 117732 - DNA, 23 bp, Homo sapiens
tcacacattctctctctggagcc

SEQ ID NO: 117733 - DNA, 23 bp, Homo sapiens
tgtctctctgtatgattgtacct

SEQ ID NO: 117734 - DNA, 23 bp, Homo sapiens
tgaaaacatggtacaatgtacag

SEQ ID NO: 117735 - DNA, 23 bp, Homo sapiens
tgtggattttcctactaataatg

SEQ ID NO: 117736 - DNA, 21 bp, Homo sapiens
tccctctctttatctgtcttt

SEQ ID NO: 117737 - DNA, 23 bp, Homo sapiens
tgagttcattgtagattctggat

SEQ ID NO: 117738 - DNA, 23 bp, Homo sapiens
tgagttcattgtagattctggat

SEQ ID NO: 117739 - DNA, 19 bp, Homo sapiens
atgaggctagtgacctgca

SEQ ID NO: 117740 - DNA, 22 bp, Homo sapiens
cctgtgcctcactctgtcagtc

SEQ ID NO: 117741 - DNA, 19 bp, Homo sapiens
taaaagaggctgcttatta

SEQ ID NO: 117742 - DNA, 21 bp, Homo sapiens
tatggcttatgttgtaaagac

SEQ ID NO: 117743 - DNA, 23 bp, Homo sapiens
tgtgtgtgtgtataagtgtgtgt

SEQ ID NO: 117744 - DNA, 20 bp, Homo sapiens
tagcaattaaagcagaatgg

SEQ ID NO: 117745 - DNA, 21 bp, Homo sapiens
atagtcaatttgtaattgttt

SEQ ID NO: 117746 - DNA, 23 bp, Homo sapiens
agagagagatttatatttgttgt

SEQ ID NO: 117747 - DNA, 23 bp, Homo sapiens
atatgtgtgtatatcatttgcat

SEQ ID NO: 117748 - DNA, 23 bp, Homo sapiens
tactttgtatgtatatgtatgta

SEQ ID NO: 117749 - DNA, 23 bp, Homo sapiens
ctcccagagcccctggaactctg

SEQ ID NO: 117750 - DNA, 23 bp, Homo sapiens
tcccagagcccctggaactctgg

SEQ ID NO: 117751 - DNA, 23 bp, Homo sapiens
tcccagagcccctggaactctgg

SEQ ID NO: 117752 - DNA, 23 bp, Homo sapiens
tcccagagcccctggaactctgg

SEQ ID NO: 117753 - DNA, 19 bp, Homo sapiens
tagttgctggcattgttgt

SEQ ID NO: 117754 - DNA, 20 bp, Homo sapiens
aggcagcagaagagttcata

SEQ ID NO: 117755 - DNA, 19 bp, Homo sapiens
tagcagcagcacatgcagg

SEQ ID NO: 117756 - DNA, 21 bp, Homo sapiens
taattgttagaatataaagct

SEQ ID NO: 117757 - DNA, 21 bp, Homo sapiens
cagtcaagatgtatagtctta

SEQ ID NO: 117758 - DNA, 23 bp, Homo sapiens
ttgttgcctgtacttttgatgtt

SEQ ID NO: 117759 - DNA, 20 bp, Homo sapiens
ggaggacaatctgaagataa

SEQ ID NO: 117760 - DNA, 23 bp, Homo sapiens
tgactctttgcaaatcatgtgtg

SEQ ID NO: 117761 - DNA, 23 bp, Homo sapiens
aatcagtcagtgagtcattcagc

SEQ ID NO: 117762 - DNA, 21 bp, Homo sapiens
tgtgtacacacagatactata

SEQ ID NO: 117763 - DNA, 23 bp, Homo sapiens
gcacagagaagcttgttagcagt

SEQ ID NO: 117764 - DNA, 23 bp, Homo sapiens
tgttacaaagtttttctaaaatg

SEQ ID NO: 117765 - DNA, 23 bp, Homo sapiens
ttttagcagacttacatttctgt

SEQ ID NO: 117766 - DNA, 19 bp, Homo sapiens
tatatacatacatgtatgt

SEQ ID NO: 117767 - DNA, 22 bp, Homo sapiens
ttatatatacaggtatacatat

SEQ ID NO: 117768 - DNA, 19 bp, Homo sapiens
tgtctcagtttgtcttata

SEQ ID NO: 117769 - DNA, 19 bp, Homo sapiens
tagggctgggatagttctg

SEQ ID NO: 117770 - DNA, 23 bp, Homo sapiens
tgtgcaactggatttgatatctc

SEQ ID NO: 117771 - DNA, 23 bp, Homo sapiens
ctctctgtgcctctatttcctca

SEQ ID NO: 117772 - DNA, 23 bp, Homo sapiens
gtgttatagtactgaatttgttc

SEQ ID NO: 117773 - DNA, 23 bp, Homo sapiens
acttcataaacaagttgaaagag

SEQ ID NO: 117774 - DNA, 23 bp, Homo sapiens
atggaagataagtcaagatttgg

SEQ ID NO: 117775 - DNA, 23 bp, Homo sapiens
tgagttcattgtagattctggat

SEQ ID NO: 117776 - DNA, 23 bp, Homo sapiens
tgagttcattgtagattctggat

SEQ ID NO: 117777 - DNA, 23 bp, Homo sapiens
tgtgtctctgtttgatttccaag

SEQ ID NO: 117778 - DNA, 21 bp, Homo sapiens
aacattttttttcttttgaga

SEQ ID NO: 117779 - DNA, 18 bp, Homo sapiens
tgatattgtcttgctacc

SEQ ID NO: 117780 - DNA, 23 bp, Homo sapiens
tctcactctgtcactgtacttca

SEQ ID NO: 117781 - DNA, 23 bp, Homo sapiens
gctacagtgaagtgtgattgcac

SEQ ID NO: 117782 - DNA, 23 bp, Homo sapiens
gatggagtctcactctgtcaccc

SEQ ID NO: 117783 - DNA, 23 bp, Homo sapiens
gccagagtctcgctctgtcaccc

SEQ ID NO: 117784 - DNA, 23 bp, Homo sapiens
tatggatcagcatgtggtggtaa

SEQ ID NO: 117785 - DNA, 21 bp, Homo sapiens
ctctgagcctctctctggctc

SEQ ID NO: 117786 - DNA, 23 bp, Homo sapiens
actctctcagactgtcattagac

SEQ ID NO: 117787 - DNA, 22 bp, Homo sapiens
tcacttactgagacatgtttgg

SEQ ID NO: 117788 - DNA, 18 bp, Homo sapiens
tagtgtattgtagtttta

SEQ ID NO: 117789 - DNA, 18 bp, Homo sapiens
aagtctagagttggagca

SEQ ID NO: 117790 - DNA, 23 bp, Homo sapiens
tgagttcattgtagattctggat

SEQ ID NO: 117791 - DNA, 23 bp, Homo sapiens
tgagttcattgtagattctggat

SEQ ID NO: 117792 - DNA, 23 bp, Homo sapiens
ttgtgtgtgtgtgtatatatata

SEQ ID NO: 117793 - DNA, 20 bp, Homo sapiens
atatttgtgtatatgtttct

SEQ ID NO: 117794 - DNA, 23 bp, Homo sapiens
ttttgtttctcatctaattcctg

SEQ ID NO: 117795 - DNA, 22 bp, Homo sapiens
tgtcatgtcccagtttaccctt

SEQ ID NO: 117796 - DNA, 23 bp, Homo sapiens
tggactctcgctctgtcacccag

SEQ ID NO: 117797 - DNA, 23 bp, Homo sapiens
tctctagtatgatagaggaatac

SEQ ID NO: 117798 - DNA, 23 bp, Homo sapiens
tgtctgtgtgtgtgtctgcgcaa

SEQ ID NO: 117799 - DNA, 22 bp, Homo sapiens
aatgtgcatttgaatagagtaa

SEQ ID NO: 117800 - DNA, 23 bp, Homo sapiens
attgcttcaaaaatgtaaactgc

SEQ ID NO: 117801 - DNA, 23 bp, Homo sapiens
ctccatctgaacagagtaaccag

SEQ ID NO: 117802 - DNA, 23 bp, Homo sapiens
tgagttcattgtagattctggat

SEQ ID NO: 117803 - DNA, 23 bp, Homo sapiens
tgagttcattgtagattctggat

SEQ ID NO: 117804 - DNA, 23 bp, Homo sapiens
ttgtaagattgctctggctagga

SEQ ID NO: 117805 - DNA, 23 bp, Homo sapiens
tgagttcattgtagattctggat

SEQ ID NO: 117806 - DNA, 23 bp, Homo sapiens
tgagttcattgtagattctggat

SEQ ID NO: 117807 - DNA, 18 bp, Homo sapiens
tgtgaagaaagtcaatgg

SEQ ID NO: 117808 - DNA, 21 bp, Homo sapiens
tttcattgagatttacttgag

SEQ ID NO: 117809 - DNA, 23 bp, Homo sapiens
ttcaatgcaccctacagtgtcac

SEQ ID NO: 117810 - DNA, 23 bp, Homo sapiens
tgagttcattgtagattctggat

SEQ ID NO: 117811 - DNA, 23 bp, Homo sapiens
tgagttcattgtagattctggat

SEQ ID NO: 117812 - DNA, 23 bp, Homo sapiens
ttctgtgaagaaagtcaatggta

SEQ ID NO: 117813 - DNA, 18 bp, Homo sapiens
tatgtatatgtgtgtgtg

SEQ ID NO: 117814 - DNA, 23 bp, Homo sapiens
gtacattatgattccaagtgtgt

SEQ ID NO: 117815 - DNA, 19 bp, Homo sapiens
ttttccactgatatttgtt

SEQ ID NO: 117816 - DNA, 23 bp, Homo sapiens
agcagagagtgatgagtctgacc

SEQ ID NO: 117817 - DNA, 23 bp, Homo sapiens
tcagactctctgttaattttccc

SEQ ID NO: 117818 - DNA, 21 bp, Homo sapiens
aggtctcagagaaatcctggc

SEQ ID NO: 117819 - DNA, 23 bp, Homo sapiens
tgagttcattgtagattctggat

SEQ ID NO: 117820 - DNA, 23 bp, Homo sapiens
tgagttcattgtagattctggat

SEQ ID NO: 117821 - DNA, 20 bp, Homo sapiens
tgtatgtatgtatatgtata

SEQ ID NO: 117822 - DNA, 23 bp, Homo sapiens
tagtcactgtctaaggtgtttgg

SEQ ID NO: 117823 - DNA, 18 bp, Homo sapiens
tatgtatatatgtataca

SEQ ID NO: 117824 - DNA, 19 bp, Homo sapiens
tgctcctatatatagtctc

SEQ ID NO: 117825 - DNA, 23 bp, Homo sapiens
gacagagtctcgctctgtcaccc

SEQ ID NO: 117826 - DNA, 21 bp, Homo sapiens
ttttagatggagtctctctct

SEQ ID NO: 117827 - DNA, 23 bp, Homo sapiens
taatctgtgtctttatgttacct

SEQ ID NO: 117828 - DNA, 23 bp, Homo sapiens
tttgagacgagacggagtcttgt

SEQ ID NO: 117829 - DNA, 20 bp, Homo sapiens
tgactcaggaactccagaag

SEQ ID NO: 117830 - DNA, 21 bp, Homo sapiens
tgagactgagtctcgctctgt

SEQ ID NO: 117831 - DNA, 22 bp, Homo sapiens
agtctcgctctgtcactcaggc

SEQ ID NO: 117832 - DNA, 23 bp, Homo sapiens
cagaatctcactctgtcacccag

SEQ ID NO: 117833 - DNA, 22 bp, Homo sapiens
ttttttgatggagtctcactct

SEQ ID NO: 117834 - DNA, 23 bp, Homo sapiens
tgagttcattgtagattctggat

SEQ ID NO: 117835 - DNA, 23 bp, Homo sapiens
tgagttcattgtagattctggat

SEQ ID NO: 117836 - DNA, 23 bp, Homo sapiens
tattggtgttaatctcttactct

SEQ ID NO: 117837 - DNA, 19 bp, Homo sapiens
ttgacgtgttttatattgg

SEQ ID NO: 117838 - DNA, 23 bp, Homo sapiens
tgagttcattgtagattctggat

SEQ ID NO: 117839 - DNA, 23 bp, Homo sapiens
tgagttcattgtagattctggat

SEQ ID NO: 117840 - DNA, 23 bp, Homo sapiens
tggagtctcactctgtcacccag

SEQ ID NO: 117841 - DNA, 23 bp, Homo sapiens
ttgacagggtctcactctgccac

SEQ ID NO: 117842 - DNA, 23 bp, Homo sapiens
tatgtatgtatatatacgtatat

SEQ ID NO: 117843 - DNA, 23 bp, Homo sapiens
tacatatgtgtgcatatatgtgt

SEQ ID NO: 117844 - DNA, 23 bp, Homo sapiens
tttcactgagtagtgtgtatgta

SEQ ID NO: 117845 - DNA, 22 bp, Homo sapiens
tttattggttacatgtctaatg

SEQ ID NO: 117846 - DNA, 20 bp, Homo sapiens
tttagatatctatgatatat

SEQ ID NO: 117847 - DNA, 22 bp, Homo sapiens
ttgagacaaggtcttgctctgt

SEQ ID NO: 117848 - DNA, 22 bp, Homo sapiens
agtgtactcagctgttagcaga

SEQ ID NO: 117849 - DNA, 22 bp, Homo sapiens
tgaaaagagagaaatttgttgt

SEQ ID NO: 117850 - DNA, 23 bp, Homo sapiens
tgctgtgtcactctgtgcctctg

SEQ ID NO: 117851 - DNA, 21 bp, Homo sapiens
agaggtaggaggtagtgttct

SEQ ID NO: 117852 - DNA, 19 bp, Homo sapiens
tagcacaggctgaatatcc

SEQ ID NO: 117853 - DNA, 20 bp, Homo sapiens
ttactgtaattgatttcaaa

SEQ ID NO: 117854 - DNA, 23 bp, Homo sapiens
tacttcaacaatgaggaggaggt

SEQ ID NO: 117855 - DNA, 23 bp, Homo sapiens
ttttgaagtgacagaggactaat

SEQ ID NO: 117856 - DNA, 23 bp, Homo sapiens
agtcaggcttggtagtttgtgcc

SEQ ID NO: 117857 - DNA, 23 bp, Homo sapiens
agagtcagggtctctctctgcca

SEQ ID NO: 117858 - DNA, 19 bp, Homo sapiens
gagtgaaatttctggttct

SEQ ID NO: 117859 - DNA, 22 bp, Homo sapiens
tttggctggatatgaaattctt

SEQ ID NO: 117860 - DNA, 19 bp, Homo sapiens
agagactgtgttggctggg

SEQ ID NO: 117861 - DNA, 23 bp, Homo sapiens
tgttctttttgtttaggattgtc

SEQ ID NO: 117862 - DNA, 23 bp, Homo sapiens
ttctgtgaagaaagtcagtggta

SEQ ID NO: 117863 - DNA, 23 bp, Homo sapiens
taagctacgtatagatgctgtat

SEQ ID NO: 117864 - DNA, 22 bp, Homo sapiens
tttggtagtttgtctgtttact

SEQ ID NO: 117865 - DNA, 23 bp, Homo sapiens
tgagttcattgtagattctggat

SEQ ID NO: 117866 - DNA, 23 bp, Homo sapiens
tgagttcattgtagattctggat

SEQ ID NO: 117867 - DNA, 23 bp, Homo sapiens
tatacagttgtgtgtgtgtgtgt

SEQ ID NO: 117868 - DNA, 23 bp, Homo sapiens
gacagagtctcgctctgtcaccc

SEQ ID NO: 117869 - DNA, 23 bp, Homo sapiens
tgcagtggcaagatcttggctca

SEQ ID NO: 117870 - DNA, 22 bp, Homo sapiens
tttggctctaggtgaaccgaag

SEQ ID NO: 117871 - DNA, 23 bp, Homo sapiens
taatgtgtatatatatatgtgtg

SEQ ID NO: 117872 - DNA, 23 bp, Homo sapiens
ttttggtctgtaactggttgtta

SEQ ID NO: 117873 - DNA, 20 bp, Homo sapiens
ttgtagaaggttggaaagtt

SEQ ID NO: 117874 - DNA, 20 bp, Homo sapiens
acatgaacatgtatggtggt

SEQ ID NO: 117875 - DNA, 23 bp, Homo sapiens
atatgtctgtatttctttatacc

SEQ ID NO: 117876 - DNA, 23 bp, Homo sapiens
atgaaaatagtagatgttaacgt

SEQ ID NO: 117877 - DNA, 23 bp, Homo sapiens
atgtgtgtatatatgtatatata

SEQ ID NO: 117878 - DNA, 23 bp, Homo sapiens
tgtgtatatatgtatatatgtgt

SEQ ID NO: 117879 - DNA, 22 bp, Homo sapiens
tatgtatatatgtgtatgtatg

SEQ ID NO: 117880 - DNA, 23 bp, Homo sapiens
tatgtgtacatatgtatatatgg

SEQ ID NO: 117881 - DNA, 23 bp, Homo sapiens
agtgaactgtgatagctgttgaa

SEQ ID NO: 117882 - DNA, 23 bp, Homo sapiens
tatcagggaacacttgtagtctc

SEQ ID NO: 117883 - DNA, 18 bp, Homo sapiens
atttggaacatctggagc

SEQ ID NO: 117884 - DNA, 22 bp, Homo sapiens
tataagtttaaattgatatgtt

SEQ ID NO: 117885 - DNA, 22 bp, Homo sapiens
accattgaaatgtaggtgacag

SEQ ID NO: 117886 - DNA, 23 bp, Homo sapiens
cacacacactcaccttatatata

SEQ ID NO: 117887 - DNA, 19 bp, Homo sapiens
tgtgaagaaagtcaatggt

SEQ ID NO: 117888 - DNA, 23 bp, Homo sapiens
atactattctgagaacattgaca

SEQ ID NO: 117889 - DNA, 22 bp, Homo sapiens
agaaagattaagtagtctaccc

SEQ ID NO: 117890 - DNA, 23 bp, Homo sapiens
ctcatttctcagtgtgaatttgg

SEQ ID NO: 117891 - DNA, 20 bp, Homo sapiens
atatgtgtgtgtgcacatgt

SEQ ID NO: 117892 - DNA, 23 bp, Homo sapiens
tgtgtgtatgtatacacatgtgt

SEQ ID NO: 117893 - DNA, 21 bp, Homo sapiens
aggagtaacagacacctttgt

SEQ ID NO: 117894 - DNA, 23 bp, Homo sapiens
gtttctgtgtctctgtctgtgtg

SEQ ID NO: 117895 - DNA, 22 bp, Homo sapiens
acacacacacatacatatatgt

SEQ ID NO: 117896 - DNA, 23 bp, Homo sapiens
atatgtgtgtgtatacatatgtg

SEQ ID NO: 117897 - DNA, 22 bp, Homo sapiens
agagtaaatagtggttaacaga

SEQ ID NO: 117898 - DNA, 23 bp, Homo sapiens
aagacacttctgtcagacctggc

SEQ ID NO: 117899 - DNA, 21 bp, Homo sapiens
tttttgctgattgtcataagt

SEQ ID NO: 117900 - DNA, 23 bp, Homo sapiens
tataagtagataatcatatcatt

SEQ ID NO: 117901 - DNA, 18 bp, Homo sapiens
tatatcatgtgattcagc

SEQ ID NO: 117902 - DNA, 22 bp, Homo sapiens
ttcctgacaagttatttttttg

SEQ ID NO: 117903 - DNA, 23 bp, Homo sapiens
tgtgtgcattgttgactctgtgt

SEQ ID NO: 117904 - DNA, 23 bp, Homo sapiens
tgagaaaatatcttcattttatt

SEQ ID NO: 117905 - DNA, 23 bp, Homo sapiens
acagtgaggtatttgtatgtaca

SEQ ID NO: 117906 - DNA, 23 bp, Homo sapiens
atatatcacattttgttattcat

SEQ ID NO: 117907 - DNA, 22 bp, Homo sapiens
tattcacatattgtatatgtga

SEQ ID NO: 117908 - DNA, 23 bp, Homo sapiens
agatagactatagactttgtcat

SEQ ID NO: 117909 - DNA, 23 bp, Homo sapiens
tgtgacagcttcttgatctgtcc

SEQ ID NO: 117910 - DNA, 23 bp, Homo sapiens
tatatgtatgtatgtatatgtgt

SEQ ID NO: 117911 - DNA, 21 bp, Homo sapiens
ttgtctgtgtccaataaatct

SEQ ID NO: 117912 - DNA, 23 bp, Homo sapiens
gtgtgtatgtgtgtatgtatgtg

SEQ ID NO: 117913 - DNA, 21 bp, Homo sapiens
ttgagtcatgaatcactggtc

SEQ ID NO: 117914 - DNA, 23 bp, Homo sapiens
tttctctctgcttctcagtgagt

SEQ ID NO: 117915 - DNA, 22 bp, Homo sapiens
agtatgataatgtatattgatt

SEQ ID NO: 117916 - DNA, 23 bp, Homo sapiens
cagttatgtcttctttctgaagc

SEQ ID NO: 117917 - DNA, 23 bp, Homo sapiens
tgagttcattgtagattctggat

SEQ ID NO: 117918 - DNA, 23 bp, Homo sapiens
tgagttcattgtagattctggat

SEQ ID NO: 117919 - DNA, 23 bp, Homo sapiens
ttggctgtgcttattttctaatt

SEQ ID NO: 117920 - DNA, 23 bp, Homo sapiens
agagtgctaccaaatgtcattga

SEQ ID NO: 117921 - DNA, 20 bp, Homo sapiens
tgagaggagagagactgctg

SEQ ID NO: 117922 - DNA, 21 bp, Homo sapiens
acatgtgcacaatgtgcaggt

SEQ ID NO: 117923 - DNA, 23 bp, Homo sapiens
tgagttcattgtagattctggat

SEQ ID NO: 117924 - DNA, 23 bp, Homo sapiens
atgtatgtatatatgtatgtatg

SEQ ID NO: 117925 - DNA, 21 bp, Homo sapiens
tgacagagcaagaccttgtct

SEQ ID NO: 117926 - DNA, 23 bp, Homo sapiens
agacagagtctcgctctgtcacc

SEQ ID NO: 117927 - DNA, 22 bp, Homo sapiens
tctgagagacagtttgttgtga

SEQ ID NO: 117928 - DNA, 21 bp, Homo sapiens
ttttgagacggagtcttgctc

SEQ ID NO: 117929 - DNA, 23 bp, Homo sapiens
tgagttcattgtagattctggat

SEQ ID NO: 117930 - DNA, 23 bp, Homo sapiens
tgagttcattgtagattctggat

SEQ ID NO: 117931 - DNA, 22 bp, Homo sapiens
aaaaatgcttttgaaatgccat

SEQ ID NO: 117932 - DNA, 23 bp, Homo sapiens
ttgccagatgaatctgatgagta

SEQ ID NO: 117933 - DNA, 23 bp, Homo sapiens
tcataattctgtgtgcagatgtt

SEQ ID NO: 117934 - DNA, 23 bp, Homo sapiens
tacatgtgcacaacgtgcaagtt

SEQ ID NO: 117935 - DNA, 23 bp, Homo sapiens
cttcagagtgcgtgtgtgtgtgt

SEQ ID NO: 117936 - DNA, 23 bp, Homo sapiens
ttcccagagctgcattcttctga

SEQ ID NO: 117937 - DNA, 21 bp, Homo sapiens
acccaggcaggctgattgcct

SEQ ID NO: 117938 - DNA, 23 bp, Homo sapiens
ctctctgtgtgtgtctgtctctt

SEQ ID NO: 117939 - DNA, 20 bp, Homo sapiens
ttcagtattcattttcttat

SEQ ID NO: 117940 - DNA, 23 bp, Homo sapiens
aatgaatgaatacaaatgagtgg

SEQ ID NO: 117941 - DNA, 23 bp, Homo sapiens
aatactgtctttttcatttgttt

SEQ ID NO: 117942 - DNA, 22 bp, Homo sapiens
atacgtatgcatatgtatttat

SEQ ID NO: 117943 - DNA, 23 bp, Homo sapiens
atcttccacaagaagttctggac

SEQ ID NO: 117944 - DNA, 23 bp, Homo sapiens
gtccctgaagatgatggtgtgct

SEQ ID NO: 117945 - DNA, 23 bp, Homo sapiens
ttctgtgaagaaagtcaatggta

SEQ ID NO: 117946 - DNA, 22 bp, Homo sapiens
catatgtacatatacatatatt

SEQ ID NO: 117947 - DNA, 20 bp, Homo sapiens
gtttctttggagtgtgtgcc

SEQ ID NO: 117948 - DNA, 23 bp, Homo sapiens
aaaagtttgttttactactttaa

SEQ ID NO: 117949 - DNA, 23 bp, Homo sapiens
agagtctcactctgtcacccagg

SEQ ID NO: 117950 - DNA, 23 bp, Homo sapiens
ccagtctcactccctctgtgccc

SEQ ID NO: 117951 - DNA, 19 bp, Homo sapiens
tatcatgatgttaccatta

SEQ ID NO: 117952 - DNA, 20 bp, Homo sapiens
ttggttgttcaatttgctta

SEQ ID NO: 117953 - DNA, 23 bp, Homo sapiens
tgagttcattgtagattctggat

SEQ ID NO: 117954 - DNA, 23 bp, Homo sapiens
tgagttcattgtagattctggat

SEQ ID NO: 117955 - DNA, 22 bp, Homo sapiens
tgttcactgccatgctattcaa

SEQ ID NO: 117956 - DNA, 23 bp, Homo sapiens
gaaatcttgtgtttttctacttc

SEQ ID NO: 117957 - DNA, 23 bp, Homo sapiens
tgatctcattttgtagaactgtg

SEQ ID NO: 117958 - DNA, 19 bp, Homo sapiens
cacagtagagcttaacggg

SEQ ID NO: 117959 - DNA, 23 bp, Homo sapiens
gacagagtctcgctctgtcaccc

SEQ ID NO: 117960 - DNA, 22 bp, Homo sapiens
ccattgctttttctccaccacc

SEQ ID NO: 117961 - DNA, 23 bp, Homo sapiens
ttaagagaatttgtacttgattt

SEQ ID NO: 117962 - DNA, 23 bp, Homo sapiens
tgagtctcactctcgctctgtca

SEQ ID NO: 117963 - DNA, 21 bp, Homo sapiens
tataggaggcaaataaatcac

SEQ ID NO: 117964 - DNA, 20 bp, Homo sapiens
tgccactggctaaggtggaa

SEQ ID NO: 117965 - DNA, 19 bp, Homo sapiens
cagtgtactcatgggatat

SEQ ID NO: 117966 - DNA, 23 bp, Homo sapiens
aatttgtagatcattttggatag

SEQ ID NO: 117967 - DNA, 22 bp, Homo sapiens
ttttatagttttcagtatgcaa

SEQ ID NO: 117968 - DNA, 19 bp, Homo sapiens
tatttctgagcactttaga

SEQ ID NO: 117969 - DNA, 22 bp, Homo sapiens
ttctcagtaggtgttctttctg

SEQ ID NO: 117970 - DNA, 19 bp, Homo sapiens
tataggtgtgagccactgt

SEQ ID NO: 117971 - DNA, 23 bp, Homo sapiens
ttttttgcttatgtttactgctt

SEQ ID NO: 117972 - DNA, 21 bp, Homo sapiens
tgcatatagcctaagctagaa

SEQ ID NO: 117973 - DNA, 23 bp, Homo sapiens
tgtcatttctgattttgtttatt

SEQ ID NO: 117974 - DNA, 23 bp, Homo sapiens
acatgtgcagaatgtgcaggttt

SEQ ID NO: 117975 - DNA, 22 bp, Homo sapiens
aaatagtacatgataagcattt

SEQ ID NO: 117976 - DNA, 23 bp, Homo sapiens
aatgaggttgctgaatcatatga

SEQ ID NO: 117977 - DNA, 19 bp, Homo sapiens
ttatattttgaggaacctc

SEQ ID NO: 117978 - DNA, 19 bp, Homo sapiens
acactgttctctttagtga

SEQ ID NO: 117979 - DNA, 23 bp, Homo sapiens
attctagttattgattccttgtc

SEQ ID NO: 117980 - DNA, 23 bp, Homo sapiens
ttatatgcacaaaatgtaataga

SEQ ID NO: 117981 - DNA, 19 bp, Homo sapiens
agcacactgatgggtcttg

SEQ ID NO: 117982 - DNA, 23 bp, Homo sapiens
agagtctcactctgtcatccagg

SEQ ID NO: 117983 - DNA, 23 bp, Homo sapiens
catacatgtgtgtacatctgcat

SEQ ID NO: 117984 - DNA, 23 bp, Homo sapiens
ttgacacttgagagggagctctt

SEQ ID NO: 117985 - DNA, 22 bp, Homo sapiens
atcagactgattttagatttca

SEQ ID NO: 117986 - DNA, 23 bp, Homo sapiens
gataactggatatcttttgaaaa

SEQ ID NO: 117987 - DNA, 21 bp, Homo sapiens
tatgtgtatatatgtatatgt

SEQ ID NO: 117988 - DNA, 22 bp, Homo sapiens
atcagtctccccattcattcag

SEQ ID NO: 117989 - DNA, 23 bp, Homo sapiens
caggttctgcatgtgcaagtcct

SEQ ID NO: 117990 - DNA, 23 bp, Homo sapiens
gaaatgaatgaaaatgtgggtga

SEQ ID NO: 117991 - DNA, 23 bp, Homo sapiens
taaaccttcaatatctaagcttc

SEQ ID NO: 117992 - DNA, 23 bp, Homo sapiens
agcacgtatgtatgtatatatgt

SEQ ID NO: 117993 - DNA, 23 bp, Homo sapiens
actgagtctcactctgtcgccca

SEQ ID NO: 117994 - DNA, 23 bp, Homo sapiens
tgaaacagacgtctgatttctgg

SEQ ID NO: 117995 - DNA, 21 bp, Homo sapiens
tttgtcgtcagtttcaagttc

SEQ ID NO: 117996 - DNA, 23 bp, Homo sapiens
gttttttagatggagtctcgctc

SEQ ID NO: 117997 - DNA, 21 bp, Homo sapiens
tatatatgtgtgttatatatg

SEQ ID NO: 117998 - DNA, 21 bp, Homo sapiens
acatgtgcacaatgtgcaggt

SEQ ID NO: 117999 - DNA, 23 bp, Homo sapiens
acatacacgtatacaattgtgtg

SEQ ID NO: 118000 - DNA, 23 bp, Homo sapiens
atgtatgtgtgtatgtgtatgta

SEQ ID NO: 118001 - DNA, 23 bp, Homo sapiens
gttatatgcacagattatgtagt

SEQ ID NO: 118002 - DNA, 23 bp, Homo sapiens
tgttattactgtgtttatgtatt

SEQ ID NO: 118003 - DNA, 22 bp, Homo sapiens
tatgtaatattgttatgtgctt

SEQ ID NO: 118004 - DNA, 23 bp, Homo sapiens
atgtatatgtatgtgtatatgta

SEQ ID NO: 118005 - DNA, 21 bp, Homo sapiens
ttggaagaagagaatgagctc

SEQ ID NO: 118006 - DNA, 23 bp, Homo sapiens
tgagttcattgtagattctggat

SEQ ID NO: 118007 - DNA, 23 bp, Homo sapiens
tgagttcattgtagattctggat

SEQ ID NO: 118008 - DNA, 23 bp, Homo sapiens
cttctgtgcacatgtgagggtgt

SEQ ID NO: 118009 - DNA, 18 bp, Homo sapiens
tgtgaggattccttcttt

SEQ ID NO: 118010 - DNA, 21 bp, Homo sapiens
ttggaagaagagaatgagctc

SEQ ID NO: 118011 - DNA, 23 bp, Homo sapiens
gaagtagtagaaagtgcattaga

SEQ ID NO: 118012 - DNA, 22 bp, Homo sapiens
aagtgtttttctaattgtaatg

SEQ ID NO: 118013 - DNA, 22 bp, Homo sapiens
tatgtacatatatatacacata

SEQ ID NO: 118014 - DNA, 20 bp, Homo sapiens
tatgtgtgtgtgtgtgtata

SEQ ID NO: 118015 - DNA, 23 bp, Homo sapiens
aagatgtgcaacactttggatat

SEQ ID NO: 118016 - DNA, 23 bp, Homo sapiens
tgtttgacccacaatttggagta

SEQ ID NO: 118017 - DNA, 23 bp, Homo sapiens
atatgtgtatatgtatatgtgtg

SEQ ID NO: 118018 - DNA, 19 bp, Homo sapiens
caggctcatggtgtagact

SEQ ID NO: 118019 - DNA, 23 bp, Homo sapiens
tatatgtgccatgttggtgtgct

SEQ ID NO: 118020 - DNA, 23 bp, Homo sapiens
taaggtagagtttttcttttcat

SEQ ID NO: 118021 - DNA, 23 bp, Homo sapiens
atatatgtgtgcatatgtatata

SEQ ID NO: 118022 - DNA, 21 bp, Homo sapiens
aggtggttttggattacaagg

SEQ ID NO: 118023 - DNA, 23 bp, Homo sapiens
ttgagacaagagtctcactctgt

SEQ ID NO: 118024 - DNA, 23 bp, Homo sapiens
tttatgcatacatacgtatgtgt

SEQ ID NO: 118025 - DNA, 22 bp, Homo sapiens
tatatgtgtgtgtgtgtatata

SEQ ID NO: 118026 - DNA, 20 bp, Homo sapiens
taacaggaatttttgagttt

SEQ ID NO: 118027 - DNA, 21 bp, Homo sapiens
agtctgtttcaatttttgcct

SEQ ID NO: 118028 - DNA, 19 bp, Homo sapiens
ttatatgaagcatacctat

SEQ ID NO: 118029 - DNA, 23 bp, Homo sapiens
tgagttcattgtagattctggat

SEQ ID NO: 118030 - DNA, 22 bp, Homo sapiens
atgtgtagatgtatacatagat

SEQ ID NO: 118031 - DNA, 18 bp, Homo sapiens
acgtatatatatgtgtat

SEQ ID NO: 118032 - DNA, 23 bp, Homo sapiens
tgtgtgtatatatatatatgtgc

SEQ ID NO: 118033 - DNA, 18 bp, Homo sapiens
acacacacatatatatat

SEQ ID NO: 118034 - DNA, 23 bp, Homo sapiens
actgaagtcagacaggaatagtt

SEQ ID NO: 118035 - DNA, 23 bp, Homo sapiens
ttatcctgttattctctttctct

SEQ ID NO: 118036 - DNA, 21 bp, Homo sapiens
agaaatcaaaatcactacatg

SEQ ID NO: 118037 - DNA, 23 bp, Homo sapiens
ttagatactatttgtaaagccaa

SEQ ID NO: 118038 - DNA, 23 bp, Homo sapiens
gttgtctgcatttgcttaagagt

SEQ ID NO: 118039 - DNA, 19 bp, Homo sapiens
tttcattattttaaaatgt

SEQ ID NO: 118040 - DNA, 23 bp, Homo sapiens
tgagttcattgtagattctggat

SEQ ID NO: 118041 - DNA, 23 bp, Homo sapiens
tgagttcattgtagattctggat

SEQ ID NO: 118042 - DNA, 22 bp, Homo sapiens
atactacatatatatagtgttt

SEQ ID NO: 118043 - DNA, 23 bp, Homo sapiens
agtttctctctgtctctgtcagg

SEQ ID NO: 118044 - DNA, 23 bp, Homo sapiens
agagggacagcaagtaaagagac

SEQ ID NO: 118045 - DNA, 18 bp, Homo sapiens
tggatatttaaataatgt

SEQ ID NO: 118046 - DNA, 23 bp, Homo sapiens
tgagttcattgtagattctggat

SEQ ID NO: 118047 - DNA, 23 bp, Homo sapiens
tgagttcattgtagattctggat

SEQ ID NO: 118048 - DNA, 21 bp, Homo sapiens
tagggattgggagaaagtact

SEQ ID NO: 118049 - DNA, 21 bp, Homo sapiens
aagagcaatttttaagtatct

SEQ ID NO: 118050 - DNA, 20 bp, Homo sapiens
atatgtatatatatatgtgt

SEQ ID NO: 118051 - DNA, 19 bp, Homo sapiens
tttgcatatatatgcacac

SEQ ID NO: 118052 - DNA, 23 bp, Homo sapiens
tactattcaggctcttttttggt

SEQ ID NO: 118053 - DNA, 23 bp, Homo sapiens
tgagtggagttttgctctttttg

SEQ ID NO: 118054 - DNA, 21 bp, Homo sapiens
atatctgtatacatgctctct

SEQ ID NO: 118055 - DNA, 23 bp, Homo sapiens
aagtctatatatttaggtatgca

SEQ ID NO: 118056 - DNA, 19 bp, Homo sapiens
tttagcatatatatctatg

SEQ ID NO: 118057 - DNA, 23 bp, Homo sapiens
tggatgaacaatgtcatctgcaa

SEQ ID NO: 118058 - DNA, 20 bp, Homo sapiens
agtacatttgctgtacctat

SEQ ID NO: 118059 - DNA, 21 bp, Homo sapiens
tgtgaagaaagtcattggtag

SEQ ID NO: 118060 - DNA, 23 bp, Homo sapiens
tcgagcttcaaggttgctttgtt

SEQ ID NO: 118061 - DNA, 18 bp, Homo sapiens
tcgaaagaaatggagtat

SEQ ID NO: 118062 - DNA, 22 bp, Homo sapiens
atatgtatatatgtatatatgt

SEQ ID NO: 118063 - DNA, 21 bp, Homo sapiens
atatgtatatatgtatatatg

SEQ ID NO: 118064 - DNA, 23 bp, Homo sapiens
tatactatatatgtatatatgta

SEQ ID NO: 118065 - DNA, 21 bp, Homo sapiens
atactatatatgtatatatgt

SEQ ID NO: 118066 - DNA, 21 bp, Homo sapiens
atactatatatgtatatatgt

SEQ ID NO: 118067 - DNA, 21 bp, Homo sapiens
atactatatatgtatatatgt

SEQ ID NO: 118068 - DNA, 22 bp, Homo sapiens
atactatatatgtatatatgtg

SEQ ID NO: 118069 - DNA, 21 bp, Homo sapiens
atactatatatgtatatatgt

SEQ ID NO: 118070 - DNA, 21 bp, Homo sapiens
atactatatatgtatatatgt

SEQ ID NO: 118071 - DNA, 21 bp, Homo sapiens
atactatatatgtatatatgt

SEQ ID NO: 118072 - DNA, 21 bp, Homo sapiens
atactatatatgtatatatgt

SEQ ID NO: 118073 - DNA, 21 bp, Homo sapiens
atactatatatgtatatatgt

SEQ ID NO: 118074 - DNA, 21 bp, Homo sapiens
atactatatatgtatatatgt

SEQ ID NO: 118075 - DNA, 23 bp, Homo sapiens
atatatgtgtatgtgtatatgtg

SEQ ID NO: 118076 - DNA, 21 bp, Homo sapiens
atgtatatatatatgtatgtg

SEQ ID NO: 118077 - DNA, 19 bp, Homo sapiens
tctgccttctatttcatgt

SEQ ID NO: 118078 - DNA, 21 bp, Homo sapiens
taggtactaaaaagatttgac

SEQ ID NO: 118079 - DNA, 18 bp, Homo sapiens
tttgtcttgaaaacatac

SEQ ID NO: 118080 - DNA, 22 bp, Homo sapiens
tatgtgtattaatatatgtgtg

SEQ ID NO: 118081 - DNA, 18 bp, Homo sapiens
ttgtgtgcatttctacca

SEQ ID NO: 118082 - DNA, 23 bp, Homo sapiens
tatctgtatatatatatctgtat

SEQ ID NO: 118083 - DNA, 23 bp, Homo sapiens
atacacatatacatatgtgtgtg

SEQ ID NO: 118084 - DNA, 21 bp, Homo sapiens
atatgtatatatatgtgtgtg

SEQ ID NO: 118085 - DNA, 23 bp, Homo sapiens
atatatgtgtatatatatgtgtg

SEQ ID NO: 118086 - DNA, 23 bp, Homo sapiens
ttttgcagtaggtggaggaaatg

SEQ ID NO: 118087 - DNA, 23 bp, Homo sapiens
ttatatgtaagcttaacaagaga

SEQ ID NO: 118088 - DNA, 23 bp, Homo sapiens
gagaggttatgagtgtgtgaagg

SEQ ID NO: 118089 - DNA, 20 bp, Homo sapiens
tgacacttgagactgaggac

SEQ ID NO: 118090 - DNA, 23 bp, Homo sapiens
agttgtttctgtctctgagagtt

SEQ ID NO: 118091 - DNA, 23 bp, Homo sapiens
atgtatatgtgtatgtgtatgtg

SEQ ID NO: 118092 - DNA, 22 bp, Homo sapiens
atttgtattttaaaatatgaga

SEQ ID NO: 118093 - DNA, 22 bp, Homo sapiens
cttctctgtttaattattgatt

SEQ ID NO: 118094 - DNA, 22 bp, Homo sapiens
tattactcaaacagctagaggt

SEQ ID NO: 118095 - DNA, 19 bp, Homo sapiens
agcaggagtgaagtggcct

SEQ ID NO: 118096 - DNA, 21 bp, Homo sapiens
tcagtttttcccatgctgttc

SEQ ID NO: 118097 - DNA, 18 bp, Homo sapiens
acatgtgccttgaatagt

SEQ ID NO: 118098 - DNA, 21 bp, Homo sapiens
tatgatagttgcattttttgt

SEQ ID NO: 118099 - DNA, 23 bp, Homo sapiens
aatgcacctggtgtagtggctca

SEQ ID NO: 118100 - DNA, 23 bp, Homo sapiens
gataagttcttggagtgtgaaaa

SEQ ID NO: 118101 - DNA, 23 bp, Homo sapiens
gacgtagttttttttaatgttgc

SEQ ID NO: 118102 - DNA, 19 bp, Homo sapiens
aatccaagggaatatgttg

SEQ ID NO: 118103 - DNA, 22 bp, Homo sapiens
tacatattacatgtatatgtta

SEQ ID NO: 118104 - DNA, 23 bp, Homo sapiens
gttcactgttattgtatagcctt

SEQ ID NO: 118105 - DNA, 22 bp, Homo sapiens
tttctctgactgactgcttgac

SEQ ID NO: 118106 - DNA, 22 bp, Homo sapiens
tacacgtatatatgtatatgta

SEQ ID NO: 118107 - DNA, 22 bp, Homo sapiens
aatgtgtttttaattcaatgtc

SEQ ID NO: 118108 - DNA, 21 bp, Homo sapiens
agtgcaattgctgggtcatat

SEQ ID NO: 118109 - DNA, 21 bp, Homo sapiens
ttcagctctaatttgattgca

SEQ ID NO: 118110 - DNA, 23 bp, Homo sapiens
ataaatgtccatatctactgatt

SEQ ID NO: 118111 - DNA, 20 bp, Homo sapiens
atatatgtatatatacatgt

SEQ ID NO: 118112 - DNA, 23 bp, Homo sapiens
tatatctatagatatctatagat

SEQ ID NO: 118113 - DNA, 20 bp, Homo sapiens
tatatatagatatctataca

SEQ ID NO: 118114 - DNA, 23 bp, Homo sapiens
catatgtatagtatatgtataca

SEQ ID NO: 118115 - DNA, 21 bp, Homo sapiens
tcccggtaataaagaggtttc

SEQ ID NO: 118116 - DNA, 22 bp, Homo sapiens
cttctcagccttagaactgtga

SEQ ID NO: 118117 - DNA, 23 bp, Homo sapiens
tttgtcacagtagcctgaaagga

SEQ ID NO: 118118 - DNA, 20 bp, Homo sapiens
atctccatattgtttcccat

SEQ ID NO: 118119 - DNA, 22 bp, Homo sapiens
aagtgaagtctgctcattggta

SEQ ID NO: 118120 - DNA, 23 bp, Homo sapiens
ttgtgtgtctgtgtgtattctgt

SEQ ID NO: 118121 - DNA, 23 bp, Homo sapiens
tttttctcattatatagaagcct

SEQ ID NO: 118122 - DNA, 21 bp, Homo sapiens
ttttaagctgtttatcaagta

SEQ ID NO: 118123 - DNA, 21 bp, Homo sapiens
ttgagcattttatgtaatact

SEQ ID NO: 118124 - DNA, 20 bp, Homo sapiens
ttggtattatgtaatatggt

SEQ ID NO: 118125 - DNA, 23 bp, Homo sapiens
aacacaatcaggcatcttttcat

SEQ ID NO: 118126 - DNA, 23 bp, Homo sapiens
tatgtgtatatatgtatatgtgt

SEQ ID NO: 118127 - DNA, 19 bp, Homo sapiens
gtatgtatgcgtgtgtgtt

SEQ ID NO: 118128 - DNA, 20 bp, Homo sapiens
cagagctactaagatatata

SEQ ID NO: 118129 - DNA, 23 bp, Homo sapiens
cttattgtatatatatcttatgt

SEQ ID NO: 118130 - DNA, 23 bp, Homo sapiens
ttcattagtattgtttctgttgt

SEQ ID NO: 118131 - DNA, 21 bp, Homo sapiens
aatgcttcattattttattga

SEQ ID NO: 118132 - DNA, 20 bp, Homo sapiens
taaagtgagagagtatagtg

SEQ ID NO: 118133 - DNA, 23 bp, Homo sapiens
tgagttcattgtagattctggat

SEQ ID NO: 118134 - DNA, 23 bp, Homo sapiens
tgagttcattgtagattctggat

SEQ ID NO: 118135 - DNA, 23 bp, Homo sapiens
gaactgtgtgatatgttgtgtct

SEQ ID NO: 118136 - DNA, 21 bp, Homo sapiens
tgactacagagagattcagct

SEQ ID NO: 118137 - DNA, 22 bp, Homo sapiens
taggttatgttatgttatgtta

SEQ ID NO: 118138 - DNA, 18 bp, Homo sapiens
agaccatgagtaccacaa

SEQ ID NO: 118139 - DNA, 23 bp, Homo sapiens
ccgagtgtgcacacttcctgctg

SEQ ID NO: 118140 - DNA, 22 bp, Homo sapiens
tggcttggtgacagctttgctg

SEQ ID NO: 118141 - DNA, 23 bp, Homo sapiens
atatacattgtatatgttatgta

SEQ ID NO: 118142 - DNA, 23 bp, Homo sapiens
acagagactcactctgtcacccc

SEQ ID NO: 118143 - DNA, 19 bp, Homo sapiens
accaggtgaagataactga

SEQ ID NO: 118144 - DNA, 23 bp, Homo sapiens
accagcttctgttatttttttga

SEQ ID NO: 118145 - DNA, 18 bp, Homo sapiens
tgaatatatctttctttt

SEQ ID NO: 118146 - DNA, 23 bp, Homo sapiens
catcaaggttgttttgttcttac

SEQ ID NO: 118147 - DNA, 21 bp, Homo sapiens
tatcacctagaaatccataca

SEQ ID NO: 118148 - DNA, 23 bp, Homo sapiens
ctcatttctttgggcaatgatag

SEQ ID NO: 118149 - DNA, 23 bp, Homo sapiens
ttttttctggtttaattatcagt

SEQ ID NO: 118150 - DNA, 19 bp, Homo sapiens
tatgcacacacacatatat

SEQ ID NO: 118151 - DNA, 22 bp, Homo sapiens
tacatgtgtgtgcatatatatg

SEQ ID NO: 118152 - DNA, 23 bp, Homo sapiens
agtgtgctttctgtgtctgtctg

SEQ ID NO: 118153 - DNA, 23 bp, Homo sapiens
ataatgacagatatagatttgaa

SEQ ID NO: 118154 - DNA, 23 bp, Homo sapiens
aaagtctctctctgtcgctcagg

SEQ ID NO: 118155 - DNA, 19 bp, Homo sapiens
tttcacccctttaggtctg

SEQ ID NO: 118156 - DNA, 23 bp, Homo sapiens
cacagtgtgtgcgtgtgtgtatg

SEQ ID NO: 118157 - DNA, 23 bp, Homo sapiens
taggtactgctcagggacttgtg

SEQ ID NO: 118158 - DNA, 20 bp, Homo sapiens
agagttaatagaagctgaac

SEQ ID NO: 118159 - DNA, 23 bp, Homo sapiens
acagaatagactagcagttttga

SEQ ID NO: 118160 - DNA, 23 bp, Homo sapiens
atgagagctgagacagatgatcc

SEQ ID NO: 118161 - DNA, 23 bp, Homo sapiens
tgagaagtgagtaagcagttgat

SEQ ID NO: 118162 - DNA, 19 bp, Homo sapiens
gagaaggaggccacctgca

SEQ ID NO: 118163 - DNA, 21 bp, Homo sapiens
tatagtgtatgtatatatatg

SEQ ID NO: 118164 - DNA, 23 bp, Homo sapiens
acacctacatatatagtgtatgt

SEQ ID NO: 118165 - DNA, 20 bp, Homo sapiens
atgcatacacacatatatgt

SEQ ID NO: 118166 - DNA, 22 bp, Homo sapiens
catttgagtgtgatgttagctg

SEQ ID NO: 118167 - DNA, 22 bp, Homo sapiens
aagagagaggagagtctgcaga

SEQ ID NO: 118168 - DNA, 23 bp, Homo sapiens
gatggagtctcactctgtcaccc

SEQ ID NO: 118169 - DNA, 21 bp, Homo sapiens
tgcctaaagagaaagagtgca

SEQ ID NO: 118170 - DNA, 23 bp, Homo sapiens
tgagttcattgtagattctggat

SEQ ID NO: 118171 - DNA, 23 bp, Homo sapiens
tgagttcattgtagattctggat

SEQ ID NO: 118172 - DNA, 23 bp, Homo sapiens
tgagttcattgtagattctggat

SEQ ID NO: 118173 - DNA, 23 bp, Homo sapiens
tgagttcattgtagattctggat

SEQ ID NO: 118174 - DNA, 23 bp, Homo sapiens
gaatactgggtagaatctagcag

SEQ ID NO: 118175 - DNA, 23 bp, Homo sapiens
attccattgcatatatatgcaat

SEQ ID NO: 118176 - DNA, 23 bp, Homo sapiens
tatatgcaatggaatactattca

SEQ ID NO: 118177 - DNA, 23 bp, Homo sapiens
ccagagccagggtttcttttttc

SEQ ID NO: 118178 - DNA, 18 bp, Homo sapiens
taatctgagctttggtta

SEQ ID NO: 118179 - DNA, 19 bp, Homo sapiens
ttagtcacagaaggatttt

SEQ ID NO: 118180 - DNA, 23 bp, Homo sapiens
acataacatacatatgtgtgtgt

SEQ ID NO: 118181 - DNA, 23 bp, Homo sapiens
atatgtgtatgtatatatgtgtg

SEQ ID NO: 118182 - DNA, 23 bp, Homo sapiens
gaagtgatgtgatttggtatatg

SEQ ID NO: 118183 - DNA, 21 bp, Homo sapiens
acatgtgcacaatgtgcaggt

SEQ ID NO: 118184 - DNA, 21 bp, Homo sapiens
atagagtcaggaaaagtttat

SEQ ID NO: 118185 - DNA, 21 bp, Homo sapiens
aatctcttttccatttctgtc

SEQ ID NO: 118186 - DNA, 20 bp, Homo sapiens
tctgtctctctctctatata

SEQ ID NO: 118187 - DNA, 23 bp, Homo sapiens
tatagtatagtttggatgttgat

SEQ ID NO: 118188 - DNA, 23 bp, Homo sapiens
atgtcctaattttaggctctgat

SEQ ID NO: 118189 - DNA, 23 bp, Homo sapiens
atataccatggaatagaattctt

SEQ ID NO: 118190 - DNA, 23 bp, Homo sapiens
tggagtctcactctgtcacccag

SEQ ID NO: 118191 - DNA, 23 bp, Homo sapiens
tatgtgcatgtatacatatgtgt

SEQ ID NO: 118192 - DNA, 22 bp, Homo sapiens
atgtgtatatatacgtatgtgt

SEQ ID NO: 118193 - DNA, 22 bp, Homo sapiens
tgagagggtcgttactcttagt

SEQ ID NO: 118194 - DNA, 22 bp, Homo sapiens
gaactgacatacagatattgtg

SEQ ID NO: 118195 - DNA, 18 bp, Homo sapiens
ctcttgctctctatctct

SEQ ID NO: 118196 - DNA, 22 bp, Homo sapiens
aatatattagatggaaatgtgt

SEQ ID NO: 118197 - DNA, 22 bp, Homo sapiens
atacacacacataaagttgttt

SEQ ID NO: 118198 - DNA, 22 bp, Homo sapiens
aatgcatttcattgtgtgtgtg

SEQ ID NO: 118199 - DNA, 22 bp, Homo sapiens
cagatgtgtgtgggaatcttcc

SEQ ID NO: 118200 - DNA, 19 bp, Homo sapiens
tttcataattttggaggtt

SEQ ID NO: 118201 - DNA, 23 bp, Homo sapiens
agccattctgacgggtgtgagat

SEQ ID NO: 118202 - DNA, 21 bp, Homo sapiens
ttggactcagatgaagatatc

SEQ ID NO: 118203 - DNA, 23 bp, Homo sapiens
aacagtggatttctttttctttt

SEQ ID NO: 118204 - DNA, 19 bp, Homo sapiens
tgtggtggtgtgatcttgg

SEQ ID NO: 118205 - DNA, 23 bp, Homo sapiens
tcctcactgaagagcctgtggag

SEQ ID NO: 118206 - DNA, 22 bp, Homo sapiens
tgtggttgctcttaggctctgg

SEQ ID NO: 118207 - DNA, 23 bp, Homo sapiens
atgtctttggtattgtaagtagt

SEQ ID NO: 118208 - DNA, 23 bp, Homo sapiens
atagcttcttgtatagcttctat

SEQ ID NO: 118209 - DNA, 22 bp, Homo sapiens
ttccagctgtggttgtgtaaat

SEQ ID NO: 118210 - DNA, 23 bp, Homo sapiens
ggagtctcactctgtcacccagg

SEQ ID NO: 118211 - DNA, 20 bp, Homo sapiens
tgcaatggtgtgatctcagc

SEQ ID NO: 118212 - DNA, 19 bp, Homo sapiens
tgcaatggtgtgatctcag

SEQ ID NO: 118213 - DNA, 20 bp, Homo sapiens
tccctgacactttgtattta

SEQ ID NO: 118214 - DNA, 21 bp, Homo sapiens
tgtgtgtgtgtaaaatggtgg

SEQ ID NO: 118215 - DNA, 20 bp, Homo sapiens
tgtgtagtattccatctcat

SEQ ID NO: 118216 - DNA, 23 bp, Homo sapiens
tcttagagtgtaaagtctagggc

SEQ ID NO: 118217 - DNA, 23 bp, Homo sapiens
ctctgccactcactcactttaag

SEQ ID NO: 118218 - DNA, 19 bp, Homo sapiens
aggaagtataaaattaagt

SEQ ID NO: 118219 - DNA, 21 bp, Homo sapiens
tttaatccatatgaaaccata

SEQ ID NO: 118220 - DNA, 23 bp, Homo sapiens
tctatactctgctactggtggca

SEQ ID NO: 118221 - DNA, 23 bp, Homo sapiens
tataggagcagatagtggatagt

SEQ ID NO: 118222 - DNA, 23 bp, Homo sapiens
tcagctacttctacataaagcat

SEQ ID NO: 118223 - DNA, 23 bp, Homo sapiens
gagaagaggatgtgaattctcat

SEQ ID NO: 118224 - DNA, 22 bp, Homo sapiens
caaaagttccttgtgtgtgtgt

SEQ ID NO: 118225 - DNA, 20 bp, Homo sapiens
tatgtgtatatatatgtatg

SEQ ID NO: 118226 - DNA, 22 bp, Homo sapiens
taacacacacacagaaacatgt

SEQ ID NO: 118227 - DNA, 23 bp, Homo sapiens
atatgtgtgtgtgtgtatatatt

SEQ ID NO: 118228 - DNA, 23 bp, Homo sapiens
gagtcagaaaagagagagaggtg

SEQ ID NO: 118229 - DNA, 22 bp, Homo sapiens
aagcctctctcaattttttcag

SEQ ID NO: 118230 - DNA, 22 bp, Homo sapiens
agtgagacagagattatatagt

SEQ ID NO: 118231 - DNA, 23 bp, Homo sapiens
ctctctgtctctccacgtgtgtg

SEQ ID NO: 118232 - DNA, 21 bp, Homo sapiens
atacacatgtgtgtgtgtgca

SEQ ID NO: 118233 - DNA, 20 bp, Homo sapiens
tctctcaatcactgacttta

SEQ ID NO: 118234 - DNA, 22 bp, Homo sapiens
tttatcattttaaaggaaggtg

SEQ ID NO: 118235 - DNA, 18 bp, Homo sapiens
tttgtttgtttgtttttt

SEQ ID NO: 118236 - DNA, 19 bp, Homo sapiens
atctatatatgtatctatg

SEQ ID NO: 118237 - DNA, 21 bp, Homo sapiens
tatgcatctatatagatatgt

SEQ ID NO: 118238 - DNA, 20 bp, Homo sapiens
gtctcgctctgtcacccagg

SEQ ID NO: 118239 - DNA, 23 bp, Homo sapiens
gagactcactctgtcactcaagc

SEQ ID NO: 118240 - DNA, 20 bp, Homo sapiens
cagtggtatgatcttggctc

SEQ ID NO: 118241 - DNA, 21 bp, Homo sapiens
catatgagtggaaataaaatg

SEQ ID NO: 118242 - DNA, 20 bp, Homo sapiens
gcccctacatgattttttct

SEQ ID NO: 118243 - DNA, 20 bp, Homo sapiens
agtgactgacatcactttct

SEQ ID NO: 118244 - DNA, 22 bp, Homo sapiens
acatgtgcagaatgtgcaggtt

SEQ ID NO: 118245 - DNA, 23 bp, Homo sapiens
ttttgagagcgagagtttcactc

SEQ ID NO: 118246 - DNA, 19 bp, Homo sapiens
tatacactgatatacatat

SEQ ID NO: 118247 - DNA, 22 bp, Homo sapiens
atgtatatatatgtgtatgtgt

SEQ ID NO: 118248 - DNA, 22 bp, Homo sapiens
agtttgagatgcagctgtggag

SEQ ID NO: 118249 - DNA, 21 bp, Homo sapiens
actaagcttatctagcacatt

SEQ ID NO: 118250 - DNA, 20 bp, Homo sapiens
aatatcctaccaaatgaata

SEQ ID NO: 118251 - DNA, 19 bp, Homo sapiens
tatttgtttttgtttgttt

SEQ ID NO: 118252 - DNA, 23 bp, Homo sapiens
tgtctgtgtgtatatatgtgtgt

SEQ ID NO: 118253 - DNA, 23 bp, Homo sapiens
acaaatgtgtgtgtatatgtttg

SEQ ID NO: 118254 - DNA, 23 bp, Homo sapiens
ttaagggacaggtagaagaatgt

SEQ ID NO: 118255 - DNA, 23 bp, Homo sapiens
agacggagtctggctctgtcacc

SEQ ID NO: 118256 - DNA, 19 bp, Homo sapiens
tattagaactgggatctca

SEQ ID NO: 118257 - DNA, 20 bp, Homo sapiens
taaactttagcaggtaatag

SEQ ID NO: 118258 - DNA, 18 bp, Homo sapiens
acacgtatatatatgtat

SEQ ID NO: 118259 - DNA, 20 bp, Homo sapiens
ttgtctctcccactccttcc

SEQ ID NO: 118260 - DNA, 23 bp, Homo sapiens
gctggctcggtgtctctgtctgt

SEQ ID NO: 118261 - DNA, 18 bp, Homo sapiens
ctgcaccagagtctcttg

SEQ ID NO: 118262 - DNA, 22 bp, Homo sapiens
ctctctctctctctgcgagggg

SEQ ID NO: 118263 - DNA, 18 bp, Homo sapiens
tagggaagaaaatgagga

SEQ ID NO: 118264 - DNA, 23 bp, Homo sapiens
tgagatggagtctcactctgtca

SEQ ID NO: 118265 - DNA, 23 bp, Homo sapiens
cggagtctcactctgtcacccag

SEQ ID NO: 118266 - DNA, 23 bp, Homo sapiens
gagtctcactctgtcacccaggc

SEQ ID NO: 118267 - DNA, 23 bp, Homo sapiens
tgacattgtattgctattggata

SEQ ID NO: 118268 - DNA, 23 bp, Homo sapiens
tatgtatgtgtaaatatgtgtat

SEQ ID NO: 118269 - DNA, 20 bp, Homo sapiens
tgtctagaaggaagaaagct

SEQ ID NO: 118270 - DNA, 21 bp, Homo sapiens
attcttttgagtttctgatta

SEQ ID NO: 118271 - DNA, 20 bp, Homo sapiens
caaagcaagatcaaagacaa

SEQ ID NO: 118272 - DNA, 23 bp, Homo sapiens
gggcaacatagtgagactctgtt

SEQ ID NO: 118273 - DNA, 20 bp, Homo sapiens
tacacttgacatattctaat

SEQ ID NO: 118274 - DNA, 23 bp, Homo sapiens
gagactgagaacagagtcaggtc

SEQ ID NO: 118275 - DNA, 20 bp, Homo sapiens
tttttttgtttgtttttttt

SEQ ID NO: 118276 - DNA, 23 bp, Homo sapiens
tgagttcattgtagattctggat

SEQ ID NO: 118277 - DNA, 23 bp, Homo sapiens
tgagttcattgtagattctggat

SEQ ID NO: 118278 - DNA, 23 bp, Homo sapiens
aagatgtaggcctgaagacttag

SEQ ID NO: 118279 - DNA, 20 bp, Homo sapiens
tagaaagagggaatgtaagt

SEQ ID NO: 118280 - DNA, 21 bp, Homo sapiens
tggtgtattgtacacattgca

SEQ ID NO: 118281 - DNA, 23 bp, Homo sapiens
tgtatgtctgtgtgtatgctggt

SEQ ID NO: 118282 - DNA, 23 bp, Homo sapiens
agggtctcactgtgtcactcagg

SEQ ID NO: 118283 - DNA, 23 bp, Homo sapiens
ttcttcttgaaaggaatagatga

SEQ ID NO: 118284 - DNA, 20 bp, Homo sapiens
atgtgcacaacgtgcaggtt

SEQ ID NO: 118285 - DNA, 23 bp, Homo sapiens
tgtgtgcatgtatgtgtatgtca

SEQ ID NO: 118286 - DNA, 23 bp, Homo sapiens
cacacagacacagtttttcatgt

SEQ ID NO: 118287 - DNA, 23 bp, Homo sapiens
tgtgaagcagaggctgtgttgag

SEQ ID NO: 118288 - DNA, 23 bp, Homo sapiens
tatttatcattgtattcttagca

SEQ ID NO: 118289 - DNA, 21 bp, Homo sapiens
tagcatgtagtagtgacttaa

SEQ ID NO: 118290 - DNA, 23 bp, Homo sapiens
tctctctgcttcttctaagtctt

SEQ ID NO: 118291 - DNA, 21 bp, Homo sapiens
agaatagaagctagagtgatt

SEQ ID NO: 118292 - DNA, 20 bp, Homo sapiens
tgtcctctgtgtctgtcaat

SEQ ID NO: 118293 - DNA, 20 bp, Homo sapiens
taaggatgaagatagccatc

SEQ ID NO: 118294 - DNA, 18 bp, Homo sapiens
atactttaagttttaggg

SEQ ID NO: 118295 - DNA, 22 bp, Homo sapiens
acatgtgcatattgtgcaggtt

SEQ ID NO: 118296 - DNA, 23 bp, Homo sapiens
ctgaagtagctacagggtctcta

SEQ ID NO: 118297 - DNA, 23 bp, Homo sapiens
agaacatggactcagtcatttct

SEQ ID NO: 118298 - DNA, 19 bp, Homo sapiens
tctctgtctgtatggcctt

SEQ ID NO: 118299 - DNA, 22 bp, Homo sapiens
tctcaccttgttttctgtctct

SEQ ID NO: 118300 - DNA, 22 bp, Homo sapiens
tcagagtttggaaagccatggt

SEQ ID NO: 118301 - DNA, 23 bp, Homo sapiens
caactctcactgttactctcacc

SEQ ID NO: 118302 - DNA, 23 bp, Homo sapiens
tgtgcaactgttagctaacaggt

SEQ ID NO: 118303 - DNA, 23 bp, Homo sapiens
ttctgtcagtgtcagtgtgttgt

SEQ ID NO: 118304 - DNA, 19 bp, Homo sapiens
tctgtgtgtgtgagtgtcc

SEQ ID NO: 118305 - DNA, 19 bp, Homo sapiens
tatttactaatacataaag

SEQ ID NO: 118306 - DNA, 23 bp, Homo sapiens
cacacctctctgtcagtctcagc

SEQ ID NO: 118307 - DNA, 23 bp, Homo sapiens
aacggtctctttctcttttctca

SEQ ID NO: 118308 - DNA, 19 bp, Homo sapiens
tacatacagatatacattt

SEQ ID NO: 118309 - DNA, 23 bp, Homo sapiens
gattcttgtcactttgtgtgatg

SEQ ID NO: 118310 - DNA, 23 bp, Homo sapiens
cagggtctcactctgtcacccag

SEQ ID NO: 118311 - DNA, 23 bp, Homo sapiens
tgccaggcactgtgtttggcatt

SEQ ID NO: 118312 - DNA, 22 bp, Homo sapiens
tacacacatgtggaagcataaa

SEQ ID NO: 118313 - DNA, 23 bp, Homo sapiens
tcagtggatgatttgacttcttt

SEQ ID NO: 118314 - DNA, 23 bp, Homo sapiens
taaaatgattttgttgttgataa

SEQ ID NO: 118315 - DNA, 21 bp, Homo sapiens
attagcttcaggtacagatgg

SEQ ID NO: 118316 - DNA, 19 bp, Homo sapiens
aagaggtagtggtggtggt

SEQ ID NO: 118317 - DNA, 23 bp, Homo sapiens
aacagacacagcacactttctct

SEQ ID NO: 118318 - DNA, 23 bp, Homo sapiens
agagtctctgtctgtcttcaagg

SEQ ID NO: 118319 - DNA, 19 bp, Homo sapiens
tttgcatttgaatgtgtat

SEQ ID NO: 118320 - DNA, 23 bp, Homo sapiens
tgactaaaagttattgtatatga

SEQ ID NO: 118321 - DNA, 23 bp, Homo sapiens
atagtcagtgcatcttttgactt

SEQ ID NO: 118322 - DNA, 23 bp, Homo sapiens
acacacacacgtgtgtgtgtgtg

SEQ ID NO: 118323 - DNA, 20 bp, Homo sapiens
ctgtccgtctctctgtctca

SEQ ID NO: 118324 - DNA, 23 bp, Homo sapiens
cagagtctcactctgtctcccag

SEQ ID NO: 118325 - DNA, 23 bp, Homo sapiens
atgatcaggagaatgtggtgctt

SEQ ID NO: 118326 - DNA, 23 bp, Homo sapiens
agactagtcatattcttcttctg

SEQ ID NO: 118327 - DNA, 19 bp, Homo sapiens
gaggtatatactaggattg

SEQ ID NO: 118328 - DNA, 22 bp, Homo sapiens
tgaatagtatactagtatatac

SEQ ID NO: 118329 - DNA, 23 bp, Homo sapiens
tgtgtgtatatatgtatgtgtgt

SEQ ID NO: 118330 - DNA, 22 bp, Homo sapiens
tttccttgggtgtgtaaaaatc

SEQ ID NO: 118331 - DNA, 23 bp, Homo sapiens
ttgagatggaatctcactctgtc

SEQ ID NO: 118332 - DNA, 23 bp, Homo sapiens
tgaggtagaaggatcacttgagc

SEQ ID NO: 118333 - DNA, 23 bp, Homo sapiens
ggcatttcactcactcttgttgc

SEQ ID NO: 118334 - DNA, 23 bp, Homo sapiens
tttgaggtggagtttcactcttg

SEQ ID NO: 118335 - DNA, 22 bp, Homo sapiens
tgtagtctaagctacttggaag

SEQ ID NO: 118336 - DNA, 23 bp, Homo sapiens
atacagatacatttcttttgtaa

SEQ ID NO: 118337 - DNA, 22 bp, Homo sapiens
tatgtgtatatatatgtgtgta

SEQ ID NO: 118338 - DNA, 23 bp, Homo sapiens
atatgtgtatatatatatgtgtg

SEQ ID NO: 118339 - DNA, 23 bp, Homo sapiens
tgatatcacagtgattttgattt

SEQ ID NO: 118340 - DNA, 22 bp, Homo sapiens
tccatgatgagtgatgttgagt

SEQ ID NO: 118341 - DNA, 23 bp, Homo sapiens
caatcatagctcactgtgaggtg

SEQ ID NO: 118342 - DNA, 23 bp, Homo sapiens
gtcttgtgtgatattgatgttct

SEQ ID NO: 118343 - DNA, 22 bp, Homo sapiens
ttgtcttaggtaaaccacaggg

SEQ ID NO: 118344 - DNA, 23 bp, Homo sapiens
ttttagcagttctattcctgaga

SEQ ID NO: 118345 - DNA, 20 bp, Homo sapiens
acacacacacacatacatat

SEQ ID NO: 118346 - DNA, 23 bp, Homo sapiens
attttcttgaatatggtaagtat

SEQ ID NO: 118347 - DNA, 23 bp, Homo sapiens
tgagttcattgtagattctggat

SEQ ID NO: 118348 - DNA, 23 bp, Homo sapiens
tgagttcattgtagattctggat

SEQ ID NO: 118349 - DNA, 20 bp, Homo sapiens
gggtgtggcttaggtggatc

SEQ ID NO: 118350 - DNA, 23 bp, Homo sapiens
tgtgtgcctttagtctcagctac

SEQ ID NO: 118351 - DNA, 18 bp, Homo sapiens
tgcaagacttggggttta

SEQ ID NO: 118352 - DNA, 23 bp, Homo sapiens
actaccagagctcctggaactct

SEQ ID NO: 118353 - DNA, 21 bp, Homo sapiens
tgtaaagtatgtatttttgtt

SEQ ID NO: 118354 - DNA, 23 bp, Homo sapiens
tgtgagaagagtgagattcaaca

SEQ ID NO: 118355 - DNA, 23 bp, Homo sapiens
atttgtctctgcaagtaaattgt

SEQ ID NO: 118356 - DNA, 18 bp, Homo sapiens
aaagatcatgaacaccct

SEQ ID NO: 118357 - DNA, 18 bp, Homo sapiens
ctgcctgggtgtgagggt

SEQ ID NO: 118358 - DNA, 22 bp, Homo sapiens
gtacagtagtgtggtcatggct

SEQ ID NO: 118359 - DNA, 23 bp, Homo sapiens
tgagtctcgctctgtcacccaag

SEQ ID NO: 118360 - DNA, 22 bp, Homo sapiens
tatatacatattctatatgtat

SEQ ID NO: 118361 - DNA, 22 bp, Homo sapiens
gatgaaagaggtgggggtctct

SEQ ID NO: 118362 - DNA, 21 bp, Homo sapiens
gcatgtgctctctttctctct

SEQ ID NO: 118363 - DNA, 23 bp, Homo sapiens
atcagctcttgtgagaactctct

SEQ ID NO: 118364 - DNA, 21 bp, Homo sapiens
tctcactctgtcacccaggct

SEQ ID NO: 118365 - DNA, 18 bp, Homo sapiens
tatcactctgtctacctt

SEQ ID NO: 118366 - DNA, 19 bp, Homo sapiens
tgtctccctttgtcactca

SEQ ID NO: 118367 - DNA, 23 bp, Homo sapiens
tttttgaagtttaacaggtgccg

SEQ ID NO: 118368 - DNA, 23 bp, Homo sapiens
gtgtgtctgtgtatgtatttagg

SEQ ID NO: 118369 - DNA, 23 bp, Homo sapiens
atgctgttgtgactgtgtatttt

SEQ ID NO: 118370 - DNA, 22 bp, Homo sapiens
ttttttcttttagaaaatgtga

SEQ ID NO: 118371 - DNA, 23 bp, Homo sapiens
ttcatgtcagtagaggctgggtg

SEQ ID NO: 118372 - DNA, 23 bp, Homo sapiens
gtctcactctgtgactgaggctg

SEQ ID NO: 118373 - DNA, 23 bp, Homo sapiens
tttctcaggctctttctgtcagt

SEQ ID NO: 118374 - DNA, 23 bp, Homo sapiens
cccttagtgacacgaatagactt

SEQ ID NO: 118375 - DNA, 19 bp, Homo sapiens
aatgcacagacacattcac

SEQ ID NO: 118376 - DNA, 23 bp, Homo sapiens
agtaaagcaggattggcagtggc

SEQ ID NO: 118377 - DNA, 21 bp, Homo sapiens
gtcatctttggtcagtgttga

SEQ ID NO: 118378 - DNA, 23 bp, Homo sapiens
tgtcagagtctggatgtgctgtg

SEQ ID NO: 118379 - DNA, 20 bp, Homo sapiens
tcacaccactgtcactgtgg

SEQ ID NO: 118380 - DNA, 22 bp, Homo sapiens
agtgacagtagagagactgcag

SEQ ID NO: 118381 - DNA, 22 bp, Homo sapiens
atcagatcctattttattgtta

SEQ ID NO: 118382 - DNA, 18 bp, Homo sapiens
gagtggctgtggaatgaa

SEQ ID NO: 118383 - DNA, 18 bp, Homo sapiens
tgtgtgtgtgtgtgtata

SEQ ID NO: 118384 - DNA, 18 bp, Homo sapiens
acgtgtatatatatgtgt

SEQ ID NO: 118385 - DNA, 23 bp, Homo sapiens
tatgtgcatatatatatacgtgt

SEQ ID NO: 118386 - DNA, 20 bp, Homo sapiens
tgtgtatatatatacacgta

SEQ ID NO: 118387 - DNA, 22 bp, Homo sapiens
tgtctccctctctcacctttgg

SEQ ID NO: 118388 - DNA, 20 bp, Homo sapiens
tcacacatcagtcaaagctg

SEQ ID NO: 118389 - DNA, 19 bp, Homo sapiens
actgacgctctctgacttt

SEQ ID NO: 118390 - DNA, 18 bp, Homo sapiens
tgttacatatgcaatgtg

SEQ ID NO: 118391 - DNA, 23 bp, Homo sapiens
tcttctctcattgtgcatatgag

SEQ ID NO: 118392 - DNA, 20 bp, Homo sapiens
atatgtatatgtatatatgt

SEQ ID NO: 118393 - DNA, 23 bp, Homo sapiens
tcactctcaggctcttttttgtg

SEQ ID NO: 118394 - DNA, 23 bp, Homo sapiens
tttatctgcatgtaaatgaatat

SEQ ID NO: 118395 - DNA, 21 bp, Homo sapiens
ttttttagtaatttcagctta

SEQ ID NO: 118396 - DNA, 23 bp, Homo sapiens
gtctcagagtcacagactcttat

SEQ ID NO: 118397 - DNA, 20 bp, Homo sapiens
gctttgcaaagaacttagaa

SEQ ID NO: 118398 - DNA, 22 bp, Homo sapiens
aatgaagtgatttagatgttat

SEQ ID NO: 118399 - DNA, 23 bp, Homo sapiens
aatgacatgagagtggtgctact

SEQ ID NO: 118400 - DNA, 19 bp, Homo sapiens
tgcagtggtgtgactgcag

SEQ ID NO: 118401 - DNA, 23 bp, Homo sapiens
tatacatatatgtatacatgtgt

SEQ ID NO: 118402 - DNA, 19 bp, Homo sapiens
tatacatatatgtatacat

SEQ ID NO: 118403 - DNA, 23 bp, Homo sapiens
agtatggtttggaaactgaaagt

SEQ ID NO: 118404 - DNA, 23 bp, Homo sapiens
tctttgcacttgattctctagtt

SEQ ID NO: 118405 - DNA, 23 bp, Homo sapiens
tgagttcattgtagattctggat

SEQ ID NO: 118406 - DNA, 23 bp, Homo sapiens
tgagttcattgtagattctggat

SEQ ID NO: 118407 - DNA, 23 bp, Homo sapiens
tctgtgtccctgtgaccctgcta

SEQ ID NO: 118408 - DNA, 23 bp, Homo sapiens
ttgtgtgtgtctgtgtgtgtata

SEQ ID NO: 118409 - DNA, 23 bp, Homo sapiens
gaaatactgccaggtaattagag

SEQ ID NO: 118410 - DNA, 21 bp, Homo sapiens
atcatgtccatttgaaaatat

SEQ ID NO: 118411 - DNA, 23 bp, Homo sapiens
tgagttcattgtagattctggat

SEQ ID NO: 118412 - DNA, 23 bp, Homo sapiens
tgagttcattgtagattctggat

SEQ ID NO: 118413 - DNA, 23 bp, Homo sapiens
tgagttcattgtagattctggat

SEQ ID NO: 118414 - DNA, 23 bp, Homo sapiens
tgagttcattgtagattctggat

SEQ ID NO: 118415 - DNA, 23 bp, Homo sapiens
ctttcagtctgttgttaggacca

SEQ ID NO: 118416 - DNA, 19 bp, Homo sapiens
tttgaagtttgattggtgt

SEQ ID NO: 118417 - DNA, 23 bp, Homo sapiens
tatcttgtctgtttttgtatgtc

SEQ ID NO: 118418 - DNA, 23 bp, Homo sapiens
gtggggtgacttgttatgctgcc

SEQ ID NO: 118419 - DNA, 18 bp, Homo sapiens
tatgatgtgtgtgaggtg

SEQ ID NO: 118420 - DNA, 18 bp, Homo sapiens
acacacacatacacacag

SEQ ID NO: 118421 - DNA, 19 bp, Homo sapiens
atttgtgtgtatttctctc

SEQ ID NO: 118422 - DNA, 22 bp, Homo sapiens
ataataccatgctatacatgtg

SEQ ID NO: 118423 - DNA, 20 bp, Homo sapiens
gacaaggttgatcaaagagg

SEQ ID NO: 118424 - DNA, 21 bp, Homo sapiens
actccttgtgtgtgaccctga

SEQ ID NO: 118425 - DNA, 23 bp, Homo sapiens
gcatttcacaggatgtccaagag

SEQ ID NO: 118426 - DNA, 21 bp, Homo sapiens
atatgtatatatgtattgtgg

SEQ ID NO: 118427 - DNA, 23 bp, Homo sapiens
agaggagtacatatatacatgtt

SEQ ID NO: 118428 - DNA, 23 bp, Homo sapiens
tggcatggatatgtattgtttat

SEQ ID NO: 118429 - DNA, 23 bp, Homo sapiens
atgactagtgtttaagcacaaaa

SEQ ID NO: 118430 - DNA, 20 bp, Homo sapiens
aagtgtgttctctttgtggc

SEQ ID NO: 118431 - DNA, 21 bp, Homo sapiens
tgtgagggagcttgaaactgg

SEQ ID NO: 118432 - DNA, 23 bp, Homo sapiens
tgagtcagaatctctcactttgt

SEQ ID NO: 118433 - DNA, 19 bp, Homo sapiens
agatactctgaggtcttca

SEQ ID NO: 118434 - DNA, 22 bp, Homo sapiens
tatgtgtgtgatatacatgtgt

SEQ ID NO: 118435 - DNA, 23 bp, Homo sapiens
ttatgtgtaatacatatgtaata

SEQ ID NO: 118436 - DNA, 22 bp, Homo sapiens
tttgagacggtctcgttctgtt

SEQ ID NO: 118437 - DNA, 23 bp, Homo sapiens
cggagtctcactctgtcacccag

SEQ ID NO: 118438 - DNA, 23 bp, Homo sapiens
gtatatttgtacatgtgtgtgta

SEQ ID NO: 118439 - DNA, 18 bp, Homo sapiens
tctgattggcttatctca

SEQ ID NO: 118440 - DNA, 23 bp, Homo sapiens
tctgagagacagtttgttatgat

SEQ ID NO: 118441 - DNA, 23 bp, Homo sapiens
tttgagacggagtctcgctctgt

SEQ ID NO: 118442 - DNA, 23 bp, Homo sapiens
tatacatgcatatatatacatat

SEQ ID NO: 118443 - DNA, 23 bp, Homo sapiens
tctcactgtggttgtgatttgca

SEQ ID NO: 118444 - DNA, 23 bp, Homo sapiens
atgtgtgtctctgtatgtgagat

SEQ ID NO: 118445 - DNA, 21 bp, Homo sapiens
acagcacactgatgggtcttg

SEQ ID NO: 118446 - DNA, 20 bp, Homo sapiens
tatatgtgtatatgtataga

SEQ ID NO: 118447 - DNA, 22 bp, Homo sapiens
ctcagtgttggtaatacgtcat

SEQ ID NO: 118448 - DNA, 23 bp, Homo sapiens
aacaatggattgttggaagctga

SEQ ID NO: 118449 - DNA, 20 bp, Homo sapiens
tgcagtggtacaaccttgac

SEQ ID NO: 118450 - DNA, 18 bp, Homo sapiens
tggtgtgtgtgtatacac

SEQ ID NO: 118451 - DNA, 19 bp, Homo sapiens
gcacgtatctaaatatgta

SEQ ID NO: 118452 - DNA, 23 bp, Homo sapiens
tgtttagagcatgtgcataggtg

SEQ ID NO: 118453 - DNA, 23 bp, Homo sapiens
tgagaatggattttaaaagttca

SEQ ID NO: 118454 - DNA, 23 bp, Homo sapiens
cattggaactggatgacttgagg

SEQ ID NO: 118455 - DNA, 20 bp, Homo sapiens
tgtgtgtagatatccacttg

SEQ ID NO: 118456 - DNA, 21 bp, Homo sapiens
acatgtgcacaatgtgcaggt

SEQ ID NO: 118457 - DNA, 23 bp, Homo sapiens
tgtgtatgtatgtatatatgtgt

SEQ ID NO: 118458 - DNA, 22 bp, Homo sapiens
tatacacatatgtatatatgtg

SEQ ID NO: 118459 - DNA, 23 bp, Homo sapiens
atatgtgtatatatgtgtatgtg

SEQ ID NO: 118460 - DNA, 23 bp, Homo sapiens
tctgcaagagatgcgtttttgta

SEQ ID NO: 118461 - DNA, 23 bp, Homo sapiens
tctttgctcatgttgctctatct

SEQ ID NO: 118462 - DNA, 20 bp, Homo sapiens
ctgagatgatatgcagctct

SEQ ID NO: 118463 - DNA, 22 bp, Homo sapiens
gtcagaaatgagacagcactgt

SEQ ID NO: 118464 - DNA, 23 bp, Homo sapiens
ctgtcactctcacagggtctaca

SEQ ID NO: 118465 - DNA, 22 bp, Homo sapiens
tcactgggtggctagacccaga

SEQ ID NO: 118466 - DNA, 23 bp, Homo sapiens
atatatcacattttgtattacac

SEQ ID NO: 118467 - DNA, 20 bp, Homo sapiens
atttgttttcaatgtggaca

SEQ ID NO: 118468 - DNA, 23 bp, Homo sapiens
cacttgagcttgaaaacaggtaa

SEQ ID NO: 118469 - DNA, 23 bp, Homo sapiens
tgagttcattgtagattctggat

SEQ ID NO: 118470 - DNA, 20 bp, Homo sapiens
tgggtggctgggactatgcc

SEQ ID NO: 118471 - DNA, 21 bp, Homo sapiens
ttttaagtgtctttttcaatt

SEQ ID NO: 118472 - DNA, 23 bp, Homo sapiens
ttgaaggacacttataatgtgtg

SEQ ID NO: 118473 - DNA, 23 bp, Homo sapiens
tgagttcattgtagattctggat

SEQ ID NO: 118474 - DNA, 23 bp, Homo sapiens
tgagttcattgtagattctggat

SEQ ID NO: 118475 - DNA, 22 bp, Homo sapiens
tctctgggagtgaggggtgctg

SEQ ID NO: 118476 - DNA, 23 bp, Homo sapiens
tgtgactctcactctccttctgg

SEQ ID NO: 118477 - DNA, 22 bp, Homo sapiens
agaggtaggtggatgacttgag

SEQ ID NO: 118478 - DNA, 23 bp, Homo sapiens
caacactcaggcagtccctctct

SEQ ID NO: 118479 - DNA, 23 bp, Homo sapiens
atgacaagtgatttctttttttt

SEQ ID NO: 118480 - DNA, 21 bp, Homo sapiens
tttctgctaaagaaaactgtc

SEQ ID NO: 118481 - DNA, 19 bp, Homo sapiens
tagctgggatgacaggtgc

SEQ ID NO: 118482 - DNA, 23 bp, Homo sapiens
agccagagtcttgctctgtcacc

SEQ ID NO: 118483 - DNA, 23 bp, Homo sapiens
tgcagtggcatgatcttggctca

SEQ ID NO: 118484 - DNA, 23 bp, Homo sapiens
gacagagtctcgctctgtcaccc

SEQ ID NO: 118485 - DNA, 23 bp, Homo sapiens
tcagagtctcactgtgtcgccca

SEQ ID NO: 118486 - DNA, 23 bp, Homo sapiens
atattgatagatttcctaatgtt

SEQ ID NO: 118487 - DNA, 18 bp, Homo sapiens
aattgaaaaggaagagaa

SEQ ID NO: 118488 - DNA, 23 bp, Homo sapiens
gtgtctttgtgtctgggaaacct

SEQ ID NO: 118489 - DNA, 18 bp, Homo sapiens
gcaagacatagggagatc

SEQ ID NO: 118490 - DNA, 23 bp, Homo sapiens
aaaatggagttggtgctccttct

SEQ ID NO: 118491 - DNA, 22 bp, Homo sapiens
atagagtctcgctcttattgcc

SEQ ID NO: 118492 - DNA, 22 bp, Homo sapiens
tctgctagtagctagttttgaa

SEQ ID NO: 118493 - DNA, 22 bp, Homo sapiens
acacacacacacatatacatat

SEQ ID NO: 118494 - DNA, 20 bp, Homo sapiens
acagggatacttttgtcttt

SEQ ID NO: 118495 - DNA, 22 bp, Homo sapiens
acagagtgagactctgtctcaa

SEQ ID NO: 118496 - DNA, 22 bp, Homo sapiens
agacagagtttcgttcttgttg

SEQ ID NO: 118497 - DNA, 20 bp, Homo sapiens
gagtctcactctgtcgccca

SEQ ID NO: 118498 - DNA, 22 bp, Homo sapiens
atatgtacactataatacatgt

SEQ ID NO: 118499 - DNA, 22 bp, Homo sapiens
ttctaatcttactccactgtga

SEQ ID NO: 118500 - DNA, 23 bp, Homo sapiens
tgagacaggatctcactgtgtga

SEQ ID NO: 118501 - DNA, 23 bp, Homo sapiens
tgcctctctctgcctgtttactc

SEQ ID NO: 118502 - DNA, 19 bp, Homo sapiens
tcacatctctttcctgtct

SEQ ID NO: 118503 - DNA, 18 bp, Homo sapiens
agagagacagagagagat

SEQ ID NO: 118504 - DNA, 19 bp, Homo sapiens
actcaggtcttaccaccct

SEQ ID NO: 118505 - DNA, 22 bp, Homo sapiens
acagaagctggcaggctgatct

SEQ ID NO: 118506 - DNA, 23 bp, Homo sapiens
ttctattgaagcacagttttttg

SEQ ID NO: 118507 - DNA, 23 bp, Homo sapiens
cactaaaggaagaattgtgatgt

SEQ ID NO: 118508 - DNA, 23 bp, Homo sapiens
cttcacactgtcagtcctacccc

SEQ ID NO: 118509 - DNA, 23 bp, Homo sapiens
aagagtgtgggaaagatgagagg

SEQ ID NO: 118510 - DNA, 20 bp, Homo sapiens
atctctatatatagagatct

SEQ ID NO: 118511 - DNA, 20 bp, Homo sapiens
gatatgaataagtgaacata

SEQ ID NO: 118512 - DNA, 23 bp, Homo sapiens
gacagagtctcgctctgtcaccc

SEQ ID NO: 118513 - DNA, 22 bp, Homo sapiens
ttgagtgttgacagagtgctca

SEQ ID NO: 118514 - DNA, 23 bp, Homo sapiens
tgtagtgtatatatatatatgtg

SEQ ID NO: 118515 - DNA, 18 bp, Homo sapiens
tttgcagattaaagtgct

SEQ ID NO: 118516 - DNA, 19 bp, Homo sapiens
gcttatctgttagtatgat

SEQ ID NO: 118517 - DNA, 23 bp, Homo sapiens
tagaagtctgaaattgttaacaa

SEQ ID NO: 118518 - DNA, 23 bp, Homo sapiens
tctctccctgtgtgcgtgtgtga

SEQ ID NO: 118519 - DNA, 23 bp, Homo sapiens
attctcagtaataaagtcgttct

SEQ ID NO: 118520 - DNA, 23 bp, Homo sapiens
tgagtcagagttttactctgtca

SEQ ID NO: 118521 - DNA, 23 bp, Homo sapiens
gttggcagtgtgagtgctggcat

SEQ ID NO: 118522 - DNA, 22 bp, Homo sapiens
tgagacagagtctcgctctgtt

SEQ ID NO: 118523 - DNA, 23 bp, Homo sapiens
tgcttcagttttaaagtagaaag

SEQ ID NO: 118524 - DNA, 23 bp, Homo sapiens
agatggagtctcgctctgtcacc

SEQ ID NO: 118525 - DNA, 23 bp, Homo sapiens
taaccgagtcggtctcttcagat

SEQ ID NO: 118526 - DNA, 22 bp, Homo sapiens
atctagaattggaggttagaga

SEQ ID NO: 118527 - DNA, 18 bp, Homo sapiens
tagactgaagttggcagc

SEQ ID NO: 118528 - DNA, 21 bp, Homo sapiens
ttaagaagagctgctcttgga

SEQ ID NO: 118529 - DNA, 22 bp, Homo sapiens
tttgagatggagtctctctctg

SEQ ID NO: 118530 - DNA, 23 bp, Homo sapiens
aacagggtctccctctgtcactc

SEQ ID NO: 118531 - DNA, 23 bp, Homo sapiens
tgcagtggcatgatcttggctca

SEQ ID NO: 118532 - DNA, 21 bp, Homo sapiens
agacagaggagagaggacaca

SEQ ID NO: 118533 - DNA, 19 bp, Homo sapiens
tctcacttactctgttgcc

SEQ ID NO: 118534 - DNA, 23 bp, Homo sapiens
tgagagaagattgagagaagatt

SEQ ID NO: 118535 - DNA, 20 bp, Homo sapiens
gcactgagtggtatggtagg

SEQ ID NO: 118536 - DNA, 21 bp, Homo sapiens
tggagtctgaggttgctgtgt

SEQ ID NO: 118537 - DNA, 18 bp, Homo sapiens
cagaagtgagagaggtga

SEQ ID NO: 118538 - DNA, 19 bp, Homo sapiens
agtgaaaagaaaatttgtt

SEQ ID NO: 118539 - DNA, 23 bp, Homo sapiens
gacagggtctcactctgtcaccc

SEQ ID NO: 118540 - DNA, 21 bp, Homo sapiens
aggacacagaggacacagggc

SEQ ID NO: 118541 - DNA, 22 bp, Homo sapiens
cacactcatcctcgtgcacaca

SEQ ID NO: 118542 - DNA, 22 bp, Homo sapiens
ttgagagctgagagtctgcaga

SEQ ID NO: 118543 - DNA, 23 bp, Homo sapiens
aaatcaatggctcctggagactg

SEQ ID NO: 118544 - DNA, 21 bp, Homo sapiens
ttttgtgctattgattacttc

SEQ ID NO: 118545 - DNA, 18 bp, Homo sapiens
tgagtgagcacacttggg

SEQ ID NO: 118546 - DNA, 19 bp, Homo sapiens
tttcatttttcagcacttt

SEQ ID NO: 118547 - DNA, 23 bp, Homo sapiens
agagtctcactctgtcacccagg

SEQ ID NO: 118548 - DNA, 23 bp, Homo sapiens
aatgtagtcagtgtggacaccat

SEQ ID NO: 118549 - DNA, 23 bp, Homo sapiens
tgaggctacagtgagttgtgttc

SEQ ID NO: 118550 - DNA, 23 bp, Homo sapiens
tatatgaggggggaaaagtagca

SEQ ID NO: 118551 - DNA, 22 bp, Homo sapiens
tgagccatgatcatgccactgc

SEQ ID NO: 118552 - DNA, 23 bp, Homo sapiens
ttcagcatcgtgtctcactctct

SEQ ID NO: 118553 - DNA, 23 bp, Homo sapiens
cggagtctcactctgtcacccag

SEQ ID NO: 118554 - DNA, 19 bp, Homo sapiens
tcgctgcctgcctgttggg

SEQ ID NO: 118555 - DNA, 20 bp, Homo sapiens
atacctacagctgcaggtgt

SEQ ID NO: 118556 - DNA, 22 bp, Homo sapiens
tctcagtctgtctccctggctg

SEQ ID NO: 118557 - DNA, 23 bp, Homo sapiens
tatggctttttattcctatgtga

SEQ ID NO: 118558 - DNA, 23 bp, Homo sapiens
ctgaggtagtagtttgtacagtt

SEQ ID NO: 118559 - DNA, 23 bp, Homo sapiens
tgagtctctgtctgtcattcagg

SEQ ID NO: 118560 - DNA, 23 bp, Homo sapiens
atagcgtgatcatagctcactga

SEQ ID NO: 118561 - DNA, 23 bp, Homo sapiens
ttgagatggagtctcactctgtc

SEQ ID NO: 118562 - DNA, 20 bp, Homo sapiens
tgagacagagtctcgctctg

SEQ ID NO: 118563 - DNA, 21 bp, Homo sapiens
tatgtctgggacacctctggg

SEQ ID NO: 118564 - DNA, 23 bp, Homo sapiens
tctgggtgtcagaactgtgtgac

SEQ ID NO: 118565 - DNA, 23 bp, Homo sapiens
gagtgtctcggtccctctgagtg

SEQ ID NO: 118566 - DNA, 21 bp, Homo sapiens
ttaactcataacaatgctgga

SEQ ID NO: 118567 - DNA, 23 bp, Homo sapiens
ttgatacagagtctcactctgtc

SEQ ID NO: 118568 - DNA, 22 bp, Homo sapiens
atcactctcaatatctcagtca

SEQ ID NO: 118569 - DNA, 23 bp, Homo sapiens
tgtcagagatgtgtcagagctga

SEQ ID NO: 118570 - DNA, 20 bp, Homo sapiens
ctttacttctgtgtttgtcc

SEQ ID NO: 118571 - DNA, 23 bp, Homo sapiens
tctcaccctctctggctgcctca

SEQ ID NO: 118572 - DNA, 23 bp, Homo sapiens
tagagacaggatcttactgtgtt

SEQ ID NO: 118573 - DNA, 22 bp, Homo sapiens
ttcaggaggtgggagtctctac

SEQ ID NO: 118574 - DNA, 23 bp, Homo sapiens
ttgacactcttcttcctctgcgt

SEQ ID NO: 118575 - DNA, 23 bp, Homo sapiens
ttgtagcaagttttgaaatcaga

SEQ ID NO: 118576 - DNA, 23 bp, Homo sapiens
acatagtctcgctctgttgcctt

SEQ ID NO: 118577 - DNA, 20 bp, Homo sapiens
gagtctcactctgtcgctca

SEQ ID NO: 118578 - DNA, 23 bp, Homo sapiens
tgtcttctgtgtcagtcacactg

SEQ ID NO: 118579 - DNA, 23 bp, Homo sapiens
tgagttcattgtagattctggat

SEQ ID NO: 118580 - DNA, 23 bp, Homo sapiens
tgagttcattgtagattctggat

SEQ ID NO: 118581 - DNA, 23 bp, Homo sapiens
ttcacctcttaaaagttactaaa

SEQ ID NO: 118582 - DNA, 23 bp, Homo sapiens
tctctgggtctctctctccgtct

SEQ ID NO: 118583 - DNA, 23 bp, Homo sapiens
ttactctctgtgcctcagttgcc

SEQ ID NO: 118584 - DNA, 21 bp, Homo sapiens
taaggacaactggggctggtg

SEQ ID NO: 118585 - DNA, 23 bp, Homo sapiens
tctgtccctgagtctctccatct

SEQ ID NO: 118586 - DNA, 23 bp, Homo sapiens
agaggtcacggtcatacctgtct

SEQ ID NO: 118587 - DNA, 23 bp, Homo sapiens
ttgtggttcaggctcaggactga

SEQ ID NO: 118588 - DNA, 20 bp, Homo sapiens
ctgaccctctcacacccaca

SEQ ID NO: 118589 - DNA, 23 bp, Homo sapiens
tgtgccactgtgcctggctctcc

SEQ ID NO: 118590 - DNA, 18 bp, Homo sapiens
gtgtacatacatatatgt

SEQ ID NO: 118591 - DNA, 23 bp, Homo sapiens
tgtatgtatgtatatgtatatgt

SEQ ID NO: 118592 - DNA, 23 bp, Homo sapiens
caaggtctcactctgtcacccag

SEQ ID NO: 118593 - DNA, 22 bp, Homo sapiens
agagtctcgctctgtcacccag

SEQ ID NO: 118594 - DNA, 21 bp, Homo sapiens
tgaggtaggtggatcacttga

SEQ ID NO: 118595 - DNA, 22 bp, Homo sapiens
tgtagtctcaggtactcaggag

SEQ ID NO: 118596 - DNA, 20 bp, Homo sapiens
acagaagagagaactctggg

SEQ ID NO: 118597 - DNA, 23 bp, Homo sapiens
gctactgtcttgactttgagagc

SEQ ID NO: 118598 - DNA, 23 bp, Homo sapiens
agacagagtctcactatgtccct

SEQ ID NO: 118599 - DNA, 22 bp, Homo sapiens
ttcattttgagacagggtctct

SEQ ID NO: 118600 - DNA, 23 bp, Homo sapiens
gagatggagtctcgctctgtcac

SEQ ID NO: 118601 - DNA, 23 bp, Homo sapiens
atgagagtcaggaaaggaagttg

SEQ ID NO: 118602 - DNA, 23 bp, Homo sapiens
tagaaatacaatgtacaataaat

SEQ ID NO: 118603 - DNA, 23 bp, Homo sapiens
gtgtctccctgcctgagtgggtg

SEQ ID NO: 118604 - DNA, 23 bp, Homo sapiens
ggtctcactcactgtcaccagac

SEQ ID NO: 118605 - DNA, 23 bp, Homo sapiens
ctgggtgacagagaccgagtttc

SEQ ID NO: 118606 - DNA, 23 bp, Homo sapiens
gacagagtctcactctgtcacct

SEQ ID NO: 118607 - DNA, 22 bp, Homo sapiens
gggagtcactgtgcctgaccag

SEQ ID NO: 118608 - DNA, 23 bp, Homo sapiens
tgagaccgtgtctcactctgtcg

SEQ ID NO: 118609 - DNA, 23 bp, Homo sapiens
ggagtctcactctgtcacccagg

SEQ ID NO: 118610 - DNA, 23 bp, Homo sapiens
tgacaatttgtatttctgagtgc

SEQ ID NO: 118611 - DNA, 18 bp, Homo sapiens
actacattttgagaacca

SEQ ID NO: 118612 - DNA, 22 bp, Homo sapiens
agagtctcactctgttacccag

SEQ ID NO: 118613 - DNA, 22 bp, Homo sapiens
tgagacagagtctcactctgtt

SEQ ID NO: 118614 - DNA, 22 bp, Homo sapiens
gtggtgcagtcactgcagcctc

SEQ ID NO: 118615 - DNA, 23 bp, Homo sapiens
ttctttttttctttttgagacag

SEQ ID NO: 118616 - DNA, 19 bp, Homo sapiens
tgagacactgtctcaaaag

SEQ ID NO: 118617 - DNA, 20 bp, Homo sapiens
tacagtggcaggatcttggc

SEQ ID NO: 118618 - DNA, 23 bp, Homo sapiens
gacagagtctcgctctgtcaccc

SEQ ID NO: 118619 - DNA, 23 bp, Homo sapiens
tcactctctgcctctcttgcccc

SEQ ID NO: 118620 - DNA, 23 bp, Homo sapiens
ttccatcatgctgtctgtctctg

SEQ ID NO: 118621 - DNA, 21 bp, Homo sapiens
acagtcctgcctagtctcgtg

SEQ ID NO: 118622 - DNA, 23 bp, Homo sapiens
cagagtctcactctgtcccccag

SEQ ID NO: 118623 - DNA, 21 bp, Homo sapiens
tgcctggcaccctgtaggcat

SEQ ID NO: 118624 - DNA, 23 bp, Homo sapiens
tgtgtgtatatatatgtttgtgt

SEQ ID NO: 118625 - DNA, 21 bp, Homo sapiens
agtctcactctgtcacccagg

SEQ ID NO: 118626 - DNA, 23 bp, Homo sapiens
ggctcagagtgtgattttttttt

SEQ ID NO: 118627 - DNA, 23 bp, Homo sapiens
tttgagactagagtcttgctctg

SEQ ID NO: 118628 - DNA, 23 bp, Homo sapiens
ttttgtatagatgtgggtcctgc

SEQ ID NO: 118629 - DNA, 23 bp, Homo sapiens
tagcttcattcttctggtttctg

SEQ ID NO: 118630 - DNA, 22 bp, Homo sapiens
ttgacacagggtctcgctctgt

SEQ ID NO: 118631 - DNA, 23 bp, Homo sapiens
cggagtctcactctgtcacccag

SEQ ID NO: 118632 - DNA, 23 bp, Homo sapiens
agacagtctcactgtgtcgccca

SEQ ID NO: 118633 - DNA, 23 bp, Homo sapiens
gacagagtctcactctgtcttca

SEQ ID NO: 118634 - DNA, 20 bp, Homo sapiens
tactgatcagatttttttga

SEQ ID NO: 118635 - DNA, 21 bp, Homo sapiens
tgagatgtagtctcactctgt

SEQ ID NO: 118636 - DNA, 23 bp, Homo sapiens
gttgcagtgagccaacatcacgc

SEQ ID NO: 118637 - DNA, 23 bp, Homo sapiens
tgaccctcccactctgccagtcg

SEQ ID NO: 118638 - DNA, 20 bp, Homo sapiens
tatgtgtgtgtgtatatata

SEQ ID NO: 118639 - DNA, 23 bp, Homo sapiens
aatccactagattgagaagcaca

SEQ ID NO: 118640 - DNA, 23 bp, Homo sapiens
ttttatttgctgtggtaggtgga

SEQ ID NO: 118641 - DNA, 22 bp, Homo sapiens
tttgagacagagtctcactctg

SEQ ID NO: 118642 - DNA, 23 bp, Homo sapiens
tgagctgagagtggtcacagagg

SEQ ID NO: 118643 - DNA, 18 bp, Homo sapiens
ctttgcgtctgtgggtgg

SEQ ID NO: 118644 - DNA, 23 bp, Homo sapiens
tctagagctatacagatatatat

SEQ ID NO: 118645 - DNA, 23 bp, Homo sapiens
agaggtgcttagtgtcactgtgt

SEQ ID NO: 118646 - DNA, 21 bp, Homo sapiens
ctggctcactcaccctctggc

SEQ ID NO: 118647 - DNA, 21 bp, Homo sapiens
agacagggtctctgtttccca

SEQ ID NO: 118648 - DNA, 23 bp, Homo sapiens
tctcaggctcctactgagtgaag

SEQ ID NO: 118649 - DNA, 19 bp, Homo sapiens
actgtcacacttcctgact

SEQ ID NO: 118650 - DNA, 20 bp, Homo sapiens
agtgtaaaaatattctcttt

SEQ ID NO: 118651 - DNA, 21 bp, Homo sapiens
aggagtaagatgatattgcat

SEQ ID NO: 118652 - DNA, 21 bp, Homo sapiens
atatgtgtatatatatatgtg

SEQ ID NO: 118653 - DNA, 21 bp, Homo sapiens
atgtgtgtgtgtatatataca

SEQ ID NO: 118654 - DNA, 23 bp, Homo sapiens
tgagttcattgtagattctggat

SEQ ID NO: 118655 - DNA, 23 bp, Homo sapiens
tgagttcattgtagattctggat

SEQ ID NO: 118656 - DNA, 20 bp, Homo sapiens
tattgattgtctcttcttca

SEQ ID NO: 118657 - DNA, 22 bp, Homo sapiens
aagagatctgattaagttgatg

SEQ ID NO: 118658 - DNA, 21 bp, Homo sapiens
cctggctctgtcacttcctgg

SEQ ID NO: 118659 - DNA, 23 bp, Homo sapiens
tgccagcatcttctgttgtcagt

SEQ ID NO: 118660 - DNA, 22 bp, Homo sapiens
aacagaagacagccaccactga

SEQ ID NO: 118661 - DNA, 23 bp, Homo sapiens
aatgatgtgaagggcatatgttg

SEQ ID NO: 118662 - DNA, 22 bp, Homo sapiens
tctaacagcattaccatgtgct

SEQ ID NO: 118663 - DNA, 21 bp, Homo sapiens
tctgtctcagtcagcttccca

SEQ ID NO: 118664 - DNA, 23 bp, Homo sapiens
agagccaattcattctgtcccac

SEQ ID NO: 118665 - DNA, 23 bp, Homo sapiens
tatgggtcaggcactgttttgag

SEQ ID NO: 118666 - DNA, 18 bp, Homo sapiens
agacacagggaaagctct

SEQ ID NO: 118667 - DNA, 23 bp, Homo sapiens
ttttgagacggagtcttgctctg

SEQ ID NO: 118668 - DNA, 22 bp, Homo sapiens
ttcggtgtggattaattttggt

SEQ ID NO: 118669 - DNA, 21 bp, Homo sapiens
atatgtatacatgcatatata

SEQ ID NO: 118670 - DNA, 21 bp, Homo sapiens
atatatgtatacatgcatata

SEQ ID NO: 118671 - DNA, 22 bp, Homo sapiens
atttattttgagactgggtctc

SEQ ID NO: 118672 - DNA, 23 bp, Homo sapiens
gacagagtctcgctctgtcaccc

SEQ ID NO: 118673 - DNA, 23 bp, Homo sapiens
gggtctcactctgtcacccaggc

SEQ ID NO: 118674 - DNA, 18 bp, Homo sapiens
tatgtgtgtgcatgtata

SEQ ID NO: 118675 - DNA, 23 bp, Homo sapiens
atacacacacatatatatgtgtg

SEQ ID NO: 118676 - DNA, 23 bp, Homo sapiens
tctgtgcctcactgtccctgtct

SEQ ID NO: 118677 - DNA, 22 bp, Homo sapiens
taagggatgcagtgaggattga

SEQ ID NO: 118678 - DNA, 22 bp, Homo sapiens
atcaaccaacggtctgtgaggg

SEQ ID NO: 118679 - DNA, 23 bp, Homo sapiens
tacaacctctacgggttatcagt

SEQ ID NO: 118680 - DNA, 22 bp, Homo sapiens
tttgagatggagttttgccctg

SEQ ID NO: 118681 - DNA, 23 bp, Homo sapiens
aaggactcagagtaaggtgaaag

SEQ ID NO: 118682 - DNA, 18 bp, Homo sapiens
tatgagtgagaacacacg

SEQ ID NO: 118683 - DNA, 23 bp, Homo sapiens
tgagttcattgtagattctggat

SEQ ID NO: 118684 - DNA, 23 bp, Homo sapiens
tgagttcattgtagattctggat

SEQ ID NO: 118685 - DNA, 23 bp, Homo sapiens
aactagtttttcaggttagcttt

SEQ ID NO: 118686 - DNA, 19 bp, Homo sapiens
agtgaaggaccctcagtca

SEQ ID NO: 118687 - DNA, 23 bp, Homo sapiens
gtaggtgcttaacatatcagtaa

SEQ ID NO: 118688 - DNA, 20 bp, Homo sapiens
tcacacaggctggattgcag

SEQ ID NO: 118689 - DNA, 20 bp, Homo sapiens
tgacaacgtgagactgtctc

SEQ ID NO: 118690 - DNA, 22 bp, Homo sapiens
ttattgtctctcaaagtgtctg

SEQ ID NO: 118691 - DNA, 23 bp, Homo sapiens
tgagttcattgtagattctggat

SEQ ID NO: 118692 - DNA, 23 bp, Homo sapiens
tgagttcattgtagattctggat

SEQ ID NO: 118693 - DNA, 21 bp, Homo sapiens
agtgggactttttgtttttgt

SEQ ID NO: 118694 - DNA, 23 bp, Homo sapiens
ttttgagacagactctcactctg

SEQ ID NO: 118695 - DNA, 23 bp, Homo sapiens
tgagttcattgtagattctggat

SEQ ID NO: 118696 - DNA, 23 bp, Homo sapiens
tgagttcattgtagattctggat

SEQ ID NO: 118697 - DNA, 23 bp, Homo sapiens
gagtgacttgagtttgattctgt

SEQ ID NO: 118698 - DNA, 23 bp, Homo sapiens
agtctcaccctgtcacccaggct

SEQ ID NO: 118699 - DNA, 18 bp, Homo sapiens
aaatgaaaggatttgtga

SEQ ID NO: 118700 - DNA, 23 bp, Homo sapiens
ttctgagagaagagtgtgtgatg

SEQ ID NO: 118701 - DNA, 23 bp, Homo sapiens
tccctgccagcctctctggctgc

SEQ ID NO: 118702 - DNA, 23 bp, Homo sapiens
gggtctcactctgtcacccaggc

SEQ ID NO: 118703 - DNA, 20 bp, Homo sapiens
agagtctagaatgtcagctc

SEQ ID NO: 118704 - DNA, 23 bp, Homo sapiens
gacagagtctcgctctgtcaccc

SEQ ID NO: 118705 - DNA, 23 bp, Homo sapiens
gggtctctgactctgtctctcct

SEQ ID NO: 118706 - DNA, 23 bp, Homo sapiens
tctagcaccatctcatatccctt

SEQ ID NO: 118707 - DNA, 23 bp, Homo sapiens
tatatgtgtatatatatatgtgt

SEQ ID NO: 118708 - DNA, 23 bp, Homo sapiens
atatgtgtatatatatgtgtgtg

SEQ ID NO: 118709 - DNA, 23 bp, Homo sapiens
tatatgtgtatctctgtgtgtgt

SEQ ID NO: 118710 - DNA, 18 bp, Homo sapiens
tcaggagttcgaaaccag

SEQ ID NO: 118711 - DNA, 23 bp, Homo sapiens
tgacagtggtcagtcagtgtgat

SEQ ID NO: 118712 - DNA, 20 bp, Homo sapiens
tcgaccagctgttgctggct

SEQ ID NO: 118713 - DNA, 19 bp, Homo sapiens
ttagctacttttttttttt

SEQ ID NO: 118714 - DNA, 20 bp, Homo sapiens
cgagtctcgctctgtcaccc

SEQ ID NO: 118715 - DNA, 21 bp, Homo sapiens
tgtccctgtgtctctggccta

SEQ ID NO: 118716 - DNA, 23 bp, Homo sapiens
gagactctggatcttgtttaaat

SEQ ID NO: 118717 - DNA, 23 bp, Homo sapiens
ttcagtttgctagtattttcttg

SEQ ID NO: 118718 - DNA, 21 bp, Homo sapiens
tttaaaatacaggtgagtgag

SEQ ID NO: 118719 - DNA, 23 bp, Homo sapiens
ctgcagagttctctttctgatct

SEQ ID NO: 118720 - DNA, 19 bp, Homo sapiens
agagatggagtctcactct

SEQ ID NO: 118721 - DNA, 23 bp, Homo sapiens
gacagagtctcactctgtcaccc

SEQ ID NO: 118722 - DNA, 23 bp, Homo sapiens
agacagagtctcgctctcttgcc

SEQ ID NO: 118723 - DNA, 23 bp, Homo sapiens
gatgaagtctcactctgtcaccc

SEQ ID NO: 118724 - DNA, 22 bp, Homo sapiens
tgaaatgtagttttattcagcg

SEQ ID NO: 118725 - DNA, 20 bp, Homo sapiens
atcagcagcttaatcacact

SEQ ID NO: 118726 - DNA, 22 bp, Homo sapiens
tattgttaagaacttacaggtg

SEQ ID NO: 118727 - DNA, 23 bp, Homo sapiens
tgcagtcattagtctttttgatg

SEQ ID NO: 118728 - DNA, 22 bp, Homo sapiens
acccacttgttgatggggttgt

SEQ ID NO: 118729 - DNA, 21 bp, Homo sapiens
attcagataaattcagtgtct

SEQ ID NO: 118730 - DNA, 19 bp, Homo sapiens
agtgattagagactaggtt

SEQ ID NO: 118731 - DNA, 23 bp, Homo sapiens
tgcatctattgagataatcatgt

SEQ ID NO: 118732 - DNA, 19 bp, Homo sapiens
ttttttctttttgagatga

SEQ ID NO: 118733 - DNA, 20 bp, Homo sapiens
ttggagatctatgtgtatat

SEQ ID NO: 118734 - DNA, 20 bp, Homo sapiens
ttaaatgtatacaagttctc

SEQ ID NO: 118735 - DNA, 20 bp, Homo sapiens
tgtgaagagtgattgtggta

SEQ ID NO: 118736 - DNA, 23 bp, Homo sapiens
tgcactgagaattgtgtccaaca

SEQ ID NO: 118737 - DNA, 19 bp, Homo sapiens
gggggacacactcagactg

SEQ ID NO: 118738 - DNA, 21 bp, Homo sapiens
agtgcaattgtttggccatat

SEQ ID NO: 118739 - DNA, 21 bp, Homo sapiens
tgaggtaggaggatcacttga

SEQ ID NO: 118740 - DNA, 23 bp, Homo sapiens
tctgaggttacagtgagctatcc

SEQ ID NO: 118741 - DNA, 23 bp, Homo sapiens
tttgatctcactgcctgttctca

SEQ ID NO: 118742 - DNA, 23 bp, Homo sapiens
aggatatgtgtgtgtgtgtgtat

SEQ ID NO: 118743 - DNA, 21 bp, Homo sapiens
tgaatacatatacatactcga

SEQ ID NO: 118744 - DNA, 20 bp, Homo sapiens
tgacatatgtgtgtgtgcac

SEQ ID NO: 118745 - DNA, 23 bp, Homo sapiens
tttaccttgaaaatgtaaaatac

SEQ ID NO: 118746 - DNA, 23 bp, Homo sapiens
tctataggatatatatatgtatg

SEQ ID NO: 118747 - DNA, 19 bp, Homo sapiens
atgtgaggacacagtgagg

SEQ ID NO: 118748 - DNA, 21 bp, Homo sapiens
gttagttgtactgagtaatat

SEQ ID NO: 118749 - DNA, 23 bp, Homo sapiens
ttaaagtaagcttggaaaagttt

SEQ ID NO: 118750 - DNA, 18 bp, Homo sapiens
tttgtcagtacatactag

SEQ ID NO: 118751 - DNA, 18 bp, Homo sapiens
agaatctggattatgaag

SEQ ID NO: 118752 - DNA, 19 bp, Homo sapiens
ttatacagagggacagatg

SEQ ID NO: 118753 - DNA, 19 bp, Homo sapiens
gctgagcaagactgttcaa

SEQ ID NO: 118754 - DNA, 22 bp, Homo sapiens
tctgagatggagtctcactgtg

SEQ ID NO: 118755 - DNA, 22 bp, Homo sapiens
agtgcaagctcaggcagtcatg

SEQ ID NO: 118756 - DNA, 23 bp, Homo sapiens
tgtgtatgtgtatgtatatacac

SEQ ID NO: 118757 - DNA, 23 bp, Homo sapiens
gagacagagtctcactctgtcgc

SEQ ID NO: 118758 - DNA, 23 bp, Homo sapiens
atatgtatttatatctatctgta

SEQ ID NO: 118759 - DNA, 20 bp, Homo sapiens
tgtgtatatatatacatttg

SEQ ID NO: 118760 - DNA, 21 bp, Homo sapiens
tgtgtctgtggctctgtctca

SEQ ID NO: 118761 - DNA, 22 bp, Homo sapiens
gacaagttctcactctcccact

SEQ ID NO: 118762 - DNA, 23 bp, Homo sapiens
gctcaaatctgtctctctgtgct

SEQ ID NO: 118763 - DNA, 22 bp, Homo sapiens
aaagtcctcccattttctttcc

SEQ ID NO: 118764 - DNA, 23 bp, Homo sapiens
agcatggttgactagctgcatga

SEQ ID NO: 118765 - DNA, 23 bp, Homo sapiens
tgtcagcctgtttctcagcttca

SEQ ID NO: 118766 - DNA, 23 bp, Homo sapiens
atacagataagtcttagagttgc

SEQ ID NO: 118767 - DNA, 23 bp, Homo sapiens
agtctctgactcaatgtcatgtg

SEQ ID NO: 118768 - DNA, 23 bp, Homo sapiens
atgtctccgtgtgtgtgtgcctg

SEQ ID NO: 118769 - DNA, 21 bp, Homo sapiens
tctgtccttcactctctcaga

SEQ ID NO: 118770 - DNA, 23 bp, Homo sapiens
tcttaggtaatataagctgaagt

SEQ ID NO: 118771 - DNA, 19 bp, Homo sapiens
aggtgccttctgtcatgat

SEQ ID NO: 118772 - DNA, 19 bp, Homo sapiens
agacagaactcagtctggg

SEQ ID NO: 118773 - DNA, 23 bp, Homo sapiens
gtttgaagagacacagcagagat

SEQ ID NO: 118774 - DNA, 23 bp, Homo sapiens
aaagtgggccaagattcagctgt

SEQ ID NO: 118775 - DNA, 23 bp, Homo sapiens
gtagagagtagaaaatgagcagt

SEQ ID NO: 118776 - DNA, 23 bp, Homo sapiens
ttggttctacttactgtgggtct

SEQ ID NO: 118777 - DNA, 20 bp, Homo sapiens
tattcccagtataataatgt

SEQ ID NO: 118778 - DNA, 23 bp, Homo sapiens
cggagtctcactctgtcacccag

SEQ ID NO: 118779 - DNA, 23 bp, Homo sapiens
caaacagtgcaagtgaatcagaa

SEQ ID NO: 118780 - DNA, 23 bp, Homo sapiens
tctttgagtcagttgtctggagc

SEQ ID NO: 118781 - DNA, 19 bp, Homo sapiens
aggcagatgttacagtgaa

SEQ ID NO: 118782 - DNA, 18 bp, Homo sapiens
atctcattcatttcagtg

SEQ ID NO: 118783 - DNA, 23 bp, Homo sapiens
tgcgtgtgtctgagtcagtgata

SEQ ID NO: 118784 - DNA, 22 bp, Homo sapiens
aacctgaagcagtttctggtat

SEQ ID NO: 118785 - DNA, 23 bp, Homo sapiens
acactgtcactctgtgttttagg

SEQ ID NO: 118786 - DNA, 23 bp, Homo sapiens
gggagagcctcagtttttttttt

SEQ ID NO: 118787 - DNA, 21 bp, Homo sapiens
attctgtctcccagattagag

SEQ ID NO: 118788 - DNA, 22 bp, Homo sapiens
ctgtggcatgatcttgcgctac

SEQ ID NO: 118789 - DNA, 20 bp, Homo sapiens
tatatgtatgtatatgtata

SEQ ID NO: 118790 - DNA, 23 bp, Homo sapiens
atgtatgtatacatgtatgtatg

SEQ ID NO: 118791 - DNA, 19 bp, Homo sapiens
agtcaacattgtgatggat

SEQ ID NO: 118792 - DNA, 23 bp, Homo sapiens
ttaagctcactgtcttatgtggg

SEQ ID NO: 118793 - DNA, 20 bp, Homo sapiens
acataagacagtgagcttaa

SEQ ID NO: 118794 - DNA, 22 bp, Homo sapiens
tgagtctcgctctgtcacccag

SEQ ID NO: 118795 - DNA, 20 bp, Homo sapiens
tatttgcatgtttacatata

SEQ ID NO: 118796 - DNA, 21 bp, Homo sapiens
ctgtctctttcataattgccc

SEQ ID NO: 118797 - DNA, 23 bp, Homo sapiens
aggcctggttctttctgttttgg

SEQ ID NO: 118798 - DNA, 23 bp, Homo sapiens
tgagttcattgtagattctggat

SEQ ID NO: 118799 - DNA, 23 bp, Homo sapiens
tgagttcattgtagattctggat

SEQ ID NO: 118800 - DNA, 23 bp, Homo sapiens
tgagagaggaataaatatctata

SEQ ID NO: 118801 - DNA, 21 bp, Homo sapiens
ttatagcagcttatcctttcc

SEQ ID NO: 118802 - DNA, 23 bp, Homo sapiens
gagagttcagagtgttctttcct

SEQ ID NO: 118803 - DNA, 20 bp, Homo sapiens
atatgtacatgtatatatgt

SEQ ID NO: 118804 - DNA, 23 bp, Homo sapiens
catatacacacacatatatatgt

SEQ ID NO: 118805 - DNA, 23 bp, Homo sapiens
gagggcaggatccatgtgttatt

SEQ ID NO: 118806 - DNA, 23 bp, Homo sapiens
tgagttcattgtagattctggat

SEQ ID NO: 118807 - DNA, 23 bp, Homo sapiens
tgagttcattgtagattctggat

SEQ ID NO: 118808 - DNA, 21 bp, Homo sapiens
tatgaccttaagtaaactatt

SEQ ID NO: 118809 - DNA, 23 bp, Homo sapiens
tgagttcattgtagattctggat

SEQ ID NO: 118810 - DNA, 23 bp, Homo sapiens
tgagttcattgtagattctggat

SEQ ID NO: 118811 - DNA, 23 bp, Homo sapiens
tacccttctggtagatttcactt

SEQ ID NO: 118812 - DNA, 23 bp, Homo sapiens
tttctgcatgtgcgtgtgtgtgt

SEQ ID NO: 118813 - DNA, 23 bp, Homo sapiens
ttgagctccttttcaagagttta

SEQ ID NO: 118814 - DNA, 23 bp, Homo sapiens
cttttgagatgtttctgtttagg

SEQ ID NO: 118815 - DNA, 22 bp, Homo sapiens
tgtatacatagatgtgtgcaca

SEQ ID NO: 118816 - DNA, 23 bp, Homo sapiens
gacagtggaattctactgaatat

SEQ ID NO: 118817 - DNA, 18 bp, Homo sapiens
tatattttaggatagtct

SEQ ID NO: 118818 - DNA, 23 bp, Homo sapiens
aggctggaatacagtggtttgat

SEQ ID NO: 118819 - DNA, 20 bp, Homo sapiens
tatgtgcatatatatgtgta

SEQ ID NO: 118820 - DNA, 23 bp, Homo sapiens
tatgtgtgtatatatatgcgtgt

SEQ ID NO: 118821 - DNA, 19 bp, Homo sapiens
tgcatgaagagggctttca

SEQ ID NO: 118822 - DNA, 18 bp, Homo sapiens
tatcagtctgtttctgca

SEQ ID NO: 118823 - DNA, 18 bp, Homo sapiens
ttattagaacataatgtt

SEQ ID NO: 118824 - DNA, 23 bp, Homo sapiens
ttagaccttgttcttataatgtg

SEQ ID NO: 118825 - DNA, 23 bp, Homo sapiens
tgcattaaagactgatatgcatg

SEQ ID NO: 118826 - DNA, 21 bp, Homo sapiens
tattcaacatatcagtgttac

SEQ ID NO: 118827 - DNA, 23 bp, Homo sapiens
gtataaactctctctctctctat

SEQ ID NO: 118828 - DNA, 23 bp, Homo sapiens
tatactgtggaaatcattgcata

SEQ ID NO: 118829 - DNA, 23 bp, Homo sapiens
agtgtcatagtatcctgtagtgt

SEQ ID NO: 118830 - DNA, 22 bp, Homo sapiens
tggaattgtttagtcaaaggtt

SEQ ID NO: 118831 - DNA, 23 bp, Homo sapiens
agacaacattttaccttctgcag

SEQ ID NO: 118832 - DNA, 21 bp, Homo sapiens
agtgtggtggcatacacctgt

SEQ ID NO: 118833 - DNA, 18 bp, Homo sapiens
acactagtgaatttgttt

SEQ ID NO: 118834 - DNA, 23 bp, Homo sapiens
tcatagacaggaaatgttcaggg

SEQ ID NO: 118835 - DNA, 23 bp, Homo sapiens
gactgtggctgcctgcctgtaat

SEQ ID NO: 118836 - DNA, 22 bp, Homo sapiens
agactgagtctctctctgtcgt

SEQ ID NO: 118837 - DNA, 20 bp, Homo sapiens
aaggatgtattcactaggca

SEQ ID NO: 118838 - DNA, 18 bp, Homo sapiens
tcctagctactcaagagg

SEQ ID NO: 118839 - DNA, 23 bp, Homo sapiens
ttttgtaagcaaggtctcactct

SEQ ID NO: 118840 - DNA, 21 bp, Homo sapiens
tttgagatggagtcttgctct

SEQ ID NO: 118841 - DNA, 19 bp, Homo sapiens
aataccacctccacctcct

SEQ ID NO: 118842 - DNA, 23 bp, Homo sapiens
tggagtctcactctgtcacccag

SEQ ID NO: 118843 - DNA, 21 bp, Homo sapiens
tagcatatacatctgtatgta

SEQ ID NO: 118844 - DNA, 23 bp, Homo sapiens
tgtatatatctcacaggactgta

SEQ ID NO: 118845 - DNA, 23 bp, Homo sapiens
tatctgtctgtctgtctttcgac

SEQ ID NO: 118846 - DNA, 23 bp, Homo sapiens
ttttgagatggagtctcactctg

SEQ ID NO: 118847 - DNA, 23 bp, Homo sapiens
tgagacagagtctcgctgtgtca

SEQ ID NO: 118848 - DNA, 23 bp, Homo sapiens
agagaactttccagatccacgag

SEQ ID NO: 118849 - DNA, 19 bp, Homo sapiens
agcctgttatctctcccga

SEQ ID NO: 118850 - DNA, 23 bp, Homo sapiens
tgtcatcatccttcactctctgc

SEQ ID NO: 118851 - DNA, 18 bp, Homo sapiens
agatgctcactctggtgt

SEQ ID NO: 118852 - DNA, 21 bp, Homo sapiens
tatatctatatgtatacatat

SEQ ID NO: 118853 - DNA, 22 bp, Homo sapiens
tacagtcttgaacatgttccgt

SEQ ID NO: 118854 - DNA, 23 bp, Homo sapiens
agataagcgcataggctttgagt

SEQ ID NO: 118855 - DNA, 23 bp, Homo sapiens
tcagtccctgcctctgtcactta

SEQ ID NO: 118856 - DNA, 23 bp, Homo sapiens
tgtctagcacgagcagatggagt

SEQ ID NO: 118857 - DNA, 23 bp, Homo sapiens
acacaggcagtttacagaaatga

SEQ ID NO: 118858 - DNA, 18 bp, Homo sapiens
agacctcaactgttcttg

SEQ ID NO: 118859 - DNA, 23 bp, Homo sapiens
cacttacacactgtctgtggctg

SEQ ID NO: 118860 - DNA, 22 bp, Homo sapiens
ttgagtagctgtgacagagact

SEQ ID NO: 118861 - DNA, 22 bp, Homo sapiens
agtgcaagcactttcagccttt

SEQ ID NO: 118862 - DNA, 23 bp, Homo sapiens
gtgttgatggcactctctctgaa

SEQ ID NO: 118863 - DNA, 23 bp, Homo sapiens
tttgacatctggcaggtgtcact

SEQ ID NO: 118864 - DNA, 23 bp, Homo sapiens
aaagacagtgctagaagttagtt

SEQ ID NO: 118865 - DNA, 23 bp, Homo sapiens
tgagttcattgtagattctggat

SEQ ID NO: 118866 - DNA, 23 bp, Homo sapiens
tgagttcattgtagattctggat

SEQ ID NO: 118867 - DNA, 23 bp, Homo sapiens
gtattgttcagctggaaggtgtc

SEQ ID NO: 118868 - DNA, 23 bp, Homo sapiens
gtctcaagagatcctcctgtctc

SEQ ID NO: 118869 - DNA, 23 bp, Homo sapiens
agagtctcactctgtcacccagg

SEQ ID NO: 118870 - DNA, 20 bp, Homo sapiens
acctagatagatagatagat

SEQ ID NO: 118871 - DNA, 21 bp, Homo sapiens
ctcagaagggtgagtctcagg

SEQ ID NO: 118872 - DNA, 23 bp, Homo sapiens
agctgactgaagagtcactgggc

SEQ ID NO: 118873 - DNA, 23 bp, Homo sapiens
acagtttctgcatgacaaatgtg

SEQ ID NO: 118874 - DNA, 23 bp, Homo sapiens
atgtgtatatatatatatgtgtg

SEQ ID NO: 118875 - DNA, 23 bp, Homo sapiens
catggtctcactctgtcacccag

SEQ ID NO: 118876 - DNA, 21 bp, Homo sapiens
tgagcaatttagatgtcaagt

SEQ ID NO: 118877 - DNA, 23 bp, Homo sapiens
tcttgtctcattcaatttttgct

SEQ ID NO: 118878 - DNA, 18 bp, Homo sapiens
tgtgtatatatatacaca

SEQ ID NO: 118879 - DNA, 23 bp, Homo sapiens
ctgggtgacacagactctgtctc

SEQ ID NO: 118880 - DNA, 22 bp, Homo sapiens
tatacacacacataaaaatgtg

SEQ ID NO: 118881 - DNA, 21 bp, Homo sapiens
gggtctcactctgtcacccag

SEQ ID NO: 118882 - DNA, 23 bp, Homo sapiens
tagagtggcatgatcttggctca

SEQ ID NO: 118883 - DNA, 23 bp, Homo sapiens
tctgtcagcctgtgtccctgagt

SEQ ID NO: 118884 - DNA, 23 bp, Homo sapiens
tgacatgctttagacgtgaagtg

SEQ ID NO: 118885 - DNA, 23 bp, Homo sapiens
attctgtgagctaaacaaatggt

SEQ ID NO: 118886 - DNA, 21 bp, Homo sapiens
ttttcaaaactagtttagtca

SEQ ID NO: 118887 - DNA, 23 bp, Homo sapiens
aatactttataatactgaaagga

SEQ ID NO: 118888 - DNA, 23 bp, Homo sapiens
aaaaggtatttcaccttacagaa

SEQ ID NO: 118889 - DNA, 20 bp, Homo sapiens
tctctgtattcctgtgtcag

SEQ ID NO: 118890 - DNA, 22 bp, Homo sapiens
atctcagaaagaatttcatgtg

SEQ ID NO: 118891 - DNA, 18 bp, Homo sapiens
ttatgcatgacttgcctt

SEQ ID NO: 118892 - DNA, 20 bp, Homo sapiens
gtatatatacacgtgtgtgt

SEQ ID NO: 118893 - DNA, 23 bp, Homo sapiens
attttcaagaagatctttcctct

SEQ ID NO: 118894 - DNA, 23 bp, Homo sapiens
agacacagaagctagtgagctca

SEQ ID NO: 118895 - DNA, 22 bp, Homo sapiens
tctcttcactaaagcaattgtg

SEQ ID NO: 118896 - DNA, 23 bp, Homo sapiens
aatgcttgttgaaaaaggaagaa

SEQ ID NO: 118897 - DNA, 19 bp, Homo sapiens
tcagggtttctcacatttt

SEQ ID NO: 118898 - DNA, 23 bp, Homo sapiens
taatgtgtggattctgattcagt

SEQ ID NO: 118899 - DNA, 20 bp, Homo sapiens
tgtataggtaacgtatatgc

SEQ ID NO: 118900 - DNA, 20 bp, Homo sapiens
aatgtatctggtattcattc

SEQ ID NO: 118901 - DNA, 23 bp, Homo sapiens
tctctctgtggctgggtctgggg

SEQ ID NO: 118902 - DNA, 18 bp, Homo sapiens
aagagaggaaattagtgt

SEQ ID NO: 118903 - DNA, 23 bp, Homo sapiens
acatacttagtacatggacgtag

SEQ ID NO: 118904 - DNA, 22 bp, Homo sapiens
tatatatgtgtgtgtatatata

SEQ ID NO: 118905 - DNA, 23 bp, Homo sapiens
agaggattgccttatgtgtaggt

SEQ ID NO: 118906 - DNA, 21 bp, Homo sapiens
ttccagaggcaactgtcagtc

SEQ ID NO: 118907 - DNA, 22 bp, Homo sapiens
tatgcaagtatatgttatgtat

SEQ ID NO: 118908 - DNA, 23 bp, Homo sapiens
atatgtataaatatatatgtgtg

SEQ ID NO: 118909 - DNA, 23 bp, Homo sapiens
tttctgtatgtttttgtttacta

SEQ ID NO: 118910 - DNA, 23 bp, Homo sapiens
gattatgtcactgaatccactag

SEQ ID NO: 118911 - DNA, 18 bp, Homo sapiens
caaggtccatagtttctt

SEQ ID NO: 118912 - DNA, 23 bp, Homo sapiens
ttgtgagttgagaagatacccca

SEQ ID NO: 118913 - DNA, 23 bp, Homo sapiens
aatccatatgaatagaccattga

SEQ ID NO: 118914 - DNA, 23 bp, Homo sapiens
ggcagaggttgcagtgagccgag

SEQ ID NO: 118915 - DNA, 21 bp, Homo sapiens
tgacagaacagtgtgtggaga

SEQ ID NO: 118916 - DNA, 23 bp, Homo sapiens
tttaagcatgtactagaggccaa

SEQ ID NO: 118917 - DNA, 23 bp, Homo sapiens
tgtatgtatatatgtatgtgtga

SEQ ID NO: 118918 - DNA, 20 bp, Homo sapiens
atagagtatggcaaaagtgt

SEQ ID NO: 118919 - DNA, 23 bp, Homo sapiens
acaatcagctagtaaatttttct

SEQ ID NO: 118920 - DNA, 21 bp, Homo sapiens
tgtatatatatatagtgtagt

SEQ ID NO: 118921 - DNA, 23 bp, Homo sapiens
tggctctctgcctcagtcctctc

SEQ ID NO: 118922 - DNA, 19 bp, Homo sapiens
ttgctgtgatgggagcagt

SEQ ID NO: 118923 - DNA, 23 bp, Homo sapiens
ccctatactctcagctctctcac

SEQ ID NO: 118924 - DNA, 23 bp, Homo sapiens
agagtctcactcagtcacccagg

SEQ ID NO: 118925 - DNA, 18 bp, Homo sapiens
gagcgagactccgtccaa

SEQ ID NO: 118926 - DNA, 21 bp, Homo sapiens
atatggggatcattttgtatg

SEQ ID NO: 118927 - DNA, 23 bp, Homo sapiens
tctgatactttgttaaggtatgg

SEQ ID NO: 118928 - DNA, 23 bp, Homo sapiens
tctctgtctctctgggtcacttg

SEQ ID NO: 118929 - DNA, 18 bp, Homo sapiens
tgtatacatatatatgtg

SEQ ID NO: 118930 - DNA, 20 bp, Homo sapiens
tgtatatatatatgtgtgta

SEQ ID NO: 118931 - DNA, 22 bp, Homo sapiens
atgagatctgtgaacagtgatc

SEQ ID NO: 118932 - DNA, 23 bp, Homo sapiens
gtgtctgtatatgtatatgtatg

SEQ ID NO: 118933 - DNA, 22 bp, Homo sapiens
tatgtatacgacgtatacagtg

SEQ ID NO: 118934 - DNA, 23 bp, Homo sapiens
tgtgtgtgtatatatatatatgt

SEQ ID NO: 118935 - DNA, 21 bp, Homo sapiens
atgtgtatatatattcacata

SEQ ID NO: 118936 - DNA, 23 bp, Homo sapiens
atatattcacatatacatatgtg

SEQ ID NO: 118937 - DNA, 18 bp, Homo sapiens
tgtatatatattcacata

SEQ ID NO: 118938 - DNA, 23 bp, Homo sapiens
tatgtgcatatatatgtgtgtgt

SEQ ID NO: 118939 - DNA, 21 bp, Homo sapiens
tttgttcttaggattgtcttg

SEQ ID NO: 118940 - DNA, 21 bp, Homo sapiens
tgtgaagaaagtcattggtag

SEQ ID NO: 118941 - DNA, 23 bp, Homo sapiens
tagtatctttggatttctaagtc

SEQ ID NO: 118942 - DNA, 19 bp, Homo sapiens
ttttgcttattatatgatt

SEQ ID NO: 118943 - DNA, 23 bp, Homo sapiens
tgagttcattgtagattctggat

SEQ ID NO: 118944 - DNA, 23 bp, Homo sapiens
tgagttcattgtagattctggat

SEQ ID NO: 118945 - DNA, 23 bp, Homo sapiens
ggagtctcactctgtcactcagg

SEQ ID NO: 118946 - DNA, 23 bp, Homo sapiens
atatatgtacatataggtacaca

SEQ ID NO: 118947 - DNA, 23 bp, Homo sapiens
taagaagtgaatttgttcttatt

SEQ ID NO: 118948 - DNA, 20 bp, Homo sapiens
atatgtacatatgtatatgt

SEQ ID NO: 118949 - DNA, 20 bp, Homo sapiens
atatgtacatatgtatatgt

SEQ ID NO: 118950 - DNA, 19 bp, Homo sapiens
ggtggtgaagactatgtgt

SEQ ID NO: 118951 - DNA, 20 bp, Homo sapiens
tagagagtttatgttcagta

SEQ ID NO: 118952 - DNA, 20 bp, Homo sapiens
tattaaggaaattttcttgt

SEQ ID NO: 118953 - DNA, 23 bp, Homo sapiens
tgagttcattgtagattctggat

SEQ ID NO: 118954 - DNA, 23 bp, Homo sapiens
tgagttcattgtagattctggat

SEQ ID NO: 118955 - DNA, 23 bp, Homo sapiens
atttttgtggataccatagtgtg

SEQ ID NO: 118956 - DNA, 23 bp, Homo sapiens
agtttcaaaacttgctggtctgt

SEQ ID NO: 118957 - DNA, 23 bp, Homo sapiens
gactgagttcagtgtctgtgagc

SEQ ID NO: 118958 - DNA, 23 bp, Homo sapiens
ttgagacaggtatatatatatgt

SEQ ID NO: 118959 - DNA, 21 bp, Homo sapiens
caggaccacacattgatgtgc

SEQ ID NO: 118960 - DNA, 23 bp, Homo sapiens
ctggctctgacactcagtgagat

SEQ ID NO: 118961 - DNA, 23 bp, Homo sapiens
aatgagtgtggtcttgttctggg

SEQ ID NO: 118962 - DNA, 23 bp, Homo sapiens
gatatcttgctagaatgatgcaa

SEQ ID NO: 118963 - DNA, 18 bp, Homo sapiens
atgtgtgtatatatatgt

SEQ ID NO: 118964 - DNA, 23 bp, Homo sapiens
tgtgtgtgtgcatgtgcatgtgt

SEQ ID NO: 118965 - DNA, 23 bp, Homo sapiens
atcatatcatagtgttcttatgc

SEQ ID NO: 118966 - DNA, 20 bp, Homo sapiens
agtgctagagaaagtaaggt

SEQ ID NO: 118967 - DNA, 23 bp, Homo sapiens
atatgtgtatatgtatatttgtg

SEQ ID NO: 118968 - DNA, 22 bp, Homo sapiens
tgttggttgtatccttttgtgt

SEQ ID NO: 118969 - DNA, 22 bp, Homo sapiens
tgacaagtagtacaggaaatga

SEQ ID NO: 118970 - DNA, 21 bp, Homo sapiens
acagaaaatatgtatatatgt

SEQ ID NO: 118971 - DNA, 23 bp, Homo sapiens
tacatactgtaggtctaggtgtt

SEQ ID NO: 118972 - DNA, 23 bp, Homo sapiens
tcccagagcccctggaactctgg

SEQ ID NO: 118973 - DNA, 21 bp, Homo sapiens
aagtctccctctgtcacccag

SEQ ID NO: 118974 - DNA, 23 bp, Homo sapiens
tatgtgtatatatatgtgtgtgt

SEQ ID NO: 118975 - DNA, 19 bp, Homo sapiens
atacacacacacatatatg

SEQ ID NO: 118976 - DNA, 23 bp, Homo sapiens
gagtctgtctctgtcacccaggc

SEQ ID NO: 118977 - DNA, 23 bp, Homo sapiens
tggatagacagaatagtgtgtgg

SEQ ID NO: 118978 - DNA, 23 bp, Homo sapiens
ctatgtggaatagcagttgtgaa

SEQ ID NO: 118979 - DNA, 23 bp, Homo sapiens
attctgtgaggtaaagaactaag

SEQ ID NO: 118980 - DNA, 23 bp, Homo sapiens
tgtcattctggatttgtttttca

SEQ ID NO: 118981 - DNA, 23 bp, Homo sapiens
ttgagacagagtcttgctctgtc

SEQ ID NO: 118982 - DNA, 23 bp, Homo sapiens
tggcaggttgacagagcaaagat

SEQ ID NO: 118983 - DNA, 23 bp, Homo sapiens
actctgtcacccaaactacagtg

SEQ ID NO: 118984 - DNA, 22 bp, Homo sapiens
tggctcactataacctccactt

SEQ ID NO: 118985 - DNA, 23 bp, Homo sapiens
tgagttcattgtagattctggat

SEQ ID NO: 118986 - DNA, 23 bp, Homo sapiens
tgagttcattgtagattctggat

SEQ ID NO: 118987 - DNA, 23 bp, Homo sapiens
ttctgtgaagaaagtcattggta

SEQ ID NO: 118988 - DNA, 23 bp, Homo sapiens
aggtaatgatgatgttgatgatg

SEQ ID NO: 118989 - DNA, 23 bp, Homo sapiens
agataaatatttgaggtgatgga

SEQ ID NO: 118990 - DNA, 18 bp, Homo sapiens
tgtagtcacagatacttg

SEQ ID NO: 118991 - DNA, 23 bp, Homo sapiens
attgtggttttgatttgcatttc

SEQ ID NO: 118992 - DNA, 22 bp, Homo sapiens
gagtctcagagtctggctctgt

SEQ ID NO: 118993 - DNA, 23 bp, Homo sapiens
tatgtgtctctttttgtacagta

SEQ ID NO: 118994 - DNA, 18 bp, Homo sapiens
tgtgcacaatgtgcaggt

SEQ ID NO: 118995 - DNA, 19 bp, Homo sapiens
tttctgtgaaaatgttgct

SEQ ID NO: 118996 - DNA, 19 bp, Homo sapiens
tgaggttggaggatctctt

SEQ ID NO: 118997 - DNA, 23 bp, Homo sapiens
tattgtctgttgttagcatgatc

SEQ ID NO: 118998 - DNA, 20 bp, Homo sapiens
acactagaatttttgctctt

SEQ ID NO: 118999 - DNA, 23 bp, Homo sapiens
gtgtgtgtctgtgtgtgtatttt

SEQ ID NO: 119000 - DNA, 23 bp, Homo sapiens
tatgtgtgtatatatgtgtgtgt

SEQ ID NO: 119001 - DNA, 23 bp, Homo sapiens
tatgtgtgtatatatatatgtgt

SEQ ID NO: 119002 - DNA, 23 bp, Homo sapiens
tatctggaaatttgttttatagt

SEQ ID NO: 119003 - DNA, 20 bp, Homo sapiens
acaggaatgaagtgggtgct

SEQ ID NO: 119004 - DNA, 23 bp, Homo sapiens
tatatctatatgtatgtgtgtat

SEQ ID NO: 119005 - DNA, 23 bp, Homo sapiens
tatgtgtgtatatatgtgtgtgt

SEQ ID NO: 119006 - DNA, 22 bp, Homo sapiens
ttatgtgcttgcaaatgtgtta

SEQ ID NO: 119007 - DNA, 22 bp, Homo sapiens
atgtgatttcattcttatctca

SEQ ID NO: 119008 - DNA, 21 bp, Homo sapiens
tgttggaccacactgcttagt

SEQ ID NO: 119009 - DNA, 23 bp, Homo sapiens
aagattgaaggtgtgagaactca

SEQ ID NO: 119010 - DNA, 23 bp, Homo sapiens
tcagtcagactctgtcaatggga

SEQ ID NO: 119011 - DNA, 23 bp, Homo sapiens
agtgcatgtgtgtgtgtgtgtgg

SEQ ID NO: 119012 - DNA, 21 bp, Homo sapiens
gactgaggaaatgaattgttt

SEQ ID NO: 119013 - DNA, 23 bp, Homo sapiens
agaactgagattgcagattgatt

SEQ ID NO: 119014 - DNA, 23 bp, Homo sapiens
aatgtggtttagctttagaaagt

SEQ ID NO: 119015 - DNA, 23 bp, Homo sapiens
aatgcaaatttgtttaaagatga

SEQ ID NO: 119016 - DNA, 20 bp, Homo sapiens
acggactctcgctctgtcgc

SEQ ID NO: 119017 - DNA, 23 bp, Homo sapiens
tttttgagtctgggtcatctgtc

SEQ ID NO: 119018 - DNA, 23 bp, Homo sapiens
tacatgtgcagaatgtgcaggtt

SEQ ID NO: 119019 - DNA, 23 bp, Homo sapiens
tgagttcattgtagattctggat

SEQ ID NO: 119020 - DNA, 23 bp, Homo sapiens
tgagttcattgtagattctggat

SEQ ID NO: 119021 - DNA, 18 bp, Homo sapiens
gctactactatattcttt

SEQ ID NO: 119022 - DNA, 23 bp, Homo sapiens
cgtattggcacacaaacttctta

SEQ ID NO: 119023 - DNA, 20 bp, Homo sapiens
gtctcgctctgtcactcagg

SEQ ID NO: 119024 - DNA, 23 bp, Homo sapiens
ttgtggcatatttaagctgtggt

SEQ ID NO: 119025 - DNA, 20 bp, Homo sapiens
atcactgtcttcccaacaga

SEQ ID NO: 119026 - DNA, 18 bp, Homo sapiens
gagctccacctcctgtca

SEQ ID NO: 119027 - DNA, 20 bp, Homo sapiens
gttgaggctgcagtgagtca

SEQ ID NO: 119028 - DNA, 22 bp, Homo sapiens
taccaacatacaaagattagag

SEQ ID NO: 119029 - DNA, 22 bp, Homo sapiens
tgaaaagtcattttgatgttaa

SEQ ID NO: 119030 - DNA, 23 bp, Homo sapiens
agtttggctggatatgaaattct

SEQ ID NO: 119031 - DNA, 23 bp, Homo sapiens
acagagtctcgctctgtcgctca

SEQ ID NO: 119032 - DNA, 23 bp, Homo sapiens
tgagttcattgtagattctggat

SEQ ID NO: 119033 - DNA, 23 bp, Homo sapiens
tgagttcattgtagattctggat

SEQ ID NO: 119034 - DNA, 19 bp, Homo sapiens
aaggttgtagaaccaggca

SEQ ID NO: 119035 - DNA, 23 bp, Homo sapiens
tgtctgtctgtgactctgtgctt

SEQ ID NO: 119036 - DNA, 22 bp, Homo sapiens
tgtgagccactgagcctggctg

SEQ ID NO: 119037 - DNA, 23 bp, Homo sapiens
tggggtctcactctgtcacccag

SEQ ID NO: 119038 - DNA, 23 bp, Homo sapiens
caattggtattcagtaagtagtt

SEQ ID NO: 119039 - DNA, 23 bp, Homo sapiens
cggagtctcactctgtcacccag

SEQ ID NO: 119040 - DNA, 23 bp, Homo sapiens
gagtctcactctgtcacccaggc

SEQ ID NO: 119041 - DNA, 19 bp, Homo sapiens
tgtgtgtgtacatatgtgt

SEQ ID NO: 119042 - DNA, 20 bp, Homo sapiens
aagagtctttctttttgtca

SEQ ID NO: 119043 - DNA, 20 bp, Homo sapiens
atacagaaacaaaaggcttc

SEQ ID NO: 119044 - DNA, 22 bp, Homo sapiens
aatgtcatttttattttgggtg

SEQ ID NO: 119045 - DNA, 19 bp, Homo sapiens
taactgtcaaaactcatct

SEQ ID NO: 119046 - DNA, 23 bp, Homo sapiens
cggagtctcgctctgtcgctcag

SEQ ID NO: 119047 - DNA, 20 bp, Homo sapiens
gtgggtgtgacagaggccca

SEQ ID NO: 119048 - DNA, 21 bp, Homo sapiens
tgagacagagtctcgctctgt

SEQ ID NO: 119049 - DNA, 23 bp, Homo sapiens
ttctgtgaagaaagtcaatggta

SEQ ID NO: 119050 - DNA, 23 bp, Homo sapiens
tgagttcattgtagattctggat

SEQ ID NO: 119051 - DNA, 23 bp, Homo sapiens
tgagttcattgtagattctggat

SEQ ID NO: 119052 - DNA, 21 bp, Homo sapiens
tgcatgtgtgtgtgtgtgtgt

SEQ ID NO: 119053 - DNA, 23 bp, Homo sapiens
agactgagtctcgctctgtcacc

SEQ ID NO: 119054 - DNA, 19 bp, Homo sapiens
tgtgatctcaactcattgc

SEQ ID NO: 119055 - DNA, 18 bp, Homo sapiens
tctcgctctgtcacccag

SEQ ID NO: 119056 - DNA, 21 bp, Homo sapiens
ctggagtgcagtgtgatgtga

SEQ ID NO: 119057 - DNA, 21 bp, Homo sapiens
tggtgatgcaggccaggtcga

SEQ ID NO: 119058 - DNA, 21 bp, Homo sapiens
aaagttgtaggtttccaactt

SEQ ID NO: 119059 - DNA, 19 bp, Homo sapiens
aggcaagaactgagtttgc

SEQ ID NO: 119060 - DNA, 21 bp, Homo sapiens
tggtgatgcaggccaggtcga

SEQ ID NO: 119061 - DNA, 23 bp, Homo sapiens
tgagttcattgtagattctggat

SEQ ID NO: 119062 - DNA, 23 bp, Homo sapiens
acagtggcagagttcacgtggca

SEQ ID NO: 119063 - DNA, 23 bp, Homo sapiens
agagtctcactctgtcacccagg

SEQ ID NO: 119064 - DNA, 23 bp, Homo sapiens
tgtcagtactgggtgtgcacaca

SEQ ID NO: 119065 - DNA, 18 bp, Homo sapiens
tgagatcctagacttggg

SEQ ID NO: 119066 - DNA, 23 bp, Homo sapiens
gacagagtctcgctctgtcaccc

SEQ ID NO: 119067 - DNA, 23 bp, Homo sapiens
ttttgagacggagtcttgctcta

SEQ ID NO: 119068 - DNA, 20 bp, Homo sapiens
tggagtctctctctgtcacc

SEQ ID NO: 119069 - DNA, 23 bp, Homo sapiens
tgcatgtatgtgtatgtgtgtgc

SEQ ID NO: 119070 - DNA, 18 bp, Homo sapiens
tatatgcttgtttatgca

SEQ ID NO: 119071 - DNA, 19 bp, Homo sapiens
agcaacctctgcctcctga

SEQ ID NO: 119072 - DNA, 21 bp, Homo sapiens
gcttatgtcacctagagtaac

SEQ ID NO: 119073 - DNA, 23 bp, Homo sapiens
tgtctgactgacactctgctaca

SEQ ID NO: 119074 - DNA, 22 bp, Homo sapiens
atgctgtcaccctctcagtgtg

SEQ ID NO: 119075 - DNA, 22 bp, Homo sapiens
ttgaggttgtagtgagctgtgt

SEQ ID NO: 119076 - DNA, 23 bp, Homo sapiens
tgagacagagtctctctctgtcg

SEQ ID NO: 119077 - DNA, 23 bp, Homo sapiens
gacagagtctcgctctgtcaccc

SEQ ID NO: 119078 - DNA, 23 bp, Homo sapiens
tgcctcggtctctgtctctgtgg

SEQ ID NO: 119079 - DNA, 20 bp, Homo sapiens
aaagcagcttccagagcact

SEQ ID NO: 119080 - DNA, 20 bp, Homo sapiens
gagagaaaagtgagagcact

SEQ ID NO: 119081 - DNA, 22 bp, Homo sapiens
cactgcctctctcaccctctgc

SEQ ID NO: 119082 - DNA, 22 bp, Homo sapiens
ttacagcaatacaaaacagagt

SEQ ID NO: 119083 - DNA, 23 bp, Homo sapiens
gaaatctgtgtctacactgggag

SEQ ID NO: 119084 - DNA, 18 bp, Homo sapiens
tgagatagggtaaagact

SEQ ID NO: 119085 - DNA, 23 bp, Homo sapiens
ttttggtggagtctcgctctgtc

SEQ ID NO: 119086 - DNA, 23 bp, Homo sapiens
tcatgacacagtgattttttttt

SEQ ID NO: 119087 - DNA, 21 bp, Homo sapiens
tgagatggagtctcactctgt

SEQ ID NO: 119088 - DNA, 23 bp, Homo sapiens
tggagtctcactctgtcacccag

SEQ ID NO: 119089 - DNA, 23 bp, Homo sapiens
tggagtctcactctgtcacccag

SEQ ID NO: 119090 - DNA, 20 bp, Homo sapiens
tatatatgtctatatgtata

SEQ ID NO: 119091 - DNA, 23 bp, Homo sapiens
tgattctatgattttgttgttgt

SEQ ID NO: 119092 - DNA, 19 bp, Homo sapiens
gagatttgagtgagaccca

SEQ ID NO: 119093 - DNA, 18 bp, Homo sapiens
tgactacactctctctct

SEQ ID NO: 119094 - DNA, 19 bp, Homo sapiens
ttctatgtgtccgtgtcct

SEQ ID NO: 119095 - DNA, 23 bp, Homo sapiens
cacagcagtccgactctgcacct

SEQ ID NO: 119096 - DNA, 23 bp, Homo sapiens
attcactcactcactcactccct

SEQ ID NO: 119097 - DNA, 23 bp, Homo sapiens
agagaaatgacagtggagaggtt

SEQ ID NO: 119098 - DNA, 23 bp, Homo sapiens
gggtctcactctgtcacccaggc

SEQ ID NO: 119099 - DNA, 23 bp, Homo sapiens
gggtcagagtgttctgtgtacct

SEQ ID NO: 119100 - DNA, 23 bp, Homo sapiens
gtctgggtctgtcagccacagca

SEQ ID NO: 119101 - DNA, 23 bp, Homo sapiens
agagaggttgtgagcctgactgt

SEQ ID NO: 119102 - DNA, 23 bp, Homo sapiens
tctgtgtctgtgtcagtgcaatg

SEQ ID NO: 119103 - DNA, 20 bp, Homo sapiens
aagcaacgaagagagagcca

SEQ ID NO: 119104 - DNA, 23 bp, Homo sapiens
gggtctcactctgtcacccaggc

SEQ ID NO: 119105 - DNA, 23 bp, Homo sapiens
tgattcactgcttgtaatctcac

SEQ ID NO: 119106 - DNA, 23 bp, Homo sapiens
acagactctcactctgtcgccca

SEQ ID NO: 119107 - DNA, 21 bp, Homo sapiens
tgtgagccactgtgcccggcc

SEQ ID NO: 119108 - DNA, 23 bp, Homo sapiens
ggctcagtggctgggtgtgtggc

SEQ ID NO: 119109 - DNA, 22 bp, Homo sapiens
gctcagctcctgctgcagtcag

SEQ ID NO: 119110 - DNA, 23 bp, Homo sapiens
aactcacagtggtttagagctat

SEQ ID NO: 119111 - DNA, 22 bp, Homo sapiens
ttttgagacagagtctcactct

SEQ ID NO: 119112 - DNA, 21 bp, Homo sapiens
ttttcactttttgaaaaaaag

SEQ ID NO: 119113 - DNA, 21 bp, Homo sapiens
tgagacagagtctggctctgt

SEQ ID NO: 119114 - DNA, 18 bp, Homo sapiens
tctcaggctcagtcactc

SEQ ID NO: 119115 - DNA, 19 bp, Homo sapiens
tcaccccgagtagctggga

SEQ ID NO: 119116 - DNA, 20 bp, Homo sapiens
tctatttttagtagagacag

SEQ ID NO: 119117 - DNA, 19 bp, Homo sapiens
tggctcacacccataatcc

SEQ ID NO: 119118 - DNA, 23 bp, Homo sapiens
gagacacagtcttgctctgtctc

SEQ ID NO: 119119 - DNA, 23 bp, Homo sapiens
gacaaagtctcgctctgtcaccc

SEQ ID NO: 119120 - DNA, 23 bp, Homo sapiens
tagtccaactctatttgtttttc

SEQ ID NO: 119121 - DNA, 23 bp, Homo sapiens
tctgtgtgtctatctgtctgagg

SEQ ID NO: 119122 - DNA, 22 bp, Homo sapiens
tgttactgtcagtggagggtct

SEQ ID NO: 119123 - DNA, 23 bp, Homo sapiens
agcctgtgcaactgcgagtcaat

SEQ ID NO: 119124 - DNA, 23 bp, Homo sapiens
gtctctctgagtctcagttttgt

SEQ ID NO: 119125 - DNA, 21 bp, Homo sapiens
taatgaccatcatcatcatat

SEQ ID NO: 119126 - DNA, 20 bp, Homo sapiens
cagtgttttaactccatgtt

SEQ ID NO: 119127 - DNA, 23 bp, Homo sapiens
tgtatatctcattatgtataagt

SEQ ID NO: 119128 - DNA, 23 bp, Homo sapiens
tctgatttggctttgttttctct

SEQ ID NO: 119129 - DNA, 19 bp, Homo sapiens
tgtgtgactgccagcctgt

SEQ ID NO: 119130 - DNA, 23 bp, Homo sapiens
tgtatgtgcatatgtatgtatgt

SEQ ID NO: 119131 - DNA, 21 bp, Homo sapiens
tggctcactgtaatctctgcc

SEQ ID NO: 119132 - DNA, 21 bp, Homo sapiens
tactatatatacatgtatgca

SEQ ID NO: 119133 - DNA, 21 bp, Homo sapiens
attcaggaattttgatcattt

SEQ ID NO: 119134 - DNA, 19 bp, Homo sapiens
ataccatgagtattgggaa

SEQ ID NO: 119135 - DNA, 23 bp, Homo sapiens
tatatatctcaaccatatgtaat

SEQ ID NO: 119136 - DNA, 20 bp, Homo sapiens
tattcctgcatattccttgg

SEQ ID NO: 119137 - DNA, 20 bp, Homo sapiens
tgcctctctctctctatata

SEQ ID NO: 119138 - DNA, 22 bp, Homo sapiens
tgtgatatatatatgtagatgt

SEQ ID NO: 119139 - DNA, 23 bp, Homo sapiens
tgtgtcattttctatatttgttg

SEQ ID NO: 119140 - DNA, 23 bp, Homo sapiens
tggcttctgtttttctaattgaa

SEQ ID NO: 119141 - DNA, 23 bp, Homo sapiens
tttaagatggagtcttgctctgt

SEQ ID NO: 119142 - DNA, 23 bp, Homo sapiens
attctgtttgttagtttctctgt

SEQ ID NO: 119143 - DNA, 23 bp, Homo sapiens
tgagttcattgtagattctggat

SEQ ID NO: 119144 - DNA, 23 bp, Homo sapiens
tgagttcattgtagattctggat

SEQ ID NO: 119145 - DNA, 23 bp, Homo sapiens
actgcagagagaccacagtcagc

SEQ ID NO: 119146 - DNA, 23 bp, Homo sapiens
tacatataactgtgtgtgtgtgt

SEQ ID NO: 119147 - DNA, 23 bp, Homo sapiens
ttctggaacatggtagttttctt

SEQ ID NO: 119148 - DNA, 23 bp, Homo sapiens
gtctaaacttggagggttgggac

SEQ ID NO: 119149 - DNA, 23 bp, Homo sapiens
ttaggtcaagttcctgctatgct

SEQ ID NO: 119150 - DNA, 23 bp, Homo sapiens
tggagtctcacactgtcacccag

SEQ ID NO: 119151 - DNA, 23 bp, Homo sapiens
ttgtagagacatatgatatgtga

SEQ ID NO: 119152 - DNA, 23 bp, Homo sapiens
agttgattagaaggacttgtctt

SEQ ID NO: 119153 - DNA, 23 bp, Homo sapiens
acagggaggctttgagatctttc

SEQ ID NO: 119154 - DNA, 23 bp, Homo sapiens
aggtgttgagagcaaagatgtct

SEQ ID NO: 119155 - DNA, 22 bp, Homo sapiens
gtgtgtgtatgtatatataggt

SEQ ID NO: 119156 - DNA, 18 bp, Homo sapiens
tggagggctgaatgtaac

SEQ ID NO: 119157 - DNA, 22 bp, Homo sapiens
tataactttatgtttatgtaat

SEQ ID NO: 119158 - DNA, 23 bp, Homo sapiens
atgttcagatttcagaaagtcct

SEQ ID NO: 119159 - DNA, 21 bp, Homo sapiens
acatatgtatgtatatatgta

SEQ ID NO: 119160 - DNA, 21 bp, Homo sapiens
tatacatatataagcatatgt

SEQ ID NO: 119161 - DNA, 20 bp, Homo sapiens
cagtggtgtgatcttggctc

SEQ ID NO: 119162 - DNA, 23 bp, Homo sapiens
ctatttgtgtgtatatgtatgtg

SEQ ID NO: 119163 - DNA, 23 bp, Homo sapiens
tgagttcattgtagattctggat

SEQ ID NO: 119164 - DNA, 23 bp, Homo sapiens
tgagttcattgtagattctggat

SEQ ID NO: 119165 - DNA, 22 bp, Homo sapiens
tcttggctctgccacttaacag

SEQ ID NO: 119166 - DNA, 19 bp, Homo sapiens
tgagatgtgaaatagatgt

SEQ ID NO: 119167 - DNA, 23 bp, Homo sapiens
tattctgtgatattgaacccttg

SEQ ID NO: 119168 - DNA, 22 bp, Homo sapiens
tgacagttgagtgagaagcaag

SEQ ID NO: 119169 - DNA, 23 bp, Homo sapiens
atctctttttttttaaagctgta

SEQ ID NO: 119170 - DNA, 23 bp, Homo sapiens
tgagttcattgtagattctggat

SEQ ID NO: 119171 - DNA, 23 bp, Homo sapiens
tgagttcattgtagattctggat

SEQ ID NO: 119172 - DNA, 22 bp, Homo sapiens
atggtggtttggatttctgtgg

SEQ ID NO: 119173 - DNA, 20 bp, Homo sapiens
tattgtgtatgtatatttat

SEQ ID NO: 119174 - DNA, 22 bp, Homo sapiens
tatgtgtatatatatatgtatg

SEQ ID NO: 119175 - DNA, 23 bp, Homo sapiens
tgagttcattgtagattctggat

SEQ ID NO: 119176 - DNA, 23 bp, Homo sapiens
tgagttcattgtagattctggat

SEQ ID NO: 119177 - DNA, 23 bp, Homo sapiens
ttcagtctgtgtgtgtgtgtgtg

SEQ ID NO: 119178 - DNA, 23 bp, Homo sapiens
tctctctctcacacaaagtattc

SEQ ID NO: 119179 - DNA, 23 bp, Homo sapiens
tacatagatgtatatgtgtatac

SEQ ID NO: 119180 - DNA, 23 bp, Homo sapiens
tatgtgtatatatgtatatgtgt

SEQ ID NO: 119181 - DNA, 23 bp, Homo sapiens
tatgtgtatatatgtatatgtgt

SEQ ID NO: 119182 - DNA, 23 bp, Homo sapiens
tatgtgtatatatgtatatgtgt

SEQ ID NO: 119183 - DNA, 23 bp, Homo sapiens
tatgtgtatatatgtatatgtgt

SEQ ID NO: 119184 - DNA, 21 bp, Homo sapiens
atatgtatatatgtatacgta

SEQ ID NO: 119185 - DNA, 20 bp, Homo sapiens
tatatgtatatatgtatatg

SEQ ID NO: 119186 - DNA, 18 bp, Homo sapiens
gtggttgattcttttttt

SEQ ID NO: 119187 - DNA, 23 bp, Homo sapiens
tgagacagaatctctctctgtcg

SEQ ID NO: 119188 - DNA, 21 bp, Homo sapiens
ttatactagaatttatgttga

SEQ ID NO: 119189 - DNA, 23 bp, Homo sapiens
aattgtggtgattttgctgtttc

SEQ ID NO: 119190 - DNA, 23 bp, Homo sapiens
cggagtctcactctgtcacccag

SEQ ID NO: 119191 - DNA, 23 bp, Homo sapiens
gagtctcactctgtcacccaggc

SEQ ID NO: 119192 - DNA, 23 bp, Homo sapiens
tttgtgtatattaccgtatgtct

SEQ ID NO: 119193 - DNA, 23 bp, Homo sapiens
tgagttcattgtagattctggat

SEQ ID NO: 119194 - DNA, 23 bp, Homo sapiens
tgagttcattgtagattctggat

SEQ ID NO: 119195 - DNA, 19 bp, Homo sapiens
agtctcgctctgtcgctca

SEQ ID NO: 119196 - DNA, 23 bp, Homo sapiens
tgagatagaatctccttctgttg

SEQ ID NO: 119197 - DNA, 23 bp, Homo sapiens
ctcacgtagtaccttgtatgcat

SEQ ID NO: 119198 - DNA, 23 bp, Homo sapiens
cagagtctcactctgtcatccag

SEQ ID NO: 119199 - DNA, 23 bp, Homo sapiens
gggtctcactctgtcactcaggc

SEQ ID NO: 119200 - DNA, 19 bp, Homo sapiens
tgggactgagcctttatcc

SEQ ID NO: 119201 - DNA, 22 bp, Homo sapiens
acacacacaatggaatactact

SEQ ID NO: 119202 - DNA, 22 bp, Homo sapiens
cctcacacagagtctctgcatc

SEQ ID NO: 119203 - DNA, 21 bp, Homo sapiens
acataagatgtttgaatgaag

SEQ ID NO: 119204 - DNA, 19 bp, Homo sapiens
ttttttgtttttgtttttg

SEQ ID NO: 119205 - DNA, 22 bp, Homo sapiens
taaagaagtttataattccttc

SEQ ID NO: 119206 - DNA, 20 bp, Homo sapiens
agttatcaaagtagttacag

SEQ ID NO: 119207 - DNA, 23 bp, Homo sapiens
acatagatgtatagatatatagg

SEQ ID NO: 119208 - DNA, 23 bp, Homo sapiens
tggagtctcactctgtcacccag

SEQ ID NO: 119209 - DNA, 23 bp, Homo sapiens
tatgtatgcatatgtgtatggtt

SEQ ID NO: 119210 - DNA, 20 bp, Homo sapiens
atatgtatgaatatatatgt

SEQ ID NO: 119211 - DNA, 21 bp, Homo sapiens
atatattcacacatatattca

SEQ ID NO: 119212 - DNA, 20 bp, Homo sapiens
tgtatgtaagtatttatgta

SEQ ID NO: 119213 - DNA, 23 bp, Homo sapiens
agtatttatgtaagtattgttca

SEQ ID NO: 119214 - DNA, 22 bp, Homo sapiens
tcaacatcacagagtattttct

SEQ ID NO: 119215 - DNA, 23 bp, Homo sapiens
aaataggttgatatagatatgtg

SEQ ID NO: 119216 - DNA, 21 bp, Homo sapiens
atatatgtatatgtatgtgta

SEQ ID NO: 119217 - DNA, 18 bp, Homo sapiens
atgttacatgtagacata

SEQ ID NO: 119218 - DNA, 19 bp, Homo sapiens
taagaagttcattaagggt

SEQ ID NO: 119219 - DNA, 23 bp, Homo sapiens
tatgtatgtatggatgtgtgtag

SEQ ID NO: 119220 - DNA, 23 bp, Homo sapiens
atatgtgtggatggatgtgtgta

SEQ ID NO: 119221 - DNA, 23 bp, Homo sapiens
tatgtatggatggatgtgtgtag

SEQ ID NO: 119222 - DNA, 23 bp, Homo sapiens
tatgtatgtatggatgtgtgtag

SEQ ID NO: 119223 - DNA, 23 bp, Homo sapiens
atatatgtgtggatggatgtgtg

SEQ ID NO: 119224 - DNA, 23 bp, Homo sapiens
tatgtatggatggatgtgtgtag

SEQ ID NO: 119225 - DNA, 23 bp, Homo sapiens
tatgtatggatggatgtgtgtag

SEQ ID NO: 119226 - DNA, 23 bp, Homo sapiens
tatgtatggatggatgtgtgtag

SEQ ID NO: 119227 - DNA, 23 bp, Homo sapiens
cagtctcaggtagttctttatag

SEQ ID NO: 119228 - DNA, 23 bp, Homo sapiens
aaattatatatgtgtatatgtac

SEQ ID NO: 119229 - DNA, 23 bp, Homo sapiens
agacagattctcactctgtcacc

SEQ ID NO: 119230 - DNA, 23 bp, Homo sapiens
tgagttcattgtagattctggat

SEQ ID NO: 119231 - DNA, 23 bp, Homo sapiens
tgagttcattgtagattctggat

SEQ ID NO: 119232 - DNA, 23 bp, Homo sapiens
acatctgtgtgtgtgtgtgcatg

SEQ ID NO: 119233 - DNA, 21 bp, Homo sapiens
tttcaagatatttcaaggtgt

SEQ ID NO: 119234 - DNA, 18 bp, Homo sapiens
atgtatatatatgtgtgt

SEQ ID NO: 119235 - DNA, 23 bp, Homo sapiens
aactgatatgaattgagtctgga

SEQ ID NO: 119236 - DNA, 23 bp, Homo sapiens
atgttcaatctgctttaggccat

SEQ ID NO: 119237 - DNA, 23 bp, Homo sapiens
gactggatgagaagtgaatatgt

SEQ ID NO: 119238 - DNA, 23 bp, Homo sapiens
tgtgtgtatatatatgtgtgtat

SEQ ID NO: 119239 - DNA, 21 bp, Homo sapiens
tcttctgtatatttgttcttg

SEQ ID NO: 119240 - DNA, 23 bp, Homo sapiens
ttgatggcatatgtagatgtata

SEQ ID NO: 119241 - DNA, 23 bp, Homo sapiens
tgtgcatgtatatatacatgtgt

SEQ ID NO: 119242 - DNA, 23 bp, Homo sapiens
tgtatctgtgtgtgtgtgtatat

SEQ ID NO: 119243 - DNA, 23 bp, Homo sapiens
tgtggtagcaggtgtcattgttt

SEQ ID NO: 119244 - DNA, 21 bp, Homo sapiens
tgagacagacactcgctctgt

SEQ ID NO: 119245 - DNA, 23 bp, Homo sapiens
acagagtctcgctctgtcaccca

SEQ ID NO: 119246 - DNA, 23 bp, Homo sapiens
tctccttttcatcctggagtggc

SEQ ID NO: 119247 - DNA, 23 bp, Homo sapiens
ttcttttttgatgatgtagatgg

SEQ ID NO: 119248 - DNA, 23 bp, Homo sapiens
gtcaatggcactggttgaaaagt

SEQ ID NO: 119249 - DNA, 21 bp, Homo sapiens
taatacaagcagaaaatttct

SEQ ID NO: 119250 - DNA, 21 bp, Homo sapiens
atatgtatatatatatgtatg

SEQ ID NO: 119251 - DNA, 21 bp, Homo sapiens
atatgtatatatatatgtatg

SEQ ID NO: 119252 - DNA, 22 bp, Homo sapiens
aacagactatatgtttgtgtgt

SEQ ID NO: 119253 - DNA, 23 bp, Homo sapiens
catgtgtgtgtgtctctgtgtct

SEQ ID NO: 119254 - DNA, 23 bp, Homo sapiens
cttaacagaactcatatcctact

SEQ ID NO: 119255 - DNA, 23 bp, Homo sapiens
tcaatatatgtttatgtgattgg

SEQ ID NO: 119256 - DNA, 23 bp, Homo sapiens
ttatatgcatgaatatgttaaca

SEQ ID NO: 119257 - DNA, 23 bp, Homo sapiens
tgggtctctgtgtgtgtctaagc

SEQ ID NO: 119258 - DNA, 23 bp, Homo sapiens
tgcctgcctgcctgcctgcgtgt

SEQ ID NO: 119259 - DNA, 23 bp, Homo sapiens
tggctggctctcagaatgcctga

SEQ ID NO: 119260 - DNA, 23 bp, Homo sapiens
gacagtctcactctgtcacccag

SEQ ID NO: 119261 - DNA, 21 bp, Homo sapiens
tggtgtgatcttggctcaatg

SEQ ID NO: 119262 - DNA, 23 bp, Homo sapiens
agacagagctcagtcagctgttc

SEQ ID NO: 119263 - DNA, 23 bp, Homo sapiens
gagtctctctctgtcacccaggc

SEQ ID NO: 119264 - DNA, 23 bp, Homo sapiens
actgtctctgggtctctcttagg

SEQ ID NO: 119265 - DNA, 23 bp, Homo sapiens
acttcagagaggctgagctgagc

SEQ ID NO: 119266 - DNA, 21 bp, Homo sapiens
catgcctatagtcttagctac

SEQ ID NO: 119267 - DNA, 21 bp, Homo sapiens
tgaggtaggaggatcacttga

SEQ ID NO: 119268 - DNA, 23 bp, Homo sapiens
tgtgtcagtatctctgtgtgtcc

SEQ ID NO: 119269 - DNA, 22 bp, Homo sapiens
actctgcctgcctgtgaccctg

SEQ ID NO: 119270 - DNA, 23 bp, Homo sapiens
gctccctgagtccctgcgtgggt

SEQ ID NO: 119271 - DNA, 23 bp, Homo sapiens
aggcacacactgacatatctgtc

SEQ ID NO: 119272 - DNA, 22 bp, Homo sapiens
ttcactgcctctctcactcctt

SEQ ID NO: 119273 - DNA, 19 bp, Homo sapiens
acagttctagaaggtgtga

SEQ ID NO: 119274 - DNA, 20 bp, Homo sapiens
acactgtctcttagaaaaag

SEQ ID NO: 119275 - DNA, 23 bp, Homo sapiens
tctttgagacggagtcttgctcc

SEQ ID NO: 119276 - DNA, 23 bp, Homo sapiens
atatgtatatatgtgtatgtgta

SEQ ID NO: 119277 - DNA, 22 bp, Homo sapiens
tgagatggagtctcactctgtc

SEQ ID NO: 119278 - DNA, 23 bp, Homo sapiens
tcactgtcagcctcactgctggg

SEQ ID NO: 119279 - DNA, 23 bp, Homo sapiens
ctcacactgtcacccagtgcaga

SEQ ID NO: 119280 - DNA, 23 bp, Homo sapiens
ttgggtgaagatgattatgctta

SEQ ID NO: 119281 - DNA, 19 bp, Homo sapiens
tggcttgagtctgggaagt

SEQ ID NO: 119282 - DNA, 23 bp, Homo sapiens
gtgctctgtgtgcacatgctcct

SEQ ID NO: 119283 - DNA, 23 bp, Homo sapiens
tgtgtgcctgtgtgcatgcctgt

SEQ ID NO: 119284 - DNA, 23 bp, Homo sapiens
tgtgtgtatgtgtgcgtgcctgt

SEQ ID NO: 119285 - DNA, 23 bp, Homo sapiens
agggtctcactgtgtcacccagg

SEQ ID NO: 119286 - DNA, 22 bp, Homo sapiens
tatgtgtatatatatatatgtg

SEQ ID NO: 119287 - DNA, 22 bp, Homo sapiens
agtctcgctctgtcactcaggc

SEQ ID NO: 119288 - DNA, 23 bp, Homo sapiens
tgtgcacatgtgtctgtgtgagc

SEQ ID NO: 119289 - DNA, 23 bp, Homo sapiens
tcctcttttctcaggcagggaca

SEQ ID NO: 119290 - DNA, 22 bp, Homo sapiens
acacacacagtggttatatata

SEQ ID NO: 119291 - DNA, 22 bp, Homo sapiens
gtctctctctctgccactcagg

SEQ ID NO: 119292 - DNA, 23 bp, Homo sapiens
cctatgattagtgattttgaaca

SEQ ID NO: 119293 - DNA, 23 bp, Homo sapiens
gtcactctgtgtctggccgtctg

SEQ ID NO: 119294 - DNA, 22 bp, Homo sapiens
tgagtgacagcagacacagtga

SEQ ID NO: 119295 - DNA, 21 bp, Homo sapiens
tctgacaggagacagagctca

SEQ ID NO: 119296 - DNA, 21 bp, Homo sapiens
tttgcacttggttgcgtctgt

SEQ ID NO: 119297 - DNA, 23 bp, Homo sapiens
agtagagagaagattgagtctag

SEQ ID NO: 119298 - DNA, 23 bp, Homo sapiens
tttggaactggaagatttaccta

SEQ ID NO: 119299 - DNA, 21 bp, Homo sapiens
agtggcaagatcatggcttac

SEQ ID NO: 119300 - DNA, 23 bp, Homo sapiens
tcttctctctgggactctgtgtg

SEQ ID NO: 119301 - DNA, 19 bp, Homo sapiens
ggcagccgctgtgtgcagt

SEQ ID NO: 119302 - DNA, 20 bp, Homo sapiens
tcagacggtctcacacagct

SEQ ID NO: 119303 - DNA, 23 bp, Homo sapiens
tctctccctgactctgtgccaca

SEQ ID NO: 119304 - DNA, 20 bp, Homo sapiens
atatgaatgaatatatatga

SEQ ID NO: 119305 - DNA, 22 bp, Homo sapiens
tatatatatgaatgtatatgaa

SEQ ID NO: 119306 - DNA, 23 bp, Homo sapiens
tgagttcattgtagattctggat

SEQ ID NO: 119307 - DNA, 23 bp, Homo sapiens
tgagttcattgtagattctggat

SEQ ID NO: 119308 - DNA, 23 bp, Homo sapiens
acagtgacaagacaacagagtgt

SEQ ID NO: 119309 - DNA, 23 bp, Homo sapiens
gcctctctctgagcctcagtttg

SEQ ID NO: 119310 - DNA, 23 bp, Homo sapiens
tgagttcattgtagattctggat

SEQ ID NO: 119311 - DNA, 23 bp, Homo sapiens
tgagttcattgtagattctggat

SEQ ID NO: 119312 - DNA, 23 bp, Homo sapiens
ttctctctgtcactgaatcccac

SEQ ID NO: 119313 - DNA, 21 bp, Homo sapiens
atagcaggctgatctaccctt

SEQ ID NO: 119314 - DNA, 23 bp, Homo sapiens
gacctctgtgtcactcaggcagt

SEQ ID NO: 119315 - DNA, 23 bp, Homo sapiens
atatgtgtgtgcatgtgcatgtg

SEQ ID NO: 119316 - DNA, 21 bp, Homo sapiens
tgcccccctccctgaatccct

SEQ ID NO: 119317 - DNA, 19 bp, Homo sapiens
tgacagccaggcctgttgc

SEQ ID NO: 119318 - DNA, 22 bp, Homo sapiens
agcctggctcggtgtctgccag

SEQ ID NO: 119319 - DNA, 23 bp, Homo sapiens
ctcaatgtctcagtggctccccc

SEQ ID NO: 119320 - DNA, 23 bp, Homo sapiens
gtctgtgtctgtgtctggggctc

SEQ ID NO: 119321 - DNA, 23 bp, Homo sapiens
cagactgactctgtctgtctggg

SEQ ID NO: 119322 - DNA, 18 bp, Homo sapiens
agtccattgagcttcagt

SEQ ID NO: 119323 - DNA, 18 bp, Homo sapiens
tggcagcaggcttcatag

SEQ ID NO: 119324 - DNA, 19 bp, Homo sapiens
tgaggtgccttctgagcag

SEQ ID NO: 119325 - DNA, 21 bp, Homo sapiens
tggtgctctctgaccctcagt

SEQ ID NO: 119326 - DNA, 21 bp, Homo sapiens
cacctactttctgaaattgtt

SEQ ID NO: 119327 - DNA, 23 bp, Homo sapiens
tcactctctcaggcacagtgagg

SEQ ID NO: 119328 - DNA, 23 bp, Homo sapiens
ggagtctcactctgtcacccagg

SEQ ID NO: 119329 - DNA, 23 bp, Homo sapiens
tgggagacttctcattttgttct

SEQ ID NO: 119330 - DNA, 23 bp, Homo sapiens
atgtatgagatgctcgatatgat

SEQ ID NO: 119331 - DNA, 23 bp, Homo sapiens
tgtggccctgtgtccctgcctgc

SEQ ID NO: 119332 - DNA, 23 bp, Homo sapiens
agaactgagtgagttcagatgct

SEQ ID NO: 119333 - DNA, 23 bp, Homo sapiens
acatctgtctgcctgtgtccagc

SEQ ID NO: 119334 - DNA, 23 bp, Homo sapiens
tctgtctgtctttttgatgattc

SEQ ID NO: 119335 - DNA, 23 bp, Homo sapiens
agaactgaatgaggaaatgtgtg

SEQ ID NO: 119336 - DNA, 22 bp, Homo sapiens
gttgtctgtccatgctgttggt

SEQ ID NO: 119337 - DNA, 20 bp, Homo sapiens
agtcagtagactgttgactg

SEQ ID NO: 119338 - DNA, 23 bp, Homo sapiens
cagatctgtctgtgtgtgtatgt

SEQ ID NO: 119339 - DNA, 23 bp, Homo sapiens
tctctctgtgcctcagtttcctc

SEQ ID NO: 119340 - DNA, 23 bp, Homo sapiens
acagagcacatagtctttggtgt

SEQ ID NO: 119341 - DNA, 23 bp, Homo sapiens
cagcatctcactctgtcgctcag

SEQ ID NO: 119342 - DNA, 23 bp, Homo sapiens
ttatcacagctgatgatggtctt

SEQ ID NO: 119343 - DNA, 18 bp, Homo sapiens
actgtctgtctctgtctc

SEQ ID NO: 119344 - DNA, 23 bp, Homo sapiens
caggctctcactctgtcgcctag

SEQ ID NO: 119345 - DNA, 20 bp, Homo sapiens
ttatgctcattttgcagatg

SEQ ID NO: 119346 - DNA, 21 bp, Homo sapiens
tctcactctgtgactcaggct

SEQ ID NO: 119347 - DNA, 21 bp, Homo sapiens
ggtgtcagtgtttgtgttcag

SEQ ID NO: 119348 - DNA, 21 bp, Homo sapiens
gtgtctgtctgtctgtctgtc

SEQ ID NO: 119349 - DNA, 22 bp, Homo sapiens
tatgcttgtgtttagctatctt

SEQ ID NO: 119350 - DNA, 19 bp, Homo sapiens
ctggacaatgtcaatcgta

SEQ ID NO: 119351 - DNA, 20 bp, Homo sapiens
gtgtgtgcatgtgcatgtgc

SEQ ID NO: 119352 - DNA, 23 bp, Homo sapiens
tgtgcatgtgcatgtgcatgcct

SEQ ID NO: 119353 - DNA, 22 bp, Homo sapiens
agagcagttggtcactctaata

SEQ ID NO: 119354 - DNA, 22 bp, Homo sapiens
gtctgactgcctgactgcctgg

SEQ ID NO: 119355 - DNA, 18 bp, Homo sapiens
tgctctttctctgtctct

SEQ ID NO: 119356 - DNA, 22 bp, Homo sapiens
atgtgactgttttaatgtctgt

SEQ ID NO: 119357 - DNA, 18 bp, Homo sapiens
tatttccaacagtatgct

SEQ ID NO: 119358 - DNA, 23 bp, Homo sapiens
atgtgtgtgtatatgtatgtgta

SEQ ID NO: 119359 - DNA, 19 bp, Homo sapiens
caagtcagtggtaggtgca

SEQ ID NO: 119360 - DNA, 23 bp, Homo sapiens
tatgtgattatatatgtatgtga

SEQ ID NO: 119361 - DNA, 23 bp, Homo sapiens
tgttaatccttgagtttaccaat

SEQ ID NO: 119362 - DNA, 23 bp, Homo sapiens
agagcaagacagagacactgtct

SEQ ID NO: 119363 - DNA, 23 bp, Homo sapiens
tgagttcattgtagattctggat

SEQ ID NO: 119364 - DNA, 23 bp, Homo sapiens
tgagttcattgtagattctggat

SEQ ID NO: 119365 - DNA, 21 bp, Homo sapiens
aaggggagtagaatgcacgta

SEQ ID NO: 119366 - DNA, 23 bp, Homo sapiens
cttgtgtgtgcgtgtgaagtgct

SEQ ID NO: 119367 - DNA, 21 bp, Homo sapiens
tgtgtatatatatatgtgtgt

SEQ ID NO: 119368 - DNA, 23 bp, Homo sapiens
acaggcacacactcacttatgtg

SEQ ID NO: 119369 - DNA, 22 bp, Homo sapiens
tgtatgtatatgtacatgtata

SEQ ID NO: 119370 - DNA, 23 bp, Homo sapiens
tgagttcattgtagattctggat

SEQ ID NO: 119371 - DNA, 23 bp, Homo sapiens
tgagttcattgtagattctggat

SEQ ID NO: 119372 - DNA, 22 bp, Homo sapiens
atgctagctgctctctatgagt

SEQ ID NO: 119373 - DNA, 23 bp, Homo sapiens
tgagttcattgtagattctggat

SEQ ID NO: 119374 - DNA, 23 bp, Homo sapiens
tgagttcattgtagattctggat

SEQ ID NO: 119375 - DNA, 23 bp, Homo sapiens
tgagttcattgtagattctggat

SEQ ID NO: 119376 - DNA, 23 bp, Homo sapiens
tgagttcattgtagattctggat

SEQ ID NO: 119377 - DNA, 22 bp, Homo sapiens
tgagtctgaagagagagggcac

SEQ ID NO: 119378 - DNA, 23 bp, Homo sapiens
ataaatacatttgtatacatata

SEQ ID NO: 119379 - DNA, 23 bp, Homo sapiens
aaatggaactagtttaggtcttg

SEQ ID NO: 119380 - DNA, 23 bp, Homo sapiens
atctcagaatgcatgttgttttt

SEQ ID NO: 119381 - DNA, 23 bp, Homo sapiens
agagtctcactctgtcacccagg

SEQ ID NO: 119382 - DNA, 19 bp, Homo sapiens
tatacttattttctattgc

SEQ ID NO: 119383 - DNA, 23 bp, Homo sapiens
gaatatctgagaatatgaagtca

SEQ ID NO: 119384 - DNA, 22 bp, Homo sapiens
aagcaagtacttgacatccact

SEQ ID NO: 119385 - DNA, 19 bp, Homo sapiens
tagtccattttcctttttt

SEQ ID NO: 119386 - DNA, 23 bp, Homo sapiens
tgagttcattgtagattctggat

SEQ ID NO: 119387 - DNA, 23 bp, Homo sapiens
tgagttcattgtagattctggat

SEQ ID NO: 119388 - DNA, 21 bp, Homo sapiens
ctagttgtgtgatgttaggga

SEQ ID NO: 119389 - DNA, 23 bp, Homo sapiens
tacttgtagatatatatacttgt

SEQ ID NO: 119390 - DNA, 23 bp, Homo sapiens
tatatacaagtatatcttgtata

SEQ ID NO: 119391 - DNA, 23 bp, Homo sapiens
tgtgtgaccctgagaaatcagtt

SEQ ID NO: 119392 - DNA, 23 bp, Homo sapiens
tgaaaacatcagctccacttcag

SEQ ID NO: 119393 - DNA, 23 bp, Homo sapiens
tgtgtgtatatatatatatgtgt

SEQ ID NO: 119394 - DNA, 23 bp, Homo sapiens
tgagttcattgtagattctggat

SEQ ID NO: 119395 - DNA, 23 bp, Homo sapiens
tgagttcattgtagattctggat

SEQ ID NO: 119396 - DNA, 23 bp, Homo sapiens
ttctttttgcttaggattttctt

SEQ ID NO: 119397 - DNA, 23 bp, Homo sapiens
ctttgagtgtgatgttagctgtg

SEQ ID NO: 119398 - DNA, 23 bp, Homo sapiens
tctgtgtctgtgttacatgtttg

SEQ ID NO: 119399 - DNA, 23 bp, Homo sapiens
tgagtctctctctgtcacccagg

SEQ ID NO: 119400 - DNA, 23 bp, Homo sapiens
ccagcttcagagctcttatcaga

SEQ ID NO: 119401 - DNA, 23 bp, Homo sapiens
gatgtctctgtgtgatatcgtgt

SEQ ID NO: 119402 - DNA, 23 bp, Homo sapiens
gacagagtctcgctctgtcaccc

SEQ ID NO: 119403 - DNA, 23 bp, Homo sapiens
tcagtgactgtgactgtgctgcc

SEQ ID NO: 119404 - DNA, 23 bp, Homo sapiens
tgagttcattgtagattctggat

SEQ ID NO: 119405 - DNA, 23 bp, Homo sapiens
tgagttcattgtagattctggat

SEQ ID NO: 119406 - DNA, 23 bp, Homo sapiens
atatagtacgtgtgtgtgtgtgt

SEQ ID NO: 119407 - DNA, 23 bp, Homo sapiens
tgagttcattgtagattctggat

SEQ ID NO: 119408 - DNA, 23 bp, Homo sapiens
tgagttcattgtagattctggat

SEQ ID NO: 119409 - DNA, 18 bp, Homo sapiens
tggggttggcttttggat

SEQ ID NO: 119410 - DNA, 23 bp, Homo sapiens
gttagagcaactccatctcaaga

SEQ ID NO: 119411 - DNA, 21 bp, Homo sapiens
aatgaagaggtagctgtagga

SEQ ID NO: 119412 - DNA, 20 bp, Homo sapiens
acccacagagtccttgtgac

SEQ ID NO: 119413 - DNA, 23 bp, Homo sapiens
agagagtgaacccactccctcaa

SEQ ID NO: 119414 - DNA, 21 bp, Homo sapiens
tgagatggagtttcactcttg

SEQ ID NO: 119415 - DNA, 23 bp, Homo sapiens
tgtatgtatgtatgtatatatgg

SEQ ID NO: 119416 - DNA, 20 bp, Homo sapiens
tatatttatcttgctttgcc

SEQ ID NO: 119417 - DNA, 19 bp, Homo sapiens
tatatctatgtatatagat

SEQ ID NO: 119418 - DNA, 23 bp, Homo sapiens
ttttttggttccatatgaaattt

SEQ ID NO: 119419 - DNA, 23 bp, Homo sapiens
tctgtgtatatgtgtgtccctct

SEQ ID NO: 119420 - DNA, 23 bp, Homo sapiens
gttttttgacaaatgggaagtct

SEQ ID NO: 119421 - DNA, 21 bp, Homo sapiens
tgtgaagaaagtcattggtag

SEQ ID NO: 119422 - DNA, 20 bp, Homo sapiens
tctctctcattcacttggct

SEQ ID NO: 119423 - DNA, 23 bp, Homo sapiens
agagtctcactctgtcacccagg

SEQ ID NO: 119424 - DNA, 23 bp, Homo sapiens
gagtctcactctgtcacccaggc

SEQ ID NO: 119425 - DNA, 23 bp, Homo sapiens
atatgtatatatacatgtgtgtg

SEQ ID NO: 119426 - DNA, 23 bp, Homo sapiens
tatatgtatatatacatatgtgt

SEQ ID NO: 119427 - DNA, 23 bp, Homo sapiens
atgtctatatataaatgtatgta

SEQ ID NO: 119428 - DNA, 20 bp, Homo sapiens
tccaagcctgcatctttctc

SEQ ID NO: 119429 - DNA, 22 bp, Homo sapiens
gaagtcactgtagagaggaggt

SEQ ID NO: 119430 - DNA, 23 bp, Homo sapiens
tgactgcctgattgccagccttt

SEQ ID NO: 119431 - DNA, 21 bp, Homo sapiens
tcactgtcattcactttttct

SEQ ID NO: 119432 - DNA, 22 bp, Homo sapiens
cacatacacatatatagatgta

SEQ ID NO: 119433 - DNA, 23 bp, Homo sapiens
tataatatgtgcatgtgcaggtg

SEQ ID NO: 119434 - DNA, 22 bp, Homo sapiens
acagagctccactttcctgtgt

SEQ ID NO: 119435 - DNA, 21 bp, Homo sapiens
tgaggtaggagaatgacatga

SEQ ID NO: 119436 - DNA, 23 bp, Homo sapiens
tatgtgtgtatatgtatatatgt

SEQ ID NO: 119437 - DNA, 21 bp, Homo sapiens
tatacgtatatatgtatacgt

SEQ ID NO: 119438 - DNA, 22 bp, Homo sapiens
gatcgcagtgtgcattcctctt

SEQ ID NO: 119439 - DNA, 23 bp, Homo sapiens
tgagttcattgtagattctggat

SEQ ID NO: 119440 - DNA, 23 bp, Homo sapiens
tgagttcattgtagattctggat

SEQ ID NO: 119441 - DNA, 23 bp, Homo sapiens
atatgcatacatacatatgtgta

SEQ ID NO: 119442 - DNA, 19 bp, Homo sapiens
tttaccaacaacttctgct

SEQ ID NO: 119443 - DNA, 23 bp, Homo sapiens
gacagagtctcgctctgtcaccc

SEQ ID NO: 119444 - DNA, 23 bp, Homo sapiens
tgagttcattgtagattctggat

SEQ ID NO: 119445 - DNA, 23 bp, Homo sapiens
tgagttcattgtagattctggat

SEQ ID NO: 119446 - DNA, 20 bp, Homo sapiens
tgtatatatgtatatgtgtg

SEQ ID NO: 119447 - DNA, 23 bp, Homo sapiens
atatactttatatatatgtgtgt

SEQ ID NO: 119448 - DNA, 23 bp, Homo sapiens
tgagttcattgtagattctggat

SEQ ID NO: 119449 - DNA, 23 bp, Homo sapiens
tgagttcattgtagattctggat

SEQ ID NO: 119450 - DNA, 23 bp, Homo sapiens
ttctgtgaagaaagtcaatggta

SEQ ID NO: 119451 - DNA, 22 bp, Homo sapiens
tgtcctgtctcttagtcactct

SEQ ID NO: 119452 - DNA, 23 bp, Homo sapiens
agtttctgagatcttcctgtttg

SEQ ID NO: 119453 - DNA, 23 bp, Homo sapiens
tgtgtatgtatatgtatatgaaa

SEQ ID NO: 119454 - DNA, 23 bp, Homo sapiens
tgagttcattgtagattctggat

SEQ ID NO: 119455 - DNA, 23 bp, Homo sapiens
tgagttcattgtagattctggat

SEQ ID NO: 119456 - DNA, 23 bp, Homo sapiens
tgaggtagtaggatcacttgaac

SEQ ID NO: 119457 - DNA, 23 bp, Homo sapiens
tcattcagcatttcctaagaacc

SEQ ID NO: 119458 - DNA, 23 bp, Homo sapiens
acagaagcatttgttaacattct

SEQ ID NO: 119459 - DNA, 21 bp, Homo sapiens
tatatatagatatctatagat

SEQ ID NO: 119460 - DNA, 22 bp, Homo sapiens
ttgtgcttgatctaaccatgtg

SEQ ID NO: 119461 - DNA, 22 bp, Homo sapiens
tctctctgccacactgcatggt

SEQ ID NO: 119462 - DNA, 23 bp, Homo sapiens
tgagttcattgtagattctggat

SEQ ID NO: 119463 - DNA, 22 bp, Homo sapiens
taagcacaggtacaaattcctt

SEQ ID NO: 119464 - DNA, 23 bp, Homo sapiens
gacagagtctcgctctgtcaccc

SEQ ID NO: 119465 - DNA, 23 bp, Homo sapiens
tatgtgtatatatacatatgtgt

SEQ ID NO: 119466 - DNA, 23 bp, Homo sapiens
acatatgtgtgtatatgtatgtg

SEQ ID NO: 119467 - DNA, 23 bp, Homo sapiens
atacatgtacatatacacgtgta

SEQ ID NO: 119468 - DNA, 21 bp, Homo sapiens
tagaaagtgtgttattcaggt

SEQ ID NO: 119469 - DNA, 23 bp, Homo sapiens
tgtatacatatgtatatatgtat

SEQ ID NO: 119470 - DNA, 23 bp, Homo sapiens
atacacacagatatgtgtgtgtg

SEQ ID NO: 119471 - DNA, 23 bp, Homo sapiens
atcatgtcaatttgtaatactca

SEQ ID NO: 119472 - DNA, 20 bp, Homo sapiens
aagacatgagttttagaagt

SEQ ID NO: 119473 - DNA, 20 bp, Homo sapiens
taatgtacattatatattga

SEQ ID NO: 119474 - DNA, 23 bp, Homo sapiens
gactgagtctcgctctgtcaccc

SEQ ID NO: 119475 - DNA, 22 bp, Homo sapiens
ttgagcagcacagagagaaaaa

SEQ ID NO: 119476 - DNA, 23 bp, Homo sapiens
atttccatctcatttgttcaaga

SEQ ID NO: 119477 - DNA, 23 bp, Homo sapiens
gcacatctgtttttgttgattgc

SEQ ID NO: 119478 - DNA, 23 bp, Homo sapiens
ttgaaagtacaactagaaatagg

SEQ ID NO: 119479 - DNA, 23 bp, Homo sapiens
ttacagcagcaattagatttctt

SEQ ID NO: 119480 - DNA, 21 bp, Homo sapiens
atcagcaatagaaatcacaga

SEQ ID NO: 119481 - DNA, 23 bp, Homo sapiens
gacagagtctgtctctgtcaccc

SEQ ID NO: 119482 - DNA, 23 bp, Homo sapiens
tgagttcattgtagattctggat

SEQ ID NO: 119483 - DNA, 23 bp, Homo sapiens
tgagttcattgtagattctggat

SEQ ID NO: 119484 - DNA, 23 bp, Homo sapiens
tatatgtgtatgtatatgtatgc

SEQ ID NO: 119485 - DNA, 22 bp, Homo sapiens
agtgtatatatgtatatatgtg

SEQ ID NO: 119486 - DNA, 23 bp, Homo sapiens
tatgtatatatacgtgtatgtat

SEQ ID NO: 119487 - DNA, 21 bp, Homo sapiens
cttgtcaattctgcatggtca

SEQ ID NO: 119488 - DNA, 23 bp, Homo sapiens
atgtgtgtatatatatatgtgtg

SEQ ID NO: 119489 - DNA, 21 bp, Homo sapiens
agacttctgacaaggattgaa

SEQ ID NO: 119490 - DNA, 23 bp, Homo sapiens
tctctcacacacatacaactcct

SEQ ID NO: 119491 - DNA, 23 bp, Homo sapiens
agagtctcactctgtcacccagg

SEQ ID NO: 119492 - DNA, 23 bp, Homo sapiens
gacagagtctcgctctgtcaccc

SEQ ID NO: 119493 - DNA, 23 bp, Homo sapiens
tgaagaaacacacagataatctc

SEQ ID NO: 119494 - DNA, 23 bp, Homo sapiens
actgagtctcggtctgtctgtcg

SEQ ID NO: 119495 - DNA, 20 bp, Homo sapiens
catgcctgtagtcccagctg

SEQ ID NO: 119496 - DNA, 23 bp, Homo sapiens
tctgaggttgcagtgagctatga

SEQ ID NO: 119497 - DNA, 23 bp, Homo sapiens
cagtcactcactcactcactcgc

SEQ ID NO: 119498 - DNA, 21 bp, Homo sapiens
tggtaagtgcctagactggtg

SEQ ID NO: 119499 - DNA, 23 bp, Homo sapiens
tgagtctcactctgtcacccagg

SEQ ID NO: 119500 - DNA, 23 bp, Homo sapiens
cggagtctcactctgtcacccag

SEQ ID NO: 119501 - DNA, 23 bp, Homo sapiens
gagtctcactctgtcacccaggc

SEQ ID NO: 119502 - DNA, 23 bp, Homo sapiens
tgagatggagtctcactctgtca

SEQ ID NO: 119503 - DNA, 18 bp, Homo sapiens
agagcgagactctatctc

SEQ ID NO: 119504 - DNA, 23 bp, Homo sapiens
ttgaaacaggatcttgctgtgtt

SEQ ID NO: 119505 - DNA, 23 bp, Homo sapiens
ttttttgtcttgcagaatcacca

SEQ ID NO: 119506 - DNA, 18 bp, Homo sapiens
tgtacttatgtatgtgta

SEQ ID NO: 119507 - DNA, 19 bp, Homo sapiens
tgagatggagtctctctct

SEQ ID NO: 119508 - DNA, 23 bp, Homo sapiens
acagagtctcactctgtaaccca

SEQ ID NO: 119509 - DNA, 18 bp, Homo sapiens
acagtggtgcgatctcag

SEQ ID NO: 119510 - DNA, 23 bp, Homo sapiens
tttcacacagaagatgtgaaaag

SEQ ID NO: 119511 - DNA, 22 bp, Homo sapiens
agactgagtctcgctctgtcac

SEQ ID NO: 119512 - DNA, 23 bp, Homo sapiens
cggagtctcgctctgtctcccag

SEQ ID NO: 119513 - DNA, 20 bp, Homo sapiens
tacacatatgtatatgtgta

SEQ ID NO: 119514 - DNA, 23 bp, Homo sapiens
tggagtctcactctgtcacccag

SEQ ID NO: 119515 - DNA, 19 bp, Homo sapiens
atctcttccgaatttttgc

SEQ ID NO: 119516 - DNA, 18 bp, Homo sapiens
tgatttttatacctgttg

SEQ ID NO: 119517 - DNA, 23 bp, Homo sapiens
tcaccatctgcatttgtgtccat

SEQ ID NO: 119518 - DNA, 18 bp, Homo sapiens
gtgacagctatttcatgt

SEQ ID NO: 119519 - DNA, 23 bp, Homo sapiens
aaaacagctttcagttgactctg

SEQ ID NO: 119520 - DNA, 23 bp, Homo sapiens
tgagtctcactctgtcacccagg

SEQ ID NO: 119521 - DNA, 23 bp, Homo sapiens
tgagtctcactctgtcacccagg

SEQ ID NO: 119522 - DNA, 23 bp, Homo sapiens
ctcacagctcatgcaggtgcctg

SEQ ID NO: 119523 - DNA, 20 bp, Homo sapiens
cagagcagagagaggacatg

SEQ ID NO: 119524 - DNA, 23 bp, Homo sapiens
aactttgtgtttctggttgtgat

SEQ ID NO: 119525 - DNA, 23 bp, Homo sapiens
tgagttcattgtagattctggat

SEQ ID NO: 119526 - DNA, 23 bp, Homo sapiens
tgagttcattgtagattctggat

SEQ ID NO: 119527 - DNA, 21 bp, Homo sapiens
aagagagaccagcattattgt

SEQ ID NO: 119528 - DNA, 23 bp, Homo sapiens
acagtagtgtatttcttcttcaa

SEQ ID NO: 119529 - DNA, 19 bp, Homo sapiens
caacatagtagtggttcag

SEQ ID NO: 119530 - DNA, 23 bp, Homo sapiens
aatggttatgttatctatagatt

SEQ ID NO: 119531 - DNA, 23 bp, Homo sapiens
gtttttctttttgaaaacagaat

SEQ ID NO: 119532 - DNA, 23 bp, Homo sapiens
attctgtaagttggttgtttact

SEQ ID NO: 119533 - DNA, 23 bp, Homo sapiens
actccaagtagctctgtctgtca

SEQ ID NO: 119534 - DNA, 23 bp, Homo sapiens
tggactagactctgcctcactct

SEQ ID NO: 119535 - DNA, 20 bp, Homo sapiens
tatgagagtgagtaaagggt

SEQ ID NO: 119536 - DNA, 23 bp, Homo sapiens
gtgacacacatttgagagtcagc

SEQ ID NO: 119537 - DNA, 18 bp, Homo sapiens
gagtctcactctgtcacc

SEQ ID NO: 119538 - DNA, 22 bp, Homo sapiens
tatctgcttataatctctctat

SEQ ID NO: 119539 - DNA, 22 bp, Homo sapiens
tagtgctactaaatatttgcta

SEQ ID NO: 119540 - DNA, 23 bp, Homo sapiens
tgagagtttcagacatttttagt

SEQ ID NO: 119541 - DNA, 22 bp, Homo sapiens
tggcagaagagagagagtgcag

SEQ ID NO: 119542 - DNA, 23 bp, Homo sapiens
cagagtctcactgtgtcacccag

SEQ ID NO: 119543 - DNA, 20 bp, Homo sapiens
cagtggtatgatcttggctc

SEQ ID NO: 119544 - DNA, 21 bp, Homo sapiens
atcagtggaatgaagttaggc

SEQ ID NO: 119545 - DNA, 20 bp, Homo sapiens
tagagcatttgaatctatca

SEQ ID NO: 119546 - DNA, 22 bp, Homo sapiens
gaggtagaggtttcagtgagcc

SEQ ID NO: 119547 - DNA, 23 bp, Homo sapiens
tgtgtgtgtatatatatatgtgt

SEQ ID NO: 119548 - DNA, 23 bp, Homo sapiens
agttaacatgcttgagtctgtgg

SEQ ID NO: 119549 - DNA, 20 bp, Homo sapiens
caattaactaactctgctgt

SEQ ID NO: 119550 - DNA, 22 bp, Homo sapiens
atttcttctatttggctgattg

SEQ ID NO: 119551 - DNA, 23 bp, Homo sapiens
cagtagtatgttgaatagaaatg

SEQ ID NO: 119552 - DNA, 23 bp, Homo sapiens
tatgtccttgtatgtgtatgtgt

SEQ ID NO: 119553 - DNA, 21 bp, Homo sapiens
atgtgttttgtacatatatgt

SEQ ID NO: 119554 - DNA, 23 bp, Homo sapiens
aaatggagacggagtctcactct

SEQ ID NO: 119555 - DNA, 20 bp, Homo sapiens
gttgatcaaggcaatttctg

SEQ ID NO: 119556 - DNA, 22 bp, Homo sapiens
atatgtacatgtatatgtatat

SEQ ID NO: 119557 - DNA, 23 bp, Homo sapiens
atatgtttcattttatagcatat

SEQ ID NO: 119558 - DNA, 23 bp, Homo sapiens
attatgtgcttaatgagcatgtt

SEQ ID NO: 119559 - DNA, 20 bp, Homo sapiens
taggttgattccatttgcta

SEQ ID NO: 119560 - DNA, 22 bp, Homo sapiens
ttttcatgagattatgatgttg

SEQ ID NO: 119561 - DNA, 23 bp, Homo sapiens
gtgcaatctccgagagcttgtca

SEQ ID NO: 119562 - DNA, 23 bp, Homo sapiens
tgagtgagtggacacagtgtggt

SEQ ID NO: 119563 - DNA, 23 bp, Homo sapiens
tctatttcagtggatacctaggg

SEQ ID NO: 119564 - DNA, 23 bp, Homo sapiens
tgagttcattgtagattctggat

SEQ ID NO: 119565 - DNA, 23 bp, Homo sapiens
tgagttcattgtagattctggat

SEQ ID NO: 119566 - DNA, 23 bp, Homo sapiens
aggcactgtctttctctgtggtt

SEQ ID NO: 119567 - DNA, 23 bp, Homo sapiens
tctctatcagtaaggaagagaag

SEQ ID NO: 119568 - DNA, 20 bp, Homo sapiens
gtgtatatatatatgtgtgt

SEQ ID NO: 119569 - DNA, 23 bp, Homo sapiens
tatgtgtgtgtatatatatgtgt

SEQ ID NO: 119570 - DNA, 21 bp, Homo sapiens
tgtgtgtatatgtgtgtgtat

SEQ ID NO: 119571 - DNA, 20 bp, Homo sapiens
atatgtatgtatatatatgt

SEQ ID NO: 119572 - DNA, 23 bp, Homo sapiens
tatgtgtctgatacatatctgac

SEQ ID NO: 119573 - DNA, 18 bp, Homo sapiens
tgcatgtttgtttgcttt

SEQ ID NO: 119574 - DNA, 23 bp, Homo sapiens
taatagtaactgtgaggttgttt

SEQ ID NO: 119575 - DNA, 23 bp, Homo sapiens
tttttggttccatatgaaatgtg

SEQ ID NO: 119576 - DNA, 20 bp, Homo sapiens
tgtgaagaaagtcaatggta

SEQ ID NO: 119577 - DNA, 20 bp, Homo sapiens
tgtgtatatgtatatatatg

SEQ ID NO: 119578 - DNA, 19 bp, Homo sapiens
atacacaaactggtatata

SEQ ID NO: 119579 - DNA, 23 bp, Homo sapiens
ttaagagtgggtctgtctctgtc

SEQ ID NO: 119580 - DNA, 23 bp, Homo sapiens
gacacagtctcactctgtttccc

SEQ ID NO: 119581 - DNA, 19 bp, Homo sapiens
gattggattgaagcgtgca

SEQ ID NO: 119582 - DNA, 22 bp, Homo sapiens
aggtgtgtctgtgaggtttttg

SEQ ID NO: 119583 - DNA, 22 bp, Homo sapiens
tacaccatatatatatgtgtat

SEQ ID NO: 119584 - DNA, 22 bp, Homo sapiens
tatatacacgtatgtgtataca

SEQ ID NO: 119585 - DNA, 22 bp, Homo sapiens
tatggattctatttatatgtat

SEQ ID NO: 119586 - DNA, 22 bp, Homo sapiens
atagaggtttatatatgtgtat

SEQ ID NO: 119587 - DNA, 22 bp, Homo sapiens
atagacgtttatatatgtgtat

SEQ ID NO: 119588 - DNA, 23 bp, Homo sapiens
aggtggttatattttcagaaagc

SEQ ID NO: 119589 - DNA, 19 bp, Homo sapiens
ttatgtatgctaatttgaa

SEQ ID NO: 119590 - DNA, 23 bp, Homo sapiens
aatgtgttttcatcaactaaaca

SEQ ID NO: 119591 - DNA, 20 bp, Homo sapiens
ctgtctggctatctgtctgt

SEQ ID NO: 119592 - DNA, 23 bp, Homo sapiens
tgagttcattgtagattctggat

SEQ ID NO: 119593 - DNA, 23 bp, Homo sapiens
tgagttcattgtagattctggat

SEQ ID NO: 119594 - DNA, 23 bp, Homo sapiens
tgagttcattgtagattctggat

SEQ ID NO: 119595 - DNA, 23 bp, Homo sapiens
tgagttcattgtagattctggat

SEQ ID NO: 119596 - DNA, 20 bp, Homo sapiens
tcagtacactggtttgagct

SEQ ID NO: 119597 - DNA, 23 bp, Homo sapiens
tataatacagtgtttgttgattt

SEQ ID NO: 119598 - DNA, 20 bp, Homo sapiens
agactacaggcatgacagca

SEQ ID NO: 119599 - DNA, 20 bp, Homo sapiens
taagaacatgaattgtatgg

SEQ ID NO: 119600 - DNA, 23 bp, Homo sapiens
tgaacatggacagtctgtcactc

SEQ ID NO: 119601 - DNA, 18 bp, Homo sapiens
gaatgtttccagattttg

SEQ ID NO: 119602 - DNA, 21 bp, Homo sapiens
atatgtttctatgtatatatg

SEQ ID NO: 119603 - DNA, 22 bp, Homo sapiens
attatctgcaagtgcatctgat

SEQ ID NO: 119604 - DNA, 23 bp, Homo sapiens
taggaaattgtaactgctgaggt

SEQ ID NO: 119605 - DNA, 23 bp, Homo sapiens
tgagttcattgtagattctggat

SEQ ID NO: 119606 - DNA, 23 bp, Homo sapiens
tgagttcattgtagattctggat

SEQ ID NO: 119607 - DNA, 23 bp, Homo sapiens
tctctcactctcagatctcttgg

SEQ ID NO: 119608 - DNA, 23 bp, Homo sapiens
cggagtctcgctctgtctcccag

SEQ ID NO: 119609 - DNA, 22 bp, Homo sapiens
tatacctgtgggcaaatcttgt

SEQ ID NO: 119610 - DNA, 19 bp, Homo sapiens
cacctctgtgtctctctcc

SEQ ID NO: 119611 - DNA, 23 bp, Homo sapiens
gatggagtctcactctgtcacca

SEQ ID NO: 119612 - DNA, 23 bp, Homo sapiens
agtgcagtggcatgatcttggct

SEQ ID NO: 119613 - DNA, 23 bp, Homo sapiens
gacagagtctcgctctgtcaccc

SEQ ID NO: 119614 - DNA, 23 bp, Homo sapiens
aacatttcagacattggtcttgg

SEQ ID NO: 119615 - DNA, 23 bp, Homo sapiens
tgtggagaagcagggcaggtgaa

SEQ ID NO: 119616 - DNA, 18 bp, Homo sapiens
ttcattgtatttattaac

SEQ ID NO: 119617 - DNA, 19 bp, Homo sapiens
tgtacacacacatatgtgt

SEQ ID NO: 119618 - DNA, 22 bp, Homo sapiens
tgtcactgtcagacattcaagt

SEQ ID NO: 119619 - DNA, 22 bp, Homo sapiens
agactccctgatgaaaggcaga

SEQ ID NO: 119620 - DNA, 23 bp, Homo sapiens
agtgactctgtgaataaggggtg

SEQ ID NO: 119621 - DNA, 23 bp, Homo sapiens
tctctcactcacagtctggtagg

SEQ ID NO: 119622 - DNA, 23 bp, Homo sapiens
actgtttgcaaagtatttatgta

SEQ ID NO: 119623 - DNA, 23 bp, Homo sapiens
acagagtctcactctgtcgccca

SEQ ID NO: 119624 - DNA, 22 bp, Homo sapiens
caaggtctcactctgtcaccca

SEQ ID NO: 119625 - DNA, 21 bp, Homo sapiens
agtggcgtgatcttggcttac

SEQ ID NO: 119626 - DNA, 23 bp, Homo sapiens
tgaggtagaaggatcacttgagg

SEQ ID NO: 119627 - DNA, 23 bp, Homo sapiens
tgggcaacagagtgagaccttgt

SEQ ID NO: 119628 - DNA, 23 bp, Homo sapiens
gtcagagtctctgtcacccagcc

SEQ ID NO: 119629 - DNA, 23 bp, Homo sapiens
agtggcacaatcatagctcagtg

SEQ ID NO: 119630 - DNA, 22 bp, Homo sapiens
taaaaatgttagtcaaggcatg

SEQ ID NO: 119631 - DNA, 19 bp, Homo sapiens
atgattagagatttagttg

SEQ ID NO: 119632 - DNA, 23 bp, Homo sapiens
atgtacgtgtgtgtgtgtatatg

SEQ ID NO: 119633 - DNA, 21 bp, Homo sapiens
ttagtctgttttcatactgct

SEQ ID NO: 119634 - DNA, 23 bp, Homo sapiens
tggagtctcactctgtcacccag

SEQ ID NO: 119635 - DNA, 23 bp, Homo sapiens
tggagtctcactctgtcacccag

SEQ ID NO: 119636 - DNA, 22 bp, Homo sapiens
cctggcagcctctattcttgaa

SEQ ID NO: 119637 - DNA, 21 bp, Homo sapiens
taatcctagcactttgggagg

SEQ ID NO: 119638 - DNA, 18 bp, Homo sapiens
tcactgcactctagcctg

SEQ ID NO: 119639 - DNA, 23 bp, Homo sapiens
tgagttcattgtagattctggat

SEQ ID NO: 119640 - DNA, 23 bp, Homo sapiens
tgagttcattgtagattctggat

SEQ ID NO: 119641 - DNA, 23 bp, Homo sapiens
ttctggaacttgaaaggatttta

SEQ ID NO: 119642 - DNA, 23 bp, Homo sapiens
tctgcactgaagtcagtcaggac

SEQ ID NO: 119643 - DNA, 23 bp, Homo sapiens
agatatatatctatatctataga

SEQ ID NO: 119644 - DNA, 23 bp, Homo sapiens
atatgtctatatgtatgtgtatg

SEQ ID NO: 119645 - DNA, 23 bp, Homo sapiens
tgagtctctctctgtcacccagg

SEQ ID NO: 119646 - DNA, 20 bp, Homo sapiens
agctatttcttcagttatgc

SEQ ID NO: 119647 - DNA, 23 bp, Homo sapiens
gcatgtctctgggaaatcttcat

SEQ ID NO: 119648 - DNA, 23 bp, Homo sapiens
atggagtctcactctgtcaccca

SEQ ID NO: 119649 - DNA, 23 bp, Homo sapiens
tggagtctcactctgtcacccag

SEQ ID NO: 119650 - DNA, 22 bp, Homo sapiens
tgtgtgagtacacactgtgatg

SEQ ID NO: 119651 - DNA, 23 bp, Homo sapiens
tttcagaccctagctattcttca

SEQ ID NO: 119652 - DNA, 23 bp, Homo sapiens
gaagatcagtggctgtttgcctg

SEQ ID NO: 119653 - DNA, 23 bp, Homo sapiens
gacagagtctcgctctgtcaccc

SEQ ID NO: 119654 - DNA, 23 bp, Homo sapiens
gacagagtttccctctgtcactc

SEQ ID NO: 119655 - DNA, 18 bp, Homo sapiens
acactcacacattttaga

SEQ ID NO: 119656 - DNA, 23 bp, Homo sapiens
gacagagtctcgctctgtcaccc

SEQ ID NO: 119657 - DNA, 23 bp, Homo sapiens
gtgtgtgtatatgtatatacaca

SEQ ID NO: 119658 - DNA, 23 bp, Homo sapiens
atgtgtatatatgtatatgtata

SEQ ID NO: 119659 - DNA, 18 bp, Homo sapiens
agccactgagacttgctg

SEQ ID NO: 119660 - DNA, 20 bp, Homo sapiens
tcagatgagactcagcacat

SEQ ID NO: 119661 - DNA, 23 bp, Homo sapiens
tgagttcattgtagattctggat

SEQ ID NO: 119662 - DNA, 23 bp, Homo sapiens
tgagttcattgtagattctggat

SEQ ID NO: 119663 - DNA, 22 bp, Homo sapiens
tttctcctagttcacaggtttc

SEQ ID NO: 119664 - DNA, 23 bp, Homo sapiens
tgagttcattgtagattctggat

SEQ ID NO: 119665 - DNA, 23 bp, Homo sapiens
tgagttcattgtagattctggat

SEQ ID NO: 119666 - DNA, 23 bp, Homo sapiens
tgagttcattgtagattctggat

SEQ ID NO: 119667 - DNA, 23 bp, Homo sapiens
tgagttcattgtagattctggat

SEQ ID NO: 119668 - DNA, 23 bp, Homo sapiens
tgagttcattgtagattctggat

SEQ ID NO: 119669 - DNA, 23 bp, Homo sapiens
tgagttcattgtagattctggat

SEQ ID NO: 119670 - DNA, 23 bp, Homo sapiens
tgactctgtgtctcacatccagg

SEQ ID NO: 119671 - DNA, 18 bp, Homo sapiens
atgatgatgcaagatatg

SEQ ID NO: 119672 - DNA, 23 bp, Homo sapiens
aaaaatgcactatttcatgactt

SEQ ID NO: 119673 - DNA, 23 bp, Homo sapiens
tgagttcattgtagattctggat

SEQ ID NO: 119674 - DNA, 23 bp, Homo sapiens
tgagttcattgtagattctggat

SEQ ID NO: 119675 - DNA, 19 bp, Homo sapiens
tgaccgcgagtgatctgcc

SEQ ID NO: 119676 - DNA, 23 bp, Homo sapiens
ttcactgacagtaagtatagtcc

SEQ ID NO: 119677 - DNA, 23 bp, Homo sapiens
tccagcacagtgactgagctgct

SEQ ID NO: 119678 - DNA, 21 bp, Homo sapiens
tgcctgggtgactatcagggt

SEQ ID NO: 119679 - DNA, 23 bp, Homo sapiens
tggcaatggctgagttctcactc

SEQ ID NO: 119680 - DNA, 23 bp, Homo sapiens
tctcaagttgcaatccccatgtg

SEQ ID NO: 119681 - DNA, 23 bp, Homo sapiens
tctgtgtatgtatatatatctgt

SEQ ID NO: 119682 - DNA, 23 bp, Homo sapiens
ccacgtatagactctcactcacc

SEQ ID NO: 119683 - DNA, 23 bp, Homo sapiens
ctggagagtcattcctggttctt

SEQ ID NO: 119684 - DNA, 22 bp, Homo sapiens
tatgcatataccacattttacc

SEQ ID NO: 119685 - DNA, 18 bp, Homo sapiens
gaagagaagtgtgcactt

SEQ ID NO: 119686 - DNA, 23 bp, Homo sapiens
gactgtgccttctctttcctgtc

SEQ ID NO: 119687 - DNA, 20 bp, Homo sapiens
tgaacagatgttgcagctat

SEQ ID NO: 119688 - DNA, 21 bp, Homo sapiens
tctgtatatatctctgtctat

SEQ ID NO: 119689 - DNA, 23 bp, Homo sapiens
aatccagtagttagagagctgta

SEQ ID NO: 119690 - DNA, 22 bp, Homo sapiens
ttgtttttgagatggggtctca

SEQ ID NO: 119691 - DNA, 21 bp, Homo sapiens
aatacatattctatatgtatg

SEQ ID NO: 119692 - DNA, 23 bp, Homo sapiens
gtctgtgtatatgcatatgtata

SEQ ID NO: 119693 - DNA, 23 bp, Homo sapiens
ttgtgtgcatgtgtgtgtataca

SEQ ID NO: 119694 - DNA, 23 bp, Homo sapiens
cactacatcgctatctctgtgtc

SEQ ID NO: 119695 - DNA, 23 bp, Homo sapiens
tatacatatgtatacatatgtgt

SEQ ID NO: 119696 - DNA, 19 bp, Homo sapiens
atatgtatacatacataca

SEQ ID NO: 119697 - DNA, 23 bp, Homo sapiens
tgagttcattgtagattctggat

SEQ ID NO: 119698 - DNA, 23 bp, Homo sapiens
tgagttcattgtagattctggat

SEQ ID NO: 119699 - DNA, 23 bp, Homo sapiens
ttgagctgcaaagaattttatgt

SEQ ID NO: 119700 - DNA, 19 bp, Homo sapiens
atgagaaagacatggaatc

SEQ ID NO: 119701 - DNA, 19 bp, Homo sapiens
actgttagtagtatgctct

SEQ ID NO: 119702 - DNA, 23 bp, Homo sapiens
tcagattggttttgtatctgttt

SEQ ID NO: 119703 - DNA, 18 bp, Homo sapiens
atttgtatgtatatgtgt

SEQ ID NO: 119704 - DNA, 23 bp, Homo sapiens
tgagttcattgtagattctggat

SEQ ID NO: 119705 - DNA, 23 bp, Homo sapiens
tgagttcattgtagattctggat

SEQ ID NO: 119706 - DNA, 23 bp, Homo sapiens
tgagactctgcctgaaatcactg

SEQ ID NO: 119707 - DNA, 20 bp, Homo sapiens
tgtatatatgtatatatgca

SEQ ID NO: 119708 - DNA, 23 bp, Homo sapiens
tatgtgtgtgtatatgtatatat

SEQ ID NO: 119709 - DNA, 23 bp, Homo sapiens
tgagttcattgtagattctggat

SEQ ID NO: 119710 - DNA, 23 bp, Homo sapiens
tgagttcattgtagattctggat

SEQ ID NO: 119711 - DNA, 22 bp, Homo sapiens
tgaggtaagaggatcacttgag

SEQ ID NO: 119712 - DNA, 23 bp, Homo sapiens
gaatgaatgaatgaataagtgag

SEQ ID NO: 119713 - DNA, 23 bp, Homo sapiens
tgagttcattgtagattctggat

SEQ ID NO: 119714 - DNA, 23 bp, Homo sapiens
tgagttcattgtagattctggat

SEQ ID NO: 119715 - DNA, 23 bp, Homo sapiens
tctcactctgtcactctggctgc

SEQ ID NO: 119716 - DNA, 23 bp, Homo sapiens
cacagaagagttggtgcagtgga

SEQ ID NO: 119717 - DNA, 23 bp, Homo sapiens
aatctctgtctgtctgtctgtct

SEQ ID NO: 119718 - DNA, 23 bp, Homo sapiens
tctctgtctgtctgtctgtctgt

SEQ ID NO: 119719 - DNA, 23 bp, Homo sapiens
ctgtctgtctgtctgtctgtctg

SEQ ID NO: 119720 - DNA, 23 bp, Homo sapiens
tgtctgtctgtctgtctgtctgt

SEQ ID NO: 119721 - DNA, 23 bp, Homo sapiens
aatctctgtctgtctgtctgtct

SEQ ID NO: 119722 - DNA, 23 bp, Homo sapiens
tctctgtctgtctgtctgtctgt

SEQ ID NO: 119723 - DNA, 23 bp, Homo sapiens
aatctctgtctgtctgtctgtct

SEQ ID NO: 119724 - DNA, 23 bp, Homo sapiens
tctctgtctgtctgtctgtctgt

SEQ ID NO: 119725 - DNA, 23 bp, Homo sapiens
ctgtctgtctgtctgtctgtctg

SEQ ID NO: 119726 - DNA, 23 bp, Homo sapiens
tgtctgtctgtctgtctgtctgt

SEQ ID NO: 119727 - DNA, 23 bp, Homo sapiens
aatctctgtctgtctgtctgtct

SEQ ID NO: 119728 - DNA, 23 bp, Homo sapiens
tctctgtctgtctgtctgtctgt

SEQ ID NO: 119729 - DNA, 23 bp, Homo sapiens
ctgtctgtctgtctgtctgtctg

SEQ ID NO: 119730 - DNA, 23 bp, Homo sapiens
tgtctgtctgtctgtctgtctgt

SEQ ID NO: 119731 - DNA, 23 bp, Homo sapiens
tgctcagtcaatatagtgaaagg

SEQ ID NO: 119732 - DNA, 23 bp, Homo sapiens
tctagtagtgcatgtcttggtga

SEQ ID NO: 119733 - DNA, 23 bp, Homo sapiens
agagtgaaaagtgacagctgtca

SEQ ID NO: 119734 - DNA, 23 bp, Homo sapiens
tgagttcattgtagattctggat

SEQ ID NO: 119735 - DNA, 23 bp, Homo sapiens
tgagttcattgtagattctggat

SEQ ID NO: 119736 - DNA, 21 bp, Homo sapiens
actgcaagtatctgtgactct

SEQ ID NO: 119737 - DNA, 18 bp, Homo sapiens
tgcatggtctgcttggag

SEQ ID NO: 119738 - DNA, 21 bp, Homo sapiens
tgtgaagaaagtcattggtag

SEQ ID NO: 119739 - DNA, 23 bp, Homo sapiens
aaaggcagtggttgaattgagtg

SEQ ID NO: 119740 - DNA, 23 bp, Homo sapiens
tgagttcattgtagattctggat

SEQ ID NO: 119741 - DNA, 23 bp, Homo sapiens
tgagttcattgtagattctggat

SEQ ID NO: 119742 - DNA, 23 bp, Homo sapiens
agccccctatgtgtttctgaaca

SEQ ID NO: 119743 - DNA, 19 bp, Homo sapiens
atttctgcatttccaactg

SEQ ID NO: 119744 - DNA, 23 bp, Homo sapiens
tatggaattatatgcagtaattt

SEQ ID NO: 119745 - DNA, 23 bp, Homo sapiens
acagacacactgctttagtctca

SEQ ID NO: 119746 - DNA, 23 bp, Homo sapiens
cagtcactctgacactgaccagg

SEQ ID NO: 119747 - DNA, 23 bp, Homo sapiens
tcttttttggttggatatgaaat

SEQ ID NO: 119748 - DNA, 21 bp, Homo sapiens
agtttttttctaattctgtga

SEQ ID NO: 119749 - DNA, 22 bp, Homo sapiens
agtcagtgtgtcattttcttct

SEQ ID NO: 119750 - DNA, 23 bp, Homo sapiens
agcaacacatagtcttttatcca

SEQ ID NO: 119751 - DNA, 23 bp, Homo sapiens
tcaccctgtcagtgtctctcccc

SEQ ID NO: 119752 - DNA, 18 bp, Homo sapiens
aggcagtcatcccacctc

SEQ ID NO: 119753 - DNA, 22 bp, Homo sapiens
tgtgagccactgtgtctgtctc

SEQ ID NO: 119754 - DNA, 23 bp, Homo sapiens
gacagagtctcgctctgtcaccc

SEQ ID NO: 119755 - DNA, 23 bp, Homo sapiens
tatgttgattttgtaacctgtaa

SEQ ID NO: 119756 - DNA, 19 bp, Homo sapiens
tgtgtatatatatatatct

SEQ ID NO: 119757 - DNA, 18 bp, Homo sapiens
acagtgtggagactcttt

SEQ ID NO: 119758 - DNA, 23 bp, Homo sapiens
tgagacagagtctcactctgtca

SEQ ID NO: 119759 - DNA, 22 bp, Homo sapiens
tttaaagtgattttcatgtttt

SEQ ID NO: 119760 - DNA, 18 bp, Homo sapiens
aaattgcttgaagtggca

SEQ ID NO: 119761 - DNA, 23 bp, Homo sapiens
tggagtctcactctgtcacccag

SEQ ID NO: 119762 - DNA, 23 bp, Homo sapiens
agagtctcactctgtcacccagg

SEQ ID NO: 119763 - DNA, 23 bp, Homo sapiens
agggtttcactctgtcactcagg

SEQ ID NO: 119764 - DNA, 23 bp, Homo sapiens
cctgagacttctctggctggtgg

SEQ ID NO: 119765 - DNA, 23 bp, Homo sapiens
gggtctcactctgtcacccaggc

SEQ ID NO: 119766 - DNA, 23 bp, Homo sapiens
tgcagtggcatgatcttggctca

SEQ ID NO: 119767 - DNA, 23 bp, Homo sapiens
aagagtgaggaattctcactagt

SEQ ID NO: 119768 - DNA, 19 bp, Homo sapiens
tatgtgtatatatatacgt

SEQ ID NO: 119769 - DNA, 20 bp, Homo sapiens
atatgtgtatatatatacgt

SEQ ID NO: 119770 - DNA, 20 bp, Homo sapiens
tgaggtaggaggatcacttg

SEQ ID NO: 119771 - DNA, 23 bp, Homo sapiens
ttgatcatttttattgtatagag

SEQ ID NO: 119772 - DNA, 18 bp, Homo sapiens
aatctcccacaaaatgat

SEQ ID NO: 119773 - DNA, 23 bp, Homo sapiens
tgagttcattgtagattctggat

SEQ ID NO: 119774 - DNA, 23 bp, Homo sapiens
tgagttcattgtagattctggat

SEQ ID NO: 119775 - DNA, 21 bp, Homo sapiens
ttatcagtatttaagtttggg

SEQ ID NO: 119776 - DNA, 23 bp, Homo sapiens
gcatacacagatttgactgtgca

SEQ ID NO: 119777 - DNA, 23 bp, Homo sapiens
ctgctctgtcaccctgtgagtgt

SEQ ID NO: 119778 - DNA, 21 bp, Homo sapiens
aggagctgttttctgtcttgg

SEQ ID NO: 119779 - DNA, 23 bp, Homo sapiens
ttttctaagaagaaagagagctg

SEQ ID NO: 119780 - DNA, 22 bp, Homo sapiens
tcattcctgtaattccagtact

SEQ ID NO: 119781 - DNA, 22 bp, Homo sapiens
agggtcagtgtgtagagtgtga

SEQ ID NO: 119782 - DNA, 18 bp, Homo sapiens
agacagattctttcctgt

SEQ ID NO: 119783 - DNA, 20 bp, Homo sapiens
tcctcactgctcttcctgac

SEQ ID NO: 119784 - DNA, 22 bp, Homo sapiens
ctctgtcactctgagtcatttc

SEQ ID NO: 119785 - DNA, 23 bp, Homo sapiens
tgagttcattgtagattctggat

SEQ ID NO: 119786 - DNA, 23 bp, Homo sapiens
tgagttcattgtagattctggat

SEQ ID NO: 119787 - DNA, 23 bp, Homo sapiens
tgagttcattgtagattctggat

SEQ ID NO: 119788 - DNA, 23 bp, Homo sapiens
tgagttcattgtagattctggat

SEQ ID NO: 119789 - DNA, 22 bp, Homo sapiens
gaattgcactgtggtaatgagg

SEQ ID NO: 119790 - DNA, 21 bp, Homo sapiens
gcatgtgcatctgcatgtgtg

SEQ ID NO: 119791 - DNA, 22 bp, Homo sapiens
tgtatatatatgcacgtgtgtg

SEQ ID NO: 119792 - DNA, 23 bp, Homo sapiens
tgtgtgtatatatacatatgtgt

SEQ ID NO: 119793 - DNA, 23 bp, Homo sapiens
tgagttcattgtagattctggat

SEQ ID NO: 119794 - DNA, 23 bp, Homo sapiens
tgagttcattgtagattctggat

SEQ ID NO: 119795 - DNA, 23 bp, Homo sapiens
tgtgtgtgtgtgtctatgtgtgt

SEQ ID NO: 119796 - DNA, 22 bp, Homo sapiens
tgccagggactttgcattgttt

SEQ ID NO: 119797 - DNA, 23 bp, Homo sapiens
tgagttcattgtagattctggat

SEQ ID NO: 119798 - DNA, 23 bp, Homo sapiens
tgagttcattgtagattctggat

SEQ ID NO: 119799 - DNA, 23 bp, Homo sapiens
tgagttcattgtagattctggat

SEQ ID NO: 119800 - DNA, 23 bp, Homo sapiens
tgagttcattgtagattctggat

SEQ ID NO: 119801 - DNA, 22 bp, Homo sapiens
tgtgtatgtatgtttatatgta

SEQ ID NO: 119802 - DNA, 21 bp, Homo sapiens
tgctactgttttggtattttg

SEQ ID NO: 119803 - DNA, 23 bp, Homo sapiens
acatgaaattagaatgtgttgct

SEQ ID NO: 119804 - DNA, 19 bp, Homo sapiens
tttgagggatacattagct

SEQ ID NO: 119805 - DNA, 23 bp, Homo sapiens
tgtatcacttctgaattgcatgt

SEQ ID NO: 119806 - DNA, 22 bp, Homo sapiens
tttgtgcaggtttgttatatag

SEQ ID NO: 119807 - DNA, 23 bp, Homo sapiens
tgagttcattgtagattctggat

SEQ ID NO: 119808 - DNA, 23 bp, Homo sapiens
tgagttcattgtagattctggat

SEQ ID NO: 119809 - DNA, 19 bp, Homo sapiens
cgatgtgtgtattgctgaa

SEQ ID NO: 119810 - DNA, 23 bp, Homo sapiens
caaattatgtgaggttttgttat

SEQ ID NO: 119811 - DNA, 23 bp, Homo sapiens
tctgagaagaatgtcagtagtag

SEQ ID NO: 119812 - DNA, 23 bp, Homo sapiens
acacacacacataggatatgtgt

SEQ ID NO: 119813 - DNA, 23 bp, Homo sapiens
atgtttgaagttacacagcagat

SEQ ID NO: 119814 - DNA, 18 bp, Homo sapiens
atgcttgtacagcctgca

SEQ ID NO: 119815 - DNA, 23 bp, Homo sapiens
aagtctcagatgtttctttacag

SEQ ID NO: 119816 - DNA, 22 bp, Homo sapiens
taaaatgatgataggttgggga

SEQ ID NO: 119817 - DNA, 22 bp, Homo sapiens
tctctgtcacccagactagagt

SEQ ID NO: 119818 - DNA, 20 bp, Homo sapiens
agtctgattttcttatgtca

SEQ ID NO: 119819 - DNA, 20 bp, Homo sapiens
ttttgttaatatataggtgt

SEQ ID NO: 119820 - DNA, 20 bp, Homo sapiens
tctcttcactttctgtcatc

SEQ ID NO: 119821 - DNA, 22 bp, Homo sapiens
aagcatgttctggtggaggagg

SEQ ID NO: 119822 - DNA, 23 bp, Homo sapiens
cctcttgtctgtggggccttgag

SEQ ID NO: 119823 - DNA, 23 bp, Homo sapiens
tgacagacaagtgtcagcagaca

SEQ ID NO: 119824 - DNA, 20 bp, Homo sapiens
tattgtgaatgggattgcat

SEQ ID NO: 119825 - DNA, 23 bp, Homo sapiens
tgagttcattgtagattctggat

SEQ ID NO: 119826 - DNA, 23 bp, Homo sapiens
tgagttcattgtagattctggat

SEQ ID NO: 119827 - DNA, 19 bp, Homo sapiens
tctgtcaccaggctagagt

SEQ ID NO: 119828 - DNA, 21 bp, Homo sapiens
ttgacagtagaaagagagaag

SEQ ID NO: 119829 - DNA, 22 bp, Homo sapiens
tcaagtcctttttctatttgaa

SEQ ID NO: 119830 - DNA, 23 bp, Homo sapiens
tgagttcattgtagattctggat

SEQ ID NO: 119831 - DNA, 23 bp, Homo sapiens
tgagttcattgtagattctggat

SEQ ID NO: 119832 - DNA, 21 bp, Homo sapiens
acagcgttctgtgtgtgtgta

SEQ ID NO: 119833 - DNA, 22 bp, Homo sapiens
aatatgtgtatatatatgtgtg

SEQ ID NO: 119834 - DNA, 22 bp, Homo sapiens
acacacacatacatatgtgtgt

SEQ ID NO: 119835 - DNA, 22 bp, Homo sapiens
tttgagcatccatgaagtttta

SEQ ID NO: 119836 - DNA, 23 bp, Homo sapiens
tgagttcattgtagattctggat

SEQ ID NO: 119837 - DNA, 23 bp, Homo sapiens
tgagttcattgtagattctggat

SEQ ID NO: 119838 - DNA, 23 bp, Homo sapiens
tgagttcattgtagattctggat

SEQ ID NO: 119839 - DNA, 23 bp, Homo sapiens
aactgtgtatatacatatgtgta

SEQ ID NO: 119840 - DNA, 19 bp, Homo sapiens
acacgtaattctatctata

SEQ ID NO: 119841 - DNA, 23 bp, Homo sapiens
acctatggtgatagaaatcagtg

SEQ ID NO: 119842 - DNA, 18 bp, Homo sapiens
atacatatatagatgaac

SEQ ID NO: 119843 - DNA, 22 bp, Homo sapiens
agtgaggctcttaatgatgtgt

SEQ ID NO: 119844 - DNA, 23 bp, Homo sapiens
tctattttagtagaggtggtgtt

SEQ ID NO: 119845 - DNA, 22 bp, Homo sapiens
tataatgtctggataagtgctt

SEQ ID NO: 119846 - DNA, 18 bp, Homo sapiens
tttaacaccctttcctag

SEQ ID NO: 119847 - DNA, 23 bp, Homo sapiens
tgagttcttattttatactgaat

SEQ ID NO: 119848 - DNA, 23 bp, Homo sapiens
aacaaaatgagctaagaatgatg

SEQ ID NO: 119849 - DNA, 23 bp, Homo sapiens
gttgtctgtgacactctttgagg

SEQ ID NO: 119850 - DNA, 23 bp, Homo sapiens
cagtggctcactgcctgtaatcc

SEQ ID NO: 119851 - DNA, 21 bp, Homo sapiens
aggcgggcagatcatgaagtc

SEQ ID NO: 119852 - DNA, 19 bp, Homo sapiens
tgtgtgtgtgtgtacgtgt

SEQ ID NO: 119853 - DNA, 19 bp, Homo sapiens
tgtgcaatatgtattcatt

SEQ ID NO: 119854 - DNA, 23 bp, Homo sapiens
tgagttcattgtagattctggat

SEQ ID NO: 119855 - DNA, 23 bp, Homo sapiens
tgagttcattgtagattctggat

SEQ ID NO: 119856 - DNA, 23 bp, Homo sapiens
tgagttcattgtagattctggat

SEQ ID NO: 119857 - DNA, 23 bp, Homo sapiens
tgagttcattgtagattctggat

SEQ ID NO: 119858 - DNA, 18 bp, Homo sapiens
atgtgtatatgtatatat

SEQ ID NO: 119859 - DNA, 23 bp, Homo sapiens
tgagttcattgtagattctggat

SEQ ID NO: 119860 - DNA, 23 bp, Homo sapiens
tgagttcattgtagattctggat

SEQ ID NO: 119861 - DNA, 18 bp, Homo sapiens
tgcatttatgtatgtatg

SEQ ID NO: 119862 - DNA, 23 bp, Homo sapiens
aagacagagattatctctctctc

SEQ ID NO: 119863 - DNA, 23 bp, Homo sapiens
tatatgtgtagttacatatttgt

SEQ ID NO: 119864 - DNA, 23 bp, Homo sapiens
gaagtcaagtgtttttcttctgg

SEQ ID NO: 119865 - DNA, 19 bp, Homo sapiens
gcagagtagggtgtacctc

SEQ ID NO: 119866 - DNA, 22 bp, Homo sapiens
tgtagatttctattgtaccctt

SEQ ID NO: 119867 - DNA, 23 bp, Homo sapiens
tgagtgtgggtgtgcgagagaga

SEQ ID NO: 119868 - DNA, 21 bp, Homo sapiens
tctctcagagtgccatcccta

SEQ ID NO: 119869 - DNA, 21 bp, Homo sapiens
tactcagaagagagagaggtg

SEQ ID NO: 119870 - DNA, 23 bp, Homo sapiens
atcacagtgtcatatatttctgt

SEQ ID NO: 119871 - DNA, 18 bp, Homo sapiens
acatattgtatacagtat

SEQ ID NO: 119872 - DNA, 21 bp, Homo sapiens
tatacgtatatatatttgtgt

SEQ ID NO: 119873 - DNA, 23 bp, Homo sapiens
tctgtcactgtctctcatcaccc

SEQ ID NO: 119874 - DNA, 18 bp, Homo sapiens
tcactacaacctccgtct

SEQ ID NO: 119875 - DNA, 23 bp, Homo sapiens
ctggctgtctcacactgtctgcc

SEQ ID NO: 119876 - DNA, 23 bp, Homo sapiens
tgtgtaaatatgtatgtgtatat

SEQ ID NO: 119877 - DNA, 23 bp, Homo sapiens
agacactgtctctttcatctttg

SEQ ID NO: 119878 - DNA, 19 bp, Homo sapiens
agtacactcactctctcct

SEQ ID NO: 119879 - DNA, 23 bp, Homo sapiens
atggagtctcactctgtcgctga

SEQ ID NO: 119880 - DNA, 23 bp, Homo sapiens
tgagttcattgtagattctggat

SEQ ID NO: 119881 - DNA, 23 bp, Homo sapiens
tgagttcattgtagattctggat

SEQ ID NO: 119882 - DNA, 23 bp, Homo sapiens
gagtgctttacttctgattatgt

SEQ ID NO: 119883 - DNA, 19 bp, Homo sapiens
tgtggtgattagatgaatg

SEQ ID NO: 119884 - DNA, 19 bp, Homo sapiens
gagagtagacagctcattg

SEQ ID NO: 119885 - DNA, 21 bp, Homo sapiens
atgattcatgatgaagtagca

SEQ ID NO: 119886 - DNA, 23 bp, Homo sapiens
atcacactggtttacaatagtgt

SEQ ID NO: 119887 - DNA, 19 bp, Homo sapiens
aaggcagggagtgtgattt

SEQ ID NO: 119888 - DNA, 20 bp, Homo sapiens
aagtacatgattgatctatg

SEQ ID NO: 119889 - DNA, 23 bp, Homo sapiens
tctcagcatgtgtgtgtgtgtgt

SEQ ID NO: 119890 - DNA, 22 bp, Homo sapiens
actagactgaatactcttgaaa

SEQ ID NO: 119891 - DNA, 21 bp, Homo sapiens
acagtagtgagagtgcacatc

SEQ ID NO: 119892 - DNA, 19 bp, Homo sapiens
tatgtgggatctttcatgc

SEQ ID NO: 119893 - DNA, 19 bp, Homo sapiens
tatgtgggatctttcatgc

SEQ ID NO: 119894 - DNA, 23 bp, Homo sapiens
ttgactcttgtagttttgtcgta

SEQ ID NO: 119895 - DNA, 19 bp, Homo sapiens
tatgtgggatctttcatgc

SEQ ID NO: 119896 - DNA, 23 bp, Homo sapiens
tgtgtgtatatatatatgtgtat

SEQ ID NO: 119897 - DNA, 23 bp, Homo sapiens
gttggaacacagtttctgagcaa

SEQ ID NO: 119898 - DNA, 22 bp, Homo sapiens
atacatgtacatatatatacat

SEQ ID NO: 119899 - DNA, 23 bp, Homo sapiens
tgagacagtgcatctctttcttc

SEQ ID NO: 119900 - DNA, 18 bp, Homo sapiens
aaatgaatcaggaacagg

SEQ ID NO: 119901 - DNA, 23 bp, Homo sapiens
tgagttcattgtagattctggat

SEQ ID NO: 119902 - DNA, 23 bp, Homo sapiens
tgagttcattgtagattctggat

SEQ ID NO: 119903 - DNA, 21 bp, Homo sapiens
atatatgtgtgcatgtgcatg

SEQ ID NO: 119904 - DNA, 23 bp, Homo sapiens
tgagttcattgtagattctggat

SEQ ID NO: 119905 - DNA, 23 bp, Homo sapiens
tgagttcattgtagattctggat

SEQ ID NO: 119906 - DNA, 23 bp, Homo sapiens
gtaaaattaaatgagtatttcat

SEQ ID NO: 119907 - DNA, 20 bp, Homo sapiens
catagagagcacaaatcaga

SEQ ID NO: 119908 - DNA, 22 bp, Homo sapiens
ttttgagacagagtctcactct

SEQ ID NO: 119909 - DNA, 23 bp, Homo sapiens
tgagttcattgtagattctggat

SEQ ID NO: 119910 - DNA, 23 bp, Homo sapiens
tgagttcattgtagattctggat

SEQ ID NO: 119911 - DNA, 22 bp, Homo sapiens
tcgtagactctgaaaaggcagg

SEQ ID NO: 119912 - DNA, 19 bp, Homo sapiens
agaatcagggtctcactct

SEQ ID NO: 119913 - DNA, 18 bp, Homo sapiens
tgagacagtctcactctg

SEQ ID NO: 119914 - DNA, 22 bp, Homo sapiens
ttctagaagatgggttgtgaca

SEQ ID NO: 119915 - DNA, 20 bp, Homo sapiens
tacaatgtatttataatgtc

SEQ ID NO: 119916 - DNA, 22 bp, Homo sapiens
atgtgtatatgtatatgtatga

SEQ ID NO: 119917 - DNA, 22 bp, Homo sapiens
tatatacatatatgtgtgtgtg

SEQ ID NO: 119918 - DNA, 23 bp, Homo sapiens
tcagagcagtgtgtggagactca

SEQ ID NO: 119919 - DNA, 22 bp, Homo sapiens
acagtgactatactagtttttc

SEQ ID NO: 119920 - DNA, 23 bp, Homo sapiens
gtatatcactctacttgtcagtc

SEQ ID NO: 119921 - DNA, 23 bp, Homo sapiens
aatttactgaatttgttcatcag

SEQ ID NO: 119922 - DNA, 23 bp, Homo sapiens
tctgtatttctgtctcactgtaa

SEQ ID NO: 119923 - DNA, 23 bp, Homo sapiens
ttgagtctgactgagtctggggc

SEQ ID NO: 119924 - DNA, 18 bp, Homo sapiens
tgatcacaggtatggatt

SEQ ID NO: 119925 - DNA, 21 bp, Homo sapiens
tcttctacagtttctctccag

SEQ ID NO: 119926 - DNA, 23 bp, Homo sapiens
tgagttcattgtagattctggat

SEQ ID NO: 119927 - DNA, 23 bp, Homo sapiens
tgagttcattgtagattctggat

SEQ ID NO: 119928 - DNA, 18 bp, Homo sapiens
taacatagtatatgttat

SEQ ID NO: 119929 - DNA, 23 bp, Homo sapiens
tgtgtgcatatatgtgtgtgtgt

SEQ ID NO: 119930 - DNA, 23 bp, Homo sapiens
ttgatgaacatgatgtggttaat

SEQ ID NO: 119931 - DNA, 23 bp, Homo sapiens
ttggttgataacatttgtttaca

SEQ ID NO: 119932 - DNA, 23 bp, Homo sapiens
agtttcactcctgtggctgtgtt

SEQ ID NO: 119933 - DNA, 23 bp, Homo sapiens
gaaagctgtgccggtgactggct

SEQ ID NO: 119934 - DNA, 23 bp, Homo sapiens
gcctcactgactccgagtgttca

SEQ ID NO: 119935 - DNA, 21 bp, Homo sapiens
tgtgtgtatatgtatgtgtgt

SEQ ID NO: 119936 - DNA, 21 bp, Homo sapiens
ataggatgttgtcgggattgt

SEQ ID NO: 119937 - DNA, 23 bp, Homo sapiens
tatatatgtgtatatgtatcgat

SEQ ID NO: 119938 - DNA, 23 bp, Homo sapiens
agaagcagctttgttgagggctt

SEQ ID NO: 119939 - DNA, 20 bp, Homo sapiens
gactgggaggaaagcagtct

SEQ ID NO: 119940 - DNA, 23 bp, Homo sapiens
aacttgagtctcttactgtctgc

SEQ ID NO: 119941 - DNA, 20 bp, Homo sapiens
tatgtgtatgcatatgtata

SEQ ID NO: 119942 - DNA, 23 bp, Homo sapiens
tatgggtatatatatatgtgtat

SEQ ID NO: 119943 - DNA, 23 bp, Homo sapiens
accttcagtcactctctgctata

SEQ ID NO: 119944 - DNA, 23 bp, Homo sapiens
aagagtatttgttgttttaagaa

SEQ ID NO: 119945 - DNA, 23 bp, Homo sapiens
agcaagtttggtgattttgttga

SEQ ID NO: 119946 - DNA, 23 bp, Homo sapiens
tgagttcattgtagattctggat

SEQ ID NO: 119947 - DNA, 23 bp, Homo sapiens
tgagttcattgtagattctggat

SEQ ID NO: 119948 - DNA, 22 bp, Homo sapiens
tatagtcccagctattcaggag

SEQ ID NO: 119949 - DNA, 19 bp, Homo sapiens
tgcagtgagccatgattgt

SEQ ID NO: 119950 - DNA, 23 bp, Homo sapiens
tggagtctctgtctgtcacccag

SEQ ID NO: 119951 - DNA, 23 bp, Homo sapiens
tgagttcattgtagattctggat

SEQ ID NO: 119952 - DNA, 23 bp, Homo sapiens
tgagttcattgtagattctggat

SEQ ID NO: 119953 - DNA, 23 bp, Homo sapiens
tgagttcattgtagattctggat

SEQ ID NO: 119954 - DNA, 23 bp, Homo sapiens
tgagttcattgtagattctggat

SEQ ID NO: 119955 - DNA, 18 bp, Homo sapiens
tgagctacgatcacttca

SEQ ID NO: 119956 - DNA, 23 bp, Homo sapiens
gggagtctcactctgtcacccag

SEQ ID NO: 119957 - DNA, 19 bp, Homo sapiens
aaaaatctgttgtttaagc

SEQ ID NO: 119958 - DNA, 23 bp, Homo sapiens
tagttagtgactgtagttagtgg

SEQ ID NO: 119959 - DNA, 20 bp, Homo sapiens
agtgggaggatcacttgagc

SEQ ID NO: 119960 - DNA, 22 bp, Homo sapiens
tatctaccactctgtctctctg

SEQ ID NO: 119961 - DNA, 23 bp, Homo sapiens
tgagttcattgtagattctggat

SEQ ID NO: 119962 - DNA, 23 bp, Homo sapiens
tgagttcattgtagattctggat

SEQ ID NO: 119963 - DNA, 22 bp, Homo sapiens
tatgtgaaggctaatactgagc

SEQ ID NO: 119964 - DNA, 21 bp, Homo sapiens
cagtcagaaaacacagcggtc

SEQ ID NO: 119965 - DNA, 23 bp, Homo sapiens
gtctgaagttgaagcacagtttt

SEQ ID NO: 119966 - DNA, 23 bp, Homo sapiens
agagctagtaggtagtagagttg

SEQ ID NO: 119967 - DNA, 23 bp, Homo sapiens
tgagacggagtctcactctgtca

SEQ ID NO: 119968 - DNA, 23 bp, Homo sapiens
agctacaatgtgtttttgaaact

SEQ ID NO: 119969 - DNA, 23 bp, Homo sapiens
agagtcctgattttgttgcagtt

SEQ ID NO: 119970 - DNA, 23 bp, Homo sapiens
tctgagtgtttgccctttgtagg

SEQ ID NO: 119971 - DNA, 21 bp, Homo sapiens
tctgcaggttgtctgtttagt

SEQ ID NO: 119972 - DNA, 23 bp, Homo sapiens
agcaccttgctattactttgaag

SEQ ID NO: 119973 - DNA, 23 bp, Homo sapiens
gacagagtctcgctctgtcaccc

SEQ ID NO: 119974 - DNA, 19 bp, Homo sapiens
aattctcttgcattaattg

SEQ ID NO: 119975 - DNA, 23 bp, Homo sapiens
gcctgttcagagagagcagagtc

SEQ ID NO: 119976 - DNA, 23 bp, Homo sapiens
agagacagtctcactctgtcacc

SEQ ID NO: 119977 - DNA, 23 bp, Homo sapiens
actctctgcctgtcacttagtag

SEQ ID NO: 119978 - DNA, 23 bp, Homo sapiens
tttgtctctgggagtgttaacgg

SEQ ID NO: 119979 - DNA, 23 bp, Homo sapiens
tgagttcattgtagattctggat

SEQ ID NO: 119980 - DNA, 23 bp, Homo sapiens
tgagttcattgtagattctggat

SEQ ID NO: 119981 - DNA, 23 bp, Homo sapiens
acactgagcttttgtacgcagaa

SEQ ID NO: 119982 - DNA, 23 bp, Homo sapiens
tctgttgcatttttttcctgttt

SEQ ID NO: 119983 - DNA, 23 bp, Homo sapiens
actggtgactgtgtgtacattca

SEQ ID NO: 119984 - DNA, 21 bp, Homo sapiens
tgtgaagaaagtcattggtag

SEQ ID NO: 119985 - DNA, 20 bp, Homo sapiens
tctgtgatgagacagtacag

SEQ ID NO: 119986 - DNA, 20 bp, Homo sapiens
tgtgtgtgtgtatgtgtata

SEQ ID NO: 119987 - DNA, 23 bp, Homo sapiens
tgcctttatatatgtgtgtgcgt

SEQ ID NO: 119988 - DNA, 23 bp, Homo sapiens
tacacacacatatacgcacacac

SEQ ID NO: 119989 - DNA, 23 bp, Homo sapiens
tgtgtatatatacacgtgtgcat

SEQ ID NO: 119990 - DNA, 23 bp, Homo sapiens
tatatgtgcgtgtgtgtgtgtat

SEQ ID NO: 119991 - DNA, 23 bp, Homo sapiens
tctcactcagtcacacagtttgg

SEQ ID NO: 119992 - DNA, 23 bp, Homo sapiens
attagacaggtatatatatgttt

SEQ ID NO: 119993 - DNA, 23 bp, Homo sapiens
gattgattagtgacaacttttaa

SEQ ID NO: 119994 - DNA, 19 bp, Homo sapiens
atgtatatatgtatacaca

SEQ ID NO: 119995 - DNA, 19 bp, Homo sapiens
atgtatatatgtatacaca

SEQ ID NO: 119996 - DNA, 23 bp, Homo sapiens
gaaatgtgtgctttacttacttt

SEQ ID NO: 119997 - DNA, 21 bp, Homo sapiens
gcactgtgtatctctgtcagt

SEQ ID NO: 119998 - DNA, 23 bp, Homo sapiens
tatacaaagtacacagtcaggtg

SEQ ID NO: 119999 - DNA, 20 bp, Homo sapiens
acattgaagagcctgcaatt

SEQ ID NO: 120000 - DNA, 23 bp, Homo sapiens
tgagttcattgtagattctggat

SEQ ID NO: 120001 - DNA, 23 bp, Homo sapiens
tgagttcattgtagattctggat

SEQ ID NO: 120002 - DNA, 23 bp, Homo sapiens
tgagtgagtgagtgagtgagtga

SEQ ID NO: 120003 - DNA, 21 bp, Homo sapiens
agcagcatcagcattccctga

SEQ ID NO: 120004 - DNA, 22 bp, Homo sapiens
tgactaacattattgagcacta

SEQ ID NO: 120005 - DNA, 18 bp, Homo sapiens
gtactatgtatatatgta

SEQ ID NO: 120006 - DNA, 23 bp, Homo sapiens
aaaatagtgttttacaaaagcag

SEQ ID NO: 120007 - DNA, 22 bp, Homo sapiens
atatatgtatgtatacatatgt

SEQ ID NO: 120008 - DNA, 23 bp, Homo sapiens
tatatgtatatatacatatgtat

SEQ ID NO: 120009 - DNA, 21 bp, Homo sapiens
tatatgtatatatacatatgt

SEQ ID NO: 120010 - DNA, 19 bp, Homo sapiens
tatacatatgtatatgtat

SEQ ID NO: 120011 - DNA, 21 bp, Homo sapiens
tatgtatatatacatatgtat

SEQ ID NO: 120012 - DNA, 23 bp, Homo sapiens
tcagactctgtcactgactggga

SEQ ID NO: 120013 - DNA, 19 bp, Homo sapiens
acagggagcttgagtggtt

SEQ ID NO: 120014 - DNA, 23 bp, Homo sapiens
cagagtctccctcactcagtgct

SEQ ID NO: 120015 - DNA, 23 bp, Homo sapiens
atattagctggttattttgctca

SEQ ID NO: 120016 - DNA, 20 bp, Homo sapiens
tgcctgtgatcccagctact

SEQ ID NO: 120017 - DNA, 21 bp, Homo sapiens
tgaggtagaaggatcatttga

SEQ ID NO: 120018 - DNA, 21 bp, Homo sapiens
ttcaccatgttgaccaggctg

SEQ ID NO: 120019 - DNA, 23 bp, Homo sapiens
agtttttatgtatgcatgtatgt

SEQ ID NO: 120020 - DNA, 23 bp, Homo sapiens
tccatacagtatagagagtgcac

SEQ ID NO: 120021 - DNA, 23 bp, Homo sapiens
tgctgtacttttcatgctgtact

SEQ ID NO: 120022 - DNA, 21 bp, Homo sapiens
tttgcatattgtacataatgg

SEQ ID NO: 120023 - DNA, 21 bp, Homo sapiens
tgtgttgattttggatcctac

SEQ ID NO: 120024 - DNA, 21 bp, Homo sapiens
ttggtggagtctctggggttt

SEQ ID NO: 120025 - DNA, 23 bp, Homo sapiens
ggctgaggtaggaggatcacttg

SEQ ID NO: 120026 - DNA, 22 bp, Homo sapiens
gggtctcactctgtcacccagg

SEQ ID NO: 120027 - DNA, 23 bp, Homo sapiens
atacagtgatgtgatcttggctc

SEQ ID NO: 120028 - DNA, 23 bp, Homo sapiens
cagtctcactcactctgtttcct

SEQ ID NO: 120029 - DNA, 19 bp, Homo sapiens
tagagtgtagtggcatgat

SEQ ID NO: 120030 - DNA, 23 bp, Homo sapiens
gactgagtctccctctgtcaccc

SEQ ID NO: 120031 - DNA, 19 bp, Homo sapiens
gcgacacactgagactctg

SEQ ID NO: 120032 - DNA, 20 bp, Homo sapiens
tctgtgttttactgtctgct

SEQ ID NO: 120033 - DNA, 22 bp, Homo sapiens
atagagcatacagttggaggag

SEQ ID NO: 120034 - DNA, 23 bp, Homo sapiens
acagagtcccactctgtcaccca

SEQ ID NO: 120035 - DNA, 19 bp, Homo sapiens
tggtgtgatcttggctcat

SEQ ID NO: 120036 - DNA, 23 bp, Homo sapiens
tggagtctcactctgtcacccag

SEQ ID NO: 120037 - DNA, 21 bp, Homo sapiens
aggtgctatttctagctgtca

SEQ ID NO: 120038 - DNA, 23 bp, Homo sapiens
tctctgtctgtcaaattcctggg

SEQ ID NO: 120039 - DNA, 23 bp, Homo sapiens
cggagtctcactctgtcacccag

SEQ ID NO: 120040 - DNA, 23 bp, Homo sapiens
tgagttcattgtagattctggat

SEQ ID NO: 120041 - DNA, 23 bp, Homo sapiens
tgagttcattgtagattctggat

SEQ ID NO: 120042 - DNA, 21 bp, Homo sapiens
atatgctatatgtataggtgt

SEQ ID NO: 120043 - DNA, 23 bp, Homo sapiens
gtatatatatagcatatgtgtgt

SEQ ID NO: 120044 - DNA, 21 bp, Homo sapiens
tgagtgtgagacctgtttcct

SEQ ID NO: 120045 - DNA, 23 bp, Homo sapiens
atacagaagagattgagcagagt

SEQ ID NO: 120046 - DNA, 23 bp, Homo sapiens
atgtgtatatatgtatatgtgta

SEQ ID NO: 120047 - DNA, 23 bp, Homo sapiens
ctctagtctgggtgcagagtgag

SEQ ID NO: 120048 - DNA, 23 bp, Homo sapiens
actctgccacccagactagagtg

SEQ ID NO: 120049 - DNA, 23 bp, Homo sapiens
tttgagagagaaaactatctgtg

SEQ ID NO: 120050 - DNA, 23 bp, Homo sapiens
tgagttcattgtagattctggat

SEQ ID NO: 120051 - DNA, 22 bp, Homo sapiens
attgttctttttgcttaggatt

SEQ ID NO: 120052 - DNA, 22 bp, Homo sapiens
tgactctcactcttcttcatca

SEQ ID NO: 120053 - DNA, 23 bp, Homo sapiens
tttaagacaggacactgagtcag

SEQ ID NO: 120054 - DNA, 23 bp, Homo sapiens
agagtctcactctgtcacccagg

SEQ ID NO: 120055 - DNA, 23 bp, Homo sapiens
acacagacatatgtttatcagtt

SEQ ID NO: 120056 - DNA, 18 bp, Homo sapiens
agaagctggagtctgtga

SEQ ID NO: 120057 - DNA, 19 bp, Homo sapiens
aatctgtgtctggatgtgg

SEQ ID NO: 120058 - DNA, 23 bp, Homo sapiens
gtgtgtgtgtgtgtgtgtgcatg

SEQ ID NO: 120059 - DNA, 23 bp, Homo sapiens
tatatgtatatatatctgtgtgt

SEQ ID NO: 120060 - DNA, 19 bp, Homo sapiens
tgtgtatatatatacatat

SEQ ID NO: 120061 - DNA, 18 bp, Homo sapiens
tgtcttgtggtgggcatt

SEQ ID NO: 120062 - DNA, 23 bp, Homo sapiens
aataagtgaacctttagacatgc

SEQ ID NO: 120063 - DNA, 23 bp, Homo sapiens
tgagttcattgtagattctggat

SEQ ID NO: 120064 - DNA, 23 bp, Homo sapiens
tgagttcattgtagattctggat

SEQ ID NO: 120065 - DNA, 23 bp, Homo sapiens
ctctctctctctgcctatctgtt

SEQ ID NO: 120066 - DNA, 20 bp, Homo sapiens
tatatagtatacatatgtgt

SEQ ID NO: 120067 - DNA, 18 bp, Homo sapiens
aggataggtatacactat

SEQ ID NO: 120068 - DNA, 23 bp, Homo sapiens
ttccatgtgtatatatacatgta

SEQ ID NO: 120069 - DNA, 23 bp, Homo sapiens
gggtctcactctgtcacccaggc

SEQ ID NO: 120070 - DNA, 23 bp, Homo sapiens
tttggtcctatacataggtatga

SEQ ID NO: 120071 - DNA, 23 bp, Homo sapiens
ttgtactgcgtggttttgagggg

SEQ ID NO: 120072 - DNA, 22 bp, Homo sapiens
agagtctcgctctgtcacccag

SEQ ID NO: 120073 - DNA, 20 bp, Homo sapiens
taatgttgtgtttttgtaga

SEQ ID NO: 120074 - DNA, 23 bp, Homo sapiens
tgttcaggatattgcagtaagtg

SEQ ID NO: 120075 - DNA, 18 bp, Homo sapiens
cgagacagagtctcactg

SEQ ID NO: 120076 - DNA, 21 bp, Homo sapiens
tatgtggttgtatatatatat

SEQ ID NO: 120077 - DNA, 21 bp, Homo sapiens
gatttgttttagatgaggtct

SEQ ID NO: 120078 - DNA, 23 bp, Homo sapiens
atgtgagtacacagtgagaaggt

SEQ ID NO: 120079 - DNA, 20 bp, Homo sapiens
tgttctttttgcttaggatt

SEQ ID NO: 120080 - DNA, 22 bp, Homo sapiens
ttctgtgaagaaagtcaatagt

SEQ ID NO: 120081 - DNA, 22 bp, Homo sapiens
atttatgtccttggtcattgca

SEQ ID NO: 120082 - DNA, 22 bp, Homo sapiens
acagagtctccctctgtcaccc

SEQ ID NO: 120083 - DNA, 23 bp, Homo sapiens
tgcagtggcatgatcctggctca

SEQ ID NO: 120084 - DNA, 23 bp, Homo sapiens
agagtctcactcactctattgcc

SEQ ID NO: 120085 - DNA, 21 bp, Homo sapiens
ctgttggaatagaatgtgtat

SEQ ID NO: 120086 - DNA, 23 bp, Homo sapiens
agtgagaagacagtcagctttct

SEQ ID NO: 120087 - DNA, 23 bp, Homo sapiens
tgacactgacagtctgtctggag

SEQ ID NO: 120088 - DNA, 18 bp, Homo sapiens
aaactggctgatgattta

SEQ ID NO: 120089 - DNA, 21 bp, Homo sapiens
tatgtatatatagatgtgtgt

SEQ ID NO: 120090 - DNA, 23 bp, Homo sapiens
tgctgtatgcctgtagtcccagc

SEQ ID NO: 120091 - DNA, 23 bp, Homo sapiens
gtgtgtgtgcttgtatgtttatg

SEQ ID NO: 120092 - DNA, 23 bp, Homo sapiens
tgagttcattgtagattctggat

SEQ ID NO: 120093 - DNA, 23 bp, Homo sapiens
tgagttcattgtagattctggat

SEQ ID NO: 120094 - DNA, 23 bp, Homo sapiens
aaagagaatgctaatgtaatgat

SEQ ID NO: 120095 - DNA, 23 bp, Homo sapiens
attctttcacatttggctttcct

SEQ ID NO: 120096 - DNA, 23 bp, Homo sapiens
gacagagtctcgctctgtcaccc

SEQ ID NO: 120097 - DNA, 23 bp, Homo sapiens
attctctcagtgtaattgttgtc

SEQ ID NO: 120098 - DNA, 22 bp, Homo sapiens
atgtgtgtatatatatacgtgt

SEQ ID NO: 120099 - DNA, 23 bp, Homo sapiens
atgtgtatatatacacgtgtgta

SEQ ID NO: 120100 - DNA, 21 bp, Homo sapiens
tggtctaatatgcagaataca

SEQ ID NO: 120101 - DNA, 23 bp, Homo sapiens
tatatatgtatatgtatatgtgt

SEQ ID NO: 120102 - DNA, 23 bp, Homo sapiens
ctgtggtaggctttgaagtattt

SEQ ID NO: 120103 - DNA, 23 bp, Homo sapiens
tggttgttgtttctgtagtatct

SEQ ID NO: 120104 - DNA, 23 bp, Homo sapiens
atacacacacacgtatatgtgtg

SEQ ID NO: 120105 - DNA, 19 bp, Homo sapiens
tgtgtgtgtgtatgtgtgt

SEQ ID NO: 120106 - DNA, 20 bp, Homo sapiens
aagtgcatggtgattttgtg

SEQ ID NO: 120107 - DNA, 19 bp, Homo sapiens
taattccaggaaatgctgt

SEQ ID NO: 120108 - DNA, 23 bp, Homo sapiens
agtgtctcactctgtcacccagg

SEQ ID NO: 120109 - DNA, 23 bp, Homo sapiens
atgagatattgatgatcatgttg

SEQ ID NO: 120110 - DNA, 22 bp, Homo sapiens
tatccacaactgtttctgttat

SEQ ID NO: 120111 - DNA, 23 bp, Homo sapiens
gtccatcatcactcaaattgttg

SEQ ID NO: 120112 - DNA, 22 bp, Homo sapiens
tgtgaagaaagtcattggtagc

SEQ ID NO: 120113 - DNA, 23 bp, Homo sapiens
gcgtgtatgtgtgtctgtgtgtg

SEQ ID NO: 120114 - DNA, 18 bp, Homo sapiens
tgagactgggaaacatca

SEQ ID NO: 120115 - DNA, 23 bp, Homo sapiens
tgatttcatatattatttttctg

SEQ ID NO: 120116 - DNA, 18 bp, Homo sapiens
atccttctctctctgtga

SEQ ID NO: 120117 - DNA, 19 bp, Homo sapiens
tttgtatatatatgtgtgt

SEQ ID NO: 120118 - DNA, 23 bp, Homo sapiens
tatgtgtgtgtgtatgtatatac

SEQ ID NO: 120119 - DNA, 23 bp, Homo sapiens
tgtatgtatatacatacatgtac

SEQ ID NO: 120120 - DNA, 23 bp, Homo sapiens
atatgtgtatgtgtatatatgtg

SEQ ID NO: 120121 - DNA, 21 bp, Homo sapiens
tgtgtatatatgtgtgtgtat

SEQ ID NO: 120122 - DNA, 19 bp, Homo sapiens
agagatgtgtatattttga

SEQ ID NO: 120123 - DNA, 23 bp, Homo sapiens
tgagttcattgtagattctggat

SEQ ID NO: 120124 - DNA, 23 bp, Homo sapiens
tgagttcattgtagattctggat

SEQ ID NO: 120125 - DNA, 22 bp, Homo sapiens
tctctctctgtcaatatgagct

SEQ ID NO: 120126 - DNA, 19 bp, Homo sapiens
ctgaaagagaggaggcatt

SEQ ID NO: 120127 - DNA, 18 bp, Homo sapiens
caaggagattgagaagag

SEQ ID NO: 120128 - DNA, 19 bp, Homo sapiens
tttctggatgatttctgat

SEQ ID NO: 120129 - DNA, 20 bp, Homo sapiens
aatgagagggttaaagttaa

SEQ ID NO: 120130 - DNA, 18 bp, Homo sapiens
tcactgcaacctctgtct

SEQ ID NO: 120131 - DNA, 23 bp, Homo sapiens
agagaagagtgagaacatgcagt

SEQ ID NO: 120132 - DNA, 23 bp, Homo sapiens
acagggtctcgctctgtcgctca

SEQ ID NO: 120133 - DNA, 23 bp, Homo sapiens
tgagttcattgtagattctggat

SEQ ID NO: 120134 - DNA, 23 bp, Homo sapiens
tgagttcattgtagattctggat

SEQ ID NO: 120135 - DNA, 20 bp, Homo sapiens
tatgcaagtcttatctgtgt

SEQ ID NO: 120136 - DNA, 23 bp, Homo sapiens
cttgtctatgtctgtctctctct

SEQ ID NO: 120137 - DNA, 23 bp, Homo sapiens
tctgtgtatgtacatgatctata

SEQ ID NO: 120138 - DNA, 23 bp, Homo sapiens
tgagttcattgtagattctggat

SEQ ID NO: 120139 - DNA, 23 bp, Homo sapiens
tgagttcattgtagattctggat

SEQ ID NO: 120140 - DNA, 21 bp, Homo sapiens
agaagctgcagtaagctgtga

SEQ ID NO: 120141 - DNA, 23 bp, Homo sapiens
attctagtgatggcacataatgg

SEQ ID NO: 120142 - DNA, 23 bp, Homo sapiens
tatgaccttgcattccttatcga

SEQ ID NO: 120143 - DNA, 23 bp, Homo sapiens
tggaagaaaagggaatttgttga

SEQ ID NO: 120144 - DNA, 23 bp, Homo sapiens
agagtctcactctgtctcccagg

SEQ ID NO: 120145 - DNA, 23 bp, Homo sapiens
ttacattcaacagtctcagctga

SEQ ID NO: 120146 - DNA, 19 bp, Homo sapiens
tcagacatgtgagtgaaga

SEQ ID NO: 120147 - DNA, 23 bp, Homo sapiens
aaatattgagaggtgacaatgtg

SEQ ID NO: 120148 - DNA, 23 bp, Homo sapiens
tcgcacagtcactcactgcttcc

SEQ ID NO: 120149 - DNA, 23 bp, Homo sapiens
tgtgctggaaatgctctgttttt

SEQ ID NO: 120150 - DNA, 23 bp, Homo sapiens
atctgagttgtgggtacattgtt

SEQ ID NO: 120151 - DNA, 23 bp, Homo sapiens
tgagtgtgggatatgttcttcat

SEQ ID NO: 120152 - DNA, 23 bp, Homo sapiens
caggtctcactctgtcgctcagc

SEQ ID NO: 120153 - DNA, 23 bp, Homo sapiens
tgagttcattgtagattctggat

SEQ ID NO: 120154 - DNA, 23 bp, Homo sapiens
tgagttcattgtagattctggat

SEQ ID NO: 120155 - DNA, 23 bp, Homo sapiens
tctcagcttgtttctctgcctgt

SEQ ID NO: 120156 - DNA, 23 bp, Homo sapiens
acggagtctctcactgtcactcg

SEQ ID NO: 120157 - DNA, 22 bp, Homo sapiens
accacacccagctaacttttta

SEQ ID NO: 120158 - DNA, 23 bp, Homo sapiens
tagagacaaggtcttgctgtgtt

SEQ ID NO: 120159 - DNA, 23 bp, Homo sapiens
ttgagtttagtcacaggagttac

SEQ ID NO: 120160 - DNA, 23 bp, Homo sapiens
ggcagagtctcactctgtcaccc

SEQ ID NO: 120161 - DNA, 23 bp, Homo sapiens
tgagttcattgtagattctggat

SEQ ID NO: 120162 - DNA, 23 bp, Homo sapiens
tgagttcattgtagattctggat

SEQ ID NO: 120163 - DNA, 20 bp, Homo sapiens
tcagtagagaaatggatgca

SEQ ID NO: 120164 - DNA, 23 bp, Homo sapiens
atctgtgtgcctctcactgagcc

SEQ ID NO: 120165 - DNA, 20 bp, Homo sapiens
agtggttgctgaagattggg

SEQ ID NO: 120166 - DNA, 23 bp, Homo sapiens
gtgtaagtggaaggagacctgga

SEQ ID NO: 120167 - DNA, 22 bp, Homo sapiens
tatacgtatatatacataggta

SEQ ID NO: 120168 - DNA, 23 bp, Homo sapiens
tggagtctcactctgtcacccag

SEQ ID NO: 120169 - DNA, 20 bp, Homo sapiens
tgctgaattacattggtgtt

SEQ ID NO: 120170 - DNA, 21 bp, Homo sapiens
aagaaacagttcagaaaatgt

SEQ ID NO: 120171 - DNA, 23 bp, Homo sapiens
tgagttcattgtagattctggat

SEQ ID NO: 120172 - DNA, 23 bp, Homo sapiens
tgagttcattgtagattctggat

SEQ ID NO: 120173 - DNA, 23 bp, Homo sapiens
tgagttcattgtagattctggat

SEQ ID NO: 120174 - DNA, 23 bp, Homo sapiens
tgagttcattgtagattctggat

SEQ ID NO: 120175 - DNA, 20 bp, Homo sapiens
aggtactttgtttatttatt

SEQ ID NO: 120176 - DNA, 23 bp, Homo sapiens
aagaaactggcactgtctgcctc

SEQ ID NO: 120177 - DNA, 21 bp, Homo sapiens
tgtctctggggatacttactg

SEQ ID NO: 120178 - DNA, 23 bp, Homo sapiens
ttttctgctatttatgtggtgtg

SEQ ID NO: 120179 - DNA, 23 bp, Homo sapiens
agagtctcactctgtcactcagg

SEQ ID NO: 120180 - DNA, 23 bp, Homo sapiens
tgaagtctcactctgtcactcag

SEQ ID NO: 120181 - DNA, 18 bp, Homo sapiens
gtagagactcattctcct

SEQ ID NO: 120182 - DNA, 23 bp, Homo sapiens
tgagttcattgtagattctggat

SEQ ID NO: 120183 - DNA, 23 bp, Homo sapiens
tgagttcattgtagattctggat

SEQ ID NO: 120184 - DNA, 23 bp, Homo sapiens
tgagttcattgtagattctggat

SEQ ID NO: 120185 - DNA, 23 bp, Homo sapiens
tgagttcattgtagattctggat

SEQ ID NO: 120186 - DNA, 23 bp, Homo sapiens
atatgtgtatatgtatatatgta

SEQ ID NO: 120187 - DNA, 22 bp, Homo sapiens
atatgtgtatatgtatatatgt

SEQ ID NO: 120188 - DNA, 23 bp, Homo sapiens
tgacacagagacttgagtgagca

SEQ ID NO: 120189 - DNA, 22 bp, Homo sapiens
atagacttgcttgacacaaggt

SEQ ID NO: 120190 - DNA, 23 bp, Homo sapiens
gtatactgcaactttactgaatt

SEQ ID NO: 120191 - DNA, 20 bp, Homo sapiens
taggtttttccagatatagg

SEQ ID NO: 120192 - DNA, 20 bp, Homo sapiens
tatgcatatatatgcatatg

SEQ ID NO: 120193 - DNA, 18 bp, Homo sapiens
gtatatgtgtgtatatgt

SEQ ID NO: 120194 - DNA, 20 bp, Homo sapiens
atgtatgtatatgtaaatat

SEQ ID NO: 120195 - DNA, 22 bp, Homo sapiens
tcacatatatatacacacacat

SEQ ID NO: 120196 - DNA, 23 bp, Homo sapiens
ttgacagaagaaagactgcctgt

SEQ ID NO: 120197 - DNA, 18 bp, Homo sapiens
tattgatatctataaata

SEQ ID NO: 120198 - DNA, 23 bp, Homo sapiens
aagcatgttgaagccagaggatg

SEQ ID NO: 120199 - DNA, 23 bp, Homo sapiens
tggagtactgatagcttctgctt

SEQ ID NO: 120200 - DNA, 23 bp, Homo sapiens
ggtttggagcagaagataacttt

SEQ ID NO: 120201 - DNA, 21 bp, Homo sapiens
ccgtgtgaagagacaagcaaa

SEQ ID NO: 120202 - DNA, 18 bp, Homo sapiens
tctggttgatttaggggt

SEQ ID NO: 120203 - DNA, 23 bp, Homo sapiens
atctactttctttgctcatcctt

SEQ ID NO: 120204 - DNA, 23 bp, Homo sapiens
gctgtgactacaggtactgtgac

SEQ ID NO: 120205 - DNA, 19 bp, Homo sapiens
agccaagattttgaatgct

SEQ ID NO: 120206 - DNA, 23 bp, Homo sapiens
gacagagtctcgctctgtcaccc

SEQ ID NO: 120207 - DNA, 23 bp, Homo sapiens
tgagttcattgtagattctggat

SEQ ID NO: 120208 - DNA, 23 bp, Homo sapiens
tgagttcattgtagattctggat

SEQ ID NO: 120209 - DNA, 23 bp, Homo sapiens
ctcattgtggttttgatttgaat

SEQ ID NO: 120210 - DNA, 23 bp, Homo sapiens
tgagttcattgtagattctggat

SEQ ID NO: 120211 - DNA, 23 bp, Homo sapiens
tgagttcattgtagattctggat

SEQ ID NO: 120212 - DNA, 23 bp, Homo sapiens
atctatgtatatatgtatacata

SEQ ID NO: 120213 - DNA, 23 bp, Homo sapiens
actgcacttttagttctctctcc

SEQ ID NO: 120214 - DNA, 20 bp, Homo sapiens
aaatcatcactttatgtata

SEQ ID NO: 120215 - DNA, 23 bp, Homo sapiens
attcttgatgatttcttcagtgg

SEQ ID NO: 120216 - DNA, 23 bp, Homo sapiens
tacactcccactcagtgcctgag

SEQ ID NO: 120217 - DNA, 18 bp, Homo sapiens
tgacatgagagccagcag

SEQ ID NO: 120218 - DNA, 21 bp, Homo sapiens
tggcatgtaatgaagcatgca

SEQ ID NO: 120219 - DNA, 23 bp, Homo sapiens
tatacctggaaatggaattgatg

SEQ ID NO: 120220 - DNA, 22 bp, Homo sapiens
ttttttttttcacagcaggtac

SEQ ID NO: 120221 - DNA, 18 bp, Homo sapiens
aagtgtatacatatatat

SEQ ID NO: 120222 - DNA, 23 bp, Homo sapiens
acggagtctcgctctgtctccca

SEQ ID NO: 120223 - DNA, 23 bp, Homo sapiens
ctgaggttgtagcatgtttagca

SEQ ID NO: 120224 - DNA, 23 bp, Homo sapiens
aggattgtgtgacaattgttatt

SEQ ID NO: 120225 - DNA, 21 bp, Homo sapiens
attagttgaatatactttcct

SEQ ID NO: 120226 - DNA, 19 bp, Homo sapiens
ttcaggggttacatgtgca

SEQ ID NO: 120227 - DNA, 23 bp, Homo sapiens
tgtgacatggatatattttgtaa

SEQ ID NO: 120228 - DNA, 23 bp, Homo sapiens
tctggttgaagcttgtatgggtt

SEQ ID NO: 120229 - DNA, 18 bp, Homo sapiens
cagctaatctgagcagtg

SEQ ID NO: 120230 - DNA, 21 bp, Homo sapiens
gtccagtactgtatttgttgt

SEQ ID NO: 120231 - DNA, 23 bp, Homo sapiens
acatgtgcacaatgtgcaggttt

SEQ ID NO: 120232 - DNA, 23 bp, Homo sapiens
atacatgtatcatgttggtgtgc

SEQ ID NO: 120233 - DNA, 23 bp, Homo sapiens
acatgtgcacaatgtgcaggttt

SEQ ID NO: 120234 - DNA, 23 bp, Homo sapiens
atacatgtatcatgttggtgtgc

SEQ ID NO: 120235 - DNA, 22 bp, Homo sapiens
tggtagcttgatgaggatggca

SEQ ID NO: 120236 - DNA, 23 bp, Homo sapiens
tcatatttttagtagaggcaggg

SEQ ID NO: 120237 - DNA, 20 bp, Homo sapiens
atgtgtgtgtatatatatac

SEQ ID NO: 120238 - DNA, 23 bp, Homo sapiens
gatgtcacccagtctctctcatt

SEQ ID NO: 120239 - DNA, 23 bp, Homo sapiens
agagagagcacaagagcgctttg

SEQ ID NO: 120240 - DNA, 21 bp, Homo sapiens
tgtgaagaaagtcattggtag

SEQ ID NO: 120241 - DNA, 21 bp, Homo sapiens
tgtgaagaaagtcattggtag

SEQ ID NO: 120242 - DNA, 21 bp, Homo sapiens
tgtgaagaaagtcattggtag

SEQ ID NO: 120243 - DNA, 20 bp, Homo sapiens
tatgtctatatatatatgtc

SEQ ID NO: 120244 - DNA, 23 bp, Homo sapiens
atgagtctcgctctgtcaccctg

SEQ ID NO: 120245 - DNA, 21 bp, Homo sapiens
taatttctgtgctgttgtgac

SEQ ID NO: 120246 - DNA, 22 bp, Homo sapiens
tcacagacaacacagagtgcag

SEQ ID NO: 120247 - DNA, 23 bp, Homo sapiens
tgagttcattgtagattctggat

SEQ ID NO: 120248 - DNA, 23 bp, Homo sapiens
tgagttcattgtagattctggat

SEQ ID NO: 120249 - DNA, 22 bp, Homo sapiens
atatgtgtatatatatgtgtgt

SEQ ID NO: 120250 - DNA, 23 bp, Homo sapiens
atgtatgtacttgtatgtgttcg

SEQ ID NO: 120251 - DNA, 23 bp, Homo sapiens
agtgttatgttatctgctaggag

SEQ ID NO: 120252 - DNA, 23 bp, Homo sapiens
acagagtctcactctgtcgccca

SEQ ID NO: 120253 - DNA, 19 bp, Homo sapiens
agtgagggattcaggtctc

SEQ ID NO: 120254 - DNA, 23 bp, Homo sapiens
cttgtgtgtctctctgtcattgc

SEQ ID NO: 120255 - DNA, 22 bp, Homo sapiens
tattggatgtggggcctggtga

SEQ ID NO: 120256 - DNA, 23 bp, Homo sapiens
tggtgtatgatgtacatgaggca

SEQ ID NO: 120257 - DNA, 23 bp, Homo sapiens
atatggtagctattgttatgagt

SEQ ID NO: 120258 - DNA, 23 bp, Homo sapiens
agtcagtatctcactgtctctcc

SEQ ID NO: 120259 - DNA, 18 bp, Homo sapiens
tatgtgtcttgatctcat

SEQ ID NO: 120260 - DNA, 20 bp, Homo sapiens
tatgtgtgtgtatatatata

SEQ ID NO: 120261 - DNA, 23 bp, Homo sapiens
tgagttcattgtagattctggat

SEQ ID NO: 120262 - DNA, 23 bp, Homo sapiens
tgagttcattgtagattctggat

SEQ ID NO: 120263 - DNA, 23 bp, Homo sapiens
aactgtgtgtatatatatgtgtg

SEQ ID NO: 120264 - DNA, 20 bp, Homo sapiens
tatatgtacatatatataca

SEQ ID NO: 120265 - DNA, 18 bp, Homo sapiens
tatgtacatatatgtaca

SEQ ID NO: 120266 - DNA, 20 bp, Homo sapiens
tgtcaatttctatggtgtaa

SEQ ID NO: 120267 - DNA, 23 bp, Homo sapiens
gacagagtctcactctgtcgccc

SEQ ID NO: 120268 - DNA, 22 bp, Homo sapiens
agagactcacaatatgtttagg

SEQ ID NO: 120269 - DNA, 19 bp, Homo sapiens
catttgtattgttggtagg

SEQ ID NO: 120270 - DNA, 20 bp, Homo sapiens
agtgcttatgttgtcaactg

SEQ ID NO: 120271 - DNA, 22 bp, Homo sapiens
ttgacagtggagtgtgagcaca

SEQ ID NO: 120272 - DNA, 22 bp, Homo sapiens
tgaggctgttaagctccttgag

SEQ ID NO: 120273 - DNA, 23 bp, Homo sapiens
tacagagcagagtgtgcacattg

SEQ ID NO: 120274 - DNA, 23 bp, Homo sapiens
gtgtgtgtgtgtgtatatacata

SEQ ID NO: 120275 - DNA, 18 bp, Homo sapiens
tgtatatatgtatatatg

SEQ ID NO: 120276 - DNA, 23 bp, Homo sapiens
atacacacacacatatatatgtg

SEQ ID NO: 120277 - DNA, 23 bp, Homo sapiens
accaagtctcgctctgtcaccca

SEQ ID NO: 120278 - DNA, 23 bp, Homo sapiens
acacacacacacaacggaatact

SEQ ID NO: 120279 - DNA, 23 bp, Homo sapiens
gggtctcactctgtcacccaggc

SEQ ID NO: 120280 - DNA, 22 bp, Homo sapiens
gagtctcactctgtcacccagg

SEQ ID NO: 120281 - DNA, 23 bp, Homo sapiens
ctgagtctcactctgtcacccag

SEQ ID NO: 120282 - DNA, 22 bp, Homo sapiens
ttttgctcttgatctttgaata

SEQ ID NO: 120283 - DNA, 20 bp, Homo sapiens
aaaagatgatcaggaaatca

SEQ ID NO: 120284 - DNA, 23 bp, Homo sapiens
tgaggtacgaggatcatttgagc

SEQ ID NO: 120285 - DNA, 22 bp, Homo sapiens
cttggctcactgcaacctctgt

SEQ ID NO: 120286 - DNA, 23 bp, Homo sapiens
gtatgcatgtatgtatgtatgta

SEQ ID NO: 120287 - DNA, 23 bp, Homo sapiens
tgcatgcatgcatgtatgtatgt

SEQ ID NO: 120288 - DNA, 23 bp, Homo sapiens
tgaaggtctagatgtagggttaa

SEQ ID NO: 120289 - DNA, 22 bp, Homo sapiens
agagtctcacttactctgttgc

SEQ ID NO: 120290 - DNA, 23 bp, Homo sapiens
tgagttcattgtagattctggat

SEQ ID NO: 120291 - DNA, 23 bp, Homo sapiens
tgagttcattgtagattctggat

SEQ ID NO: 120292 - DNA, 23 bp, Homo sapiens
ggtaatgttgttttaagttcttt

SEQ ID NO: 120293 - DNA, 23 bp, Homo sapiens
tgagttcattgtagattctggat

SEQ ID NO: 120294 - DNA, 23 bp, Homo sapiens
tgagttcattgtagattctggat

SEQ ID NO: 120295 - DNA, 23 bp, Homo sapiens
tgagttcattgtagattctggat

SEQ ID NO: 120296 - DNA, 23 bp, Homo sapiens
tgagttcattgtagattctggat

SEQ ID NO: 120297 - DNA, 23 bp, Homo sapiens
cggagtctcgctctgtctcccag

SEQ ID NO: 120298 - DNA, 21 bp, Homo sapiens
aaacatgtgttcctgttctct

SEQ ID NO: 120299 - DNA, 20 bp, Homo sapiens
tttgactgtttgaataagcc

SEQ ID NO: 120300 - DNA, 23 bp, Homo sapiens
tgtggtgtgtgtgtgtgtaaaat

SEQ ID NO: 120301 - DNA, 22 bp, Homo sapiens
tcagagtctcgcactgtctccc

SEQ ID NO: 120302 - DNA, 21 bp, Homo sapiens
tctctctttttctctgtgaaa

SEQ ID NO: 120303 - DNA, 20 bp, Homo sapiens
tccttcttcacatggcagca

SEQ ID NO: 120304 - DNA, 23 bp, Homo sapiens
aacagtactcactgagttctagc

SEQ ID NO: 120305 - DNA, 23 bp, Homo sapiens
tttgggtagctatgcaaagtatt

SEQ ID NO: 120306 - DNA, 21 bp, Homo sapiens
agggtgggtcggtctttccca

SEQ ID NO: 120307 - DNA, 23 bp, Homo sapiens
agctatcagagtctctaactctc

SEQ ID NO: 120308 - DNA, 23 bp, Homo sapiens
ctcagtgtctccctctatccaga

SEQ ID NO: 120309 - DNA, 20 bp, Homo sapiens
atatgtgtgtgtatatatat

SEQ ID NO: 120310 - DNA, 23 bp, Homo sapiens
aacctacagaatgagagagaata

SEQ ID NO: 120311 - DNA, 19 bp, Homo sapiens
tgtatctttacacttgtgt

SEQ ID NO: 120312 - DNA, 18 bp, Homo sapiens
tattcatttgatagcaaa

SEQ ID NO: 120313 - DNA, 20 bp, Homo sapiens
taagtgaaagcaactttaac

SEQ ID NO: 120314 - DNA, 23 bp, Homo sapiens
aggtagttgtatgtatatatcct

SEQ ID NO: 120315 - DNA, 23 bp, Homo sapiens
tgtgtgtgcatatatatatatat

SEQ ID NO: 120316 - DNA, 23 bp, Homo sapiens
tatatgtatacatatgtatacat

SEQ ID NO: 120317 - DNA, 23 bp, Homo sapiens
tattgctgcaaatgatatgatct

SEQ ID NO: 120318 - DNA, 22 bp, Homo sapiens
tgcatagtatttcatagtgtat

SEQ ID NO: 120319 - DNA, 23 bp, Homo sapiens
atatgtgtatatgtatacatgtg

SEQ ID NO: 120320 - DNA, 18 bp, Homo sapiens
tatgtgtatatatgtaca

SEQ ID NO: 120321 - DNA, 22 bp, Homo sapiens
ggggactcactctgtcggtcag

SEQ ID NO: 120322 - DNA, 23 bp, Homo sapiens
ctctgtgtaagtgtatatctctg

SEQ ID NO: 120323 - DNA, 20 bp, Homo sapiens
aaatttcacagagttataga

SEQ ID NO: 120324 - DNA, 22 bp, Homo sapiens
ttagtccatttatattcaatgt

SEQ ID NO: 120325 - DNA, 22 bp, Homo sapiens
tatgtgtatatgtatatgtata

SEQ ID NO: 120326 - DNA, 19 bp, Homo sapiens
tgtgtgtatatatatatgt

SEQ ID NO: 120327 - DNA, 23 bp, Homo sapiens
tgcatcaatctatgaatgtcact

SEQ ID NO: 120328 - DNA, 23 bp, Homo sapiens
gtcatgatttgtattcttcctgg

SEQ ID NO: 120329 - DNA, 22 bp, Homo sapiens
ccttcaccttctgttatgattg

SEQ ID NO: 120330 - DNA, 23 bp, Homo sapiens
ctctctgtgtgcctgagtagctg

SEQ ID NO: 120331 - DNA, 23 bp, Homo sapiens
tgagttcattgtagattctggat

SEQ ID NO: 120332 - DNA, 23 bp, Homo sapiens
tgagttcattgtagattctggat

SEQ ID NO: 120333 - DNA, 23 bp, Homo sapiens
aatgtacatgtatatgtgtgtgt

SEQ ID NO: 120334 - DNA, 23 bp, Homo sapiens
agtctcactcactctgtcaccta

SEQ ID NO: 120335 - DNA, 23 bp, Homo sapiens
ttttttccatttcaaatgatttt

SEQ ID NO: 120336 - DNA, 22 bp, Homo sapiens
tgaagtgaaattgtttgaaact

SEQ ID NO: 120337 - DNA, 23 bp, Homo sapiens
tgcctggaactgggattatgatg

SEQ ID NO: 120338 - DNA, 23 bp, Homo sapiens
ccctgtcacagtcagtttgggga

SEQ ID NO: 120339 - DNA, 23 bp, Homo sapiens
ttcacaactcactcactcagtgc

SEQ ID NO: 120340 - DNA, 20 bp, Homo sapiens
ctcctacctcagcagggagt

SEQ ID NO: 120341 - DNA, 23 bp, Homo sapiens
acagggtctcactctgtcaccca

SEQ ID NO: 120342 - DNA, 23 bp, Homo sapiens
gggtctcactctgtcacccaggc

SEQ ID NO: 120343 - DNA, 23 bp, Homo sapiens
gggtctcactctgtcacccaggc

SEQ ID NO: 120344 - DNA, 23 bp, Homo sapiens
acagagtctcactctgtcgccca

SEQ ID NO: 120345 - DNA, 23 bp, Homo sapiens
atgtattctgtaatcgtttgctt

SEQ ID NO: 120346 - DNA, 22 bp, Homo sapiens
atggagtctcactctgtcaccc

SEQ ID NO: 120347 - DNA, 23 bp, Homo sapiens
tgagttcattgtagattctggat

SEQ ID NO: 120348 - DNA, 23 bp, Homo sapiens
tgagttcattgtagattctggat

SEQ ID NO: 120349 - DNA, 23 bp, Homo sapiens
atgactcattgcagtctcagcct

SEQ ID NO: 120350 - DNA, 23 bp, Homo sapiens
agacagtctcattctgtcaccta

SEQ ID NO: 120351 - DNA, 23 bp, Homo sapiens
actgcacttcagcctgggtgaca

SEQ ID NO: 120352 - DNA, 22 bp, Homo sapiens
atatagcatcatatatatatga

SEQ ID NO: 120353 - DNA, 20 bp, Homo sapiens
tatagcatcatatatatatg

SEQ ID NO: 120354 - DNA, 18 bp, Homo sapiens
atagatagatatagttag

SEQ ID NO: 120355 - DNA, 20 bp, Homo sapiens
tgcagtgtggcaatcatggc

SEQ ID NO: 120356 - DNA, 23 bp, Homo sapiens
tgagttcattgtagattctggat

SEQ ID NO: 120357 - DNA, 23 bp, Homo sapiens
tgagttcattgtagattctggat

SEQ ID NO: 120358 - DNA, 23 bp, Homo sapiens
agtacctatatatacatatgtgt

SEQ ID NO: 120359 - DNA, 23 bp, Homo sapiens
tcccagagcccctggaactctgg

SEQ ID NO: 120360 - DNA, 23 bp, Homo sapiens
tcccagagcccctggaactctgg

SEQ ID NO: 120361 - DNA, 23 bp, Homo sapiens
tcccagagcccctggaactctgg

SEQ ID NO: 120362 - DNA, 23 bp, Homo sapiens
ccctggttcatttctgggatttc

SEQ ID NO: 120363 - DNA, 22 bp, Homo sapiens
ctctttctctctcactgtggac

SEQ ID NO: 120364 - DNA, 23 bp, Homo sapiens
tgagttcattgtagattctggat

SEQ ID NO: 120365 - DNA, 23 bp, Homo sapiens
tgagttcattgtagattctggat

SEQ ID NO: 120366 - DNA, 20 bp, Homo sapiens
aaggaaggaacgaggagaaa

SEQ ID NO: 120367 - DNA, 23 bp, Homo sapiens
tgtgtcccagagattctggtatg

SEQ ID NO: 120368 - DNA, 23 bp, Homo sapiens
tgtcaaatgtatagattgtgaag

SEQ ID NO: 120369 - DNA, 21 bp, Homo sapiens
tctcactctgtgagttgtctg

SEQ ID NO: 120370 - DNA, 20 bp, Homo sapiens
ggcacacacctgaagtccca

SEQ ID NO: 120371 - DNA, 23 bp, Homo sapiens
tgtatacccacagtatatatctg

SEQ ID NO: 120372 - DNA, 20 bp, Homo sapiens
tacacagtatatatatatga

SEQ ID NO: 120373 - DNA, 23 bp, Homo sapiens
ttccctaacatttccattagtac

SEQ ID NO: 120374 - DNA, 22 bp, Homo sapiens
aatgagagaatagattgacagg

SEQ ID NO: 120375 - DNA, 22 bp, Homo sapiens
atttcaaactttttcattagta

SEQ ID NO: 120376 - DNA, 23 bp, Homo sapiens
tgagttcattgtagattctggat

SEQ ID NO: 120377 - DNA, 23 bp, Homo sapiens
tgagttcattgtagattctggat

SEQ ID NO: 120378 - DNA, 22 bp, Homo sapiens
tacatatgtgtccatgtatatg

SEQ ID NO: 120379 - DNA, 23 bp, Homo sapiens
agagtctcactctgtcacccagg

SEQ ID NO: 120380 - DNA, 23 bp, Homo sapiens
tgagttcattgtagattctggat

SEQ ID NO: 120381 - DNA, 23 bp, Homo sapiens
tgagttcattgtagattctggat

SEQ ID NO: 120382 - DNA, 23 bp, Homo sapiens
tctctctctctctgcctcgtaat

SEQ ID NO: 120383 - DNA, 23 bp, Homo sapiens
tgagttcattgtagattctggat

SEQ ID NO: 120384 - DNA, 23 bp, Homo sapiens
tgagttcattgtagattctggat

SEQ ID NO: 120385 - DNA, 23 bp, Homo sapiens
gggtctcactctgtcacccaggc

SEQ ID NO: 120386 - DNA, 20 bp, Homo sapiens
actccttgagggaataggga

SEQ ID NO: 120387 - DNA, 23 bp, Homo sapiens
agatcagagaagagagactggtg

SEQ ID NO: 120388 - DNA, 23 bp, Homo sapiens
agagtctcactctgtcacccagg

SEQ ID NO: 120389 - DNA, 18 bp, Homo sapiens
cagtggcatgattttgac

SEQ ID NO: 120390 - DNA, 23 bp, Homo sapiens
tgtgttagcattagtaatgacat

SEQ ID NO: 120391 - DNA, 23 bp, Homo sapiens
tctgaggtgaatgtgctgttagc

SEQ ID NO: 120392 - DNA, 22 bp, Homo sapiens
aatagtgttcagtctcatccag

SEQ ID NO: 120393 - DNA, 23 bp, Homo sapiens
tctcactctgtcactgagactga

SEQ ID NO: 120394 - DNA, 23 bp, Homo sapiens
ttcacctgtgattttcttgtaat

SEQ ID NO: 120395 - DNA, 20 bp, Homo sapiens
aaaacacttgtgaaactgat

SEQ ID NO: 120396 - DNA, 22 bp, Homo sapiens
ggacagtatgctattgcacagt

SEQ ID NO: 120397 - DNA, 18 bp, Homo sapiens
tgagactggattatttat

SEQ ID NO: 120398 - DNA, 18 bp, Homo sapiens
ttcaagaacatgtgcagt

SEQ ID NO: 120399 - DNA, 21 bp, Homo sapiens
tgtgaagaaagtcattggtag

SEQ ID NO: 120400 - DNA, 21 bp, Homo sapiens
tgtgaagaaagtcattggtag

SEQ ID NO: 120401 - DNA, 18 bp, Homo sapiens
tctgtcccaatgttctca

SEQ ID NO: 120402 - DNA, 23 bp, Homo sapiens
gcgtgcgtgcgtgtgtgtatatg

SEQ ID NO: 120403 - DNA, 21 bp, Homo sapiens
aaacatgttcattgctttgtg

SEQ ID NO: 120404 - DNA, 19 bp, Homo sapiens
tgagaagtgactaatctct

SEQ ID NO: 120405 - DNA, 23 bp, Homo sapiens
attatgcattgtgtctttagtgt

SEQ ID NO: 120406 - DNA, 22 bp, Homo sapiens
tgatttcaatagatgtttgaat

SEQ ID NO: 120407 - DNA, 23 bp, Homo sapiens
gactgagtctcgctctgtcgcac

SEQ ID NO: 120408 - DNA, 23 bp, Homo sapiens
ggaagtcagagagcagagagagg

SEQ ID NO: 120409 - DNA, 23 bp, Homo sapiens
acgtatatatacgtgtatacgta

SEQ ID NO: 120410 - DNA, 21 bp, Homo sapiens
tatacgtatatatacgtatat

SEQ ID NO: 120411 - DNA, 22 bp, Homo sapiens
ttttaacttcattcacatactg

SEQ ID NO: 120412 - DNA, 23 bp, Homo sapiens
tgggtctgtgtggtaatttacac

SEQ ID NO: 120413 - DNA, 23 bp, Homo sapiens
tgtttttgcatgtgtatgtgttt

SEQ ID NO: 120414 - DNA, 23 bp, Homo sapiens
ttgaaatgaattatgaccctggc

SEQ ID NO: 120415 - DNA, 22 bp, Homo sapiens
ggactgcataaaggtatttttg

SEQ ID NO: 120416 - DNA, 20 bp, Homo sapiens
ctctgggaaaagtgagaccc

SEQ ID NO: 120417 - DNA, 23 bp, Homo sapiens
aaggccatatgtttatactaagt

SEQ ID NO: 120418 - DNA, 23 bp, Homo sapiens
tgttagtggaaatgaaatgaaat

SEQ ID NO: 120419 - DNA, 23 bp, Homo sapiens
gtatttctgtgtatatgtatttc

SEQ ID NO: 120420 - DNA, 20 bp, Homo sapiens
tcatcattgaaatcacagag

SEQ ID NO: 120421 - DNA, 23 bp, Homo sapiens
tgttctgtttggtaatcatctga

SEQ ID NO: 120422 - DNA, 21 bp, Homo sapiens
tgtgaagaaagtcaatggtag

SEQ ID NO: 120423 - DNA, 23 bp, Homo sapiens
taatgtatatttgtacatgtaat

SEQ ID NO: 120424 - DNA, 23 bp, Homo sapiens
tgagttcattgtagattctggat

SEQ ID NO: 120425 - DNA, 23 bp, Homo sapiens
tcagagtatggtagttttcctca

SEQ ID NO: 120426 - DNA, 20 bp, Homo sapiens
aaagtagtagcagtgattat

SEQ ID NO: 120427 - DNA, 23 bp, Homo sapiens
tgtagtgtggtagttagatgttg

SEQ ID NO: 120428 - DNA, 18 bp, Homo sapiens
agtacagtggcgcagtct

SEQ ID NO: 120429 - DNA, 21 bp, Homo sapiens
acaggtatatccatatatatg

SEQ ID NO: 120430 - DNA, 23 bp, Homo sapiens
gacagggtctctgtgtgtttctc

SEQ ID NO: 120431 - DNA, 20 bp, Homo sapiens
gagtttctgcacaggccact

SEQ ID NO: 120432 - DNA, 23 bp, Homo sapiens
agccagaggttgtagtttcagct

SEQ ID NO: 120433 - DNA, 23 bp, Homo sapiens
tgagttcattgtagattctggat

SEQ ID NO: 120434 - DNA, 23 bp, Homo sapiens
tgagttcattgtagattctggat

SEQ ID NO: 120435 - DNA, 23 bp, Homo sapiens
agacagatctcactctgtcaccc

SEQ ID NO: 120436 - DNA, 21 bp, Homo sapiens
ttgatctagagaatgacagtc

SEQ ID NO: 120437 - DNA, 20 bp, Homo sapiens
gatgagagagttttaggaaa

SEQ ID NO: 120438 - DNA, 23 bp, Homo sapiens
agtcaccaacatcaatcgagtgt

SEQ ID NO: 120439 - DNA, 23 bp, Homo sapiens
tgagttcattgtagattctggat

SEQ ID NO: 120440 - DNA, 23 bp, Homo sapiens
tgagttcattgtagattctggat

SEQ ID NO: 120441 - DNA, 23 bp, Homo sapiens
tgtagaacatgttttgaagtgtg

SEQ ID NO: 120442 - DNA, 21 bp, Homo sapiens
aactttaagtgatgcctggga

SEQ ID NO: 120443 - DNA, 23 bp, Homo sapiens
acatcagtggtcccagtgaagct

SEQ ID NO: 120444 - DNA, 23 bp, Homo sapiens
agacttttggatttcttttggaa

SEQ ID NO: 120445 - DNA, 23 bp, Homo sapiens
tgagttcattgtagattctggat

SEQ ID NO: 120446 - DNA, 23 bp, Homo sapiens
tgagttcattgtagattctggat

SEQ ID NO: 120447 - DNA, 22 bp, Homo sapiens
tgcctgactgtgtcagtggctg

SEQ ID NO: 120448 - DNA, 21 bp, Homo sapiens
aatttactcctaggcctattg

SEQ ID NO: 120449 - DNA, 21 bp, Homo sapiens
tatgtctggcatattataagt

SEQ ID NO: 120450 - DNA, 20 bp, Homo sapiens
attcagacaaaatatgaagt

SEQ ID NO: 120451 - DNA, 22 bp, Homo sapiens
tttcttctcctaggtatttgtg

SEQ ID NO: 120452 - DNA, 18 bp, Homo sapiens
actctttccaatgcaacg

SEQ ID NO: 120453 - DNA, 22 bp, Homo sapiens
atttgatttctatcttttagtg

SEQ ID NO: 120454 - DNA, 18 bp, Homo sapiens
taattgtttttctcttag

SEQ ID NO: 120455 - DNA, 23 bp, Homo sapiens
aactgacttcactctctgtcact

SEQ ID NO: 120456 - DNA, 23 bp, Homo sapiens
atgtatacatgaatggagtagca

SEQ ID NO: 120457 - DNA, 23 bp, Homo sapiens
agagtctcactctgtcacccagg

SEQ ID NO: 120458 - DNA, 23 bp, Homo sapiens
tctctatttctgtctgttaaaac

SEQ ID NO: 120459 - DNA, 23 bp, Homo sapiens
tgtatgtatgtatgtatgtgtgt

SEQ ID NO: 120460 - DNA, 22 bp, Homo sapiens
tggaactgtaagtccatgtgga

SEQ ID NO: 120461 - DNA, 23 bp, Homo sapiens
tctgtgaagatattcaatggtac

SEQ ID NO: 120462 - DNA, 22 bp, Homo sapiens
agagtgtcagtctgtcatttga

SEQ ID NO: 120463 - DNA, 20 bp, Homo sapiens
tgagacagactctccctctg

SEQ ID NO: 120464 - DNA, 23 bp, Homo sapiens
atatgtgtgcgtgtatatgtgtg

SEQ ID NO: 120465 - DNA, 22 bp, Homo sapiens
gagatgtagcaggaaggtttct

SEQ ID NO: 120466 - DNA, 23 bp, Homo sapiens
tgtcaagctgtctctctgaaatc

SEQ ID NO: 120467 - DNA, 18 bp, Homo sapiens
attacacgtatatattgt

SEQ ID NO: 120468 - DNA, 23 bp, Homo sapiens
agaatgatcaatgtgctaattta

SEQ ID NO: 120469 - DNA, 22 bp, Homo sapiens
tatatgcatatatatacatata

SEQ ID NO: 120470 - DNA, 23 bp, Homo sapiens
gtatatatgtatatgtatatacg

SEQ ID NO: 120471 - DNA, 19 bp, Homo sapiens
atgtatatacatgtatatg

SEQ ID NO: 120472 - DNA, 18 bp, Homo sapiens
aacagtttctgacactat

SEQ ID NO: 120473 - DNA, 23 bp, Homo sapiens
acagactctcactgttattaccg

SEQ ID NO: 120474 - DNA, 18 bp, Homo sapiens
tcactgcaatcttgactg

SEQ ID NO: 120475 - DNA, 21 bp, Homo sapiens
atctggttctactttagagtt

SEQ ID NO: 120476 - DNA, 23 bp, Homo sapiens
tgagatggagtttcactctgtca

SEQ ID NO: 120477 - DNA, 23 bp, Homo sapiens
atgtggctgtggtatcattcagt

SEQ ID NO: 120478 - DNA, 23 bp, Homo sapiens
atatttagtggtagctcattatg

SEQ ID NO: 120479 - DNA, 23 bp, Homo sapiens
tgagttcattgtagattctggat

SEQ ID NO: 120480 - DNA, 23 bp, Homo sapiens
tgagttcattgtagattctggat

SEQ ID NO: 120481 - DNA, 23 bp, Homo sapiens
acatagatggaattgagaaccaa

SEQ ID NO: 120482 - DNA, 23 bp, Homo sapiens
tatgtgtatgcatatatatatgt

SEQ ID NO: 120483 - DNA, 23 bp, Homo sapiens
tgagttcattgtagattctggat

SEQ ID NO: 120484 - DNA, 23 bp, Homo sapiens
tgagttcattgtagattctggat

SEQ ID NO: 120485 - DNA, 23 bp, Homo sapiens
atacacacatgtacacatacaca

SEQ ID NO: 120486 - DNA, 23 bp, Homo sapiens
ttgtgtgcatgcatgtgtgtata

SEQ ID NO: 120487 - DNA, 23 bp, Homo sapiens
tgagttcattgtagattctggat

SEQ ID NO: 120488 - DNA, 23 bp, Homo sapiens
tgagttcattgtagattctggat

SEQ ID NO: 120489 - DNA, 23 bp, Homo sapiens
tatatatatatgtggatgtgtat

SEQ ID NO: 120490 - DNA, 20 bp, Homo sapiens
tacacacacacacgtatatg

SEQ ID NO: 120491 - DNA, 20 bp, Homo sapiens
taagtgtatgtaatgtgtat

SEQ ID NO: 120492 - DNA, 21 bp, Homo sapiens
tatatgtatgtatatgcatgt

SEQ ID NO: 120493 - DNA, 23 bp, Homo sapiens
atatatgtatatgtgtatatgtg

SEQ ID NO: 120494 - DNA, 19 bp, Homo sapiens
atatacatacatatgtgtg

SEQ ID NO: 120495 - DNA, 21 bp, Homo sapiens
tatgtgtatatatatgtgtgt

SEQ ID NO: 120496 - DNA, 23 bp, Homo sapiens
taagggtttttaatgccttcagt

SEQ ID NO: 120497 - DNA, 19 bp, Homo sapiens
attccatgagaattgcaga

SEQ ID NO: 120498 - DNA, 23 bp, Homo sapiens
ttgtgagaaagtgcttagcatga

SEQ ID NO: 120499 - DNA, 22 bp, Homo sapiens
tgtgtgtgtatgtatatatatg

SEQ ID NO: 120500 - DNA, 23 bp, Homo sapiens
tggttggttatgaacatgctgta

SEQ ID NO: 120501 - DNA, 20 bp, Homo sapiens
gcatagattgtgaaaaagta

SEQ ID NO: 120502 - DNA, 23 bp, Homo sapiens
tgagttcattgtagattctggat

SEQ ID NO: 120503 - DNA, 23 bp, Homo sapiens
tgagttcattgtagattctggat

SEQ ID NO: 120504 - DNA, 23 bp, Homo sapiens
tgagttcattgtagattctggat

SEQ ID NO: 120505 - DNA, 23 bp, Homo sapiens
tgagttcattgtagattctggat

SEQ ID NO: 120506 - DNA, 23 bp, Homo sapiens
atatgtatatatagatgtgtgag

SEQ ID NO: 120507 - DNA, 23 bp, Homo sapiens
tcagtgggagggaaagagttcag

SEQ ID NO: 120508 - DNA, 21 bp, Homo sapiens
ccctctgtgctcctgattctc

SEQ ID NO: 120509 - DNA, 22 bp, Homo sapiens
acagtaaaaggtaatctctcgt

SEQ ID NO: 120510 - DNA, 19 bp, Homo sapiens
acagttacaaacccctgac

SEQ ID NO: 120511 - DNA, 23 bp, Homo sapiens
ttccttgtagatactggatatta

SEQ ID NO: 120512 - DNA, 23 bp, Homo sapiens
ttgtcagatgtatagattgtgaa

SEQ ID NO: 120513 - DNA, 23 bp, Homo sapiens
tctctcactctgtgtcttgtctg

SEQ ID NO: 120514 - DNA, 23 bp, Homo sapiens
cgaagtctcactctgtcacccag

SEQ ID NO: 120515 - DNA, 21 bp, Homo sapiens
ttgagagaacagtgtcagctg

SEQ ID NO: 120516 - DNA, 23 bp, Homo sapiens
gggtctctgtctgtcacccaggc

SEQ ID NO: 120517 - DNA, 23 bp, Homo sapiens
agacagagtctcactgtgtcacc

SEQ ID NO: 120518 - DNA, 23 bp, Homo sapiens
tgagttcattgtagattctggat

SEQ ID NO: 120519 - DNA, 23 bp, Homo sapiens
tgtctctctgtttctccaagtgc

SEQ ID NO: 120520 - DNA, 23 bp, Homo sapiens
tgagttcattgtagattctggat

SEQ ID NO: 120521 - DNA, 23 bp, Homo sapiens
tgagttcattgtagattctggat

SEQ ID NO: 120522 - DNA, 23 bp, Homo sapiens
gagtctcactctgtcaccctggc

SEQ ID NO: 120523 - DNA, 20 bp, Homo sapiens
tatgtgtatatatatgtatg

SEQ ID NO: 120524 - DNA, 23 bp, Homo sapiens
tgagttcattgtagattctggat

SEQ ID NO: 120525 - DNA, 23 bp, Homo sapiens
tgagttcattgtagattctggat

SEQ ID NO: 120526 - DNA, 18 bp, Homo sapiens
taagaagagagagggaca

SEQ ID NO: 120527 - DNA, 20 bp, Homo sapiens
tctctctctttctgtgagtg

SEQ ID NO: 120528 - DNA, 23 bp, Homo sapiens
acagactctcgctctgtcaccca

SEQ ID NO: 120529 - DNA, 23 bp, Homo sapiens
aggcagtgtggatagctgttgag

SEQ ID NO: 120530 - DNA, 22 bp, Homo sapiens
tggtatttgaatgtgtgtgtgt

SEQ ID NO: 120531 - DNA, 18 bp, Homo sapiens
gggtctcattctgtcacc

SEQ ID NO: 120532 - DNA, 22 bp, Homo sapiens
atctcagtgatcttcctgtctc

SEQ ID NO: 120533 - DNA, 23 bp, Homo sapiens
atgtgtgtatatatatatgtgtg

SEQ ID NO: 120534 - DNA, 23 bp, Homo sapiens
tatgtgtatgtatacatatatgt

SEQ ID NO: 120535 - DNA, 21 bp, Homo sapiens
tcactgagctagtactatgtg

SEQ ID NO: 120536 - DNA, 21 bp, Homo sapiens
tattgattgaaattgcattga

SEQ ID NO: 120537 - DNA, 19 bp, Homo sapiens
gagaggtgacagtgtgcag

SEQ ID NO: 120538 - DNA, 21 bp, Homo sapiens
aacatccgtacaagttggtgt

SEQ ID NO: 120539 - DNA, 23 bp, Homo sapiens
cactgcatgttgcttgtatagat

SEQ ID NO: 120540 - DNA, 23 bp, Homo sapiens
tgagttcattgtagattctggat

SEQ ID NO: 120541 - DNA, 23 bp, Homo sapiens
tgagttcattgtagattctggat

SEQ ID NO: 120542 - DNA, 22 bp, Homo sapiens
tatatatgcatatctatctata

SEQ ID NO: 120543 - DNA, 23 bp, Homo sapiens
tgagttcattgtagattctggat

SEQ ID NO: 120544 - DNA, 23 bp, Homo sapiens
tgagttcattgtagattctggat

SEQ ID NO: 120545 - DNA, 23 bp, Homo sapiens
agaatgctttcaacttttcctca

SEQ ID NO: 120546 - DNA, 23 bp, Homo sapiens
tgagttcattgtagattctggat

SEQ ID NO: 120547 - DNA, 23 bp, Homo sapiens
tgagttcattgtagattctggat

SEQ ID NO: 120548 - DNA, 18 bp, Homo sapiens
acaagaaggtaggtgtct

SEQ ID NO: 120549 - DNA, 20 bp, Homo sapiens
tatacacgtgtatatgtaca

SEQ ID NO: 120550 - DNA, 18 bp, Homo sapiens
aaaactctgctaatcaga

SEQ ID NO: 120551 - DNA, 20 bp, Homo sapiens
cagaaatttgttatctcatg

SEQ ID NO: 120552 - DNA, 22 bp, Homo sapiens
ttggaccaaataaaatctgtat

SEQ ID NO: 120553 - DNA, 23 bp, Homo sapiens
tcttcagtgcctgtgtgtgtggc

SEQ ID NO: 120554 - DNA, 23 bp, Homo sapiens
tcattcactgattagagagctca

SEQ ID NO: 120555 - DNA, 20 bp, Homo sapiens
tttccctctgctacaggagg

SEQ ID NO: 120556 - DNA, 23 bp, Homo sapiens
tttcactgtatgtcaattttacc

SEQ ID NO: 120557 - DNA, 23 bp, Homo sapiens
agacagagtctcactctgtcgca

SEQ ID NO: 120558 - DNA, 21 bp, Homo sapiens
tatacgtatatatacatatgt

SEQ ID NO: 120559 - DNA, 23 bp, Homo sapiens
gctgaggtaggaggatcacttga

SEQ ID NO: 120560 - DNA, 19 bp, Homo sapiens
atctacatagatgtagttc

SEQ ID NO: 120561 - DNA, 20 bp, Homo sapiens
tacacaacagtgtgtccact

SEQ ID NO: 120562 - DNA, 23 bp, Homo sapiens
ctatgtgtgtgtgtgtatatggg

SEQ ID NO: 120563 - DNA, 23 bp, Homo sapiens
aggatgagaaggcctgtgtgtgt

SEQ ID NO: 120564 - DNA, 23 bp, Homo sapiens
ttcatgctgctcagtgactgtca

SEQ ID NO: 120565 - DNA, 23 bp, Homo sapiens
tggtatatatacaccacagtttc

SEQ ID NO: 120566 - DNA, 21 bp, Homo sapiens
tatactgtatatatatacact

SEQ ID NO: 120567 - DNA, 22 bp, Homo sapiens
tgaggtagaaggatcatttgag

SEQ ID NO: 120568 - DNA, 23 bp, Homo sapiens
tgtatgtgtatatgtatatgtgt

SEQ ID NO: 120569 - DNA, 23 bp, Homo sapiens
atatacacatatacatatacaca

SEQ ID NO: 120570 - DNA, 23 bp, Homo sapiens
tgagttcattgtagattctggat

SEQ ID NO: 120571 - DNA, 23 bp, Homo sapiens
tgagttcattgtagattctggat

SEQ ID NO: 120572 - DNA, 18 bp, Homo sapiens
tcactgcagcctctgtct

SEQ ID NO: 120573 - DNA, 23 bp, Homo sapiens
tgtgtgtctgtgtgcctgcgtgt

SEQ ID NO: 120574 - DNA, 23 bp, Homo sapiens
gcgtgtgtgtgtgcatgtgtgtg

SEQ ID NO: 120575 - DNA, 18 bp, Homo sapiens
caaagtcttctctgtcct

SEQ ID NO: 120576 - DNA, 23 bp, Homo sapiens
tgtgtgtatatatatatgtgtgt

SEQ ID NO: 120577 - DNA, 23 bp, Homo sapiens
tttgtgactgaagattctgagat

SEQ ID NO: 120578 - DNA, 23 bp, Homo sapiens
aggtgtcaacagacctggtgtct

SEQ ID NO: 120579 - DNA, 23 bp, Homo sapiens
tcctggtttgtagacggctatct

SEQ ID NO: 120580 - DNA, 23 bp, Homo sapiens
tacatgtatataccacattttgt

SEQ ID NO: 120581 - DNA, 23 bp, Homo sapiens
agatggagtctctctctgtcacc

SEQ ID NO: 120582 - DNA, 22 bp, Homo sapiens
gaaaatctaggcataagtgtgc

SEQ ID NO: 120583 - DNA, 23 bp, Homo sapiens
ggatcgcttgagtctaggagttc

SEQ ID NO: 120584 - DNA, 21 bp, Homo sapiens
tgtctgtttgtctaatatctc

SEQ ID NO: 120585 - DNA, 22 bp, Homo sapiens
tatattgtagatactgtagagg

SEQ ID NO: 120586 - DNA, 20 bp, Homo sapiens
tgtgtgaagacagtgtggtc

SEQ ID NO: 120587 - DNA, 23 bp, Homo sapiens
tcacactcattctctgtccagat

SEQ ID NO: 120588 - DNA, 23 bp, Homo sapiens
aggagttgtgatcctttggagga

SEQ ID NO: 120589 - DNA, 23 bp, Homo sapiens
tatatgcatatatactggtattt

SEQ ID NO: 120590 - DNA, 23 bp, Homo sapiens
tgagttcattgtagattctggat

SEQ ID NO: 120591 - DNA, 23 bp, Homo sapiens
tgagttcattgtagattctggat

SEQ ID NO: 120592 - DNA, 23 bp, Homo sapiens
gtgtatatatatacacatacaca

SEQ ID NO: 120593 - DNA, 22 bp, Homo sapiens
tatgtgtatgtatatcctgtgt

SEQ ID NO: 120594 - DNA, 18 bp, Homo sapiens
ggagctctctgatgttgg

SEQ ID NO: 120595 - DNA, 23 bp, Homo sapiens
aagtgagattctacaaagctagg

SEQ ID NO: 120596 - DNA, 21 bp, Homo sapiens
atatgtgtatatatatacacg

SEQ ID NO: 120597 - DNA, 22 bp, Homo sapiens
ctcactcagtcactcaggttgg

SEQ ID NO: 120598 - DNA, 23 bp, Homo sapiens
acagagtctcactctgtcaccca

SEQ ID NO: 120599 - DNA, 23 bp, Homo sapiens
atatatacttgtgtgtgtgtgtg

SEQ ID NO: 120600 - DNA, 23 bp, Homo sapiens
atatgtaagtatacctatgtgta

SEQ ID NO: 120601 - DNA, 22 bp, Homo sapiens
gtgtgtgtgtgtacctgtgtgt

SEQ ID NO: 120602 - DNA, 19 bp, Homo sapiens
atgtatatacatgtatgtg

SEQ ID NO: 120603 - DNA, 21 bp, Homo sapiens
tgtgtgtatatatatatctga

SEQ ID NO: 120604 - DNA, 23 bp, Homo sapiens
gagatggagtctcactctgtcac

SEQ ID NO: 120605 - DNA, 23 bp, Homo sapiens
ttacagacaagacagaaggacca

SEQ ID NO: 120606 - DNA, 23 bp, Homo sapiens
tgttcagtcctacttaattcgtt

SEQ ID NO: 120607 - DNA, 18 bp, Homo sapiens
atgtgtatatatatacgt

SEQ ID NO: 120608 - DNA, 21 bp, Homo sapiens
actcagtctgacttggatggc

SEQ ID NO: 120609 - DNA, 23 bp, Homo sapiens
tatgtgtatatatatacgtgtgt

SEQ ID NO: 120610 - DNA, 23 bp, Homo sapiens
ggagtctcactctgtctcccagg

SEQ ID NO: 120611 - DNA, 22 bp, Homo sapiens
tctcactcactgagtgctcaat

SEQ ID NO: 120612 - DNA, 23 bp, Homo sapiens
tttcagtgagctatgattgcact

SEQ ID NO: 120613 - DNA, 20 bp, Homo sapiens
tacatacacgcatacatacg

SEQ ID NO: 120614 - DNA, 23 bp, Homo sapiens
gggtctctctctctctctggccc

SEQ ID NO: 120615 - DNA, 23 bp, Homo sapiens
agagtctcactctgtcacccagg

SEQ ID NO: 120616 - DNA, 21 bp, Homo sapiens
agagttgagacagatactgct

SEQ ID NO: 120617 - DNA, 23 bp, Homo sapiens
cggagtctcactctgtcacccag

SEQ ID NO: 120618 - DNA, 23 bp, Homo sapiens
gagtctcactctgtcacccaggc

SEQ ID NO: 120619 - DNA, 23 bp, Homo sapiens
tcattgttggctgagccagagtc

SEQ ID NO: 120620 - DNA, 18 bp, Homo sapiens
agtgagtggctgcacagt

SEQ ID NO: 120621 - DNA, 22 bp, Homo sapiens
gattcctgaggagaccgtggag

SEQ ID NO: 120622 - DNA, 23 bp, Homo sapiens
tgtccctcagaatgttcctgctg

SEQ ID NO: 120623 - DNA, 18 bp, Homo sapiens
cacaatatttgtttatca

SEQ ID NO: 120624 - DNA, 22 bp, Homo sapiens
tgactgagagcaattcatgtga

SEQ ID NO: 120625 - DNA, 23 bp, Homo sapiens
tgacaacatccctgtgggtgcgt

SEQ ID NO: 120626 - DNA, 23 bp, Homo sapiens
cgctgtctccctcgctctgtgcg

SEQ ID NO: 120627 - DNA, 21 bp, Homo sapiens
tcaggctctctcagtggacag

SEQ ID NO: 120628 - DNA, 23 bp, Homo sapiens
ccaagtgttatgcctttggtttc

SEQ ID NO: 120629 - DNA, 22 bp, Homo sapiens
catttgtttggatgtatatatg

SEQ ID NO: 120630 - DNA, 22 bp, Homo sapiens
actctcactccctctctacact

SEQ ID NO: 120631 - DNA, 23 bp, Homo sapiens
gctaattttttgtatttttagca

SEQ ID NO: 120632 - DNA, 18 bp, Homo sapiens
taagtgtgttaggggaag

SEQ ID NO: 120633 - DNA, 18 bp, Homo sapiens
tgtcagtcaagacaaggg

SEQ ID NO: 120634 - DNA, 19 bp, Homo sapiens
cacagaagtttgtcagctc

SEQ ID NO: 120635 - DNA, 22 bp, Homo sapiens
aacattcttgttcttctttcct

SEQ ID NO: 120636 - DNA, 23 bp, Homo sapiens
tgaccctgagaccttgtgttctc

SEQ ID NO: 120637 - DNA, 23 bp, Homo sapiens
tagacagatcacacagagcacct

SEQ ID NO: 120638 - DNA, 19 bp, Homo sapiens
tgtcgtacgttctatgtga

SEQ ID NO: 120639 - DNA, 22 bp, Homo sapiens
gagaggaagtctcactctgtca

SEQ ID NO: 120640 - DNA, 21 bp, Homo sapiens
agtggtctaaatggtctcaga

SEQ ID NO: 120641 - DNA, 23 bp, Homo sapiens
atgctagtccacaggcagtgaca

SEQ ID NO: 120642 - DNA, 23 bp, Homo sapiens
tattccacagagaggaaggtgtt

SEQ ID NO: 120643 - DNA, 22 bp, Homo sapiens
ctgaggtagcaggatcacttga

SEQ ID NO: 120644 - DNA, 23 bp, Homo sapiens
gagacggagtctcgctctgtctc

SEQ ID NO: 120645 - DNA, 23 bp, Homo sapiens
ttttactgtctgctctttctggc

SEQ ID NO: 120646 - DNA, 19 bp, Homo sapiens
tgaggctgggtgtggtggc

SEQ ID NO: 120647 - DNA, 23 bp, Homo sapiens
tgcctgggtgcgtgacacccagc

SEQ ID NO: 120648 - DNA, 18 bp, Homo sapiens
tgcaaatatatatggtct

SEQ ID NO: 120649 - DNA, 22 bp, Homo sapiens
atatatgtacacatacacatgt

SEQ ID NO: 120650 - DNA, 23 bp, Homo sapiens
tatatgtacatataggtataatt

SEQ ID NO: 120651 - DNA, 23 bp, Homo sapiens
tcattatttgtttataaacctga

SEQ ID NO: 120652 - DNA, 23 bp, Homo sapiens
aggcacactcagtgtgacttcac

SEQ ID NO: 120653 - DNA, 23 bp, Homo sapiens
tacagcattgtttttgtctgagt

SEQ ID NO: 120654 - DNA, 23 bp, Homo sapiens
accctgtgaagttagcagattgc

SEQ ID NO: 120655 - DNA, 20 bp, Homo sapiens
atttgttttatttatttgct

SEQ ID NO: 120656 - DNA, 23 bp, Homo sapiens
tgagttcattgtagattctggat

SEQ ID NO: 120657 - DNA, 23 bp, Homo sapiens
tgagttcattgtagattctggat

SEQ ID NO: 120658 - DNA, 23 bp, Homo sapiens
aagcttcaataagtaaagagact

SEQ ID NO: 120659 - DNA, 20 bp, Homo sapiens
acatctacatatgtatatat

SEQ ID NO: 120660 - DNA, 23 bp, Homo sapiens
taaagcatgtatttactatagta

SEQ ID NO: 120661 - DNA, 18 bp, Homo sapiens
tgtattgtatacatgtat

SEQ ID NO: 120662 - DNA, 21 bp, Homo sapiens
tatgtgtgtggatgtatatgg

SEQ ID NO: 120663 - DNA, 20 bp, Homo sapiens
atgtgagatatatatatgag

SEQ ID NO: 120664 - DNA, 23 bp, Homo sapiens
aataggctttctatagttctttg

SEQ ID NO: 120665 - DNA, 23 bp, Homo sapiens
ttgattttagctttagtaggttt

SEQ ID NO: 120666 - DNA, 23 bp, Homo sapiens
actgagtctcactctgtctccag

SEQ ID NO: 120667 - DNA, 23 bp, Homo sapiens
gcagagtctcactctgtcaccca

SEQ ID NO: 120668 - DNA, 20 bp, Homo sapiens
agtgggatgatcttggctca

SEQ ID NO: 120669 - DNA, 20 bp, Homo sapiens
gctctggctcacttatcctt

SEQ ID NO: 120670 - DNA, 23 bp, Homo sapiens
atccttcctgtttttctagttgt

SEQ ID NO: 120671 - DNA, 22 bp, Homo sapiens
tgactgggttttgtaaaaatga

SEQ ID NO: 120672 - DNA, 23 bp, Homo sapiens
tgtctggtagtttatttaattct

SEQ ID NO: 120673 - DNA, 22 bp, Homo sapiens
gtctcactctgtcactcaggct

SEQ ID NO: 120674 - DNA, 23 bp, Homo sapiens
tgtctctctgtctctctctgaca

SEQ ID NO: 120675 - DNA, 23 bp, Homo sapiens
tatatatcctactgtgtgtatat

SEQ ID NO: 120676 - DNA, 18 bp, Homo sapiens
tatatatcctagagtgtg

SEQ ID NO: 120677 - DNA, 23 bp, Homo sapiens
tatatctctatggaatatatatg

SEQ ID NO: 120678 - DNA, 18 bp, Homo sapiens
tatatatctctatggaat

SEQ ID NO: 120679 - DNA, 22 bp, Homo sapiens
tatggatagatatgtatagata

SEQ ID NO: 120680 - DNA, 22 bp, Homo sapiens
tatggatagatatgtatagata

SEQ ID NO: 120681 - DNA, 23 bp, Homo sapiens
tctatggatagatatgtatagat

SEQ ID NO: 120682 - DNA, 23 bp, Homo sapiens
tctgaggttgcagtgagttatga

SEQ ID NO: 120683 - DNA, 18 bp, Homo sapiens
gaatgtaatgaagcatct

SEQ ID NO: 120684 - DNA, 21 bp, Homo sapiens
gtatgtatgtatatgtgtgtg

SEQ ID NO: 120685 - DNA, 23 bp, Homo sapiens
tgagttcattgtagattctggat

SEQ ID NO: 120686 - DNA, 23 bp, Homo sapiens
tgagttcattgtagattctggat

SEQ ID NO: 120687 - DNA, 23 bp, Homo sapiens
tgagttcattgtagattctggat

SEQ ID NO: 120688 - DNA, 23 bp, Homo sapiens
tgagttcattgtagattctggat

SEQ ID NO: 120689 - DNA, 23 bp, Homo sapiens
ttcagaggctgttttctttctgt

SEQ ID NO: 120690 - DNA, 23 bp, Homo sapiens
atgagagttgagacagtgctgaa

SEQ ID NO: 120691 - DNA, 23 bp, Homo sapiens
tggagtctcactctgtcacccag

SEQ ID NO: 120692 - DNA, 22 bp, Homo sapiens
tacagtgagctatgattgtgtc

SEQ ID NO: 120693 - DNA, 21 bp, Homo sapiens
agggtcccgtgcttcatcctg

SEQ ID NO: 120694 - DNA, 23 bp, Homo sapiens
gacacttctatggatttgctatg

SEQ ID NO: 120695 - DNA, 21 bp, Homo sapiens
tagagttctagtgctcctgga

SEQ ID NO: 120696 - DNA, 23 bp, Homo sapiens
aacaatctgagctaaggttgcat

SEQ ID NO: 120697 - DNA, 22 bp, Homo sapiens
taagagtttgaagatttgggct

SEQ ID NO: 120698 - DNA, 22 bp, Homo sapiens
tataaggctgataatgatatac

SEQ ID NO: 120699 - DNA, 21 bp, Homo sapiens
tgtgaagaaagtcattggtag

SEQ ID NO: 120700 - DNA, 21 bp, Homo sapiens
tgtgagctgagattgctcttc

SEQ ID NO: 120701 - DNA, 18 bp, Homo sapiens
tatgtgtgtgatgtgtgt

SEQ ID NO: 120702 - DNA, 23 bp, Homo sapiens
ttacatgtatatgtatgtgtgtg

SEQ ID NO: 120703 - DNA, 22 bp, Homo sapiens
acacacacaccattacgtgtgt

SEQ ID NO: 120704 - DNA, 23 bp, Homo sapiens
ctgagcttgtaaactctggatga

SEQ ID NO: 120705 - DNA, 23 bp, Homo sapiens
cagaagaaacagaaacagcttcc

SEQ ID NO: 120706 - DNA, 23 bp, Homo sapiens
tctgtgcctctgtgcctgctact

SEQ ID NO: 120707 - DNA, 21 bp, Homo sapiens
tatatgcaaatatatacatat

SEQ ID NO: 120708 - DNA, 22 bp, Homo sapiens
gtatggtattcattttgtaatt

SEQ ID NO: 120709 - DNA, 23 bp, Homo sapiens
atcagtactgaatgaaacctcaa

SEQ ID NO: 120710 - DNA, 22 bp, Homo sapiens
catgaagcacacattcctatct

SEQ ID NO: 120711 - DNA, 23 bp, Homo sapiens
tgtctgatgtgagtgtgcagaag

SEQ ID NO: 120712 - DNA, 20 bp, Homo sapiens
tatatatgtgtatgtatatg

SEQ ID NO: 120713 - DNA, 18 bp, Homo sapiens
aactctatatggctttca

SEQ ID NO: 120714 - DNA, 22 bp, Homo sapiens
atagaatgtgtgataatcaggt

SEQ ID NO: 120715 - DNA, 23 bp, Homo sapiens
gcacatatgtgtgtgtatatgaa

SEQ ID NO: 120716 - DNA, 18 bp, Homo sapiens
tctcgctctctcgctcag

SEQ ID NO: 120717 - DNA, 23 bp, Homo sapiens
tgtatatgtgtgtatgtgtatac

SEQ ID NO: 120718 - DNA, 23 bp, Homo sapiens
tgagttcattgtagattctggat

SEQ ID NO: 120719 - DNA, 23 bp, Homo sapiens
tgagttcattgtagattctggat

SEQ ID NO: 120720 - DNA, 23 bp, Homo sapiens
ggagtctcactctgtcacccagc

SEQ ID NO: 120721 - DNA, 23 bp, Homo sapiens
tcactacttccatctatgtgtaa

SEQ ID NO: 120722 - DNA, 20 bp, Homo sapiens
acactagtgtatatgtatat

SEQ ID NO: 120723 - DNA, 23 bp, Homo sapiens
tatgtatatatacatatgagatt

SEQ ID NO: 120724 - DNA, 23 bp, Homo sapiens
tacacacatatattgaatactga

SEQ ID NO: 120725 - DNA, 23 bp, Homo sapiens
atatgtgtgtagttatcaagagg

SEQ ID NO: 120726 - DNA, 23 bp, Homo sapiens
caacagtattcataggaaattga

SEQ ID NO: 120727 - DNA, 23 bp, Homo sapiens
aaaatgtctgttgtaaagataaa

SEQ ID NO: 120728 - DNA, 20 bp, Homo sapiens
tgtgtatatatatatgtgtg

SEQ ID NO: 120729 - DNA, 19 bp, Homo sapiens
atatctatatatatatgtg

SEQ ID NO: 120730 - DNA, 22 bp, Homo sapiens
tacatacaatgaatatgtaatg

SEQ ID NO: 120731 - DNA, 21 bp, Homo sapiens
tgtctgtctgtctgggcttta

SEQ ID NO: 120732 - DNA, 23 bp, Homo sapiens
atgaagtctcactctgtcactca

SEQ ID NO: 120733 - DNA, 22 bp, Homo sapiens
gcagacactgtttagtgaggag

SEQ ID NO: 120734 - DNA, 18 bp, Homo sapiens
atgctatagatatgcaat

SEQ ID NO: 120735 - DNA, 23 bp, Homo sapiens
ttttttggttccatatgaaattt

SEQ ID NO: 120736 - DNA, 23 bp, Homo sapiens
ttctgtggaaaaggcaatggtag

SEQ ID NO: 120737 - DNA, 20 bp, Homo sapiens
acaggaggctgaggtaggag

SEQ ID NO: 120738 - DNA, 20 bp, Homo sapiens
atgtatgtatatatgtatac

SEQ ID NO: 120739 - DNA, 21 bp, Homo sapiens
agatctatatctatatagaga

SEQ ID NO: 120740 - DNA, 22 bp, Homo sapiens
agatctatatagatatagatct

SEQ ID NO: 120741 - DNA, 21 bp, Homo sapiens
atctctatagaagatctatat

SEQ ID NO: 120742 - DNA, 23 bp, Homo sapiens
tatttctatagatctatttgtag

SEQ ID NO: 120743 - DNA, 22 bp, Homo sapiens
tatgtgtatatatatatatgtg

SEQ ID NO: 120744 - DNA, 21 bp, Homo sapiens
tatacatatacatatgtgtgt

SEQ ID NO: 120745 - DNA, 21 bp, Homo sapiens
tgtgtgtctgtgtatatgtgt

SEQ ID NO: 120746 - DNA, 23 bp, Homo sapiens
tgagttcattgtagattctggat

SEQ ID NO: 120747 - DNA, 23 bp, Homo sapiens
tgagttcattgtagattctggat

SEQ ID NO: 120748 - DNA, 22 bp, Homo sapiens
accagcacctgaagatagggct

SEQ ID NO: 120749 - DNA, 23 bp, Homo sapiens
cagaggaagattagagagatacc

SEQ ID NO: 120750 - DNA, 18 bp, Homo sapiens
attaggaaagtaatctgg

SEQ ID NO: 120751 - DNA, 23 bp, Homo sapiens
atgtatacatattttgtatatgt

SEQ ID NO: 120752 - DNA, 23 bp, Homo sapiens
tatatgtatatgtgtatatgtat

SEQ ID NO: 120753 - DNA, 22 bp, Homo sapiens
tctgcgggtttaaatgtactat

SEQ ID NO: 120754 - DNA, 21 bp, Homo sapiens
tgcattggaaagagcactcta

SEQ ID NO: 120755 - DNA, 20 bp, Homo sapiens
tctataaatatgtagatcta

SEQ ID NO: 120756 - DNA, 23 bp, Homo sapiens
attgatatagagataggtataga

SEQ ID NO: 120757 - DNA, 23 bp, Homo sapiens
tatcaggttgtactcagtattgt

SEQ ID NO: 120758 - DNA, 23 bp, Homo sapiens
tttggttccatatgaattgtaaa

SEQ ID NO: 120759 - DNA, 23 bp, Homo sapiens
ttctgtgaagaatgtcaattgta

SEQ ID NO: 120760 - DNA, 23 bp, Homo sapiens
gaagactgtgtgcactgttgcac

SEQ ID NO: 120761 - DNA, 19 bp, Homo sapiens
aaacctatagttccaccta

SEQ ID NO: 120762 - DNA, 21 bp, Homo sapiens
atagttcttctcatatctttt

SEQ ID NO: 120763 - DNA, 23 bp, Homo sapiens
ttatgtttaaaacatgtactggt

SEQ ID NO: 120764 - DNA, 23 bp, Homo sapiens
ggagtctctctctgtcacccagg

SEQ ID NO: 120765 - DNA, 23 bp, Homo sapiens
gtttggaatttttagcagatttt

SEQ ID NO: 120766 - DNA, 23 bp, Homo sapiens
cacagtgtctctgaggtatgcca

SEQ ID NO: 120767 - DNA, 20 bp, Homo sapiens
agagcagaatgtgtgtgtgt

SEQ ID NO: 120768 - DNA, 23 bp, Homo sapiens
agtttggctggatatcaaattct

SEQ ID NO: 120769 - DNA, 23 bp, Homo sapiens
agagaaggctttgagtgagtctg

SEQ ID NO: 120770 - DNA, 20 bp, Homo sapiens
tgtgtgtgtgtatatatata

SEQ ID NO: 120771 - DNA, 20 bp, Homo sapiens
tagatacacacacatataca

SEQ ID NO: 120772 - DNA, 23 bp, Homo sapiens
ctcccagagcccctggaactctg

SEQ ID NO: 120773 - DNA, 23 bp, Homo sapiens
tcccagagcccctggaactctgg

SEQ ID NO: 120774 - DNA, 23 bp, Homo sapiens
tcccagagcccctggaactctgg

SEQ ID NO: 120775 - DNA, 23 bp, Homo sapiens
tcccagagcccctggaactctgg

SEQ ID NO: 120776 - DNA, 19 bp, Homo sapiens
tctgactgactccttcgca

SEQ ID NO: 120777 - DNA, 20 bp, Homo sapiens
atcatttgtgtattagttgt

SEQ ID NO: 120778 - DNA, 20 bp, Homo sapiens
tgaagattcagtactgcaca

SEQ ID NO: 120779 - DNA, 22 bp, Homo sapiens
tgacagactgattctgaaattc

SEQ ID NO: 120780 - DNA, 23 bp, Homo sapiens
tgagttcattgtagattctggat

SEQ ID NO: 120781 - DNA, 23 bp, Homo sapiens
tgagttcattgtagattctggat

SEQ ID NO: 120782 - DNA, 20 bp, Homo sapiens
tttcaggtagatagagagga

SEQ ID NO: 120783 - DNA, 21 bp, Homo sapiens
atatgcatatatgtatatatg

SEQ ID NO: 120784 - DNA, 22 bp, Homo sapiens
gtatatatatgtatgtgtatgt

SEQ ID NO: 120785 - DNA, 23 bp, Homo sapiens
tgtgtgtatatatatgtgtgtgt

SEQ ID NO: 120786 - DNA, 23 bp, Homo sapiens
acatgttgttcatccctgaattt

SEQ ID NO: 120787 - DNA, 21 bp, Homo sapiens
tgtcacactccaatgcctctc

SEQ ID NO: 120788 - DNA, 23 bp, Homo sapiens
tgagtctgtgtgtgtgtccaggg

SEQ ID NO: 120789 - DNA, 21 bp, Homo sapiens
ctcagacattctgtctcacta

SEQ ID NO: 120790 - DNA, 23 bp, Homo sapiens
tgagttcattgtagattctggat

SEQ ID NO: 120791 - DNA, 23 bp, Homo sapiens
tgagttcattgtagattctggat

SEQ ID NO: 120792 - DNA, 22 bp, Homo sapiens
tctcactctgtcacccaggctg

SEQ ID NO: 120793 - DNA, 23 bp, Homo sapiens
ttccactcccactttcctgatga

SEQ ID NO: 120794 - DNA, 21 bp, Homo sapiens
agaccaactgaattcacacag

SEQ ID NO: 120795 - DNA, 23 bp, Homo sapiens
gaagacagtgtgcacagttggtc

SEQ ID NO: 120796 - DNA, 20 bp, Homo sapiens
ttgtcagactgtaaatcatc

SEQ ID NO: 120797 - DNA, 22 bp, Homo sapiens
tatgtacatatatatacacata

SEQ ID NO: 120798 - DNA, 21 bp, Homo sapiens
aaaccagagggaatcttgaca

SEQ ID NO: 120799 - DNA, 23 bp, Homo sapiens
atgagtcactctttctaaaagtg

SEQ ID NO: 120800 - DNA, 23 bp, Homo sapiens
tctcagtcactgatatggttggg

SEQ ID NO: 120801 - DNA, 23 bp, Homo sapiens
acagagtctcactctgtcgccca

SEQ ID NO: 120802 - DNA, 23 bp, Homo sapiens
atctatctgtttatctatctatc

SEQ ID NO: 120803 - DNA, 21 bp, Homo sapiens
taacccttcttattcctgtga

SEQ ID NO: 120804 - DNA, 21 bp, Homo sapiens
tggttgtgtgcttatatgcag

SEQ ID NO: 120805 - DNA, 23 bp, Homo sapiens
agagtagtgtttaagttcaggtg

SEQ ID NO: 120806 - DNA, 23 bp, Homo sapiens
tgagttcattgtagattctggat

SEQ ID NO: 120807 - DNA, 23 bp, Homo sapiens
tgagttcattgtagattctggat

SEQ ID NO: 120808 - DNA, 20 bp, Homo sapiens
tctgtgttttactgtctgct

SEQ ID NO: 120809 - DNA, 23 bp, Homo sapiens
atatatctggatatacatagata

SEQ ID NO: 120810 - DNA, 20 bp, Homo sapiens
tatctctatgtatatccaga

SEQ ID NO: 120811 - DNA, 18 bp, Homo sapiens
attggatatatatcctat

SEQ ID NO: 120812 - DNA, 19 bp, Homo sapiens
aacagtactgaactcctag

SEQ ID NO: 120813 - DNA, 23 bp, Homo sapiens
gtgtgtgtgtgtgtaattcaaga

SEQ ID NO: 120814 - DNA, 23 bp, Homo sapiens
ttctctgaccatgttcttcactg

SEQ ID NO: 120815 - DNA, 23 bp, Homo sapiens
tgagttcattgtagattctggat

SEQ ID NO: 120816 - DNA, 23 bp, Homo sapiens
tgagttcattgtagattctggat

SEQ ID NO: 120817 - DNA, 23 bp, Homo sapiens
tatttgcatgtatacataaatag

SEQ ID NO: 120818 - DNA, 21 bp, Homo sapiens
acagtctttgttgatctgtta

SEQ ID NO: 120819 - DNA, 21 bp, Homo sapiens
taacagatcaataacagttgt

SEQ ID NO: 120820 - DNA, 23 bp, Homo sapiens
aaatgtctatatatatttgtcac

SEQ ID NO: 120821 - DNA, 23 bp, Homo sapiens
agattagtctagtttttcctctg

SEQ ID NO: 120822 - DNA, 19 bp, Homo sapiens
aaggagtcaaggtggtctc

SEQ ID NO: 120823 - DNA, 18 bp, Homo sapiens
catttattttctataagg

SEQ ID NO: 120824 - DNA, 23 bp, Homo sapiens
tcactctttctctgactccaagc

SEQ ID NO: 120825 - DNA, 20 bp, Homo sapiens
atatatacacatatacatgt

SEQ ID NO: 120826 - DNA, 20 bp, Homo sapiens
tatacatatgtatgcataca

SEQ ID NO: 120827 - DNA, 23 bp, Homo sapiens
gtatgtatatatgtatgtatatg

SEQ ID NO: 120828 - DNA, 23 bp, Homo sapiens
tgtgtggaatgatggctggagtt

SEQ ID NO: 120829 - DNA, 20 bp, Homo sapiens
tgtgtatatatatgtgtgta

SEQ ID NO: 120830 - DNA, 23 bp, Homo sapiens
atatacacacacatatatgtgtg

SEQ ID NO: 120831 - DNA, 23 bp, Homo sapiens
gagtctcactctgtcacccaggc

SEQ ID NO: 120832 - DNA, 23 bp, Homo sapiens
tgagtctcgcactgtctcccagg

SEQ ID NO: 120833 - DNA, 23 bp, Homo sapiens
aagtgagtgggtggaatttttgg

SEQ ID NO: 120834 - DNA, 19 bp, Homo sapiens
tgagggggaaattgtgctc

SEQ ID NO: 120835 - DNA, 19 bp, Homo sapiens
tgagcattttttttttttt

SEQ ID NO: 120836 - DNA, 23 bp, Homo sapiens
ggttgtcaggaggattttgtgag

SEQ ID NO: 120837 - DNA, 21 bp, Homo sapiens
tgcaaaatattgtcattggag

SEQ ID NO: 120838 - DNA, 23 bp, Homo sapiens
cagtgtctctctgtaatgcttct

SEQ ID NO: 120839 - DNA, 23 bp, Homo sapiens
acagaatctcactctgtcaccca

SEQ ID NO: 120840 - DNA, 23 bp, Homo sapiens
tgcagtggcatgatcttggctca

SEQ ID NO: 120841 - DNA, 23 bp, Homo sapiens
atcagtctctgtgctgatgctga

SEQ ID NO: 120842 - DNA, 20 bp, Homo sapiens
ctcgctctgtcactcaggct

SEQ ID NO: 120843 - DNA, 23 bp, Homo sapiens
tgagttcattgtagattctggat

SEQ ID NO: 120844 - DNA, 23 bp, Homo sapiens
tgagttcattgtagattctggat

SEQ ID NO: 120845 - DNA, 23 bp, Homo sapiens
aaacagaagacagtctgtactct

SEQ ID NO: 120846 - DNA, 21 bp, Homo sapiens
ttctgagagaaacagatgact

SEQ ID NO: 120847 - DNA, 18 bp, Homo sapiens
aggaaaattaatatgact

SEQ ID NO: 120848 - DNA, 20 bp, Homo sapiens
acagtgatgattctcagcac

SEQ ID NO: 120849 - DNA, 23 bp, Homo sapiens
tgtctgtgtgtttgctccaagat

SEQ ID NO: 120850 - DNA, 22 bp, Homo sapiens
tgtcaccaggcttgagtgcagt

SEQ ID NO: 120851 - DNA, 21 bp, Homo sapiens
tacacgtacacatacatacag

SEQ ID NO: 120852 - DNA, 21 bp, Homo sapiens
tatatgtgtttgtatgtgaat

SEQ ID NO: 120853 - DNA, 23 bp, Homo sapiens
tgtcacagtctgactcagtgact

SEQ ID NO: 120854 - DNA, 23 bp, Homo sapiens
cggagtctcactctgtcacccag

SEQ ID NO: 120855 - DNA, 22 bp, Homo sapiens
atacatagctatgcatatatat

SEQ ID NO: 120856 - DNA, 18 bp, Homo sapiens
tgctgattaccatggcta

SEQ ID NO: 120857 - DNA, 19 bp, Homo sapiens
tcactgcaatctctgtctc

SEQ ID NO: 120858 - DNA, 19 bp, Homo sapiens
actggccaatgagactttc

SEQ ID NO: 120859 - DNA, 23 bp, Homo sapiens
gagatggagtctcactctgtcac

SEQ ID NO: 120860 - DNA, 22 bp, Homo sapiens
taatgtcaatggtagtttaagg

SEQ ID NO: 120861 - DNA, 23 bp, Homo sapiens
tgagttcattgtagattctggat

SEQ ID NO: 120862 - DNA, 23 bp, Homo sapiens
tgagttcattgtagattctggat

SEQ ID NO: 120863 - DNA, 23 bp, Homo sapiens
agctgagtgatcacactgtggta

SEQ ID NO: 120864 - DNA, 23 bp, Homo sapiens
tgagttcattgtagattctggat

SEQ ID NO: 120865 - DNA, 23 bp, Homo sapiens
tgagttcattgtagattctggat

SEQ ID NO: 120866 - DNA, 22 bp, Homo sapiens
tgcctcaagagactgtggacta

SEQ ID NO: 120867 - DNA, 22 bp, Homo sapiens
tgtgtacatgtatgtgtgttca

SEQ ID NO: 120868 - DNA, 23 bp, Homo sapiens
gagtctcactctgtcacccaggc

SEQ ID NO: 120869 - DNA, 23 bp, Homo sapiens
tgagttcattgtagattctggat

SEQ ID NO: 120870 - DNA, 23 bp, Homo sapiens
tgagttcattgtagattctggat

SEQ ID NO: 120871 - DNA, 23 bp, Homo sapiens
tctgactgtgggtgtagtttatg

SEQ ID NO: 120872 - DNA, 23 bp, Homo sapiens
aactcactaggacccaatgtgag

SEQ ID NO: 120873 - DNA, 18 bp, Homo sapiens
gtttatatatatgtgtgt

SEQ ID NO: 120874 - DNA, 18 bp, Homo sapiens
tatagataaatagtatat

SEQ ID NO: 120875 - DNA, 23 bp, Homo sapiens
tgtagagtgtctgcattaccttc

SEQ ID NO: 120876 - DNA, 21 bp, Homo sapiens
tcttaacatcctactctctgg

SEQ ID NO: 120877 - DNA, 19 bp, Homo sapiens
agtgcagttgcacaatcat

SEQ ID NO: 120878 - DNA, 21 bp, Homo sapiens
tgtgatatatatgctattaaa

SEQ ID NO: 120879 - DNA, 22 bp, Homo sapiens
tatatatgtgctattaaatgtg

SEQ ID NO: 120880 - DNA, 21 bp, Homo sapiens
tggaaagaaaagtagtaagtt

SEQ ID NO: 120881 - DNA, 23 bp, Homo sapiens
tttgtgcttgagaatggcattgc

SEQ ID NO: 120882 - DNA, 20 bp, Homo sapiens
ttactggaagcacttaaaca

SEQ ID NO: 120883 - DNA, 23 bp, Homo sapiens
tatgcgtatatatatatatgtgt

SEQ ID NO: 120884 - DNA, 22 bp, Homo sapiens
tatatgtatatatgtatatgtg

SEQ ID NO: 120885 - DNA, 18 bp, Homo sapiens
tcacactatatatcacac

SEQ ID NO: 120886 - DNA, 23 bp, Homo sapiens
gtatatgtacacatattcatgta

SEQ ID NO: 120887 - DNA, 22 bp, Homo sapiens
gtatgtttatatgtatatgtgt

SEQ ID NO: 120888 - DNA, 23 bp, Homo sapiens
tacacaaacacacattaacatgt

SEQ ID NO: 120889 - DNA, 23 bp, Homo sapiens
cagggtactgtgtgtatattgtg

SEQ ID NO: 120890 - DNA, 23 bp, Homo sapiens
tactgagttcatcgaggttgcaa

SEQ ID NO: 120891 - DNA, 23 bp, Homo sapiens
atgagtatgtaggcagatgccaa

SEQ ID NO: 120892 - DNA, 23 bp, Homo sapiens
tgtactgtttgttaaatattcat

SEQ ID NO: 120893 - DNA, 23 bp, Homo sapiens
tatgtgtgtatatatatgtgtgt

SEQ ID NO: 120894 - DNA, 18 bp, Homo sapiens
acacacacacatatataa

SEQ ID NO: 120895 - DNA, 23 bp, Homo sapiens
tctcttctctctcggtgactctg

SEQ ID NO: 120896 - DNA, 23 bp, Homo sapiens
ttttcaggaacactgtgtgatct

SEQ ID NO: 120897 - DNA, 23 bp, Homo sapiens
gtcactctctctgtgctgagctg

SEQ ID NO: 120898 - DNA, 20 bp, Homo sapiens
ttagggcttcaactttgaat

SEQ ID NO: 120899 - DNA, 19 bp, Homo sapiens
tggcatgatctcggctctc

SEQ ID NO: 120900 - DNA, 19 bp, Homo sapiens
aatgcttgtgatttgtcat

SEQ ID NO: 120901 - DNA, 23 bp, Homo sapiens
atacacacacacatatatatgtg

SEQ ID NO: 120902 - DNA, 22 bp, Homo sapiens
tgaagattagtgatgttgaaca

SEQ ID NO: 120903 - DNA, 18 bp, Homo sapiens
caagtatgtatatatgta

SEQ ID NO: 120904 - DNA, 23 bp, Homo sapiens
tcccagagcccctggaactctgg

SEQ ID NO: 120905 - DNA, 21 bp, Homo sapiens
atgtacacacatatatatgtg

SEQ ID NO: 120906 - DNA, 23 bp, Homo sapiens
atatgtacacacatatatatgtg

SEQ ID NO: 120907 - DNA, 23 bp, Homo sapiens
ctcccagagcccctggaactctg

SEQ ID NO: 120908 - DNA, 23 bp, Homo sapiens
tcccagagcccctggaactctgg

SEQ ID NO: 120909 - DNA, 23 bp, Homo sapiens
tcccagagcccctggaactctgg

SEQ ID NO: 120910 - DNA, 23 bp, Homo sapiens
tcccagagcccctggaactctgg

SEQ ID NO: 120911 - DNA, 20 bp, Homo sapiens
tcatctattaagttcttgga

SEQ ID NO: 120912 - DNA, 22 bp, Homo sapiens
gtctcgctctgtcactgaggct

SEQ ID NO: 120913 - DNA, 23 bp, Homo sapiens
tgtatatatctttgcatatgtgt

SEQ ID NO: 120914 - DNA, 23 bp, Homo sapiens
tgagttcattgtagattctggat

SEQ ID NO: 120915 - DNA, 23 bp, Homo sapiens
tgagttcattgtagattctggat

SEQ ID NO: 120916 - DNA, 23 bp, Homo sapiens
tctgtcactgtctctcatcaccc

SEQ ID NO: 120917 - DNA, 23 bp, Homo sapiens
aaggatatatatctgtatttctt

SEQ ID NO: 120918 - DNA, 23 bp, Homo sapiens
tgtgtgcatatatatgtgtatat

SEQ ID NO: 120919 - DNA, 23 bp, Homo sapiens
ttcgtgaggttgcaggttgaaat

SEQ ID NO: 120920 - DNA, 20 bp, Homo sapiens
tggtggtgatgatggtgttg

SEQ ID NO: 120921 - DNA, 23 bp, Homo sapiens
gagacagtgtctcgctctgtcac

SEQ ID NO: 120922 - DNA, 20 bp, Homo sapiens
tgcgcatatatatacacata

SEQ ID NO: 120923 - DNA, 20 bp, Homo sapiens
tcagagtatatatatatgcg

SEQ ID NO: 120924 - DNA, 23 bp, Homo sapiens
tagtcactccctcagatactgca

SEQ ID NO: 120925 - DNA, 23 bp, Homo sapiens
tgagttcattgtagattctggat

SEQ ID NO: 120926 - DNA, 23 bp, Homo sapiens
tgagttcattgtagattctggat

SEQ ID NO: 120927 - DNA, 23 bp, Homo sapiens
tggagtctcactctgtcacccag

SEQ ID NO: 120928 - DNA, 21 bp, Homo sapiens
gtgtctgtgtgtgtgtgtata

SEQ ID NO: 120929 - DNA, 22 bp, Homo sapiens
tgactgtgtatctctctctgta

SEQ ID NO: 120930 - DNA, 23 bp, Homo sapiens
tgagttcattgtagattctggat

SEQ ID NO: 120931 - DNA, 23 bp, Homo sapiens
tgagttcattgtagattctggat

SEQ ID NO: 120932 - DNA, 23 bp, Homo sapiens
tattgatttgcgtatgttgaacc

SEQ ID NO: 120933 - DNA, 19 bp, Homo sapiens
tagctggggtgtatttatg

SEQ ID NO: 120934 - DNA, 23 bp, Homo sapiens
tgagttcattgtagattctggat

SEQ ID NO: 120935 - DNA, 23 bp, Homo sapiens
tgagttcattgtagattctggat

SEQ ID NO: 120936 - DNA, 21 bp, Homo sapiens
tataccaggagatcgtttggt

SEQ ID NO: 120937 - DNA, 19 bp, Homo sapiens
acacaaatatatatgtgta

SEQ ID NO: 120938 - DNA, 23 bp, Homo sapiens
atacacacacatgtatgtgtata

SEQ ID NO: 120939 - DNA, 23 bp, Homo sapiens
tttaagtcattgcttttagagat

SEQ ID NO: 120940 - DNA, 22 bp, Homo sapiens
aatagagaatttaaaaatgaga

SEQ ID NO: 120941 - DNA, 23 bp, Homo sapiens
tgagtctgagtctcactctgtca

SEQ ID NO: 120942 - DNA, 23 bp, Homo sapiens
gacagagtctcgctctgtcaccc

SEQ ID NO: 120943 - DNA, 23 bp, Homo sapiens
atggagtctcactctgtcaccca

SEQ ID NO: 120944 - DNA, 23 bp, Homo sapiens
tggagtctcactctgtcacccag

SEQ ID NO: 120945 - DNA, 23 bp, Homo sapiens
actctgtcacccagactagagtg

SEQ ID NO: 120946 - DNA, 23 bp, Homo sapiens
gggtctcactctgtcactcaggc

SEQ ID NO: 120947 - DNA, 23 bp, Homo sapiens
aggtcagtctggctctgtcaccc

SEQ ID NO: 120948 - DNA, 23 bp, Homo sapiens
tacagagtggcctgatcttggct

SEQ ID NO: 120949 - DNA, 20 bp, Homo sapiens
tttctttgagatggagtctc

SEQ ID NO: 120950 - DNA, 23 bp, Homo sapiens
tttgttactaatatcagctattg

SEQ ID NO: 120951 - DNA, 21 bp, Homo sapiens
atttcaggtgagtctgcagga

SEQ ID NO: 120952 - DNA, 18 bp, Homo sapiens
cactgaagaggaggtagt

SEQ ID NO: 120953 - DNA, 22 bp, Homo sapiens
atatatgatggaatactactca

SEQ ID NO: 120954 - DNA, 23 bp, Homo sapiens
acacgtatatgtatatatgtata

SEQ ID NO: 120955 - DNA, 23 bp, Homo sapiens
tgctgcttcaggatctggatgtg

SEQ ID NO: 120956 - DNA, 23 bp, Homo sapiens
cacagtgcaagtccaagtgattt

SEQ ID NO: 120957 - DNA, 23 bp, Homo sapiens
gaggctgaggtaggaggatcact

SEQ ID NO: 120958 - DNA, 23 bp, Homo sapiens
gagaccctgtctctctctctatt

SEQ ID NO: 120959 - DNA, 23 bp, Homo sapiens
cagagctgactcagtctcagtca

SEQ ID NO: 120960 - DNA, 23 bp, Homo sapiens
gttgcctctgtctctcgctctgc

SEQ ID NO: 120961 - DNA, 18 bp, Homo sapiens
tgaggaatagaattcttt

SEQ ID NO: 120962 - DNA, 23 bp, Homo sapiens
cagagatgagagagagctgtggg

SEQ ID NO: 120963 - DNA, 21 bp, Homo sapiens
tgaggtagaaggatcacctgt

SEQ ID NO: 120964 - DNA, 19 bp, Homo sapiens
ttagcttattttaagcctt

SEQ ID NO: 120965 - DNA, 18 bp, Homo sapiens
atatgtatcatatatatg

SEQ ID NO: 120966 - DNA, 23 bp, Homo sapiens
tatatgtatatgtgtatatgtga

SEQ ID NO: 120967 - DNA, 23 bp, Homo sapiens
tgtctcagtctccttctgtcttt

SEQ ID NO: 120968 - DNA, 23 bp, Homo sapiens
aggatctcactctgtcactcagg

SEQ ID NO: 120969 - DNA, 21 bp, Homo sapiens
aagtcaggtgctgtttcccag

SEQ ID NO: 120970 - DNA, 20 bp, Homo sapiens
actggctcacacacacacag

SEQ ID NO: 120971 - DNA, 23 bp, Homo sapiens
actgagtttcactctgtcaccca

SEQ ID NO: 120972 - DNA, 21 bp, Homo sapiens
taagaaactgtagagagtgga

SEQ ID NO: 120973 - DNA, 22 bp, Homo sapiens
agagacagaggggagtgggaga

SEQ ID NO: 120974 - DNA, 20 bp, Homo sapiens
atattgattcatgaagatgg

SEQ ID NO: 120975 - DNA, 23 bp, Homo sapiens
agtctctccctgtcacccaggct

SEQ ID NO: 120976 - DNA, 22 bp, Homo sapiens
gaagagacaactggtttggaga

SEQ ID NO: 120977 - DNA, 21 bp, Homo sapiens
atttcagtcactcagtctgtg

SEQ ID NO: 120978 - DNA, 23 bp, Homo sapiens
atggagtctcactctgtcaccca

SEQ ID NO: 120979 - DNA, 23 bp, Homo sapiens
tatgaatatatgtatatctccat

SEQ ID NO: 120980 - DNA, 23 bp, Homo sapiens
attccatgtcaatggaaaccgaa

SEQ ID NO: 120981 - DNA, 19 bp, Homo sapiens
tgagatggagtctctctct

SEQ ID NO: 120982 - DNA, 20 bp, Homo sapiens
tgtgtgttgatagtgagcag

SEQ ID NO: 120983 - DNA, 23 bp, Homo sapiens
cggagtctcgctctgtggctcag

SEQ ID NO: 120984 - DNA, 20 bp, Homo sapiens
accagctatgtatagggagt

SEQ ID NO: 120985 - DNA, 19 bp, Homo sapiens
agctctttaagtttccagt

SEQ ID NO: 120986 - DNA, 18 bp, Homo sapiens
aggatattaaatgtgtat

SEQ ID NO: 120987 - DNA, 23 bp, Homo sapiens
ggagtctcactctgtcactcagg

SEQ ID NO: 120988 - DNA, 21 bp, Homo sapiens
ctctccctctgtctctttaca

SEQ ID NO: 120989 - DNA, 23 bp, Homo sapiens
tatatgtgtatatatgtatgtgt

SEQ ID NO: 120990 - DNA, 23 bp, Homo sapiens
tatgtgtatatatatgtatctgt

SEQ ID NO: 120991 - DNA, 19 bp, Homo sapiens
tatgtatatgtgtgtgtat

SEQ ID NO: 120992 - DNA, 21 bp, Homo sapiens
atatgttaggtatatatatgt

SEQ ID NO: 120993 - DNA, 20 bp, Homo sapiens
ttgggtattggacctttctg

SEQ ID NO: 120994 - DNA, 23 bp, Homo sapiens
actcacactcagcctcactggct

SEQ ID NO: 120995 - DNA, 19 bp, Homo sapiens
tatgtagaagaatgagggt

SEQ ID NO: 120996 - DNA, 23 bp, Homo sapiens
tgagttcattgtagattctggat

SEQ ID NO: 120997 - DNA, 23 bp, Homo sapiens
tgagttcattgtagattctggat

SEQ ID NO: 120998 - DNA, 23 bp, Homo sapiens
tgagttcattgtagattctggat

SEQ ID NO: 120999 - DNA, 23 bp, Homo sapiens
tgagttcattgtagattctggat

SEQ ID NO: 121000 - DNA, 21 bp, Homo sapiens
tgcctggctccgtgttaagtg

SEQ ID NO: 121001 - DNA, 23 bp, Homo sapiens
tgagacagacagagatttcgttg

SEQ ID NO: 121002 - DNA, 23 bp, Homo sapiens
actcccagagcccctggaactct

SEQ ID NO: 121003 - DNA, 23 bp, Homo sapiens
tcccagagcccctggaactctgg

SEQ ID NO: 121004 - DNA, 20 bp, Homo sapiens
cagtgtgtgtgtgtgcgcgt

SEQ ID NO: 121005 - DNA, 23 bp, Homo sapiens
tgaaagagatgatttgagtacaa

SEQ ID NO: 121006 - DNA, 23 bp, Homo sapiens
tgagttcattgtagattctggat

SEQ ID NO: 121007 - DNA, 23 bp, Homo sapiens
tgagttcattgtagattctggat

SEQ ID NO: 121008 - DNA, 23 bp, Homo sapiens
atgtgtgtacactgtgtgtgcat

SEQ ID NO: 121009 - DNA, 22 bp, Homo sapiens
acacagaacacacacagcattt

SEQ ID NO: 121010 - DNA, 23 bp, Homo sapiens
atgtatgtgtgcatatacatgtg

SEQ ID NO: 121011 - DNA, 22 bp, Homo sapiens
atatatgtgtgcatatacatgt

SEQ ID NO: 121012 - DNA, 22 bp, Homo sapiens
atgactgtgaccaagcagtttc

SEQ ID NO: 121013 - DNA, 23 bp, Homo sapiens
tctgtctctctgactagcctgta

SEQ ID NO: 121014 - DNA, 23 bp, Homo sapiens
tgtctctgggtcacatgttgcta

SEQ ID NO: 121015 - DNA, 18 bp, Homo sapiens
tgtgatgagtgatctttg

SEQ ID NO: 121016 - DNA, 19 bp, Homo sapiens
atatgtgtgtatatcttta

SEQ ID NO: 121017 - DNA, 20 bp, Homo sapiens
atacacacatttatatgtgt

SEQ ID NO: 121018 - DNA, 23 bp, Homo sapiens
tgaattttcttatgaatgtgaac

SEQ ID NO: 121019 - DNA, 23 bp, Homo sapiens
cggagtctcactctgtcacccag

SEQ ID NO: 121020 - DNA, 18 bp, Homo sapiens
aacactgtacactggtgg

SEQ ID NO: 121021 - DNA, 22 bp, Homo sapiens
tgggtagagaaaggcaaaaatg

SEQ ID NO: 121022 - DNA, 23 bp, Homo sapiens
agtctcactctgtcactctgttg

SEQ ID NO: 121023 - DNA, 23 bp, Homo sapiens
tgagacggagtctcgctctgtca

SEQ ID NO: 121024 - DNA, 23 bp, Homo sapiens
ccaagtatgtagtgtgtgcttag

SEQ ID NO: 121025 - DNA, 21 bp, Homo sapiens
tgagaacactggaaatgttct

SEQ ID NO: 121026 - DNA, 23 bp, Homo sapiens
tctgtgtgtatctgtgtccctgt

SEQ ID NO: 121027 - DNA, 21 bp, Homo sapiens
aggatgccagtcagattggat

SEQ ID NO: 121028 - DNA, 19 bp, Homo sapiens
ataatgcatatatatatgt

SEQ ID NO: 121029 - DNA, 21 bp, Homo sapiens
tttgagatggagtcttgctct

SEQ ID NO: 121030 - DNA, 22 bp, Homo sapiens
tacaagatcctgtctcagaaaa

SEQ ID NO: 121031 - DNA, 19 bp, Homo sapiens
taggaactaaccgtgctgt

SEQ ID NO: 121032 - DNA, 23 bp, Homo sapiens
agagtctcactctgtcacccagg

SEQ ID NO: 121033 - DNA, 23 bp, Homo sapiens
gagtctcactctgtcacccaggc

SEQ ID NO: 121034 - DNA, 19 bp, Homo sapiens
tctctgtgtatgtgtctgt

SEQ ID NO: 121035 - DNA, 19 bp, Homo sapiens
tgtgtgtgtgtgtgtatac

SEQ ID NO: 121036 - DNA, 20 bp, Homo sapiens
tttgaggcatctctgttctt

SEQ ID NO: 121037 - DNA, 23 bp, Homo sapiens
taggaatgaagtgaggtgataag

SEQ ID NO: 121038 - DNA, 23 bp, Homo sapiens
gatgttactgattttgtcctgct

SEQ ID NO: 121039 - DNA, 23 bp, Homo sapiens
tgtcacacactcactgcaatcgt

SEQ ID NO: 121040 - DNA, 23 bp, Homo sapiens
tcttgctccctctcaccatgtga

SEQ ID NO: 121041 - DNA, 23 bp, Homo sapiens
tgatggtccttagtgtattcaga

SEQ ID NO: 121042 - DNA, 23 bp, Homo sapiens
tactgtaactggaatcaatttct

SEQ ID NO: 121043 - DNA, 23 bp, Homo sapiens
ataactatgtatatatgagtgtg

SEQ ID NO: 121044 - DNA, 20 bp, Homo sapiens
atagtgagatcccatgtcta

SEQ ID NO: 121045 - DNA, 23 bp, Homo sapiens
agatggagtctcactgtgtcacc

SEQ ID NO: 121046 - DNA, 23 bp, Homo sapiens
gcaatatgtagtagagtagccat

SEQ ID NO: 121047 - DNA, 19 bp, Homo sapiens
aattcactaaggattggaa

SEQ ID NO: 121048 - DNA, 19 bp, Homo sapiens
gcttttgttatcattcaca

SEQ ID NO: 121049 - DNA, 23 bp, Homo sapiens
tctctgtctccctctcttattcc

SEQ ID NO: 121050 - DNA, 18 bp, Homo sapiens
atgccatatatatgctat

SEQ ID NO: 121051 - DNA, 23 bp, Homo sapiens
tatgccatatatatgctatatat

SEQ ID NO: 121052 - DNA, 18 bp, Homo sapiens
tgcatatataatatgtat

SEQ ID NO: 121053 - DNA, 23 bp, Homo sapiens
cacatgtgcatatgtatatcata

SEQ ID NO: 121054 - DNA, 23 bp, Homo sapiens
ttaaaagtagatgtggtacacaa

SEQ ID NO: 121055 - DNA, 23 bp, Homo sapiens
cagggtctcgctctgtcgctcag

SEQ ID NO: 121056 - DNA, 23 bp, Homo sapiens
gcagagtctcactctgtcgccca

SEQ ID NO: 121057 - DNA, 23 bp, Homo sapiens
tctatggtgacattagctctgtt

SEQ ID NO: 121058 - DNA, 23 bp, Homo sapiens
agggtctcagtatctgtctctct

SEQ ID NO: 121059 - DNA, 20 bp, Homo sapiens
tacagattcattttatttct

SEQ ID NO: 121060 - DNA, 22 bp, Homo sapiens
tgagatcttgctctgtctccac

SEQ ID NO: 121061 - DNA, 19 bp, Homo sapiens
tgagatggagtttcgctgt

SEQ ID NO: 121062 - DNA, 21 bp, Homo sapiens
ctctgactgactgcttcccag

SEQ ID NO: 121063 - DNA, 23 bp, Homo sapiens
aggtgtcggactctgtttttttt

SEQ ID NO: 121064 - DNA, 23 bp, Homo sapiens
agacagagtctcattctgtcacc

SEQ ID NO: 121065 - DNA, 19 bp, Homo sapiens
ttgagattctaaatgttta

SEQ ID NO: 121066 - DNA, 23 bp, Homo sapiens
aaatggtagaacaacattagaat

SEQ ID NO: 121067 - DNA, 23 bp, Homo sapiens
aatcactgacaggttttgaagaa

SEQ ID NO: 121068 - DNA, 22 bp, Homo sapiens
tcaagggtaaactttctgtttt

SEQ ID NO: 121069 - DNA, 23 bp, Homo sapiens
aagtctgagatcaaggtgtcagc

SEQ ID NO: 121070 - DNA, 23 bp, Homo sapiens
ttatatgtctttttcatttcatt

SEQ ID NO: 121071 - DNA, 23 bp, Homo sapiens
tttctccatttgatgtctgtgca

SEQ ID NO: 121072 - DNA, 23 bp, Homo sapiens
gtgtgcgtctgtctggggctgtg

SEQ ID NO: 121073 - DNA, 22 bp, Homo sapiens
tggagtgtcactctgtcaccca

SEQ ID NO: 121074 - DNA, 21 bp, Homo sapiens
ttttttcagcgtctcactctg

SEQ ID NO: 121075 - DNA, 19 bp, Homo sapiens
cagacctagtattttggct

SEQ ID NO: 121076 - DNA, 19 bp, Homo sapiens
agcccatttcttttctttt

SEQ ID NO: 121077 - DNA, 23 bp, Homo sapiens
tttgagacggagtctggctctgt

SEQ ID NO: 121078 - DNA, 20 bp, Homo sapiens
tcaggaggctgaggtaggag

SEQ ID NO: 121079 - DNA, 21 bp, Homo sapiens
tgcagtgagctataattgtgc

SEQ ID NO: 121080 - DNA, 21 bp, Homo sapiens
tagagtaggcttctttttctt

SEQ ID NO: 121081 - DNA, 21 bp, Homo sapiens
tgtatacattgtgtaatggct

SEQ ID NO: 121082 - DNA, 23 bp, Homo sapiens
tagtgagtagttactgagctcta

SEQ ID NO: 121083 - DNA, 21 bp, Homo sapiens
tgagatggagtctcgctctgt

SEQ ID NO: 121084 - DNA, 23 bp, Homo sapiens
gctatctagagggagatgtcctg

SEQ ID NO: 121085 - DNA, 23 bp, Homo sapiens
gtgtgtgtgtgtgtgcgtgcatg

SEQ ID NO: 121086 - DNA, 23 bp, Homo sapiens
tctctgcttgtaagagtgtctcc

SEQ ID NO: 121087 - DNA, 18 bp, Homo sapiens
gatgcgtggaagtcactg

SEQ ID NO: 121088 - DNA, 21 bp, Homo sapiens
ttctgcaggttaaagagggtg

SEQ ID NO: 121089 - DNA, 23 bp, Homo sapiens
tctgtcaccctctgtttgtctcc

SEQ ID NO: 121090 - DNA, 23 bp, Homo sapiens
ctccctgtgtgcctgtgtcccag

SEQ ID NO: 121091 - DNA, 23 bp, Homo sapiens
tacctaacagtcccatttacatg

SEQ ID NO: 121092 - DNA, 19 bp, Homo sapiens
tttaagtatttcaatatat

SEQ ID NO: 121093 - DNA, 23 bp, Homo sapiens
acacagtgaattttcattctctt

SEQ ID NO: 121094 - DNA, 23 bp, Homo sapiens
tgagatggagtctcactctgtca

SEQ ID NO: 121095 - DNA, 18 bp, Homo sapiens
ttactgtcacagaatgaa

SEQ ID NO: 121096 - DNA, 23 bp, Homo sapiens
tcatagttcattacagcctcgac

SEQ ID NO: 121097 - DNA, 23 bp, Homo sapiens
tgagtattcaggcactggtggtg

SEQ ID NO: 121098 - DNA, 22 bp, Homo sapiens
atctgtatctgcttcagatttg

SEQ ID NO: 121099 - DNA, 19 bp, Homo sapiens
ttcaaaaatgaggctgggt

SEQ ID NO: 121100 - DNA, 23 bp, Homo sapiens
aatctctcacttctttagagagt

SEQ ID NO: 121101 - DNA, 19 bp, Homo sapiens
gttctggttttcttgatta

SEQ ID NO: 121102 - DNA, 23 bp, Homo sapiens
ggagtctcactctgtcacccagg

SEQ ID NO: 121103 - DNA, 23 bp, Homo sapiens
agtgcaagggtgtgatcttggct

SEQ ID NO: 121104 - DNA, 23 bp, Homo sapiens
atcacatacgcaatacatgatat

SEQ ID NO: 121105 - DNA, 23 bp, Homo sapiens
gagacagtgtctggctctgtcac

SEQ ID NO: 121106 - DNA, 23 bp, Homo sapiens
gcagagtctcgctctgtcaccca

SEQ ID NO: 121107 - DNA, 23 bp, Homo sapiens
cagttcagtcactatcagtgagc

SEQ ID NO: 121108 - DNA, 19 bp, Homo sapiens
aaagctcctggagagattg

SEQ ID NO: 121109 - DNA, 23 bp, Homo sapiens
tggagtctcactctgtcacccag

SEQ ID NO: 121110 - DNA, 21 bp, Homo sapiens
cctctgacactttcaccttgg

SEQ ID NO: 121111 - DNA, 18 bp, Homo sapiens
taaagtgttgggtttaca

SEQ ID NO: 121112 - DNA, 20 bp, Homo sapiens
tctcacaagtgactgtgggc

SEQ ID NO: 121113 - DNA, 23 bp, Homo sapiens
gcttaactctgtggttaaaatgg

SEQ ID NO: 121114 - DNA, 23 bp, Homo sapiens
gctgtcaggtacatttaggcact

SEQ ID NO: 121115 - DNA, 23 bp, Homo sapiens
tgagtttaagctacagtttcatt

SEQ ID NO: 121116 - DNA, 23 bp, Homo sapiens
agaagtcatatgcatttttgttt

SEQ ID NO: 121117 - DNA, 23 bp, Homo sapiens
gagttgttgtttgataggtacag

SEQ ID NO: 121118 - DNA, 23 bp, Homo sapiens
agagtctcactctgtcacccagg

SEQ ID NO: 121119 - DNA, 23 bp, Homo sapiens
gacagagtctcgctctgtcacct

SEQ ID NO: 121120 - DNA, 19 bp, Homo sapiens
tgccttatggacactaaac

SEQ ID NO: 121121 - DNA, 23 bp, Homo sapiens
gagaagtttcgtaatgtaatgat

SEQ ID NO: 121122 - DNA, 23 bp, Homo sapiens
acagagtctcactctgtcgccca

SEQ ID NO: 121123 - DNA, 23 bp, Homo sapiens
agagaagagtgactgctatgctt

SEQ ID NO: 121124 - DNA, 22 bp, Homo sapiens
acagccagtgataaacatgttt

SEQ ID NO: 121125 - DNA, 21 bp, Homo sapiens
gtacatatatatacatgtatg

SEQ ID NO: 121126 - DNA, 19 bp, Homo sapiens
tatgtgtatctatatgtta

SEQ ID NO: 121127 - DNA, 19 bp, Homo sapiens
gtctcgctctgtcacccag

SEQ ID NO: 121128 - DNA, 23 bp, Homo sapiens
tatctatatatgtatgtgtgtgt

SEQ ID NO: 121129 - DNA, 20 bp, Homo sapiens
tatgtgtgtgtgtgtgtgtg

SEQ ID NO: 121130 - DNA, 23 bp, Homo sapiens
atatatgtatatgcacacacata

SEQ ID NO: 121131 - DNA, 23 bp, Homo sapiens
cacatctatatctatacatatct

SEQ ID NO: 121132 - DNA, 23 bp, Homo sapiens
ttttggtcccttaggtaatgaaa

SEQ ID NO: 121133 - DNA, 23 bp, Homo sapiens
agtacgtggacagttttgtactc

SEQ ID NO: 121134 - DNA, 23 bp, Homo sapiens
atatgtatatatgtatatgtata

SEQ ID NO: 121135 - DNA, 21 bp, Homo sapiens
aagctgctctgaaaatatctt

SEQ ID NO: 121136 - DNA, 23 bp, Homo sapiens
tttgatattctgtatttcctcag

SEQ ID NO: 121137 - DNA, 23 bp, Homo sapiens
tgagttcattgtagattctggat

SEQ ID NO: 121138 - DNA, 23 bp, Homo sapiens
tgagttcattgtagattctggat

SEQ ID NO: 121139 - DNA, 23 bp, Homo sapiens
atttcaggtgctgatttttactt

SEQ ID NO: 121140 - DNA, 23 bp, Homo sapiens
agttaattggcatagctattgtt

SEQ ID NO: 121141 - DNA, 23 bp, Homo sapiens
tgagttcattgtagattctggat

SEQ ID NO: 121142 - DNA, 23 bp, Homo sapiens
tgagttcattgtagattctggat

SEQ ID NO: 121143 - DNA, 22 bp, Homo sapiens
aacattgagttggggatttcat

SEQ ID NO: 121144 - DNA, 23 bp, Homo sapiens
ccttgtcagtttattttttttcc

SEQ ID NO: 121145 - DNA, 18 bp, Homo sapiens
tattatctagtttatgca

SEQ ID NO: 121146 - DNA, 22 bp, Homo sapiens
tatacacagatatatatgtgtg

SEQ ID NO: 121147 - DNA, 22 bp, Homo sapiens
aaaatagtaaagatggtaagag

SEQ ID NO: 121148 - DNA, 22 bp, Homo sapiens
tgatgatgtgtgatattgaaca

SEQ ID NO: 121149 - DNA, 23 bp, Homo sapiens
taccacactgtgaaacttgaggc

SEQ ID NO: 121150 - DNA, 22 bp, Homo sapiens
aaggtccagatcatggagaaca

SEQ ID NO: 121151 - DNA, 23 bp, Homo sapiens
agaagtaactctctagctctctg

SEQ ID NO: 121152 - DNA, 23 bp, Homo sapiens
tatacatactaaatatgtgtgtg

SEQ ID NO: 121153 - DNA, 22 bp, Homo sapiens
agtctcgctctgtctgtcgccc

SEQ ID NO: 121154 - DNA, 23 bp, Homo sapiens
ctgaagctcacctcctgctgtgt

SEQ ID NO: 121155 - DNA, 22 bp, Homo sapiens
tctgaggagagacaaacctgga

SEQ ID NO: 121156 - DNA, 22 bp, Homo sapiens
tttgtcaacatccacatgtgta

SEQ ID NO: 121157 - DNA, 23 bp, Homo sapiens
tgctcagcgttcttggagtgtta

SEQ ID NO: 121158 - DNA, 18 bp, Homo sapiens
taaacattctaaactctt

SEQ ID NO: 121159 - DNA, 22 bp, Homo sapiens
tatatggtgattttatgtttaa

SEQ ID NO: 121160 - DNA, 23 bp, Homo sapiens
atagtagctgcactatttggtat

SEQ ID NO: 121161 - DNA, 19 bp, Homo sapiens
agagatttacaaatgctgg

SEQ ID NO: 121162 - DNA, 23 bp, Homo sapiens
agtgtctctctgtttcatgttag

SEQ ID NO: 121163 - DNA, 23 bp, Homo sapiens
gacagagtctcgctctgtcaccc

SEQ ID NO: 121164 - DNA, 22 bp, Homo sapiens
acacacacacagaaatatgtgt

SEQ ID NO: 121165 - DNA, 23 bp, Homo sapiens
acacgtatatatatgtgtgtgta

SEQ ID NO: 121166 - DNA, 21 bp, Homo sapiens
tgtgtgtgtgtatatgtgtat

SEQ ID NO: 121167 - DNA, 23 bp, Homo sapiens
tgagttcattgtagattctggat

SEQ ID NO: 121168 - DNA, 23 bp, Homo sapiens
tgagttcattgtagattctggat

SEQ ID NO: 121169 - DNA, 23 bp, Homo sapiens
tcagatgttcagatgtgtccaga

SEQ ID NO: 121170 - DNA, 23 bp, Homo sapiens
ttcatggtctcgctgacttcagg

SEQ ID NO: 121171 - DNA, 22 bp, Homo sapiens
taccctcttgttcctctttctt

SEQ ID NO: 121172 - DNA, 23 bp, Homo sapiens
gggtctcactctgtcacccaggc

SEQ ID NO: 121173 - DNA, 19 bp, Homo sapiens
tatgtgtgtatatatacgt

SEQ ID NO: 121174 - DNA, 22 bp, Homo sapiens
tatactatatatgtatatgtgt

SEQ ID NO: 121175 - DNA, 22 bp, Homo sapiens
tgtgtatatatgtatatatgtg

SEQ ID NO: 121176 - DNA, 22 bp, Homo sapiens
gtatatatgtatgtaaatgtgt

SEQ ID NO: 121177 - DNA, 23 bp, Homo sapiens
cagtgctgtgatcatggctcact

SEQ ID NO: 121178 - DNA, 21 bp, Homo sapiens
tatatgcatatatatacatat

SEQ ID NO: 121179 - DNA, 22 bp, Homo sapiens
agttttgaatttcttgttagag

SEQ ID NO: 121180 - DNA, 21 bp, Homo sapiens
tctcttcttagactttctgct

SEQ ID NO: 121181 - DNA, 23 bp, Homo sapiens
acacctgtcatctcagcactttg

SEQ ID NO: 121182 - DNA, 23 bp, Homo sapiens
tatacatataatctacatgtata

SEQ ID NO: 121183 - DNA, 22 bp, Homo sapiens
tcattcaccctcaccgtgaggt

SEQ ID NO: 121184 - DNA, 23 bp, Homo sapiens
tgagttcattgtagattctggat

SEQ ID NO: 121185 - DNA, 23 bp, Homo sapiens
tgagttcattgtagattctggat

SEQ ID NO: 121186 - DNA, 22 bp, Homo sapiens
agctatcagagtttacggatgt

SEQ ID NO: 121187 - DNA, 23 bp, Homo sapiens
tggagtctcactctgtcacccag

SEQ ID NO: 121188 - DNA, 21 bp, Homo sapiens
tatgtgtatgtagatactgta

SEQ ID NO: 121189 - DNA, 20 bp, Homo sapiens
tgtcttgcatttggatgggt

SEQ ID NO: 121190 - DNA, 20 bp, Homo sapiens
tgtcttgcatttggatgggt

SEQ ID NO: 121191 - DNA, 23 bp, Homo sapiens
gagtctcactctgtcacccaggc

SEQ ID NO: 121192 - DNA, 23 bp, Homo sapiens
tggctgcctgcctctttgtctgc

SEQ ID NO: 121193 - DNA, 23 bp, Homo sapiens
ttttctctagatcaatattgata

SEQ ID NO: 121194 - DNA, 19 bp, Homo sapiens
tgagacagagtgtcactct

SEQ ID NO: 121195 - DNA, 22 bp, Homo sapiens
atagagggagatcatgaggaaa

SEQ ID NO: 121196 - DNA, 20 bp, Homo sapiens
attgcaggtgtgagccactg

SEQ ID NO: 121197 - DNA, 23 bp, Homo sapiens
atgtgtcctgcagaactcaaagt

SEQ ID NO: 121198 - DNA, 23 bp, Homo sapiens
ttgctaaatctcttaagtgtgct

SEQ ID NO: 121199 - DNA, 22 bp, Homo sapiens
tgtaatggtccagataaggatt

SEQ ID NO: 121200 - DNA, 20 bp, Homo sapiens
caggctctctcagctcttgt

SEQ ID NO: 121201 - DNA, 23 bp, Homo sapiens
acaggtgagagaatgctgatagt

SEQ ID NO: 121202 - DNA, 23 bp, Homo sapiens
catctcaccgtaactcactcact

SEQ ID NO: 121203 - DNA, 23 bp, Homo sapiens
tatatatgaggttactgggagtc

SEQ ID NO: 121204 - DNA, 22 bp, Homo sapiens
caagaaagtgagtaggtctgtg

SEQ ID NO: 121205 - DNA, 23 bp, Homo sapiens
tctgtgatcagtgatgatctttg

SEQ ID NO: 121206 - DNA, 22 bp, Homo sapiens
catggtaatcatttcatatgta

SEQ ID NO: 121207 - DNA, 23 bp, Homo sapiens
atatatgcacacatatgtgtttg

SEQ ID NO: 121208 - DNA, 23 bp, Homo sapiens
gtgtatgtatgtatatatgtata

SEQ ID NO: 121209 - DNA, 22 bp, Homo sapiens
ttgcttcattactgagcatgtg

SEQ ID NO: 121210 - DNA, 23 bp, Homo sapiens
ttatttgtattgactggtcaagt

SEQ ID NO: 121211 - DNA, 23 bp, Homo sapiens
tgagttcattgtagattctggat

SEQ ID NO: 121212 - DNA, 23 bp, Homo sapiens
gacaggctctcactctgtctcag

SEQ ID NO: 121213 - DNA, 23 bp, Homo sapiens
cagggaatttgtagagataggta

SEQ ID NO: 121214 - DNA, 23 bp, Homo sapiens
tgagttcattgtagattctggat

SEQ ID NO: 121215 - DNA, 23 bp, Homo sapiens
tgagttcattgtagattctggat

SEQ ID NO: 121216 - DNA, 22 bp, Homo sapiens
taattgtccatttccaatgaaa

SEQ ID NO: 121217 - DNA, 23 bp, Homo sapiens
ttgagtagttttttccatgagtt

SEQ ID NO: 121218 - DNA, 21 bp, Homo sapiens
ttcttgagatgggatctctca

SEQ ID NO: 121219 - DNA, 23 bp, Homo sapiens
tcactttctcagtaccacattac

SEQ ID NO: 121220 - DNA, 23 bp, Homo sapiens
atggaaacactgaaaagtcactg

SEQ ID NO: 121221 - DNA, 23 bp, Homo sapiens
atgctgtggtatttttttgtatt

SEQ ID NO: 121222 - DNA, 23 bp, Homo sapiens
aaaatgggatttgaaaagactga

SEQ ID NO: 121223 - DNA, 23 bp, Homo sapiens
gataatgatgataagtggagaag

SEQ ID NO: 121224 - DNA, 21 bp, Homo sapiens
ttttgaagacattctaggtct

SEQ ID NO: 121225 - DNA, 22 bp, Homo sapiens
tctcagctgaacctaatttgtt

SEQ ID NO: 121226 - DNA, 23 bp, Homo sapiens
tgtgtgtgtgtgtgtgtgtacat

SEQ ID NO: 121227 - DNA, 23 bp, Homo sapiens
atgttgtgaggaacagatacaat

SEQ ID NO: 121228 - DNA, 23 bp, Homo sapiens
atattcattatatacgtatgtgt

SEQ ID NO: 121229 - DNA, 23 bp, Homo sapiens
tatatcattatatacgtatgtgt

SEQ ID NO: 121230 - DNA, 23 bp, Homo sapiens
ttaatgtggaaaagttcactttg

SEQ ID NO: 121231 - DNA, 21 bp, Homo sapiens
tgtcagagagtacaagttgtc

SEQ ID NO: 121232 - DNA, 23 bp, Homo sapiens
tgagttcattgtagattctggat

SEQ ID NO: 121233 - DNA, 23 bp, Homo sapiens
tgagttcattgtagattctggat

SEQ ID NO: 121234 - DNA, 23 bp, Homo sapiens
atcttggctcaaattgttgaaga

SEQ ID NO: 121235 - DNA, 20 bp, Homo sapiens
atgcacgttttaacatgata

SEQ ID NO: 121236 - DNA, 21 bp, Homo sapiens
aaactcatgcaatcatttgga

SEQ ID NO: 121237 - DNA, 20 bp, Homo sapiens
tgacatagtttatgaagaga

SEQ ID NO: 121238 - DNA, 23 bp, Homo sapiens
acatactcagacagatgtatcca

SEQ ID NO: 121239 - DNA, 23 bp, Homo sapiens
gaatgaccttgatgaagcagtaa

SEQ ID NO: 121240 - DNA, 23 bp, Homo sapiens
tgtgtgcattatatatgtgcata

SEQ ID NO: 121241 - DNA, 19 bp, Homo sapiens
tatgtgcatatatagtgta

SEQ ID NO: 121242 - DNA, 23 bp, Homo sapiens
agctgaaacagcaacagaagtag

SEQ ID NO: 121243 - DNA, 23 bp, Homo sapiens
aatggaagacttctgtatttgct

SEQ ID NO: 121244 - DNA, 20 bp, Homo sapiens
aaatgttacatatataacat

SEQ ID NO: 121245 - DNA, 23 bp, Homo sapiens
agtatatatgttgaagtacatat

SEQ ID NO: 121246 - DNA, 23 bp, Homo sapiens
agtggaattgttaggttatatag

SEQ ID NO: 121247 - DNA, 23 bp, Homo sapiens
atactgttttgcctagtgattgc

SEQ ID NO: 121248 - DNA, 23 bp, Homo sapiens
tcacatgtatgtttgtatatata

SEQ ID NO: 121249 - DNA, 23 bp, Homo sapiens
tatgtatatgtatgcatgtttgt

SEQ ID NO: 121250 - DNA, 19 bp, Homo sapiens
tgtgagtgtgtgtgtgtgt

SEQ ID NO: 121251 - DNA, 20 bp, Homo sapiens
tatttgcttattttaaaagg

SEQ ID NO: 121252 - DNA, 23 bp, Homo sapiens
aaactgtatgacctatgcattga

SEQ ID NO: 121253 - DNA, 22 bp, Homo sapiens
tagagaatgtctgtgagtctca

SEQ ID NO: 121254 - DNA, 23 bp, Homo sapiens
ttgtgtgcatatatatgcagata

SEQ ID NO: 121255 - DNA, 18 bp, Homo sapiens
tatgtatgtgtaaacatg

SEQ ID NO: 121256 - DNA, 22 bp, Homo sapiens
cactggctctctgtgaggctgt

SEQ ID NO: 121257 - DNA, 23 bp, Homo sapiens
atatatgtgtatgtatacgtata

SEQ ID NO: 121258 - DNA, 19 bp, Homo sapiens
ttgattttgtatcctgaga

SEQ ID NO: 121259 - DNA, 21 bp, Homo sapiens
tgagtctttagggttttctag

SEQ ID NO: 121260 - DNA, 22 bp, Homo sapiens
tttttctctgccatactttaca

SEQ ID NO: 121261 - DNA, 21 bp, Homo sapiens
tatgtgcatgtacatgtgagt

SEQ ID NO: 121262 - DNA, 23 bp, Homo sapiens
gtatatgtgtgtgctttacataa

SEQ ID NO: 121263 - DNA, 23 bp, Homo sapiens
tgcatgtcttgtgatttttttgt

SEQ ID NO: 121264 - DNA, 19 bp, Homo sapiens
gccagtggctcacatctgt

SEQ ID NO: 121265 - DNA, 19 bp, Homo sapiens
atatgtgtatatgtacatg

SEQ ID NO: 121266 - DNA, 22 bp, Homo sapiens
atttctcaggaatattagggaa

SEQ ID NO: 121267 - DNA, 23 bp, Homo sapiens
tttcagtatctgcttgtggatgt

SEQ ID NO: 121268 - DNA, 23 bp, Homo sapiens
aatttcctttttcagaggtatgt

SEQ ID NO: 121269 - DNA, 18 bp, Homo sapiens
acacacacacgtacgtat

SEQ ID NO: 121270 - DNA, 23 bp, Homo sapiens
tgagttcattgtagattctggat

SEQ ID NO: 121271 - DNA, 23 bp, Homo sapiens
tgagttcattgtagattctggat

SEQ ID NO: 121272 - DNA, 23 bp, Homo sapiens
tatatctggatatacatagagat

SEQ ID NO: 121273 - DNA, 20 bp, Homo sapiens
tgtcattatggtcagagaag

SEQ ID NO: 121274 - DNA, 23 bp, Homo sapiens
tttgtgacctaatatattgtcta

SEQ ID NO: 121275 - DNA, 23 bp, Homo sapiens
atgtcagactgtcagtctctcct

SEQ ID NO: 121276 - DNA, 20 bp, Homo sapiens
atgaacaagaacagcttaga

SEQ ID NO: 121277 - DNA, 18 bp, Homo sapiens
tcgcagtgttcagtgggg

SEQ ID NO: 121278 - DNA, 18 bp, Homo sapiens
atatattgttatgctatg

SEQ ID NO: 121279 - DNA, 23 bp, Homo sapiens
tcagtctctctgtctctctcgca

SEQ ID NO: 121280 - DNA, 22 bp, Homo sapiens
aggtgaagtctgtttcttgtag

SEQ ID NO: 121281 - DNA, 23 bp, Homo sapiens
attatgcttcaagttctagggta

SEQ ID NO: 121282 - DNA, 23 bp, Homo sapiens
aatagtaacattttcaagatttg

SEQ ID NO: 121283 - DNA, 21 bp, Homo sapiens
tctagtgcaattactatattt

SEQ ID NO: 121284 - DNA, 23 bp, Homo sapiens
tacagtaatgtcctaggccttcc

SEQ ID NO: 121285 - DNA, 23 bp, Homo sapiens
gtatgtgtgcatgtgtattgtat

SEQ ID NO: 121286 - DNA, 19 bp, Homo sapiens
atatacatatgcatatgtg

SEQ ID NO: 121287 - DNA, 22 bp, Homo sapiens
tcagcctctgtcagtcagttta

SEQ ID NO: 121288 - DNA, 23 bp, Homo sapiens
tttgagacggagtctcgctctgt

SEQ ID NO: 121289 - DNA, 23 bp, Homo sapiens
tcagcttgagcttgttgcttcta

SEQ ID NO: 121290 - DNA, 22 bp, Homo sapiens
tcagtctcagtgacttaatggc

SEQ ID NO: 121291 - DNA, 23 bp, Homo sapiens
atattcctacttaattaatgaga

SEQ ID NO: 121292 - DNA, 23 bp, Homo sapiens
ttttttggttccatatgaaattt

SEQ ID NO: 121293 - DNA, 23 bp, Homo sapiens
actgtgtcgcacactgtcaccca

SEQ ID NO: 121294 - DNA, 23 bp, Homo sapiens
tgagttcattgtagattctggat

SEQ ID NO: 121295 - DNA, 23 bp, Homo sapiens
tgagttcattgtagattctggat

SEQ ID NO: 121296 - DNA, 18 bp, Homo sapiens
tggttcatagagagctgt

SEQ ID NO: 121297 - DNA, 23 bp, Homo sapiens
agataactgtgcattttattaat

SEQ ID NO: 121298 - DNA, 23 bp, Homo sapiens
aaagtcactggtagtttaatggg

SEQ ID NO: 121299 - DNA, 23 bp, Homo sapiens
tttctggatcttttttgattaat

SEQ ID NO: 121300 - DNA, 20 bp, Homo sapiens
gaaaactgacattggtgttt

SEQ ID NO: 121301 - DNA, 18 bp, Homo sapiens
gtgtgtgtatgtctgtgt

SEQ ID NO: 121302 - DNA, 21 bp, Homo sapiens
tacacgcagacacattgttct

SEQ ID NO: 121303 - DNA, 18 bp, Homo sapiens
tgtgtgtatatatatatg

SEQ ID NO: 121304 - DNA, 23 bp, Homo sapiens
atgtgtgtatatacatatgtgtg

SEQ ID NO: 121305 - DNA, 21 bp, Homo sapiens
tgtgtatatatacatatatgt

SEQ ID NO: 121306 - DNA, 23 bp, Homo sapiens
tgtgtgtatatattcatatgtgt

SEQ ID NO: 121307 - DNA, 18 bp, Homo sapiens
aagagtttggcagggttt

SEQ ID NO: 121308 - DNA, 23 bp, Homo sapiens
attttgagctggagcctcactct

SEQ ID NO: 121309 - DNA, 23 bp, Homo sapiens
tgagttcattgtagattctggat

SEQ ID NO: 121310 - DNA, 23 bp, Homo sapiens
tgagttcattgtagattctggat

SEQ ID NO: 121311 - DNA, 22 bp, Homo sapiens
taatgccagatatgcaatggta

SEQ ID NO: 121312 - DNA, 21 bp, Homo sapiens
tttaagattgaggcatagttg

SEQ ID NO: 121313 - DNA, 21 bp, Homo sapiens
tgtgaagaaagtcattggtag

SEQ ID NO: 121314 - DNA, 20 bp, Homo sapiens
tatcatatatatgatatcat

SEQ ID NO: 121315 - DNA, 23 bp, Homo sapiens
acacacacacatatatatgtata

SEQ ID NO: 121316 - DNA, 23 bp, Homo sapiens
tatacgtatatagtatatatgta

SEQ ID NO: 121317 - DNA, 18 bp, Homo sapiens
acgtatatatatttgtgt

SEQ ID NO: 121318 - DNA, 23 bp, Homo sapiens
agtgtgtatatatatacttttgt

SEQ ID NO: 121319 - DNA, 23 bp, Homo sapiens
tctgtagtgatatttaagctatg

SEQ ID NO: 121320 - DNA, 23 bp, Homo sapiens
aaatacattggaacagaattgct

SEQ ID NO: 121321 - DNA, 21 bp, Homo sapiens
ttgctgcctgtgcagctgcag

SEQ ID NO: 121322 - DNA, 19 bp, Homo sapiens
acttcttcccaaatgtgtg

SEQ ID NO: 121323 - DNA, 23 bp, Homo sapiens
tgtacacattttcttgaagtgag

SEQ ID NO: 121324 - DNA, 23 bp, Homo sapiens
tgaactcaggtagccattctggt

SEQ ID NO: 121325 - DNA, 23 bp, Homo sapiens
tgagttcattgtagattctggat

SEQ ID NO: 121326 - DNA, 23 bp, Homo sapiens
tgagttcattgtagattctggat

SEQ ID NO: 121327 - DNA, 19 bp, Homo sapiens
accattatatttcacttac

SEQ ID NO: 121328 - DNA, 23 bp, Homo sapiens
tgagttcattgtagattctggat

SEQ ID NO: 121329 - DNA, 23 bp, Homo sapiens
tgagttcattgtagattctggat

SEQ ID NO: 121330 - DNA, 23 bp, Homo sapiens
gacggtgtctcactctgtcgccc

SEQ ID NO: 121331 - DNA, 23 bp, Homo sapiens
tgtgtatatttgtatatgtgtgt

SEQ ID NO: 121332 - DNA, 23 bp, Homo sapiens
atatatgcatatgtaggcatgtg

SEQ ID NO: 121333 - DNA, 19 bp, Homo sapiens
gtctgtggttagctggttg

SEQ ID NO: 121334 - DNA, 23 bp, Homo sapiens
tgtctctctgaccttaacataag

SEQ ID NO: 121335 - DNA, 20 bp, Homo sapiens
tgagaagtgttgttcatgtc

SEQ ID NO: 121336 - DNA, 18 bp, Homo sapiens
ttagaccttcatcaaatg

SEQ ID NO: 121337 - DNA, 23 bp, Homo sapiens
tcaagtgctaattagttagtgtc

SEQ ID NO: 121338 - DNA, 21 bp, Homo sapiens
actcagaagtcactgaggaca

SEQ ID NO: 121339 - DNA, 19 bp, Homo sapiens
tttggcttaggattgtctt

SEQ ID NO: 121340 - DNA, 23 bp, Homo sapiens
ttgttgtagtagcttgaatagtt

SEQ ID NO: 121341 - DNA, 23 bp, Homo sapiens
cactctcagactagtgttataga

SEQ ID NO: 121342 - DNA, 23 bp, Homo sapiens
cacacacacacatatatatgtgt

SEQ ID NO: 121343 - DNA, 21 bp, Homo sapiens
atatgtgtgtgtatatgtaca

SEQ ID NO: 121344 - DNA, 18 bp, Homo sapiens
tagcttgatggggatagc

SEQ ID NO: 121345 - DNA, 23 bp, Homo sapiens
tcaaggcattttgttgttgactt

SEQ ID NO: 121346 - DNA, 22 bp, Homo sapiens
caataccatctgcttattatga

SEQ ID NO: 121347 - DNA, 22 bp, Homo sapiens
tatatgtacttatagatacttg

SEQ ID NO: 121348 - DNA, 20 bp, Homo sapiens
tatgcatatatatactaata

SEQ ID NO: 121349 - DNA, 18 bp, Homo sapiens
ttatgcttgtatatataa

SEQ ID NO: 121350 - DNA, 23 bp, Homo sapiens
tgagacagagtctggctctgtcg

SEQ ID NO: 121351 - DNA, 23 bp, Homo sapiens
catctgtctctgtcagtccatcc

SEQ ID NO: 121352 - DNA, 19 bp, Homo sapiens
tatctatacctatctctat

SEQ ID NO: 121353 - DNA, 20 bp, Homo sapiens
tatattgagagatagatcta

SEQ ID NO: 121354 - DNA, 23 bp, Homo sapiens
atatatgtatgtatgtatatgta

SEQ ID NO: 121355 - DNA, 22 bp, Homo sapiens
atgtgtatatatatgtgtgtgt

SEQ ID NO: 121356 - DNA, 22 bp, Homo sapiens
tgtgaagaaagtcattggtagt

SEQ ID NO: 121357 - DNA, 20 bp, Homo sapiens
tgtttgtctgttattgatgt

SEQ ID NO: 121358 - DNA, 19 bp, Homo sapiens
aaatggttaatgaggtaat

SEQ ID NO: 121359 - DNA, 22 bp, Homo sapiens
tcaattgttttatatatatgct

SEQ ID NO: 121360 - DNA, 23 bp, Homo sapiens
atgtatgtatgtatgtgtgtgtg

SEQ ID NO: 121361 - DNA, 19 bp, Homo sapiens
atacctcaatgtgctttta

SEQ ID NO: 121362 - DNA, 21 bp, Homo sapiens
atgattagtgatattgaacat

SEQ ID NO: 121363 - DNA, 18 bp, Homo sapiens
atactatatatgtatatg

SEQ ID NO: 121364 - DNA, 23 bp, Homo sapiens
tgccttttctgtatctattgaga

SEQ ID NO: 121365 - DNA, 22 bp, Homo sapiens
agtgagagagaagagacagcag

SEQ ID NO: 121366 - DNA, 20 bp, Homo sapiens
atattgcatatctatagcat

SEQ ID NO: 121367 - DNA, 20 bp, Homo sapiens
actatgtatatctatatcta

SEQ ID NO: 121368 - DNA, 23 bp, Homo sapiens
taagcttgatcctgtcatgaaaa

SEQ ID NO: 121369 - DNA, 21 bp, Homo sapiens
ttgatgtgatagattgtttaa

SEQ ID NO: 121370 - DNA, 20 bp, Homo sapiens
actagtgttttttttttctt

SEQ ID NO: 121371 - DNA, 21 bp, Homo sapiens
tgaggacctaggtgtctctct

SEQ ID NO: 121372 - DNA, 22 bp, Homo sapiens
gtgtgtatgaatttatgtgtgt

SEQ ID NO: 121373 - DNA, 21 bp, Homo sapiens
tataccttggaaaccaaagag

SEQ ID NO: 121374 - DNA, 23 bp, Homo sapiens
tgtgtgtgtgtgagagagagaga

SEQ ID NO: 121375 - DNA, 23 bp, Homo sapiens
agacattgtgaaggtatactgaa

SEQ ID NO: 121376 - DNA, 18 bp, Homo sapiens
acagagtctttcagtgtc

SEQ ID NO: 121377 - DNA, 22 bp, Homo sapiens
tttaagcagtgtatgcagttga

SEQ ID NO: 121378 - DNA, 18 bp, Homo sapiens
aagtgtgtaaattgtggt

SEQ ID NO: 121379 - DNA, 23 bp, Homo sapiens
gtattatccttagtcatcctttg

SEQ ID NO: 121380 - DNA, 23 bp, Homo sapiens
ttatgcttaaatttcaaaggagc

SEQ ID NO: 121381 - DNA, 19 bp, Homo sapiens
tgtacagacattatgtaca

SEQ ID NO: 121382 - DNA, 23 bp, Homo sapiens
atttatgtacataatgtatttgt

SEQ ID NO: 121383 - DNA, 22 bp, Homo sapiens
ggttgaatattgattatcttct

SEQ ID NO: 121384 - DNA, 22 bp, Homo sapiens
atatgattagatgaattctcat

SEQ ID NO: 121385 - DNA, 20 bp, Homo sapiens
tgacttgtgtttttggtctt

SEQ ID NO: 121386 - DNA, 23 bp, Homo sapiens
ttagcatatgtagtaatcgcacc

SEQ ID NO: 121387 - DNA, 18 bp, Homo sapiens
atggtttgagcttttgcc

SEQ ID NO: 121388 - DNA, 23 bp, Homo sapiens
gtgtgtgtgtgtgtgtgtgcaag

SEQ ID NO: 121389 - DNA, 23 bp, Homo sapiens
ctgaatgatgtaccgtacactgt

SEQ ID NO: 121390 - DNA, 23 bp, Homo sapiens
ttacacattttgttattgtgtgg

SEQ ID NO: 121391 - DNA, 21 bp, Homo sapiens
tactggtaattctcatttagc

SEQ ID NO: 121392 - DNA, 22 bp, Homo sapiens
atgtctttttatttctatgaga

SEQ ID NO: 121393 - DNA, 23 bp, Homo sapiens
tgagttcattgtagattctggat

SEQ ID NO: 121394 - DNA, 23 bp, Homo sapiens
tatatagtatatgtatatgtatg

SEQ ID NO: 121395 - DNA, 23 bp, Homo sapiens
tatatagtatatgtatagtatat

SEQ ID NO: 121396 - DNA, 23 bp, Homo sapiens
atatctatatttatatatgtgtg

SEQ ID NO: 121397 - DNA, 23 bp, Homo sapiens
aactaaggtaaagtgtatttctt

SEQ ID NO: 121398 - DNA, 22 bp, Homo sapiens
taccatttgaaatgtatttatt

SEQ ID NO: 121399 - DNA, 22 bp, Homo sapiens
actaagtgctagtcactgtgga

SEQ ID NO: 121400 - DNA, 23 bp, Homo sapiens
ttacacacacgtaatggtgtgtg

SEQ ID NO: 121401 - DNA, 23 bp, Homo sapiens
atacacacacatacatatacatg

SEQ ID NO: 121402 - DNA, 19 bp, Homo sapiens
tgggagactccatttttct

SEQ ID NO: 121403 - DNA, 18 bp, Homo sapiens
actattagattttgtgag

SEQ ID NO: 121404 - DNA, 23 bp, Homo sapiens
tcagtcactgagtctgatgtttg

SEQ ID NO: 121405 - DNA, 23 bp, Homo sapiens
tggagtctcactctgtcacccag

SEQ ID NO: 121406 - DNA, 20 bp, Homo sapiens
agtttcactgtgttaatctc

SEQ ID NO: 121407 - DNA, 23 bp, Homo sapiens
ttctctctctctctttttggaga

SEQ ID NO: 121408 - DNA, 23 bp, Homo sapiens
gatggagtctcactctgtcaccc

SEQ ID NO: 121409 - DNA, 23 bp, Homo sapiens
tacatgtgcagaatgtgcaggtt

SEQ ID NO: 121410 - DNA, 23 bp, Homo sapiens
tgagttcattgtagattctggat

SEQ ID NO: 121411 - DNA, 23 bp, Homo sapiens
tgagttcattgtagattctggat

SEQ ID NO: 121412 - DNA, 22 bp, Homo sapiens
ttacagactccagtgtctccag

SEQ ID NO: 121413 - DNA, 23 bp, Homo sapiens
aatgtcactgtagactgtgtcca

SEQ ID NO: 121414 - DNA, 23 bp, Homo sapiens
actctacaagccagaagagagtg

SEQ ID NO: 121415 - DNA, 23 bp, Homo sapiens
tgagacatggtctcactctctaa

SEQ ID NO: 121416 - DNA, 23 bp, Homo sapiens
taaagacacaaaaggaatggaga

SEQ ID NO: 121417 - DNA, 22 bp, Homo sapiens
atatctatacatatctatccat

SEQ ID NO: 121418 - DNA, 22 bp, Homo sapiens
atatctatacatatctatccat

SEQ ID NO: 121419 - DNA, 22 bp, Homo sapiens
atatctatacatatctatccat

SEQ ID NO: 121420 - DNA, 22 bp, Homo sapiens
atatctatacatatctatccat

SEQ ID NO: 121421 - DNA, 22 bp, Homo sapiens
atatctatacatatctatccat

SEQ ID NO: 121422 - DNA, 22 bp, Homo sapiens
atatctatacatatctatccat

SEQ ID NO: 121423 - DNA, 22 bp, Homo sapiens
atatctatacatatctatccat

SEQ ID NO: 121424 - DNA, 22 bp, Homo sapiens
atatctatacatatctatccat

SEQ ID NO: 121425 - DNA, 22 bp, Homo sapiens
atatctatacatatctatccat

SEQ ID NO: 121426 - DNA, 22 bp, Homo sapiens
atatctatacatatctatccat

SEQ ID NO: 121427 - DNA, 22 bp, Homo sapiens
atatctatacatatctatccat

SEQ ID NO: 121428 - DNA, 22 bp, Homo sapiens
attccatatatattccatagag

SEQ ID NO: 121429 - DNA, 20 bp, Homo sapiens
tcagaaactcattcttttct

SEQ ID NO: 121430 - DNA, 23 bp, Homo sapiens
gttatgtggatatattgaggagt

SEQ ID NO: 121431 - DNA, 21 bp, Homo sapiens
acatgtgcacattgtgcaggt

SEQ ID NO: 121432 - DNA, 20 bp, Homo sapiens
gactagagtatgcaacctca

SEQ ID NO: 121433 - DNA, 22 bp, Homo sapiens
tgtgtatatatgtatatatgtg

SEQ ID NO: 121434 - DNA, 20 bp, Homo sapiens
atgtgtgtatatatatatgt

SEQ ID NO: 121435 - DNA, 22 bp, Homo sapiens
tacattatatatgtatatgcat

SEQ ID NO: 121436 - DNA, 21 bp, Homo sapiens
tgtatatagcatgcttatata

SEQ ID NO: 121437 - DNA, 19 bp, Homo sapiens
taatttggaatgaagtaag

SEQ ID NO: 121438 - DNA, 22 bp, Homo sapiens
cacacactagagtttctctttt

SEQ ID NO: 121439 - DNA, 23 bp, Homo sapiens
tttaactagagggagcaatggtg

SEQ ID NO: 121440 - DNA, 23 bp, Homo sapiens
tggagtctcactctgtcacccag

SEQ ID NO: 121441 - DNA, 23 bp, Homo sapiens
gacagcatctctggctttgttgt

SEQ ID NO: 121442 - DNA, 23 bp, Homo sapiens
aacttgagccagattatcttatt

SEQ ID NO: 121443 - DNA, 23 bp, Homo sapiens
tttttaatcatgataagaagtca

SEQ ID NO: 121444 - DNA, 23 bp, Homo sapiens
tggagtctcactctgtcacccag

SEQ ID NO: 121445 - DNA, 20 bp, Homo sapiens
tcactgtctctcactttaaa

SEQ ID NO: 121446 - DNA, 19 bp, Homo sapiens
agagattatagaaagagct

SEQ ID NO: 121447 - DNA, 23 bp, Homo sapiens
taagtgtgtggaaatgttttgtt

SEQ ID NO: 121448 - DNA, 21 bp, Homo sapiens
tattttctatttctctgtgtg

SEQ ID NO: 121449 - DNA, 22 bp, Homo sapiens
tttcgagatggagtcttgctct

SEQ ID NO: 121450 - DNA, 23 bp, Homo sapiens
taagagtctgcaaatagaaagaa

SEQ ID NO: 121451 - DNA, 19 bp, Homo sapiens
tcaggaagttagagaaaca

SEQ ID NO: 121452 - DNA, 23 bp, Homo sapiens
agagcatatgatttcaagtgtat

SEQ ID NO: 121453 - DNA, 23 bp, Homo sapiens
attcctatcactgcattcctttt

SEQ ID NO: 121454 - DNA, 21 bp, Homo sapiens
tggagtctcgctctgtcaccc

SEQ ID NO: 121455 - DNA, 23 bp, Homo sapiens
tgagatggagtctggctctgtcg

SEQ ID NO: 121456 - DNA, 19 bp, Homo sapiens
agacaagtgacaaagtttt

SEQ ID NO: 121457 - DNA, 20 bp, Homo sapiens
atatctgtatatatatatgt

SEQ ID NO: 121458 - DNA, 19 bp, Homo sapiens
tacttaacagaatgacttc

SEQ ID NO: 121459 - DNA, 23 bp, Homo sapiens
gagacggaatctcactctgtcac

SEQ ID NO: 121460 - DNA, 23 bp, Homo sapiens
cggagtctcgctctgtcactcag

SEQ ID NO: 121461 - DNA, 23 bp, Homo sapiens
tgattttcattctaattttgtgc

SEQ ID NO: 121462 - DNA, 21 bp, Homo sapiens
tgaggtaggaggatcacttga

SEQ ID NO: 121463 - DNA, 23 bp, Homo sapiens
gagacagagtctggctctgttgc

SEQ ID NO: 121464 - DNA, 23 bp, Homo sapiens
agtctcagctactcaagaggctg

SEQ ID NO: 121465 - DNA, 23 bp, Homo sapiens
gaaacaggcagaggttgcagtga

SEQ ID NO: 121466 - DNA, 23 bp, Homo sapiens
atgtgtgtatatatgtgtgtgtg

SEQ ID NO: 121467 - DNA, 23 bp, Homo sapiens
attgcttcatatatatagtgtgt

SEQ ID NO: 121468 - DNA, 23 bp, Homo sapiens
tttttggataagtaacccaaagt

SEQ ID NO: 121469 - DNA, 21 bp, Homo sapiens
ttaatcatgtttgaggttcaa

SEQ ID NO: 121470 - DNA, 23 bp, Homo sapiens
atgtcctctctttcattcctgat

SEQ ID NO: 121471 - DNA, 23 bp, Homo sapiens
tgtagtatgtgataggacaagtg

SEQ ID NO: 121472 - DNA, 20 bp, Homo sapiens
tatggatttatatggatttt

SEQ ID NO: 121473 - DNA, 19 bp, Homo sapiens
tgtggatatatatccatat

SEQ ID NO: 121474 - DNA, 22 bp, Homo sapiens
tcagaacttcatcccttttaat

SEQ ID NO: 121475 - DNA, 18 bp, Homo sapiens
tcagttgataggtatttg

SEQ ID NO: 121476 - DNA, 20 bp, Homo sapiens
atatatctgtatatgtattt

SEQ ID NO: 121477 - DNA, 23 bp, Homo sapiens
gagtctcactctgtcactcaggc

SEQ ID NO: 121478 - DNA, 23 bp, Homo sapiens
atagaaaaataattgggtagggt

SEQ ID NO: 121479 - DNA, 23 bp, Homo sapiens
gtgtgtattcacactggtgtgca

SEQ ID NO: 121480 - DNA, 23 bp, Homo sapiens
caatatgtcttgacactggtgat

SEQ ID NO: 121481 - DNA, 23 bp, Homo sapiens
tttagcagtgagtaagttgaggc

SEQ ID NO: 121482 - DNA, 23 bp, Homo sapiens
tgaggtgtgtacatgtatgcata

SEQ ID NO: 121483 - DNA, 23 bp, Homo sapiens
agacagagtctcgctctgtcacc

SEQ ID NO: 121484 - DNA, 18 bp, Homo sapiens
tggcatgatctcggctca

SEQ ID NO: 121485 - DNA, 23 bp, Homo sapiens
cggagtctcactctgtcacccag

SEQ ID NO: 121486 - DNA, 23 bp, Homo sapiens
gagtctcactctgtcacccaggc

SEQ ID NO: 121487 - DNA, 23 bp, Homo sapiens
tctcacacacacaaagaacctag

SEQ ID NO: 121488 - DNA, 22 bp, Homo sapiens
tgtgtatatatgtatatatgtg

SEQ ID NO: 121489 - DNA, 23 bp, Homo sapiens
atatgtgtatatgtatatgtgtg

SEQ ID NO: 121490 - DNA, 23 bp, Homo sapiens
acacatactctacaggaaaaggt

SEQ ID NO: 121491 - DNA, 23 bp, Homo sapiens
tggagtctcactctgtcacccag

SEQ ID NO: 121492 - DNA, 23 bp, Homo sapiens
tttttaactttttgatgtggcta

SEQ ID NO: 121493 - DNA, 23 bp, Homo sapiens
tgagcctgtcacagtgcctgtca

SEQ ID NO: 121494 - DNA, 23 bp, Homo sapiens
taacacacacagtttaagcagtc

SEQ ID NO: 121495 - DNA, 23 bp, Homo sapiens
ttctcagtgtttttgtctcttat

SEQ ID NO: 121496 - DNA, 22 bp, Homo sapiens
gtgtataccttgtgatatcatt

SEQ ID NO: 121497 - DNA, 23 bp, Homo sapiens
tatcacagtgggtgtacactctg

SEQ ID NO: 121498 - DNA, 23 bp, Homo sapiens
tatacgtatatatatatatgtac

SEQ ID NO: 121499 - DNA, 23 bp, Homo sapiens
ggagtctcactctgtctcccagg

SEQ ID NO: 121500 - DNA, 22 bp, Homo sapiens
agcaggaggtgacattggactt

SEQ ID NO: 121501 - DNA, 23 bp, Homo sapiens
tatgtgagagtaactattgagtt

SEQ ID NO: 121502 - DNA, 22 bp, Homo sapiens
acctttagttatcttggtatat

SEQ ID NO: 121503 - DNA, 23 bp, Homo sapiens
gagacagagtctcgctctgtggc

SEQ ID NO: 121504 - DNA, 19 bp, Homo sapiens
tgagccagcgtgggtggca

SEQ ID NO: 121505 - DNA, 23 bp, Homo sapiens
tgtgaccctgtttctctcactcc

SEQ ID NO: 121506 - DNA, 23 bp, Homo sapiens
aaaggcaatcctagcatagacaa

SEQ ID NO: 121507 - DNA, 22 bp, Homo sapiens
ccagtctcaggctctcagcccc

SEQ ID NO: 121508 - DNA, 21 bp, Homo sapiens
tgtgtacttgtagtcccagct

SEQ ID NO: 121509 - DNA, 23 bp, Homo sapiens
ttgagtgcttttatcatgaaagg

SEQ ID NO: 121510 - DNA, 23 bp, Homo sapiens
tgagttcattgtagattctggat

SEQ ID NO: 121511 - DNA, 23 bp, Homo sapiens
tgagttcattgtagattctggat

SEQ ID NO: 121512 - DNA, 23 bp, Homo sapiens
aaagcacagaagacagtaaggag

SEQ ID NO: 121513 - DNA, 23 bp, Homo sapiens
tcatgttgtcagagtttctcttg

SEQ ID NO: 121514 - DNA, 22 bp, Homo sapiens
tgtctcccacagtgtctgcctc

SEQ ID NO: 121515 - DNA, 21 bp, Homo sapiens
actgtgtgtcactgtgtgtta

SEQ ID NO: 121516 - DNA, 18 bp, Homo sapiens
gtgttttttgttttttgt

SEQ ID NO: 121517 - DNA, 23 bp, Homo sapiens
gacagagtctcgctctgtcaccc

SEQ ID NO: 121518 - DNA, 21 bp, Homo sapiens
tgacagagtaagatcatgtct

SEQ ID NO: 121519 - DNA, 23 bp, Homo sapiens
ttcaacagtctcattttgtagcc

SEQ ID NO: 121520 - DNA, 21 bp, Homo sapiens
acagtagtgtgcagtaatgtc

SEQ ID NO: 121521 - DNA, 18 bp, Homo sapiens
accttgtctgtataagaa

SEQ ID NO: 121522 - DNA, 18 bp, Homo sapiens
tgagatggagtctcactc

SEQ ID NO: 121523 - DNA, 23 bp, Homo sapiens
tcacagtctcactctgtcactta

SEQ ID NO: 121524 - DNA, 21 bp, Homo sapiens
cacactcacacacattacata

SEQ ID NO: 121525 - DNA, 22 bp, Homo sapiens
tgagtgtgtatgtgtatatgtg

SEQ ID NO: 121526 - DNA, 23 bp, Homo sapiens
ttgagatggagttttgctcttgt

SEQ ID NO: 121527 - DNA, 20 bp, Homo sapiens
atgtgccaggtactattctg

SEQ ID NO: 121528 - DNA, 20 bp, Homo sapiens
tagaagaggaaagaggtaac

SEQ ID NO: 121529 - DNA, 23 bp, Homo sapiens
tttgtttctctctgtatttgaag

SEQ ID NO: 121530 - DNA, 20 bp, Homo sapiens
tatgtcgttctttgatttgt

SEQ ID NO: 121531 - DNA, 23 bp, Homo sapiens
attagtcattcctgaagaagttt

SEQ ID NO: 121532 - DNA, 23 bp, Homo sapiens
cttacaggtgttcctgctgtata

SEQ ID NO: 121533 - DNA, 23 bp, Homo sapiens
agttgaaagagtggagatgattt

SEQ ID NO: 121534 - DNA, 22 bp, Homo sapiens
taaaacctgtatgtgtagcctc

SEQ ID NO: 121535 - DNA, 23 bp, Homo sapiens
tgagttcattgtagattctggat

SEQ ID NO: 121536 - DNA, 23 bp, Homo sapiens
tgagttcattgtagattctggat

SEQ ID NO: 121537 - DNA, 23 bp, Homo sapiens
tctgtgaagaaagtcaatggtag

SEQ ID NO: 121538 - DNA, 23 bp, Homo sapiens
gacccaatctctctctttcactt

SEQ ID NO: 121539 - DNA, 20 bp, Homo sapiens
atctctgcctcccagactca

SEQ ID NO: 121540 - DNA, 22 bp, Homo sapiens
atttgctcatgtgacacacaca

SEQ ID NO: 121541 - DNA, 23 bp, Homo sapiens
tgagttcattgtagattctggat

SEQ ID NO: 121542 - DNA, 23 bp, Homo sapiens
tgagttcattgtagattctggat

SEQ ID NO: 121543 - DNA, 22 bp, Homo sapiens
tacacataggtatacttacata

SEQ ID NO: 121544 - DNA, 23 bp, Homo sapiens
aatgagctcatcaagcagcagtg

SEQ ID NO: 121545 - DNA, 23 bp, Homo sapiens
tttgttttagtaggacttcagta

SEQ ID NO: 121546 - DNA, 23 bp, Homo sapiens
tgagttcattgtagattctggat

SEQ ID NO: 121547 - DNA, 23 bp, Homo sapiens
tgagttcattgtagattctggat

SEQ ID NO: 121548 - DNA, 22 bp, Homo sapiens
tttaatccagtcatctattgat

SEQ ID NO: 121549 - DNA, 23 bp, Homo sapiens
atcaatatgaacctgcattctgt

SEQ ID NO: 121550 - DNA, 20 bp, Homo sapiens
atttggacatatatgtatgt

SEQ ID NO: 121551 - DNA, 23 bp, Homo sapiens
ttcaccccaaatgttttcagaga

SEQ ID NO: 121552 - DNA, 23 bp, Homo sapiens
agctacttatagatgctggatat

SEQ ID NO: 121553 - DNA, 23 bp, Homo sapiens
aggtacacactgaaaatgtatta

SEQ ID NO: 121554 - DNA, 23 bp, Homo sapiens
tacatgtgcagaatgtgcaggtt

SEQ ID NO: 121555 - DNA, 23 bp, Homo sapiens
ggatcacttgagcctgagcagtt

SEQ ID NO: 121556 - DNA, 20 bp, Homo sapiens
tctctcattgtctcttttca

SEQ ID NO: 121557 - DNA, 18 bp, Homo sapiens
tttatcactgtgggtgtg

SEQ ID NO: 121558 - DNA, 22 bp, Homo sapiens
gtatagtgatctgagatcagtg

SEQ ID NO: 121559 - DNA, 23 bp, Homo sapiens
atatatgtttttctatatatgtg

SEQ ID NO: 121560 - DNA, 20 bp, Homo sapiens
tcccttccgtttaatcagtg

SEQ ID NO: 121561 - DNA, 23 bp, Homo sapiens
atactgcttctaggtttaatagt

SEQ ID NO: 121562 - DNA, 21 bp, Homo sapiens
attaggttgaaccttgaactg

SEQ ID NO: 121563 - DNA, 20 bp, Homo sapiens
aacagtgtctgtgttcttgt

SEQ ID NO: 121564 - DNA, 23 bp, Homo sapiens
tgagttcattgtagattctggat

SEQ ID NO: 121565 - DNA, 23 bp, Homo sapiens
tgagttcattgtagattctggat

SEQ ID NO: 121566 - DNA, 23 bp, Homo sapiens
tacaagcagcagagactgttcac

SEQ ID NO: 121567 - DNA, 22 bp, Homo sapiens
acatgtgcagaatgtgctggtt

SEQ ID NO: 121568 - DNA, 23 bp, Homo sapiens
tgaagtctgtggtttagttaaca

SEQ ID NO: 121569 - DNA, 23 bp, Homo sapiens
ttcaaggttgtagtgagctatga

SEQ ID NO: 121570 - DNA, 22 bp, Homo sapiens
aattcactcatgatttggctct

SEQ ID NO: 121571 - DNA, 23 bp, Homo sapiens
caggaaatgtgtgcatgtgcatg

SEQ ID NO: 121572 - DNA, 23 bp, Homo sapiens
acacactcacaccattttttatt

SEQ ID NO: 121573 - DNA, 21 bp, Homo sapiens
agtcacactctgtgtctacag

SEQ ID NO: 121574 - DNA, 18 bp, Homo sapiens
tgtagtgttcatattggt

SEQ ID NO: 121575 - DNA, 19 bp, Homo sapiens
aatgtgtctgatctatggt

SEQ ID NO: 121576 - DNA, 22 bp, Homo sapiens
tgaggcactgactttgttgtgt

SEQ ID NO: 121577 - DNA, 20 bp, Homo sapiens
tgtggtatatacatgtatgt

SEQ ID NO: 121578 - DNA, 23 bp, Homo sapiens
tgagttcattgtagattctggat

SEQ ID NO: 121579 - DNA, 23 bp, Homo sapiens
tgagttcattgtagattctggat

SEQ ID NO: 121580 - DNA, 21 bp, Homo sapiens
tggcaggcagcctctatggct

SEQ ID NO: 121581 - DNA, 23 bp, Homo sapiens
ttggatggaaatgtactcattgt

SEQ ID NO: 121582 - DNA, 23 bp, Homo sapiens
ttagagagtgggactattttcca

SEQ ID NO: 121583 - DNA, 23 bp, Homo sapiens
cacatgtgtatatgtatgtatat

SEQ ID NO: 121584 - DNA, 23 bp, Homo sapiens
tgtgtgcatgtttgtgtgtatat

SEQ ID NO: 121585 - DNA, 23 bp, Homo sapiens
agctgttctcattttgaagttgt

SEQ ID NO: 121586 - DNA, 23 bp, Homo sapiens
tgtatgtgtatatgtatatgtgt

SEQ ID NO: 121587 - DNA, 23 bp, Homo sapiens
atatacacatatacatatacaca

SEQ ID NO: 121588 - DNA, 23 bp, Homo sapiens
ttgagttagaagcttgtttgcta

SEQ ID NO: 121589 - DNA, 23 bp, Homo sapiens
tagaggagtcttttaccagttga

SEQ ID NO: 121590 - DNA, 21 bp, Homo sapiens
tgtgaagaaagtcattggtag

SEQ ID NO: 121591 - DNA, 23 bp, Homo sapiens
gtgtcacagctacttcatctgcc

SEQ ID NO: 121592 - DNA, 19 bp, Homo sapiens
agtgtatatatatacagta

SEQ ID NO: 121593 - DNA, 23 bp, Homo sapiens
ttttggacagtgataaagaagtg

SEQ ID NO: 121594 - DNA, 20 bp, Homo sapiens
tccgtgtgaagagaccacca

SEQ ID NO: 121595 - DNA, 18 bp, Homo sapiens
tgaactacatctatgtag

SEQ ID NO: 121596 - DNA, 23 bp, Homo sapiens
agatgtcagcagtttggtttctt

SEQ ID NO: 121597 - DNA, 23 bp, Homo sapiens
tggcttgcagatggtcaccttct

SEQ ID NO: 121598 - DNA, 23 bp, Homo sapiens
gagtgcctcagttcacctctatg

SEQ ID NO: 121599 - DNA, 23 bp, Homo sapiens
cagtctgtctctgtcacccaggc

SEQ ID NO: 121600 - DNA, 20 bp, Homo sapiens
agtgcagagacacgatcttg

SEQ ID NO: 121601 - DNA, 23 bp, Homo sapiens
ataagcttagttaagaaatgaag

SEQ ID NO: 121602 - DNA, 23 bp, Homo sapiens
aagactactgatttttgtttctg

SEQ ID NO: 121603 - DNA, 23 bp, Homo sapiens
atgtaagtagtagtactacagct

SEQ ID NO: 121604 - DNA, 23 bp, Homo sapiens
tgagttcattgtagattctggat

SEQ ID NO: 121605 - DNA, 23 bp, Homo sapiens
tgagttcattgtagattctggat

SEQ ID NO: 121606 - DNA, 19 bp, Homo sapiens
agagaatgaaatcacagga

SEQ ID NO: 121607 - DNA, 20 bp, Homo sapiens
taggtgtacacagacatttg

SEQ ID NO: 121608 - DNA, 22 bp, Homo sapiens
ttagcaatgaagtgatgaatga

SEQ ID NO: 121609 - DNA, 23 bp, Homo sapiens
gctctgtgccaggctctatgcca

SEQ ID NO: 121610 - DNA, 22 bp, Homo sapiens
acacgtgtacatatacacgtgt

SEQ ID NO: 121611 - DNA, 21 bp, Homo sapiens
acacgtgtacatatacacgtg

SEQ ID NO: 121612 - DNA, 21 bp, Homo sapiens
tctgggagacagtgattccag

SEQ ID NO: 121613 - DNA, 23 bp, Homo sapiens
tctgcatcactattgatcttagc

SEQ ID NO: 121614 - DNA, 23 bp, Homo sapiens
aatgtggatctagaggctatact

SEQ ID NO: 121615 - DNA, 20 bp, Homo sapiens
gtgtgtgtgtgtgtgtgcaa

SEQ ID NO: 121616 - DNA, 22 bp, Homo sapiens
acagtgatttactatatctctg

SEQ ID NO: 121617 - DNA, 23 bp, Homo sapiens
tacttttcttttagaatagctct

SEQ ID NO: 121618 - DNA, 21 bp, Homo sapiens
ttaaaagaaaatgtgatgcca

SEQ ID NO: 121619 - DNA, 19 bp, Homo sapiens
tcagaagtaacttatagct

SEQ ID NO: 121620 - DNA, 19 bp, Homo sapiens
tcagaagtaacttatagct

SEQ ID NO: 121621 - DNA, 23 bp, Homo sapiens
tgagttcattgtagattctggat

SEQ ID NO: 121622 - DNA, 23 bp, Homo sapiens
tgagttcattgtagattctggat

SEQ ID NO: 121623 - DNA, 23 bp, Homo sapiens
tggggcactgcttgaattcaccg

SEQ ID NO: 121624 - DNA, 19 bp, Homo sapiens
agagttgaagtagtgagca

SEQ ID NO: 121625 - DNA, 23 bp, Homo sapiens
tgagtgaacagtgtcaggtcttg

SEQ ID NO: 121626 - DNA, 21 bp, Homo sapiens
ttccacttcaaaatactgtct

SEQ ID NO: 121627 - DNA, 23 bp, Homo sapiens
acagagtctcgctctgtcaccca

SEQ ID NO: 121628 - DNA, 22 bp, Homo sapiens
tgatacttgttcttggttttca

SEQ ID NO: 121629 - DNA, 23 bp, Homo sapiens
tgagttcattgtagattctggat

SEQ ID NO: 121630 - DNA, 23 bp, Homo sapiens
tgagttcattgtagattctggat

SEQ ID NO: 121631 - DNA, 23 bp, Homo sapiens
actcagcatcatcatctgctgaa

SEQ ID NO: 121632 - DNA, 23 bp, Homo sapiens
gggtctcactctgtcacccaggc

SEQ ID NO: 121633 - DNA, 23 bp, Homo sapiens
gagatttgaatgggaaagttttg

SEQ ID NO: 121634 - DNA, 19 bp, Homo sapiens
ttatgtattgtcttaccat

SEQ ID NO: 121635 - DNA, 23 bp, Homo sapiens
ttctgtgaagaaagtgaatggta

SEQ ID NO: 121636 - DNA, 22 bp, Homo sapiens
tttttatgtagttctgcccctc

SEQ ID NO: 121637 - DNA, 19 bp, Homo sapiens
gtgacttactctctctgtc

SEQ ID NO: 121638 - DNA, 21 bp, Homo sapiens
aagagtaatgaataagtactt

SEQ ID NO: 121639 - DNA, 19 bp, Homo sapiens
gtgagagaatccttctttt

SEQ ID NO: 121640 - DNA, 23 bp, Homo sapiens
tatgtatatatatatgtgtgtgt

SEQ ID NO: 121641 - DNA, 23 bp, Homo sapiens
tgtgtatacacacacacatatat

SEQ ID NO: 121642 - DNA, 23 bp, Homo sapiens
tgagttcattgtagattctggat

SEQ ID NO: 121643 - DNA, 23 bp, Homo sapiens
tgagttcattgtagattctggat

SEQ ID NO: 121644 - DNA, 19 bp, Homo sapiens
atatgtatacttgtatata

SEQ ID NO: 121645 - DNA, 21 bp, Homo sapiens
tgctgtatctcacatattgca

SEQ ID NO: 121646 - DNA, 20 bp, Homo sapiens
atatctgagattataaatgt

SEQ ID NO: 121647 - DNA, 23 bp, Homo sapiens
tttgagacagggtcttgctttgt

SEQ ID NO: 121648 - DNA, 23 bp, Homo sapiens
agaaaggcgtatcagattctcca

SEQ ID NO: 121649 - DNA, 23 bp, Homo sapiens
ataaccttgctttttgtattttt

SEQ ID NO: 121650 - DNA, 23 bp, Homo sapiens
tatacatatatattcatatgtgt

SEQ ID NO: 121651 - DNA, 22 bp, Homo sapiens
tatacatatatattcatatgtg

SEQ ID NO: 121652 - DNA, 22 bp, Homo sapiens
atagaggtggttatagtattct

SEQ ID NO: 121653 - DNA, 23 bp, Homo sapiens
tgagttcattgtagattctggat

SEQ ID NO: 121654 - DNA, 23 bp, Homo sapiens
tgagttcattgtagattctggat

SEQ ID NO: 121655 - DNA, 23 bp, Homo sapiens
gggtctcactctgtcacccaggc

SEQ ID NO: 121656 - DNA, 22 bp, Homo sapiens
tgtgtgtgtgtatatatatacg

SEQ ID NO: 121657 - DNA, 23 bp, Homo sapiens
aagagttgtttcctcattgctta

SEQ ID NO: 121658 - DNA, 23 bp, Homo sapiens
ataggtgtgcatcattatttctg

SEQ ID NO: 121659 - DNA, 19 bp, Homo sapiens
tcatatgtattcatatata

SEQ ID NO: 121660 - DNA, 23 bp, Homo sapiens
tgagttcattgtagattctggat

SEQ ID NO: 121661 - DNA, 23 bp, Homo sapiens
tgagttcattgtagattctggat

SEQ ID NO: 121662 - DNA, 20 bp, Homo sapiens
acacacactgatttgcatga

SEQ ID NO: 121663 - DNA, 22 bp, Homo sapiens
tttccgagttctgtccccctct

SEQ ID NO: 121664 - DNA, 18 bp, Homo sapiens
tacatatatattgtgtat

SEQ ID NO: 121665 - DNA, 23 bp, Homo sapiens
tcttcagtgtcctttaggtgaat

SEQ ID NO: 121666 - DNA, 18 bp, Homo sapiens
acactcttgctctgtcac

SEQ ID NO: 121667 - DNA, 20 bp, Homo sapiens
tctacatacacatacgcgtt

SEQ ID NO: 121668 - DNA, 22 bp, Homo sapiens
aagacatgttttgggagtgaag

SEQ ID NO: 121669 - DNA, 19 bp, Homo sapiens
ctgtgttgttttgaagtaa

SEQ ID NO: 121670 - DNA, 23 bp, Homo sapiens
tgagttcattgtagattctggat

SEQ ID NO: 121671 - DNA, 23 bp, Homo sapiens
tgagttcattgtagattctggat

SEQ ID NO: 121672 - DNA, 23 bp, Homo sapiens
tgagttcattgtagattctggat

SEQ ID NO: 121673 - DNA, 23 bp, Homo sapiens
tgagttcattgtagattctggat

SEQ ID NO: 121674 - DNA, 23 bp, Homo sapiens
agagcatagaagtcagggttaca

SEQ ID NO: 121675 - DNA, 23 bp, Homo sapiens
aaatggtcttactctgtcaccca

SEQ ID NO: 121676 - DNA, 23 bp, Homo sapiens
agcatgtgcataagttttgataa

SEQ ID NO: 121677 - DNA, 23 bp, Homo sapiens
tgagttcattgtagattctggat

SEQ ID NO: 121678 - DNA, 23 bp, Homo sapiens
tgagttcattgtagattctggat

SEQ ID NO: 121679 - DNA, 23 bp, Homo sapiens
gggtctcagtctgtcacccaggc

SEQ ID NO: 121680 - DNA, 23 bp, Homo sapiens
ctgtctctctgtttggggatgtc

SEQ ID NO: 121681 - DNA, 23 bp, Homo sapiens
tatggtatatgtatgtgtatggt

SEQ ID NO: 121682 - DNA, 19 bp, Homo sapiens
cagtgtgtgtgtatgtata

SEQ ID NO: 121683 - DNA, 19 bp, Homo sapiens
tagagtctggctctttttt

SEQ ID NO: 121684 - DNA, 23 bp, Homo sapiens
catatacagggttttctgtggat

SEQ ID NO: 121685 - DNA, 22 bp, Homo sapiens
atatggtagttgcatgtttagt

SEQ ID NO: 121686 - DNA, 23 bp, Homo sapiens
cggagtctcactctgtcacccag

SEQ ID NO: 121687 - DNA, 23 bp, Homo sapiens
gggtgacagtaagactccatgtc

SEQ ID NO: 121688 - DNA, 23 bp, Homo sapiens
ctcactctgtcacccagactaga

SEQ ID NO: 121689 - DNA, 22 bp, Homo sapiens
gcagtgagactctttctctctc

SEQ ID NO: 121690 - DNA, 23 bp, Homo sapiens
cagagtctcgcactgtcaccctg

SEQ ID NO: 121691 - DNA, 23 bp, Homo sapiens
acacagtctcgctgtcacccggg

SEQ ID NO: 121692 - DNA, 20 bp, Homo sapiens
gttattttgtttggaagagg

SEQ ID NO: 121693 - DNA, 23 bp, Homo sapiens
cggagtctcactctgtcacccag

SEQ ID NO: 121694 - DNA, 23 bp, Homo sapiens
gagtctcactctgtcacccaggc

SEQ ID NO: 121695 - DNA, 23 bp, Homo sapiens
tgcagctgacattttcatgttct

SEQ ID NO: 121696 - DNA, 22 bp, Homo sapiens
ggatgaagaagcttttgggaga

SEQ ID NO: 121697 - DNA, 23 bp, Homo sapiens
tttgtgaacaagagatcctagag

SEQ ID NO: 121698 - DNA, 21 bp, Homo sapiens
ttttgagtttgctttgctctt

SEQ ID NO: 121699 - DNA, 19 bp, Homo sapiens
aggagcaaaaggaatctgt

SEQ ID NO: 121700 - DNA, 23 bp, Homo sapiens
tgagttcattgtagattctggat

SEQ ID NO: 121701 - DNA, 23 bp, Homo sapiens
tgagttcattgtagattctggat

SEQ ID NO: 121702 - DNA, 22 bp, Homo sapiens
ttttgagatggagtttcgttct

SEQ ID NO: 121703 - DNA, 23 bp, Homo sapiens
agggactgtgattaggatagatg

SEQ ID NO: 121704 - DNA, 18 bp, Homo sapiens
acacacacacacactttt

SEQ ID NO: 121705 - DNA, 23 bp, Homo sapiens
tgagttcattgtagattctggat

SEQ ID NO: 121706 - DNA, 23 bp, Homo sapiens
tgagttcattgtagattctggat

SEQ ID NO: 121707 - DNA, 23 bp, Homo sapiens
atgtgtatttatacatgagtata

SEQ ID NO: 121708 - DNA, 23 bp, Homo sapiens
tatgagtatatatgtatatatgt

SEQ ID NO: 121709 - DNA, 21 bp, Homo sapiens
tatgtgtatttatgcatatga

SEQ ID NO: 121710 - DNA, 23 bp, Homo sapiens
ctgtcactctgagacaatgggca

SEQ ID NO: 121711 - DNA, 20 bp, Homo sapiens
tgtgtgtgtgtgtacatata

SEQ ID NO: 121712 - DNA, 23 bp, Homo sapiens
atatgtgtatatatatgtgtgtg

SEQ ID NO: 121713 - DNA, 19 bp, Homo sapiens
taggtatatatacatatat

SEQ ID NO: 121714 - DNA, 18 bp, Homo sapiens
tgtatatgtatacacata

SEQ ID NO: 121715 - DNA, 21 bp, Homo sapiens
atacacatgtatattatgtgt

SEQ ID NO: 121716 - DNA, 23 bp, Homo sapiens
aacagagtctcgctctgtcaccc

SEQ ID NO: 121717 - DNA, 21 bp, Homo sapiens
gtgacgctgtctcagctcact

SEQ ID NO: 121718 - DNA, 23 bp, Homo sapiens
atagttgaagttgaggggaatct

SEQ ID NO: 121719 - DNA, 23 bp, Homo sapiens
taaattgatgatgatgatgataa

SEQ ID NO: 121720 - DNA, 23 bp, Homo sapiens
agaactgtgaggttaagttgttt

SEQ ID NO: 121721 - DNA, 19 bp, Homo sapiens
tacaggttgtgggcctggt

SEQ ID NO: 121722 - DNA, 22 bp, Homo sapiens
tctcaggggtttctctctctct

SEQ ID NO: 121723 - DNA, 23 bp, Homo sapiens
ggggtctcactctgtcacccagg

SEQ ID NO: 121724 - DNA, 23 bp, Homo sapiens
aacagtagtgctatttatgttag

SEQ ID NO: 121725 - DNA, 23 bp, Homo sapiens
aacatcagtgctaaagttcactt

SEQ ID NO: 121726 - DNA, 23 bp, Homo sapiens
ataggtacattgtatattagtta

SEQ ID NO: 121727 - DNA, 20 bp, Homo sapiens
ttttctgtactgttgctcac

SEQ ID NO: 121728 - DNA, 18 bp, Homo sapiens
tttcctttttaatagcaa

SEQ ID NO: 121729 - DNA, 23 bp, Homo sapiens
ctcttctggggaaagagttagtg

SEQ ID NO: 121730 - DNA, 23 bp, Homo sapiens
tatgaccttgctattgtctttat

SEQ ID NO: 121731 - DNA, 22 bp, Homo sapiens
taaggtagtttgatttttaatt

SEQ ID NO: 121732 - DNA, 22 bp, Homo sapiens
tatgtatgtatatatatgtgtg

SEQ ID NO: 121733 - DNA, 23 bp, Homo sapiens
atatgtgtatatgtgtatatgtg

SEQ ID NO: 121734 - DNA, 21 bp, Homo sapiens
tatgcatatatatgtgtatgt

SEQ ID NO: 121735 - DNA, 23 bp, Homo sapiens
tttaagagtgcaatagttggtga

SEQ ID NO: 121736 - DNA, 21 bp, Homo sapiens
tatactagagatatagttgga

SEQ ID NO: 121737 - DNA, 23 bp, Homo sapiens
ttgctattccaactacaactcta

SEQ ID NO: 121738 - DNA, 22 bp, Homo sapiens
tctaatgacccaacactgtata

SEQ ID NO: 121739 - DNA, 23 bp, Homo sapiens
cagagtctcactctgtcacccag

SEQ ID NO: 121740 - DNA, 21 bp, Homo sapiens
aatggagttatattcatctga

SEQ ID NO: 121741 - DNA, 22 bp, Homo sapiens
tttagtgctgctttaaatggga

SEQ ID NO: 121742 - DNA, 22 bp, Homo sapiens
tccatgtctttgctattgtaaa

SEQ ID NO: 121743 - DNA, 23 bp, Homo sapiens
gtaaatgcgtagtaatgggattg

SEQ ID NO: 121744 - DNA, 23 bp, Homo sapiens
attctctaaatctaggcttgtca

SEQ ID NO: 121745 - DNA, 23 bp, Homo sapiens
gaaaagagagggatagttggtgc

SEQ ID NO: 121746 - DNA, 21 bp, Homo sapiens
tttcttctattgaaaccaata

SEQ ID NO: 121747 - DNA, 23 bp, Homo sapiens
agtgtctcactctgtcatccaag

SEQ ID NO: 121748 - DNA, 19 bp, Homo sapiens
ttctgaaaatgacaacttg

SEQ ID NO: 121749 - DNA, 22 bp, Homo sapiens
agagatggaatcttcttacgtt

SEQ ID NO: 121750 - DNA, 22 bp, Homo sapiens
ttttttctagtaaaaatgttta

SEQ ID NO: 121751 - DNA, 23 bp, Homo sapiens
catgtctatgtgtaatacataac

SEQ ID NO: 121752 - DNA, 22 bp, Homo sapiens
tgtgtacaaccataaatcatgt

SEQ ID NO: 121753 - DNA, 19 bp, Homo sapiens
tatccatatatagtatatc

SEQ ID NO: 121754 - DNA, 23 bp, Homo sapiens
tcatatctcaggctgctttgtgt

SEQ ID NO: 121755 - DNA, 21 bp, Homo sapiens
agagagaggggttaagataga

SEQ ID NO: 121756 - DNA, 23 bp, Homo sapiens
atatgtgtatatatatatatgtg

SEQ ID NO: 121757 - DNA, 23 bp, Homo sapiens
atatgtgtatatacatatgtgtg

SEQ ID NO: 121758 - DNA, 23 bp, Homo sapiens
atatgtgtatatacatatgtgtg

SEQ ID NO: 121759 - DNA, 21 bp, Homo sapiens
tatatgtatatatgtatatgt

SEQ ID NO: 121760 - DNA, 19 bp, Homo sapiens
atgtgtgtgtgtgtgtgtg

SEQ ID NO: 121761 - DNA, 21 bp, Homo sapiens
tatatacattttatatatgtg

SEQ ID NO: 121762 - DNA, 23 bp, Homo sapiens
tatatatacacacacatatacat

SEQ ID NO: 121763 - DNA, 23 bp, Homo sapiens
acacacatatacatatgtatgtg

SEQ ID NO: 121764 - DNA, 23 bp, Homo sapiens
tctatagatatgaagtttcctga

SEQ ID NO: 121765 - DNA, 23 bp, Homo sapiens
aatgacgatttttatcaggtaaa

SEQ ID NO: 121766 - DNA, 23 bp, Homo sapiens
tttatgtcagttactgcttctgg

SEQ ID NO: 121767 - DNA, 23 bp, Homo sapiens
ttcacacagaatttgttaagata

SEQ ID NO: 121768 - DNA, 21 bp, Homo sapiens
taaacacacacatatatatgt

SEQ ID NO: 121769 - DNA, 23 bp, Homo sapiens
atgtgtgcctgtgtgtgtgtatg

SEQ ID NO: 121770 - DNA, 23 bp, Homo sapiens
gtgtgtgtgcatctgtgtgtgta

SEQ ID NO: 121771 - DNA, 23 bp, Homo sapiens
tgtgagccaatgtgctcagcttc

SEQ ID NO: 121772 - DNA, 20 bp, Homo sapiens
atttggacatattttctaat

SEQ ID NO: 121773 - DNA, 23 bp, Homo sapiens
tctgtgaaggatattattggtat

SEQ ID NO: 121774 - DNA, 23 bp, Homo sapiens
ttttatgtacatgtacatatgat

SEQ ID NO: 121775 - DNA, 23 bp, Homo sapiens
tatgtacatgcacatatgatatg

SEQ ID NO: 121776 - DNA, 23 bp, Homo sapiens
tattgtgtcatttattgatgtgt

SEQ ID NO: 121777 - DNA, 23 bp, Homo sapiens
agaaagatcagactgagctgaag

SEQ ID NO: 121778 - DNA, 20 bp, Homo sapiens
agtgaactgtgtatgcttag

SEQ ID NO: 121779 - DNA, 22 bp, Homo sapiens
ttatttctgttaagctttgtca

SEQ ID NO: 121780 - DNA, 19 bp, Homo sapiens
tttgctaaaatatagtatt

SEQ ID NO: 121781 - DNA, 23 bp, Homo sapiens
gtttttaacagagattggtgttg

SEQ ID NO: 121782 - DNA, 20 bp, Homo sapiens
acacacacacatatacatat

SEQ ID NO: 121783 - DNA, 23 bp, Homo sapiens
agactgtgctttgaccctgtgca

SEQ ID NO: 121784 - DNA, 23 bp, Homo sapiens
tatgtgtgcataaaatatgtgtg

SEQ ID NO: 121785 - DNA, 19 bp, Homo sapiens
tgaatatatgttggaatgt

SEQ ID NO: 121786 - DNA, 23 bp, Homo sapiens
gaagtatctagtcatttagttca

SEQ ID NO: 121787 - DNA, 23 bp, Homo sapiens
aatagttacaggaatagatgagc

SEQ ID NO: 121788 - DNA, 23 bp, Homo sapiens
actggaacttttttctctgtggt

SEQ ID NO: 121789 - DNA, 23 bp, Homo sapiens
tagtagtactaagcaatatgaga

SEQ ID NO: 121790 - DNA, 23 bp, Homo sapiens
tggatttaagtctgtaatccatt

SEQ ID NO: 121791 - DNA, 22 bp, Homo sapiens
tttattcttctacatatggcta

SEQ ID NO: 121792 - DNA, 23 bp, Homo sapiens
tgatatcaggccactctcacagt

SEQ ID NO: 121793 - DNA, 19 bp, Homo sapiens
gtctcgctctgtcacccag

SEQ ID NO: 121794 - DNA, 20 bp, Homo sapiens
ttttttgatgaaagagtaga

SEQ ID NO: 121795 - DNA, 23 bp, Homo sapiens
tgagttcattgtagattctggat

SEQ ID NO: 121796 - DNA, 23 bp, Homo sapiens
tgagttcattgtagattctggat

SEQ ID NO: 121797 - DNA, 22 bp, Homo sapiens
tgtcagtgagtatcagtttatt

SEQ ID NO: 121798 - DNA, 20 bp, Homo sapiens
ttgcctgggagagtccatgc

SEQ ID NO: 121799 - DNA, 21 bp, Homo sapiens
tatgcatatatatgtatatga

SEQ ID NO: 121800 - DNA, 22 bp, Homo sapiens
atatatgtatatgtatatgaca

SEQ ID NO: 121801 - DNA, 21 bp, Homo sapiens
atatatgtatatgtatatgac

SEQ ID NO: 121802 - DNA, 23 bp, Homo sapiens
gtctgggactctgactggctctc

SEQ ID NO: 121803 - DNA, 23 bp, Homo sapiens
tgatgatattttgtatttctgtg

SEQ ID NO: 121804 - DNA, 23 bp, Homo sapiens
caatggaaatgtcacttttgtca

SEQ ID NO: 121805 - DNA, 21 bp, Homo sapiens
ttttggccaaggtagaatact

SEQ ID NO: 121806 - DNA, 20 bp, Homo sapiens
atgagtagagaattcactga

SEQ ID NO: 121807 - DNA, 23 bp, Homo sapiens
ttatattcatcatgatctagtca

SEQ ID NO: 121808 - DNA, 19 bp, Homo sapiens
gtatgtaagcatgtgtgta

SEQ ID NO: 121809 - DNA, 18 bp, Homo sapiens
ttatattatgtatttcta

SEQ ID NO: 121810 - DNA, 21 bp, Homo sapiens
aactgcatatattagcactgc

SEQ ID NO: 121811 - DNA, 23 bp, Homo sapiens
atgtgtgtatatatatatgtgtg

SEQ ID NO: 121812 - DNA, 23 bp, Homo sapiens
acttgagtcaagagcctcagcac

SEQ ID NO: 121813 - DNA, 21 bp, Homo sapiens
gtcttgacattttctagttct

SEQ ID NO: 121814 - DNA, 18 bp, Homo sapiens
aaagggacagaatcagga

SEQ ID NO: 121815 - DNA, 23 bp, Homo sapiens
tgtatatgtatatgtgtatgtat

SEQ ID NO: 121816 - DNA, 21 bp, Homo sapiens
tgtgtatagtgtgagataaga

SEQ ID NO: 121817 - DNA, 22 bp, Homo sapiens
taccagctacataaagttgtga

SEQ ID NO: 121818 - DNA, 23 bp, Homo sapiens
agtagcaatagtagttgagatac

SEQ ID NO: 121819 - DNA, 23 bp, Homo sapiens
acatatctctgtatttatatgtg

SEQ ID NO: 121820 - DNA, 21 bp, Homo sapiens
agatagatcttctgggtaact

SEQ ID NO: 121821 - DNA, 23 bp, Homo sapiens
taagtgtgcatgtgtatgtatat

SEQ ID NO: 121822 - DNA, 23 bp, Homo sapiens
tctctgtctcacagatttatgac

SEQ ID NO: 121823 - DNA, 22 bp, Homo sapiens
ggattcatacatatctctgagg

SEQ ID NO: 121824 - DNA, 23 bp, Homo sapiens
tatatatgtgtgtaaatatgtgt

SEQ ID NO: 121825 - DNA, 23 bp, Homo sapiens
gaagggtgaggatgacatgagta

SEQ ID NO: 121826 - DNA, 22 bp, Homo sapiens
aactcacttgatcgtggtgtat

SEQ ID NO: 121827 - DNA, 23 bp, Homo sapiens
tgatatgctgtttgattcagtta

SEQ ID NO: 121828 - DNA, 22 bp, Homo sapiens
aaagtcagggattatgttgaaa

SEQ ID NO: 121829 - DNA, 22 bp, Homo sapiens
tgtcttggggttctgaatcttt

SEQ ID NO: 121830 - DNA, 22 bp, Homo sapiens
gtgtgtctgtgtgtccatataa

SEQ ID NO: 121831 - DNA, 22 bp, Homo sapiens
acaaggttcaggaaggagcaaa

SEQ ID NO: 121832 - DNA, 23 bp, Homo sapiens
gacactctgagacagaaatgaca

SEQ ID NO: 121833 - DNA, 21 bp, Homo sapiens
tatacagtatgtaatttgtgt

SEQ ID NO: 121834 - DNA, 19 bp, Homo sapiens
agacagagtctcgctctgt

SEQ ID NO: 121835 - DNA, 23 bp, Homo sapiens
ggctgtgagtgtctgtgtgtcat

SEQ ID NO: 121836 - DNA, 18 bp, Homo sapiens
acagtagtggcactcttg

SEQ ID NO: 121837 - DNA, 22 bp, Homo sapiens
tatgtgcatttcatttgattta

SEQ ID NO: 121838 - DNA, 23 bp, Homo sapiens
tagaaagtttttgttaaggcatc

SEQ ID NO: 121839 - DNA, 23 bp, Homo sapiens
atacacacacgtatatatatctc

SEQ ID NO: 121840 - DNA, 19 bp, Homo sapiens
ttccttctggtgggtttgt

SEQ ID NO: 121841 - DNA, 21 bp, Homo sapiens
tcagctgcagaccttcagggt

SEQ ID NO: 121842 - DNA, 21 bp, Homo sapiens
ctaagtcctatgtttttgtgt

SEQ ID NO: 121843 - DNA, 23 bp, Homo sapiens
tgagtcttactctgtcacccaga

SEQ ID NO: 121844 - DNA, 23 bp, Homo sapiens
catgtgtgtatatgtatatgtgt

SEQ ID NO: 121845 - DNA, 21 bp, Homo sapiens
acacacacacacacatctttt

SEQ ID NO: 121846 - DNA, 21 bp, Homo sapiens
cacatgatcaagagactatat

SEQ ID NO: 121847 - DNA, 23 bp, Homo sapiens
acaaggtctcactctgtcactca

SEQ ID NO: 121848 - DNA, 20 bp, Homo sapiens
tgtgaggacacagtgtggtg

SEQ ID NO: 121849 - DNA, 20 bp, Homo sapiens
tcacaggctgcctgtgtttg

SEQ ID NO: 121850 - DNA, 23 bp, Homo sapiens
tcagtctctctttctctttacac

SEQ ID NO: 121851 - DNA, 20 bp, Homo sapiens
ttgtatgtatatatgtgtat

SEQ ID NO: 121852 - DNA, 23 bp, Homo sapiens
atatgtatatatgcatatgtgta

SEQ ID NO: 121853 - DNA, 23 bp, Homo sapiens
agatatacatatgatgtatatgt

SEQ ID NO: 121854 - DNA, 21 bp, Homo sapiens
tatgtgtatatgtgtatgagt

SEQ ID NO: 121855 - DNA, 22 bp, Homo sapiens
aactatattgtagattctggat

SEQ ID NO: 121856 - DNA, 23 bp, Homo sapiens
tatatgtgcatatctatacatat

SEQ ID NO: 121857 - DNA, 23 bp, Homo sapiens
acttctgtgcctctgacagcccg

SEQ ID NO: 121858 - DNA, 23 bp, Homo sapiens
gacagagtctcgctctgtcaccc

SEQ ID NO: 121859 - DNA, 22 bp, Homo sapiens
tatattgtggtacgtctgtggt

SEQ ID NO: 121860 - DNA, 23 bp, Homo sapiens
gagtctcactcactccgtcaccc

SEQ ID NO: 121861 - DNA, 23 bp, Homo sapiens
agaaacagctaaagtattgagca

SEQ ID NO: 121862 - DNA, 23 bp, Homo sapiens
tctcattgtgattttgatgttca

SEQ ID NO: 121863 - DNA, 23 bp, Homo sapiens
tgagttcattgtagattctggat

SEQ ID NO: 121864 - DNA, 23 bp, Homo sapiens
tgagttcattgtagattctggat

SEQ ID NO: 121865 - DNA, 21 bp, Homo sapiens
tacatgtatgtatatgtgtat

SEQ ID NO: 121866 - DNA, 23 bp, Homo sapiens
ttttcacagtggctgtacctatt

SEQ ID NO: 121867 - DNA, 23 bp, Homo sapiens
agtatgaggtagtatttctttct

SEQ ID NO: 121868 - DNA, 23 bp, Homo sapiens
ttttgagacggaatcttctcact

SEQ ID NO: 121869 - DNA, 23 bp, Homo sapiens
tggagtctcactctgtcacccag

SEQ ID NO: 121870 - DNA, 19 bp, Homo sapiens
tacacacatacgtgtgtgt

SEQ ID NO: 121871 - DNA, 23 bp, Homo sapiens
agagtctcactctgtcacccagg

SEQ ID NO: 121872 - DNA, 23 bp, Homo sapiens
atctccctgccttccatttcctt

SEQ ID NO: 121873 - DNA, 23 bp, Homo sapiens
tgagttcattgtagattctggat

SEQ ID NO: 121874 - DNA, 23 bp, Homo sapiens
tgagttcattgtagattctggat

SEQ ID NO: 121875 - DNA, 23 bp, Homo sapiens
tgagttcattgtagattctggat

SEQ ID NO: 121876 - DNA, 23 bp, Homo sapiens
tgagttcattgtagattctggat

SEQ ID NO: 121877 - DNA, 23 bp, Homo sapiens
ctcaaatcttcagaatatgtaga

SEQ ID NO: 121878 - DNA, 23 bp, Homo sapiens
attttcttattgttttggagaag

SEQ ID NO: 121879 - DNA, 22 bp, Homo sapiens
tgtgctgttgaacggaatgtgt

SEQ ID NO: 121880 - DNA, 20 bp, Homo sapiens
tctgttaagtccatttgttc

SEQ ID NO: 121881 - DNA, 23 bp, Homo sapiens
ctctgtctgtctgtctgtctgtc

SEQ ID NO: 121882 - DNA, 23 bp, Homo sapiens
gagtctcactctgtcacccaggc

SEQ ID NO: 121883 - DNA, 20 bp, Homo sapiens
agtgtgtgtgtgtgtgtgtg

SEQ ID NO: 121884 - DNA, 23 bp, Homo sapiens
tgagttcattgtagattctggat

SEQ ID NO: 121885 - DNA, 23 bp, Homo sapiens
tgagttcattgtagattctggat

SEQ ID NO: 121886 - DNA, 19 bp, Homo sapiens
tgaagtgtgtttcttgtag

SEQ ID NO: 121887 - DNA, 23 bp, Homo sapiens
agtctctttggttgtttaatctg

SEQ ID NO: 121888 - DNA, 23 bp, Homo sapiens
gtgtatatatgtatatatgtgtg

SEQ ID NO: 121889 - DNA, 23 bp, Homo sapiens
atgtatatatgtatgtatatata

SEQ ID NO: 121890 - DNA, 21 bp, Homo sapiens
atggtagatctactgacagct

SEQ ID NO: 121891 - DNA, 23 bp, Homo sapiens
ttgatcaaatgttttgaacctta

SEQ ID NO: 121892 - DNA, 20 bp, Homo sapiens
tgtatgtatgtatatatgta

SEQ ID NO: 121893 - DNA, 22 bp, Homo sapiens
atgtgtctgaataatttgacag

SEQ ID NO: 121894 - DNA, 19 bp, Homo sapiens
ctgagatgtgaattgctag

SEQ ID NO: 121895 - DNA, 23 bp, Homo sapiens
atatgtatatgtgatatacatgt

SEQ ID NO: 121896 - DNA, 23 bp, Homo sapiens
aaggtctcactctgtcacccagg

SEQ ID NO: 121897 - DNA, 19 bp, Homo sapiens
ttgatccctctctctctgc

SEQ ID NO: 121898 - DNA, 23 bp, Homo sapiens
actcccagagcccctggaactct

SEQ ID NO: 121899 - DNA, 23 bp, Homo sapiens
tcccagagcccctggaactctgg

SEQ ID NO: 121900 - DNA, 20 bp, Homo sapiens
tatatgtgtgtatgtacatg

SEQ ID NO: 121901 - DNA, 18 bp, Homo sapiens
tctatatatgatatacag

SEQ ID NO: 121902 - DNA, 23 bp, Homo sapiens
tatacttatgtatgcatataaat

SEQ ID NO: 121903 - DNA, 23 bp, Homo sapiens
acttatgtattcaacctgaagtg

SEQ ID NO: 121904 - DNA, 19 bp, Homo sapiens
ttatactttaagttctagg

SEQ ID NO: 121905 - DNA, 22 bp, Homo sapiens
tttagtcttgttgctgttgttg

SEQ ID NO: 121906 - DNA, 23 bp, Homo sapiens
cttatcttttcttcagtttgctt

SEQ ID NO: 121907 - DNA, 22 bp, Homo sapiens
aaatctgtcaatgtatgttata

SEQ ID NO: 121908 - DNA, 22 bp, Homo sapiens
taatacagacactttatgtaat

SEQ ID NO: 121909 - DNA, 19 bp, Homo sapiens
tttgttgtagattttggca

SEQ ID NO: 121910 - DNA, 19 bp, Homo sapiens
gacatggtgctactcactc

SEQ ID NO: 121911 - DNA, 20 bp, Homo sapiens
gcaattctatccccactcat

SEQ ID NO: 121912 - DNA, 23 bp, Homo sapiens
acactgtcagtgatagatgagtg

SEQ ID NO: 121913 - DNA, 23 bp, Homo sapiens
agtggctctgtgtcgctctgagg

SEQ ID NO: 121914 - DNA, 20 bp, Homo sapiens
attgtgaatagtgtgctgca

SEQ ID NO: 121915 - DNA, 21 bp, Homo sapiens
tgaatatatgcatgaatgtat

SEQ ID NO: 121916 - DNA, 23 bp, Homo sapiens
acacatgcatgtatcttttatgg

SEQ ID NO: 121917 - DNA, 23 bp, Homo sapiens
tgagttcattgtagattctggat

SEQ ID NO: 121918 - DNA, 23 bp, Homo sapiens
tgagttcattgtagattctggat

SEQ ID NO: 121919 - DNA, 20 bp, Homo sapiens
ttattcttattttcatttgg

SEQ ID NO: 121920 - DNA, 23 bp, Homo sapiens
tgagttcattgtagattctggat

SEQ ID NO: 121921 - DNA, 23 bp, Homo sapiens
tgagttcattgtagattctggat

SEQ ID NO: 121922 - DNA, 23 bp, Homo sapiens
ttgtccaacagcatgtgctcact

SEQ ID NO: 121923 - DNA, 23 bp, Homo sapiens
ttgttgtgatctgagtacctgat

SEQ ID NO: 121924 - DNA, 18 bp, Homo sapiens
agtatctatatctaaaag

SEQ ID NO: 121925 - DNA, 22 bp, Homo sapiens
aatggctgtgtctgaaaattgg

SEQ ID NO: 121926 - DNA, 23 bp, Homo sapiens
tcccagtgagtatttcttgagct

SEQ ID NO: 121927 - DNA, 23 bp, Homo sapiens
gatttgtgtatatttcatgttag

SEQ ID NO: 121928 - DNA, 23 bp, Homo sapiens
tgcagtggcatgatcgtggctta

SEQ ID NO: 121929 - DNA, 22 bp, Homo sapiens
gtatacatacatatgtgtatat

SEQ ID NO: 121930 - DNA, 23 bp, Homo sapiens
ttttattggaaatgtgtaggttt

SEQ ID NO: 121931 - DNA, 23 bp, Homo sapiens
gagtctctctctgtgtgtgctga

SEQ ID NO: 121932 - DNA, 23 bp, Homo sapiens
ttagagaggcataaaagtttgtg

SEQ ID NO: 121933 - DNA, 23 bp, Homo sapiens
caagtagtatagtatgactacat

SEQ ID NO: 121934 - DNA, 22 bp, Homo sapiens
atacactatggcctttctattt

SEQ ID NO: 121935 - DNA, 22 bp, Homo sapiens
ttttaagatggagtcttgctgt

SEQ ID NO: 121936 - DNA, 18 bp, Homo sapiens
tatgtatacatgtgtgta

SEQ ID NO: 121937 - DNA, 23 bp, Homo sapiens
ggagtctcactctgtcacccagg

SEQ ID NO: 121938 - DNA, 23 bp, Homo sapiens
tgcatgtagatgtgcagttgttc

SEQ ID NO: 121939 - DNA, 22 bp, Homo sapiens
tacagatgtgtgccaccacatc

SEQ ID NO: 121940 - DNA, 23 bp, Homo sapiens
agcttgcttcagaattctctaag

SEQ ID NO: 121941 - DNA, 19 bp, Homo sapiens
tatacatatgtatacatat

SEQ ID NO: 121942 - DNA, 21 bp, Homo sapiens
ttacaggctcatcagtagaag

SEQ ID NO: 121943 - DNA, 23 bp, Homo sapiens
tttgagttaattctgaaatgagt

SEQ ID NO: 121944 - DNA, 23 bp, Homo sapiens
acagtcttactctgtcacccagg

SEQ ID NO: 121945 - DNA, 22 bp, Homo sapiens
tggtgtgatcatagctcactgt

SEQ ID NO: 121946 - DNA, 23 bp, Homo sapiens
accaggcttgtgagttgctttgt

SEQ ID NO: 121947 - DNA, 23 bp, Homo sapiens
agacagaagtgacagtgctcagc

SEQ ID NO: 121948 - DNA, 23 bp, Homo sapiens
atatatgtatttgtatatgtgtg

SEQ ID NO: 121949 - DNA, 19 bp, Homo sapiens
tacatgtatatgtttatgt

SEQ ID NO: 121950 - DNA, 23 bp, Homo sapiens
gtgattgccattctaactggtgt

SEQ ID NO: 121951 - DNA, 21 bp, Homo sapiens
aattccttcattttatgattg

SEQ ID NO: 121952 - DNA, 23 bp, Homo sapiens
cattttcacagtggtttttatat

SEQ ID NO: 121953 - DNA, 23 bp, Homo sapiens
ttgtagaggtctttctcctcctt

SEQ ID NO: 121954 - DNA, 23 bp, Homo sapiens
ttatacttctagtgaacccatca

SEQ ID NO: 121955 - DNA, 23 bp, Homo sapiens
tctgggactgaatggagaaatgt

SEQ ID NO: 121956 - DNA, 21 bp, Homo sapiens
atgagttctctgaccagcaca

SEQ ID NO: 121957 - DNA, 23 bp, Homo sapiens
agcaacgaaatgaaatcatattg

SEQ ID NO: 121958 - DNA, 23 bp, Homo sapiens
ctgggtgacacagtgggactctg

SEQ ID NO: 121959 - DNA, 23 bp, Homo sapiens
tttactgaatatggaattctggg

SEQ ID NO: 121960 - DNA, 18 bp, Homo sapiens
tgtctactttttccattg

SEQ ID NO: 121961 - DNA, 23 bp, Homo sapiens
agtagtttgattatgatgtgtca

SEQ ID NO: 121962 - DNA, 21 bp, Homo sapiens
atataggtactatatatgtgt

SEQ ID NO: 121963 - DNA, 23 bp, Homo sapiens
aatgagagacatttgctttatta

SEQ ID NO: 121964 - DNA, 20 bp, Homo sapiens
tgacagtttcactcacatgt

SEQ ID NO: 121965 - DNA, 22 bp, Homo sapiens
aagttgtggcttgaagatgtga

SEQ ID NO: 121966 - DNA, 23 bp, Homo sapiens
tatatgtatatgtatacgtgtgt

SEQ ID NO: 121967 - DNA, 23 bp, Homo sapiens
tgctcaaagggaaagatgtgtga

SEQ ID NO: 121968 - DNA, 23 bp, Homo sapiens
tggttcatcagtgattttgatgt

SEQ ID NO: 121969 - DNA, 21 bp, Homo sapiens
tcacagcatgcatctatgaaa

SEQ ID NO: 121970 - DNA, 23 bp, Homo sapiens
acagggtctcactctgtcaccca

SEQ ID NO: 121971 - DNA, 23 bp, Homo sapiens
gggtctcactctgtcacccaggc

SEQ ID NO: 121972 - DNA, 23 bp, Homo sapiens
gggtctcactctgtcacccaggc

SEQ ID NO: 121973 - DNA, 19 bp, Homo sapiens
cagtgagactctgtctctc

SEQ ID NO: 121974 - DNA, 19 bp, Homo sapiens
gtctccctgtgactgagac

SEQ ID NO: 121975 - DNA, 23 bp, Homo sapiens
tagtgattctccaagtacagagg

SEQ ID NO: 121976 - DNA, 23 bp, Homo sapiens
cacacacaagttgctgccatacg

SEQ ID NO: 121977 - DNA, 23 bp, Homo sapiens
tccttctgaagcctctctccttg

SEQ ID NO: 121978 - DNA, 23 bp, Homo sapiens
agttcagtgtggtaatcttggct

SEQ ID NO: 121979 - DNA, 18 bp, Homo sapiens
tgatgatttaatctgtag

SEQ ID NO: 121980 - DNA, 23 bp, Homo sapiens
catgactcactgcagtctcagcc

SEQ ID NO: 121981 - DNA, 23 bp, Homo sapiens
agacagtctcattctgtcaccta

SEQ ID NO: 121982 - DNA, 21 bp, Homo sapiens
gatgattagttaaggtcctag

SEQ ID NO: 121983 - DNA, 23 bp, Homo sapiens
gctctctctgggtgaggactggc

SEQ ID NO: 121984 - DNA, 20 bp, Homo sapiens
ttccatcattcagtagccat

SEQ ID NO: 121985 - DNA, 22 bp, Homo sapiens
ttcagtatatatatatatgtgt

SEQ ID NO: 121986 - DNA, 23 bp, Homo sapiens
tgagttcattgtagattctggat

SEQ ID NO: 121987 - DNA, 23 bp, Homo sapiens
tgagttcattgtagattctggat

SEQ ID NO: 121988 - DNA, 23 bp, Homo sapiens
tgagttcattgtagattctggat

SEQ ID NO: 121989 - DNA, 23 bp, Homo sapiens
tgagttcattgtagattctggat

SEQ ID NO: 121990 - DNA, 23 bp, Homo sapiens
agatggagtctctctctgtcacc

SEQ ID NO: 121991 - DNA, 23 bp, Homo sapiens
tttgattgtttatcttactattt

SEQ ID NO: 121992 - DNA, 23 bp, Homo sapiens
tttcagtgcatttgtttgctata

SEQ ID NO: 121993 - DNA, 19 bp, Homo sapiens
gttacacagttacttgagt

SEQ ID NO: 121994 - DNA, 23 bp, Homo sapiens
atgtaatagatggatgatttgca

SEQ ID NO: 121995 - DNA, 19 bp, Homo sapiens
tgttacaggttgtgtattc

SEQ ID NO: 121996 - DNA, 20 bp, Homo sapiens
tatacatattttatatgtgt

SEQ ID NO: 121997 - DNA, 22 bp, Homo sapiens
tgagacgtagtctcgctctgtc

SEQ ID NO: 121998 - DNA, 20 bp, Homo sapiens
ttttccttgtgtagcaatat

SEQ ID NO: 121999 - DNA, 23 bp, Homo sapiens
taaacttcaggttatgttgtatt

SEQ ID NO: 122000 - DNA, 23 bp, Homo sapiens
attcaaatgtgttaaagcataat

SEQ ID NO: 122001 - DNA, 20 bp, Homo sapiens
ttgctctaacccttactagg

SEQ ID NO: 122002 - DNA, 23 bp, Homo sapiens
tgtgtatatatatgtgtgtgtgt

SEQ ID NO: 122003 - DNA, 20 bp, Homo sapiens
atttgtttatatatatgtgt

SEQ ID NO: 122004 - DNA, 23 bp, Homo sapiens
actgcatttgataatattttgtt

SEQ ID NO: 122005 - DNA, 20 bp, Homo sapiens
attatatatgtatttgtgag

SEQ ID NO: 122006 - DNA, 18 bp, Homo sapiens
tgtgtgtgtgtgtatgaa

SEQ ID NO: 122007 - DNA, 22 bp, Homo sapiens
atatgtgtatatatgtatgtgt

SEQ ID NO: 122008 - DNA, 20 bp, Homo sapiens
atatatgtgtgtaaacatat

SEQ ID NO: 122009 - DNA, 22 bp, Homo sapiens
tgagacagtctcgctctgtcgc

SEQ ID NO: 122010 - DNA, 23 bp, Homo sapiens
gtgtatctgtctgtctgcctgtc

SEQ ID NO: 122011 - DNA, 23 bp, Homo sapiens
aagtgtgtgtgttatatatgtgt

SEQ ID NO: 122012 - DNA, 21 bp, Homo sapiens
atataaatctgtaagctgata

SEQ ID NO: 122013 - DNA, 21 bp, Homo sapiens
tcatctctttttctatatatc

SEQ ID NO: 122014 - DNA, 20 bp, Homo sapiens
aggtagatagatagatagat

SEQ ID NO: 122015 - DNA, 18 bp, Homo sapiens
taaagtgcagtttatcaa

SEQ ID NO: 122016 - DNA, 23 bp, Homo sapiens
attgtgcttctggtgttgtagct

SEQ ID NO: 122017 - DNA, 22 bp, Homo sapiens
agtatatttcttcttatgtata

SEQ ID NO: 122018 - DNA, 23 bp, Homo sapiens
agtctgagaatgacttgagttca

SEQ ID NO: 122019 - DNA, 19 bp, Homo sapiens
tgtgttagatgattgtcct

SEQ ID NO: 122020 - DNA, 21 bp, Homo sapiens
tgagtgtgcacagtctgcaga

SEQ ID NO: 122021 - DNA, 20 bp, Homo sapiens
gcatgtatgtatgtgtgtgt

SEQ ID NO: 122022 - DNA, 18 bp, Homo sapiens
atgtaggcatatatttgt

SEQ ID NO: 122023 - DNA, 19 bp, Homo sapiens
acatatacacatacatatg

SEQ ID NO: 122024 - DNA, 20 bp, Homo sapiens
tatgtatgtatacacatgcc

SEQ ID NO: 122025 - DNA, 22 bp, Homo sapiens
ttttctataatttgtaacctga

SEQ ID NO: 122026 - DNA, 23 bp, Homo sapiens
tgagttcattgtagattctggat

SEQ ID NO: 122027 - DNA, 23 bp, Homo sapiens
tgagttcattgtagattctggat

SEQ ID NO: 122028 - DNA, 22 bp, Homo sapiens
taatgtattgaaaagaatacga

SEQ ID NO: 122029 - DNA, 18 bp, Homo sapiens
ttgaccaacaagtttttt

SEQ ID NO: 122030 - DNA, 18 bp, Homo sapiens
acttctgttagttagctc

SEQ ID NO: 122031 - DNA, 23 bp, Homo sapiens
tgattgtggaagtgcatttctgc

SEQ ID NO: 122032 - DNA, 21 bp, Homo sapiens
tatggatatatatggctatgt

SEQ ID NO: 122033 - DNA, 23 bp, Homo sapiens
tagtagcataagaaaagaaatct

SEQ ID NO: 122034 - DNA, 23 bp, Homo sapiens
tagagtgttcagtcaaggttttc

SEQ ID NO: 122035 - DNA, 23 bp, Homo sapiens
gtgtgtgtgtgtgtatatatata

SEQ ID NO: 122036 - DNA, 23 bp, Homo sapiens
tgagtctcactctgtcacccagg

SEQ ID NO: 122037 - DNA, 22 bp, Homo sapiens
tttttttcactgtataaattgt

SEQ ID NO: 122038 - DNA, 23 bp, Homo sapiens
aagtgtaagaaaatgattgctta

SEQ ID NO: 122039 - DNA, 20 bp, Homo sapiens
tacagtaatcagaaaggaga

SEQ ID NO: 122040 - DNA, 23 bp, Homo sapiens
tcaatgattactgttctgggcta

SEQ ID NO: 122041 - DNA, 18 bp, Homo sapiens
tataccaagtattcaaat

SEQ ID NO: 122042 - DNA, 23 bp, Homo sapiens
atactttgtttttctaattgttg

SEQ ID NO: 122043 - DNA, 23 bp, Homo sapiens
agatcttagaggaaaggctttca

SEQ ID NO: 122044 - DNA, 23 bp, Homo sapiens
tatgcatgaatatatgtatgtat

SEQ ID NO: 122045 - DNA, 23 bp, Homo sapiens
aatattttgtgcatgtatgtttt

SEQ ID NO: 122046 - DNA, 23 bp, Homo sapiens
agggtatcactctgttgctcagt

SEQ ID NO: 122047 - DNA, 23 bp, Homo sapiens
agagtctcactctgtcacccagg

SEQ ID NO: 122048 - DNA, 18 bp, Homo sapiens
cattatatctttgactgc

SEQ ID NO: 122049 - DNA, 22 bp, Homo sapiens
tacagatgtgagccagcacact

SEQ ID NO: 122050 - DNA, 23 bp, Homo sapiens
aatgtatttgatgtgccagagag

SEQ ID NO: 122051 - DNA, 18 bp, Homo sapiens
agtcaagaatcagagctc

SEQ ID NO: 122052 - DNA, 23 bp, Homo sapiens
tatatatcaatatgtgtatagat

SEQ ID NO: 122053 - DNA, 23 bp, Homo sapiens
ttgagacagagtcttgctctgtc

SEQ ID NO: 122054 - DNA, 20 bp, Homo sapiens
cgtggatgtacttgctttga

SEQ ID NO: 122055 - DNA, 23 bp, Homo sapiens
taagtgcttccatgttttggtga

SEQ ID NO: 122056 - DNA, 19 bp, Homo sapiens
tttttagatggagtttggc

SEQ ID NO: 122057 - DNA, 23 bp, Homo sapiens
gccagagtctcgctctgtcaccc

SEQ ID NO: 122058 - DNA, 23 bp, Homo sapiens
tgtcagtttgtcatagacagctt

SEQ ID NO: 122059 - DNA, 23 bp, Homo sapiens
ctttgggtattcatcatgttcca

SEQ ID NO: 122060 - DNA, 23 bp, Homo sapiens
gttctccaagtgttatgttgatg

SEQ ID NO: 122061 - DNA, 20 bp, Homo sapiens
atggggaaaatttcacttgt

SEQ ID NO: 122062 - DNA, 23 bp, Homo sapiens
gagtctcactctgtcacccaggc

SEQ ID NO: 122063 - DNA, 23 bp, Homo sapiens
ggagtctcactctgtcacccagg

SEQ ID NO: 122064 - DNA, 21 bp, Homo sapiens
atatctatatatgtatatgtg

SEQ ID NO: 122065 - DNA, 22 bp, Homo sapiens
ctgtgtgctttcttattgttga

SEQ ID NO: 122066 - DNA, 23 bp, Homo sapiens
tacatgtgcacattgtgcaggtt

SEQ ID NO: 122067 - DNA, 23 bp, Homo sapiens
tgagttcattgtagattctggat

SEQ ID NO: 122068 - DNA, 23 bp, Homo sapiens
tgagttcattgtagattctggat

SEQ ID NO: 122069 - DNA, 22 bp, Homo sapiens
tacatgtgcacaatgtgcaggt

SEQ ID NO: 122070 - DNA, 23 bp, Homo sapiens
tgtctctcctctagaacttctct

SEQ ID NO: 122071 - DNA, 23 bp, Homo sapiens
atatgtgtggtataagtgtgtat

SEQ ID NO: 122072 - DNA, 23 bp, Homo sapiens
tctatatgcatatgtatatgtgt

SEQ ID NO: 122073 - DNA, 19 bp, Homo sapiens
atatgtgtgtatgtctata

SEQ ID NO: 122074 - DNA, 23 bp, Homo sapiens
tgagttcattgtagattctggat

SEQ ID NO: 122075 - DNA, 23 bp, Homo sapiens
tgagttcattgtagattctggat

SEQ ID NO: 122076 - DNA, 19 bp, Homo sapiens
tatactttaagttttaggg

SEQ ID NO: 122077 - DNA, 21 bp, Homo sapiens
tatgaaacatatctattgaaa

SEQ ID NO: 122078 - DNA, 21 bp, Homo sapiens
tattgttgtgtgtattgtgaa

SEQ ID NO: 122079 - DNA, 19 bp, Homo sapiens
tatagtaacttgcatagat

SEQ ID NO: 122080 - DNA, 23 bp, Homo sapiens
ctctctgtctgtctgttaatggt

SEQ ID NO: 122081 - DNA, 21 bp, Homo sapiens
tactgattttcatgtgctgat

SEQ ID NO: 122082 - DNA, 23 bp, Homo sapiens
ttactgatcagtctgggagtctt

SEQ ID NO: 122083 - DNA, 18 bp, Homo sapiens
tgagatggagtctcactg

SEQ ID NO: 122084 - DNA, 20 bp, Homo sapiens
tatactgtatatctacatgt

SEQ ID NO: 122085 - DNA, 22 bp, Homo sapiens
ttctggaatagagaggacctag

SEQ ID NO: 122086 - DNA, 23 bp, Homo sapiens
aaatgctgtggttctttagtgat

SEQ ID NO: 122087 - DNA, 22 bp, Homo sapiens
atgtatgtgtgcatgtgcatgt

SEQ ID NO: 122088 - DNA, 22 bp, Homo sapiens
tatatacaaatagatatggttt

SEQ ID NO: 122089 - DNA, 23 bp, Homo sapiens
tatcaatgctttgtttttgtttt

SEQ ID NO: 122090 - DNA, 23 bp, Homo sapiens
aaatgttctgtttttgtacatgt

SEQ ID NO: 122091 - DNA, 19 bp, Homo sapiens
atgcaaaaggtgtgtatgt

SEQ ID NO: 122092 - DNA, 23 bp, Homo sapiens
gacagagtctcgctctgtcaccc

SEQ ID NO: 122093 - DNA, 21 bp, Homo sapiens
tattctatacaaggagataca

SEQ ID NO: 122094 - DNA, 18 bp, Homo sapiens
tatagatatagatatagg

SEQ ID NO: 122095 - DNA, 23 bp, Homo sapiens
tctcactctctgtcactcaggct

SEQ ID NO: 122096 - DNA, 23 bp, Homo sapiens
gtgtgtgtatatatatgtgtgtg

SEQ ID NO: 122097 - DNA, 23 bp, Homo sapiens
tatggtattgtattgtattagta

SEQ ID NO: 122098 - DNA, 21 bp, Homo sapiens
acaatgtctagtctgaaaggt

SEQ ID NO: 122099 - DNA, 23 bp, Homo sapiens
tggagtctcgctctgtcacccag

SEQ ID NO: 122100 - DNA, 22 bp, Homo sapiens
tgtgtcacagtgcttgtgttca

SEQ ID NO: 122101 - DNA, 22 bp, Homo sapiens
cttgtttgtatttgaaaatccc

SEQ ID NO: 122102 - DNA, 21 bp, Homo sapiens
acactcacactttgggtttag

SEQ ID NO: 122103 - DNA, 22 bp, Homo sapiens
aacaaagttgatgatgcatata

SEQ ID NO: 122104 - DNA, 23 bp, Homo sapiens
taacgttgctattatttggtgtt

SEQ ID NO: 122105 - DNA, 23 bp, Homo sapiens
tgggatatctctgtctctgtgtc

SEQ ID NO: 122106 - DNA, 23 bp, Homo sapiens
tatcagtggtgagtgtgctgaca

SEQ ID NO: 122107 - DNA, 22 bp, Homo sapiens
tttctctgtaaggttatgaggt

SEQ ID NO: 122108 - DNA, 21 bp, Homo sapiens
tcagtggtgtgatctcagatc

SEQ ID NO: 122109 - DNA, 23 bp, Homo sapiens
gacagagtctcgctctgtcacct

SEQ ID NO: 122110 - DNA, 23 bp, Homo sapiens
tcttacattgattagtgaattag

SEQ ID NO: 122111 - DNA, 23 bp, Homo sapiens
tgtgagcctgtgtctcactctgt

SEQ ID NO: 122112 - DNA, 22 bp, Homo sapiens
ggtcactctgtcactcaggctg

SEQ ID NO: 122113 - DNA, 23 bp, Homo sapiens
aaagagagatgatgatgatgatg

SEQ ID NO: 122114 - DNA, 20 bp, Homo sapiens
atgtctctctcttatcagat

SEQ ID NO: 122115 - DNA, 23 bp, Homo sapiens
tctgtgcctgtctgtgaggggca

SEQ ID NO: 122116 - DNA, 23 bp, Homo sapiens
aactatgatgatgatgatgatga

SEQ ID NO: 122117 - DNA, 23 bp, Homo sapiens
tgagacaggctgtctcactctgt

SEQ ID NO: 122118 - DNA, 23 bp, Homo sapiens
agtttcagttcagaatttgttct

SEQ ID NO: 122119 - DNA, 20 bp, Homo sapiens
acacacacagttttattatt

SEQ ID NO: 122120 - DNA, 23 bp, Homo sapiens
tatatactggatcttgtattgag

SEQ ID NO: 122121 - DNA, 23 bp, Homo sapiens
tcagtgacaaatttgaaatgaga

SEQ ID NO: 122122 - DNA, 23 bp, Homo sapiens
tattgaatgttatatattcagta

SEQ ID NO: 122123 - DNA, 18 bp, Homo sapiens
ttgaatgttatatattca

SEQ ID NO: 122124 - DNA, 23 bp, Homo sapiens
tgagttcattgtagattctggat

SEQ ID NO: 122125 - DNA, 23 bp, Homo sapiens
tgagttcattgtagattctggat

SEQ ID NO: 122126 - DNA, 23 bp, Homo sapiens
tatatgtgtatgtgtatatatgt

SEQ ID NO: 122127 - DNA, 20 bp, Homo sapiens
tgtgtatgtgtatatatgtg

SEQ ID NO: 122128 - DNA, 20 bp, Homo sapiens
atatgtatgtatatatgtgt

SEQ ID NO: 122129 - DNA, 23 bp, Homo sapiens
gtatgtatatatgtatatgtgtg

SEQ ID NO: 122130 - DNA, 19 bp, Homo sapiens
tctctctctgagattgttc

SEQ ID NO: 122131 - DNA, 22 bp, Homo sapiens
atatgtatatatgtatatgtgt

SEQ ID NO: 122132 - DNA, 22 bp, Homo sapiens
atgtgtaaatatgtagatatgt

SEQ ID NO: 122133 - DNA, 21 bp, Homo sapiens
gagagtggttgcatattctta

SEQ ID NO: 122134 - DNA, 23 bp, Homo sapiens
tgtgtatctgtgtgtatgcagat

SEQ ID NO: 122135 - DNA, 22 bp, Homo sapiens
agtacactgttgatgggaatgt

SEQ ID NO: 122136 - DNA, 23 bp, Homo sapiens
attcaaatttgtgtgcatgtgta

SEQ ID NO: 122137 - DNA, 23 bp, Homo sapiens
tttagtgtatggtttgcctgtgt

SEQ ID NO: 122138 - DNA, 23 bp, Homo sapiens
tcagtactctgtctcacggtcac

SEQ ID NO: 122139 - DNA, 23 bp, Homo sapiens
tgtctctctctgtgcctgagaaa

SEQ ID NO: 122140 - DNA, 23 bp, Homo sapiens
tgtatgtgcaattcttttggctg

SEQ ID NO: 122141 - DNA, 23 bp, Homo sapiens
tgagttcattgtagattctggat

SEQ ID NO: 122142 - DNA, 23 bp, Homo sapiens
tgagttcattgtagattctggat

SEQ ID NO: 122143 - DNA, 20 bp, Homo sapiens
tttctgtttggaaatgttct

SEQ ID NO: 122144 - DNA, 18 bp, Homo sapiens
taagtcacttgctaactt

SEQ ID NO: 122145 - DNA, 23 bp, Homo sapiens
cttcagcctcagtttttgttttg

SEQ ID NO: 122146 - DNA, 21 bp, Homo sapiens
attctctgtgggtctcttgtg

SEQ ID NO: 122147 - DNA, 23 bp, Homo sapiens
gtgtgcgtgtgtgagtgtgtgta

SEQ ID NO: 122148 - DNA, 23 bp, Homo sapiens
tttaatgtatagaagttattact

SEQ ID NO: 122149 - DNA, 20 bp, Homo sapiens
tgagttttaaaacagtgctg

SEQ ID NO: 122150 - DNA, 19 bp, Homo sapiens
tttcaagtgctgggtaagt

SEQ ID NO: 122151 - DNA, 23 bp, Homo sapiens
tatatgctatatatatgtgtgtg

SEQ ID NO: 122152 - DNA, 21 bp, Homo sapiens
tctatgtacatttctatgcaa

SEQ ID NO: 122153 - DNA, 23 bp, Homo sapiens
tgagttcattgtagattctggat

SEQ ID NO: 122154 - DNA, 23 bp, Homo sapiens
tgagttcattgtagattctggat

SEQ ID NO: 122155 - DNA, 23 bp, Homo sapiens
ttaatgtttttcttgttgagttg

SEQ ID NO: 122156 - DNA, 23 bp, Homo sapiens
tgagttcattgtagattctggat

SEQ ID NO: 122157 - DNA, 23 bp, Homo sapiens
tgagttcattgtagattctggat

SEQ ID NO: 122158 - DNA, 23 bp, Homo sapiens
acattgtttgtttatatctatgt

SEQ ID NO: 122159 - DNA, 20 bp, Homo sapiens
aatatttgcatgcaaagcat

SEQ ID NO: 122160 - DNA, 23 bp, Homo sapiens
tgagttcattgtagattctggat

SEQ ID NO: 122161 - DNA, 23 bp, Homo sapiens
tgagttcattgtagattctggat

SEQ ID NO: 122162 - DNA, 21 bp, Homo sapiens
tttagtgatatttgctttata

SEQ ID NO: 122163 - DNA, 23 bp, Homo sapiens
tgagttcattgtagattctggat

SEQ ID NO: 122164 - DNA, 23 bp, Homo sapiens
tgagttcattgtagattctggat

SEQ ID NO: 122165 - DNA, 23 bp, Homo sapiens
tggggtatctatttctctctgta

SEQ ID NO: 122166 - DNA, 21 bp, Homo sapiens
atgaaagaaggtagtgagcac

SEQ ID NO: 122167 - DNA, 22 bp, Homo sapiens
acccagctcttctcttcctact

SEQ ID NO: 122168 - DNA, 21 bp, Homo sapiens
ttttcctcgtgcagctcgttg

SEQ ID NO: 122169 - DNA, 23 bp, Homo sapiens
cctgtcactctcaggtgttgatg

SEQ ID NO: 122170 - DNA, 18 bp, Homo sapiens
agtatacatggtagaatg

SEQ ID NO: 122171 - DNA, 23 bp, Homo sapiens
tggcttaggattatcttggcaat

SEQ ID NO: 122172 - DNA, 23 bp, Homo sapiens
ttctgtgaagaaagtcattggca

SEQ ID NO: 122173 - DNA, 21 bp, Homo sapiens
tgtctgggtcattggtgctgt

SEQ ID NO: 122174 - DNA, 23 bp, Homo sapiens
tcacagtaatgagtgagttctca

SEQ ID NO: 122175 - DNA, 21 bp, Homo sapiens
tttaagacatttcatagttgg

SEQ ID NO: 122176 - DNA, 23 bp, Homo sapiens
aaatgctttttctgcatctactg

SEQ ID NO: 122177 - DNA, 23 bp, Homo sapiens
ttgtattagttacttttcaaatg

SEQ ID NO: 122178 - DNA, 22 bp, Homo sapiens
tgagcctgtttatttctctttt

SEQ ID NO: 122179 - DNA, 23 bp, Homo sapiens
tttgtgattctatacaaatttta

SEQ ID NO: 122180 - DNA, 22 bp, Homo sapiens
tgtgaagaatctcaatggtgat

SEQ ID NO: 122181 - DNA, 23 bp, Homo sapiens
tgtgtatatgtatatgtgtgtgt

SEQ ID NO: 122182 - DNA, 23 bp, Homo sapiens
tgagttcattgtagattctggat

SEQ ID NO: 122183 - DNA, 23 bp, Homo sapiens
tgagttcattgtagattctggat

SEQ ID NO: 122184 - DNA, 23 bp, Homo sapiens
agaaacgtcatttagagcaggat

SEQ ID NO: 122185 - DNA, 19 bp, Homo sapiens
tgtgcatgtatgtttttta

SEQ ID NO: 122186 - DNA, 19 bp, Homo sapiens
aagctgtatgtatagtgtt

SEQ ID NO: 122187 - DNA, 23 bp, Homo sapiens
tgagttcattgtagattctggat

SEQ ID NO: 122188 - DNA, 23 bp, Homo sapiens
tgagttcattgtagattctggat

SEQ ID NO: 122189 - DNA, 23 bp, Homo sapiens
ctcccagagcccctggaactctg

SEQ ID NO: 122190 - DNA, 23 bp, Homo sapiens
tcccagagcccctggaactctgg

SEQ ID NO: 122191 - DNA, 23 bp, Homo sapiens
tcccagagcccctggaactctgg

SEQ ID NO: 122192 - DNA, 23 bp, Homo sapiens
tcccagagcccctggaactctgg

SEQ ID NO: 122193 - DNA, 21 bp, Homo sapiens
tagtgagaaaactcttagtga

SEQ ID NO: 122194 - DNA, 18 bp, Homo sapiens
tatactttaagttttagg

SEQ ID NO: 122195 - DNA, 20 bp, Homo sapiens
agtttagattctgtttttag

SEQ ID NO: 122196 - DNA, 23 bp, Homo sapiens
tctcagaacaaagtcagaagaat

SEQ ID NO: 122197 - DNA, 20 bp, Homo sapiens
atttgtctccaatttcacag

SEQ ID NO: 122198 - DNA, 23 bp, Homo sapiens
aacattttcagatggtcttggat

SEQ ID NO: 122199 - DNA, 23 bp, Homo sapiens
gcttcatgttgatgattgtggaa

SEQ ID NO: 122200 - DNA, 22 bp, Homo sapiens
tgtgtatttgttggatttagag

SEQ ID NO: 122201 - DNA, 23 bp, Homo sapiens
ttagttgtgcatatgttttgccc

SEQ ID NO: 122202 - DNA, 19 bp, Homo sapiens
aaggggtacatgtgcaggt

SEQ ID NO: 122203 - DNA, 23 bp, Homo sapiens
taggtgggtgctatagttgtaac

SEQ ID NO: 122204 - DNA, 21 bp, Homo sapiens
cagggaggatcacttgagtcc

SEQ ID NO: 122205 - DNA, 21 bp, Homo sapiens
acacagtgagactctgtctct

SEQ ID NO: 122206 - DNA, 18 bp, Homo sapiens
tatacagtatatgtatgt

SEQ ID NO: 122207 - DNA, 23 bp, Homo sapiens
gcacagtttgagctgacccaatt

SEQ ID NO: 122208 - DNA, 22 bp, Homo sapiens
tcagtggcataaatatgtcagt

SEQ ID NO: 122209 - DNA, 20 bp, Homo sapiens
agagacactgaatttgtaat

SEQ ID NO: 122210 - DNA, 20 bp, Homo sapiens
tagggtagttgcatgtttag

SEQ ID NO: 122211 - DNA, 23 bp, Homo sapiens
gacagagtctcgctctgtcaccc

SEQ ID NO: 122212 - DNA, 19 bp, Homo sapiens
tggcgtgatcttggctcac

SEQ ID NO: 122213 - DNA, 23 bp, Homo sapiens
tatatgtgtgtttatatatgtgt

SEQ ID NO: 122214 - DNA, 23 bp, Homo sapiens
atatgtgtgtttatatatgtgta

SEQ ID NO: 122215 - DNA, 23 bp, Homo sapiens
aattacattcctgattttgttct

SEQ ID NO: 122216 - DNA, 23 bp, Homo sapiens
attgttaatgtataggaatgcta

SEQ ID NO: 122217 - DNA, 20 bp, Homo sapiens
taggacctaagataatatct

SEQ ID NO: 122218 - DNA, 23 bp, Homo sapiens
tgagttcattgtagattctggat

SEQ ID NO: 122219 - DNA, 23 bp, Homo sapiens
tgagttcattgtagattctggat

SEQ ID NO: 122220 - DNA, 18 bp, Homo sapiens
gtgttctgcatgagtggt

SEQ ID NO: 122221 - DNA, 22 bp, Homo sapiens
aaagatttgtccctttggtgaa

SEQ ID NO: 122222 - DNA, 21 bp, Homo sapiens
tttattttagtagaaaatgta

SEQ ID NO: 122223 - DNA, 21 bp, Homo sapiens
tagagtgatcactgccaggtg

SEQ ID NO: 122224 - DNA, 20 bp, Homo sapiens
attgtagataaagatgttaa

SEQ ID NO: 122225 - DNA, 20 bp, Homo sapiens
atgtggtctttagttacatg

SEQ ID NO: 122226 - DNA, 23 bp, Homo sapiens
agaggaatgatctgtgactcaag

SEQ ID NO: 122227 - DNA, 20 bp, Homo sapiens
atatgtatatatgtatacac

SEQ ID NO: 122228 - DNA, 19 bp, Homo sapiens
atatgtatatatgtataca

SEQ ID NO: 122229 - DNA, 18 bp, Homo sapiens
atatgtatacacatatgt

SEQ ID NO: 122230 - DNA, 21 bp, Homo sapiens
atatatgtatatatgtataca

SEQ ID NO: 122231 - DNA, 23 bp, Homo sapiens
tatatgtgtctatgtatacacat

SEQ ID NO: 122232 - DNA, 23 bp, Homo sapiens
tatatgtgtatatatatgtgtct

SEQ ID NO: 122233 - DNA, 21 bp, Homo sapiens
tatacacatatgtatatatgt

SEQ ID NO: 122234 - DNA, 21 bp, Homo sapiens
tatacacatatgtatatatgt

SEQ ID NO: 122235 - DNA, 23 bp, Homo sapiens
ttgagagggagtctcactctgtc

SEQ ID NO: 122236 - DNA, 19 bp, Homo sapiens
gagtctggctctgtcaccc

SEQ ID NO: 122237 - DNA, 23 bp, Homo sapiens
ttggatggtgttgatgctggtag

SEQ ID NO: 122238 - DNA, 21 bp, Homo sapiens
tctattgttaagtagcatatt

SEQ ID NO: 122239 - DNA, 23 bp, Homo sapiens
agagtctcactctgtcacccagg

SEQ ID NO: 122240 - DNA, 23 bp, Homo sapiens
tgacatggagtttcactcttgtt

SEQ ID NO: 122241 - DNA, 22 bp, Homo sapiens
atactgcatgagtaactgagtg

SEQ ID NO: 122242 - DNA, 23 bp, Homo sapiens
ctatgagctagttttttcttttt

SEQ ID NO: 122243 - DNA, 23 bp, Homo sapiens
agtccttctagacctagatcaag

SEQ ID NO: 122244 - DNA, 22 bp, Homo sapiens
attagtatgcatttattggttt

SEQ ID NO: 122245 - DNA, 23 bp, Homo sapiens
agaggaaatttcttgttttgtgt

SEQ ID NO: 122246 - DNA, 18 bp, Homo sapiens
tggcagtgtgccttcatg

SEQ ID NO: 122247 - DNA, 23 bp, Homo sapiens
tgtctgtcagagtttgttttgtg

SEQ ID NO: 122248 - DNA, 23 bp, Homo sapiens
ctgggtgagtcagtgagtgagtg

SEQ ID NO: 122249 - DNA, 23 bp, Homo sapiens
tgtgtgtatatatatgtgtgtgt

SEQ ID NO: 122250 - DNA, 22 bp, Homo sapiens
tatatgtatatgtatatatgta

SEQ ID NO: 122251 - DNA, 23 bp, Homo sapiens
tgagttcattgtagattctggat

SEQ ID NO: 122252 - DNA, 23 bp, Homo sapiens
tgagttcattgtagattctggat

SEQ ID NO: 122253 - DNA, 23 bp, Homo sapiens
taatgtgtgcatgtgtgtacata

SEQ ID NO: 122254 - DNA, 19 bp, Homo sapiens
ctgcagctggagcagcttt

SEQ ID NO: 122255 - DNA, 21 bp, Homo sapiens
atgtatacacatatatgtgta

SEQ ID NO: 122256 - DNA, 23 bp, Homo sapiens
tatatgtgtatacatgtatacac

SEQ ID NO: 122257 - DNA, 23 bp, Homo sapiens
acttcccagagttagtcattctc

SEQ ID NO: 122258 - DNA, 18 bp, Homo sapiens
cctataagtttgaggtta

SEQ ID NO: 122259 - DNA, 21 bp, Homo sapiens
tctgctcttgagtctcttcct

SEQ ID NO: 122260 - DNA, 23 bp, Homo sapiens
tatgtcactagttgcatttttct

SEQ ID NO: 122261 - DNA, 23 bp, Homo sapiens
ttttttggttccatatgaaattt

SEQ ID NO: 122262 - DNA, 23 bp, Homo sapiens
tttgtgaagaaagtcaatggtag

SEQ ID NO: 122263 - DNA, 18 bp, Homo sapiens
tgcaccccaatctcttct

SEQ ID NO: 122264 - DNA, 19 bp, Homo sapiens
tgggttcctttggctctgt

SEQ ID NO: 122265 - DNA, 21 bp, Homo sapiens
atatgaacatatatatgtgtg

SEQ ID NO: 122266 - DNA, 22 bp, Homo sapiens
tatatgaacatatatatgtgtg

SEQ ID NO: 122267 - DNA, 23 bp, Homo sapiens
atatgaacatatatatatgtgtg

SEQ ID NO: 122268 - DNA, 23 bp, Homo sapiens
tatatgaacatatatatatgtgt

SEQ ID NO: 122269 - DNA, 23 bp, Homo sapiens
atatgaacatatatatatgtgtg

SEQ ID NO: 122270 - DNA, 23 bp, Homo sapiens
tatatgaacatatatatatgtgt

SEQ ID NO: 122271 - DNA, 23 bp, Homo sapiens
atatgaacatatatatatgtgtg

SEQ ID NO: 122272 - DNA, 23 bp, Homo sapiens
tatatgaacatatatatatgtgt

SEQ ID NO: 122273 - DNA, 23 bp, Homo sapiens
atatgaacatatatatatgtgtg

SEQ ID NO: 122274 - DNA, 23 bp, Homo sapiens
tatatgaacatatatatatgtgt

SEQ ID NO: 122275 - DNA, 23 bp, Homo sapiens
atatgaacatatatatatgtgtg

SEQ ID NO: 122276 - DNA, 23 bp, Homo sapiens
tatatgaacatatatatatgtgt

SEQ ID NO: 122277 - DNA, 23 bp, Homo sapiens
atatgaacatatatatatgtgtg

SEQ ID NO: 122278 - DNA, 23 bp, Homo sapiens
attggctaggtctgtaatcaagt

SEQ ID NO: 122279 - DNA, 21 bp, Homo sapiens
gcattctagtgaatttgttca

SEQ ID NO: 122280 - DNA, 22 bp, Homo sapiens
atatacgtatatatacataggt

SEQ ID NO: 122281 - DNA, 23 bp, Homo sapiens
accatcagaagtcatattctttt

SEQ ID NO: 122282 - DNA, 21 bp, Homo sapiens
ttcagaatatttgatgtctgt

SEQ ID NO: 122283 - DNA, 19 bp, Homo sapiens
ttgcttgctctcggtgcct

SEQ ID NO: 122284 - DNA, 23 bp, Homo sapiens
gagatggaatctctctctgtcac

SEQ ID NO: 122285 - DNA, 21 bp, Homo sapiens
tgaggtagaagggagattagt

SEQ ID NO: 122286 - DNA, 19 bp, Homo sapiens
tttagaattcacttacctt

SEQ ID NO: 122287 - DNA, 21 bp, Homo sapiens
tgaggtaggaggatcatttca

SEQ ID NO: 122288 - DNA, 23 bp, Homo sapiens
tctgtgtgtctgtctcattctgt

SEQ ID NO: 122289 - DNA, 23 bp, Homo sapiens
tgtagagtgatcatggctcactg

SEQ ID NO: 122290 - DNA, 23 bp, Homo sapiens
tgagttcattgtagattctggat

SEQ ID NO: 122291 - DNA, 23 bp, Homo sapiens
tgagttcattgtagattctggat

SEQ ID NO: 122292 - DNA, 22 bp, Homo sapiens
tctctctctctgtgtgtgtgcg

SEQ ID NO: 122293 - DNA, 23 bp, Homo sapiens
aatggttatggtttggcattgtt

SEQ ID NO: 122294 - DNA, 23 bp, Homo sapiens
gaatgagaggtagtaggagatac

SEQ ID NO: 122295 - DNA, 23 bp, Homo sapiens
aaaactcagttaccttagctgct

SEQ ID NO: 122296 - DNA, 22 bp, Homo sapiens
aagtaatagacttgggaacaga

SEQ ID NO: 122297 - DNA, 19 bp, Homo sapiens
agttaacacccagcactgt

SEQ ID NO: 122298 - DNA, 23 bp, Homo sapiens
gtagcaccattaggaatgatttt

SEQ ID NO: 122299 - DNA, 22 bp, Homo sapiens
taaaggcagtgcaagtttgcac

SEQ ID NO: 122300 - DNA, 23 bp, Homo sapiens
ccatagaagatataccaatgatt

SEQ ID NO: 122301 - DNA, 23 bp, Homo sapiens
agacagagtcttgttctgttgcc

SEQ ID NO: 122302 - DNA, 23 bp, Homo sapiens
aagactcagtctcaaaaaagaaa

SEQ ID NO: 122303 - DNA, 23 bp, Homo sapiens
ttttgagacggagtcttgctctg

SEQ ID NO: 122304 - DNA, 20 bp, Homo sapiens
atctttattgaatttgttca

SEQ ID NO: 122305 - DNA, 23 bp, Homo sapiens
tacatgtgcacaatgtgcaggtt

SEQ ID NO: 122306 - DNA, 23 bp, Homo sapiens
tatctgtataaagtgcagcacga

SEQ ID NO: 122307 - DNA, 23 bp, Homo sapiens
ttttggttccatatgaaatttaa

SEQ ID NO: 122308 - DNA, 23 bp, Homo sapiens
tgagaagaaagtcaatggtagct

SEQ ID NO: 122309 - DNA, 23 bp, Homo sapiens
tgagttcattgtagattctggat

SEQ ID NO: 122310 - DNA, 23 bp, Homo sapiens
tgagttcattgtagattctggat

SEQ ID NO: 122311 - DNA, 23 bp, Homo sapiens
tatgaaagtggttctcaaaagtt

SEQ ID NO: 122312 - DNA, 23 bp, Homo sapiens
tgctgtcagtttatcctgtaata

SEQ ID NO: 122313 - DNA, 23 bp, Homo sapiens
tgagttcattgtagattctggat

SEQ ID NO: 122314 - DNA, 23 bp, Homo sapiens
tgagttcattgtagattctggat

SEQ ID NO: 122315 - DNA, 19 bp, Homo sapiens
tatcttgaaattctgctga

SEQ ID NO: 122316 - DNA, 23 bp, Homo sapiens
aaatgagtattagtttgggttct

SEQ ID NO: 122317 - DNA, 23 bp, Homo sapiens
tgcatgtgtgtgtgagagagaga

SEQ ID NO: 122318 - DNA, 19 bp, Homo sapiens
tatgcatatattatatatg

SEQ ID NO: 122319 - DNA, 21 bp, Homo sapiens
ttgacaaataaaattgtgtat

SEQ ID NO: 122320 - DNA, 20 bp, Homo sapiens
atacaaatcatataattgtg

SEQ ID NO: 122321 - DNA, 23 bp, Homo sapiens
cacagttctctttcagtaaacaa

SEQ ID NO: 122322 - DNA, 20 bp, Homo sapiens
atcagagaagactgagtgaa

SEQ ID NO: 122323 - DNA, 23 bp, Homo sapiens
atgcacttgtatatgttttcttt

SEQ ID NO: 122324 - DNA, 22 bp, Homo sapiens
acatgtgcacattgtgcaggtt

SEQ ID NO: 122325 - DNA, 21 bp, Homo sapiens
atcactatttaatttgtgtat

SEQ ID NO: 122326 - DNA, 21 bp, Homo sapiens
acaccttatatatatatgtgt

SEQ ID NO: 122327 - DNA, 23 bp, Homo sapiens
tgaggaagatgttagctgtgggt

SEQ ID NO: 122328 - DNA, 23 bp, Homo sapiens
attagtattgttctcgtaatcat

SEQ ID NO: 122329 - DNA, 23 bp, Homo sapiens
tggattacagtgacttattatat

SEQ ID NO: 122330 - DNA, 22 bp, Homo sapiens
tttgctctttttgcttaggatt

SEQ ID NO: 122331 - DNA, 20 bp, Homo sapiens
tgtgaagaaagtcaatggta

SEQ ID NO: 122332 - DNA, 23 bp, Homo sapiens
tagaaatagtaagttgaattatt

SEQ ID NO: 122333 - DNA, 22 bp, Homo sapiens
ttagcttttgtaacttctgtgc

SEQ ID NO: 122334 - DNA, 22 bp, Homo sapiens
tgagatgaagtctcgctctgtt

SEQ ID NO: 122335 - DNA, 23 bp, Homo sapiens
tttctgtgtgtgtatatatagtg

SEQ ID NO: 122336 - DNA, 20 bp, Homo sapiens
acatatgttttggtgtatat

SEQ ID NO: 122337 - DNA, 22 bp, Homo sapiens
atatgtcttattatataaatgt

SEQ ID NO: 122338 - DNA, 19 bp, Homo sapiens
tgtacaattttgtagatat

SEQ ID NO: 122339 - DNA, 23 bp, Homo sapiens
gctgagaccacaagtgtgtgcca

SEQ ID NO: 122340 - DNA, 23 bp, Homo sapiens
tgagttcattgtagattctggat

SEQ ID NO: 122341 - DNA, 23 bp, Homo sapiens
tgagttcattgtagattctggat

SEQ ID NO: 122342 - DNA, 23 bp, Homo sapiens
agatgacaggtacaattctgggt

SEQ ID NO: 122343 - DNA, 23 bp, Homo sapiens
atagaatctatttgtatacgaat

SEQ ID NO: 122344 - DNA, 22 bp, Homo sapiens
tattttgactttatgtagctct

SEQ ID NO: 122345 - DNA, 23 bp, Homo sapiens
tgagttcattgtagattctggat

SEQ ID NO: 122346 - DNA, 23 bp, Homo sapiens
tgagttcattgtagattctggat

SEQ ID NO: 122347 - DNA, 23 bp, Homo sapiens
tgtctgtctatctgtctgtcttt

SEQ ID NO: 122348 - DNA, 21 bp, Homo sapiens
tctcactctgtcacccaggct

SEQ ID NO: 122349 - DNA, 22 bp, Homo sapiens
tctatgtatatatattgtgtat

SEQ ID NO: 122350 - DNA, 22 bp, Homo sapiens
tatacttttgtgtatgtttata

SEQ ID NO: 122351 - DNA, 23 bp, Homo sapiens
atatgtctaatctttgctatact

SEQ ID NO: 122352 - DNA, 22 bp, Homo sapiens
agtttgcacttgaaagctttgt

SEQ ID NO: 122353 - DNA, 19 bp, Homo sapiens
gagaatcaattgccacagc

SEQ ID NO: 122354 - DNA, 23 bp, Homo sapiens
tttctttctggtcgattttggtt

SEQ ID NO: 122355 - DNA, 22 bp, Homo sapiens
tgagatggagtctcactctgtt

SEQ ID NO: 122356 - DNA, 23 bp, Homo sapiens
ttctttcattagagagacagggt

SEQ ID NO: 122357 - DNA, 20 bp, Homo sapiens
accatgttctggggtttctg

SEQ ID NO: 122358 - DNA, 23 bp, Homo sapiens
actcccagagcccctggaactct

SEQ ID NO: 122359 - DNA, 20 bp, Homo sapiens
tctcagaagagactgatgag

SEQ ID NO: 122360 - DNA, 20 bp, Homo sapiens
ttatcaatttttttgaaggt

SEQ ID NO: 122361 - DNA, 23 bp, Homo sapiens
tagtgtgtgtatgtaaatgtggt

SEQ ID NO: 122362 - DNA, 23 bp, Homo sapiens
ttgtttcagtttttgtatatctg

SEQ ID NO: 122363 - DNA, 23 bp, Homo sapiens
tgagttcattgtagattctggat

SEQ ID NO: 122364 - DNA, 23 bp, Homo sapiens
tgagttcattgtagattctggat

SEQ ID NO: 122365 - DNA, 23 bp, Homo sapiens
aaggtcctgatgtagtagttaca

SEQ ID NO: 122366 - DNA, 22 bp, Homo sapiens
tttaagctcataattttatagt

SEQ ID NO: 122367 - DNA, 23 bp, Homo sapiens
tgacttgagattttgttcatttg

SEQ ID NO: 122368 - DNA, 21 bp, Homo sapiens
atgtgctgaaaattttgtgag

SEQ ID NO: 122369 - DNA, 23 bp, Homo sapiens
tgcacaagctctctctctctgcc

SEQ ID NO: 122370 - DNA, 21 bp, Homo sapiens
tgagttgcttctccttgcctt

SEQ ID NO: 122371 - DNA, 23 bp, Homo sapiens
atgtgtgtgtgtgtatatgtata

SEQ ID NO: 122372 - DNA, 21 bp, Homo sapiens
tgaaatccaatcatgatgttg

SEQ ID NO: 122373 - DNA, 20 bp, Homo sapiens
ctccatttagttccaggaaa

SEQ ID NO: 122374 - DNA, 22 bp, Homo sapiens
gagattttcagttgccactcag

SEQ ID NO: 122375 - DNA, 23 bp, Homo sapiens
tatgacagtgtggttagctcagg

SEQ ID NO: 122376 - DNA, 23 bp, Homo sapiens
ttgagatggagttttgctcttgt

SEQ ID NO: 122377 - DNA, 23 bp, Homo sapiens
tgtctgactgtatttcttttctt

SEQ ID NO: 122378 - DNA, 23 bp, Homo sapiens
ccttgactcatgagtgtcagtac

SEQ ID NO: 122379 - DNA, 23 bp, Homo sapiens
gtgtgaaatgattagaaaagtgt

SEQ ID NO: 122380 - DNA, 20 bp, Homo sapiens
tatatttatgtaatacatgt

SEQ ID NO: 122381 - DNA, 23 bp, Homo sapiens
gtatgtgtcctagtactttgagc

SEQ ID NO: 122382 - DNA, 21 bp, Homo sapiens
acacacctgtcagtctatctc

SEQ ID NO: 122383 - DNA, 19 bp, Homo sapiens
gtgacatgtctctcacttt

SEQ ID NO: 122384 - DNA, 20 bp, Homo sapiens
ttgagatggagtctcactct

SEQ ID NO: 122385 - DNA, 23 bp, Homo sapiens
gatggtgtctcagtctgtgacat

SEQ ID NO: 122386 - DNA, 23 bp, Homo sapiens
acacacacacacatatacgtgtg

SEQ ID NO: 122387 - DNA, 23 bp, Homo sapiens
acacacacgtatatgtatgtgta

SEQ ID NO: 122388 - DNA, 20 bp, Homo sapiens
tcatttctctgatgattagt

SEQ ID NO: 122389 - DNA, 22 bp, Homo sapiens
tatgagaatatatatatttgtg

SEQ ID NO: 122390 - DNA, 19 bp, Homo sapiens
ttattgttgtagtttggtt

SEQ ID NO: 122391 - DNA, 23 bp, Homo sapiens
acagactgtgagacagatgtttg

SEQ ID NO: 122392 - DNA, 19 bp, Homo sapiens
tatacacatatacatatac

SEQ ID NO: 122393 - DNA, 22 bp, Homo sapiens
tgtctatatgtctatatatgtg

SEQ ID NO: 122394 - DNA, 21 bp, Homo sapiens
tgtttatgtgtatatgtacat

SEQ ID NO: 122395 - DNA, 18 bp, Homo sapiens
tcctatatatatatgagt

SEQ ID NO: 122396 - DNA, 21 bp, Homo sapiens
atgtgtgtatatatgtatatc

SEQ ID NO: 122397 - DNA, 23 bp, Homo sapiens
ttggaatacacacagagatacat

SEQ ID NO: 122398 - DNA, 23 bp, Homo sapiens
tgagttcattgtagattctggat

SEQ ID NO: 122399 - DNA, 23 bp, Homo sapiens
tgagttcattgtagattctggat

SEQ ID NO: 122400 - DNA, 18 bp, Homo sapiens
atgagacctcagggagtg

SEQ ID NO: 122401 - DNA, 23 bp, Homo sapiens
atatggatatctataggataact

SEQ ID NO: 122402 - DNA, 18 bp, Homo sapiens
gtatctatgtatgtatgt

SEQ ID NO: 122403 - DNA, 23 bp, Homo sapiens
gcatacataggatttgatatgaa

SEQ ID NO: 122404 - DNA, 23 bp, Homo sapiens
aaagagaaaggtcagggaaagat

SEQ ID NO: 122405 - DNA, 22 bp, Homo sapiens
agtgttcttttgtagaagtctg

SEQ ID NO: 122406 - DNA, 23 bp, Homo sapiens
tgagttcattgtagattctggat

SEQ ID NO: 122407 - DNA, 23 bp, Homo sapiens
tgagttcattgtagattctggat

SEQ ID NO: 122408 - DNA, 23 bp, Homo sapiens
tatatgcatatatttatgtgtgt

SEQ ID NO: 122409 - DNA, 23 bp, Homo sapiens
tatatatacatgcacacatacac

SEQ ID NO: 122410 - DNA, 23 bp, Homo sapiens
gattctcagcttggtcattgtgg

SEQ ID NO: 122411 - DNA, 23 bp, Homo sapiens
agctggagtctcactctgtcacc

SEQ ID NO: 122412 - DNA, 20 bp, Homo sapiens
acagccattaaaatgttgta

SEQ ID NO: 122413 - DNA, 21 bp, Homo sapiens
aattattaatggtgtggaagg

SEQ ID NO: 122414 - DNA, 19 bp, Homo sapiens
tatgtgtgtatatatacgt

SEQ ID NO: 122415 - DNA, 23 bp, Homo sapiens
tatatacgtatatatatgtgtgt

SEQ ID NO: 122416 - DNA, 20 bp, Homo sapiens
atacgtatatatacacacac

SEQ ID NO: 122417 - DNA, 23 bp, Homo sapiens
caaggtctcactctctcacccag

SEQ ID NO: 122418 - DNA, 19 bp, Homo sapiens
gtgtgatcttggctcactg

SEQ ID NO: 122419 - DNA, 23 bp, Homo sapiens
acaggctctatgcagtgcgacct

SEQ ID NO: 122420 - DNA, 23 bp, Homo sapiens
aatgtaaaatggtgacggtgtct

SEQ ID NO: 122421 - DNA, 19 bp, Homo sapiens
ggcatgcaccaccagacca

SEQ ID NO: 122422 - DNA, 23 bp, Homo sapiens
aaatgtgtaacgtaattgacagt

SEQ ID NO: 122423 - DNA, 23 bp, Homo sapiens
tgagttcattgtagattctggat

SEQ ID NO: 122424 - DNA, 18 bp, Homo sapiens
atgcctgtagttccagct

SEQ ID NO: 122425 - DNA, 18 bp, Homo sapiens
agtgagccaagatagcac

SEQ ID NO: 122426 - DNA, 20 bp, Homo sapiens
tgggagggtccctgccaccc

SEQ ID NO: 122427 - DNA, 23 bp, Homo sapiens
tgagttcattgtagattctggat

SEQ ID NO: 122428 - DNA, 23 bp, Homo sapiens
tgagttcattgtagattctggat

SEQ ID NO: 122429 - DNA, 22 bp, Homo sapiens
tgtgctagttcaaatctctctt

SEQ ID NO: 122430 - DNA, 23 bp, Homo sapiens
ataagaggtttctttggcccaca

SEQ ID NO: 122431 - DNA, 23 bp, Homo sapiens
tttatcaaacagctaaaaatgtg

SEQ ID NO: 122432 - DNA, 23 bp, Homo sapiens
tctctctgagtctcattcttgac

SEQ ID NO: 122433 - DNA, 23 bp, Homo sapiens
tacactgagtatgtatatgtgtg

SEQ ID NO: 122434 - DNA, 23 bp, Homo sapiens
tgagttcattgtagattctggat

SEQ ID NO: 122435 - DNA, 23 bp, Homo sapiens
tgagttcattgtagattctggat

SEQ ID NO: 122436 - DNA, 23 bp, Homo sapiens
ttctggatgtttctatgaaagta

SEQ ID NO: 122437 - DNA, 20 bp, Homo sapiens
atatgtatatatttgtgtgt

SEQ ID NO: 122438 - DNA, 18 bp, Homo sapiens
tagctccctacactctaa

SEQ ID NO: 122439 - DNA, 22 bp, Homo sapiens
tgagacagggtcttgctctgtt

SEQ ID NO: 122440 - DNA, 21 bp, Homo sapiens
tgttaggatatctagggaaaa

SEQ ID NO: 122441 - DNA, 23 bp, Homo sapiens
aggcacagctattgacttcctag

SEQ ID NO: 122442 - DNA, 21 bp, Homo sapiens
tatggtagttctatttttgtt

SEQ ID NO: 122443 - DNA, 20 bp, Homo sapiens
tttcactgtgttgcctaggc

SEQ ID NO: 122444 - DNA, 23 bp, Homo sapiens
tgagttcattgtagattctggat

SEQ ID NO: 122445 - DNA, 23 bp, Homo sapiens
tgagttcattgtagattctggat

SEQ ID NO: 122446 - DNA, 21 bp, Homo sapiens
aaactggttttttaaaaatgt

SEQ ID NO: 122447 - DNA, 23 bp, Homo sapiens
aagaacagttgaaagttgcagct

SEQ ID NO: 122448 - DNA, 23 bp, Homo sapiens
tgagttcattgtagattctggat

SEQ ID NO: 122449 - DNA, 23 bp, Homo sapiens
tgagttcattgtagattctggat

SEQ ID NO: 122450 - DNA, 23 bp, Homo sapiens
tgtgtgtcacagaaagatattag

SEQ ID NO: 122451 - DNA, 23 bp, Homo sapiens
gagtactgagattagtgttggca

SEQ ID NO: 122452 - DNA, 19 bp, Homo sapiens
cagtggcatgatcttgtct

SEQ ID NO: 122453 - DNA, 23 bp, Homo sapiens
gactgagtctcgctctgtcaccc

SEQ ID NO: 122454 - DNA, 23 bp, Homo sapiens
tctgatgcttttgaattctttgt

SEQ ID NO: 122455 - DNA, 23 bp, Homo sapiens
tttcagagggagacagtgtcttt

SEQ ID NO: 122456 - DNA, 23 bp, Homo sapiens
tcagtggcagtatctcaactccc

SEQ ID NO: 122457 - DNA, 23 bp, Homo sapiens
gtgtgtgcatatatatacacaca

SEQ ID NO: 122458 - DNA, 23 bp, Homo sapiens
gagacggagtctcactctgtcac

SEQ ID NO: 122459 - DNA, 23 bp, Homo sapiens
cggagtctcactctgtcacccag

SEQ ID NO: 122460 - DNA, 20 bp, Homo sapiens
tacagtagtgtgatcttagc

SEQ ID NO: 122461 - DNA, 20 bp, Homo sapiens
gggtctcactctcagtctgt

SEQ ID NO: 122462 - DNA, 23 bp, Homo sapiens
taggtggtagaaacagaatctga

SEQ ID NO: 122463 - DNA, 23 bp, Homo sapiens
tgagttcattgtagattctggat

SEQ ID NO: 122464 - DNA, 23 bp, Homo sapiens
tgagttcattgtagattctggat

SEQ ID NO: 122465 - DNA, 19 bp, Homo sapiens
tgtatacatgtatatagat

SEQ ID NO: 122466 - DNA, 23 bp, Homo sapiens
ttcatgtgtatttatatacatgt

SEQ ID NO: 122467 - DNA, 23 bp, Homo sapiens
ttcctctgactcagtgtcctgtc

SEQ ID NO: 122468 - DNA, 23 bp, Homo sapiens
ctcaaaagtgtttatgaacatgt

SEQ ID NO: 122469 - DNA, 23 bp, Homo sapiens
tgagacaaggtctcgctctgttg

SEQ ID NO: 122470 - DNA, 23 bp, Homo sapiens
ctatatatatatgtgtgtgtgct

SEQ ID NO: 122471 - DNA, 23 bp, Homo sapiens
tgagttcattgtagattctggat

SEQ ID NO: 122472 - DNA, 23 bp, Homo sapiens
tgagttcattgtagattctggat

SEQ ID NO: 122473 - DNA, 20 bp, Homo sapiens
agacattctgcctccttttg

SEQ ID NO: 122474 - DNA, 20 bp, Homo sapiens
atgcctggaaaagttctcta

SEQ ID NO: 122475 - DNA, 20 bp, Homo sapiens
ttgtagaggacttgttttat

SEQ ID NO: 122476 - DNA, 23 bp, Homo sapiens
ttttctcagttcactttctgtcc

SEQ ID NO: 122477 - DNA, 22 bp, Homo sapiens
atgtgtatatatatatgtatgt

SEQ ID NO: 122478 - DNA, 23 bp, Homo sapiens
tgctttgtgtctatagtcagcag

SEQ ID NO: 122479 - DNA, 23 bp, Homo sapiens
tatgtgtgtgtatatatgtgtct

SEQ ID NO: 122480 - DNA, 23 bp, Homo sapiens
atttgagcaatagtaaagtatgt

SEQ ID NO: 122481 - DNA, 23 bp, Homo sapiens
tctcaagctgctagaaagaggtt

SEQ ID NO: 122482 - DNA, 18 bp, Homo sapiens
atgaggttattagttttt

SEQ ID NO: 122483 - DNA, 23 bp, Homo sapiens
gaggtcagtgaaaagggaagtca

SEQ ID NO: 122484 - DNA, 23 bp, Homo sapiens
gagatagagtctcactctgtcgc

SEQ ID NO: 122485 - DNA, 20 bp, Homo sapiens
aagtcaccagctgcattagc

SEQ ID NO: 122486 - DNA, 21 bp, Homo sapiens
aaagccaggcattaacttctc

SEQ ID NO: 122487 - DNA, 23 bp, Homo sapiens
gtgtgtgtgtgtatatgtatgtg

SEQ ID NO: 122488 - DNA, 19 bp, Homo sapiens
tggaaggatcacttgaggc

SEQ ID NO: 122489 - DNA, 23 bp, Homo sapiens
cggagtctcactctgtcacccag

SEQ ID NO: 122490 - DNA, 22 bp, Homo sapiens
atgtgtatatatatgtgtgtgt

SEQ ID NO: 122491 - DNA, 18 bp, Homo sapiens
agagaaaaaatcgagttt

SEQ ID NO: 122492 - DNA, 23 bp, Homo sapiens
tgagttcattgtagattctggat

SEQ ID NO: 122493 - DNA, 23 bp, Homo sapiens
tgagttcattgtagattctggat

SEQ ID NO: 122494 - DNA, 23 bp, Homo sapiens
tgtgtgtgtgtatgaatatgtat

SEQ ID NO: 122495 - DNA, 21 bp, Homo sapiens
gtgtgtgtctgtgtgtgccac

SEQ ID NO: 122496 - DNA, 23 bp, Homo sapiens
gcctcagaacatccttgaagcaa

SEQ ID NO: 122497 - DNA, 19 bp, Homo sapiens
gcctgtagtctcagcttct

SEQ ID NO: 122498 - DNA, 20 bp, Homo sapiens
agggaagttgaagctgcagt

SEQ ID NO: 122499 - DNA, 20 bp, Homo sapiens
gcaattctctctctcttttt

SEQ ID NO: 122500 - DNA, 23 bp, Homo sapiens
ttagttttgttatcttcctcaat

SEQ ID NO: 122501 - DNA, 23 bp, Homo sapiens
tatatgcatatatatacacatat

SEQ ID NO: 122502 - DNA, 23 bp, Homo sapiens
ctatatttgatagtttatgctga

SEQ ID NO: 122503 - DNA, 23 bp, Homo sapiens
acacacaaatgtaaatgtgtgtg

SEQ ID NO: 122504 - DNA, 23 bp, Homo sapiens
tttttcttagaaaacttttgagt

SEQ ID NO: 122505 - DNA, 23 bp, Homo sapiens
gacagagtctcgctctgtcactc

SEQ ID NO: 122506 - DNA, 23 bp, Homo sapiens
cacggtcttgctgtcactccggc

SEQ ID NO: 122507 - DNA, 23 bp, Homo sapiens
gagtctcactctgtcacccaggc

SEQ ID NO: 122508 - DNA, 22 bp, Homo sapiens
tagctagataaggttaactttg

SEQ ID NO: 122509 - DNA, 23 bp, Homo sapiens
tttgagacggagtttcactcttg

SEQ ID NO: 122510 - DNA, 23 bp, Homo sapiens
tagttagaatttgttttgcagtt

SEQ ID NO: 122511 - DNA, 23 bp, Homo sapiens
tgagacggaggctcgctctgtcc

SEQ ID NO: 122512 - DNA, 21 bp, Homo sapiens
aaggtggtgctgaataggagt

SEQ ID NO: 122513 - DNA, 23 bp, Homo sapiens
tgagttcattgtagattctggat

SEQ ID NO: 122514 - DNA, 23 bp, Homo sapiens
tgagttcattgtagattctggat

SEQ ID NO: 122515 - DNA, 23 bp, Homo sapiens
tgagttcattgtagattctggat

SEQ ID NO: 122516 - DNA, 23 bp, Homo sapiens
tgagttcattgtagattctggat

SEQ ID NO: 122517 - DNA, 21 bp, Homo sapiens
ttatgtatacatgtatgtgtg

SEQ ID NO: 122518 - DNA, 23 bp, Homo sapiens
cccattcagatgtatagacaatg

SEQ ID NO: 122519 - DNA, 23 bp, Homo sapiens
tgtgtctatgtgtgtgtgtgtat

SEQ ID NO: 122520 - DNA, 23 bp, Homo sapiens
atgtatgtgtgcttgtgatatat

SEQ ID NO: 122521 - DNA, 21 bp, Homo sapiens
tccattcagctggagaatgaa

SEQ ID NO: 122522 - DNA, 23 bp, Homo sapiens
ttttttcaagttcaatagctctt

SEQ ID NO: 122523 - DNA, 22 bp, Homo sapiens
atgtgtgtgctttgtcactctc

SEQ ID NO: 122524 - DNA, 23 bp, Homo sapiens
acatgagagttgattgtgatcac

SEQ ID NO: 122525 - DNA, 23 bp, Homo sapiens
aatcacaattacttatttgtcag

SEQ ID NO: 122526 - DNA, 20 bp, Homo sapiens
ttttttgatcatgtctgtga

SEQ ID NO: 122527 - DNA, 23 bp, Homo sapiens
actcactcactcactcactcact

SEQ ID NO: 122528 - DNA, 22 bp, Homo sapiens
atacctatatatacgtatatgt

SEQ ID NO: 122529 - DNA, 19 bp, Homo sapiens
tatacgtatatataggtat

SEQ ID NO: 122530 - DNA, 23 bp, Homo sapiens
gtatatatgtatacacataggta

SEQ ID NO: 122531 - DNA, 21 bp, Homo sapiens
tttgagacggagctctgttgt

SEQ ID NO: 122532 - DNA, 23 bp, Homo sapiens
atgttcctactctctgtgtgact

SEQ ID NO: 122533 - DNA, 23 bp, Homo sapiens
atatgtgtgtatatatgtgtgtg

SEQ ID NO: 122534 - DNA, 20 bp, Homo sapiens
atatgtgtatatgtatatat

SEQ ID NO: 122535 - DNA, 18 bp, Homo sapiens
aatgtgcagacattttaa

SEQ ID NO: 122536 - DNA, 19 bp, Homo sapiens
gacagaactaagagtgcag

SEQ ID NO: 122537 - DNA, 20 bp, Homo sapiens
atatgtatgtatacacacac

SEQ ID NO: 122538 - DNA, 21 bp, Homo sapiens
attctataacttgcttttagt

SEQ ID NO: 122539 - DNA, 23 bp, Homo sapiens
tgagttcattgtagattctggat

SEQ ID NO: 122540 - DNA, 23 bp, Homo sapiens
tgagttcattgtagattctggat

SEQ ID NO: 122541 - DNA, 23 bp, Homo sapiens
tgagttcattgtagattctggat

SEQ ID NO: 122542 - DNA, 23 bp, Homo sapiens
tgagttcattgtagattctggat

SEQ ID NO: 122543 - DNA, 23 bp, Homo sapiens
tgaacatttgtatacaagccttt

SEQ ID NO: 122544 - DNA, 23 bp, Homo sapiens
tatttgtatgcatatgtttatga

SEQ ID NO: 122545 - DNA, 23 bp, Homo sapiens
tgagttcattgtagattctggat

SEQ ID NO: 122546 - DNA, 23 bp, Homo sapiens
tgagttcattgtagattctggat

SEQ ID NO: 122547 - DNA, 19 bp, Homo sapiens
gtgtgcgtatatgtgtgtg

SEQ ID NO: 122548 - DNA, 20 bp, Homo sapiens
tgtgtgtgtgtatatgtata

SEQ ID NO: 122549 - DNA, 22 bp, Homo sapiens
atatgtgtatatatatgtgtgt

SEQ ID NO: 122550 - DNA, 22 bp, Homo sapiens
atacacacacacgtatatatgt

SEQ ID NO: 122551 - DNA, 23 bp, Homo sapiens
gtgagcagagtgagaaatgtgaa

SEQ ID NO: 122552 - DNA, 23 bp, Homo sapiens
ctcccagagcccctggaactctg

SEQ ID NO: 122553 - DNA, 23 bp, Homo sapiens
tcccagagcccctggaactctgg

SEQ ID NO: 122554 - DNA, 23 bp, Homo sapiens
tcccagagcccctggaactctgg

SEQ ID NO: 122555 - DNA, 23 bp, Homo sapiens
tcccagagcccctggaactctgg

SEQ ID NO: 122556 - DNA, 23 bp, Homo sapiens
ggagtctcactctgtcactcagg

SEQ ID NO: 122557 - DNA, 22 bp, Homo sapiens
tagctatataatagctctatat

SEQ ID NO: 122558 - DNA, 21 bp, Homo sapiens
tgtgaagaatgtcaaaggtag

SEQ ID NO: 122559 - DNA, 23 bp, Homo sapiens
gaccactgctatagatgactctt

SEQ ID NO: 122560 - DNA, 23 bp, Homo sapiens
tgagacggagtctcgctctgtca

SEQ ID NO: 122561 - DNA, 23 bp, Homo sapiens
aaaatcttcaagtgaaaccacga

SEQ ID NO: 122562 - DNA, 23 bp, Homo sapiens
tgagttcattgtagattctggat

SEQ ID NO: 122563 - DNA, 23 bp, Homo sapiens
tgagttcattgtagattctggat

SEQ ID NO: 122564 - DNA, 23 bp, Homo sapiens
gcattttgagcagtttctccacc

SEQ ID NO: 122565 - DNA, 23 bp, Homo sapiens
tatatgcaccttataatatgtta

SEQ ID NO: 122566 - DNA, 20 bp, Homo sapiens
agcttacctaacacaagtgt

SEQ ID NO: 122567 - DNA, 21 bp, Homo sapiens
tggagtctcactctgtcaccc

SEQ ID NO: 122568 - DNA, 23 bp, Homo sapiens
atagcatatgtagtatttagtgt

SEQ ID NO: 122569 - DNA, 21 bp, Homo sapiens
tcttttttggtgccatatgaa

SEQ ID NO: 122570 - DNA, 23 bp, Homo sapiens
aaagtcagtggtagcttgatggg

SEQ ID NO: 122571 - DNA, 23 bp, Homo sapiens
ttgctccatttctaaagcaagtt

SEQ ID NO: 122572 - DNA, 20 bp, Homo sapiens
ttgaccataaaactagctga

SEQ ID NO: 122573 - DNA, 18 bp, Homo sapiens
tgcctcctggcttcatgc

SEQ ID NO: 122574 - DNA, 22 bp, Homo sapiens
atgtgtatgtatatatgtgtgt

SEQ ID NO: 122575 - DNA, 23 bp, Homo sapiens
atgtgtgtgtatatatatgtgtg

SEQ ID NO: 122576 - DNA, 23 bp, Homo sapiens
tatgtgtatatatatatatgtgt

SEQ ID NO: 122577 - DNA, 23 bp, Homo sapiens
atatatgtgtatatatgtgtatg

SEQ ID NO: 122578 - DNA, 20 bp, Homo sapiens
acacatatatatggtgtgtg

SEQ ID NO: 122579 - DNA, 23 bp, Homo sapiens
tccctggctgcctctgtgccagg

SEQ ID NO: 122580 - DNA, 22 bp, Homo sapiens
tggatctgtgagaatattaagc

SEQ ID NO: 122581 - DNA, 22 bp, Homo sapiens
aaagcaagttggttgtttattt

SEQ ID NO: 122582 - DNA, 19 bp, Homo sapiens
gagacaggaaagtgaggtc

SEQ ID NO: 122583 - DNA, 22 bp, Homo sapiens
atctccatgttgagctggaagt

SEQ ID NO: 122584 - DNA, 18 bp, Homo sapiens
agggagactggttaaggt

SEQ ID NO: 122585 - DNA, 23 bp, Homo sapiens
acacaccatgtaatagtctctct

SEQ ID NO: 122586 - DNA, 23 bp, Homo sapiens
tgtaatagtacttcaggtactaa

SEQ ID NO: 122587 - DNA, 23 bp, Homo sapiens
gggtctcagggtctccctctgtc

SEQ ID NO: 122588 - DNA, 19 bp, Homo sapiens
agactacaggcacagctca

SEQ ID NO: 122589 - DNA, 23 bp, Homo sapiens
acccagctaattttttctttttt

SEQ ID NO: 122590 - DNA, 23 bp, Homo sapiens
atgttgtggctggccttgctgtg

SEQ ID NO: 122591 - DNA, 19 bp, Homo sapiens
atacctgtagttccagcta

SEQ ID NO: 122592 - DNA, 19 bp, Homo sapiens
actaagtgaggataccata

SEQ ID NO: 122593 - DNA, 23 bp, Homo sapiens
tgagatggagtcccactctgtca

SEQ ID NO: 122594 - DNA, 23 bp, Homo sapiens
tgagttcattgtagattctggat

SEQ ID NO: 122595 - DNA, 23 bp, Homo sapiens
tgagttcattgtagattctggat

SEQ ID NO: 122596 - DNA, 23 bp, Homo sapiens
aaatgtatttaaacattgctata

SEQ ID NO: 122597 - DNA, 23 bp, Homo sapiens
tgagttcattgtagattctggat

SEQ ID NO: 122598 - DNA, 23 bp, Homo sapiens
tgagttcattgtagattctggat

SEQ ID NO: 122599 - DNA, 23 bp, Homo sapiens
aatgatatctctggttctaggtc

SEQ ID NO: 122600 - DNA, 23 bp, Homo sapiens
tatcactcagactgttatttgtg

SEQ ID NO: 122601 - DNA, 22 bp, Homo sapiens
aaggtgggtggtcttgctgtgt

SEQ ID NO: 122602 - DNA, 23 bp, Homo sapiens
gtatcacagagatcttgatgtga

SEQ ID NO: 122603 - DNA, 23 bp, Homo sapiens
tgaagtcagaggggtattcaaca

SEQ ID NO: 122604 - DNA, 21 bp, Homo sapiens
aaagatcttcaacagggcgtg

SEQ ID NO: 122605 - DNA, 20 bp, Homo sapiens
tgaggttgaaggatcacctg

SEQ ID NO: 122606 - DNA, 23 bp, Homo sapiens
tgtttagtaggttgtttcctatt

SEQ ID NO: 122607 - DNA, 21 bp, Homo sapiens
acatgtgcacaatgtgcaggt

SEQ ID NO: 122608 - DNA, 22 bp, Homo sapiens
gtattgaacaagtccatgggca

SEQ ID NO: 122609 - DNA, 19 bp, Homo sapiens
tatggagaagaaagctgat

SEQ ID NO: 122610 - DNA, 22 bp, Homo sapiens
tgagatcatacagaaagtttgt

SEQ ID NO: 122611 - DNA, 23 bp, Homo sapiens
tatcgatatatatgtatatatgt

SEQ ID NO: 122612 - DNA, 21 bp, Homo sapiens
atatcgatatatatacacata

SEQ ID NO: 122613 - DNA, 20 bp, Homo sapiens
tctatgtatatatattgggg

SEQ ID NO: 122614 - DNA, 23 bp, Homo sapiens
tataagctccttttgaaaaagaa

SEQ ID NO: 122615 - DNA, 23 bp, Homo sapiens
cgcagtcacgctctgtctcccag

SEQ ID NO: 122616 - DNA, 23 bp, Homo sapiens
ctgactgtctctcagttacctca

SEQ ID NO: 122617 - DNA, 23 bp, Homo sapiens
tatatgtatatatatatacgtgt

SEQ ID NO: 122618 - DNA, 23 bp, Homo sapiens
cagtctcactctgtcacccaggc

SEQ ID NO: 122619 - DNA, 22 bp, Homo sapiens
caagtgtatggcaaagcagtgt

SEQ ID NO: 122620 - DNA, 18 bp, Homo sapiens
ttagccctttgtcaaatg

SEQ ID NO: 122621 - DNA, 23 bp, Homo sapiens
atgaagtaggtgctgctatattt

SEQ ID NO: 122622 - DNA, 22 bp, Homo sapiens
ctactatgtgctaggtattgtg

SEQ ID NO: 122623 - DNA, 23 bp, Homo sapiens
gataggtttcagagggaaaattc

SEQ ID NO: 122624 - DNA, 23 bp, Homo sapiens
taatctgaactgtctcagctggg

SEQ ID NO: 122625 - DNA, 18 bp, Homo sapiens
tcccaagtagctgggact

SEQ ID NO: 122626 - DNA, 21 bp, Homo sapiens
tgtcagaagatacagtggatg

SEQ ID NO: 122627 - DNA, 23 bp, Homo sapiens
tgcaacatagtatatgttgtgta

SEQ ID NO: 122628 - DNA, 20 bp, Homo sapiens
tgtctatatacattgtctat

SEQ ID NO: 122629 - DNA, 19 bp, Homo sapiens
taaactctctttatatatg

SEQ ID NO: 122630 - DNA, 21 bp, Homo sapiens
taaaatagtaggtgtatgtgt

SEQ ID NO: 122631 - DNA, 20 bp, Homo sapiens
ataatacatttgtgtgtgtg

SEQ ID NO: 122632 - DNA, 18 bp, Homo sapiens
catgagactttgaagatg

SEQ ID NO: 122633 - DNA, 23 bp, Homo sapiens
ttactgcttactctgtctctctg

SEQ ID NO: 122634 - DNA, 23 bp, Homo sapiens
agaaaggcagttctagaattctg

SEQ ID NO: 122635 - DNA, 20 bp, Homo sapiens
ttctctctcgctgctttgaa

SEQ ID NO: 122636 - DNA, 22 bp, Homo sapiens
tgtgagagagcatctcattgtg

SEQ ID NO: 122637 - DNA, 23 bp, Homo sapiens
tggagtctgtctgttctgactga

SEQ ID NO: 122638 - DNA, 23 bp, Homo sapiens
gctctctgtttgtctgttattgg

SEQ ID NO: 122639 - DNA, 23 bp, Homo sapiens
atgtgtgcatatatgtgcatata

SEQ ID NO: 122640 - DNA, 23 bp, Homo sapiens
atatatgtatatatacatatgtg

SEQ ID NO: 122641 - DNA, 23 bp, Homo sapiens
aatgtgtgtgtattatatgtgtg

SEQ ID NO: 122642 - DNA, 19 bp, Homo sapiens
atgagatgtatatattatg

SEQ ID NO: 122643 - DNA, 23 bp, Homo sapiens
gactggaagttgctctgtatgac

SEQ ID NO: 122644 - DNA, 22 bp, Homo sapiens
tcagtctatttctgtgtctgta

SEQ ID NO: 122645 - DNA, 19 bp, Homo sapiens
atttacgtcatgaaatgga

SEQ ID NO: 122646 - DNA, 23 bp, Homo sapiens
aattgccttactgagtttcttct

SEQ ID NO: 122647 - DNA, 19 bp, Homo sapiens
atgtatgtgtgtatataca

SEQ ID NO: 122648 - DNA, 23 bp, Homo sapiens
tcacactctctctggctctccat

SEQ ID NO: 122649 - DNA, 23 bp, Homo sapiens
tgatgtggttctttttgagtttg

SEQ ID NO: 122650 - DNA, 21 bp, Homo sapiens
cattgtggttttgatttgcat

SEQ ID NO: 122651 - DNA, 21 bp, Homo sapiens
tctaagtgcttcaatgtgttc

SEQ ID NO: 122652 - DNA, 23 bp, Homo sapiens
gtgtgtgtgtatatatacaggta

SEQ ID NO: 122653 - DNA, 23 bp, Homo sapiens
tgagttcattgtagattctggat

SEQ ID NO: 122654 - DNA, 23 bp, Homo sapiens
tgagttcattgtagattctggat

SEQ ID NO: 122655 - DNA, 23 bp, Homo sapiens
tgagttcattgtagattctggat

SEQ ID NO: 122656 - DNA, 23 bp, Homo sapiens
tgagttcattgtagattctggat

SEQ ID NO: 122657 - DNA, 23 bp, Homo sapiens
agagtctcactctgtcacccagg

SEQ ID NO: 122658 - DNA, 23 bp, Homo sapiens
ccaagtctcgctctgtcacccag

SEQ ID NO: 122659 - DNA, 19 bp, Homo sapiens
aacgagataataccttgca

SEQ ID NO: 122660 - DNA, 23 bp, Homo sapiens
tatacacactgcaagatatctca

SEQ ID NO: 122661 - DNA, 23 bp, Homo sapiens
agacagagtctcgctctgtcgct

SEQ ID NO: 122662 - DNA, 19 bp, Homo sapiens
ttgagctacaggttcatgt

SEQ ID NO: 122663 - DNA, 18 bp, Homo sapiens
aggagttgtgatcctttg

SEQ ID NO: 122664 - DNA, 18 bp, Homo sapiens
agttctttaaggatggac

SEQ ID NO: 122665 - DNA, 23 bp, Homo sapiens
tgagttcattgtagattctggat

SEQ ID NO: 122666 - DNA, 23 bp, Homo sapiens
tggcttacaatttcttgacttac

SEQ ID NO: 122667 - DNA, 22 bp, Homo sapiens
acatgtgcacattgtgcaggtt

SEQ ID NO: 122668 - DNA, 23 bp, Homo sapiens
tgagttcattgtagattctggat

SEQ ID NO: 122669 - DNA, 23 bp, Homo sapiens
tgagttcattgtagattctggat

SEQ ID NO: 122670 - DNA, 18 bp, Homo sapiens
ttactctctctctcctgt

SEQ ID NO: 122671 - DNA, 23 bp, Homo sapiens
tgtgtgtgtgttcatgtgtatag

SEQ ID NO: 122672 - DNA, 23 bp, Homo sapiens
cggagtctcgctctgtctcccag

SEQ ID NO: 122673 - DNA, 18 bp, Homo sapiens
tctctggctcttactgtc

SEQ ID NO: 122674 - DNA, 23 bp, Homo sapiens
gagtgggactctgtctatctttt

SEQ ID NO: 122675 - DNA, 18 bp, Homo sapiens
aagaggaagaaaatggga

SEQ ID NO: 122676 - DNA, 23 bp, Homo sapiens
tatctgttgtacatccaggtatg

SEQ ID NO: 122677 - DNA, 20 bp, Homo sapiens
agtctcgctctgtcgctcag

SEQ ID NO: 122678 - DNA, 23 bp, Homo sapiens
tgtatgtatttgaatagtggtgc

SEQ ID NO: 122679 - DNA, 23 bp, Homo sapiens
ttgcactgtagtcagatatgtct

SEQ ID NO: 122680 - DNA, 23 bp, Homo sapiens
actcactgggtcagtctaatcag

SEQ ID NO: 122681 - DNA, 23 bp, Homo sapiens
actagtgtgataccttgtgaaag

SEQ ID NO: 122682 - DNA, 23 bp, Homo sapiens
tagattgatttcatgtctttgct

SEQ ID NO: 122683 - DNA, 22 bp, Homo sapiens
tatatttgtctgtagtaaacat

SEQ ID NO: 122684 - DNA, 18 bp, Homo sapiens
aacttctctttttgatat

SEQ ID NO: 122685 - DNA, 20 bp, Homo sapiens
atttctgagcaaatattgcc

SEQ ID NO: 122686 - DNA, 22 bp, Homo sapiens
tatatctatatctatatctatc

SEQ ID NO: 122687 - DNA, 21 bp, Homo sapiens
atttgtgtattttaatttgag

SEQ ID NO: 122688 - DNA, 23 bp, Homo sapiens
aacacaagtgatttagtagaaca

SEQ ID NO: 122689 - DNA, 23 bp, Homo sapiens
tctcagagtctctgtgttaggtg

SEQ ID NO: 122690 - DNA, 23 bp, Homo sapiens
gtcaagtgactctctcactctgc

SEQ ID NO: 122691 - DNA, 23 bp, Homo sapiens
aatgtgcaccatatggatcccat

SEQ ID NO: 122692 - DNA, 23 bp, Homo sapiens
acatatccatttcattgcatata

SEQ ID NO: 122693 - DNA, 21 bp, Homo sapiens
tgtgtatatatatccaatgga

SEQ ID NO: 122694 - DNA, 23 bp, Homo sapiens
agattaattcatgttgtagtgta

SEQ ID NO: 122695 - DNA, 18 bp, Homo sapiens
aagtgtaacatatttgct

SEQ ID NO: 122696 - DNA, 22 bp, Homo sapiens
atacatatatatgtattgtgta

SEQ ID NO: 122697 - DNA, 23 bp, Homo sapiens
gatcagtgatattgagcatcttt

SEQ ID NO: 122698 - DNA, 21 bp, Homo sapiens
cagccagacacagtgactcat

SEQ ID NO: 122699 - DNA, 21 bp, Homo sapiens
tctccccctgttttacacaat

SEQ ID NO: 122700 - DNA, 22 bp, Homo sapiens
atacatatatatgtattgtgta

SEQ ID NO: 122701 - DNA, 21 bp, Homo sapiens
cagccagacacagtgactcat

SEQ ID NO: 122702 - DNA, 21 bp, Homo sapiens
tctccccctgttttacacaat

SEQ ID NO: 122703 - DNA, 21 bp, Homo sapiens
atttccttcagttttggaaaa

SEQ ID NO: 122704 - DNA, 23 bp, Homo sapiens
aattttatacatgcttagatagt

SEQ ID NO: 122705 - DNA, 23 bp, Homo sapiens
aatgtgataattaaaatgtgtga

SEQ ID NO: 122706 - DNA, 23 bp, Homo sapiens
tttactctctttctgtgtcccat

SEQ ID NO: 122707 - DNA, 18 bp, Homo sapiens
tcttggaggtttcgttct

SEQ ID NO: 122708 - DNA, 23 bp, Homo sapiens
agaactggtcttcgagctctgag

SEQ ID NO: 122709 - DNA, 20 bp, Homo sapiens
cattctgaggaggcatttgt

SEQ ID NO: 122710 - DNA, 23 bp, Homo sapiens
tgagttcattgtagattctggat

SEQ ID NO: 122711 - DNA, 23 bp, Homo sapiens
tgagttcattgtagattctggat

SEQ ID NO: 122712 - DNA, 23 bp, Homo sapiens
tgagaaggagtctcgctctgtcg

SEQ ID NO: 122713 - DNA, 22 bp, Homo sapiens
atgacatatagatgtgtgtatg

SEQ ID NO: 122714 - DNA, 21 bp, Homo sapiens
aaaaagcaactatgtttattt

SEQ ID NO: 122715 - DNA, 23 bp, Homo sapiens
gagtctcactctgtcacccaggc

SEQ ID NO: 122716 - DNA, 23 bp, Homo sapiens
aattgcagaattagaaaccacta

SEQ ID NO: 122717 - DNA, 21 bp, Homo sapiens
gttttccatctgttgttcata

SEQ ID NO: 122718 - DNA, 23 bp, Homo sapiens
atcttctcccttactctctgttt

SEQ ID NO: 122719 - DNA, 23 bp, Homo sapiens
tgagttcattgtagattctggat

SEQ ID NO: 122720 - DNA, 23 bp, Homo sapiens
tgagttcattgtagattctggat

SEQ ID NO: 122721 - DNA, 23 bp, Homo sapiens
gtgtgtgtgtctgtgtagtgtgt

SEQ ID NO: 122722 - DNA, 22 bp, Homo sapiens
acacactacacagacacacaca

SEQ ID NO: 122723 - DNA, 23 bp, Homo sapiens
tgagttcattgtagattctggat

SEQ ID NO: 122724 - DNA, 23 bp, Homo sapiens
tgagttcattgtagattctggat

SEQ ID NO: 122725 - DNA, 23 bp, Homo sapiens
tctgtttatactttgtgtagatg

SEQ ID NO: 122726 - DNA, 22 bp, Homo sapiens
taagttgtggatctgctggaaa

SEQ ID NO: 122727 - DNA, 23 bp, Homo sapiens
atatatgtgcatgtgtttgtgta

SEQ ID NO: 122728 - DNA, 21 bp, Homo sapiens
aattatggtagcatatgttct

SEQ ID NO: 122729 - DNA, 23 bp, Homo sapiens
tatgggtatgtatatgtatgtgt

SEQ ID NO: 122730 - DNA, 19 bp, Homo sapiens
gcatatgtatttcatgatg

SEQ ID NO: 122731 - DNA, 23 bp, Homo sapiens
tttatatttgagggcaaacagct

SEQ ID NO: 122732 - DNA, 21 bp, Homo sapiens
aaaactcattggtatttttat

SEQ ID NO: 122733 - DNA, 21 bp, Homo sapiens
tcagtgcgtgtaatcagggaa

SEQ ID NO: 122734 - DNA, 23 bp, Homo sapiens
tatatatatcttgcatatgtgta

SEQ ID NO: 122735 - DNA, 19 bp, Homo sapiens
agagatgactgagagaggc

SEQ ID NO: 122736 - DNA, 22 bp, Homo sapiens
ttcctcagttttctcttgtttc

SEQ ID NO: 122737 - DNA, 19 bp, Homo sapiens
tatgtatataagttatgcg

SEQ ID NO: 122738 - DNA, 18 bp, Homo sapiens
tgccagtgtaattctttt

SEQ ID NO: 122739 - DNA, 18 bp, Homo sapiens
agtttcactctgttgcca

SEQ ID NO: 122740 - DNA, 23 bp, Homo sapiens
tgtcttctgtgtctatctcactg

SEQ ID NO: 122741 - DNA, 22 bp, Homo sapiens
agcagagtgcaataacttgcct

SEQ ID NO: 122742 - DNA, 23 bp, Homo sapiens
tgagtgtgtggaaaggttgttgg

SEQ ID NO: 122743 - DNA, 23 bp, Homo sapiens
tgttctaagtggtttacgtatgt

SEQ ID NO: 122744 - DNA, 23 bp, Homo sapiens
aaaatgtatgtgaggtcttggag

SEQ ID NO: 122745 - DNA, 19 bp, Homo sapiens
taaagtacacgtggaagag

SEQ ID NO: 122746 - DNA, 21 bp, Homo sapiens
tgtgaatatacatacgtgtgt

SEQ ID NO: 122747 - DNA, 23 bp, Homo sapiens
tggagtctcactctgtcacccag

SEQ ID NO: 122748 - DNA, 23 bp, Homo sapiens
tgcaaatgtgcttgtattctttt

SEQ ID NO: 122749 - DNA, 23 bp, Homo sapiens
ttgagcaccaattgtatatctga

SEQ ID NO: 122750 - DNA, 23 bp, Homo sapiens
gtttatgtatattgctcatatac

SEQ ID NO: 122751 - DNA, 20 bp, Homo sapiens
tattggatgcaaagtactga

SEQ ID NO: 122752 - DNA, 23 bp, Homo sapiens
tctaattctctttgcttttgaag

SEQ ID NO: 122753 - DNA, 23 bp, Homo sapiens
tatgtgtgtgtatatgtatatat

SEQ ID NO: 122754 - DNA, 18 bp, Homo sapiens
atacatgcacacatatgt

SEQ ID NO: 122755 - DNA, 22 bp, Homo sapiens
atgtgtatatatatatgtgtgt

SEQ ID NO: 122756 - DNA, 23 bp, Homo sapiens
atatgtgtgtatatgtatatgta

SEQ ID NO: 122757 - DNA, 21 bp, Homo sapiens
atccagtccactgttgatagg

SEQ ID NO: 122758 - DNA, 23 bp, Homo sapiens
ataacaccttctgttttcaaaaa

SEQ ID NO: 122759 - DNA, 20 bp, Homo sapiens
tatgcatatgaatatatatg

SEQ ID NO: 122760 - DNA, 23 bp, Homo sapiens
agaccctccctctctgcctgcct

SEQ ID NO: 122761 - DNA, 18 bp, Homo sapiens
tgggtcttagactatttt

SEQ ID NO: 122762 - DNA, 23 bp, Homo sapiens
aggtattatgtggtttttatatg

SEQ ID NO: 122763 - DNA, 22 bp, Homo sapiens
tgtgtgtatatatatatgtgtg

SEQ ID NO: 122764 - DNA, 22 bp, Homo sapiens
tgaggtactatgttgagggcct

SEQ ID NO: 122765 - DNA, 22 bp, Homo sapiens
actaggaccttttgcatacaag

SEQ ID NO: 122766 - DNA, 23 bp, Homo sapiens
ggcagtgatgagtcttgcagtac

SEQ ID NO: 122767 - DNA, 23 bp, Homo sapiens
attctttgtgaatgcagtttgaa

SEQ ID NO: 122768 - DNA, 23 bp, Homo sapiens
tttatggtcaagaacgtgctgaa

SEQ ID NO: 122769 - DNA, 23 bp, Homo sapiens
acagtagtgctaccataaacttt

SEQ ID NO: 122770 - DNA, 19 bp, Homo sapiens
aatggtagtttcttctttt

SEQ ID NO: 122771 - DNA, 20 bp, Homo sapiens
ttgtgtctacatgtatatct

SEQ ID NO: 122772 - DNA, 23 bp, Homo sapiens
atactgtgagacgttgtgttgcg

SEQ ID NO: 122773 - DNA, 19 bp, Homo sapiens
tgtatatatgtatacatat

SEQ ID NO: 122774 - DNA, 21 bp, Homo sapiens
aggatatatatactatgtata

SEQ ID NO: 122775 - DNA, 23 bp, Homo sapiens
acacaggattttgatgacttagt

SEQ ID NO: 122776 - DNA, 21 bp, Homo sapiens
cacattattgagatgccatta

SEQ ID NO: 122777 - DNA, 23 bp, Homo sapiens
atatatgattctgatatggtctg

SEQ ID NO: 122778 - DNA, 23 bp, Homo sapiens
aagaggtatatgtatatgtgtat

SEQ ID NO: 122779 - DNA, 23 bp, Homo sapiens
aaattcttttcagtctcccttcc

SEQ ID NO: 122780 - DNA, 20 bp, Homo sapiens
gaagagagtaatcatagcat

SEQ ID NO: 122781 - DNA, 23 bp, Homo sapiens
aatacctgtgtgtgaatacagtg

SEQ ID NO: 122782 - DNA, 21 bp, Homo sapiens
tcacctgctctttaacgctgt

SEQ ID NO: 122783 - DNA, 23 bp, Homo sapiens
aatcagtctggtcccggacttca

SEQ ID NO: 122784 - DNA, 23 bp, Homo sapiens
tcagaggaaagatctgtggctca

SEQ ID NO: 122785 - DNA, 22 bp, Homo sapiens
agacgtaaaagtgacacgtgaa

SEQ ID NO: 122786 - DNA, 21 bp, Homo sapiens
tttctctttgttttttaaggt

SEQ ID NO: 122787 - DNA, 23 bp, Homo sapiens
tggagtctcactctgtcacccag

SEQ ID NO: 122788 - DNA, 23 bp, Homo sapiens
tgagacagggtctctgtcaccca

SEQ ID NO: 122789 - DNA, 23 bp, Homo sapiens
cttcagagagctcacttactctc

SEQ ID NO: 122790 - DNA, 23 bp, Homo sapiens
ttttactgagtagagggatgagg

SEQ ID NO: 122791 - DNA, 23 bp, Homo sapiens
tcatttcagactacagttggctg

SEQ ID NO: 122792 - DNA, 23 bp, Homo sapiens
tattgtatgagaattagagatgg

SEQ ID NO: 122793 - DNA, 21 bp, Homo sapiens
ctctcagtgggggttgatatt

SEQ ID NO: 122794 - DNA, 23 bp, Homo sapiens
ctatgcgtgtgtgtgtgtgtgtg

SEQ ID NO: 122795 - DNA, 23 bp, Homo sapiens
attgtactagccattttcatctt

SEQ ID NO: 122796 - DNA, 23 bp, Homo sapiens
agaaataggaacacttttacatt

SEQ ID NO: 122797 - DNA, 23 bp, Homo sapiens
tttctgtatatgcttaacttcag

SEQ ID NO: 122798 - DNA, 22 bp, Homo sapiens
atctgcttgtagattgaaatgt

SEQ ID NO: 122799 - DNA, 23 bp, Homo sapiens
tatatgcatataatatgtgtaac

SEQ ID NO: 122800 - DNA, 23 bp, Homo sapiens
cacacaaatttctgagctggcat

SEQ ID NO: 122801 - DNA, 23 bp, Homo sapiens
aaattagcaattcatgctgtact

SEQ ID NO: 122802 - DNA, 19 bp, Homo sapiens
attgtttgagacaaagctt

SEQ ID NO: 122803 - DNA, 23 bp, Homo sapiens
tatgtgtatatatatatatgtac

SEQ ID NO: 122804 - DNA, 23 bp, Homo sapiens
tgagttcattgtagattctggat

SEQ ID NO: 122805 - DNA, 23 bp, Homo sapiens
tgagttcattgtagattctggat

SEQ ID NO: 122806 - DNA, 23 bp, Homo sapiens
aatgagttaagactttggggtac

SEQ ID NO: 122807 - DNA, 22 bp, Homo sapiens
tcagatgttccacactgaattc

SEQ ID NO: 122808 - DNA, 23 bp, Homo sapiens
gttcctcagcaagataaaggatt

SEQ ID NO: 122809 - DNA, 20 bp, Homo sapiens
ggcaacttgctggacagtga

SEQ ID NO: 122810 - DNA, 21 bp, Homo sapiens
agtaattggtgaatttgaggt

SEQ ID NO: 122811 - DNA, 23 bp, Homo sapiens
tgagttcattgtagattctggat

SEQ ID NO: 122812 - DNA, 23 bp, Homo sapiens
tgagttcattgtagattctggat

SEQ ID NO: 122813 - DNA, 23 bp, Homo sapiens
ttgaactgcatatgtctacatat

SEQ ID NO: 122814 - DNA, 23 bp, Homo sapiens
agtaaatgtgtttcttattgagt

SEQ ID NO: 122815 - DNA, 22 bp, Homo sapiens
atttgctagaatatattggtta

SEQ ID NO: 122816 - DNA, 23 bp, Homo sapiens
gaggtcttaagtgattttcatga

SEQ ID NO: 122817 - DNA, 23 bp, Homo sapiens
atttgattgcattgttgtctgag

SEQ ID NO: 122818 - DNA, 23 bp, Homo sapiens
tgagttcattgtagattctggat

SEQ ID NO: 122819 - DNA, 23 bp, Homo sapiens
tgagttcattgtagattctggat

SEQ ID NO: 122820 - DNA, 23 bp, Homo sapiens
tgagttcattgtagattctggat

SEQ ID NO: 122821 - DNA, 23 bp, Homo sapiens
tgagttcattgtagattctggat

SEQ ID NO: 122822 - DNA, 19 bp, Homo sapiens
aaacttcatgatctaggaa

SEQ ID NO: 122823 - DNA, 21 bp, Homo sapiens
tatatataagtatacatatca

SEQ ID NO: 122824 - DNA, 23 bp, Homo sapiens
gagaagagagagttggcagagtg

SEQ ID NO: 122825 - DNA, 22 bp, Homo sapiens
tgagtcatatgggttccacttt

SEQ ID NO: 122826 - DNA, 21 bp, Homo sapiens
tatgagatggagtcttgctct

SEQ ID NO: 122827 - DNA, 23 bp, Homo sapiens
tacatgtgcaggatgtgcaggtt

SEQ ID NO: 122828 - DNA, 23 bp, Homo sapiens
tctcattgctctctctgtctctg

SEQ ID NO: 122829 - DNA, 23 bp, Homo sapiens
ttatatgaaatgataatgagtgt

SEQ ID NO: 122830 - DNA, 23 bp, Homo sapiens
tgagttcattgtagattctggat

SEQ ID NO: 122831 - DNA, 23 bp, Homo sapiens
tgagttcattgtagattctggat

SEQ ID NO: 122832 - DNA, 22 bp, Homo sapiens
actggaagaggcaaagatgggt

SEQ ID NO: 122833 - DNA, 23 bp, Homo sapiens
gtctgtctgcatcttgttattgg

SEQ ID NO: 122834 - DNA, 23 bp, Homo sapiens
tgagatgaagtctcactctgtca

SEQ ID NO: 122835 - DNA, 23 bp, Homo sapiens
agactggagactgtctgaacttt

SEQ ID NO: 122836 - DNA, 23 bp, Homo sapiens
tgtgcgtggtgtgtgtatgtata

SEQ ID NO: 122837 - DNA, 23 bp, Homo sapiens
tacataatcagggtaagtattgt

SEQ ID NO: 122838 - DNA, 23 bp, Homo sapiens
agacatcagtgtggatttattct

SEQ ID NO: 122839 - DNA, 23 bp, Homo sapiens
ttttgagacgagtctcgctctgt

SEQ ID NO: 122840 - DNA, 21 bp, Homo sapiens
tgtgtgtgtgtatatatatag

SEQ ID NO: 122841 - DNA, 21 bp, Homo sapiens
ttctgggttctctatctgttc

SEQ ID NO: 122842 - DNA, 18 bp, Homo sapiens
gtgggtgggtcacttgag

SEQ ID NO: 122843 - DNA, 23 bp, Homo sapiens
tgagacagcgtctcactctgtca

SEQ ID NO: 122844 - DNA, 20 bp, Homo sapiens
tgagaactgaggctactcat

SEQ ID NO: 122845 - DNA, 21 bp, Homo sapiens
tgaaaaagttctgaaaatgga

SEQ ID NO: 122846 - DNA, 22 bp, Homo sapiens
ctctgtcacccagactggagtg

SEQ ID NO: 122847 - DNA, 23 bp, Homo sapiens
aaagctaaaagtgctgctaggtc

SEQ ID NO: 122848 - DNA, 23 bp, Homo sapiens
ttgagacagggtctcactttgtt

SEQ ID NO: 122849 - DNA, 20 bp, Homo sapiens
tactgaatcagaatctgcat

SEQ ID NO: 122850 - DNA, 23 bp, Homo sapiens
tgagttcattgtagattctggat

SEQ ID NO: 122851 - DNA, 23 bp, Homo sapiens
tgagttcattgtagattctggat

SEQ ID NO: 122852 - DNA, 21 bp, Homo sapiens
agtgaaagacttggcatagga

SEQ ID NO: 122853 - DNA, 19 bp, Homo sapiens
tttgtatatcttcttttga

SEQ ID NO: 122854 - DNA, 20 bp, Homo sapiens
agagtgcagttgcacgatct

SEQ ID NO: 122855 - DNA, 22 bp, Homo sapiens
tgtgtatatatgtatgtgtgta

SEQ ID NO: 122856 - DNA, 19 bp, Homo sapiens
atatgtatgtatgtatata

SEQ ID NO: 122857 - DNA, 23 bp, Homo sapiens
tgagttcattgtagattctggat

SEQ ID NO: 122858 - DNA, 23 bp, Homo sapiens
tgagttcattgtagattctggat

SEQ ID NO: 122859 - DNA, 21 bp, Homo sapiens
gtcaccttcccattttcttct

SEQ ID NO: 122860 - DNA, 23 bp, Homo sapiens
ttagaaccatttttagatgtaca

SEQ ID NO: 122861 - DNA, 23 bp, Homo sapiens
tatgtgacacttacttaagactt

SEQ ID NO: 122862 - DNA, 22 bp, Homo sapiens
tatgaagtggttgtcatatgta

SEQ ID NO: 122863 - DNA, 23 bp, Homo sapiens
aaaatctcactctgtcactcagg

SEQ ID NO: 122864 - DNA, 23 bp, Homo sapiens
tttttgagacagtctagctctgt

SEQ ID NO: 122865 - DNA, 23 bp, Homo sapiens
tctgtctgtgtgtaatctctggc

SEQ ID NO: 122866 - DNA, 19 bp, Homo sapiens
tttactcttttgcttgtat

SEQ ID NO: 122867 - DNA, 23 bp, Homo sapiens
tgagttcattgtagattctggat

SEQ ID NO: 122868 - DNA, 23 bp, Homo sapiens
tgagttcattgtagattctggat

SEQ ID NO: 122869 - DNA, 23 bp, Homo sapiens
tcagtaagagagacatgtctgga

SEQ ID NO: 122870 - DNA, 21 bp, Homo sapiens
ttttggtagggattgcattga

SEQ ID NO: 122871 - DNA, 23 bp, Homo sapiens
tgagttcattgtagattctggat

SEQ ID NO: 122872 - DNA, 23 bp, Homo sapiens
tgagttcattgtagattctggat

SEQ ID NO: 122873 - DNA, 23 bp, Homo sapiens
tgcatcactgtgtcacactcact

SEQ ID NO: 122874 - DNA, 23 bp, Homo sapiens
agcgtgtcgttgtcttctttccc

SEQ ID NO: 122875 - DNA, 23 bp, Homo sapiens
cagggtctcactctgtcactgag

SEQ ID NO: 122876 - DNA, 23 bp, Homo sapiens
tttttgtaaagacacgtactgtt

SEQ ID NO: 122877 - DNA, 23 bp, Homo sapiens
tgagaatacaagcagaagcaaag

SEQ ID NO: 122878 - DNA, 22 bp, Homo sapiens
tgctgtgtctgtttcacctcag

SEQ ID NO: 122879 - DNA, 22 bp, Homo sapiens
tgtgtgtgtatatatatgtgtg

SEQ ID NO: 122880 - DNA, 18 bp, Homo sapiens
aagtgctaggattacagg

SEQ ID NO: 122881 - DNA, 23 bp, Homo sapiens
tatctcattgtggttttgatttg

SEQ ID NO: 122882 - DNA, 18 bp, Homo sapiens
tcactatatatgtgtgtg

SEQ ID NO: 122883 - DNA, 19 bp, Homo sapiens
tttgagacagagttttgct

SEQ ID NO: 122884 - DNA, 19 bp, Homo sapiens
tacagaagactggagaatt

SEQ ID NO: 122885 - DNA, 23 bp, Homo sapiens
aggtctcactctgtcacccaggc

SEQ ID NO: 122886 - DNA, 23 bp, Homo sapiens
aagtctgagttcaaggtgtcagc

SEQ ID NO: 122887 - DNA, 21 bp, Homo sapiens
tgatggttctcaatggagtgt

SEQ ID NO: 122888 - DNA, 23 bp, Homo sapiens
attcccagtggtagaagtgtgtg

SEQ ID NO: 122889 - DNA, 18 bp, Homo sapiens
tagagatagaaaagggga

SEQ ID NO: 122890 - DNA, 18 bp, Homo sapiens
aaagttgagttggggctg

SEQ ID NO: 122891 - DNA, 23 bp, Homo sapiens
tgagttcattgtagattctggat

SEQ ID NO: 122892 - DNA, 23 bp, Homo sapiens
tgagttcattgtagattctggat

SEQ ID NO: 122893 - DNA, 21 bp, Homo sapiens
accttaaagcagaggatccag

SEQ ID NO: 122894 - DNA, 23 bp, Homo sapiens
tgagttcattgtagattctggat

SEQ ID NO: 122895 - DNA, 23 bp, Homo sapiens
tgagttcattgtagattctggat

SEQ ID NO: 122896 - DNA, 23 bp, Homo sapiens
tctctctctgcctcccaggctgg

SEQ ID NO: 122897 - DNA, 23 bp, Homo sapiens
gtcagagtctcgctctgtcaccc

SEQ ID NO: 122898 - DNA, 23 bp, Homo sapiens
ctctctctatctctgtctcaaaa

SEQ ID NO: 122899 - DNA, 23 bp, Homo sapiens
tgtgaggtagatttctgattttg

SEQ ID NO: 122900 - DNA, 22 bp, Homo sapiens
taagtgttttgttgatcatgta

SEQ ID NO: 122901 - DNA, 23 bp, Homo sapiens
tgtgtctctgtgtgaaatggggc

SEQ ID NO: 122902 - DNA, 22 bp, Homo sapiens
ctgcgactctgtctctgtccct

SEQ ID NO: 122903 - DNA, 23 bp, Homo sapiens
tgagttcattgtagattctggat

SEQ ID NO: 122904 - DNA, 23 bp, Homo sapiens
tgagttcattgtagattctggat

SEQ ID NO: 122905 - DNA, 21 bp, Homo sapiens
tttgttctttttgcttaggat

SEQ ID NO: 122906 - DNA, 23 bp, Homo sapiens
ttctgtgaagaaagtcaatagta

SEQ ID NO: 122907 - DNA, 21 bp, Homo sapiens
tatatgtgtgtatgtatatac

SEQ ID NO: 122908 - DNA, 20 bp, Homo sapiens
tatgtgtatatatatatatg

SEQ ID NO: 122909 - DNA, 20 bp, Homo sapiens
aaaatcagttttgctaggcc

SEQ ID NO: 122910 - DNA, 19 bp, Homo sapiens
tctctctgtatttctgttg

SEQ ID NO: 122911 - DNA, 23 bp, Homo sapiens
tgagttcattgtagattctggat

SEQ ID NO: 122912 - DNA, 23 bp, Homo sapiens
tgagttcattgtagattctggat

SEQ ID NO: 122913 - DNA, 22 bp, Homo sapiens
gcagagggaaaagtatctggaa

SEQ ID NO: 122914 - DNA, 23 bp, Homo sapiens
tctgaagaaagtcaatggtagct

SEQ ID NO: 122915 - DNA, 22 bp, Homo sapiens
catgagtgagtgatttttttct

SEQ ID NO: 122916 - DNA, 23 bp, Homo sapiens
tctgcctctctgtctcactcctt

SEQ ID NO: 122917 - DNA, 23 bp, Homo sapiens
tctcactctgtcactctggctgc

SEQ ID NO: 122918 - DNA, 23 bp, Homo sapiens
aatctctgtctgtctgtctgtct

SEQ ID NO: 122919 - DNA, 23 bp, Homo sapiens
aatctctgtctgtctgtctgtct

SEQ ID NO: 122920 - DNA, 23 bp, Homo sapiens
aatctctgtctgtctgtctgtct

SEQ ID NO: 122921 - DNA, 23 bp, Homo sapiens
tctctgtctgtctgtctgtctgt

SEQ ID NO: 122922 - DNA, 23 bp, Homo sapiens
ctgtctgtctgtctgtctgtctg

SEQ ID NO: 122923 - DNA, 23 bp, Homo sapiens
tcaagaacaagctggaagacaca

SEQ ID NO: 122924 - DNA, 23 bp, Homo sapiens
tcagtatatatatatatcagtgt

SEQ ID NO: 122925 - DNA, 23 bp, Homo sapiens
atatatcagtatatatatacatc

SEQ ID NO: 122926 - DNA, 23 bp, Homo sapiens
gtcaggcatttgaagcacttaca

SEQ ID NO: 122927 - DNA, 23 bp, Homo sapiens
tgttctttttgcttaggattgtc

SEQ ID NO: 122928 - DNA, 23 bp, Homo sapiens
gagatggagtctcactctgtcac

SEQ ID NO: 122929 - DNA, 23 bp, Homo sapiens
ggagtacagtggtttgatctctg

SEQ ID NO: 122930 - DNA, 23 bp, Homo sapiens
tgagttcattgtagattctggat

SEQ ID NO: 122931 - DNA, 23 bp, Homo sapiens
tgagttcattgtagattctggat

SEQ ID NO: 122932 - DNA, 19 bp, Homo sapiens
tcacacaggctagagtgca

SEQ ID NO: 122933 - DNA, 23 bp, Homo sapiens
tatacttattgtgattatgtaat

SEQ ID NO: 122934 - DNA, 21 bp, Homo sapiens
tgcgattcaaaagcaagagtt

SEQ ID NO: 122935 - DNA, 23 bp, Homo sapiens
tacgcagagtgacaaatctgatg

SEQ ID NO: 122936 - DNA, 19 bp, Homo sapiens
tcaggttgtattttcttct

SEQ ID NO: 122937 - DNA, 21 bp, Homo sapiens
aatgcttcaaatcagggcttt

SEQ ID NO: 122938 - DNA, 23 bp, Homo sapiens
agagagctagctggttgttaagt

SEQ ID NO: 122939 - DNA, 23 bp, Homo sapiens
atatgtatatatgtatatgtata

SEQ ID NO: 122940 - DNA, 23 bp, Homo sapiens
gttgtaaggtagttgtatgttta

SEQ ID NO: 122941 - DNA, 23 bp, Homo sapiens
aaattgtccaactgttttcctga

SEQ ID NO: 122942 - DNA, 23 bp, Homo sapiens
tgtgtgtatatatatgtgtgtgt

SEQ ID NO: 122943 - DNA, 21 bp, Homo sapiens
atatatacatatacacacaca

SEQ ID NO: 122944 - DNA, 23 bp, Homo sapiens
acaatagacatattctagatctt

SEQ ID NO: 122945 - DNA, 23 bp, Homo sapiens
ttgatctggctgtgatagttgtg

SEQ ID NO: 122946 - DNA, 21 bp, Homo sapiens
aactgcatatatatacgtata

SEQ ID NO: 122947 - DNA, 23 bp, Homo sapiens
gacagagtctcgctctgtcaccc

SEQ ID NO: 122948 - DNA, 23 bp, Homo sapiens
ggtcactctctgtcacccaggct

SEQ ID NO: 122949 - DNA, 19 bp, Homo sapiens
actgcataacttgtctaac

SEQ ID NO: 122950 - DNA, 23 bp, Homo sapiens
tgagatggagtctcactctgttg

SEQ ID NO: 122951 - DNA, 20 bp, Homo sapiens
tatacatatgtatgacacct

SEQ ID NO: 122952 - DNA, 23 bp, Homo sapiens
tgagatggagtctctctctgttg

SEQ ID NO: 122953 - DNA, 23 bp, Homo sapiens
ctctgtgcctcagtttcttcagt

SEQ ID NO: 122954 - DNA, 23 bp, Homo sapiens
tggagtctcactctgtcacccag

SEQ ID NO: 122955 - DNA, 23 bp, Homo sapiens
taacttgtagtgggtcacatagc

SEQ ID NO: 122956 - DNA, 23 bp, Homo sapiens
attttttgttgttgttttcaaaa

SEQ ID NO: 122957 - DNA, 18 bp, Homo sapiens
agataagaacttgaggtt

SEQ ID NO: 122958 - DNA, 19 bp, Homo sapiens
ttgtatgtatttaagatct

SEQ ID NO: 122959 - DNA, 23 bp, Homo sapiens
agacgtagtctctctctgtcacc

SEQ ID NO: 122960 - DNA, 21 bp, Homo sapiens
tatatgtgtatatctatatca

SEQ ID NO: 122961 - DNA, 20 bp, Homo sapiens
tgaacctctgcatgtgaata

SEQ ID NO: 122962 - DNA, 23 bp, Homo sapiens
tatgtatttgcactggaagtgtt

SEQ ID NO: 122963 - DNA, 23 bp, Homo sapiens
atatgtgtatatatatatgtgtg

SEQ ID NO: 122964 - DNA, 23 bp, Homo sapiens
tacacacacgcatatatatgtgt

SEQ ID NO: 122965 - DNA, 21 bp, Homo sapiens
tgagagtagactgtctgggca

SEQ ID NO: 122966 - DNA, 23 bp, Homo sapiens
atttggagtggttgtagtttaag

SEQ ID NO: 122967 - DNA, 23 bp, Homo sapiens
gctttcagagtgatatttttggc

SEQ ID NO: 122968 - DNA, 23 bp, Homo sapiens
tgagttcattgtagattctggat

SEQ ID NO: 122969 - DNA, 23 bp, Homo sapiens
tgagttcattgtagattctggat

SEQ ID NO: 122970 - DNA, 18 bp, Homo sapiens
aaactgacaaaagcgaaa

SEQ ID NO: 122971 - DNA, 18 bp, Homo sapiens
tcaagtggacaaacttgt

SEQ ID NO: 122972 - DNA, 22 bp, Homo sapiens
acatgtgcacaatgtgcaggtt

SEQ ID NO: 122973 - DNA, 20 bp, Homo sapiens
tctgtgtgtgtattctatat

SEQ ID NO: 122974 - DNA, 23 bp, Homo sapiens
atatacaatacatatatatgtgt

SEQ ID NO: 122975 - DNA, 18 bp, Homo sapiens
tgtctgcattttctgtgt

SEQ ID NO: 122976 - DNA, 23 bp, Homo sapiens
taatttgaaccagctttgagtgt

SEQ ID NO: 122977 - DNA, 23 bp, Homo sapiens
tccatcagtaattaaaaatgtgt

SEQ ID NO: 122978 - DNA, 23 bp, Homo sapiens
atatgtgtatatgtatatatgta

SEQ ID NO: 122979 - DNA, 23 bp, Homo sapiens
tgagttcattgtagattctggat

SEQ ID NO: 122980 - DNA, 23 bp, Homo sapiens
tgagttcattgtagattctggat

SEQ ID NO: 122981 - DNA, 23 bp, Homo sapiens
agtcactccatctctctgagatt

SEQ ID NO: 122982 - DNA, 18 bp, Homo sapiens
tttgtggtcattttccat

SEQ ID NO: 122983 - DNA, 22 bp, Homo sapiens
atatatgtacacacacacacac

SEQ ID NO: 122984 - DNA, 21 bp, Homo sapiens
atgattgtgtgtgtgtatata

SEQ ID NO: 122985 - DNA, 23 bp, Homo sapiens
atatatgtatgtgtgcatatgta

SEQ ID NO: 122986 - DNA, 22 bp, Homo sapiens
tgagaacatggaaactggaaga

SEQ ID NO: 122987 - DNA, 23 bp, Homo sapiens
tgagacaggttcttgctctgtca

SEQ ID NO: 122988 - DNA, 21 bp, Homo sapiens
atgactgaatatttatttatg

SEQ ID NO: 122989 - DNA, 19 bp, Homo sapiens
cacatcttatttattcatt

SEQ ID NO: 122990 - DNA, 23 bp, Homo sapiens
atttcactgtggttgtgatttgc

SEQ ID NO: 122991 - DNA, 20 bp, Homo sapiens
agggtgactaagaaatgtct

SEQ ID NO: 122992 - DNA, 23 bp, Homo sapiens
tatatagagagacatatagatct

SEQ ID NO: 122993 - DNA, 23 bp, Homo sapiens
atagagagagacatatagatctt

SEQ ID NO: 122994 - DNA, 23 bp, Homo sapiens
tgagttcattgtagattctggat

SEQ ID NO: 122995 - DNA, 23 bp, Homo sapiens
tgagttcattgtagattctggat

SEQ ID NO: 122996 - DNA, 23 bp, Homo sapiens
tgcatgtgtatatatatgtgtgt

SEQ ID NO: 122997 - DNA, 21 bp, Homo sapiens
atactagattgcaatatcaaa

SEQ ID NO: 122998 - DNA, 20 bp, Homo sapiens
atgactagtgatattcaact

SEQ ID NO: 122999 - DNA, 21 bp, Homo sapiens
tgtcttctttagagaaatgtc

SEQ ID NO: 123000 - DNA, 19 bp, Homo sapiens
tttgagatggaggcttgct

SEQ ID NO: 123001 - DNA, 23 bp, Homo sapiens
atgacaggagcagatttgggtat

SEQ ID NO: 123002 - DNA, 22 bp, Homo sapiens
agcagctcagtcactgtgctgg

SEQ ID NO: 123003 - DNA, 23 bp, Homo sapiens
tgagttcattgtagattctggat

SEQ ID NO: 123004 - DNA, 21 bp, Homo sapiens
gagtggatatttatacacatg

SEQ ID NO: 123005 - DNA, 23 bp, Homo sapiens
gtggcagtatgttaagaagtttg

SEQ ID NO: 123006 - DNA, 22 bp, Homo sapiens
ttttctgaatttgtttatcagt

SEQ ID NO: 123007 - DNA, 23 bp, Homo sapiens
tgagttcattgtagattctggat

SEQ ID NO: 123008 - DNA, 23 bp, Homo sapiens
tgagttcattgtagattctggat

SEQ ID NO: 123009 - DNA, 23 bp, Homo sapiens
tataaatgtaagatatgtgtgtg

SEQ ID NO: 123010 - DNA, 20 bp, Homo sapiens
tttcccagaagtaaacatga

SEQ ID NO: 123011 - DNA, 23 bp, Homo sapiens
tatatggatatgtgtgtgtgtgt

SEQ ID NO: 123012 - DNA, 23 bp, Homo sapiens
tcattcacttttgtcagccagac

SEQ ID NO: 123013 - DNA, 22 bp, Homo sapiens
aactaagtattactattgggat

SEQ ID NO: 123014 - DNA, 21 bp, Homo sapiens
agcatctgacactattttctt

SEQ ID NO: 123015 - DNA, 22 bp, Homo sapiens
atatgtgcagaatgtgcaggtt

SEQ ID NO: 123016 - DNA, 21 bp, Homo sapiens
tgtgaagaaagtcattggtag

SEQ ID NO: 123017 - DNA, 22 bp, Homo sapiens
tcactgcctctcaggcagcctg

SEQ ID NO: 123018 - DNA, 23 bp, Homo sapiens
ttaggaaatcattatgagagaga

SEQ ID NO: 123019 - DNA, 22 bp, Homo sapiens
aacacttgtgatttcctagaac

SEQ ID NO: 123020 - DNA, 23 bp, Homo sapiens
tctgtgtgtgtgtgagtccatat

SEQ ID NO: 123021 - DNA, 23 bp, Homo sapiens
tctatccttttgaagctcataaa

SEQ ID NO: 123022 - DNA, 23 bp, Homo sapiens
gtgtatatatgtatgtgtatgtg

SEQ ID NO: 123023 - DNA, 23 bp, Homo sapiens
tatgtgtatatatatgtatgtgt

SEQ ID NO: 123024 - DNA, 23 bp, Homo sapiens
taaattcttcatgtagctttgtc

SEQ ID NO: 123025 - DNA, 23 bp, Homo sapiens
ataagacattctaattgagacac

SEQ ID NO: 123026 - DNA, 23 bp, Homo sapiens
acatagtgagtctctgtttctgt

SEQ ID NO: 123027 - DNA, 23 bp, Homo sapiens
tagcacagatgaaagctgaagct

SEQ ID NO: 123028 - DNA, 21 bp, Homo sapiens
tcttttgtaacagtgcttgac

SEQ ID NO: 123029 - DNA, 23 bp, Homo sapiens
tatatgcatgtatatgtatacat

SEQ ID NO: 123030 - DNA, 18 bp, Homo sapiens
gtatgtatgtatgtatgt

SEQ ID NO: 123031 - DNA, 23 bp, Homo sapiens
tgagatggagtctcactctgtca

SEQ ID NO: 123032 - DNA, 23 bp, Homo sapiens
tcatacagcagctgcatgtgggt

SEQ ID NO: 123033 - DNA, 22 bp, Homo sapiens
cactggaagtatacaggagaag

SEQ ID NO: 123034 - DNA, 21 bp, Homo sapiens
agtctcgctgtcacccaggct

SEQ ID NO: 123035 - DNA, 19 bp, Homo sapiens
tagagtctagctctgtcac

SEQ ID NO: 123036 - DNA, 23 bp, Homo sapiens
aaacagcctgtgcttcttaagag

SEQ ID NO: 123037 - DNA, 23 bp, Homo sapiens
tttgagacggagtctcactctgt

SEQ ID NO: 123038 - DNA, 22 bp, Homo sapiens
aagattcttcctcagtcagaca

SEQ ID NO: 123039 - DNA, 23 bp, Homo sapiens
acagagtctcgctctgtcaccca

SEQ ID NO: 123040 - DNA, 23 bp, Homo sapiens
ttatagctattgagtggctctga

SEQ ID NO: 123041 - DNA, 18 bp, Homo sapiens
tgtgtttgttttttgttt

SEQ ID NO: 123042 - DNA, 23 bp, Homo sapiens
gagacagggtctcactctgccac

SEQ ID NO: 123043 - DNA, 23 bp, Homo sapiens
ttttgtagaggtgagggtctcat

SEQ ID NO: 123044 - DNA, 21 bp, Homo sapiens
tttagagagggtctccttctg

SEQ ID NO: 123045 - DNA, 19 bp, Homo sapiens
tgggtagaaatcattatgt

SEQ ID NO: 123046 - DNA, 18 bp, Homo sapiens
tctcacgaggctagtctc

SEQ ID NO: 123047 - DNA, 23 bp, Homo sapiens
agagagagtctcgctctgtcacc

SEQ ID NO: 123048 - DNA, 23 bp, Homo sapiens
ggagtctcactctgtctcccagg

SEQ ID NO: 123049 - DNA, 23 bp, Homo sapiens
ttatctatacatatatgtgtgtg

SEQ ID NO: 123050 - DNA, 22 bp, Homo sapiens
tacatatgtgtgtgtatatatt

SEQ ID NO: 123051 - DNA, 23 bp, Homo sapiens
tgagttcattgtagattctggat

SEQ ID NO: 123052 - DNA, 23 bp, Homo sapiens
tgagttcattgtagattctggat

SEQ ID NO: 123053 - DNA, 23 bp, Homo sapiens
agagtgagaccctgtctcaaaaa

SEQ ID NO: 123054 - DNA, 23 bp, Homo sapiens
agacaaggtctcgctctgtcacc

SEQ ID NO: 123055 - DNA, 21 bp, Homo sapiens
ggtatgagctaccactgctgg

SEQ ID NO: 123056 - DNA, 23 bp, Homo sapiens
atgcctagcacagagtaagctct

SEQ ID NO: 123057 - DNA, 19 bp, Homo sapiens
ctcaggctggtatcgaact

SEQ ID NO: 123058 - DNA, 19 bp, Homo sapiens
ccacagactacaaagctgt

SEQ ID NO: 123059 - DNA, 22 bp, Homo sapiens
tttctgtctctctgtttctact

SEQ ID NO: 123060 - DNA, 23 bp, Homo sapiens
atttcagtgtggctttaatttgt

SEQ ID NO: 123061 - DNA, 19 bp, Homo sapiens
agaggttgcagtgagctga

SEQ ID NO: 123062 - DNA, 18 bp, Homo sapiens
tatatgtatatatatatg

SEQ ID NO: 123063 - DNA, 20 bp, Homo sapiens
cttagagaagtctgactgct

SEQ ID NO: 123064 - DNA, 23 bp, Homo sapiens
tgagttcattgtagattctggat

SEQ ID NO: 123065 - DNA, 23 bp, Homo sapiens
tgagttcattgtagattctggat

SEQ ID NO: 123066 - DNA, 23 bp, Homo sapiens
attccctcagttgtcgcttgtct

SEQ ID NO: 123067 - DNA, 23 bp, Homo sapiens
tttcttcttcattatggaaggac

SEQ ID NO: 123068 - DNA, 23 bp, Homo sapiens
aaagtgaatgcttaagaacagag

SEQ ID NO: 123069 - DNA, 23 bp, Homo sapiens
gaaaagtgcaacttctgaggttg

SEQ ID NO: 123070 - DNA, 23 bp, Homo sapiens
gatgcctcactccctgttttcct

SEQ ID NO: 123071 - DNA, 23 bp, Homo sapiens
gactttgtagatgacatagtgtg

SEQ ID NO: 123072 - DNA, 18 bp, Homo sapiens
tatttagtgtagcctaag

SEQ ID NO: 123073 - DNA, 23 bp, Homo sapiens
tttcagcaactttactgtgcaaa

SEQ ID NO: 123074 - DNA, 23 bp, Homo sapiens
attcgttgagtttagttcagaag

SEQ ID NO: 123075 - DNA, 23 bp, Homo sapiens
ggcaggctgactctgtgactgcc

SEQ ID NO: 123076 - DNA, 23 bp, Homo sapiens
agatggagtctcgctctgttact

SEQ ID NO: 123077 - DNA, 23 bp, Homo sapiens
ctgtaactcagtgcagtcttgcc

SEQ ID NO: 123078 - DNA, 23 bp, Homo sapiens
atatgtatatgtacatatgtgtg

SEQ ID NO: 123079 - DNA, 21 bp, Homo sapiens
tgaggtaggaggatcacttga

SEQ ID NO: 123080 - DNA, 23 bp, Homo sapiens
gcctgtcactctctagctgtgtg

SEQ ID NO: 123081 - DNA, 18 bp, Homo sapiens
acagaaatctgagtggac

SEQ ID NO: 123082 - DNA, 23 bp, Homo sapiens
actctccttctccatgctgtaag

SEQ ID NO: 123083 - DNA, 23 bp, Homo sapiens
tacatgtgcaggatgtgcaggtt

SEQ ID NO: 123084 - DNA, 23 bp, Homo sapiens
gcactgactgtgttgttggtagg

SEQ ID NO: 123085 - DNA, 21 bp, Homo sapiens
aaagagtctccctctgttgcc

SEQ ID NO: 123086 - DNA, 23 bp, Homo sapiens
tgagttcattgtagattctggat

SEQ ID NO: 123087 - DNA, 23 bp, Homo sapiens
tgagttcattgtagattctggat

SEQ ID NO: 123088 - DNA, 23 bp, Homo sapiens
tatatgaatatgtatatgtatgt

SEQ ID NO: 123089 - DNA, 23 bp, Homo sapiens
tgtggttttgatttgcatttctc

SEQ ID NO: 123090 - DNA, 23 bp, Homo sapiens
aaatcaactcaagatggattaca

SEQ ID NO: 123091 - DNA, 21 bp, Homo sapiens
tcaccattctaactggtgtga

SEQ ID NO: 123092 - DNA, 18 bp, Homo sapiens
aatctccagccactgaaa

SEQ ID NO: 123093 - DNA, 23 bp, Homo sapiens
agagtctcactctgtcacccagg

SEQ ID NO: 123094 - DNA, 23 bp, Homo sapiens
acagagagagctgacactgctgt

SEQ ID NO: 123095 - DNA, 23 bp, Homo sapiens
cagtagatgagagattttgttgt

SEQ ID NO: 123096 - DNA, 23 bp, Homo sapiens
agggtctctggtttgcatgtgct

SEQ ID NO: 123097 - DNA, 23 bp, Homo sapiens
atagacagtggatgttataagag

SEQ ID NO: 123098 - DNA, 23 bp, Homo sapiens
gtttatgcatctatatgttttgt

SEQ ID NO: 123099 - DNA, 23 bp, Homo sapiens
tgtggtattgatttgtatttctc

SEQ ID NO: 123100 - DNA, 23 bp, Homo sapiens
aatctgtggattattgtgagcag

SEQ ID NO: 123101 - DNA, 23 bp, Homo sapiens
tcatgatgagcagatgtttgcat

SEQ ID NO: 123102 - DNA, 18 bp, Homo sapiens
ctctgtttcaattttttc

SEQ ID NO: 123103 - DNA, 23 bp, Homo sapiens
tggtaccttctgttttggaatgt

SEQ ID NO: 123104 - DNA, 18 bp, Homo sapiens
atgtatgtatatatgtgt

SEQ ID NO: 123105 - DNA, 23 bp, Homo sapiens
tgtatatgtatgtatatatgtgt

SEQ ID NO: 123106 - DNA, 20 bp, Homo sapiens
gtgtggaagcctgtgtggct

SEQ ID NO: 123107 - DNA, 19 bp, Homo sapiens
aacttgtgggaagtgcaga

SEQ ID NO: 123108 - DNA, 22 bp, Homo sapiens
aatctgcattttataacagtct

SEQ ID NO: 123109 - DNA, 19 bp, Homo sapiens
agatgtaatgtatataatg

SEQ ID NO: 123110 - DNA, 23 bp, Homo sapiens
gtgtgtgcttgtgtgtgtgtata

SEQ ID NO: 123111 - DNA, 22 bp, Homo sapiens
atatacacacagatatacatat

SEQ ID NO: 123112 - DNA, 22 bp, Homo sapiens
tatatgtatatatatatgtgta

SEQ ID NO: 123113 - DNA, 23 bp, Homo sapiens
tattcatagtttagaatagtata

SEQ ID NO: 123114 - DNA, 23 bp, Homo sapiens
tatatcaatttaatattgtgagt

SEQ ID NO: 123115 - DNA, 23 bp, Homo sapiens
aaaaactgttttctaatgatggc

SEQ ID NO: 123116 - DNA, 23 bp, Homo sapiens
aatactactgattttgtagttga

SEQ ID NO: 123117 - DNA, 19 bp, Homo sapiens
tggaaagacagaatagtgt

SEQ ID NO: 123118 - DNA, 19 bp, Homo sapiens
taaatgtgtgaacatatgt

SEQ ID NO: 123119 - DNA, 19 bp, Homo sapiens
ccctagaggttggagtgca

SEQ ID NO: 123120 - DNA, 19 bp, Homo sapiens
tcacttcagctaccactgt

SEQ ID NO: 123121 - DNA, 23 bp, Homo sapiens
tggaagataagtgaatgtgtgta

SEQ ID NO: 123122 - DNA, 23 bp, Homo sapiens
tttaattctttttgtacagggaa

SEQ ID NO: 123123 - DNA, 21 bp, Homo sapiens
acgtgtatatatatatgtgta

SEQ ID NO: 123124 - DNA, 21 bp, Homo sapiens
tatacacaacatgcacacaca

SEQ ID NO: 123125 - DNA, 19 bp, Homo sapiens
agtatagtcaacctgctgt

SEQ ID NO: 123126 - DNA, 18 bp, Homo sapiens
accagcatctgttatttt

SEQ ID NO: 123127 - DNA, 23 bp, Homo sapiens
cttgagtcagtttttcaattcca

SEQ ID NO: 123128 - DNA, 19 bp, Homo sapiens
tgtgtctatatgtatatat

SEQ ID NO: 123129 - DNA, 18 bp, Homo sapiens
tgtgtgtgtgtgtgtgtg

SEQ ID NO: 123130 - DNA, 23 bp, Homo sapiens
atgtgtcccatacaattgtgtga

SEQ ID NO: 123131 - DNA, 23 bp, Homo sapiens
tttgtgacagagtctcactttgt

SEQ ID NO: 123132 - DNA, 23 bp, Homo sapiens
tctcagatgagactgtggacttg

SEQ ID NO: 123133 - DNA, 20 bp, Homo sapiens
tgctggaatgatttaagact

SEQ ID NO: 123134 - DNA, 23 bp, Homo sapiens
tgtgtgtagttggttgagtaaat

SEQ ID NO: 123135 - DNA, 18 bp, Homo sapiens
tacagctacaattttgtt

SEQ ID NO: 123136 - DNA, 22 bp, Homo sapiens
tatacatactgtatttgtatgt

SEQ ID NO: 123137 - DNA, 21 bp, Homo sapiens
tatatctaatgtataggtatc

SEQ ID NO: 123138 - DNA, 23 bp, Homo sapiens
agagtctcactctgtcacccagg

SEQ ID NO: 123139 - DNA, 22 bp, Homo sapiens
aggcatcttgttgcaatgactt

SEQ ID NO: 123140 - DNA, 23 bp, Homo sapiens
agagtgtttcttgatgtcttacc

SEQ ID NO: 123141 - DNA, 22 bp, Homo sapiens
tgtatatatatgtatatgtgtg

SEQ ID NO: 123142 - DNA, 21 bp, Homo sapiens
atgtgtgtgtatatatatgtg

SEQ ID NO: 123143 - DNA, 23 bp, Homo sapiens
tgacaaggttcaaggtgtggccg

SEQ ID NO: 123144 - DNA, 23 bp, Homo sapiens
tgagttcattgtagattctggat

SEQ ID NO: 123145 - DNA, 23 bp, Homo sapiens
tgagttcattgtagattctggat

SEQ ID NO: 123146 - DNA, 23 bp, Homo sapiens
agtaggttagttatcaagagagt

SEQ ID NO: 123147 - DNA, 18 bp, Homo sapiens
tttgcatatatttacata

SEQ ID NO: 123148 - DNA, 23 bp, Homo sapiens
ataaatagaggtatacatgtaca

SEQ ID NO: 123149 - DNA, 23 bp, Homo sapiens
gactgagaagtcagtgaggagca

SEQ ID NO: 123150 - DNA, 19 bp, Homo sapiens
acacagtgatgccctgtct

SEQ ID NO: 123151 - DNA, 23 bp, Homo sapiens
attacatacataatgttaggtat

SEQ ID NO: 123152 - DNA, 23 bp, Homo sapiens
ttatctgattctttatgtagagt

SEQ ID NO: 123153 - DNA, 21 bp, Homo sapiens
atgtgtatatatatatatgtg

SEQ ID NO: 123154 - DNA, 19 bp, Homo sapiens
ttactcaggaacataaaag

SEQ ID NO: 123155 - DNA, 23 bp, Homo sapiens
agagtctcactctgtcacccagg

SEQ ID NO: 123156 - DNA, 22 bp, Homo sapiens
tcattgcttatattatgtgtgt

SEQ ID NO: 123157 - DNA, 21 bp, Homo sapiens
tacaagatatataggatatgt

SEQ ID NO: 123158 - DNA, 23 bp, Homo sapiens
tacagttcagatttagttctagt

SEQ ID NO: 123159 - DNA, 21 bp, Homo sapiens
tcactgagctatagaagtgaa

SEQ ID NO: 123160 - DNA, 19 bp, Homo sapiens
agtgaatatgttatgttac

SEQ ID NO: 123161 - DNA, 21 bp, Homo sapiens
tatgtgcatattcaataattc

SEQ ID NO: 123162 - DNA, 20 bp, Homo sapiens
gtgtgtgtgtgtgtgtgtgt

SEQ ID NO: 123163 - DNA, 23 bp, Homo sapiens
tatatgtatatatacgtgtgtgt

SEQ ID NO: 123164 - DNA, 23 bp, Homo sapiens
gtgtatatatgtatatgtgcata

SEQ ID NO: 123165 - DNA, 20 bp, Homo sapiens
tcagtctgtcactcaggctg

SEQ ID NO: 123166 - DNA, 22 bp, Homo sapiens
tctgaaccagctagagtgagat

SEQ ID NO: 123167 - DNA, 19 bp, Homo sapiens
gtagaatagtaaagacttg

SEQ ID NO: 123168 - DNA, 23 bp, Homo sapiens
cctgagagtgaacagagtgagat

SEQ ID NO: 123169 - DNA, 21 bp, Homo sapiens
aactcctttgagtaaatccag

SEQ ID NO: 123170 - DNA, 23 bp, Homo sapiens
tatggttagaggatgtttagttt

SEQ ID NO: 123171 - DNA, 23 bp, Homo sapiens
atacttttaaggagtttttgttg

SEQ ID NO: 123172 - DNA, 21 bp, Homo sapiens
atacctatatatgtatatgta

SEQ ID NO: 123173 - DNA, 23 bp, Homo sapiens
atattgatgaatacttacatata

SEQ ID NO: 123174 - DNA, 23 bp, Homo sapiens
ttcagctaaatgttgctttgaga

SEQ ID NO: 123175 - DNA, 23 bp, Homo sapiens
ttttttatgacgtgggtcacatt

SEQ ID NO: 123176 - DNA, 23 bp, Homo sapiens
ttgtgtgtttatatatgtatgtg

SEQ ID NO: 123177 - DNA, 21 bp, Homo sapiens
tatctaagcaaataattttgt

SEQ ID NO: 123178 - DNA, 23 bp, Homo sapiens
aaacagtgtgtgcttagcttgtc

SEQ ID NO: 123179 - DNA, 23 bp, Homo sapiens
aatggaataggaagaattgaaga

SEQ ID NO: 123180 - DNA, 22 bp, Homo sapiens
atatttatagtaccaaaagata

SEQ ID NO: 123181 - DNA, 23 bp, Homo sapiens
taagatgaagtctcgctctgtca

SEQ ID NO: 123182 - DNA, 18 bp, Homo sapiens
tacacacatatgtatgtg

SEQ ID NO: 123183 - DNA, 18 bp, Homo sapiens
tacacacatatgtatgtg

SEQ ID NO: 123184 - DNA, 18 bp, Homo sapiens
tacacacatatgtatgtg

SEQ ID NO: 123185 - DNA, 19 bp, Homo sapiens
tacacacatatgtatgtgt

SEQ ID NO: 123186 - DNA, 23 bp, Homo sapiens
ctcatatatgtgactggtgtgtg

SEQ ID NO: 123187 - DNA, 23 bp, Homo sapiens
tatctcattgcagtcagagtgca

SEQ ID NO: 123188 - DNA, 21 bp, Homo sapiens
tctctgtctgtcaaatggagg

SEQ ID NO: 123189 - DNA, 19 bp, Homo sapiens
gaaatgctactgatgttgg

SEQ ID NO: 123190 - DNA, 22 bp, Homo sapiens
aaaataggcccctaatgtttcc

SEQ ID NO: 123191 - DNA, 23 bp, Homo sapiens
agagtctcactctgtcacccagg

SEQ ID NO: 123192 - DNA, 23 bp, Homo sapiens
tgatggcattggaagaaatctca

SEQ ID NO: 123193 - DNA, 22 bp, Homo sapiens
tgaattttccttgtaaatgttt

SEQ ID NO: 123194 - DNA, 23 bp, Homo sapiens
tgactgtgtgtgtgtatgcatag

SEQ ID NO: 123195 - DNA, 23 bp, Homo sapiens
tcattccatgttattgctattgt

SEQ ID NO: 123196 - DNA, 18 bp, Homo sapiens
acatatggatgcatgtgt

SEQ ID NO: 123197 - DNA, 22 bp, Homo sapiens
gagtctcaccctgtctcccagg

SEQ ID NO: 123198 - DNA, 20 bp, Homo sapiens
ctcactctgtcactcaggcc

SEQ ID NO: 123199 - DNA, 23 bp, Homo sapiens
ttgtgggagaatttgatcaccaa

SEQ ID NO: 123200 - DNA, 23 bp, Homo sapiens
acagattctcactctgtcagcct

SEQ ID NO: 123201 - DNA, 23 bp, Homo sapiens
tttactgaatttgttaattagtt

SEQ ID NO: 123202 - DNA, 20 bp, Homo sapiens
aggcctagaagaatgcatat

SEQ ID NO: 123203 - DNA, 18 bp, Homo sapiens
atatatgtctatatgtag

SEQ ID NO: 123204 - DNA, 23 bp, Homo sapiens
gggctgtgcttcttgtattgttt

SEQ ID NO: 123205 - DNA, 23 bp, Homo sapiens
tgagttcattgtagattctggat

SEQ ID NO: 123206 - DNA, 23 bp, Homo sapiens
tgagttcattgtagattctggat

SEQ ID NO: 123207 - DNA, 23 bp, Homo sapiens
ctcaccctctctcagctgctact

SEQ ID NO: 123208 - DNA, 22 bp, Homo sapiens
tgacaactggctaatgactgag

SEQ ID NO: 123209 - DNA, 19 bp, Homo sapiens
tgagtgaacagactgagca

SEQ ID NO: 123210 - DNA, 18 bp, Homo sapiens
acgtatatatatgtgtgt

SEQ ID NO: 123211 - DNA, 19 bp, Homo sapiens
acgtatatatatatgtgtg

SEQ ID NO: 123212 - DNA, 23 bp, Homo sapiens
ctctctgtgtctctgtgtcttct

SEQ ID NO: 123213 - DNA, 23 bp, Homo sapiens
tttgagatgaagtgttgctctgt

SEQ ID NO: 123214 - DNA, 23 bp, Homo sapiens
tctgtgaatgtcactctcagttg

SEQ ID NO: 123215 - DNA, 21 bp, Homo sapiens
tgcctggctcagtgtagctca

SEQ ID NO: 123216 - DNA, 23 bp, Homo sapiens
tggctgtcactgacaaggcactt

SEQ ID NO: 123217 - DNA, 23 bp, Homo sapiens
tgtgtatgtatatgtgtgtgcat

SEQ ID NO: 123218 - DNA, 23 bp, Homo sapiens
tgagtctcgctctgtcacccaaa

SEQ ID NO: 123219 - DNA, 21 bp, Homo sapiens
cagtggcatgatcttggctca

SEQ ID NO: 123220 - DNA, 22 bp, Homo sapiens
tgagatggagtctcactctgta

SEQ ID NO: 123221 - DNA, 22 bp, Homo sapiens
gagagctgaaaagatctgttac

SEQ ID NO: 123222 - DNA, 21 bp, Homo sapiens
ttcagtgaaggaagagacctc

SEQ ID NO: 123223 - DNA, 18 bp, Homo sapiens
ataaggcaggaaatctac

SEQ ID NO: 123224 - DNA, 23 bp, Homo sapiens
ttttgtttgaagaaagagctctg

SEQ ID NO: 123225 - DNA, 21 bp, Homo sapiens
ttttgagacagactttcactc

SEQ ID NO: 123226 - DNA, 19 bp, Homo sapiens
ggcactgtgactgtcacag

SEQ ID NO: 123227 - DNA, 21 bp, Homo sapiens
ccaggctagagtgcaggttgt

SEQ ID NO: 123228 - DNA, 22 bp, Homo sapiens
tctgtgtgtctctccttctcct

SEQ ID NO: 123229 - DNA, 23 bp, Homo sapiens
aatgtgaccagatttatgctgtt

SEQ ID NO: 123230 - DNA, 22 bp, Homo sapiens
ttattgcttgttttctttagcc

SEQ ID NO: 123231 - DNA, 21 bp, Homo sapiens
tgtggctgcttttgtgcttca

SEQ ID NO: 123232 - DNA, 20 bp, Homo sapiens
tggcagagttgagcaggtac

SEQ ID NO: 123233 - DNA, 23 bp, Homo sapiens
tctgaagtgcaatacatttggag

SEQ ID NO: 123234 - DNA, 23 bp, Homo sapiens
agtgagaccctgtctctcagaca

SEQ ID NO: 123235 - DNA, 23 bp, Homo sapiens
ttttgtgaagaaagtcaatggta

SEQ ID NO: 123236 - DNA, 20 bp, Homo sapiens
tgaggtagggtctcactctg

SEQ ID NO: 123237 - DNA, 18 bp, Homo sapiens
atatgtatatatgtacat

SEQ ID NO: 123238 - DNA, 23 bp, Homo sapiens
cggagtctcactctgtcacccag

SEQ ID NO: 123239 - DNA, 23 bp, Homo sapiens
gagtctcactctgtcacccaggc

SEQ ID NO: 123240 - DNA, 23 bp, Homo sapiens
agagagagaggagtggcagctct

SEQ ID NO: 123241 - DNA, 23 bp, Homo sapiens
gacagagtctcgctgtgtcaccc

SEQ ID NO: 123242 - DNA, 23 bp, Homo sapiens
aattaatgtttgatgtgcatgac

SEQ ID NO: 123243 - DNA, 21 bp, Homo sapiens
tgacatgtcacacattcttga

SEQ ID NO: 123244 - DNA, 23 bp, Homo sapiens
gtgtgcatagatttatgtgtgtg

SEQ ID NO: 123245 - DNA, 21 bp, Homo sapiens
taaacttacgatgcaaattat

SEQ ID NO: 123246 - DNA, 21 bp, Homo sapiens
catagtaggcactcaataaat

SEQ ID NO: 123247 - DNA, 21 bp, Homo sapiens
tatgcatgtttatatgtatct

SEQ ID NO: 123248 - DNA, 23 bp, Homo sapiens
tggcgtgatcttggctcactgca

SEQ ID NO: 123249 - DNA, 23 bp, Homo sapiens
tgagttcattgtagattctggat

SEQ ID NO: 123250 - DNA, 23 bp, Homo sapiens
tgagttcattgtagattctggat

SEQ ID NO: 123251 - DNA, 18 bp, Homo sapiens
tgtgtgtatgtatacaca

SEQ ID NO: 123252 - DNA, 22 bp, Homo sapiens
tgtgtatatatgtgtgtctata

SEQ ID NO: 123253 - DNA, 23 bp, Homo sapiens
tgagttcattgtagattctggat

SEQ ID NO: 123254 - DNA, 23 bp, Homo sapiens
tgagttcattgtagattctggat

SEQ ID NO: 123255 - DNA, 22 bp, Homo sapiens
atgtctctggaatatgtacagg

SEQ ID NO: 123256 - DNA, 20 bp, Homo sapiens
tgtgcaattgtttgggtgac

SEQ ID NO: 123257 - DNA, 23 bp, Homo sapiens
gagacagagtctcactgtcaccc

SEQ ID NO: 123258 - DNA, 22 bp, Homo sapiens
tgtcattaattcatgaatagag

SEQ ID NO: 123259 - DNA, 22 bp, Homo sapiens
tgactagtggtgataatgttga

SEQ ID NO: 123260 - DNA, 22 bp, Homo sapiens
taattccttttaaattctgaaa

SEQ ID NO: 123261 - DNA, 19 bp, Homo sapiens
tttgagatggagttttgct

SEQ ID NO: 123262 - DNA, 21 bp, Homo sapiens
aaagagtttcctttttattac

SEQ ID NO: 123263 - DNA, 23 bp, Homo sapiens
ttcaagtggagcatttaggatgt

SEQ ID NO: 123264 - DNA, 22 bp, Homo sapiens
atggatgatatgtaaactaata

SEQ ID NO: 123265 - DNA, 23 bp, Homo sapiens
acatggcagtggatcacctaagc

SEQ ID NO: 123266 - DNA, 18 bp, Homo sapiens
agcaattgtggaaagcag

SEQ ID NO: 123267 - DNA, 23 bp, Homo sapiens
tgaggctggctctgtctctccca

SEQ ID NO: 123268 - DNA, 22 bp, Homo sapiens
tgtgatttggtgttctttcaga

SEQ ID NO: 123269 - DNA, 23 bp, Homo sapiens
cataagtatggtatggaaagctt

SEQ ID NO: 123270 - DNA, 23 bp, Homo sapiens
ttccagtgcattacatttattgt

SEQ ID NO: 123271 - DNA, 22 bp, Homo sapiens
tggactcagtgggaatcttgag

SEQ ID NO: 123272 - DNA, 21 bp, Homo sapiens
ttgactccagaattcatagtt

SEQ ID NO: 123273 - DNA, 23 bp, Homo sapiens
atatgtctatgtgtatgtgtgtg

SEQ ID NO: 123274 - DNA, 22 bp, Homo sapiens
tgctcatgggaatgttctctgc

SEQ ID NO: 123275 - DNA, 23 bp, Homo sapiens
tccctgacctaatgaaagcaaat

SEQ ID NO: 123276 - DNA, 21 bp, Homo sapiens
tatatgtatatatgtacatgt

SEQ ID NO: 123277 - DNA, 21 bp, Homo sapiens
aggagcagtgactttgttctg

SEQ ID NO: 123278 - DNA, 23 bp, Homo sapiens
agtgagcatctcagagctagact

SEQ ID NO: 123279 - DNA, 22 bp, Homo sapiens
ttgagagggagctatctgtttt

SEQ ID NO: 123280 - DNA, 18 bp, Homo sapiens
ttcatgaggaaaacaagt

SEQ ID NO: 123281 - DNA, 23 bp, Homo sapiens
cagaatctcactctgtcactcag

SEQ ID NO: 123282 - DNA, 21 bp, Homo sapiens
tggtgtgatcttggctcactg

SEQ ID NO: 123283 - DNA, 23 bp, Homo sapiens
gagtctcactctgtcacccaggc

SEQ ID NO: 123284 - DNA, 21 bp, Homo sapiens
tgtctggatctggtttgcaga

SEQ ID NO: 123285 - DNA, 23 bp, Homo sapiens
agagagagtaagggcaagttctc

SEQ ID NO: 123286 - DNA, 22 bp, Homo sapiens
agaggtagtaccatgttctgga

SEQ ID NO: 123287 - DNA, 18 bp, Homo sapiens
tgtctcaagattggtttg

SEQ ID NO: 123288 - DNA, 19 bp, Homo sapiens
tgtgtatatataaatctgt

SEQ ID NO: 123289 - DNA, 23 bp, Homo sapiens
tgtttggtaaagcaaatgtgaca

SEQ ID NO: 123290 - DNA, 23 bp, Homo sapiens
tgagttcattgtagattctggat

SEQ ID NO: 123291 - DNA, 23 bp, Homo sapiens
tgagttcattgtagattctggat

SEQ ID NO: 123292 - DNA, 23 bp, Homo sapiens
agtgttgagtacctaatgcaatg

SEQ ID NO: 123293 - DNA, 19 bp, Homo sapiens
tctatctccttatctctct

SEQ ID NO: 123294 - DNA, 23 bp, Homo sapiens
tttttgtgtgtgtggaaacgggg

SEQ ID NO: 123295 - DNA, 23 bp, Homo sapiens
atctcctagaataagatgtgtgt

SEQ ID NO: 123296 - DNA, 23 bp, Homo sapiens
atttaagtgcaacatcttaagga

SEQ ID NO: 123297 - DNA, 23 bp, Homo sapiens
agagagtgtagggatgaagagtg

SEQ ID NO: 123298 - DNA, 23 bp, Homo sapiens
atgtgtatatttacgtatgtgtg

SEQ ID NO: 123299 - DNA, 23 bp, Homo sapiens
gacagagtctcgctctgtcaccc

SEQ ID NO: 123300 - DNA, 23 bp, Homo sapiens
acagagtctcgctctgtcaccca

SEQ ID NO: 123301 - DNA, 23 bp, Homo sapiens
gctggcaggtgtagaagagtata

SEQ ID NO: 123302 - DNA, 19 bp, Homo sapiens
tctctttaattaattagct

SEQ ID NO: 123303 - DNA, 23 bp, Homo sapiens
tgtgtgtatatatatatgtgtgt

SEQ ID NO: 123304 - DNA, 23 bp, Homo sapiens
atatgtgtgtatatatatatgtg

SEQ ID NO: 123305 - DNA, 19 bp, Homo sapiens
ttgtgaatcgtgttgtgat

SEQ ID NO: 123306 - DNA, 23 bp, Homo sapiens
tgagttcattgtagattctggat

SEQ ID NO: 123307 - DNA, 23 bp, Homo sapiens
tgagttcattgtagattctggat

SEQ ID NO: 123308 - DNA, 18 bp, Homo sapiens
aacttgctcaaggtcaca

SEQ ID NO: 123309 - DNA, 23 bp, Homo sapiens
agatgagagtgagcagaatggat

SEQ ID NO: 123310 - DNA, 23 bp, Homo sapiens
agtgtaagaatgcagtttgaaaa

SEQ ID NO: 123311 - DNA, 22 bp, Homo sapiens
acatacacacatttacatgtac

SEQ ID NO: 123312 - DNA, 18 bp, Homo sapiens
tatatgtatatgtatgtg

SEQ ID NO: 123313 - DNA, 22 bp, Homo sapiens
tgtgaagatattttgtagatgt

SEQ ID NO: 123314 - DNA, 23 bp, Homo sapiens
tgtagaagctttttagtttaatg

SEQ ID NO: 123315 - DNA, 20 bp, Homo sapiens
ttgtaattcaactgctagca

SEQ ID NO: 123316 - DNA, 23 bp, Homo sapiens
aaaggcactggatgtattctgca

SEQ ID NO: 123317 - DNA, 22 bp, Homo sapiens
tattccatgtatagctttgatt

SEQ ID NO: 123318 - DNA, 18 bp, Homo sapiens
tatttgtttttcattttg

SEQ ID NO: 123319 - DNA, 19 bp, Homo sapiens
tgtatgtatatgtatatgt

SEQ ID NO: 123320 - DNA, 20 bp, Homo sapiens
catatgtattgtgtatgtag

SEQ ID NO: 123321 - DNA, 21 bp, Homo sapiens
tatatgtgtatatatatgtgt

SEQ ID NO: 123322 - DNA, 23 bp, Homo sapiens
agtgcaagagtagtgatgttggt

SEQ ID NO: 123323 - DNA, 23 bp, Homo sapiens
actgtcaagtgcttcctttaagt

SEQ ID NO: 123324 - DNA, 22 bp, Homo sapiens
tttttaagtagaatgcagtaga

SEQ ID NO: 123325 - DNA, 23 bp, Homo sapiens
ttgaggtattactgcatatagaa

SEQ ID NO: 123326 - DNA, 22 bp, Homo sapiens
tatcgatatatatagatatatc

SEQ ID NO: 123327 - DNA, 23 bp, Homo sapiens
cttatgatctgagtttcttgttc

SEQ ID NO: 123328 - DNA, 20 bp, Homo sapiens
aagtggcatgaaaagatcag

SEQ ID NO: 123329 - DNA, 20 bp, Homo sapiens
ttgcctgtagtcccagctat

SEQ ID NO: 123330 - DNA, 23 bp, Homo sapiens
agagtctcactctgtcatccagg

SEQ ID NO: 123331 - DNA, 23 bp, Homo sapiens
aatgtgtgtgcaaatattgggta

SEQ ID NO: 123332 - DNA, 23 bp, Homo sapiens
aagctttgaaatagttttgactg

SEQ ID NO: 123333 - DNA, 23 bp, Homo sapiens
gtgtgtgtgtatgtgcatgtgtg

SEQ ID NO: 123334 - DNA, 19 bp, Homo sapiens
tacatatgtatatacatac

SEQ ID NO: 123335 - DNA, 23 bp, Homo sapiens
atgtgtagtaatcttgtattctg

SEQ ID NO: 123336 - DNA, 23 bp, Homo sapiens
attacataatgtgtgtgtatatc

SEQ ID NO: 123337 - DNA, 22 bp, Homo sapiens
atgtgcatatgtatatatgaat

SEQ ID NO: 123338 - DNA, 21 bp, Homo sapiens
atgaatgtctattacatatgt

SEQ ID NO: 123339 - DNA, 23 bp, Homo sapiens
actctgtttctctctgcattaat

SEQ ID NO: 123340 - DNA, 20 bp, Homo sapiens
tgtgacgcattgagtagagt

SEQ ID NO: 123341 - DNA, 23 bp, Homo sapiens
aaaatacttgcatatatatacat

SEQ ID NO: 123342 - DNA, 23 bp, Homo sapiens
tatgtaatttttcttttgtgagg

SEQ ID NO: 123343 - DNA, 18 bp, Homo sapiens
attaaagctaggatatat

SEQ ID NO: 123344 - DNA, 23 bp, Homo sapiens
tatgaagatgcttttcagctgaa

SEQ ID NO: 123345 - DNA, 18 bp, Homo sapiens
tatgtttactgcttgtgg

SEQ ID NO: 123346 - DNA, 20 bp, Homo sapiens
tatgtgcatatatatgtgta

SEQ ID NO: 123347 - DNA, 18 bp, Homo sapiens
attttagtctggctcctg

SEQ ID NO: 123348 - DNA, 19 bp, Homo sapiens
atgtactacttcttttaat

SEQ ID NO: 123349 - DNA, 23 bp, Homo sapiens
tatgtacacacacatactcggca

SEQ ID NO: 123350 - DNA, 23 bp, Homo sapiens
caatgagttgaatgcagattcca

SEQ ID NO: 123351 - DNA, 23 bp, Homo sapiens
gcttggtcatgaactctttgcct

SEQ ID NO: 123352 - DNA, 23 bp, Homo sapiens
agagagaatatatatatgtatgc

SEQ ID NO: 123353 - DNA, 23 bp, Homo sapiens
tctgtgaagaaagtcaatggtag

SEQ ID NO: 123354 - DNA, 18 bp, Homo sapiens
aagtccttttaatgaaaa

SEQ ID NO: 123355 - DNA, 23 bp, Homo sapiens
tcactgatttgatctttctggat

SEQ ID NO: 123356 - DNA, 23 bp, Homo sapiens
tatgagactggattagattttat

SEQ ID NO: 123357 - DNA, 19 bp, Homo sapiens
aatctggtagttccaaaat

SEQ ID NO: 123358 - DNA, 18 bp, Homo sapiens
tggaaggatcacttgagt

SEQ ID NO: 123359 - DNA, 23 bp, Homo sapiens
cacagagtcagtatctgtctgtc

SEQ ID NO: 123360 - DNA, 23 bp, Homo sapiens
tcagttcaaaggctatggtcctg

SEQ ID NO: 123361 - DNA, 18 bp, Homo sapiens
ttagtggatattaattaa

SEQ ID NO: 123362 - DNA, 20 bp, Homo sapiens
ttatcacattgaatccatgt

SEQ ID NO: 123363 - DNA, 20 bp, Homo sapiens
tctggtttctaaatggaatg

SEQ ID NO: 123364 - DNA, 20 bp, Homo sapiens
tccctgtgtgtctgtctgtg

SEQ ID NO: 123365 - DNA, 18 bp, Homo sapiens
taaaccatgaaatgagag

SEQ ID NO: 123366 - DNA, 19 bp, Homo sapiens
atagaagattctatttgaa

SEQ ID NO: 123367 - DNA, 18 bp, Homo sapiens
catgagtatgtattatgt

SEQ ID NO: 123368 - DNA, 21 bp, Homo sapiens
tgagacaggtagaggtctctc

SEQ ID NO: 123369 - DNA, 23 bp, Homo sapiens
tatctgtatgtatgtatatatgt

SEQ ID NO: 123370 - DNA, 19 bp, Homo sapiens
atatgtatgtatatatgta

SEQ ID NO: 123371 - DNA, 19 bp, Homo sapiens
aaaatctttgcttatcaca

SEQ ID NO: 123372 - DNA, 23 bp, Homo sapiens
tgagttcattgtagattctggat

SEQ ID NO: 123373 - DNA, 23 bp, Homo sapiens
tgagttcattgtagattctggat

SEQ ID NO: 123374 - DNA, 23 bp, Homo sapiens
catagatatactcatatgtgtgt

SEQ ID NO: 123375 - DNA, 22 bp, Homo sapiens
attttttaatcaggattgagtg

SEQ ID NO: 123376 - DNA, 23 bp, Homo sapiens
actgactctctgtctggaagagt

SEQ ID NO: 123377 - DNA, 23 bp, Homo sapiens
tatgtatgtatataagtatatgt

SEQ ID NO: 123378 - DNA, 23 bp, Homo sapiens
cacactctcacatatacatgtgt

SEQ ID NO: 123379 - DNA, 23 bp, Homo sapiens
tatatccaattaaaatgtgtgtg

SEQ ID NO: 123380 - DNA, 23 bp, Homo sapiens
tgctctctctctctccatgagca

SEQ ID NO: 123381 - DNA, 20 bp, Homo sapiens
aaagaggaacatcattggat

SEQ ID NO: 123382 - DNA, 23 bp, Homo sapiens
tttttgtgagaacatacagagta

SEQ ID NO: 123383 - DNA, 23 bp, Homo sapiens
ttacttcttgtatgtttcaggga

SEQ ID NO: 123384 - DNA, 22 bp, Homo sapiens
tatttatgtgatgcctggcact

SEQ ID NO: 123385 - DNA, 23 bp, Homo sapiens
tgtggtctcactgtcacccaggc

SEQ ID NO: 123386 - DNA, 23 bp, Homo sapiens
caactaatagatactgagtatgc

SEQ ID NO: 123387 - DNA, 21 bp, Homo sapiens
atatatgtttgcatttcatat

SEQ ID NO: 123388 - DNA, 22 bp, Homo sapiens
tgggtgtgggttattgctgaga

SEQ ID NO: 123389 - DNA, 23 bp, Homo sapiens
tgcattgctatataaatgtgtgt

SEQ ID NO: 123390 - DNA, 20 bp, Homo sapiens
acacacagtgagtatgtggg

SEQ ID NO: 123391 - DNA, 23 bp, Homo sapiens
tgagttcattgtagattctggat

SEQ ID NO: 123392 - DNA, 23 bp, Homo sapiens
tgagttcattgtagattctggat

SEQ ID NO: 123393 - DNA, 23 bp, Homo sapiens
tacttactaatacagttgggtag

SEQ ID NO: 123394 - DNA, 23 bp, Homo sapiens
tctgaccctgtctctctggctat

SEQ ID NO: 123395 - DNA, 23 bp, Homo sapiens
ttttgttgctactgagtccctga

SEQ ID NO: 123396 - DNA, 23 bp, Homo sapiens
ctcactgtgcctgtgactgtgga

SEQ ID NO: 123397 - DNA, 22 bp, Homo sapiens
atctcagtggtttccaacagca

SEQ ID NO: 123398 - DNA, 23 bp, Homo sapiens
ccttcctcatactgtgtgtccta

SEQ ID NO: 123399 - DNA, 23 bp, Homo sapiens
tgagttcattgtagattctggat

SEQ ID NO: 123400 - DNA, 23 bp, Homo sapiens
tgagttcattgtagattctggat

SEQ ID NO: 123401 - DNA, 23 bp, Homo sapiens
tctcacagagtgtcagtcttttg

SEQ ID NO: 123402 - DNA, 19 bp, Homo sapiens
agacccactctcaatctgt

SEQ ID NO: 123403 - DNA, 22 bp, Homo sapiens
aaagtgaagtgattagcagtgt

SEQ ID NO: 123404 - DNA, 23 bp, Homo sapiens
gctatgtagatgtttcaatagta

SEQ ID NO: 123405 - DNA, 21 bp, Homo sapiens
ttgagacggagtttccactct

SEQ ID NO: 123406 - DNA, 23 bp, Homo sapiens
tatatatgtttatgtgtatgtgt

SEQ ID NO: 123407 - DNA, 19 bp, Homo sapiens
tacgtatatgtttatgtgt

SEQ ID NO: 123408 - DNA, 21 bp, Homo sapiens
ttcagcttcttcaagccctgg

SEQ ID NO: 123409 - DNA, 23 bp, Homo sapiens
attaagtttggaggcagtgggag

SEQ ID NO: 123410 - DNA, 23 bp, Homo sapiens
tgagttcattgtagattctggat

SEQ ID NO: 123411 - DNA, 23 bp, Homo sapiens
tgagttcattgtagattctggat

SEQ ID NO: 123412 - DNA, 23 bp, Homo sapiens
aagacaccctctttacttgtatg

SEQ ID NO: 123413 - DNA, 22 bp, Homo sapiens
gtgtgtgtgtgtgtgtctgtat

SEQ ID NO: 123414 - DNA, 23 bp, Homo sapiens
agctagtacgatcaaaactatag

SEQ ID NO: 123415 - DNA, 22 bp, Homo sapiens
ttttttctttgcctgttaagtg

SEQ ID NO: 123416 - DNA, 22 bp, Homo sapiens
atatatgtatatgtatatgtgt

SEQ ID NO: 123417 - DNA, 19 bp, Homo sapiens
tatatgtgtgtatatatag

SEQ ID NO: 123418 - DNA, 20 bp, Homo sapiens
gtatgtatacatacaggtgt

SEQ ID NO: 123419 - DNA, 18 bp, Homo sapiens
cgtaggtatatatacgtg

SEQ ID NO: 123420 - DNA, 23 bp, Homo sapiens
tatatgtatgtatgtatacgtgt

SEQ ID NO: 123421 - DNA, 23 bp, Homo sapiens
tgagttcattgtagattctggat

SEQ ID NO: 123422 - DNA, 23 bp, Homo sapiens
tgagttcattgtagattctggat

SEQ ID NO: 123423 - DNA, 23 bp, Homo sapiens
ttcagtctctctgtctttccctg

SEQ ID NO: 123424 - DNA, 23 bp, Homo sapiens
tggatcagactgtgttaggtgct

SEQ ID NO: 123425 - DNA, 19 bp, Homo sapiens
ttgagagggtgatggatcc

SEQ ID NO: 123426 - DNA, 19 bp, Homo sapiens
tgtctctgtgtgtgtatat

SEQ ID NO: 123427 - DNA, 21 bp, Homo sapiens
atacactttgtttaccattat

SEQ ID NO: 123428 - DNA, 20 bp, Homo sapiens
ttgacagtagagagagagta

SEQ ID NO: 123429 - DNA, 23 bp, Homo sapiens
ttatgtgttgtaatacatatgta

SEQ ID NO: 123430 - DNA, 23 bp, Homo sapiens
ctgagtacagcagcatgtggtag

SEQ ID NO: 123431 - DNA, 23 bp, Homo sapiens
tgagttcattgtagattctggat

SEQ ID NO: 123432 - DNA, 23 bp, Homo sapiens
tgagttcattgtagattctggat

SEQ ID NO: 123433 - DNA, 23 bp, Homo sapiens
acagatggtcatgttctcattgt

SEQ ID NO: 123434 - DNA, 21 bp, Homo sapiens
gtgtgtgtgtgtgtatatata

SEQ ID NO: 123435 - DNA, 21 bp, Homo sapiens
atagagagagtttatatatag

SEQ ID NO: 123436 - DNA, 23 bp, Homo sapiens
gaggaattgaggagctgttttac

SEQ ID NO: 123437 - DNA, 23 bp, Homo sapiens
tgagacagtctcactctgttgcc

SEQ ID NO: 123438 - DNA, 22 bp, Homo sapiens
aatgtgtatttatatctttgtg

SEQ ID NO: 123439 - DNA, 19 bp, Homo sapiens
tcccacctggcttcaaccc

SEQ ID NO: 123440 - DNA, 18 bp, Homo sapiens
atcctgttttcattgcac

SEQ ID NO: 123441 - DNA, 23 bp, Homo sapiens
tttttaagtacttctaatgttga

SEQ ID NO: 123442 - DNA, 23 bp, Homo sapiens
atgtgacaggtttagacttcctt

SEQ ID NO: 123443 - DNA, 23 bp, Homo sapiens
tgagaccgagtctcactctgtca

SEQ ID NO: 123444 - DNA, 23 bp, Homo sapiens
ctgtgtgtcacactttcttctga

SEQ ID NO: 123445 - DNA, 22 bp, Homo sapiens
atatgtatatgtatatgtatgt

SEQ ID NO: 123446 - DNA, 23 bp, Homo sapiens
tatatgtgtatatgtgtgtgtat

SEQ ID NO: 123447 - DNA, 23 bp, Homo sapiens
atgtgtatgtgtatatatgtgta

SEQ ID NO: 123448 - DNA, 19 bp, Homo sapiens
atgtgtacatgtgtgtatg

SEQ ID NO: 123449 - DNA, 23 bp, Homo sapiens
tctcaggctcttagagtcacact

SEQ ID NO: 123450 - DNA, 19 bp, Homo sapiens
tttgtgaagaacgtcaagg

SEQ ID NO: 123451 - DNA, 23 bp, Homo sapiens
tcagctcagtctcagtcaccaac

SEQ ID NO: 123452 - DNA, 19 bp, Homo sapiens
tgggtcagtgggaggctgt

SEQ ID NO: 123453 - DNA, 18 bp, Homo sapiens
agcagaagatgttaatct

SEQ ID NO: 123454 - DNA, 19 bp, Homo sapiens
aatgagcatttttttttct

SEQ ID NO: 123455 - DNA, 18 bp, Homo sapiens
ttttgtgagacggagttt

SEQ ID NO: 123456 - DNA, 18 bp, Homo sapiens
tggctggctctttcctcc

SEQ ID NO: 123457 - DNA, 23 bp, Homo sapiens
ggctccctcactctgtgactgtg

SEQ ID NO: 123458 - DNA, 23 bp, Homo sapiens
tgtcactctctgaccctctgtct

SEQ ID NO: 123459 - DNA, 23 bp, Homo sapiens
taaaatctgcatttgctttctta

SEQ ID NO: 123460 - DNA, 23 bp, Homo sapiens
gctctgcgtctgtgtgatggtgg

SEQ ID NO: 123461 - DNA, 23 bp, Homo sapiens
tctctgtgtctctatttcttcac

SEQ ID NO: 123462 - DNA, 23 bp, Homo sapiens
agtctgagatcaaggtgtcagct

SEQ ID NO: 123463 - DNA, 21 bp, Homo sapiens
ttattgctcatggtcctggca

SEQ ID NO: 123464 - DNA, 23 bp, Homo sapiens
ttcaacgggtatttattgagcac

SEQ ID NO: 123465 - DNA, 23 bp, Homo sapiens
tgagttcattgtagattctggat

SEQ ID NO: 123466 - DNA, 23 bp, Homo sapiens
tgagttcattgtagattctggat

SEQ ID NO: 123467 - DNA, 23 bp, Homo sapiens
tgtgtcacccaggtttgaagtgc

SEQ ID NO: 123468 - DNA, 23 bp, Homo sapiens
gagatggattctcactctgtcac

SEQ ID NO: 123469 - DNA, 19 bp, Homo sapiens
aagtcagtgttgttatagc

SEQ ID NO: 123470 - DNA, 23 bp, Homo sapiens
gggcctctctgtgtgcctgtggc

SEQ ID NO: 123471 - DNA, 23 bp, Homo sapiens
tggctgcctctgtccctgtcact

SEQ ID NO: 123472 - DNA, 23 bp, Homo sapiens
ctgggtccctgagtcactgcctg

SEQ ID NO: 123473 - DNA, 22 bp, Homo sapiens
tcttgagacagaagacaggggg

SEQ ID NO: 123474 - DNA, 19 bp, Homo sapiens
cgtatatatatatgtgtgt

SEQ ID NO: 123475 - DNA, 21 bp, Homo sapiens
gacagagtctcgctctgtcgc

SEQ ID NO: 123476 - DNA, 23 bp, Homo sapiens
ctctgcctctctgagcctcagtt

SEQ ID NO: 123477 - DNA, 18 bp, Homo sapiens
aatgtcagataaagtctg

SEQ ID NO: 123478 - DNA, 21 bp, Homo sapiens
tctgcctgctttactagctgt

SEQ ID NO: 123479 - DNA, 21 bp, Homo sapiens
tggagtctcgctctgtgaccc

SEQ ID NO: 123480 - DNA, 23 bp, Homo sapiens
gggtctgaccctgggtctgtaat

SEQ ID NO: 123481 - DNA, 23 bp, Homo sapiens
tcacacggtctctctgagcctca

SEQ ID NO: 123482 - DNA, 20 bp, Homo sapiens
actcccacacacacaggctg

SEQ ID NO: 123483 - DNA, 18 bp, Homo sapiens
gactctctgtggctctgg

SEQ ID NO: 123484 - DNA, 22 bp, Homo sapiens
ctgctggactctctcagtctct

SEQ ID NO: 123485 - DNA, 23 bp, Homo sapiens
aaggctgccagtctctgtccatc

SEQ ID NO: 123486 - DNA, 21 bp, Homo sapiens
tgcaatgaaaagaacaatgga

SEQ ID NO: 123487 - DNA, 18 bp, Homo sapiens
tagagcatgataaaacca

SEQ ID NO: 123488 - DNA, 23 bp, Homo sapiens
tgagacagagtctcgctctgtca

SEQ ID NO: 123489 - DNA, 23 bp, Homo sapiens
tgtgtgtctatttgtctctgtat

SEQ ID NO: 123490 - DNA, 23 bp, Homo sapiens
tcagagacatgtggcaagagaga

SEQ ID NO: 123491 - DNA, 23 bp, Homo sapiens
tgtcgaggctctgctggagcagc

SEQ ID NO: 123492 - DNA, 22 bp, Homo sapiens
tgagatggagtctctctctgtt

SEQ ID NO: 123493 - DNA, 23 bp, Homo sapiens
gccagtcactgtctctcagtttc

SEQ ID NO: 123494 - DNA, 19 bp, Homo sapiens
agtggtgaaagtgggcatc

SEQ ID NO: 123495 - DNA, 23 bp, Homo sapiens
tcctaagagaagacagtcatcac

SEQ ID NO: 123496 - DNA, 22 bp, Homo sapiens
ttcatatgtattcatatatatg

SEQ ID NO: 123497 - DNA, 22 bp, Homo sapiens
tttgttctttttgcttaggatt

SEQ ID NO: 123498 - DNA, 23 bp, Homo sapiens
ggctcactctgtgccagtcacag

SEQ ID NO: 123499 - DNA, 22 bp, Homo sapiens
aaggtgtttcgtaaatgtgtgt

SEQ ID NO: 123500 - DNA, 23 bp, Homo sapiens
aaaagtgtatatgtatttgtggg

SEQ ID NO: 123501 - DNA, 22 bp, Homo sapiens
tagtgttacatttttattgtaa

SEQ ID NO: 123502 - DNA, 23 bp, Homo sapiens
ttttgagtgaaattcattgcaat

SEQ ID NO: 123503 - DNA, 21 bp, Homo sapiens
ccacctgacactgtgtctgtg

SEQ ID NO: 123504 - DNA, 18 bp, Homo sapiens
ggcagaggttgtgctgag

SEQ ID NO: 123505 - DNA, 23 bp, Homo sapiens
gaactttttaaaactagctttct

SEQ ID NO: 123506 - DNA, 23 bp, Homo sapiens
tgtgtgtgtatatgtatacacgt

SEQ ID NO: 123507 - DNA, 23 bp, Homo sapiens
atatgtatatattcatgtgtgtg

SEQ ID NO: 123508 - DNA, 23 bp, Homo sapiens
gcttctgagaggtaacactgggg

SEQ ID NO: 123509 - DNA, 23 bp, Homo sapiens
tgtctctgtgactcagcgtgtcc

SEQ ID NO: 123510 - DNA, 23 bp, Homo sapiens
tctctgtgcctcagttgctccat

SEQ ID NO: 123511 - DNA, 23 bp, Homo sapiens
tctctgtgcctcagttgctccat

SEQ ID NO: 123512 - DNA, 23 bp, Homo sapiens
tatacatgtatatgtatatatgt

SEQ ID NO: 123513 - DNA, 23 bp, Homo sapiens
atacatgtacatgtgtatatgtg

SEQ ID NO: 123514 - DNA, 20 bp, Homo sapiens
tgagagagtctcgctctgtc

SEQ ID NO: 123515 - DNA, 23 bp, Homo sapiens
actgcatctctctgtgctgttgt

SEQ ID NO: 123516 - DNA, 22 bp, Homo sapiens
agcgtctctccctcactctgcc

SEQ ID NO: 123517 - DNA, 21 bp, Homo sapiens
tttctggtagaattttttttt

SEQ ID NO: 123518 - DNA, 20 bp, Homo sapiens
acacacactggtatatatat

SEQ ID NO: 123519 - DNA, 18 bp, Homo sapiens
tataaccactgtgtgtgt

SEQ ID NO: 123520 - DNA, 23 bp, Homo sapiens
catgtatgtgcgtgcatattgtg

SEQ ID NO: 123521 - DNA, 23 bp, Homo sapiens
catgtatgtgcgtgcatattgtg

SEQ ID NO: 123522 - DNA, 22 bp, Homo sapiens
atgacagacagcagacacgggc

SEQ ID NO: 123523 - DNA, 23 bp, Homo sapiens
gatgtgctagttctgtagtctgt

SEQ ID NO: 123524 - DNA, 23 bp, Homo sapiens
ttgacatgaacctagcttcataa

SEQ ID NO: 123525 - DNA, 20 bp, Homo sapiens
ggaatggtatgaccagagca

SEQ ID NO: 123526 - DNA, 22 bp, Homo sapiens
gtctgggtctctgtctctccca

SEQ ID NO: 123527 - DNA, 21 bp, Homo sapiens
tctcagaggtcacagaggtca

SEQ ID NO: 123528 - DNA, 23 bp, Homo sapiens
acagtcacttggtctctctgtgt

SEQ ID NO: 123529 - DNA, 23 bp, Homo sapiens
ggtgtggttgcctactgattttc

SEQ ID NO: 123530 - DNA, 20 bp, Homo sapiens
aactcactgcagactctgcc

SEQ ID NO: 123531 - DNA, 22 bp, Homo sapiens
ctgggtcactctgtctctgcgg

SEQ ID NO: 123532 - DNA, 23 bp, Homo sapiens
gacatagtctcactctgtcgccc

SEQ ID NO: 123533 - DNA, 23 bp, Homo sapiens
gtgacccaagatcgtgccattgc

SEQ ID NO: 123534 - DNA, 23 bp, Homo sapiens
ttgttgcttgtgctttaggtgtc

SEQ ID NO: 123535 - DNA, 23 bp, Homo sapiens
gtctgtccctctgtgtgagcgtg

SEQ ID NO: 123536 - DNA, 18 bp, Homo sapiens
tgcctgcctggctgccac

SEQ ID NO: 123537 - DNA, 23 bp, Homo sapiens
tcacacctgtaatctcagcactt

SEQ ID NO: 123538 - DNA, 20 bp, Homo sapiens
tgaggtaggtggatcacttg

SEQ ID NO: 123539 - DNA, 23 bp, Homo sapiens
gcgtgtctctcggtctgtcttcc

SEQ ID NO: 123540 - DNA, 23 bp, Homo sapiens
acagagtctcactctgtcgccca

SEQ ID NO: 123541 - DNA, 23 bp, Homo sapiens
tcagagcctgtcactgtccgtcc

SEQ ID NO: 123542 - DNA, 22 bp, Homo sapiens
tatgtgtttgtttgttgagaca

SEQ ID NO: 123543 - DNA, 23 bp, Homo sapiens
agagctgagagtgcagagtgtgg

SEQ ID NO: 123544 - DNA, 22 bp, Homo sapiens
tatatgtatgtacatatgtgtg

SEQ ID NO: 123545 - DNA, 19 bp, Homo sapiens
atatgtacatgagaggcag

SEQ ID NO: 123546 - DNA, 23 bp, Homo sapiens
tttttttgagacggagtttcact

SEQ ID NO: 123547 - DNA, 23 bp, Homo sapiens
gtgtccctccctgtgtctggcgc

SEQ ID NO: 123548 - DNA, 23 bp, Homo sapiens
tagtagagacgggtttcactatg

SEQ ID NO: 123549 - DNA, 23 bp, Homo sapiens
aagagaagctgcttcagaagcag

SEQ ID NO: 123550 - DNA, 21 bp, Homo sapiens
tcagggtccctgggtccctct

SEQ ID NO: 123551 - DNA, 23 bp, Homo sapiens
actgaatcactcagcacatgtaa

SEQ ID NO: 123552 - DNA, 23 bp, Homo sapiens
tttgtgtttgaaggttctgggtg

SEQ ID NO: 123553 - DNA, 23 bp, Homo sapiens
atgctgctatgaacaggggtatg

SEQ ID NO: 123554 - DNA, 20 bp, Homo sapiens
tcacagcctcaatctctgtg

SEQ ID NO: 123555 - DNA, 22 bp, Homo sapiens
atgtgtgtgcagggcgtgagtt

SEQ ID NO: 123556 - DNA, 21 bp, Homo sapiens
tctgccactctctgtgggtca

SEQ ID NO: 123557 - DNA, 21 bp, Homo sapiens
ttgagtgaacataggcagcag

SEQ ID NO: 123558 - DNA, 23 bp, Homo sapiens
cggagtctcactctgtcacccag

SEQ ID NO: 123559 - DNA, 22 bp, Homo sapiens
aactagagcacattggtattgg

SEQ ID NO: 123560 - DNA, 21 bp, Homo sapiens
acatgtgcacaatgtgcaggt

SEQ ID NO: 123561 - DNA, 23 bp, Homo sapiens
ctgtcagtgactcactgcgtggg

SEQ ID NO: 123562 - DNA, 23 bp, Homo sapiens
gggtctcactctgtcacccaggc

SEQ ID NO: 123563 - DNA, 23 bp, Homo sapiens
tgagtttggaggaggttcttcag

SEQ ID NO: 123564 - DNA, 23 bp, Homo sapiens
tcaccatccctgtctctctctca

SEQ ID NO: 123565 - DNA, 19 bp, Homo sapiens
ctggctctgtcactcactc

SEQ ID NO: 123566 - DNA, 18 bp, Homo sapiens
tgtgtgcatgtgtgtact

SEQ ID NO: 123567 - DNA, 20 bp, Homo sapiens
tgtgtgtgtgcatgtgcatg

SEQ ID NO: 123568 - DNA, 19 bp, Homo sapiens
agagtacagtcacacttgt

SEQ ID NO: 123569 - DNA, 19 bp, Homo sapiens
gagaggacagtgtcaccag

SEQ ID NO: 123570 - DNA, 22 bp, Homo sapiens
tgtgggtgcctctgttgtcagg

SEQ ID NO: 123571 - DNA, 23 bp, Homo sapiens
attctgcttctggttcagatagt

SEQ ID NO: 123572 - DNA, 23 bp, Homo sapiens
aactcagtttcttttacttaacc

SEQ ID NO: 123573 - DNA, 21 bp, Homo sapiens
actggctgtcactgtctgtcc

SEQ ID NO: 123574 - DNA, 22 bp, Homo sapiens
gtgctgaggtaaagtttctgta

SEQ ID NO: 123575 - DNA, 18 bp, Homo sapiens
tgtgcatatgtgtggatg

SEQ ID NO: 123576 - DNA, 23 bp, Homo sapiens
tgtgtgctgcatgtgtgtgtatg

SEQ ID NO: 123577 - DNA, 21 bp, Homo sapiens
agtactgtgatgcgatatctt

SEQ ID NO: 123578 - DNA, 22 bp, Homo sapiens
tatcagaatatatatatatcag

SEQ ID NO: 123579 - DNA, 20 bp, Homo sapiens
tgtccctctgtttctctgct

SEQ ID NO: 123580 - DNA, 23 bp, Homo sapiens
ccctctctgtgtgtgacttggcc

SEQ ID NO: 123581 - DNA, 23 bp, Homo sapiens
tgtgtgtctctgtgtatgtggat

SEQ ID NO: 123582 - DNA, 19 bp, Homo sapiens
tctgtaatacacacagata

SEQ ID NO: 123583 - DNA, 23 bp, Homo sapiens
tatatctgaatgtctatgtccct

SEQ ID NO: 123584 - DNA, 23 bp, Homo sapiens
agaccgagtctcactctgtcacc

SEQ ID NO: 123585 - DNA, 23 bp, Homo sapiens
aatgtatcactcgcagatattga

SEQ ID NO: 123586 - DNA, 22 bp, Homo sapiens
ctgctgtcacacagaccaagtc

SEQ ID NO: 123587 - DNA, 23 bp, Homo sapiens
tctgtctctgagaatctgcttct

SEQ ID NO: 123588 - DNA, 23 bp, Homo sapiens
agattccaggagtgagagtgaga

SEQ ID NO: 123589 - DNA, 23 bp, Homo sapiens
tgtgtatgtgtgagtgtctgtgt

SEQ ID NO: 123590 - DNA, 21 bp, Homo sapiens
atacagtttctttatccactc

SEQ ID NO: 123591 - DNA, 23 bp, Homo sapiens
agcccctgaagcacctgcactgt

SEQ ID NO: 123592 - DNA, 21 bp, Homo sapiens
tgtatgtgtgtgtgtgtgcgt

SEQ ID NO: 123593 - DNA, 20 bp, Homo sapiens
cccacttctcacacagtgag

SEQ ID NO: 123594 - DNA, 22 bp, Homo sapiens
atatacacgtgtgtgtgtgtgt

SEQ ID NO: 123595 - DNA, 23 bp, Homo sapiens
tttctaattatcttgcattcgta

SEQ ID NO: 123596 - DNA, 23 bp, Homo sapiens
tgaatggagaaccagtgctcctg

SEQ ID NO: 123597 - DNA, 23 bp, Homo sapiens
gtgtctgtctgtccgtgtgtgtg

SEQ ID NO: 123598 - DNA, 19 bp, Homo sapiens
tgtgtatacatatatatgt

SEQ ID NO: 123599 - DNA, 19 bp, Homo sapiens
atatatttgtatacatatg

SEQ ID NO: 123600 - DNA, 21 bp, Homo sapiens
ttaactatatatgtatatgtg

SEQ ID NO: 123601 - DNA, 21 bp, Homo sapiens
gaagcaggatcagtaaaagca

SEQ ID NO: 123602 - DNA, 23 bp, Homo sapiens
gttatcttgtatactatgggtca

SEQ ID NO: 123603 - DNA, 23 bp, Homo sapiens
tcactgggtttctctctctgagt

SEQ ID NO: 123604 - DNA, 23 bp, Homo sapiens
tgagttcattgtagattctggat

SEQ ID NO: 123605 - DNA, 23 bp, Homo sapiens
tgagttcattgtagattctggat

SEQ ID NO: 123606 - DNA, 23 bp, Homo sapiens
atatctgcactatatatatatgt

SEQ ID NO: 123607 - DNA, 23 bp, Homo sapiens
ggctcactgtactcactgtggac

SEQ ID NO: 123608 - DNA, 22 bp, Homo sapiens
gggtagaaaacaaactgtcagc

SEQ ID NO: 123609 - DNA, 23 bp, Homo sapiens
tattgtgcatgtgtatgtgtgag

SEQ ID NO: 123610 - DNA, 21 bp, Homo sapiens
tatatatgtgtgtgtacatat

SEQ ID NO: 123611 - DNA, 21 bp, Homo sapiens
tgggatggaaagaagattgta

SEQ ID NO: 123612 - DNA, 23 bp, Homo sapiens
ctctccctgtgtgtgcgtctgtc

SEQ ID NO: 123613 - DNA, 23 bp, Homo sapiens
atgacttttgatattgatgttgg

SEQ ID NO: 123614 - DNA, 23 bp, Homo sapiens
tggtcttcagactctctctctct

SEQ ID NO: 123615 - DNA, 23 bp, Homo sapiens
tgtgtatatatgtatatatgtgt

SEQ ID NO: 123616 - DNA, 19 bp, Homo sapiens
tgtcccactgtcagaggca

SEQ ID NO: 123617 - DNA, 23 bp, Homo sapiens
actcatcaaatggtacactcacc

SEQ ID NO: 123618 - DNA, 18 bp, Homo sapiens
tgagtgtttggtgggttt

SEQ ID NO: 123619 - DNA, 23 bp, Homo sapiens
agatgagcaaaaagtaattttct

SEQ ID NO: 123620 - DNA, 22 bp, Homo sapiens
tactgctaattgattccttttt

SEQ ID NO: 123621 - DNA, 23 bp, Homo sapiens
tctgagtttcactctccgagtcc

SEQ ID NO: 123622 - DNA, 23 bp, Homo sapiens
tgaggtaggtgatcatgcaccag

SEQ ID NO: 123623 - DNA, 23 bp, Homo sapiens
tgacaggagagtctgagctggat

SEQ ID NO: 123624 - DNA, 23 bp, Homo sapiens
actggtatatgggttcttcctgc

SEQ ID NO: 123625 - DNA, 23 bp, Homo sapiens
atgtatgtgtatttgtatagatg

SEQ ID NO: 123626 - DNA, 23 bp, Homo sapiens
tgagttcattgtagattctggat

SEQ ID NO: 123627 - DNA, 23 bp, Homo sapiens
tgagttcattgtagattctggat

SEQ ID NO: 123628 - DNA, 23 bp, Homo sapiens
tttcacagccaccttatatgttg

SEQ ID NO: 123629 - DNA, 19 bp, Homo sapiens
tgaggctctctctcactgc

SEQ ID NO: 123630 - DNA, 23 bp, Homo sapiens
gatggagtctctctcagtcaccc

SEQ ID NO: 123631 - DNA, 19 bp, Homo sapiens
tatacacactcatatagat

SEQ ID NO: 123632 - DNA, 19 bp, Homo sapiens
aacactgtctcgtgtgggt

SEQ ID NO: 123633 - DNA, 18 bp, Homo sapiens
aataaactttgtgtcctc

SEQ ID NO: 123634 - DNA, 23 bp, Homo sapiens
ctctgaacacagaatgcacacag

SEQ ID NO: 123635 - DNA, 21 bp, Homo sapiens
tgtgttcattctgtttcacat

SEQ ID NO: 123636 - DNA, 23 bp, Homo sapiens
ctgtgcctcacttctgctccagg

SEQ ID NO: 123637 - DNA, 20 bp, Homo sapiens
taaggttggtgagccagggt

SEQ ID NO: 123638 - DNA, 19 bp, Homo sapiens
tagatagattttaatagat

SEQ ID NO: 123639 - DNA, 23 bp, Homo sapiens
atttgtgtctgtgtatatgtgtg

SEQ ID NO: 123640 - DNA, 23 bp, Homo sapiens
catatagacacacatatacatga

SEQ ID NO: 123641 - DNA, 21 bp, Homo sapiens
tgtgtaaatatatatatgtgt

SEQ ID NO: 123642 - DNA, 23 bp, Homo sapiens
ccaatgtcagaatagagagtggg

SEQ ID NO: 123643 - DNA, 23 bp, Homo sapiens
gagctgacagtgtagattgcact

SEQ ID NO: 123644 - DNA, 23 bp, Homo sapiens
caacacagtgtgactctgtctct

SEQ ID NO: 123645 - DNA, 23 bp, Homo sapiens
agatgagatttgagtgaggacac

SEQ ID NO: 123646 - DNA, 23 bp, Homo sapiens
ctgtgaagttaatttgtagatgt

SEQ ID NO: 123647 - DNA, 23 bp, Homo sapiens
ctgtctgtctgtctgtctgtgtc

SEQ ID NO: 123648 - DNA, 21 bp, Homo sapiens
agtgagagaaagtactgtgtc

SEQ ID NO: 123649 - DNA, 21 bp, Homo sapiens
ctctgtcacccagtctagagt

SEQ ID NO: 123650 - DNA, 23 bp, Homo sapiens
gacggagtctcactctgcctccc

SEQ ID NO: 123651 - DNA, 23 bp, Homo sapiens
tctctgaagctgtgtctctctga

SEQ ID NO: 123652 - DNA, 23 bp, Homo sapiens
tctgtggctgtcttatttgtgtt

SEQ ID NO: 123653 - DNA, 23 bp, Homo sapiens
agtggccttggtgtttcactctg

SEQ ID NO: 123654 - DNA, 23 bp, Homo sapiens
tgaggcttatttttggtctgtgt

SEQ ID NO: 123655 - DNA, 19 bp, Homo sapiens
taagagggttcatgatgtt

SEQ ID NO: 123656 - DNA, 23 bp, Homo sapiens
atgtgtgtatatatgtgtgtgtg

SEQ ID NO: 123657 - DNA, 23 bp, Homo sapiens
ttctttttgcttaggattgtctt

SEQ ID NO: 123658 - DNA, 23 bp, Homo sapiens
ttctgtgaagaaagtcaatggta

SEQ ID NO: 123659 - DNA, 23 bp, Homo sapiens
tctccctctgtctgagtcagtct

SEQ ID NO: 123660 - DNA, 23 bp, Homo sapiens
tgagatacttgcacagttggaaa

SEQ ID NO: 123661 - DNA, 22 bp, Homo sapiens
agacagtgacattatcttatag

SEQ ID NO: 123662 - DNA, 18 bp, Homo sapiens
atatacacatatgtgtac

SEQ ID NO: 123663 - DNA, 23 bp, Homo sapiens
actgctagaggagctgtagctca

SEQ ID NO: 123664 - DNA, 23 bp, Homo sapiens
aatgcataatgaactaaggagat

SEQ ID NO: 123665 - DNA, 23 bp, Homo sapiens
atgtatatatgtatatatgatct

SEQ ID NO: 123666 - DNA, 23 bp, Homo sapiens
tatagaatagtgtgtgtgtgtgt

SEQ ID NO: 123667 - DNA, 20 bp, Homo sapiens
atatgtgtatatgtatataa

SEQ ID NO: 123668 - DNA, 19 bp, Homo sapiens
tatgtgtatatgtatataa

SEQ ID NO: 123669 - DNA, 21 bp, Homo sapiens
tgactctctctggctttcaag

SEQ ID NO: 123670 - DNA, 18 bp, Homo sapiens
tatgcatatatttacata

SEQ ID NO: 123671 - DNA, 21 bp, Homo sapiens
ttgtgtgtatatttgtatatg

SEQ ID NO: 123672 - DNA, 23 bp, Homo sapiens
aaagccacacctacaattatctg

SEQ ID NO: 123673 - DNA, 18 bp, Homo sapiens
ctagacactccatttgct

SEQ ID NO: 123674 - DNA, 21 bp, Homo sapiens
tcaaaatcacactggatgagg

SEQ ID NO: 123675 - DNA, 20 bp, Homo sapiens
actctcaagtctgtctgcac

SEQ ID NO: 123676 - DNA, 19 bp, Homo sapiens
atatgtatgtatgtatgtg

SEQ ID NO: 123677 - DNA, 21 bp, Homo sapiens
tgggaggagagagaggtcagt

SEQ ID NO: 123678 - DNA, 23 bp, Homo sapiens
tgtgtctgagtgtctgtttagct

SEQ ID NO: 123679 - DNA, 23 bp, Homo sapiens
ttgctgtcacccactctcagtct

SEQ ID NO: 123680 - DNA, 23 bp, Homo sapiens
atttgttttgtggttaaaggact

SEQ ID NO: 123681 - DNA, 20 bp, Homo sapiens
aaattagtcctggtatttct

SEQ ID NO: 123682 - DNA, 22 bp, Homo sapiens
tctatagatatctatctgtatc

SEQ ID NO: 123683 - DNA, 23 bp, Homo sapiens
tagacagtgcacacacacagtct

SEQ ID NO: 123684 - DNA, 18 bp, Homo sapiens
tctctggcaggattgagc

SEQ ID NO: 123685 - DNA, 23 bp, Homo sapiens
tgagtctcacactctctcccatt

SEQ ID NO: 123686 - DNA, 23 bp, Homo sapiens
tctgtcactctcaatgtcatctg

SEQ ID NO: 123687 - DNA, 22 bp, Homo sapiens
tgactgaactgtgtgtgctggt

SEQ ID NO: 123688 - DNA, 23 bp, Homo sapiens
tctgcctgactgtctttgatctg

SEQ ID NO: 123689 - DNA, 22 bp, Homo sapiens
tcagtcttctgtctttgaagtt

SEQ ID NO: 123690 - DNA, 23 bp, Homo sapiens
acaggttgagaccttatgttctg

SEQ ID NO: 123691 - DNA, 23 bp, Homo sapiens
gtctgccagacacacgctctcta

SEQ ID NO: 123692 - DNA, 22 bp, Homo sapiens
tgtgagtttatttccaaaggta

SEQ ID NO: 123693 - DNA, 19 bp, Homo sapiens
gaaatcactgggaatttca

SEQ ID NO: 123694 - DNA, 23 bp, Homo sapiens
gaaatgtcagaggttaggtagag

SEQ ID NO: 123695 - DNA, 22 bp, Homo sapiens
tattcctcatttctgaaaccta

SEQ ID NO: 123696 - DNA, 23 bp, Homo sapiens
tgagttcattgtagattctggat

SEQ ID NO: 123697 - DNA, 23 bp, Homo sapiens
tgagttcattgtagattctggat

SEQ ID NO: 123698 - DNA, 21 bp, Homo sapiens
agacactgggagaagtgagcc

SEQ ID NO: 123699 - DNA, 21 bp, Homo sapiens
tactcactactcttcctgtct

SEQ ID NO: 123700 - DNA, 23 bp, Homo sapiens
tcagcctttttgttctagtcagg

SEQ ID NO: 123701 - DNA, 23 bp, Homo sapiens
aggtagtaggttctcaactctgt

SEQ ID NO: 123702 - DNA, 23 bp, Homo sapiens
tctctctgtgaaatactctcact

SEQ ID NO: 123703 - DNA, 21 bp, Homo sapiens
tcacaagactgactcaaatca

SEQ ID NO: 123704 - DNA, 23 bp, Homo sapiens
cacgtatactgtttttcttgatc

SEQ ID NO: 123705 - DNA, 23 bp, Homo sapiens
gggtctcactctgtcacccaggc

SEQ ID NO: 123706 - DNA, 19 bp, Homo sapiens
tgagttgtgacacagcctg

SEQ ID NO: 123707 - DNA, 20 bp, Homo sapiens
gaaagtgcatctgcttggtg

SEQ ID NO: 123708 - DNA, 23 bp, Homo sapiens
acagagaggttcagatggtatag

SEQ ID NO: 123709 - DNA, 23 bp, Homo sapiens
aggagtctcactctgtcacccag

SEQ ID NO: 123710 - DNA, 23 bp, Homo sapiens
tgagacagagtctcactctgtcg

SEQ ID NO: 123711 - DNA, 21 bp, Homo sapiens
ttgactcagcatgacttctgg

SEQ ID NO: 123712 - DNA, 23 bp, Homo sapiens
agaaacaggaagaattgctgttg

SEQ ID NO: 123713 - DNA, 23 bp, Homo sapiens
tggctcactgaaagcttcatctc

SEQ ID NO: 123714 - DNA, 18 bp, Homo sapiens
atgtttctgatgatatga

SEQ ID NO: 123715 - DNA, 22 bp, Homo sapiens
ggagtctcactctgtcacccag

SEQ ID NO: 123716 - DNA, 23 bp, Homo sapiens
acagagcatatatatgtgtgtgt

SEQ ID NO: 123717 - DNA, 20 bp, Homo sapiens
tatatatgtatatgtatgtg

SEQ ID NO: 123718 - DNA, 23 bp, Homo sapiens
ttctgtcaatttgtttatctgat

SEQ ID NO: 123719 - DNA, 22 bp, Homo sapiens
gagagactttgtaatcatttgg

SEQ ID NO: 123720 - DNA, 22 bp, Homo sapiens
tgcatttctctgaagattggtg

SEQ ID NO: 123721 - DNA, 23 bp, Homo sapiens
cggagtctcgctctgtctcccag

SEQ ID NO: 123722 - DNA, 23 bp, Homo sapiens
tatatgcatatatatatgtgtac

SEQ ID NO: 123723 - DNA, 23 bp, Homo sapiens
tatatgcatatatatatgtgtac

SEQ ID NO: 123724 - DNA, 23 bp, Homo sapiens
atatatgcatatatatgtgtaca

SEQ ID NO: 123725 - DNA, 23 bp, Homo sapiens
tatatgcatatatatatgtgtac

SEQ ID NO: 123726 - DNA, 23 bp, Homo sapiens
tatatgcatatatatatgtgtac

SEQ ID NO: 123727 - DNA, 23 bp, Homo sapiens
tatatgcatatatatatgtgtat

SEQ ID NO: 123728 - DNA, 23 bp, Homo sapiens
atatgtgtatatatatatgtgtg

SEQ ID NO: 123729 - DNA, 22 bp, Homo sapiens
taaatagttgttgaggtttgct

SEQ ID NO: 123730 - DNA, 23 bp, Homo sapiens
tgagttcattgtagattctggat

SEQ ID NO: 123731 - DNA, 23 bp, Homo sapiens
tgagttcattgtagattctggat

SEQ ID NO: 123732 - DNA, 20 bp, Homo sapiens
aagttgcagctgagaaatgc

SEQ ID NO: 123733 - DNA, 23 bp, Homo sapiens
acagagtctcactctgtcgccca

SEQ ID NO: 123734 - DNA, 23 bp, Homo sapiens
agagtctcactctgtcacccagc

SEQ ID NO: 123735 - DNA, 23 bp, Homo sapiens
tgtatatatgcatatgtatatat

SEQ ID NO: 123736 - DNA, 22 bp, Homo sapiens
tccatagtagtttgatttaccc

SEQ ID NO: 123737 - DNA, 23 bp, Homo sapiens
acagtctctccatgagcaactgc

SEQ ID NO: 123738 - DNA, 23 bp, Homo sapiens
tatatgtacatatatgtatgtat

SEQ ID NO: 123739 - DNA, 19 bp, Homo sapiens
atatgtatatatccaatgt

SEQ ID NO: 123740 - DNA, 21 bp, Homo sapiens
acgtgtatatgtatacatata

SEQ ID NO: 123741 - DNA, 20 bp, Homo sapiens
tatgcatacctatatgtatg

SEQ ID NO: 123742 - DNA, 23 bp, Homo sapiens
atgtctgtgtgaatatgtgtgtg

SEQ ID NO: 123743 - DNA, 23 bp, Homo sapiens
tgaaagggtactctttgtgatga

SEQ ID NO: 123744 - DNA, 23 bp, Homo sapiens
tttcttgagtcctaaacttgggt

SEQ ID NO: 123745 - DNA, 22 bp, Homo sapiens
tcactttaatctggataggctt

SEQ ID NO: 123746 - DNA, 23 bp, Homo sapiens
taatatgcagcttatgagttgga

SEQ ID NO: 123747 - DNA, 20 bp, Homo sapiens
tgcatgtgtgtatatataca

SEQ ID NO: 123748 - DNA, 18 bp, Homo sapiens
atgtgtgtatatttgtat

SEQ ID NO: 123749 - DNA, 23 bp, Homo sapiens
tacacacatgtatgactgcacat

SEQ ID NO: 123750 - DNA, 23 bp, Homo sapiens
tgtatctctagctctctctctct

SEQ ID NO: 123751 - DNA, 21 bp, Homo sapiens
atatccagctcttaatctctg

SEQ ID NO: 123752 - DNA, 23 bp, Homo sapiens
tcagctcagagccagtgtccagt

SEQ ID NO: 123753 - DNA, 21 bp, Homo sapiens
tatacgtatatatacgtatat

SEQ ID NO: 123754 - DNA, 20 bp, Homo sapiens
atatgtatgtatatatacgt

SEQ ID NO: 123755 - DNA, 23 bp, Homo sapiens
tagctacatgatttgggtgagat

SEQ ID NO: 123756 - DNA, 22 bp, Homo sapiens
ctctgtcacccagactagaggg

SEQ ID NO: 123757 - DNA, 21 bp, Homo sapiens
attgtggtttcgatttgaatt

SEQ ID NO: 123758 - DNA, 20 bp, Homo sapiens
atttgtatatcttcttttga

SEQ ID NO: 123759 - DNA, 20 bp, Homo sapiens
tatgttacgtatgtgtgtgt

SEQ ID NO: 123760 - DNA, 20 bp, Homo sapiens
tacatgcacagatatatatg

SEQ ID NO: 123761 - DNA, 23 bp, Homo sapiens
catatgtatatatgtatatgtgt

SEQ ID NO: 123762 - DNA, 23 bp, Homo sapiens
catatgtatatatgtatatgtgt

SEQ ID NO: 123763 - DNA, 23 bp, Homo sapiens
ctgtgtgagtagtgtgtgagcag

SEQ ID NO: 123764 - DNA, 23 bp, Homo sapiens
atacacacacatatatatgtgtg

SEQ ID NO: 123765 - DNA, 23 bp, Homo sapiens
atgtgtatatatatgtgtgtgtg

SEQ ID NO: 123766 - DNA, 22 bp, Homo sapiens
tatatgcatatatatgcatata

SEQ ID NO: 123767 - DNA, 22 bp, Homo sapiens
atgtgtatatatgtatatatgc

SEQ ID NO: 123768 - DNA, 23 bp, Homo sapiens
actcagtctgtggtattctgttt

SEQ ID NO: 123769 - DNA, 21 bp, Homo sapiens
tctacttttgcttggctctca

SEQ ID NO: 123770 - DNA, 23 bp, Homo sapiens
tctgtgttttactgtctggtttt

SEQ ID NO: 123771 - DNA, 23 bp, Homo sapiens
tatatatacacatagtatgtgta

SEQ ID NO: 123772 - DNA, 22 bp, Homo sapiens
aattgtgaatgggagttcactt

SEQ ID NO: 123773 - DNA, 20 bp, Homo sapiens
tgatatatacattacgtatg

SEQ ID NO: 123774 - DNA, 23 bp, Homo sapiens
tatacacacacatatagatacac

SEQ ID NO: 123775 - DNA, 23 bp, Homo sapiens
atgtgtgtatatgtatatgtgtg

SEQ ID NO: 123776 - DNA, 18 bp, Homo sapiens
tatgtatatatgtatgta

SEQ ID NO: 123777 - DNA, 22 bp, Homo sapiens
atatgtatgtatgtatatgtat

SEQ ID NO: 123778 - DNA, 23 bp, Homo sapiens
tctgtatatgtatgcatatatgt

SEQ ID NO: 123779 - DNA, 23 bp, Homo sapiens
tgagttcattgtagattctggat

SEQ ID NO: 123780 - DNA, 23 bp, Homo sapiens
tgagttcattgtagattctggat

SEQ ID NO: 123781 - DNA, 23 bp, Homo sapiens
gggtgaaaacagagctcttatca

SEQ ID NO: 123782 - DNA, 22 bp, Homo sapiens
tatatatgcatggaagtgtgta

SEQ ID NO: 123783 - DNA, 23 bp, Homo sapiens
tatacacacacacatacatgtgt

SEQ ID NO: 123784 - DNA, 18 bp, Homo sapiens
attgtgaatgggagttca

SEQ ID NO: 123785 - DNA, 23 bp, Homo sapiens
tagtgtgttagttcttgtgagag

SEQ ID NO: 123786 - DNA, 21 bp, Homo sapiens
tgtgtgtgtgtgtatacacac

SEQ ID NO: 123787 - DNA, 23 bp, Homo sapiens
tatggatatagatgtgtatgtgt

SEQ ID NO: 123788 - DNA, 21 bp, Homo sapiens
tctcagtttctctctccagag

SEQ ID NO: 123789 - DNA, 21 bp, Homo sapiens
tgtgtacatacatgtatatgc

SEQ ID NO: 123790 - DNA, 23 bp, Homo sapiens
tatatgtatatatgtatatgtgt

SEQ ID NO: 123791 - DNA, 23 bp, Homo sapiens
atgatgatgaaaatgcagtgtta

SEQ ID NO: 123792 - DNA, 22 bp, Homo sapiens
ttttagaggtattttatctgca

SEQ ID NO: 123793 - DNA, 23 bp, Homo sapiens
tatgtgtatatatacatatgtgt

SEQ ID NO: 123794 - DNA, 23 bp, Homo sapiens
atgtgtatatatatgtatgtctg

SEQ ID NO: 123795 - DNA, 21 bp, Homo sapiens
tacagtatatatgtgtatgta

SEQ ID NO: 123796 - DNA, 23 bp, Homo sapiens
gagatttgagtgaggacacagag

SEQ ID NO: 123797 - DNA, 20 bp, Homo sapiens
taagtatatatatgtgtatg

SEQ ID NO: 123798 - DNA, 23 bp, Homo sapiens
atatagcacatgtatatctgtgt

SEQ ID NO: 123799 - DNA, 23 bp, Homo sapiens
agatatagtttacatatgtgagc

SEQ ID NO: 123800 - DNA, 23 bp, Homo sapiens
tgtgtatctttgtgtgtgtgtat

SEQ ID NO: 123801 - DNA, 23 bp, Homo sapiens
taacagtgtatatatagtgtata

SEQ ID NO: 123802 - DNA, 23 bp, Homo sapiens
tgctggttggaagtgtagttctg

SEQ ID NO: 123803 - DNA, 23 bp, Homo sapiens
gtgtgtgtgtgtctgtatgtgtg

SEQ ID NO: 123804 - DNA, 23 bp, Homo sapiens
tgagttcattgtagattctggat

SEQ ID NO: 123805 - DNA, 23 bp, Homo sapiens
tgagttcattgtagattctggat

SEQ ID NO: 123806 - DNA, 20 bp, Homo sapiens
tttagtcattctggtgggag

SEQ ID NO: 123807 - DNA, 23 bp, Homo sapiens
ggagtctcactctgtcacccatg

SEQ ID NO: 123808 - DNA, 19 bp, Homo sapiens
tacagtagtgcggtcttag

SEQ ID NO: 123809 - DNA, 21 bp, Homo sapiens
ttctacctcctcagtgtctct

SEQ ID NO: 123810 - DNA, 18 bp, Homo sapiens
tacatgtatgtatatgtg

SEQ ID NO: 123811 - DNA, 19 bp, Homo sapiens
tacagtatactatatatag

SEQ ID NO: 123812 - DNA, 21 bp, Homo sapiens
atatgtatatatagtatacat

SEQ ID NO: 123813 - DNA, 23 bp, Homo sapiens
actcccagagcccctggaactct

SEQ ID NO: 123814 - DNA, 23 bp, Homo sapiens
aggctctctgactgactccttcc

SEQ ID NO: 123815 - DNA, 22 bp, Homo sapiens
agtgacagtggctcacttcagg

SEQ ID NO: 123816 - DNA, 23 bp, Homo sapiens
aaaactatcatttgtttctgaag

SEQ ID NO: 123817 - DNA, 23 bp, Homo sapiens
aatactcatgacagttacagtcc

SEQ ID NO: 123818 - DNA, 23 bp, Homo sapiens
atgtggttgtagctggtattgat

SEQ ID NO: 123819 - DNA, 19 bp, Homo sapiens
gatctatgtgtgtgtatat

SEQ ID NO: 123820 - DNA, 19 bp, Homo sapiens
tacatgtatgtatatatgt

SEQ ID NO: 123821 - DNA, 21 bp, Homo sapiens
tgagatggagtctcgctctgt

SEQ ID NO: 123822 - DNA, 23 bp, Homo sapiens
gtttctgtgtgtgcttgtgcatg

SEQ ID NO: 123823 - DNA, 21 bp, Homo sapiens
ctcactctttctgtcacctaa

SEQ ID NO: 123824 - DNA, 23 bp, Homo sapiens
tgagttcattgtagattctggat

SEQ ID NO: 123825 - DNA, 23 bp, Homo sapiens
tgagttcattgtagattctggat

SEQ ID NO: 123826 - DNA, 23 bp, Homo sapiens
tgagttcattgtagattctggat

SEQ ID NO: 123827 - DNA, 23 bp, Homo sapiens
tgagttcattgtagattctggat

SEQ ID NO: 123828 - DNA, 19 bp, Homo sapiens
tatatcctcatatacaatt

SEQ ID NO: 123829 - DNA, 23 bp, Homo sapiens
tatgtatatatgtatgcataagt

SEQ ID NO: 123830 - DNA, 22 bp, Homo sapiens
ttgaaccatatgaaatgactga

SEQ ID NO: 123831 - DNA, 23 bp, Homo sapiens
tataaaaatcaatttcttgtggt

SEQ ID NO: 123832 - DNA, 22 bp, Homo sapiens
tatatgggtgtgtatgcataca

SEQ ID NO: 123833 - DNA, 22 bp, Homo sapiens
taaggtagaaggatgtataatt

SEQ ID NO: 123834 - DNA, 18 bp, Homo sapiens
catcaatgtcactgtcct

SEQ ID NO: 123835 - DNA, 19 bp, Homo sapiens
ccattacttttgtctggca

SEQ ID NO: 123836 - DNA, 21 bp, Homo sapiens
tctctctctgtaatgctggtt

SEQ ID NO: 123837 - DNA, 23 bp, Homo sapiens
actctgtgtgaagagggtgacct

SEQ ID NO: 123838 - DNA, 22 bp, Homo sapiens
tggaatgaaatgaagtttcaac

SEQ ID NO: 123839 - DNA, 23 bp, Homo sapiens
tatgtgtatatatatgtgtgtgt

SEQ ID NO: 123840 - DNA, 23 bp, Homo sapiens
aaacacagagttcacatagagct

SEQ ID NO: 123841 - DNA, 23 bp, Homo sapiens
tgacattagacagtctctcagtc

SEQ ID NO: 123842 - DNA, 21 bp, Homo sapiens
tttgcttgaatatagatatag

SEQ ID NO: 123843 - DNA, 21 bp, Homo sapiens
tgacactgacttactttattg

SEQ ID NO: 123844 - DNA, 23 bp, Homo sapiens
gggtctctctctgtcacccaggc

SEQ ID NO: 123845 - DNA, 23 bp, Homo sapiens
atatctatatatagatatgtgtg

SEQ ID NO: 123846 - DNA, 23 bp, Homo sapiens
cttattccttcagctctctctct

SEQ ID NO: 123847 - DNA, 22 bp, Homo sapiens
tgtgtatgtgtgtatatgtata

SEQ ID NO: 123848 - DNA, 20 bp, Homo sapiens
tgaggtaggaggatcacttg

SEQ ID NO: 123849 - DNA, 23 bp, Homo sapiens
gtctctcagtctgagtccatgat

SEQ ID NO: 123850 - DNA, 21 bp, Homo sapiens
agacagactctcattctgtct

SEQ ID NO: 123851 - DNA, 23 bp, Homo sapiens
atcacttctgaatttcctgaagt

SEQ ID NO: 123852 - DNA, 22 bp, Homo sapiens
caaagaaatgaaatctatacgt

SEQ ID NO: 123853 - DNA, 22 bp, Homo sapiens
agactagtggatggtgtttgtt

SEQ ID NO: 123854 - DNA, 23 bp, Homo sapiens
tagtttcagagacaatttgattt

SEQ ID NO: 123855 - DNA, 18 bp, Homo sapiens
gtcaggagtttgagacca

SEQ ID NO: 123856 - DNA, 18 bp, Homo sapiens
cagtagtcattttcatga

SEQ ID NO: 123857 - DNA, 21 bp, Homo sapiens
tgaaacaaggtctcactctgt

SEQ ID NO: 123858 - DNA, 23 bp, Homo sapiens
tgagatggagtctcactctgtca

SEQ ID NO: 123859 - DNA, 21 bp, Homo sapiens
attttgcaagaattctactta

SEQ ID NO: 123860 - DNA, 19 bp, Homo sapiens
atcagagctttccgagggc

SEQ ID NO: 123861 - DNA, 22 bp, Homo sapiens
catgactctgtgattctctgac

SEQ ID NO: 123862 - DNA, 23 bp, Homo sapiens
tgagttcattgtagattctggat

SEQ ID NO: 123863 - DNA, 23 bp, Homo sapiens
tgagttcattgtagattctggat

SEQ ID NO: 123864 - DNA, 23 bp, Homo sapiens
ttggaggtcactctgtctttgtc

SEQ ID NO: 123865 - DNA, 23 bp, Homo sapiens
gagtctcacactgtcactcaggc

SEQ ID NO: 123866 - DNA, 23 bp, Homo sapiens
tggagtctcactctgtcacccag

SEQ ID NO: 123867 - DNA, 23 bp, Homo sapiens
aagtctgagatcaaggtgtcagc

SEQ ID NO: 123868 - DNA, 20 bp, Homo sapiens
acacacacacatatatatat

SEQ ID NO: 123869 - DNA, 23 bp, Homo sapiens
tctgtccgtacagtctctcagtt

SEQ ID NO: 123870 - DNA, 23 bp, Homo sapiens
gacctatccatctgtgtgttgac

SEQ ID NO: 123871 - DNA, 18 bp, Homo sapiens
aatgtatgaatatatgta

SEQ ID NO: 123872 - DNA, 22 bp, Homo sapiens
atatatatgtattgcatagcaa

SEQ ID NO: 123873 - DNA, 22 bp, Homo sapiens
atatatatgtattgcatagcaa

SEQ ID NO: 123874 - DNA, 22 bp, Homo sapiens
atatatatgtattgcatagcaa

SEQ ID NO: 123875 - DNA, 18 bp, Homo sapiens
gtgtgctgtacagtgtgt

SEQ ID NO: 123876 - DNA, 23 bp, Homo sapiens
tatgtatgtagatgtagatgtgt

SEQ ID NO: 123877 - DNA, 21 bp, Homo sapiens
atgtgtatgtatgtatattgt

SEQ ID NO: 123878 - DNA, 23 bp, Homo sapiens
caaggtctcactctgtcacccag

SEQ ID NO: 123879 - DNA, 21 bp, Homo sapiens
atattgggagtagttgtttct

SEQ ID NO: 123880 - DNA, 23 bp, Homo sapiens
cctccctccctgactgcctcaga

SEQ ID NO: 123881 - DNA, 19 bp, Homo sapiens
ttggaccaactccttctgg

SEQ ID NO: 123882 - DNA, 22 bp, Homo sapiens
aggtattttattctctttgaag

SEQ ID NO: 123883 - DNA, 23 bp, Homo sapiens
tctgtgaagaaagtcaatggtag

SEQ ID NO: 123884 - DNA, 20 bp, Homo sapiens
ctcactctgtcactcagcta

SEQ ID NO: 123885 - DNA, 23 bp, Homo sapiens
acagagtctcactctgtcgccca

SEQ ID NO: 123886 - DNA, 20 bp, Homo sapiens
tgcttgaacataataatgtt

SEQ ID NO: 123887 - DNA, 22 bp, Homo sapiens
tataatgaacattatgttcaag

SEQ ID NO: 123888 - DNA, 23 bp, Homo sapiens
gggctctctctcacacacaggcc

SEQ ID NO: 123889 - DNA, 23 bp, Homo sapiens
catgagagtgctgagtgaggaga

SEQ ID NO: 123890 - DNA, 22 bp, Homo sapiens
aaatctgttttgtgttgtggtt

SEQ ID NO: 123891 - DNA, 23 bp, Homo sapiens
gcttccctgtgtgcctcagctgt

SEQ ID NO: 123892 - DNA, 23 bp, Homo sapiens
tgagttcattgtagattctggat

SEQ ID NO: 123893 - DNA, 23 bp, Homo sapiens
tgagttcattgtagattctggat

SEQ ID NO: 123894 - DNA, 23 bp, Homo sapiens
tgagttcattgtagattctggat

SEQ ID NO: 123895 - DNA, 22 bp, Homo sapiens
taaggagaggatgtgttcacaa

SEQ ID NO: 123896 - DNA, 20 bp, Homo sapiens
taacagcaatttggggaggt

SEQ ID NO: 123897 - DNA, 23 bp, Homo sapiens
acaggatctcactctgtctctgg

SEQ ID NO: 123898 - DNA, 23 bp, Homo sapiens
acagagtctcgcactgtcaccca

SEQ ID NO: 123899 - DNA, 20 bp, Homo sapiens
caagagatacataggtgaaa

SEQ ID NO: 123900 - DNA, 20 bp, Homo sapiens
aattgtttgaaagtattggt

SEQ ID NO: 123901 - DNA, 18 bp, Homo sapiens
gtgggttccatttgaaga

SEQ ID NO: 123902 - DNA, 23 bp, Homo sapiens
gagacggagtctcgctctgtcac

SEQ ID NO: 123903 - DNA, 23 bp, Homo sapiens
ttgttctttttgcttaggattgc

SEQ ID NO: 123904 - DNA, 23 bp, Homo sapiens
ttctgtgaagaaagtcaatggta

SEQ ID NO: 123905 - DNA, 21 bp, Homo sapiens
tgagttgaaaaaagtttcttg

SEQ ID NO: 123906 - DNA, 20 bp, Homo sapiens
tatacagtatatatattcgt

SEQ ID NO: 123907 - DNA, 21 bp, Homo sapiens
tatatacagtatatatatttg

SEQ ID NO: 123908 - DNA, 18 bp, Homo sapiens
aggctatttgttagcttt

SEQ ID NO: 123909 - DNA, 23 bp, Homo sapiens
cagggtgtgtcagtgggtctgac

SEQ ID NO: 123910 - DNA, 23 bp, Homo sapiens
gtgtatgtatatgtatatgtgtg

SEQ ID NO: 123911 - DNA, 20 bp, Homo sapiens
tacacatatgtatacctatg

SEQ ID NO: 123912 - DNA, 23 bp, Homo sapiens
gcacagtgcaaccagactgagag

SEQ ID NO: 123913 - DNA, 23 bp, Homo sapiens
gcaactttactgaatttgttgat

SEQ ID NO: 123914 - DNA, 22 bp, Homo sapiens
aatagtttcttggtgaagtctt

SEQ ID NO: 123915 - DNA, 23 bp, Homo sapiens
ttttgctatatatgatgttgctg

SEQ ID NO: 123916 - DNA, 23 bp, Homo sapiens
tatctgtgtgtgtgtgtatgtac

SEQ ID NO: 123917 - DNA, 23 bp, Homo sapiens
cggagtctcactctgtcacccag

SEQ ID NO: 123918 - DNA, 23 bp, Homo sapiens
agagtctcactctgtcacccagg

SEQ ID NO: 123919 - DNA, 19 bp, Homo sapiens
aattgaatagaagtttgat

SEQ ID NO: 123920 - DNA, 18 bp, Homo sapiens
atacacacacacatacat

SEQ ID NO: 123921 - DNA, 23 bp, Homo sapiens
tgtggttgtagctggtattgata

SEQ ID NO: 123922 - DNA, 23 bp, Homo sapiens
gttgagacagggtctcacactgt

SEQ ID NO: 123923 - DNA, 20 bp, Homo sapiens
tcaagctgctaagtttgtaa

SEQ ID NO: 123924 - DNA, 23 bp, Homo sapiens
ttttacacagtaattgatgatat

SEQ ID NO: 123925 - DNA, 18 bp, Homo sapiens
tctagttaacaagagaat

SEQ ID NO: 123926 - DNA, 23 bp, Homo sapiens
atctctcttgtaaacatagttaa

SEQ ID NO: 123927 - DNA, 23 bp, Homo sapiens
tgagttcattgtagattctggat

SEQ ID NO: 123928 - DNA, 23 bp, Homo sapiens
tgagttcattgtagattctggat

SEQ ID NO: 123929 - DNA, 23 bp, Homo sapiens
tagctcagagatgacactgaaga

SEQ ID NO: 123930 - DNA, 23 bp, Homo sapiens
tgtagatatatatatgtgtgtgt

SEQ ID NO: 123931 - DNA, 22 bp, Homo sapiens
tatgtgtacatatatatgtgtg

SEQ ID NO: 123932 - DNA, 18 bp, Homo sapiens
tgtatatatatatatgtg

SEQ ID NO: 123933 - DNA, 23 bp, Homo sapiens
tgagttcattgtagattctggat

SEQ ID NO: 123934 - DNA, 23 bp, Homo sapiens
tgagttcattgtagattctggat

SEQ ID NO: 123935 - DNA, 23 bp, Homo sapiens
atttacagcatgtggaactgtga

SEQ ID NO: 123936 - DNA, 23 bp, Homo sapiens
ttgctaatgttccagcagactta

SEQ ID NO: 123937 - DNA, 23 bp, Homo sapiens
tatgtctgtctggctaacatctc

SEQ ID NO: 123938 - DNA, 23 bp, Homo sapiens
tgagttcattgtagattctggat

SEQ ID NO: 123939 - DNA, 23 bp, Homo sapiens
tgagttcattgtagattctggat

SEQ ID NO: 123940 - DNA, 23 bp, Homo sapiens
atagtgggtcatttttgtggtgt

SEQ ID NO: 123941 - DNA, 20 bp, Homo sapiens
aaagacttcatattcttttc

SEQ ID NO: 123942 - DNA, 20 bp, Homo sapiens
atttctctttgtatttcatt

SEQ ID NO: 123943 - DNA, 22 bp, Homo sapiens
tgtctgtttgtttttttgagac

SEQ ID NO: 123944 - DNA, 23 bp, Homo sapiens
ctctgagcttcttgtatctggat

SEQ ID NO: 123945 - DNA, 23 bp, Homo sapiens
aattctcctagtttttgtttatt

SEQ ID NO: 123946 - DNA, 23 bp, Homo sapiens
tatgtatatctatacatatctac

SEQ ID NO: 123947 - DNA, 23 bp, Homo sapiens
tctctctctgtcagtatcttcag

SEQ ID NO: 123948 - DNA, 23 bp, Homo sapiens
ttgagatctgaaattgttgttca

SEQ ID NO: 123949 - DNA, 23 bp, Homo sapiens
attttttgttgaagtctttaggg

SEQ ID NO: 123950 - DNA, 23 bp, Homo sapiens
gaaattgaatatgtagattgctt

SEQ ID NO: 123951 - DNA, 22 bp, Homo sapiens
tgagacagagtctctctctgtc

SEQ ID NO: 123952 - DNA, 23 bp, Homo sapiens
gagactcagtgcctctgtgtgtc

SEQ ID NO: 123953 - DNA, 23 bp, Homo sapiens
tagttagtaacagagtcaggatt

SEQ ID NO: 123954 - DNA, 23 bp, Homo sapiens
ctgactcttactcactgtgtctt

SEQ ID NO: 123955 - DNA, 22 bp, Homo sapiens
taaggtagtattctgaaattgt

SEQ ID NO: 123956 - DNA, 21 bp, Homo sapiens
tagagtggcagttgtggtgga

SEQ ID NO: 123957 - DNA, 23 bp, Homo sapiens
tgagttcattgtagattctggat

SEQ ID NO: 123958 - DNA, 23 bp, Homo sapiens
tgagttcattgtagattctggat

SEQ ID NO: 123959 - DNA, 23 bp, Homo sapiens
tggagtctcactctgtcacccag

SEQ ID NO: 123960 - DNA, 22 bp, Homo sapiens
tgagagaaaatagtgtggaaag

SEQ ID NO: 123961 - DNA, 23 bp, Homo sapiens
tatcagaatatatatatatgtgt

SEQ ID NO: 123962 - DNA, 23 bp, Homo sapiens
gcagtgcatctagaatgagactt

SEQ ID NO: 123963 - DNA, 22 bp, Homo sapiens
aattttcattttgagcaagcac

SEQ ID NO: 123964 - DNA, 23 bp, Homo sapiens
tatgtctgtgcttttgatgactt

SEQ ID NO: 123965 - DNA, 20 bp, Homo sapiens
tgaccaagaatatttatagt

SEQ ID NO: 123966 - DNA, 23 bp, Homo sapiens
agagggagtctcactctgtcacc

SEQ ID NO: 123967 - DNA, 23 bp, Homo sapiens
gactgagtctcgctctgtcaccc

SEQ ID NO: 123968 - DNA, 23 bp, Homo sapiens
ataatggcagaggaagaattcag

SEQ ID NO: 123969 - DNA, 23 bp, Homo sapiens
tctcagatgagagtttggactgt

SEQ ID NO: 123970 - DNA, 20 bp, Homo sapiens
atgggtcaggcacaaataag

SEQ ID NO: 123971 - DNA, 22 bp, Homo sapiens
acaaggtttcactctctctccc

SEQ ID NO: 123972 - DNA, 23 bp, Homo sapiens
tattctctctcaggcatatctct

SEQ ID NO: 123973 - DNA, 18 bp, Homo sapiens
atgtatatatatatatgt

SEQ ID NO: 123974 - DNA, 23 bp, Homo sapiens
attgtgtatgcttattttatgta

SEQ ID NO: 123975 - DNA, 23 bp, Homo sapiens
tattgtactggaggttgtacatg

SEQ ID NO: 123976 - DNA, 21 bp, Homo sapiens
tatcagaaaagaaaaactgta

SEQ ID NO: 123977 - DNA, 23 bp, Homo sapiens
tgagacggagtctcactctgtca

SEQ ID NO: 123978 - DNA, 18 bp, Homo sapiens
tgagagaagaactagaga

SEQ ID NO: 123979 - DNA, 18 bp, Homo sapiens
ttgaagaaaccgctttgt

SEQ ID NO: 123980 - DNA, 23 bp, Homo sapiens
ttctcacagagttaagcgtttct

SEQ ID NO: 123981 - DNA, 23 bp, Homo sapiens
aaactgcttcatgatgtgtgcat

SEQ ID NO: 123982 - DNA, 23 bp, Homo sapiens
ctcacagagagaaaagtttctct

SEQ ID NO: 123983 - DNA, 23 bp, Homo sapiens
tgttattctgtcagttattgaaa

SEQ ID NO: 123984 - DNA, 21 bp, Homo sapiens
atatgtatgtatgtatatgtg

SEQ ID NO: 123985 - DNA, 23 bp, Homo sapiens
tgtgtatatccttgtcaaatgca

SEQ ID NO: 123986 - DNA, 23 bp, Homo sapiens
actctgtcacccagactagagtg

SEQ ID NO: 123987 - DNA, 23 bp, Homo sapiens
tatgtgtatatatacatttgtac

SEQ ID NO: 123988 - DNA, 23 bp, Homo sapiens
tgaaatagtttcagcaaaagacc

SEQ ID NO: 123989 - DNA, 23 bp, Homo sapiens
tacacctgtggttcatgattatg

SEQ ID NO: 123990 - DNA, 22 bp, Homo sapiens
tagagaagagagtatgctctgc

SEQ ID NO: 123991 - DNA, 23 bp, Homo sapiens
tatgtctgtcatatatatgtata

SEQ ID NO: 123992 - DNA, 18 bp, Homo sapiens
agtgcagcagtgttattt

SEQ ID NO: 123993 - DNA, 23 bp, Homo sapiens
gtctgaagaaagtttgctcaccc

SEQ ID NO: 123994 - DNA, 19 bp, Homo sapiens
tagactgcattcaacactg

SEQ ID NO: 123995 - DNA, 23 bp, Homo sapiens
gtgtgtgtgtctgagtgtgttga

SEQ ID NO: 123996 - DNA, 23 bp, Homo sapiens
catttctctgagactcttgagtt

SEQ ID NO: 123997 - DNA, 23 bp, Homo sapiens
ttttcagtctcagattgataagt

SEQ ID NO: 123998 - DNA, 23 bp, Homo sapiens
acttttctgaatttgtttatcag

SEQ ID NO: 123999 - DNA, 20 bp, Homo sapiens
atgtgtatatatatatatgt

SEQ ID NO: 124000 - DNA, 23 bp, Homo sapiens
agtgtgtgtctgtctatctgtgt

SEQ ID NO: 124001 - DNA, 20 bp, Homo sapiens
atgactgctaatatcattgt

SEQ ID NO: 124002 - DNA, 21 bp, Homo sapiens
tgaggtagcaggatcacttga

SEQ ID NO: 124003 - DNA, 23 bp, Homo sapiens
tggagtctcactctgtcacccag

SEQ ID NO: 124004 - DNA, 23 bp, Homo sapiens
tcacactctctgatgttcatgca

SEQ ID NO: 124005 - DNA, 22 bp, Homo sapiens
tggtatcttgatggggatagca

SEQ ID NO: 124006 - DNA, 23 bp, Homo sapiens
tgagttcattgtagattctggat

SEQ ID NO: 124007 - DNA, 23 bp, Homo sapiens
tgagttcattgtagattctggat

SEQ ID NO: 124008 - DNA, 20 bp, Homo sapiens
aacatttgagtcagtgggct

SEQ ID NO: 124009 - DNA, 22 bp, Homo sapiens
ttcacacaagagtgtcagcaga

SEQ ID NO: 124010 - DNA, 23 bp, Homo sapiens
tgttctttttgcttaggattgtc

SEQ ID NO: 124011 - DNA, 23 bp, Homo sapiens
ttttgacgctgttaagtaccact

SEQ ID NO: 124012 - DNA, 23 bp, Homo sapiens
tgtaagtgcctgggagtgtcaat

SEQ ID NO: 124013 - DNA, 23 bp, Homo sapiens
tgctaatgattctgtgtatctct

SEQ ID NO: 124014 - DNA, 23 bp, Homo sapiens
cagagtctcactctgtcacttag

SEQ ID NO: 124015 - DNA, 18 bp, Homo sapiens
tataggtgcatgtatgga

SEQ ID NO: 124016 - DNA, 21 bp, Homo sapiens
agagcaggaagagagagggcc

SEQ ID NO: 124017 - DNA, 23 bp, Homo sapiens
catcacatctctctgtcactgtc

SEQ ID NO: 124018 - DNA, 23 bp, Homo sapiens
gggtctcactctgtcacccaggc

SEQ ID NO: 124019 - DNA, 23 bp, Homo sapiens
agatggagtctcgctctgtcact

SEQ ID NO: 124020 - DNA, 23 bp, Homo sapiens
tgagttcattgtagattctggat

SEQ ID NO: 124021 - DNA, 23 bp, Homo sapiens
tgagttcattgtagattctggat

SEQ ID NO: 124022 - DNA, 23 bp, Homo sapiens
attcttggtctgtcacaaatgag

SEQ ID NO: 124023 - DNA, 20 bp, Homo sapiens
tccgagtgggaatcctgagt

SEQ ID NO: 124024 - DNA, 21 bp, Homo sapiens
agataactctggcagcagtct

SEQ ID NO: 124025 - DNA, 22 bp, Homo sapiens
tgttagagcttctccatgtggt

SEQ ID NO: 124026 - DNA, 23 bp, Homo sapiens
aaagttcttcgttatcttttctt

SEQ ID NO: 124027 - DNA, 21 bp, Homo sapiens
taaaagggagaaaaagcagtt

SEQ ID NO: 124028 - DNA, 23 bp, Homo sapiens
tgtcagtgtttatctccatgtga

SEQ ID NO: 124029 - DNA, 23 bp, Homo sapiens
gtctgtctggataaccatgtgat

SEQ ID NO: 124030 - DNA, 23 bp, Homo sapiens
tggagtctcactctgtcacccag

SEQ ID NO: 124031 - DNA, 23 bp, Homo sapiens
cagagtctcactctgtcacccag

SEQ ID NO: 124032 - DNA, 20 bp, Homo sapiens
actgttctgagcacagtgct

SEQ ID NO: 124033 - DNA, 18 bp, Homo sapiens
acagtagggtttgcgctc

SEQ ID NO: 124034 - DNA, 23 bp, Homo sapiens
tggtctcactctgtcacccaggc

SEQ ID NO: 124035 - DNA, 19 bp, Homo sapiens
cagtggcatgatcatggct

SEQ ID NO: 124036 - DNA, 23 bp, Homo sapiens
atagggagtatagcttagtgcct

SEQ ID NO: 124037 - DNA, 18 bp, Homo sapiens
ttaaactctataaacctt

SEQ ID NO: 124038 - DNA, 23 bp, Homo sapiens
agtgcattaatttggagaaacta

SEQ ID NO: 124039 - DNA, 22 bp, Homo sapiens
ctctgtctcagtgtctgcttcc

SEQ ID NO: 124040 - DNA, 18 bp, Homo sapiens
cacaatgcttgcataatg

SEQ ID NO: 124041 - DNA, 23 bp, Homo sapiens
tagcctgttcatggctccctgtg

SEQ ID NO: 124042 - DNA, 23 bp, Homo sapiens
ggtagaacaggaggtggagtcag

SEQ ID NO: 124043 - DNA, 23 bp, Homo sapiens
tgagttcattgtagattctggat

SEQ ID NO: 124044 - DNA, 22 bp, Homo sapiens
ttcacagtctccctattatgtg

SEQ ID NO: 124045 - DNA, 19 bp, Homo sapiens
tgaggtagaagaatctcat

SEQ ID NO: 124046 - DNA, 20 bp, Homo sapiens
aacagggtggattggaagtt

SEQ ID NO: 124047 - DNA, 22 bp, Homo sapiens
cccagctgggatcacactcagt

SEQ ID NO: 124048 - DNA, 23 bp, Homo sapiens
cgagtctcagattgtaatatcct

SEQ ID NO: 124049 - DNA, 23 bp, Homo sapiens
tggcatgatcttggttcactgta

SEQ ID NO: 124050 - DNA, 23 bp, Homo sapiens
atctacctctgatactctctctc

SEQ ID NO: 124051 - DNA, 23 bp, Homo sapiens
tgtgctactctcagtctctgcct

SEQ ID NO: 124052 - DNA, 23 bp, Homo sapiens
ggcattttgttgttgactttctg

SEQ ID NO: 124053 - DNA, 23 bp, Homo sapiens
actctctcagccactgtttaggt

SEQ ID NO: 124054 - DNA, 23 bp, Homo sapiens
ctcagccagtggaatgtgaatgc

SEQ ID NO: 124055 - DNA, 23 bp, Homo sapiens
tctgctttgactctctctgtgtg

SEQ ID NO: 124056 - DNA, 20 bp, Homo sapiens
agctctgtgggctaccacca

SEQ ID NO: 124057 - DNA, 23 bp, Homo sapiens
tcactgggtcactctgtgctagc

SEQ ID NO: 124058 - DNA, 19 bp, Homo sapiens
tctttttgagaagcatagc

SEQ ID NO: 124059 - DNA, 19 bp, Homo sapiens
gtatgcacatatgtatgta

SEQ ID NO: 124060 - DNA, 22 bp, Homo sapiens
ttttacttgatttcttttgaag

SEQ ID NO: 124061 - DNA, 22 bp, Homo sapiens
atctcaatttttaaaattgtca

SEQ ID NO: 124062 - DNA, 22 bp, Homo sapiens
tgagagggagcagtcttggttt

SEQ ID NO: 124063 - DNA, 23 bp, Homo sapiens
acaggcttgcctttcttattgaa

SEQ ID NO: 124064 - DNA, 23 bp, Homo sapiens
tgagttcattgtagattctggat

SEQ ID NO: 124065 - DNA, 23 bp, Homo sapiens
tgagttcattgtagattctggat

SEQ ID NO: 124066 - DNA, 22 bp, Homo sapiens
aaaatgcatgtttactttaggg

SEQ ID NO: 124067 - DNA, 23 bp, Homo sapiens
agagtctcactctgtcacccagg

SEQ ID NO: 124068 - DNA, 19 bp, Homo sapiens
aacatgcatctagatgatg

SEQ ID NO: 124069 - DNA, 23 bp, Homo sapiens
tagagtggcatgatcctggctca

SEQ ID NO: 124070 - DNA, 23 bp, Homo sapiens
atgataaagatgctgctaacgat

SEQ ID NO: 124071 - DNA, 21 bp, Homo sapiens
ttgagctctctttgtataaca

SEQ ID NO: 124072 - DNA, 21 bp, Homo sapiens
aaagtgcttggattacaggca

SEQ ID NO: 124073 - DNA, 22 bp, Homo sapiens
ggcatgatggtgtgtacctgca

SEQ ID NO: 124074 - DNA, 23 bp, Homo sapiens
gacagagtctcgctctgtcaccc

SEQ ID NO: 124075 - DNA, 23 bp, Homo sapiens
acagagtctcgctctgtcaccca

SEQ ID NO: 124076 - DNA, 23 bp, Homo sapiens
aaggaaggatgactgaatgtatg

SEQ ID NO: 124077 - DNA, 23 bp, Homo sapiens
tttctctgtgagtctcagcctca

SEQ ID NO: 124078 - DNA, 22 bp, Homo sapiens
ctcaggctcagtctctcacggc

SEQ ID NO: 124079 - DNA, 23 bp, Homo sapiens
aaagtcaatggtagcttgatgga

SEQ ID NO: 124080 - DNA, 23 bp, Homo sapiens
ttttgtttttttgagacggtctc

SEQ ID NO: 124081 - DNA, 21 bp, Homo sapiens
tgaggttggaggatcatttga

SEQ ID NO: 124082 - DNA, 23 bp, Homo sapiens
gagacagagtctcactctgtcac

SEQ ID NO: 124083 - DNA, 23 bp, Homo sapiens
tgtctctgtcagtaatttaagcc

SEQ ID NO: 124084 - DNA, 23 bp, Homo sapiens
atcacagccagctaattttcata

SEQ ID NO: 124085 - DNA, 23 bp, Homo sapiens
atctttgacaagtgatttacaag

SEQ ID NO: 124086 - DNA, 18 bp, Homo sapiens
cagagacacagatggttg

SEQ ID NO: 124087 - DNA, 23 bp, Homo sapiens
agtgtatgtatttatctatctat

SEQ ID NO: 124088 - DNA, 20 bp, Homo sapiens
tatgtgcatgtgtgttctgt

SEQ ID NO: 124089 - DNA, 23 bp, Homo sapiens
ctgacaggagacagagctcaggt

SEQ ID NO: 124090 - DNA, 23 bp, Homo sapiens
tatcatctgcagctcaactcctg

SEQ ID NO: 124091 - DNA, 22 bp, Homo sapiens
ctcttgctggaggtgtgtcact

SEQ ID NO: 124092 - DNA, 23 bp, Homo sapiens
tatgtatagatgtatatatacgt

SEQ ID NO: 124093 - DNA, 23 bp, Homo sapiens
gtatagaggaagaagttgcatct

SEQ ID NO: 124094 - DNA, 23 bp, Homo sapiens
aacagtggagcagagtctggaag

SEQ ID NO: 124095 - DNA, 23 bp, Homo sapiens
tctctctgtgtctttttgtagtc

SEQ ID NO: 124096 - DNA, 23 bp, Homo sapiens
tgagttcattgtagattctggat

SEQ ID NO: 124097 - DNA, 23 bp, Homo sapiens
tgagttcattgtagattctggat

SEQ ID NO: 124098 - DNA, 23 bp, Homo sapiens
tgagttcattgtagattctggat

SEQ ID NO: 124099 - DNA, 23 bp, Homo sapiens
tgagttcattgtagattctggat

SEQ ID NO: 124100 - DNA, 21 bp, Homo sapiens
tcacactgtctctctaaaatg

SEQ ID NO: 124101 - DNA, 21 bp, Homo sapiens
taagccatagttatgtaatga

SEQ ID NO: 124102 - DNA, 18 bp, Homo sapiens
gaactgtattaagctata

SEQ ID NO: 124103 - DNA, 23 bp, Homo sapiens
tttgagacagagtttttgctcct

SEQ ID NO: 124104 - DNA, 19 bp, Homo sapiens
ggtgtgatcatggcttact

SEQ ID NO: 124105 - DNA, 23 bp, Homo sapiens
aatggagtctcactctgtcaccc

SEQ ID NO: 124106 - DNA, 23 bp, Homo sapiens
ttgagtactaagaagcagactca

SEQ ID NO: 124107 - DNA, 23 bp, Homo sapiens
tgtttgagtctcgctctgttgcc

SEQ ID NO: 124108 - DNA, 19 bp, Homo sapiens
tatagacaggaactgtggg

SEQ ID NO: 124109 - DNA, 23 bp, Homo sapiens
taacagtaaatctgattggcatg

SEQ ID NO: 124110 - DNA, 21 bp, Homo sapiens
tatgactgttaactatggtca

SEQ ID NO: 124111 - DNA, 23 bp, Homo sapiens
atagtatatgtatatgtatatgt

SEQ ID NO: 124112 - DNA, 22 bp, Homo sapiens
tacatatagtgtatgtatatgt

SEQ ID NO: 124113 - DNA, 21 bp, Homo sapiens
tgtgtacatatatgtgtgtgt

SEQ ID NO: 124114 - DNA, 23 bp, Homo sapiens
atatgtgtatgtgtatgtatata

SEQ ID NO: 124115 - DNA, 23 bp, Homo sapiens
taactgcatacaaatagagagag

SEQ ID NO: 124116 - DNA, 21 bp, Homo sapiens
atgtctgtctatttctctctc

SEQ ID NO: 124117 - DNA, 22 bp, Homo sapiens
tttatcagaaccagattaaggg

SEQ ID NO: 124118 - DNA, 23 bp, Homo sapiens
gtgctcagagtcactcagtgtgg

SEQ ID NO: 124119 - DNA, 23 bp, Homo sapiens
tcatcactgtgattcctgattgt

SEQ ID NO: 124120 - DNA, 23 bp, Homo sapiens
tgagttcattgtagattctggat

SEQ ID NO: 124121 - DNA, 23 bp, Homo sapiens
tgagttcattgtagattctggat

SEQ ID NO: 124122 - DNA, 23 bp, Homo sapiens
atgcagcaagttagtcagtctgt

SEQ ID NO: 124123 - DNA, 23 bp, Homo sapiens
agaaagacagtaatggcttggtg

SEQ ID NO: 124124 - DNA, 23 bp, Homo sapiens
ttctgttttgtctttggcattcc

SEQ ID NO: 124125 - DNA, 23 bp, Homo sapiens
ggggtcagaaaacagtgtggtca

SEQ ID NO: 124126 - DNA, 21 bp, Homo sapiens
tatgtgtatatacgtatatgt

SEQ ID NO: 124127 - DNA, 23 bp, Homo sapiens
aattggaactggatgacataggt

SEQ ID NO: 124128 - DNA, 20 bp, Homo sapiens
tgcaatggtgtgatctcagc

SEQ ID NO: 124129 - DNA, 23 bp, Homo sapiens
gtctggctgtgtctctcccacat

SEQ ID NO: 124130 - DNA, 18 bp, Homo sapiens
aagtcagagagggaagga

SEQ ID NO: 124131 - DNA, 23 bp, Homo sapiens
tctctgaagataatatttcttta

SEQ ID NO: 124132 - DNA, 21 bp, Homo sapiens
aaagtggtgattgtggtagta

SEQ ID NO: 124133 - DNA, 23 bp, Homo sapiens
tgtcagtctgagtgactggtctt

SEQ ID NO: 124134 - DNA, 23 bp, Homo sapiens
tccctcactctgtgcctctgtga

SEQ ID NO: 124135 - DNA, 23 bp, Homo sapiens
tgagttcattgtagattctggat

SEQ ID NO: 124136 - DNA, 23 bp, Homo sapiens
tgagttcattgtagattctggat

SEQ ID NO: 124137 - DNA, 23 bp, Homo sapiens
gtgtgtgtgtgtgtgtatacgta

SEQ ID NO: 124138 - DNA, 19 bp, Homo sapiens
atacatggtatacatgcac

SEQ ID NO: 124139 - DNA, 21 bp, Homo sapiens
agaatgttcataactatggct

SEQ ID NO: 124140 - DNA, 22 bp, Homo sapiens
tcacacgtgtatatatgtgtat

SEQ ID NO: 124141 - DNA, 23 bp, Homo sapiens
tgagttcattgtagattctggat

SEQ ID NO: 124142 - DNA, 23 bp, Homo sapiens
tgagttcattgtagattctggat

SEQ ID NO: 124143 - DNA, 19 bp, Homo sapiens
tatctatatgtatacatat

SEQ ID NO: 124144 - DNA, 22 bp, Homo sapiens
atgtatctgcatgtatacacat

SEQ ID NO: 124145 - DNA, 23 bp, Homo sapiens
actgagtctcactctgtcgccca

SEQ ID NO: 124146 - DNA, 23 bp, Homo sapiens
tctttcactgtcacaattttctc

SEQ ID NO: 124147 - DNA, 23 bp, Homo sapiens
tcttttgtgattccatatgaatt

SEQ ID NO: 124148 - DNA, 23 bp, Homo sapiens
tctcactgggatattgatgggaa

SEQ ID NO: 124149 - DNA, 23 bp, Homo sapiens
acccagtgcttaagtaagtgtat

SEQ ID NO: 124150 - DNA, 22 bp, Homo sapiens
tcactgcagtctctgtctcctg

SEQ ID NO: 124151 - DNA, 19 bp, Homo sapiens
agtgctgggattacaggcg

SEQ ID NO: 124152 - DNA, 23 bp, Homo sapiens
gtggcttacatctgtaatcccag

SEQ ID NO: 124153 - DNA, 23 bp, Homo sapiens
ttaagacagggtctggctctgtt

SEQ ID NO: 124154 - DNA, 23 bp, Homo sapiens
tgctgtgtcactgtcacccaggc

SEQ ID NO: 124155 - DNA, 23 bp, Homo sapiens
gttgttgttttgagacactgtct

SEQ ID NO: 124156 - DNA, 23 bp, Homo sapiens
ttccctttcagtctgtttctctc

SEQ ID NO: 124157 - DNA, 23 bp, Homo sapiens
gacagagtctcgctctgtcaccc

SEQ ID NO: 124158 - DNA, 18 bp, Homo sapiens
tgacagagtctcgctctc

SEQ ID NO: 124159 - DNA, 18 bp, Homo sapiens
tcactgcagccttgaatt

SEQ ID NO: 124160 - DNA, 23 bp, Homo sapiens
gacagagtctcgctctgtcaccc

SEQ ID NO: 124161 - DNA, 23 bp, Homo sapiens
tggagtctcactctgtcacccag

SEQ ID NO: 124162 - DNA, 21 bp, Homo sapiens
ttgagacagagtctcattctg

SEQ ID NO: 124163 - DNA, 18 bp, Homo sapiens
tgtgaactatatagctgt

SEQ ID NO: 124164 - DNA, 22 bp, Homo sapiens
tatatggattcataggttacag

SEQ ID NO: 124165 - DNA, 22 bp, Homo sapiens
ataccgggagacttaatgcagt

SEQ ID NO: 124166 - DNA, 23 bp, Homo sapiens
tcataaggatagaaaagaactat

SEQ ID NO: 124167 - DNA, 23 bp, Homo sapiens
gcagaagacagcaaagggttctg

SEQ ID NO: 124168 - DNA, 23 bp, Homo sapiens
tacatgtgcacaatgtgcaggtt

SEQ ID NO: 124169 - DNA, 20 bp, Homo sapiens
atatcatgcacacacattta

SEQ ID NO: 124170 - DNA, 23 bp, Homo sapiens
tgagttcattgtagattctggat

SEQ ID NO: 124171 - DNA, 23 bp, Homo sapiens
tgagttcattgtagattctggat

SEQ ID NO: 124172 - DNA, 18 bp, Homo sapiens
atagagtcttgctctgtt

SEQ ID NO: 124173 - DNA, 21 bp, Homo sapiens
agtgctaggattacaggcatg

SEQ ID NO: 124174 - DNA, 23 bp, Homo sapiens
attctctctgtcagtgtcatcag

SEQ ID NO: 124175 - DNA, 23 bp, Homo sapiens
tctctgcaagagaaatgtaaatg

SEQ ID NO: 124176 - DNA, 23 bp, Homo sapiens
ctttctgcagcgtctgcttcctg

SEQ ID NO: 124177 - DNA, 18 bp, Homo sapiens
tgtgaactatatagctgt

SEQ ID NO: 124178 - DNA, 22 bp, Homo sapiens
tatatggattcataggttacag

SEQ ID NO: 124179 - DNA, 23 bp, Homo sapiens
tcataaggatagaaaagaactat

SEQ ID NO: 124180 - DNA, 20 bp, Homo sapiens
atatcatgcacacacattta

SEQ ID NO: 124181 - DNA, 18 bp, Homo sapiens
tgacagagtctcgctctc

SEQ ID NO: 124182 - DNA, 18 bp, Homo sapiens
tcactgcagccttgaatt

SEQ ID NO: 124183 - DNA, 23 bp, Homo sapiens
gacagagtctcgctctgtcaccc

SEQ ID NO: 124184 - DNA, 23 bp, Homo sapiens
tggagtctcactctgtcacccag

SEQ ID NO: 124185 - DNA, 21 bp, Homo sapiens
ttgagacagagtctcattctg

SEQ ID NO: 124186 - DNA, 23 bp, Homo sapiens
tgagacagtctcactctgtcacc

SEQ ID NO: 124187 - DNA, 21 bp, Homo sapiens
ttgagacagagtctcattctg

SEQ ID NO: 124188 - DNA, 23 bp, Homo sapiens
tgagacagtctcactctgtcacc

SEQ ID NO: 124189 - DNA, 18 bp, Homo sapiens
tgtgaactatatagctgt

SEQ ID NO: 124190 - DNA, 22 bp, Homo sapiens
tatatggattcataggttacag

SEQ ID NO: 124191 - DNA, 22 bp, Homo sapiens
ataccgggagacttaatgcagt

SEQ ID NO: 124192 - DNA, 23 bp, Homo sapiens
tcataaggatagaaaagaactat

SEQ ID NO: 124193 - DNA, 23 bp, Homo sapiens
gcagaagacagcaaagggttctg

SEQ ID NO: 124194 - DNA, 23 bp, Homo sapiens
tacatgtgcacaatgtgcaggtt

SEQ ID NO: 124195 - DNA, 22 bp, Homo sapiens
tagctacatgatttgggtgaga

SEQ ID NO: 124196 - DNA, 22 bp, Homo sapiens
ctctgtcacccagactagaggg

SEQ ID NO: 124197 - DNA, 20 bp, Homo sapiens
atatcatgcacacacattta

SEQ ID NO: 124198 - DNA, 23 bp, Homo sapiens
tgagttcattgtagattctggat

SEQ ID NO: 124199 - DNA, 23 bp, Homo sapiens
tgagttcattgtagattctggat

SEQ ID NO: 124200 - DNA, 21 bp, Homo sapiens
agtgctaggattacaggcatg

SEQ ID NO: 124201 - DNA, 23 bp, Homo sapiens
attctctctgtcagtgtcatcag

SEQ ID NO: 124202 - DNA, 23 bp, Homo sapiens
tctctgcaagagaaatgtaaatg

SEQ ID NO: 124203 - DNA, 23 bp, Homo sapiens
ctttctgcagcgtctgcttcctg

SEQ ID NO: 124204 - DNA, 23 bp, Homo sapiens
attctctctgtcagtgtcatcag

SEQ ID NO: 124205 - DNA, 23 bp, Homo sapiens
tctctgcaagagaaatgtaaatg

SEQ ID NO: 124206 - DNA, 23 bp, Homo sapiens
ctttctgcagcgtctgcttcctg

SEQ ID NO: 124207 - DNA, 23 bp, Homo sapiens
tgagacagtctcactctgtcacc

SEQ ID NO: 124208 - DNA, 21 bp, Homo sapiens
ttgagacagagtctcattctg

SEQ ID NO: 124209 - DNA, 21 bp, Homo sapiens
ttgagacagagtctcattctg

SEQ ID NO: 124210 - DNA, 18 bp, Homo sapiens
tgtgaactatatagctgt

SEQ ID NO: 124211 - DNA, 22 bp, Homo sapiens
tatatggattcataggttacag

SEQ ID NO: 124212 - DNA, 18 bp, Homo sapiens
ttgacacctgattgtgtg

SEQ ID NO: 124213 - DNA, 23 bp, Homo sapiens
tacatgtgcacaatgtgcaggtt

SEQ ID NO: 124214 - DNA, 21 bp, Homo sapiens
tacacacacacatatacatgt

SEQ ID NO: 124215 - DNA, 22 bp, Homo sapiens
ataccgggagacttaatgcagt

SEQ ID NO: 124216 - DNA, 18 bp, Homo sapiens
atctgtgtatatgtgtat

SEQ ID NO: 124217 - DNA, 18 bp, Homo sapiens
tacatgcacagatatata

SEQ ID NO: 124218 - DNA, 19 bp, Homo sapiens
tatatacacatatacatat

SEQ ID NO: 124219 - DNA, 21 bp, Homo sapiens
tacactatatatgtatatgtg

SEQ ID NO: 124220 - DNA, 23 bp, Homo sapiens
tttatgctgtgataggaaggtga

SEQ ID NO: 124221 - DNA, 23 bp, Homo sapiens
gagaccgagtctcactctgtcac

SEQ ID NO: 124222 - DNA, 23 bp, Homo sapiens
ccgagtctcactctgtcacccag

SEQ ID NO: 124223 - DNA, 23 bp, Homo sapiens
tttgagacggagtctcactctgt

SEQ ID NO: 124224 - DNA, 23 bp, Homo sapiens
agtctgccacactgactgactct

SEQ ID NO: 124225 - DNA, 23 bp, Homo sapiens
actggctccctgactggtaggat

SEQ ID NO: 124226 - DNA, 23 bp, Homo sapiens
tgtttgtggcaggttgtattttc

SEQ ID NO: 124227 - DNA, 19 bp, Homo sapiens
agcacctacaatataccag

SEQ ID NO: 124228 - DNA, 23 bp, Homo sapiens
tggtgagtgaggacactgtgaag

SEQ ID NO: 124229 - DNA, 21 bp, Homo sapiens
gtatgtatgtatgtatgttga

SEQ ID NO: 124230 - DNA, 18 bp, Homo sapiens
ctccccaagaatggacag

SEQ ID NO: 124231 - DNA, 23 bp, Homo sapiens
tgacacaactttgtgaggtttct

SEQ ID NO: 124232 - DNA, 23 bp, Homo sapiens
tgatggagtctcactctgtcacc

SEQ ID NO: 124233 - DNA, 23 bp, Homo sapiens
gacagagtctcgctctgtcaccc

SEQ ID NO: 124234 - DNA, 23 bp, Homo sapiens
tagacactgtgtgagataataga

SEQ ID NO: 124235 - DNA, 23 bp, Homo sapiens
gatgacatacaaggttttatagt

SEQ ID NO: 124236 - DNA, 23 bp, Homo sapiens
tgaatgaagtttgtgtgcagaga

SEQ ID NO: 124237 - DNA, 23 bp, Homo sapiens
ttggtggttcagagaggacagag

SEQ ID NO: 124238 - DNA, 23 bp, Homo sapiens
agagtctcaccctgtctcccagg

SEQ ID NO: 124239 - DNA, 23 bp, Homo sapiens
agggtctcactctgtcactcagg

SEQ ID NO: 124240 - DNA, 22 bp, Homo sapiens
atggagctccctttggttacag

SEQ ID NO: 124241 - DNA, 23 bp, Homo sapiens
ttttctgattttgttgatcatct

SEQ ID NO: 124242 - DNA, 23 bp, Homo sapiens
ctgtgcttctgtgcctctgtctc

SEQ ID NO: 124243 - DNA, 23 bp, Homo sapiens
tggtttactttcctgatggtgga

SEQ ID NO: 124244 - DNA, 23 bp, Homo sapiens
acagaagagagtaaacacactcc

SEQ ID NO: 124245 - DNA, 22 bp, Homo sapiens
tgtcaagttgtcattttctcca

SEQ ID NO: 124246 - DNA, 23 bp, Homo sapiens
cactccgtggttggtggtctctt

SEQ ID NO: 124247 - DNA, 23 bp, Homo sapiens
tcaggtagttggttgatatcagt

SEQ ID NO: 124248 - DNA, 18 bp, Homo sapiens
tcaccgggtgttgaaatg

SEQ ID NO: 124249 - DNA, 23 bp, Homo sapiens
tgagttcattgtagattctggat

SEQ ID NO: 124250 - DNA, 23 bp, Homo sapiens
tgagttcattgtagattctggat

SEQ ID NO: 124251 - DNA, 20 bp, Homo sapiens
tgtatgcacataaacttgtg

SEQ ID NO: 124252 - DNA, 23 bp, Homo sapiens
ttagtagagacagtttcaccatg

SEQ ID NO: 124253 - DNA, 20 bp, Homo sapiens
tgcctctctgagtcactgcc

SEQ ID NO: 124254 - DNA, 21 bp, Homo sapiens
catgtgtgtgtgtgtgcacgc

SEQ ID NO: 124255 - DNA, 23 bp, Homo sapiens
tctcagactcagtttctcatcag

SEQ ID NO: 124256 - DNA, 23 bp, Homo sapiens
cggagtctcactctgtcacccag

SEQ ID NO: 124257 - DNA, 22 bp, Homo sapiens
cagacagggtgagttttgtcat

SEQ ID NO: 124258 - DNA, 23 bp, Homo sapiens
ttgggtgtgaaattgaatctgtg

SEQ ID NO: 124259 - DNA, 20 bp, Homo sapiens
cttcagtctgaaataccagt

SEQ ID NO: 124260 - DNA, 20 bp, Homo sapiens
ttaacagcttttggtggagt

SEQ ID NO: 124261 - DNA, 23 bp, Homo sapiens
tgagttcattgtagattctggat

SEQ ID NO: 124262 - DNA, 23 bp, Homo sapiens
tgagttcattgtagattctggat

SEQ ID NO: 124263 - DNA, 23 bp, Homo sapiens
tgagttcattgtagattctggat

SEQ ID NO: 124264 - DNA, 23 bp, Homo sapiens
tgagttcattgtagattctggat

SEQ ID NO: 124265 - DNA, 23 bp, Homo sapiens
tgtctcacacattgcaggatgtt

SEQ ID NO: 124266 - DNA, 18 bp, Homo sapiens
aactctatgaagaaagga

SEQ ID NO: 124267 - DNA, 23 bp, Homo sapiens
gggtctcactctgtcacccaggg

SEQ ID NO: 124268 - DNA, 23 bp, Homo sapiens
aggtgtcagtggaagatgccaag

SEQ ID NO: 124269 - DNA, 21 bp, Homo sapiens
atacacacacatatacatgca

SEQ ID NO: 124270 - DNA, 23 bp, Homo sapiens
atatgtgtatatatatgtgtgtg

SEQ ID NO: 124271 - DNA, 23 bp, Homo sapiens
agacagtctccctctgtcacccc

SEQ ID NO: 124272 - DNA, 18 bp, Homo sapiens
gtggagtgatctcagctc

SEQ ID NO: 124273 - DNA, 20 bp, Homo sapiens
ctgtggctttcctgctagtt

SEQ ID NO: 124274 - DNA, 19 bp, Homo sapiens
aaatgtgtgtatatctata

SEQ ID NO: 124275 - DNA, 23 bp, Homo sapiens
tgtgtgtatatatatatgtgtgt

SEQ ID NO: 124276 - DNA, 21 bp, Homo sapiens
atatagtatggctgctgattt

SEQ ID NO: 124277 - DNA, 23 bp, Homo sapiens
tacacaaatgttttagtttcctg

SEQ ID NO: 124278 - DNA, 23 bp, Homo sapiens
gtagcagctttagattactctta

SEQ ID NO: 124279 - DNA, 18 bp, Homo sapiens
aaggacctcagagagact

SEQ ID NO: 124280 - DNA, 23 bp, Homo sapiens
ctgtctgtctcactgcttgtcca

SEQ ID NO: 124281 - DNA, 20 bp, Homo sapiens
tatgtgtgtgtgtgtgtgta

SEQ ID NO: 124282 - DNA, 20 bp, Homo sapiens
atgtgaatctatatgtgaat

SEQ ID NO: 124283 - DNA, 23 bp, Homo sapiens
gacagagtctcactgtctcccag

SEQ ID NO: 124284 - DNA, 23 bp, Homo sapiens
aggttggaggatcatttgagcct

SEQ ID NO: 124285 - DNA, 18 bp, Homo sapiens
tcactgtagcctctgcct

SEQ ID NO: 124286 - DNA, 23 bp, Homo sapiens
atgtgtgtatatgtatatgtgtg

SEQ ID NO: 124287 - DNA, 21 bp, Homo sapiens
agcaagagccttcttcatgtg

SEQ ID NO: 124288 - DNA, 23 bp, Homo sapiens
tgagttcattgtagattctggat

SEQ ID NO: 124289 - DNA, 23 bp, Homo sapiens
tgagttcattgtagattctggat

SEQ ID NO: 124290 - DNA, 20 bp, Homo sapiens
aattgatctggagatgggct

SEQ ID NO: 124291 - DNA, 18 bp, Homo sapiens
atgagctgctgcacctgg

SEQ ID NO: 124292 - DNA, 23 bp, Homo sapiens
agacagtatctcactctgtcacc

SEQ ID NO: 124293 - DNA, 19 bp, Homo sapiens
tgtgtgtatatgtatatat

SEQ ID NO: 124294 - DNA, 21 bp, Homo sapiens
tgaggtaggaggatggattga

SEQ ID NO: 124295 - DNA, 23 bp, Homo sapiens
gagacagtgtctcactctgtccc

SEQ ID NO: 124296 - DNA, 21 bp, Homo sapiens
gagaggttggatggttgctgt

SEQ ID NO: 124297 - DNA, 23 bp, Homo sapiens
ccagtgactcaagaggttgaggt

SEQ ID NO: 124298 - DNA, 23 bp, Homo sapiens
agagtctcactctgtcacccagg

SEQ ID NO: 124299 - DNA, 23 bp, Homo sapiens
atagtgcaactaagtttcttttt

SEQ ID NO: 124300 - DNA, 23 bp, Homo sapiens
gggtctcactctgtcacccaggc

SEQ ID NO: 124301 - DNA, 23 bp, Homo sapiens
taaacatgtatatgtttagatag

SEQ ID NO: 124302 - DNA, 23 bp, Homo sapiens
atagatatacatgcacatgtata

SEQ ID NO: 124303 - DNA, 23 bp, Homo sapiens
ataaatatacatgcacatgtata

SEQ ID NO: 124304 - DNA, 19 bp, Homo sapiens
aatatgcacatgtatatgt

SEQ ID NO: 124305 - DNA, 18 bp, Homo sapiens
ttatacatgatatgagtt

SEQ ID NO: 124306 - DNA, 23 bp, Homo sapiens
acagagtctcactctgtcgccca

SEQ ID NO: 124307 - DNA, 18 bp, Homo sapiens
aagatgcacagtttttca

SEQ ID NO: 124308 - DNA, 21 bp, Homo sapiens
ttttaatctcttggaaatcag

SEQ ID NO: 124309 - DNA, 23 bp, Homo sapiens
tatgtatatgtacatgtatatgc

SEQ ID NO: 124310 - DNA, 19 bp, Homo sapiens
atacacgtatatatacgtg

SEQ ID NO: 124311 - DNA, 23 bp, Homo sapiens
tatagtatatatgtatatatgta

SEQ ID NO: 124312 - DNA, 21 bp, Homo sapiens
tacactatatatattgtgtgt

SEQ ID NO: 124313 - DNA, 22 bp, Homo sapiens
atgtgtatattgtatgtgtata

SEQ ID NO: 124314 - DNA, 23 bp, Homo sapiens
actgagtctcgctctgtcactca

SEQ ID NO: 124315 - DNA, 18 bp, Homo sapiens
tgtgaagaaagtcactgg

SEQ ID NO: 124316 - DNA, 23 bp, Homo sapiens
tgagttcattgtagattctggat

SEQ ID NO: 124317 - DNA, 23 bp, Homo sapiens
tgagttcattgtagattctggat

SEQ ID NO: 124318 - DNA, 23 bp, Homo sapiens
tgagttcattgtagattctggat

SEQ ID NO: 124319 - DNA, 23 bp, Homo sapiens
tgagttcattgtagattctggat

SEQ ID NO: 124320 - DNA, 23 bp, Homo sapiens
tgagttcattgtagattctggat

SEQ ID NO: 124321 - DNA, 23 bp, Homo sapiens
tgagttcattgtagattctggat

SEQ ID NO: 124322 - DNA, 19 bp, Homo sapiens
tgggagggtccctggatgg

SEQ ID NO: 124323 - DNA, 23 bp, Homo sapiens
ttacctagattcactgtttgaat

SEQ ID NO: 124324 - DNA, 23 bp, Homo sapiens
tgagttcattgtagattctggat

SEQ ID NO: 124325 - DNA, 23 bp, Homo sapiens
tgagttcattgtagattctggat

SEQ ID NO: 124326 - DNA, 23 bp, Homo sapiens
gtatttctgatgtttcactgggc

SEQ ID NO: 124327 - DNA, 18 bp, Homo sapiens
aagtggaatatttatgca

SEQ ID NO: 124328 - DNA, 23 bp, Homo sapiens
tatgcatatatgtatgtatatgt

SEQ ID NO: 124329 - DNA, 23 bp, Homo sapiens
atacgtatacatatgtatacata

SEQ ID NO: 124330 - DNA, 23 bp, Homo sapiens
atgtatgtttatgtgtatatgta

SEQ ID NO: 124331 - DNA, 23 bp, Homo sapiens
cggagtctcactctgtcacccag

SEQ ID NO: 124332 - DNA, 23 bp, Homo sapiens
acacgcactcagactctcctatt

SEQ ID NO: 124333 - DNA, 23 bp, Homo sapiens
tgagttcattgtagattctggat

SEQ ID NO: 124334 - DNA, 23 bp, Homo sapiens
tgagttcattgtagattctggat

SEQ ID NO: 124335 - DNA, 23 bp, Homo sapiens
tacactgctttactatatttgat

SEQ ID NO: 124336 - DNA, 19 bp, Homo sapiens
aatataggaagaaaatgta

SEQ ID NO: 124337 - DNA, 23 bp, Homo sapiens
tatgtgaatatatatgtgtgtgt

SEQ ID NO: 124338 - DNA, 19 bp, Homo sapiens
cagtggcatgatcttgact

SEQ ID NO: 124339 - DNA, 22 bp, Homo sapiens
acacgtatatatatgtatacat

SEQ ID NO: 124340 - DNA, 23 bp, Homo sapiens
tatgtgtgtgtatatgtatatat

SEQ ID NO: 124341 - DNA, 22 bp, Homo sapiens
tatgtgtgtatatatgtgtgta

SEQ ID NO: 124342 - DNA, 23 bp, Homo sapiens
taatgtgtatacatatatatgtg

SEQ ID NO: 124343 - DNA, 23 bp, Homo sapiens
tcaggtagctgctttgtgaggac

SEQ ID NO: 124344 - DNA, 21 bp, Homo sapiens
ctactagcttctgactctgaa

SEQ ID NO: 124345 - DNA, 21 bp, Homo sapiens
tctcagatgagactgttgact

SEQ ID NO: 124346 - DNA, 23 bp, Homo sapiens
tgagttcattgtagattctggat

SEQ ID NO: 124347 - DNA, 23 bp, Homo sapiens
tgagttcattgtagattctggat

SEQ ID NO: 124348 - DNA, 23 bp, Homo sapiens
tatagagagagagtgtaaaagcg

SEQ ID NO: 124349 - DNA, 23 bp, Homo sapiens
tctgtggttgttggatgaaatgt

SEQ ID NO: 124350 - DNA, 23 bp, Homo sapiens
tgagttcattgtagattctggat

SEQ ID NO: 124351 - DNA, 23 bp, Homo sapiens
tgagttcattgtagattctggat

SEQ ID NO: 124352 - DNA, 23 bp, Homo sapiens
gtatggatcatgctggcattggt

SEQ ID NO: 124353 - DNA, 23 bp, Homo sapiens
ataaaacatgatcatgatcacaa

SEQ ID NO: 124354 - DNA, 23 bp, Homo sapiens
aaggagaaagtatatgttgtgat

SEQ ID NO: 124355 - DNA, 23 bp, Homo sapiens
tctatcatctctgtgtgtgtgta

SEQ ID NO: 124356 - DNA, 18 bp, Homo sapiens
tgcatgtgtgtgtgtata

SEQ ID NO: 124357 - DNA, 22 bp, Homo sapiens
taattttctcatccaattgtag

SEQ ID NO: 124358 - DNA, 23 bp, Homo sapiens
tggagtctcactctgtcacccag

SEQ ID NO: 124359 - DNA, 23 bp, Homo sapiens
atgagtgccttctctggagcaat

SEQ ID NO: 124360 - DNA, 23 bp, Homo sapiens
acagagtctcactctgtcgccca

SEQ ID NO: 124361 - DNA, 23 bp, Homo sapiens
gagattgagtctcactctgtcgc

SEQ ID NO: 124362 - DNA, 23 bp, Homo sapiens
tgagatggagtctcactctgtca

SEQ ID NO: 124363 - DNA, 23 bp, Homo sapiens
tggagtctcactctgtcacccag

SEQ ID NO: 124364 - DNA, 23 bp, Homo sapiens
tctaattctgtgaggaatgtcaa

SEQ ID NO: 124365 - DNA, 22 bp, Homo sapiens
tcccaagtagctggcattacag

SEQ ID NO: 124366 - DNA, 22 bp, Homo sapiens
gtttcaccatgttggccaggct

SEQ ID NO: 124367 - DNA, 23 bp, Homo sapiens
tccctcagtgttctgggtgaggt

SEQ ID NO: 124368 - DNA, 23 bp, Homo sapiens
actgacagactgaaaagctacaa

SEQ ID NO: 124369 - DNA, 19 bp, Homo sapiens
tctgcaccctgtctcttta

SEQ ID NO: 124370 - DNA, 23 bp, Homo sapiens
tcccagtctcacacttcactcta

SEQ ID NO: 124371 - DNA, 23 bp, Homo sapiens
gacagagtctcactctgtcaccc

SEQ ID NO: 124372 - DNA, 21 bp, Homo sapiens
ccaacgcattgttcactggcc

SEQ ID NO: 124373 - DNA, 23 bp, Homo sapiens
atagttgtacaagctgttgactg

SEQ ID NO: 124374 - DNA, 23 bp, Homo sapiens
gggtctcactctgtcacccaggc

SEQ ID NO: 124375 - DNA, 22 bp, Homo sapiens
tttcggttatctagctttatga

SEQ ID NO: 124376 - DNA, 23 bp, Homo sapiens
atacagctagataaccaaagata

SEQ ID NO: 124377 - DNA, 22 bp, Homo sapiens
ttatgtgttttcatgcagtctg

SEQ ID NO: 124378 - DNA, 23 bp, Homo sapiens
attcaagacagtctgctgacgtg

SEQ ID NO: 124379 - DNA, 21 bp, Homo sapiens
tttatgggactgaatgatttg

SEQ ID NO: 124380 - DNA, 23 bp, Homo sapiens
ttattcttgaaattgatatctat

SEQ ID NO: 124381 - DNA, 22 bp, Homo sapiens
ttagagtgtgcatgagttgaga

SEQ ID NO: 124382 - DNA, 23 bp, Homo sapiens
tctgagccagagatagagaagtt

SEQ ID NO: 124383 - DNA, 19 bp, Homo sapiens
aagcgggtgtagaatagtt

SEQ ID NO: 124384 - DNA, 20 bp, Homo sapiens
tgtatacatatatatgtgtg

SEQ ID NO: 124385 - DNA, 23 bp, Homo sapiens
tgagttcattgtagattctggat

SEQ ID NO: 124386 - DNA, 23 bp, Homo sapiens
atggagtctcactctgtcaccca

SEQ ID NO: 124387 - DNA, 19 bp, Homo sapiens
agtagtgcgatctcagctc

SEQ ID NO: 124388 - DNA, 23 bp, Homo sapiens
tgagttcattgtagattctggat

SEQ ID NO: 124389 - DNA, 23 bp, Homo sapiens
tgagttcattgtagattctggat

SEQ ID NO: 124390 - DNA, 23 bp, Homo sapiens
atgtgctgttgaatatggtttgt

SEQ ID NO: 124391 - DNA, 23 bp, Homo sapiens
tcgatgtttatcaaggatactgt

SEQ ID NO: 124392 - DNA, 23 bp, Homo sapiens
tagctgttgatagaagttagtga

SEQ ID NO: 124393 - DNA, 19 bp, Homo sapiens
catcaacttccccaagcag

SEQ ID NO: 124394 - DNA, 23 bp, Homo sapiens
agagtctcactctgtcacccagg

SEQ ID NO: 124395 - DNA, 18 bp, Homo sapiens
tgagcctgtgagatggtg

SEQ ID NO: 124396 - DNA, 18 bp, Homo sapiens
atagtctggattttactt

SEQ ID NO: 124397 - DNA, 22 bp, Homo sapiens
agtgtctgactggaatggataa

SEQ ID NO: 124398 - DNA, 23 bp, Homo sapiens
agacttctgacactctcaggacc

SEQ ID NO: 124399 - DNA, 23 bp, Homo sapiens
gttaacagaggattttggtgata

SEQ ID NO: 124400 - DNA, 23 bp, Homo sapiens
tgagttcattgtagattctggat

SEQ ID NO: 124401 - DNA, 23 bp, Homo sapiens
tgagttcattgtagattctggat

SEQ ID NO: 124402 - DNA, 21 bp, Homo sapiens
ttgaactactgggtgctagct

SEQ ID NO: 124403 - DNA, 18 bp, Homo sapiens
aagtataagttccagaaa

SEQ ID NO: 124404 - DNA, 23 bp, Homo sapiens
tatcacagtgcttttttggtctg

SEQ ID NO: 124405 - DNA, 23 bp, Homo sapiens
ggttttcacagtggctgaactaa

SEQ ID NO: 124406 - DNA, 22 bp, Homo sapiens
tatacgtgtatatatgtatgta

SEQ ID NO: 124407 - DNA, 23 bp, Homo sapiens
gaagctttgtacagagtagagtt

SEQ ID NO: 124408 - DNA, 23 bp, Homo sapiens
gactgagtctcgctctgtcaccc

SEQ ID NO: 124409 - DNA, 21 bp, Homo sapiens
tatcacagccttctccctgtg

SEQ ID NO: 124410 - DNA, 21 bp, Homo sapiens
ttgaatagtttccatatatat

SEQ ID NO: 124411 - DNA, 19 bp, Homo sapiens
atattccatatctatatat

SEQ ID NO: 124412 - DNA, 23 bp, Homo sapiens
ggagtctcacactgtcacccagg

SEQ ID NO: 124413 - DNA, 18 bp, Homo sapiens
acacaggttggtagctga

SEQ ID NO: 124414 - DNA, 21 bp, Homo sapiens
gagatttctatggcttatgat

SEQ ID NO: 124415 - DNA, 19 bp, Homo sapiens
tctgtctctgtcagggcca

SEQ ID NO: 124416 - DNA, 20 bp, Homo sapiens
aacactgtgtcagatgatgg

SEQ ID NO: 124417 - DNA, 19 bp, Homo sapiens
actgcagtgagccatgatc

SEQ ID NO: 124418 - DNA, 23 bp, Homo sapiens
cggagtctcgctctgtctcccag

SEQ ID NO: 124419 - DNA, 18 bp, Homo sapiens
tgaaatgtggatgttctt

SEQ ID NO: 124420 - DNA, 20 bp, Homo sapiens
acagcaagcatgaaactctg

SEQ ID NO: 124421 - DNA, 23 bp, Homo sapiens
aaggacaagtctcaaacaggcac

SEQ ID NO: 124422 - DNA, 19 bp, Homo sapiens
gaattcatgtttgggtgag

SEQ ID NO: 124423 - DNA, 23 bp, Homo sapiens
aggtctgtgataatcctgttagt

SEQ ID NO: 124424 - DNA, 19 bp, Homo sapiens
actgtggcagtgactcagg

SEQ ID NO: 124425 - DNA, 21 bp, Homo sapiens
tcacatgaagatgtgggcttg

SEQ ID NO: 124426 - DNA, 19 bp, Homo sapiens
aggtgggtacagtggggga

SEQ ID NO: 124427 - DNA, 22 bp, Homo sapiens
tggcgtgatcttggctcactgc

SEQ ID NO: 124428 - DNA, 23 bp, Homo sapiens
atatgtatatatgtgcatgtgta

SEQ ID NO: 124429 - DNA, 23 bp, Homo sapiens
tgaatttgaagaagtgtggttgt

SEQ ID NO: 124430 - DNA, 23 bp, Homo sapiens
agtccatggagcttaccatcttg

SEQ ID NO: 124431 - DNA, 23 bp, Homo sapiens
tgagttcattgtagattctggat

SEQ ID NO: 124432 - DNA, 23 bp, Homo sapiens
tgagttcattgtagattctggat

SEQ ID NO: 124433 - DNA, 23 bp, Homo sapiens
tgagttcattgtagattctggat

SEQ ID NO: 124434 - DNA, 23 bp, Homo sapiens
tgagttcattgtagattctggat

SEQ ID NO: 124435 - DNA, 22 bp, Homo sapiens
tctacaaggactatgtcttctt

SEQ ID NO: 124436 - DNA, 23 bp, Homo sapiens
taatctttatttgttaatctgaa

SEQ ID NO: 124437 - DNA, 19 bp, Homo sapiens
tcagagagaagtatagagt

SEQ ID NO: 124438 - DNA, 22 bp, Homo sapiens
tatatatatatatgtacatgtg

SEQ ID NO: 124439 - DNA, 23 bp, Homo sapiens
tgagttcattgtagattctggat

SEQ ID NO: 124440 - DNA, 23 bp, Homo sapiens
tgagttcattgtagattctggat

SEQ ID NO: 124441 - DNA, 23 bp, Homo sapiens
catggtgttggtgtgtcagtgag

SEQ ID NO: 124442 - DNA, 23 bp, Homo sapiens
gtttgaggtgttggagcagaatt

SEQ ID NO: 124443 - DNA, 23 bp, Homo sapiens
tgagttcattgtagattctggat

SEQ ID NO: 124444 - DNA, 23 bp, Homo sapiens
tgagttcattgtagattctggat

SEQ ID NO: 124445 - DNA, 23 bp, Homo sapiens
tctactatgcttttctaatcctg

SEQ ID NO: 124446 - DNA, 20 bp, Homo sapiens
tctttgggagcatgtgtttg

SEQ ID NO: 124447 - DNA, 19 bp, Homo sapiens
agagcataagaatagactt

SEQ ID NO: 124448 - DNA, 21 bp, Homo sapiens
tgtgaatatatttgtatgtga

SEQ ID NO: 124449 - DNA, 19 bp, Homo sapiens
agagagaagtgtctgagca

SEQ ID NO: 124450 - DNA, 19 bp, Homo sapiens
atgctaatctctgtgatta

SEQ ID NO: 124451 - DNA, 20 bp, Homo sapiens
atgacatatgtatatgtgta

SEQ ID NO: 124452 - DNA, 23 bp, Homo sapiens
gtatatgtatatgtatacatgta

SEQ ID NO: 124453 - DNA, 21 bp, Homo sapiens
aaggcaggcacacacaggcac

SEQ ID NO: 124454 - DNA, 20 bp, Homo sapiens
accatgtgtgtatatatata

SEQ ID NO: 124455 - DNA, 23 bp, Homo sapiens
tcattgtgctagcatttgatttg

SEQ ID NO: 124456 - DNA, 22 bp, Homo sapiens
tgtgtgtgtatatatatatatg

SEQ ID NO: 124457 - DNA, 21 bp, Homo sapiens
tgtgtatgtatgtatgtatgt

SEQ ID NO: 124458 - DNA, 23 bp, Homo sapiens
taaggaacttgaagcatagaagt

SEQ ID NO: 124459 - DNA, 23 bp, Homo sapiens
ctcagaccctgtgtctgtcttct

SEQ ID NO: 124460 - DNA, 23 bp, Homo sapiens
aaatctcatttagatgtagtact

SEQ ID NO: 124461 - DNA, 23 bp, Homo sapiens
agagtctcactctgtcactcagg

SEQ ID NO: 124462 - DNA, 23 bp, Homo sapiens
atgtgtgtgtatgcatgtgtgtg

SEQ ID NO: 124463 - DNA, 22 bp, Homo sapiens
tagtcaggttttgtagtcagat

SEQ ID NO: 124464 - DNA, 23 bp, Homo sapiens
tggagtctcactctgtcacccag

SEQ ID NO: 124465 - DNA, 20 bp, Homo sapiens
aggcatgagattggataacg

SEQ ID NO: 124466 - DNA, 21 bp, Homo sapiens
ttgaagtgcaataacatgatc

SEQ ID NO: 124467 - DNA, 21 bp, Homo sapiens
atgacagtagaaagtgaacac

SEQ ID NO: 124468 - DNA, 22 bp, Homo sapiens
ggtactgctttttcattccaaa

SEQ ID NO: 124469 - DNA, 23 bp, Homo sapiens
ttgtgtatatgtatgggtgtgtg

SEQ ID NO: 124470 - DNA, 18 bp, Homo sapiens
tatgcatatatatgtgta

SEQ ID NO: 124471 - DNA, 21 bp, Homo sapiens
tatatctacatatacttatgt

SEQ ID NO: 124472 - DNA, 21 bp, Homo sapiens
tatatctacatatacttatgt

SEQ ID NO: 124473 - DNA, 18 bp, Homo sapiens
ggtaggtgtgtgtatgca

SEQ ID NO: 124474 - DNA, 22 bp, Homo sapiens
gtttatatgtacatatacatat

SEQ ID NO: 124475 - DNA, 23 bp, Homo sapiens
tgtgtatatatatatgtgtgtgt

SEQ ID NO: 124476 - DNA, 21 bp, Homo sapiens
ctcagaggttgctgttaccat

SEQ ID NO: 124477 - DNA, 21 bp, Homo sapiens
tcagtccaagagaatgggcct

SEQ ID NO: 124478 - DNA, 23 bp, Homo sapiens
aagacaagagtgagagctttctg

SEQ ID NO: 124479 - DNA, 23 bp, Homo sapiens
gtagagtagaatgctgatagctt

SEQ ID NO: 124480 - DNA, 22 bp, Homo sapiens
tctctgaatttatttatttgag

SEQ ID NO: 124481 - DNA, 23 bp, Homo sapiens
aactgatgaatgaattcagtaaa

SEQ ID NO: 124482 - DNA, 23 bp, Homo sapiens
atatatacacaatggaatgctac

SEQ ID NO: 124483 - DNA, 23 bp, Homo sapiens
tgtgtctgtatgtatatatgtgt

SEQ ID NO: 124484 - DNA, 23 bp, Homo sapiens
acacatgtgtttatgtttatatg

SEQ ID NO: 124485 - DNA, 23 bp, Homo sapiens
tctgtgtgtgcatgagcagctga

SEQ ID NO: 124486 - DNA, 23 bp, Homo sapiens
atggtatatatatggtgtgtgtg

SEQ ID NO: 124487 - DNA, 23 bp, Homo sapiens
agtgagtcagatttggcttgtaa

SEQ ID NO: 124488 - DNA, 23 bp, Homo sapiens
ttccaggacattttggcttgaga

SEQ ID NO: 124489 - DNA, 23 bp, Homo sapiens
aaaacatgaattggatactgggt

SEQ ID NO: 124490 - DNA, 23 bp, Homo sapiens
cggagtctcactctgtcacccag

SEQ ID NO: 124491 - DNA, 23 bp, Homo sapiens
acaagagtctcactctgtcaccc

SEQ ID NO: 124492 - DNA, 22 bp, Homo sapiens
tacttgggagatgtttagttgt

SEQ ID NO: 124493 - DNA, 23 bp, Homo sapiens
cttttcactcagttttccatggc

SEQ ID NO: 124494 - DNA, 23 bp, Homo sapiens
atgtatgactggatgtgttttct

SEQ ID NO: 124495 - DNA, 23 bp, Homo sapiens
atatgtgtcatgttggtgtgatg

SEQ ID NO: 124496 - DNA, 23 bp, Homo sapiens
atctatccatgtgtgtgtgtgtg

SEQ ID NO: 124497 - DNA, 20 bp, Homo sapiens
gtctcactatgtcactcagg

SEQ ID NO: 124498 - DNA, 23 bp, Homo sapiens
tgagttcattgtagattctggat

SEQ ID NO: 124499 - DNA, 23 bp, Homo sapiens
tgagttcattgtagattctggat

SEQ ID NO: 124500 - DNA, 19 bp, Homo sapiens
tattgttatacagtatatg

SEQ ID NO: 124501 - DNA, 20 bp, Homo sapiens
tgtatgtgtgtgtatgtata

SEQ ID NO: 124502 - DNA, 23 bp, Homo sapiens
ataatagttgaactccatctcaa

SEQ ID NO: 124503 - DNA, 23 bp, Homo sapiens
gggtctcactctgtcactcaggc

SEQ ID NO: 124504 - DNA, 23 bp, Homo sapiens
tgagttcattgtagattctggat

SEQ ID NO: 124505 - DNA, 23 bp, Homo sapiens
tgagttcattgtagattctggat

SEQ ID NO: 124506 - DNA, 23 bp, Homo sapiens
tgtgtataaatctctgtcagtta

SEQ ID NO: 124507 - DNA, 21 bp, Homo sapiens
cacaggtgtatgtgtgtgtgt

SEQ ID NO: 124508 - DNA, 19 bp, Homo sapiens
agtcctctgcacaatggtt

SEQ ID NO: 124509 - DNA, 19 bp, Homo sapiens
tagctacatatacatatgt

SEQ ID NO: 124510 - DNA, 20 bp, Homo sapiens
tatatctgtgtacatatgtg

SEQ ID NO: 124511 - DNA, 23 bp, Homo sapiens
tgagttcattgtagattctggat

SEQ ID NO: 124512 - DNA, 23 bp, Homo sapiens
tgagttcattgtagattctggat

SEQ ID NO: 124513 - DNA, 19 bp, Homo sapiens
taaagtggtataagtatat

SEQ ID NO: 124514 - DNA, 23 bp, Homo sapiens
tgagttcattgtagattctggat

SEQ ID NO: 124515 - DNA, 23 bp, Homo sapiens
tgagttcattgtagattctggat

SEQ ID NO: 124516 - DNA, 23 bp, Homo sapiens
tgagttcattgtagattctggat

SEQ ID NO: 124517 - DNA, 23 bp, Homo sapiens
tgagttcattgtagattctggat

SEQ ID NO: 124518 - DNA, 20 bp, Homo sapiens
tgtgtataaatacatgtgtg

SEQ ID NO: 124519 - DNA, 23 bp, Homo sapiens
tatacatacattatgtatgcata

SEQ ID NO: 124520 - DNA, 23 bp, Homo sapiens
tatgtatatatgtatgtttccac

SEQ ID NO: 124521 - DNA, 19 bp, Homo sapiens
tatatgtatatatgtgtat

SEQ ID NO: 124522 - DNA, 19 bp, Homo sapiens
atatgtgtgtatgtatata

SEQ ID NO: 124523 - DNA, 23 bp, Homo sapiens
tgactctttgtgactgtgtcatt

SEQ ID NO: 124524 - DNA, 19 bp, Homo sapiens
gtgtgagtgtgtgatcggg

SEQ ID NO: 124525 - DNA, 19 bp, Homo sapiens
tagtaaaacatgctgtaaa

SEQ ID NO: 124526 - DNA, 21 bp, Homo sapiens
acacaggcagagtcaatttag

SEQ ID NO: 124527 - DNA, 23 bp, Homo sapiens
aatactgtgttgttcagaaaaga

SEQ ID NO: 124528 - DNA, 23 bp, Homo sapiens
cagggtctcactctgtcacttag

SEQ ID NO: 124529 - DNA, 23 bp, Homo sapiens
tgagttcattgtagattctggat

SEQ ID NO: 124530 - DNA, 23 bp, Homo sapiens
tgagttcattgtagattctggat

SEQ ID NO: 124531 - DNA, 19 bp, Homo sapiens
ctgacttctgtctgagcac

SEQ ID NO: 124532 - DNA, 23 bp, Homo sapiens
tatctatctatagatatgtagat

SEQ ID NO: 124533 - DNA, 22 bp, Homo sapiens
taagttatctaagagatgtgct

SEQ ID NO: 124534 - DNA, 18 bp, Homo sapiens
gagttgtgttattgtttg

SEQ ID NO: 124535 - DNA, 23 bp, Homo sapiens
tgagttcattgtagattctggat

SEQ ID NO: 124536 - DNA, 23 bp, Homo sapiens
tgagttcattgtagattctggat

SEQ ID NO: 124537 - DNA, 19 bp, Homo sapiens
tatgtatatgtatacatat

SEQ ID NO: 124538 - DNA, 23 bp, Homo sapiens
tgtatgtatgtatacatgcatac

SEQ ID NO: 124539 - DNA, 22 bp, Homo sapiens
ttacagtgatgagtgagtgctc

SEQ ID NO: 124540 - DNA, 18 bp, Homo sapiens
agttccttgatgagggga

SEQ ID NO: 124541 - DNA, 23 bp, Homo sapiens
gtgataagagagtgttcagtggg

SEQ ID NO: 124542 - DNA, 23 bp, Homo sapiens
actgggtcaggaagagctctgta

SEQ ID NO: 124543 - DNA, 19 bp, Homo sapiens
tgtatacatattctatgta

SEQ ID NO: 124544 - DNA, 19 bp, Homo sapiens
tgtatacatattctatgta

SEQ ID NO: 124545 - DNA, 23 bp, Homo sapiens
tgtatttgtatacatattctatg

SEQ ID NO: 124546 - DNA, 18 bp, Homo sapiens
ctgcaggaagaaacctgt

SEQ ID NO: 124547 - DNA, 21 bp, Homo sapiens
ttatatgtatatatgtataca

SEQ ID NO: 124548 - DNA, 21 bp, Homo sapiens
tattgtgagagaaaatgtttt

SEQ ID NO: 124549 - DNA, 19 bp, Homo sapiens
tcacaggaaactaatacag

SEQ ID NO: 124550 - DNA, 23 bp, Homo sapiens
agagtctcactctgtcacccagg

SEQ ID NO: 124551 - DNA, 23 bp, Homo sapiens
tgtgaagaaagtcaatggtagct

SEQ ID NO: 124552 - DNA, 23 bp, Homo sapiens
cagagtctcacactgtcacccag

SEQ ID NO: 124553 - DNA, 23 bp, Homo sapiens
tggagtctcactctgtcacccag

SEQ ID NO: 124554 - DNA, 23 bp, Homo sapiens
tatatgatccttttaatatgtat

SEQ ID NO: 124555 - DNA, 23 bp, Homo sapiens
tattgaggatttttacatctgtg

SEQ ID NO: 124556 - DNA, 23 bp, Homo sapiens
gtctttgatatctgtttttagtg

SEQ ID NO: 124557 - DNA, 23 bp, Homo sapiens
aatttttctaattgatttcatga

SEQ ID NO: 124558 - DNA, 22 bp, Homo sapiens
tgccacacacatacctgggaca

SEQ ID NO: 124559 - DNA, 21 bp, Homo sapiens
agtgagaaaagacgatctgca

SEQ ID NO: 124560 - DNA, 23 bp, Homo sapiens
ttgctattatgtttggtataaaa

SEQ ID NO: 124561 - DNA, 23 bp, Homo sapiens
agtctgcaagaattattagtcat

SEQ ID NO: 124562 - DNA, 21 bp, Homo sapiens
ttttgtttgtacttaccttga

SEQ ID NO: 124563 - DNA, 21 bp, Homo sapiens
ataagcttttagagcactgtg

SEQ ID NO: 124564 - DNA, 23 bp, Homo sapiens
agacttttgtaattgtagttcta

SEQ ID NO: 124565 - DNA, 21 bp, Homo sapiens
aatctcagtgggacatcaaat

SEQ ID NO: 124566 - DNA, 23 bp, Homo sapiens
aaatggtatgatggaactccctg

SEQ ID NO: 124567 - DNA, 23 bp, Homo sapiens
tgagttcattgtagattctggat

SEQ ID NO: 124568 - DNA, 23 bp, Homo sapiens
tgagttcattgtagattctggat

SEQ ID NO: 124569 - DNA, 19 bp, Homo sapiens
attgtggatgggagttcat

SEQ ID NO: 124570 - DNA, 23 bp, Homo sapiens
tgagttcattgtagattctggat

SEQ ID NO: 124571 - DNA, 23 bp, Homo sapiens
tgagttcattgtagattctggat

SEQ ID NO: 124572 - DNA, 23 bp, Homo sapiens
ctcccagagcccctggaactctg

SEQ ID NO: 124573 - DNA, 23 bp, Homo sapiens
tcccagagcccctggaactctgg

SEQ ID NO: 124574 - DNA, 23 bp, Homo sapiens
tcccagagcccctggaactctgg

SEQ ID NO: 124575 - DNA, 23 bp, Homo sapiens
tcccagagcccctggaactctgg

SEQ ID NO: 124576 - DNA, 23 bp, Homo sapiens
tgccttgatgatctctctgtcag

SEQ ID NO: 124577 - DNA, 19 bp, Homo sapiens
agtgtacagggttcccttt

SEQ ID NO: 124578 - DNA, 23 bp, Homo sapiens
cagggtctcactctgtcacccag

SEQ ID NO: 124579 - DNA, 22 bp, Homo sapiens
atatgttctgagaaatgagttg

SEQ ID NO: 124580 - DNA, 22 bp, Homo sapiens
aagtacatgactgcgtgtgtgt

SEQ ID NO: 124581 - DNA, 22 bp, Homo sapiens
tgtgtatatatgtatatatgtg

SEQ ID NO: 124582 - DNA, 23 bp, Homo sapiens
tgagttcattgtagattctggat

SEQ ID NO: 124583 - DNA, 23 bp, Homo sapiens
tgagttcattgtagattctggat

SEQ ID NO: 124584 - DNA, 23 bp, Homo sapiens
tgagttcattgtagattctggat

SEQ ID NO: 124585 - DNA, 23 bp, Homo sapiens
tgagttcattgtagattctggat

SEQ ID NO: 124586 - DNA, 23 bp, Homo sapiens
gagccctgtctctttctctctgt

SEQ ID NO: 124587 - DNA, 22 bp, Homo sapiens
aaatgtgtttttatttatctga

SEQ ID NO: 124588 - DNA, 23 bp, Homo sapiens
tatatgtatgtgtatatgtatgt

SEQ ID NO: 124589 - DNA, 23 bp, Homo sapiens
tgagttcattgtagattctggat

SEQ ID NO: 124590 - DNA, 23 bp, Homo sapiens
tgagttcattgtagattctggat

SEQ ID NO: 124591 - DNA, 23 bp, Homo sapiens
tgagttcattgtagattctggat

SEQ ID NO: 124592 - DNA, 23 bp, Homo sapiens
tgagttcattgtagattctggat

SEQ ID NO: 124593 - DNA, 20 bp, Homo sapiens
tctcagatgagactgtggac

SEQ ID NO: 124594 - DNA, 20 bp, Homo sapiens
tattacgaagatatcacata

SEQ ID NO: 124595 - DNA, 23 bp, Homo sapiens
acagcaagttgctgtgtctgaat

SEQ ID NO: 124596 - DNA, 23 bp, Homo sapiens
atggcaaatgtttgaagtgtggg

SEQ ID NO: 124597 - DNA, 23 bp, Homo sapiens
tgagttcattgtagattctggat

SEQ ID NO: 124598 - DNA, 23 bp, Homo sapiens
tgagttcattgtagattctggat

SEQ ID NO: 124599 - DNA, 22 bp, Homo sapiens
ttaatggttgtcaaaagcctgt

SEQ ID NO: 124600 - DNA, 18 bp, Homo sapiens
tactttctatatgtgtat

SEQ ID NO: 124601 - DNA, 22 bp, Homo sapiens
ttcttcaggcaataagaagagt

SEQ ID NO: 124602 - DNA, 23 bp, Homo sapiens
tctgtgaacagtgtgtccacatt

SEQ ID NO: 124603 - DNA, 20 bp, Homo sapiens
aaaaggagattagagttacc

SEQ ID NO: 124604 - DNA, 22 bp, Homo sapiens
ttgaaggaaataaaatgtgaaa

SEQ ID NO: 124605 - DNA, 23 bp, Homo sapiens
tttgaattacattttctttacct

SEQ ID NO: 124606 - DNA, 21 bp, Homo sapiens
tcactgcagcctctgtctccc

SEQ ID NO: 124607 - DNA, 23 bp, Homo sapiens
cgatcacactgaccagacaaggc

SEQ ID NO: 124608 - DNA, 19 bp, Homo sapiens
acagcagactgagctgaca

SEQ ID NO: 124609 - DNA, 23 bp, Homo sapiens
tgagttcattgtagattctggat

SEQ ID NO: 124610 - DNA, 23 bp, Homo sapiens
tgagttcattgtagattctggat

SEQ ID NO: 124611 - DNA, 19 bp, Homo sapiens
tcatacctgtagtcccagc

SEQ ID NO: 124612 - DNA, 22 bp, Homo sapiens
ctgaggtagaagaatcacttga

SEQ ID NO: 124613 - DNA, 23 bp, Homo sapiens
tgagttcattgtagattctggat

SEQ ID NO: 124614 - DNA, 23 bp, Homo sapiens
tgagttcattgtagattctggat

SEQ ID NO: 124615 - DNA, 23 bp, Homo sapiens
tgagttcattgtagattctggat

SEQ ID NO: 124616 - DNA, 23 bp, Homo sapiens
tgagttcattgtagattctggat

SEQ ID NO: 124617 - DNA, 23 bp, Homo sapiens
ttccatggtatgggtgtgtgtgt

SEQ ID NO: 124618 - DNA, 23 bp, Homo sapiens
tatacatacacattttctttatc

SEQ ID NO: 124619 - DNA, 23 bp, Homo sapiens
tatgtgtgtacatatcatataca

SEQ ID NO: 124620 - DNA, 21 bp, Homo sapiens
tatatgtatgtacatatcaca

SEQ ID NO: 124621 - DNA, 23 bp, Homo sapiens
acagagtctcactcactttgtgg

SEQ ID NO: 124622 - DNA, 23 bp, Homo sapiens
acattcacacacacatagacaca

SEQ ID NO: 124623 - DNA, 22 bp, Homo sapiens
atcacagagccaagacaggtgc

SEQ ID NO: 124624 - DNA, 23 bp, Homo sapiens
ccccttatcttccttctgtgagt

SEQ ID NO: 124625 - DNA, 21 bp, Homo sapiens
atatgagattagactacatct

SEQ ID NO: 124626 - DNA, 23 bp, Homo sapiens
tgttttgtgtatttcatcatgtg

SEQ ID NO: 124627 - DNA, 21 bp, Homo sapiens
ctacagaaaagagtgtggaga

SEQ ID NO: 124628 - DNA, 19 bp, Homo sapiens
tatgtatacatgtatgttg

SEQ ID NO: 124629 - DNA, 23 bp, Homo sapiens
tatatatatgtgtgtgtgcatat

SEQ ID NO: 124630 - DNA, 22 bp, Homo sapiens
aacacagtgagaccccatctct

SEQ ID NO: 124631 - DNA, 23 bp, Homo sapiens
tcagactagagacagaatgagat

SEQ ID NO: 124632 - DNA, 19 bp, Homo sapiens
tagcttgactctcttgtct

SEQ ID NO: 124633 - DNA, 23 bp, Homo sapiens
tctttctctgtgtgcataccaag

SEQ ID NO: 124634 - DNA, 23 bp, Homo sapiens
tgtcgtagatggtagttatgtaa

SEQ ID NO: 124635 - DNA, 23 bp, Homo sapiens
tgagttcattgtagattctggat

SEQ ID NO: 124636 - DNA, 23 bp, Homo sapiens
tgagttcattgtagattctggat

SEQ ID NO: 124637 - DNA, 23 bp, Homo sapiens
taacagcatgtttagttttgtga

SEQ ID NO: 124638 - DNA, 23 bp, Homo sapiens
tgagttcattgtagattctggat

SEQ ID NO: 124639 - DNA, 23 bp, Homo sapiens
tgagttcattgtagattctggat

SEQ ID NO: 124640 - DNA, 23 bp, Homo sapiens
tgagttcattgtagattctggat

SEQ ID NO: 124641 - DNA, 23 bp, Homo sapiens
tgagttcattgtagattctggat

SEQ ID NO: 124642 - DNA, 22 bp, Homo sapiens
cctgtgtgactgttaggtctga

SEQ ID NO: 124643 - DNA, 23 bp, Homo sapiens
aaatgtgaatatgtatttctctc

SEQ ID NO: 124644 - DNA, 23 bp, Homo sapiens
ttagtggatgatatttgagttca

SEQ ID NO: 124645 - DNA, 23 bp, Homo sapiens
ggtatctcagacagattttttcc

SEQ ID NO: 124646 - DNA, 21 bp, Homo sapiens
tcagagaagttaagtgccttg

SEQ ID NO: 124647 - DNA, 21 bp, Homo sapiens
tttcaaacactcagttgaatt

SEQ ID NO: 124648 - DNA, 20 bp, Homo sapiens
aacatgtggcaattccatct

SEQ ID NO: 124649 - DNA, 18 bp, Homo sapiens
agtctctctgagtcactg

SEQ ID NO: 124650 - DNA, 23 bp, Homo sapiens
attgaggttcagagactttaggg

SEQ ID NO: 124651 - DNA, 22 bp, Homo sapiens
tgagtctcagagaatgtggaga

SEQ ID NO: 124652 - DNA, 23 bp, Homo sapiens
aagatggaaatagataagttatg

SEQ ID NO: 124653 - DNA, 18 bp, Homo sapiens
tatgtatatatgtgtgta

SEQ ID NO: 124654 - DNA, 23 bp, Homo sapiens
atatatgtatatgtatatgtgtg

SEQ ID NO: 124655 - DNA, 23 bp, Homo sapiens
atatatgtatatgtatatatgtg

SEQ ID NO: 124656 - DNA, 22 bp, Homo sapiens
ggtagagtgaggaaaaagcaga

SEQ ID NO: 124657 - DNA, 23 bp, Homo sapiens
gattgccatcctaactggtgtga

SEQ ID NO: 124658 - DNA, 21 bp, Homo sapiens
aggaggattctattactgttt

SEQ ID NO: 124659 - DNA, 23 bp, Homo sapiens
ttctgtcttccctctgtgtcagc

SEQ ID NO: 124660 - DNA, 20 bp, Homo sapiens
actgtgtatatatatactgt

SEQ ID NO: 124661 - DNA, 21 bp, Homo sapiens
atacacagtgtatatatatac

SEQ ID NO: 124662 - DNA, 23 bp, Homo sapiens
actgtgtgtatacatactgtgta

SEQ ID NO: 124663 - DNA, 23 bp, Homo sapiens
tatgtgtgtatacatgctgtgtg

SEQ ID NO: 124664 - DNA, 23 bp, Homo sapiens
tacgctgtgtatatatatactgt

SEQ ID NO: 124665 - DNA, 23 bp, Homo sapiens
tatactgtgtgtatatatactgt

SEQ ID NO: 124666 - DNA, 23 bp, Homo sapiens
tgtgtatgtgtgtgtgtctatat

SEQ ID NO: 124667 - DNA, 22 bp, Homo sapiens
tatatagacacacacacataca

SEQ ID NO: 124668 - DNA, 21 bp, Homo sapiens
tctgtcactgtctggctggca

SEQ ID NO: 124669 - DNA, 22 bp, Homo sapiens
agacctcactattactttggga

SEQ ID NO: 124670 - DNA, 23 bp, Homo sapiens
agtcagaagacacagattctgta

SEQ ID NO: 124671 - DNA, 23 bp, Homo sapiens
acggagtctcactctgtcaccca

SEQ ID NO: 124672 - DNA, 23 bp, Homo sapiens
cggagtctcgctctgtctcccag

SEQ ID NO: 124673 - DNA, 23 bp, Homo sapiens
ttgaactgttacttaataaaggt

SEQ ID NO: 124674 - DNA, 22 bp, Homo sapiens
attctaggcttttgttttgatg

SEQ ID NO: 124675 - DNA, 23 bp, Homo sapiens
attgtagtcagtgctgtaatctt

SEQ ID NO: 124676 - DNA, 20 bp, Homo sapiens
tcagtagagtttttaggttt

SEQ ID NO: 124677 - DNA, 23 bp, Homo sapiens
gagatctctgagtggagtgtgag

SEQ ID NO: 124678 - DNA, 23 bp, Homo sapiens
cctgggtgagacagtcagactct

SEQ ID NO: 124679 - DNA, 23 bp, Homo sapiens
tgagttcattgtagattctggat

SEQ ID NO: 124680 - DNA, 23 bp, Homo sapiens
tgagttcattgtagattctggat

SEQ ID NO: 124681 - DNA, 23 bp, Homo sapiens
agatagagtggttactttgtcac

SEQ ID NO: 124682 - DNA, 18 bp, Homo sapiens
agggctgaagataacatt

SEQ ID NO: 124683 - DNA, 23 bp, Homo sapiens
tggagtctcactctgtcacccag

SEQ ID NO: 124684 - DNA, 23 bp, Homo sapiens
tgtgtctctcacaatgtaatttc

SEQ ID NO: 124685 - DNA, 21 bp, Homo sapiens
ctcagggtctttgctgcttca

SEQ ID NO: 124686 - DNA, 23 bp, Homo sapiens
ttagagtatgcttgttttcactc

SEQ ID NO: 124687 - DNA, 23 bp, Homo sapiens
tgagttcattgtagattctggat

SEQ ID NO: 124688 - DNA, 18 bp, Homo sapiens
tttatgtatgtatggaaa

SEQ ID NO: 124689 - DNA, 23 bp, Homo sapiens
acacacacgcgtatacatatgtg

SEQ ID NO: 124690 - DNA, 20 bp, Homo sapiens
tatgtgtgtatgtgtgtgtg

SEQ ID NO: 124691 - DNA, 23 bp, Homo sapiens
tgtatgtgtgcatgtgtattcat

SEQ ID NO: 124692 - DNA, 23 bp, Homo sapiens
tatacatgtgtatacatgtatat

SEQ ID NO: 124693 - DNA, 23 bp, Homo sapiens
ttctaggcacagggtgtaagctg

SEQ ID NO: 124694 - DNA, 23 bp, Homo sapiens
atatgtacttaagttatgaataa

SEQ ID NO: 124695 - DNA, 23 bp, Homo sapiens
ttttttaggtattgtatacatat

SEQ ID NO: 124696 - DNA, 23 bp, Homo sapiens
aacagagagaagatagtttggag

SEQ ID NO: 124697 - DNA, 19 bp, Homo sapiens
attgtgactggttgtcctg

SEQ ID NO: 124698 - DNA, 23 bp, Homo sapiens
ctctcttacactgtctgcctttg

SEQ ID NO: 124699 - DNA, 23 bp, Homo sapiens
tgagttcattgtagattctggat

SEQ ID NO: 124700 - DNA, 23 bp, Homo sapiens
tgagttcattgtagattctggat

SEQ ID NO: 124701 - DNA, 23 bp, Homo sapiens
tgagttcattgtagattctggat

SEQ ID NO: 124702 - DNA, 23 bp, Homo sapiens
tgagttcattgtagattctggat

SEQ ID NO: 124703 - DNA, 19 bp, Homo sapiens
cactgcaatctccatctcc

SEQ ID NO: 124704 - DNA, 20 bp, Homo sapiens
tgtcacagacaagggtttag

SEQ ID NO: 124705 - DNA, 23 bp, Homo sapiens
ctctgtctgtctgttattggtgt

SEQ ID NO: 124706 - DNA, 23 bp, Homo sapiens
gaagagacaccagagagaggaca

SEQ ID NO: 124707 - DNA, 22 bp, Homo sapiens
ttagcttaggttacctagaact

SEQ ID NO: 124708 - DNA, 18 bp, Homo sapiens
ggggtctgtctgcccttc

SEQ ID NO: 124709 - DNA, 20 bp, Homo sapiens
agtgagaagttagagatctc

SEQ ID NO: 124710 - DNA, 23 bp, Homo sapiens
agaatggatgtagttccttctga

SEQ ID NO: 124711 - DNA, 23 bp, Homo sapiens
tctcactcactgttagcacagca

SEQ ID NO: 124712 - DNA, 22 bp, Homo sapiens
atccaactgcaaggtggcagtg

SEQ ID NO: 124713 - DNA, 23 bp, Homo sapiens
ggggactctgggtgtgtctgtgg

SEQ ID NO: 124714 - DNA, 20 bp, Homo sapiens
aatggactaatacaagttgt

SEQ ID NO: 124715 - DNA, 22 bp, Homo sapiens
ttcagtcaactaggtatagtcc

SEQ ID NO: 124716 - DNA, 23 bp, Homo sapiens
tatatgcatgtctatgtatacat

SEQ ID NO: 124717 - DNA, 22 bp, Homo sapiens
gctgtgagaagagactgtcctg

SEQ ID NO: 124718 - DNA, 21 bp, Homo sapiens
tatagctttttttctaattct

SEQ ID NO: 124719 - DNA, 20 bp, Homo sapiens
atacaggcttgtcattgtca

SEQ ID NO: 124720 - DNA, 23 bp, Homo sapiens
atcattgtcatatatatgacaat

SEQ ID NO: 124721 - DNA, 20 bp, Homo sapiens
tgtatgtatgcatgtatctg

SEQ ID NO: 124722 - DNA, 22 bp, Homo sapiens
taactttggagatgatgactta

SEQ ID NO: 124723 - DNA, 22 bp, Homo sapiens
atttaagacctggaaatgctat

SEQ ID NO: 124724 - DNA, 23 bp, Homo sapiens
tggcgcgctctctctgtctctca

SEQ ID NO: 124725 - DNA, 23 bp, Homo sapiens
cagttagagcatgagaatgtggt

SEQ ID NO: 124726 - DNA, 23 bp, Homo sapiens
atgatgatgatgatgatgatgat

SEQ ID NO: 124727 - DNA, 23 bp, Homo sapiens
atatatgaagtatatgttatata

SEQ ID NO: 124728 - DNA, 23 bp, Homo sapiens
tcattggtgtttttggtgcctta

SEQ ID NO: 124729 - DNA, 20 bp, Homo sapiens
tgattgttgactgagaggag

SEQ ID NO: 124730 - DNA, 23 bp, Homo sapiens
gagtctcactctgtcacccaggc

SEQ ID NO: 124731 - DNA, 23 bp, Homo sapiens
tgagttcattgtagattctggat

SEQ ID NO: 124732 - DNA, 23 bp, Homo sapiens
tgagttcattgtagattctggat

SEQ ID NO: 124733 - DNA, 23 bp, Homo sapiens
tgagttcattgtagattctggat

SEQ ID NO: 124734 - DNA, 23 bp, Homo sapiens
tgagttcattgtagattctggat

SEQ ID NO: 124735 - DNA, 22 bp, Homo sapiens
tcaaacactagtctatatgttg

SEQ ID NO: 124736 - DNA, 21 bp, Homo sapiens
aatggagttgaaatgggaaaa

SEQ ID NO: 124737 - DNA, 20 bp, Homo sapiens
catctgttatgttcactaag

SEQ ID NO: 124738 - DNA, 23 bp, Homo sapiens
tgagttcattgtagattctggat

SEQ ID NO: 124739 - DNA, 23 bp, Homo sapiens
tgagttcattgtagattctggat

SEQ ID NO: 124740 - DNA, 23 bp, Homo sapiens
tctgttcttggatcttagccagt

SEQ ID NO: 124741 - DNA, 22 bp, Homo sapiens
agctcactgtaacctctgcctc

SEQ ID NO: 124742 - DNA, 23 bp, Homo sapiens
tatgtgtgtatatatatgtgtgt

SEQ ID NO: 124743 - DNA, 23 bp, Homo sapiens
agggtctcactctgtcactaggc

SEQ ID NO: 124744 - DNA, 23 bp, Homo sapiens
tgtgaaccatgaggaaccgaatt

SEQ ID NO: 124745 - DNA, 20 bp, Homo sapiens
aagagaatgcgttcctaggg

SEQ ID NO: 124746 - DNA, 22 bp, Homo sapiens
ctgctctgggactgtctctctt

SEQ ID NO: 124747 - DNA, 18 bp, Homo sapiens
tcccacatgatcccataa

SEQ ID NO: 124748 - DNA, 23 bp, Homo sapiens
tgagttcattgtagattctggat

SEQ ID NO: 124749 - DNA, 23 bp, Homo sapiens
tgagttcattgtagattctggat

SEQ ID NO: 124750 - DNA, 23 bp, Homo sapiens
tttgaaagtgaatgcaaaatttc

SEQ ID NO: 124751 - DNA, 23 bp, Homo sapiens
ttgtttctggaactgcatgtgct

SEQ ID NO: 124752 - DNA, 21 bp, Homo sapiens
tatccgtatatgtatatatgt

SEQ ID NO: 124753 - DNA, 21 bp, Homo sapiens
tatccgtatatgtatatatgt

SEQ ID NO: 124754 - DNA, 21 bp, Homo sapiens
tatccgtatatgtatatatgt

SEQ ID NO: 124755 - DNA, 21 bp, Homo sapiens
atgtatctgtatatgtatgta

SEQ ID NO: 124756 - DNA, 22 bp, Homo sapiens
atgagattccatgaaattgcaa

SEQ ID NO: 124757 - DNA, 22 bp, Homo sapiens
ttaaaactatgttttatttggt

SEQ ID NO: 124758 - DNA, 23 bp, Homo sapiens
ttttagcaactggatctgattag

SEQ ID NO: 124759 - DNA, 21 bp, Homo sapiens
tgatacagatagcccagtggt

SEQ ID NO: 124760 - DNA, 18 bp, Homo sapiens
tgtatatatatgtgtgtg

SEQ ID NO: 124761 - DNA, 18 bp, Homo sapiens
taatgttctggaggttcc

SEQ ID NO: 124762 - DNA, 18 bp, Homo sapiens
tgtatatatatatagata

SEQ ID NO: 124763 - DNA, 19 bp, Homo sapiens
aaagagttgagccaactgt

SEQ ID NO: 124764 - DNA, 23 bp, Homo sapiens
tctctggtagttctttttacagt

SEQ ID NO: 124765 - DNA, 23 bp, Homo sapiens
tgcctgtcaccatttaagatgtg

SEQ ID NO: 124766 - DNA, 23 bp, Homo sapiens
tgggagagagcacagttccagtg

SEQ ID NO: 124767 - DNA, 19 bp, Homo sapiens
tttccacaattctggctgt

SEQ ID NO: 124768 - DNA, 23 bp, Homo sapiens
acagagtctcgctctgtcaccca

SEQ ID NO: 124769 - DNA, 23 bp, Homo sapiens
ttttgtggttccatatgaatttt

SEQ ID NO: 124770 - DNA, 22 bp, Homo sapiens
ttatttctatttctgtgaggaa

SEQ ID NO: 124771 - DNA, 23 bp, Homo sapiens
tgagttcattgtagattctggat

SEQ ID NO: 124772 - DNA, 23 bp, Homo sapiens
tgagttcattgtagattctggat

SEQ ID NO: 124773 - DNA, 20 bp, Homo sapiens
tgaggtaggaggatcacttg

SEQ ID NO: 124774 - DNA, 21 bp, Homo sapiens
tactcagagaggataaatagt

SEQ ID NO: 124775 - DNA, 21 bp, Homo sapiens
aaactgggactatatctgtct

SEQ ID NO: 124776 - DNA, 20 bp, Homo sapiens
tgactatatatatagtcata

SEQ ID NO: 124777 - DNA, 21 bp, Homo sapiens
gtacacaactgtatacgatgt

SEQ ID NO: 124778 - DNA, 23 bp, Homo sapiens
tttgttctttttgcttaggattg

SEQ ID NO: 124779 - DNA, 23 bp, Homo sapiens
ttctgtgaagaaagtcaatggta

SEQ ID NO: 124780 - DNA, 22 bp, Homo sapiens
gcttcacacagcctctctgcct

SEQ ID NO: 124781 - DNA, 22 bp, Homo sapiens
atgctcaattccttttcagtct

SEQ ID NO: 124782 - DNA, 23 bp, Homo sapiens
tgaagtctcactctgtcacccag

SEQ ID NO: 124783 - DNA, 22 bp, Homo sapiens
atttttctgcataattattgtt

SEQ ID NO: 124784 - DNA, 21 bp, Homo sapiens
tcagatacagacatttcttgg

SEQ ID NO: 124785 - DNA, 23 bp, Homo sapiens
atagagatgagtgtgtgctcaga

SEQ ID NO: 124786 - DNA, 23 bp, Homo sapiens
agtggttcaagcttgtaaactca

SEQ ID NO: 124787 - DNA, 18 bp, Homo sapiens
agtgggtggatcacctga

SEQ ID NO: 124788 - DNA, 22 bp, Homo sapiens
tctttctcacagagtaatcaga

SEQ ID NO: 124789 - DNA, 22 bp, Homo sapiens
tctcacccaccctctgtctgag

SEQ ID NO: 124790 - DNA, 20 bp, Homo sapiens
tgtatatatgtgtatgtgtg

SEQ ID NO: 124791 - DNA, 23 bp, Homo sapiens
tgcagtgagacccagtctctacc

SEQ ID NO: 124792 - DNA, 22 bp, Homo sapiens
agagtctcactctgtcacccag

SEQ ID NO: 124793 - DNA, 23 bp, Homo sapiens
tttgagacggagtctcactctgt

SEQ ID NO: 124794 - DNA, 21 bp, Homo sapiens
aggactgatgagagaaagcag

SEQ ID NO: 124795 - DNA, 23 bp, Homo sapiens
agtacatgcgagtgtgcacatgt

SEQ ID NO: 124796 - DNA, 23 bp, Homo sapiens
acacatgcagtacatgcgagtgt

SEQ ID NO: 124797 - DNA, 21 bp, Homo sapiens
tgacttaatctctctgtgtct

SEQ ID NO: 124798 - DNA, 23 bp, Homo sapiens
actctgaggagggttgaatggcc

SEQ ID NO: 124799 - DNA, 23 bp, Homo sapiens
agcatgtgtgagtgtatgtgaga

SEQ ID NO: 124800 - DNA, 23 bp, Homo sapiens
atatatgtctgaatatgtatgtg

SEQ ID NO: 124801 - DNA, 19 bp, Homo sapiens
tagcactctcactctgtcc

SEQ ID NO: 124802 - DNA, 23 bp, Homo sapiens
actgtcactgactttagctcctg

SEQ ID NO: 124803 - DNA, 23 bp, Homo sapiens
agatggagtctcactctgtcacc

SEQ ID NO: 124804 - DNA, 23 bp, Homo sapiens
tgtgtcacccacagtctggatct

SEQ ID NO: 124805 - DNA, 19 bp, Homo sapiens
actgtctcactggattctg

SEQ ID NO: 124806 - DNA, 22 bp, Homo sapiens
agagagaagagtcacagcctgc

SEQ ID NO: 124807 - DNA, 23 bp, Homo sapiens
aaagaggatgcttatacactgct

SEQ ID NO: 124808 - DNA, 23 bp, Homo sapiens
agccagtgtagagagcagtttgg

SEQ ID NO: 124809 - DNA, 20 bp, Homo sapiens
acagtctccactgtctggct

SEQ ID NO: 124810 - DNA, 23 bp, Homo sapiens
agattttagctgtttctctttta

SEQ ID NO: 124811 - DNA, 20 bp, Homo sapiens
ctgacagcttgttctttttc

SEQ ID NO: 124812 - DNA, 23 bp, Homo sapiens
tcctgaagtgattttgttcttat

SEQ ID NO: 124813 - DNA, 23 bp, Homo sapiens
gttacacaggctggtttcaaact

SEQ ID NO: 124814 - DNA, 21 bp, Homo sapiens
agtggcacgatctcaactgac

SEQ ID NO: 124815 - DNA, 18 bp, Homo sapiens
acagacagactctgtcta

SEQ ID NO: 124816 - DNA, 23 bp, Homo sapiens
ctttagtctgtctctctttgaag

SEQ ID NO: 124817 - DNA, 23 bp, Homo sapiens
acagaagagacacaggcttttct

SEQ ID NO: 124818 - DNA, 22 bp, Homo sapiens
atgtgcacatatatgtacatac

SEQ ID NO: 124819 - DNA, 23 bp, Homo sapiens
tatgtgtatgtatatgtatatgt

SEQ ID NO: 124820 - DNA, 23 bp, Homo sapiens
tatctgacagatgaaggtgtgga

SEQ ID NO: 124821 - DNA, 22 bp, Homo sapiens
cccactctgtctgacttttgga

SEQ ID NO: 124822 - DNA, 23 bp, Homo sapiens
gagtctcacactgtcacccaggc

SEQ ID NO: 124823 - DNA, 23 bp, Homo sapiens
tgtgtgcatgtgtgtgtgtgtgt

SEQ ID NO: 124824 - DNA, 23 bp, Homo sapiens
ttggatttagcacaatttacagg

SEQ ID NO: 124825 - DNA, 22 bp, Homo sapiens
aaaatcagtgggtatcttgttt

SEQ ID NO: 124826 - DNA, 22 bp, Homo sapiens
tggtcatctgagacagtctctc

SEQ ID NO: 124827 - DNA, 21 bp, Homo sapiens
tagagagagagagttctatat

SEQ ID NO: 124828 - DNA, 23 bp, Homo sapiens
tagagagactgagtcttacttga

SEQ ID NO: 124829 - DNA, 23 bp, Homo sapiens
gagtaggtgtctccttcagtttt

SEQ ID NO: 124830 - DNA, 21 bp, Homo sapiens
ttggagattttagttcctgtc

SEQ ID NO: 124831 - DNA, 23 bp, Homo sapiens
tgagttcattgtagattctggat

SEQ ID NO: 124832 - DNA, 23 bp, Homo sapiens
tgagttcattgtagattctggat

SEQ ID NO: 124833 - DNA, 21 bp, Homo sapiens
gtctcgctctgtcactcaggc

SEQ ID NO: 124834 - DNA, 23 bp, Homo sapiens
gacagagtctccctctgtcaccc

SEQ ID NO: 124835 - DNA, 21 bp, Homo sapiens
tagtttgaagtcaagtaatgt

SEQ ID NO: 124836 - DNA, 23 bp, Homo sapiens
tgagttcattgtagattctggat

SEQ ID NO: 124837 - DNA, 23 bp, Homo sapiens
tgagttcattgtagattctggat

SEQ ID NO: 124838 - DNA, 23 bp, Homo sapiens
tgagttcattgtagattctggat

SEQ ID NO: 124839 - DNA, 23 bp, Homo sapiens
tgagttcattgtagattctggat

SEQ ID NO: 124840 - DNA, 20 bp, Homo sapiens
aggcacagtcaaaactcaag

SEQ ID NO: 124841 - DNA, 23 bp, Homo sapiens
attccagtgtttttgttttgtca

SEQ ID NO: 124842 - DNA, 18 bp, Homo sapiens
atgcctgtagtcccagct

SEQ ID NO: 124843 - DNA, 23 bp, Homo sapiens
ggctgaggtaggaggatcacttg

SEQ ID NO: 124844 - DNA, 23 bp, Homo sapiens
tgagttcattgtagattctggat

SEQ ID NO: 124845 - DNA, 23 bp, Homo sapiens
tgagttcattgtagattctggat

SEQ ID NO: 124846 - DNA, 23 bp, Homo sapiens
ggaatctcactctgtctcaccca

SEQ ID NO: 124847 - DNA, 21 bp, Homo sapiens
ttcaagacagagtctccctct

SEQ ID NO: 124848 - DNA, 23 bp, Homo sapiens
caatgatgtctccaacagtctca

SEQ ID NO: 124849 - DNA, 19 bp, Homo sapiens
agtgctgggctggctctct

SEQ ID NO: 124850 - DNA, 20 bp, Homo sapiens
cagagtgaggccctgtctca

SEQ ID NO: 124851 - DNA, 23 bp, Homo sapiens
ttgtagagacagggactcactct

SEQ ID NO: 124852 - DNA, 21 bp, Homo sapiens
acagaagctgcaaagtctttt

SEQ ID NO: 124853 - DNA, 23 bp, Homo sapiens
tgacagagcagagtgtacatttc

SEQ ID NO: 124854 - DNA, 20 bp, Homo sapiens
gtgacacgctctgtagtccc

SEQ ID NO: 124855 - DNA, 23 bp, Homo sapiens
tgctgagtttgtttttcattctg

SEQ ID NO: 124856 - DNA, 20 bp, Homo sapiens
ccactagaatgcagtctgaa

SEQ ID NO: 124857 - DNA, 22 bp, Homo sapiens
ggatcttgctctgttatctagg

SEQ ID NO: 124858 - DNA, 18 bp, Homo sapiens
aagttgctgattttgttc

SEQ ID NO: 124859 - DNA, 21 bp, Homo sapiens
aatgagcaaaattaatcttcg

SEQ ID NO: 124860 - DNA, 23 bp, Homo sapiens
tgagttcattgtagattctggat

SEQ ID NO: 124861 - DNA, 23 bp, Homo sapiens
tgagttcattgtagattctggat

SEQ ID NO: 124862 - DNA, 23 bp, Homo sapiens
tgagttcattgtagattctggat

SEQ ID NO: 124863 - DNA, 23 bp, Homo sapiens
tgagttcattgtagattctggat

SEQ ID NO: 124864 - DNA, 23 bp, Homo sapiens
gagtctcactctgtcacccaggc

SEQ ID NO: 124865 - DNA, 19 bp, Homo sapiens
gggtgtggtgacgcacctg

SEQ ID NO: 124866 - DNA, 23 bp, Homo sapiens
agacggagtctcactctgtcacc

SEQ ID NO: 124867 - DNA, 23 bp, Homo sapiens
gtgtgcgtgtgtgcgtgcgtgtg

SEQ ID NO: 124868 - DNA, 23 bp, Homo sapiens
ttgagtgagatagatctgagttt

SEQ ID NO: 124869 - DNA, 23 bp, Homo sapiens
tcattctctctcactaactttgg

SEQ ID NO: 124870 - DNA, 23 bp, Homo sapiens
tctctgtctctctctgctaggtc

SEQ ID NO: 124871 - DNA, 23 bp, Homo sapiens
actgcctctctcaccctctgttc

SEQ ID NO: 124872 - DNA, 23 bp, Homo sapiens
tgagagttcagactgagtagaag

SEQ ID NO: 124873 - DNA, 20 bp, Homo sapiens
tgaaaagctgattgctactc

SEQ ID NO: 124874 - DNA, 19 bp, Homo sapiens
tgtgacgtaggtctttctc

SEQ ID NO: 124875 - DNA, 23 bp, Homo sapiens
ctcctggactacgtgctctaact

SEQ ID NO: 124876 - DNA, 20 bp, Homo sapiens
atatgtgtatatatatatgt

SEQ ID NO: 124877 - DNA, 23 bp, Homo sapiens
gaaataatagcactaggtctgtt

SEQ ID NO: 124878 - DNA, 23 bp, Homo sapiens
tgagttcattgtagattctggat

SEQ ID NO: 124879 - DNA, 23 bp, Homo sapiens
tgagttcattgtagattctggat

SEQ ID NO: 124880 - DNA, 23 bp, Homo sapiens
agtttcattcctctgcatatgga

SEQ ID NO: 124881 - DNA, 23 bp, Homo sapiens
attagctaaatcaggaatgcagg

SEQ ID NO: 124882 - DNA, 23 bp, Homo sapiens
atgtagagacaagggtcttgcta

SEQ ID NO: 124883 - DNA, 21 bp, Homo sapiens
tgtagtggtcgtccaggacca

SEQ ID NO: 124884 - DNA, 23 bp, Homo sapiens
acagcatcccagatgtcctggct

SEQ ID NO: 124885 - DNA, 23 bp, Homo sapiens
atgagtctcactctgtcacccag

SEQ ID NO: 124886 - DNA, 22 bp, Homo sapiens
agagcactatcttgagaataag

SEQ ID NO: 124887 - DNA, 18 bp, Homo sapiens
tatagtctatatgtatat

SEQ ID NO: 124888 - DNA, 23 bp, Homo sapiens
tggagtctcactctgtcacccag

SEQ ID NO: 124889 - DNA, 23 bp, Homo sapiens
cagagtctcactctgccactcag

SEQ ID NO: 124890 - DNA, 23 bp, Homo sapiens
tgggtccctcagtggctctcgac

SEQ ID NO: 124891 - DNA, 19 bp, Homo sapiens
tgtatatatatatgtatat

SEQ ID NO: 124892 - DNA, 20 bp, Homo sapiens
tgaggaggtgtctattttct

SEQ ID NO: 124893 - DNA, 20 bp, Homo sapiens
tccaggaggcattttggaca

SEQ ID NO: 124894 - DNA, 19 bp, Homo sapiens
ctaggttatgtcctctttg

SEQ ID NO: 124895 - DNA, 23 bp, Homo sapiens
tgtgtgtcaggtattctgttcta

SEQ ID NO: 124896 - DNA, 23 bp, Homo sapiens
gagtctcactctgtcacccaggc

SEQ ID NO: 124897 - DNA, 23 bp, Homo sapiens
gatagtctgtctggtaaccaaga

SEQ ID NO: 124898 - DNA, 23 bp, Homo sapiens
taactgactaatgggtgagtagt

SEQ ID NO: 124899 - DNA, 23 bp, Homo sapiens
tgtatgtatacatatgtatacac

SEQ ID NO: 124900 - DNA, 23 bp, Homo sapiens
actctgtctctctctgtgcatgc

SEQ ID NO: 124901 - DNA, 23 bp, Homo sapiens
tgacttaggatggggtaatgttc

SEQ ID NO: 124902 - DNA, 22 bp, Homo sapiens
ataatgtccatatgcattagtt

SEQ ID NO: 124903 - DNA, 20 bp, Homo sapiens
ttttgagtgcctctgcatgg

SEQ ID NO: 124904 - DNA, 21 bp, Homo sapiens
aagcagcatttaatctgagaa

SEQ ID NO: 124905 - DNA, 23 bp, Homo sapiens
actgaaagttagctgctttgagt

SEQ ID NO: 124906 - DNA, 23 bp, Homo sapiens
tagactagacattttgaacttgt

SEQ ID NO: 124907 - DNA, 22 bp, Homo sapiens
ttgattctacattatggtgagt

SEQ ID NO: 124908 - DNA, 22 bp, Homo sapiens
tgtttgcaatattagcattgct

SEQ ID NO: 124909 - DNA, 18 bp, Homo sapiens
caggatagaatcacctgt

SEQ ID NO: 124910 - DNA, 23 bp, Homo sapiens
gagtctcactctgtcacccaggc

SEQ ID NO: 124911 - DNA, 20 bp, Homo sapiens
tgcattggtgtgatctctgc

SEQ ID NO: 124912 - DNA, 23 bp, Homo sapiens
tggagtctcactctgtcacccag

SEQ ID NO: 124913 - DNA, 19 bp, Homo sapiens
aggctagatcaaggcaaat

SEQ ID NO: 124914 - DNA, 23 bp, Homo sapiens
tactctgtgccaggtattgtgtg

SEQ ID NO: 124915 - DNA, 22 bp, Homo sapiens
taattctggcaagaaaccagga

SEQ ID NO: 124916 - DNA, 23 bp, Homo sapiens
aaatgattttatatgtgtgtgtg

SEQ ID NO: 124917 - DNA, 23 bp, Homo sapiens
actctgtctctgtttcacctgtg

SEQ ID NO: 124918 - DNA, 23 bp, Homo sapiens
atacacacacacatttgagtgtg

SEQ ID NO: 124919 - DNA, 23 bp, Homo sapiens
tgagttcattgtagattctggat

SEQ ID NO: 124920 - DNA, 23 bp, Homo sapiens
tgagttcattgtagattctggat

SEQ ID NO: 124921 - DNA, 22 bp, Homo sapiens
ataaatgtagtgtagcctaagt

SEQ ID NO: 124922 - DNA, 20 bp, Homo sapiens
gtgagaaataagtgagatga

SEQ ID NO: 124923 - DNA, 18 bp, Homo sapiens
agtgagactaaaatctga

SEQ ID NO: 124924 - DNA, 19 bp, Homo sapiens
tcaatctttgtttttatgt

SEQ ID NO: 124925 - DNA, 19 bp, Homo sapiens
tcaggacttttatgcaaaa

SEQ ID NO: 124926 - DNA, 21 bp, Homo sapiens
taagactgtcactgactctgc

SEQ ID NO: 124927 - DNA, 19 bp, Homo sapiens
tacagtgagctttgattgt

SEQ ID NO: 124928 - DNA, 19 bp, Homo sapiens
taactctagtgatagcagt

SEQ ID NO: 124929 - DNA, 22 bp, Homo sapiens
tactgctatcactagagttact

SEQ ID NO: 124930 - DNA, 20 bp, Homo sapiens
acgctctcacgctctcttta

SEQ ID NO: 124931 - DNA, 23 bp, Homo sapiens
atgtgtgtgtatatatatatgtg

SEQ ID NO: 124932 - DNA, 21 bp, Homo sapiens
ttcagagaagatagtgtggag

SEQ ID NO: 124933 - DNA, 23 bp, Homo sapiens
actgtgagtctgttaaacctctt

SEQ ID NO: 124934 - DNA, 21 bp, Homo sapiens
aacacagttcttgctttccac

SEQ ID NO: 124935 - DNA, 20 bp, Homo sapiens
agagcatggaagtctgatcc

SEQ ID NO: 124936 - DNA, 23 bp, Homo sapiens
gtgtgtgtgtgcgtgtatgtata

SEQ ID NO: 124937 - DNA, 18 bp, Homo sapiens
tatgactaagaaatggct

SEQ ID NO: 124938 - DNA, 21 bp, Homo sapiens
atttgtctatttctttttcag

SEQ ID NO: 124939 - DNA, 23 bp, Homo sapiens
tatgtgtatgtttgtgtacttgt

SEQ ID NO: 124940 - DNA, 21 bp, Homo sapiens
tgtgtatatatatatgtgtgt

SEQ ID NO: 124941 - DNA, 23 bp, Homo sapiens
atgtgtgagtatatatatgtgtg

SEQ ID NO: 124942 - DNA, 23 bp, Homo sapiens
tttgactttgcttaaattgactt

SEQ ID NO: 124943 - DNA, 23 bp, Homo sapiens
aggagaacagtgtgtattctgca

SEQ ID NO: 124944 - DNA, 23 bp, Homo sapiens
tgagttcattgtagattctggat

SEQ ID NO: 124945 - DNA, 23 bp, Homo sapiens
tgagttcattgtagattctggat

SEQ ID NO: 124946 - DNA, 18 bp, Homo sapiens
tctgtgttagctggtctt

SEQ ID NO: 124947 - DNA, 22 bp, Homo sapiens
ttgtactgcttgttatctcact

SEQ ID NO: 124948 - DNA, 19 bp, Homo sapiens
cactgagtgattttgagga

SEQ ID NO: 124949 - DNA, 22 bp, Homo sapiens
aacagtggcaggatgtcatggt

SEQ ID NO: 124950 - DNA, 23 bp, Homo sapiens
agagtctcactctgtcacccagg

SEQ ID NO: 124951 - DNA, 23 bp, Homo sapiens
tttcactgcctccctcttacaca

SEQ ID NO: 124952 - DNA, 21 bp, Homo sapiens
tcaaggtcacacagcaaactg

SEQ ID NO: 124953 - DNA, 22 bp, Homo sapiens
tgagatgaagcactgtagctca

SEQ ID NO: 124954 - DNA, 23 bp, Homo sapiens
gtccagttttcccaggaatccct

SEQ ID NO: 124955 - DNA, 23 bp, Homo sapiens
tttgcctctgactgtccctctgc

SEQ ID NO: 124956 - DNA, 22 bp, Homo sapiens
agtaagacctttatttgtctct

SEQ ID NO: 124957 - DNA, 20 bp, Homo sapiens
gagtctcactctgtcaccca

SEQ ID NO: 124958 - DNA, 23 bp, Homo sapiens
gagccagctgcaggagctgctgt

SEQ ID NO: 124959 - DNA, 23 bp, Homo sapiens
tcaccttctctgtgtctcagtat

SEQ ID NO: 124960 - DNA, 21 bp, Homo sapiens
gagagaagtttgacaggacct

SEQ ID NO: 124961 - DNA, 23 bp, Homo sapiens
tgtgtgtgtccatgtgcatgtgt

SEQ ID NO: 124962 - DNA, 21 bp, Homo sapiens
gtgtgtgtgcatgtgcatgtg

SEQ ID NO: 124963 - DNA, 23 bp, Homo sapiens
tggagtctcactctgtcacccag

SEQ ID NO: 124964 - DNA, 21 bp, Homo sapiens
ttgactcactgcaacttctgc

SEQ ID NO: 124965 - DNA, 18 bp, Homo sapiens
atgtgggatgaatggagc

SEQ ID NO: 124966 - DNA, 23 bp, Homo sapiens
ggccctgtctgtgagtctcatct

SEQ ID NO: 124967 - DNA, 23 bp, Homo sapiens
tgtctttctctgtgggtctcagg

SEQ ID NO: 124968 - DNA, 23 bp, Homo sapiens
tgtggcagaaacaaccgagtcag

SEQ ID NO: 124969 - DNA, 23 bp, Homo sapiens
gcctctgactgactgtgtgacct

SEQ ID NO: 124970 - DNA, 22 bp, Homo sapiens
ctctaggtctccctctctgaag

SEQ ID NO: 124971 - DNA, 23 bp, Homo sapiens
gtgatctcactctgtcacccggt

SEQ ID NO: 124972 - DNA, 23 bp, Homo sapiens
ggagtctcactctgtcactcagg

SEQ ID NO: 124973 - DNA, 23 bp, Homo sapiens
tctcattgtggttctgatatgca

SEQ ID NO: 124974 - DNA, 23 bp, Homo sapiens
taatgaccagtaatgatgaactt

SEQ ID NO: 124975 - DNA, 23 bp, Homo sapiens
tagatctcaatttcttcatctgt

SEQ ID NO: 124976 - DNA, 23 bp, Homo sapiens
tgagttcattgtagattctggat

SEQ ID NO: 124977 - DNA, 23 bp, Homo sapiens
tgagttcattgtagattctggat

SEQ ID NO: 124978 - DNA, 21 bp, Homo sapiens
aatggatagtaggtaggctgt

SEQ ID NO: 124979 - DNA, 22 bp, Homo sapiens
tcatgctctctctccatgctct

SEQ ID NO: 124980 - DNA, 23 bp, Homo sapiens
tgagttcattgtagattctggat

SEQ ID NO: 124981 - DNA, 23 bp, Homo sapiens
tgagttcattgtagattctggat

SEQ ID NO: 124982 - DNA, 21 bp, Homo sapiens
ctctgagttctcaggcctttg

SEQ ID NO: 124983 - DNA, 23 bp, Homo sapiens
tgagttcattgtagattctggat

SEQ ID NO: 124984 - DNA, 23 bp, Homo sapiens
tgagttcattgtagattctggat

SEQ ID NO: 124985 - DNA, 23 bp, Homo sapiens
tgagttcattgtagattctggat

SEQ ID NO: 124986 - DNA, 23 bp, Homo sapiens
tgagttcattgtagattctggat

SEQ ID NO: 124987 - DNA, 22 bp, Homo sapiens
ataaaacaagctgtggtaaaga

SEQ ID NO: 124988 - DNA, 20 bp, Homo sapiens
tctcttattcactgtggtat

SEQ ID NO: 124989 - DNA, 23 bp, Homo sapiens
ttcccacaccttatgtatagttg

SEQ ID NO: 124990 - DNA, 18 bp, Homo sapiens
atgtacttgaagaaaagt

SEQ ID NO: 124991 - DNA, 23 bp, Homo sapiens
ttttctggttccatatgaaattt

SEQ ID NO: 124992 - DNA, 23 bp, Homo sapiens
taggacataggtattgttatccc

SEQ ID NO: 124993 - DNA, 23 bp, Homo sapiens
catatcacagacattaaggactc

SEQ ID NO: 124994 - DNA, 18 bp, Homo sapiens
tcagactggtagaggtca

SEQ ID NO: 124995 - DNA, 19 bp, Homo sapiens
ggatgtggaaagagtcgtc

SEQ ID NO: 124996 - DNA, 19 bp, Homo sapiens
tcaggcagcgtctgttgct

SEQ ID NO: 124997 - DNA, 23 bp, Homo sapiens
aaagtctcagtagagaaagagga

SEQ ID NO: 124998 - DNA, 23 bp, Homo sapiens
cggagtctcactctgtcacccag

SEQ ID NO: 124999 - DNA, 23 bp, Homo sapiens
ttccagagtcactgcctgagttc

SEQ ID NO: 125000 - DNA, 23 bp, Homo sapiens
agttcccactctctctgtctcat

SEQ ID NO: 125001 - DNA, 23 bp, Homo sapiens
tcatctcagtctctctttctcac

SEQ ID NO: 125002 - DNA, 21 bp, Homo sapiens
agtgtttaaggctgattttca

SEQ ID NO: 125003 - DNA, 23 bp, Homo sapiens
aatgagtctgttactgtctgcca

SEQ ID NO: 125004 - DNA, 23 bp, Homo sapiens
aggcagagttcttcagagacaaa

SEQ ID NO: 125005 - DNA, 23 bp, Homo sapiens
tgtctctgtctgtatctctctct

SEQ ID NO: 125006 - DNA, 23 bp, Homo sapiens
tgagttcattgtagattctggat

SEQ ID NO: 125007 - DNA, 23 bp, Homo sapiens
tgagttcattgtagattctggat

SEQ ID NO: 125008 - DNA, 23 bp, Homo sapiens
aggtaaaaagagagtagatacac

SEQ ID NO: 125009 - DNA, 21 bp, Homo sapiens
agtgaatgtatgtatgtatgt

SEQ ID NO: 125010 - DNA, 23 bp, Homo sapiens
tacacacacacacatacatgtgt

SEQ ID NO: 125011 - DNA, 23 bp, Homo sapiens
tctgtcactgtctctcatcaccc

SEQ ID NO: 125012 - DNA, 23 bp, Homo sapiens
gggtctcactctgtcacccaagc

SEQ ID NO: 125013 - DNA, 23 bp, Homo sapiens
agtacatattgcctgctttactt

SEQ ID NO: 125014 - DNA, 22 bp, Homo sapiens
tttcttgatgaggaatgtggta

SEQ ID NO: 125015 - DNA, 23 bp, Homo sapiens
accagagagagaactcagatact

SEQ ID NO: 125016 - DNA, 23 bp, Homo sapiens
tcagacctcacttctcaatcact

SEQ ID NO: 125017 - DNA, 21 bp, Homo sapiens
cactcaagctggagcacagtg

SEQ ID NO: 125018 - DNA, 22 bp, Homo sapiens
cacactaggacatgacagtgtc

SEQ ID NO: 125019 - DNA, 22 bp, Homo sapiens
ttgtatttttagtagaaacggg

SEQ ID NO: 125020 - DNA, 21 bp, Homo sapiens
tttcactgtgttggctaggct

SEQ ID NO: 125021 - DNA, 23 bp, Homo sapiens
tgacagatgacagtttgctctgt

SEQ ID NO: 125022 - DNA, 23 bp, Homo sapiens
gacagactctcgctctgtcaccc

SEQ ID NO: 125023 - DNA, 23 bp, Homo sapiens
ctgacactctcagaaaatgcagg

SEQ ID NO: 125024 - DNA, 23 bp, Homo sapiens
gaggtcatgctggtatccatttt

SEQ ID NO: 125025 - DNA, 23 bp, Homo sapiens
ttcaaacagttaagttcatgtag

SEQ ID NO: 125026 - DNA, 20 bp, Homo sapiens
agacagatgacaatgtccag

SEQ ID NO: 125027 - DNA, 23 bp, Homo sapiens
tatccattagatatcttctctct

SEQ ID NO: 125028 - DNA, 23 bp, Homo sapiens
gacagaggttacagtgaactgag

SEQ ID NO: 125029 - DNA, 23 bp, Homo sapiens
gagtctcactctgtcacccaggc

SEQ ID NO: 125030 - DNA, 23 bp, Homo sapiens
cagcctctgtggcacagtctccc

SEQ ID NO: 125031 - DNA, 23 bp, Homo sapiens
atgcctgtgcctgcatcaggtga

SEQ ID NO: 125032 - DNA, 23 bp, Homo sapiens
ctctctgactcagacactggtct

SEQ ID NO: 125033 - DNA, 23 bp, Homo sapiens
agagtctcactctgtcacccagg

SEQ ID NO: 125034 - DNA, 23 bp, Homo sapiens
gagtctcactctgtcacccaggc

SEQ ID NO: 125035 - DNA, 22 bp, Homo sapiens
tgagaactgaattccatgggtt

SEQ ID NO: 125036 - DNA, 20 bp, Homo sapiens
tcagacctctgaaattcagt

SEQ ID NO: 125037 - DNA, 20 bp, Homo sapiens
tgacagtgtcctgggatgag

SEQ ID NO: 125038 - DNA, 23 bp, Homo sapiens
tttctcactcagcctctgtctct

SEQ ID NO: 125039 - DNA, 23 bp, Homo sapiens
agtgcctctctgactgtctcatt

SEQ ID NO: 125040 - DNA, 23 bp, Homo sapiens
ctctcagtgactcacagctcaca

SEQ ID NO: 125041 - DNA, 23 bp, Homo sapiens
tgagttcattgtagattctggat

SEQ ID NO: 125042 - DNA, 23 bp, Homo sapiens
tgagttcattgtagattctggat

SEQ ID NO: 125043 - DNA, 23 bp, Homo sapiens
tggagtctcactctgtcacccag

SEQ ID NO: 125044 - DNA, 23 bp, Homo sapiens
tctttctctctccaagagatgag

SEQ ID NO: 125045 - DNA, 23 bp, Homo sapiens
tctctgagagagagagagagaga

SEQ ID NO: 125046 - DNA, 23 bp, Homo sapiens
ttatgtggctgagttgagggata

SEQ ID NO: 125047 - DNA, 22 bp, Homo sapiens
tatgagtgagaatatgtggtat

SEQ ID NO: 125048 - DNA, 23 bp, Homo sapiens
ttgtgtgtgtatatgtatgtgtt

SEQ ID NO: 125049 - DNA, 21 bp, Homo sapiens
ttcagaggtgtctgaccacac

SEQ ID NO: 125050 - DNA, 18 bp, Homo sapiens
gagcccctgaaactctgg

SEQ ID NO: 125051 - DNA, 23 bp, Homo sapiens
atctttaccacactgaaaacagt

SEQ ID NO: 125052 - DNA, 23 bp, Homo sapiens
cagtggatatgtcttttctgtag

SEQ ID NO: 125053 - DNA, 23 bp, Homo sapiens
ttatgtgtacatatatatgtgtg

SEQ ID NO: 125054 - DNA, 22 bp, Homo sapiens
tcctttttatggctgagtagta

SEQ ID NO: 125055 - DNA, 23 bp, Homo sapiens
tgagttcattgtagattctggat

SEQ ID NO: 125056 - DNA, 23 bp, Homo sapiens
tgagttcattgtagattctggat

SEQ ID NO: 125057 - DNA, 21 bp, Homo sapiens
tgtgtgcatgtgttgtgtgaa

SEQ ID NO: 125058 - DNA, 20 bp, Homo sapiens
atgtgtgtatatatatgtgt

SEQ ID NO: 125059 - DNA, 20 bp, Homo sapiens
ctgcctctgactggctgggt

SEQ ID NO: 125060 - DNA, 23 bp, Homo sapiens
tgagttcattgtagattctggat

SEQ ID NO: 125061 - DNA, 23 bp, Homo sapiens
tgagttcattgtagattctggat

SEQ ID NO: 125062 - DNA, 23 bp, Homo sapiens
tcagagtctcactctgtcgccca

SEQ ID NO: 125063 - DNA, 23 bp, Homo sapiens
acagaacacagagaagacaatgt

SEQ ID NO: 125064 - DNA, 23 bp, Homo sapiens
ttttggtgaagtctttggtagaa

SEQ ID NO: 125065 - DNA, 21 bp, Homo sapiens
cattctccattcactgatggt

SEQ ID NO: 125066 - DNA, 23 bp, Homo sapiens
tcagaatactgagaggagagcat

SEQ ID NO: 125067 - DNA, 23 bp, Homo sapiens
atctgtgtgtatatctatatctg

SEQ ID NO: 125068 - DNA, 23 bp, Homo sapiens
aatcactctggttattgttggca

SEQ ID NO: 125069 - DNA, 23 bp, Homo sapiens
tatatgttcatatatatgtgtgt

SEQ ID NO: 125070 - DNA, 23 bp, Homo sapiens
atatgtgtgtgtatatatgttca

SEQ ID NO: 125071 - DNA, 23 bp, Homo sapiens
tatatgtatctatgtatttgtgt

SEQ ID NO: 125072 - DNA, 23 bp, Homo sapiens
tatctggttgttctgcagctgta

SEQ ID NO: 125073 - DNA, 23 bp, Homo sapiens
gtgggtctctctctcccagtcta

SEQ ID NO: 125074 - DNA, 23 bp, Homo sapiens
gccagagttgttcttcagtgggt

SEQ ID NO: 125075 - DNA, 23 bp, Homo sapiens
tatatgtatttctataaatatgt

SEQ ID NO: 125076 - DNA, 19 bp, Homo sapiens
atatatgtatatatgtatt

SEQ ID NO: 125077 - DNA, 20 bp, Homo sapiens
tatgtacatacctgtgtgtg

SEQ ID NO: 125078 - DNA, 23 bp, Homo sapiens
tctcattctcagattttgttggg

SEQ ID NO: 125079 - DNA, 22 bp, Homo sapiens
taactgagtatatatattgata

SEQ ID NO: 125080 - DNA, 20 bp, Homo sapiens
ataactgagtatatgtatat

SEQ ID NO: 125081 - DNA, 23 bp, Homo sapiens
tgacagttctctgtgtgcattat

SEQ ID NO: 125082 - DNA, 23 bp, Homo sapiens
tgacagtagagtgacatgtctgg

SEQ ID NO: 125083 - DNA, 22 bp, Homo sapiens
atgtgtaaagttagatgtctga

SEQ ID NO: 125084 - DNA, 23 bp, Homo sapiens
gtgtgtgtgtgttttgagataga

SEQ ID NO: 125085 - DNA, 22 bp, Homo sapiens
tgtgtgtgtgtgtatatatata

SEQ ID NO: 125086 - DNA, 20 bp, Homo sapiens
tgcgtgtgtatatacacgta

SEQ ID NO: 125087 - DNA, 21 bp, Homo sapiens
tgtgattgattaagtatgaaa

SEQ ID NO: 125088 - DNA, 20 bp, Homo sapiens
ttctttcattttgaaattgc

SEQ ID NO: 125089 - DNA, 23 bp, Homo sapiens
ttttcagtgcttagctatgtgaa

SEQ ID NO: 125090 - DNA, 23 bp, Homo sapiens
tgtgtgtgtgtgtttgtgcacat

SEQ ID NO: 125091 - DNA, 23 bp, Homo sapiens
tgtatctatgtatttgtgtatct

SEQ ID NO: 125092 - DNA, 23 bp, Homo sapiens
gagtctcactctgtctccgaggc

SEQ ID NO: 125093 - DNA, 19 bp, Homo sapiens
agtggcaccgtgtcagctc

SEQ ID NO: 125094 - DNA, 23 bp, Homo sapiens
ggagtctcactctgtctcccagg

SEQ ID NO: 125095 - DNA, 21 bp, Homo sapiens
tatatgtatatgtatgcatac

SEQ ID NO: 125096 - DNA, 23 bp, Homo sapiens
agaagagcacattttcaagagtt

SEQ ID NO: 125097 - DNA, 21 bp, Homo sapiens
gtggtagtttgttcatttgtt

SEQ ID NO: 125098 - DNA, 23 bp, Homo sapiens
gtaattgttcttgtataagatgt

SEQ ID NO: 125099 - DNA, 18 bp, Homo sapiens
gtgtgtatatatatatgt

SEQ ID NO: 125100 - DNA, 19 bp, Homo sapiens
tgtgtatatatatttctgt

SEQ ID NO: 125101 - DNA, 23 bp, Homo sapiens
ggtgtgatcttggctcactgcaa

SEQ ID NO: 125102 - DNA, 22 bp, Homo sapiens
ttctccacttactggacccacc

SEQ ID NO: 125103 - DNA, 22 bp, Homo sapiens
agagacatgagagtgtgcacat

SEQ ID NO: 125104 - DNA, 23 bp, Homo sapiens
ggtgcaattcataagttttctca

SEQ ID NO: 125105 - DNA, 19 bp, Homo sapiens
tcagtgtggagaaggaggg

SEQ ID NO: 125106 - DNA, 23 bp, Homo sapiens
catcactctcactcacaatagaa

SEQ ID NO: 125107 - DNA, 23 bp, Homo sapiens
tgagttcattgtagattctggat

SEQ ID NO: 125108 - DNA, 23 bp, Homo sapiens
tgagttcattgtagattctggat

SEQ ID NO: 125109 - DNA, 19 bp, Homo sapiens
tcatagtccttggccttag

SEQ ID NO: 125110 - DNA, 23 bp, Homo sapiens
tggagtctcactctgtcacccag

SEQ ID NO: 125111 - DNA, 22 bp, Homo sapiens
tctctctttcttttgtgtaagg

SEQ ID NO: 125112 - DNA, 23 bp, Homo sapiens
gcaaaagttctaacacacaagaa

SEQ ID NO: 125113 - DNA, 23 bp, Homo sapiens
atatggaagttcaatgctttctg

SEQ ID NO: 125114 - DNA, 20 bp, Homo sapiens
taaaatctttagctacagat

SEQ ID NO: 125115 - DNA, 23 bp, Homo sapiens
gtgtgcttgtgtgtgtatgtata

SEQ ID NO: 125116 - DNA, 21 bp, Homo sapiens
acatccatattctagctatgt

SEQ ID NO: 125117 - DNA, 23 bp, Homo sapiens
tgtatatatgtatgcatatcata

SEQ ID NO: 125118 - DNA, 22 bp, Homo sapiens
ttgcttcttctgcaagggcaag

SEQ ID NO: 125119 - DNA, 23 bp, Homo sapiens
tgtatgtgtatatatatacgtat

SEQ ID NO: 125120 - DNA, 22 bp, Homo sapiens
ttccagagagcctttgagctct

SEQ ID NO: 125121 - DNA, 23 bp, Homo sapiens
agagtctcactctgtcacccagg

SEQ ID NO: 125122 - DNA, 22 bp, Homo sapiens
agtcttaaatttgttttgcttg

SEQ ID NO: 125123 - DNA, 23 bp, Homo sapiens
tcaatttgaatactcattcaatt

SEQ ID NO: 125124 - DNA, 19 bp, Homo sapiens
tatgtatatatatatgtgt

SEQ ID NO: 125125 - DNA, 23 bp, Homo sapiens
caggctctgacactcagtagctg

SEQ ID NO: 125126 - DNA, 23 bp, Homo sapiens
tctcagtctctctccatgtaaaa

SEQ ID NO: 125127 - DNA, 23 bp, Homo sapiens
aaacagagtagagtgtgtggtct

SEQ ID NO: 125128 - DNA, 23 bp, Homo sapiens
tggagtctcactctgtcacccag

SEQ ID NO: 125129 - DNA, 23 bp, Homo sapiens
tatctcactcaactgtgagagag

SEQ ID NO: 125130 - DNA, 23 bp, Homo sapiens
tatgcatatatgtatgtatgtat

SEQ ID NO: 125131 - DNA, 22 bp, Homo sapiens
tatgcatatatgtatgtatgta

SEQ ID NO: 125132 - DNA, 23 bp, Homo sapiens
aagtatcagcatatctatatatg

SEQ ID NO: 125133 - DNA, 21 bp, Homo sapiens
gaacttatatatgtgtgtgta

SEQ ID NO: 125134 - DNA, 21 bp, Homo sapiens
atacacacacatatgtatgtg

SEQ ID NO: 125135 - DNA, 22 bp, Homo sapiens
tatatatgtgtgcatatgtata

SEQ ID NO: 125136 - DNA, 23 bp, Homo sapiens
ctgtctgtctgtctgtctgtctg

SEQ ID NO: 125137 - DNA, 23 bp, Homo sapiens
agcatctctctgactgacactgg

SEQ ID NO: 125138 - DNA, 23 bp, Homo sapiens
tgtatgacagatgtgtgtttgga

SEQ ID NO: 125139 - DNA, 23 bp, Homo sapiens
aaagacactgtatctgtctctgt

SEQ ID NO: 125140 - DNA, 19 bp, Homo sapiens
ggagtctcactctgtcacc

SEQ ID NO: 125141 - DNA, 20 bp, Homo sapiens
acagcacctgctgttggtgc

SEQ ID NO: 125142 - DNA, 23 bp, Homo sapiens
agggctctgtctgtctgtccgat

SEQ ID NO: 125143 - DNA, 23 bp, Homo sapiens
cggagtctcactctgtcacccag

SEQ ID NO: 125144 - DNA, 23 bp, Homo sapiens
ggttcaagtgattctcctgcctc

SEQ ID NO: 125145 - DNA, 23 bp, Homo sapiens
tcggtcagactgacttcagactc

SEQ ID NO: 125146 - DNA, 21 bp, Homo sapiens
agtccctcacatcccttgctg

SEQ ID NO: 125147 - DNA, 20 bp, Homo sapiens
attgtgaatgggagttcatt

SEQ ID NO: 125148 - DNA, 23 bp, Homo sapiens
tttgtctctttcaggtacttcaa

SEQ ID NO: 125149 - DNA, 22 bp, Homo sapiens
tttgttctttttgcttaggatt

SEQ ID NO: 125150 - DNA, 19 bp, Homo sapiens
tagcttgatgaggatagct

SEQ ID NO: 125151 - DNA, 21 bp, Homo sapiens
atatatgctcagtgtgtatat

SEQ ID NO: 125152 - DNA, 22 bp, Homo sapiens
tatatatatgctcagtctgtgt

SEQ ID NO: 125153 - DNA, 23 bp, Homo sapiens
atatatatatgctcagtctgtgt

SEQ ID NO: 125154 - DNA, 23 bp, Homo sapiens
ttgatttgtatatgtggaaccag

SEQ ID NO: 125155 - DNA, 23 bp, Homo sapiens
tgagttcattgtagattctggat

SEQ ID NO: 125156 - DNA, 23 bp, Homo sapiens
tgagttcattgtagattctggat

SEQ ID NO: 125157 - DNA, 22 bp, Homo sapiens
agactggggaaacactgtctct

SEQ ID NO: 125158 - DNA, 23 bp, Homo sapiens
tactatgtgtcgagcactgtatt

SEQ ID NO: 125159 - DNA, 22 bp, Homo sapiens
tgtggctgaccctttcaagtga

SEQ ID NO: 125160 - DNA, 18 bp, Homo sapiens
ccctcactttgtcactca

SEQ ID NO: 125161 - DNA, 22 bp, Homo sapiens
tttgcctctctctggctgtggt

SEQ ID NO: 125162 - DNA, 23 bp, Homo sapiens
atcactgctcatgtattcattct

SEQ ID NO: 125163 - DNA, 21 bp, Homo sapiens
gtgattggctcaggagtggtc

SEQ ID NO: 125164 - DNA, 22 bp, Homo sapiens
tgtggcccagttctggccaatg

SEQ ID NO: 125165 - DNA, 23 bp, Homo sapiens
agagagaacagactgtggacgtg

SEQ ID NO: 125166 - DNA, 22 bp, Homo sapiens
aagactctgaatctctctggat

SEQ ID NO: 125167 - DNA, 23 bp, Homo sapiens
tctctctctcacttacgtccctc

SEQ ID NO: 125168 - DNA, 23 bp, Homo sapiens
ccgagtctcactctgtcacccag

SEQ ID NO: 125169 - DNA, 23 bp, Homo sapiens
gagagtctcgctctgtcacccag

SEQ ID NO: 125170 - DNA, 21 bp, Homo sapiens
tgaggtagaaggatcacttgt

SEQ ID NO: 125171 - DNA, 23 bp, Homo sapiens
gtcacagagccagctctgctgct

SEQ ID NO: 125172 - DNA, 20 bp, Homo sapiens
acaatggaggtagcagtttc

SEQ ID NO: 125173 - DNA, 20 bp, Homo sapiens
agtccataaataaacctaca

SEQ ID NO: 125174 - DNA, 20 bp, Homo sapiens
tcagagtctaagatgtttag

SEQ ID NO: 125175 - DNA, 18 bp, Homo sapiens
agctatgtacactctctg

SEQ ID NO: 125176 - DNA, 21 bp, Homo sapiens
tggactagcagggcaggtcca

SEQ ID NO: 125177 - DNA, 23 bp, Homo sapiens
gagacagagtctcactctgtcgc

SEQ ID NO: 125178 - DNA, 23 bp, Homo sapiens
agtgagccatgttcatgccattg

SEQ ID NO: 125179 - DNA, 23 bp, Homo sapiens
gagagtctcactgtcacccaggc

SEQ ID NO: 125180 - DNA, 23 bp, Homo sapiens
cagggtctcactctgtctcccag

SEQ ID NO: 125181 - DNA, 23 bp, Homo sapiens
tgagttcattgtagattctggat

SEQ ID NO: 125182 - DNA, 23 bp, Homo sapiens
tgagttcattgtagattctggat

SEQ ID NO: 125183 - DNA, 19 bp, Homo sapiens
ctcatatatgtatatgtgt

SEQ ID NO: 125184 - DNA, 23 bp, Homo sapiens
tgaacagttttgttgaagtataa

SEQ ID NO: 125185 - DNA, 20 bp, Homo sapiens
tgtatactttgataagcttt

SEQ ID NO: 125186 - DNA, 23 bp, Homo sapiens
gagccagtgaagtgtgtgtgcac

SEQ ID NO: 125187 - DNA, 22 bp, Homo sapiens
tatatttgtgtgcattagaaat

SEQ ID NO: 125188 - DNA, 18 bp, Homo sapiens
acaacctgatgctgcaga

SEQ ID NO: 125189 - DNA, 23 bp, Homo sapiens
ggtgagagaagagtctcagaaat

SEQ ID NO: 125190 - DNA, 19 bp, Homo sapiens
ctgtctctgtctcacccac

SEQ ID NO: 125191 - DNA, 23 bp, Homo sapiens
gtgcagctctcagagtctgaagg

SEQ ID NO: 125192 - DNA, 23 bp, Homo sapiens
tgagtctctctctgtaaggtttc

SEQ ID NO: 125193 - DNA, 23 bp, Homo sapiens
tcagggtctcactctgtcaccca

SEQ ID NO: 125194 - DNA, 23 bp, Homo sapiens
ctgggtgtgtctgtctccaaggt

SEQ ID NO: 125195 - DNA, 22 bp, Homo sapiens
atcacagcgtgctttcttgtct

SEQ ID NO: 125196 - DNA, 22 bp, Homo sapiens
tctcactctgtcacctaagctg

SEQ ID NO: 125197 - DNA, 23 bp, Homo sapiens
gttgtgattggtaattttatgtg

SEQ ID NO: 125198 - DNA, 23 bp, Homo sapiens
tcacagggagaagacatggaagc

SEQ ID NO: 125199 - DNA, 23 bp, Homo sapiens
gagctcactctatgtctctctcc

SEQ ID NO: 125200 - DNA, 20 bp, Homo sapiens
gagtctcattctgtcactca

SEQ ID NO: 125201 - DNA, 23 bp, Homo sapiens
tgagttcattgtagattctggat

SEQ ID NO: 125202 - DNA, 23 bp, Homo sapiens
tgagttcattgtagattctggat

SEQ ID NO: 125203 - DNA, 23 bp, Homo sapiens
taagctttacatgcataactctg

SEQ ID NO: 125204 - DNA, 22 bp, Homo sapiens
tcagagagcagtgactgagcag

SEQ ID NO: 125205 - DNA, 23 bp, Homo sapiens
tgtgtgtatatatatatgtgtgt

SEQ ID NO: 125206 - DNA, 21 bp, Homo sapiens
actttttttgttttatggggt

SEQ ID NO: 125207 - DNA, 22 bp, Homo sapiens
ctcactcactcacactcactag

SEQ ID NO: 125208 - DNA, 23 bp, Homo sapiens
ttttttgttcttgttgaagaaac

SEQ ID NO: 125209 - DNA, 23 bp, Homo sapiens
ttttaagctctttgagaaacgtc

SEQ ID NO: 125210 - DNA, 23 bp, Homo sapiens
tttcacagtggctgaactagtgt

SEQ ID NO: 125211 - DNA, 23 bp, Homo sapiens
atatgtgtgtatatgtatatata

SEQ ID NO: 125212 - DNA, 23 bp, Homo sapiens
tatgcaatacatatatatgtgta

SEQ ID NO: 125213 - DNA, 23 bp, Homo sapiens
atctgacttctgtctctctcaca

SEQ ID NO: 125214 - DNA, 23 bp, Homo sapiens
gacagagtctcgctctgtcaccc

SEQ ID NO: 125215 - DNA, 21 bp, Homo sapiens
aaatgctaaatgtgtctgcac

SEQ ID NO: 125216 - DNA, 23 bp, Homo sapiens
agagtctcactctgtcacccagg

SEQ ID NO: 125217 - DNA, 19 bp, Homo sapiens
atgtcagcttgcctctgtg

SEQ ID NO: 125218 - DNA, 23 bp, Homo sapiens
tgaggttggtggatcatttgaag

SEQ ID NO: 125219 - DNA, 23 bp, Homo sapiens
tctcagcctgacacacagctgag

SEQ ID NO: 125220 - DNA, 23 bp, Homo sapiens
agtctcaccctgtcacccaggct

SEQ ID NO: 125221 - DNA, 22 bp, Homo sapiens
ttttgaaggaaaagaaaagttt

SEQ ID NO: 125222 - DNA, 22 bp, Homo sapiens
aaaagatgtgtaaattgcatgt

SEQ ID NO: 125223 - DNA, 22 bp, Homo sapiens
atttaacttctttagtttggaa

SEQ ID NO: 125224 - DNA, 19 bp, Homo sapiens
tgaggttggaggatcattt

SEQ ID NO: 125225 - DNA, 23 bp, Homo sapiens
gtgtgtgtgtgtgactgtgtgtg

SEQ ID NO: 125226 - DNA, 23 bp, Homo sapiens
tctcactggctctgacactggga

SEQ ID NO: 125227 - DNA, 20 bp, Homo sapiens
agtctcgctctgtcacccag

SEQ ID NO: 125228 - DNA, 23 bp, Homo sapiens
tgatgctagctggttgttttgcc

SEQ ID NO: 125229 - DNA, 23 bp, Homo sapiens
taactccttgtctctctgcctct

SEQ ID NO: 125230 - DNA, 19 bp, Homo sapiens
atgcatagaagccacctct

SEQ ID NO: 125231 - DNA, 23 bp, Homo sapiens
tctgtcacacaggctggaatgca

SEQ ID NO: 125232 - DNA, 23 bp, Homo sapiens
agttagaactgagtgaggttagc

SEQ ID NO: 125233 - DNA, 23 bp, Homo sapiens
tgaaagagttgtgaatttcaaga

SEQ ID NO: 125234 - DNA, 22 bp, Homo sapiens
agacagggtcttgtactgtttc

SEQ ID NO: 125235 - DNA, 23 bp, Homo sapiens
agaccagagtctcactctgtcgc

SEQ ID NO: 125236 - DNA, 21 bp, Homo sapiens
aatcagactcactctgtcgcc

SEQ ID NO: 125237 - DNA, 21 bp, Homo sapiens
ttagagtgcagagcctggagt

SEQ ID NO: 125238 - DNA, 23 bp, Homo sapiens
aaccaagagctctcagtcatggt

SEQ ID NO: 125239 - DNA, 22 bp, Homo sapiens
aagcaccttctcaacctgcaat

SEQ ID NO: 125240 - DNA, 22 bp, Homo sapiens
aagttaggtgatgaagggctgg

SEQ ID NO: 125241 - DNA, 23 bp, Homo sapiens
tgtctctctctgtgtctttgtcc

SEQ ID NO: 125242 - DNA, 23 bp, Homo sapiens
acactacaagggtcagaccatgc

SEQ ID NO: 125243 - DNA, 22 bp, Homo sapiens
ttttgaaggaaaagaaaagttt

SEQ ID NO: 125244 - DNA, 22 bp, Homo sapiens
aaaagatgtgtaaattgcatgt

SEQ ID NO: 125245 - DNA, 22 bp, Homo sapiens
atttaacttctttagtttggaa

SEQ ID NO: 125246 - DNA, 23 bp, Homo sapiens
agagtctcactctgtcacccagg

SEQ ID NO: 125247 - DNA, 23 bp, Homo sapiens
tatgtgtatatatatgtgtgtgt

SEQ ID NO: 125248 - DNA, 21 bp, Homo sapiens
gacagagtctcactctctctt

SEQ ID NO: 125249 - DNA, 22 bp, Homo sapiens
gctcacaggctgtgttctgcag

SEQ ID NO: 125250 - DNA, 23 bp, Homo sapiens
aagatgtctcagagaaactagag

SEQ ID NO: 125251 - DNA, 18 bp, Homo sapiens
tgagaaactagtgcagtc

SEQ ID NO: 125252 - DNA, 21 bp, Homo sapiens
agtttgttcttgatcctgttt

SEQ ID NO: 125253 - DNA, 22 bp, Homo sapiens
aaggcccaggagaacctgctgt

SEQ ID NO: 125254 - DNA, 23 bp, Homo sapiens
gagtcgctctgtggctgtgtatt

SEQ ID NO: 125255 - DNA, 23 bp, Homo sapiens
gagtctatggatgtgtgtgcatg

SEQ ID NO: 125256 - DNA, 21 bp, Homo sapiens
acatgcacacacacaaacgtg

SEQ ID NO: 125257 - DNA, 23 bp, Homo sapiens
gggcctctctgtgtccctgtctg

SEQ ID NO: 125258 - DNA, 23 bp, Homo sapiens
catccttcactctgtgcctctgt

SEQ ID NO: 125259 - DNA, 23 bp, Homo sapiens
tcacgtgtcacattcactctcat

SEQ ID NO: 125260 - DNA, 23 bp, Homo sapiens
aagacactgaggcatcaagcagt

SEQ ID NO: 125261 - DNA, 22 bp, Homo sapiens
gtctgactctgtcacccaggct

SEQ ID NO: 125262 - DNA, 23 bp, Homo sapiens
cagcttcagggtgtgacagccgc

SEQ ID NO: 125263 - DNA, 23 bp, Homo sapiens
aaacaggctgctgtagtcccagc

SEQ ID NO: 125264 - DNA, 21 bp, Homo sapiens
gtggtaggatcacttgaggcc

SEQ ID NO: 125265 - DNA, 21 bp, Homo sapiens
gactcggggtccagctgctgc

SEQ ID NO: 125266 - DNA, 23 bp, Homo sapiens
tgtgtctcactgtgggtctcttt

SEQ ID NO: 125267 - DNA, 22 bp, Homo sapiens
agagtctcgctctgtcacccag

SEQ ID NO: 125268 - DNA, 21 bp, Homo sapiens
acagccagggtttccagactg

SEQ ID NO: 125269 - DNA, 23 bp, Homo sapiens
tgaaagaactcaaactggagaga

SEQ ID NO: 125270 - DNA, 20 bp, Homo sapiens
tgtgtgaagagactgtggtt

SEQ ID NO: 125271 - DNA, 23 bp, Homo sapiens
ctgagtctcgcactgtctcccag

SEQ ID NO: 125272 - DNA, 23 bp, Homo sapiens
tctcactctgtgtcacccaggct

SEQ ID NO: 125273 - DNA, 21 bp, Homo sapiens
gtctcgctctgtcactcaggc

SEQ ID NO: 125274 - DNA, 22 bp, Homo sapiens
atgtatctagatgtatatgtat

SEQ ID NO: 125275 - DNA, 20 bp, Homo sapiens
tattttaggccaggcacagt

SEQ ID NO: 125276 - DNA, 22 bp, Homo sapiens
acagagctgtgtgtggtgactg

SEQ ID NO: 125277 - DNA, 22 bp, Homo sapiens
ttgtctcacagttttggaggct

SEQ ID NO: 125278 - DNA, 21 bp, Homo sapiens
tggttccttctgaggctgtga

SEQ ID NO: 125279 - DNA, 23 bp, Homo sapiens
tggctggtacagtattaggtgta

SEQ ID NO: 125280 - DNA, 23 bp, Homo sapiens
tgagttcattgtagattctggat

SEQ ID NO: 125281 - DNA, 23 bp, Homo sapiens
tgagttcattgtagattctggat

SEQ ID NO: 125282 - DNA, 23 bp, Homo sapiens
tgtgagcctcgctctctgagcct

SEQ ID NO: 125283 - DNA, 21 bp, Homo sapiens
gattgtagtgagctatgatgg

SEQ ID NO: 125284 - DNA, 23 bp, Homo sapiens
ccagacacactctgacttagctc

SEQ ID NO: 125285 - DNA, 22 bp, Homo sapiens
atcatggtcattctctgtctca

SEQ ID NO: 125286 - DNA, 23 bp, Homo sapiens
gcatgtatatgtatgtgtgtgtg

SEQ ID NO: 125287 - DNA, 23 bp, Homo sapiens
gcatgtatatgtatgtgtgtgtg

SEQ ID NO: 125288 - DNA, 23 bp, Homo sapiens
tatgtgtatatatatgtatgtat

SEQ ID NO: 125289 - DNA, 21 bp, Homo sapiens
cctgtcacagtcagtttgggg

SEQ ID NO: 125290 - DNA, 23 bp, Homo sapiens
agtccctctgtctgtgtgtgcct

SEQ ID NO: 125291 - DNA, 21 bp, Homo sapiens
gatgattagttaaggtcctag

SEQ ID NO: 125292 - DNA, 23 bp, Homo sapiens
catgactcactgcagtctcagcc

SEQ ID NO: 125293 - DNA, 23 bp, Homo sapiens
tgtctgcctgtctgcctctcata

SEQ ID NO: 125294 - DNA, 21 bp, Homo sapiens
tgagtcagagtctcactctgt

SEQ ID NO: 125295 - DNA, 23 bp, Homo sapiens
tttttaggttccatatgaaattt

SEQ ID NO: 125296 - DNA, 23 bp, Homo sapiens
aggtctcactctgtcacccacgc

SEQ ID NO: 125297 - DNA, 18 bp, Homo sapiens
cagtggtgtgatcatagc

SEQ ID NO: 125298 - DNA, 21 bp, Homo sapiens
agcctacactctccctgttgt

SEQ ID NO: 125299 - DNA, 21 bp, Homo sapiens
tcccactccacctccaggtct

SEQ ID NO: 125300 - DNA, 19 bp, Homo sapiens
tgagaggagacagagccct

SEQ ID NO: 125301 - DNA, 18 bp, Homo sapiens
tacatatacatctagata

SEQ ID NO: 125302 - DNA, 22 bp, Homo sapiens
ttactgcctgctctttctggtt

SEQ ID NO: 125303 - DNA, 21 bp, Homo sapiens
gctagaaagagagctggaact

SEQ ID NO: 125304 - DNA, 23 bp, Homo sapiens
agggtgagagcacagagtggggt

SEQ ID NO: 125305 - DNA, 23 bp, Homo sapiens
tggagtctcactctgtcacccag

SEQ ID NO: 125306 - DNA, 20 bp, Homo sapiens
tgagaggagagtgtgacgag

SEQ ID NO: 125307 - DNA, 23 bp, Homo sapiens
tcacaagtgtttttgttctgctt

SEQ ID NO: 125308 - DNA, 23 bp, Homo sapiens
tctcctagggaaaggttgagctt

SEQ ID NO: 125309 - DNA, 22 bp, Homo sapiens
taaagcacttttttcctttctg

SEQ ID NO: 125310 - DNA, 19 bp, Homo sapiens
agtctcagtctctatgtgg

SEQ ID NO: 125311 - DNA, 23 bp, Homo sapiens
ctgagcctcagtctctccctgtg

SEQ ID NO: 125312 - DNA, 23 bp, Homo sapiens
cctggcaccctcagtccctggca

SEQ ID NO: 125313 - DNA, 20 bp, Homo sapiens
tacctggtgtgattataaag

SEQ ID NO: 125314 - DNA, 22 bp, Homo sapiens
aatgagactgattgtcatatgt

SEQ ID NO: 125315 - DNA, 23 bp, Homo sapiens
tccgtctcagttactttatagcc

SEQ ID NO: 125316 - DNA, 23 bp, Homo sapiens
tatattgttcaggccaaagttgt

SEQ ID NO: 125317 - DNA, 22 bp, Homo sapiens
cagtcagcctgaagtgactgtg

SEQ ID NO: 125318 - DNA, 23 bp, Homo sapiens
tctcactctgtcacccatgctgg

SEQ ID NO: 125319 - DNA, 22 bp, Homo sapiens
acaatgggtgatgatcaaggct

SEQ ID NO: 125320 - DNA, 23 bp, Homo sapiens
aggcacagtctcgctctgtcacc

SEQ ID NO: 125321 - DNA, 23 bp, Homo sapiens
atgagatgtgataatgtagtaga

SEQ ID NO: 125322 - DNA, 23 bp, Homo sapiens
gacagagtctcgctctgtcaccc

SEQ ID NO: 125323 - DNA, 19 bp, Homo sapiens
atatgtctatgtatatatg

SEQ ID NO: 125324 - DNA, 23 bp, Homo sapiens
tggagactcactctgtcacccag

SEQ ID NO: 125325 - DNA, 23 bp, Homo sapiens
cggagtctcgctctgtcactcag

SEQ ID NO: 125326 - DNA, 23 bp, Homo sapiens
cggagtctcgctctgtcactcag

SEQ ID NO: 125327 - DNA, 23 bp, Homo sapiens
gacagagtctcgctctgtcaccc

SEQ ID NO: 125328 - DNA, 23 bp, Homo sapiens
cagggtctgtctctgtctcccag

SEQ ID NO: 125329 - DNA, 23 bp, Homo sapiens
acagagtctcactctgtcgccca

SEQ ID NO: 125330 - DNA, 23 bp, Homo sapiens
acagagtctcactctgtcgccca

SEQ ID NO: 125331 - DNA, 18 bp, Homo sapiens
gacagggtctcactcagt

SEQ ID NO: 125332 - DNA, 23 bp, Homo sapiens
tgcgagtagagagtgtgctctgt

SEQ ID NO: 125333 - DNA, 22 bp, Homo sapiens
acatgtgcacaatgtgcaggtt

SEQ ID NO: 125334 - DNA, 23 bp, Homo sapiens
agagcagagtgtggacacggtgg

SEQ ID NO: 125335 - DNA, 23 bp, Homo sapiens
agacagagtctcactctgttgct

SEQ ID NO: 125336 - DNA, 19 bp, Homo sapiens
gcctgttcacgaggagcgg

SEQ ID NO: 125337 - DNA, 22 bp, Homo sapiens
agagacactgccacttctgttc

SEQ ID NO: 125338 - DNA, 23 bp, Homo sapiens
ttgtctgtgactttgttttctct

SEQ ID NO: 125339 - DNA, 21 bp, Homo sapiens
tctgtcagaatgtctgtccat

SEQ ID NO: 125340 - DNA, 21 bp, Homo sapiens
tgtctgaacatccgtctgtca

SEQ ID NO: 125341 - DNA, 20 bp, Homo sapiens
ctcagaactgagggtgcaca

SEQ ID NO: 125342 - DNA, 23 bp, Homo sapiens
atatacgtatatgtgtatacata

SEQ ID NO: 125343 - DNA, 23 bp, Homo sapiens
atatatgcatgtgtatatgtgtg

SEQ ID NO: 125344 - DNA, 23 bp, Homo sapiens
cagtgtctggatatggagatgat

SEQ ID NO: 125345 - DNA, 23 bp, Homo sapiens
aaagggcttaaagaacttgtagt

SEQ ID NO: 125346 - DNA, 23 bp, Homo sapiens
cctagaattgatttgcatgtgta

SEQ ID NO: 125347 - DNA, 20 bp, Homo sapiens
actctcacatggttgcttat

SEQ ID NO: 125348 - DNA, 22 bp, Homo sapiens
aagcaccttctcaacctgcaat

SEQ ID NO: 125349 - DNA, 22 bp, Homo sapiens
aagttaggtgatgaagggctgg

SEQ ID NO: 125350 - DNA, 23 bp, Homo sapiens
tgtctctctctgtgtctttgtcc

SEQ ID NO: 125351 - DNA, 23 bp, Homo sapiens
acactacaagggtcagaccatgc

SEQ ID NO: 125352 - DNA, 23 bp, Homo sapiens
tgaggttggtggatcatttgaag

SEQ ID NO: 125353 - DNA, 23 bp, Homo sapiens
tctcagcctgacacacagctgag

SEQ ID NO: 125354 - DNA, 23 bp, Homo sapiens
agtctcaccctgtcacccaggct

SEQ ID NO: 125355 - DNA, 23 bp, Homo sapiens
tgagtagatctttttctgatttt

SEQ ID NO: 125356 - DNA, 22 bp, Homo sapiens
ttttgaaggaaaagaaaagttt

SEQ ID NO: 125357 - DNA, 22 bp, Homo sapiens
aaaagatgtgtaaattgcatgt

SEQ ID NO: 125358 - DNA, 22 bp, Homo sapiens
atttaacttctttagtttggaa

SEQ ID NO: 125359 - DNA, 23 bp, Homo sapiens
tgagttcattgtagattctggat

SEQ ID NO: 125360 - DNA, 23 bp, Homo sapiens
tgagttcattgtagattctggat

SEQ ID NO: 125361 - DNA, 23 bp, Homo sapiens
gagagtctctctgtcacccaggc

SEQ ID NO: 125362 - DNA, 23 bp, Homo sapiens
gtccctggctccctcactcctta

SEQ ID NO: 125363 - DNA, 23 bp, Homo sapiens
gggcctcgctctgtggctcaggc

SEQ ID NO: 125364 - DNA, 23 bp, Homo sapiens
atccaggcaggtatagttgacag

SEQ ID NO: 125365 - DNA, 21 bp, Homo sapiens
tgaggtaggaggatcatttgt

SEQ ID NO: 125366 - DNA, 23 bp, Homo sapiens
gacagagtctcgctctgtcaccc

SEQ ID NO: 125367 - DNA, 23 bp, Homo sapiens
acagagtctcgctctgtcaccca

SEQ ID NO: 125368 - DNA, 23 bp, Homo sapiens
agcctttcacactgtctcactct

SEQ ID NO: 125369 - DNA, 23 bp, Homo sapiens
agagtctcactctgtcacccagg

SEQ ID NO: 125370 - DNA, 23 bp, Homo sapiens
agagtctcactctgtcacccagg

SEQ ID NO: 125371 - DNA, 18 bp, Homo sapiens
agtggtcattctgaatct

SEQ ID NO: 125372 - DNA, 20 bp, Homo sapiens
tttagagacaggatctcact

SEQ ID NO: 125373 - DNA, 22 bp, Homo sapiens
gctttctgtctctgtctgcctc

SEQ ID NO: 125374 - DNA, 23 bp, Homo sapiens
gagacagagtctcactctgtcgc

SEQ ID NO: 125375 - DNA, 23 bp, Homo sapiens
agtctccctgtctgtgaagtggg

SEQ ID NO: 125376 - DNA, 23 bp, Homo sapiens
gaggagactgaagtcagactgaa

SEQ ID NO: 125377 - DNA, 23 bp, Homo sapiens
taaatctcctttgccacttcaga

SEQ ID NO: 125378 - DNA, 23 bp, Homo sapiens
gggagtctcactctgtcacccag

SEQ ID NO: 125379 - DNA, 23 bp, Homo sapiens
gagatgagtctcactctgtcgcc

SEQ ID NO: 125380 - DNA, 22 bp, Homo sapiens
aagcaccttctcaacctgcaat

SEQ ID NO: 125381 - DNA, 22 bp, Homo sapiens
aagttaggtgatgaagggctgg

SEQ ID NO: 125382 - DNA, 23 bp, Homo sapiens
tgtctctctctgtgtctttgtcc

SEQ ID NO: 125383 - DNA, 23 bp, Homo sapiens
acactacaagggtcagaccatgc

SEQ ID NO: 125384 - DNA, 23 bp, Homo sapiens
gagttccttgtacattctggata

SEQ ID NO: 125385 - DNA, 23 bp, Homo sapiens
gcatctgagtgtctgtctccgtg

SEQ ID NO: 125386 - DNA, 23 bp, Homo sapiens
aggaagagtagtgagcttcttgt

SEQ ID NO: 125387 - DNA, 23 bp, Homo sapiens
cgactctctgtgtgacactgggc

SEQ ID NO: 125388 - DNA, 23 bp, Homo sapiens
atatatgtgtgtgtggtttccag

SEQ ID NO: 125389 - DNA, 22 bp, Homo sapiens
ttctacactttttctttcaacg

SEQ ID NO: 125390 - DNA, 23 bp, Homo sapiens
tgattcaacatgatggtgacttg

SEQ ID NO: 125391 - DNA, 20 bp, Homo sapiens
tctcagtgacttacaacaat

SEQ ID NO: 125392 - DNA, 18 bp, Homo sapiens
ttgttttgttttgtcttt

SEQ ID NO: 125393 - DNA, 18 bp, Homo sapiens
agaggtaattgcatatat

SEQ ID NO: 125394 - DNA, 23 bp, Homo sapiens
atgcaattgaagagggatttgga

SEQ ID NO: 125395 - DNA, 20 bp, Homo sapiens
attgttggctgctattgttg

SEQ ID NO: 125396 - DNA, 23 bp, Homo sapiens
tgtcagagtctggctctgtcacc

SEQ ID NO: 125397 - DNA, 22 bp, Homo sapiens
tgtctggatttgaagtaatgga

SEQ ID NO: 125398 - DNA, 21 bp, Homo sapiens
agtttcaggatttctctgtgt

SEQ ID NO: 125399 - DNA, 23 bp, Homo sapiens
cagcctcagtgtctcagtcatgc

SEQ ID NO: 125400 - DNA, 23 bp, Homo sapiens
caaacagaaaactgtgaggtcag

SEQ ID NO: 125401 - DNA, 23 bp, Homo sapiens
gtctgcctctgtggctgcttaaa

SEQ ID NO: 125402 - DNA, 23 bp, Homo sapiens
tgtttgtgtatatgtgtaagtct

SEQ ID NO: 125403 - DNA, 23 bp, Homo sapiens
aattcttctgatgtttgctcatt

SEQ ID NO: 125404 - DNA, 23 bp, Homo sapiens
ccagccttcagactctgagagct

SEQ ID NO: 125405 - DNA, 23 bp, Homo sapiens
tctcaggtctcagactgtgagtg

SEQ ID NO: 125406 - DNA, 23 bp, Homo sapiens
aacagtagacactgaggactcta

SEQ ID NO: 125407 - DNA, 21 bp, Homo sapiens
ggtcaacagtacctattgagt

SEQ ID NO: 125408 - DNA, 23 bp, Homo sapiens
agagtctcactctgtcacccagg

SEQ ID NO: 125409 - DNA, 23 bp, Homo sapiens
gatcacagtctgaaatattagag

SEQ ID NO: 125410 - DNA, 23 bp, Homo sapiens
tgactgacacactcaatcaagac

SEQ ID NO: 125411 - DNA, 19 bp, Homo sapiens
acacttggaggaaatcagg

SEQ ID NO: 125412 - DNA, 21 bp, Homo sapiens
tgattagtgatgtagaatatt

SEQ ID NO: 125413 - DNA, 23 bp, Homo sapiens
gtcagagtggaggtcctggtctg

SEQ ID NO: 125414 - DNA, 23 bp, Homo sapiens
tgtgtgtctgtgtcctaatttcc

SEQ ID NO: 125415 - DNA, 23 bp, Homo sapiens
taaccacatgatcttgagcaagt

SEQ ID NO: 125416 - DNA, 23 bp, Homo sapiens
actctctgagcctcagttggggg

SEQ ID NO: 125417 - DNA, 21 bp, Homo sapiens
taggaagttgagaaatcggtt

SEQ ID NO: 125418 - DNA, 23 bp, Homo sapiens
aatctctgtttttaaatctcctt

SEQ ID NO: 125419 - DNA, 23 bp, Homo sapiens
tcagggtctctgtgtgtttgctg

SEQ ID NO: 125420 - DNA, 20 bp, Homo sapiens
tcacagagcacagacagctg

SEQ ID NO: 125421 - DNA, 23 bp, Homo sapiens
ttttaaagactttttattttgaa

SEQ ID NO: 125422 - DNA, 23 bp, Homo sapiens
ggaagttggaaaaatagtacata

SEQ ID NO: 125423 - DNA, 20 bp, Homo sapiens
actgcatatacacacgcagt

SEQ ID NO: 125424 - DNA, 23 bp, Homo sapiens
tatgcagtgtgtgtgtgtgtgtg

SEQ ID NO: 125425 - DNA, 22 bp, Homo sapiens
aaaattttgtagagacagaggt

SEQ ID NO: 125426 - DNA, 23 bp, Homo sapiens
gtatcagcaactctaactgatag

SEQ ID NO: 125427 - DNA, 21 bp, Homo sapiens
acagagcctgaccctgtctct

SEQ ID NO: 125428 - DNA, 21 bp, Homo sapiens
tcagacagtctcgctctctca

SEQ ID NO: 125429 - DNA, 18 bp, Homo sapiens
gagtgtatgtgtgtgtgt

SEQ ID NO: 125430 - DNA, 21 bp, Homo sapiens
agtgagtacaagggcctgctt

SEQ ID NO: 125431 - DNA, 23 bp, Homo sapiens
tttgagacggagtctcactctgt

SEQ ID NO: 125432 - DNA, 23 bp, Homo sapiens
acagagtctcactctgtcgccca

SEQ ID NO: 125433 - DNA, 23 bp, Homo sapiens
tgagacagagtctcgctctgtca

SEQ ID NO: 125434 - DNA, 21 bp, Homo sapiens
attggctctctctctgtctct

SEQ ID NO: 125435 - DNA, 18 bp, Homo sapiens
tccagggttgagtcccag

SEQ ID NO: 125436 - DNA, 21 bp, Homo sapiens
cagtggcatgatgatagctca

SEQ ID NO: 125437 - DNA, 19 bp, Homo sapiens
ttttgagacggagtttcac

SEQ ID NO: 125438 - DNA, 23 bp, Homo sapiens
cggagtctcactctgtcacccag

SEQ ID NO: 125439 - DNA, 23 bp, Homo sapiens
gagtctcactctgtcacccaggc

SEQ ID NO: 125440 - DNA, 23 bp, Homo sapiens
gactgagtctcgctctgtcaccc

SEQ ID NO: 125441 - DNA, 23 bp, Homo sapiens
atttatgagcatgctcattcgat

SEQ ID NO: 125442 - DNA, 21 bp, Homo sapiens
tatcctgtaagacctgcctgc

SEQ ID NO: 125443 - DNA, 23 bp, Homo sapiens
agtgagagtagtgtgtatagtgt

SEQ ID NO: 125444 - DNA, 22 bp, Homo sapiens
ttaaacttgatgttctggtgag

SEQ ID NO: 125445 - DNA, 23 bp, Homo sapiens
ctggctctgtgggtcactctgct

SEQ ID NO: 125446 - DNA, 18 bp, Homo sapiens
acagtgataaacacagtc

SEQ ID NO: 125447 - DNA, 23 bp, Homo sapiens
actggccctctctctgtctcagc

SEQ ID NO: 125448 - DNA, 23 bp, Homo sapiens
atgaatgaatgaatgaatgtgca

SEQ ID NO: 125449 - DNA, 23 bp, Homo sapiens
tacagacagcactgagaggtcac

SEQ ID NO: 125450 - DNA, 21 bp, Homo sapiens
acagagccaggattggaaccc

SEQ ID NO: 125451 - DNA, 23 bp, Homo sapiens
tgaggaagggtttgttgaatcca

SEQ ID NO: 125452 - DNA, 23 bp, Homo sapiens
atgggtgagacagagtctcactc

SEQ ID NO: 125453 - DNA, 23 bp, Homo sapiens
tacagagcaactggaatcctcat

SEQ ID NO: 125454 - DNA, 23 bp, Homo sapiens
aaatgctgtcactgtcactctgg

SEQ ID NO: 125455 - DNA, 23 bp, Homo sapiens
tattaggtacacttacaagtttc

SEQ ID NO: 125456 - DNA, 18 bp, Homo sapiens
tacaacttcatattcaag

SEQ ID NO: 125457 - DNA, 23 bp, Homo sapiens
cggagtctcactctgtcacccag

SEQ ID NO: 125458 - DNA, 23 bp, Homo sapiens
gagtctcactctgtcacccaggc

SEQ ID NO: 125459 - DNA, 23 bp, Homo sapiens
atatgcagttctcattatgatgt

SEQ ID NO: 125460 - DNA, 23 bp, Homo sapiens
tctccaggacagaatttggttca

SEQ ID NO: 125461 - DNA, 21 bp, Homo sapiens
tctacaaatgtttattagatt

SEQ ID NO: 125462 - DNA, 18 bp, Homo sapiens
tggtacagggtgtgctca

SEQ ID NO: 125463 - DNA, 22 bp, Homo sapiens
tttagatggtgtctcgctctgt

SEQ ID NO: 125464 - DNA, 20 bp, Homo sapiens
tatcagtctttttaattgtg

SEQ ID NO: 125465 - DNA, 18 bp, Homo sapiens
aagaccagtgatatagag

SEQ ID NO: 125466 - DNA, 23 bp, Homo sapiens
acagagtctcactctgtcgccca

SEQ ID NO: 125467 - DNA, 18 bp, Homo sapiens
aaagggagtgaatcactt

SEQ ID NO: 125468 - DNA, 19 bp, Homo sapiens
tgacagagagcaatcgatg

SEQ ID NO: 125469 - DNA, 21 bp, Homo sapiens
tgaacacctgctgtataccag

SEQ ID NO: 125470 - DNA, 23 bp, Homo sapiens
taccagctcctctctgtcactct

SEQ ID NO: 125471 - DNA, 22 bp, Homo sapiens
tgattttcacttggcattggag

SEQ ID NO: 125472 - DNA, 23 bp, Homo sapiens
tctgtcagtgctaatgaaactgg

SEQ ID NO: 125473 - DNA, 21 bp, Homo sapiens
tgaggttgatccaattttggt

SEQ ID NO: 125474 - DNA, 23 bp, Homo sapiens
agttgagagtgaccttaagcagt

SEQ ID NO: 125475 - DNA, 23 bp, Homo sapiens
aaagcccaaactctctctctctc

SEQ ID NO: 125476 - DNA, 23 bp, Homo sapiens
tcccccagttctttgcagtgttt

SEQ ID NO: 125477 - DNA, 21 bp, Homo sapiens
tctgtatgtatatatatgtgt

SEQ ID NO: 125478 - DNA, 23 bp, Homo sapiens
atatgtgtgtatatatgtgtgtg

SEQ ID NO: 125479 - DNA, 23 bp, Homo sapiens
acagagtctcgcactgtcaccca

SEQ ID NO: 125480 - DNA, 23 bp, Homo sapiens
tctgagcagagagtgagcacaga

SEQ ID NO: 125481 - DNA, 19 bp, Homo sapiens
tctctctaactgactctcc

SEQ ID NO: 125482 - DNA, 23 bp, Homo sapiens
tctctctcacagttgagtgagat

SEQ ID NO: 125483 - DNA, 23 bp, Homo sapiens
atctctctcacagttgagtgaga

SEQ ID NO: 125484 - DNA, 22 bp, Homo sapiens
tgagcttgtaggtagaattgta

SEQ ID NO: 125485 - DNA, 21 bp, Homo sapiens
tctttctatttatacctcaat

SEQ ID NO: 125486 - DNA, 23 bp, Homo sapiens
tattctctctactttttatgtgt

SEQ ID NO: 125487 - DNA, 22 bp, Homo sapiens
cagcccctcacactctgagtct

SEQ ID NO: 125488 - DNA, 23 bp, Homo sapiens
gtggggtagtagtaggtggtcag

SEQ ID NO: 125489 - DNA, 23 bp, Homo sapiens
atgaggttttttaaagatggaaa

SEQ ID NO: 125490 - DNA, 23 bp, Homo sapiens
tgtgtattgtatagtagatacac

SEQ ID NO: 125491 - DNA, 23 bp, Homo sapiens
tctttcctcatttctgaggggtt

SEQ ID NO: 125492 - DNA, 21 bp, Homo sapiens
tgtgaacagagattttgatct

SEQ ID NO: 125493 - DNA, 23 bp, Homo sapiens
tgaaagaggagacagagctgtca

SEQ ID NO: 125494 - DNA, 23 bp, Homo sapiens
agcagcattgtacagggctatga

SEQ ID NO: 125495 - DNA, 23 bp, Homo sapiens
gacagagtctcgctctgtcaccc

SEQ ID NO: 125496 - DNA, 23 bp, Homo sapiens
accagagttcaaggcccagtctg

SEQ ID NO: 125497 - DNA, 23 bp, Homo sapiens
agctagagctgccaattgtttga

SEQ ID NO: 125498 - DNA, 23 bp, Homo sapiens
ttttgaaacagggtctcactctg

SEQ ID NO: 125499 - DNA, 23 bp, Homo sapiens
gagacagtctcgctctgtcaccc

SEQ ID NO: 125500 - DNA, 23 bp, Homo sapiens
gaattgtattcgaagatgtcaga

SEQ ID NO: 125501 - DNA, 21 bp, Homo sapiens
gtagatccacctctctgagcc

SEQ ID NO: 125502 - DNA, 23 bp, Homo sapiens
acaggatctcgctctgtcactca

SEQ ID NO: 125503 - DNA, 23 bp, Homo sapiens
tatgtatgtttatatatgtgtat

SEQ ID NO: 125504 - DNA, 23 bp, Homo sapiens
tgtgtgtatatatgtgtatatgt

SEQ ID NO: 125505 - DNA, 23 bp, Homo sapiens
actcaccttgtaggatgttttct

SEQ ID NO: 125506 - DNA, 19 bp, Homo sapiens
tgtgagccactgtgcccag

SEQ ID NO: 125507 - DNA, 23 bp, Homo sapiens
taagtgccagtctgtgtctctca

SEQ ID NO: 125508 - DNA, 22 bp, Homo sapiens
tatatatctgtagctaaagatt

SEQ ID NO: 125509 - DNA, 18 bp, Homo sapiens
caccctctctcacactct

SEQ ID NO: 125510 - DNA, 23 bp, Homo sapiens
atacacacaaatatatatgtgta

SEQ ID NO: 125511 - DNA, 21 bp, Homo sapiens
tgtgtatatatgggtgtgtgt

SEQ ID NO: 125512 - DNA, 21 bp, Homo sapiens
gcatgtatgtatgtatgtgca

SEQ ID NO: 125513 - DNA, 23 bp, Homo sapiens
tctccctctcagcgaggttgtca

SEQ ID NO: 125514 - DNA, 20 bp, Homo sapiens
atatgtaaatgtatatgtat

SEQ ID NO: 125515 - DNA, 23 bp, Homo sapiens
acagagtctcgctctgtcactca

SEQ ID NO: 125516 - DNA, 19 bp, Homo sapiens
agagggaaactctgtctct

SEQ ID NO: 125517 - DNA, 23 bp, Homo sapiens
acacagtacagtcttggagatgg

SEQ ID NO: 125518 - DNA, 23 bp, Homo sapiens
agtctcgctctgtcacccaggct

SEQ ID NO: 125519 - DNA, 23 bp, Homo sapiens
tgggtctctgttacacttttgta

SEQ ID NO: 125520 - DNA, 23 bp, Homo sapiens
tttcattattattatatctgtta

SEQ ID NO: 125521 - DNA, 22 bp, Homo sapiens
attattgttctttgatttcatg

SEQ ID NO: 125522 - DNA, 23 bp, Homo sapiens
tgacatgacagttttatgtcata

SEQ ID NO: 125523 - DNA, 18 bp, Homo sapiens
taagtatatctatacaag

SEQ ID NO: 125524 - DNA, 20 bp, Homo sapiens
atatgtaaatgtatgcttta

SEQ ID NO: 125525 - DNA, 21 bp, Homo sapiens
tatgtgtatatatatatatgt

SEQ ID NO: 125526 - DNA, 23 bp, Homo sapiens
tcagagtctcactgtcacccagg

SEQ ID NO: 125527 - DNA, 23 bp, Homo sapiens
actcactcactgtttctttaggc

SEQ ID NO: 125528 - DNA, 23 bp, Homo sapiens
gaagacagagaggatacactggg

SEQ ID NO: 125529 - DNA, 22 bp, Homo sapiens
tgtgtgtgtgtatatatatatg

SEQ ID NO: 125530 - DNA, 20 bp, Homo sapiens
tgtgtatatatatgtatgtg

SEQ ID NO: 125531 - DNA, 21 bp, Homo sapiens
atataaatatgtataagtgtg

SEQ ID NO: 125532 - DNA, 19 bp, Homo sapiens
gagtgtgtggtgttaaagt

SEQ ID NO: 125533 - DNA, 23 bp, Homo sapiens
ctgtctcactgtcttatttctgg

SEQ ID NO: 125534 - DNA, 22 bp, Homo sapiens
tgtgtatatatgtgtgtgtata

SEQ ID NO: 125535 - DNA, 18 bp, Homo sapiens
atgtgtgtatatatatgt

SEQ ID NO: 125536 - DNA, 21 bp, Homo sapiens
atactcagttatatatatcaa

SEQ ID NO: 125537 - DNA, 23 bp, Homo sapiens
ttttaaaggtgtcagactctcaa

SEQ ID NO: 125538 - DNA, 21 bp, Homo sapiens
acagatgtgtgccaccacatc

SEQ ID NO: 125539 - DNA, 23 bp, Homo sapiens
tttagtagagatgggggtctcat

SEQ ID NO: 125540 - DNA, 23 bp, Homo sapiens
tgagttcattgtagattctggat

SEQ ID NO: 125541 - DNA, 23 bp, Homo sapiens
tgagttcattgtagattctggat

SEQ ID NO: 125542 - DNA, 23 bp, Homo sapiens
aggcagaagtgtcagtgcagagt

SEQ ID NO: 125543 - DNA, 19 bp, Homo sapiens
tcaattttgtgtgcatatg

SEQ ID NO: 125544 - DNA, 23 bp, Homo sapiens
attattgttttctagctgaggga

SEQ ID NO: 125545 - DNA, 20 bp, Homo sapiens
tcatctatatatatatatgt

SEQ ID NO: 125546 - DNA, 20 bp, Homo sapiens
tatgccaacaataaccagag

SEQ ID NO: 125547 - DNA, 22 bp, Homo sapiens
tctacttctacaagaggatagt

SEQ ID NO: 125548 - DNA, 19 bp, Homo sapiens
taaactagtagatatggct

SEQ ID NO: 125549 - DNA, 23 bp, Homo sapiens
agggtagtatgtagattagtttt

SEQ ID NO: 125550 - DNA, 21 bp, Homo sapiens
tgtatacaatatgtatatgat

SEQ ID NO: 125551 - DNA, 18 bp, Homo sapiens
tctatatatgtagtatgt

SEQ ID NO: 125552 - DNA, 22 bp, Homo sapiens
ttactgcaacatctgcctcctg

SEQ ID NO: 125553 - DNA, 23 bp, Homo sapiens
ttcaagctgtgtcccaaaggtct

SEQ ID NO: 125554 - DNA, 23 bp, Homo sapiens
gaggagtggttgtctgatcaaag

SEQ ID NO: 125555 - DNA, 20 bp, Homo sapiens
aatgtgcatatatgtatatg

SEQ ID NO: 125556 - DNA, 19 bp, Homo sapiens
atctatacatatatgtgtg

SEQ ID NO: 125557 - DNA, 20 bp, Homo sapiens
ctggaaggatgtttaaatat

SEQ ID NO: 125558 - DNA, 21 bp, Homo sapiens
tgtgcttccaactaaagtcag

SEQ ID NO: 125559 - DNA, 23 bp, Homo sapiens
tgtatgtatttgttgtctgcaac

SEQ ID NO: 125560 - DNA, 23 bp, Homo sapiens
tgagatggagtttcactcttgtt

SEQ ID NO: 125561 - DNA, 23 bp, Homo sapiens
aatgcaaatgttatgtaaatagt

SEQ ID NO: 125562 - DNA, 23 bp, Homo sapiens
acatcagtgtgctctctctctct

SEQ ID NO: 125563 - DNA, 23 bp, Homo sapiens
tatatgtatttgagcatatgtat

SEQ ID NO: 125564 - DNA, 20 bp, Homo sapiens
accttgatgtgtttgctgtt

SEQ ID NO: 125565 - DNA, 23 bp, Homo sapiens
aagttgtgactggaagaaatatc

SEQ ID NO: 125566 - DNA, 18 bp, Homo sapiens
actcagtgaagcttctac

SEQ ID NO: 125567 - DNA, 19 bp, Homo sapiens
gagagagagagacagagag

SEQ ID NO: 125568 - DNA, 23 bp, Homo sapiens
tgaagtctcactctgtcacccag

SEQ ID NO: 125569 - DNA, 21 bp, Homo sapiens
tgactttatatttgtatgatg

SEQ ID NO: 125570 - DNA, 23 bp, Homo sapiens
tgagttcattgtagattctggat

SEQ ID NO: 125571 - DNA, 23 bp, Homo sapiens
tgagttcattgtagattctggat

SEQ ID NO: 125572 - DNA, 22 bp, Homo sapiens
tttctctgaacttagtgatgag

SEQ ID NO: 125573 - DNA, 20 bp, Homo sapiens
tgagcagttcacatgatgct

SEQ ID NO: 125574 - DNA, 22 bp, Homo sapiens
ccagtctctgtgactcaaaaac

SEQ ID NO: 125575 - DNA, 23 bp, Homo sapiens
tgtttctgtgcatgtgcatgcac

SEQ ID NO: 125576 - DNA, 20 bp, Homo sapiens
tctaaggatgtaagtggtat

SEQ ID NO: 125577 - DNA, 22 bp, Homo sapiens
tctgtctgtgtggtttgcatct

SEQ ID NO: 125578 - DNA, 23 bp, Homo sapiens
attcagaggttacatgatcaggt

SEQ ID NO: 125579 - DNA, 20 bp, Homo sapiens
tatctacatgtatatatgtg

SEQ ID NO: 125580 - DNA, 23 bp, Homo sapiens
ttgacactgagaatggaggctct

SEQ ID NO: 125581 - DNA, 23 bp, Homo sapiens
tttgtactctcagtctgtgtctt

SEQ ID NO: 125582 - DNA, 23 bp, Homo sapiens
tttttgagacggagttttgctct

SEQ ID NO: 125583 - DNA, 23 bp, Homo sapiens
tgtttgcagcactatagggtaaa

SEQ ID NO: 125584 - DNA, 19 bp, Homo sapiens
tgtgagggtgtttccagag

SEQ ID NO: 125585 - DNA, 23 bp, Homo sapiens
ttcttttttatgtaaggttgcag

SEQ ID NO: 125586 - DNA, 18 bp, Homo sapiens
gataagaacagagttagc

SEQ ID NO: 125587 - DNA, 23 bp, Homo sapiens
aaacataaacactctggaagtga

SEQ ID NO: 125588 - DNA, 19 bp, Homo sapiens
acgtatatatatgtgtgtg

SEQ ID NO: 125589 - DNA, 20 bp, Homo sapiens
acacacacacacatacatgt

SEQ ID NO: 125590 - DNA, 21 bp, Homo sapiens
tgagatcaaggtgtaagcaag

SEQ ID NO: 125591 - DNA, 20 bp, Homo sapiens
tgagaagataatctgtttcc

SEQ ID NO: 125592 - DNA, 23 bp, Homo sapiens
ttaagagtcaggacagagtgtgg

SEQ ID NO: 125593 - DNA, 20 bp, Homo sapiens
cttagtggactaggagaagg

SEQ ID NO: 125594 - DNA, 23 bp, Homo sapiens
tctgaatctcagtctctaagggg

SEQ ID NO: 125595 - DNA, 23 bp, Homo sapiens
tctgtgaagaaagtcaatggtag

SEQ ID NO: 125596 - DNA, 20 bp, Homo sapiens
aatcagagttttgttggact

SEQ ID NO: 125597 - DNA, 21 bp, Homo sapiens
ttttgagacggagtcttactc

SEQ ID NO: 125598 - DNA, 23 bp, Homo sapiens
agacagtggaatctgaccagtct

SEQ ID NO: 125599 - DNA, 23 bp, Homo sapiens
tgtgaatggatgtgaaatgaatt

SEQ ID NO: 125600 - DNA, 23 bp, Homo sapiens
aaactgtagctccatcagtgagt

SEQ ID NO: 125601 - DNA, 23 bp, Homo sapiens
ctcttctcactgcaacctctgcc

SEQ ID NO: 125602 - DNA, 18 bp, Homo sapiens
tgagatggagtctggctc

SEQ ID NO: 125603 - DNA, 23 bp, Homo sapiens
tgagagaagtgaggctggagact

SEQ ID NO: 125604 - DNA, 23 bp, Homo sapiens
gtgtgtgtatatatatgtgtgtg

SEQ ID NO: 125605 - DNA, 23 bp, Homo sapiens
ttttagtcatgcaaatgtattac

SEQ ID NO: 125606 - DNA, 22 bp, Homo sapiens
tgaagacagaagtcttacggta

SEQ ID NO: 125607 - DNA, 23 bp, Homo sapiens
agttagtcttgtagcatctgtat

SEQ ID NO: 125608 - DNA, 23 bp, Homo sapiens
agatagtctctggctaatttaag

SEQ ID NO: 125609 - DNA, 22 bp, Homo sapiens
catctctctgtctaaagacaag

SEQ ID NO: 125610 - DNA, 23 bp, Homo sapiens
atgtgagcctctgtgtctgtgtg

SEQ ID NO: 125611 - DNA, 23 bp, Homo sapiens
tgagttcattgtagattctggat

SEQ ID NO: 125612 - DNA, 23 bp, Homo sapiens
tgagttcattgtagattctggat

SEQ ID NO: 125613 - DNA, 20 bp, Homo sapiens
gtaagacttcttgtatttct

SEQ ID NO: 125614 - DNA, 23 bp, Homo sapiens
tagatctcagaatttgttttatt

SEQ ID NO: 125615 - DNA, 23 bp, Homo sapiens
gtcacatatgcatgttaactgtc

SEQ ID NO: 125616 - DNA, 20 bp, Homo sapiens
cacatgtgcaggatgtgcag

SEQ ID NO: 125617 - DNA, 21 bp, Homo sapiens
actgatatgtgtatgtgtata

SEQ ID NO: 125618 - DNA, 23 bp, Homo sapiens
tatacacacatgtatgtatgtat

SEQ ID NO: 125619 - DNA, 23 bp, Homo sapiens
tatacatgcatgtatgtgtgtgt

SEQ ID NO: 125620 - DNA, 23 bp, Homo sapiens
aagtcacagcatgttgtttttag

SEQ ID NO: 125621 - DNA, 23 bp, Homo sapiens
tttttacgtcatatagaagaaaa

SEQ ID NO: 125622 - DNA, 19 bp, Homo sapiens
tgagatggagtctcactct

SEQ ID NO: 125623 - DNA, 21 bp, Homo sapiens
tgtgtatatatatacatatgt

SEQ ID NO: 125624 - DNA, 20 bp, Homo sapiens
agcagctaaaaggtcaggta

SEQ ID NO: 125625 - DNA, 23 bp, Homo sapiens
ttaaggacagggtctcactctgt

SEQ ID NO: 125626 - DNA, 20 bp, Homo sapiens
aaaggaagaaatggagcagt

SEQ ID NO: 125627 - DNA, 22 bp, Homo sapiens
tgtcactttgtataaatgtctt

SEQ ID NO: 125628 - DNA, 22 bp, Homo sapiens
tagctgggatcacaggtgcaac

SEQ ID NO: 125629 - DNA, 22 bp, Homo sapiens
tatgtatgtatgtatatgtata

SEQ ID NO: 125630 - DNA, 23 bp, Homo sapiens
aaccaacctcaggcagagtagct

SEQ ID NO: 125631 - DNA, 23 bp, Homo sapiens
tgactcactctgtctgagccagt

SEQ ID NO: 125632 - DNA, 21 bp, Homo sapiens
attgcctaataattgagttct

SEQ ID NO: 125633 - DNA, 23 bp, Homo sapiens
cactgtcacactgaattgagttt

SEQ ID NO: 125634 - DNA, 20 bp, Homo sapiens
ttttagtacagatggggttt

SEQ ID NO: 125635 - DNA, 21 bp, Homo sapiens
tctactggaaatccaatgaga

SEQ ID NO: 125636 - DNA, 20 bp, Homo sapiens
tggagtctcactctgtcacc

SEQ ID NO: 125637 - DNA, 20 bp, Homo sapiens
tgtgagagcacagtgaggag

SEQ ID NO: 125638 - DNA, 21 bp, Homo sapiens
acacactctgggagaatgcca

SEQ ID NO: 125639 - DNA, 23 bp, Homo sapiens
aatctgtctgagtcttttcgttt

SEQ ID NO: 125640 - DNA, 23 bp, Homo sapiens
ttttgagacggagtcttgctctg

SEQ ID NO: 125641 - DNA, 23 bp, Homo sapiens
tgagttcattgtagattctggat

SEQ ID NO: 125642 - DNA, 23 bp, Homo sapiens
tgagttcattgtagattctggat

SEQ ID NO: 125643 - DNA, 22 bp, Homo sapiens
tctgaaggtcattgagtgtcct

SEQ ID NO: 125644 - DNA, 23 bp, Homo sapiens
gcaagatctcgctctgtcactca

SEQ ID NO: 125645 - DNA, 22 bp, Homo sapiens
tgcaggggcttgatcatggctt

SEQ ID NO: 125646 - DNA, 22 bp, Homo sapiens
ctcaacttgtaatatgctgata

SEQ ID NO: 125647 - DNA, 20 bp, Homo sapiens
aagctgctatagcacagctg

SEQ ID NO: 125648 - DNA, 21 bp, Homo sapiens
tctcactctgtcacccaggct

SEQ ID NO: 125649 - DNA, 20 bp, Homo sapiens
acacacatgtacatatgtaa

SEQ ID NO: 125650 - DNA, 21 bp, Homo sapiens
tatatattctgtatatgtatg

SEQ ID NO: 125651 - DNA, 23 bp, Homo sapiens
actgtctcactgtctctttttgg

SEQ ID NO: 125652 - DNA, 23 bp, Homo sapiens
tgtgtcaagagactctgggtgat

SEQ ID NO: 125653 - DNA, 18 bp, Homo sapiens
agcagtaaggcatttgag

SEQ ID NO: 125654 - DNA, 20 bp, Homo sapiens
ttagtcaatggtattttttt

SEQ ID NO: 125655 - DNA, 20 bp, Homo sapiens
ttacatgtatttatgtatac

SEQ ID NO: 125656 - DNA, 19 bp, Homo sapiens
tgactatgcataggatgtc

SEQ ID NO: 125657 - DNA, 23 bp, Homo sapiens
tctggttgtttagagaggtgtgt

SEQ ID NO: 125658 - DNA, 22 bp, Homo sapiens
tgtgagaaaacacagaggtcac

SEQ ID NO: 125659 - DNA, 22 bp, Homo sapiens
tgcctctgttctcactacctga

SEQ ID NO: 125660 - DNA, 20 bp, Homo sapiens
acacacacacgtatatatat

SEQ ID NO: 125661 - DNA, 22 bp, Homo sapiens
ctcagatgacacagaggagatc

SEQ ID NO: 125662 - DNA, 23 bp, Homo sapiens
gctgggtgtgtctgtgagtgtgt

SEQ ID NO: 125663 - DNA, 20 bp, Homo sapiens
cacagagagattcccatctc

SEQ ID NO: 125664 - DNA, 23 bp, Homo sapiens
tgtgtatatatgtatatatgtgc

SEQ ID NO: 125665 - DNA, 19 bp, Homo sapiens
ctgtaaacatttagtactt

SEQ ID NO: 125666 - DNA, 23 bp, Homo sapiens
actgagtctcgctctgtcaccca

SEQ ID NO: 125667 - DNA, 23 bp, Homo sapiens
tgagacagagtctcgctctgtca

SEQ ID NO: 125668 - DNA, 19 bp, Homo sapiens
actgcagtttctgcctcct

SEQ ID NO: 125669 - DNA, 23 bp, Homo sapiens
agagtctcactctgtcacccagg

SEQ ID NO: 125670 - DNA, 23 bp, Homo sapiens
tgagttcattgtagattctggat

SEQ ID NO: 125671 - DNA, 23 bp, Homo sapiens
tgagttcattgtagattctggat

SEQ ID NO: 125672 - DNA, 21 bp, Homo sapiens
tgaggtaggaggatcacttga

SEQ ID NO: 125673 - DNA, 23 bp, Homo sapiens
ctgagcaacatagtgagattcca

SEQ ID NO: 125674 - DNA, 23 bp, Homo sapiens
atgaagaggtgctgtggaagtgt

SEQ ID NO: 125675 - DNA, 23 bp, Homo sapiens
ttaatctttttcaggaaatgatt

SEQ ID NO: 125676 - DNA, 22 bp, Homo sapiens
tctccctcactctgtgcctctc

SEQ ID NO: 125677 - DNA, 23 bp, Homo sapiens
aaaaacacaggcttggatctagg

SEQ ID NO: 125678 - DNA, 23 bp, Homo sapiens
agttcggactcagtctctgactg

SEQ ID NO: 125679 - DNA, 23 bp, Homo sapiens
ttctgtgaagaaagtcagtggta

SEQ ID NO: 125680 - DNA, 23 bp, Homo sapiens
tgttagtctgatgggcttccctt

SEQ ID NO: 125681 - DNA, 23 bp, Homo sapiens
ctctctctctgagtgaatccagt

SEQ ID NO: 125682 - DNA, 23 bp, Homo sapiens
aggaacacataatggaaagtttt

SEQ ID NO: 125683 - DNA, 23 bp, Homo sapiens
tttttctgagacaatatcttgtt

SEQ ID NO: 125684 - DNA, 20 bp, Homo sapiens
atatgcatatatatacatat

SEQ ID NO: 125685 - DNA, 22 bp, Homo sapiens
gtctcactctgccacccaggct

SEQ ID NO: 125686 - DNA, 23 bp, Homo sapiens
aatttccttgcttatagtagtgt

SEQ ID NO: 125687 - DNA, 23 bp, Homo sapiens
aagtgtgtgtgcatgtgcatgtg

SEQ ID NO: 125688 - DNA, 23 bp, Homo sapiens
tatgttgattttgtatcctgaaa

SEQ ID NO: 125689 - DNA, 22 bp, Homo sapiens
tgggtgagtgttgactgagttc

SEQ ID NO: 125690 - DNA, 23 bp, Homo sapiens
agatggagtctcgctctgtcacc

SEQ ID NO: 125691 - DNA, 21 bp, Homo sapiens
tctgtgtctctgtttcttagt

SEQ ID NO: 125692 - DNA, 23 bp, Homo sapiens
tgagttcattgtagattctggat

SEQ ID NO: 125693 - DNA, 23 bp, Homo sapiens
tgagttcattgtagattctggat

SEQ ID NO: 125694 - DNA, 20 bp, Homo sapiens
agtggataaagaaactgtga

SEQ ID NO: 125695 - DNA, 20 bp, Homo sapiens
gacgtaaaccccaagggtac

SEQ ID NO: 125696 - DNA, 23 bp, Homo sapiens
atgtgtatttatatgtatgtgta

SEQ ID NO: 125697 - DNA, 21 bp, Homo sapiens
aactgtatttatatgtatgtg

SEQ ID NO: 125698 - DNA, 23 bp, Homo sapiens
tctgagactcagtctttccagtg

SEQ ID NO: 125699 - DNA, 23 bp, Homo sapiens
tacttcagctcttggtagacagt

SEQ ID NO: 125700 - DNA, 22 bp, Homo sapiens
tctgtgtgtttgtctctcatct

SEQ ID NO: 125701 - DNA, 23 bp, Homo sapiens
acaactgaggaacttgaaacata

SEQ ID NO: 125702 - DNA, 23 bp, Homo sapiens
atgtggaatacaaatgaatagga

SEQ ID NO: 125703 - DNA, 19 bp, Homo sapiens
cacggttgactgagagtaa

SEQ ID NO: 125704 - DNA, 23 bp, Homo sapiens
tgagttcattgtagattctggat

SEQ ID NO: 125705 - DNA, 23 bp, Homo sapiens
tgagttcattgtagattctggat

SEQ ID NO: 125706 - DNA, 22 bp, Homo sapiens
tattatattgtatatgtacatg

SEQ ID NO: 125707 - DNA, 20 bp, Homo sapiens
atatgtatatgtatatacgt

SEQ ID NO: 125708 - DNA, 22 bp, Homo sapiens
aacacacccagctaatttttgt

SEQ ID NO: 125709 - DNA, 19 bp, Homo sapiens
tgactctgactctgactct

SEQ ID NO: 125710 - DNA, 19 bp, Homo sapiens
tgccagcctggctcaatac

SEQ ID NO: 125711 - DNA, 23 bp, Homo sapiens
tgagttcattgtagattctggat

SEQ ID NO: 125712 - DNA, 23 bp, Homo sapiens
tgagttcattgtagattctggat

SEQ ID NO: 125713 - DNA, 23 bp, Homo sapiens
tgagttcattgtagattctggat

SEQ ID NO: 125714 - DNA, 23 bp, Homo sapiens
tgagttcattgtagattctggat

SEQ ID NO: 125715 - DNA, 19 bp, Homo sapiens
gaaaaattgtttctgtggt

SEQ ID NO: 125716 - DNA, 20 bp, Homo sapiens
ccagtcactcactcactgct

SEQ ID NO: 125717 - DNA, 23 bp, Homo sapiens
ctctgtgtgactgtgtgacctgg

SEQ ID NO: 125718 - DNA, 23 bp, Homo sapiens
agacagagtctcactctgtcgcc

SEQ ID NO: 125719 - DNA, 23 bp, Homo sapiens
acagagtctcgctctgtcaccca

SEQ ID NO: 125720 - DNA, 20 bp, Homo sapiens
ttgccaggcacaaagtaaac

SEQ ID NO: 125721 - DNA, 19 bp, Homo sapiens
agacttctaaaaaatttgt

SEQ ID NO: 125722 - DNA, 21 bp, Homo sapiens
tctctcactgtctcttccccc

SEQ ID NO: 125723 - DNA, 23 bp, Homo sapiens
tgagacagagtctcactctattg

SEQ ID NO: 125724 - DNA, 23 bp, Homo sapiens
tgagatggagtctcactctgtcc

SEQ ID NO: 125725 - DNA, 23 bp, Homo sapiens
ctcagagagtcagtgagttaggg

SEQ ID NO: 125726 - DNA, 19 bp, Homo sapiens
cccagtctcaggactttct

SEQ ID NO: 125727 - DNA, 19 bp, Homo sapiens
cagagaagaaacagttgtc

SEQ ID NO: 125728 - DNA, 23 bp, Homo sapiens
tgattggttttgaaatgttagga

SEQ ID NO: 125729 - DNA, 23 bp, Homo sapiens
gaatatctcctacatgttctagg

SEQ ID NO: 125730 - DNA, 23 bp, Homo sapiens
cattagagttactcttctagtca

SEQ ID NO: 125731 - DNA, 22 bp, Homo sapiens
agtacagtgacccttagatgac

SEQ ID NO: 125732 - DNA, 21 bp, Homo sapiens
atacagcaagattctgtacat

SEQ ID NO: 125733 - DNA, 23 bp, Homo sapiens
agacagagtctcgctctgtcacc

SEQ ID NO: 125734 - DNA, 23 bp, Homo sapiens
tgctgtgtgtctgtgtgcgtgtc

SEQ ID NO: 125735 - DNA, 19 bp, Homo sapiens
agagagaggtcccgtctct

SEQ ID NO: 125736 - DNA, 18 bp, Homo sapiens
tggcctgccagtttgtga

SEQ ID NO: 125737 - DNA, 22 bp, Homo sapiens
tgtgaagtttgagatccattgt

SEQ ID NO: 125738 - DNA, 23 bp, Homo sapiens
acagagtctcgctctgtcaccca

SEQ ID NO: 125739 - DNA, 23 bp, Homo sapiens
tgagacggagtctcactcagcct

SEQ ID NO: 125740 - DNA, 23 bp, Homo sapiens
tcagtctgagagtctagacactg

SEQ ID NO: 125741 - DNA, 23 bp, Homo sapiens
cggagtctcactctgtctcccag

SEQ ID NO: 125742 - DNA, 23 bp, Homo sapiens
tggttcagcaactccatgtccag

SEQ ID NO: 125743 - DNA, 23 bp, Homo sapiens
gagagcacaaccagctcatgttg

SEQ ID NO: 125744 - DNA, 23 bp, Homo sapiens
tcactctgtctgtgactggccag

SEQ ID NO: 125745 - DNA, 23 bp, Homo sapiens
aaagagaggagatgatggctctt

SEQ ID NO: 125746 - DNA, 18 bp, Homo sapiens
tctctgccacactgggag

SEQ ID NO: 125747 - DNA, 23 bp, Homo sapiens
tgggagacacagtggtctgatag

SEQ ID NO: 125748 - DNA, 21 bp, Homo sapiens
tcatcactgccactgagtctc

SEQ ID NO: 125749 - DNA, 23 bp, Homo sapiens
caacatagtggatgtgaaatgat

SEQ ID NO: 125750 - DNA, 23 bp, Homo sapiens
acagagtctcactctgtcgccca

SEQ ID NO: 125751 - DNA, 18 bp, Homo sapiens
attatactttaagttcta

SEQ ID NO: 125752 - DNA, 23 bp, Homo sapiens
tgagttcattgtagattctggat

SEQ ID NO: 125753 - DNA, 23 bp, Homo sapiens
tgagttcattgtagattctggat

SEQ ID NO: 125754 - DNA, 23 bp, Homo sapiens
tgaccctcagtctcttcatctat

SEQ ID NO: 125755 - DNA, 20 bp, Homo sapiens
tactctgagtatgtgtatac

SEQ ID NO: 125756 - DNA, 23 bp, Homo sapiens
tacatgtgtgtatatgcatgtat

SEQ ID NO: 125757 - DNA, 19 bp, Homo sapiens
tttgtggataatgaaagga

SEQ ID NO: 125758 - DNA, 22 bp, Homo sapiens
tatggtagttgcatgtttagtt

SEQ ID NO: 125759 - DNA, 20 bp, Homo sapiens
taacaaaatgtcaaactatt

SEQ ID NO: 125760 - DNA, 23 bp, Homo sapiens
ttcactgagtattatgtatctgt

SEQ ID NO: 125761 - DNA, 22 bp, Homo sapiens
acacggggcattatttgtcttt

SEQ ID NO: 125762 - DNA, 23 bp, Homo sapiens
ctgtgtatgtgtgtgtgtgcatg

SEQ ID NO: 125763 - DNA, 22 bp, Homo sapiens
ttgtgtttatatatacgtgtgt

SEQ ID NO: 125764 - DNA, 23 bp, Homo sapiens
tgagttcattgtagattctggat

SEQ ID NO: 125765 - DNA, 23 bp, Homo sapiens
tgagttcattgtagattctggat

SEQ ID NO: 125766 - DNA, 21 bp, Homo sapiens
tgtatgcatgcatgtatgtag

SEQ ID NO: 125767 - DNA, 23 bp, Homo sapiens
tatatgcatgtttatatgtattt

SEQ ID NO: 125768 - DNA, 23 bp, Homo sapiens
cactgtgggtctgagaggtggtg

SEQ ID NO: 125769 - DNA, 23 bp, Homo sapiens
atatgtttgtgtgtgtataggta

SEQ ID NO: 125770 - DNA, 23 bp, Homo sapiens
cctattcacacacacaaactttt

SEQ ID NO: 125771 - DNA, 22 bp, Homo sapiens
tgtcactgtctgtaagatcact

SEQ ID NO: 125772 - DNA, 21 bp, Homo sapiens
tggcactttaaggcactgtga

SEQ ID NO: 125773 - DNA, 23 bp, Homo sapiens
attctttggttatgtagctttct

SEQ ID NO: 125774 - DNA, 23 bp, Homo sapiens
tgagttcattgtagattctggat

SEQ ID NO: 125775 - DNA, 23 bp, Homo sapiens
tgagttcattgtagattctggat

SEQ ID NO: 125776 - DNA, 18 bp, Homo sapiens
tactccaagcagtggtgg

SEQ ID NO: 125777 - DNA, 23 bp, Homo sapiens
gttctgtcactcagcctctctga

SEQ ID NO: 125778 - DNA, 20 bp, Homo sapiens
agagcaattctttttttttt

SEQ ID NO: 125779 - DNA, 22 bp, Homo sapiens
tcttgagaaggagtcttgctct

SEQ ID NO: 125780 - DNA, 23 bp, Homo sapiens
gtttctgcttgtgcacatgtgtg

SEQ ID NO: 125781 - DNA, 23 bp, Homo sapiens
tgagttcattgtagattctggat

SEQ ID NO: 125782 - DNA, 23 bp, Homo sapiens
tgagttcattgtagattctggat

SEQ ID NO: 125783 - DNA, 23 bp, Homo sapiens
tgagttcattgtagattctggat

SEQ ID NO: 125784 - DNA, 23 bp, Homo sapiens
tgagttcattgtagattctggat

SEQ ID NO: 125785 - DNA, 23 bp, Homo sapiens
ttatcacagaggaagagaattgt

SEQ ID NO: 125786 - DNA, 23 bp, Homo sapiens
ggagtctcactctgtcacccagg

SEQ ID NO: 125787 - DNA, 19 bp, Homo sapiens
tgtgtgtatgtgtgtaggg

SEQ ID NO: 125788 - DNA, 19 bp, Homo sapiens
cacacgcacacacacacgt

SEQ ID NO: 125789 - DNA, 23 bp, Homo sapiens
tatgcattttcagattttagtct

SEQ ID NO: 125790 - DNA, 22 bp, Homo sapiens
ttcacacaatctacatcccatg

SEQ ID NO: 125791 - DNA, 20 bp, Homo sapiens
tactactacataagccaact

SEQ ID NO: 125792 - DNA, 19 bp, Homo sapiens
ataaagtatatataaaagt

SEQ ID NO: 125793 - DNA, 20 bp, Homo sapiens
aattctggggccataagagg

SEQ ID NO: 125794 - DNA, 23 bp, Homo sapiens
tggtctcagttcaaggtgagagg

SEQ ID NO: 125795 - DNA, 20 bp, Homo sapiens
aagaagagaggcattttggt

SEQ ID NO: 125796 - DNA, 23 bp, Homo sapiens
gagagagctctgagagcacacta

SEQ ID NO: 125797 - DNA, 22 bp, Homo sapiens
ctgtcactcactgtctgatgtt

SEQ ID NO: 125798 - DNA, 23 bp, Homo sapiens
tggagtgcaatgatgaaagctca

SEQ ID NO: 125799 - DNA, 23 bp, Homo sapiens
tatgtatgtatgtatgtgtgtgt

SEQ ID NO: 125800 - DNA, 23 bp, Homo sapiens
tgagttcattgtagattctggat

SEQ ID NO: 125801 - DNA, 23 bp, Homo sapiens
tgagttcattgtagattctggat

SEQ ID NO: 125802 - DNA, 23 bp, Homo sapiens
aatatgagtggtgagagagggca

SEQ ID NO: 125803 - DNA, 23 bp, Homo sapiens
cccattcagtatgatattgagtg

SEQ ID NO: 125804 - DNA, 20 bp, Homo sapiens
tgacttgtctcttttgtcat

SEQ ID NO: 125805 - DNA, 23 bp, Homo sapiens
tggcagaaggatatctattgctt

SEQ ID NO: 125806 - DNA, 23 bp, Homo sapiens
tgagttcattgtagattctggat

SEQ ID NO: 125807 - DNA, 23 bp, Homo sapiens
tgagttcattgtagattctggat

SEQ ID NO: 125808 - DNA, 22 bp, Homo sapiens
tagattctctaatttctattgt

SEQ ID NO: 125809 - DNA, 23 bp, Homo sapiens
tgtattcattgttcacttacaag

SEQ ID NO: 125810 - DNA, 23 bp, Homo sapiens
tgagttcattgtagattctggat

SEQ ID NO: 125811 - DNA, 23 bp, Homo sapiens
tgagttcattgtagattctggat

SEQ ID NO: 125812 - DNA, 23 bp, Homo sapiens
gagttttgagtaggttgtataga

SEQ ID NO: 125813 - DNA, 22 bp, Homo sapiens
attctcctcattttggagctga

SEQ ID NO: 125814 - DNA, 22 bp, Homo sapiens
tttatgtgtatgtgcatgtgca

SEQ ID NO: 125815 - DNA, 20 bp, Homo sapiens
tgtgttcaaactcaatactt

SEQ ID NO: 125816 - DNA, 23 bp, Homo sapiens
atgcatgttgtactgcattttct

SEQ ID NO: 125817 - DNA, 21 bp, Homo sapiens
acatgtgcacaatgtgcagct

SEQ ID NO: 125818 - DNA, 18 bp, Homo sapiens
agatgtaatatatgcaat

SEQ ID NO: 125819 - DNA, 23 bp, Homo sapiens
agtgatgttccattactctttat

SEQ ID NO: 125820 - DNA, 23 bp, Homo sapiens
atataagtggaagttctagtgct

SEQ ID NO: 125821 - DNA, 21 bp, Homo sapiens
gtgagaatacaagaagaacat

SEQ ID NO: 125822 - DNA, 23 bp, Homo sapiens
gggtctcactctgtcactcaggc

SEQ ID NO: 125823 - DNA, 23 bp, Homo sapiens
tctctctctctcatgttgtgcca

SEQ ID NO: 125824 - DNA, 23 bp, Homo sapiens
cactgagtcagtctgacattcaa

SEQ ID NO: 125825 - DNA, 20 bp, Homo sapiens
tgtgtatatatgtatatatg

SEQ ID NO: 125826 - DNA, 23 bp, Homo sapiens
tccatccatgttgatgaaagaga

SEQ ID NO: 125827 - DNA, 23 bp, Homo sapiens
aggaagtcagtggtagcttgatg

SEQ ID NO: 125828 - DNA, 23 bp, Homo sapiens
attttggtcaagttcaatttgtt

SEQ ID NO: 125829 - DNA, 22 bp, Homo sapiens
tttaaattgtgcttttgatgtt

SEQ ID NO: 125830 - DNA, 23 bp, Homo sapiens
aagatgaggtcttactgtgtcac

SEQ ID NO: 125831 - DNA, 23 bp, Homo sapiens
tcaggaggggaatgaagtctgca

SEQ ID NO: 125832 - DNA, 23 bp, Homo sapiens
caccaccacagtgtctctcacat

SEQ ID NO: 125833 - DNA, 20 bp, Homo sapiens
cagacggagtctcactctgt

SEQ ID NO: 125834 - DNA, 23 bp, Homo sapiens
caggcagcatttgaattcagtga

SEQ ID NO: 125835 - DNA, 22 bp, Homo sapiens
atgtatgttttcatgtatatgt

SEQ ID NO: 125836 - DNA, 23 bp, Homo sapiens
gagtctcgctgtctcccaggctg

SEQ ID NO: 125837 - DNA, 23 bp, Homo sapiens
acagagtctcgcactgtcaccca

SEQ ID NO: 125838 - DNA, 22 bp, Homo sapiens
tcagtcttgctctgtcactcag

SEQ ID NO: 125839 - DNA, 23 bp, Homo sapiens
aacagatgtttattgaatgcctc

SEQ ID NO: 125840 - DNA, 20 bp, Homo sapiens
tatgtgccaggcactgttct

SEQ ID NO: 125841 - DNA, 20 bp, Homo sapiens
agtctcgctctgtcgctcag

SEQ ID NO: 125842 - DNA, 23 bp, Homo sapiens
tatctgtcagcatcagcaagagc

SEQ ID NO: 125843 - DNA, 23 bp, Homo sapiens
tctctctctgagtgccagaaagg

SEQ ID NO: 125844 - DNA, 23 bp, Homo sapiens
ttgtctgagtgcactaggagggg

SEQ ID NO: 125845 - DNA, 20 bp, Homo sapiens
tttgatgtactgtacctttg

SEQ ID NO: 125846 - DNA, 23 bp, Homo sapiens
atccgtgtctgtctctctctctt

SEQ ID NO: 125847 - DNA, 23 bp, Homo sapiens
gcctgagtctctgtctgtggcgc

SEQ ID NO: 125848 - DNA, 23 bp, Homo sapiens
tctgacacttcatcagcatctgt

SEQ ID NO: 125849 - DNA, 21 bp, Homo sapiens
attctgactggtttgagaggg

SEQ ID NO: 125850 - DNA, 23 bp, Homo sapiens
tgagttcattgtagattctggat

SEQ ID NO: 125851 - DNA, 23 bp, Homo sapiens
tgagttcattgtagattctggat

SEQ ID NO: 125852 - DNA, 23 bp, Homo sapiens
tatatgtgtgcatatcatgggaa

SEQ ID NO: 125853 - DNA, 23 bp, Homo sapiens
agagtctcactctgtcacccagg

SEQ ID NO: 125854 - DNA, 23 bp, Homo sapiens
gactcccactcactcagtagcct

SEQ ID NO: 125855 - DNA, 23 bp, Homo sapiens
agacagagtctcgctctgtcacc

SEQ ID NO: 125856 - DNA, 19 bp, Homo sapiens
agattctgagtacgtttga

SEQ ID NO: 125857 - DNA, 21 bp, Homo sapiens
acaaacgtattcagcctctct

SEQ ID NO: 125858 - DNA, 22 bp, Homo sapiens
tgagctacagtgaagttttaat

SEQ ID NO: 125859 - DNA, 20 bp, Homo sapiens
tgtactcagctactctcagc

SEQ ID NO: 125860 - DNA, 23 bp, Homo sapiens
ttgtgagctgactgagctcagag

SEQ ID NO: 125861 - DNA, 23 bp, Homo sapiens
aagtatgtttatgatgaagagtt

SEQ ID NO: 125862 - DNA, 23 bp, Homo sapiens
tcactgaacacacaaagcacttt

SEQ ID NO: 125863 - DNA, 23 bp, Homo sapiens
gactctgggtctcagtatcttca

SEQ ID NO: 125864 - DNA, 23 bp, Homo sapiens
tgctgctacagctgctactgctg

SEQ ID NO: 125865 - DNA, 18 bp, Homo sapiens
gagggaagagagaaggaa

SEQ ID NO: 125866 - DNA, 21 bp, Homo sapiens
tcagcttatttgtttctttct

SEQ ID NO: 125867 - DNA, 22 bp, Homo sapiens
gagacagtctcgctctgtcgcc

SEQ ID NO: 125868 - DNA, 23 bp, Homo sapiens
ggagtctcgctctgtcactgccc

SEQ ID NO: 125869 - DNA, 22 bp, Homo sapiens
tctcactctgtcacccaggctg

SEQ ID NO: 125870 - DNA, 23 bp, Homo sapiens
attgttagcaataaatttctgtt

SEQ ID NO: 125871 - DNA, 19 bp, Homo sapiens
agatagaaattggttctga

SEQ ID NO: 125872 - DNA, 23 bp, Homo sapiens
ctctgtcacacaggctgaagtgt

SEQ ID NO: 125873 - DNA, 18 bp, Homo sapiens
gtctgggtgactctgtga

SEQ ID NO: 125874 - DNA, 20 bp, Homo sapiens
tcctttgtcagatatgtgat

SEQ ID NO: 125875 - DNA, 23 bp, Homo sapiens
aatttcacagaggtttttatttt

SEQ ID NO: 125876 - DNA, 23 bp, Homo sapiens
tcacagaagtcagagagatcttg

SEQ ID NO: 125877 - DNA, 20 bp, Homo sapiens
gtcagggctcagtttctctg

SEQ ID NO: 125878 - DNA, 23 bp, Homo sapiens
agtctatgtctcaggcataaagc

SEQ ID NO: 125879 - DNA, 23 bp, Homo sapiens
gctctcactgtcagataaagggg

SEQ ID NO: 125880 - DNA, 23 bp, Homo sapiens
tacattcttaggtgtatttgctc

SEQ ID NO: 125881 - DNA, 21 bp, Homo sapiens
acagagcaagactctgtctca

SEQ ID NO: 125882 - DNA, 23 bp, Homo sapiens
acacagtttcactctggtttcca

SEQ ID NO: 125883 - DNA, 22 bp, Homo sapiens
ttttgtacagatgggggcctca

SEQ ID NO: 125884 - DNA, 23 bp, Homo sapiens
ctgagtgacagagtgaggcgttg

SEQ ID NO: 125885 - DNA, 23 bp, Homo sapiens
agagtcttgctctgtcacccaga

SEQ ID NO: 125886 - DNA, 23 bp, Homo sapiens
gacagagtctcgctctgtcaccc

SEQ ID NO: 125887 - DNA, 23 bp, Homo sapiens
gagtctcactctgtcaccctggc

SEQ ID NO: 125888 - DNA, 21 bp, Homo sapiens
tattgagaagagtctgtggac

SEQ ID NO: 125889 - DNA, 23 bp, Homo sapiens
tggagtctcactctgtcacccag

SEQ ID NO: 125890 - DNA, 23 bp, Homo sapiens
agacttgagacagattctggaag

SEQ ID NO: 125891 - DNA, 19 bp, Homo sapiens
tgcactccagcctgggcga

SEQ ID NO: 125892 - DNA, 20 bp, Homo sapiens
agagggagactctgtcttga

SEQ ID NO: 125893 - DNA, 22 bp, Homo sapiens
ggagtctcgctctgtgtcgccc

SEQ ID NO: 125894 - DNA, 23 bp, Homo sapiens
gactgcctccgtctgtctgttat

SEQ ID NO: 125895 - DNA, 23 bp, Homo sapiens
agacagaactgagtcaccagatg

SEQ ID NO: 125896 - DNA, 23 bp, Homo sapiens
tgagttcattgtagattctggat

SEQ ID NO: 125897 - DNA, 23 bp, Homo sapiens
tgagttcattgtagattctggat

SEQ ID NO: 125898 - DNA, 21 bp, Homo sapiens
aatggagagaatagagctgtt

SEQ ID NO: 125899 - DNA, 23 bp, Homo sapiens
ttcttaatgttcatgatgctcct

SEQ ID NO: 125900 - DNA, 19 bp, Homo sapiens
tcagaagacactcagcaca

SEQ ID NO: 125901 - DNA, 23 bp, Homo sapiens
agagtctcactctgtcacccagg

SEQ ID NO: 125902 - DNA, 23 bp, Homo sapiens
atgacatcaagcaattgtgcagt

SEQ ID NO: 125903 - DNA, 23 bp, Homo sapiens
tgatgagtgcaaagttgtgaggg

SEQ ID NO: 125904 - DNA, 23 bp, Homo sapiens
gttttgtgctcaggttgtttggt

SEQ ID NO: 125905 - DNA, 22 bp, Homo sapiens
tatgtatgtatgtatatgtgtg

SEQ ID NO: 125906 - DNA, 21 bp, Homo sapiens
tatgcatgcatgcatgtatgt

SEQ ID NO: 125907 - DNA, 22 bp, Homo sapiens
gagatgaatatttgttagaagg

SEQ ID NO: 125908 - DNA, 23 bp, Homo sapiens
tggaaccatttagattcaggaaa

SEQ ID NO: 125909 - DNA, 22 bp, Homo sapiens
aattgcaacatgttaaagtggc

SEQ ID NO: 125910 - DNA, 23 bp, Homo sapiens
actagtgacaagtcacagttgac

SEQ ID NO: 125911 - DNA, 23 bp, Homo sapiens
cttcactgactgctgttggccag

SEQ ID NO: 125912 - DNA, 23 bp, Homo sapiens
tctcagacactcagtctggctct

SEQ ID NO: 125913 - DNA, 19 bp, Homo sapiens
catatctttgctattgaga

SEQ ID NO: 125914 - DNA, 23 bp, Homo sapiens
atacacagtagtgagattgctgg

SEQ ID NO: 125915 - DNA, 23 bp, Homo sapiens
catctctccctccctctctgggt

SEQ ID NO: 125916 - DNA, 23 bp, Homo sapiens
tctgtgtgcctggctgcctgcta

SEQ ID NO: 125917 - DNA, 21 bp, Homo sapiens
agattcagggagtacctgtgc

SEQ ID NO: 125918 - DNA, 23 bp, Homo sapiens
ttacacatttgaattcaagcttt

SEQ ID NO: 125919 - DNA, 23 bp, Homo sapiens
tcctttataaatcatgttgttgc

SEQ ID NO: 125920 - DNA, 21 bp, Homo sapiens
ttgagtgtctactgtggacca

SEQ ID NO: 125921 - DNA, 23 bp, Homo sapiens
acagtctctctctctctctctcc

SEQ ID NO: 125922 - DNA, 23 bp, Homo sapiens
taacagactcctctatctgtgtg

SEQ ID NO: 125923 - DNA, 18 bp, Homo sapiens
agctttacagtaccttgt

SEQ ID NO: 125924 - DNA, 22 bp, Homo sapiens
tctctcactgggtccctcccac

SEQ ID NO: 125925 - DNA, 23 bp, Homo sapiens
actgtgaaagaataaatgtgtgt

SEQ ID NO: 125926 - DNA, 23 bp, Homo sapiens
taagctactaagtttgtgttaat

SEQ ID NO: 125927 - DNA, 20 bp, Homo sapiens
aacactagagatattgtaga

SEQ ID NO: 125928 - DNA, 23 bp, Homo sapiens
taccacagtgtgttaacactgga

SEQ ID NO: 125929 - DNA, 18 bp, Homo sapiens
tagtgtgttaacagtaga

SEQ ID NO: 125930 - DNA, 23 bp, Homo sapiens
tcccagagcccctggaactctgg

SEQ ID NO: 125931 - DNA, 23 bp, Homo sapiens
tcccagagcccctggaactctgg

SEQ ID NO: 125932 - DNA, 23 bp, Homo sapiens
tcccagagcccctggaactctgg

SEQ ID NO: 125933 - DNA, 23 bp, Homo sapiens
tcccagagcccctggaactctgg

SEQ ID NO: 125934 - DNA, 23 bp, Homo sapiens
ggttttacagtgtggttttgtgt

SEQ ID NO: 125935 - DNA, 18 bp, Homo sapiens
gtgaaaaaaaaaagagga

SEQ ID NO: 125936 - DNA, 23 bp, Homo sapiens
ccatgtctagtgagaatgctgct

SEQ ID NO: 125937 - DNA, 23 bp, Homo sapiens
acacacccacactgactgtcctc

SEQ ID NO: 125938 - DNA, 23 bp, Homo sapiens
acacactgcctctctgattcaga

SEQ ID NO: 125939 - DNA, 23 bp, Homo sapiens
ttgtctcagctcatactgtaaac

SEQ ID NO: 125940 - DNA, 23 bp, Homo sapiens
gatggagtttgcttttgttgccc

SEQ ID NO: 125941 - DNA, 23 bp, Homo sapiens
gtggcaaatgtatgcaaaacaga

SEQ ID NO: 125942 - DNA, 20 bp, Homo sapiens
tgtgacacatggtttgttgt

SEQ ID NO: 125943 - DNA, 23 bp, Homo sapiens
gagggtctgcctgtcttcagcag

SEQ ID NO: 125944 - DNA, 19 bp, Homo sapiens
cactccctctgtggctctg

SEQ ID NO: 125945 - DNA, 20 bp, Homo sapiens
aaatgagcaacatcaataaa

SEQ ID NO: 125946 - DNA, 19 bp, Homo sapiens
atttgagacggagtcttac

SEQ ID NO: 125947 - DNA, 23 bp, Homo sapiens
cagtaactgacacaatttcatct

SEQ ID NO: 125948 - DNA, 23 bp, Homo sapiens
tgagtctcacactgtcacccagg

SEQ ID NO: 125949 - DNA, 22 bp, Homo sapiens
gggtctcactctgtcacccagg

SEQ ID NO: 125950 - DNA, 23 bp, Homo sapiens
ttgagatggagttttgctcttgt

SEQ ID NO: 125951 - DNA, 21 bp, Homo sapiens
agactgagactgtctctgtcg

SEQ ID NO: 125952 - DNA, 18 bp, Homo sapiens
tagagtgagatcatagga

SEQ ID NO: 125953 - DNA, 20 bp, Homo sapiens
ttaagatggagtctctctct

SEQ ID NO: 125954 - DNA, 23 bp, Homo sapiens
agtaagaatgttgaattgtccct

SEQ ID NO: 125955 - DNA, 23 bp, Homo sapiens
agtctcactgtctcactatatcg

SEQ ID NO: 125956 - DNA, 23 bp, Homo sapiens
tattacagtatttttttttgaga

SEQ ID NO: 125957 - DNA, 19 bp, Homo sapiens
gtctcgctctgtcacccag

SEQ ID NO: 125958 - DNA, 23 bp, Homo sapiens
taatgcacttaaaatattcagta

SEQ ID NO: 125959 - DNA, 22 bp, Homo sapiens
ctctgcctctgtggctgcatga

SEQ ID NO: 125960 - DNA, 23 bp, Homo sapiens
ttttgagatagagtttcactctg

SEQ ID NO: 125961 - DNA, 23 bp, Homo sapiens
atttgagacagagtctcactctt

SEQ ID NO: 125962 - DNA, 23 bp, Homo sapiens
ctttgcagatgtttgcagatgtg

SEQ ID NO: 125963 - DNA, 21 bp, Homo sapiens
aatgtcactctgtcagtcagg

SEQ ID NO: 125964 - DNA, 23 bp, Homo sapiens
gaagactagagtttttgttctta

SEQ ID NO: 125965 - DNA, 23 bp, Homo sapiens
ttttgagacggagtctcactctg

SEQ ID NO: 125966 - DNA, 19 bp, Homo sapiens
tttgcacttgcatgtggag

SEQ ID NO: 125967 - DNA, 23 bp, Homo sapiens
ctctgaaagatgacattgagcag

SEQ ID NO: 125968 - DNA, 23 bp, Homo sapiens
atatgtgtgtgtgcatgtgtgtg

SEQ ID NO: 125969 - DNA, 23 bp, Homo sapiens
gtgacagtgagactctgtctcac

SEQ ID NO: 125970 - DNA, 22 bp, Homo sapiens
aacttgaccaagaggtggttcc

SEQ ID NO: 125971 - DNA, 21 bp, Homo sapiens
atttttgttaacttcctcaag

SEQ ID NO: 125972 - DNA, 22 bp, Homo sapiens
gctgaatttcaaggattataac

SEQ ID NO: 125973 - DNA, 22 bp, Homo sapiens
ttactgtcatcacttgggtgcc

SEQ ID NO: 125974 - DNA, 23 bp, Homo sapiens
tttggagacagagtctcgctctg

SEQ ID NO: 125975 - DNA, 23 bp, Homo sapiens
aggagattcaggttgcagtgagc

SEQ ID NO: 125976 - DNA, 23 bp, Homo sapiens
acatagtagtgactgtggtcact

SEQ ID NO: 125977 - DNA, 20 bp, Homo sapiens
gtctgccactacacttggct

SEQ ID NO: 125978 - DNA, 23 bp, Homo sapiens
tataccacattttgtttatctga

SEQ ID NO: 125979 - DNA, 22 bp, Homo sapiens
tgggtgtgtccatattttgact

SEQ ID NO: 125980 - DNA, 23 bp, Homo sapiens
tggaattaatttttgtgtatgat

SEQ ID NO: 125981 - DNA, 23 bp, Homo sapiens
tgagttcattgtagattctggat

SEQ ID NO: 125982 - DNA, 23 bp, Homo sapiens
tgagttcattgtagattctggat

SEQ ID NO: 125983 - DNA, 21 bp, Homo sapiens
tctcacatctctcacagtctg

SEQ ID NO: 125984 - DNA, 21 bp, Homo sapiens
agacaccagagagtgagctct

SEQ ID NO: 125985 - DNA, 22 bp, Homo sapiens
agccaagttaagggtctgtagt

SEQ ID NO: 125986 - DNA, 23 bp, Homo sapiens
cctctctgtgtgactttaagcac

SEQ ID NO: 125987 - DNA, 23 bp, Homo sapiens
ttctctgtgcctctgacacaggc

SEQ ID NO: 125988 - DNA, 23 bp, Homo sapiens
tgagttcattgtagattctggat

SEQ ID NO: 125989 - DNA, 23 bp, Homo sapiens
tgagttcattgtagattctggat

SEQ ID NO: 125990 - DNA, 23 bp, Homo sapiens
ggcagagtctctccctctgtcac

SEQ ID NO: 125991 - DNA, 23 bp, Homo sapiens
ctgcctcagtctctgtctgtgta

SEQ ID NO: 125992 - DNA, 23 bp, Homo sapiens
gtgtctgtgactggctgtgcagg

SEQ ID NO: 125993 - DNA, 20 bp, Homo sapiens
agtctcgctctgtctcccag

SEQ ID NO: 125994 - DNA, 20 bp, Homo sapiens
tacagtagtgtgatctctgc

SEQ ID NO: 125995 - DNA, 23 bp, Homo sapiens
tgaaaagatgaagttctccagtt

SEQ ID NO: 125996 - DNA, 23 bp, Homo sapiens
tatgtgtgtgtgtgtatatatac

SEQ ID NO: 125997 - DNA, 21 bp, Homo sapiens
tatgtgtatatatatatatgt

SEQ ID NO: 125998 - DNA, 23 bp, Homo sapiens
tggtatgttaaacattatgtgag

SEQ ID NO: 125999 - DNA, 22 bp, Homo sapiens
acatgtgcagaatgtgcaggtt

SEQ ID NO: 126000 - DNA, 23 bp, Homo sapiens
agtcagggtctcgctctgtcacc

SEQ ID NO: 126001 - DNA, 22 bp, Homo sapiens
tatgctcatttataagttgtga

SEQ ID NO: 126002 - DNA, 21 bp, Homo sapiens
cagtgcacacatacacactca

SEQ ID NO: 126003 - DNA, 20 bp, Homo sapiens
tatgtgtgtatatgtataca

SEQ ID NO: 126004 - DNA, 23 bp, Homo sapiens
aaaggtgactagtgtgattgaag

SEQ ID NO: 126005 - DNA, 21 bp, Homo sapiens
gtgatattacatatgagacaa

SEQ ID NO: 126006 - DNA, 23 bp, Homo sapiens
aattctaagtttttgatttctca

SEQ ID NO: 126007 - DNA, 23 bp, Homo sapiens
aacactatatatatgtgtgtgtg

SEQ ID NO: 126008 - DNA, 23 bp, Homo sapiens
attttagttgttctaataggtat

SEQ ID NO: 126009 - DNA, 22 bp, Homo sapiens
tatatcactgttaagttcctgt

SEQ ID NO: 126010 - DNA, 21 bp, Homo sapiens
ttatcaattacttagaggagt

SEQ ID NO: 126011 - DNA, 21 bp, Homo sapiens
ttcagttttctagttgtattt

SEQ ID NO: 126012 - DNA, 23 bp, Homo sapiens
tgacagggtgtgagaaagtagtc

SEQ ID NO: 126013 - DNA, 23 bp, Homo sapiens
gagatggagtctcactctgtcac

SEQ ID NO: 126014 - DNA, 19 bp, Homo sapiens
ttaatgcttgcaaaggact

SEQ ID NO: 126015 - DNA, 22 bp, Homo sapiens
tatgtgggacaatatctcttca

SEQ ID NO: 126016 - DNA, 23 bp, Homo sapiens
tctggaggtagaaagttcattcc

SEQ ID NO: 126017 - DNA, 19 bp, Homo sapiens
cagagaataagtgaaggta

SEQ ID NO: 126018 - DNA, 23 bp, Homo sapiens
agagtctcactctgtcactcagg

SEQ ID NO: 126019 - DNA, 20 bp, Homo sapiens
agaaaacatctcctccaact

SEQ ID NO: 126020 - DNA, 21 bp, Homo sapiens
atatgttcatgtatatgtata

SEQ ID NO: 126021 - DNA, 23 bp, Homo sapiens
tgagttcattgtagattctggat

SEQ ID NO: 126022 - DNA, 23 bp, Homo sapiens
tgagttcattgtagattctggat

SEQ ID NO: 126023 - DNA, 19 bp, Homo sapiens
agaggttatggtaacccgt

SEQ ID NO: 126024 - DNA, 18 bp, Homo sapiens
tataggaccaaatttcta

SEQ ID NO: 126025 - DNA, 23 bp, Homo sapiens
tgagttcattgtagattctggat

SEQ ID NO: 126026 - DNA, 23 bp, Homo sapiens
tgagttcattgtagattctggat

SEQ ID NO: 126027 - DNA, 21 bp, Homo sapiens
tttgtgacagagtctcactct

SEQ ID NO: 126028 - DNA, 23 bp, Homo sapiens
tggagtctctctctgtcacccag

SEQ ID NO: 126029 - DNA, 23 bp, Homo sapiens
atttgatcaacatagactcatag

SEQ ID NO: 126030 - DNA, 21 bp, Homo sapiens
tgtatgtatgtatatatgtat

SEQ ID NO: 126031 - DNA, 23 bp, Homo sapiens
gatcaagttgtagcttgaattct

SEQ ID NO: 126032 - DNA, 21 bp, Homo sapiens
tttcaagagacagattcaggt

SEQ ID NO: 126033 - DNA, 18 bp, Homo sapiens
tgagactgggttacttct

SEQ ID NO: 126034 - DNA, 23 bp, Homo sapiens
ttctgagatggagttcctctatt

SEQ ID NO: 126035 - DNA, 22 bp, Homo sapiens
tttcacagtggctgaactattt

SEQ ID NO: 126036 - DNA, 18 bp, Homo sapiens
tatgtgactacatgaaaa

SEQ ID NO: 126037 - DNA, 23 bp, Homo sapiens
tcccagagcccctggaactctgg

SEQ ID NO: 126038 - DNA, 23 bp, Homo sapiens
tcccagagcccctggaactctgg

SEQ ID NO: 126039 - DNA, 23 bp, Homo sapiens
tcccagagcccctggaactctgg

SEQ ID NO: 126040 - DNA, 21 bp, Homo sapiens
ctatgaagaagaccatgaggt

SEQ ID NO: 126041 - DNA, 19 bp, Homo sapiens
agtctgcccttagtttttg

SEQ ID NO: 126042 - DNA, 22 bp, Homo sapiens
taactgagactacaagcgagag

SEQ ID NO: 126043 - DNA, 22 bp, Homo sapiens
gagtcagagtctcgctctgttg

SEQ ID NO: 126044 - DNA, 23 bp, Homo sapiens
agatagagttttgctcttgtccc

SEQ ID NO: 126045 - DNA, 23 bp, Homo sapiens
actgagtctcgctctgtcaccca

SEQ ID NO: 126046 - DNA, 23 bp, Homo sapiens
tgaggtaggaggatcactagagc

SEQ ID NO: 126047 - DNA, 23 bp, Homo sapiens
agccatgatcctgccactgcact

SEQ ID NO: 126048 - DNA, 19 bp, Homo sapiens
tttgagatggagtcttgct

SEQ ID NO: 126049 - DNA, 23 bp, Homo sapiens
ctcaccctgtctgtgactgttgc

SEQ ID NO: 126050 - DNA, 23 bp, Homo sapiens
tgagtgtagaagtgtgtagaagc

SEQ ID NO: 126051 - DNA, 22 bp, Homo sapiens
atagtagttggtgttggactga

SEQ ID NO: 126052 - DNA, 22 bp, Homo sapiens
atacaccaacaatagctaagct

SEQ ID NO: 126053 - DNA, 22 bp, Homo sapiens
actgggtcatgttaggctgtgt

SEQ ID NO: 126054 - DNA, 23 bp, Homo sapiens
gaaatagaagtacatgcagagaa

SEQ ID NO: 126055 - DNA, 23 bp, Homo sapiens
tgtgtatatgtatacatgtgtgt

SEQ ID NO: 126056 - DNA, 23 bp, Homo sapiens
atatgattcattttgaatatatt

SEQ ID NO: 126057 - DNA, 23 bp, Homo sapiens
cgatgaattgtagtttctttgga

SEQ ID NO: 126058 - DNA, 23 bp, Homo sapiens
ttgtgctttaatttagctgtggt

SEQ ID NO: 126059 - DNA, 18 bp, Homo sapiens
ttcttgttttgggagctg

SEQ ID NO: 126060 - DNA, 23 bp, Homo sapiens
tattctctgtggatgtagtttct

SEQ ID NO: 126061 - DNA, 23 bp, Homo sapiens
ataacatgattactgtgtgcctg

SEQ ID NO: 126062 - DNA, 23 bp, Homo sapiens
tctctgagcttcttgtatctgga

SEQ ID NO: 126063 - DNA, 23 bp, Homo sapiens
aattaggtattgatgggttgaca

SEQ ID NO: 126064 - DNA, 19 bp, Homo sapiens
agtctatattataatatgt

SEQ ID NO: 126065 - DNA, 20 bp, Homo sapiens
tctattttgatgttgggatt

SEQ ID NO: 126066 - DNA, 23 bp, Homo sapiens
agaatctcactctgtctcccagg

SEQ ID NO: 126067 - DNA, 23 bp, Homo sapiens
agatgaagcttcactcactcact

SEQ ID NO: 126068 - DNA, 21 bp, Homo sapiens
tgtatacatgcatgtgtgtgt

SEQ ID NO: 126069 - DNA, 21 bp, Homo sapiens
tagtgtgatctcggttcactg

SEQ ID NO: 126070 - DNA, 20 bp, Homo sapiens
tttggagaaggagtctcact

SEQ ID NO: 126071 - DNA, 20 bp, Homo sapiens
tgaggctgcagtgagttgtg

SEQ ID NO: 126072 - DNA, 22 bp, Homo sapiens
tttgatgttattgtaattgctt

SEQ ID NO: 126073 - DNA, 22 bp, Homo sapiens
tgtcttggtagagtttgtgttt

SEQ ID NO: 126074 - DNA, 19 bp, Homo sapiens
tgagagcagtgttgtgtct

SEQ ID NO: 126075 - DNA, 19 bp, Homo sapiens
catcacagtgatttttctt

SEQ ID NO: 126076 - DNA, 20 bp, Homo sapiens
aaaagctaagaaaacaaagt

SEQ ID NO: 126077 - DNA, 23 bp, Homo sapiens
gagtctcactctgtcacccaggc

SEQ ID NO: 126078 - DNA, 23 bp, Homo sapiens
tttctgaatatatattctgtttc

SEQ ID NO: 126079 - DNA, 18 bp, Homo sapiens
taatatatatgtattcag

SEQ ID NO: 126080 - DNA, 23 bp, Homo sapiens
taacacatgcaattatatacata

SEQ ID NO: 126081 - DNA, 23 bp, Homo sapiens
atgtatgttgtatgtatgtatgt

SEQ ID NO: 126082 - DNA, 23 bp, Homo sapiens
tcttgaaagtgtatttcctgtgt

SEQ ID NO: 126083 - DNA, 23 bp, Homo sapiens
tatgcgtgtatttagcagggtgt

SEQ ID NO: 126084 - DNA, 21 bp, Homo sapiens
agcattgttatgaagtatgag

SEQ ID NO: 126085 - DNA, 23 bp, Homo sapiens
tgtcagatatattcagagtaggt

SEQ ID NO: 126086 - DNA, 19 bp, Homo sapiens
agtatattacttcaaatgt

SEQ ID NO: 126087 - DNA, 20 bp, Homo sapiens
ttgtgcatgtaaaagacagt

SEQ ID NO: 126088 - DNA, 21 bp, Homo sapiens
tatcacatgcttaaaattagt

SEQ ID NO: 126089 - DNA, 23 bp, Homo sapiens
attactgtatttgttattcactg

SEQ ID NO: 126090 - DNA, 23 bp, Homo sapiens
ttttttgagatggagttttgctc

SEQ ID NO: 126091 - DNA, 21 bp, Homo sapiens
tgtgtatatgctcacacttta

SEQ ID NO: 126092 - DNA, 23 bp, Homo sapiens
atgtgtatatatgtatatgtgta

SEQ ID NO: 126093 - DNA, 23 bp, Homo sapiens
agagtgaggcagagatgagagag

SEQ ID NO: 126094 - DNA, 23 bp, Homo sapiens
actcactgactgtcagggacttt

SEQ ID NO: 126095 - DNA, 23 bp, Homo sapiens
tacatgtgcacaacgtgcaggtt

SEQ ID NO: 126096 - DNA, 23 bp, Homo sapiens
tacatgtgccatgttggtgtgct

SEQ ID NO: 126097 - DNA, 23 bp, Homo sapiens
agaatcatcatctgcatctggag

SEQ ID NO: 126098 - DNA, 23 bp, Homo sapiens
tgtgtgtgtatatgtctgtatgt

SEQ ID NO: 126099 - DNA, 20 bp, Homo sapiens
agtgagatgtcactgttgac

SEQ ID NO: 126100 - DNA, 23 bp, Homo sapiens
gcttcttacattttgactttcac

SEQ ID NO: 126101 - DNA, 20 bp, Homo sapiens
ttgggctgagtttcaggagt

SEQ ID NO: 126102 - DNA, 23 bp, Homo sapiens
tgagttcattgtagattctggat

SEQ ID NO: 126103 - DNA, 23 bp, Homo sapiens
tgagttcattgtagattctggat

SEQ ID NO: 126104 - DNA, 23 bp, Homo sapiens
atgttaagaccaaaaaggtatca

SEQ ID NO: 126105 - DNA, 19 bp, Homo sapiens
tgtgtgtatgtatatgtcc

SEQ ID NO: 126106 - DNA, 23 bp, Homo sapiens
tacatgtgcagaaactgcaggtt

SEQ ID NO: 126107 - DNA, 23 bp, Homo sapiens
tccttctgtgtgtgtctgtgtcc

SEQ ID NO: 126108 - DNA, 23 bp, Homo sapiens
actgacatttgagagagcacaat

SEQ ID NO: 126109 - DNA, 23 bp, Homo sapiens
aaagttgttgatttcttttctaa

SEQ ID NO: 126110 - DNA, 23 bp, Homo sapiens
tgagttcattgtagattctggat

SEQ ID NO: 126111 - DNA, 23 bp, Homo sapiens
tgagttcattgtagattctggat

SEQ ID NO: 126112 - DNA, 23 bp, Homo sapiens
tgagttcattgtagattctggat

SEQ ID NO: 126113 - DNA, 23 bp, Homo sapiens
tgagttcattgtagattctggat

SEQ ID NO: 126114 - DNA, 23 bp, Homo sapiens
ttttatgttctaatcttggaaat

SEQ ID NO: 126115 - DNA, 23 bp, Homo sapiens
ttgaactgtgtgtgtgtgtgtgt

SEQ ID NO: 126116 - DNA, 23 bp, Homo sapiens
tgtgttcatgtaagttctttttc

SEQ ID NO: 126117 - DNA, 19 bp, Homo sapiens
atgtgcacaatgtgcaggc

SEQ ID NO: 126118 - DNA, 22 bp, Homo sapiens
catgtatatatgtatacatgtg

SEQ ID NO: 126119 - DNA, 23 bp, Homo sapiens
acatgtatatatgtatacatgta

SEQ ID NO: 126120 - DNA, 20 bp, Homo sapiens
atgtatatatgtatacatgt

SEQ ID NO: 126121 - DNA, 23 bp, Homo sapiens
atacatgtgtatatgtatacatg

SEQ ID NO: 126122 - DNA, 23 bp, Homo sapiens
tagaatcagaaagtatgattttt

SEQ ID NO: 126123 - DNA, 23 bp, Homo sapiens
aaacatttcctattcttttcatt

SEQ ID NO: 126124 - DNA, 23 bp, Homo sapiens
tggagtctcactctgtcactcag

SEQ ID NO: 126125 - DNA, 22 bp, Homo sapiens
tagagttttgaaggagtattag

SEQ ID NO: 126126 - DNA, 18 bp, Homo sapiens
tgtgtgtgtgtatatatg

SEQ ID NO: 126127 - DNA, 23 bp, Homo sapiens
atctgaataatgtatgcactttg

SEQ ID NO: 126128 - DNA, 23 bp, Homo sapiens
aaatgtgccatattaatctgaga

SEQ ID NO: 126129 - DNA, 21 bp, Homo sapiens
ttttatgtagattagatagat

SEQ ID NO: 126130 - DNA, 23 bp, Homo sapiens
atatatgtacatatgtatagaac

SEQ ID NO: 126131 - DNA, 21 bp, Homo sapiens
tcaggaagtttcaagtatatt

SEQ ID NO: 126132 - DNA, 19 bp, Homo sapiens
ttcttggaacattttgatt

SEQ ID NO: 126133 - DNA, 23 bp, Homo sapiens
tcttaggatggaattgctgtgtt

SEQ ID NO: 126134 - DNA, 23 bp, Homo sapiens
ttgccagcatgttgttttttgat

SEQ ID NO: 126135 - DNA, 22 bp, Homo sapiens
tataaggttgtgtacttggaac

SEQ ID NO: 126136 - DNA, 23 bp, Homo sapiens
cacagacctcttactgtctgacc

SEQ ID NO: 126137 - DNA, 23 bp, Homo sapiens
ttctcagtggttcttctttgtac

SEQ ID NO: 126138 - DNA, 23 bp, Homo sapiens
tatatgtatgtatatatgtgtgt

SEQ ID NO: 126139 - DNA, 23 bp, Homo sapiens
aatgttacaacagcctaagctga

SEQ ID NO: 126140 - DNA, 23 bp, Homo sapiens
gatttctgagttctgctaggctt

SEQ ID NO: 126141 - DNA, 23 bp, Homo sapiens
tctgaggttgtagatagtattta

SEQ ID NO: 126142 - DNA, 21 bp, Homo sapiens
atagaacttgagttaacttga

SEQ ID NO: 126143 - DNA, 23 bp, Homo sapiens
tttcttctgcatatggttattta

SEQ ID NO: 126144 - DNA, 23 bp, Homo sapiens
gagtcagtgtctggctctgttgc

SEQ ID NO: 126145 - DNA, 23 bp, Homo sapiens
acctttgatctttgaggttgctg

SEQ ID NO: 126146 - DNA, 23 bp, Homo sapiens
tattttgttacattggtctatgt

SEQ ID NO: 126147 - DNA, 22 bp, Homo sapiens
tacatgtgcacaatgtgcaggt

SEQ ID NO: 126148 - DNA, 20 bp, Homo sapiens
ttaggtatttcaggtatgga

SEQ ID NO: 126149 - DNA, 19 bp, Homo sapiens
tttcaggtttagagtattt

SEQ ID NO: 126150 - DNA, 23 bp, Homo sapiens
gtgtatatatacagtgtatagag

SEQ ID NO: 126151 - DNA, 18 bp, Homo sapiens
gagagctagaatatggtc

SEQ ID NO: 126152 - DNA, 23 bp, Homo sapiens
atctatagaaatctatataaatc

SEQ ID NO: 126153 - DNA, 20 bp, Homo sapiens
tatctatatctatagatatc

SEQ ID NO: 126154 - DNA, 23 bp, Homo sapiens
tatctgtatatctatatatctct

SEQ ID NO: 126155 - DNA, 23 bp, Homo sapiens
tgtctgtatctatagatatagat

SEQ ID NO: 126156 - DNA, 23 bp, Homo sapiens
tgagttcattgtagattctggat

SEQ ID NO: 126157 - DNA, 23 bp, Homo sapiens
aattaggttgcatatatatacat

SEQ ID NO: 126158 - DNA, 22 bp, Homo sapiens
atatatgcatgtgtgtgtgtat

SEQ ID NO: 126159 - DNA, 23 bp, Homo sapiens
ctctctctatatgtgtatgtgtg

SEQ ID NO: 126160 - DNA, 23 bp, Homo sapiens
aatagagagcaaggtgtaagcta

SEQ ID NO: 126161 - DNA, 20 bp, Homo sapiens
tataggatatatataggtga

SEQ ID NO: 126162 - DNA, 23 bp, Homo sapiens
acacacgcacatatacatagagt

SEQ ID NO: 126163 - DNA, 18 bp, Homo sapiens
tgtggtgctttttcttgg

SEQ ID NO: 126164 - DNA, 22 bp, Homo sapiens
atttcattatgatttggatttg

SEQ ID NO: 126165 - DNA, 22 bp, Homo sapiens
agcatggcagagatgatctgtg

SEQ ID NO: 126166 - DNA, 23 bp, Homo sapiens
acactgactctggaacatctcaa

SEQ ID NO: 126167 - DNA, 23 bp, Homo sapiens
gacagtaaagaagttagtgactg

SEQ ID NO: 126168 - DNA, 23 bp, Homo sapiens
acacaacaatttcactcttggaa

SEQ ID NO: 126169 - DNA, 23 bp, Homo sapiens
tgatgagagtgaggaaagcatta

SEQ ID NO: 126170 - DNA, 22 bp, Homo sapiens
tatgactgtggttccagctgct

SEQ ID NO: 126171 - DNA, 23 bp, Homo sapiens
tttgagatggagtcttactctgt

SEQ ID NO: 126172 - DNA, 19 bp, Homo sapiens
attgaggtgtaggtggtag

SEQ ID NO: 126173 - DNA, 18 bp, Homo sapiens
gtgtatatatgtaagtgt

SEQ ID NO: 126174 - DNA, 23 bp, Homo sapiens
tatatgtatgtgtatatatgtat

SEQ ID NO: 126175 - DNA, 18 bp, Homo sapiens
acgtatattatatgtatg

SEQ ID NO: 126176 - DNA, 22 bp, Homo sapiens
atcacctagattttagtgacaa

SEQ ID NO: 126177 - DNA, 23 bp, Homo sapiens
tgggtgacagagtaagactctgt

SEQ ID NO: 126178 - DNA, 18 bp, Homo sapiens
ttctatttatatgaaatg

SEQ ID NO: 126179 - DNA, 21 bp, Homo sapiens
agacagaacataaactagtgg

SEQ ID NO: 126180 - DNA, 20 bp, Homo sapiens
tatggtatacaatatgatgc

SEQ ID NO: 126181 - DNA, 21 bp, Homo sapiens
ggaaatcttacagatatgctt

SEQ ID NO: 126182 - DNA, 23 bp, Homo sapiens
tattacatgatgtatagtataca

SEQ ID NO: 126183 - DNA, 19 bp, Homo sapiens
tgagaatgaatgttgaatt

SEQ ID NO: 126184 - DNA, 23 bp, Homo sapiens
tacctgctctgagtatactctgg

SEQ ID NO: 126185 - DNA, 21 bp, Homo sapiens
actgagactcactctgtttcc

SEQ ID NO: 126186 - DNA, 23 bp, Homo sapiens
aacagctggagatcatttgcctc

SEQ ID NO: 126187 - DNA, 19 bp, Homo sapiens
gagagagaaaaagaaaggg

SEQ ID NO: 126188 - DNA, 21 bp, Homo sapiens
tttagagtaccaagacaccac

SEQ ID NO: 126189 - DNA, 23 bp, Homo sapiens
aagatgtctggttttttgtgtgt

SEQ ID NO: 126190 - DNA, 19 bp, Homo sapiens
tgtaactgcagcacttaca

SEQ ID NO: 126191 - DNA, 22 bp, Homo sapiens
caatgggacttgtacgcaatgt

SEQ ID NO: 126192 - DNA, 23 bp, Homo sapiens
cactgggcagtctgtcacgtatc

SEQ ID NO: 126193 - DNA, 23 bp, Homo sapiens
agagagactgtacagaacgtgca

SEQ ID NO: 126194 - DNA, 18 bp, Homo sapiens
aagtagtaacaaatctca

SEQ ID NO: 126195 - DNA, 23 bp, Homo sapiens
tgtatgtgtatatgtatatgtat

SEQ ID NO: 126196 - DNA, 23 bp, Homo sapiens
tgaatactcaaagactatttccc

SEQ ID NO: 126197 - DNA, 23 bp, Homo sapiens
tgagttcattgtagattctggat

SEQ ID NO: 126198 - DNA, 23 bp, Homo sapiens
tgagttcattgtagattctggat

SEQ ID NO: 126199 - DNA, 18 bp, Homo sapiens
taaagacaggatctggtt

SEQ ID NO: 126200 - DNA, 18 bp, Homo sapiens
ctactgtgtttgttaaat

SEQ ID NO: 126201 - DNA, 19 bp, Homo sapiens
ataaagagcagtaaattct

SEQ ID NO: 126202 - DNA, 21 bp, Homo sapiens
tctctgtctctctgtctttgc

SEQ ID NO: 126203 - DNA, 23 bp, Homo sapiens
tttgtgctcttgttctgggcctc

SEQ ID NO: 126204 - DNA, 18 bp, Homo sapiens
tggtttatttatttgtat

SEQ ID NO: 126205 - DNA, 23 bp, Homo sapiens
tgagttcattgtagattctggat

SEQ ID NO: 126206 - DNA, 23 bp, Homo sapiens
tgagttcattgtagattctggat

SEQ ID NO: 126207 - DNA, 23 bp, Homo sapiens
tgagttcattgtagattctggat

SEQ ID NO: 126208 - DNA, 23 bp, Homo sapiens
tgagttcattgtagattctggat

SEQ ID NO: 126209 - DNA, 22 bp, Homo sapiens
cagactcctctcactgtcactt

SEQ ID NO: 126210 - DNA, 21 bp, Homo sapiens
tatttcttaatgtagatgctt

SEQ ID NO: 126211 - DNA, 22 bp, Homo sapiens
agacttagaacagagtgaggac

SEQ ID NO: 126212 - DNA, 23 bp, Homo sapiens
tgagttcattgtagattctggat

SEQ ID NO: 126213 - DNA, 23 bp, Homo sapiens
tgagttcattgtagattctggat

SEQ ID NO: 126214 - DNA, 23 bp, Homo sapiens
ccattcctttcagtgcactgcca

SEQ ID NO: 126215 - DNA, 23 bp, Homo sapiens
tggctctctccctctgtctgaag

SEQ ID NO: 126216 - DNA, 23 bp, Homo sapiens
tccacacagctttatgtatctga

SEQ ID NO: 126217 - DNA, 23 bp, Homo sapiens
tgagttcattgtagattctggat

SEQ ID NO: 126218 - DNA, 23 bp, Homo sapiens
tgagttcattgtagattctggat

SEQ ID NO: 126219 - DNA, 23 bp, Homo sapiens
tgtgtgtctatgtgtgtgtgaat

SEQ ID NO: 126220 - DNA, 23 bp, Homo sapiens
gagacagagtctcgctgtgtcac

SEQ ID NO: 126221 - DNA, 22 bp, Homo sapiens
aacctgcacattgtgcacatgt

SEQ ID NO: 126222 - DNA, 23 bp, Homo sapiens
ctgtagtcccagctattcaggag

SEQ ID NO: 126223 - DNA, 21 bp, Homo sapiens
tagttgttatactgtgttgtt

SEQ ID NO: 126224 - DNA, 23 bp, Homo sapiens
tacacacatatgtgtgtgtatgt

SEQ ID NO: 126225 - DNA, 23 bp, Homo sapiens
aaatgtgtatatgtatatatgtg

SEQ ID NO: 126226 - DNA, 23 bp, Homo sapiens
taaagattttgaatagttactgt

SEQ ID NO: 126227 - DNA, 23 bp, Homo sapiens
agagtcaggggatgttttgtttc

SEQ ID NO: 126228 - DNA, 21 bp, Homo sapiens
tgagacagagtctcctgctgg

SEQ ID NO: 126229 - DNA, 22 bp, Homo sapiens
caagatgtaggttggttagatt

SEQ ID NO: 126230 - DNA, 22 bp, Homo sapiens
tattcatcaagactttctctgt

SEQ ID NO: 126231 - DNA, 23 bp, Homo sapiens
tgtctggctctgtcgctccggct

SEQ ID NO: 126232 - DNA, 22 bp, Homo sapiens
tatttggatttctagctgtttt

SEQ ID NO: 126233 - DNA, 18 bp, Homo sapiens
tgattttgtagcctgaaa

SEQ ID NO: 126234 - DNA, 23 bp, Homo sapiens
tttactgaaattgtttatcagtt

SEQ ID NO: 126235 - DNA, 23 bp, Homo sapiens
tgtatgtgtatatgtgtatgtgt

SEQ ID NO: 126236 - DNA, 23 bp, Homo sapiens
tgatatacatatggacacagaca

SEQ ID NO: 126237 - DNA, 23 bp, Homo sapiens
tttcttcattagatttctgagct

SEQ ID NO: 126238 - DNA, 23 bp, Homo sapiens
agctgtaccatcagtaggtctat

SEQ ID NO: 126239 - DNA, 22 bp, Homo sapiens
tctgtttacatcactaggtcta

SEQ ID NO: 126240 - DNA, 23 bp, Homo sapiens
ctcacacagaaggcagtgtccac

SEQ ID NO: 126241 - DNA, 23 bp, Homo sapiens
gtcagtctctgcctgcctgcgtt

SEQ ID NO: 126242 - DNA, 23 bp, Homo sapiens
actctgtgtgtatgtgtatatat

SEQ ID NO: 126243 - DNA, 23 bp, Homo sapiens
ttaccaatgaatacacagtgcat

SEQ ID NO: 126244 - DNA, 23 bp, Homo sapiens
tctgtcactcagtgtttgttgat

SEQ ID NO: 126245 - DNA, 23 bp, Homo sapiens
caggggatcaactaactggtttt

SEQ ID NO: 126246 - DNA, 23 bp, Homo sapiens
tttgagaccgagtcttgctctgt

SEQ ID NO: 126247 - DNA, 23 bp, Homo sapiens
agtcagggtctccctctgtcact

SEQ ID NO: 126248 - DNA, 18 bp, Homo sapiens
tggtatgatcactgctca

SEQ ID NO: 126249 - DNA, 23 bp, Homo sapiens
tgtaagaaattgtttcttatgtg

SEQ ID NO: 126250 - DNA, 20 bp, Homo sapiens
aacaaagtacaagaaatcat

SEQ ID NO: 126251 - DNA, 23 bp, Homo sapiens
gagtctcactcactctgtcgccc

SEQ ID NO: 126252 - DNA, 20 bp, Homo sapiens
tttttgtaattgaaaatacg

SEQ ID NO: 126253 - DNA, 22 bp, Homo sapiens
tatatctatgtgtgtatctatt

SEQ ID NO: 126254 - DNA, 21 bp, Homo sapiens
atacagcatcagataagggta

SEQ ID NO: 126255 - DNA, 23 bp, Homo sapiens
tctgttttgttttcttattcgat

SEQ ID NO: 126256 - DNA, 23 bp, Homo sapiens
tcaagtcaaattgtaattctcag

SEQ ID NO: 126257 - DNA, 23 bp, Homo sapiens
gagatgtgtggcagaatttggtt

SEQ ID NO: 126258 - DNA, 23 bp, Homo sapiens
tggagtctcactctgtcacccag

SEQ ID NO: 126259 - DNA, 22 bp, Homo sapiens
tctgtgtgacttgtatagatgt

SEQ ID NO: 126260 - DNA, 23 bp, Homo sapiens
atataatatgtatacatatgtat

SEQ ID NO: 126261 - DNA, 22 bp, Homo sapiens
gggtatgacttgaggaaggagt

SEQ ID NO: 126262 - DNA, 22 bp, Homo sapiens
tgaagatttgctttggaagata

SEQ ID NO: 126263 - DNA, 20 bp, Homo sapiens
agtgctaattaaaggtttct

SEQ ID NO: 126264 - DNA, 23 bp, Homo sapiens
gacagggtctctctctctctcgt

SEQ ID NO: 126265 - DNA, 23 bp, Homo sapiens
tgagttcattgtagattctggat

SEQ ID NO: 126266 - DNA, 23 bp, Homo sapiens
tgagttcattgtagattctggat

SEQ ID NO: 126267 - DNA, 23 bp, Homo sapiens
tatgtgtgtatatatgtgtgtgt

SEQ ID NO: 126268 - DNA, 23 bp, Homo sapiens
tgagttcattgtagattctggat

SEQ ID NO: 126269 - DNA, 23 bp, Homo sapiens
tgagttcattgtagattctggat

SEQ ID NO: 126270 - DNA, 22 bp, Homo sapiens
tgtattctgattttgtttttct

SEQ ID NO: 126271 - DNA, 23 bp, Homo sapiens
acagtggttggcaatggtagaat

SEQ ID NO: 126272 - DNA, 23 bp, Homo sapiens
aataacttcttcaggtaaagaac

SEQ ID NO: 126273 - DNA, 23 bp, Homo sapiens
acagcctctcagtgactctgggg

SEQ ID NO: 126274 - DNA, 22 bp, Homo sapiens
gtaactctcaaagcattttatg

SEQ ID NO: 126275 - DNA, 23 bp, Homo sapiens
catcacattagtcttactgttct

SEQ ID NO: 126276 - DNA, 21 bp, Homo sapiens
atttatgtttgcatgtgtgtg

SEQ ID NO: 126277 - DNA, 18 bp, Homo sapiens
tgactggcatgagatggg

SEQ ID NO: 126278 - DNA, 23 bp, Homo sapiens
tgactgtctctctgaccctcttc

SEQ ID NO: 126279 - DNA, 22 bp, Homo sapiens
atctagtagtatttgttttgtg

SEQ ID NO: 126280 - DNA, 23 bp, Homo sapiens
tccacaacttcaccagcacctgt

SEQ ID NO: 126281 - DNA, 22 bp, Homo sapiens
tttgcttggctccatgttgctc

SEQ ID NO: 126282 - DNA, 18 bp, Homo sapiens
aaagaggattagagagag

SEQ ID NO: 126283 - DNA, 20 bp, Homo sapiens
ttttttttttgttgttgttg

SEQ ID NO: 126284 - DNA, 23 bp, Homo sapiens
aaatgtgctaatagattgttctc

SEQ ID NO: 126285 - DNA, 22 bp, Homo sapiens
gtgtgtgtgtgtgtgtctgcct

SEQ ID NO: 126286 - DNA, 23 bp, Homo sapiens
ttggcatatgtaaagttatctta

SEQ ID NO: 126287 - DNA, 23 bp, Homo sapiens
tagagcaactccatgagctagtg

SEQ ID NO: 126288 - DNA, 23 bp, Homo sapiens
taagtatatatatacgtgtgtgt

SEQ ID NO: 126289 - DNA, 23 bp, Homo sapiens
gtcacagtgactgactctaagct

SEQ ID NO: 126290 - DNA, 23 bp, Homo sapiens
tgtatgtgtgcatgtgcatgtct

SEQ ID NO: 126291 - DNA, 23 bp, Homo sapiens
tgaagtctgaggttgtttttttt

SEQ ID NO: 126292 - DNA, 23 bp, Homo sapiens
agatctcggctcactgcaagctc

SEQ ID NO: 126293 - DNA, 23 bp, Homo sapiens
tgagttcattgtagattctggat

SEQ ID NO: 126294 - DNA, 23 bp, Homo sapiens
tgagttcattgtagattctggat

SEQ ID NO: 126295 - DNA, 23 bp, Homo sapiens
aaaaggatgttatttgttcagtt

SEQ ID NO: 126296 - DNA, 20 bp, Homo sapiens
atgtatatacacatatgtgt

SEQ ID NO: 126297 - DNA, 20 bp, Homo sapiens
attatgtatgcttatgtgtt

SEQ ID NO: 126298 - DNA, 21 bp, Homo sapiens
gatctaacacataagcatttg

SEQ ID NO: 126299 - DNA, 23 bp, Homo sapiens
atatctcattatgtttttgattt

SEQ ID NO: 126300 - DNA, 21 bp, Homo sapiens
atgattagtgattttgaggat

SEQ ID NO: 126301 - DNA, 23 bp, Homo sapiens
cagaataatatgttgaatatgta

SEQ ID NO: 126302 - DNA, 23 bp, Homo sapiens
atactggtatttctggtttgact

SEQ ID NO: 126303 - DNA, 23 bp, Homo sapiens
gagaactccatttggactactat

SEQ ID NO: 126304 - DNA, 23 bp, Homo sapiens
ttctgagtgggtgtgtagtggta

SEQ ID NO: 126305 - DNA, 23 bp, Homo sapiens
ttctctcagatattattatgcag

SEQ ID NO: 126306 - DNA, 23 bp, Homo sapiens
tatgacagagtgctaacatgatc

SEQ ID NO: 126307 - DNA, 19 bp, Homo sapiens
taaaagtagaattctgatg

SEQ ID NO: 126308 - DNA, 22 bp, Homo sapiens
attatgtgtgtgcttaagtatt

SEQ ID NO: 126309 - DNA, 23 bp, Homo sapiens
tgagttcattgtagattctggat

SEQ ID NO: 126310 - DNA, 23 bp, Homo sapiens
tgagttcattgtagattctggat

SEQ ID NO: 126311 - DNA, 20 bp, Homo sapiens
aggcaggctggctgtttgcg

SEQ ID NO: 126312 - DNA, 23 bp, Homo sapiens
ctgactcagagtctctcacaagt

SEQ ID NO: 126313 - DNA, 23 bp, Homo sapiens
tctgagacggtgtctcgctctgt

SEQ ID NO: 126314 - DNA, 21 bp, Homo sapiens
tccaaatctttgctattgtga

SEQ ID NO: 126315 - DNA, 23 bp, Homo sapiens
tggagtctcactctgtcacccag

SEQ ID NO: 126316 - DNA, 23 bp, Homo sapiens
aaagattgtaggttgtgtgctgg

SEQ ID NO: 126317 - DNA, 23 bp, Homo sapiens
taacagccacttgatgatttgag

SEQ ID NO: 126318 - DNA, 20 bp, Homo sapiens
tggcatggtgtacctcggct

SEQ ID NO: 126319 - DNA, 21 bp, Homo sapiens
atatgtatttgtatacattct

SEQ ID NO: 126320 - DNA, 23 bp, Homo sapiens
aaatacatagaatatgtatacaa

SEQ ID NO: 126321 - DNA, 22 bp, Homo sapiens
aaatacatagaatatgtataca

SEQ ID NO: 126322 - DNA, 22 bp, Homo sapiens
aaatacatagaatatgtataca

SEQ ID NO: 126323 - DNA, 23 bp, Homo sapiens
taaatacatagaatatgtataca

SEQ ID NO: 126324 - DNA, 22 bp, Homo sapiens
attctgaattttttctaatgag

SEQ ID NO: 126325 - DNA, 22 bp, Homo sapiens
aggcaggtaaagtagtttggac

SEQ ID NO: 126326 - DNA, 23 bp, Homo sapiens
tacatatgtatgtgtgtgtgtgt

SEQ ID NO: 126327 - DNA, 21 bp, Homo sapiens
ataccatatatgtatatgtgt

SEQ ID NO: 126328 - DNA, 22 bp, Homo sapiens
tataccatatatgtatatgtgt

SEQ ID NO: 126329 - DNA, 21 bp, Homo sapiens
taccatatatgtatatatgta

SEQ ID NO: 126330 - DNA, 22 bp, Homo sapiens
tatatgtatgtatatatgtatg

SEQ ID NO: 126331 - DNA, 23 bp, Homo sapiens
tatacacacagatatatatgtgt

SEQ ID NO: 126332 - DNA, 23 bp, Homo sapiens
tttatgtatatgtatatgtgtat

SEQ ID NO: 126333 - DNA, 19 bp, Homo sapiens
tcattggtcagcttctcca

SEQ ID NO: 126334 - DNA, 20 bp, Homo sapiens
atgtgcataacgtgcaggtt

SEQ ID NO: 126335 - DNA, 23 bp, Homo sapiens
tacatgtgccatgttggtgtgct

SEQ ID NO: 126336 - DNA, 23 bp, Homo sapiens
gaattcaccatgtgtatatgtaa

SEQ ID NO: 126337 - DNA, 20 bp, Homo sapiens
ggagtctccctctgtcaccc

SEQ ID NO: 126338 - DNA, 23 bp, Homo sapiens
ggttgtagaagttttagtggaca

SEQ ID NO: 126339 - DNA, 23 bp, Homo sapiens
aaatctgtcacactatcatcttt

SEQ ID NO: 126340 - DNA, 23 bp, Homo sapiens
tatatctgttatagtaatcagtg

SEQ ID NO: 126341 - DNA, 23 bp, Homo sapiens
tgagttcattgtagattctggat

SEQ ID NO: 126342 - DNA, 23 bp, Homo sapiens
tgtgtgtctgtgtgtgtatgcat

SEQ ID NO: 126343 - DNA, 19 bp, Homo sapiens
aggtgaattaaattgtgat

SEQ ID NO: 126344 - DNA, 22 bp, Homo sapiens
cttggcacaggaagtatgcagt

SEQ ID NO: 126345 - DNA, 23 bp, Homo sapiens
agagtctcactctgtcacccagg

SEQ ID NO: 126346 - DNA, 23 bp, Homo sapiens
tgcagtctcactctgtcacccag

SEQ ID NO: 126347 - DNA, 23 bp, Homo sapiens
tgtgagcatcttcaattgttttt

SEQ ID NO: 126348 - DNA, 19 bp, Homo sapiens
acagatggtgtctcactct

SEQ ID NO: 126349 - DNA, 21 bp, Homo sapiens
taatagaatttcaataattga

SEQ ID NO: 126350 - DNA, 21 bp, Homo sapiens
tttttggtccagatttccctt

SEQ ID NO: 126351 - DNA, 21 bp, Homo sapiens
aatcaactcttaatcttttca

SEQ ID NO: 126352 - DNA, 23 bp, Homo sapiens
ttagtatcaaatgctatgttcat

SEQ ID NO: 126353 - DNA, 18 bp, Homo sapiens
accagcctttgatatctg

SEQ ID NO: 126354 - DNA, 19 bp, Homo sapiens
tgactgtgtgtgtaatagc

SEQ ID NO: 126355 - DNA, 23 bp, Homo sapiens
gagtctcactctgtcacccaggc

SEQ ID NO: 126356 - DNA, 23 bp, Homo sapiens
atatatatgtatgcatatgtata

SEQ ID NO: 126357 - DNA, 23 bp, Homo sapiens
gtagctggaactgcaagtgcatg

SEQ ID NO: 126358 - DNA, 21 bp, Homo sapiens
agctcagtggctgttcatttt

SEQ ID NO: 126359 - DNA, 21 bp, Homo sapiens
tatgtgtttatatatatgtgt

SEQ ID NO: 126360 - DNA, 22 bp, Homo sapiens
atataatactatatgaatatgt

SEQ ID NO: 126361 - DNA, 23 bp, Homo sapiens
agtcagagaagatgcttgaaatg

SEQ ID NO: 126362 - DNA, 22 bp, Homo sapiens
atgacattatttttgagtgagt

SEQ ID NO: 126363 - DNA, 19 bp, Homo sapiens
atgtactaataagttatgt

SEQ ID NO: 126364 - DNA, 23 bp, Homo sapiens
gacagagtctcgctctgtcaccc

SEQ ID NO: 126365 - DNA, 23 bp, Homo sapiens
tcgctctctgtatgtgtgtgtgc

SEQ ID NO: 126366 - DNA, 22 bp, Homo sapiens
tgtgtgtctgtgtccaaataaa

SEQ ID NO: 126367 - DNA, 22 bp, Homo sapiens
ttgtagtcttggcatctttcac

SEQ ID NO: 126368 - DNA, 23 bp, Homo sapiens
ttattgcttctaccataaacagt

SEQ ID NO: 126369 - DNA, 18 bp, Homo sapiens
gtgtataagggcaaagtg

SEQ ID NO: 126370 - DNA, 23 bp, Homo sapiens
atgtatgtttctatatgtatatc

SEQ ID NO: 126371 - DNA, 23 bp, Homo sapiens
tgagttcattgtagattctggat

SEQ ID NO: 126372 - DNA, 23 bp, Homo sapiens
tgagttcattgtagattctggat

SEQ ID NO: 126373 - DNA, 22 bp, Homo sapiens
actgcttgttgtgatgtgatct

SEQ ID NO: 126374 - DNA, 23 bp, Homo sapiens
cagaatctcactctgtcactcag

SEQ ID NO: 126375 - DNA, 23 bp, Homo sapiens
tatgtatgtatatatacctatat

SEQ ID NO: 126376 - DNA, 22 bp, Homo sapiens
atgtatgtatgtatatatacct

SEQ ID NO: 126377 - DNA, 21 bp, Homo sapiens
acgtatgtatacatgtgtgta

SEQ ID NO: 126378 - DNA, 22 bp, Homo sapiens
atagcaagactctgtctctaaa

SEQ ID NO: 126379 - DNA, 23 bp, Homo sapiens
gagacggagtctcactctgtcac

SEQ ID NO: 126380 - DNA, 21 bp, Homo sapiens
agagagaagaatgagagctga

SEQ ID NO: 126381 - DNA, 23 bp, Homo sapiens
tgagttcattgtagattctggat

SEQ ID NO: 126382 - DNA, 23 bp, Homo sapiens
tgagttcattgtagattctggat

SEQ ID NO: 126383 - DNA, 22 bp, Homo sapiens
accaggatgtaaagaaatgaga

SEQ ID NO: 126384 - DNA, 20 bp, Homo sapiens
atttttctagaaatggcaag

SEQ ID NO: 126385 - DNA, 23 bp, Homo sapiens
gtctggctgcctctgtctgtcac

SEQ ID NO: 126386 - DNA, 19 bp, Homo sapiens
atttaagtttgtatcctgt

SEQ ID NO: 126387 - DNA, 23 bp, Homo sapiens
aggaaatagcatgattagtttcc

SEQ ID NO: 126388 - DNA, 21 bp, Homo sapiens
tttacgtatatatgtgtatgt

SEQ ID NO: 126389 - DNA, 22 bp, Homo sapiens
tcatccaaagagagaaaagaga

SEQ ID NO: 126390 - DNA, 23 bp, Homo sapiens
tgagttcattgtagattctggat

SEQ ID NO: 126391 - DNA, 23 bp, Homo sapiens
tgagttcattgtagattctggat

SEQ ID NO: 126392 - DNA, 22 bp, Homo sapiens
tatctatctagagagagatata

SEQ ID NO: 126393 - DNA, 23 bp, Homo sapiens
aaagagtctcgctctgttgtcag

SEQ ID NO: 126394 - DNA, 22 bp, Homo sapiens
atagccaccttggatgtgttta

SEQ ID NO: 126395 - DNA, 23 bp, Homo sapiens
ggagtctcactctgtcactcagg

SEQ ID NO: 126396 - DNA, 23 bp, Homo sapiens
ggagtctcactctgtctcccagg

SEQ ID NO: 126397 - DNA, 18 bp, Homo sapiens
acagtggtgtgatctcag

SEQ ID NO: 126398 - DNA, 22 bp, Homo sapiens
ctgttcatgttgatagcttgat

SEQ ID NO: 126399 - DNA, 23 bp, Homo sapiens
gtctgtctgaaatcaaagctgtg

SEQ ID NO: 126400 - DNA, 23 bp, Homo sapiens
tgagttcattgtagattctggat

SEQ ID NO: 126401 - DNA, 23 bp, Homo sapiens
tgagttcattgtagattctggat

SEQ ID NO: 126402 - DNA, 19 bp, Homo sapiens
tatctatacatacacacac

SEQ ID NO: 126403 - DNA, 23 bp, Homo sapiens
ggactctcacactgtcacccagg

SEQ ID NO: 126404 - DNA, 21 bp, Homo sapiens
tctggaagaattttctggatt

SEQ ID NO: 126405 - DNA, 20 bp, Homo sapiens
atatctatatgttatcttga

SEQ ID NO: 126406 - DNA, 18 bp, Homo sapiens
tatctatctatatctata

SEQ ID NO: 126407 - DNA, 23 bp, Homo sapiens
tgttgttctttatgtattccgaa

SEQ ID NO: 126408 - DNA, 22 bp, Homo sapiens
tacatgtgcacaatgtgcaggt

SEQ ID NO: 126409 - DNA, 23 bp, Homo sapiens
gaagtttgttgatgtttctgtaa

SEQ ID NO: 126410 - DNA, 23 bp, Homo sapiens
ctagctccatttgaaaagtctgt

SEQ ID NO: 126411 - DNA, 19 bp, Homo sapiens
ttaaaatcagatttacttg

SEQ ID NO: 126412 - DNA, 21 bp, Homo sapiens
tcaaagtttgtgaagtgaatc

SEQ ID NO: 126413 - DNA, 23 bp, Homo sapiens
tgaggtagaaggatcacttgagc

SEQ ID NO: 126414 - DNA, 23 bp, Homo sapiens
tgagttcattgtagattctggat

SEQ ID NO: 126415 - DNA, 23 bp, Homo sapiens
tgagttcattgtagattctggat

SEQ ID NO: 126416 - DNA, 21 bp, Homo sapiens
agacataaaggaatctgatta

SEQ ID NO: 126417 - DNA, 23 bp, Homo sapiens
tgtgtgtatatatatatgtgtgt

SEQ ID NO: 126418 - DNA, 23 bp, Homo sapiens
taagggtgtgcataggtatacat

SEQ ID NO: 126419 - DNA, 23 bp, Homo sapiens
tttcatgatgtttatctttgatt

SEQ ID NO: 126420 - DNA, 23 bp, Homo sapiens
cgtaaacagagagcacacagggc

SEQ ID NO: 126421 - DNA, 21 bp, Homo sapiens
tgtaatactctttgaattatg

SEQ ID NO: 126422 - DNA, 22 bp, Homo sapiens
tgattcagagtgtattttgtct

SEQ ID NO: 126423 - DNA, 20 bp, Homo sapiens
tgtatatatgtatgtgtgta

SEQ ID NO: 126424 - DNA, 23 bp, Homo sapiens
tatgtgtgtatgtacatatgtgt

SEQ ID NO: 126425 - DNA, 22 bp, Homo sapiens
tatgtatatatgtgtgtatgtg

SEQ ID NO: 126426 - DNA, 23 bp, Homo sapiens
tgtatgtatgtatatgataagcc

SEQ ID NO: 126427 - DNA, 22 bp, Homo sapiens
tcatagcttttatattcttctt

SEQ ID NO: 126428 - DNA, 23 bp, Homo sapiens
agtttgagtgtagagtttgtgtt

SEQ ID NO: 126429 - DNA, 23 bp, Homo sapiens
ttttaggagattttagattactt

SEQ ID NO: 126430 - DNA, 19 bp, Homo sapiens
tttccttttgagtcagttt

SEQ ID NO: 126431 - DNA, 23 bp, Homo sapiens
aagagtgtagatagaattcagag

SEQ ID NO: 126432 - DNA, 23 bp, Homo sapiens
atatgtatatgcaaatatgtgtg

SEQ ID NO: 126433 - DNA, 23 bp, Homo sapiens
catatatgtgtatatgtatatat

SEQ ID NO: 126434 - DNA, 23 bp, Homo sapiens
tatacacatatgtgtatgtgttt

SEQ ID NO: 126435 - DNA, 20 bp, Homo sapiens
tacacacacacacaccggaa

SEQ ID NO: 126436 - DNA, 23 bp, Homo sapiens
gtgtgtgtgtgtatatacacatg

SEQ ID NO: 126437 - DNA, 20 bp, Homo sapiens
tgtgtatatatgtatgtata

SEQ ID NO: 126438 - DNA, 22 bp, Homo sapiens
tttcgatattcatggtgctttg

SEQ ID NO: 126439 - DNA, 23 bp, Homo sapiens
ctcccagagcccctggaactctg

SEQ ID NO: 126440 - DNA, 23 bp, Homo sapiens
tcccagagcccctggaactctgg

SEQ ID NO: 126441 - DNA, 23 bp, Homo sapiens
tcccagagcccctggaactctgg

SEQ ID NO: 126442 - DNA, 23 bp, Homo sapiens
tcccagagcccctggaactctgg

SEQ ID NO: 126443 - DNA, 20 bp, Homo sapiens
tacatgtacatatatgtatg

SEQ ID NO: 126444 - DNA, 23 bp, Homo sapiens
agaatgtatatgtatatgtatac

SEQ ID NO: 126445 - DNA, 23 bp, Homo sapiens
ttgctctctctgtgtgtgtgtgt

SEQ ID NO: 126446 - DNA, 19 bp, Homo sapiens
tacatacatatacatatgt

SEQ ID NO: 126447 - DNA, 23 bp, Homo sapiens
tatgtatgtatgtatgtatatgt

SEQ ID NO: 126448 - DNA, 20 bp, Homo sapiens
atatgtatgtatatatatgt

SEQ ID NO: 126449 - DNA, 21 bp, Homo sapiens
gagtctcgctctgtcacccag

SEQ ID NO: 126450 - DNA, 19 bp, Homo sapiens
agctacatatatttacata

SEQ ID NO: 126451 - DNA, 23 bp, Homo sapiens
taatgctctaaatggtatctttg

SEQ ID NO: 126452 - DNA, 22 bp, Homo sapiens
ctatgataagtccatttggagt

SEQ ID NO: 126453 - DNA, 23 bp, Homo sapiens
tgagccactgtgcctggctgata

SEQ ID NO: 126454 - DNA, 23 bp, Homo sapiens
atgtgtgtgtatgcatgtgtgtg

SEQ ID NO: 126455 - DNA, 23 bp, Homo sapiens
tatgtgtatgtgtatatatgtgt

SEQ ID NO: 126456 - DNA, 23 bp, Homo sapiens
catggtggattagttttctgata

SEQ ID NO: 126457 - DNA, 23 bp, Homo sapiens
tgagttcattgtagattctggat

SEQ ID NO: 126458 - DNA, 23 bp, Homo sapiens
tgagttcattgtagattctggat

SEQ ID NO: 126459 - DNA, 20 bp, Homo sapiens
tatgtatatatgtacatata

SEQ ID NO: 126460 - DNA, 22 bp, Homo sapiens
tagtcaggttttgtagtcagat

SEQ ID NO: 126461 - DNA, 23 bp, Homo sapiens
gctacaatgagccagcctttctc

SEQ ID NO: 126462 - DNA, 23 bp, Homo sapiens
tgagacaggctctggctctgttg

SEQ ID NO: 126463 - DNA, 18 bp, Homo sapiens
aatctgcccctttttcat

SEQ ID NO: 126464 - DNA, 23 bp, Homo sapiens
tgagttcattgtagattctggat

SEQ ID NO: 126465 - DNA, 23 bp, Homo sapiens
tgagttcattgtagattctggat

SEQ ID NO: 126466 - DNA, 23 bp, Homo sapiens
tgagttcattgtagattctggat

SEQ ID NO: 126467 - DNA, 23 bp, Homo sapiens
tgagttcattgtagattctggat

SEQ ID NO: 126468 - DNA, 23 bp, Homo sapiens
tgagttcattgtagattctggat

SEQ ID NO: 126469 - DNA, 23 bp, Homo sapiens
tgagttcattgtagattctggat

SEQ ID NO: 126470 - DNA, 23 bp, Homo sapiens
tgagttcattgtagattctggat

SEQ ID NO: 126471 - DNA, 23 bp, Homo sapiens
tgagttcattgtagattctggat

SEQ ID NO: 126472 - DNA, 23 bp, Homo sapiens
tgagttcattgtagattctggat

SEQ ID NO: 126473 - DNA, 23 bp, Homo sapiens
tgagttcattgtagattctggat

SEQ ID NO: 126474 - DNA, 18 bp, Homo sapiens
taccatatatatacgtat

SEQ ID NO: 126475 - DNA, 22 bp, Homo sapiens
taccatatatatgtgtatatat

SEQ ID NO: 126476 - DNA, 18 bp, Homo sapiens
tgtgtatgtatgtatacc

SEQ ID NO: 126477 - DNA, 20 bp, Homo sapiens
tatgtgtatgtatatatatg

SEQ ID NO: 126478 - DNA, 21 bp, Homo sapiens
tgagaatggcattcttgtctt

SEQ ID NO: 126479 - DNA, 18 bp, Homo sapiens
ttcactgtaatgttcgct

SEQ ID NO: 126480 - DNA, 22 bp, Homo sapiens
atatgtatatgtatacatgtgt

SEQ ID NO: 126481 - DNA, 23 bp, Homo sapiens
acacagatgcatatgtatacaga

SEQ ID NO: 126482 - DNA, 23 bp, Homo sapiens
gacagagtctcgctctgtcaccc

SEQ ID NO: 126483 - DNA, 23 bp, Homo sapiens
tttgagatggagtcttgctctgt

SEQ ID NO: 126484 - DNA, 21 bp, Homo sapiens
tctcactctgtcacccaggct

SEQ ID NO: 126485 - DNA, 18 bp, Homo sapiens
tgtgatcatagttcagtg

SEQ ID NO: 126486 - DNA, 19 bp, Homo sapiens
agagtgtcactctattgcc

SEQ ID NO: 126487 - DNA, 21 bp, Homo sapiens
cagtggtatgatcttggctca

SEQ ID NO: 126488 - DNA, 18 bp, Homo sapiens
agtagctctttagatagt

SEQ ID NO: 126489 - DNA, 19 bp, Homo sapiens
atatgaaaaggttgagtag

SEQ ID NO: 126490 - DNA, 22 bp, Homo sapiens
tacctgggggaagaagagcaga

SEQ ID NO: 126491 - DNA, 23 bp, Homo sapiens
taagtctcgctctgtcaccccag

SEQ ID NO: 126492 - DNA, 23 bp, Homo sapiens
tctctgccaggttttggtatcag

SEQ ID NO: 126493 - DNA, 20 bp, Homo sapiens
attagtttcatgtttatggt

SEQ ID NO: 126494 - DNA, 23 bp, Homo sapiens
atatatgtattagttccaggtgt

SEQ ID NO: 126495 - DNA, 18 bp, Homo sapiens
acacacacatatgtgtgt

SEQ ID NO: 126496 - DNA, 21 bp, Homo sapiens
acacatggtgtgtatgtgtgt

SEQ ID NO: 126497 - DNA, 23 bp, Homo sapiens
tgagttcattgtagattctggat

SEQ ID NO: 126498 - DNA, 23 bp, Homo sapiens
tgagttcattgtagattctggat

SEQ ID NO: 126499 - DNA, 19 bp, Homo sapiens
atatttgatgtatcgatat

SEQ ID NO: 126500 - DNA, 22 bp, Homo sapiens
agacagacaatagtcactgcag

SEQ ID NO: 126501 - DNA, 21 bp, Homo sapiens
cagtactgtgctgacttctgt

SEQ ID NO: 126502 - DNA, 21 bp, Homo sapiens
tatacacatatacatatagtc

SEQ ID NO: 126503 - DNA, 22 bp, Homo sapiens
tgtgtgtgtgtgtgtgcacgcg

SEQ ID NO: 126504 - DNA, 23 bp, Homo sapiens
ttctcagtgtcagtaaacggttt

SEQ ID NO: 126505 - DNA, 23 bp, Homo sapiens
catgattttgaagtacttattgc

SEQ ID NO: 126506 - DNA, 23 bp, Homo sapiens
actacatatgtatacatgtagta

SEQ ID NO: 126507 - DNA, 23 bp, Homo sapiens
atatgtgtatatatatatgtgtg

SEQ ID NO: 126508 - DNA, 23 bp, Homo sapiens
atatgtgtgtatatatatgtgtg

SEQ ID NO: 126509 - DNA, 23 bp, Homo sapiens
tatatagtagagagactgctata

SEQ ID NO: 126510 - DNA, 19 bp, Homo sapiens
atatgtatacatgtataca

SEQ ID NO: 126511 - DNA, 23 bp, Homo sapiens
tgagttcattgtagattctggat

SEQ ID NO: 126512 - DNA, 23 bp, Homo sapiens
tgagttcattgtagattctggat

SEQ ID NO: 126513 - DNA, 23 bp, Homo sapiens
tggtctgtgactctctctttggg

SEQ ID NO: 126514 - DNA, 23 bp, Homo sapiens
acataggtatagttccagtatgt

SEQ ID NO: 126515 - DNA, 23 bp, Homo sapiens
tatagtatataaatatgtgtgtt

SEQ ID NO: 126516 - DNA, 23 bp, Homo sapiens
accctgtgtccaagtgttctcgt

SEQ ID NO: 126517 - DNA, 22 bp, Homo sapiens
tggagtctcgctctgtcaccag

SEQ ID NO: 126518 - DNA, 23 bp, Homo sapiens
atggagtctcactctgtcaccca

SEQ ID NO: 126519 - DNA, 23 bp, Homo sapiens
tggagtctcactctgtcacccag

SEQ ID NO: 126520 - DNA, 23 bp, Homo sapiens
tgtgtgtatatgtatatgtgtgt

SEQ ID NO: 126521 - DNA, 22 bp, Homo sapiens
atatacacacacatatacatat

SEQ ID NO: 126522 - DNA, 22 bp, Homo sapiens
tttagggttttctacatataag

SEQ ID NO: 126523 - DNA, 23 bp, Homo sapiens
ggtattctctgtctctgtcagcc

SEQ ID NO: 126524 - DNA, 21 bp, Homo sapiens
tgtgtgtgtgtgtgtgcatat

SEQ ID NO: 126525 - DNA, 23 bp, Homo sapiens
tagagatagcatattactctgtc

SEQ ID NO: 126526 - DNA, 23 bp, Homo sapiens
tcccagagcccctggaactctgg

SEQ ID NO: 126527 - DNA, 20 bp, Homo sapiens
tgtgtatatatacatgtatg

SEQ ID NO: 126528 - DNA, 18 bp, Homo sapiens
gtgtatgtatgtgtatgt

SEQ ID NO: 126529 - DNA, 22 bp, Homo sapiens
tacacacacacatataattgag

SEQ ID NO: 126530 - DNA, 21 bp, Homo sapiens
catgtgcgtatatatacatgt

SEQ ID NO: 126531 - DNA, 23 bp, Homo sapiens
ggacaatgttgttgatttcgagt

SEQ ID NO: 126532 - DNA, 23 bp, Homo sapiens
tgtgtgtactgtgtttgcagtac

SEQ ID NO: 126533 - DNA, 23 bp, Homo sapiens
tgtaaactagtgtatgtcatgtg

SEQ ID NO: 126534 - DNA, 23 bp, Homo sapiens
attcctatacttccagctactca

SEQ ID NO: 126535 - DNA, 22 bp, Homo sapiens
atatacacacacatatatatgt

SEQ ID NO: 126536 - DNA, 19 bp, Homo sapiens
agcaagactctgtctcaaa

SEQ ID NO: 126537 - DNA, 20 bp, Homo sapiens
tgagacagtgtctcactctg

SEQ ID NO: 126538 - DNA, 23 bp, Homo sapiens
acatgcttatagtctcagctact

SEQ ID NO: 126539 - DNA, 21 bp, Homo sapiens
tgaggtaggaggatctcttga

SEQ ID NO: 126540 - DNA, 21 bp, Homo sapiens
ctttatatcttctggtggaag

SEQ ID NO: 126541 - DNA, 23 bp, Homo sapiens
agacactgtgcttgttctattta

SEQ ID NO: 126542 - DNA, 21 bp, Homo sapiens
aacatgaacttgacttacagg

SEQ ID NO: 126543 - DNA, 20 bp, Homo sapiens
agccaagttcatgttctcat

SEQ ID NO: 126544 - DNA, 20 bp, Homo sapiens
tgagaagagtctcactctgt

SEQ ID NO: 126545 - DNA, 18 bp, Homo sapiens
ttttgtgacggagtttta

SEQ ID NO: 126546 - DNA, 19 bp, Homo sapiens
aaaagagaattcagatagg

SEQ ID NO: 126547 - DNA, 23 bp, Homo sapiens
tttcgattgctaagaagtatgta

SEQ ID NO: 126548 - DNA, 22 bp, Homo sapiens
tagtgtataaatgtatacgcta

SEQ ID NO: 126549 - DNA, 23 bp, Homo sapiens
aatcacactgtctgtaaaatggg

SEQ ID NO: 126550 - DNA, 21 bp, Homo sapiens
taaaggtacattacagtatat

SEQ ID NO: 126551 - DNA, 22 bp, Homo sapiens
gtgtatttttttccatgtgttt

SEQ ID NO: 126552 - DNA, 23 bp, Homo sapiens
agagtctctcactgtcacccggg

SEQ ID NO: 126553 - DNA, 21 bp, Homo sapiens
taagcagcatggtaataggaa

SEQ ID NO: 126554 - DNA, 19 bp, Homo sapiens
tgcctgacaacctttctgt

SEQ ID NO: 126555 - DNA, 23 bp, Homo sapiens
tgagttcattgtagattctggat

SEQ ID NO: 126556 - DNA, 23 bp, Homo sapiens
tgagttcattgtagattctggat

SEQ ID NO: 126557 - DNA, 19 bp, Homo sapiens
tgtgtccctgtgtgtctgg

SEQ ID NO: 126558 - DNA, 22 bp, Homo sapiens
attgtactgacatctctattgc

SEQ ID NO: 126559 - DNA, 23 bp, Homo sapiens
atgagagacattagactgtggac

SEQ ID NO: 126560 - DNA, 20 bp, Homo sapiens
atattccatatctatatata

SEQ ID NO: 126561 - DNA, 23 bp, Homo sapiens
tgtttagaaatctaccagtaaaa

SEQ ID NO: 126562 - DNA, 20 bp, Homo sapiens
tgttatgtattatatatttg

SEQ ID NO: 126563 - DNA, 22 bp, Homo sapiens
ataaatatgtttatgtacatat

SEQ ID NO: 126564 - DNA, 22 bp, Homo sapiens
tctatgtatgtatgtatgtatc

SEQ ID NO: 126565 - DNA, 21 bp, Homo sapiens
tgtattgatcctagtatgtag

SEQ ID NO: 126566 - DNA, 20 bp, Homo sapiens
tatacatacatatacatatg

SEQ ID NO: 126567 - DNA, 21 bp, Homo sapiens
tatacgtatacatacatatgt

SEQ ID NO: 126568 - DNA, 23 bp, Homo sapiens
tatatacgtgtatatatgtatgt

SEQ ID NO: 126569 - DNA, 23 bp, Homo sapiens
tgtatatctgcatgtgcatgtgt

SEQ ID NO: 126570 - DNA, 23 bp, Homo sapiens
tgtgtctctgtgtgtattttctg

SEQ ID NO: 126571 - DNA, 23 bp, Homo sapiens
tgagttcattgtagattctggat

SEQ ID NO: 126572 - DNA, 23 bp, Homo sapiens
tgagttcattgtagattctggat

SEQ ID NO: 126573 - DNA, 23 bp, Homo sapiens
ctctctatactttctggacagaa

SEQ ID NO: 126574 - DNA, 22 bp, Homo sapiens
tttagatggagtctcgctctgt

SEQ ID NO: 126575 - DNA, 23 bp, Homo sapiens
tgtgtgtgtatatatatgtgtgt

SEQ ID NO: 126576 - DNA, 23 bp, Homo sapiens
aagtataattgcatgtccttttc

SEQ ID NO: 126577 - DNA, 21 bp, Homo sapiens
acgatgttatcttagctgtct

SEQ ID NO: 126578 - DNA, 18 bp, Homo sapiens
atcctgttttgtaacttc

SEQ ID NO: 126579 - DNA, 19 bp, Homo sapiens
tgtctagtgatttagttct

SEQ ID NO: 126580 - DNA, 23 bp, Homo sapiens
ttaagtctctgtttcctaaagca

SEQ ID NO: 126581 - DNA, 22 bp, Homo sapiens
tgacccagtgactttctttttt

SEQ ID NO: 126582 - DNA, 23 bp, Homo sapiens
tgagagagagtctcgctctgtcg

SEQ ID NO: 126583 - DNA, 23 bp, Homo sapiens
agtgaaacagtatagagtgagca

SEQ ID NO: 126584 - DNA, 23 bp, Homo sapiens
gataagacttgataatccagtct

SEQ ID NO: 126585 - DNA, 23 bp, Homo sapiens
tttctgagactgattctcactct

SEQ ID NO: 126586 - DNA, 21 bp, Homo sapiens
gtgtatatatgtatatatgcg

SEQ ID NO: 126587 - DNA, 23 bp, Homo sapiens
ttctgctactgattcatacttga

SEQ ID NO: 126588 - DNA, 22 bp, Homo sapiens
tctctgtctctctgttctgagc

SEQ ID NO: 126589 - DNA, 23 bp, Homo sapiens
tgagtgtgtgcatgaggaactgt

SEQ ID NO: 126590 - DNA, 22 bp, Homo sapiens
ttatggtcaatgttgcaggagt

SEQ ID NO: 126591 - DNA, 23 bp, Homo sapiens
atttttggttccatatgaaattt

SEQ ID NO: 126592 - DNA, 19 bp, Homo sapiens
tggccattcttataggagt

SEQ ID NO: 126593 - DNA, 21 bp, Homo sapiens
agttgagtcaggttaagatga

SEQ ID NO: 126594 - DNA, 21 bp, Homo sapiens
accttttaatttcatgaagta

SEQ ID NO: 126595 - DNA, 21 bp, Homo sapiens
aagcaagaaaaagaaggagtt

SEQ ID NO: 126596 - DNA, 23 bp, Homo sapiens
ttgttttgtgtcctaatgatatg

SEQ ID NO: 126597 - DNA, 21 bp, Homo sapiens
tgagtctcacctgaagccatc

SEQ ID NO: 126598 - DNA, 23 bp, Homo sapiens
atgtatatatgtatatgtatatg

SEQ ID NO: 126599 - DNA, 23 bp, Homo sapiens
tatatttatgtatgcatatgtgt

SEQ ID NO: 126600 - DNA, 22 bp, Homo sapiens
attagtaccatgctgttttggt

SEQ ID NO: 126601 - DNA, 23 bp, Homo sapiens
gacagtctcactctgtcatccag

SEQ ID NO: 126602 - DNA, 20 bp, Homo sapiens
aatatgtgtgttatacatga

SEQ ID NO: 126603 - DNA, 19 bp, Homo sapiens
actgtgcatatatatagat

SEQ ID NO: 126604 - DNA, 23 bp, Homo sapiens
tatgtagtatgtatatgtagcag

SEQ ID NO: 126605 - DNA, 23 bp, Homo sapiens
agggttgtacactgaacttagta

SEQ ID NO: 126606 - DNA, 23 bp, Homo sapiens
tctttggttatctagctgtatga

SEQ ID NO: 126607 - DNA, 22 bp, Homo sapiens
ataaagctagataaccgaaagt

SEQ ID NO: 126608 - DNA, 23 bp, Homo sapiens
tgtgggtgtaggacagttatgaa

SEQ ID NO: 126609 - DNA, 20 bp, Homo sapiens
tgttttcatagtaaacttac

SEQ ID NO: 126610 - DNA, 22 bp, Homo sapiens
tgcaaagatctatgagagaagc

SEQ ID NO: 126611 - DNA, 23 bp, Homo sapiens
ctcactcatactcactgcatccc

SEQ ID NO: 126612 - DNA, 23 bp, Homo sapiens
tgagttcattgtagattctggat

SEQ ID NO: 126613 - DNA, 23 bp, Homo sapiens
tgagttcattgtagattctggat

SEQ ID NO: 126614 - DNA, 21 bp, Homo sapiens
agagagggagagatacttgtg

SEQ ID NO: 126615 - DNA, 23 bp, Homo sapiens
tatagtaggtgtatagatttatg

SEQ ID NO: 126616 - DNA, 23 bp, Homo sapiens
gaatgtatatatatgtgtgtgtg

SEQ ID NO: 126617 - DNA, 20 bp, Homo sapiens
aagagagaacaaagtgagca

SEQ ID NO: 126618 - DNA, 23 bp, Homo sapiens
tgagtgacaaatgccaatcccaa

SEQ ID NO: 126619 - DNA, 22 bp, Homo sapiens
cattttgaggcaggttatcatt

SEQ ID NO: 126620 - DNA, 23 bp, Homo sapiens
gagacagagtctcactctgtcac

SEQ ID NO: 126621 - DNA, 20 bp, Homo sapiens
ttttagtatgaatatttgta

SEQ ID NO: 126622 - DNA, 22 bp, Homo sapiens
gctgtgtcagtgtgtgtgttga

SEQ ID NO: 126623 - DNA, 20 bp, Homo sapiens
tgtatgtgtgtgtgtgtaga

SEQ ID NO: 126624 - DNA, 23 bp, Homo sapiens
tgagttcattgtagattctggat

SEQ ID NO: 126625 - DNA, 23 bp, Homo sapiens
tgagttcattgtagattctggat

SEQ ID NO: 126626 - DNA, 20 bp, Homo sapiens
acatacacacacatatatct

SEQ ID NO: 126627 - DNA, 23 bp, Homo sapiens
ctttcatatggaattctttactt

SEQ ID NO: 126628 - DNA, 21 bp, Homo sapiens
tttagacatactgctattgca

SEQ ID NO: 126629 - DNA, 22 bp, Homo sapiens
gctgactgttctcaaggagttc

SEQ ID NO: 126630 - DNA, 23 bp, Homo sapiens
gaagacacagaggatagggagcg

SEQ ID NO: 126631 - DNA, 23 bp, Homo sapiens
tgagttcattgtagattctggat

SEQ ID NO: 126632 - DNA, 23 bp, Homo sapiens
tgagttcattgtagattctggat

SEQ ID NO: 126633 - DNA, 22 bp, Homo sapiens
atatactgtgaggtatatatat

SEQ ID NO: 126634 - DNA, 19 bp, Homo sapiens
tatgtgtgtgtatatctat

SEQ ID NO: 126635 - DNA, 18 bp, Homo sapiens
tgtatatgtatagacctg

SEQ ID NO: 126636 - DNA, 19 bp, Homo sapiens
tgtacatatgtatatgtgt

SEQ ID NO: 126637 - DNA, 23 bp, Homo sapiens
taatgtatatatgtatatgtata

SEQ ID NO: 126638 - DNA, 18 bp, Homo sapiens
agacaagattgtttcaat

SEQ ID NO: 126639 - DNA, 19 bp, Homo sapiens
tttcaggagatcctttagt

SEQ ID NO: 126640 - DNA, 23 bp, Homo sapiens
tgtcccagagaggttatgtggca

SEQ ID NO: 126641 - DNA, 23 bp, Homo sapiens
tgagttcattgtagattctggat

SEQ ID NO: 126642 - DNA, 23 bp, Homo sapiens
tgagttcattgtagattctggat

SEQ ID NO: 126643 - DNA, 22 bp, Homo sapiens
aaagttcatggtatttcagata

SEQ ID NO: 126644 - DNA, 19 bp, Homo sapiens
tatatgtatatgtatatgt

SEQ ID NO: 126645 - DNA, 19 bp, Homo sapiens
gatgacatctgatttagat

SEQ ID NO: 126646 - DNA, 18 bp, Homo sapiens
tacatgtacacaagcata

SEQ ID NO: 126647 - DNA, 21 bp, Homo sapiens
tgctgggtagctagacccaga

SEQ ID NO: 126648 - DNA, 21 bp, Homo sapiens
tggctcacaggaaatcacatc

SEQ ID NO: 126649 - DNA, 23 bp, Homo sapiens
atgtctttagtttgtgtactgaa

SEQ ID NO: 126650 - DNA, 23 bp, Homo sapiens
tattctgtttttttgttgaaatt

SEQ ID NO: 126651 - DNA, 23 bp, Homo sapiens
tttttgactgagatattaatgtg

SEQ ID NO: 126652 - DNA, 18 bp, Homo sapiens
tctcggctcactgcaacc

SEQ ID NO: 126653 - DNA, 23 bp, Homo sapiens
tgcactgtggttttgatttgcat

SEQ ID NO: 126654 - DNA, 23 bp, Homo sapiens
acagagtctcgctctgtcaccca

SEQ ID NO: 126655 - DNA, 23 bp, Homo sapiens
atttgtctttttcttgttgagct

SEQ ID NO: 126656 - DNA, 23 bp, Homo sapiens
gacagagtctcgctctgtcaccc

SEQ ID NO: 126657 - DNA, 23 bp, Homo sapiens
atgtatgtgtgtatatgcatgtg

SEQ ID NO: 126658 - DNA, 20 bp, Homo sapiens
tatgcgtgtgcatatataca

SEQ ID NO: 126659 - DNA, 21 bp, Homo sapiens
tctgtggatgaacatgtaggt

SEQ ID NO: 126660 - DNA, 19 bp, Homo sapiens
ttatatatttccaaagcat

SEQ ID NO: 126661 - DNA, 20 bp, Homo sapiens
taagcagacttagatattca

SEQ ID NO: 126662 - DNA, 20 bp, Homo sapiens
aattgaaatatttccaaatg

SEQ ID NO: 126663 - DNA, 23 bp, Homo sapiens
aatgtgaggaatttactctgtga

SEQ ID NO: 126664 - DNA, 21 bp, Homo sapiens
taggcaatacatgatctagta

SEQ ID NO: 126665 - DNA, 20 bp, Homo sapiens
tcacatgaactaaaaggcat

SEQ ID NO: 126666 - DNA, 23 bp, Homo sapiens
tattgcttggataagtgtatttt

SEQ ID NO: 126667 - DNA, 20 bp, Homo sapiens
aattttcatgtttctgtagt

SEQ ID NO: 126668 - DNA, 22 bp, Homo sapiens
tatatagtgctaaatgtatctg

SEQ ID NO: 126669 - DNA, 23 bp, Homo sapiens
aaaaacactcagattgaataaaa

SEQ ID NO: 126670 - DNA, 23 bp, Homo sapiens
tgagttcattgtagattctggat

SEQ ID NO: 126671 - DNA, 23 bp, Homo sapiens
tgagttcattgtagattctggat

SEQ ID NO: 126672 - DNA, 23 bp, Homo sapiens
tggagtggcaagatcatggctca

SEQ ID NO: 126673 - DNA, 23 bp, Homo sapiens
agactgaggtaggaggttcttgt

SEQ ID NO: 126674 - DNA, 23 bp, Homo sapiens
tcattggtttattagctataact

SEQ ID NO: 126675 - DNA, 20 bp, Homo sapiens
tacagacaagtttttatgag

SEQ ID NO: 126676 - DNA, 19 bp, Homo sapiens
agagcagcacaaatggact

SEQ ID NO: 126677 - DNA, 23 bp, Homo sapiens
tttagatgtgatttgctatgttg

SEQ ID NO: 126678 - DNA, 23 bp, Homo sapiens
taggaccatgtgaatactgaatg

SEQ ID NO: 126679 - DNA, 23 bp, Homo sapiens
ataagtacatctatgtacgtgtg

SEQ ID NO: 126680 - DNA, 20 bp, Homo sapiens
tttggctgaaaaagatgcct

SEQ ID NO: 126681 - DNA, 22 bp, Homo sapiens
ttgtttagtcagtttttttcat

SEQ ID NO: 126682 - DNA, 23 bp, Homo sapiens
tgtgtctctgtcagcatgtgagt

SEQ ID NO: 126683 - DNA, 19 bp, Homo sapiens
attgtactatttttgcata

SEQ ID NO: 126684 - DNA, 19 bp, Homo sapiens
tcatatgtatatatgtatg

SEQ ID NO: 126685 - DNA, 22 bp, Homo sapiens
ttttgagatggagtctcactct

SEQ ID NO: 126686 - DNA, 23 bp, Homo sapiens
ctgattttgtggttggtacattt

SEQ ID NO: 126687 - DNA, 23 bp, Homo sapiens
tgagacggtgtctcgctctgtcg

SEQ ID NO: 126688 - DNA, 21 bp, Homo sapiens
tgccctaaaagatagtgttgt

SEQ ID NO: 126689 - DNA, 19 bp, Homo sapiens
aatggtagcttgatgggga

SEQ ID NO: 126690 - DNA, 20 bp, Homo sapiens
tattgcttcattatttcatt

SEQ ID NO: 126691 - DNA, 23 bp, Homo sapiens
agagatgtacagtaatgatcaat

SEQ ID NO: 126692 - DNA, 23 bp, Homo sapiens
atttgcatcttttgaaatgacaa

SEQ ID NO: 126693 - DNA, 18 bp, Homo sapiens
taatgagacagctgctga

SEQ ID NO: 126694 - DNA, 23 bp, Homo sapiens
ttttcaaaccatttcattagtca

SEQ ID NO: 126695 - DNA, 21 bp, Homo sapiens
ttagctacattaatgaagttg

SEQ ID NO: 126696 - DNA, 23 bp, Homo sapiens
cagttatgtagtcattttcttca

SEQ ID NO: 126697 - DNA, 23 bp, Homo sapiens
ttatagcagcataaaaattgaaa

SEQ ID NO: 126698 - DNA, 23 bp, Homo sapiens
atatacatgtgcatgtatattta

SEQ ID NO: 126699 - DNA, 23 bp, Homo sapiens
aacatatacatgtgcatgtatat

SEQ ID NO: 126700 - DNA, 23 bp, Homo sapiens
tatacatgtgcatgtatatttat

SEQ ID NO: 126701 - DNA, 23 bp, Homo sapiens
atatacatgtgcatgtatattta

SEQ ID NO: 126702 - DNA, 23 bp, Homo sapiens
tatacatgtgcatgtatatttat

SEQ ID NO: 126703 - DNA, 23 bp, Homo sapiens
atatacatgtgcatgtatattta

SEQ ID NO: 126704 - DNA, 23 bp, Homo sapiens
tatacatgtgcatgtatatttat

SEQ ID NO: 126705 - DNA, 23 bp, Homo sapiens
atatacatgtgcatgtatattta

SEQ ID NO: 126706 - DNA, 23 bp, Homo sapiens
tatacatgtgcatgtatatttat

SEQ ID NO: 126707 - DNA, 23 bp, Homo sapiens
atatacatgtgcatgtatattta

SEQ ID NO: 126708 - DNA, 23 bp, Homo sapiens
tatacatgtgcatgtatatttat

SEQ ID NO: 126709 - DNA, 23 bp, Homo sapiens
atatacatgtgcatgtatattta

SEQ ID NO: 126710 - DNA, 23 bp, Homo sapiens
tatacatgtgcatgtatatttat

SEQ ID NO: 126711 - DNA, 23 bp, Homo sapiens
atatacatgtgcatgtatattta

SEQ ID NO: 126712 - DNA, 23 bp, Homo sapiens
tatctaaacatatacatgtgtat

SEQ ID NO: 126713 - DNA, 22 bp, Homo sapiens
aacatactgtttatctatctaa

SEQ ID NO: 126714 - DNA, 19 bp, Homo sapiens
attgcatttatgtatgtat

SEQ ID NO: 126715 - DNA, 19 bp, Homo sapiens
agtcttgctctgtcactca

SEQ ID NO: 126716 - DNA, 23 bp, Homo sapiens
agttcttaggggaaagtgagaga

SEQ ID NO: 126717 - DNA, 23 bp, Homo sapiens
tgagacaaggtctcactctgttg

SEQ ID NO: 126718 - DNA, 23 bp, Homo sapiens
tgcattttgtacatcttggagat

SEQ ID NO: 126719 - DNA, 23 bp, Homo sapiens
atatgtatttatatgtgtgtgtg

SEQ ID NO: 126720 - DNA, 23 bp, Homo sapiens
acagagtctcactctgtcgccca

SEQ ID NO: 126721 - DNA, 23 bp, Homo sapiens
tgttcaagagcaccagacttttt

SEQ ID NO: 126722 - DNA, 23 bp, Homo sapiens
acagagtcttgctctgtcaccag

SEQ ID NO: 126723 - DNA, 23 bp, Homo sapiens
cttttgagatggagtttcactct

SEQ ID NO: 126724 - DNA, 23 bp, Homo sapiens
ttctctctgtgtgtgtctgtgcc

SEQ ID NO: 126725 - DNA, 23 bp, Homo sapiens
aatgagttgacacaggttaagca

SEQ ID NO: 126726 - DNA, 23 bp, Homo sapiens
tttaaaggagttgaggtcttgtt

SEQ ID NO: 126727 - DNA, 21 bp, Homo sapiens
aaagtgataggattacaggtg

SEQ ID NO: 126728 - DNA, 18 bp, Homo sapiens
ttgcttctttggtaatgt

SEQ ID NO: 126729 - DNA, 18 bp, Homo sapiens
tatgtgtgtgtgtgtata

SEQ ID NO: 126730 - DNA, 23 bp, Homo sapiens
atgtgtgtatatatatatgtgtg

SEQ ID NO: 126731 - DNA, 22 bp, Homo sapiens
tacacacatatacatatacaca

SEQ ID NO: 126732 - DNA, 23 bp, Homo sapiens
tgtatatatgtacatatacgtat

SEQ ID NO: 126733 - DNA, 20 bp, Homo sapiens
tatatgtacatatacgtata

SEQ ID NO: 126734 - DNA, 19 bp, Homo sapiens
cagtggtactttgttttat

SEQ ID NO: 126735 - DNA, 22 bp, Homo sapiens
acagtggtatgatctcagccgt

SEQ ID NO: 126736 - DNA, 18 bp, Homo sapiens
tatctgtgggttttttgt

SEQ ID NO: 126737 - DNA, 20 bp, Homo sapiens
acatgacaaatgtatggcat

SEQ ID NO: 126738 - DNA, 19 bp, Homo sapiens
attcatgtatattcgtatg

SEQ ID NO: 126739 - DNA, 18 bp, Homo sapiens
tattcgtatatattcgtt

SEQ ID NO: 126740 - DNA, 22 bp, Homo sapiens
ttagtgggagtgcttctgtgtg

SEQ ID NO: 126741 - DNA, 21 bp, Homo sapiens
ggtgtgatagaagattgaggt

SEQ ID NO: 126742 - DNA, 23 bp, Homo sapiens
agacagagtctcgctctgtcacc

SEQ ID NO: 126743 - DNA, 23 bp, Homo sapiens
ccaggcactgtctgcctgagtgg

SEQ ID NO: 126744 - DNA, 23 bp, Homo sapiens
agacaagagtctcactctgtcac

SEQ ID NO: 126745 - DNA, 22 bp, Homo sapiens
gactatggaaatgcttttcttc

SEQ ID NO: 126746 - DNA, 23 bp, Homo sapiens
tgtgtatatatatatgtgtgtgt

SEQ ID NO: 126747 - DNA, 20 bp, Homo sapiens
agagtgggtagatgggagat

SEQ ID NO: 126748 - DNA, 22 bp, Homo sapiens
ttggagctcagtttctgaagtg

SEQ ID NO: 126749 - DNA, 21 bp, Homo sapiens
tgagacagagtttccctctgt

SEQ ID NO: 126750 - DNA, 23 bp, Homo sapiens
tgagttcattgtagattctggat

SEQ ID NO: 126751 - DNA, 23 bp, Homo sapiens
tgagttcattgtagattctggat

SEQ ID NO: 126752 - DNA, 23 bp, Homo sapiens
gttctaagactctatttcttgat

SEQ ID NO: 126753 - DNA, 22 bp, Homo sapiens
acatgagatttggaggagacac

SEQ ID NO: 126754 - DNA, 23 bp, Homo sapiens
tagagcctcctaaccaatctgct

SEQ ID NO: 126755 - DNA, 23 bp, Homo sapiens
ttgtggttgagaaatgtaaacaa

SEQ ID NO: 126756 - DNA, 21 bp, Homo sapiens
ttgatttgcatctctatgatg

SEQ ID NO: 126757 - DNA, 23 bp, Homo sapiens
atgtccttgaatgtaaggctgag

SEQ ID NO: 126758 - DNA, 18 bp, Homo sapiens
aggtttttagatggtagg

SEQ ID NO: 126759 - DNA, 23 bp, Homo sapiens
actgactcagtggctgtgagtgg

SEQ ID NO: 126760 - DNA, 20 bp, Homo sapiens
ctcttcttggctgtttgact

SEQ ID NO: 126761 - DNA, 21 bp, Homo sapiens
tgagttgtaggagtttcttat

SEQ ID NO: 126762 - DNA, 20 bp, Homo sapiens
attatgtaggttacctttgc

SEQ ID NO: 126763 - DNA, 21 bp, Homo sapiens
ctcctgctttctgactctgaa

SEQ ID NO: 126764 - DNA, 23 bp, Homo sapiens
tatatctggtttagatggatcaa

SEQ ID NO: 126765 - DNA, 22 bp, Homo sapiens
agtctgtcctattctaatccta

SEQ ID NO: 126766 - DNA, 23 bp, Homo sapiens
gtgggaccctgtctcactcaaga

SEQ ID NO: 126767 - DNA, 22 bp, Homo sapiens
gtctcgctctgtcacccaggct

SEQ ID NO: 126768 - DNA, 21 bp, Homo sapiens
tttcaaggtcttggtcagttt

SEQ ID NO: 126769 - DNA, 19 bp, Homo sapiens
cctgccacacatattggtt

SEQ ID NO: 126770 - DNA, 19 bp, Homo sapiens
tggagaacttaggtgtgag

SEQ ID NO: 126771 - DNA, 23 bp, Homo sapiens
aaaagactgaatgcaattgtttt

SEQ ID NO: 126772 - DNA, 18 bp, Homo sapiens
gagtctcactctgtcgct

SEQ ID NO: 126773 - DNA, 23 bp, Homo sapiens
atatatatatctgatggttttgc

SEQ ID NO: 126774 - DNA, 19 bp, Homo sapiens
tatccatatatatatatat

SEQ ID NO: 126775 - DNA, 23 bp, Homo sapiens
ctcattgtggttttgatttgcat

SEQ ID NO: 126776 - DNA, 23 bp, Homo sapiens
tggccatgtgtatgtcttctttt

SEQ ID NO: 126777 - DNA, 23 bp, Homo sapiens
tgagttcattgtagattctggat

SEQ ID NO: 126778 - DNA, 23 bp, Homo sapiens
tgagttcattgtagattctggat

SEQ ID NO: 126779 - DNA, 21 bp, Homo sapiens
gtctgtcacccagactggagt

SEQ ID NO: 126780 - DNA, 23 bp, Homo sapiens
tgagttcattgtagattctggat

SEQ ID NO: 126781 - DNA, 23 bp, Homo sapiens
tgagttcattgtagattctggat

SEQ ID NO: 126782 - DNA, 23 bp, Homo sapiens
tatgctttccatgtatattcatg

SEQ ID NO: 126783 - DNA, 21 bp, Homo sapiens
ttcaaacataactagtaaggt

SEQ ID NO: 126784 - DNA, 23 bp, Homo sapiens
tgacaagatgtagtttctagatt

SEQ ID NO: 126785 - DNA, 18 bp, Homo sapiens
tataaaatgtcaatggat

SEQ ID NO: 126786 - DNA, 20 bp, Homo sapiens
acattgtatataattttgtt

SEQ ID NO: 126787 - DNA, 22 bp, Homo sapiens
ttctcctgtctcagctgggatt

SEQ ID NO: 126788 - DNA, 21 bp, Homo sapiens
gcctgatacatcatacctgca

SEQ ID NO: 126789 - DNA, 23 bp, Homo sapiens
gatgttaacactggatggctttt

SEQ ID NO: 126790 - DNA, 23 bp, Homo sapiens
tgagttcattgtagattctggat

SEQ ID NO: 126791 - DNA, 23 bp, Homo sapiens
tgagttcattgtagattctggat

SEQ ID NO: 126792 - DNA, 19 bp, Homo sapiens
ttgcatctatattaatatg

SEQ ID NO: 126793 - DNA, 23 bp, Homo sapiens
tttggtttaattttcgtatgagt

SEQ ID NO: 126794 - DNA, 23 bp, Homo sapiens
cggagtctcactctgtcacccag

SEQ ID NO: 126795 - DNA, 23 bp, Homo sapiens
ttttagcttgtacataaatatgt

SEQ ID NO: 126796 - DNA, 23 bp, Homo sapiens
tctcagactcagtttctcatcag

SEQ ID NO: 126797 - DNA, 23 bp, Homo sapiens
ggttgtgaggttgtaggctgaat

SEQ ID NO: 126798 - DNA, 23 bp, Homo sapiens
aaacacactggaatacatgagtt

SEQ ID NO: 126799 - DNA, 23 bp, Homo sapiens
tatggaacagtgcctggtaggga

SEQ ID NO: 126800 - DNA, 19 bp, Homo sapiens
atacacagaggagagggag

SEQ ID NO: 126801 - DNA, 21 bp, Homo sapiens
tatatggtacatatagatgta

SEQ ID NO: 126802 - DNA, 18 bp, Homo sapiens
tagatagatagtatatct

SEQ ID NO: 126803 - DNA, 22 bp, Homo sapiens
ctctgtgcctctctggcataca

SEQ ID NO: 126804 - DNA, 23 bp, Homo sapiens
tatcatcatgatatcctatccat

SEQ ID NO: 126805 - DNA, 20 bp, Homo sapiens
acttctggtagaagaaacca

SEQ ID NO: 126806 - DNA, 23 bp, Homo sapiens
ttatctattgtatacttgtactc

SEQ ID NO: 126807 - DNA, 23 bp, Homo sapiens
acagggtctcactctgtcactca

SEQ ID NO: 126808 - DNA, 23 bp, Homo sapiens
acagtctcactctgtcacccagg

SEQ ID NO: 126809 - DNA, 19 bp, Homo sapiens
taggataaccttgtattct

SEQ ID NO: 126810 - DNA, 20 bp, Homo sapiens
atatgtgtatatgtatatat

SEQ ID NO: 126811 - DNA, 23 bp, Homo sapiens
ttttcttagtttttgtagagaga

SEQ ID NO: 126812 - DNA, 23 bp, Homo sapiens
gctgactcagtctctctttctcc

SEQ ID NO: 126813 - DNA, 23 bp, Homo sapiens
tctgtctctgtgactcagatggg

SEQ ID NO: 126814 - DNA, 22 bp, Homo sapiens
atacacacacacatatagttgt

SEQ ID NO: 126815 - DNA, 23 bp, Homo sapiens
atgtatacatatgtgtgtatatg

SEQ ID NO: 126816 - DNA, 21 bp, Homo sapiens
tatgtatatgtatatgtatgt

SEQ ID NO: 126817 - DNA, 23 bp, Homo sapiens
tgagatggagtctcactctgtgg

SEQ ID NO: 126818 - DNA, 23 bp, Homo sapiens
acagagtctcactctgtcgccca

SEQ ID NO: 126819 - DNA, 23 bp, Homo sapiens
ttatcagtgtatttccaaagcct

SEQ ID NO: 126820 - DNA, 23 bp, Homo sapiens
ctgagtcctgagactctctcaca

SEQ ID NO: 126821 - DNA, 22 bp, Homo sapiens
ataggtgcttatactgtagctt

SEQ ID NO: 126822 - DNA, 23 bp, Homo sapiens
acagatgtcagatgggagtgtgc

SEQ ID NO: 126823 - DNA, 20 bp, Homo sapiens
gtgatcctgaccctgtgcag

SEQ ID NO: 126824 - DNA, 21 bp, Homo sapiens
attctgactgcctcccttatg

SEQ ID NO: 126825 - DNA, 23 bp, Homo sapiens
tctgtgtccctgtgtgggtcaga

SEQ ID NO: 126826 - DNA, 23 bp, Homo sapiens
acgactctgactctctgaggccc

SEQ ID NO: 126827 - DNA, 19 bp, Homo sapiens
agcgtcagagaaagctgta

SEQ ID NO: 126828 - DNA, 18 bp, Homo sapiens
atactttaagttttaggg

SEQ ID NO: 126829 - DNA, 23 bp, Homo sapiens
attctgactggtgtgagatggtg

SEQ ID NO: 126830 - DNA, 23 bp, Homo sapiens
tgaggtagaaggatcacttgagc

SEQ ID NO: 126831 - DNA, 20 bp, Homo sapiens
aagaggctgcagtgagccag

SEQ ID NO: 126832 - DNA, 21 bp, Homo sapiens
ctgcagtgagccgtaatcatg

SEQ ID NO: 126833 - DNA, 19 bp, Homo sapiens
tatacacatatatatgtac

SEQ ID NO: 126834 - DNA, 22 bp, Homo sapiens
atatgtatatatgtatatgtgt

SEQ ID NO: 126835 - DNA, 23 bp, Homo sapiens
tcataaggatagaaaagaactat

SEQ ID NO: 126836 - DNA, 23 bp, Homo sapiens
gcagaagacagcaaagggttctg

SEQ ID NO: 126837 - DNA, 23 bp, Homo sapiens
tacatgtgcacaatgtgcaggtt

SEQ ID NO: 126838 - DNA, 22 bp, Homo sapiens
tagctacatgatttgggtgaga

SEQ ID NO: 126839 - DNA, 23 bp, Homo sapiens
tgagttcattgtagattctggat

SEQ ID NO: 126840 - DNA, 23 bp, Homo sapiens
tgagttcattgtagattctggat

SEQ ID NO: 126841 - DNA, 18 bp, Homo sapiens
atagagtcttgctctgtt

SEQ ID NO: 126842 - DNA, 18 bp, Homo sapiens
atagagtcttgctctgtt

SEQ ID NO: 126843 - DNA, 23 bp, Homo sapiens
tggagtctcactctgtcacccag

SEQ ID NO: 126844 - DNA, 18 bp, Homo sapiens
tgacagagtctcgctctc

SEQ ID NO: 126845 - DNA, 18 bp, Homo sapiens
tcactgcagccttgaatt

SEQ ID NO: 126846 - DNA, 23 bp, Homo sapiens
gacagagtctcgctctgtcaccc

SEQ ID NO: 126847 - DNA, 23 bp, Homo sapiens
tggagtctcactctgtcacccag

SEQ ID NO: 126848 - DNA, 18 bp, Homo sapiens
tgtgaactatatagctgt

SEQ ID NO: 126849 - DNA, 22 bp, Homo sapiens
tatatggattcataggttacag

SEQ ID NO: 126850 - DNA, 18 bp, Homo sapiens
ttgacacctgattgtgtg

SEQ ID NO: 126851 - DNA, 23 bp, Homo sapiens
tacatgtgcacaatgtgcaggtt

SEQ ID NO: 126852 - DNA, 21 bp, Homo sapiens
tacacacacacatatacatgt

SEQ ID NO: 126853 - DNA, 22 bp, Homo sapiens
ataccgggagacttaatgcagt

SEQ ID NO: 126854 - DNA, 23 bp, Homo sapiens
tcataaggatagaaaagaactat

SEQ ID NO: 126855 - DNA, 23 bp, Homo sapiens
gcagaagacagcaaagggttctg

SEQ ID NO: 126856 - DNA, 23 bp, Homo sapiens
tacatgtgcacaatgtgcaggtt

SEQ ID NO: 126857 - DNA, 20 bp, Homo sapiens
atatcatgcacacacattta

SEQ ID NO: 126858 - DNA, 18 bp, Homo sapiens
atagagtcttgctctgtt

SEQ ID NO: 126859 - DNA, 18 bp, Homo sapiens
atagagtcttgctctgtt

SEQ ID NO: 126860 - DNA, 23 bp, Homo sapiens
tcataaggatagaaaagaactat

SEQ ID NO: 126861 - DNA, 23 bp, Homo sapiens
gcagaagacagcaaagggttctg

SEQ ID NO: 126862 - DNA, 23 bp, Homo sapiens
tacatgtgcacaatgtgcaggtt

SEQ ID NO: 126863 - DNA, 22 bp, Homo sapiens
tagctacatgatttgggtgaga

SEQ ID NO: 126864 - DNA, 22 bp, Homo sapiens
ctctgtcacccagactagaggg

SEQ ID NO: 126865 - DNA, 20 bp, Homo sapiens
atatcatgcacacacattta

SEQ ID NO: 126866 - DNA, 18 bp, Homo sapiens
atagagtcttgctctgtt

SEQ ID NO: 126867 - DNA, 18 bp, Homo sapiens
atagagtcttgctctgtt

SEQ ID NO: 126868 - DNA, 23 bp, Homo sapiens
tggagtctcactctgtcacccag

SEQ ID NO: 126869 - DNA, 18 bp, Homo sapiens
tgtgaactatatagctgt

SEQ ID NO: 126870 - DNA, 22 bp, Homo sapiens
tatatggattcataggttacag

SEQ ID NO: 126871 - DNA, 18 bp, Homo sapiens
ttgacacctgattgtgtg

SEQ ID NO: 126872 - DNA, 23 bp, Homo sapiens
tacatgtgcacaatgtgcaggtt

SEQ ID NO: 126873 - DNA, 22 bp, Homo sapiens
ataccgggagacttaatgcagt

SEQ ID NO: 126874 - DNA, 23 bp, Homo sapiens
tcataaggatagaaaagaactat

SEQ ID NO: 126875 - DNA, 23 bp, Homo sapiens
gcagaagacagcaaagggttctg

SEQ ID NO: 126876 - DNA, 23 bp, Homo sapiens
tacatgtgcacaatgtgcaggtt

SEQ ID NO: 126877 - DNA, 20 bp, Homo sapiens
atatcatgcacacacattta

SEQ ID NO: 126878 - DNA, 23 bp, Homo sapiens
tgagttcattgtagattctggat

SEQ ID NO: 126879 - DNA, 23 bp, Homo sapiens
tgagttcattgtagattctggat

SEQ ID NO: 126880 - DNA, 18 bp, Homo sapiens
atagagtcttgctctgtt

SEQ ID NO: 126881 - DNA, 21 bp, Homo sapiens
agaccttgtcagatggataga

SEQ ID NO: 126882 - DNA, 21 bp, Homo sapiens
attgcactccagcgtgggtga

SEQ ID NO: 126883 - DNA, 21 bp, Homo sapiens
gagagtgaaactctgtctcaa

SEQ ID NO: 126884 - DNA, 23 bp, Homo sapiens
gtatcactgtcaccctaactgga

SEQ ID NO: 126885 - DNA, 21 bp, Homo sapiens
tttcagacggagtctcactct

SEQ ID NO: 126886 - DNA, 19 bp, Homo sapiens
ttttgagtcggagtcttgc

SEQ ID NO: 126887 - DNA, 21 bp, Homo sapiens
agtcgattaagttagatctct

SEQ ID NO: 126888 - DNA, 23 bp, Homo sapiens
tcactgtctcagtcacaattgtg

SEQ ID NO: 126889 - DNA, 21 bp, Homo sapiens
ttttaaattttggtcacaaag

SEQ ID NO: 126890 - DNA, 19 bp, Homo sapiens
taatgcaaattcacaggag

SEQ ID NO: 126891 - DNA, 19 bp, Homo sapiens
acaggaatcagtttctagg

SEQ ID NO: 126892 - DNA, 21 bp, Homo sapiens
ttgatgcacttcttgcttttc

SEQ ID NO: 126893 - DNA, 21 bp, Homo sapiens
tctttagtaatgtagcagttt

SEQ ID NO: 126894 - DNA, 20 bp, Homo sapiens
tactgctacttgaagggaca

SEQ ID NO: 126895 - DNA, 23 bp, Homo sapiens
acagagtctcgctctgtcaccca

SEQ ID NO: 126896 - DNA, 22 bp, Homo sapiens
attctgcaactttactgaattt

SEQ ID NO: 126897 - DNA, 23 bp, Homo sapiens
tatgtgcatgtatatatatgtat

SEQ ID NO: 126898 - DNA, 23 bp, Homo sapiens
atatatatatatgtatatgtgtg

SEQ ID NO: 126899 - DNA, 23 bp, Homo sapiens
tgtatgtgtgtgtgtgcgtgtgt

SEQ ID NO: 126900 - DNA, 23 bp, Homo sapiens
ttagaggctagacaccagagagg

SEQ ID NO: 126901 - DNA, 23 bp, Homo sapiens
gtctgaatctcactgtcacccag

SEQ ID NO: 126902 - DNA, 23 bp, Homo sapiens
tgagcatgtgtgtgtgtgtgtgt

SEQ ID NO: 126903 - DNA, 21 bp, Homo sapiens
tgtgaagaaagtcattggtag

SEQ ID NO: 126904 - DNA, 23 bp, Homo sapiens
tgagttcattgtagattctggat

SEQ ID NO: 126905 - DNA, 23 bp, Homo sapiens
tgagttcattgtagattctggat

SEQ ID NO: 126906 - DNA, 22 bp, Homo sapiens
tcacactcagtgaaagctctta

SEQ ID NO: 126907 - DNA, 23 bp, Homo sapiens
atatgtatatatgtatatgtgta

SEQ ID NO: 126908 - DNA, 22 bp, Homo sapiens
atatgtgtatatatgtatatgt

SEQ ID NO: 126909 - DNA, 19 bp, Homo sapiens
cagtctcactctctccctg

SEQ ID NO: 126910 - DNA, 23 bp, Homo sapiens
acaaagtgaattcttattctcta

SEQ ID NO: 126911 - DNA, 22 bp, Homo sapiens
ttttattagataagaattcatt

SEQ ID NO: 126912 - DNA, 20 bp, Homo sapiens
tgcctgtgtgtatatttgta

SEQ ID NO: 126913 - DNA, 20 bp, Homo sapiens
agacttgcagttatactatt

SEQ ID NO: 126914 - DNA, 23 bp, Homo sapiens
atattgcaacatttcagcagaga

SEQ ID NO: 126915 - DNA, 21 bp, Homo sapiens
tggaacacagtgagaactctg

SEQ ID NO: 126916 - DNA, 22 bp, Homo sapiens
cgggctcactctgtcactcagg

SEQ ID NO: 126917 - DNA, 23 bp, Homo sapiens
tgtgtgtatttatatatgtgtat

SEQ ID NO: 126918 - DNA, 21 bp, Homo sapiens
atacgtatatatatatatgtg

SEQ ID NO: 126919 - DNA, 19 bp, Homo sapiens
gcaagtgtgttgtgtgttg

SEQ ID NO: 126920 - DNA, 23 bp, Homo sapiens
tgagagtctcgctctgtcaccca

SEQ ID NO: 126921 - DNA, 18 bp, Homo sapiens
tggtgtgatcttggctca

SEQ ID NO: 126922 - DNA, 23 bp, Homo sapiens
atatatacacatatacatgtgta

SEQ ID NO: 126923 - DNA, 21 bp, Homo sapiens
tcatagagacaaaaagtagac

SEQ ID NO: 126924 - DNA, 23 bp, Homo sapiens
agtgaagaatgtcaggaaaggat

SEQ ID NO: 126925 - DNA, 23 bp, Homo sapiens
agtattccatggtgtgtgtgtgt

SEQ ID NO: 126926 - DNA, 19 bp, Homo sapiens
ttggtttatgagcattaag

SEQ ID NO: 126927 - DNA, 20 bp, Homo sapiens
tccaagtcctggtcctgcac

SEQ ID NO: 126928 - DNA, 23 bp, Homo sapiens
gcatgtgtctgtgtgtgcgcatg

SEQ ID NO: 126929 - DNA, 23 bp, Homo sapiens
agtagcatgatctcggcttaact

SEQ ID NO: 126930 - DNA, 19 bp, Homo sapiens
tgaggttctttatagtaat

SEQ ID NO: 126931 - DNA, 23 bp, Homo sapiens
tgtcgcagcagtttcattcctgg

SEQ ID NO: 126932 - DNA, 23 bp, Homo sapiens
agagtctctctctgtcacccagg

SEQ ID NO: 126933 - DNA, 23 bp, Homo sapiens
gagtggcagaagattgtgaacag

SEQ ID NO: 126934 - DNA, 20 bp, Homo sapiens
aagacttttgaaattgcagt

SEQ ID NO: 126935 - DNA, 23 bp, Homo sapiens
tgagttcattgtagattctggat

SEQ ID NO: 126936 - DNA, 23 bp, Homo sapiens
tgagttcattgtagattctggat

SEQ ID NO: 126937 - DNA, 23 bp, Homo sapiens
tccatgtgtgcctgtgtgtgtgt

SEQ ID NO: 126938 - DNA, 23 bp, Homo sapiens
tgagttcattgtagattctggat

SEQ ID NO: 126939 - DNA, 23 bp, Homo sapiens
tgagttcattgtagattctggat

SEQ ID NO: 126940 - DNA, 23 bp, Homo sapiens
gctaagttgaaacttgtatagtt

SEQ ID NO: 126941 - DNA, 20 bp, Homo sapiens
ttaagaaggcaaagcatttc

SEQ ID NO: 126942 - DNA, 20 bp, Homo sapiens
atctctccacatgcttatct

SEQ ID NO: 126943 - DNA, 19 bp, Homo sapiens
aggcagtttgtttatatcc

SEQ ID NO: 126944 - DNA, 21 bp, Homo sapiens
tagtgctttctatatgcatat

SEQ ID NO: 126945 - DNA, 23 bp, Homo sapiens
gtcaggatgtatgatgtattatt

SEQ ID NO: 126946 - DNA, 23 bp, Homo sapiens
gaggatcacttgagtgtaggagt

SEQ ID NO: 126947 - DNA, 23 bp, Homo sapiens
atgattgcactccagcctgagtg

SEQ ID NO: 126948 - DNA, 23 bp, Homo sapiens
tgacagtgagactctctctctct

SEQ ID NO: 126949 - DNA, 23 bp, Homo sapiens
ataattgtatatgtatatgtgtg

SEQ ID NO: 126950 - DNA, 21 bp, Homo sapiens
tatacatagaattgcatatca

SEQ ID NO: 126951 - DNA, 23 bp, Homo sapiens
atctcagtctctgtgtatcccca

SEQ ID NO: 126952 - DNA, 22 bp, Homo sapiens
attcttctacatatggatatct

SEQ ID NO: 126953 - DNA, 23 bp, Homo sapiens
tgagttcattgtagattctggat

SEQ ID NO: 126954 - DNA, 23 bp, Homo sapiens
tgagttcattgtagattctggat

SEQ ID NO: 126955 - DNA, 20 bp, Homo sapiens
atagagcacagacagaaagc

SEQ ID NO: 126956 - DNA, 23 bp, Homo sapiens
atatgcatgtatatatatgtgtg

SEQ ID NO: 126957 - DNA, 23 bp, Homo sapiens
gaagcagcatttctaaagtgttt

SEQ ID NO: 126958 - DNA, 19 bp, Homo sapiens
tttgtatattttatatgct

SEQ ID NO: 126959 - DNA, 23 bp, Homo sapiens
aggaagagctctctctgttccct

SEQ ID NO: 126960 - DNA, 22 bp, Homo sapiens
acacagggagaaagtggccatc

SEQ ID NO: 126961 - DNA, 23 bp, Homo sapiens
tatgtgacacaggagttgccaag

SEQ ID NO: 126962 - DNA, 21 bp, Homo sapiens
acatgtgcacaatgtgcagct

SEQ ID NO: 126963 - DNA, 23 bp, Homo sapiens
tgagttcattgtagattctggat

SEQ ID NO: 126964 - DNA, 23 bp, Homo sapiens
tgagttcattgtagattctggat

SEQ ID NO: 126965 - DNA, 23 bp, Homo sapiens
aagtgactgttttattttgagta

SEQ ID NO: 126966 - DNA, 20 bp, Homo sapiens
atatgtgaatatttataagt

SEQ ID NO: 126967 - DNA, 19 bp, Homo sapiens
tatacatactgtatatgat

SEQ ID NO: 126968 - DNA, 23 bp, Homo sapiens
tctgtgtgtgcacatgtatgcat

SEQ ID NO: 126969 - DNA, 22 bp, Homo sapiens
tatgtgcttgctttgtgtctct

SEQ ID NO: 126970 - DNA, 23 bp, Homo sapiens
tatgtgtatatatatgtatgtgt

SEQ ID NO: 126971 - DNA, 23 bp, Homo sapiens
tgagttcattgtagattctggat

SEQ ID NO: 126972 - DNA, 23 bp, Homo sapiens
tgagttcattgtagattctggat

SEQ ID NO: 126973 - DNA, 20 bp, Homo sapiens
actatacattcttctctctc

SEQ ID NO: 126974 - DNA, 23 bp, Homo sapiens
tgcagtggcatgatcatggctca

SEQ ID NO: 126975 - DNA, 23 bp, Homo sapiens
tctctctctctctcttttgagac

SEQ ID NO: 126976 - DNA, 18 bp, Homo sapiens
tctgtggttgaatttggc

SEQ ID NO: 126977 - DNA, 23 bp, Homo sapiens
tttttgctcagtgggattgttga

SEQ ID NO: 126978 - DNA, 22 bp, Homo sapiens
tctctgctgctatttatgggct

SEQ ID NO: 126979 - DNA, 23 bp, Homo sapiens
agtgtggagcaaatggtctctct

SEQ ID NO: 126980 - DNA, 18 bp, Homo sapiens
ctgaggacaattaaactc

SEQ ID NO: 126981 - DNA, 21 bp, Homo sapiens
tgcactatatgtattgtgtgt

SEQ ID NO: 126982 - DNA, 23 bp, Homo sapiens
tggagtctcactctgtcacccag

SEQ ID NO: 126983 - DNA, 23 bp, Homo sapiens
tgtgtatatgtatatatgtgtgt

SEQ ID NO: 126984 - DNA, 23 bp, Homo sapiens
aggcaattctcagggaaagatgc

SEQ ID NO: 126985 - DNA, 23 bp, Homo sapiens
ttttgagacggagtctcactcta

SEQ ID NO: 126986 - DNA, 22 bp, Homo sapiens
tgtcagggtcttgctctgttca

SEQ ID NO: 126987 - DNA, 23 bp, Homo sapiens
ggagtctcactctgtcacccagg

SEQ ID NO: 126988 - DNA, 18 bp, Homo sapiens
gtatgtatgtatgtatgt

SEQ ID NO: 126989 - DNA, 23 bp, Homo sapiens
cagagtctcgctctgtcacccag

SEQ ID NO: 126990 - DNA, 22 bp, Homo sapiens
taactggaatttcttatcagtg

SEQ ID NO: 126991 - DNA, 23 bp, Homo sapiens
attactaatgatcttcatgtgtg

SEQ ID NO: 126992 - DNA, 23 bp, Homo sapiens
tctctgcctgtgtgtctctctgt

SEQ ID NO: 126993 - DNA, 19 bp, Homo sapiens
agagagcaaacaagttgtc

SEQ ID NO: 126994 - DNA, 23 bp, Homo sapiens
aatatgcaatggtattcatgagt

SEQ ID NO: 126995 - DNA, 23 bp, Homo sapiens
tctgtctctctctctgtcttgag

SEQ ID NO: 126996 - DNA, 23 bp, Homo sapiens
tgtgtgtatatatatatgtgtgt

SEQ ID NO: 126997 - DNA, 21 bp, Homo sapiens
tggcagagataattccaagag

SEQ ID NO: 126998 - DNA, 19 bp, Homo sapiens
ctgaggcttcatgcagctg

SEQ ID NO: 126999 - DNA, 23 bp, Homo sapiens
aagtgactgtgtttagactttca

SEQ ID NO: 127000 - DNA, 23 bp, Homo sapiens
agtcagttacccagtgatttcta

SEQ ID NO: 127001 - DNA, 23 bp, Homo sapiens
ttatttattttgaggctgggtct

SEQ ID NO: 127002 - DNA, 23 bp, Homo sapiens
tacactcgggtttacttttcttt

SEQ ID NO: 127003 - DNA, 23 bp, Homo sapiens
tatgcatgtacttcatatgtgtg

SEQ ID NO: 127004 - DNA, 23 bp, Homo sapiens
tttttcctagctgaggatgggtt

SEQ ID NO: 127005 - DNA, 19 bp, Homo sapiens
tagaaatataagtgcagag

SEQ ID NO: 127006 - DNA, 19 bp, Homo sapiens
ttgagatggagtctcactc

SEQ ID NO: 127007 - DNA, 21 bp, Homo sapiens
ttgatacagtttctagatgga

SEQ ID NO: 127008 - DNA, 18 bp, Homo sapiens
tgaaaagacattttgtac

SEQ ID NO: 127009 - DNA, 22 bp, Homo sapiens
tattacatgttatcgtatactt

SEQ ID NO: 127010 - DNA, 22 bp, Homo sapiens
ctgtgaagaaagtcatgggtag

SEQ ID NO: 127011 - DNA, 23 bp, Homo sapiens
tgagttcattgtagattctggat

SEQ ID NO: 127012 - DNA, 23 bp, Homo sapiens
tgagttcattgtagattctggat

SEQ ID NO: 127013 - DNA, 23 bp, Homo sapiens
tgagttcattgtagattctggat

SEQ ID NO: 127014 - DNA, 23 bp, Homo sapiens
ggaagtggaaaagaaagttgtga

SEQ ID NO: 127015 - DNA, 22 bp, Homo sapiens
tctctcactgagccacagctcc

SEQ ID NO: 127016 - DNA, 23 bp, Homo sapiens
aatcagccacgtgatcaagaggg

SEQ ID NO: 127017 - DNA, 21 bp, Homo sapiens
acagatgagagagacctgtct

SEQ ID NO: 127018 - DNA, 23 bp, Homo sapiens
cctgtcactgtcactttgcactg

SEQ ID NO: 127019 - DNA, 23 bp, Homo sapiens
agagacgtaaagaaaagctttgt

SEQ ID NO: 127020 - DNA, 23 bp, Homo sapiens
atacatgtgcttcaggtcatgtt

SEQ ID NO: 127021 - DNA, 23 bp, Homo sapiens
tctctctggggctgttgagctgc

SEQ ID NO: 127022 - DNA, 21 bp, Homo sapiens
atagcagcagacgctctgtag

SEQ ID NO: 127023 - DNA, 23 bp, Homo sapiens
gacactgggtgtgttctgctgct

SEQ ID NO: 127024 - DNA, 22 bp, Homo sapiens
atttttgttgttttgctaaagt

SEQ ID NO: 127025 - DNA, 23 bp, Homo sapiens
cttttgtagtaggttggattgtt

SEQ ID NO: 127026 - DNA, 23 bp, Homo sapiens
tgagttcattgtagattctggat

SEQ ID NO: 127027 - DNA, 23 bp, Homo sapiens
tgagttcattgtagattctggat

SEQ ID NO: 127028 - DNA, 18 bp, Homo sapiens
tatatgtagaattcccct

SEQ ID NO: 127029 - DNA, 21 bp, Homo sapiens
cctctcactctgtctgtcctc

SEQ ID NO: 127030 - DNA, 22 bp, Homo sapiens
tgagacagagtcttgctctctc

SEQ ID NO: 127031 - DNA, 22 bp, Homo sapiens
ccctggctccctctctgtcagg

SEQ ID NO: 127032 - DNA, 23 bp, Homo sapiens
attctgtggttgttggatggaat

SEQ ID NO: 127033 - DNA, 22 bp, Homo sapiens
tcactctgtcaccaaagttgga

SEQ ID NO: 127034 - DNA, 23 bp, Homo sapiens
tattcaatgctattagaaagggg

SEQ ID NO: 127035 - DNA, 23 bp, Homo sapiens
tatggaatacttgcaggagtgct

SEQ ID NO: 127036 - DNA, 19 bp, Homo sapiens
tgttttcagatgttctaag

SEQ ID NO: 127037 - DNA, 19 bp, Homo sapiens
aacccatatgtagacattg

SEQ ID NO: 127038 - DNA, 23 bp, Homo sapiens
tataaggtccaaatgtatggttt

SEQ ID NO: 127039 - DNA, 23 bp, Homo sapiens
tgtctggctgagtggctggcttt

SEQ ID NO: 127040 - DNA, 18 bp, Homo sapiens
tggcaaggaccaggcaat

SEQ ID NO: 127041 - DNA, 21 bp, Homo sapiens
ctgagtgcctgagttcagatc

SEQ ID NO: 127042 - DNA, 23 bp, Homo sapiens
aatatgctctttttgttgtacag

SEQ ID NO: 127043 - DNA, 21 bp, Homo sapiens
agaggagatatttagttggat

SEQ ID NO: 127044 - DNA, 23 bp, Homo sapiens
tggagtctcactctgtcacccag

SEQ ID NO: 127045 - DNA, 23 bp, Homo sapiens
acaggtctcactctgtcacccag

SEQ ID NO: 127046 - DNA, 21 bp, Homo sapiens
tctgagacggagtcttgtctc

SEQ ID NO: 127047 - DNA, 23 bp, Homo sapiens
acagagtctcactctgtcgccca

SEQ ID NO: 127048 - DNA, 23 bp, Homo sapiens
taagggcagtgcgtgtacagtgc

SEQ ID NO: 127049 - DNA, 23 bp, Homo sapiens
ggtagaaggttctaaagttgact

SEQ ID NO: 127050 - DNA, 23 bp, Homo sapiens
tgactgggatacctggaacagct

SEQ ID NO: 127051 - DNA, 18 bp, Homo sapiens
cacagtctcatgtttaag

SEQ ID NO: 127052 - DNA, 23 bp, Homo sapiens
tcataagaagaaccacatttttt

SEQ ID NO: 127053 - DNA, 23 bp, Homo sapiens
atattatagtagagatggggtct

SEQ ID NO: 127054 - DNA, 23 bp, Homo sapiens
tctccatttgatttgataaaaca

SEQ ID NO: 127055 - DNA, 20 bp, Homo sapiens
ttacaggatctccaggtgtt

SEQ ID NO: 127056 - DNA, 22 bp, Homo sapiens
tatccatgtatatatgtgtgtg

SEQ ID NO: 127057 - DNA, 22 bp, Homo sapiens
ctgtctctccctctgtggccca

SEQ ID NO: 127058 - DNA, 23 bp, Homo sapiens
atgactgttagcttctttatgcc

SEQ ID NO: 127059 - DNA, 19 bp, Homo sapiens
agagagagataaagagaga

SEQ ID NO: 127060 - DNA, 23 bp, Homo sapiens
agcgtctcactctgtcacccagg

SEQ ID NO: 127061 - DNA, 23 bp, Homo sapiens
tgcagtagtgtgatcttggctca

SEQ ID NO: 127062 - DNA, 21 bp, Homo sapiens
acatgtgcacaatgtgcaggt

SEQ ID NO: 127063 - DNA, 18 bp, Homo sapiens
ggtatatatgtatgtgta

SEQ ID NO: 127064 - DNA, 18 bp, Homo sapiens
tatagtgtatatatgtat

SEQ ID NO: 127065 - DNA, 23 bp, Homo sapiens
gtcactgactgagaaacatgaca

SEQ ID NO: 127066 - DNA, 22 bp, Homo sapiens
tcactgtctcctgagtcagagt

SEQ ID NO: 127067 - DNA, 23 bp, Homo sapiens
tgactctctgtgactctctaagg

SEQ ID NO: 127068 - DNA, 23 bp, Homo sapiens
ggtagttagaacatgttgtggtg

SEQ ID NO: 127069 - DNA, 23 bp, Homo sapiens
ttacttatactttaagttttagg

SEQ ID NO: 127070 - DNA, 18 bp, Homo sapiens
accaataaaattaagaat

SEQ ID NO: 127071 - DNA, 23 bp, Homo sapiens
ataacattggttttctcaggaat

SEQ ID NO: 127072 - DNA, 21 bp, Homo sapiens
aggctctctgtctctgtcacc

SEQ ID NO: 127073 - DNA, 23 bp, Homo sapiens
tgttggacagtcttgggctttgt

SEQ ID NO: 127074 - DNA, 23 bp, Homo sapiens
attcagagccaagtctggtgaat

SEQ ID NO: 127075 - DNA, 19 bp, Homo sapiens
agtggagtgatcttggctc

SEQ ID NO: 127076 - DNA, 23 bp, Homo sapiens
atgttctagtccccatgctgagt

SEQ ID NO: 127077 - DNA, 23 bp, Homo sapiens
ttcaaattcttgagtaaagaaat

SEQ ID NO: 127078 - DNA, 23 bp, Homo sapiens
cattcagtccactgttgattggc

SEQ ID NO: 127079 - DNA, 23 bp, Homo sapiens
cctgcctctgtctgtcactgggt

SEQ ID NO: 127080 - DNA, 22 bp, Homo sapiens
tgtgcatgtatgtttgtatgta

SEQ ID NO: 127081 - DNA, 23 bp, Homo sapiens
atatgtgtgtatttgtatcctta

SEQ ID NO: 127082 - DNA, 18 bp, Homo sapiens
agtcagcctctctccctc

SEQ ID NO: 127083 - DNA, 21 bp, Homo sapiens
acgtgtgcatatatatgtgtg

SEQ ID NO: 127084 - DNA, 21 bp, Homo sapiens
attgggaatattttcttatgt

SEQ ID NO: 127085 - DNA, 22 bp, Homo sapiens
atatgctatatatagtgtatct

SEQ ID NO: 127086 - DNA, 23 bp, Homo sapiens
tctgacaggatgtctagtgtttt

SEQ ID NO: 127087 - DNA, 23 bp, Homo sapiens
tggcaaagagtggtgactgctgg

SEQ ID NO: 127088 - DNA, 23 bp, Homo sapiens
atatatgtgtatatgtatgccta

SEQ ID NO: 127089 - DNA, 23 bp, Homo sapiens
tatgtatatgtaagtgtatgtgt

SEQ ID NO: 127090 - DNA, 22 bp, Homo sapiens
agactagagatttacttcacca

SEQ ID NO: 127091 - DNA, 20 bp, Homo sapiens
tatattgatctttcaaagag

SEQ ID NO: 127092 - DNA, 23 bp, Homo sapiens
tgagttcattgtagattctggat

SEQ ID NO: 127093 - DNA, 23 bp, Homo sapiens
tgagttcattgtagattctggat

SEQ ID NO: 127094 - DNA, 19 bp, Homo sapiens
acacatatatagttgtgca

SEQ ID NO: 127095 - DNA, 18 bp, Homo sapiens
agcatattttatgtgttt

SEQ ID NO: 127096 - DNA, 21 bp, Homo sapiens
gttttgtcaatatagaattct

SEQ ID NO: 127097 - DNA, 23 bp, Homo sapiens
gaataagtgtgccctaactttat

SEQ ID NO: 127098 - DNA, 23 bp, Homo sapiens
tatgtatatatgtaggtatgtgt

SEQ ID NO: 127099 - DNA, 23 bp, Homo sapiens
cagtagaggcagcaaaaataagc

SEQ ID NO: 127100 - DNA, 18 bp, Homo sapiens
tccaaatttttattgtct

SEQ ID NO: 127101 - DNA, 21 bp, Homo sapiens
aatattgtgttgatggacatt

SEQ ID NO: 127102 - DNA, 23 bp, Homo sapiens
tttgtgtgtgcgattcttgtgat

SEQ ID NO: 127103 - DNA, 22 bp, Homo sapiens
ttgctcctaatcagaacacaca

SEQ ID NO: 127104 - DNA, 23 bp, Homo sapiens
tgagttcattgtagattctggat

SEQ ID NO: 127105 - DNA, 23 bp, Homo sapiens
tgagttcattgtagattctggat

SEQ ID NO: 127106 - DNA, 23 bp, Homo sapiens
tgagttcattgtagattctggat

SEQ ID NO: 127107 - DNA, 23 bp, Homo sapiens
tgagttcattgtagattctggat

SEQ ID NO: 127108 - DNA, 23 bp, Homo sapiens
aacacagataaaaatgatgtaag

SEQ ID NO: 127109 - DNA, 22 bp, Homo sapiens
ttatttctagttctgtagcact

SEQ ID NO: 127110 - DNA, 21 bp, Homo sapiens
atattgcatatatatactata

SEQ ID NO: 127111 - DNA, 23 bp, Homo sapiens
actcatgaaatgtgttggtcatg

SEQ ID NO: 127112 - DNA, 19 bp, Homo sapiens
agtggaagctgacacaaca

SEQ ID NO: 127113 - DNA, 20 bp, Homo sapiens
ttgtgttctgtcattggtgt

SEQ ID NO: 127114 - DNA, 20 bp, Homo sapiens
agtcctaatgtatacttttt

SEQ ID NO: 127115 - DNA, 19 bp, Homo sapiens
tttgagatggagttttgct

SEQ ID NO: 127116 - DNA, 22 bp, Homo sapiens
cactgattgtgaaatggcaagg

SEQ ID NO: 127117 - DNA, 22 bp, Homo sapiens
cagtatttcagatggaaatgca

SEQ ID NO: 127118 - DNA, 23 bp, Homo sapiens
tgtcttctgtgtcagtcatgctg

SEQ ID NO: 127119 - DNA, 23 bp, Homo sapiens
ccagaaggatcctttctgagaag

SEQ ID NO: 127120 - DNA, 21 bp, Homo sapiens
tgtaaacactgtttttgtaga

SEQ ID NO: 127121 - DNA, 23 bp, Homo sapiens
tgagttcattgtagattctggat

SEQ ID NO: 127122 - DNA, 23 bp, Homo sapiens
tgagttcattgtagattctggat

SEQ ID NO: 127123 - DNA, 23 bp, Homo sapiens
ttttttggttccatatgaaattt

SEQ ID NO: 127124 - DNA, 22 bp, Homo sapiens
ttcactcatggtttggctctct

SEQ ID NO: 127125 - DNA, 23 bp, Homo sapiens
ctagcattgtcagattttgtttt

SEQ ID NO: 127126 - DNA, 23 bp, Homo sapiens
tgagttcattgtagattctggat

SEQ ID NO: 127127 - DNA, 23 bp, Homo sapiens
tgagttcattgtagattctggat

SEQ ID NO: 127128 - DNA, 23 bp, Homo sapiens
acactcactttgttatactgtct

SEQ ID NO: 127129 - DNA, 23 bp, Homo sapiens
aaatctgtctggaagatttgtgc

SEQ ID NO: 127130 - DNA, 20 bp, Homo sapiens
tctctcagtctctctctgtc

SEQ ID NO: 127131 - DNA, 20 bp, Homo sapiens
atatgtatcataaaatatga

SEQ ID NO: 127132 - DNA, 23 bp, Homo sapiens
tctctctgggtgtgtgtgtgtgc

SEQ ID NO: 127133 - DNA, 23 bp, Homo sapiens
tgagttcattgtagattctggat

SEQ ID NO: 127134 - DNA, 23 bp, Homo sapiens
acacaggatttatatacctataa

SEQ ID NO: 127135 - DNA, 23 bp, Homo sapiens
ataatatgtctgcaatttttctc

SEQ ID NO: 127136 - DNA, 23 bp, Homo sapiens
aaaatggtagctattggtgtgtg

SEQ ID NO: 127137 - DNA, 20 bp, Homo sapiens
tagtcaccatttttgtttga

SEQ ID NO: 127138 - DNA, 23 bp, Homo sapiens
taatgcatgtaaagtacttagtt

SEQ ID NO: 127139 - DNA, 18 bp, Homo sapiens
tatgtgtctgaataacat

SEQ ID NO: 127140 - DNA, 19 bp, Homo sapiens
attgtgactggttgtcctg

SEQ ID NO: 127141 - DNA, 23 bp, Homo sapiens
tttcctcaggttttctttcgcca

SEQ ID NO: 127142 - DNA, 21 bp, Homo sapiens
gtggatggctgtgttgaatgg

SEQ ID NO: 127143 - DNA, 23 bp, Homo sapiens
ggaatgagtcctttaccttctgt

SEQ ID NO: 127144 - DNA, 23 bp, Homo sapiens
tgagttcattgtagattctggat

SEQ ID NO: 127145 - DNA, 23 bp, Homo sapiens
tgagttcattgtagattctggat

SEQ ID NO: 127146 - DNA, 19 bp, Homo sapiens
atttgaatgtatttacagt

SEQ ID NO: 127147 - DNA, 21 bp, Homo sapiens
atgtgcttgtagtcccagttt

SEQ ID NO: 127148 - DNA, 23 bp, Homo sapiens
ggctgaggtaggaggatcacttg

SEQ ID NO: 127149 - DNA, 23 bp, Homo sapiens
tatgagtgcatgtgtaaatatct

SEQ ID NO: 127150 - DNA, 20 bp, Homo sapiens
aactgaattcaagtaggtgt

SEQ ID NO: 127151 - DNA, 23 bp, Homo sapiens
gttgtatgtatgtatatgttatg

SEQ ID NO: 127152 - DNA, 23 bp, Homo sapiens
aatgtatgtagttgattcttaat

SEQ ID NO: 127153 - DNA, 22 bp, Homo sapiens
tcaaatctgcatcagattcgaa

SEQ ID NO: 127154 - DNA, 23 bp, Homo sapiens
tgagttcattgtagattctggat

SEQ ID NO: 127155 - DNA, 23 bp, Homo sapiens
tgagttcattgtagattctggat

SEQ ID NO: 127156 - DNA, 21 bp, Homo sapiens
ttttagtcagtttctcttgtg

SEQ ID NO: 127157 - DNA, 21 bp, Homo sapiens
aagaccttgtcaattctttgt

SEQ ID NO: 127158 - DNA, 23 bp, Homo sapiens
tacatgtgcacaatgtgcaggtt

SEQ ID NO: 127159 - DNA, 19 bp, Homo sapiens
tagctacattcttattttc

SEQ ID NO: 127160 - DNA, 21 bp, Homo sapiens
ttatatgtgtgtatatgtatg

SEQ ID NO: 127161 - DNA, 23 bp, Homo sapiens
ctcagtttctctctcttgattcc

SEQ ID NO: 127162 - DNA, 21 bp, Homo sapiens
aatgtgtatatatatagttgt

SEQ ID NO: 127163 - DNA, 23 bp, Homo sapiens
atgacttttctatcagttggcaa

SEQ ID NO: 127164 - DNA, 18 bp, Homo sapiens
acagaacattgaaactag

SEQ ID NO: 127165 - DNA, 21 bp, Homo sapiens
ttttcaagaaggtagtataga

SEQ ID NO: 127166 - DNA, 20 bp, Homo sapiens
aaagtgctgggattacaggc

SEQ ID NO: 127167 - DNA, 23 bp, Homo sapiens
tctgtcactgtaattactgcaat

SEQ ID NO: 127168 - DNA, 20 bp, Homo sapiens
tacccctttgatttcagagt

SEQ ID NO: 127169 - DNA, 23 bp, Homo sapiens
tcttctgattttcatcttctctt

SEQ ID NO: 127170 - DNA, 20 bp, Homo sapiens
tgaggcttcagttgctgtta

SEQ ID NO: 127171 - DNA, 23 bp, Homo sapiens
cagccaagagggactcaaaggtt

SEQ ID NO: 127172 - DNA, 23 bp, Homo sapiens
cagtccctctctggctttctgga

SEQ ID NO: 127173 - DNA, 23 bp, Homo sapiens
tgagttcattgtagattctggat

SEQ ID NO: 127174 - DNA, 23 bp, Homo sapiens
tgagttcattgtagattctggat

SEQ ID NO: 127175 - DNA, 21 bp, Homo sapiens
tctcttatgaaaatgttcttg

SEQ ID NO: 127176 - DNA, 23 bp, Homo sapiens
gcaaaagagaagaatgagagctg

SEQ ID NO: 127177 - DNA, 23 bp, Homo sapiens
atgtatgtagatatgtatagata

SEQ ID NO: 127178 - DNA, 22 bp, Homo sapiens
ttttctagttatttatagaagg

SEQ ID NO: 127179 - DNA, 23 bp, Homo sapiens
tacatttgagagagaaagatgac

SEQ ID NO: 127180 - DNA, 20 bp, Homo sapiens
taatgaagattttctttttc

SEQ ID NO: 127181 - DNA, 23 bp, Homo sapiens
gaggagcttctctgaaatgtata

SEQ ID NO: 127182 - DNA, 18 bp, Homo sapiens
taaagatacttttcagaa

SEQ ID NO: 127183 - DNA, 23 bp, Homo sapiens
taatatctttttctatttgaaag

SEQ ID NO: 127184 - DNA, 19 bp, Homo sapiens
cagaaaactgattctgtgg

SEQ ID NO: 127185 - DNA, 23 bp, Homo sapiens
gtccactctgtctgtttttgtct

SEQ ID NO: 127186 - DNA, 20 bp, Homo sapiens
gatatgtatgcatacagata

SEQ ID NO: 127187 - DNA, 23 bp, Homo sapiens
tgagacagggtctcactgtcact

SEQ ID NO: 127188 - DNA, 23 bp, Homo sapiens
tgtaagtgtatgtatgtatgtgt

SEQ ID NO: 127189 - DNA, 23 bp, Homo sapiens
tttggctgaatatgaaattcttg

SEQ ID NO: 127190 - DNA, 23 bp, Homo sapiens
ctgcactgtctctctgtctgcct

SEQ ID NO: 127191 - DNA, 23 bp, Homo sapiens
gtagagacagggtctctcactgt

SEQ ID NO: 127192 - DNA, 23 bp, Homo sapiens
caaagtcctcagtgaggtggtgt

SEQ ID NO: 127193 - DNA, 23 bp, Homo sapiens
tgagttcattgtagattctggat

SEQ ID NO: 127194 - DNA, 23 bp, Homo sapiens
tgagttcattgtagattctggat

SEQ ID NO: 127195 - DNA, 23 bp, Homo sapiens
tacacacacacatatatatgtac

SEQ ID NO: 127196 - DNA, 21 bp, Homo sapiens
tgaaggtggagattgtgctga

SEQ ID NO: 127197 - DNA, 21 bp, Homo sapiens
cagtggtgtgatctcagctca

SEQ ID NO: 127198 - DNA, 23 bp, Homo sapiens
gtgagatctagctgagtgccaga

SEQ ID NO: 127199 - DNA, 23 bp, Homo sapiens
tgtattatatatgtatatgtaca

SEQ ID NO: 127200 - DNA, 23 bp, Homo sapiens
tatacagctatatgtatatgtgt

SEQ ID NO: 127201 - DNA, 21 bp, Homo sapiens
gcagaggtataagattgtgta

SEQ ID NO: 127202 - DNA, 22 bp, Homo sapiens
atgagtctattgagatgatcat

SEQ ID NO: 127203 - DNA, 21 bp, Homo sapiens
atgacagatgaaaaccatctc

SEQ ID NO: 127204 - DNA, 20 bp, Homo sapiens
agaggtaggagttttaaatg

SEQ ID NO: 127205 - DNA, 23 bp, Homo sapiens
tatacatatattgtatatgtgtg

SEQ ID NO: 127206 - DNA, 23 bp, Homo sapiens
tgagttcattgtagattctggat

SEQ ID NO: 127207 - DNA, 23 bp, Homo sapiens
tgagttcattgtagattctggat

SEQ ID NO: 127208 - DNA, 23 bp, Homo sapiens
gttaatgaaaactttttgatttc

SEQ ID NO: 127209 - DNA, 23 bp, Homo sapiens
tatgtatttgtatatgtacatgt

SEQ ID NO: 127210 - DNA, 22 bp, Homo sapiens
tgcatgtatacacatgtatgtg

SEQ ID NO: 127211 - DNA, 23 bp, Homo sapiens
atatatgtatatatatatgtgtg

SEQ ID NO: 127212 - DNA, 21 bp, Homo sapiens
tacttctcccttcactctctg

SEQ ID NO: 127213 - DNA, 21 bp, Homo sapiens
tgagtttatagtgtatgtata

SEQ ID NO: 127214 - DNA, 22 bp, Homo sapiens
agagaacttgctgtttcataaa

SEQ ID NO: 127215 - DNA, 23 bp, Homo sapiens
tgagtttgcatgtctctctctgt

SEQ ID NO: 127216 - DNA, 23 bp, Homo sapiens
cggagtctcgctctgtcgctcag

SEQ ID NO: 127217 - DNA, 23 bp, Homo sapiens
tgagacaaggtcttgctctgtca

SEQ ID NO: 127218 - DNA, 23 bp, Homo sapiens
tgtctgtgtctgtctatgttttc

SEQ ID NO: 127219 - DNA, 22 bp, Homo sapiens
tagtatgtgagagtaatacatt

SEQ ID NO: 127220 - DNA, 23 bp, Homo sapiens
gagatggggttttgctcttgttg

SEQ ID NO: 127221 - DNA, 23 bp, Homo sapiens
ttttgagacggagtcttctctgt

SEQ ID NO: 127222 - DNA, 21 bp, Homo sapiens
ttgcctgtacaatgagatttg

SEQ ID NO: 127223 - DNA, 21 bp, Homo sapiens
ggggtctcactctgtcaccca

SEQ ID NO: 127224 - DNA, 21 bp, Homo sapiens
tgtctggctctgaaactcccc

SEQ ID NO: 127225 - DNA, 23 bp, Homo sapiens
tgtctgtctgtgtgtgtgcgtgt

SEQ ID NO: 127226 - DNA, 21 bp, Homo sapiens
gtgtgtgcatgtgcatgtgtg

SEQ ID NO: 127227 - DNA, 19 bp, Homo sapiens
atgtgtgtgcatgtgcatg

SEQ ID NO: 127228 - DNA, 22 bp, Homo sapiens
tgtgtgggtgagattctgggat

SEQ ID NO: 127229 - DNA, 23 bp, Homo sapiens
tctttgctcagagtctcacctga

SEQ ID NO: 127230 - DNA, 20 bp, Homo sapiens
agggtctgggaaaatggtct

SEQ ID NO: 127231 - DNA, 23 bp, Homo sapiens
tgagatggagtctggctctgtcc

SEQ ID NO: 127232 - DNA, 23 bp, Homo sapiens
tgagttcattgtagattctggat

SEQ ID NO: 127233 - DNA, 23 bp, Homo sapiens
tgagttcattgtagattctggat

SEQ ID NO: 127234 - DNA, 23 bp, Homo sapiens
aagtgtctcgctctgtctcccaa

SEQ ID NO: 127235 - DNA, 20 bp, Homo sapiens
tgtggtaccagctactcagg

SEQ ID NO: 127236 - DNA, 19 bp, Homo sapiens
aggtggtaggatcacttga

SEQ ID NO: 127237 - DNA, 23 bp, Homo sapiens
tttcattgtttttgtaaatacct

SEQ ID NO: 127238 - DNA, 23 bp, Homo sapiens
taaaaaggatggatatagtatgt

SEQ ID NO: 127239 - DNA, 23 bp, Homo sapiens
tggaaccagatgaagctgacttc

SEQ ID NO: 127240 - DNA, 22 bp, Homo sapiens
agagtctcgctctgtcacccag

SEQ ID NO: 127241 - DNA, 19 bp, Homo sapiens
acatgcatatatatacaca

SEQ ID NO: 127242 - DNA, 23 bp, Homo sapiens
tttcactggcaccttaggtacag

SEQ ID NO: 127243 - DNA, 23 bp, Homo sapiens
tctcacagggatatcagaatatt

SEQ ID NO: 127244 - DNA, 20 bp, Homo sapiens
agcagcaacacagtgcttgg

SEQ ID NO: 127245 - DNA, 23 bp, Homo sapiens
tatgtgtgtgagtgccaggttgc

SEQ ID NO: 127246 - DNA, 21 bp, Homo sapiens
atgttcattatgtgcagtata

SEQ ID NO: 127247 - DNA, 22 bp, Homo sapiens
tgggctctagaaaggataatgt

SEQ ID NO: 127248 - DNA, 23 bp, Homo sapiens
aaatttttcttatgaaatcattt

SEQ ID NO: 127249 - DNA, 23 bp, Homo sapiens
ttgattttccaaatgttatcata

SEQ ID NO: 127250 - DNA, 21 bp, Homo sapiens
tttcacagtggctgaactaat

SEQ ID NO: 127251 - DNA, 23 bp, Homo sapiens
cagaccagcagtgtataagcact

SEQ ID NO: 127252 - DNA, 22 bp, Homo sapiens
tttctctctttctctaaggagt

SEQ ID NO: 127253 - DNA, 18 bp, Homo sapiens
tcctttgagtggaggatg

SEQ ID NO: 127254 - DNA, 20 bp, Homo sapiens
tgagtctcattctctgtcca

SEQ ID NO: 127255 - DNA, 23 bp, Homo sapiens
agaggagttgtgattatttggag

SEQ ID NO: 127256 - DNA, 23 bp, Homo sapiens
atataatgtatacatgttgtttt

SEQ ID NO: 127257 - DNA, 19 bp, Homo sapiens
tcgtaaagtgaatgaaagc

SEQ ID NO: 127258 - DNA, 18 bp, Homo sapiens
agtgtggtgtccctgcag

SEQ ID NO: 127259 - DNA, 20 bp, Homo sapiens
tcagagtagcgttgagattt

SEQ ID NO: 127260 - DNA, 22 bp, Homo sapiens
tgtcaagaatctgtaatctctt

SEQ ID NO: 127261 - DNA, 23 bp, Homo sapiens
tttgagacagtcttgctctgtca

SEQ ID NO: 127262 - DNA, 20 bp, Homo sapiens
tataatgaacattatgttca

SEQ ID NO: 127263 - DNA, 19 bp, Homo sapiens
tctgtccatatatgtgtgt

SEQ ID NO: 127264 - DNA, 22 bp, Homo sapiens
acacacacacatatatagacag

SEQ ID NO: 127265 - DNA, 21 bp, Homo sapiens
tgtctggcataagtatggcta

SEQ ID NO: 127266 - DNA, 22 bp, Homo sapiens
aagagtatgtatatatatgtgt

SEQ ID NO: 127267 - DNA, 23 bp, Homo sapiens
atatgtgtatgtatatgtgtgtg

SEQ ID NO: 127268 - DNA, 18 bp, Homo sapiens
atacacacacatatacat

SEQ ID NO: 127269 - DNA, 23 bp, Homo sapiens
tatgcaattgtattgtatatgta

SEQ ID NO: 127270 - DNA, 22 bp, Homo sapiens
agaattgtaacatatatttgca

SEQ ID NO: 127271 - DNA, 23 bp, Homo sapiens
agacaggcagggagactgagagc

SEQ ID NO: 127272 - DNA, 22 bp, Homo sapiens
gtagatgctcagtaagaatgtg

SEQ ID NO: 127273 - DNA, 21 bp, Homo sapiens
tgtgtctatatatgtgtgtat

SEQ ID NO: 127274 - DNA, 20 bp, Homo sapiens
caagtcacactgaggcttct

SEQ ID NO: 127275 - DNA, 23 bp, Homo sapiens
gactgccactctcagtggctcag

SEQ ID NO: 127276 - DNA, 22 bp, Homo sapiens
acagagagggagacatgagact

SEQ ID NO: 127277 - DNA, 20 bp, Homo sapiens
tgagacagagtctggctctg

SEQ ID NO: 127278 - DNA, 23 bp, Homo sapiens
gtatatgcatatgtatatgtatg

SEQ ID NO: 127279 - DNA, 23 bp, Homo sapiens
ttgtcagtgggaatactatgtgt

SEQ ID NO: 127280 - DNA, 23 bp, Homo sapiens
atattctatctgtagagcaaggt

SEQ ID NO: 127281 - DNA, 23 bp, Homo sapiens
tcagctcagagccagtgtccagt

SEQ ID NO: 127282 - DNA, 23 bp, Homo sapiens
tatatacacgtatgtgtgtgtgt

SEQ ID NO: 127283 - DNA, 22 bp, Homo sapiens
taactgtgatgagactgcttca

SEQ ID NO: 127284 - DNA, 23 bp, Homo sapiens
tgtatctctagctctctctctct

SEQ ID NO: 127285 - DNA, 23 bp, Homo sapiens
tgagttcattgtagattctggat

SEQ ID NO: 127286 - DNA, 23 bp, Homo sapiens
tgagttcattgtagattctggat

SEQ ID NO: 127287 - DNA, 23 bp, Homo sapiens
aaaaaatgatttgtaaaagcagt

SEQ ID NO: 127288 - DNA, 20 bp, Homo sapiens
gacacaagactctgtgcaga

SEQ ID NO: 127289 - DNA, 23 bp, Homo sapiens
gaaatagaccttcaaatagcttt

SEQ ID NO: 127290 - DNA, 23 bp, Homo sapiens
aatgttcttcaagggctgcttgt

SEQ ID NO: 127291 - DNA, 23 bp, Homo sapiens
ctgccaggatttgagttctctgt

SEQ ID NO: 127292 - DNA, 23 bp, Homo sapiens
ctcctttccttatcaaagcactc

SEQ ID NO: 127293 - DNA, 18 bp, Homo sapiens
agtgaggagagagtgggc

SEQ ID NO: 127294 - DNA, 23 bp, Homo sapiens
gagtccgtcactgactcattgac

SEQ ID NO: 127295 - DNA, 23 bp, Homo sapiens
actcactctggaagcattggtta

SEQ ID NO: 127296 - DNA, 23 bp, Homo sapiens
ttgagatgaagtttcactcttgt

SEQ ID NO: 127297 - DNA, 18 bp, Homo sapiens
tgaggcagaacagttgtc

SEQ ID NO: 127298 - DNA, 23 bp, Homo sapiens
tgagttcattgtagattctggat

SEQ ID NO: 127299 - DNA, 23 bp, Homo sapiens
tgagttcattgtagattctggat

SEQ ID NO: 127300 - DNA, 23 bp, Homo sapiens
atatgtagtacctattcactaag

SEQ ID NO: 127301 - DNA, 22 bp, Homo sapiens
ttacggatacataaagtggaga

SEQ ID NO: 127302 - DNA, 19 bp, Homo sapiens
taaatgtctttctcatctt

SEQ ID NO: 127303 - DNA, 23 bp, Homo sapiens
tgagttcattgtagattctggat

SEQ ID NO: 127304 - DNA, 23 bp, Homo sapiens
tgagttcattgtagattctggat

SEQ ID NO: 127305 - DNA, 19 bp, Homo sapiens
tgaatagtattccattgtg

SEQ ID NO: 127306 - DNA, 23 bp, Homo sapiens
attggtgaacacttaggttgatt

SEQ ID NO: 127307 - DNA, 23 bp, Homo sapiens
tcagtaggggcttttgagttcat

SEQ ID NO: 127308 - DNA, 23 bp, Homo sapiens
tgagttcattgtagattctggat

SEQ ID NO: 127309 - DNA, 23 bp, Homo sapiens
tgagttcattgtagattctggat

SEQ ID NO: 127310 - DNA, 22 bp, Homo sapiens
tgagaggaaaatctgtctccca

SEQ ID NO: 127311 - DNA, 23 bp, Homo sapiens
cctaaaacctaatttcttgagtt

SEQ ID NO: 127312 - DNA, 23 bp, Homo sapiens
aagtgatagtaggatcttttgtt

SEQ ID NO: 127313 - DNA, 21 bp, Homo sapiens
tgcagcagcacaatctcggct

SEQ ID NO: 127314 - DNA, 21 bp, Homo sapiens
ttgctttgaaatgatgtatgc

SEQ ID NO: 127315 - DNA, 23 bp, Homo sapiens
gagtctcactctgtcattcaggt

SEQ ID NO: 127316 - DNA, 23 bp, Homo sapiens
cactggaatagtgaacattttga

SEQ ID NO: 127317 - DNA, 21 bp, Homo sapiens
aacagaactgattaagttgtt

SEQ ID NO: 127318 - DNA, 23 bp, Homo sapiens
agactgagtgtcactctatcacc

SEQ ID NO: 127319 - DNA, 21 bp, Homo sapiens
tttgagatggaatctcgctct

SEQ ID NO: 127320 - DNA, 23 bp, Homo sapiens
cagagtctcactgtgtcgcccag

SEQ ID NO: 127321 - DNA, 23 bp, Homo sapiens
agacaaggtctccctctgtcacc

SEQ ID NO: 127322 - DNA, 22 bp, Homo sapiens
cagtttctgcatcagcagctct

SEQ ID NO: 127323 - DNA, 23 bp, Homo sapiens
ggagtctcactctgtcacccagg

SEQ ID NO: 127324 - DNA, 22 bp, Homo sapiens
cagagtctcactctgtcgccca

SEQ ID NO: 127325 - DNA, 23 bp, Homo sapiens
aggatgtatgtatgtatgtatgt

SEQ ID NO: 127326 - DNA, 23 bp, Homo sapiens
gacagagtctcgctctgtcaccc

SEQ ID NO: 127327 - DNA, 23 bp, Homo sapiens
tttgagacggagtctccctctgt

SEQ ID NO: 127328 - DNA, 23 bp, Homo sapiens
ctgagtcaccctctgtcacccag

SEQ ID NO: 127329 - DNA, 23 bp, Homo sapiens
acgaagtgttgtgtttctgttct

SEQ ID NO: 127330 - DNA, 22 bp, Homo sapiens
ccaactagattgtgacttagca

SEQ ID NO: 127331 - DNA, 23 bp, Homo sapiens
gagtatttggtgtagagtaggcc

SEQ ID NO: 127332 - DNA, 23 bp, Homo sapiens
agtatctttgcatttcattgagg

SEQ ID NO: 127333 - DNA, 23 bp, Homo sapiens
aggaatgtaaagaactaaggctg

SEQ ID NO: 127334 - DNA, 23 bp, Homo sapiens
tctcactctctcactctgtcacc

SEQ ID NO: 127335 - DNA, 19 bp, Homo sapiens
tggcatgatcttggtttac

SEQ ID NO: 127336 - DNA, 19 bp, Homo sapiens
atgtatatgtgcaaaccta

SEQ ID NO: 127337 - DNA, 23 bp, Homo sapiens
tgcatgtatatatgtatgcatat

SEQ ID NO: 127338 - DNA, 21 bp, Homo sapiens
acacataatatatatatgtgt

SEQ ID NO: 127339 - DNA, 23 bp, Homo sapiens
acatacacacttgtaggtttaag

SEQ ID NO: 127340 - DNA, 23 bp, Homo sapiens
gagtctcactctgtcacccaggc

SEQ ID NO: 127341 - DNA, 23 bp, Homo sapiens
gcatatgtatatttgtatggtgt

SEQ ID NO: 127342 - DNA, 20 bp, Homo sapiens
tataggtatatatgttatgt

SEQ ID NO: 127343 - DNA, 19 bp, Homo sapiens
ttgccttagtattccatgg

SEQ ID NO: 127344 - DNA, 23 bp, Homo sapiens
aaaagaaacagaattgggataac

SEQ ID NO: 127345 - DNA, 22 bp, Homo sapiens
agtttagtctttttcatgttgt

SEQ ID NO: 127346 - DNA, 21 bp, Homo sapiens
aatctcagagctagagagact

SEQ ID NO: 127347 - DNA, 20 bp, Homo sapiens
tttttctagtctcagatttc

SEQ ID NO: 127348 - DNA, 23 bp, Homo sapiens
cttgccagactcagtttgtctct

SEQ ID NO: 127349 - DNA, 23 bp, Homo sapiens
taagtgtgtacataagttttgaa

SEQ ID NO: 127350 - DNA, 22 bp, Homo sapiens
taagtttgaaaaacataaggtc

SEQ ID NO: 127351 - DNA, 21 bp, Homo sapiens
tatatgtgcatatatgtgtgt

SEQ ID NO: 127352 - DNA, 23 bp, Homo sapiens
gtgtgtgtatatatatgtgtgtg

SEQ ID NO: 127353 - DNA, 20 bp, Homo sapiens
agaggtatttcccaaattca

SEQ ID NO: 127354 - DNA, 21 bp, Homo sapiens
ttatgtcagcagcaagttatt

SEQ ID NO: 127355 - DNA, 18 bp, Homo sapiens
tatgtgtgtatatatgta

SEQ ID NO: 127356 - DNA, 22 bp, Homo sapiens
atgtgtatatatgtatatatgt

SEQ ID NO: 127357 - DNA, 20 bp, Homo sapiens
tgtgtatatatgtatgtatg

SEQ ID NO: 127358 - DNA, 22 bp, Homo sapiens
tgtgtatatatgtatatatgtg

SEQ ID NO: 127359 - DNA, 23 bp, Homo sapiens
tgtgtgtatatatgtatatatgt

SEQ ID NO: 127360 - DNA, 20 bp, Homo sapiens
atatgtgcatatacgtgtgt

SEQ ID NO: 127361 - DNA, 19 bp, Homo sapiens
tgtgctttgtttttgtttt

SEQ ID NO: 127362 - DNA, 23 bp, Homo sapiens
atgtttgtgtttatgtgtctata

SEQ ID NO: 127363 - DNA, 23 bp, Homo sapiens
atatatgtctgcttctgatgggg

SEQ ID NO: 127364 - DNA, 22 bp, Homo sapiens
ggaaaactttcagaatacaata

SEQ ID NO: 127365 - DNA, 23 bp, Homo sapiens
aatggaagcatagaattgattta

SEQ ID NO: 127366 - DNA, 23 bp, Homo sapiens
tctcagaaggaattgttctcaat

SEQ ID NO: 127367 - DNA, 19 bp, Homo sapiens
atatggtctggctatgttg

SEQ ID NO: 127368 - DNA, 23 bp, Homo sapiens
tttgagacggagtctcgctctgt

SEQ ID NO: 127369 - DNA, 22 bp, Homo sapiens
gtgtgtgtgtgtgtgtgtacct

SEQ ID NO: 127370 - DNA, 23 bp, Homo sapiens
ttggtagtctcataggaatagca

SEQ ID NO: 127371 - DNA, 23 bp, Homo sapiens
tgtgtgtatctctctgtatatat

SEQ ID NO: 127372 - DNA, 23 bp, Homo sapiens
aatgagagttcagagtgacaaga

SEQ ID NO: 127373 - DNA, 23 bp, Homo sapiens
ttcgtgagttttctggaaaaggg

SEQ ID NO: 127374 - DNA, 21 bp, Homo sapiens
ctgtgagtccgttaaacctct

SEQ ID NO: 127375 - DNA, 23 bp, Homo sapiens
cttgaaatcagccagagtgagag

SEQ ID NO: 127376 - DNA, 23 bp, Homo sapiens
acttctcgatttgttattatgtt

SEQ ID NO: 127377 - DNA, 18 bp, Homo sapiens
caggaaggtgagacataa

SEQ ID NO: 127378 - DNA, 21 bp, Homo sapiens
ttctctcatgattatccaatc

SEQ ID NO: 127379 - DNA, 23 bp, Homo sapiens
ggaatctctgtatgccttagctg

SEQ ID NO: 127380 - DNA, 19 bp, Homo sapiens
aatacaggtattagccaag

SEQ ID NO: 127381 - DNA, 23 bp, Homo sapiens
gggagtctcactgtgtcacccag

SEQ ID NO: 127382 - DNA, 23 bp, Homo sapiens
atgtctgtgagtatgtgtgtgta

SEQ ID NO: 127383 - DNA, 21 bp, Homo sapiens
atatgtgtgtgtgtatatatg

SEQ ID NO: 127384 - DNA, 20 bp, Homo sapiens
atatctatatatctatatct

SEQ ID NO: 127385 - DNA, 23 bp, Homo sapiens
tctatatctatatctatatatct

SEQ ID NO: 127386 - DNA, 23 bp, Homo sapiens
atctctatatatatctatgtcta

SEQ ID NO: 127387 - DNA, 23 bp, Homo sapiens
agagatatagatagagatataga

SEQ ID NO: 127388 - DNA, 23 bp, Homo sapiens
gtatatgtgtatatgtatagcta

SEQ ID NO: 127389 - DNA, 19 bp, Homo sapiens
atatatgtatatatgtata

SEQ ID NO: 127390 - DNA, 23 bp, Homo sapiens
ctggctgtctcagtgggtctctc

SEQ ID NO: 127391 - DNA, 18 bp, Homo sapiens
ttgttctacataatgctt

SEQ ID NO: 127392 - DNA, 23 bp, Homo sapiens
tttatggttccatatgaatttta

SEQ ID NO: 127393 - DNA, 23 bp, Homo sapiens
tagggattatactgaatatgtag

SEQ ID NO: 127394 - DNA, 20 bp, Homo sapiens
tctgcttttgtaaagtgtga

SEQ ID NO: 127395 - DNA, 23 bp, Homo sapiens
ctgtgtctgcctgtctgcctctc

SEQ ID NO: 127396 - DNA, 21 bp, Homo sapiens
tcacagccttctgggtagctg

SEQ ID NO: 127397 - DNA, 22 bp, Homo sapiens
aagttctgaggatcctgttaca

SEQ ID NO: 127398 - DNA, 19 bp, Homo sapiens
tatgtccaagcatattcag

SEQ ID NO: 127399 - DNA, 23 bp, Homo sapiens
ttttgatatctaagtttttgttt

SEQ ID NO: 127400 - DNA, 23 bp, Homo sapiens
tgtttatgtgagatgatattgca

SEQ ID NO: 127401 - DNA, 23 bp, Homo sapiens
aaaagaaatgtatgtatttcata

SEQ ID NO: 127402 - DNA, 22 bp, Homo sapiens
atatacatctttctctctctct

SEQ ID NO: 127403 - DNA, 22 bp, Homo sapiens
tgtttggctgttctgtgtcctt

SEQ ID NO: 127404 - DNA, 23 bp, Homo sapiens
tgagagggagtctcgctctgtca

SEQ ID NO: 127405 - DNA, 23 bp, Homo sapiens
attggattgaagggtgcaaagta

SEQ ID NO: 127406 - DNA, 22 bp, Homo sapiens
atgtgcagaacatgcaggtttg

SEQ ID NO: 127407 - DNA, 22 bp, Homo sapiens
cattggtctgtgtgtctctctg

SEQ ID NO: 127408 - DNA, 22 bp, Homo sapiens
taaatgtgccacaatatcttga

SEQ ID NO: 127409 - DNA, 23 bp, Homo sapiens
tgtgttgattttgtatcctgtaa

SEQ ID NO: 127410 - DNA, 20 bp, Homo sapiens
aatgtgtatatataatgtgt

SEQ ID NO: 127411 - DNA, 23 bp, Homo sapiens
tatcacattgtggttttgatttg

SEQ ID NO: 127412 - DNA, 22 bp, Homo sapiens
ttgctgtgcataccatatcctt

SEQ ID NO: 127413 - DNA, 23 bp, Homo sapiens
aatcttactgcaggctgtgttta

SEQ ID NO: 127414 - DNA, 23 bp, Homo sapiens
tattgtctcaatttgtttttctg

SEQ ID NO: 127415 - DNA, 20 bp, Homo sapiens
tataatgagaggtgataaga

SEQ ID NO: 127416 - DNA, 18 bp, Homo sapiens
atcaatctaagtaactgt

SEQ ID NO: 127417 - DNA, 20 bp, Homo sapiens
tacactatagtatataatgt

SEQ ID NO: 127418 - DNA, 23 bp, Homo sapiens
gatatgttaattaggttaagtgt

SEQ ID NO: 127419 - DNA, 23 bp, Homo sapiens
tgtatatcaaaacatcatattgt

SEQ ID NO: 127420 - DNA, 23 bp, Homo sapiens
ttctgtgaagaaagtcaatggtg

SEQ ID NO: 127421 - DNA, 22 bp, Homo sapiens
tgaaaatactttgaggttgctg

SEQ ID NO: 127422 - DNA, 21 bp, Homo sapiens
actatagtgtatactatactt

SEQ ID NO: 127423 - DNA, 23 bp, Homo sapiens
ttttgagacggagtcttgctctg

SEQ ID NO: 127424 - DNA, 23 bp, Homo sapiens
acattctgtgcaatatatatgta

SEQ ID NO: 127425 - DNA, 22 bp, Homo sapiens
caaaatttgagactaatgtgtt

SEQ ID NO: 127426 - DNA, 22 bp, Homo sapiens
atagactgaaacaattgagtta

SEQ ID NO: 127427 - DNA, 23 bp, Homo sapiens
tactacagacattctctgtctct

SEQ ID NO: 127428 - DNA, 23 bp, Homo sapiens
aataatgaaaatgtggtgcaaga

SEQ ID NO: 127429 - DNA, 23 bp, Homo sapiens
atatgtatgtatatgtatacgta

SEQ ID NO: 127430 - DNA, 23 bp, Homo sapiens
atatgtgtatatatatatgtgtg

SEQ ID NO: 127431 - DNA, 23 bp, Homo sapiens
atatgtacacacacacacatata

SEQ ID NO: 127432 - DNA, 21 bp, Homo sapiens
ataattgagactctatgacct

SEQ ID NO: 127433 - DNA, 22 bp, Homo sapiens
tctcagcctctcaagcagctga

SEQ ID NO: 127434 - DNA, 22 bp, Homo sapiens
tcactatgttgcccagtctggt

SEQ ID NO: 127435 - DNA, 23 bp, Homo sapiens
tgtcactgtcttacttggttcta

SEQ ID NO: 127436 - DNA, 20 bp, Homo sapiens
taagagatcatagagaggag

SEQ ID NO: 127437 - DNA, 23 bp, Homo sapiens
gaccctcactctgtcacccaggc

SEQ ID NO: 127438 - DNA, 23 bp, Homo sapiens
atgtgacatcatgttaaaaactc

SEQ ID NO: 127439 - DNA, 22 bp, Homo sapiens
ttatgtatgtatatcatgtgta

SEQ ID NO: 127440 - DNA, 21 bp, Homo sapiens
tgtgaagaacgttaatggtag

SEQ ID NO: 127441 - DNA, 23 bp, Homo sapiens
taacacaaccatattgaatgaaa

SEQ ID NO: 127442 - DNA, 22 bp, Homo sapiens
attggggtctgtctctctctct

SEQ ID NO: 127443 - DNA, 23 bp, Homo sapiens
ttatatgtatatgtatacgtatt

SEQ ID NO: 127444 - DNA, 23 bp, Homo sapiens
atatgtgccatgttggtgtgctg

SEQ ID NO: 127445 - DNA, 21 bp, Homo sapiens
agagttcatatatatatgaga

SEQ ID NO: 127446 - DNA, 22 bp, Homo sapiens
tatgtgcatttatttatagtta

SEQ ID NO: 127447 - DNA, 23 bp, Homo sapiens
atctgagtctcgctctgtcgcct

SEQ ID NO: 127448 - DNA, 21 bp, Homo sapiens
acatgtttatgttttgtgtat

SEQ ID NO: 127449 - DNA, 20 bp, Homo sapiens
tatgtaagactatatgtatt

SEQ ID NO: 127450 - DNA, 23 bp, Homo sapiens
tcactgttgagagacaggagtag

SEQ ID NO: 127451 - DNA, 23 bp, Homo sapiens
tgagttcattgtagattctggat

SEQ ID NO: 127452 - DNA, 23 bp, Homo sapiens
tgagttcattgtagattctggat

SEQ ID NO: 127453 - DNA, 19 bp, Homo sapiens
acatgtatgtgtgtgtgta

SEQ ID NO: 127454 - DNA, 19 bp, Homo sapiens
agtggaataagaagaaagt

SEQ ID NO: 127455 - DNA, 19 bp, Homo sapiens
attatctatacatatcttt

SEQ ID NO: 127456 - DNA, 22 bp, Homo sapiens
tctatgtgtctttataggtgag

SEQ ID NO: 127457 - DNA, 23 bp, Homo sapiens
attcagccatactattggagact

SEQ ID NO: 127458 - DNA, 22 bp, Homo sapiens
tattggaggtgaaattactttg

SEQ ID NO: 127459 - DNA, 18 bp, Homo sapiens
gtgggatgatcttggctt

SEQ ID NO: 127460 - DNA, 23 bp, Homo sapiens
aaaggtatttgtgcaatgaagaa

SEQ ID NO: 127461 - DNA, 19 bp, Homo sapiens
ggcagtctgtcaggggctc

SEQ ID NO: 127462 - DNA, 23 bp, Homo sapiens
atgtgtgtgtatctatatgtgtg

SEQ ID NO: 127463 - DNA, 23 bp, Homo sapiens
taaggttgtctctctgtatgtgt

SEQ ID NO: 127464 - DNA, 20 bp, Homo sapiens
gtgtatatatataatgtgta

SEQ ID NO: 127465 - DNA, 23 bp, Homo sapiens
ctatgtgtatatataatgtgtat

SEQ ID NO: 127466 - DNA, 18 bp, Homo sapiens
atatagcttgtgaatgat

SEQ ID NO: 127467 - DNA, 21 bp, Homo sapiens
aaatagaatggttagggaaag

SEQ ID NO: 127468 - DNA, 20 bp, Homo sapiens
ttttcaacttttagtttctg

SEQ ID NO: 127469 - DNA, 22 bp, Homo sapiens
agattctttttgttttcagaaa

SEQ ID NO: 127470 - DNA, 23 bp, Homo sapiens
aatctgtcttttttagtttttga

SEQ ID NO: 127471 - DNA, 23 bp, Homo sapiens
tctgtgtctcaccctgtgtcagc

SEQ ID NO: 127472 - DNA, 18 bp, Homo sapiens
acaatgatagcaggatgt

SEQ ID NO: 127473 - DNA, 19 bp, Homo sapiens
tgtatatatgtatatgtat

SEQ ID NO: 127474 - DNA, 20 bp, Homo sapiens
atatgtgtatgtatgtatat

SEQ ID NO: 127475 - DNA, 20 bp, Homo sapiens
atatgtgtatgtctatatgt

SEQ ID NO: 127476 - DNA, 22 bp, Homo sapiens
gtatatagacacacatatatat

SEQ ID NO: 127477 - DNA, 23 bp, Homo sapiens
tttttagtagaggtggggtttca

SEQ ID NO: 127478 - DNA, 20 bp, Homo sapiens
tttaggtctttaaaatgtgg

SEQ ID NO: 127479 - DNA, 23 bp, Homo sapiens
tctcattgtggttgtgatttgaa

SEQ ID NO: 127480 - DNA, 23 bp, Homo sapiens
tgagttcattgtagattctggat

SEQ ID NO: 127481 - DNA, 23 bp, Homo sapiens
tgagttcattgtagattctggat

SEQ ID NO: 127482 - DNA, 23 bp, Homo sapiens
tgaaaacagagcatttgaacagt

SEQ ID NO: 127483 - DNA, 21 bp, Homo sapiens
ttttgagacggagtcttgctc

SEQ ID NO: 127484 - DNA, 23 bp, Homo sapiens
agagtctcactctgtcacccagg

SEQ ID NO: 127485 - DNA, 23 bp, Homo sapiens
tgagttcattgtagattctggat

SEQ ID NO: 127486 - DNA, 23 bp, Homo sapiens
tgagttcattgtagattctggat

SEQ ID NO: 127487 - DNA, 23 bp, Homo sapiens
ctatctgtgtctctgtgtgtgca

SEQ ID NO: 127488 - DNA, 20 bp, Homo sapiens
acaggaacatagatcatagt

SEQ ID NO: 127489 - DNA, 19 bp, Homo sapiens
aaccaaagaaatgactatg

SEQ ID NO: 127490 - DNA, 23 bp, Homo sapiens
atttttctctgtttttgaaaatg

SEQ ID NO: 127491 - DNA, 23 bp, Homo sapiens
ttttgagacagagtctcattctg

SEQ ID NO: 127492 - DNA, 22 bp, Homo sapiens
tatatgtgtgtgtatatgtgtg

SEQ ID NO: 127493 - DNA, 18 bp, Homo sapiens
actacatagacaataggg

SEQ ID NO: 127494 - DNA, 21 bp, Homo sapiens
agagattcttctgcctcagcc

SEQ ID NO: 127495 - DNA, 23 bp, Homo sapiens
actgcttgataattgattgtgtg

SEQ ID NO: 127496 - DNA, 22 bp, Homo sapiens
acatgtgcacaatgtgcaggtt

SEQ ID NO: 127497 - DNA, 23 bp, Homo sapiens
tgtatatgtatagaagcgtatgt

SEQ ID NO: 127498 - DNA, 21 bp, Homo sapiens
gacttgtatagatcaagggtg

SEQ ID NO: 127499 - DNA, 23 bp, Homo sapiens
tgagttcattgtagattctggat

SEQ ID NO: 127500 - DNA, 23 bp, Homo sapiens
tgagttcattgtagattctggat

SEQ ID NO: 127501 - DNA, 23 bp, Homo sapiens
ttacaactacagactctgctgta

SEQ ID NO: 127502 - DNA, 21 bp, Homo sapiens
tatgtatgtatatatgtgtac

SEQ ID NO: 127503 - DNA, 23 bp, Homo sapiens
atacatgtgtatgcttatgtata

SEQ ID NO: 127504 - DNA, 23 bp, Homo sapiens
atgtgtatcagattctttttacc

SEQ ID NO: 127505 - DNA, 23 bp, Homo sapiens
tctgagtgtctctgtgtctgtca

SEQ ID NO: 127506 - DNA, 23 bp, Homo sapiens
ttgaatgagattttgtagatgtg

SEQ ID NO: 127507 - DNA, 23 bp, Homo sapiens
tgtgtgtgtgtctatatatatcc

SEQ ID NO: 127508 - DNA, 23 bp, Homo sapiens
atgtgtatatatacatatgactg

SEQ ID NO: 127509 - DNA, 23 bp, Homo sapiens
tctctcattcactctctgtttcc

SEQ ID NO: 127510 - DNA, 23 bp, Homo sapiens
tatgtgtatgtatatatgtgtat

SEQ ID NO: 127511 - DNA, 19 bp, Homo sapiens
tcactctgtcacccaggct

SEQ ID NO: 127512 - DNA, 23 bp, Homo sapiens
tatatgtgtgtgtgcatgtgtat

SEQ ID NO: 127513 - DNA, 23 bp, Homo sapiens
attgagagaagtgatattgttct

SEQ ID NO: 127514 - DNA, 23 bp, Homo sapiens
tatagacttcattagaatttgtc

SEQ ID NO: 127515 - DNA, 19 bp, Homo sapiens
tagaggtatatctatgtat

SEQ ID NO: 127516 - DNA, 21 bp, Homo sapiens
ttaagcatgagatgccatcta

SEQ ID NO: 127517 - DNA, 21 bp, Homo sapiens
atgacaattttatctttccag

SEQ ID NO: 127518 - DNA, 23 bp, Homo sapiens
tcatagagtgagatagatctatt

SEQ ID NO: 127519 - DNA, 20 bp, Homo sapiens
atatgtttatatatatgcgt

SEQ ID NO: 127520 - DNA, 22 bp, Homo sapiens
atatgtttatatatatgcgtgt

SEQ ID NO: 127521 - DNA, 23 bp, Homo sapiens
ctctctgtgtcactttgctgcct

SEQ ID NO: 127522 - DNA, 19 bp, Homo sapiens
cacacacacatatatggtt

SEQ ID NO: 127523 - DNA, 23 bp, Homo sapiens
tgtgtatatatctatgtatgtgt

SEQ ID NO: 127524 - DNA, 23 bp, Homo sapiens
tggagtctcactctgtcacccag

SEQ ID NO: 127525 - DNA, 22 bp, Homo sapiens
tttcacagctttattatgagaa

SEQ ID NO: 127526 - DNA, 20 bp, Homo sapiens
agggtgcattatcaatccat

SEQ ID NO: 127527 - DNA, 21 bp, Homo sapiens
tgtgtatatatgtatgtgtgt

SEQ ID NO: 127528 - DNA, 23 bp, Homo sapiens
tatgtgtatatatacgtatatgt

SEQ ID NO: 127529 - DNA, 20 bp, Homo sapiens
atagttgtgtcatattgttg

SEQ ID NO: 127530 - DNA, 23 bp, Homo sapiens
tatagtgcatatctataccttat

SEQ ID NO: 127531 - DNA, 20 bp, Homo sapiens
atagggtcttgctctgtcac

SEQ ID NO: 127532 - DNA, 23 bp, Homo sapiens
atctacttgtacattttctttct

SEQ ID NO: 127533 - DNA, 23 bp, Homo sapiens
atatgtatatatgtatatatgtg

SEQ ID NO: 127534 - DNA, 22 bp, Homo sapiens
atatgtatatatgtatatatgt

SEQ ID NO: 127535 - DNA, 20 bp, Homo sapiens
tgacagtagactgagtgggc

SEQ ID NO: 127536 - DNA, 23 bp, Homo sapiens
gagacggtgtctcactctgtcgc

SEQ ID NO: 127537 - DNA, 20 bp, Homo sapiens
atgtttacttactggagagt

SEQ ID NO: 127538 - DNA, 23 bp, Homo sapiens
tgttctttttgcttaggattgtc

SEQ ID NO: 127539 - DNA, 23 bp, Homo sapiens
gtgtatatatgtatatatgtgta

SEQ ID NO: 127540 - DNA, 23 bp, Homo sapiens
tgtatgtgtatatacatatgtgt

SEQ ID NO: 127541 - DNA, 20 bp, Homo sapiens
tatatacatatatgtgtatg

SEQ ID NO: 127542 - DNA, 23 bp, Homo sapiens
aatcactgtgctttgtttggatg

SEQ ID NO: 127543 - DNA, 19 bp, Homo sapiens
acatatatatgtatgtgga

SEQ ID NO: 127544 - DNA, 21 bp, Homo sapiens
tatgcaagtaagtatatatgt

SEQ ID NO: 127545 - DNA, 23 bp, Homo sapiens
tatgtgtagtttgataccagaat

SEQ ID NO: 127546 - DNA, 20 bp, Homo sapiens
aagagaactctttctctaga

SEQ ID NO: 127547 - DNA, 18 bp, Homo sapiens
agtggtagaaggatggtt

SEQ ID NO: 127548 - DNA, 23 bp, Homo sapiens
atgttgagtggatatgaatatat

SEQ ID NO: 127549 - DNA, 18 bp, Homo sapiens
tgaggttgaaggatcatt

SEQ ID NO: 127550 - DNA, 19 bp, Homo sapiens
gtttcagctactccagagg

SEQ ID NO: 127551 - DNA, 18 bp, Homo sapiens
atatgtgtttatgtagat

SEQ ID NO: 127552 - DNA, 23 bp, Homo sapiens
atgtgtgtgcatatgtatgcatg

SEQ ID NO: 127553 - DNA, 23 bp, Homo sapiens
tcactctgtcacccagactagag

SEQ ID NO: 127554 - DNA, 23 bp, Homo sapiens
atggaagagaaactggaactgca

SEQ ID NO: 127555 - DNA, 19 bp, Homo sapiens
agtgcagttgctcgatctt

SEQ ID NO: 127556 - DNA, 23 bp, Homo sapiens
tggagtctcactctgtcacccag

SEQ ID NO: 127557 - DNA, 23 bp, Homo sapiens
tttttctctctgctacttgccag

SEQ ID NO: 127558 - DNA, 21 bp, Homo sapiens
gggtgaggaaacactgcaggt

SEQ ID NO: 127559 - DNA, 19 bp, Homo sapiens
tgtgagccactgtgcccag

SEQ ID NO: 127560 - DNA, 23 bp, Homo sapiens
agagtctcactctgtcacccagg

SEQ ID NO: 127561 - DNA, 22 bp, Homo sapiens
ttggctcactgcaacctttgtc

SEQ ID NO: 127562 - DNA, 23 bp, Homo sapiens
acagtctcactctgtcacccagg

SEQ ID NO: 127563 - DNA, 18 bp, Homo sapiens
cagtacctggtgcagccc

SEQ ID NO: 127564 - DNA, 23 bp, Homo sapiens
tgaggtggagtctctctgtcacc

SEQ ID NO: 127565 - DNA, 23 bp, Homo sapiens
tctcatgtatatgtatatgtgaa

SEQ ID NO: 127566 - DNA, 23 bp, Homo sapiens
gacagagtctcgctctgtcaccc

SEQ ID NO: 127567 - DNA, 23 bp, Homo sapiens
tgtcagcagtagttctgatcttg

SEQ ID NO: 127568 - DNA, 23 bp, Homo sapiens
tacagagtctcgctctgtcactg

SEQ ID NO: 127569 - DNA, 23 bp, Homo sapiens
ccgtgtgtgtctgtgttttaaac

SEQ ID NO: 127570 - DNA, 20 bp, Homo sapiens
tctgtcaccaggctacagtg

SEQ ID NO: 127571 - DNA, 18 bp, Homo sapiens
agaggcacagtcacagct

SEQ ID NO: 127572 - DNA, 23 bp, Homo sapiens
tcagtatttttacttttgattct

SEQ ID NO: 127573 - DNA, 22 bp, Homo sapiens
tcaggtagaaggtggaatagga

SEQ ID NO: 127574 - DNA, 21 bp, Homo sapiens
cttaggtacatgttagtgatc

SEQ ID NO: 127575 - DNA, 23 bp, Homo sapiens
atgtgtatatatatatgtgtata

SEQ ID NO: 127576 - DNA, 18 bp, Homo sapiens
atacacacccacatacat

SEQ ID NO: 127577 - DNA, 23 bp, Homo sapiens
agtctgccactctgccactctgc

SEQ ID NO: 127578 - DNA, 22 bp, Homo sapiens
tttgtgggtacagagtaggtat

SEQ ID NO: 127579 - DNA, 22 bp, Homo sapiens
actgctataaggatgtttgtta

SEQ ID NO: 127580 - DNA, 18 bp, Homo sapiens
gcaagtggaggctgtctc

SEQ ID NO: 127581 - DNA, 23 bp, Homo sapiens
tgtgagacagagtctcgctctgt

SEQ ID NO: 127582 - DNA, 20 bp, Homo sapiens
tttgagatggagtcttgctc

SEQ ID NO: 127583 - DNA, 23 bp, Homo sapiens
tgagtcttcatatcttttcgaac

SEQ ID NO: 127584 - DNA, 19 bp, Homo sapiens
tggcagtttggaaaggtgc

SEQ ID NO: 127585 - DNA, 23 bp, Homo sapiens
atgtgtatgtatatgtatgtgta

SEQ ID NO: 127586 - DNA, 23 bp, Homo sapiens
tgatctcgatttgtttttctgtg

SEQ ID NO: 127587 - DNA, 23 bp, Homo sapiens
tgttgctgtgaaggcattttgta

SEQ ID NO: 127588 - DNA, 22 bp, Homo sapiens
acagacagacagatatagatga

SEQ ID NO: 127589 - DNA, 20 bp, Homo sapiens
agcttctatgttttagaaat

SEQ ID NO: 127590 - DNA, 20 bp, Homo sapiens
atcttctctgactacagtgg

SEQ ID NO: 127591 - DNA, 18 bp, Homo sapiens
atctcagagggagaggag

SEQ ID NO: 127592 - DNA, 23 bp, Homo sapiens
gatctgtcactgtctctcatcac

SEQ ID NO: 127593 - DNA, 22 bp, Homo sapiens
tctggttgcaggaaaacaagct

SEQ ID NO: 127594 - DNA, 23 bp, Homo sapiens
tgagttcattgtagattctggat

SEQ ID NO: 127595 - DNA, 23 bp, Homo sapiens
tgagttcattgtagattctggat

SEQ ID NO: 127596 - DNA, 23 bp, Homo sapiens
atatgtgtatgtgtatatacata

SEQ ID NO: 127597 - DNA, 20 bp, Homo sapiens
gtgtgtgtatgtatatacgg

SEQ ID NO: 127598 - DNA, 23 bp, Homo sapiens
atatgtgtatatgtatatgtatg

SEQ ID NO: 127599 - DNA, 19 bp, Homo sapiens
atatgtatgtatatgtata

SEQ ID NO: 127600 - DNA, 23 bp, Homo sapiens
tgagacacagtctcgctctgttg

SEQ ID NO: 127601 - DNA, 23 bp, Homo sapiens
atatgtgtgtatatatatgtgtg

SEQ ID NO: 127602 - DNA, 21 bp, Homo sapiens
atttcacaggcaccattgaag

SEQ ID NO: 127603 - DNA, 23 bp, Homo sapiens
taatagtgtctggaatgtaggag

SEQ ID NO: 127604 - DNA, 21 bp, Homo sapiens
aatactcactttttctctctc

SEQ ID NO: 127605 - DNA, 22 bp, Homo sapiens
tacctgacaggtataccacagg

SEQ ID NO: 127606 - DNA, 23 bp, Homo sapiens
taggacatgagactgagctgaga

SEQ ID NO: 127607 - DNA, 22 bp, Homo sapiens
aggacagggaggtatgcttctt

SEQ ID NO: 127608 - DNA, 19 bp, Homo sapiens
agtgaagtgtgagtggtca

SEQ ID NO: 127609 - DNA, 20 bp, Homo sapiens
gtctcactcactctgttgcc

SEQ ID NO: 127610 - DNA, 23 bp, Homo sapiens
tagctgtatatctttatctctgt

SEQ ID NO: 127611 - DNA, 20 bp, Homo sapiens
acagtgtactgattgctcag

SEQ ID NO: 127612 - DNA, 23 bp, Homo sapiens
tggaacataaaagtagtagagga

SEQ ID NO: 127613 - DNA, 23 bp, Homo sapiens
ttttttgaaagcttttggtgaga

SEQ ID NO: 127614 - DNA, 19 bp, Homo sapiens
tatgtcgatgtatatatat

SEQ ID NO: 127615 - DNA, 21 bp, Homo sapiens
atatgtcggtatatatatgtc

SEQ ID NO: 127616 - DNA, 23 bp, Homo sapiens
atgtatgtgtgcctgtgtatgtg

SEQ ID NO: 127617 - DNA, 22 bp, Homo sapiens
tattcactttggtttgcctgtg

SEQ ID NO: 127618 - DNA, 23 bp, Homo sapiens
gacagagcagttggatgtgtcac

SEQ ID NO: 127619 - DNA, 23 bp, Homo sapiens
tgtacagctatataggtatatgt

SEQ ID NO: 127620 - DNA, 23 bp, Homo sapiens
tgagttcattgtagattctggat

SEQ ID NO: 127621 - DNA, 23 bp, Homo sapiens
tgagttcattgtagattctggat

SEQ ID NO: 127622 - DNA, 22 bp, Homo sapiens
tgagatgcagttccactcttgt

SEQ ID NO: 127623 - DNA, 23 bp, Homo sapiens
tgagcaaaaaaatggtgtattaa

SEQ ID NO: 127624 - DNA, 23 bp, Homo sapiens
ttctgaccttttcatttctctaa

SEQ ID NO: 127625 - DNA, 21 bp, Homo sapiens
tttctatctctcagtgcctct

SEQ ID NO: 127626 - DNA, 22 bp, Homo sapiens
tatgtgtatatatgtgtgtgta

SEQ ID NO: 127627 - DNA, 20 bp, Homo sapiens
aagtgctatgatgtttattt

SEQ ID NO: 127628 - DNA, 18 bp, Homo sapiens
tgcagtgtcacaatcttg

SEQ ID NO: 127629 - DNA, 23 bp, Homo sapiens
tcccagagcccctggaactctgg

SEQ ID NO: 127630 - DNA, 23 bp, Homo sapiens
agatggagtctcgctgtgtcacc

SEQ ID NO: 127631 - DNA, 23 bp, Homo sapiens
tacataccatggaatactattca

SEQ ID NO: 127632 - DNA, 21 bp, Homo sapiens
atgtatataagtatatgtgtg

SEQ ID NO: 127633 - DNA, 23 bp, Homo sapiens
ctttggatatatatgcagtagtg

SEQ ID NO: 127634 - DNA, 22 bp, Homo sapiens
tgagactccctctcactcccag

SEQ ID NO: 127635 - DNA, 19 bp, Homo sapiens
tgggagtgtgggttggagg

SEQ ID NO: 127636 - DNA, 23 bp, Homo sapiens
ctgctgatgagagagctgctgga

SEQ ID NO: 127637 - DNA, 23 bp, Homo sapiens
atatgtgtatatgtatatatgtg

SEQ ID NO: 127638 - DNA, 18 bp, Homo sapiens
tgtacacatatgtacata

SEQ ID NO: 127639 - DNA, 21 bp, Homo sapiens
tatacacacatgtatacatat

SEQ ID NO: 127640 - DNA, 23 bp, Homo sapiens
gaaattaggtcctaaaagataaa

SEQ ID NO: 127641 - DNA, 23 bp, Homo sapiens
tgcctgaactgagtgagcagaat

SEQ ID NO: 127642 - DNA, 20 bp, Homo sapiens
ggaattcacaccccaatcac

SEQ ID NO: 127643 - DNA, 19 bp, Homo sapiens
tgtgtgtctgagttcaggc

SEQ ID NO: 127644 - DNA, 23 bp, Homo sapiens
tttattgagtgttttacttctga

SEQ ID NO: 127645 - DNA, 22 bp, Homo sapiens
aatattaaaagtatgcactgaa

SEQ ID NO: 127646 - DNA, 22 bp, Homo sapiens
tagcatcatcacatttctgtta

SEQ ID NO: 127647 - DNA, 23 bp, Homo sapiens
tatcctcatgatgaaaatactag

SEQ ID NO: 127648 - DNA, 22 bp, Homo sapiens
tatatgtgtgtgtgtgtgtata

SEQ ID NO: 127649 - DNA, 23 bp, Homo sapiens
tactatgaatttgattaccagag

SEQ ID NO: 127650 - DNA, 19 bp, Homo sapiens
tgctctctcaggtatctgt

SEQ ID NO: 127651 - DNA, 23 bp, Homo sapiens
ggagtctctctctgtcacccagg

SEQ ID NO: 127652 - DNA, 23 bp, Homo sapiens
gaactttcttgtagatcggtagt

SEQ ID NO: 127653 - DNA, 23 bp, Homo sapiens
tagtgtgtatgtatatctgtgtg

SEQ ID NO: 127654 - DNA, 23 bp, Homo sapiens
taatgtgtatatatatctgtgtg

SEQ ID NO: 127655 - DNA, 19 bp, Homo sapiens
tccatgaccttgagcaagt

SEQ ID NO: 127656 - DNA, 23 bp, Homo sapiens
gtgttttcatcagcatgtgctgg

SEQ ID NO: 127657 - DNA, 20 bp, Homo sapiens
tcagtctctcataaccacca

SEQ ID NO: 127658 - DNA, 20 bp, Homo sapiens
tctgcttctacaaagcatgt

SEQ ID NO: 127659 - DNA, 23 bp, Homo sapiens
tgtctgtgtctgtctctttctac

SEQ ID NO: 127660 - DNA, 22 bp, Homo sapiens
aagacagggtctcactttgtca

SEQ ID NO: 127661 - DNA, 21 bp, Homo sapiens
taggagagttcttgggtcttt

SEQ ID NO: 127662 - DNA, 21 bp, Homo sapiens
attagcatctttttttcatgt

SEQ ID NO: 127663 - DNA, 22 bp, Homo sapiens
ttggggaagaggtagtgttggt

SEQ ID NO: 127664 - DNA, 20 bp, Homo sapiens
attactattgtacatgttac

SEQ ID NO: 127665 - DNA, 22 bp, Homo sapiens
tctgtcagtaattcactctgtc

SEQ ID NO: 127666 - DNA, 22 bp, Homo sapiens
ctttctgactatttcatgggta

SEQ ID NO: 127667 - DNA, 23 bp, Homo sapiens
cggagtctcactctgtcacccag

SEQ ID NO: 127668 - DNA, 20 bp, Homo sapiens
agtaggtctgtttgctttct

SEQ ID NO: 127669 - DNA, 23 bp, Homo sapiens
tttgtgggtacatagtaggtaca

SEQ ID NO: 127670 - DNA, 23 bp, Homo sapiens
tatatgtatgtatatatatgtat

SEQ ID NO: 127671 - DNA, 23 bp, Homo sapiens
tatatgtatgcatatatatacat

SEQ ID NO: 127672 - DNA, 23 bp, Homo sapiens
cagggtctcacactgtcacccag

SEQ ID NO: 127673 - DNA, 19 bp, Homo sapiens
ttctcagatgatagtgttc

SEQ ID NO: 127674 - DNA, 23 bp, Homo sapiens
gcacacacagaatattgcactgt

SEQ ID NO: 127675 - DNA, 23 bp, Homo sapiens
atacactgtatatatatgtgtag

SEQ ID NO: 127676 - DNA, 23 bp, Homo sapiens
atatactgtatatatatgtgtgt

SEQ ID NO: 127677 - DNA, 23 bp, Homo sapiens
agtagtttccaattcaaataaaa

SEQ ID NO: 127678 - DNA, 23 bp, Homo sapiens
acggtaatgatgatgatgatgat

SEQ ID NO: 127679 - DNA, 23 bp, Homo sapiens
cttgtcttctgtcagttttgtga

SEQ ID NO: 127680 - DNA, 23 bp, Homo sapiens
tctcattggggatctgactgatc

SEQ ID NO: 127681 - DNA, 22 bp, Homo sapiens
gacagacagatgtgtgtgtgca

SEQ ID NO: 127682 - DNA, 23 bp, Homo sapiens
aggatctctctctgtcacccagg

SEQ ID NO: 127683 - DNA, 20 bp, Homo sapiens
agtgcagtgacaggatcgtg

SEQ ID NO: 127684 - DNA, 18 bp, Homo sapiens
gtttagatttctatgtat

SEQ ID NO: 127685 - DNA, 23 bp, Homo sapiens
aaacactaaagattcatatgtgt

SEQ ID NO: 127686 - DNA, 21 bp, Homo sapiens
tgcaatatatatattgtgtgt

SEQ ID NO: 127687 - DNA, 23 bp, Homo sapiens
tgagttcattgtagattctggat

SEQ ID NO: 127688 - DNA, 23 bp, Homo sapiens
tgagttcattgtagattctggat

SEQ ID NO: 127689 - DNA, 23 bp, Homo sapiens
ttaaattcagcatctcatctcat

SEQ ID NO: 127690 - DNA, 20 bp, Homo sapiens
ttgcagactgattattttga

SEQ ID NO: 127691 - DNA, 22 bp, Homo sapiens
tacatgtgcacaatgtgcaggt

SEQ ID NO: 127692 - DNA, 23 bp, Homo sapiens
tgagttcattgtagattctggat

SEQ ID NO: 127693 - DNA, 23 bp, Homo sapiens
tgagttcattgtagattctggat

SEQ ID NO: 127694 - DNA, 20 bp, Homo sapiens
tcaatcagagtaattttgta

SEQ ID NO: 127695 - DNA, 20 bp, Homo sapiens
aaaggaggcaattagttgtg

SEQ ID NO: 127696 - DNA, 21 bp, Homo sapiens
tatggaattttataggatact

SEQ ID NO: 127697 - DNA, 22 bp, Homo sapiens
tagactggacaacatagtgaga

SEQ ID NO: 127698 - DNA, 23 bp, Homo sapiens
tctgcctgtctgtgtggatgcta

SEQ ID NO: 127699 - DNA, 23 bp, Homo sapiens
tgtatatatatgtgtgtatgtgt

SEQ ID NO: 127700 - DNA, 23 bp, Homo sapiens
tgagacggagtctcgctctgtct

SEQ ID NO: 127701 - DNA, 23 bp, Homo sapiens
gtatatgttgtacatatgtttgt

SEQ ID NO: 127702 - DNA, 22 bp, Homo sapiens
tgtcactctgtcacacgggctg

SEQ ID NO: 127703 - DNA, 20 bp, Homo sapiens
gcgtccctttctctctctct

SEQ ID NO: 127704 - DNA, 23 bp, Homo sapiens
atatgcatatatgtatatatgtg

SEQ ID NO: 127705 - DNA, 20 bp, Homo sapiens
tttgagacggagtctcgctc

SEQ ID NO: 127706 - DNA, 23 bp, Homo sapiens
acactctttgctttttatatctg

SEQ ID NO: 127707 - DNA, 23 bp, Homo sapiens
tttcagcatttgtaaaccaaaga

SEQ ID NO: 127708 - DNA, 23 bp, Homo sapiens
agtacagtagcgtgatcttggct

SEQ ID NO: 127709 - DNA, 23 bp, Homo sapiens
tgagttcattgtagattctggat

SEQ ID NO: 127710 - DNA, 23 bp, Homo sapiens
tgagttcattgtagattctggat

SEQ ID NO: 127711 - DNA, 23 bp, Homo sapiens
tggctccgtgcctgcatccctgc

SEQ ID NO: 127712 - DNA, 21 bp, Homo sapiens
gcgtgtgtgtgcacatggtgc

SEQ ID NO: 127713 - DNA, 23 bp, Homo sapiens
gtctgtgtgtgtgtgtgcatgtg

SEQ ID NO: 127714 - DNA, 23 bp, Homo sapiens
tacagttgtgatattgttgtaga

SEQ ID NO: 127715 - DNA, 22 bp, Homo sapiens
tgagttctctaagataatgatg

SEQ ID NO: 127716 - DNA, 22 bp, Homo sapiens
ctctgactctctctcttcatgg

SEQ ID NO: 127717 - DNA, 19 bp, Homo sapiens
taaaacaggaagagaagca

SEQ ID NO: 127718 - DNA, 23 bp, Homo sapiens
attacttttgagcgatgggattg

SEQ ID NO: 127719 - DNA, 23 bp, Homo sapiens
ttccaaagtctctatagtgaaca

SEQ ID NO: 127720 - DNA, 21 bp, Homo sapiens
tgagcataaacaaagagcaga

SEQ ID NO: 127721 - DNA, 21 bp, Homo sapiens
tgtctgtgactttcagtctct

SEQ ID NO: 127722 - DNA, 22 bp, Homo sapiens
ttgtgttcatcctgagatatga

SEQ ID NO: 127723 - DNA, 23 bp, Homo sapiens
acagcttatgtaatcactgagtt

SEQ ID NO: 127724 - DNA, 23 bp, Homo sapiens
aacagctgagagtgcacactcgg

SEQ ID NO: 127725 - DNA, 19 bp, Homo sapiens
tatggatgggttactgaag

SEQ ID NO: 127726 - DNA, 23 bp, Homo sapiens
tatgtgtctatatatatatgtct

SEQ ID NO: 127727 - DNA, 23 bp, Homo sapiens
tatgtctttttaatagtctgtgg

SEQ ID NO: 127728 - DNA, 21 bp, Homo sapiens
atggagtgtcgctttgttgcc

SEQ ID NO: 127729 - DNA, 23 bp, Homo sapiens
tcggtctctggatgaatcctccc

SEQ ID NO: 127730 - DNA, 21 bp, Homo sapiens
attaatctaggtatggataga

SEQ ID NO: 127731 - DNA, 22 bp, Homo sapiens
aagtgtctggaagtctagagta

SEQ ID NO: 127732 - DNA, 20 bp, Homo sapiens
ttttgagtgtgtcaatgatg

SEQ ID NO: 127733 - DNA, 20 bp, Homo sapiens
aagagagagagaatgttccc

SEQ ID NO: 127734 - DNA, 21 bp, Homo sapiens
tggctctgtctctctttctct

SEQ ID NO: 127735 - DNA, 23 bp, Homo sapiens
gtgagcttggagtgactggaggc

SEQ ID NO: 127736 - DNA, 20 bp, Homo sapiens
gttcacactctctgcctctg

SEQ ID NO: 127737 - DNA, 23 bp, Homo sapiens
tctctgtgtgtctctgtgtttaa

SEQ ID NO: 127738 - DNA, 18 bp, Homo sapiens
aagacaccagacatatca

SEQ ID NO: 127739 - DNA, 23 bp, Homo sapiens
tccagacaccaaatctttaggag

SEQ ID NO: 127740 - DNA, 21 bp, Homo sapiens
aggacacaagtccttgggttt

SEQ ID NO: 127741 - DNA, 19 bp, Homo sapiens
atatatgtatatgtatatg

SEQ ID NO: 127742 - DNA, 21 bp, Homo sapiens
acatgtgcactatgtgcaggt

SEQ ID NO: 127743 - DNA, 20 bp, Homo sapiens
ttagaccagttttctctctc

SEQ ID NO: 127744 - DNA, 22 bp, Homo sapiens
tgtgtgtgcatcagcatgtgta

SEQ ID NO: 127745 - DNA, 23 bp, Homo sapiens
tgagttcattgtagattctggat

SEQ ID NO: 127746 - DNA, 23 bp, Homo sapiens
tgagttcattgtagattctggat

SEQ ID NO: 127747 - DNA, 23 bp, Homo sapiens
tatgttgattttgtatcctgtaa

SEQ ID NO: 127748 - DNA, 20 bp, Homo sapiens
acaccatttcttacattcag

SEQ ID NO: 127749 - DNA, 23 bp, Homo sapiens
tatatctgcaaaagttttgtgca

SEQ ID NO: 127750 - DNA, 23 bp, Homo sapiens
taagtttcttaaagatgctggat

SEQ ID NO: 127751 - DNA, 23 bp, Homo sapiens
tgtgttctgccatgagacccaca

SEQ ID NO: 127752 - DNA, 19 bp, Homo sapiens
tgtatatacacacatacac

SEQ ID NO: 127753 - DNA, 21 bp, Homo sapiens
tacacacacacacatatatat

SEQ ID NO: 127754 - DNA, 19 bp, Homo sapiens
tgtatatatgtatatatat

SEQ ID NO: 127755 - DNA, 23 bp, Homo sapiens
atgtgtatatatgtatatatgtg

SEQ ID NO: 127756 - DNA, 22 bp, Homo sapiens
tgtgtatatatgtatatgtgta

SEQ ID NO: 127757 - DNA, 20 bp, Homo sapiens
tatgtatatatgtatatatg

SEQ ID NO: 127758 - DNA, 18 bp, Homo sapiens
atatgtttacctatagta

SEQ ID NO: 127759 - DNA, 22 bp, Homo sapiens
attatatgtgtacatgtatatg

SEQ ID NO: 127760 - DNA, 23 bp, Homo sapiens
tctgtgacagtgaccttatttgg

SEQ ID NO: 127761 - DNA, 23 bp, Homo sapiens
gtatagtgtgtgcatatgtgtag

SEQ ID NO: 127762 - DNA, 23 bp, Homo sapiens
tatatgagtgtatagtgtgtgga

SEQ ID NO: 127763 - DNA, 23 bp, Homo sapiens
tgggagactagtaatattctaga

SEQ ID NO: 127764 - DNA, 23 bp, Homo sapiens
tgtgcctgtgtgtccgcctgtgc

SEQ ID NO: 127765 - DNA, 23 bp, Homo sapiens
tctgcctctggatttgttcatgc

SEQ ID NO: 127766 - DNA, 23 bp, Homo sapiens
agatgttgttcattgatcaaatg

SEQ ID NO: 127767 - DNA, 22 bp, Homo sapiens
tctgttcatggtgtgtctatgg

SEQ ID NO: 127768 - DNA, 23 bp, Homo sapiens
tgtgtgtgaacatgcaggtgtgt

SEQ ID NO: 127769 - DNA, 22 bp, Homo sapiens
atgtgtgtgactgtgtgtgttc

SEQ ID NO: 127770 - DNA, 22 bp, Homo sapiens
cacacgctttctctctctcaac

SEQ ID NO: 127771 - DNA, 23 bp, Homo sapiens
cactgagaccctcacatttctct

SEQ ID NO: 127772 - DNA, 23 bp, Homo sapiens
tgactgtggctgtggctggctct

SEQ ID NO: 127773 - DNA, 23 bp, Homo sapiens
gctgtggatgtagctggctctgt

SEQ ID NO: 127774 - DNA, 23 bp, Homo sapiens
ctgtggctgtgagtggcactgtg

SEQ ID NO: 127775 - DNA, 20 bp, Homo sapiens
cacagaactgtgtgtgcaca

SEQ ID NO: 127776 - DNA, 23 bp, Homo sapiens
ggtgctgtctgtgtgtctgcgtg

SEQ ID NO: 127777 - DNA, 23 bp, Homo sapiens
atatatgtatatatacgtatatg

SEQ ID NO: 127778 - DNA, 23 bp, Homo sapiens
atacgtatatatatatgtgtgtg

SEQ ID NO: 127779 - DNA, 23 bp, Homo sapiens
tcacatttctctgtctgactccc

SEQ ID NO: 127780 - DNA, 21 bp, Homo sapiens
tgtctctgtatgtgtatgtgt

SEQ ID NO: 127781 - DNA, 20 bp, Homo sapiens
agacacacacacaatgtaca

SEQ ID NO: 127782 - DNA, 19 bp, Homo sapiens
tatcctatatatatgtcct

SEQ ID NO: 127783 - DNA, 18 bp, Homo sapiens
tgtgctcagtgtgtgcag

SEQ ID NO: 127784 - DNA, 23 bp, Homo sapiens
tgagttcattgtagattctggat

SEQ ID NO: 127785 - DNA, 23 bp, Homo sapiens
tgagttcattgtagattctggat

SEQ ID NO: 127786 - DNA, 23 bp, Homo sapiens
tgagttcattgtagattctggat

SEQ ID NO: 127787 - DNA, 23 bp, Homo sapiens
tgagttcattgtagattctggat

SEQ ID NO: 127788 - DNA, 23 bp, Homo sapiens
agggtccctgcctccctcactgc

SEQ ID NO: 127789 - DNA, 23 bp, Homo sapiens
ggttctgtgtctgtgtgtggctc

SEQ ID NO: 127790 - DNA, 21 bp, Homo sapiens
tgtgtgtttatctgtgtgcat

SEQ ID NO: 127791 - DNA, 23 bp, Homo sapiens
atgtcacacatgtgagagtccac

SEQ ID NO: 127792 - DNA, 23 bp, Homo sapiens
gtgtgtgtctgtgtgtgaggctc

SEQ ID NO: 127793 - DNA, 23 bp, Homo sapiens
agtctgtcagtgttactacaaag

SEQ ID NO: 127794 - DNA, 23 bp, Homo sapiens
gtgtgtgtctgtgtgtgaggctc

SEQ ID NO: 127795 - DNA, 20 bp, Homo sapiens
acagccaccctctggggtct

SEQ ID NO: 127796 - DNA, 23 bp, Homo sapiens
agactcacactcccacacatggt

SEQ ID NO: 127797 - DNA, 23 bp, Homo sapiens
gtgctgacagtgcagtcagtgga

SEQ ID NO: 127798 - DNA, 23 bp, Homo sapiens
tcttcactttcttactgtctctt

SEQ ID NO: 127799 - DNA, 22 bp, Homo sapiens
agtgcagtggctctatcttggc

SEQ ID NO: 127800 - DNA, 22 bp, Homo sapiens
gccacactctctctctctacat

SEQ ID NO: 127801 - DNA, 23 bp, Homo sapiens
tataattgtgctaagacgttgag

SEQ ID NO: 127802 - DNA, 19 bp, Homo sapiens
atcggcaacttcaaaggtg

SEQ ID NO: 127803 - DNA, 21 bp, Homo sapiens
tttcctgccacttgttccgta

SEQ ID NO: 127804 - DNA, 23 bp, Homo sapiens
cagtcagtctctccgtgtgtcgt

SEQ ID NO: 127805 - DNA, 23 bp, Homo sapiens
tcagtctcactgggtggctcgca

SEQ ID NO: 127806 - DNA, 22 bp, Homo sapiens
ttgactggtcaaagagagcagg

SEQ ID NO: 127807 - DNA, 20 bp, Homo sapiens
ttgactggtcaaagagagca

SEQ ID NO: 127808 - DNA, 20 bp, Homo sapiens
atacacacacatatatatat

SEQ ID NO: 127809 - DNA, 23 bp, Homo sapiens
tgctgtctgcctccctctgtcag

SEQ ID NO: 127810 - DNA, 21 bp, Homo sapiens
caggtggcactgcctggcaca

SEQ ID NO: 127811 - DNA, 22 bp, Homo sapiens
accagcaaaaaaattggtaaat

SEQ ID NO: 127812 - DNA, 23 bp, Homo sapiens
cactcagtggatagaggataggg

SEQ ID NO: 127813 - DNA, 23 bp, Homo sapiens
tctaaacatcctacagtgcacag

SEQ ID NO: 127814 - DNA, 22 bp, Homo sapiens
gtctgtctgtctctctctgggc

SEQ ID NO: 127815 - DNA, 20 bp, Homo sapiens
gggcctcacagtggctgtgc

SEQ ID NO: 127816 - DNA, 22 bp, Homo sapiens
ccccgacactcactgcctcacc

SEQ ID NO: 127817 - DNA, 22 bp, Homo sapiens
tgtgtgtgtgtatatatacaca

SEQ ID NO: 127818 - DNA, 21 bp, Homo sapiens
tccctccctggctgtatggga

SEQ ID NO: 127819 - DNA, 23 bp, Homo sapiens
tgagttcattgtagattctggat

SEQ ID NO: 127820 - DNA, 23 bp, Homo sapiens
tgagttcattgtagattctggat

SEQ ID NO: 127821 - DNA, 20 bp, Homo sapiens
ctgtgttcagtagcactcac

SEQ ID NO: 127822 - DNA, 23 bp, Homo sapiens
tactctctctgacatgcaggtcc

SEQ ID NO: 127823 - DNA, 23 bp, Homo sapiens
tctctgtatgacacatgttcaca

SEQ ID NO: 127824 - DNA, 22 bp, Homo sapiens
tgaagcgtgttcacacagtgca

SEQ ID NO: 127825 - DNA, 20 bp, Homo sapiens
actttgttgatgaggaggtt

SEQ ID NO: 127826 - DNA, 23 bp, Homo sapiens
aacatgggtgtgggtgaactgag

SEQ ID NO: 127827 - DNA, 23 bp, Homo sapiens
cggagtctcactctgtcacccag

SEQ ID NO: 127828 - DNA, 23 bp, Homo sapiens
tatgtgtgtatatgcatatatgt

SEQ ID NO: 127829 - DNA, 23 bp, Homo sapiens
tatgtgtatgcgtgtgtatgtgc

SEQ ID NO: 127830 - DNA, 23 bp, Homo sapiens
gagtctcactctgtcacccaggc

SEQ ID NO: 127831 - DNA, 20 bp, Homo sapiens
ctgtgtccatctgcaggacg

SEQ ID NO: 127832 - DNA, 23 bp, Homo sapiens
tgagttcattgtagattctggat

SEQ ID NO: 127833 - DNA, 23 bp, Homo sapiens
tgagttcattgtagattctggat

SEQ ID NO: 127834 - DNA, 18 bp, Homo sapiens
acctaggagttcttcgtg

SEQ ID NO: 127835 - DNA, 22 bp, Homo sapiens
ttctgcatctccaactcctacc

SEQ ID NO: 127836 - DNA, 23 bp, Homo sapiens
tgtctgcctgtctgcctcacatg

SEQ ID NO: 127837 - DNA, 23 bp, Homo sapiens
tgagttcattgtagattctggat

SEQ ID NO: 127838 - DNA, 23 bp, Homo sapiens
tgagttcattgtagattctggat

SEQ ID NO: 127839 - DNA, 23 bp, Homo sapiens
actgtgtcttagtcactgtgttt

SEQ ID NO: 127840 - DNA, 20 bp, Homo sapiens
tgacagtcaaactctctctc

SEQ ID NO: 127841 - DNA, 23 bp, Homo sapiens
actgtggctctgtgtccctgtcc

SEQ ID NO: 127842 - DNA, 21 bp, Homo sapiens
tatatgtgtatgcatatgtgt

SEQ ID NO: 127843 - DNA, 23 bp, Homo sapiens
tatgtgcatgtatacatgtatgt

SEQ ID NO: 127844 - DNA, 23 bp, Homo sapiens
tatgcatgtatgtatatatgtgc

SEQ ID NO: 127845 - DNA, 21 bp, Homo sapiens
tatgcatgtatgtatatatgt

SEQ ID NO: 127846 - DNA, 20 bp, Homo sapiens
ggagtctcactctgtcgctc

SEQ ID NO: 127847 - DNA, 20 bp, Homo sapiens
tacaggcatgagccactgtg

SEQ ID NO: 127848 - DNA, 23 bp, Homo sapiens
gacagagtctcgctctgtcaccc

SEQ ID NO: 127849 - DNA, 23 bp, Homo sapiens
gcagagtctcactctgtcaccca

SEQ ID NO: 127850 - DNA, 23 bp, Homo sapiens
ttactgtctggctgactgtttgc

SEQ ID NO: 127851 - DNA, 23 bp, Homo sapiens
acagtctgtctatctgtctgctt

SEQ ID NO: 127852 - DNA, 20 bp, Homo sapiens
agcaagaggaaggtcatgtg

SEQ ID NO: 127853 - DNA, 23 bp, Homo sapiens
ctggacaccaattcttatgtcga

SEQ ID NO: 127854 - DNA, 23 bp, Homo sapiens
tgacattttgttgatgtcttgga

SEQ ID NO: 127855 - DNA, 23 bp, Homo sapiens
cacacactcagcctctgcctcag

SEQ ID NO: 127856 - DNA, 23 bp, Homo sapiens
ttctgtgaagaaagtcaatggta

SEQ ID NO: 127857 - DNA, 18 bp, Homo sapiens
tctgtctttctctagaga

SEQ ID NO: 127858 - DNA, 23 bp, Homo sapiens
taaccccaagatgtatttggagt

SEQ ID NO: 127859 - DNA, 23 bp, Homo sapiens
tgagttcattgtagattctggat

SEQ ID NO: 127860 - DNA, 23 bp, Homo sapiens
tgagttcattgtagattctggat

SEQ ID NO: 127861 - DNA, 23 bp, Homo sapiens
tgagttcattgtagattctggat

SEQ ID NO: 127862 - DNA, 23 bp, Homo sapiens
tgagttcattgtagattctggat

SEQ ID NO: 127863 - DNA, 22 bp, Homo sapiens
agtgagttctcagaggtctgat

SEQ ID NO: 127864 - DNA, 23 bp, Homo sapiens
acgcagtctgtgttcatgctgag

SEQ ID NO: 127865 - DNA, 23 bp, Homo sapiens
tctgtctctgtgtgttccctcct

SEQ ID NO: 127866 - DNA, 22 bp, Homo sapiens
agatctcactctgtcacccaga

SEQ ID NO: 127867 - DNA, 22 bp, Homo sapiens
tgagctcacacacacaggcaca

SEQ ID NO: 127868 - DNA, 21 bp, Homo sapiens
tcacacccgctcacttactgg

SEQ ID NO: 127869 - DNA, 23 bp, Homo sapiens
ggagtctcactctgtcacccagg

SEQ ID NO: 127870 - DNA, 21 bp, Homo sapiens
aaatgcagattctcaggcccc

SEQ ID NO: 127871 - DNA, 23 bp, Homo sapiens
tctagagactgggtctcactgtg

SEQ ID NO: 127872 - DNA, 23 bp, Homo sapiens
catacacacacacgtatgtatat

SEQ ID NO: 127873 - DNA, 23 bp, Homo sapiens
taattctgtcactcactggctgc

SEQ ID NO: 127874 - DNA, 23 bp, Homo sapiens
ctgtgcctctctcagtggctcac

SEQ ID NO: 127875 - DNA, 23 bp, Homo sapiens
gagacagagtctcactctgtcac

SEQ ID NO: 127876 - DNA, 23 bp, Homo sapiens
tgtcactctctgtttctcagaaa

SEQ ID NO: 127877 - DNA, 23 bp, Homo sapiens
tttcaggaacactgagaactcca

SEQ ID NO: 127878 - DNA, 20 bp, Homo sapiens
tttcacatcttgtgtcacca

SEQ ID NO: 127879 - DNA, 23 bp, Homo sapiens
gtgtgtgtgtgtgtgtgtacttg

SEQ ID NO: 127880 - DNA, 23 bp, Homo sapiens
atctgtgtgtgtatacacacaca

SEQ ID NO: 127881 - DNA, 23 bp, Homo sapiens
aacaactgcctctgtgtctctgt

SEQ ID NO: 127882 - DNA, 23 bp, Homo sapiens
aggtactgagagagctggttgtt

SEQ ID NO: 127883 - DNA, 21 bp, Homo sapiens
ttccttggctagttgctgcag

SEQ ID NO: 127884 - DNA, 23 bp, Homo sapiens
tattgtccatgtgtattcaatct

SEQ ID NO: 127885 - DNA, 20 bp, Homo sapiens
atgtctgtgtatgtatttat

SEQ ID NO: 127886 - DNA, 23 bp, Homo sapiens
gactgttagaattcactgtgttc

SEQ ID NO: 127887 - DNA, 21 bp, Homo sapiens
ttttcagcctcttaatcagct

SEQ ID NO: 127888 - DNA, 21 bp, Homo sapiens
atatacacatatgtatatgta

SEQ ID NO: 127889 - DNA, 21 bp, Homo sapiens
tgtgaagaaagtcattggtag

SEQ ID NO: 127890 - DNA, 23 bp, Homo sapiens
tgagttcattgtagattctggat

SEQ ID NO: 127891 - DNA, 23 bp, Homo sapiens
tgagttcattgtagattctggat

SEQ ID NO: 127892 - DNA, 23 bp, Homo sapiens
aactgtgtctgatgtctgtgagc

SEQ ID NO: 127893 - DNA, 23 bp, Homo sapiens
tctctggttcaaagtatttccat

SEQ ID NO: 127894 - DNA, 22 bp, Homo sapiens
atgatcagtgatgttgaggtgt

SEQ ID NO: 127895 - DNA, 23 bp, Homo sapiens
atgtgtgtatatataggtatgtg

SEQ ID NO: 127896 - DNA, 23 bp, Homo sapiens
atgtgtgtatatataggtatgtg

SEQ ID NO: 127897 - DNA, 23 bp, Homo sapiens
cggagtctcactctgtcacccag

SEQ ID NO: 127898 - DNA, 23 bp, Homo sapiens
gagtctcactctgtcacccaggc

SEQ ID NO: 127899 - DNA, 23 bp, Homo sapiens
atatgtgtatatatatatgtgtg

SEQ ID NO: 127900 - DNA, 20 bp, Homo sapiens
cgtgacacacacagtgtctg

SEQ ID NO: 127901 - DNA, 21 bp, Homo sapiens
tagaggtatcagtatgaactc

SEQ ID NO: 127902 - DNA, 23 bp, Homo sapiens
tgagagagagagagagagatcta

SEQ ID NO: 127903 - DNA, 23 bp, Homo sapiens
gttgagagtgtgattgctgcttg

SEQ ID NO: 127904 - DNA, 23 bp, Homo sapiens
tcacgctgtcacagtctataacc

SEQ ID NO: 127905 - DNA, 23 bp, Homo sapiens
atctggcactctctgtggctgag

SEQ ID NO: 127906 - DNA, 23 bp, Homo sapiens
tgtctatgtatatatatgtgtgt

SEQ ID NO: 127907 - DNA, 21 bp, Homo sapiens
acacaaatgtgtgtgtgtgta

SEQ ID NO: 127908 - DNA, 23 bp, Homo sapiens
tcacttactctgagtctctgagt

SEQ ID NO: 127909 - DNA, 23 bp, Homo sapiens
tgtttctgtccctgtgtttgtgg

SEQ ID NO: 127910 - DNA, 23 bp, Homo sapiens
ccactctgtctgagtaactgact

SEQ ID NO: 127911 - DNA, 23 bp, Homo sapiens
aaaatggtggctttacatttgtt

SEQ ID NO: 127912 - DNA, 23 bp, Homo sapiens
gacagagtctcactgtgtcaccc

SEQ ID NO: 127913 - DNA, 23 bp, Homo sapiens
aagtgtgagtagtaagtgaggtg

SEQ ID NO: 127914 - DNA, 18 bp, Homo sapiens
agtgtgaggattgaattt

SEQ ID NO: 127915 - DNA, 23 bp, Homo sapiens
ttgagtgaagattcagtcctcat

SEQ ID NO: 127916 - DNA, 23 bp, Homo sapiens
tccctgcctccttgtgtccctgc

SEQ ID NO: 127917 - DNA, 23 bp, Homo sapiens
tcagggtcctggcttctgtggcc

SEQ ID NO: 127918 - DNA, 18 bp, Homo sapiens
ttagatcctggcaaagga

SEQ ID NO: 127919 - DNA, 23 bp, Homo sapiens
agacggagtctcactctatcact

SEQ ID NO: 127920 - DNA, 23 bp, Homo sapiens
tttctggctcgtaatctggtgat

SEQ ID NO: 127921 - DNA, 20 bp, Homo sapiens
tgtatttgtatttgtatttc

SEQ ID NO: 127922 - DNA, 21 bp, Homo sapiens
ttctgatttcactgtggcatt

SEQ ID NO: 127923 - DNA, 23 bp, Homo sapiens
ccctctgtctgtgtgtgtcctga

SEQ ID NO: 127924 - DNA, 19 bp, Homo sapiens
atgtgtatagatgtatatg

SEQ ID NO: 127925 - DNA, 23 bp, Homo sapiens
tgttctgtatttgtatatgactg

SEQ ID NO: 127926 - DNA, 19 bp, Homo sapiens
aaggaggattaaatctgtt

SEQ ID NO: 127927 - DNA, 23 bp, Homo sapiens
tatacatgtacatgtatatatgt

SEQ ID NO: 127928 - DNA, 23 bp, Homo sapiens
tatatacatgtacatgtatatat

SEQ ID NO: 127929 - DNA, 23 bp, Homo sapiens
tatatacatgtacatgtatatat

SEQ ID NO: 127930 - DNA, 19 bp, Homo sapiens
atacatatacatatgtgta

SEQ ID NO: 127931 - DNA, 21 bp, Homo sapiens
tacacatacacgtatatatgt

SEQ ID NO: 127932 - DNA, 22 bp, Homo sapiens
ctctgctactttgtgactgtgt

SEQ ID NO: 127933 - DNA, 23 bp, Homo sapiens
tggagtctcactctgtcacccag

SEQ ID NO: 127934 - DNA, 23 bp, Homo sapiens
cgtgtgtgtgtgtaaactagcac

SEQ ID NO: 127935 - DNA, 21 bp, Homo sapiens
tagtggtagtccaggaacaag

SEQ ID NO: 127936 - DNA, 23 bp, Homo sapiens
acagacatgcacacacatatatg

SEQ ID NO: 127937 - DNA, 23 bp, Homo sapiens
tatgtgtatatatatgtgtgtgt

SEQ ID NO: 127938 - DNA, 23 bp, Homo sapiens
tttctgtgtgtgtcttgatatct

SEQ ID NO: 127939 - DNA, 22 bp, Homo sapiens
tgtcaagcagcatttgatatcc

SEQ ID NO: 127940 - DNA, 23 bp, Homo sapiens
gacaaacacactctctgatatac

SEQ ID NO: 127941 - DNA, 22 bp, Homo sapiens
ccaagaataacatgctagagtc

SEQ ID NO: 127942 - DNA, 23 bp, Homo sapiens
ccctcactcgctctcagtgcctt

SEQ ID NO: 127943 - DNA, 23 bp, Homo sapiens
tttgagacggagtctcactctgt

SEQ ID NO: 127944 - DNA, 23 bp, Homo sapiens
atgtgtgtatatatatgtgtgtg

SEQ ID NO: 127945 - DNA, 23 bp, Homo sapiens
tggaatggattgaagagagaaga

SEQ ID NO: 127946 - DNA, 19 bp, Homo sapiens
ggtgagtttcagttctttg

SEQ ID NO: 127947 - DNA, 23 bp, Homo sapiens
ttgagtggactggaagtactctc

SEQ ID NO: 127948 - DNA, 23 bp, Homo sapiens
aaggatgaaagactgttcattgg

SEQ ID NO: 127949 - DNA, 23 bp, Homo sapiens
gaagtgtgtgaaaagatgaaggg

SEQ ID NO: 127950 - DNA, 22 bp, Homo sapiens
catcatgttctgcaagtatttc

SEQ ID NO: 127951 - DNA, 23 bp, Homo sapiens
tgagttcacattttgttgatttg

SEQ ID NO: 127952 - DNA, 23 bp, Homo sapiens
gcctctgtgcctgtgactctgac

SEQ ID NO: 127953 - DNA, 23 bp, Homo sapiens
tgtctgtgcctctgtcagcctca

SEQ ID NO: 127954 - DNA, 20 bp, Homo sapiens
tgtcagggtactgggttgca

SEQ ID NO: 127955 - DNA, 23 bp, Homo sapiens
agattacatgcttcactctcaag

SEQ ID NO: 127956 - DNA, 23 bp, Homo sapiens
tgtgtgtgtgtgtgtgtcagaga

SEQ ID NO: 127957 - DNA, 18 bp, Homo sapiens
ttgcagatgtctgtgttc

SEQ ID NO: 127958 - DNA, 18 bp, Homo sapiens
tctcagtctgtaaccaga

SEQ ID NO: 127959 - DNA, 23 bp, Homo sapiens
tggagtctcactctgtcacccag

SEQ ID NO: 127960 - DNA, 23 bp, Homo sapiens
tgaagaggagctgaaagcatgtg

SEQ ID NO: 127961 - DNA, 23 bp, Homo sapiens
tgtgtgtttctctctgtccaaac

SEQ ID NO: 127962 - DNA, 23 bp, Homo sapiens
tctcttattctgcctggaatttt

SEQ ID NO: 127963 - DNA, 23 bp, Homo sapiens
gagatggagtctcactctgtcac

SEQ ID NO: 127964 - DNA, 23 bp, Homo sapiens
aggaggctctcagagtctgagtc

SEQ ID NO: 127965 - DNA, 23 bp, Homo sapiens
cagagtgctcacagtgcagttgc

SEQ ID NO: 127966 - DNA, 23 bp, Homo sapiens
gagagtctcgctctgtcacccag

SEQ ID NO: 127967 - DNA, 21 bp, Homo sapiens
tgacatggaaaaggtatgtat

SEQ ID NO: 127968 - DNA, 23 bp, Homo sapiens
tgtcattagggtatgcatttctt

SEQ ID NO: 127969 - DNA, 23 bp, Homo sapiens
tgagttcattgtagattctggat

SEQ ID NO: 127970 - DNA, 23 bp, Homo sapiens
tgagttcattgtagattctggat

SEQ ID NO: 127971 - DNA, 22 bp, Homo sapiens
tagatgtctgaaatcagggtgt

SEQ ID NO: 127972 - DNA, 23 bp, Homo sapiens
cttccttgtgtcctctggctctg

SEQ ID NO: 127973 - DNA, 23 bp, Homo sapiens
gagtctcactctgtcacccaggc

SEQ ID NO: 127974 - DNA, 19 bp, Homo sapiens
tcagtctcctttgggtgcc

SEQ ID NO: 127975 - DNA, 23 bp, Homo sapiens
actgtctctcagtcagtgcggcc

SEQ ID NO: 127976 - DNA, 23 bp, Homo sapiens
tgtttcactgtctggatggctct

SEQ ID NO: 127977 - DNA, 22 bp, Homo sapiens
attattcttggttgtgtctgtg

SEQ ID NO: 127978 - DNA, 22 bp, Homo sapiens
tgatatgcatacatgtgtgcag

SEQ ID NO: 127979 - DNA, 22 bp, Homo sapiens
tgagtgtgtacacagtgtgcag

SEQ ID NO: 127980 - DNA, 23 bp, Homo sapiens
atgactgtgcatgtatatgtaca

SEQ ID NO: 127981 - DNA, 23 bp, Homo sapiens
ttggagacagagtctcactctgt

SEQ ID NO: 127982 - DNA, 23 bp, Homo sapiens
ttcagacttttaaaggtgtcaga

SEQ ID NO: 127983 - DNA, 20 bp, Homo sapiens
aggcaggaaaacaacagctt

SEQ ID NO: 127984 - DNA, 23 bp, Homo sapiens
tgatttctgtagttttcttgggg

SEQ ID NO: 127985 - DNA, 23 bp, Homo sapiens
caggctctcactctgtcacccag

SEQ ID NO: 127986 - DNA, 23 bp, Homo sapiens
acagggtctcgctctgtcactca

SEQ ID NO: 127987 - DNA, 23 bp, Homo sapiens
tgaggtagaaggatcacttgaag

SEQ ID NO: 127988 - DNA, 22 bp, Homo sapiens
tctcactctgtcactcaggctg

SEQ ID NO: 127989 - DNA, 23 bp, Homo sapiens
agggtctcactctctgttttcca

SEQ ID NO: 127990 - DNA, 23 bp, Homo sapiens
cggagtctcactctgtcacccag

SEQ ID NO: 127991 - DNA, 23 bp, Homo sapiens
gacagagtctcgctctgtcaccc

SEQ ID NO: 127992 - DNA, 21 bp, Homo sapiens
tctcactgtgtcactcaggct

SEQ ID NO: 127993 - DNA, 22 bp, Homo sapiens
tcactgcagccttcacttcctg

SEQ ID NO: 127994 - DNA, 23 bp, Homo sapiens
tcagggtctctctctgtccccta

SEQ ID NO: 127995 - DNA, 19 bp, Homo sapiens
cagtggcacaatcttggct

SEQ ID NO: 127996 - DNA, 23 bp, Homo sapiens
gagtctcactctgtctcccagcc

SEQ ID NO: 127997 - DNA, 20 bp, Homo sapiens
tacagtagtgtgatcttggc

SEQ ID NO: 127998 - DNA, 20 bp, Homo sapiens
agtgggtagagagagggtag

SEQ ID NO: 127999 - DNA, 23 bp, Homo sapiens
cagggtctcactctgtcaccccg

SEQ ID NO: 128000 - DNA, 21 bp, Homo sapiens
cagtggcatgatcttggctca

SEQ ID NO: 128001 - DNA, 23 bp, Homo sapiens
cctgtctgactgtcactctgctg

SEQ ID NO: 128002 - DNA, 21 bp, Homo sapiens
tttctactttttcagagttca

SEQ ID NO: 128003 - DNA, 23 bp, Homo sapiens
tcattcactgtgtctgatggtgc

SEQ ID NO: 128004 - DNA, 23 bp, Homo sapiens
tgagttcattgtagattctggat

SEQ ID NO: 128005 - DNA, 23 bp, Homo sapiens
tgagttcattgtagattctggat

SEQ ID NO: 128006 - DNA, 23 bp, Homo sapiens
aatagtggctgaaaatgtactgt

SEQ ID NO: 128007 - DNA, 23 bp, Homo sapiens
ttctacatcttcagtaccacctt

SEQ ID NO: 128008 - DNA, 22 bp, Homo sapiens
tatatgtatatctggtatgtgc

SEQ ID NO: 128009 - DNA, 23 bp, Homo sapiens
tatatggatatactttgtgtgga

SEQ ID NO: 128010 - DNA, 23 bp, Homo sapiens
atatgtgtatgtatatgtatata

SEQ ID NO: 128011 - DNA, 22 bp, Homo sapiens
atatatgtatatgtatatgtgt

SEQ ID NO: 128012 - DNA, 21 bp, Homo sapiens
aactgtttgaagtattatgag

SEQ ID NO: 128013 - DNA, 19 bp, Homo sapiens
tcctgatgtgtgtgctcta

SEQ ID NO: 128014 - DNA, 23 bp, Homo sapiens
tgtgtgtgcatatgcatgtgtgt

SEQ ID NO: 128015 - DNA, 23 bp, Homo sapiens
aaaagttctgtatttcaatgtct

SEQ ID NO: 128016 - DNA, 23 bp, Homo sapiens
gatcactgcttttaaaatcacca

SEQ ID NO: 128017 - DNA, 19 bp, Homo sapiens
ttatgtaatgtcatacaca

SEQ ID NO: 128018 - DNA, 20 bp, Homo sapiens
tagaagtcattttcttgaaa

SEQ ID NO: 128019 - DNA, 19 bp, Homo sapiens
tttacaaagaaaactgatg

SEQ ID NO: 128020 - DNA, 18 bp, Homo sapiens
aactaggactacaagcac

SEQ ID NO: 128021 - DNA, 21 bp, Homo sapiens
taggttggtcttgaactcctg

SEQ ID NO: 128022 - DNA, 21 bp, Homo sapiens
tttctcactgtgcaatgcaag

SEQ ID NO: 128023 - DNA, 19 bp, Homo sapiens
taggtgatgctactatgca

SEQ ID NO: 128024 - DNA, 23 bp, Homo sapiens
tatgtgtgtgagtatgagcgtgt

SEQ ID NO: 128025 - DNA, 23 bp, Homo sapiens
tcacactcattctctgtccagtt

SEQ ID NO: 128026 - DNA, 20 bp, Homo sapiens
aggagttgtgatcctttgga

SEQ ID NO: 128027 - DNA, 23 bp, Homo sapiens
tcatgtctgtgtctttatctgtg

SEQ ID NO: 128028 - DNA, 23 bp, Homo sapiens
tgagttcattgtagattctggat

SEQ ID NO: 128029 - DNA, 23 bp, Homo sapiens
tgagttcattgtagattctggat

SEQ ID NO: 128030 - DNA, 20 bp, Homo sapiens
tttctgaggctatttcacgg

SEQ ID NO: 128031 - DNA, 23 bp, Homo sapiens
agacagagtctcactctgtcacc

SEQ ID NO: 128032 - DNA, 20 bp, Homo sapiens
atcacgatcacataagaacc

SEQ ID NO: 128033 - DNA, 23 bp, Homo sapiens
tgagttcattgtagattctggat

SEQ ID NO: 128034 - DNA, 23 bp, Homo sapiens
tgagttcattgtagattctggat

SEQ ID NO: 128035 - DNA, 21 bp, Homo sapiens
tggctgacacctgtaatccca

SEQ ID NO: 128036 - DNA, 20 bp, Homo sapiens
agtctagaaacaaggtagag

SEQ ID NO: 128037 - DNA, 18 bp, Homo sapiens
tgtggagaaaagttcttt

SEQ ID NO: 128038 - DNA, 23 bp, Homo sapiens
tgcctggcaccctgatttccagc

SEQ ID NO: 128039 - DNA, 18 bp, Homo sapiens
ggagtcaagagtggcttt

SEQ ID NO: 128040 - DNA, 23 bp, Homo sapiens
gactgagtctcgctctgtcaccc

SEQ ID NO: 128041 - DNA, 19 bp, Homo sapiens
gtggcgtgatcttggctta

SEQ ID NO: 128042 - DNA, 20 bp, Homo sapiens
atggagtttcaccatgttgg

SEQ ID NO: 128043 - DNA, 23 bp, Homo sapiens
gacagagtctcgctctgtcaccc

SEQ ID NO: 128044 - DNA, 23 bp, Homo sapiens
tgcatcatatgtaatgtatattg

SEQ ID NO: 128045 - DNA, 23 bp, Homo sapiens
aatgagtctctgtctctttctta

SEQ ID NO: 128046 - DNA, 23 bp, Homo sapiens
tgtatatctacatatacaggtat

SEQ ID NO: 128047 - DNA, 23 bp, Homo sapiens
ttgtctatggtagagttgagtat

SEQ ID NO: 128048 - DNA, 23 bp, Homo sapiens
ggagtctcactctgtctcccagg

SEQ ID NO: 128049 - DNA, 23 bp, Homo sapiens
gtatgtatatgtgtatatgtata

SEQ ID NO: 128050 - DNA, 23 bp, Homo sapiens
atatacacacgtatatatatgta

SEQ ID NO: 128051 - DNA, 22 bp, Homo sapiens
tatacacacgtatatatatgta

SEQ ID NO: 128052 - DNA, 22 bp, Homo sapiens
tatacacacgtatatatatgta

SEQ ID NO: 128053 - DNA, 22 bp, Homo sapiens
acactgtcttagtgtgtctgct

SEQ ID NO: 128054 - DNA, 18 bp, Homo sapiens
tatatgtatatgtatatg

SEQ ID NO: 128055 - DNA, 23 bp, Homo sapiens
aagtcagtctttttctctgaaag

SEQ ID NO: 128056 - DNA, 23 bp, Homo sapiens
cggagtctcactctgtcacccag

SEQ ID NO: 128057 - DNA, 21 bp, Homo sapiens
aatctgtcaatctgtctctaa

SEQ ID NO: 128058 - DNA, 21 bp, Homo sapiens
tcgctgggattacacgtgcac

SEQ ID NO: 128059 - DNA, 23 bp, Homo sapiens
accatgttgatcaagctggtctt

SEQ ID NO: 128060 - DNA, 23 bp, Homo sapiens
tgagttcattgtagattctggat

SEQ ID NO: 128061 - DNA, 23 bp, Homo sapiens
tgagttcattgtagattctggat

SEQ ID NO: 128062 - DNA, 21 bp, Homo sapiens
tgagttggagtctcgctctgt

SEQ ID NO: 128063 - DNA, 23 bp, Homo sapiens
cggagtctcgctctgtctcccag

SEQ ID NO: 128064 - DNA, 23 bp, Homo sapiens
cagagtctcactgtgtcactcag

SEQ ID NO: 128065 - DNA, 18 bp, Homo sapiens
agagatgtaggctgtgtg

SEQ ID NO: 128066 - DNA, 22 bp, Homo sapiens
actgactatgacatagatgtct

SEQ ID NO: 128067 - DNA, 20 bp, Homo sapiens
atccagagttcgtagttaga

SEQ ID NO: 128068 - DNA, 22 bp, Homo sapiens
atagtgacacaagttaccaaaa

SEQ ID NO: 128069 - DNA, 23 bp, Homo sapiens
gggagagaattgagtgagatcaa

SEQ ID NO: 128070 - DNA, 22 bp, Homo sapiens
ttacttgaagcacttatatttt

SEQ ID NO: 128071 - DNA, 23 bp, Homo sapiens
gagtctcacactgtcacccaggc

SEQ ID NO: 128072 - DNA, 20 bp, Homo sapiens
tgcaatggtgtgatctcagc

SEQ ID NO: 128073 - DNA, 20 bp, Homo sapiens
tgtctctctcagacttttgc

SEQ ID NO: 128074 - DNA, 18 bp, Homo sapiens
caaatatttgaatcgaga

SEQ ID NO: 128075 - DNA, 21 bp, Homo sapiens
acctagagtggcttaatcctg

SEQ ID NO: 128076 - DNA, 23 bp, Homo sapiens
cggagtctcgctctgtcgctcag

SEQ ID NO: 128077 - DNA, 23 bp, Homo sapiens
tacagaaaagagtctggacttgg

SEQ ID NO: 128078 - DNA, 23 bp, Homo sapiens
ttttgagacagtctcactctgtc

SEQ ID NO: 128079 - DNA, 18 bp, Homo sapiens
ttgttgttgttttgagat

SEQ ID NO: 128080 - DNA, 21 bp, Homo sapiens
tagcagagacgtcatgagagt

SEQ ID NO: 128081 - DNA, 23 bp, Homo sapiens
tgtcagcgagcacatagctgcaa

SEQ ID NO: 128082 - DNA, 23 bp, Homo sapiens
tagatatgtacatatctatagat

SEQ ID NO: 128083 - DNA, 23 bp, Homo sapiens
aatatgtatatatctataggtac

SEQ ID NO: 128084 - DNA, 21 bp, Homo sapiens
tgacttgtagcttcttacatg

SEQ ID NO: 128085 - DNA, 23 bp, Homo sapiens
atatgtgtatacatgcacatgta

SEQ ID NO: 128086 - DNA, 23 bp, Homo sapiens
tgagttcattgtagattctggat

SEQ ID NO: 128087 - DNA, 23 bp, Homo sapiens
tgagttcattgtagattctggat

SEQ ID NO: 128088 - DNA, 20 bp, Homo sapiens
gtgtgtctgtgtgtgtgtat

SEQ ID NO: 128089 - DNA, 19 bp, Homo sapiens
cacagacacacatatgttt

SEQ ID NO: 128090 - DNA, 22 bp, Homo sapiens
tatatgctattctaacagatgt

SEQ ID NO: 128091 - DNA, 23 bp, Homo sapiens
acagagtctcactctgtcgccca

SEQ ID NO: 128092 - DNA, 18 bp, Homo sapiens
agtggtatcatctcagct

SEQ ID NO: 128093 - DNA, 23 bp, Homo sapiens
tatatgtctgtatgtgtatacat

SEQ ID NO: 128094 - DNA, 23 bp, Homo sapiens
taagagtggtgagagtggacatt

SEQ ID NO: 128095 - DNA, 20 bp, Homo sapiens
tgtcttcatcccaatgttat

SEQ ID NO: 128096 - DNA, 23 bp, Homo sapiens
aactcctttgtcttctaccagtg

SEQ ID NO: 128097 - DNA, 20 bp, Homo sapiens
agggatgtttgcaactgtgt

SEQ ID NO: 128098 - DNA, 20 bp, Homo sapiens
tttgtaaatccttgtaatgt

SEQ ID NO: 128099 - DNA, 18 bp, Homo sapiens
ttggctcactgtaacctc

SEQ ID NO: 128100 - DNA, 23 bp, Homo sapiens
ttgtttggttccatatgaaattt

SEQ ID NO: 128101 - DNA, 23 bp, Homo sapiens
gggtctcactctgtcacccaggc

SEQ ID NO: 128102 - DNA, 23 bp, Homo sapiens
ttccagagactgtatgaggtgag

SEQ ID NO: 128103 - DNA, 23 bp, Homo sapiens
ggagtctcactctgtcacccagg

SEQ ID NO: 128104 - DNA, 23 bp, Homo sapiens
tgtctggttatgtctctgtctcc

SEQ ID NO: 128105 - DNA, 23 bp, Homo sapiens
ttgaattgtgatattgttcttga

SEQ ID NO: 128106 - DNA, 23 bp, Homo sapiens
aactgcatgtgcatgtgcatgga

SEQ ID NO: 128107 - DNA, 23 bp, Homo sapiens
cacagagtctcgctctgtcaccc

SEQ ID NO: 128108 - DNA, 21 bp, Homo sapiens
ttcaagtgattctcctgcctc

SEQ ID NO: 128109 - DNA, 22 bp, Homo sapiens
tcacctttcagagtgatctcac

SEQ ID NO: 128110 - DNA, 23 bp, Homo sapiens
tgagatgagtctcactctgtcaa

SEQ ID NO: 128111 - DNA, 18 bp, Homo sapiens
tgaggttgtaggttgaga

SEQ ID NO: 128112 - DNA, 23 bp, Homo sapiens
agaatcacttgaacccaggaagt

SEQ ID NO: 128113 - DNA, 22 bp, Homo sapiens
tattgcactccagcctgggcga

SEQ ID NO: 128114 - DNA, 23 bp, Homo sapiens
agactgagtctcgctctgtcacc

SEQ ID NO: 128115 - DNA, 23 bp, Homo sapiens
gactgagtctcgctctgtcaccc

SEQ ID NO: 128116 - DNA, 18 bp, Homo sapiens
gctcacactctcactctg

SEQ ID NO: 128117 - DNA, 23 bp, Homo sapiens
ggagtctcactctgtctcccagg

SEQ ID NO: 128118 - DNA, 22 bp, Homo sapiens
tctcactctgtcacccaggctg

SEQ ID NO: 128119 - DNA, 23 bp, Homo sapiens
agagtctcactctgtcacccagg

SEQ ID NO: 128120 - DNA, 22 bp, Homo sapiens
cacagagctgtggttcactctc

SEQ ID NO: 128121 - DNA, 23 bp, Homo sapiens
cagtctgcctgtctgcctggttc

SEQ ID NO: 128122 - DNA, 23 bp, Homo sapiens
gcctctctgtctctcgggctcac

SEQ ID NO: 128123 - DNA, 18 bp, Homo sapiens
gaactttcttgtctggta

SEQ ID NO: 128124 - DNA, 22 bp, Homo sapiens
gacagaatctcactctgtcacc

SEQ ID NO: 128125 - DNA, 23 bp, Homo sapiens
gagtctcactctcactcttgtcg

SEQ ID NO: 128126 - DNA, 23 bp, Homo sapiens
gtctctgtgtgtgtctgagcagc

SEQ ID NO: 128127 - DNA, 23 bp, Homo sapiens
attcagcaagtacatgtggaggt

SEQ ID NO: 128128 - DNA, 19 bp, Homo sapiens
cctgtagtctcagctactt

SEQ ID NO: 128129 - DNA, 18 bp, Homo sapiens
ctcacatcttttgtctgt

SEQ ID NO: 128130 - DNA, 21 bp, Homo sapiens
attgtgagaagagaatgagct

SEQ ID NO: 128131 - DNA, 22 bp, Homo sapiens
aatgtccctggagtcacagaaa

SEQ ID NO: 128132 - DNA, 19 bp, Homo sapiens
tcactgaagagagtgtggt

SEQ ID NO: 128133 - DNA, 23 bp, Homo sapiens
tgtctgtctgtcactcaccttct

SEQ ID NO: 128134 - DNA, 23 bp, Homo sapiens
tgattgtccaaacgcaattctcg

SEQ ID NO: 128135 - DNA, 23 bp, Homo sapiens
tgagttcattgtagattctggat

SEQ ID NO: 128136 - DNA, 23 bp, Homo sapiens
tgagttcattgtagattctggat

SEQ ID NO: 128137 - DNA, 21 bp, Homo sapiens
attgcactccagcctgggtga

SEQ ID NO: 128138 - DNA, 23 bp, Homo sapiens
acagtgtcttactctgtcaccca

SEQ ID NO: 128139 - DNA, 23 bp, Homo sapiens
tgtgactctctgtgacccccagc

SEQ ID NO: 128140 - DNA, 23 bp, Homo sapiens
cttgctctgtggctctgtcgccc

SEQ ID NO: 128141 - DNA, 23 bp, Homo sapiens
gcccctctgtgtctctctgtcgc

SEQ ID NO: 128142 - DNA, 23 bp, Homo sapiens
gacagagtctcgctctgtcaccc

SEQ ID NO: 128143 - DNA, 19 bp, Homo sapiens
tgacatgtgcactttgcta

SEQ ID NO: 128144 - DNA, 22 bp, Homo sapiens
acagaacagactcagctcatca

SEQ ID NO: 128145 - DNA, 23 bp, Homo sapiens
ctgtctgtctgtctgtctctggg

SEQ ID NO: 128146 - DNA, 23 bp, Homo sapiens
tggagtctcactctgtcacccag

SEQ ID NO: 128147 - DNA, 19 bp, Homo sapiens
gtctcagctacttgagagg

SEQ ID NO: 128148 - DNA, 23 bp, Homo sapiens
gagtctctgcctctgtcccagcc

SEQ ID NO: 128149 - DNA, 20 bp, Homo sapiens
tatggaacttcacagacatg

SEQ ID NO: 128150 - DNA, 23 bp, Homo sapiens
gtgctctgtctgtgagagtcccc

SEQ ID NO: 128151 - DNA, 23 bp, Homo sapiens
cggagtctcgctctgtctcccag

SEQ ID NO: 128152 - DNA, 18 bp, Homo sapiens
tgtgatcatagttcactg

SEQ ID NO: 128153 - DNA, 23 bp, Homo sapiens
agagacagcgtcagtgtcacagt

SEQ ID NO: 128154 - DNA, 19 bp, Homo sapiens
actggttttccagctagta

SEQ ID NO: 128155 - DNA, 23 bp, Homo sapiens
caggctaagatgagactgtgctg

SEQ ID NO: 128156 - DNA, 23 bp, Homo sapiens
tgggagacttctcattttgttct

SEQ ID NO: 128157 - DNA, 23 bp, Homo sapiens
agtcagtgtctcgctctgtcacc

SEQ ID NO: 128158 - DNA, 23 bp, Homo sapiens
agtggtagtgataagattcactg

SEQ ID NO: 128159 - DNA, 19 bp, Homo sapiens
tgtgccactgcactctagc

SEQ ID NO: 128160 - DNA, 21 bp, Homo sapiens
tccctcagtggttattatgag

SEQ ID NO: 128161 - DNA, 23 bp, Homo sapiens
tgagttcattgtagattctggat

SEQ ID NO: 128162 - DNA, 23 bp, Homo sapiens
tgagttcattgtagattctggat

SEQ ID NO: 128163 - DNA, 23 bp, Homo sapiens
gacacatctgccagtcctcacag

SEQ ID NO: 128164 - DNA, 20 bp, Homo sapiens
acacagatgtgagtctggac

SEQ ID NO: 128165 - DNA, 23 bp, Homo sapiens
gacggagtctcactctgtcactc

SEQ ID NO: 128166 - DNA, 23 bp, Homo sapiens
ggagtctcactctgtcactcagg

SEQ ID NO: 128167 - DNA, 23 bp, Homo sapiens
gacaggaaagccaagaagttggg

SEQ ID NO: 128168 - DNA, 21 bp, Homo sapiens
tcactgccagctttgtcgacc

SEQ ID NO: 128169 - DNA, 23 bp, Homo sapiens
gcctcactcactcactcccttgc

SEQ ID NO: 128170 - DNA, 21 bp, Homo sapiens
aagcactgaatagtactagac

SEQ ID NO: 128171 - DNA, 22 bp, Homo sapiens
cagtggcatgatcttggctcac

SEQ ID NO: 128172 - DNA, 21 bp, Homo sapiens
cagtggcatgatcttggctca

SEQ ID NO: 128173 - DNA, 23 bp, Homo sapiens
tggagtctcactctgtcacccag

SEQ ID NO: 128174 - DNA, 23 bp, Homo sapiens
tctctgtccctcagtttacccgt

SEQ ID NO: 128175 - DNA, 20 bp, Homo sapiens
tgagccatgatcgtgccact

SEQ ID NO: 128176 - DNA, 23 bp, Homo sapiens
cggagtctcactctgtcacccag

SEQ ID NO: 128177 - DNA, 23 bp, Homo sapiens
cagggtctcactgtgacactcag

SEQ ID NO: 128178 - DNA, 18 bp, Homo sapiens
gcagtggcacaatcttgg

SEQ ID NO: 128179 - DNA, 22 bp, Homo sapiens
gattccttgatcattctgaaat

SEQ ID NO: 128180 - DNA, 22 bp, Homo sapiens
gagtgtcactcacactgtcatc

SEQ ID NO: 128181 - DNA, 23 bp, Homo sapiens
aattggactgtatggagtagcaa

SEQ ID NO: 128182 - DNA, 23 bp, Homo sapiens
tgtctctgtaatccttgtgattt

SEQ ID NO: 128183 - DNA, 20 bp, Homo sapiens
tgcagtctcactctgtcacc

SEQ ID NO: 128184 - DNA, 23 bp, Homo sapiens
gtaagagtgaagagtgtgagccc

SEQ ID NO: 128185 - DNA, 23 bp, Homo sapiens
tgagagcagtgtgtgtgcacatg

SEQ ID NO: 128186 - DNA, 23 bp, Homo sapiens
tggagtctcactctgtcacccag

SEQ ID NO: 128187 - DNA, 23 bp, Homo sapiens
tggagtctcactctgtcacccag

SEQ ID NO: 128188 - DNA, 22 bp, Homo sapiens
ttttgtagagatgggggtctgt

SEQ ID NO: 128189 - DNA, 23 bp, Homo sapiens
ggcaaagctagtttaaagaagaa

SEQ ID NO: 128190 - DNA, 23 bp, Homo sapiens
ttttttgtagttctgtaagcatt

SEQ ID NO: 128191 - DNA, 22 bp, Homo sapiens
cactcacagtcactcattctgg

SEQ ID NO: 128192 - DNA, 18 bp, Homo sapiens
tatgtataggtgtatgta

SEQ ID NO: 128193 - DNA, 23 bp, Homo sapiens
gtgtggctgagacacagactgtc

SEQ ID NO: 128194 - DNA, 21 bp, Homo sapiens
tgagtgagcagagtgtgtgtg

SEQ ID NO: 128195 - DNA, 21 bp, Homo sapiens
tgagggatgtcagagtgctca

SEQ ID NO: 128196 - DNA, 23 bp, Homo sapiens
tttgtatgtatatgtaaaagcat

SEQ ID NO: 128197 - DNA, 23 bp, Homo sapiens
atatgtatatatgtatatatgta

SEQ ID NO: 128198 - DNA, 23 bp, Homo sapiens
atatgtatatatgtatatgtgta

SEQ ID NO: 128199 - DNA, 22 bp, Homo sapiens
atacatgtatatgtatatacgt

SEQ ID NO: 128200 - DNA, 23 bp, Homo sapiens
atatgtatatatgtatatgtatg

SEQ ID NO: 128201 - DNA, 23 bp, Homo sapiens
tctggccctgagtctctggtctt

SEQ ID NO: 128202 - DNA, 20 bp, Homo sapiens
cactgtgttataccatctgc

SEQ ID NO: 128203 - DNA, 23 bp, Homo sapiens
catatgtgagggattcttatcta

SEQ ID NO: 128204 - DNA, 23 bp, Homo sapiens
gactctcagacactggctggttc

SEQ ID NO: 128205 - DNA, 23 bp, Homo sapiens
caacagtctggctcagtccctct

SEQ ID NO: 128206 - DNA, 21 bp, Homo sapiens
tgtgtatgtgtatatgtacgc

SEQ ID NO: 128207 - DNA, 23 bp, Homo sapiens
gtgtctgtgtctgcatgtgcatg

SEQ ID NO: 128208 - DNA, 23 bp, Homo sapiens
aacctctctgtgcctcactaggg

SEQ ID NO: 128209 - DNA, 23 bp, Homo sapiens
acagagtctcactctgtcgccca

SEQ ID NO: 128210 - DNA, 23 bp, Homo sapiens
ttgggtgatgatcatagtgtctg

SEQ ID NO: 128211 - DNA, 22 bp, Homo sapiens
agaccttagaaagagacagagg

SEQ ID NO: 128212 - DNA, 23 bp, Homo sapiens
tctgcctctgtctctgtcctgag

SEQ ID NO: 128213 - DNA, 23 bp, Homo sapiens
acagacagaacagtgtgtggaga

SEQ ID NO: 128214 - DNA, 23 bp, Homo sapiens
ttgagctgtctgtatttcatgcc

SEQ ID NO: 128215 - DNA, 23 bp, Homo sapiens
tgtgtggatgtgtggctggctga

SEQ ID NO: 128216 - DNA, 19 bp, Homo sapiens
actgggactgtctgtctct

SEQ ID NO: 128217 - DNA, 19 bp, Homo sapiens
agtgtgagaggcagtggtg

SEQ ID NO: 128218 - DNA, 20 bp, Homo sapiens
acgttttgaatccttcccat

SEQ ID NO: 128219 - DNA, 23 bp, Homo sapiens
ctgtctctcagtccctgcctcag

SEQ ID NO: 128220 - DNA, 21 bp, Homo sapiens
atatctgcatatggattgaaa

SEQ ID NO: 128221 - DNA, 19 bp, Homo sapiens
agcttatttctgtgtgtgt

SEQ ID NO: 128222 - DNA, 22 bp, Homo sapiens
tgtgagaagtcagtgagctgta

SEQ ID NO: 128223 - DNA, 18 bp, Homo sapiens
tgtggaacatagaatttt

SEQ ID NO: 128224 - DNA, 18 bp, Homo sapiens
ggagtctctctctgtcac

SEQ ID NO: 128225 - DNA, 20 bp, Homo sapiens
agtctcgctctgtcacccag

SEQ ID NO: 128226 - DNA, 23 bp, Homo sapiens
ggaatgtagtccacagagggcag

SEQ ID NO: 128227 - DNA, 23 bp, Homo sapiens
cagcctctgtctctgtcaggctg

SEQ ID NO: 128228 - DNA, 19 bp, Homo sapiens
tatgtatgtatatatacgt

SEQ ID NO: 128229 - DNA, 18 bp, Homo sapiens
atatatgtatgtatacag

SEQ ID NO: 128230 - DNA, 21 bp, Homo sapiens
actgtgcacacagtgcccaca

SEQ ID NO: 128231 - DNA, 20 bp, Homo sapiens
tcacatcactctctgtctga

SEQ ID NO: 128232 - DNA, 23 bp, Homo sapiens
atacatacacgtgtgtgtgtgtg

SEQ ID NO: 128233 - DNA, 21 bp, Homo sapiens
tttatgtcagccgccttctct

SEQ ID NO: 128234 - DNA, 23 bp, Homo sapiens
gttctcactcactcacttcctga

SEQ ID NO: 128235 - DNA, 23 bp, Homo sapiens
tatttgtccatcattaattttgt

SEQ ID NO: 128236 - DNA, 21 bp, Homo sapiens
cagtggcaagatctcggctca

SEQ ID NO: 128237 - DNA, 23 bp, Homo sapiens
atcctgtgaccaacacattagaa

SEQ ID NO: 128238 - DNA, 23 bp, Homo sapiens
gaaatgtaactcagtggttgagt

SEQ ID NO: 128239 - DNA, 20 bp, Homo sapiens
tctcactctgtcacttaggc

SEQ ID NO: 128240 - DNA, 23 bp, Homo sapiens
acggagtctcactctgtcacccg

SEQ ID NO: 128241 - DNA, 23 bp, Homo sapiens
tgagggtctagtgaggtgtgtgt

SEQ ID NO: 128242 - DNA, 18 bp, Homo sapiens
tcctcctcaacatggact

SEQ ID NO: 128243 - DNA, 23 bp, Homo sapiens
tctgtctgtctacctgtccctga

SEQ ID NO: 128244 - DNA, 23 bp, Homo sapiens
actctctggttgtagtttcttgt

SEQ ID NO: 128245 - DNA, 19 bp, Homo sapiens
ttaaggactggagccaggg

SEQ ID NO: 128246 - DNA, 23 bp, Homo sapiens
cacttcctccttgttagactcaa

SEQ ID NO: 128247 - DNA, 22 bp, Homo sapiens
atatgtgtattagtatatatat

SEQ ID NO: 128248 - DNA, 22 bp, Homo sapiens
agggtggagacagaggacacag

SEQ ID NO: 128249 - DNA, 23 bp, Homo sapiens
ctctctctgtatctcagtgtcct

SEQ ID NO: 128250 - DNA, 23 bp, Homo sapiens
tgtgtgtgtgagagacagggtct

SEQ ID NO: 128251 - DNA, 23 bp, Homo sapiens
agagtctcactctgtcacccagg

SEQ ID NO: 128252 - DNA, 23 bp, Homo sapiens
gagtctcactctgtcacccaggc

SEQ ID NO: 128253 - DNA, 23 bp, Homo sapiens
tctgagacactgcttctagttgt

SEQ ID NO: 128254 - DNA, 22 bp, Homo sapiens
tgtctctgtccctgcctcacag

SEQ ID NO: 128255 - DNA, 23 bp, Homo sapiens
tagccacagccatcctatgccag

SEQ ID NO: 128256 - DNA, 22 bp, Homo sapiens
taaacagatgatagtgtccagc

SEQ ID NO: 128257 - DNA, 23 bp, Homo sapiens
tgagttcattgtagattctggat

SEQ ID NO: 128258 - DNA, 23 bp, Homo sapiens
tgagttcattgtagattctggat

SEQ ID NO: 128259 - DNA, 23 bp, Homo sapiens
ttctctgtgcctgagctgctggt

SEQ ID NO: 128260 - DNA, 23 bp, Homo sapiens
gcatggtgaagaagggaatggct

SEQ ID NO: 128261 - DNA, 23 bp, Homo sapiens
tctctctcaatcactctgctata

SEQ ID NO: 128262 - DNA, 20 bp, Homo sapiens
atatatatatgtatatgtgt

SEQ ID NO: 128263 - DNA, 21 bp, Homo sapiens
ttcacagtgaagttctcccaa

SEQ ID NO: 128264 - DNA, 22 bp, Homo sapiens
tgagagcctctgtgactcacag

SEQ ID NO: 128265 - DNA, 23 bp, Homo sapiens
tgtatcagtgaactcagaccctg

SEQ ID NO: 128266 - DNA, 23 bp, Homo sapiens
agagtctcactctgtcacccagg

SEQ ID NO: 128267 - DNA, 23 bp, Homo sapiens
gagtctcactctgtcacccaggc

SEQ ID NO: 128268 - DNA, 23 bp, Homo sapiens
gtaattgagtttgctttacattt

SEQ ID NO: 128269 - DNA, 23 bp, Homo sapiens
attgagacggagtctcgctctgt

SEQ ID NO: 128270 - DNA, 21 bp, Homo sapiens
taagcatgtctactggtgtca

SEQ ID NO: 128271 - DNA, 21 bp, Homo sapiens
tgggtagagacacattcagtt

SEQ ID NO: 128272 - DNA, 22 bp, Homo sapiens
tgtgtgtgtgtgtttgtgcata

SEQ ID NO: 128273 - DNA, 23 bp, Homo sapiens
tgtgtgtgtatatatgtatattt

SEQ ID NO: 128274 - DNA, 21 bp, Homo sapiens
tgtgtatatatatgtgtgtgt

SEQ ID NO: 128275 - DNA, 18 bp, Homo sapiens
acacacacacacatacat

SEQ ID NO: 128276 - DNA, 21 bp, Homo sapiens
tgtgagccactgtgcccggct

SEQ ID NO: 128277 - DNA, 23 bp, Homo sapiens
tgagttcattgtagattctggat

SEQ ID NO: 128278 - DNA, 23 bp, Homo sapiens
tgagttcattgtagattctggat

SEQ ID NO: 128279 - DNA, 22 bp, Homo sapiens
tttgttctttttgcttaggatt

SEQ ID NO: 128280 - DNA, 22 bp, Homo sapiens
tgtgtatatatgtatatatgtg

SEQ ID NO: 128281 - DNA, 19 bp, Homo sapiens
agcagaagggacttgcctt

SEQ ID NO: 128282 - DNA, 19 bp, Homo sapiens
tgaaatgagttaagactgt

SEQ ID NO: 128283 - DNA, 21 bp, Homo sapiens
tataggtatatattgtataga

SEQ ID NO: 128284 - DNA, 21 bp, Homo sapiens
atgagatttcaccatgttggc

SEQ ID NO: 128285 - DNA, 23 bp, Homo sapiens
atcatgttattcaggatatccat

SEQ ID NO: 128286 - DNA, 21 bp, Homo sapiens
gtctcacaaatgagtttctgt

SEQ ID NO: 128287 - DNA, 19 bp, Homo sapiens
attatatatgtatacatta

SEQ ID NO: 128288 - DNA, 23 bp, Homo sapiens
tatgtatacattatgtatacata

SEQ ID NO: 128289 - DNA, 23 bp, Homo sapiens
atactctgtgtagctctgtgtgt

SEQ ID NO: 128290 - DNA, 23 bp, Homo sapiens
tgagttcattgtagattctggat

SEQ ID NO: 128291 - DNA, 23 bp, Homo sapiens
tgagttcattgtagattctggat

SEQ ID NO: 128292 - DNA, 23 bp, Homo sapiens
tgagttcattgtagattctggat

SEQ ID NO: 128293 - DNA, 23 bp, Homo sapiens
tgagttcattgtagattctggat

SEQ ID NO: 128294 - DNA, 23 bp, Homo sapiens
ctctctgtcactctgagaggctc

SEQ ID NO: 128295 - DNA, 23 bp, Homo sapiens
tatacacacacacaaatgtgtac

SEQ ID NO: 128296 - DNA, 20 bp, Homo sapiens
tttcagtgttgctatgaggg

SEQ ID NO: 128297 - DNA, 23 bp, Homo sapiens
gtgcgatctcagctcactgtgac

SEQ ID NO: 128298 - DNA, 22 bp, Homo sapiens
caactgtttggaagatagagga

SEQ ID NO: 128299 - DNA, 20 bp, Homo sapiens
aaaggagatgaatatgtgga

SEQ ID NO: 128300 - DNA, 19 bp, Homo sapiens
atttctatgtatttcaatt

SEQ ID NO: 128301 - DNA, 22 bp, Homo sapiens
tttttggtttctatgcagtaga

SEQ ID NO: 128302 - DNA, 23 bp, Homo sapiens
ggttgagagtgaattcagtggtg

SEQ ID NO: 128303 - DNA, 23 bp, Homo sapiens
ttgcaagaacatactgagcacat

SEQ ID NO: 128304 - DNA, 21 bp, Homo sapiens
tatctgctgttatattaggac

SEQ ID NO: 128305 - DNA, 23 bp, Homo sapiens
tatgaagaaaagcaatagatgtc

SEQ ID NO: 128306 - DNA, 23 bp, Homo sapiens
acctctctcagtctgagtggttg

SEQ ID NO: 128307 - DNA, 23 bp, Homo sapiens
tgagttcattgtagattctggat

SEQ ID NO: 128308 - DNA, 23 bp, Homo sapiens
tgagttcattgtagattctggat

SEQ ID NO: 128309 - DNA, 23 bp, Homo sapiens
atggaatgtaaggaagtgtgtgg

SEQ ID NO: 128310 - DNA, 19 bp, Homo sapiens
tgagatcgagtctcactct

SEQ ID NO: 128311 - DNA, 21 bp, Homo sapiens
agacagggtctcactctgtca

SEQ ID NO: 128312 - DNA, 20 bp, Homo sapiens
catatagtatgtatatgtgt

SEQ ID NO: 128313 - DNA, 23 bp, Homo sapiens
agttttgttctttttgcttagga

SEQ ID NO: 128314 - DNA, 23 bp, Homo sapiens
ttctgtgaagaaagtcagtggta

SEQ ID NO: 128315 - DNA, 19 bp, Homo sapiens
attgtgtatatatatatgt

SEQ ID NO: 128316 - DNA, 23 bp, Homo sapiens
gacagagtctcgctctgtcaccc

SEQ ID NO: 128317 - DNA, 23 bp, Homo sapiens
acagagtctcgctctgtcaccca

SEQ ID NO: 128318 - DNA, 23 bp, Homo sapiens
gagagagtctcgctctgtcaccc

SEQ ID NO: 128319 - DNA, 22 bp, Homo sapiens
agtgaaataagaatctgttttt

SEQ ID NO: 128320 - DNA, 22 bp, Homo sapiens
aaactggttattttactgagtc

SEQ ID NO: 128321 - DNA, 19 bp, Homo sapiens
tgagaagatgaccttttag

SEQ ID NO: 128322 - DNA, 23 bp, Homo sapiens
gcactctctgactgtctctccca

SEQ ID NO: 128323 - DNA, 23 bp, Homo sapiens
ctgagtctcactctgtcacccag

SEQ ID NO: 128324 - DNA, 23 bp, Homo sapiens
gtcaggctgtggctctctttctc

SEQ ID NO: 128325 - DNA, 20 bp, Homo sapiens
ctttgtgcatcatcttctca

SEQ ID NO: 128326 - DNA, 18 bp, Homo sapiens
aagtagctgggattacag

SEQ ID NO: 128327 - DNA, 23 bp, Homo sapiens
cacacacatacacacacatatat

SEQ ID NO: 128328 - DNA, 23 bp, Homo sapiens
acatgaatatatgtatatgtgtg

SEQ ID NO: 128329 - DNA, 21 bp, Homo sapiens
gagcttctttgttgtagtagc

SEQ ID NO: 128330 - DNA, 23 bp, Homo sapiens
tacacacacacatatatatgtgt

SEQ ID NO: 128331 - DNA, 22 bp, Homo sapiens
tatgtgtatatatatgtgtgtg

SEQ ID NO: 128332 - DNA, 23 bp, Homo sapiens
tctgtgaagaaagtcaatggtag

SEQ ID NO: 128333 - DNA, 19 bp, Homo sapiens
tgtatatgtatgtgtatat

SEQ ID NO: 128334 - DNA, 23 bp, Homo sapiens
tatatgtgtatacgtatgtgtgt

SEQ ID NO: 128335 - DNA, 23 bp, Homo sapiens
tatgtgtatatatatatgtgtgt

SEQ ID NO: 128336 - DNA, 23 bp, Homo sapiens
tgtgactgagttaaatttgagtt

SEQ ID NO: 128337 - DNA, 23 bp, Homo sapiens
gagacggagtctcactctgtcac

SEQ ID NO: 128338 - DNA, 23 bp, Homo sapiens
tggatatggtattctatggtatt

SEQ ID NO: 128339 - DNA, 23 bp, Homo sapiens
atttgcaatacatctgtttttct

SEQ ID NO: 128340 - DNA, 23 bp, Homo sapiens
agtacatgtgcatgtgttttgtt

SEQ ID NO: 128341 - DNA, 22 bp, Homo sapiens
atgtgcacaacgtgcaggtttg

SEQ ID NO: 128342 - DNA, 23 bp, Homo sapiens
acatgtgctatgttggtgtgctg

SEQ ID NO: 128343 - DNA, 23 bp, Homo sapiens
acgtatgtatatatgtatgtgtg

SEQ ID NO: 128344 - DNA, 20 bp, Homo sapiens
atacacacacatatacatat

SEQ ID NO: 128345 - DNA, 19 bp, Homo sapiens
atcgcaaagcgtgtacact

SEQ ID NO: 128346 - DNA, 23 bp, Homo sapiens
aggctccttaactaatgttgtag

SEQ ID NO: 128347 - DNA, 21 bp, Homo sapiens
atccaggagtaacccaatgct

SEQ ID NO: 128348 - DNA, 23 bp, Homo sapiens
tacagaaaagagtctggacttgg

SEQ ID NO: 128349 - DNA, 20 bp, Homo sapiens
gtatgtatacatgtatgtac

SEQ ID NO: 128350 - DNA, 19 bp, Homo sapiens
gtctcactctgtcacccag

SEQ ID NO: 128351 - DNA, 22 bp, Homo sapiens
tatatcgatatagatataggta

SEQ ID NO: 128352 - DNA, 22 bp, Homo sapiens
acaggtttcagaatgagctcac

SEQ ID NO: 128353 - DNA, 23 bp, Homo sapiens
tgagttcattgtagattctggat

SEQ ID NO: 128354 - DNA, 23 bp, Homo sapiens
tgagttcattgtagattctggat

SEQ ID NO: 128355 - DNA, 19 bp, Homo sapiens
gaaagctctgtctctgtgt

SEQ ID NO: 128356 - DNA, 20 bp, Homo sapiens
atatgtgtatatatatatgt

SEQ ID NO: 128357 - DNA, 23 bp, Homo sapiens
gtcaattgcctttctctttgtct

SEQ ID NO: 128358 - DNA, 23 bp, Homo sapiens
tgacacaagacactgagaagata

SEQ ID NO: 128359 - DNA, 23 bp, Homo sapiens
gtgtgtgtctctgtgtgtatgcc

SEQ ID NO: 128360 - DNA, 23 bp, Homo sapiens
cttatgtatacatacatatgtgt

SEQ ID NO: 128361 - DNA, 23 bp, Homo sapiens
tatgtatgtatgtatacatgtgt

SEQ ID NO: 128362 - DNA, 21 bp, Homo sapiens
atgtatgtatacatgtgtgta

SEQ ID NO: 128363 - DNA, 18 bp, Homo sapiens
tggaacataacatggagt

SEQ ID NO: 128364 - DNA, 23 bp, Homo sapiens
acatgtatgttcaattgttcttt

SEQ ID NO: 128365 - DNA, 20 bp, Homo sapiens
atgcttaattattctttagt

SEQ ID NO: 128366 - DNA, 23 bp, Homo sapiens
ttacagtctcaccaatgcaacac

SEQ ID NO: 128367 - DNA, 23 bp, Homo sapiens
atatacacacacatatatgtgtg

SEQ ID NO: 128368 - DNA, 23 bp, Homo sapiens
gacagagtctcgctctgtcaccc

SEQ ID NO: 128369 - DNA, 23 bp, Homo sapiens
agatggagtctcactctgtcacc

SEQ ID NO: 128370 - DNA, 20 bp, Homo sapiens
tatatgtatatatgcataga

SEQ ID NO: 128371 - DNA, 23 bp, Homo sapiens
tgagttcattgtagattctggat

SEQ ID NO: 128372 - DNA, 23 bp, Homo sapiens
tgagttcattgtagattctggat

SEQ ID NO: 128373 - DNA, 23 bp, Homo sapiens
ggactcaggatagctgcctgtat

SEQ ID NO: 128374 - DNA, 23 bp, Homo sapiens
tgtgtgtatatatgtatatatgt

SEQ ID NO: 128375 - DNA, 23 bp, Homo sapiens
tattttacagtttatcataaaga

SEQ ID NO: 128376 - DNA, 23 bp, Homo sapiens
tatgaggtactactgtacagaat

SEQ ID NO: 128377 - DNA, 23 bp, Homo sapiens
gaatgttgagatctatacttgtt

SEQ ID NO: 128378 - DNA, 21 bp, Homo sapiens
tgtattctgcttgctttctct

SEQ ID NO: 128379 - DNA, 18 bp, Homo sapiens
gtgtatacctgtgtatgt

SEQ ID NO: 128380 - DNA, 20 bp, Homo sapiens
atttgtacatatacctacag

SEQ ID NO: 128381 - DNA, 23 bp, Homo sapiens
tatgagaatgtaatggcactgct

SEQ ID NO: 128382 - DNA, 23 bp, Homo sapiens
gtaaatgactactctttctgtac

SEQ ID NO: 128383 - DNA, 21 bp, Homo sapiens
tggtgtctgatttacataggg

SEQ ID NO: 128384 - DNA, 21 bp, Homo sapiens
atgacatctacatagtgcttg

SEQ ID NO: 128385 - DNA, 23 bp, Homo sapiens
attctgagagggaaatatctgct

SEQ ID NO: 128386 - DNA, 23 bp, Homo sapiens
atatgtgtacatatttgtgtgtg

SEQ ID NO: 128387 - DNA, 22 bp, Homo sapiens
ttaaaagtgcaagatatttttt

SEQ ID NO: 128388 - DNA, 19 bp, Homo sapiens
atagtttgtatatatctgt

SEQ ID NO: 128389 - DNA, 23 bp, Homo sapiens
tggatatatattctctataacta

SEQ ID NO: 128390 - DNA, 23 bp, Homo sapiens
tggatatatattctctataacta

SEQ ID NO: 128391 - DNA, 19 bp, Homo sapiens
tggatatatattctctata

SEQ ID NO: 128392 - DNA, 22 bp, Homo sapiens
tattctatataactatatgtga

SEQ ID NO: 128393 - DNA, 23 bp, Homo sapiens
tatactatatatgtatatatgtg

SEQ ID NO: 128394 - DNA, 20 bp, Homo sapiens
tataacaggatgtatatatc

SEQ ID NO: 128395 - DNA, 19 bp, Homo sapiens
tatatgtgtctgcataatt

SEQ ID NO: 128396 - DNA, 23 bp, Homo sapiens
tctgaattatgtatgcatatgca

SEQ ID NO: 128397 - DNA, 21 bp, Homo sapiens
agagagaagaatgagagctga

SEQ ID NO: 128398 - DNA, 20 bp, Homo sapiens
agatatgtaaattagcttga

SEQ ID NO: 128399 - DNA, 23 bp, Homo sapiens
ttgtttgcatatatatatgagtg

SEQ ID NO: 128400 - DNA, 23 bp, Homo sapiens
tgagttcattgtagattctggat

SEQ ID NO: 128401 - DNA, 23 bp, Homo sapiens
tgagttcattgtagattctggat

SEQ ID NO: 128402 - DNA, 23 bp, Homo sapiens
actgatatggcacgggctctttt

SEQ ID NO: 128403 - DNA, 20 bp, Homo sapiens
ttaacttaaagaatactgta

SEQ ID NO: 128404 - DNA, 22 bp, Homo sapiens
tcatgtcaaattgtaattctca

SEQ ID NO: 128405 - DNA, 18 bp, Homo sapiens
aaattgacaggtatatat

SEQ ID NO: 128406 - DNA, 20 bp, Homo sapiens
tgagttgatttttgtatatg

SEQ ID NO: 128407 - DNA, 23 bp, Homo sapiens
tatgtgtgtgtatatatatgtgt

SEQ ID NO: 128408 - DNA, 23 bp, Homo sapiens
gtctcactctgtgtctgtcagtg

SEQ ID NO: 128409 - DNA, 22 bp, Homo sapiens
tgtcatgatccagagactgtga

SEQ ID NO: 128410 - DNA, 23 bp, Homo sapiens
tgtttctgcaacagcttctgctt

SEQ ID NO: 128411 - DNA, 18 bp, Homo sapiens
tttgtctgttattgatgt

SEQ ID NO: 128412 - DNA, 20 bp, Homo sapiens
tactgtagagaatttaatga

SEQ ID NO: 128413 - DNA, 23 bp, Homo sapiens
tctctggctgtctgattcctggg

SEQ ID NO: 128414 - DNA, 22 bp, Homo sapiens
acagtgagtacagctggttgtg

SEQ ID NO: 128415 - DNA, 21 bp, Homo sapiens
tgtccttggctttcttctaga

SEQ ID NO: 128416 - DNA, 23 bp, Homo sapiens
tgagttcattgtagattctggat

SEQ ID NO: 128417 - DNA, 23 bp, Homo sapiens
tgagttcattgtagattctggat

SEQ ID NO: 128418 - DNA, 23 bp, Homo sapiens
cggagtctcgctctgtctcccag

SEQ ID NO: 128419 - DNA, 18 bp, Homo sapiens
tgaactgtgttagaagta

SEQ ID NO: 128420 - DNA, 23 bp, Homo sapiens
gtcagggtcagaagtgacagtgg

SEQ ID NO: 128421 - DNA, 23 bp, Homo sapiens
tatacacacacatatacagttgt

SEQ ID NO: 128422 - DNA, 23 bp, Homo sapiens
agacggtgtctcactctctgttg

SEQ ID NO: 128423 - DNA, 23 bp, Homo sapiens
agcttcttggtagtatagtcttg

SEQ ID NO: 128424 - DNA, 22 bp, Homo sapiens
gctcactctcagaagaggcttg

SEQ ID NO: 128425 - DNA, 23 bp, Homo sapiens
aaaactatgcagatagcttcctg

SEQ ID NO: 128426 - DNA, 19 bp, Homo sapiens
tttttggttatataatgtt

SEQ ID NO: 128427 - DNA, 23 bp, Homo sapiens
cccctgcctgtggagtctgcatg

SEQ ID NO: 128428 - DNA, 19 bp, Homo sapiens
tcgcaggaggcttcttggc

SEQ ID NO: 128429 - DNA, 22 bp, Homo sapiens
acattgctttatcatcctgtaa

SEQ ID NO: 128430 - DNA, 23 bp, Homo sapiens
ataactgatatggttttgctctg

SEQ ID NO: 128431 - DNA, 19 bp, Homo sapiens
atatgtatgtatatatatg

SEQ ID NO: 128432 - DNA, 23 bp, Homo sapiens
cagagtctcacactgtcacccag

SEQ ID NO: 128433 - DNA, 19 bp, Homo sapiens
tcaggcttaagttggtgaa

SEQ ID NO: 128434 - DNA, 23 bp, Homo sapiens
tgagttcattgtagattctggat

SEQ ID NO: 128435 - DNA, 23 bp, Homo sapiens
tgagttcattgtagattctggat

SEQ ID NO: 128436 - DNA, 23 bp, Homo sapiens
ggttacagtcagatgttagctga

SEQ ID NO: 128437 - DNA, 23 bp, Homo sapiens
tgagttcattgtagattctggat

SEQ ID NO: 128438 - DNA, 23 bp, Homo sapiens
tgagttcattgtagattctggat

SEQ ID NO: 128439 - DNA, 20 bp, Homo sapiens
aatatgtgcttgcatgtgtt

SEQ ID NO: 128440 - DNA, 22 bp, Homo sapiens
tgtgtgtctgtgtctgtatgtg

SEQ ID NO: 128441 - DNA, 22 bp, Homo sapiens
tatgtgtgctgtgtgtgcacat

SEQ ID NO: 128442 - DNA, 23 bp, Homo sapiens
ggagtcactcactctcagggtct

SEQ ID NO: 128443 - DNA, 23 bp, Homo sapiens
tctgagagtgagtgccaccttaa

SEQ ID NO: 128444 - DNA, 23 bp, Homo sapiens
agcttgttcttgtctcactgtct

SEQ ID NO: 128445 - DNA, 18 bp, Homo sapiens
tgattttgtacctggaaa

SEQ ID NO: 128446 - DNA, 22 bp, Homo sapiens
tttactgaatttgtttatcagt

SEQ ID NO: 128447 - DNA, 23 bp, Homo sapiens
ttttggtggattctttaggtttt

SEQ ID NO: 128448 - DNA, 22 bp, Homo sapiens
aaactgtggtatatatatgatg

SEQ ID NO: 128449 - DNA, 23 bp, Homo sapiens
tgtgacaaaggagaaggtccatg

SEQ ID NO: 128450 - DNA, 23 bp, Homo sapiens
tgagttcattgtagattctggat

SEQ ID NO: 128451 - DNA, 23 bp, Homo sapiens
tgagttcattgtagattctggat

SEQ ID NO: 128452 - DNA, 23 bp, Homo sapiens
gggtctctcgctctgtcacccag

SEQ ID NO: 128453 - DNA, 23 bp, Homo sapiens
aagtgctgagattacagatgtga

SEQ ID NO: 128454 - DNA, 23 bp, Homo sapiens
ttattctcattatgtagttgaga

SEQ ID NO: 128455 - DNA, 20 bp, Homo sapiens
catcagagagagtaacctgc

SEQ ID NO: 128456 - DNA, 23 bp, Homo sapiens
acagtctcactctgtcacccagg

SEQ ID NO: 128457 - DNA, 23 bp, Homo sapiens
tgagttcattgtagattctggat

SEQ ID NO: 128458 - DNA, 23 bp, Homo sapiens
tgagttcattgtagattctggat

SEQ ID NO: 128459 - DNA, 23 bp, Homo sapiens
tgagttcattgtagattctggat

SEQ ID NO: 128460 - DNA, 23 bp, Homo sapiens
tgagttcattgtagattctggat

SEQ ID NO: 128461 - DNA, 23 bp, Homo sapiens
aggcagagtctcactctgttgcc

SEQ ID NO: 128462 - DNA, 23 bp, Homo sapiens
tgagttcattgtagattctggat

SEQ ID NO: 128463 - DNA, 23 bp, Homo sapiens
tgagttcattgtagattctggat

SEQ ID NO: 128464 - DNA, 19 bp, Homo sapiens
atatatacacatacatatg

SEQ ID NO: 128465 - DNA, 18 bp, Homo sapiens
tatatgtgtatatatagt

SEQ ID NO: 128466 - DNA, 22 bp, Homo sapiens
tttgagaattgtctatgtcctt

SEQ ID NO: 128467 - DNA, 23 bp, Homo sapiens
ttctctccctctgacagagcaca

SEQ ID NO: 128468 - DNA, 23 bp, Homo sapiens
cagtcactgagtcctatggtgtc

SEQ ID NO: 128469 - DNA, 23 bp, Homo sapiens
cagggtctctctctgtcacccag

SEQ ID NO: 128470 - DNA, 22 bp, Homo sapiens
aaagtgtcagttttcctttctg

SEQ ID NO: 128471 - DNA, 23 bp, Homo sapiens
gaggagaactgattttcttgctt

SEQ ID NO: 128472 - DNA, 23 bp, Homo sapiens
tcagtgtgtactgtctttgatga

SEQ ID NO: 128473 - DNA, 23 bp, Homo sapiens
tacactcagaatggttaacatga

SEQ ID NO: 128474 - DNA, 22 bp, Homo sapiens
tttttttgagatgagagtctcg

SEQ ID NO: 128475 - DNA, 23 bp, Homo sapiens
tggagtctcgctctgtcacccag

SEQ ID NO: 128476 - DNA, 20 bp, Homo sapiens
cagtggtatgatcatggctc

SEQ ID NO: 128477 - DNA, 21 bp, Homo sapiens
tctgggtgacagagcgagact

SEQ ID NO: 128478 - DNA, 23 bp, Homo sapiens
agactgagtctcgctctgtcacc

SEQ ID NO: 128479 - DNA, 23 bp, Homo sapiens
tgagtctcactctgtcgccgagt

SEQ ID NO: 128480 - DNA, 19 bp, Homo sapiens
tgcaaaaaaatttaatgta

SEQ ID NO: 128481 - DNA, 23 bp, Homo sapiens
tgagttcattgtagattctggat

SEQ ID NO: 128482 - DNA, 23 bp, Homo sapiens
tgagttcattgtagattctggat

SEQ ID NO: 128483 - DNA, 23 bp, Homo sapiens
tttattggttccatttgaatttt

SEQ ID NO: 128484 - DNA, 23 bp, Homo sapiens
gtgagcaagagttgagaatatgt

SEQ ID NO: 128485 - DNA, 19 bp, Homo sapiens
tgcattagtccttattatg

SEQ ID NO: 128486 - DNA, 23 bp, Homo sapiens
cttctgtgacttttcctctgtgt

SEQ ID NO: 128487 - DNA, 23 bp, Homo sapiens
ttatgaagtgagagagcagagtt

SEQ ID NO: 128488 - DNA, 23 bp, Homo sapiens
tggacagagagctttggttgtga

SEQ ID NO: 128489 - DNA, 23 bp, Homo sapiens
tgagttcattgtagattctggat

SEQ ID NO: 128490 - DNA, 23 bp, Homo sapiens
tgagttcattgtagattctggat

SEQ ID NO: 128491 - DNA, 20 bp, Homo sapiens
agtggggcagagattctaca

SEQ ID NO: 128492 - DNA, 23 bp, Homo sapiens
tagtgtgtttctaattctgtgaa

SEQ ID NO: 128493 - DNA, 21 bp, Homo sapiens
aatgccaatggtagtttaatg

SEQ ID NO: 128494 - DNA, 23 bp, Homo sapiens
tcctgactctgaattgacatgct

SEQ ID NO: 128495 - DNA, 23 bp, Homo sapiens
cttcactctctgtcacaccctga

SEQ ID NO: 128496 - DNA, 23 bp, Homo sapiens
ctatcactgatctgattgcttca

SEQ ID NO: 128497 - DNA, 23 bp, Homo sapiens
tgagttcattgtagattctggat

SEQ ID NO: 128498 - DNA, 23 bp, Homo sapiens
tgagttcattgtagattctggat

SEQ ID NO: 128499 - DNA, 23 bp, Homo sapiens
tacatatgcatatatatactata

SEQ ID NO: 128500 - DNA, 20 bp, Homo sapiens
tatatggatatatactatac

SEQ ID NO: 128501 - DNA, 19 bp, Homo sapiens
tctggccaagatagtgact

SEQ ID NO: 128502 - DNA, 22 bp, Homo sapiens
tctttggagaacataaagatgt

SEQ ID NO: 128503 - DNA, 20 bp, Homo sapiens
tatgtgtacatatatatatc

SEQ ID NO: 128504 - DNA, 23 bp, Homo sapiens
ttgtgtatgtaaatgtttctgta

SEQ ID NO: 128505 - DNA, 23 bp, Homo sapiens
tgctcattgtatttcaatgtgaa

SEQ ID NO: 128506 - DNA, 23 bp, Homo sapiens
tgagttcattgtagattctggat

SEQ ID NO: 128507 - DNA, 23 bp, Homo sapiens
tgagttcattgtagattctggat

SEQ ID NO: 128508 - DNA, 23 bp, Homo sapiens
aattttcttgttgtaaatggcag

SEQ ID NO: 128509 - DNA, 23 bp, Homo sapiens
agccttgtagtgtggtttgaagt

SEQ ID NO: 128510 - DNA, 23 bp, Homo sapiens
actgtctgtgggtctctcagccg

SEQ ID NO: 128511 - DNA, 23 bp, Homo sapiens
agttaatgagagtgttttccttc

SEQ ID NO: 128512 - DNA, 23 bp, Homo sapiens
ttttttggttccatatgaaattt

SEQ ID NO: 128513 - DNA, 23 bp, Homo sapiens
gctaaactagtcaatatgttcaa

SEQ ID NO: 128514 - DNA, 23 bp, Homo sapiens
tctgtctatgtctgtgtcctaac

SEQ ID NO: 128515 - DNA, 22 bp, Homo sapiens
agactcagaagtgtgtctgcag

SEQ ID NO: 128516 - DNA, 23 bp, Homo sapiens
acagagtctcactctgtcgccca

SEQ ID NO: 128517 - DNA, 20 bp, Homo sapiens
tgaatgaacacagagaggac

SEQ ID NO: 128518 - DNA, 23 bp, Homo sapiens
ggagtctcactctgtcacccagg

SEQ ID NO: 128519 - DNA, 23 bp, Homo sapiens
tattagctgattatgacttgata

SEQ ID NO: 128520 - DNA, 23 bp, Homo sapiens
gggttcttgatcaggaagtcttt

SEQ ID NO: 128521 - DNA, 23 bp, Homo sapiens
tgtgtcagactgaccctctctca

SEQ ID NO: 128522 - DNA, 23 bp, Homo sapiens
tgtatagatcatgaatatgcatg

SEQ ID NO: 128523 - DNA, 23 bp, Homo sapiens
tgagttcattgtagattctggat

SEQ ID NO: 128524 - DNA, 23 bp, Homo sapiens
tgagttcattgtagattctggat

SEQ ID NO: 128525 - DNA, 23 bp, Homo sapiens
tctgtctcagttactatagatgg

SEQ ID NO: 128526 - DNA, 23 bp, Homo sapiens
acacattttaatgctgacagtgt

SEQ ID NO: 128527 - DNA, 18 bp, Homo sapiens
tgttgattgtgtatcctg

SEQ ID NO: 128528 - DNA, 23 bp, Homo sapiens
aaattttttggtggagttttacg

SEQ ID NO: 128529 - DNA, 20 bp, Homo sapiens
tatatatgagattatgttgt

SEQ ID NO: 128530 - DNA, 23 bp, Homo sapiens
accctggctccctgcatccctga

SEQ ID NO: 128531 - DNA, 23 bp, Homo sapiens
tgagttcattgtagattctggat

SEQ ID NO: 128532 - DNA, 23 bp, Homo sapiens
tgagttcattgtagattctggat

SEQ ID NO: 128533 - DNA, 23 bp, Homo sapiens
tgaaattctgcttggaaatcaga

SEQ ID NO: 128534 - DNA, 23 bp, Homo sapiens
ttacaaaggaaatttagttgtag

SEQ ID NO: 128535 - DNA, 23 bp, Homo sapiens
gctgaggtagttgtttctttgct

SEQ ID NO: 128536 - DNA, 23 bp, Homo sapiens
gtttctccctctccatgtggtct

SEQ ID NO: 128537 - DNA, 20 bp, Homo sapiens
tctggttttaaaatcagaaa

SEQ ID NO: 128538 - DNA, 20 bp, Homo sapiens
tgaataacaaggctttttct

SEQ ID NO: 128539 - DNA, 23 bp, Homo sapiens
acagagtctcgctctgtcaccca

SEQ ID NO: 128540 - DNA, 23 bp, Homo sapiens
cttgttgagcaaatctattggga

SEQ ID NO: 128541 - DNA, 22 bp, Homo sapiens
tgcctccctcactgcgtgggtg

SEQ ID NO: 128542 - DNA, 18 bp, Homo sapiens
tgtgttttccaagctttt

SEQ ID NO: 128543 - DNA, 23 bp, Homo sapiens
acaatgggtctgtggctcactct

SEQ ID NO: 128544 - DNA, 23 bp, Homo sapiens
tatcgttttgatatgctgttgga

SEQ ID NO: 128545 - DNA, 22 bp, Homo sapiens
ttaggtagtatgttgtagagaa

SEQ ID NO: 128546 - DNA, 22 bp, Homo sapiens
tgcacatgacacacacacactt

SEQ ID NO: 128547 - DNA, 21 bp, Homo sapiens
tgaccatatatatacatatga

SEQ ID NO: 128548 - DNA, 21 bp, Homo sapiens
atatgtatatatgtatatgtg

SEQ ID NO: 128549 - DNA, 23 bp, Homo sapiens
tatatgaccatatatatggacat

SEQ ID NO: 128550 - DNA, 23 bp, Homo sapiens
gggtctcactctgtcactcaggc

SEQ ID NO: 128551 - DNA, 23 bp, Homo sapiens
cattcacttgaacctgctgtgtt

SEQ ID NO: 128552 - DNA, 23 bp, Homo sapiens
gattgtcgtggctatgcaggctc

SEQ ID NO: 128553 - DNA, 23 bp, Homo sapiens
tgagttcattgtagattctggat

SEQ ID NO: 128554 - DNA, 23 bp, Homo sapiens
tgagttcattgtagattctggat

SEQ ID NO: 128555 - DNA, 23 bp, Homo sapiens
tgtcaggaaggtgttggagtcct

SEQ ID NO: 128556 - DNA, 23 bp, Homo sapiens
cggagtctcactctgtcacccag

SEQ ID NO: 128557 - DNA, 23 bp, Homo sapiens
gagtctcactctgtcacccaggc

SEQ ID NO: 128558 - DNA, 23 bp, Homo sapiens
aataggaggtgtttatgtcatag

SEQ ID NO: 128559 - DNA, 23 bp, Homo sapiens
attcaggtatttttttcttaatt

SEQ ID NO: 128560 - DNA, 21 bp, Homo sapiens
tatttatttatgaggtacatg

SEQ ID NO: 128561 - DNA, 23 bp, Homo sapiens
tgagatcatggtgtctctgtgtg

SEQ ID NO: 128562 - DNA, 23 bp, Homo sapiens
tgagttcattgtagattctggat

SEQ ID NO: 128563 - DNA, 23 bp, Homo sapiens
tgagttcattgtagattctggat

SEQ ID NO: 128564 - DNA, 23 bp, Homo sapiens
cggagtctcactctgtcacccag

SEQ ID NO: 128565 - DNA, 23 bp, Homo sapiens
gagtctcactctgtcacccaggc

SEQ ID NO: 128566 - DNA, 23 bp, Homo sapiens
tcaggctgtctgtctgcctctca

SEQ ID NO: 128567 - DNA, 23 bp, Homo sapiens
gtgagtggagtgtgagcagagag

SEQ ID NO: 128568 - DNA, 23 bp, Homo sapiens
taaagtgatgatgatgttgttta

SEQ ID NO: 128569 - DNA, 20 bp, Homo sapiens
tgatatagtaatggaggaaa

SEQ ID NO: 128570 - DNA, 21 bp, Homo sapiens
ttttctttccaactaaatcca

SEQ ID NO: 128571 - DNA, 23 bp, Homo sapiens
gacagagtctcgctctgtcaccc

SEQ ID NO: 128572 - DNA, 18 bp, Homo sapiens
aagagtggattctgttgt

SEQ ID NO: 128573 - DNA, 23 bp, Homo sapiens
tggaactgcattagcatgtgtac

SEQ ID NO: 128574 - DNA, 23 bp, Homo sapiens
ctacacagcctctctctctctct

SEQ ID NO: 128575 - DNA, 21 bp, Homo sapiens
tgtgcctgagagatttgcgaa

SEQ ID NO: 128576 - DNA, 22 bp, Homo sapiens
tagagaagtgtctgagcacatg

SEQ ID NO: 128577 - DNA, 23 bp, Homo sapiens
tgagttcattgtagattctggat

SEQ ID NO: 128578 - DNA, 23 bp, Homo sapiens
tgagttcattgtagattctggat

SEQ ID NO: 128579 - DNA, 22 bp, Homo sapiens
gtaggaggatcacttgagcctg

SEQ ID NO: 128580 - DNA, 22 bp, Homo sapiens
agtgattgtacctgcactccag

SEQ ID NO: 128581 - DNA, 23 bp, Homo sapiens
atatacatgtaaataaaatgtgt

SEQ ID NO: 128582 - DNA, 21 bp, Homo sapiens
tatagcatatattagtaagca

SEQ ID NO: 128583 - DNA, 21 bp, Homo sapiens
gagtacacagactagtaggtg

SEQ ID NO: 128584 - DNA, 23 bp, Homo sapiens
actgtagtagtcccagcaactca

SEQ ID NO: 128585 - DNA, 21 bp, Homo sapiens
acagtgagatactgtctcaaa

SEQ ID NO: 128586 - DNA, 20 bp, Homo sapiens
agacagggtcttactctgtc

SEQ ID NO: 128587 - DNA, 23 bp, Homo sapiens
aggtgtgctacatgtttgtttat

SEQ ID NO: 128588 - DNA, 21 bp, Homo sapiens
ttaagtgaggctctttttttt

SEQ ID NO: 128589 - DNA, 21 bp, Homo sapiens
ctctactgccagcattagcag

SEQ ID NO: 128590 - DNA, 22 bp, Homo sapiens
ttcaagactagtgaaattccat

SEQ ID NO: 128591 - DNA, 21 bp, Homo sapiens
tttgagacacggtctggtctg

SEQ ID NO: 128592 - DNA, 23 bp, Homo sapiens
agtcagtctgaatatcaactcca

SEQ ID NO: 128593 - DNA, 22 bp, Homo sapiens
ccagcccctttcattcttcaga

SEQ ID NO: 128594 - DNA, 22 bp, Homo sapiens
agacaagctcctagtgggcact

SEQ ID NO: 128595 - DNA, 20 bp, Homo sapiens
cctgtagtcccagctatgtg

SEQ ID NO: 128596 - DNA, 21 bp, Homo sapiens
ttaatgctatttaattcagct

SEQ ID NO: 128597 - DNA, 23 bp, Homo sapiens
tttgagtgacttgtgcgtagtga

SEQ ID NO: 128598 - DNA, 23 bp, Homo sapiens
tgtgtatgtatatgtatatatgt

SEQ ID NO: 128599 - DNA, 23 bp, Homo sapiens
tgagttcattgtagattctggat

SEQ ID NO: 128600 - DNA, 23 bp, Homo sapiens
tgagttcattgtagattctggat

SEQ ID NO: 128601 - DNA, 23 bp, Homo sapiens
tctgagatcaaggtgtcagcagg

SEQ ID NO: 128602 - DNA, 21 bp, Homo sapiens
tgtgaagaagcactggtgatg

SEQ ID NO: 128603 - DNA, 22 bp, Homo sapiens
agtctctggctctcaggctcag

SEQ ID NO: 128604 - DNA, 21 bp, Homo sapiens
ctcccaagtagctgagattgc

SEQ ID NO: 128605 - DNA, 22 bp, Homo sapiens
aattgtcttactctcactgtca

SEQ ID NO: 128606 - DNA, 23 bp, Homo sapiens
atatgtgtgtatatatatgtgtg

SEQ ID NO: 128607 - DNA, 18 bp, Homo sapiens
catgaccctcagtctcac

SEQ ID NO: 128608 - DNA, 23 bp, Homo sapiens
atatgtgtgtatatatatgtttc

SEQ ID NO: 128609 - DNA, 23 bp, Homo sapiens
atggtatttaaagaactatgcag

SEQ ID NO: 128610 - DNA, 18 bp, Homo sapiens
tgtgtgtgtgtgtatata

SEQ ID NO: 128611 - DNA, 22 bp, Homo sapiens
aaatcaaataaaggaaaggatg

SEQ ID NO: 128612 - DNA, 20 bp, Homo sapiens
atgtggatatatgtacaata

SEQ ID NO: 128613 - DNA, 23 bp, Homo sapiens
tatcctcaaccatctactttgag

SEQ ID NO: 128614 - DNA, 23 bp, Homo sapiens
tgtagtgctagctgtttgggagg

SEQ ID NO: 128615 - DNA, 23 bp, Homo sapiens
agtttgaggttacagagatgtat

SEQ ID NO: 128616 - DNA, 23 bp, Homo sapiens
tatgtgacaggtactattctttt

SEQ ID NO: 128617 - DNA, 23 bp, Homo sapiens
aacagagtctcgctctgtcaccc

SEQ ID NO: 128618 - DNA, 20 bp, Homo sapiens
tgtctatttgagtaaaaggc

SEQ ID NO: 128619 - DNA, 21 bp, Homo sapiens
aaaactccaattaatagagca

SEQ ID NO: 128620 - DNA, 23 bp, Homo sapiens
cattgtttattgtgcacattgga

SEQ ID NO: 128621 - DNA, 23 bp, Homo sapiens
acagggacagattaactggacag

SEQ ID NO: 128622 - DNA, 23 bp, Homo sapiens
tgagttcattgtagattctggat

SEQ ID NO: 128623 - DNA, 23 bp, Homo sapiens
tgagttcattgtagattctggat

SEQ ID NO: 128624 - DNA, 23 bp, Homo sapiens
tggtgtccatgacttttcctttg

SEQ ID NO: 128625 - DNA, 23 bp, Homo sapiens
tttttgggttccatatgaaattt

SEQ ID NO: 128626 - DNA, 21 bp, Homo sapiens
tagttttattctaattctgtg

SEQ ID NO: 128627 - DNA, 23 bp, Homo sapiens
tgagttcattgtagattctggat

SEQ ID NO: 128628 - DNA, 23 bp, Homo sapiens
tgagttcattgtagattctggat

SEQ ID NO: 128629 - DNA, 21 bp, Homo sapiens
atacacatatgtatatatgtg

SEQ ID NO: 128630 - DNA, 21 bp, Homo sapiens
tacatatatatgcatatatgt

SEQ ID NO: 128631 - DNA, 21 bp, Homo sapiens
taatgtcaaattggagaatgt

SEQ ID NO: 128632 - DNA, 23 bp, Homo sapiens
agttctctctctctctctgcgtg

SEQ ID NO: 128633 - DNA, 23 bp, Homo sapiens
tgagttcattgtagattctggat

SEQ ID NO: 128634 - DNA, 23 bp, Homo sapiens
tgagttcattgtagattctggat

SEQ ID NO: 128635 - DNA, 19 bp, Homo sapiens
gtctcgctctgtcacccag

SEQ ID NO: 128636 - DNA, 23 bp, Homo sapiens
aaggagtcagattaaattcactg

SEQ ID NO: 128637 - DNA, 23 bp, Homo sapiens
agcctgggagcttttgtacacta

SEQ ID NO: 128638 - DNA, 23 bp, Homo sapiens
tcatctgatgagagcctgctttt

SEQ ID NO: 128639 - DNA, 23 bp, Homo sapiens
taaagacagttctatggaagagt

SEQ ID NO: 128640 - DNA, 23 bp, Homo sapiens
ccccagtcaatcctgtgtcagcc

SEQ ID NO: 128641 - DNA, 23 bp, Homo sapiens
agaatatgtggtagtgagttatt

SEQ ID NO: 128642 - DNA, 23 bp, Homo sapiens
atagaggtattcatggatagtga

SEQ ID NO: 128643 - DNA, 21 bp, Homo sapiens
aatgacagctagttacaggct

SEQ ID NO: 128644 - DNA, 23 bp, Homo sapiens
atagtgtgtgtatatatatgtat

SEQ ID NO: 128645 - DNA, 23 bp, Homo sapiens
tgctagatcagggatttggaata

SEQ ID NO: 128646 - DNA, 23 bp, Homo sapiens
taatgtttcctttagtatagcta

SEQ ID NO: 128647 - DNA, 18 bp, Homo sapiens
tgtatatatatatgtgtg

SEQ ID NO: 128648 - DNA, 23 bp, Homo sapiens
tctcggctcactgtaactctgtc

SEQ ID NO: 128649 - DNA, 23 bp, Homo sapiens
attgatgtacatagtatttttgt

SEQ ID NO: 128650 - DNA, 21 bp, Homo sapiens
tataactagtactatgtccat

SEQ ID NO: 128651 - DNA, 23 bp, Homo sapiens
tgtgtgtgtgtgtgtgtataata

SEQ ID NO: 128652 - DNA, 22 bp, Homo sapiens
ggaaagatttctctgtagcatg

SEQ ID NO: 128653 - DNA, 23 bp, Homo sapiens
tgtgcattgattttgtatcctga

SEQ ID NO: 128654 - DNA, 23 bp, Homo sapiens
tgaactggattatcttaagtaga

SEQ ID NO: 128655 - DNA, 23 bp, Homo sapiens
cttgagagatctgaatcaggaaa

SEQ ID NO: 128656 - DNA, 21 bp, Homo sapiens
actctctctttgtgtctctgc

SEQ ID NO: 128657 - DNA, 20 bp, Homo sapiens
aggaagaatctaagattctt

SEQ ID NO: 128658 - DNA, 21 bp, Homo sapiens
tcagagttttagagtctttct

SEQ ID NO: 128659 - DNA, 23 bp, Homo sapiens
ctctgtctgactctctacttggt

SEQ ID NO: 128660 - DNA, 23 bp, Homo sapiens
tatatgctgaatgttgtagtagg

SEQ ID NO: 128661 - DNA, 21 bp, Homo sapiens
ttcagggaaggaagtgatgag

SEQ ID NO: 128662 - DNA, 22 bp, Homo sapiens
actctgtctcccagactagagt

SEQ ID NO: 128663 - DNA, 18 bp, Homo sapiens
gcgtgtactgggtgctgg

SEQ ID NO: 128664 - DNA, 18 bp, Homo sapiens
ttatggatgttttcgaaa

SEQ ID NO: 128665 - DNA, 18 bp, Homo sapiens
tgttttgttttgtttttg

SEQ ID NO: 128666 - DNA, 23 bp, Homo sapiens
tcagtctcaattacttgacattc

SEQ ID NO: 128667 - DNA, 21 bp, Homo sapiens
tacacagtaccaatgttggga

SEQ ID NO: 128668 - DNA, 23 bp, Homo sapiens
gtgtgtgtatgtatatatgtgtg

SEQ ID NO: 128669 - DNA, 23 bp, Homo sapiens
tgtctgtgtgtacatgtgtgtgt

SEQ ID NO: 128670 - DNA, 23 bp, Homo sapiens
gagacggtgtctcactctgtcac

SEQ ID NO: 128671 - DNA, 23 bp, Homo sapiens
ttactggggtcagtctctctctc

SEQ ID NO: 128672 - DNA, 23 bp, Homo sapiens
aaagttcatgatcaaggcagatt

SEQ ID NO: 128673 - DNA, 23 bp, Homo sapiens
tggagtctcactctgtcacccag

SEQ ID NO: 128674 - DNA, 23 bp, Homo sapiens
acaaggtctgcctctgtcactca

SEQ ID NO: 128675 - DNA, 23 bp, Homo sapiens
tgagttcattgtagattctggat

SEQ ID NO: 128676 - DNA, 23 bp, Homo sapiens
tgagttcattgtagattctggat

SEQ ID NO: 128677 - DNA, 21 bp, Homo sapiens
tttacactgaactggcttctg

SEQ ID NO: 128678 - DNA, 22 bp, Homo sapiens
taagcatatatatgtatatgtg

SEQ ID NO: 128679 - DNA, 22 bp, Homo sapiens
tctccttgagactctgtcacct

SEQ ID NO: 128680 - DNA, 23 bp, Homo sapiens
tgagttcattgtagattctggat

SEQ ID NO: 128681 - DNA, 23 bp, Homo sapiens
tgagttcattgtagattctggat

SEQ ID NO: 128682 - DNA, 23 bp, Homo sapiens
gtgcgtgtgtgtgtgcctgcgtg

SEQ ID NO: 128683 - DNA, 23 bp, Homo sapiens
tggcacgctctctgagtgtcttt

SEQ ID NO: 128684 - DNA, 23 bp, Homo sapiens
atgtgtgtgtgtatgttatatgt

SEQ ID NO: 128685 - DNA, 21 bp, Homo sapiens
tatgtgtgtgtatatatatac

SEQ ID NO: 128686 - DNA, 22 bp, Homo sapiens
gagacagcagtgagacagcagt

SEQ ID NO: 128687 - DNA, 21 bp, Homo sapiens
ttgagagagtggatttgttat

SEQ ID NO: 128688 - DNA, 22 bp, Homo sapiens
aagatgatattgttttgtattt

SEQ ID NO: 128689 - DNA, 23 bp, Homo sapiens
ctctgtaaacactctggtcatat

SEQ ID NO: 128690 - DNA, 23 bp, Homo sapiens
tgagttcattgtagattctggat

SEQ ID NO: 128691 - DNA, 23 bp, Homo sapiens
tgagttcattgtagattctggat

SEQ ID NO: 128692 - DNA, 20 bp, Homo sapiens
tgcgtgtgtgtgtgtatata

SEQ ID NO: 128693 - DNA, 23 bp, Homo sapiens
atgtgtatatatgtatatatgtg

SEQ ID NO: 128694 - DNA, 23 bp, Homo sapiens
tgagttcattgtagattctggat

SEQ ID NO: 128695 - DNA, 23 bp, Homo sapiens
tgagttcattgtagattctggat

SEQ ID NO: 128696 - DNA, 23 bp, Homo sapiens
gtctttctcacttaatcttggct

SEQ ID NO: 128697 - DNA, 23 bp, Homo sapiens
tgattgagaggctttgatgtaac

SEQ ID NO: 128698 - DNA, 23 bp, Homo sapiens
actgactcagtctgtgttctagg

SEQ ID NO: 128699 - DNA, 23 bp, Homo sapiens
gtgtttgaatgtatatatgtgtg

SEQ ID NO: 128700 - DNA, 23 bp, Homo sapiens
agagtctcactctgtcacccagg

SEQ ID NO: 128701 - DNA, 23 bp, Homo sapiens
gagtctcactctgtcacccaggc

SEQ ID NO: 128702 - DNA, 23 bp, Homo sapiens
gagtcaggtagtttttaggccat

SEQ ID NO: 128703 - DNA, 23 bp, Homo sapiens
aacaacatttgcatatctcatct

SEQ ID NO: 128704 - DNA, 23 bp, Homo sapiens
tttgagattctggttgtagtttc

SEQ ID NO: 128705 - DNA, 23 bp, Homo sapiens
tgtattagattccattagttgag

SEQ ID NO: 128706 - DNA, 20 bp, Homo sapiens
ttgagtcttcagatgtttcc

SEQ ID NO: 128707 - DNA, 23 bp, Homo sapiens
taagtttagtgaggaaagcatgt

SEQ ID NO: 128708 - DNA, 21 bp, Homo sapiens
tatgtgtgtgtatatatgtgt

SEQ ID NO: 128709 - DNA, 23 bp, Homo sapiens
tgagactcagcacattcctggct

SEQ ID NO: 128710 - DNA, 23 bp, Homo sapiens
tgagttcattgtagattctggat

SEQ ID NO: 128711 - DNA, 23 bp, Homo sapiens
actgcagtgagccatgatcatac

SEQ ID NO: 128712 - DNA, 23 bp, Homo sapiens
ccaatgttaagtgataatgttgt

SEQ ID NO: 128713 - DNA, 21 bp, Homo sapiens
tggatactacttggaaagtca

SEQ ID NO: 128714 - DNA, 23 bp, Homo sapiens
ctgctctgtctctgagttcattc

SEQ ID NO: 128715 - DNA, 23 bp, Homo sapiens
actgaatattgaaagctcagtca

SEQ ID NO: 128716 - DNA, 23 bp, Homo sapiens
tatatgtatatgaatatgtacac

SEQ ID NO: 128717 - DNA, 19 bp, Homo sapiens
atatatgtatatgaatatg

SEQ ID NO: 128718 - DNA, 23 bp, Homo sapiens
tggagtctcactctgtcacccag

SEQ ID NO: 128719 - DNA, 23 bp, Homo sapiens
aatctatggcagggatgaagtgg

SEQ ID NO: 128720 - DNA, 23 bp, Homo sapiens
cagagtctcactctgtcgctcag

SEQ ID NO: 128721 - DNA, 19 bp, Homo sapiens
tgtgtgtatatatatgtat

SEQ ID NO: 128722 - DNA, 23 bp, Homo sapiens
tatatgtgtgtatatatatgtat

SEQ ID NO: 128723 - DNA, 23 bp, Homo sapiens
tgtatatacatatatgtgtgtgt

SEQ ID NO: 128724 - DNA, 22 bp, Homo sapiens
tatatgtgtgtgtgtatatatg

SEQ ID NO: 128725 - DNA, 23 bp, Homo sapiens
gtgccagtctgtgtgcgtgtgtg

SEQ ID NO: 128726 - DNA, 23 bp, Homo sapiens
cagagtctcgctctgtcacccca

SEQ ID NO: 128727 - DNA, 23 bp, Homo sapiens
atccatgttgcaattgacatgat

SEQ ID NO: 128728 - DNA, 20 bp, Homo sapiens
tttcctttggttttcttgag

SEQ ID NO: 128729 - DNA, 18 bp, Homo sapiens
atatgtttgtatatatag

SEQ ID NO: 128730 - DNA, 23 bp, Homo sapiens
cagagtctcactctgtcgctcag

SEQ ID NO: 128731 - DNA, 22 bp, Homo sapiens
tctgagttgaagaattctatat

SEQ ID NO: 128732 - DNA, 23 bp, Homo sapiens
tccaactgtctctctatctgacc

SEQ ID NO: 128733 - DNA, 19 bp, Homo sapiens
agagtttctttcttttttt

SEQ ID NO: 128734 - DNA, 19 bp, Homo sapiens
tgagagagagtctcactct

SEQ ID NO: 128735 - DNA, 23 bp, Homo sapiens
tcacaatagtgagtgaggtcttg

SEQ ID NO: 128736 - DNA, 23 bp, Homo sapiens
tgagttcattgtagattctggat

SEQ ID NO: 128737 - DNA, 23 bp, Homo sapiens
tgagttcattgtagattctggat

SEQ ID NO: 128738 - DNA, 22 bp, Homo sapiens
gtcatgcatatgtacacatata

SEQ ID NO: 128739 - DNA, 20 bp, Homo sapiens
acacatatgtatacatatgt

SEQ ID NO: 128740 - DNA, 18 bp, Homo sapiens
tgaccaacatagtgaaac

SEQ ID NO: 128741 - DNA, 20 bp, Homo sapiens
tgagacagagtctcgctctg

SEQ ID NO: 128742 - DNA, 21 bp, Homo sapiens
tttctctgtcagtgtttttgc

SEQ ID NO: 128743 - DNA, 22 bp, Homo sapiens
ctggctggctggctggctggct

SEQ ID NO: 128744 - DNA, 23 bp, Homo sapiens
agagaagatagtttcctctggtt

SEQ ID NO: 128745 - DNA, 23 bp, Homo sapiens
acaaggtctcactctgtcaccca

SEQ ID NO: 128746 - DNA, 23 bp, Homo sapiens
tgcagtgttgtgatcttggctca

SEQ ID NO: 128747 - DNA, 20 bp, Homo sapiens
aaagtgaggaaagtgaaacc

SEQ ID NO: 128748 - DNA, 23 bp, Homo sapiens
actgacactttcacaaattaggt

SEQ ID NO: 128749 - DNA, 23 bp, Homo sapiens
tgagttcattgtagattctggat

SEQ ID NO: 128750 - DNA, 23 bp, Homo sapiens
tgagttcattgtagattctggat

SEQ ID NO: 128751 - DNA, 22 bp, Homo sapiens
taatgagaggttgagatcacac

SEQ ID NO: 128752 - DNA, 23 bp, Homo sapiens
tgctttcactctctccatctctg

SEQ ID NO: 128753 - DNA, 23 bp, Homo sapiens
acagagaagaccctgagctcagg

SEQ ID NO: 128754 - DNA, 23 bp, Homo sapiens
gtttccatcctgtgcctctctac

SEQ ID NO: 128755 - DNA, 23 bp, Homo sapiens
gtctctctcagcctcagtgagca

SEQ ID NO: 128756 - DNA, 18 bp, Homo sapiens
attgcatattatattgta

SEQ ID NO: 128757 - DNA, 21 bp, Homo sapiens
ataaggtgattttgttgttgt

SEQ ID NO: 128758 - DNA, 21 bp, Homo sapiens
caaacagcatagagtgtactt

SEQ ID NO: 128759 - DNA, 23 bp, Homo sapiens
ttttttggttccatatgaaattt

SEQ ID NO: 128760 - DNA, 20 bp, Homo sapiens
tagcttgatgagaatagcat

SEQ ID NO: 128761 - DNA, 23 bp, Homo sapiens
gtgtgtgtgtgcatgtgcttgtg

SEQ ID NO: 128762 - DNA, 23 bp, Homo sapiens
acaatttgttgagtagagtgtca

SEQ ID NO: 128763 - DNA, 21 bp, Homo sapiens
tcggagtctcgctctgtcacc

SEQ ID NO: 128764 - DNA, 23 bp, Homo sapiens
tgagttcattgtagattctggat

SEQ ID NO: 128765 - DNA, 23 bp, Homo sapiens
tgagttcattgtagattctggat

SEQ ID NO: 128766 - DNA, 23 bp, Homo sapiens
cagctatctacttgtgccccagg

SEQ ID NO: 128767 - DNA, 23 bp, Homo sapiens
acttgtctgggtcctggagcctt

SEQ ID NO: 128768 - DNA, 23 bp, Homo sapiens
actatgtctgtctctctcttccc

SEQ ID NO: 128769 - DNA, 23 bp, Homo sapiens
tcaggcacagtcacaggaagtgt

SEQ ID NO: 128770 - DNA, 21 bp, Homo sapiens
tcttgcagtgtttttcatgta

SEQ ID NO: 128771 - DNA, 23 bp, Homo sapiens
tgagatggagtcccactcactct

SEQ ID NO: 128772 - DNA, 22 bp, Homo sapiens
atacgtatatatatatgtgtgt

SEQ ID NO: 128773 - DNA, 22 bp, Homo sapiens
tacgtgtatatatatatatgtg

SEQ ID NO: 128774 - DNA, 23 bp, Homo sapiens
gacagagtctcgctctgtcgctc

SEQ ID NO: 128775 - DNA, 23 bp, Homo sapiens
gggtctcactctgtcacccaggc

SEQ ID NO: 128776 - DNA, 22 bp, Homo sapiens
gtacttttcaatgcataaagca

SEQ ID NO: 128777 - DNA, 18 bp, Homo sapiens
tggaaccagaaggtgtgt

SEQ ID NO: 128778 - DNA, 23 bp, Homo sapiens
ttaaggaactttactctttgtta

SEQ ID NO: 128779 - DNA, 18 bp, Homo sapiens
tagtcctagcccctagag

SEQ ID NO: 128780 - DNA, 21 bp, Homo sapiens
aggagtttgaggttacagtga

SEQ ID NO: 128781 - DNA, 23 bp, Homo sapiens
ttttgttgagactggagagatgg

SEQ ID NO: 128782 - DNA, 21 bp, Homo sapiens
agagcaacatgatctcataga

SEQ ID NO: 128783 - DNA, 23 bp, Homo sapiens
agacagggtctcactgtgtcacc

SEQ ID NO: 128784 - DNA, 22 bp, Homo sapiens
tgaaataaattgaagctttgtg

SEQ ID NO: 128785 - DNA, 22 bp, Homo sapiens
tgggaccctccctccatgcgtg

SEQ ID NO: 128786 - DNA, 23 bp, Homo sapiens
ctactgtctgtgtctgagtgttc

SEQ ID NO: 128787 - DNA, 23 bp, Homo sapiens
tgagttcattgtagattctggat

SEQ ID NO: 128788 - DNA, 23 bp, Homo sapiens
tgagttcattgtagattctggat

SEQ ID NO: 128789 - DNA, 22 bp, Homo sapiens
agtgatcaaggtgaaagcaaga

SEQ ID NO: 128790 - DNA, 23 bp, Homo sapiens
atttatggtgattttcctgttct

SEQ ID NO: 128791 - DNA, 23 bp, Homo sapiens
tatttacctcttattgttcttca

SEQ ID NO: 128792 - DNA, 23 bp, Homo sapiens
tgagttcattgtagattctggat

SEQ ID NO: 128793 - DNA, 23 bp, Homo sapiens
tgagttcattgtagattctggat

SEQ ID NO: 128794 - DNA, 20 bp, Homo sapiens
tccgtgtgtgtgtatatata

SEQ ID NO: 128795 - DNA, 23 bp, Homo sapiens
tacatgtgcatgtgtgtgtgtgt

SEQ ID NO: 128796 - DNA, 23 bp, Homo sapiens
tctcacactgcctctgactttgg

SEQ ID NO: 128797 - DNA, 23 bp, Homo sapiens
gtgagttctcactctgtgagttc

SEQ ID NO: 128798 - DNA, 23 bp, Homo sapiens
tgcttcaccagggttatcttgct

SEQ ID NO: 128799 - DNA, 23 bp, Homo sapiens
atgtgtatatatatatatgtgtg

SEQ ID NO: 128800 - DNA, 22 bp, Homo sapiens
gtgtgtgtatatatatgtgtgt

SEQ ID NO: 128801 - DNA, 22 bp, Homo sapiens
tgtgataaaagctatgtaacca

SEQ ID NO: 128802 - DNA, 21 bp, Homo sapiens
agtatatctatagcatatata

SEQ ID NO: 128803 - DNA, 19 bp, Homo sapiens
acactatatatatagagat

SEQ ID NO: 128804 - DNA, 22 bp, Homo sapiens
atctgcatatatatgtgtgtgt

SEQ ID NO: 128805 - DNA, 22 bp, Homo sapiens
tgcttcacagtaactctggaca

SEQ ID NO: 128806 - DNA, 23 bp, Homo sapiens
tttacagagaagagtgacaggtc

SEQ ID NO: 128807 - DNA, 23 bp, Homo sapiens
catctgcatgtatatgtgtgtgt

SEQ ID NO: 128808 - DNA, 21 bp, Homo sapiens
agacacacacacatatatgtg

SEQ ID NO: 128809 - DNA, 21 bp, Homo sapiens
atacagcatcttcaagtggtg

SEQ ID NO: 128810 - DNA, 18 bp, Homo sapiens
actgaggcagctaagctt

SEQ ID NO: 128811 - DNA, 23 bp, Homo sapiens
aagagtcccactctgactcccag

SEQ ID NO: 128812 - DNA, 19 bp, Homo sapiens
ctgatggtctcgatctctt

SEQ ID NO: 128813 - DNA, 23 bp, Homo sapiens
cagagtctcgctctgtcgctcag

SEQ ID NO: 128814 - DNA, 23 bp, Homo sapiens
tctccttcactcactgtctgaca

SEQ ID NO: 128815 - DNA, 23 bp, Homo sapiens
tgattcactgtgacaatagactg

SEQ ID NO: 128816 - DNA, 21 bp, Homo sapiens
attctgtaattctgtctccta

SEQ ID NO: 128817 - DNA, 21 bp, Homo sapiens
gtaagaccagaacgaagtgat

SEQ ID NO: 128818 - DNA, 23 bp, Homo sapiens
ctgtttcagcttctgcttttgga

SEQ ID NO: 128819 - DNA, 23 bp, Homo sapiens
acagaagcaagttgaaagcagaa

SEQ ID NO: 128820 - DNA, 23 bp, Homo sapiens
tttggtgaagaaagtgaatggta

SEQ ID NO: 128821 - DNA, 23 bp, Homo sapiens
ggcctctctctctctctctgatg

SEQ ID NO: 128822 - DNA, 23 bp, Homo sapiens
cagtggtgtgatcttggctcact

SEQ ID NO: 128823 - DNA, 23 bp, Homo sapiens
tgtgtgtatatgtatgtgtatgt

SEQ ID NO: 128824 - DNA, 21 bp, Homo sapiens
taaagggtgggaaggaaaggt

SEQ ID NO: 128825 - DNA, 23 bp, Homo sapiens
taacactggttttttgtttgagt

SEQ ID NO: 128826 - DNA, 23 bp, Homo sapiens
agtctcactctgtcacccaggct

SEQ ID NO: 128827 - DNA, 23 bp, Homo sapiens
aatggtgtgatcttggctcactg

SEQ ID NO: 128828 - DNA, 19 bp, Homo sapiens
tgaattcatggttggttga

SEQ ID NO: 128829 - DNA, 23 bp, Homo sapiens
ggagtctctctctgtcacccagg

SEQ ID NO: 128830 - DNA, 23 bp, Homo sapiens
agagatgaaagaaaatgctgcta

SEQ ID NO: 128831 - DNA, 23 bp, Homo sapiens
tgtgtctcagagaaatggctgcc

SEQ ID NO: 128832 - DNA, 21 bp, Homo sapiens
ttatccctggctttctttcct

SEQ ID NO: 128833 - DNA, 22 bp, Homo sapiens
aagtcagaagtaactggacact

SEQ ID NO: 128834 - DNA, 23 bp, Homo sapiens
tgtgtgtatacatgtatatatgt

SEQ ID NO: 128835 - DNA, 23 bp, Homo sapiens
atatgtgtatatatatgtgtgtg

SEQ ID NO: 128836 - DNA, 23 bp, Homo sapiens
tgagctagttggttgatttcttg

SEQ ID NO: 128837 - DNA, 21 bp, Homo sapiens
aactggatggagtttgtctgc

SEQ ID NO: 128838 - DNA, 20 bp, Homo sapiens
atgtgtgtgtgtgtatacat

SEQ ID NO: 128839 - DNA, 21 bp, Homo sapiens
atgtatacacacacacacata

SEQ ID NO: 128840 - DNA, 23 bp, Homo sapiens
tagtcttgcctcctattcatcct

SEQ ID NO: 128841 - DNA, 23 bp, Homo sapiens
acaccctcactgtcacattggga

SEQ ID NO: 128842 - DNA, 23 bp, Homo sapiens
tatatacgtatatgtatatatgt

SEQ ID NO: 128843 - DNA, 21 bp, Homo sapiens
tatgcatttgtatatatgtgt

SEQ ID NO: 128844 - DNA, 23 bp, Homo sapiens
tgagttcattgtagattctggat

SEQ ID NO: 128845 - DNA, 23 bp, Homo sapiens
tgagttcattgtagattctggat

SEQ ID NO: 128846 - DNA, 23 bp, Homo sapiens
tgagttcattgtagattctggat

SEQ ID NO: 128847 - DNA, 23 bp, Homo sapiens
tgagttcattgtagattctggat

SEQ ID NO: 128848 - DNA, 23 bp, Homo sapiens
gtacatttcagtttttcaagttg

SEQ ID NO: 128849 - DNA, 23 bp, Homo sapiens
ttacccagtggtagagttctgat

SEQ ID NO: 128850 - DNA, 21 bp, Homo sapiens
atgtatatatatatgtgtgta

SEQ ID NO: 128851 - DNA, 23 bp, Homo sapiens
atatatgtgtatatgtatatatg

SEQ ID NO: 128852 - DNA, 23 bp, Homo sapiens
atatgtatatatgtatatatgtg

SEQ ID NO: 128853 - DNA, 21 bp, Homo sapiens
tatatgtatatgtatatgtat

SEQ ID NO: 128854 - DNA, 21 bp, Homo sapiens
acacacacacatatttgtgat

SEQ ID NO: 128855 - DNA, 23 bp, Homo sapiens
gggtttcaaactttttgttaagg

SEQ ID NO: 128856 - DNA, 21 bp, Homo sapiens
aaggaggaagaagcagaactg

SEQ ID NO: 128857 - DNA, 23 bp, Homo sapiens
ttcagattgtcttggctatacag

SEQ ID NO: 128858 - DNA, 19 bp, Homo sapiens
tgtgaagaaagtcaatggt

SEQ ID NO: 128859 - DNA, 23 bp, Homo sapiens
tctctccctgtgtggctgagtct

SEQ ID NO: 128860 - DNA, 23 bp, Homo sapiens
tactcagtcactctatgaagtgt

SEQ ID NO: 128861 - DNA, 23 bp, Homo sapiens
tttgagatcacagtgagctatga

SEQ ID NO: 128862 - DNA, 23 bp, Homo sapiens
tgagttcattgtagattctggat

SEQ ID NO: 128863 - DNA, 23 bp, Homo sapiens
tgagttcattgtagattctggat

SEQ ID NO: 128864 - DNA, 23 bp, Homo sapiens
tgtgtgtctcagtgcctgttctg

SEQ ID NO: 128865 - DNA, 19 bp, Homo sapiens
agaaaatggacctgttgtg

SEQ ID NO: 128866 - DNA, 18 bp, Homo sapiens
taacatcctctttttctt

SEQ ID NO: 128867 - DNA, 20 bp, Homo sapiens
acagtagtgttttacatgat

SEQ ID NO: 128868 - DNA, 23 bp, Homo sapiens
tcagaagaagatgaggagctcag

SEQ ID NO: 128869 - DNA, 23 bp, Homo sapiens
tattgattacttacagtgctctt

SEQ ID NO: 128870 - DNA, 22 bp, Homo sapiens
ttgtacctgtgtatgtgtgtgg

SEQ ID NO: 128871 - DNA, 23 bp, Homo sapiens
tgtatatatgtatctatagtggg

SEQ ID NO: 128872 - DNA, 23 bp, Homo sapiens
tgagttcattgtagattctggat

SEQ ID NO: 128873 - DNA, 23 bp, Homo sapiens
tgagttcattgtagattctggat

SEQ ID NO: 128874 - DNA, 20 bp, Homo sapiens
gctcattacaagctccacct

SEQ ID NO: 128875 - DNA, 20 bp, Homo sapiens
agtactggctccagtagttg

SEQ ID NO: 128876 - DNA, 23 bp, Homo sapiens
tcccagagcccctggaactctgg

SEQ ID NO: 128877 - DNA, 23 bp, Homo sapiens
tcccagagcccctggaactctgg

SEQ ID NO: 128878 - DNA, 21 bp, Homo sapiens
agtggactaccacctgaatgt

SEQ ID NO: 128879 - DNA, 23 bp, Homo sapiens
tggagtctcactctgtcacccag

SEQ ID NO: 128880 - DNA, 20 bp, Homo sapiens
aggatcagcttgtcaattta

SEQ ID NO: 128881 - DNA, 23 bp, Homo sapiens
atatgtgtgtgtctatatataca

SEQ ID NO: 128882 - DNA, 23 bp, Homo sapiens
aatgaaagttaaactaatgggga

SEQ ID NO: 128883 - DNA, 18 bp, Homo sapiens
cttctggtagttactatt

SEQ ID NO: 128884 - DNA, 23 bp, Homo sapiens
atcttctctggactagtgtgtgt

SEQ ID NO: 128885 - DNA, 23 bp, Homo sapiens
attttttccagcagtttgtgttc

SEQ ID NO: 128886 - DNA, 23 bp, Homo sapiens
tgagttcattgtagattctggat

SEQ ID NO: 128887 - DNA, 23 bp, Homo sapiens
tgagttcattgtagattctggat

SEQ ID NO: 128888 - DNA, 20 bp, Homo sapiens
ttttatttttgtagctatct

SEQ ID NO: 128889 - DNA, 21 bp, Homo sapiens
tttaggaataaaagggaaaga

SEQ ID NO: 128890 - DNA, 23 bp, Homo sapiens
tgagttcattgtagattctggat

SEQ ID NO: 128891 - DNA, 23 bp, Homo sapiens
tgagttcattgtagattctggat

SEQ ID NO: 128892 - DNA, 19 bp, Homo sapiens
caatgtccctgagataaga

SEQ ID NO: 128893 - DNA, 23 bp, Homo sapiens
ctcaggcactttctcactgttta

SEQ ID NO: 128894 - DNA, 19 bp, Homo sapiens
agctggagagaaaaatact

SEQ ID NO: 128895 - DNA, 23 bp, Homo sapiens
gaaatcactgtctttttctcttt

SEQ ID NO: 128896 - DNA, 23 bp, Homo sapiens
tttggtagtatgtttgcaggttt

SEQ ID NO: 128897 - DNA, 21 bp, Homo sapiens
gaaatgtgaggctgagtgccc

SEQ ID NO: 128898 - DNA, 23 bp, Homo sapiens
agggtattctgtgtctgactcta

SEQ ID NO: 128899 - DNA, 19 bp, Homo sapiens
aggatataggaagttcagt

SEQ ID NO: 128900 - DNA, 23 bp, Homo sapiens
tgacaccctcagtgtcaccatca

SEQ ID NO: 128901 - DNA, 23 bp, Homo sapiens
atgtgcaggtttgttatataggt

SEQ ID NO: 128902 - DNA, 23 bp, Homo sapiens
tgtctgtttctgtctctctgacc

SEQ ID NO: 128903 - DNA, 23 bp, Homo sapiens
aactcattcctcactctctgtgt

SEQ ID NO: 128904 - DNA, 19 bp, Homo sapiens
tcgctggctgtattacctg

SEQ ID NO: 128905 - DNA, 23 bp, Homo sapiens
ttttatctagtaaagttaacagg

SEQ ID NO: 128906 - DNA, 22 bp, Homo sapiens
aaatctcattttgtagttccca

SEQ ID NO: 128907 - DNA, 23 bp, Homo sapiens
cacaatctggttgagaaatggtt

SEQ ID NO: 128908 - DNA, 23 bp, Homo sapiens
ttttttggttccatatgaaattt

SEQ ID NO: 128909 - DNA, 23 bp, Homo sapiens
atgagacatttattctattccag

SEQ ID NO: 128910 - DNA, 23 bp, Homo sapiens
tggtaaggagataagagagatgg

SEQ ID NO: 128911 - DNA, 22 bp, Homo sapiens
tgtggttttcgtcatgggttct

SEQ ID NO: 128912 - DNA, 18 bp, Homo sapiens
tgatttgtgtacgtggaa

SEQ ID NO: 128913 - DNA, 20 bp, Homo sapiens
gtgtatatatatgtgtgtgt

SEQ ID NO: 128914 - DNA, 23 bp, Homo sapiens
tgacagtctcactctgtcaccca

SEQ ID NO: 128915 - DNA, 23 bp, Homo sapiens
ttacagtggtatgatcatagctc

SEQ ID NO: 128916 - DNA, 23 bp, Homo sapiens
atgtatgtgtgcatgttcatatg

SEQ ID NO: 128917 - DNA, 20 bp, Homo sapiens
tgtatatattcatgtctgtg

SEQ ID NO: 128918 - DNA, 21 bp, Homo sapiens
tcctgctaaataatgccattt

SEQ ID NO: 128919 - DNA, 23 bp, Homo sapiens
ggtcatcttcaccttgatctgca

SEQ ID NO: 128920 - DNA, 20 bp, Homo sapiens
tgagaacacagagaggagaa

SEQ ID NO: 128921 - DNA, 23 bp, Homo sapiens
agacacagatgattcaaagctga

SEQ ID NO: 128922 - DNA, 20 bp, Homo sapiens
agtctcgctctgtcacccag

SEQ ID NO: 128923 - DNA, 23 bp, Homo sapiens
tgagtctcactctgtcacccagg

SEQ ID NO: 128924 - DNA, 19 bp, Homo sapiens
agagtgaatctctcactga

SEQ ID NO: 128925 - DNA, 21 bp, Homo sapiens
ttgtgagtattgttcctcaat

SEQ ID NO: 128926 - DNA, 23 bp, Homo sapiens
ggagtctcactctgtcacccagg

SEQ ID NO: 128927 - DNA, 23 bp, Homo sapiens
agagcttgcagtgagtgagtaga

SEQ ID NO: 128928 - DNA, 23 bp, Homo sapiens
tgagttcattgtagattctggat

SEQ ID NO: 128929 - DNA, 23 bp, Homo sapiens
tgagttcattgtagattctggat

SEQ ID NO: 128930 - DNA, 23 bp, Homo sapiens
atgtctatatatatatgtatggt

SEQ ID NO: 128931 - DNA, 23 bp, Homo sapiens
tcttacatagtgaaagcactttg

SEQ ID NO: 128932 - DNA, 23 bp, Homo sapiens
ttatccagtttgtctagttgttg

SEQ ID NO: 128933 - DNA, 23 bp, Homo sapiens
tgagacagagtctcgctctgtca

SEQ ID NO: 128934 - DNA, 21 bp, Homo sapiens
gatgtagtaagagaaatgtct

SEQ ID NO: 128935 - DNA, 23 bp, Homo sapiens
taaactttctcctattgcttaga

SEQ ID NO: 128936 - DNA, 20 bp, Homo sapiens
atctggaactatatatatgt

SEQ ID NO: 128937 - DNA, 23 bp, Homo sapiens
agagtctcactctgtctcccagg

SEQ ID NO: 128938 - DNA, 23 bp, Homo sapiens
tctgtctgtctgtctctctctct

SEQ ID NO: 128939 - DNA, 23 bp, Homo sapiens
tgcgtgtgtgtgtatgtatatgt

SEQ ID NO: 128940 - DNA, 23 bp, Homo sapiens
tgtacattttatatgtatatgtg

SEQ ID NO: 128941 - DNA, 23 bp, Homo sapiens
tattgtgtgtacatgtattcatt

SEQ ID NO: 128942 - DNA, 23 bp, Homo sapiens
agtgagtgtagtaagctgatttc

SEQ ID NO: 128943 - DNA, 22 bp, Homo sapiens
tcattgtattctgagtgtcagg

SEQ ID NO: 128944 - DNA, 23 bp, Homo sapiens
tggagtctcactctgtcacccag

SEQ ID NO: 128945 - DNA, 21 bp, Homo sapiens
ttcatactttttgtggtggct

SEQ ID NO: 128946 - DNA, 19 bp, Homo sapiens
attatatatttgtgtttga

SEQ ID NO: 128947 - DNA, 21 bp, Homo sapiens
ccatgtgtcactctctctgcc

SEQ ID NO: 128948 - DNA, 23 bp, Homo sapiens
tggagtctcgctctgactcccag

SEQ ID NO: 128949 - DNA, 23 bp, Homo sapiens
aggtcctttgttttgaaatagga

SEQ ID NO: 128950 - DNA, 22 bp, Homo sapiens
cagagatttcagagtgatgttg

SEQ ID NO: 128951 - DNA, 23 bp, Homo sapiens
actcccagagcccctggaactct

SEQ ID NO: 128952 - DNA, 20 bp, Homo sapiens
cctgtcagtcctgggtctgg

SEQ ID NO: 128953 - DNA, 23 bp, Homo sapiens
aaagtcagtttcaaaatgtgata

SEQ ID NO: 128954 - DNA, 23 bp, Homo sapiens
actgagtctcactctgtcgccca

SEQ ID NO: 128955 - DNA, 23 bp, Homo sapiens
tgagttcattgtagattctggat

SEQ ID NO: 128956 - DNA, 23 bp, Homo sapiens
tgagttcattgtagattctggat

SEQ ID NO: 128957 - DNA, 18 bp, Homo sapiens
tttgtggagatgatggtg

SEQ ID NO: 128958 - DNA, 23 bp, Homo sapiens
actcccagagcccctggaactct

SEQ ID NO: 128959 - DNA, 23 bp, Homo sapiens
tcccagagcccctggaactctgg

SEQ ID NO: 128960 - DNA, 23 bp, Homo sapiens
actttctcactgagaatttcagt

SEQ ID NO: 128961 - DNA, 18 bp, Homo sapiens
tcacctcgagtatttatc

SEQ ID NO: 128962 - DNA, 19 bp, Homo sapiens
gtctcgctctgtcacccag

SEQ ID NO: 128963 - DNA, 23 bp, Homo sapiens
tttctgcaacatatttccactct

SEQ ID NO: 128964 - DNA, 19 bp, Homo sapiens
agtgctctacactagtgtg

SEQ ID NO: 128965 - DNA, 23 bp, Homo sapiens
tgagttcattgtagattctggat

SEQ ID NO: 128966 - DNA, 23 bp, Homo sapiens
tgagttcattgtagattctggat

SEQ ID NO: 128967 - DNA, 22 bp, Homo sapiens
attcacaaagcatttactgtct

SEQ ID NO: 128968 - DNA, 22 bp, Homo sapiens
acacatatacatatacagacgt

SEQ ID NO: 128969 - DNA, 20 bp, Homo sapiens
agcgtcagagattttgttgt

SEQ ID NO: 128970 - DNA, 19 bp, Homo sapiens
ttgccatggacttggtaag

SEQ ID NO: 128971 - DNA, 19 bp, Homo sapiens
tcaactagcaagacaggtg

SEQ ID NO: 128972 - DNA, 23 bp, Homo sapiens
gggtctcactctgtcacccaggc

SEQ ID NO: 128973 - DNA, 21 bp, Homo sapiens
tgagttgtaggagtaaggaat

SEQ ID NO: 128974 - DNA, 23 bp, Homo sapiens
aggattgttatgatgtttgaatg

SEQ ID NO: 128975 - DNA, 19 bp, Homo sapiens
agacctttaggaagagaaa

SEQ ID NO: 128976 - DNA, 21 bp, Homo sapiens
aaaaattatagtggacttgcc

SEQ ID NO: 128977 - DNA, 23 bp, Homo sapiens
agagtctcgctctgtcacccagg

SEQ ID NO: 128978 - DNA, 19 bp, Homo sapiens
tgagatggagtctcactct

SEQ ID NO: 128979 - DNA, 23 bp, Homo sapiens
tttttggttccatatgaaattta

SEQ ID NO: 128980 - DNA, 20 bp, Homo sapiens
tcagtggtagcttgatgggg

SEQ ID NO: 128981 - DNA, 23 bp, Homo sapiens
aagtctcactctgtcacccaggc

SEQ ID NO: 128982 - DNA, 23 bp, Homo sapiens
acaggatctcgctctgtcactca

SEQ ID NO: 128983 - DNA, 23 bp, Homo sapiens
aacatgtagatactgcatttttt

SEQ ID NO: 128984 - DNA, 19 bp, Homo sapiens
tgaggatgtgtgttcaggg

SEQ ID NO: 128985 - DNA, 23 bp, Homo sapiens
tgagttcattgtagattctggat

SEQ ID NO: 128986 - DNA, 23 bp, Homo sapiens
tgagttcattgtagattctggat

SEQ ID NO: 128987 - DNA, 23 bp, Homo sapiens
tctgaacaatgtcaatgatagtt

SEQ ID NO: 128988 - DNA, 23 bp, Homo sapiens
tcacaccctctgtcactgcagcc

SEQ ID NO: 128989 - DNA, 23 bp, Homo sapiens
ctcaggtgaggcttgacagtccc

SEQ ID NO: 128990 - DNA, 21 bp, Homo sapiens
tctatacatccttctctgcat

SEQ ID NO: 128991 - DNA, 21 bp, Homo sapiens
taggatgatatatcatcaatg

SEQ ID NO: 128992 - DNA, 23 bp, Homo sapiens
agggtctcgctctgtcactcagg

SEQ ID NO: 128993 - DNA, 23 bp, Homo sapiens
acaaagaagacactgagctcaag

SEQ ID NO: 128994 - DNA, 23 bp, Homo sapiens
tgctatttttccttgtttgtgat

SEQ ID NO: 128995 - DNA, 23 bp, Homo sapiens
gtgagtactgagtgagcagaagg

SEQ ID NO: 128996 - DNA, 23 bp, Homo sapiens
tgagttcattgtagattctggat

SEQ ID NO: 128997 - DNA, 23 bp, Homo sapiens
tgagttcattgtagattctggat

SEQ ID NO: 128998 - DNA, 20 bp, Homo sapiens
tctttgtttttttaaacaga

SEQ ID NO: 128999 - DNA, 21 bp, Homo sapiens
taaccaactgtttgtttattt

SEQ ID NO: 129000 - DNA, 22 bp, Homo sapiens
tggtaaatgtgggcattcttgt

SEQ ID NO: 129001 - DNA, 21 bp, Homo sapiens
tatgtgtatatatatatatgt

SEQ ID NO: 129002 - DNA, 23 bp, Homo sapiens
cctcttcttcttcaacaagtgat

SEQ ID NO: 129003 - DNA, 23 bp, Homo sapiens
catgtcattgaagagtgagagga

SEQ ID NO: 129004 - DNA, 22 bp, Homo sapiens
tgtcaccctgtgtctgtctcca

SEQ ID NO: 129005 - DNA, 23 bp, Homo sapiens
agagagaaattatcatggcttag

SEQ ID NO: 129006 - DNA, 21 bp, Homo sapiens
acagtctcactctgtcgccca

SEQ ID NO: 129007 - DNA, 23 bp, Homo sapiens
tgactgtgtctctgggtccctct

SEQ ID NO: 129008 - DNA, 21 bp, Homo sapiens
accagtagtagtttcatctgt

SEQ ID NO: 129009 - DNA, 18 bp, Homo sapiens
tgaggtaggaggatcact

SEQ ID NO: 129010 - DNA, 23 bp, Homo sapiens
ttgagactcactctgtcgctcag

SEQ ID NO: 129011 - DNA, 23 bp, Homo sapiens
atactctgtcttatgactgccac

SEQ ID NO: 129012 - DNA, 23 bp, Homo sapiens
tggagtctcactctgtcacccag

SEQ ID NO: 129013 - DNA, 18 bp, Homo sapiens
tgagtgggattgctgggt

SEQ ID NO: 129014 - DNA, 23 bp, Homo sapiens
taatagaagtatgcagattgctt

SEQ ID NO: 129015 - DNA, 23 bp, Homo sapiens
tgtgagtgtatatgtatgtatat

SEQ ID NO: 129016 - DNA, 22 bp, Homo sapiens
agtatcatgactgtggtggctg

SEQ ID NO: 129017 - DNA, 23 bp, Homo sapiens
agtgactcactgtgaatgctatt

SEQ ID NO: 129018 - DNA, 23 bp, Homo sapiens
gttagtgtgctctggaattcttc

SEQ ID NO: 129019 - DNA, 19 bp, Homo sapiens
tgagacagagtctcactct

SEQ ID NO: 129020 - DNA, 22 bp, Homo sapiens
atctccagcttgtgctgtaaca

SEQ ID NO: 129021 - DNA, 23 bp, Homo sapiens
cggagtctcactctgtcacccag

SEQ ID NO: 129022 - DNA, 22 bp, Homo sapiens
tctcagcttggttgctgttggt

SEQ ID NO: 129023 - DNA, 23 bp, Homo sapiens
tcgtggagcacagtgtatttata

SEQ ID NO: 129024 - DNA, 19 bp, Homo sapiens
taattgccctgtgtgtttg

SEQ ID NO: 129025 - DNA, 23 bp, Homo sapiens
tgtgtgtgtgtgtatgtatatac

SEQ ID NO: 129026 - DNA, 20 bp, Homo sapiens
tgtgtatatatatacacata

SEQ ID NO: 129027 - DNA, 23 bp, Homo sapiens
tatttcaaatgttttcattatta

SEQ ID NO: 129028 - DNA, 23 bp, Homo sapiens
catatgtatagtacatatgtata

SEQ ID NO: 129029 - DNA, 21 bp, Homo sapiens
acgtatgtatatgtatatgtg

SEQ ID NO: 129030 - DNA, 20 bp, Homo sapiens
tgaaggacataaatgggtat

SEQ ID NO: 129031 - DNA, 23 bp, Homo sapiens
tgagaacgtggctgtctctctta

SEQ ID NO: 129032 - DNA, 23 bp, Homo sapiens
ttttgagacagtgtctggctctg

SEQ ID NO: 129033 - DNA, 23 bp, Homo sapiens
gtaggcagtggtagaactttgaa

SEQ ID NO: 129034 - DNA, 19 bp, Homo sapiens
gagatggtatcagtctatt

SEQ ID NO: 129035 - DNA, 22 bp, Homo sapiens
gttctcactctgtcactcaggc

SEQ ID NO: 129036 - DNA, 21 bp, Homo sapiens
atagagaatatatattctcta

SEQ ID NO: 129037 - DNA, 23 bp, Homo sapiens
ctctatagatatagagaatatat

SEQ ID NO: 129038 - DNA, 23 bp, Homo sapiens
aggctggagaagaaggcaaggtc

SEQ ID NO: 129039 - DNA, 21 bp, Homo sapiens
tctcacagtaactcactctct

SEQ ID NO: 129040 - DNA, 18 bp, Homo sapiens
tcagtggtattcatgaca

SEQ ID NO: 129041 - DNA, 23 bp, Homo sapiens
actttcaactggtgggcctgatc

SEQ ID NO: 129042 - DNA, 22 bp, Homo sapiens
agagtctcgctctgtcacccag

SEQ ID NO: 129043 - DNA, 23 bp, Homo sapiens
gtatgaatgtatgtatgtgtatg

SEQ ID NO: 129044 - DNA, 23 bp, Homo sapiens
tagatatagatatagatatctct

SEQ ID NO: 129045 - DNA, 22 bp, Homo sapiens
ttttatggtcataattttcttc

SEQ ID NO: 129046 - DNA, 19 bp, Homo sapiens
acatgcacaaacacacaca

SEQ ID NO: 129047 - DNA, 23 bp, Homo sapiens
tttagcgttctctagaattcaga

SEQ ID NO: 129048 - DNA, 23 bp, Homo sapiens
ctcccagagcccctggaactctg

SEQ ID NO: 129049 - DNA, 23 bp, Homo sapiens
tcccagagcccctggaactctgg

SEQ ID NO: 129050 - DNA, 23 bp, Homo sapiens
tgataatatcttgcaaaactata

SEQ ID NO: 129051 - DNA, 22 bp, Homo sapiens
taaagctcatatatatcaaggt

SEQ ID NO: 129052 - DNA, 22 bp, Homo sapiens
taactccttgacctattgattt

SEQ ID NO: 129053 - DNA, 19 bp, Homo sapiens
tagctccagtttgtgataa

SEQ ID NO: 129054 - DNA, 23 bp, Homo sapiens
ttgagacagagtctggttctgtt

SEQ ID NO: 129055 - DNA, 22 bp, Homo sapiens
gtctctctctgtcacccaggct

SEQ ID NO: 129056 - DNA, 21 bp, Homo sapiens
gaagacgttttgcagcagatg

SEQ ID NO: 129057 - DNA, 23 bp, Homo sapiens
ataaagacattttgtagatgtgt

SEQ ID NO: 129058 - DNA, 23 bp, Homo sapiens
tccaactgtctactgctggctct

SEQ ID NO: 129059 - DNA, 19 bp, Homo sapiens
gcatgtatatatgtgtgta

SEQ ID NO: 129060 - DNA, 19 bp, Homo sapiens
agtctcattctgtcactca

SEQ ID NO: 129061 - DNA, 23 bp, Homo sapiens
tgtgtgcctgtgacacagcctca

SEQ ID NO: 129062 - DNA, 23 bp, Homo sapiens
tgagaatttctacttgacatcat

SEQ ID NO: 129063 - DNA, 22 bp, Homo sapiens
taaatctgtcacccgtggatgt

SEQ ID NO: 129064 - DNA, 19 bp, Homo sapiens
tcacttgagtactgtacat

SEQ ID NO: 129065 - DNA, 21 bp, Homo sapiens
gagcagttctaggaaattcag

SEQ ID NO: 129066 - DNA, 20 bp, Homo sapiens
ttgagtgttggaggactagc

SEQ ID NO: 129067 - DNA, 21 bp, Homo sapiens
atctctctggtgccttctgtg

SEQ ID NO: 129068 - DNA, 23 bp, Homo sapiens
cctgacactctgtgtatttgggg

SEQ ID NO: 129069 - DNA, 22 bp, Homo sapiens
actgaagcctcagtctgactct

SEQ ID NO: 129070 - DNA, 21 bp, Homo sapiens
actcagtctcgctctgtcgcc

SEQ ID NO: 129071 - DNA, 18 bp, Homo sapiens
ccatccaaatgaagtatt

SEQ ID NO: 129072 - DNA, 22 bp, Homo sapiens
tgagaagtgttttacttgtgat

SEQ ID NO: 129073 - DNA, 23 bp, Homo sapiens
aatttgtgtgtgtgtgtatatac

SEQ ID NO: 129074 - DNA, 23 bp, Homo sapiens
tgagttcattgtagattctggat

SEQ ID NO: 129075 - DNA, 23 bp, Homo sapiens
tgagttcattgtagattctggat

SEQ ID NO: 129076 - DNA, 19 bp, Homo sapiens
gttaagctccagttgtcca

SEQ ID NO: 129077 - DNA, 23 bp, Homo sapiens
tgagttcattgtagattctggat

SEQ ID NO: 129078 - DNA, 23 bp, Homo sapiens
tgagttcattgtagattctggat

SEQ ID NO: 129079 - DNA, 23 bp, Homo sapiens
tgaccaatgctatagtcattgag

SEQ ID NO: 129080 - DNA, 23 bp, Homo sapiens
ataagattgtttttcattttgaa

SEQ ID NO: 129081 - DNA, 23 bp, Homo sapiens
agactaagtctcgctctgtcacc

SEQ ID NO: 129082 - DNA, 22 bp, Homo sapiens
gagtctcactttgtcactcagg

SEQ ID NO: 129083 - DNA, 23 bp, Homo sapiens
tgagttcattgtagattctggat

SEQ ID NO: 129084 - DNA, 23 bp, Homo sapiens
tttcactctactcccatatcagt

SEQ ID NO: 129085 - DNA, 23 bp, Homo sapiens
tctgtggatttgtctgtgttttc

SEQ ID NO: 129086 - DNA, 20 bp, Homo sapiens
atgagtgaagactctgagca

SEQ ID NO: 129087 - DNA, 23 bp, Homo sapiens
gacagagtctcgctctgtcaccc

SEQ ID NO: 129088 - DNA, 21 bp, Homo sapiens
atgtgtgtgtgcatgtgcttg

SEQ ID NO: 129089 - DNA, 21 bp, Homo sapiens
tgtcttagttacaaaaattgt

SEQ ID NO: 129090 - DNA, 22 bp, Homo sapiens
tttcaccctggatttgatctgt

SEQ ID NO: 129091 - DNA, 21 bp, Homo sapiens
tgtcaccacccaaatctcatg

SEQ ID NO: 129092 - DNA, 23 bp, Homo sapiens
tgagttcattgtagattctggat

SEQ ID NO: 129093 - DNA, 23 bp, Homo sapiens
tgagttcattgtagattctggat

SEQ ID NO: 129094 - DNA, 23 bp, Homo sapiens
agacttaggttagggagttaaat

SEQ ID NO: 129095 - DNA, 23 bp, Homo sapiens
actagtccctgacactgagtccc

SEQ ID NO: 129096 - DNA, 23 bp, Homo sapiens
tgtgtatatatatatgtgtgtgt

SEQ ID NO: 129097 - DNA, 23 bp, Homo sapiens
aaagataatcatcaggtagttgg

SEQ ID NO: 129098 - DNA, 20 bp, Homo sapiens
tgagacagtctcactctgtc

SEQ ID NO: 129099 - DNA, 23 bp, Homo sapiens
gacagagtctcgctctgtcaccc

SEQ ID NO: 129100 - DNA, 23 bp, Homo sapiens
gtgtatgtatatgtatatgtgtg

SEQ ID NO: 129101 - DNA, 23 bp, Homo sapiens
gacagagtctcgctctgtcaccc

SEQ ID NO: 129102 - DNA, 23 bp, Homo sapiens
gacagagtgagactctgtctttt

SEQ ID NO: 129103 - DNA, 23 bp, Homo sapiens
gctcaatgtggctgtggagctgc

SEQ ID NO: 129104 - DNA, 21 bp, Homo sapiens
tttcacagtgagctcactgag

SEQ ID NO: 129105 - DNA, 20 bp, Homo sapiens
tctcactctgtcacttaggc

SEQ ID NO: 129106 - DNA, 23 bp, Homo sapiens
tgaaagagcttactcactctctc

SEQ ID NO: 129107 - DNA, 20 bp, Homo sapiens
tctcactctgtcacttaggc

SEQ ID NO: 129108 - DNA, 23 bp, Homo sapiens
taaagtactgataatctagttct

SEQ ID NO: 129109 - DNA, 22 bp, Homo sapiens
ttgctgctgggatattttggtc

SEQ ID NO: 129110 - DNA, 23 bp, Homo sapiens
gccccactcactgcctctcattt

SEQ ID NO: 129111 - DNA, 22 bp, Homo sapiens
atgcagcattccatttcacctt

SEQ ID NO: 129112 - DNA, 21 bp, Homo sapiens
aggcaatctcagtcaaaaccc

SEQ ID NO: 129113 - DNA, 19 bp, Homo sapiens
tgagatggagtctcactct

SEQ ID NO: 129114 - DNA, 23 bp, Homo sapiens
gactatttgatgttcagtttgga

SEQ ID NO: 129115 - DNA, 23 bp, Homo sapiens
cggaatctcactctgtcgcacag

SEQ ID NO: 129116 - DNA, 21 bp, Homo sapiens
agcaaagaaatgactgagcac

SEQ ID NO: 129117 - DNA, 23 bp, Homo sapiens
attgaatgtgattatgttgttct

SEQ ID NO: 129118 - DNA, 23 bp, Homo sapiens
tttgctcttgtgtctgtttaaca

SEQ ID NO: 129119 - DNA, 23 bp, Homo sapiens
ttatgttaacaggcactctgttt

SEQ ID NO: 129120 - DNA, 23 bp, Homo sapiens
ctcactgtcactcaggctggaat

SEQ ID NO: 129121 - DNA, 23 bp, Homo sapiens
tgtgtgtgtgtgtttatatacac

SEQ ID NO: 129122 - DNA, 23 bp, Homo sapiens
atatgtatatatatatgtgtgtg

SEQ ID NO: 129123 - DNA, 21 bp, Homo sapiens
tatacacacacatatacatgt

SEQ ID NO: 129124 - DNA, 23 bp, Homo sapiens
gacagagtctcgctctgtcaccc

SEQ ID NO: 129125 - DNA, 23 bp, Homo sapiens
gagtctcgctctgtcactcaggc

SEQ ID NO: 129126 - DNA, 22 bp, Homo sapiens
ttctatgaagaaagtcaatggt

SEQ ID NO: 129127 - DNA, 23 bp, Homo sapiens
tgagttcattgtagattctggat

SEQ ID NO: 129128 - DNA, 23 bp, Homo sapiens
tgagttcattgtagattctggat

SEQ ID NO: 129129 - DNA, 23 bp, Homo sapiens
agtaagatgttcagctgctctta

SEQ ID NO: 129130 - DNA, 23 bp, Homo sapiens
tgagttcattgtagattctggat

SEQ ID NO: 129131 - DNA, 23 bp, Homo sapiens
tgagttcattgtagattctggat

SEQ ID NO: 129132 - DNA, 23 bp, Homo sapiens
atctccactcactgcaagctctg

SEQ ID NO: 129133 - DNA, 23 bp, Homo sapiens
tcttagtgcttgtgatatgtagt

SEQ ID NO: 129134 - DNA, 22 bp, Homo sapiens
tggagtctcactctgtcactca

SEQ ID NO: 129135 - DNA, 23 bp, Homo sapiens
atgacactgtagtcagactggag

SEQ ID NO: 129136 - DNA, 23 bp, Homo sapiens
actctgagctcaacttgaatgca

SEQ ID NO: 129137 - DNA, 23 bp, Homo sapiens
tacatgcatgtatagatagatat

SEQ ID NO: 129138 - DNA, 22 bp, Homo sapiens
tccaggaagaatcagattacat

SEQ ID NO: 129139 - DNA, 23 bp, Homo sapiens
ctgagatcaaggtgtcagcagga

SEQ ID NO: 129140 - DNA, 21 bp, Homo sapiens
agatatgtatagatccattta

SEQ ID NO: 129141 - DNA, 23 bp, Homo sapiens
tgaggtaggaggatcacttgaac

SEQ ID NO: 129142 - DNA, 22 bp, Homo sapiens
tttcagagaagataagttgttt

SEQ ID NO: 129143 - DNA, 23 bp, Homo sapiens
tatcatactcactgcagccttga

SEQ ID NO: 129144 - DNA, 23 bp, Homo sapiens
gcatttgtagtcctagctacttt

SEQ ID NO: 129145 - DNA, 18 bp, Homo sapiens
aatagttttgtgcaggat

SEQ ID NO: 129146 - DNA, 22 bp, Homo sapiens
agagtgaagatggtctgattat

SEQ ID NO: 129147 - DNA, 20 bp, Homo sapiens
tgagacagagtctcactctg

SEQ ID NO: 129148 - DNA, 21 bp, Homo sapiens
agcatgtatatagtattatgt

SEQ ID NO: 129149 - DNA, 23 bp, Homo sapiens
atctctcatttctgtttctctca

SEQ ID NO: 129150 - DNA, 22 bp, Homo sapiens
atatgtatatatgtatatatgt

SEQ ID NO: 129151 - DNA, 23 bp, Homo sapiens
ctcccagagcccctggaactctg

SEQ ID NO: 129152 - DNA, 23 bp, Homo sapiens
tcccagagcccctggaactctgg

SEQ ID NO: 129153 - DNA, 23 bp, Homo sapiens
tcccagagcccctggaactctgg

SEQ ID NO: 129154 - DNA, 23 bp, Homo sapiens
tcccagagcccctggaactctgg

SEQ ID NO: 129155 - DNA, 20 bp, Homo sapiens
accaatggtatatgtgtgta

SEQ ID NO: 129156 - DNA, 23 bp, Homo sapiens
tgtatacaagtatacatgtatac

SEQ ID NO: 129157 - DNA, 23 bp, Homo sapiens
atgtgtgtatatgtatatatgtg

SEQ ID NO: 129158 - DNA, 20 bp, Homo sapiens
tatatgtatatatatgtgtg

SEQ ID NO: 129159 - DNA, 21 bp, Homo sapiens
tatgcatatttatatgtatgt

SEQ ID NO: 129160 - DNA, 22 bp, Homo sapiens
tataatatgcatatgtatccat

SEQ ID NO: 129161 - DNA, 23 bp, Homo sapiens
tatatgtatgtatatgtaggtat

SEQ ID NO: 129162 - DNA, 19 bp, Homo sapiens
tgtgtctgtgtatataagt

SEQ ID NO: 129163 - DNA, 21 bp, Homo sapiens
atatgtgtatatacatatatg

SEQ ID NO: 129164 - DNA, 18 bp, Homo sapiens
tatacacatacatataga

SEQ ID NO: 129165 - DNA, 23 bp, Homo sapiens
catatgtgtgtatacacatgtgt

SEQ ID NO: 129166 - DNA, 23 bp, Homo sapiens
tatgtgtatatatacatgtgtgt

SEQ ID NO: 129167 - DNA, 23 bp, Homo sapiens
acagagtctcactctgtcgccca

SEQ ID NO: 129168 - DNA, 23 bp, Homo sapiens
ggagtctcactctgtcacccagg

SEQ ID NO: 129169 - DNA, 19 bp, Homo sapiens
tgactgttttctgatctct

SEQ ID NO: 129170 - DNA, 18 bp, Homo sapiens
tgagagagaagagatggc

SEQ ID NO: 129171 - DNA, 23 bp, Homo sapiens
gggtctcactctgtcacccaggc

SEQ ID NO: 129172 - DNA, 22 bp, Homo sapiens
atggtgtgatcatggctcattg

SEQ ID NO: 129173 - DNA, 21 bp, Homo sapiens
atgacagatgtgagccaccac

SEQ ID NO: 129174 - DNA, 23 bp, Homo sapiens
tctcactcagagtaaaagcccaa

SEQ ID NO: 129175 - DNA, 23 bp, Homo sapiens
ttttatggtgtacaacgtactgt

SEQ ID NO: 129176 - DNA, 22 bp, Homo sapiens
ggactgtctgtcactctctcct

SEQ ID NO: 129177 - DNA, 23 bp, Homo sapiens
atatgtgtgtatatatatgtgtg

SEQ ID NO: 129178 - DNA, 23 bp, Homo sapiens
acatgtgtatatgtatatgtgtg

SEQ ID NO: 129179 - DNA, 23 bp, Homo sapiens
tgacttggaaatgttacagttgt

SEQ ID NO: 129180 - DNA, 23 bp, Homo sapiens
tgagttcattgtagattctggat

SEQ ID NO: 129181 - DNA, 23 bp, Homo sapiens
tgagttcattgtagattctggat

SEQ ID NO: 129182 - DNA, 23 bp, Homo sapiens
ttcacagtcagtatactgagagc

SEQ ID NO: 129183 - DNA, 23 bp, Homo sapiens
acagatctgcctgtgtttagaag

SEQ ID NO: 129184 - DNA, 20 bp, Homo sapiens
tctgtaattccagcactttg

SEQ ID NO: 129185 - DNA, 23 bp, Homo sapiens
cctctctctgtgtgtgccagagc

SEQ ID NO: 129186 - DNA, 23 bp, Homo sapiens
tgacttttctgttattgttgttc

SEQ ID NO: 129187 - DNA, 21 bp, Homo sapiens
aaaaggaacaaaaaagcttag

SEQ ID NO: 129188 - DNA, 18 bp, Homo sapiens
gacactctcagttgtggg

SEQ ID NO: 129189 - DNA, 22 bp, Homo sapiens
tcacagtgtgcactcaccgagc

SEQ ID NO: 129190 - DNA, 23 bp, Homo sapiens
aaatactctggagaaaagatcat

SEQ ID NO: 129191 - DNA, 22 bp, Homo sapiens
tcttgtattattgaatttctca

SEQ ID NO: 129192 - DNA, 23 bp, Homo sapiens
gagagtctcgctctgtcacccag

SEQ ID NO: 129193 - DNA, 23 bp, Homo sapiens
cggagtctcactctgtcacccag

SEQ ID NO: 129194 - DNA, 23 bp, Homo sapiens
gagtctcactctgtcacccaggc

SEQ ID NO: 129195 - DNA, 23 bp, Homo sapiens
agagtctcactctgtcacccagg

SEQ ID NO: 129196 - DNA, 23 bp, Homo sapiens
gagtctcactctgtcacccaggc

SEQ ID NO: 129197 - DNA, 23 bp, Homo sapiens
ttttgagacagagtctcaccctg

SEQ ID NO: 129198 - DNA, 23 bp, Homo sapiens
ttgtgtcgtttttatttgcagtg

SEQ ID NO: 129199 - DNA, 19 bp, Homo sapiens
aggtccatgcagaatggat

SEQ ID NO: 129200 - DNA, 18 bp, Homo sapiens
tttaccaaagagaggaat

SEQ ID NO: 129201 - DNA, 23 bp, Homo sapiens
ctgtctcctccagctccaccctc

SEQ ID NO: 129202 - DNA, 23 bp, Homo sapiens
ctgtgagtctgtgagagtcagtc

SEQ ID NO: 129203 - DNA, 23 bp, Homo sapiens
tcacttgctcacacactccctct

SEQ ID NO: 129204 - DNA, 23 bp, Homo sapiens
ctcaggcactgactctgagttct

SEQ ID NO: 129205 - DNA, 23 bp, Homo sapiens
tgaaactgcatactgtggtgact

SEQ ID NO: 129206 - DNA, 21 bp, Homo sapiens
tgggacggagtctcgctctgt

SEQ ID NO: 129207 - DNA, 20 bp, Homo sapiens
aaggaatctttgaaaactaa

SEQ ID NO: 129208 - DNA, 23 bp, Homo sapiens
ccgtgtctgacacgctcacgtgt

SEQ ID NO: 129209 - DNA, 21 bp, Homo sapiens
ataacagggaggacaggatgt

SEQ ID NO: 129210 - DNA, 19 bp, Homo sapiens
ttcacatcttcctccaatg

SEQ ID NO: 129211 - DNA, 22 bp, Homo sapiens
tgtgtacatatacatttacaca

SEQ ID NO: 129212 - DNA, 20 bp, Homo sapiens
tatatctatatatatatgtg

SEQ ID NO: 129213 - DNA, 23 bp, Homo sapiens
cggagtctcactctgtcacccag

SEQ ID NO: 129214 - DNA, 23 bp, Homo sapiens
tttttgaggtggagtctcactct

SEQ ID NO: 129215 - DNA, 23 bp, Homo sapiens
cactcactaagtgtctctggtac

SEQ ID NO: 129216 - DNA, 23 bp, Homo sapiens
gaaaatcagtgggcataggcatt

SEQ ID NO: 129217 - DNA, 23 bp, Homo sapiens
aagagtactgttgatgttgttga

SEQ ID NO: 129218 - DNA, 23 bp, Homo sapiens
tgtcacggtccctctgtcagtag

SEQ ID NO: 129219 - DNA, 23 bp, Homo sapiens
gagagatgtgactgtgatctgag

SEQ ID NO: 129220 - DNA, 23 bp, Homo sapiens
ccctctctgtctctaacacctgt

SEQ ID NO: 129221 - DNA, 19 bp, Homo sapiens
gtgtctggttttcctgctg

SEQ ID NO: 129222 - DNA, 23 bp, Homo sapiens
acgatggctctctgtttccctct

SEQ ID NO: 129223 - DNA, 23 bp, Homo sapiens
attctctctctctatctaatctt

SEQ ID NO: 129224 - DNA, 22 bp, Homo sapiens
atgtgtatatatgtatatatgt

SEQ ID NO: 129225 - DNA, 23 bp, Homo sapiens
tacgtatatatgtatacatgtat

SEQ ID NO: 129226 - DNA, 23 bp, Homo sapiens
tgtaagtatgtgtgtatatgtat

SEQ ID NO: 129227 - DNA, 21 bp, Homo sapiens
atatatgtatgtatatgatgg

SEQ ID NO: 129228 - DNA, 23 bp, Homo sapiens
agacacagcctcgctctgtcgct

SEQ ID NO: 129229 - DNA, 23 bp, Homo sapiens
actgttgagattttgttctggaa

SEQ ID NO: 129230 - DNA, 23 bp, Homo sapiens
tgactctccctgtgtcagggcat

SEQ ID NO: 129231 - DNA, 23 bp, Homo sapiens
cggagtctcgctctgtctcccag

SEQ ID NO: 129232 - DNA, 23 bp, Homo sapiens
aattagtggaactgattagtttt

SEQ ID NO: 129233 - DNA, 20 bp, Homo sapiens
ttccatcttgaagaggccct

SEQ ID NO: 129234 - DNA, 22 bp, Homo sapiens
agcacagtgttgaacctgggag

SEQ ID NO: 129235 - DNA, 20 bp, Homo sapiens
ctgagagccttccatgtctc

SEQ ID NO: 129236 - DNA, 23 bp, Homo sapiens
ctctctgactcagagaattgatg

SEQ ID NO: 129237 - DNA, 19 bp, Homo sapiens
gagtggtgactgcgtgtgc

SEQ ID NO: 129238 - DNA, 23 bp, Homo sapiens
ctgacagggtgaggacagctgca

SEQ ID NO: 129239 - DNA, 21 bp, Homo sapiens
tataggtatatgtatatatgt

SEQ ID NO: 129240 - DNA, 22 bp, Homo sapiens
tatgtatatatctatatgtatg

SEQ ID NO: 129241 - DNA, 21 bp, Homo sapiens
tatatctatatctatatatct

SEQ ID NO: 129242 - DNA, 21 bp, Homo sapiens
tatatgtatatatgtatatgt

SEQ ID NO: 129243 - DNA, 21 bp, Homo sapiens
atatatgtatatgtatacgta

SEQ ID NO: 129244 - DNA, 21 bp, Homo sapiens
atatatgtatatgtatacgta

SEQ ID NO: 129245 - DNA, 22 bp, Homo sapiens
tatatgtgtatatatatgtatg

SEQ ID NO: 129246 - DNA, 23 bp, Homo sapiens
ctctgtcactcagtctggagtgc

SEQ ID NO: 129247 - DNA, 23 bp, Homo sapiens
ttggacactatcactgtctctat

SEQ ID NO: 129248 - DNA, 23 bp, Homo sapiens
agcagctaaacagccgatagctg

SEQ ID NO: 129249 - DNA, 23 bp, Homo sapiens
gacagagtctcgctctgtcaccc

SEQ ID NO: 129250 - DNA, 23 bp, Homo sapiens
ttatgtatgtgtgtgtatcatgt

SEQ ID NO: 129251 - DNA, 23 bp, Homo sapiens
tgagttcattgtagattctggat

SEQ ID NO: 129252 - DNA, 23 bp, Homo sapiens
tgagttcattgtagattctggat

SEQ ID NO: 129253 - DNA, 18 bp, Homo sapiens
agaatagacggtccagaa

SEQ ID NO: 129254 - DNA, 23 bp, Homo sapiens
tgagttcattgtagattctggat

SEQ ID NO: 129255 - DNA, 23 bp, Homo sapiens
tgagttcattgtagattctggat

SEQ ID NO: 129256 - DNA, 23 bp, Homo sapiens
tgtgagaagagagacaccatttc

SEQ ID NO: 129257 - DNA, 22 bp, Homo sapiens
aatgaccctcttattctctgtg

SEQ ID NO: 129258 - DNA, 23 bp, Homo sapiens
tatctctgagtccttctccagtc

SEQ ID NO: 129259 - DNA, 21 bp, Homo sapiens
tgaggtaggaggatcacttga

SEQ ID NO: 129260 - DNA, 19 bp, Homo sapiens
tccatgtatatatagacat

SEQ ID NO: 129261 - DNA, 20 bp, Homo sapiens
tgtgtatatatatatatgtg

SEQ ID NO: 129262 - DNA, 23 bp, Homo sapiens
taatgtgtatatctatatgtgtg

SEQ ID NO: 129263 - DNA, 22 bp, Homo sapiens
cagcctctgtctcactctcttg

SEQ ID NO: 129264 - DNA, 23 bp, Homo sapiens
ccgagtctcgctctgtctcccag

SEQ ID NO: 129265 - DNA, 23 bp, Homo sapiens
tgagaacagagtgaggtcatggg

SEQ ID NO: 129266 - DNA, 18 bp, Homo sapiens
aagctgctcttgtcctag

SEQ ID NO: 129267 - DNA, 23 bp, Homo sapiens
tctctctgtctgtgtcctaacct

SEQ ID NO: 129268 - DNA, 23 bp, Homo sapiens
ctttgtgtctgaccctctgtaga

SEQ ID NO: 129269 - DNA, 23 bp, Homo sapiens
cagtgtctctgtgtcttagtttt

SEQ ID NO: 129270 - DNA, 22 bp, Homo sapiens
aattgtcaagtacctactgtgt

SEQ ID NO: 129271 - DNA, 23 bp, Homo sapiens
gtgtgatgactctagctggtatg

SEQ ID NO: 129272 - DNA, 23 bp, Homo sapiens
tgaccccatctagtgtgatgact

SEQ ID NO: 129273 - DNA, 22 bp, Homo sapiens
tctctgcctgtcagtctcatct

SEQ ID NO: 129274 - DNA, 20 bp, Homo sapiens
ttatgtagtggtttatgcca

SEQ ID NO: 129275 - DNA, 23 bp, Homo sapiens
ttaactatatatgtagttgttga

SEQ ID NO: 129276 - DNA, 23 bp, Homo sapiens
tgtgtctgtatgtgtgtgtgtat

SEQ ID NO: 129277 - DNA, 23 bp, Homo sapiens
ctgggagagacagacccactctc

SEQ ID NO: 129278 - DNA, 22 bp, Homo sapiens
tatatgcatatatatacatata

SEQ ID NO: 129279 - DNA, 19 bp, Homo sapiens
tgcatgtgtgtatgtacat

SEQ ID NO: 129280 - DNA, 22 bp, Homo sapiens
accttccagatgatgctgcact

SEQ ID NO: 129281 - DNA, 22 bp, Homo sapiens
tcctcagcctctgtgactgtgt

SEQ ID NO: 129282 - DNA, 23 bp, Homo sapiens
tggagtctcactctgtcacccag

SEQ ID NO: 129283 - DNA, 21 bp, Homo sapiens
aggatgccactctgtttggct

SEQ ID NO: 129284 - DNA, 23 bp, Homo sapiens
ttttggttccatatgaattgcaa

SEQ ID NO: 129285 - DNA, 23 bp, Homo sapiens
gacagtgacagcagctgcatgtg

SEQ ID NO: 129286 - DNA, 23 bp, Homo sapiens
tgaacgcatttgcagctggtgct

SEQ ID NO: 129287 - DNA, 23 bp, Homo sapiens
atgtgtttgtgcatgtgcatgtg

SEQ ID NO: 129288 - DNA, 22 bp, Homo sapiens
tttggttccatatgaattctaa

SEQ ID NO: 129289 - DNA, 19 bp, Homo sapiens
taatttggtaggcattgca

SEQ ID NO: 129290 - DNA, 23 bp, Homo sapiens
gctcactgtcagtgtcactgtgc

SEQ ID NO: 129291 - DNA, 21 bp, Homo sapiens
aagttcaatgagaggtgtagg

SEQ ID NO: 129292 - DNA, 23 bp, Homo sapiens
tgtctgtgtgtatgtgtgtctga

SEQ ID NO: 129293 - DNA, 22 bp, Homo sapiens
tttaggttccatatgaatttta

SEQ ID NO: 129294 - DNA, 23 bp, Homo sapiens
ctaattctgtgaaaaaatgatgt

SEQ ID NO: 129295 - DNA, 23 bp, Homo sapiens
aggctgagtcacacagtccctca

SEQ ID NO: 129296 - DNA, 23 bp, Homo sapiens
agtgctctctgactctcacctgt

SEQ ID NO: 129297 - DNA, 23 bp, Homo sapiens
tgcctgagaaatgtcatagtgca

SEQ ID NO: 129298 - DNA, 23 bp, Homo sapiens
tgagagagatgactgagtccagt

SEQ ID NO: 129299 - DNA, 23 bp, Homo sapiens
acaggctcctggagacactgaag

SEQ ID NO: 129300 - DNA, 20 bp, Homo sapiens
ctatctctgtctctctctct

SEQ ID NO: 129301 - DNA, 23 bp, Homo sapiens
tctgggtgagtcagtgagtgtgt

SEQ ID NO: 129302 - DNA, 19 bp, Homo sapiens
agactctgattctctgtgt

SEQ ID NO: 129303 - DNA, 23 bp, Homo sapiens
gtctgggtctctcactctctccc

SEQ ID NO: 129304 - DNA, 22 bp, Homo sapiens
aatgtttcaacacttttggtat

SEQ ID NO: 129305 - DNA, 23 bp, Homo sapiens
tggagtctcactctgtcacccag

SEQ ID NO: 129306 - DNA, 19 bp, Homo sapiens
tttgatttctatatgaatt

SEQ ID NO: 129307 - DNA, 18 bp, Homo sapiens
acagtcagctgtgaggcc

SEQ ID NO: 129308 - DNA, 23 bp, Homo sapiens
gctctctcaggctcacagatggg

SEQ ID NO: 129309 - DNA, 20 bp, Homo sapiens
tgagaaccaggagagcggct

SEQ ID NO: 129310 - DNA, 23 bp, Homo sapiens
ccctctgtgtctgtgtgtccagc

SEQ ID NO: 129311 - DNA, 23 bp, Homo sapiens
agattcacctcctccagcaggta

SEQ ID NO: 129312 - DNA, 23 bp, Homo sapiens
ggcctgagtctctcacacacagt

SEQ ID NO: 129313 - DNA, 19 bp, Homo sapiens
tttatactacttggagttg

SEQ ID NO: 129314 - DNA, 22 bp, Homo sapiens
tgagcttcttggatgtttagat

SEQ ID NO: 129315 - DNA, 19 bp, Homo sapiens
gcactgtctctcaggggct

SEQ ID NO: 129316 - DNA, 21 bp, Homo sapiens
tgtgtgcatgtgtgcacatgc

SEQ ID NO: 129317 - DNA, 22 bp, Homo sapiens
agtgtgtgcatgtgcatgtggt

SEQ ID NO: 129318 - DNA, 23 bp, Homo sapiens
tatgcaatatgaaacaggtgtgt

SEQ ID NO: 129319 - DNA, 20 bp, Homo sapiens
agatcaagctgttagcaagt

SEQ ID NO: 129320 - DNA, 23 bp, Homo sapiens
taagagcctggtttccatttcta

SEQ ID NO: 129321 - DNA, 22 bp, Homo sapiens
ttaacaccactcactatagact

SEQ ID NO: 129322 - DNA, 23 bp, Homo sapiens
agagtctcactctgtcacccagg

SEQ ID NO: 129323 - DNA, 23 bp, Homo sapiens
gaaatgttacttcaacctgctct

SEQ ID NO: 129324 - DNA, 23 bp, Homo sapiens
gtgtgtgcgtgtgcatgtgcatg

SEQ ID NO: 129325 - DNA, 23 bp, Homo sapiens
cttcaaacacagccatgtaagtt

SEQ ID NO: 129326 - DNA, 22 bp, Homo sapiens
aaaatggttgttgagaaaattg

SEQ ID NO: 129327 - DNA, 23 bp, Homo sapiens
tgaattctccctcttcaatacat

SEQ ID NO: 129328 - DNA, 19 bp, Homo sapiens
actggctactaatgaagaa

SEQ ID NO: 129329 - DNA, 20 bp, Homo sapiens
tgcttcacttttccatgtgt

SEQ ID NO: 129330 - DNA, 23 bp, Homo sapiens
tagagacagaacagtgactgcag

SEQ ID NO: 129331 - DNA, 18 bp, Homo sapiens
tctaattctatgaagaaa

SEQ ID NO: 129332 - DNA, 23 bp, Homo sapiens
tgcctgtgtgtgtgcatgttctt

SEQ ID NO: 129333 - DNA, 23 bp, Homo sapiens
actcactgtgactggttgtcctg

SEQ ID NO: 129334 - DNA, 23 bp, Homo sapiens
gcatgtatatgtatgtgtgtgtg

SEQ ID NO: 129335 - DNA, 23 bp, Homo sapiens
gcatgtatatgtatgtgtgtgtg

SEQ ID NO: 129336 - DNA, 23 bp, Homo sapiens
tatgtgtatatatatgtatgtat

SEQ ID NO: 129337 - DNA, 22 bp, Homo sapiens
cctgtcacagtcagtttgggga

SEQ ID NO: 129338 - DNA, 23 bp, Homo sapiens
tctgtgcgtgagtccctgtgtgt

SEQ ID NO: 129339 - DNA, 23 bp, Homo sapiens
agtccctctgtctgtgtgtgcct

SEQ ID NO: 129340 - DNA, 21 bp, Homo sapiens
gatgattagttaaggtcctag

SEQ ID NO: 129341 - DNA, 23 bp, Homo sapiens
tgtcagtcagtcaggctgtaaat

SEQ ID NO: 129342 - DNA, 20 bp, Homo sapiens
tgcctgggaccctgaatgcc

SEQ ID NO: 129343 - DNA, 18 bp, Homo sapiens
atcccacagctgcaggtc

SEQ ID NO: 129344 - DNA, 22 bp, Homo sapiens
agtcaaaagatggagaaaagga

SEQ ID NO: 129345 - DNA, 23 bp, Homo sapiens
aggtattttattctttttgtagc

SEQ ID NO: 129346 - DNA, 23 bp, Homo sapiens
tctggctgagagaactgactgcg

SEQ ID NO: 129347 - DNA, 23 bp, Homo sapiens
gcctgcgtccctgtgtccctgag

SEQ ID NO: 129348 - DNA, 18 bp, Homo sapiens
ctgtgtgtgtgtgtgcgc

SEQ ID NO: 129349 - DNA, 23 bp, Homo sapiens
gtgtctgtgtgtgtgtgtgtacg

SEQ ID NO: 129350 - DNA, 23 bp, Homo sapiens
tcacgctctctggctttttacag

SEQ ID NO: 129351 - DNA, 22 bp, Homo sapiens
aatgcagagcctcggtctcaac

SEQ ID NO: 129352 - DNA, 22 bp, Homo sapiens
agtgtgagcacagagagcccac

SEQ ID NO: 129353 - DNA, 22 bp, Homo sapiens
gtctcgctcactcagtgctcaa

SEQ ID NO: 129354 - DNA, 23 bp, Homo sapiens
ttgtgtctggatgaaaaccgaga

SEQ ID NO: 129355 - DNA, 23 bp, Homo sapiens
ctgtcaccctctgtgggtgtgca

SEQ ID NO: 129356 - DNA, 23 bp, Homo sapiens
atgcatgcatgcatgtgtgtgcg

SEQ ID NO: 129357 - DNA, 23 bp, Homo sapiens
ttctgcctgggagttttgtctgg

SEQ ID NO: 129358 - DNA, 21 bp, Homo sapiens
aaacacagggataaacatttc

SEQ ID NO: 129359 - DNA, 22 bp, Homo sapiens
gtgggtgcatatgtgcatgtat

SEQ ID NO: 129360 - DNA, 22 bp, Homo sapiens
tatgtgtgtgtgtatgtgcatg

SEQ ID NO: 129361 - DNA, 20 bp, Homo sapiens
ccagtctctcactgcctctc

SEQ ID NO: 129362 - DNA, 23 bp, Homo sapiens
tgtctttcactttgattatctta

SEQ ID NO: 129363 - DNA, 21 bp, Homo sapiens
gttcaaaggaaggatagaatt

SEQ ID NO: 129364 - DNA, 18 bp, Homo sapiens
gtatagatatgtacgtat

SEQ ID NO: 129365 - DNA, 23 bp, Homo sapiens
agcagctctggaactgagtgtgc

SEQ ID NO: 129366 - DNA, 23 bp, Homo sapiens
tgtgtctcagggaatttcctgag

SEQ ID NO: 129367 - DNA, 23 bp, Homo sapiens
cacctccagtctgtctctctctc

SEQ ID NO: 129368 - DNA, 22 bp, Homo sapiens
actccgaagttggtgctctctt

SEQ ID NO: 129369 - DNA, 18 bp, Homo sapiens
gtctctctgggtctctct

SEQ ID NO: 129370 - DNA, 23 bp, Homo sapiens
cacggtctctgtctttgtgcatg

SEQ ID NO: 129371 - DNA, 23 bp, Homo sapiens
agtctctctcggtcacatgagga

SEQ ID NO: 129372 - DNA, 22 bp, Homo sapiens
gtcggctcactctgtctctcac

SEQ ID NO: 129373 - DNA, 23 bp, Homo sapiens
tgtgtgtatatataaatgagtac

SEQ ID NO: 129374 - DNA, 23 bp, Homo sapiens
tgtgtgtatgtatatgtgtgtgt

SEQ ID NO: 129375 - DNA, 23 bp, Homo sapiens
atgtgtgtgcatatgtatgtgtg

SEQ ID NO: 129376 - DNA, 23 bp, Homo sapiens
atgtgtgtatatgtatatgtgta

SEQ ID NO: 129377 - DNA, 23 bp, Homo sapiens
tgtgtgtgcatatgtgtgtatat

SEQ ID NO: 129378 - DNA, 23 bp, Homo sapiens
aagacctaaaactttgactgtca

SEQ ID NO: 129379 - DNA, 23 bp, Homo sapiens
acaggctcctggagacactgaag

SEQ ID NO: 129380 - DNA, 19 bp, Homo sapiens
tgtccatatatacatgtat

SEQ ID NO: 129381 - DNA, 23 bp, Homo sapiens
tacatatgcatatgtatacgatt

SEQ ID NO: 129382 - DNA, 22 bp, Homo sapiens
tgtctctgtgtctagttcctct

SEQ ID NO: 129383 - DNA, 23 bp, Homo sapiens
aaactggatggagaatgagtttg

SEQ ID NO: 129384 - DNA, 23 bp, Homo sapiens
caattcagtgtttgatgttgtga

SEQ ID NO: 129385 - DNA, 23 bp, Homo sapiens
actgagtctcactctgtcgccca

SEQ ID NO: 129386 - DNA, 19 bp, Homo sapiens
tcactgcaacctctgtctc

SEQ ID NO: 129387 - DNA, 23 bp, Homo sapiens
agagtctcactctgtcacccagg

SEQ ID NO: 129388 - DNA, 23 bp, Homo sapiens
tgtggagagaagagtgtgatgtc

SEQ ID NO: 129389 - DNA, 21 bp, Homo sapiens
acagtgtaaaagtgttccctt

SEQ ID NO: 129390 - DNA, 22 bp, Homo sapiens
agtgagatgatattgcattgtg

SEQ ID NO: 129391 - DNA, 23 bp, Homo sapiens
tgagttcattgtagattctggat

SEQ ID NO: 129392 - DNA, 23 bp, Homo sapiens
tgagttcattgtagattctggat

SEQ ID NO: 129393 - DNA, 21 bp, Homo sapiens
aataccatgtgtttctgatgt

SEQ ID NO: 129394 - DNA, 21 bp, Homo sapiens
tcagactagaatcagagctga

SEQ ID NO: 129395 - DNA, 18 bp, Homo sapiens
ttaatttgattttatttt

SEQ ID NO: 129396 - DNA, 21 bp, Homo sapiens
tcagtgcctcccttagtctct

SEQ ID NO: 129397 - DNA, 19 bp, Homo sapiens
ctgtgttttactgtctgct

SEQ ID NO: 129398 - DNA, 23 bp, Homo sapiens
atatctatgtatatatctctgta

SEQ ID NO: 129399 - DNA, 18 bp, Homo sapiens
tatatctgtatatctata

SEQ ID NO: 129400 - DNA, 23 bp, Homo sapiens
aacaagtctgattttgtatttct

SEQ ID NO: 129401 - DNA, 22 bp, Homo sapiens
aggaaaagaacccggacttgta

SEQ ID NO: 129402 - DNA, 23 bp, Homo sapiens
tctttagaagtggaactgctggg

SEQ ID NO: 129403 - DNA, 22 bp, Homo sapiens
atgtatccatatatatgtatcc

SEQ ID NO: 129404 - DNA, 23 bp, Homo sapiens
ttcactgtgtctgtgcattggct

SEQ ID NO: 129405 - DNA, 19 bp, Homo sapiens
tgtatatatatgtatgtgt

SEQ ID NO: 129406 - DNA, 21 bp, Homo sapiens
tatgtacatatatgtatatgt

SEQ ID NO: 129407 - DNA, 20 bp, Homo sapiens
agagaggacagtcaggcgac

SEQ ID NO: 129408 - DNA, 21 bp, Homo sapiens
ttggttgttgatggggttctc

SEQ ID NO: 129409 - DNA, 23 bp, Homo sapiens
accttcagtgaaatgttggctgg

SEQ ID NO: 129410 - DNA, 23 bp, Homo sapiens
aaatgtgtctaattgttgagtgt

SEQ ID NO: 129411 - DNA, 23 bp, Homo sapiens
gggtctcactctgtcacccaggc

SEQ ID NO: 129412 - DNA, 23 bp, Homo sapiens
gtagtgcattttgagttgttggg

SEQ ID NO: 129413 - DNA, 23 bp, Homo sapiens
agtctcaggattgatgctgtgac

SEQ ID NO: 129414 - DNA, 19 bp, Homo sapiens
tagagccagggtttgaatg

SEQ ID NO: 129415 - DNA, 23 bp, Homo sapiens
tgagttcattgtagattctggat

SEQ ID NO: 129416 - DNA, 23 bp, Homo sapiens
tgagttcattgtagattctggat

SEQ ID NO: 129417 - DNA, 21 bp, Homo sapiens
ttttgagacggagtctcactg

SEQ ID NO: 129418 - DNA, 22 bp, Homo sapiens
caagtcattttgttcaactgag

SEQ ID NO: 129419 - DNA, 23 bp, Homo sapiens
tgagttcattgtagattctggat

SEQ ID NO: 129420 - DNA, 22 bp, Homo sapiens
atggtgcatatattttgtgata

SEQ ID NO: 129421 - DNA, 19 bp, Homo sapiens
tgagtggaatgtagtttgg

SEQ ID NO: 129422 - DNA, 21 bp, Homo sapiens
tgcatatatatgtatatatgt

SEQ ID NO: 129423 - DNA, 21 bp, Homo sapiens
tatgcatatatgtatatatgt

SEQ ID NO: 129424 - DNA, 23 bp, Homo sapiens
tatgcatatatatacatatgtta

SEQ ID NO: 129425 - DNA, 21 bp, Homo sapiens
atatatgtgtgatatatatgc

SEQ ID NO: 129426 - DNA, 23 bp, Homo sapiens
tatgcatatttatacatatgtgt

SEQ ID NO: 129427 - DNA, 23 bp, Homo sapiens
atatatgcatgcatatatatgca

SEQ ID NO: 129428 - DNA, 20 bp, Homo sapiens
tatatatgtgtatatgtaca

SEQ ID NO: 129429 - DNA, 23 bp, Homo sapiens
atatatgtatatgtatatgtgta

SEQ ID NO: 129430 - DNA, 21 bp, Homo sapiens
atatgtatatgtatatatatg

SEQ ID NO: 129431 - DNA, 23 bp, Homo sapiens
tgtgtcttggtgtatttgtcttt

SEQ ID NO: 129432 - DNA, 23 bp, Homo sapiens
gagacagagtctcactctgtcat

SEQ ID NO: 129433 - DNA, 21 bp, Homo sapiens
ttctgtgactgttagttgttt

SEQ ID NO: 129434 - DNA, 23 bp, Homo sapiens
agtcctgaaggtcactgactctg

SEQ ID NO: 129435 - DNA, 23 bp, Homo sapiens
ctcccagagcccctggaactctg

SEQ ID NO: 129436 - DNA, 23 bp, Homo sapiens
tcccagagcccctggaactctgg

SEQ ID NO: 129437 - DNA, 23 bp, Homo sapiens
tcccagagcccctggaactctgg

SEQ ID NO: 129438 - DNA, 23 bp, Homo sapiens
tcccagagcccctggaactctgg

SEQ ID NO: 129439 - DNA, 19 bp, Homo sapiens
atgtatgtgtgtatgtata

SEQ ID NO: 129440 - DNA, 22 bp, Homo sapiens
ttgtatgtatgtatgtgtgtat

SEQ ID NO: 129441 - DNA, 21 bp, Homo sapiens
tatatacacacacatatggca

SEQ ID NO: 129442 - DNA, 21 bp, Homo sapiens
aatagatagttgaagtagcct

SEQ ID NO: 129443 - DNA, 18 bp, Homo sapiens
tagaatgatagtgtgtca

SEQ ID NO: 129444 - DNA, 23 bp, Homo sapiens
tgagttcattgtagattctggat

SEQ ID NO: 129445 - DNA, 23 bp, Homo sapiens
tgagttcattgtagattctggat

SEQ ID NO: 129446 - DNA, 21 bp, Homo sapiens
ttattaaatttagtagcagtt

SEQ ID NO: 129447 - DNA, 19 bp, Homo sapiens
atctttgtattagtcaggg

SEQ ID NO: 129448 - DNA, 23 bp, Homo sapiens
atatgtacatcttgtgctccaca

SEQ ID NO: 129449 - DNA, 20 bp, Homo sapiens
accatgaagcttgaaaactc

SEQ ID NO: 129450 - DNA, 23 bp, Homo sapiens
ttgaatctctggttttgaaagct

SEQ ID NO: 129451 - DNA, 22 bp, Homo sapiens
tctctctctcagtgacttagga

SEQ ID NO: 129452 - DNA, 23 bp, Homo sapiens
atttccttcgttgagaaagcaat

SEQ ID NO: 129453 - DNA, 23 bp, Homo sapiens
gagtgtctgactcactgggtctg

SEQ ID NO: 129454 - DNA, 19 bp, Homo sapiens
tatacatataatatgtata

SEQ ID NO: 129455 - DNA, 23 bp, Homo sapiens
caagactttacattcttttgtct

SEQ ID NO: 129456 - DNA, 20 bp, Homo sapiens
caaagtccagagttagtagg

SEQ ID NO: 129457 - DNA, 22 bp, Homo sapiens
tattgctcactgcagcctctaa

SEQ ID NO: 129458 - DNA, 22 bp, Homo sapiens
tgagatggagtctcactctgtt

SEQ ID NO: 129459 - DNA, 19 bp, Homo sapiens
aaagtggaggcttctgttt

SEQ ID NO: 129460 - DNA, 19 bp, Homo sapiens
acacgtataactatgttgt

SEQ ID NO: 129461 - DNA, 23 bp, Homo sapiens
tttcactagagacttagatgatg

SEQ ID NO: 129462 - DNA, 23 bp, Homo sapiens
tttgtcgagatggctctgggtta

SEQ ID NO: 129463 - DNA, 20 bp, Homo sapiens
gaagagagagaatgatgaga

SEQ ID NO: 129464 - DNA, 23 bp, Homo sapiens
agtaaatatgattgcttcttttg

SEQ ID NO: 129465 - DNA, 22 bp, Homo sapiens
tatgtgcatgtatatgtgagtg

SEQ ID NO: 129466 - DNA, 23 bp, Homo sapiens
ggtgacacggagtctctgtcgtt

SEQ ID NO: 129467 - DNA, 23 bp, Homo sapiens
tatgtctgtgcatatctagattc

SEQ ID NO: 129468 - DNA, 23 bp, Homo sapiens
atatgtgcatatctagaatctag

SEQ ID NO: 129469 - DNA, 23 bp, Homo sapiens
gtgtatatatctatgtatgtgtg

SEQ ID NO: 129470 - DNA, 23 bp, Homo sapiens
gtgcgtgtgtgtgtctgtccttc

SEQ ID NO: 129471 - DNA, 23 bp, Homo sapiens
gttggatgcattggtagtttagt

SEQ ID NO: 129472 - DNA, 23 bp, Homo sapiens
atgaagattttctgctttggttg

SEQ ID NO: 129473 - DNA, 23 bp, Homo sapiens
actaatgagtcattgttcttctg

SEQ ID NO: 129474 - DNA, 23 bp, Homo sapiens
catagtctcgctctgtcgctctg

SEQ ID NO: 129475 - DNA, 20 bp, Homo sapiens
tggaggcattagatgacttt

SEQ ID NO: 129476 - DNA, 23 bp, Homo sapiens
gtgagtcagtgagtgagtggaga

SEQ ID NO: 129477 - DNA, 23 bp, Homo sapiens
taccctctagcagttggtctcta

SEQ ID NO: 129478 - DNA, 23 bp, Homo sapiens
gtgtgcctgtgacacagcctcag

SEQ ID NO: 129479 - DNA, 21 bp, Homo sapiens
tgtaagtaagtgaattccgca

SEQ ID NO: 129480 - DNA, 20 bp, Homo sapiens
tgtgtgtgtgtatatataga

SEQ ID NO: 129481 - DNA, 23 bp, Homo sapiens
actgtctgtgtgtgttatctcag

SEQ ID NO: 129482 - DNA, 23 bp, Homo sapiens
tttgagaccgggtctcactctat

SEQ ID NO: 129483 - DNA, 23 bp, Homo sapiens
aattttgaactgtttcatatcag

SEQ ID NO: 129484 - DNA, 23 bp, Homo sapiens
attgtgtgtgtgtgtctgtatat

SEQ ID NO: 129485 - DNA, 20 bp, Homo sapiens
ataacacagacacacacata

SEQ ID NO: 129486 - DNA, 19 bp, Homo sapiens
tgtgtatttatatatgcac

SEQ ID NO: 129487 - DNA, 18 bp, Homo sapiens
atacagactagtattcat

SEQ ID NO: 129488 - DNA, 20 bp, Homo sapiens
atatactatctctgctgagg

SEQ ID NO: 129489 - DNA, 23 bp, Homo sapiens
acagagtctcccactgtcaccca

SEQ ID NO: 129490 - DNA, 23 bp, Homo sapiens
tgagttcattgtagattctggat

SEQ ID NO: 129491 - DNA, 23 bp, Homo sapiens
tgagttcattgtagattctggat

SEQ ID NO: 129492 - DNA, 23 bp, Homo sapiens
ctctgggtgagtcagtgagtgag

SEQ ID NO: 129493 - DNA, 23 bp, Homo sapiens
atagagctgtgtgtgtgtgtgtg

SEQ ID NO: 129494 - DNA, 23 bp, Homo sapiens
cagggtctgcctctgtctctcag

SEQ ID NO: 129495 - DNA, 20 bp, Homo sapiens
tacagaggcacgaacttggc

SEQ ID NO: 129496 - DNA, 23 bp, Homo sapiens
tatatgatggaatatatatgata

SEQ ID NO: 129497 - DNA, 23 bp, Homo sapiens
tatatatgatggaatatatatga

SEQ ID NO: 129498 - DNA, 23 bp, Homo sapiens
tatcacattgtggttttgatttg

SEQ ID NO: 129499 - DNA, 23 bp, Homo sapiens
tatacatatgtatagatatatag

SEQ ID NO: 129500 - DNA, 23 bp, Homo sapiens
gtatatctatacatatgtataga

SEQ ID NO: 129501 - DNA, 18 bp, Homo sapiens
tgtgccactgtgcctggc

SEQ ID NO: 129502 - DNA, 23 bp, Homo sapiens
agagtttcatcatgtttctcagg

SEQ ID NO: 129503 - DNA, 23 bp, Homo sapiens
tggacagtaaagaagaatgggca

SEQ ID NO: 129504 - DNA, 22 bp, Homo sapiens
ttagggtcaatttggaaatcag

SEQ ID NO: 129505 - DNA, 23 bp, Homo sapiens
ctctctaagtgtctgaaaatgct

SEQ ID NO: 129506 - DNA, 23 bp, Homo sapiens
aaaagtatgacttatctgtatga

SEQ ID NO: 129507 - DNA, 21 bp, Homo sapiens
caatgtggttgctttgtgaga

SEQ ID NO: 129508 - DNA, 22 bp, Homo sapiens
tagagtactgttattggtgtag

SEQ ID NO: 129509 - DNA, 23 bp, Homo sapiens
aactgtagagtttttcttttttt

SEQ ID NO: 129510 - DNA, 21 bp, Homo sapiens
gaattgataaagataatgttt

SEQ ID NO: 129511 - DNA, 19 bp, Homo sapiens
aaagtgctgggattacagg

SEQ ID NO: 129512 - DNA, 22 bp, Homo sapiens
tataacaaagtacctgagactg

SEQ ID NO: 129513 - DNA, 23 bp, Homo sapiens
agacagtctcgctctgttcacca

SEQ ID NO: 129514 - DNA, 18 bp, Homo sapiens
atagggagtagaactctt

SEQ ID NO: 129515 - DNA, 18 bp, Homo sapiens
cagtcttgctctgttgcc

SEQ ID NO: 129516 - DNA, 21 bp, Homo sapiens
agaaggtcctggaggccttga

SEQ ID NO: 129517 - DNA, 23 bp, Homo sapiens
ttggcactgccacagttctcact

SEQ ID NO: 129518 - DNA, 22 bp, Homo sapiens
tgtgagcatgcgagtgtgcgtg

SEQ ID NO: 129519 - DNA, 18 bp, Homo sapiens
cattgatatgaggtctgt

SEQ ID NO: 129520 - DNA, 23 bp, Homo sapiens
gtttgctaatatcttgttaagga

SEQ ID NO: 129521 - DNA, 22 bp, Homo sapiens
tttcgagatggagtcttgctct

SEQ ID NO: 129522 - DNA, 19 bp, Homo sapiens
gccaccccttcaatcctgt

SEQ ID NO: 129523 - DNA, 20 bp, Homo sapiens
actgcatgcttgtctgcctc

SEQ ID NO: 129524 - DNA, 23 bp, Homo sapiens
gactgactctcacagactcacag

SEQ ID NO: 129525 - DNA, 20 bp, Homo sapiens
agctggaggagacagtcaag

SEQ ID NO: 129526 - DNA, 21 bp, Homo sapiens
ttatttggtgcataaatgttg

SEQ ID NO: 129527 - DNA, 21 bp, Homo sapiens
tgcaatggtgtgatcttggct

SEQ ID NO: 129528 - DNA, 19 bp, Homo sapiens
tatgtgtgtatatatacgt

SEQ ID NO: 129529 - DNA, 21 bp, Homo sapiens
atatacgtatatatatgtgta

SEQ ID NO: 129530 - DNA, 19 bp, Homo sapiens
tctctctttctgagtcatt

SEQ ID NO: 129531 - DNA, 23 bp, Homo sapiens
aaactctctctctttgtctgacg

SEQ ID NO: 129532 - DNA, 23 bp, Homo sapiens
tggcactcatcatcttcacctgg

SEQ ID NO: 129533 - DNA, 18 bp, Homo sapiens
tatacatacgtatgtgtg

SEQ ID NO: 129534 - DNA, 23 bp, Homo sapiens
tatgtatatacatacgtatgtgt

SEQ ID NO: 129535 - DNA, 22 bp, Homo sapiens
tatgtatatacatacgtatgtg

SEQ ID NO: 129536 - DNA, 21 bp, Homo sapiens
agctaatattgttatgtgtga

SEQ ID NO: 129537 - DNA, 23 bp, Homo sapiens
tgagttcattgtagattctggat

SEQ ID NO: 129538 - DNA, 23 bp, Homo sapiens
tgagttcattgtagattctggat

SEQ ID NO: 129539 - DNA, 23 bp, Homo sapiens
actctggctgtcagtcacttctc

SEQ ID NO: 129540 - DNA, 23 bp, Homo sapiens
catctctctctctctgaagtttc

SEQ ID NO: 129541 - DNA, 18 bp, Homo sapiens
tggagaggctagtgcctg

SEQ ID NO: 129542 - DNA, 19 bp, Homo sapiens
actgtatatatatatagct

SEQ ID NO: 129543 - DNA, 21 bp, Homo sapiens
atgtgtgtgtgtatatacatg

SEQ ID NO: 129544 - DNA, 23 bp, Homo sapiens
tgagttcattgtagattctggat

SEQ ID NO: 129545 - DNA, 23 bp, Homo sapiens
tgagttcattgtagattctggat

SEQ ID NO: 129546 - DNA, 22 bp, Homo sapiens
aattctcagcacaatggataca

SEQ ID NO: 129547 - DNA, 23 bp, Homo sapiens
tgtgtgtgtgcttatatttacct

SEQ ID NO: 129548 - DNA, 23 bp, Homo sapiens
acatatacatggtcatgatgaag

SEQ ID NO: 129549 - DNA, 18 bp, Homo sapiens
tctcatgacagtagcagt

SEQ ID NO: 129550 - DNA, 18 bp, Homo sapiens
aaagaactttctcagggc

SEQ ID NO: 129551 - DNA, 22 bp, Homo sapiens
tcagcatgtataatgtacagta

SEQ ID NO: 129552 - DNA, 23 bp, Homo sapiens
gatggagtctcactctgttgctc

SEQ ID NO: 129553 - DNA, 18 bp, Homo sapiens
tatgtgagtgtgtataca

SEQ ID NO: 129554 - DNA, 18 bp, Homo sapiens
catgtgtgtgtgtgtata

SEQ ID NO: 129555 - DNA, 21 bp, Homo sapiens
tcacttgaggcatcaatgatc

SEQ ID NO: 129556 - DNA, 19 bp, Homo sapiens
aggctggagtacagtggca

SEQ ID NO: 129557 - DNA, 21 bp, Homo sapiens
tacctgaatttggaaactagt

SEQ ID NO: 129558 - DNA, 21 bp, Homo sapiens
tttgagacaacagactgagca

SEQ ID NO: 129559 - DNA, 18 bp, Homo sapiens
agctgggactacaggtac

SEQ ID NO: 129560 - DNA, 23 bp, Homo sapiens
tcactctctgagattcatctttc

SEQ ID NO: 129561 - DNA, 21 bp, Homo sapiens
ataggtgagttgaatggggat

SEQ ID NO: 129562 - DNA, 23 bp, Homo sapiens
tgtatgtgtatatatacacatgt

SEQ ID NO: 129563 - DNA, 19 bp, Homo sapiens
tatatctatatgtatgtgt

SEQ ID NO: 129564 - DNA, 23 bp, Homo sapiens
tatatctgtatgtgtatatgtgt

SEQ ID NO: 129565 - DNA, 22 bp, Homo sapiens
atatatctatatgtatatgtgt

SEQ ID NO: 129566 - DNA, 22 bp, Homo sapiens
atgtatgtatgtatgtgtgtgc

SEQ ID NO: 129567 - DNA, 23 bp, Homo sapiens
atgtatgtgtgtatatatgtgtg

SEQ ID NO: 129568 - DNA, 18 bp, Homo sapiens
aatgactgccagcattgc

SEQ ID NO: 129569 - DNA, 23 bp, Homo sapiens
agagggaatagactaagtgatct

SEQ ID NO: 129570 - DNA, 23 bp, Homo sapiens
gggtctcactctgtcagccaggc

SEQ ID NO: 129571 - DNA, 23 bp, Homo sapiens
gctgaggtagaagaatcacttga

SEQ ID NO: 129572 - DNA, 23 bp, Homo sapiens
gtgaaaacagtagcacatttggg

SEQ ID NO: 129573 - DNA, 23 bp, Homo sapiens
gcagagatgagactgagcagaag

SEQ ID NO: 129574 - DNA, 22 bp, Homo sapiens
tggttcacagaaggcagtgagc

SEQ ID NO: 129575 - DNA, 23 bp, Homo sapiens
gttctatgcttgatgttggctat

SEQ ID NO: 129576 - DNA, 23 bp, Homo sapiens
attctgagggtttttgaagaaga

SEQ ID NO: 129577 - DNA, 22 bp, Homo sapiens
tatatgtgtttccatatgtagt

SEQ ID NO: 129578 - DNA, 21 bp, Homo sapiens
tgtgtgtatatatatatgtgt

SEQ ID NO: 129579 - DNA, 23 bp, Homo sapiens
gagaaggagtctcgctctgtcac

SEQ ID NO: 129580 - DNA, 22 bp, Homo sapiens
aatgcttgtaatttgtcgtgtg

SEQ ID NO: 129581 - DNA, 20 bp, Homo sapiens
aggaactttgtcttttgata

SEQ ID NO: 129582 - DNA, 23 bp, Homo sapiens
tgtcaggctcactctttccttat

SEQ ID NO: 129583 - DNA, 23 bp, Homo sapiens
gaaagcaacagaatatgttttgt

SEQ ID NO: 129584 - DNA, 21 bp, Homo sapiens
agccagaactgagagggcaca

SEQ ID NO: 129585 - DNA, 23 bp, Homo sapiens
ttcccagagctatgctgtgtgca

SEQ ID NO: 129586 - DNA, 23 bp, Homo sapiens
tgtgtgtgcatgtgcatgtgtgt

SEQ ID NO: 129587 - DNA, 23 bp, Homo sapiens
gttgaatctagtttagtatttgt

SEQ ID NO: 129588 - DNA, 18 bp, Homo sapiens
ttgcactcaagtaagcag

SEQ ID NO: 129589 - DNA, 23 bp, Homo sapiens
tttaaatggatttgaaaccatat

SEQ ID NO: 129590 - DNA, 23 bp, Homo sapiens
ttttttggttccatatgaaattt

SEQ ID NO: 129591 - DNA, 22 bp, Homo sapiens
tgtcattctgtgtttttttagt

SEQ ID NO: 129592 - DNA, 19 bp, Homo sapiens
aatcagatgatcatgattc

SEQ ID NO: 129593 - DNA, 20 bp, Homo sapiens
tgtatatatgtatatgtgta

SEQ ID NO: 129594 - DNA, 23 bp, Homo sapiens
tgtatgtgtatatgtatatgtgt

SEQ ID NO: 129595 - DNA, 19 bp, Homo sapiens
ctacatatgtatgccacca

SEQ ID NO: 129596 - DNA, 23 bp, Homo sapiens
tctgtgcctgtcaccctcagaga

SEQ ID NO: 129597 - DNA, 23 bp, Homo sapiens
ttttgaaagtttttgtagtggca

SEQ ID NO: 129598 - DNA, 23 bp, Homo sapiens
tgtatgtgtgtgtatatacaggt

SEQ ID NO: 129599 - DNA, 20 bp, Homo sapiens
tatatgtacatatacatatg

SEQ ID NO: 129600 - DNA, 23 bp, Homo sapiens
ctgagtctcactctgtcacccag

SEQ ID NO: 129601 - DNA, 23 bp, Homo sapiens
catgcatgtatagatagatagta

SEQ ID NO: 129602 - DNA, 23 bp, Homo sapiens
aaagtgcttgtatctattcagaa

SEQ ID NO: 129603 - DNA, 23 bp, Homo sapiens
caaaggcagactggaatagaagt

SEQ ID NO: 129604 - DNA, 23 bp, Homo sapiens
tggagtctcactctgtcacccag

SEQ ID NO: 129605 - DNA, 23 bp, Homo sapiens
taagcagcttttgtatgcagtgt

SEQ ID NO: 129606 - DNA, 23 bp, Homo sapiens
tatagatatataagcatatatgt

SEQ ID NO: 129607 - DNA, 22 bp, Homo sapiens
tatgtgtgtttgtatatacgtg

SEQ ID NO: 129608 - DNA, 19 bp, Homo sapiens
tgatgtattcgtgaagtag

SEQ ID NO: 129609 - DNA, 21 bp, Homo sapiens
tgagacagagtctcactctat

SEQ ID NO: 129610 - DNA, 22 bp, Homo sapiens
aagtgcaatgatttggcactgt

SEQ ID NO: 129611 - DNA, 23 bp, Homo sapiens
agagtctcactctgtcacccagg

SEQ ID NO: 129612 - DNA, 23 bp, Homo sapiens
agacacagtctcagtctgtcacc

SEQ ID NO: 129613 - DNA, 23 bp, Homo sapiens
gtgtgtgtgtctgcctgtctgtc

SEQ ID NO: 129614 - DNA, 23 bp, Homo sapiens
gatggagtctctctgtgtcaccc

SEQ ID NO: 129615 - DNA, 23 bp, Homo sapiens
atgtggtagttgcatttttagtt

SEQ ID NO: 129616 - DNA, 22 bp, Homo sapiens
tctcactgtgtcactcaggctg

SEQ ID NO: 129617 - DNA, 23 bp, Homo sapiens
tagctcactgcagcttcaaactc

SEQ ID NO: 129618 - DNA, 22 bp, Homo sapiens
tgtgtgtatatatatacacata

SEQ ID NO: 129619 - DNA, 19 bp, Homo sapiens
actgagtctcactctgtcg

SEQ ID NO: 129620 - DNA, 23 bp, Homo sapiens
ggagtctcactctgtctcccagg

SEQ ID NO: 129621 - DNA, 18 bp, Homo sapiens
agtggcaggatctcaact

SEQ ID NO: 129622 - DNA, 21 bp, Homo sapiens
ggttttctgtggaaaggaata

SEQ ID NO: 129623 - DNA, 18 bp, Homo sapiens
agggttgacaatggaatg

SEQ ID NO: 129624 - DNA, 23 bp, Homo sapiens
tgagatggagtctcactctgttg

SEQ ID NO: 129625 - DNA, 23 bp, Homo sapiens
aaaggatttgaagaaatcactat

SEQ ID NO: 129626 - DNA, 23 bp, Homo sapiens
atttcaccatgttgaccaggctg

SEQ ID NO: 129627 - DNA, 23 bp, Homo sapiens
gggtgtcagaacagtgtcagcag

SEQ ID NO: 129628 - DNA, 18 bp, Homo sapiens
ctgacaactgtaggccca

SEQ ID NO: 129629 - DNA, 23 bp, Homo sapiens
ttcttgagatggagtctcgctct

SEQ ID NO: 129630 - DNA, 23 bp, Homo sapiens
tatctgtatatatatatatgtgt

SEQ ID NO: 129631 - DNA, 23 bp, Homo sapiens
acagtgacaggttgagaattggg

SEQ ID NO: 129632 - DNA, 19 bp, Homo sapiens
atgtggtaccaggttctct

SEQ ID NO: 129633 - DNA, 21 bp, Homo sapiens
ttcttacttctgccagccaca

SEQ ID NO: 129634 - DNA, 23 bp, Homo sapiens
gagtctcactcagtcgcccaggc

SEQ ID NO: 129635 - DNA, 23 bp, Homo sapiens
gatcataattcactgtagccttg

SEQ ID NO: 129636 - DNA, 23 bp, Homo sapiens
gactgagtctcgctctgtcaccc

SEQ ID NO: 129637 - DNA, 23 bp, Homo sapiens
gagtctcgctcactcagtgctca

SEQ ID NO: 129638 - DNA, 21 bp, Homo sapiens
attgcactgtagcctgggtga

SEQ ID NO: 129639 - DNA, 23 bp, Homo sapiens
agacagagtcttactctgtcacc

SEQ ID NO: 129640 - DNA, 23 bp, Homo sapiens
ggagtctctctctgtcacccagg

SEQ ID NO: 129641 - DNA, 23 bp, Homo sapiens
tgcagtggcatgatcttggctca

SEQ ID NO: 129642 - DNA, 23 bp, Homo sapiens
gggtctcactctgtcacccaggc

SEQ ID NO: 129643 - DNA, 23 bp, Homo sapiens
ggagtctctctctgtcacccagg

SEQ ID NO: 129644 - DNA, 23 bp, Homo sapiens
tgcagtggcatgatcttggctca

SEQ ID NO: 129645 - DNA, 21 bp, Homo sapiens
tgtgttgcttcttactgtttt

SEQ ID NO: 129646 - DNA, 22 bp, Homo sapiens
ttctctctgtggttatgacatt

SEQ ID NO: 129647 - DNA, 21 bp, Homo sapiens
ttggtccttacaatgtaaggt

SEQ ID NO: 129648 - DNA, 23 bp, Homo sapiens
cactgggtgacacactggctgac

SEQ ID NO: 129649 - DNA, 23 bp, Homo sapiens
gagtctcactctgtcactcagct

SEQ ID NO: 129650 - DNA, 23 bp, Homo sapiens
gggtcacactctgtcacccaggc

SEQ ID NO: 129651 - DNA, 23 bp, Homo sapiens
ttaaatgcatgtttaatccagag

SEQ ID NO: 129652 - DNA, 19 bp, Homo sapiens
agacaaggtctcgctctgt

SEQ ID NO: 129653 - DNA, 18 bp, Homo sapiens
gtgtgatcctggttcact

SEQ ID NO: 129654 - DNA, 18 bp, Homo sapiens
tgtataattgctgaatgt

SEQ ID NO: 129655 - DNA, 19 bp, Homo sapiens
ccttaatttgaaaatgttg

SEQ ID NO: 129656 - DNA, 23 bp, Homo sapiens
cataagtgattttgtttatgaaa

SEQ ID NO: 129657 - DNA, 20 bp, Homo sapiens
ttttttgtttttgtttttca

SEQ ID NO: 129658 - DNA, 21 bp, Homo sapiens
taacaggacaaacaccaaaga

SEQ ID NO: 129659 - DNA, 22 bp, Homo sapiens
tttttgcatcttaattcagctc

SEQ ID NO: 129660 - DNA, 20 bp, Homo sapiens
agagtcttgtgggtgaggtg

SEQ ID NO: 129661 - DNA, 21 bp, Homo sapiens
tttttgttttttcagataggg

SEQ ID NO: 129662 - DNA, 23 bp, Homo sapiens
tgagcaacagagtgagactctct

SEQ ID NO: 129663 - DNA, 19 bp, Homo sapiens
tatatatttgttgttgttg

SEQ ID NO: 129664 - DNA, 23 bp, Homo sapiens
tagtttgtctgaaattttctctg

SEQ ID NO: 129665 - DNA, 23 bp, Homo sapiens
cctgaggtagtcacatttttttc

SEQ ID NO: 129666 - DNA, 23 bp, Homo sapiens
gacagagtctcgctctgtcaccc

SEQ ID NO: 129667 - DNA, 23 bp, Homo sapiens
tctttgcatgttgaatatgggtt

SEQ ID NO: 129668 - DNA, 23 bp, Homo sapiens
agaatgtgcatgagcagctgaca

SEQ ID NO: 129669 - DNA, 21 bp, Homo sapiens
tctgaattttattctgggagc

SEQ ID NO: 129670 - DNA, 18 bp, Homo sapiens
tctcactctgtcacccag

SEQ ID NO: 129671 - DNA, 22 bp, Homo sapiens
gtggcgtgatcttggctcactg

SEQ ID NO: 129672 - DNA, 23 bp, Homo sapiens
tgtgtgtgtgtgtatatatatag

SEQ ID NO: 129673 - DNA, 23 bp, Homo sapiens
tatatgtatatatgtatacgtgt

SEQ ID NO: 129674 - DNA, 23 bp, Homo sapiens
aggatacaggtacagaatgtgca

SEQ ID NO: 129675 - DNA, 23 bp, Homo sapiens
tgagttcattgtagattctggat

SEQ ID NO: 129676 - DNA, 23 bp, Homo sapiens
tgagttcattgtagattctggat

SEQ ID NO: 129677 - DNA, 21 bp, Homo sapiens
atacacacatgtaatgtatgt

SEQ ID NO: 129678 - DNA, 23 bp, Homo sapiens
tgagttcattgtagattctggat

SEQ ID NO: 129679 - DNA, 23 bp, Homo sapiens
tgagttcattgtagattctggat

SEQ ID NO: 129680 - DNA, 23 bp, Homo sapiens
ttctgtgaagaaagtcaatggta

SEQ ID NO: 129681 - DNA, 23 bp, Homo sapiens
tgagtctcactctgtcacccagg

SEQ ID NO: 129682 - DNA, 22 bp, Homo sapiens
agaagtagaagcatgtatacat

SEQ ID NO: 129683 - DNA, 23 bp, Homo sapiens
tctgggtgagtctgtgagtgagt

SEQ ID NO: 129684 - DNA, 23 bp, Homo sapiens
tgagttcattgtagattctggat

SEQ ID NO: 129685 - DNA, 23 bp, Homo sapiens
tgagttcattgtagattctggat

SEQ ID NO: 129686 - DNA, 23 bp, Homo sapiens
tgagttcattgtagattctggat

SEQ ID NO: 129687 - DNA, 23 bp, Homo sapiens
tgagttcattgtagattctggat

SEQ ID NO: 129688 - DNA, 23 bp, Homo sapiens
atattcattgtgtatatgtatat

SEQ ID NO: 129689 - DNA, 23 bp, Homo sapiens
agacacagtgcttcttcatgttg

SEQ ID NO: 129690 - DNA, 20 bp, Homo sapiens
ttcctgcgactggcagcctt

SEQ ID NO: 129691 - DNA, 23 bp, Homo sapiens
tgagttcattgtagattctggat

SEQ ID NO: 129692 - DNA, 23 bp, Homo sapiens
tgagttcattgtagattctggat

SEQ ID NO: 129693 - DNA, 23 bp, Homo sapiens
agagtcagaggagagtgaagaca

SEQ ID NO: 129694 - DNA, 23 bp, Homo sapiens
tgcgtgcctgcctgcctgcatct

SEQ ID NO: 129695 - DNA, 21 bp, Homo sapiens
aaatccaaatcaaatcagtaa

SEQ ID NO: 129696 - DNA, 22 bp, Homo sapiens
tgagatggagtcttactctgtc

SEQ ID NO: 129697 - DNA, 18 bp, Homo sapiens
tgaaaatatatatgtttg

SEQ ID NO: 129698 - DNA, 20 bp, Homo sapiens
atgtatatatacatgtgtgt

SEQ ID NO: 129699 - DNA, 23 bp, Homo sapiens
agacagagtgtcgctctgtcacc

SEQ ID NO: 129700 - DNA, 23 bp, Homo sapiens
aattatcatttgcttggagttag

SEQ ID NO: 129701 - DNA, 23 bp, Homo sapiens
cagagtctcgctctgtctcccag

SEQ ID NO: 129702 - DNA, 23 bp, Homo sapiens
tccattaaataactgactgataa

SEQ ID NO: 129703 - DNA, 22 bp, Homo sapiens
atgattctacattatggtgagt

SEQ ID NO: 129704 - DNA, 22 bp, Homo sapiens
atatgtatatgtatgcatatgt

SEQ ID NO: 129705 - DNA, 23 bp, Homo sapiens
tctgtgtgtgtgaatgtagtacc

SEQ ID NO: 129706 - DNA, 21 bp, Homo sapiens
tgtgaagaaagtcaatggtag

SEQ ID NO: 129707 - DNA, 23 bp, Homo sapiens
ctcagatgacacagtgcagaaca

SEQ ID NO: 129708 - DNA, 20 bp, Homo sapiens
atcccatgcactgtgaagtc

SEQ ID NO: 129709 - DNA, 19 bp, Homo sapiens
tgtgtgttgtgtctgtgca

SEQ ID NO: 129710 - DNA, 23 bp, Homo sapiens
ttatgttgattttgtatcttgta

SEQ ID NO: 129711 - DNA, 22 bp, Homo sapiens
tatagctgagtgactttgggca

SEQ ID NO: 129712 - DNA, 20 bp, Homo sapiens
tgtctcagtccctcatctat

SEQ ID NO: 129713 - DNA, 23 bp, Homo sapiens
gacagagtctcgctctgtcaccc

SEQ ID NO: 129714 - DNA, 23 bp, Homo sapiens
aggatcagaagatattaagtgtg

SEQ ID NO: 129715 - DNA, 23 bp, Homo sapiens
tgactctatctcaatctattctc

SEQ ID NO: 129716 - DNA, 23 bp, Homo sapiens
ttagggagacgaagaactgatca

SEQ ID NO: 129717 - DNA, 23 bp, Homo sapiens
tttgaatgtgtgtgtctctctaa

SEQ ID NO: 129718 - DNA, 19 bp, Homo sapiens
tgttttttttcgagacagg

SEQ ID NO: 129719 - DNA, 23 bp, Homo sapiens
tccctgtcactcagagtgcagtg

SEQ ID NO: 129720 - DNA, 20 bp, Homo sapiens
tcagcagggttagctcttct

SEQ ID NO: 129721 - DNA, 23 bp, Homo sapiens
gcaatcctagttgttcctgggct

SEQ ID NO: 129722 - DNA, 23 bp, Homo sapiens
tgtacttcatgagcttgttagtg

SEQ ID NO: 129723 - DNA, 21 bp, Homo sapiens
aggttggactacatggtgaag

SEQ ID NO: 129724 - DNA, 23 bp, Homo sapiens
agactagtttatatgttgttcaa

SEQ ID NO: 129725 - DNA, 18 bp, Homo sapiens
gcgcctgagtctgtctct

SEQ ID NO: 129726 - DNA, 19 bp, Homo sapiens
tgtgtgtgtgtgtgtatat

SEQ ID NO: 129727 - DNA, 20 bp, Homo sapiens
gacagtttcactctgtcacc

SEQ ID NO: 129728 - DNA, 21 bp, Homo sapiens
tgttagggtcagttttgggat

SEQ ID NO: 129729 - DNA, 23 bp, Homo sapiens
gatggaagtctcactgtcaccca

SEQ ID NO: 129730 - DNA, 19 bp, Homo sapiens
agtggatctcacagatatg

SEQ ID NO: 129731 - DNA, 23 bp, Homo sapiens
tagacacaagagtgtatgctgaa

SEQ ID NO: 129732 - DNA, 23 bp, Homo sapiens
ataatgtagtatgtaataattta

SEQ ID NO: 129733 - DNA, 23 bp, Homo sapiens
tctgagagtgtagttggtataat

SEQ ID NO: 129734 - DNA, 21 bp, Homo sapiens
ttcatcacagttgggtgtctg

SEQ ID NO: 129735 - DNA, 23 bp, Homo sapiens
agtagtgggattactggtagtta

SEQ ID NO: 129736 - DNA, 23 bp, Homo sapiens
tttacagaatcagcagcaatatg

SEQ ID NO: 129737 - DNA, 19 bp, Homo sapiens
cattactttctattttctg

SEQ ID NO: 129738 - DNA, 23 bp, Homo sapiens
tctttgttattaagatgggattg

SEQ ID NO: 129739 - DNA, 19 bp, Homo sapiens
tactgacttgagatactga

SEQ ID NO: 129740 - DNA, 23 bp, Homo sapiens
tgagttcattgtagattctggat

SEQ ID NO: 129741 - DNA, 23 bp, Homo sapiens
tgagttcattgtagattctggat

SEQ ID NO: 129742 - DNA, 23 bp, Homo sapiens
ggaattttgtcagatatgcatat

SEQ ID NO: 129743 - DNA, 19 bp, Homo sapiens
ataaagtacatttatatgt

SEQ ID NO: 129744 - DNA, 23 bp, Homo sapiens
ttactgaatatacatattagtgt

SEQ ID NO: 129745 - DNA, 23 bp, Homo sapiens
gtatattgaggaacttctttgta

SEQ ID NO: 129746 - DNA, 22 bp, Homo sapiens
tatacgtgtatatatatatgtg

SEQ ID NO: 129747 - DNA, 18 bp, Homo sapiens
atgcatatatatgtgtat

SEQ ID NO: 129748 - DNA, 21 bp, Homo sapiens
tatatgcatatatatgtgtat

SEQ ID NO: 129749 - DNA, 23 bp, Homo sapiens
atatgtgtatatatatgtgtgtg

SEQ ID NO: 129750 - DNA, 20 bp, Homo sapiens
tatgagagagatatatatga

SEQ ID NO: 129751 - DNA, 23 bp, Homo sapiens
atctatctatctgtctatcatct

SEQ ID NO: 129752 - DNA, 18 bp, Homo sapiens
gacactggctgagttctg

SEQ ID NO: 129753 - DNA, 19 bp, Homo sapiens
tatgtatgtctttgtgatg

SEQ ID NO: 129754 - DNA, 18 bp, Homo sapiens
cacaggctcataggcaga

SEQ ID NO: 129755 - DNA, 23 bp, Homo sapiens
tctcagatgagactgtgaacttg

SEQ ID NO: 129756 - DNA, 21 bp, Homo sapiens
tgaggtagtaggatcacttga

SEQ ID NO: 129757 - DNA, 20 bp, Homo sapiens
tgtattctcgaagtagagga

SEQ ID NO: 129758 - DNA, 22 bp, Homo sapiens
tttgttttgtggaaatggccca

SEQ ID NO: 129759 - DNA, 23 bp, Homo sapiens
taatgtatatgtgtatatgtata

SEQ ID NO: 129760 - DNA, 22 bp, Homo sapiens
taatgtatatatgtatatgtgt

SEQ ID NO: 129761 - DNA, 21 bp, Homo sapiens
agtggaatgaagggaggataa

SEQ ID NO: 129762 - DNA, 18 bp, Homo sapiens
gataagtgattctgttga

SEQ ID NO: 129763 - DNA, 23 bp, Homo sapiens
ctaaagattagtgaatgatgaag

SEQ ID NO: 129764 - DNA, 21 bp, Homo sapiens
ttttagagacaggatcctcat

SEQ ID NO: 129765 - DNA, 23 bp, Homo sapiens
tgagttcattgtagattctggat

SEQ ID NO: 129766 - DNA, 23 bp, Homo sapiens
tgagttcattgtagattctggat

SEQ ID NO: 129767 - DNA, 23 bp, Homo sapiens
atatgtgtatttgaatatgtgtg

SEQ ID NO: 129768 - DNA, 22 bp, Homo sapiens
ttcagaggtgtcagaccacaca

SEQ ID NO: 129769 - DNA, 20 bp, Homo sapiens
atacatacatatctatgcat

SEQ ID NO: 129770 - DNA, 23 bp, Homo sapiens
gtgttgtttctaccacatattcc

SEQ ID NO: 129771 - DNA, 22 bp, Homo sapiens
tacatgtgcagaatgtgcagtt

SEQ ID NO: 129772 - DNA, 22 bp, Homo sapiens
tatacagattttaaaaatctgt

SEQ ID NO: 129773 - DNA, 23 bp, Homo sapiens
atttttgatggagtcattggtta

SEQ ID NO: 129774 - DNA, 23 bp, Homo sapiens
tgtctctctctgtcccaaacatg

SEQ ID NO: 129775 - DNA, 22 bp, Homo sapiens
actgtgacagaaaagagaagtc

SEQ ID NO: 129776 - DNA, 22 bp, Homo sapiens
aaaagagtcacttacttatgag

SEQ ID NO: 129777 - DNA, 23 bp, Homo sapiens
tacagctctgactgctgaccttg

SEQ ID NO: 129778 - DNA, 23 bp, Homo sapiens
tcagtgtcacactcagtctttgt

SEQ ID NO: 129779 - DNA, 23 bp, Homo sapiens
gacagagtctcgctctgtcaccc

SEQ ID NO: 129780 - DNA, 21 bp, Homo sapiens
agagagctttattattcttgg

SEQ ID NO: 129781 - DNA, 23 bp, Homo sapiens
tttttgagatggagtctcactct

SEQ ID NO: 129782 - DNA, 18 bp, Homo sapiens
tgagacagagtctcgctc

SEQ ID NO: 129783 - DNA, 22 bp, Homo sapiens
ttgagacagagtctcgttctgt

SEQ ID NO: 129784 - DNA, 23 bp, Homo sapiens
ctgagtctcactctgtcatccag

SEQ ID NO: 129785 - DNA, 22 bp, Homo sapiens
agaagtgttttatttgtttaga

SEQ ID NO: 129786 - DNA, 19 bp, Homo sapiens
tgagaagagactgtctttg

SEQ ID NO: 129787 - DNA, 21 bp, Homo sapiens
tctttagagagtttttcttta

SEQ ID NO: 129788 - DNA, 22 bp, Homo sapiens
ggctgaggtaggaggatcactt

SEQ ID NO: 129789 - DNA, 23 bp, Homo sapiens
tgtctgtctgtgtctgtctgttt

SEQ ID NO: 129790 - DNA, 22 bp, Homo sapiens
ggtgcatagtaagtgtatatgt

SEQ ID NO: 129791 - DNA, 23 bp, Homo sapiens
tttttggtattgaaatggagtgc

SEQ ID NO: 129792 - DNA, 23 bp, Homo sapiens
tggagtctcactctgtcacccag

SEQ ID NO: 129793 - DNA, 20 bp, Homo sapiens
tgcaatggtgtgatctcagc

SEQ ID NO: 129794 - DNA, 19 bp, Homo sapiens
tctctgtgtctctgtctct

SEQ ID NO: 129795 - DNA, 22 bp, Homo sapiens
ataacaaattttatatatgagt

SEQ ID NO: 129796 - DNA, 22 bp, Homo sapiens
atatgtgtgtatgtgtatatgt

SEQ ID NO: 129797 - DNA, 19 bp, Homo sapiens
gaggttgaagttttcttat

SEQ ID NO: 129798 - DNA, 18 bp, Homo sapiens
gtctgagctgatacctgt

SEQ ID NO: 129799 - DNA, 23 bp, Homo sapiens
acaaggtctcactctgtcaccca

SEQ ID NO: 129800 - DNA, 23 bp, Homo sapiens
gtgtgtgtgtatatatgtgtgtg

SEQ ID NO: 129801 - DNA, 23 bp, Homo sapiens
tgtgtgtgtatatatgtgtgtgt

SEQ ID NO: 129802 - DNA, 19 bp, Homo sapiens
aagaatatatatgtatatg

SEQ ID NO: 129803 - DNA, 23 bp, Homo sapiens
tggagtactggttgttttctgtt

SEQ ID NO: 129804 - DNA, 23 bp, Homo sapiens
gagatgcagtctcactctgtcgc

SEQ ID NO: 129805 - DNA, 18 bp, Homo sapiens
tgtttctcgcctctcttt

SEQ ID NO: 129806 - DNA, 20 bp, Homo sapiens
caaagaggaatgattttgag

SEQ ID NO: 129807 - DNA, 20 bp, Homo sapiens
ttttgtgattttttttagct

SEQ ID NO: 129808 - DNA, 22 bp, Homo sapiens
cagaggatgtttcttgttgatg

SEQ ID NO: 129809 - DNA, 21 bp, Homo sapiens
tacacacacacatacatatat

SEQ ID NO: 129810 - DNA, 23 bp, Homo sapiens
atatgtgtgtgtatgtatatatc

SEQ ID NO: 129811 - DNA, 23 bp, Homo sapiens
ctaagttactcattcacctgaag

SEQ ID NO: 129812 - DNA, 23 bp, Homo sapiens
gaagcagtcactgtgtgtgtccc

SEQ ID NO: 129813 - DNA, 23 bp, Homo sapiens
cctgagtcgctgagtcgctggga

SEQ ID NO: 129814 - DNA, 22 bp, Homo sapiens
catgtcattttgttgttgacag

SEQ ID NO: 129815 - DNA, 21 bp, Homo sapiens
tgtatggaaatgctactgatt

SEQ ID NO: 129816 - DNA, 18 bp, Homo sapiens
gtaatatgtatttatgca

SEQ ID NO: 129817 - DNA, 21 bp, Homo sapiens
agcaactccgctgtctctgac

SEQ ID NO: 129818 - DNA, 21 bp, Homo sapiens
tcccagcaggcttcattctgc

SEQ ID NO: 129819 - DNA, 19 bp, Homo sapiens
aaatgtgagtgtatctgct

SEQ ID NO: 129820 - DNA, 22 bp, Homo sapiens
atgtgtgtgtatatgtatatat

SEQ ID NO: 129821 - DNA, 20 bp, Homo sapiens
tatatacatatatgtggata

SEQ ID NO: 129822 - DNA, 23 bp, Homo sapiens
tcaatggagatgaagcagctttc

SEQ ID NO: 129823 - DNA, 19 bp, Homo sapiens
agtagtttcatagctaaag

SEQ ID NO: 129824 - DNA, 23 bp, Homo sapiens
tatggatatatgtaggtgtgtgt

SEQ ID NO: 129825 - DNA, 23 bp, Homo sapiens
tgtaaaggaacaaatactaatca

SEQ ID NO: 129826 - DNA, 23 bp, Homo sapiens
aaatgttaatgtgtacatatgta

SEQ ID NO: 129827 - DNA, 22 bp, Homo sapiens
ttaaccaggctggtcttgaact

SEQ ID NO: 129828 - DNA, 23 bp, Homo sapiens
tgagacagagtctctctctgttg

SEQ ID NO: 129829 - DNA, 18 bp, Homo sapiens
tatagtatatatgtataa

SEQ ID NO: 129830 - DNA, 22 bp, Homo sapiens
gtcagaagagtgtgtgctgatg

SEQ ID NO: 129831 - DNA, 20 bp, Homo sapiens
agaagagtcacaaaagagat

SEQ ID NO: 129832 - DNA, 23 bp, Homo sapiens
agtggaacctgtggctctctgtg

SEQ ID NO: 129833 - DNA, 21 bp, Homo sapiens
atgagtaaagtagaagaagat

SEQ ID NO: 129834 - DNA, 23 bp, Homo sapiens
aagtcagtgagcatatccaggtg

SEQ ID NO: 129835 - DNA, 23 bp, Homo sapiens
tcagtttggttttgatttccatt

SEQ ID NO: 129836 - DNA, 23 bp, Homo sapiens
agacagtctgtcactccatcacc

SEQ ID NO: 129837 - DNA, 19 bp, Homo sapiens
ctctatatatatactctct

SEQ ID NO: 129838 - DNA, 23 bp, Homo sapiens
ttcaatgttcagtgcctcatgtg

SEQ ID NO: 129839 - DNA, 21 bp, Homo sapiens
tatgagacatgggacagggtc

SEQ ID NO: 129840 - DNA, 23 bp, Homo sapiens
tgtgtgtatatgtatgtgtgtgt

SEQ ID NO: 129841 - DNA, 23 bp, Homo sapiens
agaatcttgaggatcctgcttct

SEQ ID NO: 129842 - DNA, 19 bp, Homo sapiens
tggcaagttgatggctttt

SEQ ID NO: 129843 - DNA, 20 bp, Homo sapiens
gtcccagtgagaaaacagga

SEQ ID NO: 129844 - DNA, 23 bp, Homo sapiens
gtagtctccctgtgactgtcact

SEQ ID NO: 129845 - DNA, 23 bp, Homo sapiens
gagagtgtaaatgtattggcaca

SEQ ID NO: 129846 - DNA, 23 bp, Homo sapiens
atgaaagtgcttgatttttccag

SEQ ID NO: 129847 - DNA, 19 bp, Homo sapiens
ttaagtatatatgtataca

SEQ ID NO: 129848 - DNA, 23 bp, Homo sapiens
tgagttcattgtagattctggat

SEQ ID NO: 129849 - DNA, 23 bp, Homo sapiens
tgagttcattgtagattctggat

SEQ ID NO: 129850 - DNA, 20 bp, Homo sapiens
ctgagctgtccatccacagt

SEQ ID NO: 129851 - DNA, 20 bp, Homo sapiens
actcagaatcatgaaccaca

SEQ ID NO: 129852 - DNA, 21 bp, Homo sapiens
gtctgtatatgtatatgtgtg

SEQ ID NO: 129853 - DNA, 23 bp, Homo sapiens
atagacagtaaatgctttgtgaa

SEQ ID NO: 129854 - DNA, 23 bp, Homo sapiens
gctgtgacactgtctggcacaca

SEQ ID NO: 129855 - DNA, 20 bp, Homo sapiens
ttgcatgttttgtgggaggt

SEQ ID NO: 129856 - DNA, 20 bp, Homo sapiens
agagtatatatatgtgtgtg

SEQ ID NO: 129857 - DNA, 23 bp, Homo sapiens
atcacagaggctggtaatttatt

SEQ ID NO: 129858 - DNA, 23 bp, Homo sapiens
tgagacagtctccctctgtcacc

SEQ ID NO: 129859 - DNA, 20 bp, Homo sapiens
atatgtatatatatatatgt

SEQ ID NO: 129860 - DNA, 22 bp, Homo sapiens
atctggttgtttgaaagtgtgt

SEQ ID NO: 129861 - DNA, 23 bp, Homo sapiens
tttgagacaggatctctctgtca

SEQ ID NO: 129862 - DNA, 18 bp, Homo sapiens
tgtatatatgtatacata

SEQ ID NO: 129863 - DNA, 20 bp, Homo sapiens
atgtatacatagatatgtat

SEQ ID NO: 129864 - DNA, 18 bp, Homo sapiens
cacattgccctttgagtt

SEQ ID NO: 129865 - DNA, 23 bp, Homo sapiens
gggtctcactctgtcacccaggc

SEQ ID NO: 129866 - DNA, 23 bp, Homo sapiens
actcccagagcccctggaactct

SEQ ID NO: 129867 - DNA, 19 bp, Homo sapiens
ttgttgttgttttgagaca

SEQ ID NO: 129868 - DNA, 22 bp, Homo sapiens
tttaagatggagttttgctctt

SEQ ID NO: 129869 - DNA, 23 bp, Homo sapiens
tggcacaggttgtactgtctcct

SEQ ID NO: 129870 - DNA, 23 bp, Homo sapiens
cttgagacagagtctggctgtgt

SEQ ID NO: 129871 - DNA, 19 bp, Homo sapiens
tgtgataggtaatagattc

SEQ ID NO: 129872 - DNA, 23 bp, Homo sapiens
gggtctcactctgtcacccaggc

SEQ ID NO: 129873 - DNA, 21 bp, Homo sapiens
tgaggtagtaggatcatttga

SEQ ID NO: 129874 - DNA, 18 bp, Homo sapiens
atgtgtgtgtatgtatat

SEQ ID NO: 129875 - DNA, 19 bp, Homo sapiens
agaatatatacacatacac

SEQ ID NO: 129876 - DNA, 23 bp, Homo sapiens
gtatgtatatgtatatgttatct

SEQ ID NO: 129877 - DNA, 21 bp, Homo sapiens
taaacaaagaacaccctttga

SEQ ID NO: 129878 - DNA, 23 bp, Homo sapiens
tcagatactgagtctcgctgtgt

SEQ ID NO: 129879 - DNA, 23 bp, Homo sapiens
gggtgtctcagtctgtctgtgct

SEQ ID NO: 129880 - DNA, 21 bp, Homo sapiens
tttaatgttatctatgtgaag

SEQ ID NO: 129881 - DNA, 18 bp, Homo sapiens
aggtcctgcagctgctgc

SEQ ID NO: 129882 - DNA, 22 bp, Homo sapiens
agaccctctttcagactctgtg

SEQ ID NO: 129883 - DNA, 23 bp, Homo sapiens
tacacgtatatgtatatgtgtac

SEQ ID NO: 129884 - DNA, 23 bp, Homo sapiens
tgagttcattgtagattctggat

SEQ ID NO: 129885 - DNA, 23 bp, Homo sapiens
tgagttcattgtagattctggat

SEQ ID NO: 129886 - DNA, 19 bp, Homo sapiens
atggttttaacaatgttag

SEQ ID NO: 129887 - DNA, 22 bp, Homo sapiens
aaatgtgtgagggtcagatgag

SEQ ID NO: 129888 - DNA, 23 bp, Homo sapiens
ctctctgtgtatatatacacaca

SEQ ID NO: 129889 - DNA, 19 bp, Homo sapiens
ttggcaaagtgtgacttaa

SEQ ID NO: 129890 - DNA, 20 bp, Homo sapiens
tttttttctctttttctttt

SEQ ID NO: 129891 - DNA, 18 bp, Homo sapiens
tctccccctgtcacccag

SEQ ID NO: 129892 - DNA, 23 bp, Homo sapiens
ggatctctctcgctgtgtcaccc

SEQ ID NO: 129893 - DNA, 22 bp, Homo sapiens
tggtgtgatcttggctcactgt

SEQ ID NO: 129894 - DNA, 23 bp, Homo sapiens
tgtatgttattcttttagtcatc

SEQ ID NO: 129895 - DNA, 21 bp, Homo sapiens
atactttaagttttagggtac

SEQ ID NO: 129896 - DNA, 21 bp, Homo sapiens
tatgtgtgtgtgcatgtgcat

SEQ ID NO: 129897 - DNA, 23 bp, Homo sapiens
gggtgacttttcagtttggtgta

SEQ ID NO: 129898 - DNA, 23 bp, Homo sapiens
tgaaaaataatattgatttgacc

SEQ ID NO: 129899 - DNA, 22 bp, Homo sapiens
ggtactctaatctttttgtaca

SEQ ID NO: 129900 - DNA, 22 bp, Homo sapiens
tgagttcttaatgaggtaatag

SEQ ID NO: 129901 - DNA, 23 bp, Homo sapiens
aagtgcatattatgatgttaagt

SEQ ID NO: 129902 - DNA, 22 bp, Homo sapiens
tacttgtgcagaatgtgcagtt

SEQ ID NO: 129903 - DNA, 23 bp, Homo sapiens
aaagctgtatattttgtaagtca

SEQ ID NO: 129904 - DNA, 23 bp, Homo sapiens
tatacacacatatagatgtacat

SEQ ID NO: 129905 - DNA, 23 bp, Homo sapiens
atatgtgtatatgtatatgtgtg

SEQ ID NO: 129906 - DNA, 23 bp, Homo sapiens
tttctatgtatatatgtatacca

SEQ ID NO: 129907 - DNA, 19 bp, Homo sapiens
aatgaacaaggacagcttg

SEQ ID NO: 129908 - DNA, 21 bp, Homo sapiens
actgtctcagttacaattttg

SEQ ID NO: 129909 - DNA, 23 bp, Homo sapiens
ttaggattgttttggctatgtag

SEQ ID NO: 129910 - DNA, 21 bp, Homo sapiens
tttctgtctgcattttttgcc

SEQ ID NO: 129911 - DNA, 18 bp, Homo sapiens
tcatcttttgaaccagca

SEQ ID NO: 129912 - DNA, 23 bp, Homo sapiens
tgagttcattgtagattctggat

SEQ ID NO: 129913 - DNA, 23 bp, Homo sapiens
tgagttcattgtagattctggat

SEQ ID NO: 129914 - DNA, 23 bp, Homo sapiens
ggatctgtctttatccttatcct

SEQ ID NO: 129915 - DNA, 22 bp, Homo sapiens
acatgtgctcattgtgcaggtt

SEQ ID NO: 129916 - DNA, 23 bp, Homo sapiens
tgtgagtagaaagtgaggaccta

SEQ ID NO: 129917 - DNA, 23 bp, Homo sapiens
tgagttcattgtagattctggat

SEQ ID NO: 129918 - DNA, 23 bp, Homo sapiens
tgagttcattgtagattctggat

SEQ ID NO: 129919 - DNA, 20 bp, Homo sapiens
tagcttgatgaggatagcat

SEQ ID NO: 129920 - DNA, 23 bp, Homo sapiens
aaaagtgtatcttgaagatctgg

SEQ ID NO: 129921 - DNA, 21 bp, Homo sapiens
ttttatctttagttgctttga

SEQ ID NO: 129922 - DNA, 21 bp, Homo sapiens
atctttagtgattttgcagtt

SEQ ID NO: 129923 - DNA, 21 bp, Homo sapiens
tgagatggagtctcgctctgt

SEQ ID NO: 129924 - DNA, 23 bp, Homo sapiens
tattccatgcatatggaatataa

SEQ ID NO: 129925 - DNA, 20 bp, Homo sapiens
agtattccatgcatatggaa

SEQ ID NO: 129926 - DNA, 23 bp, Homo sapiens
aaatctttatttgtatttcttcc

SEQ ID NO: 129927 - DNA, 23 bp, Homo sapiens
tacatgtgctggatgtgcaggtt

SEQ ID NO: 129928 - DNA, 21 bp, Homo sapiens
tttactgaatttgtttatcag

SEQ ID NO: 129929 - DNA, 23 bp, Homo sapiens
acccctctgtctgtcagcctctc

SEQ ID NO: 129930 - DNA, 23 bp, Homo sapiens
atgtatgtgtgtgtaggtagctc

SEQ ID NO: 129931 - DNA, 21 bp, Homo sapiens
ccagagcccctggaactctgg

SEQ ID NO: 129932 - DNA, 20 bp, Homo sapiens
actgactctgttgctagctg

SEQ ID NO: 129933 - DNA, 23 bp, Homo sapiens
tggacaagtcatttagttgttct

SEQ ID NO: 129934 - DNA, 23 bp, Homo sapiens
tgagttcattgtagattctggat

SEQ ID NO: 129935 - DNA, 23 bp, Homo sapiens
tgagttcattgtagattctggat

SEQ ID NO: 129936 - DNA, 23 bp, Homo sapiens
tgagttcattgtagattctggat

SEQ ID NO: 129937 - DNA, 23 bp, Homo sapiens
tgagttcattgtagattctggat

SEQ ID NO: 129938 - DNA, 23 bp, Homo sapiens
ttttttggttccatatgaaattt

SEQ ID NO: 129939 - DNA, 22 bp, Homo sapiens
tatgcatatatttttcatctgt

SEQ ID NO: 129940 - DNA, 23 bp, Homo sapiens
cagcctggctctctcagcttctc

SEQ ID NO: 129941 - DNA, 22 bp, Homo sapiens
catgtgtatatatatatatgtg

SEQ ID NO: 129942 - DNA, 20 bp, Homo sapiens
atacacacacacatatatgt

SEQ ID NO: 129943 - DNA, 21 bp, Homo sapiens
tgtgtgcttatacatgtgtat

SEQ ID NO: 129944 - DNA, 22 bp, Homo sapiens
tatatgcatctatattcagcta

SEQ ID NO: 129945 - DNA, 18 bp, Homo sapiens
agagattaaagagagcac

SEQ ID NO: 129946 - DNA, 19 bp, Homo sapiens
ctcaagctctcggagtcat

SEQ ID NO: 129947 - DNA, 23 bp, Homo sapiens
tcaagatgtattataatacagtt

SEQ ID NO: 129948 - DNA, 23 bp, Homo sapiens
tgtaaatttgaagattttcatat

SEQ ID NO: 129949 - DNA, 22 bp, Homo sapiens
ctagacactgtacgctttgtga

SEQ ID NO: 129950 - DNA, 20 bp, Homo sapiens
agtctcgctctgtcgctcag

SEQ ID NO: 129951 - DNA, 22 bp, Homo sapiens
ctgtgtgtgtgtgtgtgtatct

SEQ ID NO: 129952 - DNA, 21 bp, Homo sapiens
acgtatatatatatgtgtata

SEQ ID NO: 129953 - DNA, 22 bp, Homo sapiens
atatacacacacatatatatgt

SEQ ID NO: 129954 - DNA, 22 bp, Homo sapiens
tatacatatatgtatatgtgtg

SEQ ID NO: 129955 - DNA, 22 bp, Homo sapiens
tatacatatatgtatatgtgtg

SEQ ID NO: 129956 - DNA, 23 bp, Homo sapiens
ttatgctgtattcagttattgat

SEQ ID NO: 129957 - DNA, 23 bp, Homo sapiens
tctgtctttgtgaacggacatgt

SEQ ID NO: 129958 - DNA, 23 bp, Homo sapiens
atgtgtgcatatgtttagattct

SEQ ID NO: 129959 - DNA, 23 bp, Homo sapiens
tgagttcattgtagattctggat

SEQ ID NO: 129960 - DNA, 23 bp, Homo sapiens
tgagttcattgtagattctggat

SEQ ID NO: 129961 - DNA, 23 bp, Homo sapiens
tgagttcattgtagattctggat

SEQ ID NO: 129962 - DNA, 23 bp, Homo sapiens
tgagttcattgtagattctggat

SEQ ID NO: 129963 - DNA, 18 bp, Homo sapiens
ctaaacaagtatcattct

SEQ ID NO: 129964 - DNA, 21 bp, Homo sapiens
gaatccttttacagcattatg

SEQ ID NO: 129965 - DNA, 21 bp, Homo sapiens
attttgctagtggtggtggta

SEQ ID NO: 129966 - DNA, 19 bp, Homo sapiens
agtgctataatatatagtt

SEQ ID NO: 129967 - DNA, 23 bp, Homo sapiens
atgtgcataatttatgtatatgt

SEQ ID NO: 129968 - DNA, 23 bp, Homo sapiens
tttgtttttgttttggtgacaga

SEQ ID NO: 129969 - DNA, 21 bp, Homo sapiens
agggatggtcttgctgtcttg

SEQ ID NO: 129970 - DNA, 23 bp, Homo sapiens
atatgtgtgtgtatgtatatatg

SEQ ID NO: 129971 - DNA, 23 bp, Homo sapiens
taactgttgcattttatttcttt

SEQ ID NO: 129972 - DNA, 23 bp, Homo sapiens
gacagagtctcgctctgtcaccc

SEQ ID NO: 129973 - DNA, 23 bp, Homo sapiens
ccctaatctcacaggactgtggc

SEQ ID NO: 129974 - DNA, 20 bp, Homo sapiens
atatatgtagtatatagttt

SEQ ID NO: 129975 - DNA, 23 bp, Homo sapiens
cggagtctcactctgtcacccag

SEQ ID NO: 129976 - DNA, 23 bp, Homo sapiens
cagtctgtcctaactcttttgct

SEQ ID NO: 129977 - DNA, 23 bp, Homo sapiens
tgtcactctgccactctctctgg

SEQ ID NO: 129978 - DNA, 23 bp, Homo sapiens
gagtctcacactgtcactcaggc

SEQ ID NO: 129979 - DNA, 23 bp, Homo sapiens
tatatctatatctatatatgtac

SEQ ID NO: 129980 - DNA, 23 bp, Homo sapiens
ggcagaggtagtagtgagtggag

SEQ ID NO: 129981 - DNA, 23 bp, Homo sapiens
tgagatggagcttcactctgtca

SEQ ID NO: 129982 - DNA, 23 bp, Homo sapiens
tatatgtatgtgtatgtacacat

SEQ ID NO: 129983 - DNA, 21 bp, Homo sapiens
atgtatgtatgtgtgtgtcta

SEQ ID NO: 129984 - DNA, 23 bp, Homo sapiens
tgtgtgtgtatatatatatgtgt

SEQ ID NO: 129985 - DNA, 20 bp, Homo sapiens
atgtgcacaacgtgcaggtt

SEQ ID NO: 129986 - DNA, 23 bp, Homo sapiens
ggctctctgtttgtctgttattg

SEQ ID NO: 129987 - DNA, 23 bp, Homo sapiens
tttacacgttgattttgtatcct

SEQ ID NO: 129988 - DNA, 23 bp, Homo sapiens
tgagttcattgtagattctggat

SEQ ID NO: 129989 - DNA, 23 bp, Homo sapiens
tgagttcattgtagattctggat

SEQ ID NO: 129990 - DNA, 21 bp, Homo sapiens
tatgtatgtatatatatgtat

SEQ ID NO: 129991 - DNA, 22 bp, Homo sapiens
tatgtgtatatatatacgtatg

SEQ ID NO: 129992 - DNA, 22 bp, Homo sapiens
atatgtgtatatatatatgtgt

SEQ ID NO: 129993 - DNA, 23 bp, Homo sapiens
tggagtctcactctgtcacccag

SEQ ID NO: 129994 - DNA, 23 bp, Homo sapiens
atgtgcacaacgtgcaggtttgt

SEQ ID NO: 129995 - DNA, 18 bp, Homo sapiens
atctgtatatctttattt

SEQ ID NO: 129996 - DNA, 18 bp, Homo sapiens
aatacgaactatatctat

SEQ ID NO: 129997 - DNA, 21 bp, Homo sapiens
gagataaatgtgtataggtat

SEQ ID NO: 129998 - DNA, 23 bp, Homo sapiens
cataatgtcttggtaaagatctc

SEQ ID NO: 129999 - DNA, 23 bp, Homo sapiens
tgagttcattgtagattctggat

SEQ ID NO: 130000 - DNA, 23 bp, Homo sapiens
tgagttcattgtagattctggat

SEQ ID NO: 130001 - DNA, 20 bp, Homo sapiens
acacaggctaatatttaggt

SEQ ID NO: 130002 - DNA, 21 bp, Homo sapiens
atgtctgtgtgtgtgtgtgtg

SEQ ID NO: 130003 - DNA, 23 bp, Homo sapiens
tgagttcattgtagattctggat

SEQ ID NO: 130004 - DNA, 23 bp, Homo sapiens
tgagttcattgtagattctggat

SEQ ID NO: 130005 - DNA, 23 bp, Homo sapiens
tgagcttgttgaaagatattttg

SEQ ID NO: 130006 - DNA, 19 bp, Homo sapiens
tgtcctatgaatacacaca

SEQ ID NO: 130007 - DNA, 20 bp, Homo sapiens
atgtgcacaacgtgcaggtt

SEQ ID NO: 130008 - DNA, 23 bp, Homo sapiens
ccatgttgatgttctgcacctgt

SEQ ID NO: 130009 - DNA, 21 bp, Homo sapiens
tttgaaggtgctctttttcaa

SEQ ID NO: 130010 - DNA, 21 bp, Homo sapiens
tatatgtgtatatatacgtat

SEQ ID NO: 130011 - DNA, 23 bp, Homo sapiens
tatatgtatatatgtatacgtgt

SEQ ID NO: 130012 - DNA, 23 bp, Homo sapiens
tggagtctcactctgtcacccag

SEQ ID NO: 130013 - DNA, 21 bp, Homo sapiens
tatatatatgctgtgtgtgta

SEQ ID NO: 130014 - DNA, 22 bp, Homo sapiens
atgtgcatatatatgtgtgtgt

SEQ ID NO: 130015 - DNA, 21 bp, Homo sapiens
tatatacacacacacatacac

SEQ ID NO: 130016 - DNA, 21 bp, Homo sapiens
catgtgcaggatgtgcaggtt

SEQ ID NO: 130017 - DNA, 23 bp, Homo sapiens
tgtgtctgagagtctgtcccaga

SEQ ID NO: 130018 - DNA, 23 bp, Homo sapiens
gtaatcacagtgctttagaagga

SEQ ID NO: 130019 - DNA, 23 bp, Homo sapiens
gtctaatgagagcctgctttgtg

SEQ ID NO: 130020 - DNA, 23 bp, Homo sapiens
tgcatgacttgtcatatacttga

SEQ ID NO: 130021 - DNA, 23 bp, Homo sapiens
tttttctctatgctcccactggc

SEQ ID NO: 130022 - DNA, 22 bp, Homo sapiens
tttcagaggacagtgtgagcag

SEQ ID NO: 130023 - DNA, 22 bp, Homo sapiens
aataacaatggtaatctgtaat

SEQ ID NO: 130024 - DNA, 23 bp, Homo sapiens
aaagtgcctgaggttttcaacag

SEQ ID NO: 130025 - DNA, 19 bp, Homo sapiens
tggaagcttatctgtagaa

SEQ ID NO: 130026 - DNA, 23 bp, Homo sapiens
aacatgtgtttggttttctgtcc

SEQ ID NO: 130027 - DNA, 23 bp, Homo sapiens
agcataagaaattggaattcaaa

SEQ ID NO: 130028 - DNA, 18 bp, Homo sapiens
tgtggtagatagatgtgt

SEQ ID NO: 130029 - DNA, 18 bp, Homo sapiens
ttttgtttgtttgtttat

SEQ ID NO: 130030 - DNA, 23 bp, Homo sapiens
agtgagtgaggtaaggcaatgga

SEQ ID NO: 130031 - DNA, 21 bp, Homo sapiens
tgagacgaagttgtgttgccc

SEQ ID NO: 130032 - DNA, 23 bp, Homo sapiens
cggagtctcgctctgtctcccag

SEQ ID NO: 130033 - DNA, 21 bp, Homo sapiens
tatatagtagcagcatttgtt

SEQ ID NO: 130034 - DNA, 22 bp, Homo sapiens
tcagaggttatacaaagaactt

SEQ ID NO: 130035 - DNA, 20 bp, Homo sapiens
ttggtgctttcattttctct

SEQ ID NO: 130036 - DNA, 23 bp, Homo sapiens
tccgagagaggaaatggagtacc

SEQ ID NO: 130037 - DNA, 21 bp, Homo sapiens
ttgcctatggttctatgtgga

SEQ ID NO: 130038 - DNA, 23 bp, Homo sapiens
gaaaacagtctgtactgtcgccc

SEQ ID NO: 130039 - DNA, 19 bp, Homo sapiens
tgaaatgttggtactttta

SEQ ID NO: 130040 - DNA, 23 bp, Homo sapiens
tagacagccaacaagatgagatt

SEQ ID NO: 130041 - DNA, 23 bp, Homo sapiens
tgagttcattgtagattctggat

SEQ ID NO: 130042 - DNA, 23 bp, Homo sapiens
agagttcacagtttccatgctaa

SEQ ID NO: 130043 - DNA, 23 bp, Homo sapiens
acagaagaatgtgagctttccat

SEQ ID NO: 130044 - DNA, 22 bp, Homo sapiens
tgtgagcctgtagttccagtta

SEQ ID NO: 130045 - DNA, 20 bp, Homo sapiens
aaggtaggaggatctattga

SEQ ID NO: 130046 - DNA, 21 bp, Homo sapiens
atagtatatatatcctatgtg

SEQ ID NO: 130047 - DNA, 23 bp, Homo sapiens
tatgtgcatatgtatatatgtac

SEQ ID NO: 130048 - DNA, 21 bp, Homo sapiens
tatatgtatatatacatatgt

SEQ ID NO: 130049 - DNA, 23 bp, Homo sapiens
agctgtcagatttcactggctct

SEQ ID NO: 130050 - DNA, 23 bp, Homo sapiens
ctttaggagtcattttgttgtca

SEQ ID NO: 130051 - DNA, 23 bp, Homo sapiens
gcattggtagtacattgagatgt

SEQ ID NO: 130052 - DNA, 22 bp, Homo sapiens
aatactgagttgtgtgatttct

SEQ ID NO: 130053 - DNA, 20 bp, Homo sapiens
gtatatatatgtgtatgcac

SEQ ID NO: 130054 - DNA, 18 bp, Homo sapiens
tatccatatatatacaca

SEQ ID NO: 130055 - DNA, 23 bp, Homo sapiens
tgagttcattgtagattctggat

SEQ ID NO: 130056 - DNA, 23 bp, Homo sapiens
tgagttcattgtagattctggat

SEQ ID NO: 130057 - DNA, 23 bp, Homo sapiens
caacttatgtgatatacatttag

SEQ ID NO: 130058 - DNA, 21 bp, Homo sapiens
taccatgaagaattaggtttc

SEQ ID NO: 130059 - DNA, 22 bp, Homo sapiens
attctgactggtaaacttcagt

SEQ ID NO: 130060 - DNA, 20 bp, Homo sapiens
attcattgatatggaatgag

SEQ ID NO: 130061 - DNA, 23 bp, Homo sapiens
atctgtagacttccagtactatg

SEQ ID NO: 130062 - DNA, 23 bp, Homo sapiens
ttttcagagaaaaagttggcttt

SEQ ID NO: 130063 - DNA, 23 bp, Homo sapiens
atacatgtggaattctttttttt

SEQ ID NO: 130064 - DNA, 23 bp, Homo sapiens
agagtcagggtctcactatgttg

SEQ ID NO: 130065 - DNA, 21 bp, Homo sapiens
tatgagattttagtgcaccca

SEQ ID NO: 130066 - DNA, 23 bp, Homo sapiens
ttcctgtcaacatttgaggatag

SEQ ID NO: 130067 - DNA, 19 bp, Homo sapiens
ttcttcatggattgtcatt

SEQ ID NO: 130068 - DNA, 22 bp, Homo sapiens
agagtctcactctgtcacccag

SEQ ID NO: 130069 - DNA, 22 bp, Homo sapiens
aaagtcagtggtagcttgatga

SEQ ID NO: 130070 - DNA, 18 bp, Homo sapiens
gtctcactctgtcgccca

SEQ ID NO: 130071 - DNA, 23 bp, Homo sapiens
ggagactcactcagtctgtttcc

SEQ ID NO: 130072 - DNA, 19 bp, Homo sapiens
agcctctgagatttgctga

SEQ ID NO: 130073 - DNA, 21 bp, Homo sapiens
tattttgtgtttctaaatgta

SEQ ID NO: 130074 - DNA, 22 bp, Homo sapiens
tgtttgtgcatctggtaatgct

SEQ ID NO: 130075 - DNA, 21 bp, Homo sapiens
agtaaaatactatccatcctc

SEQ ID NO: 130076 - DNA, 23 bp, Homo sapiens
gtgaagaatgtcagtggtagttt

SEQ ID NO: 130077 - DNA, 22 bp, Homo sapiens
tggtaattgcatgtttagtttt

SEQ ID NO: 130078 - DNA, 23 bp, Homo sapiens
attttacatttccatcagcagtg

SEQ ID NO: 130079 - DNA, 19 bp, Homo sapiens
tgagtcaagttagagagct

SEQ ID NO: 130080 - DNA, 23 bp, Homo sapiens
actgctgagagagcacactgagc

SEQ ID NO: 130081 - DNA, 20 bp, Homo sapiens
ttatgtgtatatgtttatgt

SEQ ID NO: 130082 - DNA, 23 bp, Homo sapiens
tggtttgttttctagatgtaggt

SEQ ID NO: 130083 - DNA, 23 bp, Homo sapiens
atgtagagttgcttatggaatgt

SEQ ID NO: 130084 - DNA, 20 bp, Homo sapiens
ttatatatatgtatatgtgt

SEQ ID NO: 130085 - DNA, 23 bp, Homo sapiens
agagagagacttgagtgtgagtt

SEQ ID NO: 130086 - DNA, 23 bp, Homo sapiens
tgtaatattggtgctttggaaga

SEQ ID NO: 130087 - DNA, 22 bp, Homo sapiens
tggccgtgagtgtatctagtgt

SEQ ID NO: 130088 - DNA, 22 bp, Homo sapiens
tcagactggggaaagggtaaag

SEQ ID NO: 130089 - DNA, 19 bp, Homo sapiens
gaaatataatttctgttca

SEQ ID NO: 130090 - DNA, 20 bp, Homo sapiens
ctcagcctccagagtagctg

SEQ ID NO: 130091 - DNA, 22 bp, Homo sapiens
tttttaccactctttagtcttc

SEQ ID NO: 130092 - DNA, 22 bp, Homo sapiens
taagatcatgatgagttagagt

SEQ ID NO: 130093 - DNA, 19 bp, Homo sapiens
tatatatacacatacagat

SEQ ID NO: 130094 - DNA, 19 bp, Homo sapiens
tatatatacacatacagat

SEQ ID NO: 130095 - DNA, 22 bp, Homo sapiens
ttttgagacagagtctcactct

SEQ ID NO: 130096 - DNA, 23 bp, Homo sapiens
gacagagtctcactctgttaccc

SEQ ID NO: 130097 - DNA, 23 bp, Homo sapiens
tgagacagagtctcgctctgtcg

SEQ ID NO: 130098 - DNA, 22 bp, Homo sapiens
gattacaggagtgagtcacctc

SEQ ID NO: 130099 - DNA, 22 bp, Homo sapiens
tcacagggatttcctaagcagt

SEQ ID NO: 130100 - DNA, 23 bp, Homo sapiens
agaaactgttgtcagagtgaaca

SEQ ID NO: 130101 - DNA, 23 bp, Homo sapiens
agactgtctcactctgtcaccca

SEQ ID NO: 130102 - DNA, 20 bp, Homo sapiens
agaataaatacaactgtttg

SEQ ID NO: 130103 - DNA, 22 bp, Homo sapiens
atgtgtatatatatgtgtgtgt

SEQ ID NO: 130104 - DNA, 21 bp, Homo sapiens
tattggatttaatttgtagta

SEQ ID NO: 130105 - DNA, 22 bp, Homo sapiens
ttgttacataggtaaacttgtg

SEQ ID NO: 130106 - DNA, 23 bp, Homo sapiens
ttaagttccttatagatgctgaa

SEQ ID NO: 130107 - DNA, 23 bp, Homo sapiens
ttttgagatggagtctagctctg

SEQ ID NO: 130108 - DNA, 23 bp, Homo sapiens
atatgcatatatatacatatgtg

SEQ ID NO: 130109 - DNA, 23 bp, Homo sapiens
atatatgcatatgtatatgtatg

SEQ ID NO: 130110 - DNA, 22 bp, Homo sapiens
atatatgcatatgtatatgtat

SEQ ID NO: 130111 - DNA, 20 bp, Homo sapiens
ttataaggtatttgtgtttc

SEQ ID NO: 130112 - DNA, 21 bp, Homo sapiens
tatgtgtgtgtatatatagag

SEQ ID NO: 130113 - DNA, 23 bp, Homo sapiens
tctgcctctttgtctgtctctga

SEQ ID NO: 130114 - DNA, 21 bp, Homo sapiens
tgtgtatatatatacatatgt

SEQ ID NO: 130115 - DNA, 23 bp, Homo sapiens
tgagttcattgtagattctggat

SEQ ID NO: 130116 - DNA, 23 bp, Homo sapiens
tgagttcattgtagattctggat

SEQ ID NO: 130117 - DNA, 23 bp, Homo sapiens
tgagttcattgtagattctggat

SEQ ID NO: 130118 - DNA, 23 bp, Homo sapiens
tgagttcattgtagattctggat

SEQ ID NO: 130119 - DNA, 23 bp, Homo sapiens
gtctcactctcactctgtcaccc

SEQ ID NO: 130120 - DNA, 23 bp, Homo sapiens
tgattggaagtagaatgaatagt

SEQ ID NO: 130121 - DNA, 23 bp, Homo sapiens
tggctctacttcctggagaggca

SEQ ID NO: 130122 - DNA, 22 bp, Homo sapiens
tatgtatatatgtatatatgta

SEQ ID NO: 130123 - DNA, 21 bp, Homo sapiens
tatatgtatatatatgtatgt

SEQ ID NO: 130124 - DNA, 23 bp, Homo sapiens
cggagtctcgctctgtcgctcag

SEQ ID NO: 130125 - DNA, 21 bp, Homo sapiens
cagtggcatgatcttggctca

SEQ ID NO: 130126 - DNA, 23 bp, Homo sapiens
aagcagaactgtctctcagtctg

SEQ ID NO: 130127 - DNA, 23 bp, Homo sapiens
taaatgctcattcaatagttgtt

SEQ ID NO: 130128 - DNA, 23 bp, Homo sapiens
tcttcagagaacacagagagggg

SEQ ID NO: 130129 - DNA, 23 bp, Homo sapiens
agaggtttattagtgatggttgt

SEQ ID NO: 130130 - DNA, 21 bp, Homo sapiens
ttgaaagtaaagatgtaaaca

SEQ ID NO: 130131 - DNA, 20 bp, Homo sapiens
atatgtatatatatatatgt

SEQ ID NO: 130132 - DNA, 22 bp, Homo sapiens
atatgtttctgaggaaagtggt

SEQ ID NO: 130133 - DNA, 23 bp, Homo sapiens
ggagtctcactctgtcacccagg

SEQ ID NO: 130134 - DNA, 23 bp, Homo sapiens
agatggagtctcactctgtcacc

SEQ ID NO: 130135 - DNA, 23 bp, Homo sapiens
atgttagtgagattttgcagcgg

SEQ ID NO: 130136 - DNA, 23 bp, Homo sapiens
gatggagtctcactctgtcaccc

SEQ ID NO: 130137 - DNA, 21 bp, Homo sapiens
tgtgtgcctccatgtctggct

SEQ ID NO: 130138 - DNA, 23 bp, Homo sapiens
ggtacatgggtctcgctctgttg

SEQ ID NO: 130139 - DNA, 23 bp, Homo sapiens
ccatctgtgacagcttcttgatc

SEQ ID NO: 130140 - DNA, 20 bp, Homo sapiens
tgagacagagtctcactctg

SEQ ID NO: 130141 - DNA, 23 bp, Homo sapiens
tgcagtggcatgatcttggctca

SEQ ID NO: 130142 - DNA, 20 bp, Homo sapiens
atgagacagggtctctgttg

SEQ ID NO: 130143 - DNA, 20 bp, Homo sapiens
ttactctgttgattgatgct

SEQ ID NO: 130144 - DNA, 22 bp, Homo sapiens
tagcactgtgatcaacagatgt

SEQ ID NO: 130145 - DNA, 23 bp, Homo sapiens
tatatatgtgtatatgtatgtgt

SEQ ID NO: 130146 - DNA, 20 bp, Homo sapiens
tttctcagagcttaaactaa

SEQ ID NO: 130147 - DNA, 20 bp, Homo sapiens
agtctcgctctgtcgctcag

SEQ ID NO: 130148 - DNA, 19 bp, Homo sapiens
agagttccttcatgatttg

SEQ ID NO: 130149 - DNA, 23 bp, Homo sapiens
tgtgttcaaaacttataacattc

SEQ ID NO: 130150 - DNA, 22 bp, Homo sapiens
tctggtagaatgttctatggta

SEQ ID NO: 130151 - DNA, 23 bp, Homo sapiens
ggtgagctagtatctttcttatt

SEQ ID NO: 130152 - DNA, 23 bp, Homo sapiens
ttgagacagggtctgactccatc

SEQ ID NO: 130153 - DNA, 23 bp, Homo sapiens
tgatacactcactctaacttctc

SEQ ID NO: 130154 - DNA, 21 bp, Homo sapiens
tcacatgcacctgtagtccca

SEQ ID NO: 130155 - DNA, 21 bp, Homo sapiens
tgaggtagtaggatcacttga

SEQ ID NO: 130156 - DNA, 23 bp, Homo sapiens
atgtgtcagtgtgagttaaaggg

SEQ ID NO: 130157 - DNA, 23 bp, Homo sapiens
ctatgcacatcttcctgtatact

SEQ ID NO: 130158 - DNA, 23 bp, Homo sapiens
tacatgtgcacaatgtgcaggtt

SEQ ID NO: 130159 - DNA, 22 bp, Homo sapiens
tatgtatatatatgaaaatgtg

SEQ ID NO: 130160 - DNA, 23 bp, Homo sapiens
tgcatgtgtgtagatgagatatg

SEQ ID NO: 130161 - DNA, 23 bp, Homo sapiens
tgtatatgtatgtatacatatgt

SEQ ID NO: 130162 - DNA, 22 bp, Homo sapiens
atgtatgtatatatgtatatat

SEQ ID NO: 130163 - DNA, 23 bp, Homo sapiens
tggagtctcactctgtcacccag

SEQ ID NO: 130164 - DNA, 23 bp, Homo sapiens
tatatctaaatgtctgattgaga

SEQ ID NO: 130165 - DNA, 23 bp, Homo sapiens
gccagagtctcgctctgtcaccc

SEQ ID NO: 130166 - DNA, 23 bp, Homo sapiens
gtgcaactgcaactgcaactgca

SEQ ID NO: 130167 - DNA, 22 bp, Homo sapiens
attcacacctgtaaaaatgtca

SEQ ID NO: 130168 - DNA, 21 bp, Homo sapiens
aaaatatttggataagtattg

SEQ ID NO: 130169 - DNA, 23 bp, Homo sapiens
gggtctcactctgtcacccaggc

SEQ ID NO: 130170 - DNA, 23 bp, Homo sapiens
agacactgtagatgagccactcc

SEQ ID NO: 130171 - DNA, 23 bp, Homo sapiens
gtttttctacctctgttttgagt

SEQ ID NO: 130172 - DNA, 23 bp, Homo sapiens
tttgaacctctctaatctagtct

SEQ ID NO: 130173 - DNA, 23 bp, Homo sapiens
tcagtctgtaagaggaggagtca

SEQ ID NO: 130174 - DNA, 23 bp, Homo sapiens
agagatatctctatctctataga

SEQ ID NO: 130175 - DNA, 20 bp, Homo sapiens
atatatgaatatatgtatac

SEQ ID NO: 130176 - DNA, 23 bp, Homo sapiens
aggttccaaatctagctgaatgt

SEQ ID NO: 130177 - DNA, 21 bp, Homo sapiens
ttttctgaagaaagacagctg

SEQ ID NO: 130178 - DNA, 23 bp, Homo sapiens
aacactcccaggaaatgttacct

SEQ ID NO: 130179 - DNA, 23 bp, Homo sapiens
catgagcaaatgttgggagagtg

SEQ ID NO: 130180 - DNA, 21 bp, Homo sapiens
tggttgatattcaaggccttg

SEQ ID NO: 130181 - DNA, 21 bp, Homo sapiens
tgtctgtgtatgtgtgtgtat

SEQ ID NO: 130182 - DNA, 22 bp, Homo sapiens
tgtgtgtgtgtatatatatatg

SEQ ID NO: 130183 - DNA, 23 bp, Homo sapiens
actcactcgctcacaggctccca

SEQ ID NO: 130184 - DNA, 23 bp, Homo sapiens
gagacagagtctcgctctgtcac

SEQ ID NO: 130185 - DNA, 22 bp, Homo sapiens
atattgctagatatttatttct

SEQ ID NO: 130186 - DNA, 19 bp, Homo sapiens
atagaaagaatgaatgtct

SEQ ID NO: 130187 - DNA, 23 bp, Homo sapiens
aatgctgggattagagacgtgag

SEQ ID NO: 130188 - DNA, 19 bp, Homo sapiens
tgaaaagaagctcctctaa

SEQ ID NO: 130189 - DNA, 21 bp, Homo sapiens
acctcacagcatgagctgagg

SEQ ID NO: 130190 - DNA, 20 bp, Homo sapiens
taatgtttcattttactggt

SEQ ID NO: 130191 - DNA, 23 bp, Homo sapiens
gagatgagatcttgctgtgttgc

SEQ ID NO: 130192 - DNA, 20 bp, Homo sapiens
aaaactaatcatcctttctg

SEQ ID NO: 130193 - DNA, 23 bp, Homo sapiens
aaatgtatgtatatatgtgtgtg

SEQ ID NO: 130194 - DNA, 23 bp, Homo sapiens
atacgtatatatatgtgtgtgtg

SEQ ID NO: 130195 - DNA, 18 bp, Homo sapiens
ttcagagacggagtcttg

SEQ ID NO: 130196 - DNA, 19 bp, Homo sapiens
tgcaatggtgtgatctctg

SEQ ID NO: 130197 - DNA, 23 bp, Homo sapiens
ctatatatagatatctgtatcta

SEQ ID NO: 130198 - DNA, 23 bp, Homo sapiens
aagagacagggtttcactatgtt

SEQ ID NO: 130199 - DNA, 23 bp, Homo sapiens
agagtctcactctgtcacccagg

SEQ ID NO: 130200 - DNA, 18 bp, Homo sapiens
taagccactgtgccccgc

SEQ ID NO: 130201 - DNA, 23 bp, Homo sapiens
tctctggctgtgtgtgtgtgtgc

SEQ ID NO: 130202 - DNA, 22 bp, Homo sapiens
tttttgagacggagtcttgttc

SEQ ID NO: 130203 - DNA, 23 bp, Homo sapiens
atggagtctcactctgtcaccca

SEQ ID NO: 130204 - DNA, 23 bp, Homo sapiens
agtcaagatacagagcagttcca

SEQ ID NO: 130205 - DNA, 23 bp, Homo sapiens
gtgtgtgtatatatatatgtgtg

SEQ ID NO: 130206 - DNA, 18 bp, Homo sapiens
tctcgctctgtcgctcag

SEQ ID NO: 130207 - DNA, 21 bp, Homo sapiens
gttagctttttatttctttaa

SEQ ID NO: 130208 - DNA, 22 bp, Homo sapiens
tgtgtgtatatatatatatgtg

SEQ ID NO: 130209 - DNA, 19 bp, Homo sapiens
tgtgtatatatatatgtgt

SEQ ID NO: 130210 - DNA, 23 bp, Homo sapiens
catcaggtagaatgatgaggact

SEQ ID NO: 130211 - DNA, 18 bp, Homo sapiens
actgagcatggtggtaca

SEQ ID NO: 130212 - DNA, 22 bp, Homo sapiens
tagagacggtgtatttcaaaag

SEQ ID NO: 130213 - DNA, 21 bp, Homo sapiens
ttttgagacagagtctcactc

SEQ ID NO: 130214 - DNA, 23 bp, Homo sapiens
accaacactgtttaattcctgct

SEQ ID NO: 130215 - DNA, 23 bp, Homo sapiens
tccctgcctgtgtgcctgacatc

SEQ ID NO: 130216 - DNA, 22 bp, Homo sapiens
taagcccctacatattgtctca

SEQ ID NO: 130217 - DNA, 23 bp, Homo sapiens
ctccgtcactcagtgagtgaggc

SEQ ID NO: 130218 - DNA, 23 bp, Homo sapiens
tgtgtggctctctgtctgtctgg

SEQ ID NO: 130219 - DNA, 22 bp, Homo sapiens
agtttttcctctttgtacttga

SEQ ID NO: 130220 - DNA, 23 bp, Homo sapiens
atttttcaagtggaggtggatag

SEQ ID NO: 130221 - DNA, 19 bp, Homo sapiens
aatgcatatgagtggggct

SEQ ID NO: 130222 - DNA, 22 bp, Homo sapiens
tctcccagtgggtcagttcagt

SEQ ID NO: 130223 - DNA, 22 bp, Homo sapiens
tagcatgtacattgttcacacc

SEQ ID NO: 130224 - DNA, 19 bp, Homo sapiens
tgtgctaaaaatctggatg

SEQ ID NO: 130225 - DNA, 23 bp, Homo sapiens
tgaggaagaaatttctcctgggt

SEQ ID NO: 130226 - DNA, 23 bp, Homo sapiens
ctttcagagaacagtgacatcag

SEQ ID NO: 130227 - DNA, 23 bp, Homo sapiens
ggcactttcatgtggttcatcct

SEQ ID NO: 130228 - DNA, 23 bp, Homo sapiens
taagagtatggcaatagagttag

SEQ ID NO: 130229 - DNA, 23 bp, Homo sapiens
tatatatgtgtgtgtacatatgt

SEQ ID NO: 130230 - DNA, 23 bp, Homo sapiens
atgtgtgtctctgtatgtgagat

SEQ ID NO: 130231 - DNA, 21 bp, Homo sapiens
acagcacactgatgggtcttg

SEQ ID NO: 130232 - DNA, 23 bp, Homo sapiens
aatatatcttgcacatggtcaaa

SEQ ID NO: 130233 - DNA, 23 bp, Homo sapiens
gaggttcatgtgcaggatgtgca

SEQ ID NO: 130234 - DNA, 20 bp, Homo sapiens
ctatgagcatgccactgaac

SEQ ID NO: 130235 - DNA, 23 bp, Homo sapiens
taaaactctcaggtagtgttgtt

SEQ ID NO: 130236 - DNA, 23 bp, Homo sapiens
aaatgctcagagtacattttcat

SEQ ID NO: 130237 - DNA, 18 bp, Homo sapiens
tctgagccccttatcttt

SEQ ID NO: 130238 - DNA, 20 bp, Homo sapiens
taatagaaactggaatggta

SEQ ID NO: 130239 - DNA, 22 bp, Homo sapiens
tgtgtatatatattcgtataca

SEQ ID NO: 130240 - DNA, 20 bp, Homo sapiens
tgtgtatatattcgtataca

SEQ ID NO: 130241 - DNA, 22 bp, Homo sapiens
aatttccttgtataaagattgt

SEQ ID NO: 130242 - DNA, 22 bp, Homo sapiens
taaggtggttttacattgtggt

SEQ ID NO: 130243 - DNA, 19 bp, Homo sapiens
tagatgttatactgtagtt

SEQ ID NO: 130244 - DNA, 21 bp, Homo sapiens
taattcttataactgtctggg

SEQ ID NO: 130245 - DNA, 23 bp, Homo sapiens
tgagttcattgtagattctggat

SEQ ID NO: 130246 - DNA, 23 bp, Homo sapiens
tgagttcattgtagattctggat

SEQ ID NO: 130247 - DNA, 22 bp, Homo sapiens
atgtgtgtgtatgtatatgtgt

SEQ ID NO: 130248 - DNA, 23 bp, Homo sapiens
tgagttcattgtagattctggat

SEQ ID NO: 130249 - DNA, 23 bp, Homo sapiens
tgagttcattgtagattctggat

SEQ ID NO: 130250 - DNA, 19 bp, Homo sapiens
tatggatatatatacatat

SEQ ID NO: 130251 - DNA, 22 bp, Homo sapiens
aagtctggtaatgtaatgcttc

SEQ ID NO: 130252 - DNA, 21 bp, Homo sapiens
tgcagactacacttggaacag

SEQ ID NO: 130253 - DNA, 23 bp, Homo sapiens
taggggttgtagtacaagtctag

SEQ ID NO: 130254 - DNA, 23 bp, Homo sapiens
ttagacatgagagattctgaact

SEQ ID NO: 130255 - DNA, 19 bp, Homo sapiens
ctctctgtgtgtctatttc

SEQ ID NO: 130256 - DNA, 21 bp, Homo sapiens
atactgtgtggcatataattg

SEQ ID NO: 130257 - DNA, 23 bp, Homo sapiens
tatttcttgtcctacgtctttgt

SEQ ID NO: 130258 - DNA, 18 bp, Homo sapiens
atctgcttggctatttaa

SEQ ID NO: 130259 - DNA, 23 bp, Homo sapiens
ttgtctttgcaaatctcttagca

SEQ ID NO: 130260 - DNA, 21 bp, Homo sapiens
tatacattgaagaggtaatca

SEQ ID NO: 130261 - DNA, 23 bp, Homo sapiens
tgagttcattgtagattctggat

SEQ ID NO: 130262 - DNA, 23 bp, Homo sapiens
tgagttcattgtagattctggat

SEQ ID NO: 130263 - DNA, 23 bp, Homo sapiens
aatgaggttcttgtttccttact

SEQ ID NO: 130264 - DNA, 18 bp, Homo sapiens
tggctacacagtagatat

SEQ ID NO: 130265 - DNA, 23 bp, Homo sapiens
tatgcatatgtatatatgtatat

SEQ ID NO: 130266 - DNA, 23 bp, Homo sapiens
catatgtgtatatatgtatatgt

SEQ ID NO: 130267 - DNA, 20 bp, Homo sapiens
atatgtatatatgtatatgt

SEQ ID NO: 130268 - DNA, 19 bp, Homo sapiens
aatcagtgaggatactagg

SEQ ID NO: 130269 - DNA, 23 bp, Homo sapiens
atatatgagcatatgatctgata

SEQ ID NO: 130270 - DNA, 23 bp, Homo sapiens
tgagttcattgtagattctggat

SEQ ID NO: 130271 - DNA, 23 bp, Homo sapiens
tgagttcattgtagattctggat

SEQ ID NO: 130272 - DNA, 22 bp, Homo sapiens
tgtatgtatatatgtatacatg

SEQ ID NO: 130273 - DNA, 23 bp, Homo sapiens
atgtgtatatatgtatatgtata

SEQ ID NO: 130274 - DNA, 22 bp, Homo sapiens
tatatgcatatgtatatatgta

SEQ ID NO: 130275 - DNA, 18 bp, Homo sapiens
atatgtatatatatgtgt

SEQ ID NO: 130276 - DNA, 22 bp, Homo sapiens
tttatttttcatttgcaatgca

SEQ ID NO: 130277 - DNA, 23 bp, Homo sapiens
tgagttcattgtagattctggat

SEQ ID NO: 130278 - DNA, 23 bp, Homo sapiens
tgagttcattgtagattctggat

SEQ ID NO: 130279 - DNA, 23 bp, Homo sapiens
tatagtgtatatgtatgtgtgtg

SEQ ID NO: 130280 - DNA, 23 bp, Homo sapiens
atgtgtatgtatatatatgcata

SEQ ID NO: 130281 - DNA, 18 bp, Homo sapiens
atactttaagttttaggg

SEQ ID NO: 130282 - DNA, 23 bp, Homo sapiens
tatactgtgtgtttttcaacact

SEQ ID NO: 130283 - DNA, 23 bp, Homo sapiens
tacaatgtatattaatatatgtg

SEQ ID NO: 130284 - DNA, 23 bp, Homo sapiens
cacagaccattttttttctttta

SEQ ID NO: 130285 - DNA, 22 bp, Homo sapiens
tatcatacacaaaatcatgtac

SEQ ID NO: 130286 - DNA, 20 bp, Homo sapiens
ttatacatatatgtgttagc

SEQ ID NO: 130287 - DNA, 19 bp, Homo sapiens
tatatgtgtgtatgtgtat

SEQ ID NO: 130288 - DNA, 22 bp, Homo sapiens
tataactataactatatatgtg

SEQ ID NO: 130289 - DNA, 18 bp, Homo sapiens
agactacagccatgcacc

SEQ ID NO: 130290 - DNA, 23 bp, Homo sapiens
agagatgtgttctgataatgttg

SEQ ID NO: 130291 - DNA, 23 bp, Homo sapiens
tatgcatgtatatatgtatgtat

SEQ ID NO: 130292 - DNA, 23 bp, Homo sapiens
tgtgtgtatgtatgcatatgtgt

SEQ ID NO: 130293 - DNA, 19 bp, Homo sapiens
ctgggtagagactgacata

SEQ ID NO: 130294 - DNA, 23 bp, Homo sapiens
aacagctgcccgaccagattgag

SEQ ID NO: 130295 - DNA, 23 bp, Homo sapiens
gtgagccactgtgcttggcctct

SEQ ID NO: 130296 - DNA, 23 bp, Homo sapiens
cggagtctcactctgtcacccag

SEQ ID NO: 130297 - DNA, 23 bp, Homo sapiens
gagtctcactctgtcacccaggc

SEQ ID NO: 130298 - DNA, 21 bp, Homo sapiens
actgttcctgggtgtgtctgt

SEQ ID NO: 130299 - DNA, 19 bp, Homo sapiens
ttagtgggttaagtatcca

SEQ ID NO: 130300 - DNA, 23 bp, Homo sapiens
agaatgactactccataggatga

SEQ ID NO: 130301 - DNA, 18 bp, Homo sapiens
cagtctttcttctctttc

SEQ ID NO: 130302 - DNA, 23 bp, Homo sapiens
tgtctctgtctgccactttatgc

SEQ ID NO: 130303 - DNA, 19 bp, Homo sapiens
acatggtatccctctgtca

SEQ ID NO: 130304 - DNA, 23 bp, Homo sapiens
aatgtaattgaacaattgagtat

SEQ ID NO: 130305 - DNA, 23 bp, Homo sapiens
aaatatctgaggtttagtggggt

SEQ ID NO: 130306 - DNA, 21 bp, Homo sapiens
ttcagcatattaaatttagtg

SEQ ID NO: 130307 - DNA, 22 bp, Homo sapiens
tatgaatatatacatatgtgtg

SEQ ID NO: 130308 - DNA, 23 bp, Homo sapiens
aatgagtgtgtgtatgcaggcac

SEQ ID NO: 130309 - DNA, 20 bp, Homo sapiens
tgtggtttttctctcagcga

SEQ ID NO: 130310 - DNA, 23 bp, Homo sapiens
cggagtctcactctgtcacccag

SEQ ID NO: 130311 - DNA, 20 bp, Homo sapiens
tatggatatatatacatgta

SEQ ID NO: 130312 - DNA, 22 bp, Homo sapiens
tatgtgtatatgtatatgtgtg

SEQ ID NO: 130313 - DNA, 21 bp, Homo sapiens
tgaggtaggaggatcacttga

SEQ ID NO: 130314 - DNA, 20 bp, Homo sapiens
tatataatggtatactattc

SEQ ID NO: 130315 - DNA, 19 bp, Homo sapiens
tatgtatatatacatatgt

SEQ ID NO: 130316 - DNA, 19 bp, Homo sapiens
atatgtatatatacatatg

SEQ ID NO: 130317 - DNA, 22 bp, Homo sapiens
tgattttcatatgttgattttg

SEQ ID NO: 130318 - DNA, 23 bp, Homo sapiens
tgaatttatacttactggttgag

SEQ ID NO: 130319 - DNA, 23 bp, Homo sapiens
aattgtgatttttttttccatat

SEQ ID NO: 130320 - DNA, 20 bp, Homo sapiens
ttgcaccaacctaatactgt

SEQ ID NO: 130321 - DNA, 20 bp, Homo sapiens
tgctattaccttggaattat

SEQ ID NO: 130322 - DNA, 21 bp, Homo sapiens
acatgtgcacaatgtgcaggt

SEQ ID NO: 130323 - DNA, 23 bp, Homo sapiens
cggagtctcactctgtcacccag

SEQ ID NO: 130324 - DNA, 23 bp, Homo sapiens
gagtctcactctgtcacccaggc

SEQ ID NO: 130325 - DNA, 23 bp, Homo sapiens
tatgtgtgtatatatgtatgtgt

SEQ ID NO: 130326 - DNA, 22 bp, Homo sapiens
tgcagataaggatgatgtttat

SEQ ID NO: 130327 - DNA, 18 bp, Homo sapiens
tcaatatattagcagtat

SEQ ID NO: 130328 - DNA, 19 bp, Homo sapiens
atgtggaacagtttgatcc

SEQ ID NO: 130329 - DNA, 19 bp, Homo sapiens
tagggcaaattattcctca

SEQ ID NO: 130330 - DNA, 23 bp, Homo sapiens
atgagtatgtaaatgtgtgtgtg

SEQ ID NO: 130331 - DNA, 20 bp, Homo sapiens
ctattgcttcaattatgtta

SEQ ID NO: 130332 - DNA, 23 bp, Homo sapiens
tgagttcattgtagattctggat

SEQ ID NO: 130333 - DNA, 23 bp, Homo sapiens
tgagttcattgtagattctggat

SEQ ID NO: 130334 - DNA, 19 bp, Homo sapiens
tgacatatgtgtgtgtgta

SEQ ID NO: 130335 - DNA, 23 bp, Homo sapiens
atatgtgtatatatatatatgtg

SEQ ID NO: 130336 - DNA, 23 bp, Homo sapiens
agtgtgtgtgcatatatatatgt

SEQ ID NO: 130337 - DNA, 22 bp, Homo sapiens
tttgtgtatatttacatgtgtg

SEQ ID NO: 130338 - DNA, 23 bp, Homo sapiens
tgtatatatatgtgtgtgtgcat

SEQ ID NO: 130339 - DNA, 22 bp, Homo sapiens
tatgtgtatatatgtatatgtg

SEQ ID NO: 130340 - DNA, 22 bp, Homo sapiens
tgtaaggatggaagacttaatc

SEQ ID NO: 130341 - DNA, 23 bp, Homo sapiens
atatgtatatgcatgtatattgt

SEQ ID NO: 130342 - DNA, 23 bp, Homo sapiens
taacacctagttaaaagcattag

SEQ ID NO: 130343 - DNA, 23 bp, Homo sapiens
ggtgtctcacactgtcaccctgg

SEQ ID NO: 130344 - DNA, 23 bp, Homo sapiens
tacagaggttttgtttttgtctt

SEQ ID NO: 130345 - DNA, 18 bp, Homo sapiens
tgtaatggagtggccctg

SEQ ID NO: 130346 - DNA, 19 bp, Homo sapiens
tgagatggagtctcgctct

SEQ ID NO: 130347 - DNA, 20 bp, Homo sapiens
agagtgctattgtggtggtt

SEQ ID NO: 130348 - DNA, 23 bp, Homo sapiens
aagcctcattttgttcatctggt

SEQ ID NO: 130349 - DNA, 23 bp, Homo sapiens
tatagtagagatgatcagcaaag

SEQ ID NO: 130350 - DNA, 18 bp, Homo sapiens
gacgttgatttatcagtt

SEQ ID NO: 130351 - DNA, 23 bp, Homo sapiens
ttatgatttacttgctaatatac

SEQ ID NO: 130352 - DNA, 18 bp, Homo sapiens
tttactgaatttgttgat

SEQ ID NO: 130353 - DNA, 20 bp, Homo sapiens
tgaggaagaaggaagaagaa

SEQ ID NO: 130354 - DNA, 21 bp, Homo sapiens
actctagttgaataagtcaga

SEQ ID NO: 130355 - DNA, 23 bp, Homo sapiens
tttgagacagggtttcactcttg

SEQ ID NO: 130356 - DNA, 20 bp, Homo sapiens
tttgatctacatcaaagcta

SEQ ID NO: 130357 - DNA, 20 bp, Homo sapiens
ttgagatggagtctcgctct

SEQ ID NO: 130358 - DNA, 22 bp, Homo sapiens
acagtctctgtggctctgcatg

SEQ ID NO: 130359 - DNA, 21 bp, Homo sapiens
atatgtgtgtgtatgtatatg

SEQ ID NO: 130360 - DNA, 21 bp, Homo sapiens
tgagaagaaactaggaaagat

SEQ ID NO: 130361 - DNA, 23 bp, Homo sapiens
tgagttcattgtagattctggat

SEQ ID NO: 130362 - DNA, 23 bp, Homo sapiens
tgagttcattgtagattctggat

SEQ ID NO: 130363 - DNA, 23 bp, Homo sapiens
tgagttcattgtagattctggat

SEQ ID NO: 130364 - DNA, 23 bp, Homo sapiens
tgagttcattgtagattctggat

SEQ ID NO: 130365 - DNA, 23 bp, Homo sapiens
tgagttcattgtagattctggat

SEQ ID NO: 130366 - DNA, 23 bp, Homo sapiens
tgagttcattgtagattctggat

SEQ ID NO: 130367 - DNA, 21 bp, Homo sapiens
aatctcctgctattattgttt

SEQ ID NO: 130368 - DNA, 23 bp, Homo sapiens
acatgtcaatttctttaggtgtt

SEQ ID NO: 130369 - DNA, 20 bp, Homo sapiens
ttatcctgctgctcccattg

SEQ ID NO: 130370 - DNA, 23 bp, Homo sapiens
gacagtctcgctctgtcacccag

SEQ ID NO: 130371 - DNA, 23 bp, Homo sapiens
tcaggtggtttgttttagagtta

SEQ ID NO: 130372 - DNA, 23 bp, Homo sapiens
tacagagactgtgattgtgaata

SEQ ID NO: 130373 - DNA, 20 bp, Homo sapiens
atgtgcagaacgtgcaggtt

SEQ ID NO: 130374 - DNA, 20 bp, Homo sapiens
tttttccctatctgttcagt

SEQ ID NO: 130375 - DNA, 23 bp, Homo sapiens
ttcttcagaagcgattttgttgt

SEQ ID NO: 130376 - DNA, 22 bp, Homo sapiens
tgaagaatccctacagactctg

SEQ ID NO: 130377 - DNA, 23 bp, Homo sapiens
atacacattatttatatgtgtgc

SEQ ID NO: 130378 - DNA, 23 bp, Homo sapiens
atacatatgcatgtggtattcta

SEQ ID NO: 130379 - DNA, 23 bp, Homo sapiens
tatatatgtgtgtgtgtatacat

SEQ ID NO: 130380 - DNA, 20 bp, Homo sapiens
ttgtgtgtatatatgtatac

SEQ ID NO: 130381 - DNA, 23 bp, Homo sapiens
aggaggttcatccatgttagtca

SEQ ID NO: 130382 - DNA, 23 bp, Homo sapiens
atcaggaggaaaattctcccaaa

SEQ ID NO: 130383 - DNA, 23 bp, Homo sapiens
aggagaaaagcctttgagtcttt

SEQ ID NO: 130384 - DNA, 21 bp, Homo sapiens
tgtggatatatatatatatct

SEQ ID NO: 130385 - DNA, 21 bp, Homo sapiens
tgtatacatacatgtttgcgt

SEQ ID NO: 130386 - DNA, 23 bp, Homo sapiens
taggatcacagtttatgaaattc

SEQ ID NO: 130387 - DNA, 22 bp, Homo sapiens
aaaagtcctttatcagctgtat

SEQ ID NO: 130388 - DNA, 23 bp, Homo sapiens
acagacagagtagtgtgtggaga

SEQ ID NO: 130389 - DNA, 22 bp, Homo sapiens
gactctgtttctgactgtacac

SEQ ID NO: 130390 - DNA, 21 bp, Homo sapiens
tctgtctcccagactagagtg

SEQ ID NO: 130391 - DNA, 23 bp, Homo sapiens
ctcctaatgtttacattatcctg

SEQ ID NO: 130392 - DNA, 23 bp, Homo sapiens
taatatgtattctagcaaaattc

SEQ ID NO: 130393 - DNA, 23 bp, Homo sapiens
ttcatctctttggtatagttggg

SEQ ID NO: 130394 - DNA, 20 bp, Homo sapiens
ttaggtatgtgcttgttctt

SEQ ID NO: 130395 - DNA, 23 bp, Homo sapiens
ctgagaatgtctttggtattatt

SEQ ID NO: 130396 - DNA, 22 bp, Homo sapiens
tttatatagttaacatatgtat

SEQ ID NO: 130397 - DNA, 23 bp, Homo sapiens
gtcaatttgaagtggtttgggat

SEQ ID NO: 130398 - DNA, 22 bp, Homo sapiens
actcactctgtcttacttcttc

SEQ ID NO: 130399 - DNA, 21 bp, Homo sapiens
tgtgtgtatatatatatcttg

SEQ ID NO: 130400 - DNA, 21 bp, Homo sapiens
tatatgatactatatatatga

SEQ ID NO: 130401 - DNA, 22 bp, Homo sapiens
tatatggtactatatatatgat

SEQ ID NO: 130402 - DNA, 23 bp, Homo sapiens
tgtatatatgtgtgtgtgtgtct

SEQ ID NO: 130403 - DNA, 20 bp, Homo sapiens
tgttcttcctctgagcttga

SEQ ID NO: 130404 - DNA, 23 bp, Homo sapiens
agagatgacagtgaagattcagg

SEQ ID NO: 130405 - DNA, 21 bp, Homo sapiens
ctatagtattctttctcttta

SEQ ID NO: 130406 - DNA, 19 bp, Homo sapiens
gagtgaccatacagttttc

SEQ ID NO: 130407 - DNA, 23 bp, Homo sapiens
agtttaattcttctgcctatgaa

SEQ ID NO: 130408 - DNA, 23 bp, Homo sapiens
tgagttcattgtagattctggat

SEQ ID NO: 130409 - DNA, 23 bp, Homo sapiens
tgagttcattgtagattctggat

SEQ ID NO: 130410 - DNA, 18 bp, Homo sapiens
tacgataactctgagtaa

SEQ ID NO: 130411 - DNA, 21 bp, Homo sapiens
cggagtctcgctctgtcaccc

SEQ ID NO: 130412 - DNA, 23 bp, Homo sapiens
atatgtatatgtgtatatgtata

SEQ ID NO: 130413 - DNA, 23 bp, Homo sapiens
atatgtgtgtgtatgtatatgtg

SEQ ID NO: 130414 - DNA, 20 bp, Homo sapiens
aatctaggatcaccttgcct

SEQ ID NO: 130415 - DNA, 23 bp, Homo sapiens
tgtaagacagttttgctttaggc

SEQ ID NO: 130416 - DNA, 18 bp, Homo sapiens
aaatgagtgtgtttcttt

SEQ ID NO: 130417 - DNA, 23 bp, Homo sapiens
tgtgtgtgcgtatgtatacacat

SEQ ID NO: 130418 - DNA, 23 bp, Homo sapiens
ggagtctcactctgtcacccagg

SEQ ID NO: 130419 - DNA, 23 bp, Homo sapiens
attaaggatcttaaatgaggaga

SEQ ID NO: 130420 - DNA, 23 bp, Homo sapiens
tacagtggctcacatctgtaatt

SEQ ID NO: 130421 - DNA, 23 bp, Homo sapiens
gaaaacagtgagcacagggtgtg

SEQ ID NO: 130422 - DNA, 19 bp, Homo sapiens
taaacctagaattaccata

SEQ ID NO: 130423 - DNA, 23 bp, Homo sapiens
acaagtttgagcctctttctttt

SEQ ID NO: 130424 - DNA, 23 bp, Homo sapiens
tgagatgtagtctcgctctgtcg

SEQ ID NO: 130425 - DNA, 18 bp, Homo sapiens
taatggaagttagcagat

SEQ ID NO: 130426 - DNA, 23 bp, Homo sapiens
atacacgtgcaggatgtgcaggt

SEQ ID NO: 130427 - DNA, 23 bp, Homo sapiens
aatacacactagagtgtctccca

SEQ ID NO: 130428 - DNA, 23 bp, Homo sapiens
cttgagacaagagtctcactttg

SEQ ID NO: 130429 - DNA, 23 bp, Homo sapiens
ttcaagtgcaagtgatgcaatgt

SEQ ID NO: 130430 - DNA, 23 bp, Homo sapiens
actaggggagaaaatctagtcta

SEQ ID NO: 130431 - DNA, 23 bp, Homo sapiens
agacagagtctccctctgtcacc

SEQ ID NO: 130432 - DNA, 23 bp, Homo sapiens
tcacagtactgagtctgcaatga

SEQ ID NO: 130433 - DNA, 23 bp, Homo sapiens
agtatttatgttatggagctcta

SEQ ID NO: 130434 - DNA, 23 bp, Homo sapiens
tgtgtatgtgtatatgtatatgt

SEQ ID NO: 130435 - DNA, 22 bp, Homo sapiens
tctgtcactcagtagctgtgtg

SEQ ID NO: 130436 - DNA, 23 bp, Homo sapiens
gctgacagtggctgctttagttc

SEQ ID NO: 130437 - DNA, 22 bp, Homo sapiens
gtgacagagtaagaccctgtct

SEQ ID NO: 130438 - DNA, 22 bp, Homo sapiens
tgagacagtatctcactgtgtc

SEQ ID NO: 130439 - DNA, 20 bp, Homo sapiens
atatgtatatgtatatatgt

SEQ ID NO: 130440 - DNA, 23 bp, Homo sapiens
tatgtatatatgtatatgtatac

SEQ ID NO: 130441 - DNA, 23 bp, Homo sapiens
tatgcatatatatgcatatatgt

SEQ ID NO: 130442 - DNA, 23 bp, Homo sapiens
tgtagtctcagctacttatgagg

SEQ ID NO: 130443 - DNA, 22 bp, Homo sapiens
tgtgaatttctaatgtgaatag

SEQ ID NO: 130444 - DNA, 18 bp, Homo sapiens
agcatgagattttgctca

SEQ ID NO: 130445 - DNA, 22 bp, Homo sapiens
tttgttctttttgcttaggatt

SEQ ID NO: 130446 - DNA, 23 bp, Homo sapiens
tgagttcattgtagattctggat

SEQ ID NO: 130447 - DNA, 23 bp, Homo sapiens
tgagttcattgtagattctggat

SEQ ID NO: 130448 - DNA, 23 bp, Homo sapiens
actggattctcatgtaggtgagg

SEQ ID NO: 130449 - DNA, 23 bp, Homo sapiens
actctctgacccttacttgatgc

SEQ ID NO: 130450 - DNA, 21 bp, Homo sapiens
tcagtgtgtggttttgagctc

SEQ ID NO: 130451 - DNA, 23 bp, Homo sapiens
tgagttcattgtagattctggat

SEQ ID NO: 130452 - DNA, 23 bp, Homo sapiens
tgagttcattgtagattctggat

SEQ ID NO: 130453 - DNA, 20 bp, Homo sapiens
tgtggtgcttttgtatatat

SEQ ID NO: 130454 - DNA, 23 bp, Homo sapiens
tatacatatgtaacacatcacag

SEQ ID NO: 130455 - DNA, 23 bp, Homo sapiens
actgtggtcatgttcctggtact

SEQ ID NO: 130456 - DNA, 21 bp, Homo sapiens
atggagcccttcttggtgctg

SEQ ID NO: 130457 - DNA, 19 bp, Homo sapiens
tatatgtacatatatatgt

SEQ ID NO: 130458 - DNA, 23 bp, Homo sapiens
caagagtgtaaagtggtattttt

SEQ ID NO: 130459 - DNA, 20 bp, Homo sapiens
tctgtcacccagactagagt

SEQ ID NO: 130460 - DNA, 22 bp, Homo sapiens
tgacaatcgatttcatatacat

SEQ ID NO: 130461 - DNA, 23 bp, Homo sapiens
ttccatgtttttatgtatatgaa

SEQ ID NO: 130462 - DNA, 22 bp, Homo sapiens
tggagtctcactctgtcaccca

SEQ ID NO: 130463 - DNA, 19 bp, Homo sapiens
tgtgcatttattatgtagg

SEQ ID NO: 130464 - DNA, 23 bp, Homo sapiens
tggagtctcactctgtcacccag

SEQ ID NO: 130465 - DNA, 23 bp, Homo sapiens
cactcatcttctctctgtcacac

SEQ ID NO: 130466 - DNA, 18 bp, Homo sapiens
gacagtgggtggatgtgg

SEQ ID NO: 130467 - DNA, 23 bp, Homo sapiens
tgagttcattgtagattctggat

SEQ ID NO: 130468 - DNA, 23 bp, Homo sapiens
tgagttcattgtagattctggat

SEQ ID NO: 130469 - DNA, 20 bp, Homo sapiens
caatgtccagctgcttcacc

SEQ ID NO: 130470 - DNA, 23 bp, Homo sapiens
gtacttgattgtacatatgcact

SEQ ID NO: 130471 - DNA, 23 bp, Homo sapiens
tggagtctcactctgtcacccag

SEQ ID NO: 130472 - DNA, 22 bp, Homo sapiens
tagttctccttgaagaggtcct

SEQ ID NO: 130473 - DNA, 23 bp, Homo sapiens
atgtgtgtctctgtatgtgagat

SEQ ID NO: 130474 - DNA, 21 bp, Homo sapiens
acagcacactgatgggtcttg

SEQ ID NO: 130475 - DNA, 21 bp, Homo sapiens
acatgtgcacaatgtgcaggt

SEQ ID NO: 130476 - DNA, 20 bp, Homo sapiens
atgcatgtagagtgggttca

SEQ ID NO: 130477 - DNA, 23 bp, Homo sapiens
tatgaattcaactaggagtggac

SEQ ID NO: 130478 - DNA, 23 bp, Homo sapiens
gggattgctggatgatgtagtag

SEQ ID NO: 130479 - DNA, 23 bp, Homo sapiens
ttcttcacagtggctgtacaaat

SEQ ID NO: 130480 - DNA, 22 bp, Homo sapiens
agtgggatattgaagttttcta

SEQ ID NO: 130481 - DNA, 22 bp, Homo sapiens
taagaatctttgtatttctgag

SEQ ID NO: 130482 - DNA, 23 bp, Homo sapiens
tgagttcattgtagattctggat

SEQ ID NO: 130483 - DNA, 23 bp, Homo sapiens
tgagttcattgtagattctggat

SEQ ID NO: 130484 - DNA, 20 bp, Homo sapiens
tatgtgtgtgtgtatatatg

SEQ ID NO: 130485 - DNA, 22 bp, Homo sapiens
tctcacactttctgtctgtcag

SEQ ID NO: 130486 - DNA, 23 bp, Homo sapiens
gctaagtggatctggatcagagt

SEQ ID NO: 130487 - DNA, 23 bp, Homo sapiens
tcaaattcagcttggttttgata

SEQ ID NO: 130488 - DNA, 23 bp, Homo sapiens
gtcagagtctcgctctgtcaccc

SEQ ID NO: 130489 - DNA, 23 bp, Homo sapiens
cctgtgttagatacattttaagt

SEQ ID NO: 130490 - DNA, 23 bp, Homo sapiens
tggagtctcactctgtcacccag

SEQ ID NO: 130491 - DNA, 23 bp, Homo sapiens
tgagttcattgtagattctggat

SEQ ID NO: 130492 - DNA, 23 bp, Homo sapiens
tgagttcattgtagattctggat

SEQ ID NO: 130493 - DNA, 20 bp, Homo sapiens
gtgtgtgtgtgtgtgtgtgt

SEQ ID NO: 130494 - DNA, 21 bp, Homo sapiens
tcagagtagatagtgggcact

SEQ ID NO: 130495 - DNA, 23 bp, Homo sapiens
actgtggccctctgtgtgcctgt

SEQ ID NO: 130496 - DNA, 23 bp, Homo sapiens
tgtttgtgcatgtgcatgtgttt

SEQ ID NO: 130497 - DNA, 20 bp, Homo sapiens
atagttattcttaatgggtg

SEQ ID NO: 130498 - DNA, 23 bp, Homo sapiens
tacattatatatgtatatgtgtg

SEQ ID NO: 130499 - DNA, 22 bp, Homo sapiens
attatatatatgtatatgtgtg

SEQ ID NO: 130500 - DNA, 23 bp, Homo sapiens
tgtagccaggtattgatcttttt

SEQ ID NO: 130501 - DNA, 22 bp, Homo sapiens
tgagcttcttggatgtgtagat

SEQ ID NO: 130502 - DNA, 23 bp, Homo sapiens
ttgttcaaaaaggaatgtcataa

SEQ ID NO: 130503 - DNA, 23 bp, Homo sapiens
tacccctagtcattgtcatctag

SEQ ID NO: 130504 - DNA, 23 bp, Homo sapiens
tgagaactggttaatattgagca

SEQ ID NO: 130505 - DNA, 23 bp, Homo sapiens
tagtgtattagtttatcagagtt

SEQ ID NO: 130506 - DNA, 21 bp, Homo sapiens
tagggcatctttttcctttgt

SEQ ID NO: 130507 - DNA, 20 bp, Homo sapiens
aacagtatttcaggatcaac

SEQ ID NO: 130508 - DNA, 19 bp, Homo sapiens
attgctagataatacggta

SEQ ID NO: 130509 - DNA, 22 bp, Homo sapiens
agacagagtctggctctgttgc

SEQ ID NO: 130510 - DNA, 21 bp, Homo sapiens
gatagcttttctagttctgtg

SEQ ID NO: 130511 - DNA, 20 bp, Homo sapiens
atctgtatatatgtatatgt

SEQ ID NO: 130512 - DNA, 20 bp, Homo sapiens
tatacgtggtatatacacgt

SEQ ID NO: 130513 - DNA, 23 bp, Homo sapiens
cggagtctcactctgtcacccag

SEQ ID NO: 130514 - DNA, 23 bp, Homo sapiens
tgagtctcgctctgtctcctaga

SEQ ID NO: 130515 - DNA, 23 bp, Homo sapiens
aactctgatagggattgtactga

SEQ ID NO: 130516 - DNA, 23 bp, Homo sapiens
tgagttcattgtagattctggat

SEQ ID NO: 130517 - DNA, 23 bp, Homo sapiens
tgagttcattgtagattctggat

SEQ ID NO: 130518 - DNA, 23 bp, Homo sapiens
tgagttcattgtagattctggat

SEQ ID NO: 130519 - DNA, 18 bp, Homo sapiens
tgcattttgggctggtat

SEQ ID NO: 130520 - DNA, 23 bp, Homo sapiens
ttaactgtccattgcaagtgtat

SEQ ID NO: 130521 - DNA, 23 bp, Homo sapiens
ttatgtgactggtaatccttggc

SEQ ID NO: 130522 - DNA, 23 bp, Homo sapiens
atttacacagtgattattaagtg

SEQ ID NO: 130523 - DNA, 22 bp, Homo sapiens
attcacagatgtaaagatctat

SEQ ID NO: 130524 - DNA, 22 bp, Homo sapiens
gataaactttggccattcattt

SEQ ID NO: 130525 - DNA, 23 bp, Homo sapiens
gagtctcactctgtcactcaggc

SEQ ID NO: 130526 - DNA, 20 bp, Homo sapiens
ttatttgtatatcatttttg

SEQ ID NO: 130527 - DNA, 23 bp, Homo sapiens
tttaagtttgcataagctaagtg

SEQ ID NO: 130528 - DNA, 18 bp, Homo sapiens
ttgttccttttgaagtat

SEQ ID NO: 130529 - DNA, 20 bp, Homo sapiens
gtatttcagtagctctagag

SEQ ID NO: 130530 - DNA, 23 bp, Homo sapiens
tagtacttcattgtgtataggca

SEQ ID NO: 130531 - DNA, 22 bp, Homo sapiens
tacatgtgcacaatgtgcagtt

SEQ ID NO: 130532 - DNA, 22 bp, Homo sapiens
tctcactgtgtctcaaactcct

SEQ ID NO: 130533 - DNA, 22 bp, Homo sapiens
tctctactcactgtgtttcctg

SEQ ID NO: 130534 - DNA, 20 bp, Homo sapiens
tatgtttataatagatgtat

SEQ ID NO: 130535 - DNA, 21 bp, Homo sapiens
tttttgcatattttaaatggt

SEQ ID NO: 130536 - DNA, 23 bp, Homo sapiens
tatatgcatctatctatctatgt

SEQ ID NO: 130537 - DNA, 23 bp, Homo sapiens
tgagttcattgtagattctggat

SEQ ID NO: 130538 - DNA, 23 bp, Homo sapiens
tgagttcattgtagattctggat

SEQ ID NO: 130539 - DNA, 23 bp, Homo sapiens
tgagttcattgtagattctggat

SEQ ID NO: 130540 - DNA, 20 bp, Homo sapiens
taacttttttgagaatgcaa

SEQ ID NO: 130541 - DNA, 23 bp, Homo sapiens
catgctcactctgtctgtgactg

SEQ ID NO: 130542 - DNA, 23 bp, Homo sapiens
ctgtcttctgtgtcgctcacact

SEQ ID NO: 130543 - DNA, 23 bp, Homo sapiens
tgtgtgtatatatatatgtgtgt

SEQ ID NO: 130544 - DNA, 23 bp, Homo sapiens
tatgtgctacatatagcttagta

SEQ ID NO: 130545 - DNA, 22 bp, Homo sapiens
tttctccatgagtattgtcaga

SEQ ID NO: 130546 - DNA, 23 bp, Homo sapiens
tgtcagactgaagaaagacacct

SEQ ID NO: 130547 - DNA, 21 bp, Homo sapiens
aatgtcagaaagtaaaagacc

SEQ ID NO: 130548 - DNA, 20 bp, Homo sapiens
tattgtatatatgtatactg

SEQ ID NO: 130549 - DNA, 20 bp, Homo sapiens
tatgtgtatatatatacagt

SEQ ID NO: 130550 - DNA, 22 bp, Homo sapiens
tttgaggtacaaagttgaaaag

SEQ ID NO: 130551 - DNA, 23 bp, Homo sapiens
tctcgaagtctcactctgtcacc

SEQ ID NO: 130552 - DNA, 20 bp, Homo sapiens
atgaagtatgtatatgtata

SEQ ID NO: 130553 - DNA, 23 bp, Homo sapiens
cagggtctcactgtgtcacccag

SEQ ID NO: 130554 - DNA, 19 bp, Homo sapiens
agtggcgagatcttggctc

SEQ ID NO: 130555 - DNA, 23 bp, Homo sapiens
aaagaggaatgttgaagggtatg

SEQ ID NO: 130556 - DNA, 23 bp, Homo sapiens
tgagttcattgtagattctggat

SEQ ID NO: 130557 - DNA, 23 bp, Homo sapiens
tgagttcattgtagattctggat

SEQ ID NO: 130558 - DNA, 23 bp, Homo sapiens
atcttgtaaggttttgtatattt

SEQ ID NO: 130559 - DNA, 22 bp, Homo sapiens
acatgtgcacaatgtgcaggtt

SEQ ID NO: 130560 - DNA, 23 bp, Homo sapiens
tgagttcattgtagattctggat

SEQ ID NO: 130561 - DNA, 23 bp, Homo sapiens
tgagttcattgtagattctggat

SEQ ID NO: 130562 - DNA, 22 bp, Homo sapiens
atatgtgtgtatatatatgtat

SEQ ID NO: 130563 - DNA, 22 bp, Homo sapiens
atatgtatatatgtatatgtgt

SEQ ID NO: 130564 - DNA, 23 bp, Homo sapiens
tatatgtatatatgtatatgtgt

SEQ ID NO: 130565 - DNA, 18 bp, Homo sapiens
atatgtatatatgtatat

SEQ ID NO: 130566 - DNA, 23 bp, Homo sapiens
tgtatatatgtatatatgtatag

SEQ ID NO: 130567 - DNA, 22 bp, Homo sapiens
tgtgtatatatgtatatatgta

SEQ ID NO: 130568 - DNA, 23 bp, Homo sapiens
atgtgtatatatgtatatatgta

SEQ ID NO: 130569 - DNA, 23 bp, Homo sapiens
tgagttcattgtagattctggat

SEQ ID NO: 130570 - DNA, 23 bp, Homo sapiens
tgagttcattgtagattctggat

SEQ ID NO: 130571 - DNA, 19 bp, Homo sapiens
aacttactgaatttgttta

SEQ ID NO: 130572 - DNA, 23 bp, Homo sapiens
cacgtatatatatgtatatacat

SEQ ID NO: 130573 - DNA, 23 bp, Homo sapiens
ctcattgtggttttgatttgcat

SEQ ID NO: 130574 - DNA, 23 bp, Homo sapiens
tttttggtggtatgtatgtctta

SEQ ID NO: 130575 - DNA, 22 bp, Homo sapiens
atgtgtatatatgtatatatgt

SEQ ID NO: 130576 - DNA, 19 bp, Homo sapiens
tatgtatatacacatatgt

SEQ ID NO: 130577 - DNA, 23 bp, Homo sapiens
agagcaacaaaagtatacagata

SEQ ID NO: 130578 - DNA, 22 bp, Homo sapiens
tgttgaaagcatttccagacat

SEQ ID NO: 130579 - DNA, 23 bp, Homo sapiens
tctgtgtgtgtaaatgtgtgtgt

SEQ ID NO: 130580 - DNA, 20 bp, Homo sapiens
tgtgttgctcaggctgtctt

SEQ ID NO: 130581 - DNA, 20 bp, Homo sapiens
agagtataagaattcctgtt

SEQ ID NO: 130582 - DNA, 23 bp, Homo sapiens
tgagttcattgtagattctggat

SEQ ID NO: 130583 - DNA, 23 bp, Homo sapiens
tgagttcattgtagattctggat

SEQ ID NO: 130584 - DNA, 23 bp, Homo sapiens
atttttggttccatatgaatttt

SEQ ID NO: 130585 - DNA, 23 bp, Homo sapiens
aatgatgctagtaatttgattga

SEQ ID NO: 130586 - DNA, 23 bp, Homo sapiens
actttgtgctatgaatttgtctg

SEQ ID NO: 130587 - DNA, 22 bp, Homo sapiens
taggaccacataagccagctgt

SEQ ID NO: 130588 - DNA, 23 bp, Homo sapiens
atactttctgtatatgtttattt

SEQ ID NO: 130589 - DNA, 22 bp, Homo sapiens
tcaagagttacgtaaacatgag

SEQ ID NO: 130590 - DNA, 23 bp, Homo sapiens
aaatcttgtacatttgctccttt

SEQ ID NO: 130591 - DNA, 21 bp, Homo sapiens
tcagtgtatgtgtatgagaag

SEQ ID NO: 130592 - DNA, 22 bp, Homo sapiens
attttgcctctttatgaacact

SEQ ID NO: 130593 - DNA, 23 bp, Homo sapiens
actcttagcattttaaaagacat

SEQ ID NO: 130594 - DNA, 23 bp, Homo sapiens
cagtggaagagaatagacagaat

SEQ ID NO: 130595 - DNA, 23 bp, Homo sapiens
aggagcaatatttgaggagctaa

SEQ ID NO: 130596 - DNA, 22 bp, Homo sapiens
ataacttcctactttctggaaa

SEQ ID NO: 130597 - DNA, 21 bp, Homo sapiens
tctaacaggattaagtttagg

SEQ ID NO: 130598 - DNA, 19 bp, Homo sapiens
tctcgctctgtcattctgg

SEQ ID NO: 130599 - DNA, 23 bp, Homo sapiens
ctcaatgtggttttgatttgaat

SEQ ID NO: 130600 - DNA, 21 bp, Homo sapiens
atgagcattttttcatgtgtc

SEQ ID NO: 130601 - DNA, 19 bp, Homo sapiens
ttttttttgtttttctttt

SEQ ID NO: 130602 - DNA, 23 bp, Homo sapiens
gacagagtctcgctctgtcaccc

SEQ ID NO: 130603 - DNA, 23 bp, Homo sapiens
acagagtctcgctctgtcaccca

SEQ ID NO: 130604 - DNA, 23 bp, Homo sapiens
tcttctgtcaggcatattgatga

SEQ ID NO: 130605 - DNA, 23 bp, Homo sapiens
gagtctcacactgtcacccaggc

SEQ ID NO: 130606 - DNA, 23 bp, Homo sapiens
ttcaaggaagtagagagaggcct

SEQ ID NO: 130607 - DNA, 18 bp, Homo sapiens
tctaggtgaactagaact

SEQ ID NO: 130608 - DNA, 18 bp, Homo sapiens
agagtcagtgggatcaat

SEQ ID NO: 130609 - DNA, 23 bp, Homo sapiens
taagtgtgaatatacatgtgtgt

SEQ ID NO: 130610 - DNA, 21 bp, Homo sapiens
atgttaagtatacaagcatta

SEQ ID NO: 130611 - DNA, 23 bp, Homo sapiens
atgtgtgtctctgtatgtgagat

SEQ ID NO: 130612 - DNA, 21 bp, Homo sapiens
acagcacactgatgggtcttg

SEQ ID NO: 130613 - DNA, 22 bp, Homo sapiens
atatctctgtatatgtatatca

SEQ ID NO: 130614 - DNA, 23 bp, Homo sapiens
tgtgtatgtacctgtgtatgtac

SEQ ID NO: 130615 - DNA, 23 bp, Homo sapiens
ctcccagagcccctggaactctg

SEQ ID NO: 130616 - DNA, 23 bp, Homo sapiens
tcccagagcccctggaactctgg

SEQ ID NO: 130617 - DNA, 23 bp, Homo sapiens
tcccagagcccctggaactctgg

SEQ ID NO: 130618 - DNA, 23 bp, Homo sapiens
tcccagagcccctggaactctgg

SEQ ID NO: 130619 - DNA, 21 bp, Homo sapiens
atttggaagaatactgattat

SEQ ID NO: 130620 - DNA, 23 bp, Homo sapiens
tgtccaccaaatgatttgtgtga

SEQ ID NO: 130621 - DNA, 23 bp, Homo sapiens
cttttctgtggtatattttagta

SEQ ID NO: 130622 - DNA, 23 bp, Homo sapiens
aaaaactgcagaaagcttttctg

SEQ ID NO: 130623 - DNA, 22 bp, Homo sapiens
aattgcatatatagaagagaca

SEQ ID NO: 130624 - DNA, 23 bp, Homo sapiens
ttgctcagtctgtctctctctgc

SEQ ID NO: 130625 - DNA, 23 bp, Homo sapiens
agagggtttgtttacatcagaat

SEQ ID NO: 130626 - DNA, 23 bp, Homo sapiens
tgagttcattgtagattctggat

SEQ ID NO: 130627 - DNA, 23 bp, Homo sapiens
tgagttcattgtagattctggat

SEQ ID NO: 130628 - DNA, 23 bp, Homo sapiens
tgagttcattgtagattctggat

SEQ ID NO: 130629 - DNA, 23 bp, Homo sapiens
tgagttcattgtagattctggat

SEQ ID NO: 130630 - DNA, 23 bp, Homo sapiens
tgagttcattgtagattctggat

SEQ ID NO: 130631 - DNA, 23 bp, Homo sapiens
tgagttcattgtagattctggat

SEQ ID NO: 130632 - DNA, 22 bp, Homo sapiens
atatgtgtatatatgtatgagt

SEQ ID NO: 130633 - DNA, 18 bp, Homo sapiens
tacatatgtatacattat

SEQ ID NO: 130634 - DNA, 18 bp, Homo sapiens
tcactcccactatgtctc

SEQ ID NO: 130635 - DNA, 22 bp, Homo sapiens
tctccatttgttttcataactc

SEQ ID NO: 130636 - DNA, 23 bp, Homo sapiens
ttgtccaagagcatgaaactaaa

SEQ ID NO: 130637 - DNA, 20 bp, Homo sapiens
agtcaaaatgaatgcaaaaa

SEQ ID NO: 130638 - DNA, 23 bp, Homo sapiens
atttagcaatcctaatgtagtgt

SEQ ID NO: 130639 - DNA, 23 bp, Homo sapiens
gggtgagaagtcaagtgtgtctg

SEQ ID NO: 130640 - DNA, 23 bp, Homo sapiens
aggcagagtcttgctctgtcacc

SEQ ID NO: 130641 - DNA, 23 bp, Homo sapiens
tctcaacacattttgtaattttg

SEQ ID NO: 130642 - DNA, 23 bp, Homo sapiens
tgtgtgtatatatatatgtgtgt

SEQ ID NO: 130643 - DNA, 22 bp, Homo sapiens
atgtgtatatatgtatatatgt

SEQ ID NO: 130644 - DNA, 22 bp, Homo sapiens
atatatgtgtgtgtgtgtatat

SEQ ID NO: 130645 - DNA, 23 bp, Homo sapiens
ctgggtgacagagcgagactcag

SEQ ID NO: 130646 - DNA, 21 bp, Homo sapiens
ctctgtcacccagactagagt

SEQ ID NO: 130647 - DNA, 21 bp, Homo sapiens
tatgtctatatatgtatatgt

SEQ ID NO: 130648 - DNA, 23 bp, Homo sapiens
atgtctttggatttcaaatggat

SEQ ID NO: 130649 - DNA, 22 bp, Homo sapiens
gtatgtgtgtacatgtatatag

SEQ ID NO: 130650 - DNA, 23 bp, Homo sapiens
gactgagtctcgctctgtcaccc

SEQ ID NO: 130651 - DNA, 23 bp, Homo sapiens
aggtaggaggatcatttgagctt

SEQ ID NO: 130652 - DNA, 23 bp, Homo sapiens
gtggattagatctctgtgaagaa

SEQ ID NO: 130653 - DNA, 23 bp, Homo sapiens
aaatggagggagaacaagtcata

SEQ ID NO: 130654 - DNA, 23 bp, Homo sapiens
cagtgtgtgtgtatatgctgtgt

SEQ ID NO: 130655 - DNA, 18 bp, Homo sapiens
cctgagatgggatgttgt

SEQ ID NO: 130656 - DNA, 23 bp, Homo sapiens
agctctgagatatgactttctcc

SEQ ID NO: 130657 - DNA, 23 bp, Homo sapiens
tttgttcaagatgaagtgcagta

SEQ ID NO: 130658 - DNA, 23 bp, Homo sapiens
gttttctgatcaggaattgaaaa

SEQ ID NO: 130659 - DNA, 23 bp, Homo sapiens
attaaacctctttttctttataa

SEQ ID NO: 130660 - DNA, 23 bp, Homo sapiens
tatctggagcatgagaatgggct

SEQ ID NO: 130661 - DNA, 21 bp, Homo sapiens
tgtgcaattaaaaacagtaga

SEQ ID NO: 130662 - DNA, 21 bp, Homo sapiens
taaggtatagttaactgatac

SEQ ID NO: 130663 - DNA, 23 bp, Homo sapiens
tatgtatgtgtatatgtatgtat

SEQ ID NO: 130664 - DNA, 20 bp, Homo sapiens
atgtctgtatatatgtacag

SEQ ID NO: 130665 - DNA, 22 bp, Homo sapiens
atatattatctatatgtagaga

SEQ ID NO: 130666 - DNA, 21 bp, Homo sapiens
tggattggataaaagacagtt

SEQ ID NO: 130667 - DNA, 23 bp, Homo sapiens
atgtgtatacttgtgtatatgta

SEQ ID NO: 130668 - DNA, 20 bp, Homo sapiens
tcattagaaatgtagtttaa

SEQ ID NO: 130669 - DNA, 23 bp, Homo sapiens
tctcattgttattgatttctaat

SEQ ID NO: 130670 - DNA, 23 bp, Homo sapiens
tcccagagtggttctcttctgtt

SEQ ID NO: 130671 - DNA, 23 bp, Homo sapiens
tgagttcattgtagattctggat

SEQ ID NO: 130672 - DNA, 23 bp, Homo sapiens
tgagttcattgtagattctggat

SEQ ID NO: 130673 - DNA, 23 bp, Homo sapiens
gttgttgttgttgttgtcactgt

SEQ ID NO: 130674 - DNA, 20 bp, Homo sapiens
acacacacacatatacatat

SEQ ID NO: 130675 - DNA, 19 bp, Homo sapiens
tgagcaccagtgcgtgggt

SEQ ID NO: 130676 - DNA, 22 bp, Homo sapiens
tgaggcagagagtttctttttt

SEQ ID NO: 130677 - DNA, 23 bp, Homo sapiens
tagacagagtctcgctgtgtcac

SEQ ID NO: 130678 - DNA, 23 bp, Homo sapiens
tggtaagaaatgttgaaagcaga

SEQ ID NO: 130679 - DNA, 23 bp, Homo sapiens
ccaagtctcgctctgtcactcag

SEQ ID NO: 130680 - DNA, 19 bp, Homo sapiens
ttttgagacggagtcttgc

SEQ ID NO: 130681 - DNA, 23 bp, Homo sapiens
tgagacaggatctcactctgtca

SEQ ID NO: 130682 - DNA, 18 bp, Homo sapiens
gtctcgctctgtcaccag

SEQ ID NO: 130683 - DNA, 21 bp, Homo sapiens
ttttgagaccgagtctcactc

SEQ ID NO: 130684 - DNA, 23 bp, Homo sapiens
tctgtctcaaagaaaaggattct

SEQ ID NO: 130685 - DNA, 21 bp, Homo sapiens
gtctcgctctgtcactcaggc

SEQ ID NO: 130686 - DNA, 23 bp, Homo sapiens
tgtgtgtgtatatatatgtgtgt

SEQ ID NO: 130687 - DNA, 22 bp, Homo sapiens
tggatttaaaaaggattagtga

SEQ ID NO: 130688 - DNA, 19 bp, Homo sapiens
tactgtgtacaggtctttc

SEQ ID NO: 130689 - DNA, 23 bp, Homo sapiens
agtgagactgggtatgtttaaga

SEQ ID NO: 130690 - DNA, 23 bp, Homo sapiens
tgagatggagtctcactctgtcg

SEQ ID NO: 130691 - DNA, 23 bp, Homo sapiens
atgtgtgtatatatatatgtgta

SEQ ID NO: 130692 - DNA, 23 bp, Homo sapiens
tgagttcattgtagattctggat

SEQ ID NO: 130693 - DNA, 23 bp, Homo sapiens
tgagttcattgtagattctggat

SEQ ID NO: 130694 - DNA, 23 bp, Homo sapiens
tgtgtgtgtatatatatatgtgt

SEQ ID NO: 130695 - DNA, 23 bp, Homo sapiens
tcactctcagagtctgcaaatgc

SEQ ID NO: 130696 - DNA, 23 bp, Homo sapiens
tgagtgactccttaaattttctg

SEQ ID NO: 130697 - DNA, 23 bp, Homo sapiens
tacatttcctgaatcaccagagt

SEQ ID NO: 130698 - DNA, 23 bp, Homo sapiens
aaaagtaaagatgaagcctagag

SEQ ID NO: 130699 - DNA, 23 bp, Homo sapiens
aatatgaacatgtatatatgtgc

SEQ ID NO: 130700 - DNA, 18 bp, Homo sapiens
tgtgtatatatattcata

SEQ ID NO: 130701 - DNA, 21 bp, Homo sapiens
tcataataacctccagttcca

SEQ ID NO: 130702 - DNA, 18 bp, Homo sapiens
tgtgtgtgtatatatata

SEQ ID NO: 130703 - DNA, 23 bp, Homo sapiens
atatgtacatatgtatgtatgta

SEQ ID NO: 130704 - DNA, 23 bp, Homo sapiens
caattatctgcaaacagtttgag

SEQ ID NO: 130705 - DNA, 23 bp, Homo sapiens
acagagcaaaaccatatcagtta

SEQ ID NO: 130706 - DNA, 23 bp, Homo sapiens
tgtaaacatcctcgactggaagc

SEQ ID NO: 130707 - DNA, 22 bp, Homo sapiens
ctttcagtcggatgtttgcagc

SEQ ID NO: 130708 - DNA, 23 bp, Homo sapiens
tgtaaacatcctacactctcagc

SEQ ID NO: 130709 - DNA, 22 bp, Homo sapiens
tatatgtatatatacatatgtg

SEQ ID NO: 130710 - DNA, 19 bp, Homo sapiens
gtatatatgtatatgtgtg

SEQ ID NO: 130711 - DNA, 23 bp, Homo sapiens
gaagagcagtagttgtaatgagt

SEQ ID NO: 130712 - DNA, 23 bp, Homo sapiens
attggatttgtattgtttactta

SEQ ID NO: 130713 - DNA, 19 bp, Homo sapiens
tacagagagtaagttatat

SEQ ID NO: 130714 - DNA, 18 bp, Homo sapiens
tgtgtgtgtgtgtgtgtg

SEQ ID NO: 130715 - DNA, 22 bp, Homo sapiens
ttggtagtaattgtgaagggga

SEQ ID NO: 130716 - DNA, 20 bp, Homo sapiens
tttctctgatggccagtgat

SEQ ID NO: 130717 - DNA, 23 bp, Homo sapiens
gtcttcttttgagaagtgtctgt

SEQ ID NO: 130718 - DNA, 19 bp, Homo sapiens
tatacttctaacacagttc

SEQ ID NO: 130719 - DNA, 23 bp, Homo sapiens
tgagttcattgtagattctggat

SEQ ID NO: 130720 - DNA, 23 bp, Homo sapiens
tgagttcattgtagattctggat

SEQ ID NO: 130721 - DNA, 20 bp, Homo sapiens
atgtctatgaatatatatga

SEQ ID NO: 130722 - DNA, 23 bp, Homo sapiens
tccatgatttgtcattttgttct

SEQ ID NO: 130723 - DNA, 22 bp, Homo sapiens
cacatggaggtttttgctaatt

SEQ ID NO: 130724 - DNA, 19 bp, Homo sapiens
ctgtatatcgctttgtttc

SEQ ID NO: 130725 - DNA, 21 bp, Homo sapiens
taaaacagtgtagtatacttc

SEQ ID NO: 130726 - DNA, 21 bp, Homo sapiens
taagaaatcactcttaagtga

SEQ ID NO: 130727 - DNA, 21 bp, Homo sapiens
tttggaaatcttttcattgtt

SEQ ID NO: 130728 - DNA, 23 bp, Homo sapiens
tgagttcattgtagattctggat

SEQ ID NO: 130729 - DNA, 23 bp, Homo sapiens
tgagttcattgtagattctggat

SEQ ID NO: 130730 - DNA, 21 bp, Homo sapiens
aatgttactcgttagcttttt

SEQ ID NO: 130731 - DNA, 23 bp, Homo sapiens
agagtcacattctgttttcagta

SEQ ID NO: 130732 - DNA, 23 bp, Homo sapiens
ctcactgcaacagcaacaggagg

SEQ ID NO: 130733 - DNA, 23 bp, Homo sapiens
acactctgtctcataattttctg

SEQ ID NO: 130734 - DNA, 22 bp, Homo sapiens
agagtctctgctatctcactgt

SEQ ID NO: 130735 - DNA, 20 bp, Homo sapiens
ttgatgaatgtctggaggaa

SEQ ID NO: 130736 - DNA, 20 bp, Homo sapiens
agtgtgtgtgtgtatctata

SEQ ID NO: 130737 - DNA, 23 bp, Homo sapiens
aaggtcacagaataagttgtatg

SEQ ID NO: 130738 - DNA, 23 bp, Homo sapiens
atgtccatctggttctgaaggtg

SEQ ID NO: 130739 - DNA, 22 bp, Homo sapiens
acagacacagagtgagacacag

SEQ ID NO: 130740 - DNA, 23 bp, Homo sapiens
cagtctcactcccactgtgtccc

SEQ ID NO: 130741 - DNA, 19 bp, Homo sapiens
agcagggctgagaacttgc

SEQ ID NO: 130742 - DNA, 23 bp, Homo sapiens
atctcagtactttggaaggccat

SEQ ID NO: 130743 - DNA, 23 bp, Homo sapiens
tgaagtcagaagtttgagaccag

SEQ ID NO: 130744 - DNA, 22 bp, Homo sapiens
cagtctgtgtgtgtctttacag

SEQ ID NO: 130745 - DNA, 21 bp, Homo sapiens
gaacacaatagattatgatgt

SEQ ID NO: 130746 - DNA, 23 bp, Homo sapiens
ttctggttatgaatccaaacaat

SEQ ID NO: 130747 - DNA, 23 bp, Homo sapiens
atatgaaagtaattgtatgcttt

SEQ ID NO: 130748 - DNA, 19 bp, Homo sapiens
tggaatcaatgcttgactc

SEQ ID NO: 130749 - DNA, 23 bp, Homo sapiens
ccctctctgccactgtctctgca

SEQ ID NO: 130750 - DNA, 19 bp, Homo sapiens
atatctagatagatatata

SEQ ID NO: 130751 - DNA, 21 bp, Homo sapiens
tgaatatttggaaatgtcagg

SEQ ID NO: 130752 - DNA, 23 bp, Homo sapiens
actggaattgtatagatcactct

SEQ ID NO: 130753 - DNA, 23 bp, Homo sapiens
tggagctcagtctctgtgtgaca

SEQ ID NO: 130754 - DNA, 23 bp, Homo sapiens
tgtgtatatatatatatgtgtgt

SEQ ID NO: 130755 - DNA, 23 bp, Homo sapiens
tgtatatatgtatatatatgtgt

SEQ ID NO: 130756 - DNA, 18 bp, Homo sapiens
tatatatgtgtatatgta

SEQ ID NO: 130757 - DNA, 23 bp, Homo sapiens
tctcacacactgtctctctctct

SEQ ID NO: 130758 - DNA, 22 bp, Homo sapiens
tgtgagtatgtgtaataccagc

SEQ ID NO: 130759 - DNA, 23 bp, Homo sapiens
tatgtggtatatatgctggtata

SEQ ID NO: 130760 - DNA, 20 bp, Homo sapiens
taaatgagtcacgtgtacaa

SEQ ID NO: 130761 - DNA, 23 bp, Homo sapiens
gtgtgtgcgtgtatttgtgcatg

SEQ ID NO: 130762 - DNA, 23 bp, Homo sapiens
atttgagtgcaagtaattctgtg

SEQ ID NO: 130763 - DNA, 23 bp, Homo sapiens
tcagtgaatagagataacttgat

SEQ ID NO: 130764 - DNA, 22 bp, Homo sapiens
tggaaaattatgaagacagttt

SEQ ID NO: 130765 - DNA, 23 bp, Homo sapiens
attggaatggcaggatatctctg

SEQ ID NO: 130766 - DNA, 19 bp, Homo sapiens
atatatatgatgtatacat

SEQ ID NO: 130767 - DNA, 23 bp, Homo sapiens
atatatatggttttaaattgtat

SEQ ID NO: 130768 - DNA, 19 bp, Homo sapiens
gcatgtatgtatatatgta

SEQ ID NO: 130769 - DNA, 18 bp, Homo sapiens
catgtatgtatatatgta

SEQ ID NO: 130770 - DNA, 23 bp, Homo sapiens
atgtatatacatgtatacatatg

SEQ ID NO: 130771 - DNA, 20 bp, Homo sapiens
tttattagtttgagtcatag

SEQ ID NO: 130772 - DNA, 23 bp, Homo sapiens
catatatattcacatatagttat

SEQ ID NO: 130773 - DNA, 22 bp, Homo sapiens
tatatccatatatagttataga

SEQ ID NO: 130774 - DNA, 23 bp, Homo sapiens
tatatccatatatattcatatat

SEQ ID NO: 130775 - DNA, 23 bp, Homo sapiens
tatatccatatatattcatatat

SEQ ID NO: 130776 - DNA, 23 bp, Homo sapiens
tatatccatatatattcatatat

SEQ ID NO: 130777 - DNA, 22 bp, Homo sapiens
tatatccatatatattcatata

SEQ ID NO: 130778 - DNA, 19 bp, Homo sapiens
tatgtatgtaagtgtgtgt

SEQ ID NO: 130779 - DNA, 23 bp, Homo sapiens
tgagttcattgtagattctggat

SEQ ID NO: 130780 - DNA, 23 bp, Homo sapiens
tgagttcattgtagattctggat

SEQ ID NO: 130781 - DNA, 23 bp, Homo sapiens
tataacaggcattaacaattgtt

SEQ ID NO: 130782 - DNA, 20 bp, Homo sapiens
ttaacaattgttgaaaattg

SEQ ID NO: 130783 - DNA, 19 bp, Homo sapiens
agatgttgaacttactaga

SEQ ID NO: 130784 - DNA, 21 bp, Homo sapiens
tgtctagtagattttctggtc

SEQ ID NO: 130785 - DNA, 19 bp, Homo sapiens
agtagctagttgctcagaa

SEQ ID NO: 130786 - DNA, 23 bp, Homo sapiens
tgagttcattgtagattctggat

SEQ ID NO: 130787 - DNA, 23 bp, Homo sapiens
tgagttcattgtagattctggat

SEQ ID NO: 130788 - DNA, 23 bp, Homo sapiens
tgagttcattgtagattctggat

SEQ ID NO: 130789 - DNA, 23 bp, Homo sapiens
ttcacagcatgttgaagtagaga

SEQ ID NO: 130790 - DNA, 23 bp, Homo sapiens
agagtctcactctgtcacccagg

SEQ ID NO: 130791 - DNA, 23 bp, Homo sapiens
tattttgttttacaaaaggaaaa

SEQ ID NO: 130792 - DNA, 23 bp, Homo sapiens
agagtctcactctgtcacccagg

SEQ ID NO: 130793 - DNA, 23 bp, Homo sapiens
cttgctataagagtgtatttgtt

SEQ ID NO: 130794 - DNA, 23 bp, Homo sapiens
agaaaactgtgttaaagtaaacc

SEQ ID NO: 130795 - DNA, 18 bp, Homo sapiens
tccatatatattcatatt

SEQ ID NO: 130796 - DNA, 23 bp, Homo sapiens
atagaggatatgtgtgtgtgtgt

SEQ ID NO: 130797 - DNA, 23 bp, Homo sapiens
tagaggatatgtgtgtgtgtgta

SEQ ID NO: 130798 - DNA, 23 bp, Homo sapiens
tagaggatatgtatatatgtgtg

SEQ ID NO: 130799 - DNA, 23 bp, Homo sapiens
atcttctatatatgtatatctgt

SEQ ID NO: 130800 - DNA, 23 bp, Homo sapiens
agagctttcaggttgttatctct

SEQ ID NO: 130801 - DNA, 18 bp, Homo sapiens
tacatatgtcttgctaat

SEQ ID NO: 130802 - DNA, 23 bp, Homo sapiens
aagctatttttactattgtcaga

SEQ ID NO: 130803 - DNA, 23 bp, Homo sapiens
tgagttcattgtagattctggat

SEQ ID NO: 130804 - DNA, 23 bp, Homo sapiens
tgagttcattgtagattctggat

SEQ ID NO: 130805 - DNA, 22 bp, Homo sapiens
agagtgtatatatatatatgtg

SEQ ID NO: 130806 - DNA, 23 bp, Homo sapiens
actgggtcacagagagtttgagg

SEQ ID NO: 130807 - DNA, 20 bp, Homo sapiens
gtgtatatacatgtgtgtat

SEQ ID NO: 130808 - DNA, 21 bp, Homo sapiens
tgagaagaaactgaaagataa

SEQ ID NO: 130809 - DNA, 23 bp, Homo sapiens
tgagttcattgtagattctggat

SEQ ID NO: 130810 - DNA, 23 bp, Homo sapiens
tgagttcattgtagattctggat

SEQ ID NO: 130811 - DNA, 23 bp, Homo sapiens
tatttggatcaatgcttcacaaa

SEQ ID NO: 130812 - DNA, 22 bp, Homo sapiens
tatgaatcatgtgggactcttg

SEQ ID NO: 130813 - DNA, 23 bp, Homo sapiens
gagtcatatgcatatgtatatct

SEQ ID NO: 130814 - DNA, 22 bp, Homo sapiens
atatatgtatatgtatatgtgt

SEQ ID NO: 130815 - DNA, 23 bp, Homo sapiens
acattgccatatatttatagtgt

SEQ ID NO: 130816 - DNA, 22 bp, Homo sapiens
atctatgtatatatatgtgtat

SEQ ID NO: 130817 - DNA, 23 bp, Homo sapiens
tatatgtgtgtatatatatacac

SEQ ID NO: 130818 - DNA, 23 bp, Homo sapiens
tctatccatatatatagatatgt

SEQ ID NO: 130819 - DNA, 23 bp, Homo sapiens
ggaaagatgtgaggttatgttat

SEQ ID NO: 130820 - DNA, 23 bp, Homo sapiens
ttagtcacactgataatttgcac

SEQ ID NO: 130821 - DNA, 21 bp, Homo sapiens
tcttggaggctttgtctgttc

SEQ ID NO: 130822 - DNA, 23 bp, Homo sapiens
tgaaatggagtctcactctgtcg

SEQ ID NO: 130823 - DNA, 22 bp, Homo sapiens
atgtatatatatatatgtgtgt

SEQ ID NO: 130824 - DNA, 20 bp, Homo sapiens
tgttaactaaagtagatact

SEQ ID NO: 130825 - DNA, 23 bp, Homo sapiens
tgaaacagactctcgctctgttg

SEQ ID NO: 130826 - DNA, 21 bp, Homo sapiens
tatacgtgtatttatatatgt

SEQ ID NO: 130827 - DNA, 21 bp, Homo sapiens
tttgagatggagttttgctct

SEQ ID NO: 130828 - DNA, 23 bp, Homo sapiens
ttgagacggagtttcactcttgt

SEQ ID NO: 130829 - DNA, 22 bp, Homo sapiens
agacatggtctcactctgtcac

SEQ ID NO: 130830 - DNA, 23 bp, Homo sapiens
ttcatatgtgtgtgatgtataca

SEQ ID NO: 130831 - DNA, 20 bp, Homo sapiens
ttcccattcactttctgtca

SEQ ID NO: 130832 - DNA, 22 bp, Homo sapiens
acttaccttggatagtatatgt

SEQ ID NO: 130833 - DNA, 23 bp, Homo sapiens
ttcagaactccctgtgtgatttt

SEQ ID NO: 130834 - DNA, 22 bp, Homo sapiens
catcactgtcatttctgactct

SEQ ID NO: 130835 - DNA, 23 bp, Homo sapiens
tcctcagtgctactgaagactgt

SEQ ID NO: 130836 - DNA, 21 bp, Homo sapiens
acacacatatatatgtgtgtg

SEQ ID NO: 130837 - DNA, 20 bp, Homo sapiens
atatgtgtgtatatgtatat

SEQ ID NO: 130838 - DNA, 23 bp, Homo sapiens
tgagttcattgtagattctggat

SEQ ID NO: 130839 - DNA, 23 bp, Homo sapiens
tgagttcattgtagattctggat

SEQ ID NO: 130840 - DNA, 23 bp, Homo sapiens
agtataatagtttttgttttgct

SEQ ID NO: 130841 - DNA, 21 bp, Homo sapiens
tgattttcaccataagatatc

SEQ ID NO: 130842 - DNA, 22 bp, Homo sapiens
catgtatgtatatatgtatgtg

SEQ ID NO: 130843 - DNA, 20 bp, Homo sapiens
tctcagacctggcatcactg

SEQ ID NO: 130844 - DNA, 22 bp, Homo sapiens
atgagtaaggtttaatacgtga

SEQ ID NO: 130845 - DNA, 22 bp, Homo sapiens
aacagagtcaggttacatactg

SEQ ID NO: 130846 - DNA, 23 bp, Homo sapiens
aggctccttaactaatgttgtag

SEQ ID NO: 130847 - DNA, 21 bp, Homo sapiens
atccaggagtaacccaatgct

SEQ ID NO: 130848 - DNA, 23 bp, Homo sapiens
tgagttcattgtagattctggat

SEQ ID NO: 130849 - DNA, 23 bp, Homo sapiens
tgagttcattgtagattctggat

SEQ ID NO: 130850 - DNA, 21 bp, Homo sapiens
tgtggtctaagagtgtgcttg

SEQ ID NO: 130851 - DNA, 21 bp, Homo sapiens
tgcatttatctcgcagagtta

SEQ ID NO: 130852 - DNA, 22 bp, Homo sapiens
accagcatgttagtttttgaat

SEQ ID NO: 130853 - DNA, 22 bp, Homo sapiens
tcattgtggttttgatttgcat

SEQ ID NO: 130854 - DNA, 21 bp, Homo sapiens
ctgagtctattcagtatgttt

SEQ ID NO: 130855 - DNA, 23 bp, Homo sapiens
catgttttgagaagctgttgaat

SEQ ID NO: 130856 - DNA, 23 bp, Homo sapiens
tgagttcattgtagattctggat

SEQ ID NO: 130857 - DNA, 23 bp, Homo sapiens
tgagttcattgtagattctggat

SEQ ID NO: 130858 - DNA, 20 bp, Homo sapiens
ggttccatgtgaacttcaaa

SEQ ID NO: 130859 - DNA, 23 bp, Homo sapiens
ttctgtgaagaaagtcattggta

SEQ ID NO: 130860 - DNA, 21 bp, Homo sapiens
ctgctccaactatctaggact

SEQ ID NO: 130861 - DNA, 22 bp, Homo sapiens
tagcatgtatatatgtatgtat

SEQ ID NO: 130862 - DNA, 23 bp, Homo sapiens
tgtggtgtgagaatgtgcttggt

SEQ ID NO: 130863 - DNA, 23 bp, Homo sapiens
tgtgatgatctcactctgtcacc

SEQ ID NO: 130864 - DNA, 18 bp, Homo sapiens
atagagtcttgctctgtt

SEQ ID NO: 130865 - DNA, 18 bp, Homo sapiens
tggtatatagtaactagg

SEQ ID NO: 130866 - DNA, 18 bp, Homo sapiens
tagtataaaataaaaggt

SEQ ID NO: 130867 - DNA, 21 bp, Homo sapiens
agcatgtatgtatgtatgtat

SEQ ID NO: 130868 - DNA, 23 bp, Homo sapiens
tgagttcattgtagattctggat

SEQ ID NO: 130869 - DNA, 23 bp, Homo sapiens
tgagttcattgtagattctggat

SEQ ID NO: 130870 - DNA, 23 bp, Homo sapiens
tgtggtgtgagaatgtgcttggt

SEQ ID NO: 130871 - DNA, 18 bp, Homo sapiens
tatcgatatatatgagta

SEQ ID NO: 130872 - DNA, 18 bp, Homo sapiens
actccataccaaaatgtg

SEQ ID NO: 130873 - DNA, 20 bp, Homo sapiens
atacacacatatatacatgt

SEQ ID NO: 130874 - DNA, 21 bp, Homo sapiens
tgaggtaggaggatcacttga

SEQ ID NO: 130875 - DNA, 18 bp, Homo sapiens
acaaggcattcactgtgg

SEQ ID NO: 130876 - DNA, 22 bp, Homo sapiens
agtctcgctctgtcactcaggc

SEQ ID NO: 130877 - DNA, 23 bp, Homo sapiens
tgagttcattgtagattctggat

SEQ ID NO: 130878 - DNA, 23 bp, Homo sapiens
tgagttcattgtagattctggat

SEQ ID NO: 130879 - DNA, 21 bp, Homo sapiens
aataaactctggtactggttt

SEQ ID NO: 130880 - DNA, 20 bp, Homo sapiens
tgagagtatggttcatataa

SEQ ID NO: 130881 - DNA, 22 bp, Homo sapiens
atcagagtaaagagacagccca

SEQ ID NO: 130882 - DNA, 23 bp, Homo sapiens
gagatgagtctcactctgtcacc

SEQ ID NO: 130883 - DNA, 21 bp, Homo sapiens
cggagtgtaatggcatggtct

SEQ ID NO: 130884 - DNA, 18 bp, Homo sapiens
tttgtggaaggattttga

SEQ ID NO: 130885 - DNA, 22 bp, Homo sapiens
agtgcaaaagaaaactacttga

SEQ ID NO: 130886 - DNA, 22 bp, Homo sapiens
ttcacatatgttttccagcata

SEQ ID NO: 130887 - DNA, 21 bp, Homo sapiens
aaacaggaggaaaaggtagct

SEQ ID NO: 130888 - DNA, 18 bp, Homo sapiens
tgagaaggagtctcactc

SEQ ID NO: 130889 - DNA, 18 bp, Homo sapiens
cagaggtagttttgactc

SEQ ID NO: 130890 - DNA, 21 bp, Homo sapiens
ttgagatggagtctcactcca

SEQ ID NO: 130891 - DNA, 23 bp, Homo sapiens
tgtgtctgtctctgcctggctcc

SEQ ID NO: 130892 - DNA, 18 bp, Homo sapiens
atgaggaggaggtagaag

SEQ ID NO: 130893 - DNA, 23 bp, Homo sapiens
gtttactgtttgattgctctact

SEQ ID NO: 130894 - DNA, 23 bp, Homo sapiens
gagagagagtgtgtgtgtgagtg

SEQ ID NO: 130895 - DNA, 22 bp, Homo sapiens
tatgagagtggttctctttatg

SEQ ID NO: 130896 - DNA, 23 bp, Homo sapiens
acagtctcactcgctctgtcacc

SEQ ID NO: 130897 - DNA, 22 bp, Homo sapiens
tgtttctctgtttgtaaaatgg

SEQ ID NO: 130898 - DNA, 23 bp, Homo sapiens
actttatgcacatagcttgaaga

SEQ ID NO: 130899 - DNA, 23 bp, Homo sapiens
atatgtattgtattgtaatgatt

SEQ ID NO: 130900 - DNA, 23 bp, Homo sapiens
acatatcactttctccaatacac

SEQ ID NO: 130901 - DNA, 22 bp, Homo sapiens
ttgtcagtatatgaatgtgtct

SEQ ID NO: 130902 - DNA, 20 bp, Homo sapiens
acacacacacgtatatatgt

SEQ ID NO: 130903 - DNA, 23 bp, Homo sapiens
taaatgtgtatgttaatttaact

SEQ ID NO: 130904 - DNA, 23 bp, Homo sapiens
tatgtgtatatatgtatgtgtac

SEQ ID NO: 130905 - DNA, 23 bp, Homo sapiens
tttcataggaattgtattgaatt

SEQ ID NO: 130906 - DNA, 22 bp, Homo sapiens
tttgtgacacagcatatgatct

SEQ ID NO: 130907 - DNA, 23 bp, Homo sapiens
atcacttcaagcacttgagtttt

SEQ ID NO: 130908 - DNA, 23 bp, Homo sapiens
tctgtgtgtgtgtctgtgtccta

SEQ ID NO: 130909 - DNA, 23 bp, Homo sapiens
tgtgtgtatatatatgtatgtgt

SEQ ID NO: 130910 - DNA, 23 bp, Homo sapiens
tgagttcattgtagattctggat

SEQ ID NO: 130911 - DNA, 23 bp, Homo sapiens
tgagttcattgtagattctggat

SEQ ID NO: 130912 - DNA, 21 bp, Homo sapiens
tatgaaaggagatagtcaaga

SEQ ID NO: 130913 - DNA, 23 bp, Homo sapiens
aaactctctgtgtctgtatgtgt

SEQ ID NO: 130914 - DNA, 23 bp, Homo sapiens
tgagtctcactctgtcacccagg

SEQ ID NO: 130915 - DNA, 23 bp, Homo sapiens
tgacacagtgagactctgtctct

SEQ ID NO: 130916 - DNA, 20 bp, Homo sapiens
tctcagtaaacacagagctc

SEQ ID NO: 130917 - DNA, 18 bp, Homo sapiens
agaacaggcagctttgca

SEQ ID NO: 130918 - DNA, 23 bp, Homo sapiens
gtgcacctgtagtctcagctact

SEQ ID NO: 130919 - DNA, 18 bp, Homo sapiens
agccaggcacagtgggtc

SEQ ID NO: 130920 - DNA, 23 bp, Homo sapiens
tggagtctctctctgtcacccag

SEQ ID NO: 130921 - DNA, 23 bp, Homo sapiens
tggagtctcactctgtcacccag

SEQ ID NO: 130922 - DNA, 23 bp, Homo sapiens
aaaaacttatgttggtaatgtga

SEQ ID NO: 130923 - DNA, 23 bp, Homo sapiens
tctctgtctctcaggctgctgct

SEQ ID NO: 130924 - DNA, 23 bp, Homo sapiens
gctgtttcctattgttgctcctt

SEQ ID NO: 130925 - DNA, 23 bp, Homo sapiens
gacagagtctcgctctgtcaccc

SEQ ID NO: 130926 - DNA, 21 bp, Homo sapiens
acatgtgcacaatgtgcaggt

SEQ ID NO: 130927 - DNA, 23 bp, Homo sapiens
tgagttcattgtagattctggat

SEQ ID NO: 130928 - DNA, 23 bp, Homo sapiens
tgagttcattgtagattctggat

SEQ ID NO: 130929 - DNA, 20 bp, Homo sapiens
tgcttgactaaaagcactgt

SEQ ID NO: 130930 - DNA, 22 bp, Homo sapiens
atacagggtggcttttcagtct

SEQ ID NO: 130931 - DNA, 23 bp, Homo sapiens
tgaggtaggaggatcatttgagg

SEQ ID NO: 130932 - DNA, 20 bp, Homo sapiens
acggactctcgctctgtcgc

SEQ ID NO: 130933 - DNA, 23 bp, Homo sapiens
atcactctgtccctctgtgtgcc

SEQ ID NO: 130934 - DNA, 23 bp, Homo sapiens
tacatgtgcaggatgtgcaggtt

SEQ ID NO: 130935 - DNA, 20 bp, Homo sapiens
tttctctgatggccagtgat

SEQ ID NO: 130936 - DNA, 23 bp, Homo sapiens
ttatgtgtgtggtagaattcact

SEQ ID NO: 130937 - DNA, 23 bp, Homo sapiens
ctttgaactgtccttatttgaag

SEQ ID NO: 130938 - DNA, 20 bp, Homo sapiens
tagagctcaatatacattca

SEQ ID NO: 130939 - DNA, 23 bp, Homo sapiens
tatatagtgaggtttggatatgt

SEQ ID NO: 130940 - DNA, 23 bp, Homo sapiens
tatgtctctatatataatgtgta

SEQ ID NO: 130941 - DNA, 20 bp, Homo sapiens
tcaatgaggaagctgatctg

SEQ ID NO: 130942 - DNA, 23 bp, Homo sapiens
gtcagtttttctctctgtatctg

SEQ ID NO: 130943 - DNA, 20 bp, Homo sapiens
atatggttcaagtcttaaca

SEQ ID NO: 130944 - DNA, 21 bp, Homo sapiens
acactatatatatgtatgtat

SEQ ID NO: 130945 - DNA, 21 bp, Homo sapiens
atatgtgtgtaaatatatgtg

SEQ ID NO: 130946 - DNA, 23 bp, Homo sapiens
tgagttcattgtagattctggat

SEQ ID NO: 130947 - DNA, 23 bp, Homo sapiens
tgagttcattgtagattctggat

SEQ ID NO: 130948 - DNA, 21 bp, Homo sapiens
tatatagagagatatacatat

SEQ ID NO: 130949 - DNA, 18 bp, Homo sapiens
atgcccaagagctctggt

SEQ ID NO: 130950 - DNA, 18 bp, Homo sapiens
aggtattttattctcttt

SEQ ID NO: 130951 - DNA, 18 bp, Homo sapiens
tatacgtacatataagta

SEQ ID NO: 130952 - DNA, 22 bp, Homo sapiens
taagtacttatgtataatgtat

SEQ ID NO: 130953 - DNA, 18 bp, Homo sapiens
tcttgagcaaatgccata

SEQ ID NO: 130954 - DNA, 23 bp, Homo sapiens
cacttccagctttagaattccct

SEQ ID NO: 130955 - DNA, 21 bp, Homo sapiens
taaaggagttctagtggtgat

SEQ ID NO: 130956 - DNA, 21 bp, Homo sapiens
attccatataattccagactg

SEQ ID NO: 130957 - DNA, 23 bp, Homo sapiens
aagtgtcttttgagtctatgttg

SEQ ID NO: 130958 - DNA, 22 bp, Homo sapiens
tctctggcagtatagaagcttt

SEQ ID NO: 130959 - DNA, 22 bp, Homo sapiens
tgagctagtaggttttagagct

SEQ ID NO: 130960 - DNA, 23 bp, Homo sapiens
tgtgtgttgtgtgtgtctgatat

SEQ ID NO: 130961 - DNA, 20 bp, Homo sapiens
tcagtgaatccaagtattcc

SEQ ID NO: 130962 - DNA, 18 bp, Homo sapiens
ctaatcacagccagcatt

SEQ ID NO: 130963 - DNA, 23 bp, Homo sapiens
tctgctttaggttgagttgaaga

SEQ ID NO: 130964 - DNA, 23 bp, Homo sapiens
ctgtctcagtgtctgtgggaaaa

SEQ ID NO: 130965 - DNA, 18 bp, Homo sapiens
atacacacaggttgttct

SEQ ID NO: 130966 - DNA, 21 bp, Homo sapiens
acattatatatgtatacatat

SEQ ID NO: 130967 - DNA, 22 bp, Homo sapiens
ataatgcatacatatataatgt

SEQ ID NO: 130968 - DNA, 23 bp, Homo sapiens
tactgtgtgtgtgtgtgtgtgta

SEQ ID NO: 130969 - DNA, 23 bp, Homo sapiens
tagatatatatatctccaagata

SEQ ID NO: 130970 - DNA, 21 bp, Homo sapiens
acatgtgcacaatgtgcaggt

SEQ ID NO: 130971 - DNA, 23 bp, Homo sapiens
tgagttcattgtagattctggat

SEQ ID NO: 130972 - DNA, 23 bp, Homo sapiens
tgagttcattgtagattctggat

SEQ ID NO: 130973 - DNA, 23 bp, Homo sapiens
gcaatgaagactgcaagaatatt

SEQ ID NO: 130974 - DNA, 23 bp, Homo sapiens
tatcacattgtggttttgatttg

SEQ ID NO: 130975 - DNA, 22 bp, Homo sapiens
tcattgtggttttaatttgcat

SEQ ID NO: 130976 - DNA, 21 bp, Homo sapiens
cttgatgattagtgattttga

SEQ ID NO: 130977 - DNA, 23 bp, Homo sapiens
atatgtgagatatatatatgtga

SEQ ID NO: 130978 - DNA, 23 bp, Homo sapiens
tatatctcagagatatatatcac

SEQ ID NO: 130979 - DNA, 22 bp, Homo sapiens
atgtgtatatatatatatgtgt

SEQ ID NO: 130980 - DNA, 20 bp, Homo sapiens
atatgtgtgtgtgtatatac

SEQ ID NO: 130981 - DNA, 22 bp, Homo sapiens
atggtgtgatcttggctcactg

SEQ ID NO: 130982 - DNA, 23 bp, Homo sapiens
cagaagaatcaaatgtgtctgac

SEQ ID NO: 130983 - DNA, 23 bp, Homo sapiens
tatgtgcatatatatatgtgtgt

SEQ ID NO: 130984 - DNA, 23 bp, Homo sapiens
tatatgtgcatatatatgtgtat

SEQ ID NO: 130985 - DNA, 23 bp, Homo sapiens
tatgtgtatatatatatatgtgt

SEQ ID NO: 130986 - DNA, 23 bp, Homo sapiens
gagaccgtgtctcactctgtcat

SEQ ID NO: 130987 - DNA, 23 bp, Homo sapiens
ataaagaaaataatgctatgtga

SEQ ID NO: 130988 - DNA, 21 bp, Homo sapiens
tgtttgtatgtatatgtgtat

SEQ ID NO: 130989 - DNA, 22 bp, Homo sapiens
tatatgcataaatacatattct

SEQ ID NO: 130990 - DNA, 19 bp, Homo sapiens
acgtatatatatatgtgtg

SEQ ID NO: 130991 - DNA, 23 bp, Homo sapiens
tgagtctcactctgtctcccagg

SEQ ID NO: 130992 - DNA, 23 bp, Homo sapiens
ttgattctaggtgagatttgttt

SEQ ID NO: 130993 - DNA, 19 bp, Homo sapiens
tggttttgaattggggatg

SEQ ID NO: 130994 - DNA, 21 bp, Homo sapiens
tatatatagttctgctaaact

SEQ ID NO: 130995 - DNA, 22 bp, Homo sapiens
acacagctacttgagaggcaga

SEQ ID NO: 130996 - DNA, 23 bp, Homo sapiens
tgtgtgtgtgtatatatatgtgt

SEQ ID NO: 130997 - DNA, 23 bp, Homo sapiens
tatgtgcacatacatatgtgtat

SEQ ID NO: 130998 - DNA, 23 bp, Homo sapiens
tatatgtgtgtatatgtatgtgt

SEQ ID NO: 130999 - DNA, 23 bp, Homo sapiens
agaaaagagactgcttttgatat

SEQ ID NO: 131000 - DNA, 23 bp, Homo sapiens
agagcctgcaactgtgtgtcggt

SEQ ID NO: 131001 - DNA, 23 bp, Homo sapiens
tgagttcattgtagattctggat

SEQ ID NO: 131002 - DNA, 23 bp, Homo sapiens
tgagttcattgtagattctggat

SEQ ID NO: 131003 - DNA, 23 bp, Homo sapiens
ttgagtttgcttttcattctgta

SEQ ID NO: 131004 - DNA, 23 bp, Homo sapiens
tcatctggaggtgcaggtgggga

SEQ ID NO: 131005 - DNA, 23 bp, Homo sapiens
tcacttctgactcattcaggttg

SEQ ID NO: 131006 - DNA, 23 bp, Homo sapiens
aatgagaggcatgttgtgggcta

SEQ ID NO: 131007 - DNA, 22 bp, Homo sapiens
tcgccctctggttagctgctgc

SEQ ID NO: 131008 - DNA, 23 bp, Homo sapiens
tatgtgtgtatgtatatgtgtat

SEQ ID NO: 131009 - DNA, 23 bp, Homo sapiens
tcattctctctgtcagatgagga

SEQ ID NO: 131010 - DNA, 21 bp, Homo sapiens
tgaatacatatatattcagta

SEQ ID NO: 131011 - DNA, 23 bp, Homo sapiens
tgtgtcagtgtctcagttgtggc

SEQ ID NO: 131012 - DNA, 19 bp, Homo sapiens
acagctccatctagatggg

SEQ ID NO: 131013 - DNA, 19 bp, Homo sapiens
ttgaggaggcagtctgtcc

SEQ ID NO: 131014 - DNA, 21 bp, Homo sapiens
cacagcacactctgtcaccct

SEQ ID NO: 131015 - DNA, 23 bp, Homo sapiens
catttgatttctacttttgcagc

SEQ ID NO: 131016 - DNA, 23 bp, Homo sapiens
agattctcactctgtcaccctgg

SEQ ID NO: 131017 - DNA, 23 bp, Homo sapiens
attgaggctgtttgttattgtag

SEQ ID NO: 131018 - DNA, 23 bp, Homo sapiens
tgagtctcactctgtcacccagg

SEQ ID NO: 131019 - DNA, 21 bp, Homo sapiens
tatgccacagaaggaagaggg

SEQ ID NO: 131020 - DNA, 20 bp, Homo sapiens
tgtgtatgtatatatgtatg

SEQ ID NO: 131021 - DNA, 20 bp, Homo sapiens
tgtatgtatatgtatatgtg

SEQ ID NO: 131022 - DNA, 23 bp, Homo sapiens
tgtgagccactgtgcctggctga

SEQ ID NO: 131023 - DNA, 23 bp, Homo sapiens
tcagacactgagagaaacaagtt

SEQ ID NO: 131024 - DNA, 20 bp, Homo sapiens
tgaggctgcagtgagctgtg

SEQ ID NO: 131025 - DNA, 22 bp, Homo sapiens
aaaatcaccagctgcatgagcc

SEQ ID NO: 131026 - DNA, 23 bp, Homo sapiens
tgagttcattgtagattctggat

SEQ ID NO: 131027 - DNA, 23 bp, Homo sapiens
tgagttcattgtagattctggat

SEQ ID NO: 131028 - DNA, 20 bp, Homo sapiens
tagcacactgttaaaaatca

SEQ ID NO: 131029 - DNA, 23 bp, Homo sapiens
tggagtctctcgctctgtcatcc

SEQ ID NO: 131030 - DNA, 23 bp, Homo sapiens
ctctgtccctctctccttggctc

SEQ ID NO: 131031 - DNA, 23 bp, Homo sapiens
tgtccctctctgggcctcagttt

SEQ ID NO: 131032 - DNA, 21 bp, Homo sapiens
cctcagactctgagtgtctgc

SEQ ID NO: 131033 - DNA, 23 bp, Homo sapiens
gacagagtctcactctgtcgccc

SEQ ID NO: 131034 - DNA, 19 bp, Homo sapiens
gtcagaggtcacagaggag

SEQ ID NO: 131035 - DNA, 23 bp, Homo sapiens
tcactcatgtgtctggtgattga

SEQ ID NO: 131036 - DNA, 23 bp, Homo sapiens
gacagtgtctcactctgtcgccc

SEQ ID NO: 131037 - DNA, 23 bp, Homo sapiens
cactctcattctctctgtcttag

SEQ ID NO: 131038 - DNA, 23 bp, Homo sapiens
aactgtatggttttcttgcttaa

SEQ ID NO: 131039 - DNA, 23 bp, Homo sapiens
tgaaacagacaactgtcttggcc

SEQ ID NO: 131040 - DNA, 23 bp, Homo sapiens
tctgtgtgtgtgtgcctgtctgt

SEQ ID NO: 131041 - DNA, 23 bp, Homo sapiens
ggaagagagtcaggacactgggc

SEQ ID NO: 131042 - DNA, 22 bp, Homo sapiens
tttctcagtcactcagttcaga

SEQ ID NO: 131043 - DNA, 18 bp, Homo sapiens
agcatgatcacgctgttg

SEQ ID NO: 131044 - DNA, 23 bp, Homo sapiens
gtgcaacagagtgagactctgtc

SEQ ID NO: 131045 - DNA, 23 bp, Homo sapiens
tctgtgcctctgtcttcccatct

SEQ ID NO: 131046 - DNA, 23 bp, Homo sapiens
tggagtctcactctgtcacccag

SEQ ID NO: 131047 - DNA, 23 bp, Homo sapiens
tcctgtgcctgagttttctgttt

SEQ ID NO: 131048 - DNA, 18 bp, Homo sapiens
agtgctgggatcacaggc

SEQ ID NO: 131049 - DNA, 19 bp, Homo sapiens
agacaggagacagtggggt

SEQ ID NO: 131050 - DNA, 23 bp, Homo sapiens
acagagtctcactctgtcgccca

SEQ ID NO: 131051 - DNA, 23 bp, Homo sapiens
gagtcactggctctgtgagtgtc

SEQ ID NO: 131052 - DNA, 23 bp, Homo sapiens
gacagagtctggctctgtcacgc

SEQ ID NO: 131053 - DNA, 21 bp, Homo sapiens
ttgagacagagtctggctctg

SEQ ID NO: 131054 - DNA, 21 bp, Homo sapiens
tctgtcacccagactggagtg

SEQ ID NO: 131055 - DNA, 23 bp, Homo sapiens
ggagtctcactctgtcacccagg

SEQ ID NO: 131056 - DNA, 23 bp, Homo sapiens
tatatgtatgtatacatgtgtgt

SEQ ID NO: 131057 - DNA, 20 bp, Homo sapiens
atacatatacatatgtgtat

SEQ ID NO: 131058 - DNA, 22 bp, Homo sapiens
ctgaggtaggaggatcacttga

SEQ ID NO: 131059 - DNA, 23 bp, Homo sapiens
ttgagacggagtctcactctgtc

SEQ ID NO: 131060 - DNA, 21 bp, Homo sapiens
atgtacgtgtgtgtgtatata

SEQ ID NO: 131061 - DNA, 23 bp, Homo sapiens
ttgagacagggtctggctctgtt

SEQ ID NO: 131062 - DNA, 21 bp, Homo sapiens
tctatatgtcttctgggactg

SEQ ID NO: 131063 - DNA, 23 bp, Homo sapiens
tgtgcatgcctgtagtcccagct

SEQ ID NO: 131064 - DNA, 23 bp, Homo sapiens
cggagtctcactctgtcacccag

SEQ ID NO: 131065 - DNA, 23 bp, Homo sapiens
gacagtgtctccctctgtcaccc

SEQ ID NO: 131066 - DNA, 23 bp, Homo sapiens
tgagttcattgtagattctggat

SEQ ID NO: 131067 - DNA, 23 bp, Homo sapiens
tgagttcattgtagattctggat

SEQ ID NO: 131068 - DNA, 22 bp, Homo sapiens
cactgcctgtctgcctctctct

SEQ ID NO: 131069 - DNA, 18 bp, Homo sapiens
ctcactgcaacctctgtc

SEQ ID NO: 131070 - DNA, 23 bp, Homo sapiens
tcggttcactgcaacctctgtct

SEQ ID NO: 131071 - DNA, 23 bp, Homo sapiens
tcacgtacacagtctcaggacta

SEQ ID NO: 131072 - DNA, 23 bp, Homo sapiens
tgactgcctgtgtgcgtgacatg

SEQ ID NO: 131073 - DNA, 23 bp, Homo sapiens
aagagtctgtcgctctgtcaccc

SEQ ID NO: 131074 - DNA, 20 bp, Homo sapiens
tctgtcacccagactggctc

SEQ ID NO: 131075 - DNA, 18 bp, Homo sapiens
atggtcttgatctcttgt

SEQ ID NO: 131076 - DNA, 18 bp, Homo sapiens
tcactgcaagctctgcct

SEQ ID NO: 131077 - DNA, 23 bp, Homo sapiens
acccactgtggctctgagcctgg

SEQ ID NO: 131078 - DNA, 23 bp, Homo sapiens
ttcttgagcttttttttagatga

SEQ ID NO: 131079 - DNA, 23 bp, Homo sapiens
tctctgaggcctcagtttctctg

SEQ ID NO: 131080 - DNA, 23 bp, Homo sapiens
cggagtctcgctctgtcgctcag

SEQ ID NO: 131081 - DNA, 23 bp, Homo sapiens
taagaagagacacaggagagctt

SEQ ID NO: 131082 - DNA, 22 bp, Homo sapiens
tttctgtctgctttttatcaca

SEQ ID NO: 131083 - DNA, 23 bp, Homo sapiens
atctctcactgtgtctgtggctc

SEQ ID NO: 131084 - DNA, 18 bp, Homo sapiens
aggtgcttctcctctctg

SEQ ID NO: 131085 - DNA, 22 bp, Homo sapiens
tagccacttgtgtgtgtgctca

SEQ ID NO: 131086 - DNA, 23 bp, Homo sapiens
tttacctaaatcaatctggtctg

SEQ ID NO: 131087 - DNA, 23 bp, Homo sapiens
tccctggctcagtcagactcaga

SEQ ID NO: 131088 - DNA, 23 bp, Homo sapiens
ctcttcactgtctctctagtggc

SEQ ID NO: 131089 - DNA, 23 bp, Homo sapiens
cagacactgtctccatgtctgtg

SEQ ID NO: 131090 - DNA, 21 bp, Homo sapiens
tgagcatggcagagatgcagc

SEQ ID NO: 131091 - DNA, 23 bp, Homo sapiens
tggagtctcactctgtcacccag

SEQ ID NO: 131092 - DNA, 18 bp, Homo sapiens
atgtttagaagtattccc

SEQ ID NO: 131093 - DNA, 19 bp, Homo sapiens
atgtgtgtgtatatatatg

SEQ ID NO: 131094 - DNA, 19 bp, Homo sapiens
tatgtgtgtatgtgtatat

SEQ ID NO: 131095 - DNA, 23 bp, Homo sapiens
atatgtatatatgtatatgtgtg

SEQ ID NO: 131096 - DNA, 20 bp, Homo sapiens
gtggtggtggtggtggtggt

SEQ ID NO: 131097 - DNA, 22 bp, Homo sapiens
gttttcactggcattttctttt

SEQ ID NO: 131098 - DNA, 23 bp, Homo sapiens
ttattgagatggagtctcactct

SEQ ID NO: 131099 - DNA, 20 bp, Homo sapiens
atggtgccctggtacttgaa

SEQ ID NO: 131100 - DNA, 23 bp, Homo sapiens
gatacatgtgcaggatgtgcagg

SEQ ID NO: 131101 - DNA, 23 bp, Homo sapiens
tgagttcattgtagattctggat

SEQ ID NO: 131102 - DNA, 23 bp, Homo sapiens
tgagttcattgtagattctggat

SEQ ID NO: 131103 - DNA, 23 bp, Homo sapiens
acacggtcactctgtgagcagat

SEQ ID NO: 131104 - DNA, 18 bp, Homo sapiens
aagagcccagagtccaga

SEQ ID NO: 131105 - DNA, 23 bp, Homo sapiens
acagagtctcactctgtcgccca

SEQ ID NO: 131106 - DNA, 22 bp, Homo sapiens
caaacttctcagtgggtgttca

SEQ ID NO: 131107 - DNA, 23 bp, Homo sapiens
gactgaatctctctctgtcaccc

SEQ ID NO: 131108 - DNA, 20 bp, Homo sapiens
acagtggtgtgatctcagct

SEQ ID NO: 131109 - DNA, 23 bp, Homo sapiens
atttatggtgcttttgacataca

SEQ ID NO: 131110 - DNA, 23 bp, Homo sapiens
ggaacaggttgtgtttggttgca

SEQ ID NO: 131111 - DNA, 23 bp, Homo sapiens
accctcactctctcactccagct

SEQ ID NO: 131112 - DNA, 23 bp, Homo sapiens
agatggtgtctcactctgtcacc

SEQ ID NO: 131113 - DNA, 23 bp, Homo sapiens
aatcactctgaaaagcttggcat

SEQ ID NO: 131114 - DNA, 23 bp, Homo sapiens
caatcagtggtttcattgtggga

SEQ ID NO: 131115 - DNA, 20 bp, Homo sapiens
agctcttctcaaattcttgt

SEQ ID NO: 131116 - DNA, 23 bp, Homo sapiens
tggcagtgtgctgaggaggatga

SEQ ID NO: 131117 - DNA, 20 bp, Homo sapiens
tgtggtttgttttgagacag

SEQ ID NO: 131118 - DNA, 23 bp, Homo sapiens
tatgtatgtatgtgtgtgtgtat

SEQ ID NO: 131119 - DNA, 23 bp, Homo sapiens
tatatgtgtatatatacacgtgt

SEQ ID NO: 131120 - DNA, 21 bp, Homo sapiens
tatatgtgtgtatatatatac

SEQ ID NO: 131121 - DNA, 23 bp, Homo sapiens
tgtgtgtgtatatatatgtgtgt

SEQ ID NO: 131122 - DNA, 20 bp, Homo sapiens
ctgaggtaggaggatcgttt

SEQ ID NO: 131123 - DNA, 22 bp, Homo sapiens
tatgcatatgtatcatatagtg

SEQ ID NO: 131124 - DNA, 21 bp, Homo sapiens
ttgccactgagttattttccc

SEQ ID NO: 131125 - DNA, 23 bp, Homo sapiens
ttatgtctgtctattgtccatgt

SEQ ID NO: 131126 - DNA, 18 bp, Homo sapiens
tcagagaggttaagtaat

SEQ ID NO: 131127 - DNA, 20 bp, Homo sapiens
gtgagaaacaggtattggtt

SEQ ID NO: 131128 - DNA, 23 bp, Homo sapiens
agcagtgacaattctcattctta

SEQ ID NO: 131129 - DNA, 19 bp, Homo sapiens
tgaatctaagagaaaatgg

SEQ ID NO: 131130 - DNA, 23 bp, Homo sapiens
agagtctcactttgttaattagg

SEQ ID NO: 131131 - DNA, 23 bp, Homo sapiens
ttgagacggagtttcactcttgt

SEQ ID NO: 131132 - DNA, 20 bp, Homo sapiens
acagaggcagaaatcgtttt

SEQ ID NO: 131133 - DNA, 23 bp, Homo sapiens
tttgagacggagtctcactctgt

SEQ ID NO: 131134 - DNA, 20 bp, Homo sapiens
gtgtgtgcatatatatatgc

SEQ ID NO: 131135 - DNA, 21 bp, Homo sapiens
tgttatgtatgtatacatgta

SEQ ID NO: 131136 - DNA, 18 bp, Homo sapiens
agagaggtacaggttctg

SEQ ID NO: 131137 - DNA, 23 bp, Homo sapiens
tgtgtctgtgtcctaatcttctc

SEQ ID NO: 131138 - DNA, 21 bp, Homo sapiens
attaggtctgacactaatgac

SEQ ID NO: 131139 - DNA, 20 bp, Homo sapiens
gtctgctttttactgagaga

SEQ ID NO: 131140 - DNA, 23 bp, Homo sapiens
ctgaccctgtctgtgcctccctg

SEQ ID NO: 131141 - DNA, 21 bp, Homo sapiens
tgctgatgcaggccaggtgca

SEQ ID NO: 131142 - DNA, 22 bp, Homo sapiens
ggtgagtgaagaagctgagcag

SEQ ID NO: 131143 - DNA, 23 bp, Homo sapiens
ttgagacagagtcttgctctgtc

SEQ ID NO: 131144 - DNA, 23 bp, Homo sapiens
cctttatgtagatcaaagctgat

SEQ ID NO: 131145 - DNA, 21 bp, Homo sapiens
tggaaacgatacagcagtcaa

SEQ ID NO: 131146 - DNA, 23 bp, Homo sapiens
tcagagagaagggactgtggaga

SEQ ID NO: 131147 - DNA, 23 bp, Homo sapiens
tgtgtgtgtgtgtgtgtgtacta

SEQ ID NO: 131148 - DNA, 20 bp, Homo sapiens
atgtgtgtatatatacgtat

SEQ ID NO: 131149 - DNA, 23 bp, Homo sapiens
atatgtgtatatgtatatatgta

SEQ ID NO: 131150 - DNA, 23 bp, Homo sapiens
atatatacatatgtatacatgtg

SEQ ID NO: 131151 - DNA, 23 bp, Homo sapiens
tggagtctcactctgtcacccag

SEQ ID NO: 131152 - DNA, 23 bp, Homo sapiens
cataactattgattttgtacttg

SEQ ID NO: 131153 - DNA, 22 bp, Homo sapiens
ttttgagacggagtcttgctct

SEQ ID NO: 131154 - DNA, 23 bp, Homo sapiens
atggagtctcactctgtcaccca

SEQ ID NO: 131155 - DNA, 23 bp, Homo sapiens
tggagtctcactctgtcacccag

SEQ ID NO: 131156 - DNA, 22 bp, Homo sapiens
tatgtcacccaggctggaatgc

SEQ ID NO: 131157 - DNA, 23 bp, Homo sapiens
gacggagtctctcgctctgtcgc

SEQ ID NO: 131158 - DNA, 18 bp, Homo sapiens
cagtgacaccctgtctct

SEQ ID NO: 131159 - DNA, 23 bp, Homo sapiens
tggagtctcactctgtcacccag

SEQ ID NO: 131160 - DNA, 23 bp, Homo sapiens
agacagagtctggctctgttgac

SEQ ID NO: 131161 - DNA, 23 bp, Homo sapiens
tcgctctgtggctgtgagtgcag

SEQ ID NO: 131162 - DNA, 23 bp, Homo sapiens
tctgtctgtcactcactgggact

SEQ ID NO: 131163 - DNA, 23 bp, Homo sapiens
cggagtctcactctgtcacccag

SEQ ID NO: 131164 - DNA, 20 bp, Homo sapiens
agcctccaggcttcttcccg

SEQ ID NO: 131165 - DNA, 23 bp, Homo sapiens
tgcctcttcttgatctctctctg

SEQ ID NO: 131166 - DNA, 23 bp, Homo sapiens
agtctcactctgtcccacccagg

SEQ ID NO: 131167 - DNA, 21 bp, Homo sapiens
gagacagtctcactctgttgc

SEQ ID NO: 131168 - DNA, 23 bp, Homo sapiens
agacagtctcgctctgttgctca

SEQ ID NO: 131169 - DNA, 21 bp, Homo sapiens
tgaggtggaaggatcaattga

SEQ ID NO: 131170 - DNA, 19 bp, Homo sapiens
aactagtgggttaagcaga

SEQ ID NO: 131171 - DNA, 23 bp, Homo sapiens
ctgaccctgctgtgtgacttcag

SEQ ID NO: 131172 - DNA, 23 bp, Homo sapiens
tggggcagctttagttgtatcgg

SEQ ID NO: 131173 - DNA, 23 bp, Homo sapiens
agtcaagtgcttttctaggatca

SEQ ID NO: 131174 - DNA, 20 bp, Homo sapiens
agtctcgctctgtcgctcag

SEQ ID NO: 131175 - DNA, 19 bp, Homo sapiens
acagtcctctccctggtgg

SEQ ID NO: 131176 - DNA, 21 bp, Homo sapiens
tagagcttgaaaaggagactg

SEQ ID NO: 131177 - DNA, 23 bp, Homo sapiens
tcagagcactctctgtcaggcag

SEQ ID NO: 131178 - DNA, 23 bp, Homo sapiens
tatatgtgtgtggaatatatgtg

SEQ ID NO: 131179 - DNA, 23 bp, Homo sapiens
actctctaggagactgtctcttt

SEQ ID NO: 131180 - DNA, 23 bp, Homo sapiens
gtctcggtgtgtctctgccccta

SEQ ID NO: 131181 - DNA, 22 bp, Homo sapiens
acggagtctcactctgtcgccc

SEQ ID NO: 131182 - DNA, 23 bp, Homo sapiens
cggactctcgctctgtcacccag

SEQ ID NO: 131183 - DNA, 23 bp, Homo sapiens
tgagacagagtctggctgtgtca

SEQ ID NO: 131184 - DNA, 23 bp, Homo sapiens
tgtctgactgtgagtcaggatgg

SEQ ID NO: 131185 - DNA, 23 bp, Homo sapiens
atcctttacatccttctgtctgt

SEQ ID NO: 131186 - DNA, 23 bp, Homo sapiens
cagagtctccctctgtctcccag

SEQ ID NO: 131187 - DNA, 22 bp, Homo sapiens
tgtgtgtatatatatatgtttg

SEQ ID NO: 131188 - DNA, 23 bp, Homo sapiens
acaccaggaggaaaggggttgtg

SEQ ID NO: 131189 - DNA, 23 bp, Homo sapiens
tgagacagagtctcgctctgtcg

SEQ ID NO: 131190 - DNA, 22 bp, Homo sapiens
tgtgtctctttctctctcggag

SEQ ID NO: 131191 - DNA, 23 bp, Homo sapiens
tctctctggcacaatgtctggga

SEQ ID NO: 131192 - DNA, 23 bp, Homo sapiens
tgtcaagtgagcttcagattttg

SEQ ID NO: 131193 - DNA, 19 bp, Homo sapiens
tcttcctttatgtaggtat

SEQ ID NO: 131194 - DNA, 20 bp, Homo sapiens
tgcacagagcctgcagagag

SEQ ID NO: 131195 - DNA, 23 bp, Homo sapiens
catctgtctctacctgtctctgt

SEQ ID NO: 131196 - DNA, 23 bp, Homo sapiens
tccacgttcagttttgtgttcct

SEQ ID NO: 131197 - DNA, 23 bp, Homo sapiens
cacagaactgacagaggacaggc

SEQ ID NO: 131198 - DNA, 19 bp, Homo sapiens
tgtctgtgttgggaaaagg

SEQ ID NO: 131199 - DNA, 19 bp, Homo sapiens
tgtctgtgttgggaaaagg

SEQ ID NO: 131200 - DNA, 20 bp, Homo sapiens
tcccccagattctcctgcca

SEQ ID NO: 131201 - DNA, 23 bp, Homo sapiens
gagtctcacactgtcacccaggc

SEQ ID NO: 131202 - DNA, 22 bp, Homo sapiens
cttcatcctgctctgtgtctgt

SEQ ID NO: 131203 - DNA, 23 bp, Homo sapiens
agactgagtctcactctgtcgcc

SEQ ID NO: 131204 - DNA, 21 bp, Homo sapiens
gtgagatctctgctcattgca

SEQ ID NO: 131205 - DNA, 19 bp, Homo sapiens
aggcagagactcaccctct

SEQ ID NO: 131206 - DNA, 23 bp, Homo sapiens
ctgactggctgtcatctctctcc

SEQ ID NO: 131207 - DNA, 23 bp, Homo sapiens
tgagatggagtctcactctgtca

SEQ ID NO: 131208 - DNA, 23 bp, Homo sapiens
gactgagtctcgctctgtcaccc

SEQ ID NO: 131209 - DNA, 23 bp, Homo sapiens
aatgagaatgttgaaagagagct

SEQ ID NO: 131210 - DNA, 22 bp, Homo sapiens
acagcctctgtgtgcctccctc

SEQ ID NO: 131211 - DNA, 23 bp, Homo sapiens
gtcactggctcagacactgcagt

SEQ ID NO: 131212 - DNA, 22 bp, Homo sapiens
tcttacagtcagtctatgttgc

SEQ ID NO: 131213 - DNA, 22 bp, Homo sapiens
ttttgtttgtttttgagacagg

SEQ ID NO: 131214 - DNA, 23 bp, Homo sapiens
cagggtctctcactctgttgtcc

SEQ ID NO: 131215 - DNA, 22 bp, Homo sapiens
tttttagatggagtctcgctct

SEQ ID NO: 131216 - DNA, 23 bp, Homo sapiens
aagaatatgtgatagagattgta

SEQ ID NO: 131217 - DNA, 23 bp, Homo sapiens
tcctggtcatgaagtctttgcct

SEQ ID NO: 131218 - DNA, 23 bp, Homo sapiens
tggagtctcactctgtcacccag

SEQ ID NO: 131219 - DNA, 23 bp, Homo sapiens
agggtggctgggtctgtctgtca

SEQ ID NO: 131220 - DNA, 22 bp, Homo sapiens
cagaggttgcagtgagcagaga

SEQ ID NO: 131221 - DNA, 20 bp, Homo sapiens
tgagctactaagaaataagg

SEQ ID NO: 131222 - DNA, 23 bp, Homo sapiens
ttcatttgcaagtaagcttatca

SEQ ID NO: 131223 - DNA, 19 bp, Homo sapiens
tgacagcacagcctgccct

SEQ ID NO: 131224 - DNA, 23 bp, Homo sapiens
tgtctctaccacttcagcgggtt

SEQ ID NO: 131225 - DNA, 23 bp, Homo sapiens
attgactctggatgacataatat

SEQ ID NO: 131226 - DNA, 18 bp, Homo sapiens
gcaagagaatgtctgttc

SEQ ID NO: 131227 - DNA, 23 bp, Homo sapiens
tcccagagcccctggaactctgc

SEQ ID NO: 131228 - DNA, 23 bp, Homo sapiens
gtccttttgtttcattatgtatg

SEQ ID NO: 131229 - DNA, 23 bp, Homo sapiens
agtctcactcccactgtgcctcc

SEQ ID NO: 131230 - DNA, 22 bp, Homo sapiens
cagtctcactctgtccctcagg

SEQ ID NO: 131231 - DNA, 22 bp, Homo sapiens
agtggaatatatatgtgtgtgt

SEQ ID NO: 131232 - DNA, 23 bp, Homo sapiens
atatatgtatatgtacatatgac

SEQ ID NO: 131233 - DNA, 21 bp, Homo sapiens
aaaaggaaaagtctagataat

SEQ ID NO: 131234 - DNA, 23 bp, Homo sapiens
gatagtttcctttagttttctga

SEQ ID NO: 131235 - DNA, 23 bp, Homo sapiens
aagggagtctcgctctgtctccc

SEQ ID NO: 131236 - DNA, 23 bp, Homo sapiens
agccctcctattgatatgttcat

SEQ ID NO: 131237 - DNA, 23 bp, Homo sapiens
ttcaatgtgtgtatgtgtgtgta

SEQ ID NO: 131238 - DNA, 23 bp, Homo sapiens
taattcattgtagaggggtatgt

SEQ ID NO: 131239 - DNA, 19 bp, Homo sapiens
tactgcagctggtgattat

SEQ ID NO: 131240 - DNA, 23 bp, Homo sapiens
tcttggcttagtctctctctctg

SEQ ID NO: 131241 - DNA, 19 bp, Homo sapiens
tttggaagtagtccctcct

SEQ ID NO: 131242 - DNA, 23 bp, Homo sapiens
tttgaagaatttgaataggattg

SEQ ID NO: 131243 - DNA, 23 bp, Homo sapiens
tttaaatgtttggtagaattcag

SEQ ID NO: 131244 - DNA, 23 bp, Homo sapiens
tgagttcattgtagattctggat

SEQ ID NO: 131245 - DNA, 23 bp, Homo sapiens
tgagttcattgtagattctggat

SEQ ID NO: 131246 - DNA, 23 bp, Homo sapiens
atagctgtggttttgtttagaaa

SEQ ID NO: 131247 - DNA, 22 bp, Homo sapiens
tgtatgtgtatgtatatgtcag

SEQ ID NO: 131248 - DNA, 23 bp, Homo sapiens
aagtgtgagaactgacggtggag

SEQ ID NO: 131249 - DNA, 23 bp, Homo sapiens
taactgtacatatataattgtgt

SEQ ID NO: 131250 - DNA, 22 bp, Homo sapiens
aggtgagcagagggaggacagt

SEQ ID NO: 131251 - DNA, 23 bp, Homo sapiens
tcactctgtcacccagactaaag

SEQ ID NO: 131252 - DNA, 19 bp, Homo sapiens
atattgatatctatacagt

SEQ ID NO: 131253 - DNA, 23 bp, Homo sapiens
gacagagtctcactctgtcgccc

SEQ ID NO: 131254 - DNA, 18 bp, Homo sapiens
tggcgagatcttggctca

SEQ ID NO: 131255 - DNA, 18 bp, Homo sapiens
cacagaatatattctgtg

SEQ ID NO: 131256 - DNA, 23 bp, Homo sapiens
gtgtcgctctgagtgtcactcag

SEQ ID NO: 131257 - DNA, 23 bp, Homo sapiens
agtcactgcctattgtctatctg

SEQ ID NO: 131258 - DNA, 19 bp, Homo sapiens
atatgtgtgcatgtatata

SEQ ID NO: 131259 - DNA, 19 bp, Homo sapiens
atatgtgtgtatatgtata

SEQ ID NO: 131260 - DNA, 23 bp, Homo sapiens
tccgtctctctgtggcacagttc

SEQ ID NO: 131261 - DNA, 23 bp, Homo sapiens
tgacagaagagagtgtcttgggt

SEQ ID NO: 131262 - DNA, 22 bp, Homo sapiens
tagctacatgatttgggtgaga

SEQ ID NO: 131263 - DNA, 22 bp, Homo sapiens
ctctgtcacccagactagaggg

SEQ ID NO: 131264 - DNA, 23 bp, Homo sapiens
tatatatgtatgtatatgtgtgt

SEQ ID NO: 131265 - DNA, 18 bp, Homo sapiens
atacacacacacacatat

SEQ ID NO: 131266 - DNA, 23 bp, Homo sapiens
tgagttcattgtagattctggat

SEQ ID NO: 131267 - DNA, 23 bp, Homo sapiens
tgagttcattgtagattctggat

SEQ ID NO: 131268 - DNA, 19 bp, Homo sapiens
agtaatagccattgtgagt

SEQ ID NO: 131269 - DNA, 23 bp, Homo sapiens
tgactttttttttcactgtgtct

SEQ ID NO: 131270 - DNA, 23 bp, Homo sapiens
tacagaaaagagtctggacttgg

SEQ ID NO: 131271 - DNA, 23 bp, Homo sapiens
ttttgagacagggtctcactctg

SEQ ID NO: 131272 - DNA, 22 bp, Homo sapiens
agtgagccatgatcatgccact

SEQ ID NO: 131273 - DNA, 22 bp, Homo sapiens
ggacagagtctggctcagttgc

SEQ ID NO: 131274 - DNA, 23 bp, Homo sapiens
tgtgtgtatatatatgtgtgtgt

SEQ ID NO: 131275 - DNA, 21 bp, Homo sapiens
cagtgctatttttttgggaga

SEQ ID NO: 131276 - DNA, 23 bp, Homo sapiens
gtgaagtgagtggcatgatctcg

SEQ ID NO: 131277 - DNA, 23 bp, Homo sapiens
acagtgtgagtcacttttttgaa

SEQ ID NO: 131278 - DNA, 23 bp, Homo sapiens
cttactctgtcactctgttaccc

SEQ ID NO: 131279 - DNA, 23 bp, Homo sapiens
taagcatttgtgtgtgtgtgtgt

SEQ ID NO: 131280 - DNA, 23 bp, Homo sapiens
tcctatgcacattttgttgtaca

SEQ ID NO: 131281 - DNA, 23 bp, Homo sapiens
taatggctgcaagtatagtgtgt

SEQ ID NO: 131282 - DNA, 21 bp, Homo sapiens
cgttggcttagaagcagattt

SEQ ID NO: 131283 - DNA, 20 bp, Homo sapiens
ttatgtatttatacataagt

SEQ ID NO: 131284 - DNA, 22 bp, Homo sapiens
agtggaataagttttgggaaag

SEQ ID NO: 131285 - DNA, 22 bp, Homo sapiens
tgactgagtcttgctctgtctc

SEQ ID NO: 131286 - DNA, 23 bp, Homo sapiens
tgagctggtctctctgtgcctgt

SEQ ID NO: 131287 - DNA, 20 bp, Homo sapiens
tgtagctatttaaatatgtg

SEQ ID NO: 131288 - DNA, 19 bp, Homo sapiens
tctgctagatttttaaggg

SEQ ID NO: 131289 - DNA, 20 bp, Homo sapiens
tgacagtctctcttttaggg

SEQ ID NO: 131290 - DNA, 23 bp, Homo sapiens
atatgactcatacaaatgagtat

SEQ ID NO: 131291 - DNA, 23 bp, Homo sapiens
tatgtggagtactttgttcaatg

SEQ ID NO: 131292 - DNA, 23 bp, Homo sapiens
tctcagtgtgtccattatatctc

SEQ ID NO: 131293 - DNA, 20 bp, Homo sapiens
cagacacagcatgtttagcc

SEQ ID NO: 131294 - DNA, 22 bp, Homo sapiens
agagtctcgctctgtcacccag

SEQ ID NO: 131295 - DNA, 23 bp, Homo sapiens
agacagaagtcagagagcaactc

SEQ ID NO: 131296 - DNA, 23 bp, Homo sapiens
tggctgtctagtgattttgacca

SEQ ID NO: 131297 - DNA, 19 bp, Homo sapiens
tttacagctggaaaaaggt

SEQ ID NO: 131298 - DNA, 21 bp, Homo sapiens
aaagctacatgaattggccta

SEQ ID NO: 131299 - DNA, 23 bp, Homo sapiens
tatgtactctgctctttggtctc

SEQ ID NO: 131300 - DNA, 23 bp, Homo sapiens
atgtgaagatgatgaatggaaca

SEQ ID NO: 131301 - DNA, 23 bp, Homo sapiens
atacagctactatatatatgtgt

SEQ ID NO: 131302 - DNA, 23 bp, Homo sapiens
aatctagttggagagacaagact

SEQ ID NO: 131303 - DNA, 21 bp, Homo sapiens
agctgtcaggttttcttagat

SEQ ID NO: 131304 - DNA, 19 bp, Homo sapiens
acggagtctggctctgttg

SEQ ID NO: 131305 - DNA, 22 bp, Homo sapiens
ttgaggttttatatggagtgtg

SEQ ID NO: 131306 - DNA, 18 bp, Homo sapiens
agctagagaaaaggataa

SEQ ID NO: 131307 - DNA, 23 bp, Homo sapiens
tctctgcctgtcagtgtgtctca

SEQ ID NO: 131308 - DNA, 22 bp, Homo sapiens
tcttaggtgttctggctttgtt

SEQ ID NO: 131309 - DNA, 23 bp, Homo sapiens
agagagaccaaagagtgtgtgtt

SEQ ID NO: 131310 - DNA, 23 bp, Homo sapiens
taacaggtttgttgttgttgtta

SEQ ID NO: 131311 - DNA, 23 bp, Homo sapiens
ttaatgcacacctactcctgtta

SEQ ID NO: 131312 - DNA, 23 bp, Homo sapiens
acagagtctcactctgtcgccca

SEQ ID NO: 131313 - DNA, 23 bp, Homo sapiens
acagtttttatgtttttgtttcc

SEQ ID NO: 131314 - DNA, 21 bp, Homo sapiens
tgcctgccaccgtgcctgtct

SEQ ID NO: 131315 - DNA, 19 bp, Homo sapiens
tctgccagtttggatgatg

SEQ ID NO: 131316 - DNA, 23 bp, Homo sapiens
ttttgagacagggtctcactctg

SEQ ID NO: 131317 - DNA, 23 bp, Homo sapiens
acaagggtgaggttgactttttt

SEQ ID NO: 131318 - DNA, 23 bp, Homo sapiens
ttgggacggagtctcactctgcc

SEQ ID NO: 131319 - DNA, 22 bp, Homo sapiens
actattgcagacttaggtgttc

SEQ ID NO: 131320 - DNA, 23 bp, Homo sapiens
tcacagaactcacagagcagtgt

SEQ ID NO: 131321 - DNA, 23 bp, Homo sapiens
tgagttcattgtagattctggat

SEQ ID NO: 131322 - DNA, 23 bp, Homo sapiens
tgagttcattgtagattctggat

SEQ ID NO: 131323 - DNA, 23 bp, Homo sapiens
tggacagaacagtgtgtggagat

SEQ ID NO: 131324 - DNA, 23 bp, Homo sapiens
tattagtctgttgttttcaagag

SEQ ID NO: 131325 - DNA, 23 bp, Homo sapiens
tggagtctcactctgtcacccag

SEQ ID NO: 131326 - DNA, 23 bp, Homo sapiens
tacatgtgcacaacgtgcaggtt

SEQ ID NO: 131327 - DNA, 23 bp, Homo sapiens
agcctgtgtctgtctgaggctga

SEQ ID NO: 131328 - DNA, 23 bp, Homo sapiens
tgagttcattgtagattctggat

SEQ ID NO: 131329 - DNA, 23 bp, Homo sapiens
tgagttcattgtagattctggat

SEQ ID NO: 131330 - DNA, 19 bp, Homo sapiens
tttgcttaactttgagctc

SEQ ID NO: 131331 - DNA, 21 bp, Homo sapiens
ggatggatatgttatgtatgt

SEQ ID NO: 131332 - DNA, 23 bp, Homo sapiens
tgtctgcctgtctctgtgcaaac

SEQ ID NO: 131333 - DNA, 19 bp, Homo sapiens
agagtgaactgaaagggat

SEQ ID NO: 131334 - DNA, 19 bp, Homo sapiens
aagaaaatataggaatttt

SEQ ID NO: 131335 - DNA, 21 bp, Homo sapiens
acatgtgcacaatgtgcaggt

SEQ ID NO: 131336 - DNA, 18 bp, Homo sapiens
tgtgttcattgctgctag

SEQ ID NO: 131337 - DNA, 22 bp, Homo sapiens
attgtcacaggctgaattaatg

SEQ ID NO: 131338 - DNA, 18 bp, Homo sapiens
cacacgtatatacgtgtg

SEQ ID NO: 131339 - DNA, 22 bp, Homo sapiens
tatatgtatacacacacacaca

SEQ ID NO: 131340 - DNA, 21 bp, Homo sapiens
aatatacctgtatatgtagat

SEQ ID NO: 131341 - DNA, 18 bp, Homo sapiens
tacatacatgtgtgtacc

SEQ ID NO: 131342 - DNA, 23 bp, Homo sapiens
actcccagagcccctggaactct

SEQ ID NO: 131343 - DNA, 23 bp, Homo sapiens
tcccagagcccctggaactctgg

SEQ ID NO: 131344 - DNA, 23 bp, Homo sapiens
aagtcagtggtagcttgatgggg

SEQ ID NO: 131345 - DNA, 23 bp, Homo sapiens
gtgtctccctccctctgtgcctt

SEQ ID NO: 131346 - DNA, 22 bp, Homo sapiens
agtgtgctacaattttctaggc

SEQ ID NO: 131347 - DNA, 23 bp, Homo sapiens
gttgaaaagatatgagaaaagct

SEQ ID NO: 131348 - DNA, 21 bp, Homo sapiens
aggcagaaaataaaagcagta

SEQ ID NO: 131349 - DNA, 21 bp, Homo sapiens
agttagctcaatgactcactc

SEQ ID NO: 131350 - DNA, 23 bp, Homo sapiens
taaactttggttattttttcttt

SEQ ID NO: 131351 - DNA, 23 bp, Homo sapiens
attgagacggagtctcattctgt

SEQ ID NO: 131352 - DNA, 22 bp, Homo sapiens
atttttagtagagacggggttt

SEQ ID NO: 131353 - DNA, 20 bp, Homo sapiens
ttttgtctttgttttttgtt

SEQ ID NO: 131354 - DNA, 22 bp, Homo sapiens
ttgtcagaaggaagtgacctgc

SEQ ID NO: 131355 - DNA, 23 bp, Homo sapiens
acatttctgtgttggtcttatag

SEQ ID NO: 131356 - DNA, 22 bp, Homo sapiens
gtagttgcttctatagataaca

SEQ ID NO: 131357 - DNA, 23 bp, Homo sapiens
tcacaagtcgcttctctgtctgt

SEQ ID NO: 131358 - DNA, 22 bp, Homo sapiens
tgagatcaaggtgtcagcaagt

SEQ ID NO: 131359 - DNA, 19 bp, Homo sapiens
tgtacatatatatactata

SEQ ID NO: 131360 - DNA, 23 bp, Homo sapiens
tgagttcattgtagattctggat

SEQ ID NO: 131361 - DNA, 23 bp, Homo sapiens
tgagttcattgtagattctggat

SEQ ID NO: 131362 - DNA, 20 bp, Homo sapiens
agactgagaggatttctggg

SEQ ID NO: 131363 - DNA, 22 bp, Homo sapiens
acatgtgcacaatgtgcaggtt

SEQ ID NO: 131364 - DNA, 21 bp, Homo sapiens
tgtttctagaagcagctgtta

SEQ ID NO: 131365 - DNA, 23 bp, Homo sapiens
atagttcttctaaaaatcactga

SEQ ID NO: 131366 - DNA, 23 bp, Homo sapiens
gtatgtatgtatgtgtgtgtgtg

SEQ ID NO: 131367 - DNA, 23 bp, Homo sapiens
atgcacatacacacacatataca

SEQ ID NO: 131368 - DNA, 22 bp, Homo sapiens
gctctcctgtgagaatctgatg

SEQ ID NO: 131369 - DNA, 23 bp, Homo sapiens
atctgacaggagacagagctcag

SEQ ID NO: 131370 - DNA, 23 bp, Homo sapiens
gagatcaagtctttctctctcac

SEQ ID NO: 131371 - DNA, 23 bp, Homo sapiens
tgagttcattgtagattctggat

SEQ ID NO: 131372 - DNA, 23 bp, Homo sapiens
tgagttcattgtagattctggat

SEQ ID NO: 131373 - DNA, 23 bp, Homo sapiens
tttaatatatctgaatatgttat

SEQ ID NO: 131374 - DNA, 20 bp, Homo sapiens
atatattcagatatactaga

SEQ ID NO: 131375 - DNA, 23 bp, Homo sapiens
tcatactgggtcctcttttcttt

SEQ ID NO: 131376 - DNA, 23 bp, Homo sapiens
ttaagatggagtctggctctgtc

SEQ ID NO: 131377 - DNA, 19 bp, Homo sapiens
tgtgtatatatgtgtccat

SEQ ID NO: 131378 - DNA, 23 bp, Homo sapiens
tcagtgacacgcaataacctctg

SEQ ID NO: 131379 - DNA, 23 bp, Homo sapiens
ttttactgttaggatttccactc

SEQ ID NO: 131380 - DNA, 23 bp, Homo sapiens
cttcttaggagcaatctttattt

SEQ ID NO: 131381 - DNA, 23 bp, Homo sapiens
tcacagattgcatttgaacgagt

SEQ ID NO: 131382 - DNA, 19 bp, Homo sapiens
tttctacattatggtgagt

SEQ ID NO: 131383 - DNA, 23 bp, Homo sapiens
aaatgtaatgcacttggatcatc

SEQ ID NO: 131384 - DNA, 23 bp, Homo sapiens
ttaatctgtctggttaagatgtc

SEQ ID NO: 131385 - DNA, 19 bp, Homo sapiens
aattaggaagaaaagggaa

SEQ ID NO: 131386 - DNA, 23 bp, Homo sapiens
atttcaaaggtgtgcgtgtgttg

SEQ ID NO: 131387 - DNA, 23 bp, Homo sapiens
ttcagagggagtgttttctctat

SEQ ID NO: 131388 - DNA, 22 bp, Homo sapiens
aatactttctattagttgccat

SEQ ID NO: 131389 - DNA, 22 bp, Homo sapiens
tatatgtgtatatacgtatatg

SEQ ID NO: 131390 - DNA, 22 bp, Homo sapiens
tggcttgtatctgtaatctcaa

SEQ ID NO: 131391 - DNA, 23 bp, Homo sapiens
aggaagcacaagatgcaagctgt

SEQ ID NO: 131392 - DNA, 22 bp, Homo sapiens
tttgggagtccctcaaatgtgc

SEQ ID NO: 131393 - DNA, 19 bp, Homo sapiens
tgagagaatgtcagactgc

SEQ ID NO: 131394 - DNA, 23 bp, Homo sapiens
tcacagtctctctcttctctctc

SEQ ID NO: 131395 - DNA, 23 bp, Homo sapiens
atatattgattttgtatcctgca

SEQ ID NO: 131396 - DNA, 23 bp, Homo sapiens
tttctctttactgattttgttct

SEQ ID NO: 131397 - DNA, 19 bp, Homo sapiens
acactgaatccaagatgag

SEQ ID NO: 131398 - DNA, 23 bp, Homo sapiens
acagagtctcactctgtcgccca

SEQ ID NO: 131399 - DNA, 21 bp, Homo sapiens
agagtgaaactgtgtctcaat

SEQ ID NO: 131400 - DNA, 23 bp, Homo sapiens
ttgaaaaagaaatgtttagtaaa

SEQ ID NO: 131401 - DNA, 18 bp, Homo sapiens
ttttgagacagagtctta

SEQ ID NO: 131402 - DNA, 23 bp, Homo sapiens
tcattgatttctgtttatgaagt

SEQ ID NO: 131403 - DNA, 19 bp, Homo sapiens
agtgcagtgacacgatctt

SEQ ID NO: 131404 - DNA, 20 bp, Homo sapiens
tgaagctaggatgagacagc

SEQ ID NO: 131405 - DNA, 23 bp, Homo sapiens
gacagagtctcgctctgtcaccc

SEQ ID NO: 131406 - DNA, 18 bp, Homo sapiens
ggagtctcgctgtgtcac

SEQ ID NO: 131407 - DNA, 23 bp, Homo sapiens
aggatagttgtgaggattgagat

SEQ ID NO: 131408 - DNA, 23 bp, Homo sapiens
tgggtgtgcatatgtatatgtgt

SEQ ID NO: 131409 - DNA, 21 bp, Homo sapiens
tatagcactttacaatgagtc

SEQ ID NO: 131410 - DNA, 22 bp, Homo sapiens
aaagcctcttgcacatttttag

SEQ ID NO: 131411 - DNA, 23 bp, Homo sapiens
agatagagtatggttctgttgcc

SEQ ID NO: 131412 - DNA, 19 bp, Homo sapiens
ttcgaaatggagtctcact

SEQ ID NO: 131413 - DNA, 22 bp, Homo sapiens
tatgtgtatatatatgtgtgtg

SEQ ID NO: 131414 - DNA, 23 bp, Homo sapiens
gacagagtctcgctctgtcaccc

SEQ ID NO: 131415 - DNA, 18 bp, Homo sapiens
gactcactctccctctgg

SEQ ID NO: 131416 - DNA, 23 bp, Homo sapiens
tggagtctcactctgtcacccag

SEQ ID NO: 131417 - DNA, 23 bp, Homo sapiens
tcttttttggttccatatgaatt

SEQ ID NO: 131418 - DNA, 23 bp, Homo sapiens
ttctgtgaagaaagtcaatggta

SEQ ID NO: 131419 - DNA, 23 bp, Homo sapiens
ataagtgtgtgtatatgtatata

SEQ ID NO: 131420 - DNA, 23 bp, Homo sapiens
agagtctcactgtgtctccaatg

SEQ ID NO: 131421 - DNA, 23 bp, Homo sapiens
tgagttcattgtagattctggat

SEQ ID NO: 131422 - DNA, 23 bp, Homo sapiens
tgagttcattgtagattctggat

SEQ ID NO: 131423 - DNA, 23 bp, Homo sapiens
ggattggtgtctgtttattttta

SEQ ID NO: 131424 - DNA, 23 bp, Homo sapiens
agatgtgcttatagtccagctac

SEQ ID NO: 131425 - DNA, 23 bp, Homo sapiens
tctgctagtcactcactgtgtcc

SEQ ID NO: 131426 - DNA, 23 bp, Homo sapiens
gggtctcactctgtcacccaggc

SEQ ID NO: 131427 - DNA, 23 bp, Homo sapiens
tgagatggagtctcactctgtca

SEQ ID NO: 131428 - DNA, 23 bp, Homo sapiens
atgtatgtatatatgtatatgta

SEQ ID NO: 131429 - DNA, 21 bp, Homo sapiens
tgactggatgtctaatgagtg

SEQ ID NO: 131430 - DNA, 23 bp, Homo sapiens
tcactcgctctctgtctctctgt

SEQ ID NO: 131431 - DNA, 19 bp, Homo sapiens
ttgggcttatttagcagca

SEQ ID NO: 131432 - DNA, 23 bp, Homo sapiens
acagagtctcgctctgtcgctca

SEQ ID NO: 131433 - DNA, 19 bp, Homo sapiens
gtctcgctctgtctcccac

SEQ ID NO: 131434 - DNA, 23 bp, Homo sapiens
ttaatgtgtggtttgcatttcaa

SEQ ID NO: 131435 - DNA, 23 bp, Homo sapiens
gaattcttgagtttttgttgttc

SEQ ID NO: 131436 - DNA, 23 bp, Homo sapiens
tgagacaggatctcactctgtca

SEQ ID NO: 131437 - DNA, 18 bp, Homo sapiens
aaagtagagatgatgcag

SEQ ID NO: 131438 - DNA, 23 bp, Homo sapiens
ttaaggatgagaaaagattggga

SEQ ID NO: 131439 - DNA, 19 bp, Homo sapiens
tgagactgagtctcactct

SEQ ID NO: 131440 - DNA, 23 bp, Homo sapiens
tctgtctcagacactttttggtt

SEQ ID NO: 131441 - DNA, 23 bp, Homo sapiens
ggaagtagagagaaatttcatca

SEQ ID NO: 131442 - DNA, 23 bp, Homo sapiens
tttgagacggtctcgctctgtct

SEQ ID NO: 131443 - DNA, 22 bp, Homo sapiens
aaagagatgacataggtagaga

SEQ ID NO: 131444 - DNA, 18 bp, Homo sapiens
ctatgtgtgaaaatagag

SEQ ID NO: 131445 - DNA, 20 bp, Homo sapiens
tggctctctgacaaaccaca

SEQ ID NO: 131446 - DNA, 21 bp, Homo sapiens
tgaacgacagtaacagtgaca

SEQ ID NO: 131447 - DNA, 23 bp, Homo sapiens
agtatagcaggatttcttttaaa

SEQ ID NO: 131448 - DNA, 21 bp, Homo sapiens
atttgactgcatcaaatttga

SEQ ID NO: 131449 - DNA, 23 bp, Homo sapiens
gtacatgtgcaggatgtgcaggt

SEQ ID NO: 131450 - DNA, 20 bp, Homo sapiens
atatacacacatatatatgt

SEQ ID NO: 131451 - DNA, 23 bp, Homo sapiens
gagccagagtctcaccctgtcgc

SEQ ID NO: 131452 - DNA, 20 bp, Homo sapiens
agagacggaggaaacaagct

SEQ ID NO: 131453 - DNA, 21 bp, Homo sapiens
ttttgagacggagtcttgctc

SEQ ID NO: 131454 - DNA, 23 bp, Homo sapiens
agttttgtgaaattctttttcta

SEQ ID NO: 131455 - DNA, 22 bp, Homo sapiens
aagagcatttttttaagtgtag

SEQ ID NO: 131456 - DNA, 23 bp, Homo sapiens
tgaggctgcagtgagtcatgatt

SEQ ID NO: 131457 - DNA, 21 bp, Homo sapiens
cttcgactttgtcagcttcca

SEQ ID NO: 131458 - DNA, 23 bp, Homo sapiens
tgacagactgagaccctgtctct

SEQ ID NO: 131459 - DNA, 22 bp, Homo sapiens
atatatgtacgtatatatatgt

SEQ ID NO: 131460 - DNA, 22 bp, Homo sapiens
tcagtacttcgtcactgaacct

SEQ ID NO: 131461 - DNA, 23 bp, Homo sapiens
tggagtctcactctgtcacccag

SEQ ID NO: 131462 - DNA, 18 bp, Homo sapiens
ctcatggaattactgtga

SEQ ID NO: 131463 - DNA, 23 bp, Homo sapiens
atgtgtatatatatatgtgtgtg

SEQ ID NO: 131464 - DNA, 23 bp, Homo sapiens
tgtgtatagatatacatgtaagt

SEQ ID NO: 131465 - DNA, 23 bp, Homo sapiens
gtgtgtatatgtacatatcatgt

SEQ ID NO: 131466 - DNA, 23 bp, Homo sapiens
tgtgtataggtatatgtgtatag

SEQ ID NO: 131467 - DNA, 23 bp, Homo sapiens
gaggtttttgcttgttaattcca

SEQ ID NO: 131468 - DNA, 23 bp, Homo sapiens
catgtgcatatatatacatattt

SEQ ID NO: 131469 - DNA, 23 bp, Homo sapiens
cactgtgatttgtatttgtactt

SEQ ID NO: 131470 - DNA, 18 bp, Homo sapiens
tgccaaggcctaggcttc

SEQ ID NO: 131471 - DNA, 23 bp, Homo sapiens
agctcccacacagagtgctcact

SEQ ID NO: 131472 - DNA, 22 bp, Homo sapiens
agctgtgagaagagagtcacca

SEQ ID NO: 131473 - DNA, 21 bp, Homo sapiens
tacacacacacatatgtatat

SEQ ID NO: 131474 - DNA, 23 bp, Homo sapiens
gacagagtctcgctctgtcaccc

SEQ ID NO: 131475 - DNA, 22 bp, Homo sapiens
tatgtatatatgtatatatgta

SEQ ID NO: 131476 - DNA, 22 bp, Homo sapiens
tatatatatatgtatatgtgtg

SEQ ID NO: 131477 - DNA, 21 bp, Homo sapiens
tacacacacacatatacatat

SEQ ID NO: 131478 - DNA, 18 bp, Homo sapiens
ctcaagtctgtgtcctct

SEQ ID NO: 131479 - DNA, 23 bp, Homo sapiens
atataggtagaagttgaattgat

SEQ ID NO: 131480 - DNA, 20 bp, Homo sapiens
aggaacatagacagatactt

SEQ ID NO: 131481 - DNA, 21 bp, Homo sapiens
atggatgtgtgcatgtgcatg

SEQ ID NO: 131482 - DNA, 18 bp, Homo sapiens
aggcacggtgacttacgc

SEQ ID NO: 131483 - DNA, 23 bp, Homo sapiens
tggaaaagatctgtttgtgttag

SEQ ID NO: 131484 - DNA, 21 bp, Homo sapiens
tgtgtacatatacgtatgtat

SEQ ID NO: 131485 - DNA, 23 bp, Homo sapiens
tgtaaagtaaagaagcaccagca

SEQ ID NO: 131486 - DNA, 23 bp, Homo sapiens
tgagagtctgtgagtctgtattt

SEQ ID NO: 131487 - DNA, 23 bp, Homo sapiens
ttgaattcagtgaaggcagtgtg

SEQ ID NO: 131488 - DNA, 20 bp, Homo sapiens
tgtctcactctgtcaccctg

SEQ ID NO: 131489 - DNA, 23 bp, Homo sapiens
gctgaggtatgaggatcacttga

SEQ ID NO: 131490 - DNA, 19 bp, Homo sapiens
tagaaattaattgatttgc

SEQ ID NO: 131491 - DNA, 23 bp, Homo sapiens
tgagactctgagtggctcacatg

SEQ ID NO: 131492 - DNA, 23 bp, Homo sapiens
agacagggtctggctctgttgtc

SEQ ID NO: 131493 - DNA, 23 bp, Homo sapiens
gacagagtctcgctctgtcaccc

SEQ ID NO: 131494 - DNA, 19 bp, Homo sapiens
tggattatatatatgtgta

SEQ ID NO: 131495 - DNA, 21 bp, Homo sapiens
agagatggaggtttctagtgc

SEQ ID NO: 131496 - DNA, 23 bp, Homo sapiens
cggagtctcgctctgtctcccag

SEQ ID NO: 131497 - DNA, 18 bp, Homo sapiens
ctgcatgcttcttttcga

SEQ ID NO: 131498 - DNA, 19 bp, Homo sapiens
tatagagagagtcttcttg

SEQ ID NO: 131499 - DNA, 19 bp, Homo sapiens
tgtgtatatatatacacat

SEQ ID NO: 131500 - DNA, 18 bp, Homo sapiens
gtgtatatatatacacat

SEQ ID NO: 131501 - DNA, 23 bp, Homo sapiens
gagaaaacagtgaggaaattggc

SEQ ID NO: 131502 - DNA, 23 bp, Homo sapiens
atgagcctgtggttctgagttaa

SEQ ID NO: 131503 - DNA, 23 bp, Homo sapiens
aatgcttcatgaggtcataggag

SEQ ID NO: 131504 - DNA, 20 bp, Homo sapiens
gtgtggacagtaggcagtct

SEQ ID NO: 131505 - DNA, 22 bp, Homo sapiens
ttttactagtagattaattgtg

SEQ ID NO: 131506 - DNA, 19 bp, Homo sapiens
tttgagatggagttttgct

SEQ ID NO: 131507 - DNA, 22 bp, Homo sapiens
tatatatgcacagtttgtataa

SEQ ID NO: 131508 - DNA, 21 bp, Homo sapiens
attccactgtatcccacctca

SEQ ID NO: 131509 - DNA, 23 bp, Homo sapiens
agacaaggtctcactctgttgcc

SEQ ID NO: 131510 - DNA, 21 bp, Homo sapiens
tttaggatagaaaggaaagga

SEQ ID NO: 131511 - DNA, 23 bp, Homo sapiens
agacggagtctcgctctgtcacc

SEQ ID NO: 131512 - DNA, 19 bp, Homo sapiens
tggcatgatctcggctcag

SEQ ID NO: 131513 - DNA, 23 bp, Homo sapiens
cactgcctgagtgcctgagtgac

SEQ ID NO: 131514 - DNA, 23 bp, Homo sapiens
acaggtctcactctgtcacccag

SEQ ID NO: 131515 - DNA, 23 bp, Homo sapiens
gggagacacagacccactctcaa

SEQ ID NO: 131516 - DNA, 23 bp, Homo sapiens
aaggtctcactctgtcacccagg

SEQ ID NO: 131517 - DNA, 21 bp, Homo sapiens
agtatatatatagcatatgtt

SEQ ID NO: 131518 - DNA, 23 bp, Homo sapiens
agaacaaagatgggagtagtaat

SEQ ID NO: 131519 - DNA, 22 bp, Homo sapiens
aacagccactgtttttctggtg

SEQ ID NO: 131520 - DNA, 23 bp, Homo sapiens
gacagagtctcgctctgtcaccc

SEQ ID NO: 131521 - DNA, 23 bp, Homo sapiens
gggtcacactctgtcaccctggc

SEQ ID NO: 131522 - DNA, 23 bp, Homo sapiens
tggctcagacctgtaatgccagc

SEQ ID NO: 131523 - DNA, 23 bp, Homo sapiens
ctgtgggtctgtgtctgtgctct

SEQ ID NO: 131524 - DNA, 21 bp, Homo sapiens
acaatctgctactaacatcat

SEQ ID NO: 131525 - DNA, 19 bp, Homo sapiens
tcgttctaggtgcaggaga

SEQ ID NO: 131526 - DNA, 20 bp, Homo sapiens
agaagaatcatgaagaggga

SEQ ID NO: 131527 - DNA, 23 bp, Homo sapiens
gtatgtatgtacgtgtgtgtgtg

SEQ ID NO: 131528 - DNA, 23 bp, Homo sapiens
gtatctgtgtgcctgtgtgtgtg

SEQ ID NO: 131529 - DNA, 21 bp, Homo sapiens
agctctggaacttacatgcag

SEQ ID NO: 131530 - DNA, 22 bp, Homo sapiens
gaggagacagaaggaccaaggc

SEQ ID NO: 131531 - DNA, 18 bp, Homo sapiens
gactgatctcgaactcct

SEQ ID NO: 131532 - DNA, 23 bp, Homo sapiens
ttccctgaatttgtctttggaag

SEQ ID NO: 131533 - DNA, 23 bp, Homo sapiens
aatttcaagaggatgtgctggct

SEQ ID NO: 131534 - DNA, 23 bp, Homo sapiens
ctgtagctccttgtcttatggca

SEQ ID NO: 131535 - DNA, 21 bp, Homo sapiens
ataggtaaacatgtgtcacag

SEQ ID NO: 131536 - DNA, 23 bp, Homo sapiens
cactgaaaacagattctgttctt

SEQ ID NO: 131537 - DNA, 23 bp, Homo sapiens
tacacacacacacatatatgtgt

SEQ ID NO: 131538 - DNA, 23 bp, Homo sapiens
ttgtgtatatatatatgtgtgtg

SEQ ID NO: 131539 - DNA, 23 bp, Homo sapiens
tgcaactttactgaatttgttga

SEQ ID NO: 131540 - DNA, 22 bp, Homo sapiens
atataggttccatatatatata

SEQ ID NO: 131541 - DNA, 23 bp, Homo sapiens
atttactatacatagcacctgct

SEQ ID NO: 131542 - DNA, 20 bp, Homo sapiens
acagtggagcgatctcagct

SEQ ID NO: 131543 - DNA, 23 bp, Homo sapiens
ctgtgtctctctgacagtctcct

SEQ ID NO: 131544 - DNA, 23 bp, Homo sapiens
aagtgacagcagagactgagggc

SEQ ID NO: 131545 - DNA, 19 bp, Homo sapiens
tagaggaataagagcttat

SEQ ID NO: 131546 - DNA, 18 bp, Homo sapiens
aaaagaattgaaaagggc

SEQ ID NO: 131547 - DNA, 21 bp, Homo sapiens
atatgtcaggcagcaatgagg

SEQ ID NO: 131548 - DNA, 20 bp, Homo sapiens
gtatacagacagaaaggcct

SEQ ID NO: 131549 - DNA, 23 bp, Homo sapiens
agaagacagaaatgagtgtgcac

SEQ ID NO: 131550 - DNA, 23 bp, Homo sapiens
gggtcacatgtgcagcaacacat

SEQ ID NO: 131551 - DNA, 23 bp, Homo sapiens
aatttcttgtagaggtgaggtct

SEQ ID NO: 131552 - DNA, 23 bp, Homo sapiens
tttgtcactcactcattggtggt

SEQ ID NO: 131553 - DNA, 22 bp, Homo sapiens
tgtctcaccctgtctcccaggc

SEQ ID NO: 131554 - DNA, 23 bp, Homo sapiens
tgagttcattgtagattctggat

SEQ ID NO: 131555 - DNA, 23 bp, Homo sapiens
tgagttcattgtagattctggat

SEQ ID NO: 131556 - DNA, 23 bp, Homo sapiens
tcctctctcggtcactgactcat

SEQ ID NO: 131557 - DNA, 23 bp, Homo sapiens
ctgtggagacagtacctgtgctg

SEQ ID NO: 131558 - DNA, 21 bp, Homo sapiens
tcagatctcacagtgctcagt

SEQ ID NO: 131559 - DNA, 22 bp, Homo sapiens
tgtgagtgtggtatggctgtgt

SEQ ID NO: 131560 - DNA, 23 bp, Homo sapiens
aggcagagtcttgctctgtcacc

SEQ ID NO: 131561 - DNA, 23 bp, Homo sapiens
acctgggctttctctgtctctcc

SEQ ID NO: 131562 - DNA, 21 bp, Homo sapiens
agacacccagtaaaactggct

SEQ ID NO: 131563 - DNA, 23 bp, Homo sapiens
acttgtgactgtgactgtgtgtg

SEQ ID NO: 131564 - DNA, 20 bp, Homo sapiens
atgcctgtagtcccagctat

SEQ ID NO: 131565 - DNA, 23 bp, Homo sapiens
gaagttgaggctgcagtgagccg

SEQ ID NO: 131566 - DNA, 23 bp, Homo sapiens
ccctctgtgtgtgtctgtgtcct

SEQ ID NO: 131567 - DNA, 20 bp, Homo sapiens
agccatattccactgcatgg

SEQ ID NO: 131568 - DNA, 19 bp, Homo sapiens
acgcagggttgtttccagc

SEQ ID NO: 131569 - DNA, 23 bp, Homo sapiens
gagaagagagtgaggtcaggcac

SEQ ID NO: 131570 - DNA, 23 bp, Homo sapiens
gactctgtgttcaacatggtttg

SEQ ID NO: 131571 - DNA, 22 bp, Homo sapiens
attcagctctgagtccagtgcc

SEQ ID NO: 131572 - DNA, 22 bp, Homo sapiens
agagagggactagaaatgctta

SEQ ID NO: 131573 - DNA, 20 bp, Homo sapiens
tccgtgtgaagagaccacca

SEQ ID NO: 131574 - DNA, 21 bp, Homo sapiens
tcaggaaatatgtatataaga

SEQ ID NO: 131575 - DNA, 23 bp, Homo sapiens
actagtgtttttgaagttccagg

SEQ ID NO: 131576 - DNA, 23 bp, Homo sapiens
acaaagtgggaagagttttggaa

SEQ ID NO: 131577 - DNA, 23 bp, Homo sapiens
acactgtgatcagtcagggctgt

SEQ ID NO: 131578 - DNA, 22 bp, Homo sapiens
agtagtgggattgctggatcaa

SEQ ID NO: 131579 - DNA, 22 bp, Homo sapiens
attgactgagtgcctttttttt

SEQ ID NO: 131580 - DNA, 23 bp, Homo sapiens
tggagtctcggtctgtctcccag

SEQ ID NO: 131581 - DNA, 22 bp, Homo sapiens
acactggctcactctttcctgg

SEQ ID NO: 131582 - DNA, 21 bp, Homo sapiens
acatgtgcacaatgtgcaggt

SEQ ID NO: 131583 - DNA, 19 bp, Homo sapiens
tatcatgtacataacatta

SEQ ID NO: 131584 - DNA, 23 bp, Homo sapiens
tttcttcttatgctttgctgtat

SEQ ID NO: 131585 - DNA, 23 bp, Homo sapiens
ggactcagtctgtcactgaggct

SEQ ID NO: 131586 - DNA, 22 bp, Homo sapiens
tattggcctgaaaatgcagtgt

SEQ ID NO: 131587 - DNA, 23 bp, Homo sapiens
atgaacatgagtttgattcctga

SEQ ID NO: 131588 - DNA, 23 bp, Homo sapiens
gcctgtcactttgagagatagtg

SEQ ID NO: 131589 - DNA, 20 bp, Homo sapiens
agaacatggtgagagaaaca

SEQ ID NO: 131590 - DNA, 23 bp, Homo sapiens
tgtggttgaaggttcttcttagg

SEQ ID NO: 131591 - DNA, 23 bp, Homo sapiens
tcaatgtgcattttctacaagat

SEQ ID NO: 131592 - DNA, 18 bp, Homo sapiens
atgtatgtatatatgtat

SEQ ID NO: 131593 - DNA, 23 bp, Homo sapiens
atagatgtgcttgtactagtgtt

SEQ ID NO: 131594 - DNA, 22 bp, Homo sapiens
gaaagtcagtggcagcttgatg

SEQ ID NO: 131595 - DNA, 23 bp, Homo sapiens
tgtctgacaggttctgtgggtca

SEQ ID NO: 131596 - DNA, 19 bp, Homo sapiens
tgctcctgcctgtgctccc

SEQ ID NO: 131597 - DNA, 23 bp, Homo sapiens
ctgcctctctgagcctctgtcac

SEQ ID NO: 131598 - DNA, 21 bp, Homo sapiens
tctcactctgacacccaggct

SEQ ID NO: 131599 - DNA, 21 bp, Homo sapiens
tagagactttgggagtgatat

SEQ ID NO: 131600 - DNA, 23 bp, Homo sapiens
tgtgtgtacatgcagtgatgcca

SEQ ID NO: 131601 - DNA, 21 bp, Homo sapiens
atatatacacatatactacat

SEQ ID NO: 131602 - DNA, 22 bp, Homo sapiens
acacacatatatatggtatgtg

SEQ ID NO: 131603 - DNA, 23 bp, Homo sapiens
tgtatatgtgtgtgcataggtcc

SEQ ID NO: 131604 - DNA, 23 bp, Homo sapiens
tcacctatacatcatgtatgtat

SEQ ID NO: 131605 - DNA, 23 bp, Homo sapiens
tatatataggtatctatatatat

SEQ ID NO: 131606 - DNA, 23 bp, Homo sapiens
cagagtctcactgtgtctccaga

SEQ ID NO: 131607 - DNA, 23 bp, Homo sapiens
tgagtctcactctgtcactcagg

SEQ ID NO: 131608 - DNA, 22 bp, Homo sapiens
atgtatgtatatatgtatgtgt

SEQ ID NO: 131609 - DNA, 22 bp, Homo sapiens
tatggctaggaacttagtgtgt

SEQ ID NO: 131610 - DNA, 23 bp, Homo sapiens
gtaaatctgctttgtttggaggt

SEQ ID NO: 131611 - DNA, 23 bp, Homo sapiens
taattctctttggtaatggatag

SEQ ID NO: 131612 - DNA, 23 bp, Homo sapiens
ccctctgtgtgtgtctctgtcca

SEQ ID NO: 131613 - DNA, 22 bp, Homo sapiens
tctgtgtgggtctctttctggt

SEQ ID NO: 131614 - DNA, 22 bp, Homo sapiens
ggctgagattttataaagtgtt

SEQ ID NO: 131615 - DNA, 22 bp, Homo sapiens
atcatggtcattctctgtctca

SEQ ID NO: 131616 - DNA, 23 bp, Homo sapiens
gcatgtatatgtatgtgtgtgtg

SEQ ID NO: 131617 - DNA, 23 bp, Homo sapiens
gcatgtatatgtatgtgtgtgtg

SEQ ID NO: 131618 - DNA, 23 bp, Homo sapiens
tatgtgtatatatatgtatgtat

SEQ ID NO: 131619 - DNA, 23 bp, Homo sapiens
acacagtcagtctctgtctcttc

SEQ ID NO: 131620 - DNA, 23 bp, Homo sapiens
gaatagctggtagaaagtattga

SEQ ID NO: 131621 - DNA, 23 bp, Homo sapiens
gtatgtatgtatgtatatatgtg

SEQ ID NO: 131622 - DNA, 23 bp, Homo sapiens
catgactcactgcagtctcagcc

SEQ ID NO: 131623 - DNA, 23 bp, Homo sapiens
tgtctccatatgtgtgtctgtgt

SEQ ID NO: 131624 - DNA, 23 bp, Homo sapiens
tttctgtgtctgcatgtgcacac

SEQ ID NO: 131625 - DNA, 23 bp, Homo sapiens
gtgtgcgtgtgtttctgcatgta

SEQ ID NO: 131626 - DNA, 20 bp, Homo sapiens
cacttgactgcctctctggg

SEQ ID NO: 131627 - DNA, 21 bp, Homo sapiens
tatatacgtatatatacgtat

SEQ ID NO: 131628 - DNA, 23 bp, Homo sapiens
gatggagtctcactctgtcaccc

SEQ ID NO: 131629 - DNA, 22 bp, Homo sapiens
agacagggtctcactgtgtctc

SEQ ID NO: 131630 - DNA, 23 bp, Homo sapiens
tgacagagagcagacacgggaca

SEQ ID NO: 131631 - DNA, 20 bp, Homo sapiens
gggactctctctctctcccc

SEQ ID NO: 131632 - DNA, 19 bp, Homo sapiens
atatatatagctatagttg

SEQ ID NO: 131633 - DNA, 23 bp, Homo sapiens
accctctgactgtcacacatccc

SEQ ID NO: 131634 - DNA, 23 bp, Homo sapiens
tttttttgaggtggagtctcact

SEQ ID NO: 131635 - DNA, 23 bp, Homo sapiens
catatgtatatatgtatatgtgt

SEQ ID NO: 131636 - DNA, 22 bp, Homo sapiens
gtacatatctatgcatatatgt

SEQ ID NO: 131637 - DNA, 21 bp, Homo sapiens
tatgtgcatatgtatatgtgt

SEQ ID NO: 131638 - DNA, 23 bp, Homo sapiens
atgtgtatacatgcatgtgtatg

SEQ ID NO: 131639 - DNA, 23 bp, Homo sapiens
tatgtgtatatgtatgtgtatgt

SEQ ID NO: 131640 - DNA, 20 bp, Homo sapiens
taagtatgtatatgtatagt

SEQ ID NO: 131641 - DNA, 20 bp, Homo sapiens
tagtctatatatgtatatgt

SEQ ID NO: 131642 - DNA, 21 bp, Homo sapiens
tgtgtgtatatgtatatgtgt

SEQ ID NO: 131643 - DNA, 22 bp, Homo sapiens
atatgtgtatatgtatatgtgt

SEQ ID NO: 131644 - DNA, 23 bp, Homo sapiens
tttttgagatggagtctcactct

SEQ ID NO: 131645 - DNA, 23 bp, Homo sapiens
cctgtctgtctctgtgaccggaa

SEQ ID NO: 131646 - DNA, 20 bp, Homo sapiens
cagacagcagatggtggggc

SEQ ID NO: 131647 - DNA, 23 bp, Homo sapiens
tctcagcctctgtgattctgtga

SEQ ID NO: 131648 - DNA, 21 bp, Homo sapiens
tcccactctcacttcctgggt

SEQ ID NO: 131649 - DNA, 23 bp, Homo sapiens
tcttgggcctctctctctctctg

SEQ ID NO: 131650 - DNA, 23 bp, Homo sapiens
tctcactcactcagtgctcagtg

SEQ ID NO: 131651 - DNA, 23 bp, Homo sapiens
ttttgagacagagtctcactctg

SEQ ID NO: 131652 - DNA, 23 bp, Homo sapiens
tcaggcactcggtgtctgtgtct

SEQ ID NO: 131653 - DNA, 23 bp, Homo sapiens
tcagtctctgcctctgtcatcac

SEQ ID NO: 131654 - DNA, 23 bp, Homo sapiens
gggctaacagtgagacactctcc

SEQ ID NO: 131655 - DNA, 23 bp, Homo sapiens
cagagtctcactctgtcatttag

SEQ ID NO: 131656 - DNA, 23 bp, Homo sapiens
tgggtccctctctgcctccctca

SEQ ID NO: 131657 - DNA, 23 bp, Homo sapiens
tgtccctctcagggtcagtggtg

SEQ ID NO: 131658 - DNA, 23 bp, Homo sapiens
tgtccgtgtgtctgtccctccca

SEQ ID NO: 131659 - DNA, 23 bp, Homo sapiens
cctctgtgtctctgtatctctga

SEQ ID NO: 131660 - DNA, 19 bp, Homo sapiens
tcactgcaacctctgtctc

SEQ ID NO: 131661 - DNA, 23 bp, Homo sapiens
agtgtgaggcagggttgagaggc

SEQ ID NO: 131662 - DNA, 22 bp, Homo sapiens
taggacgattacaaatcagagt

SEQ ID NO: 131663 - DNA, 23 bp, Homo sapiens
gtgaatgtgtatgtgcatgtgga

SEQ ID NO: 131664 - DNA, 23 bp, Homo sapiens
tatgtgaccatgtgcatgtatgc

SEQ ID NO: 131665 - DNA, 18 bp, Homo sapiens
gcgtatgtgtgtctctgt

SEQ ID NO: 131666 - DNA, 23 bp, Homo sapiens
tttctcagtccctctgtggctgg

SEQ ID NO: 131667 - DNA, 23 bp, Homo sapiens
tctctctctctctctccatgtgt

SEQ ID NO: 131668 - DNA, 19 bp, Homo sapiens
gatggaactgtgcttggct

SEQ ID NO: 131669 - DNA, 23 bp, Homo sapiens
tgagttcattgtagattctggat

SEQ ID NO: 131670 - DNA, 23 bp, Homo sapiens
tgaggtaggaggatcacttgagc

SEQ ID NO: 131671 - DNA, 23 bp, Homo sapiens
caactaagtgattatgttgatgt

SEQ ID NO: 131672 - DNA, 23 bp, Homo sapiens
tgagttcattgtagattctggat

SEQ ID NO: 131673 - DNA, 23 bp, Homo sapiens
tgagttcattgtagattctggat

SEQ ID NO: 131674 - DNA, 23 bp, Homo sapiens
tgtgtccctgtctgtgtggcggt

SEQ ID NO: 131675 - DNA, 23 bp, Homo sapiens
tggagtctcactctgtcacccag

SEQ ID NO: 131676 - DNA, 23 bp, Homo sapiens
tgagttcattgtagattctggat

SEQ ID NO: 131677 - DNA, 23 bp, Homo sapiens
tgagttcattgtagattctggat

SEQ ID NO: 131678 - DNA, 19 bp, Homo sapiens
aaatgctaggattacaggc

SEQ ID NO: 131679 - DNA, 23 bp, Homo sapiens
gggtctcactctgtcacccaggc

SEQ ID NO: 131680 - DNA, 19 bp, Homo sapiens
tgagtagctgggactacag

SEQ ID NO: 131681 - DNA, 22 bp, Homo sapiens
atatgtgtatatgtatataagt

SEQ ID NO: 131682 - DNA, 22 bp, Homo sapiens
atatacgtgtatatacgtgtat

SEQ ID NO: 131683 - DNA, 23 bp, Homo sapiens
ggtgtgtctgtgtgactgcctcc

SEQ ID NO: 131684 - DNA, 19 bp, Homo sapiens
tgtagacacatatgcatac

SEQ ID NO: 131685 - DNA, 23 bp, Homo sapiens
ctcactctgtcacccaggctgtc

SEQ ID NO: 131686 - DNA, 19 bp, Homo sapiens
aagtgctgggattacaggc

SEQ ID NO: 131687 - DNA, 22 bp, Homo sapiens
cagtcactgtctctttgatgtt

SEQ ID NO: 131688 - DNA, 23 bp, Homo sapiens
tcattgacggagactttcagtta

SEQ ID NO: 131689 - DNA, 22 bp, Homo sapiens
gtgcctcagtctgccactctgt

SEQ ID NO: 131690 - DNA, 23 bp, Homo sapiens
gacagagtctcgctctgtcaccc

SEQ ID NO: 131691 - DNA, 23 bp, Homo sapiens
gagatggagtctcactctgtcac

SEQ ID NO: 131692 - DNA, 23 bp, Homo sapiens
gtgagtctcgctgtgtcactcag

SEQ ID NO: 131693 - DNA, 20 bp, Homo sapiens
tacgtgtatatattcacgta

SEQ ID NO: 131694 - DNA, 20 bp, Homo sapiens
attcgtatatatacgtgtat

SEQ ID NO: 131695 - DNA, 23 bp, Homo sapiens
ggagtgtctctctgtcgctcagg

SEQ ID NO: 131696 - DNA, 21 bp, Homo sapiens
aaagtgctgggattgcaatat

SEQ ID NO: 131697 - DNA, 21 bp, Homo sapiens
atgtatacatatttgtatgtg

SEQ ID NO: 131698 - DNA, 23 bp, Homo sapiens
agacactgtctccctctgtcacc

SEQ ID NO: 131699 - DNA, 20 bp, Homo sapiens
attggtgtcatctgagcact

SEQ ID NO: 131700 - DNA, 23 bp, Homo sapiens
tggagtctcactctgtcacccag

SEQ ID NO: 131701 - DNA, 23 bp, Homo sapiens
agagagagtctcgcactgtcacc

SEQ ID NO: 131702 - DNA, 23 bp, Homo sapiens
tttttttttgagacggtctcact

SEQ ID NO: 131703 - DNA, 23 bp, Homo sapiens
gagtctcgctctgtcactcaggc

SEQ ID NO: 131704 - DNA, 23 bp, Homo sapiens
gtcagacttcatggtgtatgcct

SEQ ID NO: 131705 - DNA, 21 bp, Homo sapiens
acagtgggacaagattgacat

SEQ ID NO: 131706 - DNA, 22 bp, Homo sapiens
tgagatgaagtctcgctctgtt

SEQ ID NO: 131707 - DNA, 20 bp, Homo sapiens
tttgagacggagttttgctc

SEQ ID NO: 131708 - DNA, 23 bp, Homo sapiens
agtccattaaacctctttttctt

SEQ ID NO: 131709 - DNA, 22 bp, Homo sapiens
ttagcagagtgagaatggacta

SEQ ID NO: 131710 - DNA, 23 bp, Homo sapiens
tcaaatggtgatctagttccatt

SEQ ID NO: 131711 - DNA, 22 bp, Homo sapiens
tatatgttacataatatatgta

SEQ ID NO: 131712 - DNA, 20 bp, Homo sapiens
tataacaggtatatataatg

SEQ ID NO: 131713 - DNA, 23 bp, Homo sapiens
agggtctcactctgtcacccagg

SEQ ID NO: 131714 - DNA, 19 bp, Homo sapiens
agtgacgacatgatggctt

SEQ ID NO: 131715 - DNA, 20 bp, Homo sapiens
tcactgcagagactgagttc

SEQ ID NO: 131716 - DNA, 22 bp, Homo sapiens
aataagtgtaaacattctgtcg

SEQ ID NO: 131717 - DNA, 23 bp, Homo sapiens
tgagttcattgtagattctggat

SEQ ID NO: 131718 - DNA, 23 bp, Homo sapiens
tgagttcattgtagattctggat

SEQ ID NO: 131719 - DNA, 20 bp, Homo sapiens
gacagggtctcactctgtca

SEQ ID NO: 131720 - DNA, 23 bp, Homo sapiens
cattcagagatgtgtttgagcag

SEQ ID NO: 131721 - DNA, 20 bp, Homo sapiens
tgaatgtatgtatatatgtg

SEQ ID NO: 131722 - DNA, 21 bp, Homo sapiens
tgtatatacatgtacatgcat

SEQ ID NO: 131723 - DNA, 23 bp, Homo sapiens
gttctttctgcttaggattgtct

SEQ ID NO: 131724 - DNA, 21 bp, Homo sapiens
ttcagtgccatggatatcaca

SEQ ID NO: 131725 - DNA, 23 bp, Homo sapiens
agcctccctcagtgcgtcccacc

SEQ ID NO: 131726 - DNA, 23 bp, Homo sapiens
tgagagacatgtgactgtgctga

SEQ ID NO: 131727 - DNA, 19 bp, Homo sapiens
ttaaaacttgcatggcaga

SEQ ID NO: 131728 - DNA, 23 bp, Homo sapiens
ctctctctgggtctgagtaatct

SEQ ID NO: 131729 - DNA, 22 bp, Homo sapiens
atacgtgtatatatatatgtgt

SEQ ID NO: 131730 - DNA, 23 bp, Homo sapiens
gaaatgtcactgcacttgctgtc

SEQ ID NO: 131731 - DNA, 23 bp, Homo sapiens
acagttgtgatgatgatgatgac

SEQ ID NO: 131732 - DNA, 22 bp, Homo sapiens
tgtcagttcaaatctctgtgta

SEQ ID NO: 131733 - DNA, 19 bp, Homo sapiens
tgtgtgtgtgtgtataaac

SEQ ID NO: 131734 - DNA, 21 bp, Homo sapiens
agagggagggaaagaagttcc

SEQ ID NO: 131735 - DNA, 23 bp, Homo sapiens
tcattggtattatgatagggatt

SEQ ID NO: 131736 - DNA, 23 bp, Homo sapiens
gacagagtctcgctctgtcaccc

SEQ ID NO: 131737 - DNA, 23 bp, Homo sapiens
gtagtctcactctgtcactcagg

SEQ ID NO: 131738 - DNA, 22 bp, Homo sapiens
tgtgtgggtgtctatgccagtg

SEQ ID NO: 131739 - DNA, 18 bp, Homo sapiens
cctcacttcagttgctct

SEQ ID NO: 131740 - DNA, 18 bp, Homo sapiens
tgtacatatgtatatatg

SEQ ID NO: 131741 - DNA, 23 bp, Homo sapiens
tatgtatatatgtatatgtgtac

SEQ ID NO: 131742 - DNA, 20 bp, Homo sapiens
tatgtgtgtatatatacatg

SEQ ID NO: 131743 - DNA, 23 bp, Homo sapiens
tgagttcattgtagattctggat

SEQ ID NO: 131744 - DNA, 23 bp, Homo sapiens
tgagttcattgtagattctggat

SEQ ID NO: 131745 - DNA, 23 bp, Homo sapiens
aatacacacaaacctgtattgtg

SEQ ID NO: 131746 - DNA, 22 bp, Homo sapiens
agggaattctgctcattgtggt

SEQ ID NO: 131747 - DNA, 19 bp, Homo sapiens
gagagatgagtgccagcag

SEQ ID NO: 131748 - DNA, 21 bp, Homo sapiens
tcagatcgtgtgagactcact

SEQ ID NO: 131749 - DNA, 23 bp, Homo sapiens
aagtgtatatatgtatatatgta

SEQ ID NO: 131750 - DNA, 20 bp, Homo sapiens
ataagtacttatatatgtgt

SEQ ID NO: 131751 - DNA, 23 bp, Homo sapiens
tgagttcattgtagattctggat

SEQ ID NO: 131752 - DNA, 23 bp, Homo sapiens
tgagttcattgtagattctggat

SEQ ID NO: 131753 - DNA, 23 bp, Homo sapiens
acaagtattgttttcatctatgc

SEQ ID NO: 131754 - DNA, 18 bp, Homo sapiens
tatatgtattccatatgt

SEQ ID NO: 131755 - DNA, 20 bp, Homo sapiens
agagaacataacatgaacat

SEQ ID NO: 131756 - DNA, 23 bp, Homo sapiens
gacagagtctcgctcagtcactc

SEQ ID NO: 131757 - DNA, 22 bp, Homo sapiens
aacagtactgagtttgcttttc

SEQ ID NO: 131758 - DNA, 20 bp, Homo sapiens
agaaatgcaaattctcactc

SEQ ID NO: 131759 - DNA, 23 bp, Homo sapiens
ttggatctctgagcttttatctg

SEQ ID NO: 131760 - DNA, 19 bp, Homo sapiens
taactgtggcaaactaggt

SEQ ID NO: 131761 - DNA, 20 bp, Homo sapiens
atttcagattgaaaatctat

SEQ ID NO: 131762 - DNA, 23 bp, Homo sapiens
aatctcagagtctgtgtcagtcc

SEQ ID NO: 131763 - DNA, 19 bp, Homo sapiens
agagctgaacccactgctg

SEQ ID NO: 131764 - DNA, 18 bp, Homo sapiens
atttcaggctggattcct

SEQ ID NO: 131765 - DNA, 23 bp, Homo sapiens
gtgtttagtgattttcatgtgct

SEQ ID NO: 131766 - DNA, 23 bp, Homo sapiens
tgagctactctctgactctgaca

SEQ ID NO: 131767 - DNA, 22 bp, Homo sapiens
tatgtatgtatgtgtgtgtata

SEQ ID NO: 131768 - DNA, 22 bp, Homo sapiens
taatccaagtatatatatgcat

SEQ ID NO: 131769 - DNA, 23 bp, Homo sapiens
tgtgtatgtgtgttcatgtatgt

SEQ ID NO: 131770 - DNA, 23 bp, Homo sapiens
acttcagtgaaggaagtcaccac

SEQ ID NO: 131771 - DNA, 23 bp, Homo sapiens
attgtgtctgcttctctagtggg

SEQ ID NO: 131772 - DNA, 20 bp, Homo sapiens
atagattcacttatagaaca

SEQ ID NO: 131773 - DNA, 23 bp, Homo sapiens
atatgtgtgtgttatgtgtatgt

SEQ ID NO: 131774 - DNA, 23 bp, Homo sapiens
taatatgtgtggatggagagaga

SEQ ID NO: 131775 - DNA, 21 bp, Homo sapiens
tttaaaagaagtcgttcagct

SEQ ID NO: 131776 - DNA, 23 bp, Homo sapiens
tgagttcattgtagattctggat

SEQ ID NO: 131777 - DNA, 23 bp, Homo sapiens
tgagttcattgtagattctggat

SEQ ID NO: 131778 - DNA, 23 bp, Homo sapiens
tgacaaggatatgtaatgttatt

SEQ ID NO: 131779 - DNA, 21 bp, Homo sapiens
ttcagaaggtctcagataagt

SEQ ID NO: 131780 - DNA, 23 bp, Homo sapiens
gctcactgtgtctgtccctgcca

SEQ ID NO: 131781 - DNA, 23 bp, Homo sapiens
atgagtgtgtatgtatatgtata

SEQ ID NO: 131782 - DNA, 20 bp, Homo sapiens
aaatgtgcaaatacaaatat

SEQ ID NO: 131783 - DNA, 23 bp, Homo sapiens
agacggagtctcactctgtcgct

SEQ ID NO: 131784 - DNA, 23 bp, Homo sapiens
aggaggtttcaccaagtgggcca

SEQ ID NO: 131785 - DNA, 21 bp, Homo sapiens
gtttggacaatttaggtgaaa

SEQ ID NO: 131786 - DNA, 22 bp, Homo sapiens
atacactgtatgtatgtgtata

SEQ ID NO: 131787 - DNA, 19 bp, Homo sapiens
atacacatatatacatgtg

SEQ ID NO: 131788 - DNA, 23 bp, Homo sapiens
acatgtatatatgtgtatgtgtg

SEQ ID NO: 131789 - DNA, 23 bp, Homo sapiens
attaagcatgtttttgagatcta

SEQ ID NO: 131790 - DNA, 23 bp, Homo sapiens
tgagttcattgtagattctggat

SEQ ID NO: 131791 - DNA, 23 bp, Homo sapiens
tgagttcattgtagattctggat

SEQ ID NO: 131792 - DNA, 23 bp, Homo sapiens
gaatctctgtgcttcgaatgtga

SEQ ID NO: 131793 - DNA, 23 bp, Homo sapiens
ccaacactgtgcaaaggctcccg

SEQ ID NO: 131794 - DNA, 23 bp, Homo sapiens
aactgtggatatgttatcagagt

SEQ ID NO: 131795 - DNA, 19 bp, Homo sapiens
aatatttttagtgtagctt

SEQ ID NO: 131796 - DNA, 20 bp, Homo sapiens
tactatgttgaatagaagtg

SEQ ID NO: 131797 - DNA, 18 bp, Homo sapiens
ggaagttgaagtacacat

SEQ ID NO: 131798 - DNA, 23 bp, Homo sapiens
tatgtgtatatatgtatatgtgt

SEQ ID NO: 131799 - DNA, 20 bp, Homo sapiens
tgtatatgtgtatatgtgtg

SEQ ID NO: 131800 - DNA, 23 bp, Homo sapiens
acatatgtgtatatgtatatatg

SEQ ID NO: 131801 - DNA, 20 bp, Homo sapiens
tctccaatcattttgtcctg

SEQ ID NO: 131802 - DNA, 23 bp, Homo sapiens
tagagacagaagacagataggtc

SEQ ID NO: 131803 - DNA, 23 bp, Homo sapiens
tgagttcattgtagattctggat

SEQ ID NO: 131804 - DNA, 23 bp, Homo sapiens
tgagttcattgtagattctggat

SEQ ID NO: 131805 - DNA, 23 bp, Homo sapiens
tgagttcattgtagattctggat

SEQ ID NO: 131806 - DNA, 23 bp, Homo sapiens
tgagttcattgtagattctggat

SEQ ID NO: 131807 - DNA, 19 bp, Homo sapiens
ttcttatagtagctgaaag

SEQ ID NO: 131808 - DNA, 23 bp, Homo sapiens
tgctgattagatgatgcagaaga

SEQ ID NO: 131809 - DNA, 22 bp, Homo sapiens
tgacaagacaccgtggacacgt

SEQ ID NO: 131810 - DNA, 23 bp, Homo sapiens
tgtgcttctgtgtggatggggat

SEQ ID NO: 131811 - DNA, 23 bp, Homo sapiens
tctctctttcacacagtggccag

SEQ ID NO: 131812 - DNA, 21 bp, Homo sapiens
tgttgttcactatgaggagta

SEQ ID NO: 131813 - DNA, 23 bp, Homo sapiens
atctagtagagatgtatttttct

SEQ ID NO: 131814 - DNA, 18 bp, Homo sapiens
ggggattgtagtatgggg

SEQ ID NO: 131815 - DNA, 23 bp, Homo sapiens
ttttttggttccatatgaaattt

SEQ ID NO: 131816 - DNA, 21 bp, Homo sapiens
aggcactgacacaggaatagg

SEQ ID NO: 131817 - DNA, 23 bp, Homo sapiens
aagatctcctggctcactatgct

SEQ ID NO: 131818 - DNA, 23 bp, Homo sapiens
tggagaagagtttttgttgttta

SEQ ID NO: 131819 - DNA, 23 bp, Homo sapiens
ttttctagttcctgaagggttag

SEQ ID NO: 131820 - DNA, 21 bp, Homo sapiens
actattcagggtcttctgtga

SEQ ID NO: 131821 - DNA, 23 bp, Homo sapiens
ttctgtcagtgattagccactgt

SEQ ID NO: 131822 - DNA, 22 bp, Homo sapiens
acacacagacagctaagcttgt

SEQ ID NO: 131823 - DNA, 20 bp, Homo sapiens
attgaaagaagtggctggtt

SEQ ID NO: 131824 - DNA, 20 bp, Homo sapiens
tgattcaggagagtgagcac

SEQ ID NO: 131825 - DNA, 23 bp, Homo sapiens
atgtcaggatggctctgtccctc

SEQ ID NO: 131826 - DNA, 23 bp, Homo sapiens
agaacattctagacagagagcag

SEQ ID NO: 131827 - DNA, 23 bp, Homo sapiens
tcgctgggtcagtgtttgcctct

SEQ ID NO: 131828 - DNA, 23 bp, Homo sapiens
ataaagtaggtgcttagaaacca

SEQ ID NO: 131829 - DNA, 22 bp, Homo sapiens
gtcaatgagcatctgcatgtgt

SEQ ID NO: 131830 - DNA, 23 bp, Homo sapiens
tattgagattttctagatgaagc

SEQ ID NO: 131831 - DNA, 23 bp, Homo sapiens
agggagtctcactgtgtcgctca

SEQ ID NO: 131832 - DNA, 20 bp, Homo sapiens
ggcaagactctgtctaaaat

SEQ ID NO: 131833 - DNA, 19 bp, Homo sapiens
taggcagagtctcgctctg

SEQ ID NO: 131834 - DNA, 23 bp, Homo sapiens
agactgtctctctatggatttgc

SEQ ID NO: 131835 - DNA, 23 bp, Homo sapiens
tttactgtctcaaaggtgtggct

SEQ ID NO: 131836 - DNA, 23 bp, Homo sapiens
aagaatgcatccttcagccattg

SEQ ID NO: 131837 - DNA, 23 bp, Homo sapiens
tgtgctttgtttttcagatggga

SEQ ID NO: 131838 - DNA, 23 bp, Homo sapiens
agggttgcttgagtgcaggagtc

SEQ ID NO: 131839 - DNA, 23 bp, Homo sapiens
cagtctcactctgtctgcactcc

SEQ ID NO: 131840 - DNA, 18 bp, Homo sapiens
cagtggcatgatcttggc

SEQ ID NO: 131841 - DNA, 23 bp, Homo sapiens
tgagttcattgtagattctggat

SEQ ID NO: 131842 - DNA, 23 bp, Homo sapiens
tgagttcattgtagattctggat

SEQ ID NO: 131843 - DNA, 19 bp, Homo sapiens
agtgagcctagattgcacc

SEQ ID NO: 131844 - DNA, 23 bp, Homo sapiens
atgaattagcagcacttgcaatg

SEQ ID NO: 131845 - DNA, 23 bp, Homo sapiens
tgagttcattgtagattctggat

SEQ ID NO: 131846 - DNA, 23 bp, Homo sapiens
tgagttcattgtagattctggat

SEQ ID NO: 131847 - DNA, 23 bp, Homo sapiens
atgccagttcaaagagtcctcct

SEQ ID NO: 131848 - DNA, 22 bp, Homo sapiens
aggagacagttttgggaagaca

SEQ ID NO: 131849 - DNA, 22 bp, Homo sapiens
tcacccactgactttctgctgt

SEQ ID NO: 131850 - DNA, 23 bp, Homo sapiens
tgagagttgtctgtgtgtctggc

SEQ ID NO: 131851 - DNA, 23 bp, Homo sapiens
tgagttcattgtagattctggat

SEQ ID NO: 131852 - DNA, 23 bp, Homo sapiens
tgagttcattgtagattctggat

SEQ ID NO: 131853 - DNA, 23 bp, Homo sapiens
tgagttcattgtagattctggat

SEQ ID NO: 131854 - DNA, 23 bp, Homo sapiens
tgagttcattgtagattctggat

SEQ ID NO: 131855 - DNA, 23 bp, Homo sapiens
tttgtgtgtgcatatatatacat

SEQ ID NO: 131856 - DNA, 22 bp, Homo sapiens
acttgaggtagaaactttaatt

SEQ ID NO: 131857 - DNA, 23 bp, Homo sapiens
gactgagttcagtgtctgtgagc

SEQ ID NO: 131858 - DNA, 20 bp, Homo sapiens
agagtactcagcagcaaaca

SEQ ID NO: 131859 - DNA, 23 bp, Homo sapiens
cctgggtgacagagacagactct

SEQ ID NO: 131860 - DNA, 23 bp, Homo sapiens
gagagagtctcactctgtcaccc

SEQ ID NO: 131861 - DNA, 23 bp, Homo sapiens
gacagagtctcgctctgtctccc

SEQ ID NO: 131862 - DNA, 22 bp, Homo sapiens
tgatagggttttaaaactgcaa

SEQ ID NO: 131863 - DNA, 23 bp, Homo sapiens
tgtctatcagcatctgatatcat

SEQ ID NO: 131864 - DNA, 23 bp, Homo sapiens
atgaatgagtgagtgaatggtct

SEQ ID NO: 131865 - DNA, 21 bp, Homo sapiens
cagtgtatttctctctcatat

SEQ ID NO: 131866 - DNA, 22 bp, Homo sapiens
atacagtggttctactatgtca

SEQ ID NO: 131867 - DNA, 23 bp, Homo sapiens
agaaattgagtagacccaaggaa

SEQ ID NO: 131868 - DNA, 23 bp, Homo sapiens
gggtcaattagattctgcttgtt

SEQ ID NO: 131869 - DNA, 23 bp, Homo sapiens
tggagtctcactctgtctcccag

SEQ ID NO: 131870 - DNA, 23 bp, Homo sapiens
aagttggtgtgcacctgcagtct

SEQ ID NO: 131871 - DNA, 21 bp, Homo sapiens
tgaggtgggaggatgacttga

SEQ ID NO: 131872 - DNA, 23 bp, Homo sapiens
tataaatggaattgttttccttt

SEQ ID NO: 131873 - DNA, 21 bp, Homo sapiens
caggtggtttctgagtctcaa

SEQ ID NO: 131874 - DNA, 23 bp, Homo sapiens
ttatgagttctaagattcctgga

SEQ ID NO: 131875 - DNA, 23 bp, Homo sapiens
caaggtctcactctgtcacccag

SEQ ID NO: 131876 - DNA, 22 bp, Homo sapiens
gtacatatgtatacgtacatgt

SEQ ID NO: 131877 - DNA, 22 bp, Homo sapiens
tccaagagaaatgttttctatg

SEQ ID NO: 131878 - DNA, 18 bp, Homo sapiens
tatgcatatatatgtata

SEQ ID NO: 131879 - DNA, 23 bp, Homo sapiens
acaagttctcgctctgtcactca

SEQ ID NO: 131880 - DNA, 21 bp, Homo sapiens
ctacacggagtgctgtgtttc

SEQ ID NO: 131881 - DNA, 23 bp, Homo sapiens
acaggatgagaattgacaaaggg

SEQ ID NO: 131882 - DNA, 23 bp, Homo sapiens
taggaggtcactcagtgtcagtg

SEQ ID NO: 131883 - DNA, 23 bp, Homo sapiens
tgaggagtgtttttgttcataac

SEQ ID NO: 131884 - DNA, 22 bp, Homo sapiens
tgatatgtggaaactgatttct

SEQ ID NO: 131885 - DNA, 20 bp, Homo sapiens
ataccatatatatagagaga

SEQ ID NO: 131886 - DNA, 23 bp, Homo sapiens
acatatgtacattggattatgtg

SEQ ID NO: 131887 - DNA, 20 bp, Homo sapiens
aggcactgcacgttgtgtga

SEQ ID NO: 131888 - DNA, 20 bp, Homo sapiens
tctcgcactgtcactcaggc

SEQ ID NO: 131889 - DNA, 23 bp, Homo sapiens
gggtctcactctgtcactcaggc

SEQ ID NO: 131890 - DNA, 23 bp, Homo sapiens
tctctctgggtctgacacgccct

SEQ ID NO: 131891 - DNA, 23 bp, Homo sapiens
acagagtctcactctgtcgccca

SEQ ID NO: 131892 - DNA, 23 bp, Homo sapiens
tgagttcattgtagattctggat

SEQ ID NO: 131893 - DNA, 23 bp, Homo sapiens
tgagttcattgtagattctggat

SEQ ID NO: 131894 - DNA, 23 bp, Homo sapiens
aaaagtactagacaatgtccaga

SEQ ID NO: 131895 - DNA, 22 bp, Homo sapiens
tatttgtgtatatatatgtgtg

SEQ ID NO: 131896 - DNA, 23 bp, Homo sapiens
tatgtgtgtggtatgtcactgtg

SEQ ID NO: 131897 - DNA, 20 bp, Homo sapiens
tatatgtatgtattagaaaa

SEQ ID NO: 131898 - DNA, 23 bp, Homo sapiens
tgtgtgtctctgtatgtgagatg

SEQ ID NO: 131899 - DNA, 19 bp, Homo sapiens
agcacactgatgggtcttg

SEQ ID NO: 131900 - DNA, 23 bp, Homo sapiens
actcactcagtgtcactttcacc

SEQ ID NO: 131901 - DNA, 23 bp, Homo sapiens
gtgcacacactgtctctgcctgt

SEQ ID NO: 131902 - DNA, 19 bp, Homo sapiens
cagggagcaagatgtaaac

SEQ ID NO: 131903 - DNA, 23 bp, Homo sapiens
tgagttcattgtagattctggat

SEQ ID NO: 131904 - DNA, 23 bp, Homo sapiens
tgagttcattgtagattctggat

SEQ ID NO: 131905 - DNA, 20 bp, Homo sapiens
atagttcactgatggctgat

SEQ ID NO: 131906 - DNA, 21 bp, Homo sapiens
tgacacactgacaactggccc

SEQ ID NO: 131907 - DNA, 23 bp, Homo sapiens
agggacagtggcattgaagtgag

SEQ ID NO: 131908 - DNA, 20 bp, Homo sapiens
tggcttttatttcttttacc

SEQ ID NO: 131909 - DNA, 22 bp, Homo sapiens
agtacaaggttgaatagtagta

SEQ ID NO: 131910 - DNA, 23 bp, Homo sapiens
tgagttcattgtagattctggat

SEQ ID NO: 131911 - DNA, 23 bp, Homo sapiens
tgagttcattgtagattctggat

SEQ ID NO: 131912 - DNA, 18 bp, Homo sapiens
atatcaggaggaatatga

SEQ ID NO: 131913 - DNA, 18 bp, Homo sapiens
aacacaagcgtgattcct

SEQ ID NO: 131914 - DNA, 23 bp, Homo sapiens
atggctcactgcagccttgactc

SEQ ID NO: 131915 - DNA, 23 bp, Homo sapiens
ttaagatgtatgtaatatagttt

SEQ ID NO: 131916 - DNA, 23 bp, Homo sapiens
cagagtagtgatggagctctggt

SEQ ID NO: 131917 - DNA, 23 bp, Homo sapiens
tctggccctgactccctcactca

SEQ ID NO: 131918 - DNA, 23 bp, Homo sapiens
tgagttcattgtagattctggat

SEQ ID NO: 131919 - DNA, 23 bp, Homo sapiens
tgagttcattgtagattctggat

SEQ ID NO: 131920 - DNA, 23 bp, Homo sapiens
ggctgaggtaggaggatcacttg

SEQ ID NO: 131921 - DNA, 22 bp, Homo sapiens
taagacagtagacatagaggtc

SEQ ID NO: 131922 - DNA, 18 bp, Homo sapiens
agtgtggtttctctttct

SEQ ID NO: 131923 - DNA, 23 bp, Homo sapiens
tgtcagacattgtgaattgtacc

SEQ ID NO: 131924 - DNA, 21 bp, Homo sapiens
agtcaagttgctctgaaacag

SEQ ID NO: 131925 - DNA, 23 bp, Homo sapiens
agaaagcaagagaattagaatgc

SEQ ID NO: 131926 - DNA, 23 bp, Homo sapiens
taattctggtagacttatttagt

SEQ ID NO: 131927 - DNA, 23 bp, Homo sapiens
ttcattgtatttgatgtgaatat

SEQ ID NO: 131928 - DNA, 19 bp, Homo sapiens
tgagaactatgcttgaaac

SEQ ID NO: 131929 - DNA, 18 bp, Homo sapiens
ttaaatgagtggttctgg

SEQ ID NO: 131930 - DNA, 23 bp, Homo sapiens
tatgaaatacaatgtaaatttgt

SEQ ID NO: 131931 - DNA, 23 bp, Homo sapiens
tgactgtgtgggtctctctcttt

SEQ ID NO: 131932 - DNA, 23 bp, Homo sapiens
tgtgagtctgttaaacctctttt

SEQ ID NO: 131933 - DNA, 23 bp, Homo sapiens
tatcagcagtgtgaaaatggact

SEQ ID NO: 131934 - DNA, 23 bp, Homo sapiens
aaattggctctacatgggctgct

SEQ ID NO: 131935 - DNA, 20 bp, Homo sapiens
tgtgtgtgtgtgacagggag

SEQ ID NO: 131936 - DNA, 22 bp, Homo sapiens
ttctttaattgatgcttagtct

SEQ ID NO: 131937 - DNA, 23 bp, Homo sapiens
tgagaagtttcagactaggaaat

SEQ ID NO: 131938 - DNA, 23 bp, Homo sapiens
gggagagcattttttgtctgaac

SEQ ID NO: 131939 - DNA, 18 bp, Homo sapiens
tgtgtatgtgtgtatgta

SEQ ID NO: 131940 - DNA, 18 bp, Homo sapiens
tgtgtatgtgtgtatgta

SEQ ID NO: 131941 - DNA, 18 bp, Homo sapiens
tgtgtatgtgtgtatgta

SEQ ID NO: 131942 - DNA, 18 bp, Homo sapiens
tgtgtatgtgtgtatgta

SEQ ID NO: 131943 - DNA, 18 bp, Homo sapiens
tgtgtatgtgtgtatgta

SEQ ID NO: 131944 - DNA, 18 bp, Homo sapiens
tgtgtatgtgtgtatgta

SEQ ID NO: 131945 - DNA, 18 bp, Homo sapiens
tgtgtatgtgtgtatgta

SEQ ID NO: 131946 - DNA, 18 bp, Homo sapiens
tgtgtatgtgtgtatgta

SEQ ID NO: 131947 - DNA, 18 bp, Homo sapiens
tgtgtatgtgtgtatgta

SEQ ID NO: 131948 - DNA, 19 bp, Homo sapiens
tgaggtattttgaaagccc

SEQ ID NO: 131949 - DNA, 22 bp, Homo sapiens
atacacacacacatatatatgt

SEQ ID NO: 131950 - DNA, 23 bp, Homo sapiens
atgtgtgtgtgtatatatatacg

SEQ ID NO: 131951 - DNA, 20 bp, Homo sapiens
tgaggtagtaggattgcttg

SEQ ID NO: 131952 - DNA, 21 bp, Homo sapiens
tgagacagagtctcgctctat

SEQ ID NO: 131953 - DNA, 23 bp, Homo sapiens
gtcagagacagaaatgtgtgagt

SEQ ID NO: 131954 - DNA, 23 bp, Homo sapiens
acagactctcgctctgtcaccca

SEQ ID NO: 131955 - DNA, 22 bp, Homo sapiens
taagacagtagacatagaggtc

SEQ ID NO: 131956 - DNA, 21 bp, Homo sapiens
agagaggcaactgggtcaggt

SEQ ID NO: 131957 - DNA, 21 bp, Homo sapiens
atgcttgtagttccagctgct

SEQ ID NO: 131958 - DNA, 23 bp, Homo sapiens
ttgagacccagataaactgcaga

SEQ ID NO: 131959 - DNA, 22 bp, Homo sapiens
tgcttcattctgtagacctttg

SEQ ID NO: 131960 - DNA, 19 bp, Homo sapiens
gtgcagtggtgtgatcaga

SEQ ID NO: 131961 - DNA, 23 bp, Homo sapiens
ctctctcaccctttctttgccct

SEQ ID NO: 131962 - DNA, 23 bp, Homo sapiens
gacagagtctcgctctgtcaccc

SEQ ID NO: 131963 - DNA, 23 bp, Homo sapiens
gacagagtctcgctctgtcaccc

SEQ ID NO: 131964 - DNA, 23 bp, Homo sapiens
ctctgagagtgggacacttctgt

SEQ ID NO: 131965 - DNA, 23 bp, Homo sapiens
tggagtctcactctgtcacccag

SEQ ID NO: 131966 - DNA, 23 bp, Homo sapiens
tttgagacggagtctcactctgt

SEQ ID NO: 131967 - DNA, 22 bp, Homo sapiens
agtgctagatgcttgtataatt

SEQ ID NO: 131968 - DNA, 23 bp, Homo sapiens
ctgtccctctgacactggccatt

SEQ ID NO: 131969 - DNA, 19 bp, Homo sapiens
tgccatttgtacatatatc

SEQ ID NO: 131970 - DNA, 23 bp, Homo sapiens
tctatatctgtatatctatatct

SEQ ID NO: 131971 - DNA, 20 bp, Homo sapiens
tgagtgagaacacaaggtgt

SEQ ID NO: 131972 - DNA, 19 bp, Homo sapiens
agtgggcctgagatccatc

SEQ ID NO: 131973 - DNA, 23 bp, Homo sapiens
tgcgaccgagtctcgctctgtca

SEQ ID NO: 131974 - DNA, 23 bp, Homo sapiens
tcggtgtgtctgtgagtgtgttt

SEQ ID NO: 131975 - DNA, 22 bp, Homo sapiens
tctgtgggactctgagtctctc

SEQ ID NO: 131976 - DNA, 23 bp, Homo sapiens
tggagtctcactctgtcacccag

SEQ ID NO: 131977 - DNA, 21 bp, Homo sapiens
actgagtctcgctctgtcacc

SEQ ID NO: 131978 - DNA, 23 bp, Homo sapiens
tgagttcattgtagattctggat

SEQ ID NO: 131979 - DNA, 23 bp, Homo sapiens
tgagttcattgtagattctggat

SEQ ID NO: 131980 - DNA, 23 bp, Homo sapiens
ctagcaccttatgtaattggtaa

SEQ ID NO: 131981 - DNA, 23 bp, Homo sapiens
tcctacatgaccaactattgact

SEQ ID NO: 131982 - DNA, 23 bp, Homo sapiens
agtgccactgcttgaattgaggg

SEQ ID NO: 131983 - DNA, 23 bp, Homo sapiens
tggagtctcactctgtcacccag

SEQ ID NO: 131984 - DNA, 21 bp, Homo sapiens
tgattctacattatggtgagt

SEQ ID NO: 131985 - DNA, 21 bp, Homo sapiens
taaagctttttttttcttagt

SEQ ID NO: 131986 - DNA, 23 bp, Homo sapiens
tctgtgaagagactcagctgagt

SEQ ID NO: 131987 - DNA, 23 bp, Homo sapiens
tgagttcattgtagattctggat

SEQ ID NO: 131988 - DNA, 23 bp, Homo sapiens
tgagttcattgtagattctggat

SEQ ID NO: 131989 - DNA, 23 bp, Homo sapiens
gggtctcactctgtcacccaggc

SEQ ID NO: 131990 - DNA, 23 bp, Homo sapiens
gggtctcactctgtcacccaggc

SEQ ID NO: 131991 - DNA, 23 bp, Homo sapiens
gacagagtctcgctctgtcaccc

SEQ ID NO: 131992 - DNA, 23 bp, Homo sapiens
acagtgtctcactctgtcaccca

SEQ ID NO: 131993 - DNA, 23 bp, Homo sapiens
tataactatttcattatatgtta

SEQ ID NO: 131994 - DNA, 23 bp, Homo sapiens
acaagaaatgtaatgtacttgaa

SEQ ID NO: 131995 - DNA, 18 bp, Homo sapiens
actgcactccagcctggg

SEQ ID NO: 131996 - DNA, 22 bp, Homo sapiens
tttagtctttttgtttttcaga

SEQ ID NO: 131997 - DNA, 23 bp, Homo sapiens
aatctcagcgctttacatggctt

SEQ ID NO: 131998 - DNA, 23 bp, Homo sapiens
tatgtatatatgtgtgtgtaaaa

SEQ ID NO: 131999 - DNA, 23 bp, Homo sapiens
tcgtggtctcgctgacttcagga

SEQ ID NO: 132000 - DNA, 22 bp, Homo sapiens
ttgagagtacacagaaaggaga

SEQ ID NO: 132001 - DNA, 23 bp, Homo sapiens
tcaggtaaggttttgcagcctga

SEQ ID NO: 132002 - DNA, 23 bp, Homo sapiens
ggttcttggtctcgctgacttca

SEQ ID NO: 132003 - DNA, 23 bp, Homo sapiens
gacagagtctcgctctgtcaccc

SEQ ID NO: 132004 - DNA, 23 bp, Homo sapiens
tctctgactctctgactttcagg

SEQ ID NO: 132005 - DNA, 23 bp, Homo sapiens
atggagtctctctctgacactca

SEQ ID NO: 132006 - DNA, 23 bp, Homo sapiens
agagtctcactctgtcacccagg

SEQ ID NO: 132007 - DNA, 23 bp, Homo sapiens
gttgacagagaatagagtgagga

SEQ ID NO: 132008 - DNA, 21 bp, Homo sapiens
agccactatgtatttgccaaa

SEQ ID NO: 132009 - DNA, 23 bp, Homo sapiens
tccctctcagggaatttgcagga

SEQ ID NO: 132010 - DNA, 22 bp, Homo sapiens
aagagaagagagtgtgtgcaga

SEQ ID NO: 132011 - DNA, 23 bp, Homo sapiens
aagatggctgataatgttgttca

SEQ ID NO: 132012 - DNA, 19 bp, Homo sapiens
tgtatatatacgtgtatgt

SEQ ID NO: 132013 - DNA, 23 bp, Homo sapiens
atgtatatatacgtgtgtgtgtg

SEQ ID NO: 132014 - DNA, 23 bp, Homo sapiens
tgtggttccagactgaggatgtc

SEQ ID NO: 132015 - DNA, 23 bp, Homo sapiens
gatggagtctcactctgtcactc

SEQ ID NO: 132016 - DNA, 23 bp, Homo sapiens
tgtcacagagtacagtgcatgat

SEQ ID NO: 132017 - DNA, 23 bp, Homo sapiens
tgccacagcttcagcagctgcga

SEQ ID NO: 132018 - DNA, 23 bp, Homo sapiens
gagtcacagaagatacagaagtc

SEQ ID NO: 132019 - DNA, 23 bp, Homo sapiens
tgagttcattgtagattctggat

SEQ ID NO: 132020 - DNA, 23 bp, Homo sapiens
tgagttcattgtagattctggat

SEQ ID NO: 132021 - DNA, 23 bp, Homo sapiens
atggagtctcactctgtcaccca

SEQ ID NO: 132022 - DNA, 23 bp, Homo sapiens
tgagttcattgtagattctggat

SEQ ID NO: 132023 - DNA, 23 bp, Homo sapiens
tgagttcattgtagattctggat

SEQ ID NO: 132024 - DNA, 23 bp, Homo sapiens
tgagatggagtctcactctgtca

SEQ ID NO: 132025 - DNA, 18 bp, Homo sapiens
gtgtgtgtgtgtgtgtgt

SEQ ID NO: 132026 - DNA, 21 bp, Homo sapiens
tgaggtaggaggatcacttga

SEQ ID NO: 132027 - DNA, 22 bp, Homo sapiens
tgtgtgcatacaatgtgtgtgt

SEQ ID NO: 132028 - DNA, 23 bp, Homo sapiens
tgtgtacctgcatgtgcatgtgg

SEQ ID NO: 132029 - DNA, 23 bp, Homo sapiens
atgtactgtgtgtgcagtttgtg

SEQ ID NO: 132030 - DNA, 21 bp, Homo sapiens
aacacagcaagatattgtgtt

SEQ ID NO: 132031 - DNA, 23 bp, Homo sapiens
agacagtgtctcactgtgtcatc

SEQ ID NO: 132032 - DNA, 23 bp, Homo sapiens
accgtgcctctgtccctttctcc

SEQ ID NO: 132033 - DNA, 23 bp, Homo sapiens
tttaagactgaatagccaggcat

SEQ ID NO: 132034 - DNA, 18 bp, Homo sapiens
tctctgtctctcaggctg

SEQ ID NO: 132035 - DNA, 23 bp, Homo sapiens
ggagtctcactctgtctcccagg

SEQ ID NO: 132036 - DNA, 22 bp, Homo sapiens
tttctgcatgttggccaggctg

SEQ ID NO: 132037 - DNA, 23 bp, Homo sapiens
agtccgctttctgtttctctgag

SEQ ID NO: 132038 - DNA, 23 bp, Homo sapiens
ctctgacactgtgtcactttggg

SEQ ID NO: 132039 - DNA, 19 bp, Homo sapiens
agtggttgtcgaggagata

SEQ ID NO: 132040 - DNA, 23 bp, Homo sapiens
gggtctggcagcctgtgactgac

SEQ ID NO: 132041 - DNA, 23 bp, Homo sapiens
tcactgtctcagttataattttg

SEQ ID NO: 132042 - DNA, 21 bp, Homo sapiens
tggcacactgcagccttgact

SEQ ID NO: 132043 - DNA, 20 bp, Homo sapiens
tgtcctatctctggtggctg

SEQ ID NO: 132044 - DNA, 23 bp, Homo sapiens
tatgtgtgagcatatgttcatga

SEQ ID NO: 132045 - DNA, 23 bp, Homo sapiens
tcctgagtgtgtgtgtgactgtg

SEQ ID NO: 132046 - DNA, 23 bp, Homo sapiens
aatgacaggatttttgtctggga

SEQ ID NO: 132047 - DNA, 22 bp, Homo sapiens
acagagtctcattgttaggtgt

SEQ ID NO: 132048 - DNA, 22 bp, Homo sapiens
tgtgcatctgtgtgtctgtgcc

SEQ ID NO: 132049 - DNA, 23 bp, Homo sapiens
tgagttcattgtagattctggat

SEQ ID NO: 132050 - DNA, 23 bp, Homo sapiens
tgagttcattgtagattctggat

SEQ ID NO: 132051 - DNA, 18 bp, Homo sapiens
gcctccctgaattctctc

SEQ ID NO: 132052 - DNA, 23 bp, Homo sapiens
atcaggtagatgtgtttgcgtgg

SEQ ID NO: 132053 - DNA, 23 bp, Homo sapiens
atgtctgtgtgtgtatgtctgtg

SEQ ID NO: 132054 - DNA, 23 bp, Homo sapiens
tctcttactctgtcacctaatca

SEQ ID NO: 132055 - DNA, 18 bp, Homo sapiens
aggctgggagagagaagg

SEQ ID NO: 132056 - DNA, 23 bp, Homo sapiens
acagggtctcactctgtcaccca

SEQ ID NO: 132057 - DNA, 23 bp, Homo sapiens
gggtctcactctgtcacccaggc

SEQ ID NO: 132058 - DNA, 23 bp, Homo sapiens
gggtctcactctgtcacccaggc

SEQ ID NO: 132059 - DNA, 19 bp, Homo sapiens
atgtatatatatatgtgtg

SEQ ID NO: 132060 - DNA, 19 bp, Homo sapiens
ctcaccctctgactgtccg

SEQ ID NO: 132061 - DNA, 18 bp, Homo sapiens
tgcagggttgtgtggagg

SEQ ID NO: 132062 - DNA, 23 bp, Homo sapiens
aataagttatttcattatgtagg

SEQ ID NO: 132063 - DNA, 23 bp, Homo sapiens
agtgtggtttaggtgctgcatct

SEQ ID NO: 132064 - DNA, 18 bp, Homo sapiens
agtcatgaagcagagcac

SEQ ID NO: 132065 - DNA, 23 bp, Homo sapiens
tctctcattggttttcttcttta

SEQ ID NO: 132066 - DNA, 23 bp, Homo sapiens
tctgtggctctgtcactctactg

SEQ ID NO: 132067 - DNA, 23 bp, Homo sapiens
agactgcctctctgactgcctgt

SEQ ID NO: 132068 - DNA, 23 bp, Homo sapiens
tggatgagttgtctccacattac

SEQ ID NO: 132069 - DNA, 23 bp, Homo sapiens
tactgtgtcagagtctgtgtgtc

SEQ ID NO: 132070 - DNA, 21 bp, Homo sapiens
atatgtatgtatgtatatgta

SEQ ID NO: 132071 - DNA, 21 bp, Homo sapiens
aggttgagatcttcctggttt

SEQ ID NO: 132072 - DNA, 21 bp, Homo sapiens
atgaccagtgatttttttgtt

SEQ ID NO: 132073 - DNA, 19 bp, Homo sapiens
cagccacacactgcctctc

SEQ ID NO: 132074 - DNA, 18 bp, Homo sapiens
cacactctctggctctgc

SEQ ID NO: 132075 - DNA, 22 bp, Homo sapiens
tatgtgtatgcattgcttgtga

SEQ ID NO: 132076 - DNA, 23 bp, Homo sapiens
actgacagtcagaagccagctcc

SEQ ID NO: 132077 - DNA, 22 bp, Homo sapiens
aagcccttttcaaaggtgtcac

SEQ ID NO: 132078 - DNA, 23 bp, Homo sapiens
actctcactgccacagctgaggc

SEQ ID NO: 132079 - DNA, 21 bp, Homo sapiens
tcagctaatataatggttttt

SEQ ID NO: 132080 - DNA, 22 bp, Homo sapiens
ttagtggttcttctaggtgtta

SEQ ID NO: 132081 - DNA, 19 bp, Homo sapiens
atgtcttgtgatattgctt

SEQ ID NO: 132082 - DNA, 23 bp, Homo sapiens
tctccctggctctctgtatctca

SEQ ID NO: 132083 - DNA, 22 bp, Homo sapiens
tctccaagacttttctttggaa

SEQ ID NO: 132084 - DNA, 21 bp, Homo sapiens
tgggtctgtcacactctgggc

SEQ ID NO: 132085 - DNA, 21 bp, Homo sapiens
tgaatgcctctgtttcaagta

SEQ ID NO: 132086 - DNA, 23 bp, Homo sapiens
aattctcagtatatcttttttat

SEQ ID NO: 132087 - DNA, 18 bp, Homo sapiens
gtgtgtgtatatatatag

SEQ ID NO: 132088 - DNA, 23 bp, Homo sapiens
tgagttcattgtagattctggat

SEQ ID NO: 132089 - DNA, 23 bp, Homo sapiens
tgagttcattgtagattctggat

SEQ ID NO: 132090 - DNA, 21 bp, Homo sapiens
tctgcttctctttaactctca

SEQ ID NO: 132091 - DNA, 22 bp, Homo sapiens
tgttggagaaaagtgtgttgta

SEQ ID NO: 132092 - DNA, 23 bp, Homo sapiens
tatggcactcttataaaacactg

SEQ ID NO: 132093 - DNA, 23 bp, Homo sapiens
atatgcatgtgtgtgtgtctgta

SEQ ID NO: 132094 - DNA, 23 bp, Homo sapiens
atatgtgtgcatatatatgcata

SEQ ID NO: 132095 - DNA, 20 bp, Homo sapiens
atgcgtatatatgcgtatat

SEQ ID NO: 132096 - DNA, 23 bp, Homo sapiens
tgggcaaaagatatgagtagaca

SEQ ID NO: 132097 - DNA, 18 bp, Homo sapiens
aaagaggtagcattccaa

SEQ ID NO: 132098 - DNA, 23 bp, Homo sapiens
ctctctgggactgcatggcttca

SEQ ID NO: 132099 - DNA, 19 bp, Homo sapiens
tgacagtccagggcagtga

SEQ ID NO: 132100 - DNA, 23 bp, Homo sapiens
acagggtctcactctgtcacccc

SEQ ID NO: 132101 - DNA, 23 bp, Homo sapiens
tcaggctggttacttaggtataa

SEQ ID NO: 132102 - DNA, 22 bp, Homo sapiens
aggtatatagttatggaaccag

SEQ ID NO: 132103 - DNA, 23 bp, Homo sapiens
agtgagtacagagtgtggtcatg

SEQ ID NO: 132104 - DNA, 23 bp, Homo sapiens
tctgtggccctgtgtttggagac

SEQ ID NO: 132105 - DNA, 21 bp, Homo sapiens
atagatatagatatagatatc

SEQ ID NO: 132106 - DNA, 23 bp, Homo sapiens
gagtatctaggttgaatactctg

SEQ ID NO: 132107 - DNA, 23 bp, Homo sapiens
ttctgtgaagaaagtcaatggtg

SEQ ID NO: 132108 - DNA, 23 bp, Homo sapiens
cttgagagggatttgggagagag

SEQ ID NO: 132109 - DNA, 21 bp, Homo sapiens
attaagcttgatattttaggt

SEQ ID NO: 132110 - DNA, 23 bp, Homo sapiens
tgagttcattgtagattctggat

SEQ ID NO: 132111 - DNA, 23 bp, Homo sapiens
tgagttcattgtagattctggat

SEQ ID NO: 132112 - DNA, 20 bp, Homo sapiens
tcacacagatgcgtgtgaca

SEQ ID NO: 132113 - DNA, 23 bp, Homo sapiens
tgtgcgtgtgcatctgcatgtgt

SEQ ID NO: 132114 - DNA, 23 bp, Homo sapiens
accaaaagagtttttgttgatgt

SEQ ID NO: 132115 - DNA, 22 bp, Homo sapiens
atatatcaacatttaccaagtt

SEQ ID NO: 132116 - DNA, 23 bp, Homo sapiens
ctttgtctttactttatgtcttg

SEQ ID NO: 132117 - DNA, 23 bp, Homo sapiens
gcaagtagagagagtgcagagaa

SEQ ID NO: 132118 - DNA, 18 bp, Homo sapiens
acatttgagttaatgttg

SEQ ID NO: 132119 - DNA, 22 bp, Homo sapiens
agtacactctgaaaactgagtc

SEQ ID NO: 132120 - DNA, 23 bp, Homo sapiens
tgagttcattgtagattctggat

SEQ ID NO: 132121 - DNA, 23 bp, Homo sapiens
tgagttcattgtagattctggat

SEQ ID NO: 132122 - DNA, 23 bp, Homo sapiens
atatgtgtgtgcttgtgtattta

SEQ ID NO: 132123 - DNA, 23 bp, Homo sapiens
agaggaaggataggcattcttca

SEQ ID NO: 132124 - DNA, 23 bp, Homo sapiens
ataggtttgcaaatgttttcttt

SEQ ID NO: 132125 - DNA, 22 bp, Homo sapiens
tgcatgtgtgcatgtgtgtgta

SEQ ID NO: 132126 - DNA, 18 bp, Homo sapiens
acacacacacatacatat

SEQ ID NO: 132127 - DNA, 23 bp, Homo sapiens
aacacagaatagtgtcaccactg

SEQ ID NO: 132128 - DNA, 23 bp, Homo sapiens
tggaatagtgtcactattgtagt

SEQ ID NO: 132129 - DNA, 20 bp, Homo sapiens
tccctgggtcccagtctggg

SEQ ID NO: 132130 - DNA, 23 bp, Homo sapiens
tgagttcattgtagattctggat

SEQ ID NO: 132131 - DNA, 23 bp, Homo sapiens
tgagttcattgtagattctggat

SEQ ID NO: 132132 - DNA, 23 bp, Homo sapiens
gaagccactaggagatattaggt

SEQ ID NO: 132133 - DNA, 23 bp, Homo sapiens
tatatgtgtgtgtgcatatgtgt

SEQ ID NO: 132134 - DNA, 21 bp, Homo sapiens
tttgctgaatttgtttatcag

SEQ ID NO: 132135 - DNA, 20 bp, Homo sapiens
tttaggatttctaggtatac

SEQ ID NO: 132136 - DNA, 19 bp, Homo sapiens
tattctgtttcattggtct

SEQ ID NO: 132137 - DNA, 22 bp, Homo sapiens
tacaaatagagatagtttactc

SEQ ID NO: 132138 - DNA, 20 bp, Homo sapiens
tatgatgatgatgatgatca

SEQ ID NO: 132139 - DNA, 22 bp, Homo sapiens
tgtttatttcatctgatagttg

SEQ ID NO: 132140 - DNA, 23 bp, Homo sapiens
tgacagagactctgccacttctt

SEQ ID NO: 132141 - DNA, 21 bp, Homo sapiens
gcgtctgtagttccagctact

SEQ ID NO: 132142 - DNA, 18 bp, Homo sapiens
tcaccgtgttaaccagga

SEQ ID NO: 132143 - DNA, 22 bp, Homo sapiens
atatgtatgtgtatatgtgtat

SEQ ID NO: 132144 - DNA, 23 bp, Homo sapiens
tgagaagtttgtactttgcattg

SEQ ID NO: 132145 - DNA, 23 bp, Homo sapiens
tgtcactgtgtggctctgaaaac

SEQ ID NO: 132146 - DNA, 22 bp, Homo sapiens
ctgctctgtctccctgtcagcc

SEQ ID NO: 132147 - DNA, 23 bp, Homo sapiens
tgtgtgtgtgtgcatgtgaatgt

SEQ ID NO: 132148 - DNA, 21 bp, Homo sapiens
agagagaagagagtgtggtag

SEQ ID NO: 132149 - DNA, 23 bp, Homo sapiens
acggagtctcactgtgtcaccag

SEQ ID NO: 132150 - DNA, 23 bp, Homo sapiens
tgtgtcacagatgtgtgtctgca

SEQ ID NO: 132151 - DNA, 23 bp, Homo sapiens
tacatgtatatatgtatatgtgt

SEQ ID NO: 132152 - DNA, 23 bp, Homo sapiens
acagagtctcactctgtcgccca

SEQ ID NO: 132153 - DNA, 23 bp, Homo sapiens
tgagtacatatacatatgagtat

SEQ ID NO: 132154 - DNA, 23 bp, Homo sapiens
atatatgagtatatatatatgag

SEQ ID NO: 132155 - DNA, 21 bp, Homo sapiens
gtctcgctctgtcaccctggc

SEQ ID NO: 132156 - DNA, 18 bp, Homo sapiens
atacacagacaaggctgg

SEQ ID NO: 132157 - DNA, 22 bp, Homo sapiens
acagtggtgcagtctcagctca

SEQ ID NO: 132158 - DNA, 19 bp, Homo sapiens
acaggcatgagacactgcg

SEQ ID NO: 132159 - DNA, 21 bp, Homo sapiens
ctggctctgtcacccaggctg

SEQ ID NO: 132160 - DNA, 23 bp, Homo sapiens
cagtctctcactctgtcacccag

SEQ ID NO: 132161 - DNA, 21 bp, Homo sapiens
tacacctgggtttgcagccac

SEQ ID NO: 132162 - DNA, 20 bp, Homo sapiens
tcaccctctctgggcctcag

SEQ ID NO: 132163 - DNA, 21 bp, Homo sapiens
atgtgtctgtctctgtgtcca

SEQ ID NO: 132164 - DNA, 23 bp, Homo sapiens
tgcacagaagaaatgtgtcattc

SEQ ID NO: 132165 - DNA, 23 bp, Homo sapiens
ttggatcatgttagtctgacact

SEQ ID NO: 132166 - DNA, 21 bp, Homo sapiens
tgtcacagtctgtataaaggg

SEQ ID NO: 132167 - DNA, 23 bp, Homo sapiens
agagtctcactctgtcacccagg

SEQ ID NO: 132168 - DNA, 23 bp, Homo sapiens
gagtctcactctgtcacccaggc

SEQ ID NO: 132169 - DNA, 22 bp, Homo sapiens
gacaaatcacagacaccacgga

SEQ ID NO: 132170 - DNA, 19 bp, Homo sapiens
acagagcacttgcaaaatc

SEQ ID NO: 132171 - DNA, 22 bp, Homo sapiens
tgatgttttgatgctgttcaaa

SEQ ID NO: 132172 - DNA, 22 bp, Homo sapiens
tggtgacagtggctgtcatggg

SEQ ID NO: 132173 - DNA, 19 bp, Homo sapiens
tgagaaatttctttgtgat

SEQ ID NO: 132174 - DNA, 23 bp, Homo sapiens
tcacagagttgagattttcttgt

SEQ ID NO: 132175 - DNA, 23 bp, Homo sapiens
tgagttcattgtagattctggat

SEQ ID NO: 132176 - DNA, 23 bp, Homo sapiens
tgagttcattgtagattctggat

SEQ ID NO: 132177 - DNA, 21 bp, Homo sapiens
ctccatcacagatttgcttgt

SEQ ID NO: 132178 - DNA, 23 bp, Homo sapiens
tgtgaatggacattttgtagttc

SEQ ID NO: 132179 - DNA, 18 bp, Homo sapiens
agatgaggccaatgatgt

SEQ ID NO: 132180 - DNA, 23 bp, Homo sapiens
actgtcactggctgtcatggggc

SEQ ID NO: 132181 - DNA, 23 bp, Homo sapiens
gacacagcattttaattgtttat

SEQ ID NO: 132182 - DNA, 23 bp, Homo sapiens
ttctaaaaatatgtgtctgtttg

SEQ ID NO: 132183 - DNA, 23 bp, Homo sapiens
gacagagtctcgctctgtcaccc

SEQ ID NO: 132184 - DNA, 23 bp, Homo sapiens
acagagtctcgctctgtcaccca

SEQ ID NO: 132185 - DNA, 23 bp, Homo sapiens
tgagttcattgtagattctggat

SEQ ID NO: 132186 - DNA, 23 bp, Homo sapiens
tgagttcattgtagattctggat

SEQ ID NO: 132187 - DNA, 22 bp, Homo sapiens
tctctgtgcctcagtcgccctc

SEQ ID NO: 132188 - DNA, 23 bp, Homo sapiens
tgagatggagtctcactctgttg

SEQ ID NO: 132189 - DNA, 23 bp, Homo sapiens
gtggagtctcactctgtcaccca

SEQ ID NO: 132190 - DNA, 23 bp, Homo sapiens
agatggagtctcactctgtcacc

SEQ ID NO: 132191 - DNA, 21 bp, Homo sapiens
agtgtggtagtgtgatcttgg

SEQ ID NO: 132192 - DNA, 23 bp, Homo sapiens
tgaggtggattctcactctgtca

SEQ ID NO: 132193 - DNA, 21 bp, Homo sapiens
cagaactcagaaaaacagttt

SEQ ID NO: 132194 - DNA, 23 bp, Homo sapiens
actgtgtattgtgttgtcatatg

SEQ ID NO: 132195 - DNA, 22 bp, Homo sapiens
ctctcagtctcactgagacact

SEQ ID NO: 132196 - DNA, 22 bp, Homo sapiens
tgtgtatatatgtatgaatgtg

SEQ ID NO: 132197 - DNA, 23 bp, Homo sapiens
caatgtatgtatatatgtgtatg

SEQ ID NO: 132198 - DNA, 23 bp, Homo sapiens
atatatgcatgtatatatgtgtg

SEQ ID NO: 132199 - DNA, 23 bp, Homo sapiens
agacagtatctcactctgtcacc

SEQ ID NO: 132200 - DNA, 23 bp, Homo sapiens
cacacttctgagtgtgacacgcc

SEQ ID NO: 132201 - DNA, 23 bp, Homo sapiens
tcagtgaggacacagccacctgt

SEQ ID NO: 132202 - DNA, 22 bp, Homo sapiens
taaactgatttcaaagtgtagt

SEQ ID NO: 132203 - DNA, 18 bp, Homo sapiens
ttgtagatgagattgctt

SEQ ID NO: 132204 - DNA, 20 bp, Homo sapiens
tatgagtgcccaagatgtga

SEQ ID NO: 132205 - DNA, 23 bp, Homo sapiens
tctcaccctgtgacttagaatgc

SEQ ID NO: 132206 - DNA, 23 bp, Homo sapiens
atgcagctcagtaggtctcagcc

SEQ ID NO: 132207 - DNA, 23 bp, Homo sapiens
tgacatgtggatagtgtgactga

SEQ ID NO: 132208 - DNA, 23 bp, Homo sapiens
tcaggcagcaaaactgttggtaa

SEQ ID NO: 132209 - DNA, 23 bp, Homo sapiens
cagggtctcactctgtcacccag

SEQ ID NO: 132210 - DNA, 23 bp, Homo sapiens
gacagagtctcgctctgtcactc

SEQ ID NO: 132211 - DNA, 19 bp, Homo sapiens
tttgagactcatttaaacc

SEQ ID NO: 132212 - DNA, 22 bp, Homo sapiens
cggtgactcaagatagtggcac

SEQ ID NO: 132213 - DNA, 23 bp, Homo sapiens
ggagtctcactcactctttcgtc

SEQ ID NO: 132214 - DNA, 23 bp, Homo sapiens
tgacatgtggatagtgtgactga

SEQ ID NO: 132215 - DNA, 23 bp, Homo sapiens
tcaggcagcaaaactgttggtaa

SEQ ID NO: 132216 - DNA, 23 bp, Homo sapiens
cagggtctcactctgtcacccag

SEQ ID NO: 132217 - DNA, 20 bp, Homo sapiens
tgtgtatgtatgtatatatg

SEQ ID NO: 132218 - DNA, 20 bp, Homo sapiens
tgtatgtatatgtatatgta

SEQ ID NO: 132219 - DNA, 22 bp, Homo sapiens
gaagatggtgatgatggtaatg

SEQ ID NO: 132220 - DNA, 23 bp, Homo sapiens
gggtctcactctgtcacccaggc

SEQ ID NO: 132221 - DNA, 23 bp, Homo sapiens
gggtctcactctgtcacccaggc

SEQ ID NO: 132222 - DNA, 23 bp, Homo sapiens
tgagttcattgtagattctggat

SEQ ID NO: 132223 - DNA, 20 bp, Homo sapiens
agtcttgatgttggtggcta

SEQ ID NO: 132224 - DNA, 23 bp, Homo sapiens
gggtctcactctgtcacccaggc

SEQ ID NO: 132225 - DNA, 18 bp, Homo sapiens
aggaagttgaggctgcag

SEQ ID NO: 132226 - DNA, 23 bp, Homo sapiens
agtctagttttgatgtaaaggta

SEQ ID NO: 132227 - DNA, 23 bp, Homo sapiens
gtgtgtatatatatatgtgtgtg

SEQ ID NO: 132228 - DNA, 23 bp, Homo sapiens
tatgtgtgtgtgtatatatatac

SEQ ID NO: 132229 - DNA, 21 bp, Homo sapiens
tgtgtgtatatatgtgtgtat

SEQ ID NO: 132230 - DNA, 23 bp, Homo sapiens
aatgtgtgtatatatatgtgtgt

SEQ ID NO: 132231 - DNA, 23 bp, Homo sapiens
tatgggtatatatatgtgtgtgt

SEQ ID NO: 132232 - DNA, 22 bp, Homo sapiens
aagactgtgccagtctttgctt

SEQ ID NO: 132233 - DNA, 23 bp, Homo sapiens
acagagtctcactgtgtcgccca

SEQ ID NO: 132234 - DNA, 23 bp, Homo sapiens
ctcccaaagtgctgggattgcag

SEQ ID NO: 132235 - DNA, 21 bp, Homo sapiens
tctctgcgtctatctgtggct

SEQ ID NO: 132236 - DNA, 21 bp, Homo sapiens
tggaactgtgattttcaagat

SEQ ID NO: 132237 - DNA, 20 bp, Homo sapiens
actttagagattttgatttt

SEQ ID NO: 132238 - DNA, 20 bp, Homo sapiens
gtctcgctctgtcacccagg

SEQ ID NO: 132239 - DNA, 23 bp, Homo sapiens
gagtcggagtctcactctgtctc

SEQ ID NO: 132240 - DNA, 23 bp, Homo sapiens
atacatgtgtatatgtagttgtg

SEQ ID NO: 132241 - DNA, 23 bp, Homo sapiens
ataggtacatgcacaaatatatt

SEQ ID NO: 132242 - DNA, 21 bp, Homo sapiens
aatgagtgattgtgatggtgt

SEQ ID NO: 132243 - DNA, 23 bp, Homo sapiens
acgagatctgatggttttaaaag

SEQ ID NO: 132244 - DNA, 23 bp, Homo sapiens
ggctctcactctctctcttgtct

SEQ ID NO: 132245 - DNA, 23 bp, Homo sapiens
accgagtctcgctctgtcaccca

SEQ ID NO: 132246 - DNA, 23 bp, Homo sapiens
tctcggctcactgaaagctccat

SEQ ID NO: 132247 - DNA, 23 bp, Homo sapiens
acagagtctcactctgtcgccca

SEQ ID NO: 132248 - DNA, 23 bp, Homo sapiens
tgtgactatgtgttggcaaagct

SEQ ID NO: 132249 - DNA, 23 bp, Homo sapiens
tgtctctctctgtgaaagatgtt

SEQ ID NO: 132250 - DNA, 21 bp, Homo sapiens
tagctgggactacatgtgcac

SEQ ID NO: 132251 - DNA, 19 bp, Homo sapiens
tgcatattttttggtagag

SEQ ID NO: 132252 - DNA, 22 bp, Homo sapiens
tcagtgcaaatgtaaagacaac

SEQ ID NO: 132253 - DNA, 23 bp, Homo sapiens
tggagtctcactctgtcacccag

SEQ ID NO: 132254 - DNA, 18 bp, Homo sapiens
gtatatatgtatgtgtct

SEQ ID NO: 132255 - DNA, 23 bp, Homo sapiens
ttgagtcagggtctcactgtgtc

SEQ ID NO: 132256 - DNA, 23 bp, Homo sapiens
tccaactctaaatacagatgcca

SEQ ID NO: 132257 - DNA, 22 bp, Homo sapiens
tttttttgagacggagtctctc

SEQ ID NO: 132258 - DNA, 23 bp, Homo sapiens
gcagagtctcgctctgtcaccca

SEQ ID NO: 132259 - DNA, 23 bp, Homo sapiens
atctctggatctctctctggctc

SEQ ID NO: 132260 - DNA, 22 bp, Homo sapiens
gtacacagatatgcatgtgttt

SEQ ID NO: 132261 - DNA, 20 bp, Homo sapiens
atatgtatatttgtatatac

SEQ ID NO: 132262 - DNA, 23 bp, Homo sapiens
tgtgtgtatatatgcatgtgtac

SEQ ID NO: 132263 - DNA, 22 bp, Homo sapiens
ttacaggagatattcaaaccag

SEQ ID NO: 132264 - DNA, 23 bp, Homo sapiens
tgagttcattgtagattctggat

SEQ ID NO: 132265 - DNA, 23 bp, Homo sapiens
tgagttcattgtagattctggat

SEQ ID NO: 132266 - DNA, 23 bp, Homo sapiens
gacagagtctggctctgtcactc

SEQ ID NO: 132267 - DNA, 22 bp, Homo sapiens
agcgtctcactctgttacctag

SEQ ID NO: 132268 - DNA, 22 bp, Homo sapiens
acatatgtgtgtatatatatgt

SEQ ID NO: 132269 - DNA, 23 bp, Homo sapiens
tatacacacatatgtgtatgtac

SEQ ID NO: 132270 - DNA, 23 bp, Homo sapiens
gggtctcactctgtcactcaggc

SEQ ID NO: 132271 - DNA, 23 bp, Homo sapiens
acagagtctgtctctgtcgccca

SEQ ID NO: 132272 - DNA, 22 bp, Homo sapiens
aaatgtactatagtatatgtat

SEQ ID NO: 132273 - DNA, 23 bp, Homo sapiens
tatgtgtatatgattatgtgtgt

SEQ ID NO: 132274 - DNA, 22 bp, Homo sapiens
tttttagtagatgtgggggtct

SEQ ID NO: 132275 - DNA, 23 bp, Homo sapiens
tggagtctcactctgtcacccag

SEQ ID NO: 132276 - DNA, 18 bp, Homo sapiens
caagtagctgggactaca

SEQ ID NO: 132277 - DNA, 22 bp, Homo sapiens
aacacaccctgctaagttttaa

SEQ ID NO: 132278 - DNA, 23 bp, Homo sapiens
tgagtctcactctgtcacccagg

SEQ ID NO: 132279 - DNA, 23 bp, Homo sapiens
cggagtctcactctgtcacccag

SEQ ID NO: 132280 - DNA, 23 bp, Homo sapiens
cagaacaagaccctgtctcttaa

SEQ ID NO: 132281 - DNA, 23 bp, Homo sapiens
agagtctcagtctgtctcccagg

SEQ ID NO: 132282 - DNA, 22 bp, Homo sapiens
cttctctctgtctctacttagt

SEQ ID NO: 132283 - DNA, 23 bp, Homo sapiens
tcagtgacaggtgactctgagct

SEQ ID NO: 132284 - DNA, 22 bp, Homo sapiens
tggcatcaatgggctgtcttct

SEQ ID NO: 132285 - DNA, 23 bp, Homo sapiens
gtgtgaagtcactctctggctct

SEQ ID NO: 132286 - DNA, 21 bp, Homo sapiens
tctatagtctggaaaagattt

SEQ ID NO: 132287 - DNA, 22 bp, Homo sapiens
tataaatctccagcaagactga

SEQ ID NO: 132288 - DNA, 23 bp, Homo sapiens
gggaattgagtatctggaatgga

SEQ ID NO: 132289 - DNA, 23 bp, Homo sapiens
aggttgtcagctgtgagtgagca

SEQ ID NO: 132290 - DNA, 21 bp, Homo sapiens
tgaggtaggaggatcacttga

SEQ ID NO: 132291 - DNA, 23 bp, Homo sapiens
agagtctcactctgtcacccagg

SEQ ID NO: 132292 - DNA, 23 bp, Homo sapiens
ctcactctgtcacccaagctgga

SEQ ID NO: 132293 - DNA, 23 bp, Homo sapiens
cagtggtcagtagctgagtgtca

SEQ ID NO: 132294 - DNA, 23 bp, Homo sapiens
agactgagtctcgctctgtcacc

SEQ ID NO: 132295 - DNA, 21 bp, Homo sapiens
gccgctccctctgtgcctccc

SEQ ID NO: 132296 - DNA, 22 bp, Homo sapiens
gctacagtgagctatggttgtg

SEQ ID NO: 132297 - DNA, 23 bp, Homo sapiens
atggtctcactctgtctcccagg

SEQ ID NO: 132298 - DNA, 19 bp, Homo sapiens
tgtgtatatatatacgtat

SEQ ID NO: 132299 - DNA, 23 bp, Homo sapiens
ggtgtctcactgtgtcacccagg

SEQ ID NO: 132300 - DNA, 19 bp, Homo sapiens
tgagtatagatacagcaca

SEQ ID NO: 132301 - DNA, 18 bp, Homo sapiens
tatgtatgtatttatatg

SEQ ID NO: 132302 - DNA, 19 bp, Homo sapiens
tgagagagtctcgctctgt

SEQ ID NO: 132303 - DNA, 23 bp, Homo sapiens
gatggagtctcactctgtcaccc

SEQ ID NO: 132304 - DNA, 23 bp, Homo sapiens
cagagtctcgctctgtctcccag

SEQ ID NO: 132305 - DNA, 23 bp, Homo sapiens
ttacccagttttaggtatgtcct

SEQ ID NO: 132306 - DNA, 23 bp, Homo sapiens
agctcaaatctgtctctctgtgc

SEQ ID NO: 132307 - DNA, 23 bp, Homo sapiens
acagagtctcactctgtcgccca

SEQ ID NO: 132308 - DNA, 23 bp, Homo sapiens
tggagtctcactctgtcacccag

SEQ ID NO: 132309 - DNA, 20 bp, Homo sapiens
tgtgctgcaagaaaaaggca

SEQ ID NO: 132310 - DNA, 23 bp, Homo sapiens
aacactcactgtgactattggaa

SEQ ID NO: 132311 - DNA, 23 bp, Homo sapiens
agagtctcactctgtcacccagg

SEQ ID NO: 132312 - DNA, 23 bp, Homo sapiens
gagtctcactctgtcacccaggc

SEQ ID NO: 132313 - DNA, 23 bp, Homo sapiens
ggagtctcactctgtcacccagg

SEQ ID NO: 132314 - DNA, 18 bp, Homo sapiens
tctgtcagtcagtgggtg

SEQ ID NO: 132315 - DNA, 23 bp, Homo sapiens
tgtatctatatctatgtgtgtgt

SEQ ID NO: 132316 - DNA, 22 bp, Homo sapiens
atatgtaattatatatatgtct

SEQ ID NO: 132317 - DNA, 23 bp, Homo sapiens
tacatctatatgtatatatgtgt

SEQ ID NO: 132318 - DNA, 22 bp, Homo sapiens
tgaggtagaaggatcacttgag

SEQ ID NO: 132319 - DNA, 23 bp, Homo sapiens
gctgcagtgagctatgattgtgc

SEQ ID NO: 132320 - DNA, 23 bp, Homo sapiens
agacagtctcactctgtcaccca

SEQ ID NO: 132321 - DNA, 23 bp, Homo sapiens
gggtctcactctgtcacccaggc

SEQ ID NO: 132322 - DNA, 18 bp, Homo sapiens
gccactgtgcctgggcca

SEQ ID NO: 132323 - DNA, 23 bp, Homo sapiens
acagagtgaaactctgtctcaaa

SEQ ID NO: 132324 - DNA, 19 bp, Homo sapiens
tgagatggagtctggctct

SEQ ID NO: 132325 - DNA, 22 bp, Homo sapiens
ggagtctcactcactctgtctc

SEQ ID NO: 132326 - DNA, 23 bp, Homo sapiens
tgaagtcagaagtttgagaccag

SEQ ID NO: 132327 - DNA, 19 bp, Homo sapiens
tgaggtaggaggatctcat

SEQ ID NO: 132328 - DNA, 23 bp, Homo sapiens
tcactgactcactcattggacaa

SEQ ID NO: 132329 - DNA, 21 bp, Homo sapiens
attcactgagtgctgttatgt

SEQ ID NO: 132330 - DNA, 23 bp, Homo sapiens
tctgtcactctgtccctctgtgg

SEQ ID NO: 132331 - DNA, 20 bp, Homo sapiens
cacagtgagaccctgtctca

SEQ ID NO: 132332 - DNA, 23 bp, Homo sapiens
agtgcctgtctgagtccttctgt

SEQ ID NO: 132333 - DNA, 21 bp, Homo sapiens
agtttgcagatcttcctgtta

SEQ ID NO: 132334 - DNA, 23 bp, Homo sapiens
gggtctcactctgtcacccaggc

SEQ ID NO: 132335 - DNA, 21 bp, Homo sapiens
actgcacttcagcctgggtga

SEQ ID NO: 132336 - DNA, 20 bp, Homo sapiens
tcagtccgtctgtctcaggc

SEQ ID NO: 132337 - DNA, 20 bp, Homo sapiens
tatgagagttttcattcatc

SEQ ID NO: 132338 - DNA, 23 bp, Homo sapiens
tgagatggagtctctctctgtca

SEQ ID NO: 132339 - DNA, 23 bp, Homo sapiens
ctcaccctctgtggctgtgtttt

SEQ ID NO: 132340 - DNA, 22 bp, Homo sapiens
atatgtctcaaatttttgttga

SEQ ID NO: 132341 - DNA, 19 bp, Homo sapiens
cagactggagtgagtgcag

SEQ ID NO: 132342 - DNA, 21 bp, Homo sapiens
atctcggctcactgcagcctc

SEQ ID NO: 132343 - DNA, 23 bp, Homo sapiens
caggcacccactgtgcgtgtggt

SEQ ID NO: 132344 - DNA, 23 bp, Homo sapiens
aacagggtctcactctgtcaccc

SEQ ID NO: 132345 - DNA, 23 bp, Homo sapiens
tagagacaggctctcactctgtc

SEQ ID NO: 132346 - DNA, 23 bp, Homo sapiens
gcctgtgtctctctgtgccagcc

SEQ ID NO: 132347 - DNA, 18 bp, Homo sapiens
tgtgtggacatgcatgtg

SEQ ID NO: 132348 - DNA, 23 bp, Homo sapiens
aaatggagcatatgacatgggag

SEQ ID NO: 132349 - DNA, 23 bp, Homo sapiens
gacagagtctcgctctgtcaccc

SEQ ID NO: 132350 - DNA, 23 bp, Homo sapiens
tccaattttgaaacaagttctac

SEQ ID NO: 132351 - DNA, 21 bp, Homo sapiens
tcacactacagagagaccttt

SEQ ID NO: 132352 - DNA, 23 bp, Homo sapiens
gagtctcactcactctgtctccc

SEQ ID NO: 132353 - DNA, 23 bp, Homo sapiens
tgtgtacagccacagcttctagt

SEQ ID NO: 132354 - DNA, 23 bp, Homo sapiens
gagtgtgagaagagagacaggag

SEQ ID NO: 132355 - DNA, 23 bp, Homo sapiens
gaaatctcaggttgtgctcctgg

SEQ ID NO: 132356 - DNA, 22 bp, Homo sapiens
tttttttcttgagatggcgtct

SEQ ID NO: 132357 - DNA, 21 bp, Homo sapiens
ttgtgttttgttttgaggcag

SEQ ID NO: 132358 - DNA, 19 bp, Homo sapiens
attgtattattattggggt

SEQ ID NO: 132359 - DNA, 23 bp, Homo sapiens
tttgtctccctgtctctgtcaaa

SEQ ID NO: 132360 - DNA, 23 bp, Homo sapiens
acagagtctcactctgtcgccca

SEQ ID NO: 132361 - DNA, 22 bp, Homo sapiens
cagagtctcactctgtcgccca

SEQ ID NO: 132362 - DNA, 23 bp, Homo sapiens
atatgtatatgtgtttatgtata

SEQ ID NO: 132363 - DNA, 21 bp, Homo sapiens
tatatgtatatgtgtatatgt

SEQ ID NO: 132364 - DNA, 23 bp, Homo sapiens
gggtctcactctgtcacccaggc

SEQ ID NO: 132365 - DNA, 19 bp, Homo sapiens
agtgcagtggcatgaccct

SEQ ID NO: 132366 - DNA, 23 bp, Homo sapiens
atggaggtacaacctgtagtccc

SEQ ID NO: 132367 - DNA, 23 bp, Homo sapiens
tgaggtaggaggatctcttgagc

SEQ ID NO: 132368 - DNA, 19 bp, Homo sapiens
caatcatggctcactgtag

SEQ ID NO: 132369 - DNA, 23 bp, Homo sapiens
tctctgtctctgtgacatcactg

SEQ ID NO: 132370 - DNA, 19 bp, Homo sapiens
tttgggttttttttgtttt

SEQ ID NO: 132371 - DNA, 23 bp, Homo sapiens
agacagtctcgctctgtcgctca

SEQ ID NO: 132372 - DNA, 23 bp, Homo sapiens
tgagttcattgtagattctggat

SEQ ID NO: 132373 - DNA, 23 bp, Homo sapiens
tgagttcattgtagattctggat

SEQ ID NO: 132374 - DNA, 22 bp, Homo sapiens
acacacacacatatatatgtgt

SEQ ID NO: 132375 - DNA, 18 bp, Homo sapiens
tgtatatatatgtatgtg

SEQ ID NO: 132376 - DNA, 23 bp, Homo sapiens
ttggttgtaacagtgaaaagctt

SEQ ID NO: 132377 - DNA, 23 bp, Homo sapiens
tggagtctcactctgtcacccag

SEQ ID NO: 132378 - DNA, 23 bp, Homo sapiens
acagagtctcactctgtcgccca

SEQ ID NO: 132379 - DNA, 23 bp, Homo sapiens
tgaatctgcaggtgcatgtgtgt

SEQ ID NO: 132380 - DNA, 18 bp, Homo sapiens
agtctgtgtatatgtctg

SEQ ID NO: 132381 - DNA, 23 bp, Homo sapiens
acagggtcactctgtcactcagg

SEQ ID NO: 132382 - DNA, 23 bp, Homo sapiens
cagagtcctgatcatgactcact

SEQ ID NO: 132383 - DNA, 23 bp, Homo sapiens
gagtctcactctgtcacccaggc

SEQ ID NO: 132384 - DNA, 23 bp, Homo sapiens
tctggacggtgacagaagtatgt

SEQ ID NO: 132385 - DNA, 20 bp, Homo sapiens
tgtgtgtatatatatatacg

SEQ ID NO: 132386 - DNA, 23 bp, Homo sapiens
acagagtctcactctgtcgccca

SEQ ID NO: 132387 - DNA, 22 bp, Homo sapiens
tcacacacatactcactctgaa

SEQ ID NO: 132388 - DNA, 23 bp, Homo sapiens
acagagtctcgctctgtcaccca

SEQ ID NO: 132389 - DNA, 23 bp, Homo sapiens
tctctccctctctgcgtgtctgc

SEQ ID NO: 132390 - DNA, 20 bp, Homo sapiens
aggtcctgagtgtgtgcatg

SEQ ID NO: 132391 - DNA, 21 bp, Homo sapiens
agcatgtagcttgttaagttg

SEQ ID NO: 132392 - DNA, 23 bp, Homo sapiens
aatagcacgtgctcactttgtgt

SEQ ID NO: 132393 - DNA, 21 bp, Homo sapiens
tgtctcaatgtcaatatgtga

SEQ ID NO: 132394 - DNA, 21 bp, Homo sapiens
tattggtccacaatggattga

SEQ ID NO: 132395 - DNA, 22 bp, Homo sapiens
tagttagaatttcaatgagagt

SEQ ID NO: 132396 - DNA, 23 bp, Homo sapiens
tctctccctctctgcgtgtctgc

SEQ ID NO: 132397 - DNA, 20 bp, Homo sapiens
acagtatttttcattatgat

SEQ ID NO: 132398 - DNA, 23 bp, Homo sapiens
agatagttagaaatgcaatgctt

SEQ ID NO: 132399 - DNA, 23 bp, Homo sapiens
tcccagagcccctggaactctgg

SEQ ID NO: 132400 - DNA, 23 bp, Homo sapiens
cagggtctcactctgtcacccag

SEQ ID NO: 132401 - DNA, 22 bp, Homo sapiens
aagtgtgtgtttagcccatgtt

SEQ ID NO: 132402 - DNA, 21 bp, Homo sapiens
tctggctctgactctatacac

SEQ ID NO: 132403 - DNA, 23 bp, Homo sapiens
agtgtgaatatgtataggtatgt

SEQ ID NO: 132404 - DNA, 23 bp, Homo sapiens
ccttggagctttggatgtagaga

SEQ ID NO: 132405 - DNA, 20 bp, Homo sapiens
tttcactgtatttgatcact

SEQ ID NO: 132406 - DNA, 23 bp, Homo sapiens
atatgtatatatgtgtacatatg

SEQ ID NO: 132407 - DNA, 20 bp, Homo sapiens
tatatgtatatatatgtgtg

SEQ ID NO: 132408 - DNA, 23 bp, Homo sapiens
tatgtgtatatatatatgtgtgt

SEQ ID NO: 132409 - DNA, 18 bp, Homo sapiens
atatatgtagatatagta

SEQ ID NO: 132410 - DNA, 20 bp, Homo sapiens
aggaagtatgtttttatgtt

SEQ ID NO: 132411 - DNA, 19 bp, Homo sapiens
gcaggaactgaaagcgttt

SEQ ID NO: 132412 - DNA, 22 bp, Homo sapiens
ttggaagtcgttcctttatctt

SEQ ID NO: 132413 - DNA, 23 bp, Homo sapiens
aggcatggagttgggaaagctga

SEQ ID NO: 132414 - DNA, 18 bp, Homo sapiens
tatgcatatgtatgtata

SEQ ID NO: 132415 - DNA, 19 bp, Homo sapiens
gctgctgttgttgttttga

SEQ ID NO: 132416 - DNA, 23 bp, Homo sapiens
cagggtctcactctgtcacccag

SEQ ID NO: 132417 - DNA, 23 bp, Homo sapiens
tgtagtggcatgatcttggctca

SEQ ID NO: 132418 - DNA, 23 bp, Homo sapiens
actggaaatctttgaatttttaa

SEQ ID NO: 132419 - DNA, 23 bp, Homo sapiens
tgagttcattgtagattctggat

SEQ ID NO: 132420 - DNA, 23 bp, Homo sapiens
tgagttcattgtagattctggat

SEQ ID NO: 132421 - DNA, 23 bp, Homo sapiens
aaaagaagttctactgtaggtaa

SEQ ID NO: 132422 - DNA, 22 bp, Homo sapiens
tagatagatacgttgtgtgtgt

SEQ ID NO: 132423 - DNA, 22 bp, Homo sapiens
attgacagtgcggtacatgagt

SEQ ID NO: 132424 - DNA, 23 bp, Homo sapiens
tctctctctagctctcactcctg

SEQ ID NO: 132425 - DNA, 23 bp, Homo sapiens
ataatgatgtttttcatacgtgt

SEQ ID NO: 132426 - DNA, 21 bp, Homo sapiens
tgtctgtcaaaagcaatggac

SEQ ID NO: 132427 - DNA, 23 bp, Homo sapiens
aaatgcatttcagtttttgatta

SEQ ID NO: 132428 - DNA, 20 bp, Homo sapiens
agcctgtctctttggtgctt

SEQ ID NO: 132429 - DNA, 20 bp, Homo sapiens
tcagagggtcagtctgtgct

SEQ ID NO: 132430 - DNA, 21 bp, Homo sapiens
aggaattttgtctggttcagg

SEQ ID NO: 132431 - DNA, 23 bp, Homo sapiens
aaggaagttcactatcagattgg

SEQ ID NO: 132432 - DNA, 23 bp, Homo sapiens
agtttggtagcacaaatttttgt

SEQ ID NO: 132433 - DNA, 23 bp, Homo sapiens
taactatctgcagtctgtggagt

SEQ ID NO: 132434 - DNA, 22 bp, Homo sapiens
atgtgtatatatacgtatacgt

SEQ ID NO: 132435 - DNA, 23 bp, Homo sapiens
tatacgtatatatacgtatatgt

SEQ ID NO: 132436 - DNA, 23 bp, Homo sapiens
atgtgtatttatacgtatatgtg

SEQ ID NO: 132437 - DNA, 23 bp, Homo sapiens
tatgtgtatatatacgtatatgt

SEQ ID NO: 132438 - DNA, 19 bp, Homo sapiens
tgtgtgtgtgtgtgtgtat

SEQ ID NO: 132439 - DNA, 22 bp, Homo sapiens
ataacatatgtaacttatataa

SEQ ID NO: 132440 - DNA, 19 bp, Homo sapiens
acatagtgctaagtatctg

SEQ ID NO: 132441 - DNA, 22 bp, Homo sapiens
tgtgtatatatgtatatatgtg

SEQ ID NO: 132442 - DNA, 23 bp, Homo sapiens
acagagtctcactctgtcgccca

SEQ ID NO: 132443 - DNA, 23 bp, Homo sapiens
tcacgtctgaaaagagagaagac

SEQ ID NO: 132444 - DNA, 22 bp, Homo sapiens
ggaggctcgctctgtcgcacag

SEQ ID NO: 132445 - DNA, 21 bp, Homo sapiens
acagtggtgcgatctcagctg

SEQ ID NO: 132446 - DNA, 20 bp, Homo sapiens
tatctattttaagcttatga

SEQ ID NO: 132447 - DNA, 23 bp, Homo sapiens
taaaatagatgttatcttttgct

SEQ ID NO: 132448 - DNA, 18 bp, Homo sapiens
gtctctccctctggctca

SEQ ID NO: 132449 - DNA, 23 bp, Homo sapiens
tatctctgtggtatggtttgact

SEQ ID NO: 132450 - DNA, 23 bp, Homo sapiens
aaatgtagtagtttaggtgagag

SEQ ID NO: 132451 - DNA, 23 bp, Homo sapiens
ttctgttgtcattttgaaattgt

SEQ ID NO: 132452 - DNA, 22 bp, Homo sapiens
gtacatatgtatagatgtgtgt

SEQ ID NO: 132453 - DNA, 23 bp, Homo sapiens
tggagtctcactctgtcacccag

SEQ ID NO: 132454 - DNA, 23 bp, Homo sapiens
tgtatcatgatgtacatgtggat

SEQ ID NO: 132455 - DNA, 20 bp, Homo sapiens
ttcttcactttttcaatttc

SEQ ID NO: 132456 - DNA, 20 bp, Homo sapiens
tattccagtggtagtaggat

SEQ ID NO: 132457 - DNA, 23 bp, Homo sapiens
agaagtttcagtggaaagtaaaa

SEQ ID NO: 132458 - DNA, 22 bp, Homo sapiens
atatgtatgtatatatagtaca

SEQ ID NO: 132459 - DNA, 23 bp, Homo sapiens
tatgtgtacatatatgtgtgtgc

SEQ ID NO: 132460 - DNA, 18 bp, Homo sapiens
tggatagatatatatgga

SEQ ID NO: 132461 - DNA, 19 bp, Homo sapiens
tatatggatatatatatga

SEQ ID NO: 132462 - DNA, 23 bp, Homo sapiens
tgagttcattgtagattctggat

SEQ ID NO: 132463 - DNA, 23 bp, Homo sapiens
tgagttcattgtagattctggat

SEQ ID NO: 132464 - DNA, 23 bp, Homo sapiens
tgtagtttcatattgtttccatc

SEQ ID NO: 132465 - DNA, 23 bp, Homo sapiens
tttatgccactgcttcatatctc

SEQ ID NO: 132466 - DNA, 20 bp, Homo sapiens
tacccttcagtctttcttga

SEQ ID NO: 132467 - DNA, 23 bp, Homo sapiens
tgagttcattgtagattctggat

SEQ ID NO: 132468 - DNA, 23 bp, Homo sapiens
tgagttcattgtagattctggat

SEQ ID NO: 132469 - DNA, 22 bp, Homo sapiens
gagcttgcatgtttattttcac

SEQ ID NO: 132470 - DNA, 23 bp, Homo sapiens
ggtgtcttgtgattctgttgaag

SEQ ID NO: 132471 - DNA, 23 bp, Homo sapiens
ttattggtagttcagcttctctt

SEQ ID NO: 132472 - DNA, 23 bp, Homo sapiens
tgagttcattgtagattctggat

SEQ ID NO: 132473 - DNA, 23 bp, Homo sapiens
ttcagtggcatgatcatggctca

SEQ ID NO: 132474 - DNA, 23 bp, Homo sapiens
tgtatatatgtatgtataaatgt

SEQ ID NO: 132475 - DNA, 20 bp, Homo sapiens
tttctgttgtgtgtatagtg

SEQ ID NO: 132476 - DNA, 23 bp, Homo sapiens
tagtctcttctagaagttgtccc

SEQ ID NO: 132477 - DNA, 23 bp, Homo sapiens
gcaacagactgaggacagagagg

SEQ ID NO: 132478 - DNA, 23 bp, Homo sapiens
tatatgtgcatatagatatcata

SEQ ID NO: 132479 - DNA, 18 bp, Homo sapiens
atagcatatatatagcat

SEQ ID NO: 132480 - DNA, 20 bp, Homo sapiens
atatatgtatatgtatacac

SEQ ID NO: 132481 - DNA, 23 bp, Homo sapiens
tgcagagacacctgagagtcgac

SEQ ID NO: 132482 - DNA, 23 bp, Homo sapiens
tatgagctcctaggtgatgctga

SEQ ID NO: 132483 - DNA, 22 bp, Homo sapiens
agtaactaaatgaaaatgcttt

SEQ ID NO: 132484 - DNA, 19 bp, Homo sapiens
atacgtatatatacgtata

SEQ ID NO: 132485 - DNA, 23 bp, Homo sapiens
ttctgtgtgtgtctgtatccaaa

SEQ ID NO: 132486 - DNA, 23 bp, Homo sapiens
ttattgctagaaatggaattctt

SEQ ID NO: 132487 - DNA, 19 bp, Homo sapiens
cagtctgtgtaactatatt

SEQ ID NO: 132488 - DNA, 20 bp, Homo sapiens
tatgtgtatatacatatatg

SEQ ID NO: 132489 - DNA, 23 bp, Homo sapiens
tataagaagttaaagaaaccaaa

SEQ ID NO: 132490 - DNA, 23 bp, Homo sapiens
tggtgagactgtgtctttctgga

SEQ ID NO: 132491 - DNA, 23 bp, Homo sapiens
tgagttcattgtagattctggat

SEQ ID NO: 132492 - DNA, 23 bp, Homo sapiens
tgagttcattgtagattctggat

SEQ ID NO: 132493 - DNA, 23 bp, Homo sapiens
tgagttcattgtagattctggat

SEQ ID NO: 132494 - DNA, 23 bp, Homo sapiens
tgagttcattgtagattctggat

SEQ ID NO: 132495 - DNA, 23 bp, Homo sapiens
acacgttgtgcacatgtatccta

SEQ ID NO: 132496 - DNA, 19 bp, Homo sapiens
atgtgcagaacatgcaggt

SEQ ID NO: 132497 - DNA, 18 bp, Homo sapiens
tgcacatatatatacaga

SEQ ID NO: 132498 - DNA, 23 bp, Homo sapiens
tgtctgtgtctggctctctggaa

SEQ ID NO: 132499 - DNA, 23 bp, Homo sapiens
cagacaagagaggcagcactcca

SEQ ID NO: 132500 - DNA, 20 bp, Homo sapiens
agcatgacagaatattttgt

SEQ ID NO: 132501 - DNA, 23 bp, Homo sapiens
tagtttctgtgtcttttagatga

SEQ ID NO: 132502 - DNA, 23 bp, Homo sapiens
caagagagaattttgagactact

SEQ ID NO: 132503 - DNA, 23 bp, Homo sapiens
tgtcagtcctctctttatttgta

SEQ ID NO: 132504 - DNA, 23 bp, Homo sapiens
ataacacccatcagagctgcagc

SEQ ID NO: 132505 - DNA, 21 bp, Homo sapiens
tcctagagtgcttgagtgatt

SEQ ID NO: 132506 - DNA, 23 bp, Homo sapiens
attttctcctatagttttcaaat

SEQ ID NO: 132507 - DNA, 23 bp, Homo sapiens
tgttttggttccatatgaaattt

SEQ ID NO: 132508 - DNA, 23 bp, Homo sapiens
tatatgtgtgtatatgtagtata

SEQ ID NO: 132509 - DNA, 23 bp, Homo sapiens
tatatgtgtgcatatatatgtat

SEQ ID NO: 132510 - DNA, 21 bp, Homo sapiens
atatatgtgtgcatatatatg

SEQ ID NO: 132511 - DNA, 19 bp, Homo sapiens
ttcatatatatatagtgtg

SEQ ID NO: 132512 - DNA, 23 bp, Homo sapiens
atctatatagtgtgtgtgtgtgt

SEQ ID NO: 132513 - DNA, 23 bp, Homo sapiens
gatttgtcacagttagctgttcc

SEQ ID NO: 132514 - DNA, 22 bp, Homo sapiens
atatatgtatttatgcatatgt

SEQ ID NO: 132515 - DNA, 23 bp, Homo sapiens
tgagttcattgtagattctggat

SEQ ID NO: 132516 - DNA, 22 bp, Homo sapiens
tatttgaaagaaatggctccca

SEQ ID NO: 132517 - DNA, 21 bp, Homo sapiens
atgggaagatcattggtgagt

SEQ ID NO: 132518 - DNA, 23 bp, Homo sapiens
tatgtatatatatgtatatgtat

SEQ ID NO: 132519 - DNA, 18 bp, Homo sapiens
tatgcatatatatatgta

SEQ ID NO: 132520 - DNA, 23 bp, Homo sapiens
tgagttcattgtagattctggat

SEQ ID NO: 132521 - DNA, 23 bp, Homo sapiens
tgagttcattgtagattctggat

SEQ ID NO: 132522 - DNA, 21 bp, Homo sapiens
tgtgaagaaagtctttggtag

SEQ ID NO: 132523 - DNA, 23 bp, Homo sapiens
gggtctcactctgtcacccaggc

SEQ ID NO: 132524 - DNA, 20 bp, Homo sapiens
gtgagcgtgattatgccatt

SEQ ID NO: 132525 - DNA, 21 bp, Homo sapiens
tctcagccactctcaggctga

SEQ ID NO: 132526 - DNA, 20 bp, Homo sapiens
ttcactgttgatctgaaatt

SEQ ID NO: 132527 - DNA, 18 bp, Homo sapiens
ggcagagtctcactcttt

SEQ ID NO: 132528 - DNA, 22 bp, Homo sapiens
ctaacagtttttggtggagtct

SEQ ID NO: 132529 - DNA, 21 bp, Homo sapiens
tctgattttatttgtattctt

SEQ ID NO: 132530 - DNA, 22 bp, Homo sapiens
tgtgtatatatgtatatatgtg

SEQ ID NO: 132531 - DNA, 22 bp, Homo sapiens
atatgtgcatatatatgtgtgt

SEQ ID NO: 132532 - DNA, 23 bp, Homo sapiens
gtatgtgctatgagtggtgtgtg

SEQ ID NO: 132533 - DNA, 21 bp, Homo sapiens
atgtttcatgcacagaatgtc

SEQ ID NO: 132534 - DNA, 19 bp, Homo sapiens
tgtggttcctcactttgga

SEQ ID NO: 132535 - DNA, 22 bp, Homo sapiens
agtaaactttgccacctttcat

SEQ ID NO: 132536 - DNA, 22 bp, Homo sapiens
ttctgcttgtaaaactttcttt

SEQ ID NO: 132537 - DNA, 23 bp, Homo sapiens
taagtcagaaaggcaaagaactc

SEQ ID NO: 132538 - DNA, 23 bp, Homo sapiens
tattggactctgagctttgtggt

SEQ ID NO: 132539 - DNA, 23 bp, Homo sapiens
gacagagtctcactgtgtcaccc

SEQ ID NO: 132540 - DNA, 21 bp, Homo sapiens
aatgtttggatagcttctaat

SEQ ID NO: 132541 - DNA, 20 bp, Homo sapiens
tgtggtaacactgtgtcaag

SEQ ID NO: 132542 - DNA, 20 bp, Homo sapiens
ttcaacagcatgtgctcact

SEQ ID NO: 132543 - DNA, 18 bp, Homo sapiens
agtatttggagtgtcaat

SEQ ID NO: 132544 - DNA, 23 bp, Homo sapiens
attgattgtgctggatgtttgca

SEQ ID NO: 132545 - DNA, 23 bp, Homo sapiens
taaggtggtgaagatcacagata

SEQ ID NO: 132546 - DNA, 21 bp, Homo sapiens
tacagtatatatatactgtat

SEQ ID NO: 132547 - DNA, 19 bp, Homo sapiens
cagtatatatatacagtat

SEQ ID NO: 132548 - DNA, 20 bp, Homo sapiens
ttataactaatggtgctgga

SEQ ID NO: 132549 - DNA, 23 bp, Homo sapiens
tttgaagaacttgagcatctgtt

SEQ ID NO: 132550 - DNA, 23 bp, Homo sapiens
tttttggttccatatgaaattta

SEQ ID NO: 132551 - DNA, 19 bp, Homo sapiens
atgtcagtgggagcttgag

SEQ ID NO: 132552 - DNA, 19 bp, Homo sapiens
cacgcagggtgtgaagtct

SEQ ID NO: 132553 - DNA, 23 bp, Homo sapiens
ttttcattccatatgaattgtag

SEQ ID NO: 132554 - DNA, 23 bp, Homo sapiens
tttgttctttttgcttaggattg

SEQ ID NO: 132555 - DNA, 23 bp, Homo sapiens
tgagttcattgtagattctggat

SEQ ID NO: 132556 - DNA, 23 bp, Homo sapiens
tgagttcattgtagattctggat

SEQ ID NO: 132557 - DNA, 18 bp, Homo sapiens
cagaccaggtgcactgca

SEQ ID NO: 132558 - DNA, 22 bp, Homo sapiens
ttaatgactaaggtttagattt

SEQ ID NO: 132559 - DNA, 21 bp, Homo sapiens
atatgtatatgtatacatata

SEQ ID NO: 132560 - DNA, 22 bp, Homo sapiens
gtatatatgtatatgtatacat

SEQ ID NO: 132561 - DNA, 23 bp, Homo sapiens
tctgagggacatatagaagagct

SEQ ID NO: 132562 - DNA, 23 bp, Homo sapiens
ctctgccactctgccactcttct

SEQ ID NO: 132563 - DNA, 23 bp, Homo sapiens
aactctcactgtatttaatgtgt

SEQ ID NO: 132564 - DNA, 23 bp, Homo sapiens
taggacagtggttcttcttttta

SEQ ID NO: 132565 - DNA, 23 bp, Homo sapiens
tatgtgtgtgtgcatgtgcacgt

SEQ ID NO: 132566 - DNA, 23 bp, Homo sapiens
tctctctttttcattcttggtga

SEQ ID NO: 132567 - DNA, 23 bp, Homo sapiens
tgagttcattgtagattctggat

SEQ ID NO: 132568 - DNA, 23 bp, Homo sapiens
tgagttcattgtagattctggat

SEQ ID NO: 132569 - DNA, 22 bp, Homo sapiens
ttcagttctgagctctttggaa

SEQ ID NO: 132570 - DNA, 23 bp, Homo sapiens
agggagtgctagagcacagaatg

SEQ ID NO: 132571 - DNA, 23 bp, Homo sapiens
cggagtctcactctgtcacccag

SEQ ID NO: 132572 - DNA, 21 bp, Homo sapiens
agtgtccttttattatgagac

SEQ ID NO: 132573 - DNA, 21 bp, Homo sapiens
ttttttccagagtctcgttct

SEQ ID NO: 132574 - DNA, 23 bp, Homo sapiens
gggagtctcactctgtcacccag

SEQ ID NO: 132575 - DNA, 23 bp, Homo sapiens
agagtctcactctgtcacccagg

SEQ ID NO: 132576 - DNA, 23 bp, Homo sapiens
gagtctcactctgtcacccaggc

SEQ ID NO: 132577 - DNA, 23 bp, Homo sapiens
gtgtatatatatgtgtatatgta

SEQ ID NO: 132578 - DNA, 23 bp, Homo sapiens
atctgtgtgtgcatgcataggtg

SEQ ID NO: 132579 - DNA, 21 bp, Homo sapiens
gtatgtgtgcatgagcatgtg

SEQ ID NO: 132580 - DNA, 23 bp, Homo sapiens
aatgagagactagtcccagcctt

SEQ ID NO: 132581 - DNA, 23 bp, Homo sapiens
gggtgcctgggtccctgtaagac

SEQ ID NO: 132582 - DNA, 23 bp, Homo sapiens
gagtctcactctgtcacccgggc

SEQ ID NO: 132583 - DNA, 23 bp, Homo sapiens
ggtctctctgtctgtctttatgc

SEQ ID NO: 132584 - DNA, 21 bp, Homo sapiens
acacacctgtagttccagcta

SEQ ID NO: 132585 - DNA, 23 bp, Homo sapiens
tgtgtatatatatatatgtgtgt

SEQ ID NO: 132586 - DNA, 23 bp, Homo sapiens
actgggtctcactccctgaatga

SEQ ID NO: 132587 - DNA, 23 bp, Homo sapiens
cagagtctcactctgtcacccag

SEQ ID NO: 132588 - DNA, 23 bp, Homo sapiens
tcacttcctctgactttctggtg

SEQ ID NO: 132589 - DNA, 23 bp, Homo sapiens
gtggatctgcatcttgatcatgc

SEQ ID NO: 132590 - DNA, 21 bp, Homo sapiens
tagagagaagacagtgagtag

SEQ ID NO: 132591 - DNA, 23 bp, Homo sapiens
tgccagtcctacctgttgacagt

SEQ ID NO: 132592 - DNA, 20 bp, Homo sapiens
agtccctgagagtgagtttc

SEQ ID NO: 132593 - DNA, 23 bp, Homo sapiens
gacagagtctcgctctgtcaccc

SEQ ID NO: 132594 - DNA, 23 bp, Homo sapiens
tgtgtatatatatatatgtgtgt

SEQ ID NO: 132595 - DNA, 21 bp, Homo sapiens
tgtgtgtatatatatatacgt

SEQ ID NO: 132596 - DNA, 23 bp, Homo sapiens
tatgtgtgtatatatatatgtgt

SEQ ID NO: 132597 - DNA, 23 bp, Homo sapiens
tatatgtgtgtatatatatacgt

SEQ ID NO: 132598 - DNA, 23 bp, Homo sapiens
gacagagtctcgctctgtcaccc

SEQ ID NO: 132599 - DNA, 23 bp, Homo sapiens
acagagtctcgctctgtcaccca

SEQ ID NO: 132600 - DNA, 23 bp, Homo sapiens
gagacggagtctcactctgtcac

SEQ ID NO: 132601 - DNA, 23 bp, Homo sapiens
gtctgagactgccctttcttttt

SEQ ID NO: 132602 - DNA, 23 bp, Homo sapiens
acagagtctcactgtgtctccca

SEQ ID NO: 132603 - DNA, 21 bp, Homo sapiens
gagtctcgctctgtcacccac

SEQ ID NO: 132604 - DNA, 19 bp, Homo sapiens
gtctcgctctgtcacccac

SEQ ID NO: 132605 - DNA, 23 bp, Homo sapiens
aggatctagcttgttttggtttg

SEQ ID NO: 132606 - DNA, 22 bp, Homo sapiens
caggtacaatgtggatgccgag

SEQ ID NO: 132607 - DNA, 23 bp, Homo sapiens
gtctgtgtccctcactgcctctc

SEQ ID NO: 132608 - DNA, 23 bp, Homo sapiens
gtcagggtctctctgtctcccag

SEQ ID NO: 132609 - DNA, 23 bp, Homo sapiens
agagtctcactctgtcacccagg

SEQ ID NO: 132610 - DNA, 23 bp, Homo sapiens
gtcagagtctcgctctgtcaccc

SEQ ID NO: 132611 - DNA, 23 bp, Homo sapiens
ctgggtgacacagtgagactctg

SEQ ID NO: 132612 - DNA, 23 bp, Homo sapiens
acacagtctcactctgtcgccca

SEQ ID NO: 132613 - DNA, 19 bp, Homo sapiens
ggcactctctaaggctgtg

SEQ ID NO: 132614 - DNA, 21 bp, Homo sapiens
atatgtgtatctatgtgtgtg

SEQ ID NO: 132615 - DNA, 23 bp, Homo sapiens
gatagtctcgctctgtcactcag

SEQ ID NO: 132616 - DNA, 23 bp, Homo sapiens
cggagtctcgctctgtctcccag

SEQ ID NO: 132617 - DNA, 19 bp, Homo sapiens
aaagtctttgaagtctgat

SEQ ID NO: 132618 - DNA, 21 bp, Homo sapiens
tgagatggagtctcactcttt

SEQ ID NO: 132619 - DNA, 19 bp, Homo sapiens
tttttttttttctggagac

SEQ ID NO: 132620 - DNA, 21 bp, Homo sapiens
agagcgtacactgcaggttgg

SEQ ID NO: 132621 - DNA, 22 bp, Homo sapiens
aatcagtgtctgaatgtgtgct

SEQ ID NO: 132622 - DNA, 23 bp, Homo sapiens
gaagaagtctcactctgtcaccc

SEQ ID NO: 132623 - DNA, 23 bp, Homo sapiens
agatggagtctctctctgtcacc

SEQ ID NO: 132624 - DNA, 23 bp, Homo sapiens
tctctgtgtccctctgtcatggg

SEQ ID NO: 132625 - DNA, 18 bp, Homo sapiens
tgcctgtagttccagcta

SEQ ID NO: 132626 - DNA, 23 bp, Homo sapiens
gtgtgtgtgcctgtgtctgtggg

SEQ ID NO: 132627 - DNA, 23 bp, Homo sapiens
ctcacagtctgtgtctgtgcttt

SEQ ID NO: 132628 - DNA, 23 bp, Homo sapiens
tgagtggagagttgtgtgtatgg

SEQ ID NO: 132629 - DNA, 23 bp, Homo sapiens
gagagtgcctgagatctgatttt

SEQ ID NO: 132630 - DNA, 23 bp, Homo sapiens
gagtctcactctgtcacccaggc

SEQ ID NO: 132631 - DNA, 21 bp, Homo sapiens
ggcagggactgtgactgtctc

SEQ ID NO: 132632 - DNA, 20 bp, Homo sapiens
tgagtctcgctctgtcaccc

SEQ ID NO: 132633 - DNA, 20 bp, Homo sapiens
cacaggctcacacactctgt

SEQ ID NO: 132634 - DNA, 20 bp, Homo sapiens
tttattgattttgagacagg

SEQ ID NO: 132635 - DNA, 23 bp, Homo sapiens
gcaggcacagtcactctgtcact

SEQ ID NO: 132636 - DNA, 23 bp, Homo sapiens
acccagtgctggaggaccagaag

SEQ ID NO: 132637 - DNA, 23 bp, Homo sapiens
ggtctgtgggtctctccccgtgt

SEQ ID NO: 132638 - DNA, 23 bp, Homo sapiens
gggtctcactctgtcacccaggc

SEQ ID NO: 132639 - DNA, 23 bp, Homo sapiens
atagactgtttacatgtaatgtg

SEQ ID NO: 132640 - DNA, 18 bp, Homo sapiens
acatgccttagtttcagc

SEQ ID NO: 132641 - DNA, 18 bp, Homo sapiens
aggaggctgaggtaggag

SEQ ID NO: 132642 - DNA, 23 bp, Homo sapiens
tgagttcattgtagattctggat

SEQ ID NO: 132643 - DNA, 23 bp, Homo sapiens
tgagttcattgtagattctggat

SEQ ID NO: 132644 - DNA, 23 bp, Homo sapiens
taacagtagtgacagtggacatc

SEQ ID NO: 132645 - DNA, 21 bp, Homo sapiens
tatcacattttctaatacagt

SEQ ID NO: 132646 - DNA, 23 bp, Homo sapiens
aacaagtgtgattatgtggttaa

SEQ ID NO: 132647 - DNA, 23 bp, Homo sapiens
tgagttcattgtagattctggat

SEQ ID NO: 132648 - DNA, 23 bp, Homo sapiens
attgtgtttattaagcagtttgg

SEQ ID NO: 132649 - DNA, 18 bp, Homo sapiens
caggtattattttcattt

SEQ ID NO: 132650 - DNA, 23 bp, Homo sapiens
ctactgtacttagcacaatggat

SEQ ID NO: 132651 - DNA, 23 bp, Homo sapiens
ataattcattgctgtggggctgt

SEQ ID NO: 132652 - DNA, 23 bp, Homo sapiens
acagagtctcactctgtcgccca

SEQ ID NO: 132653 - DNA, 21 bp, Homo sapiens
ttcaagtgattctcctgcctc

SEQ ID NO: 132654 - DNA, 23 bp, Homo sapiens
atatgtgtatatgtatgtgtgtg

SEQ ID NO: 132655 - DNA, 18 bp, Homo sapiens
tagtagcacagactctct

SEQ ID NO: 132656 - DNA, 21 bp, Homo sapiens
atttgtttgtttacgaaacac

SEQ ID NO: 132657 - DNA, 18 bp, Homo sapiens
cacttctttacttttgga

SEQ ID NO: 132658 - DNA, 23 bp, Homo sapiens
ctgactgtgtgtgtgagtgggtg

SEQ ID NO: 132659 - DNA, 19 bp, Homo sapiens
aacagtgaagagggaggtg

SEQ ID NO: 132660 - DNA, 21 bp, Homo sapiens
agtgtgcttcttgcttcttta

SEQ ID NO: 132661 - DNA, 23 bp, Homo sapiens
actcctacacactgcttggcctt

SEQ ID NO: 132662 - DNA, 21 bp, Homo sapiens
actcaggagagagtgtggaga

SEQ ID NO: 132663 - DNA, 23 bp, Homo sapiens
gatgtcatttctgaggttagggt

SEQ ID NO: 132664 - DNA, 23 bp, Homo sapiens
actgctgtcacttctgttgctct

SEQ ID NO: 132665 - DNA, 23 bp, Homo sapiens
tatgtatgtatatatatgtgtat

SEQ ID NO: 132666 - DNA, 23 bp, Homo sapiens
agagaacagactgagggctttag

SEQ ID NO: 132667 - DNA, 23 bp, Homo sapiens
aagtctacagtgcttgctgtgct

SEQ ID NO: 132668 - DNA, 18 bp, Homo sapiens
aagctagatctggtggac

SEQ ID NO: 132669 - DNA, 21 bp, Homo sapiens
agtgctctgtctcctgcctct

SEQ ID NO: 132670 - DNA, 23 bp, Homo sapiens
tgagacacagtctcgctctgtca

SEQ ID NO: 132671 - DNA, 23 bp, Homo sapiens
gagagatgagggaactgtctgtc

SEQ ID NO: 132672 - DNA, 18 bp, Homo sapiens
atgaatacatgtatgttc

SEQ ID NO: 132673 - DNA, 23 bp, Homo sapiens
gagttgggatctcactctgtcac

SEQ ID NO: 132674 - DNA, 22 bp, Homo sapiens
atatatgtgtatatgtatgtgt

SEQ ID NO: 132675 - DNA, 23 bp, Homo sapiens
tgcatcaggtaattttttgcact

SEQ ID NO: 132676 - DNA, 23 bp, Homo sapiens
agaaagaagacactgagcagtgg

SEQ ID NO: 132677 - DNA, 23 bp, Homo sapiens
catacacgtatgtatatatgtgt

SEQ ID NO: 132678 - DNA, 23 bp, Homo sapiens
acacacacatacacgtatgtata

SEQ ID NO: 132679 - DNA, 23 bp, Homo sapiens
gctgtatagtattcattccattg

SEQ ID NO: 132680 - DNA, 22 bp, Homo sapiens
tgtattcatcctacagtttgtg

SEQ ID NO: 132681 - DNA, 23 bp, Homo sapiens
tatgtttcattatattgctctta

SEQ ID NO: 132682 - DNA, 23 bp, Homo sapiens
atgtatagtactgatattgtact

SEQ ID NO: 132683 - DNA, 22 bp, Homo sapiens
tgaaaagtaagatttttatgct

SEQ ID NO: 132684 - DNA, 23 bp, Homo sapiens
agagtctcactctgtctcccagg

SEQ ID NO: 132685 - DNA, 22 bp, Homo sapiens
tgagtgatgagactgtgggttg

SEQ ID NO: 132686 - DNA, 23 bp, Homo sapiens
tgggtgtgctttcatttggctga

SEQ ID NO: 132687 - DNA, 23 bp, Homo sapiens
tctgtgaccctgtcacagcgtca

SEQ ID NO: 132688 - DNA, 22 bp, Homo sapiens
atcacactggttgagtaaagca

SEQ ID NO: 132689 - DNA, 23 bp, Homo sapiens
tttgacagtgagcagtctgcctg

SEQ ID NO: 132690 - DNA, 23 bp, Homo sapiens
tctcaagtgttttggtagtgatt

SEQ ID NO: 132691 - DNA, 23 bp, Homo sapiens
tgaggcttgaagatcagtagaaa

SEQ ID NO: 132692 - DNA, 20 bp, Homo sapiens
attgtgggtcatatagtagt

SEQ ID NO: 132693 - DNA, 23 bp, Homo sapiens
tgagttcattgtagattctggat

SEQ ID NO: 132694 - DNA, 23 bp, Homo sapiens
tgagttcattgtagattctggat

SEQ ID NO: 132695 - DNA, 19 bp, Homo sapiens
tgcaatggtgtgatctcag

SEQ ID NO: 132696 - DNA, 20 bp, Homo sapiens
cctttgtaaacatgcatata

SEQ ID NO: 132697 - DNA, 23 bp, Homo sapiens
tgagttcattgtagattctggat

SEQ ID NO: 132698 - DNA, 23 bp, Homo sapiens
tgagttcattgtagattctggat

SEQ ID NO: 132699 - DNA, 19 bp, Homo sapiens
tgtgtgtgtgtatgtgtgt

SEQ ID NO: 132700 - DNA, 23 bp, Homo sapiens
ctctctttctgtctcatatagat

SEQ ID NO: 132701 - DNA, 22 bp, Homo sapiens
tacacaccattgaattgtgaca

SEQ ID NO: 132702 - DNA, 22 bp, Homo sapiens
tatgtacatgtacacatattta

SEQ ID NO: 132703 - DNA, 23 bp, Homo sapiens
aaagtgctctttttgcttaaatt

SEQ ID NO: 132704 - DNA, 23 bp, Homo sapiens
atgtgtgtatatatgtatgtgaa

SEQ ID NO: 132705 - DNA, 23 bp, Homo sapiens
cttgcatatgtaaacagatagct

SEQ ID NO: 132706 - DNA, 23 bp, Homo sapiens
ttacattgtttttcaaagccttt

SEQ ID NO: 132707 - DNA, 22 bp, Homo sapiens
atcttccaacatgatcgtgagt

SEQ ID NO: 132708 - DNA, 22 bp, Homo sapiens
atctgaagtataaattacgtgt

SEQ ID NO: 132709 - DNA, 22 bp, Homo sapiens
tttttgctttatatatgtgtat

SEQ ID NO: 132710 - DNA, 23 bp, Homo sapiens
tatgtatatatgtatgtatatgt

SEQ ID NO: 132711 - DNA, 23 bp, Homo sapiens
aggcaggcaaagagtatagtgaa

SEQ ID NO: 132712 - DNA, 23 bp, Homo sapiens
tgagttcattgtagattctggat

SEQ ID NO: 132713 - DNA, 23 bp, Homo sapiens
tgagttcattgtagattctggat

SEQ ID NO: 132714 - DNA, 23 bp, Homo sapiens
ttcagtcagaattgagtgagctc

SEQ ID NO: 132715 - DNA, 23 bp, Homo sapiens
tattcattgcatttctaatcaaa

SEQ ID NO: 132716 - DNA, 23 bp, Homo sapiens
tgagttcattgtagattctggat

SEQ ID NO: 132717 - DNA, 23 bp, Homo sapiens
tgagttcattgtagattctggat

SEQ ID NO: 132718 - DNA, 23 bp, Homo sapiens
gggtctcactctgtcacccaggc

SEQ ID NO: 132719 - DNA, 23 bp, Homo sapiens
tgtgtgttcaatatcaaaacatc

SEQ ID NO: 132720 - DNA, 23 bp, Homo sapiens
agagtggctctctctttctctgt

SEQ ID NO: 132721 - DNA, 19 bp, Homo sapiens
tgagtcagagtctcactct

SEQ ID NO: 132722 - DNA, 22 bp, Homo sapiens
tacagagtcttactgtctccta

SEQ ID NO: 132723 - DNA, 23 bp, Homo sapiens
taatcacactgctcatgcagccc

SEQ ID NO: 132724 - DNA, 23 bp, Homo sapiens
tgtatcactcattttgtacttct

SEQ ID NO: 132725 - DNA, 23 bp, Homo sapiens
ggcttacagtatgcctttcttct

SEQ ID NO: 132726 - DNA, 23 bp, Homo sapiens
attaatgtggatactgatatgat

SEQ ID NO: 132727 - DNA, 22 bp, Homo sapiens
gcactgactctatacagacagg

SEQ ID NO: 132728 - DNA, 23 bp, Homo sapiens
agtctgtcttcctgtgtgtctca

SEQ ID NO: 132729 - DNA, 23 bp, Homo sapiens
tcttttttggttccatatgaaat

SEQ ID NO: 132730 - DNA, 23 bp, Homo sapiens
tgtgaagaaagtcaatggtagct

SEQ ID NO: 132731 - DNA, 23 bp, Homo sapiens
agagatgtggttttcttgacctg

SEQ ID NO: 132732 - DNA, 23 bp, Homo sapiens
aaatcttatttccttttagtgtg

SEQ ID NO: 132733 - DNA, 19 bp, Homo sapiens
tttaatcctgcttgtgtga

SEQ ID NO: 132734 - DNA, 23 bp, Homo sapiens
tgagttcattgtagattctggat

SEQ ID NO: 132735 - DNA, 23 bp, Homo sapiens
tgagttcattgtagattctggat

SEQ ID NO: 132736 - DNA, 23 bp, Homo sapiens
tggagtctcactctgtcacccag

SEQ ID NO: 132737 - DNA, 23 bp, Homo sapiens
tgagttcattgtagattctggat

SEQ ID NO: 132738 - DNA, 23 bp, Homo sapiens
tgagttcattgtagattctggat

SEQ ID NO: 132739 - DNA, 22 bp, Homo sapiens
gctttttgaatgttctctgggg

SEQ ID NO: 132740 - DNA, 22 bp, Homo sapiens
catgattactatagaagtatgt

SEQ ID NO: 132741 - DNA, 23 bp, Homo sapiens
tttttgggtgtgtaaaggctttt

SEQ ID NO: 132742 - DNA, 23 bp, Homo sapiens
acagagtctcgctctgtcaccca

SEQ ID NO: 132743 - DNA, 23 bp, Homo sapiens
gacagagtctcgctctgtcgctc

SEQ ID NO: 132744 - DNA, 20 bp, Homo sapiens
gtgtgtgtgtgtgtgtgtgt

SEQ ID NO: 132745 - DNA, 18 bp, Homo sapiens
tatatgtacatataatag

SEQ ID NO: 132746 - DNA, 21 bp, Homo sapiens
tatacgtatatatgcattgtg

SEQ ID NO: 132747 - DNA, 23 bp, Homo sapiens
cggagtctcgctctgtctcccag

SEQ ID NO: 132748 - DNA, 19 bp, Homo sapiens
tcactggcaataaggtgtt

SEQ ID NO: 132749 - DNA, 19 bp, Homo sapiens
tctgctcttgtcaagtatc

SEQ ID NO: 132750 - DNA, 23 bp, Homo sapiens
gagatatgacctttggccttgga

SEQ ID NO: 132751 - DNA, 23 bp, Homo sapiens
tatatgtatgtatatatgtgtgt

SEQ ID NO: 132752 - DNA, 18 bp, Homo sapiens
atatgtatgtaaaacata

SEQ ID NO: 132753 - DNA, 23 bp, Homo sapiens
cactgagtctcactctgttgctc

SEQ ID NO: 132754 - DNA, 22 bp, Homo sapiens
tttctagaagtgagtgtggtca

SEQ ID NO: 132755 - DNA, 23 bp, Homo sapiens
ctcccagagcccctggaactctg

SEQ ID NO: 132756 - DNA, 23 bp, Homo sapiens
tcaaggtagtgtctggctacgat

SEQ ID NO: 132757 - DNA, 23 bp, Homo sapiens
agtaaatgtaggtgcttttgatg

SEQ ID NO: 132758 - DNA, 23 bp, Homo sapiens
agcctgcctccctccgtgtctgg

SEQ ID NO: 132759 - DNA, 21 bp, Homo sapiens
atatctatagatgtactagta

SEQ ID NO: 132760 - DNA, 23 bp, Homo sapiens
aatgtgcaactaggattgagtct

SEQ ID NO: 132761 - DNA, 23 bp, Homo sapiens
ttgtaggttgtgagtcagagttc

SEQ ID NO: 132762 - DNA, 22 bp, Homo sapiens
tacctgtttgtatattcactct

SEQ ID NO: 132763 - DNA, 23 bp, Homo sapiens
cgctcagtccctcactctgcctg

SEQ ID NO: 132764 - DNA, 18 bp, Homo sapiens
agatgcacagtctgtgac

SEQ ID NO: 132765 - DNA, 23 bp, Homo sapiens
tctgtgatagcagactgagcaga

SEQ ID NO: 132766 - DNA, 19 bp, Homo sapiens
agtgccatgtcatcacaga

SEQ ID NO: 132767 - DNA, 21 bp, Homo sapiens
tccaggagtcattggaatctg

SEQ ID NO: 132768 - DNA, 23 bp, Homo sapiens
agagtctcactctgtcacccagg

SEQ ID NO: 132769 - DNA, 23 bp, Homo sapiens
gagtctcactctgtcacccaggc

SEQ ID NO: 132770 - DNA, 23 bp, Homo sapiens
actgtgtctggtccaatatgcat

SEQ ID NO: 132771 - DNA, 23 bp, Homo sapiens
atctcgtttcactgcaacctctg

SEQ ID NO: 132772 - DNA, 22 bp, Homo sapiens
tttgtgcatgctcaaagctaga

SEQ ID NO: 132773 - DNA, 23 bp, Homo sapiens
agttcttgttttcagattttgta

SEQ ID NO: 132774 - DNA, 21 bp, Homo sapiens
tatacatacatatacatatgt

SEQ ID NO: 132775 - DNA, 21 bp, Homo sapiens
tatacatacatatacatatgt

SEQ ID NO: 132776 - DNA, 23 bp, Homo sapiens
atgcatctgtctctgtctgtctc

SEQ ID NO: 132777 - DNA, 22 bp, Homo sapiens
tgacaattacagcaaggggtca

SEQ ID NO: 132778 - DNA, 18 bp, Homo sapiens
tgcaatgtaaagaagtaa

SEQ ID NO: 132779 - DNA, 23 bp, Homo sapiens
tgagttcattgtagattctggat

SEQ ID NO: 132780 - DNA, 23 bp, Homo sapiens
tgagttcattgtagattctggat

SEQ ID NO: 132781 - DNA, 21 bp, Homo sapiens
tatgtgtgtggctcttctttt

SEQ ID NO: 132782 - DNA, 23 bp, Homo sapiens
acctcttcttggtcctgtgtgag

SEQ ID NO: 132783 - DNA, 23 bp, Homo sapiens
ttgattctcagatttgtcattgt

SEQ ID NO: 132784 - DNA, 23 bp, Homo sapiens
ggttcaatgttgtacagcagata

SEQ ID NO: 132785 - DNA, 20 bp, Homo sapiens
agcaagtgacaaattatgta

SEQ ID NO: 132786 - DNA, 23 bp, Homo sapiens
atatatgatgtacaacatgatgt

SEQ ID NO: 132787 - DNA, 23 bp, Homo sapiens
aaagatttacttgcttgtttact

SEQ ID NO: 132788 - DNA, 23 bp, Homo sapiens
agtgagaagtgaaagcaaagtct

SEQ ID NO: 132789 - DNA, 23 bp, Homo sapiens
tgagttcattgtagattctggat

SEQ ID NO: 132790 - DNA, 23 bp, Homo sapiens
tgagttcattgtagattctggat

SEQ ID NO: 132791 - DNA, 23 bp, Homo sapiens
agtgcatgaaagtaaatgtctgt

SEQ ID NO: 132792 - DNA, 23 bp, Homo sapiens
tgcctctctctctctggctctgc

SEQ ID NO: 132793 - DNA, 23 bp, Homo sapiens
tagagagcaatgttgtttgggga

SEQ ID NO: 132794 - DNA, 23 bp, Homo sapiens
tgagttcattgtagattctggat

SEQ ID NO: 132795 - DNA, 23 bp, Homo sapiens
tgagttcattgtagattctggat

SEQ ID NO: 132796 - DNA, 23 bp, Homo sapiens
tgcagtatttggttttctattgc

SEQ ID NO: 132797 - DNA, 23 bp, Homo sapiens
tattgcttgtatttttatgtatg

SEQ ID NO: 132798 - DNA, 23 bp, Homo sapiens
tatgtgtgtatatataatagtga

SEQ ID NO: 132799 - DNA, 23 bp, Homo sapiens
atataacaggtgcaaactgagca

SEQ ID NO: 132800 - DNA, 23 bp, Homo sapiens
agactttcttgatgagattggaa

SEQ ID NO: 132801 - DNA, 23 bp, Homo sapiens
aaatctgagtgtaaaagcagact

SEQ ID NO: 132802 - DNA, 21 bp, Homo sapiens
tcatcgtaataaaaccattga

SEQ ID NO: 132803 - DNA, 22 bp, Homo sapiens
tctctgaagaatctgtccagct

SEQ ID NO: 132804 - DNA, 23 bp, Homo sapiens
tttgtgtcagaacagtgtgagtc

SEQ ID NO: 132805 - DNA, 23 bp, Homo sapiens
tcaggataagtattcttcatgaa

SEQ ID NO: 132806 - DNA, 23 bp, Homo sapiens
tgtgggtgagtgtctgtgtgtct

SEQ ID NO: 132807 - DNA, 22 bp, Homo sapiens
ctcactgaaagctcagcctcct

SEQ ID NO: 132808 - DNA, 22 bp, Homo sapiens
tagacgacagatataggtgtgt

SEQ ID NO: 132809 - DNA, 23 bp, Homo sapiens
tatgtgtgtgtgtatgtacatag

SEQ ID NO: 132810 - DNA, 23 bp, Homo sapiens
tttaagttatcagaagttttgtt

SEQ ID NO: 132811 - DNA, 20 bp, Homo sapiens
aggtggactggctgtcttct

SEQ ID NO: 132812 - DNA, 23 bp, Homo sapiens
catacactagtcaatatcttcag

SEQ ID NO: 132813 - DNA, 19 bp, Homo sapiens
tgacagaacagtgtcagca

SEQ ID NO: 132814 - DNA, 23 bp, Homo sapiens
tgagttcattgtagattctggat

SEQ ID NO: 132815 - DNA, 23 bp, Homo sapiens
tgagttcattgtagattctggat

SEQ ID NO: 132816 - DNA, 23 bp, Homo sapiens
tgagttcattgtagattctggat

SEQ ID NO: 132817 - DNA, 23 bp, Homo sapiens
tgagttcattgtagattctggat

SEQ ID NO: 132818 - DNA, 21 bp, Homo sapiens
agagtgcctactttgtgtcag

SEQ ID NO: 132819 - DNA, 23 bp, Homo sapiens
taaatgtgtggttttgttgctgt

SEQ ID NO: 132820 - DNA, 18 bp, Homo sapiens
atatgcttatatattcaa

SEQ ID NO: 132821 - DNA, 18 bp, Homo sapiens
tgcttatatattcaagga

SEQ ID NO: 132822 - DNA, 18 bp, Homo sapiens
atatgcttatatattcaa

SEQ ID NO: 132823 - DNA, 23 bp, Homo sapiens
tgtatgtgtgtgtgtgtacatac

SEQ ID NO: 132824 - DNA, 22 bp, Homo sapiens
atatgtatgtatgtatatatgt

SEQ ID NO: 132825 - DNA, 22 bp, Homo sapiens
gtgtgtgtgtgtatatgtggat

SEQ ID NO: 132826 - DNA, 22 bp, Homo sapiens
agacagaagagtctgtgcccat

SEQ ID NO: 132827 - DNA, 21 bp, Homo sapiens
tgtaaggctgcttctaactgt

SEQ ID NO: 132828 - DNA, 23 bp, Homo sapiens
ctcaatctctgtctgaggggttg

SEQ ID NO: 132829 - DNA, 22 bp, Homo sapiens
atatatctacatgtatctgtat

SEQ ID NO: 132830 - DNA, 22 bp, Homo sapiens
gcgtgtggtagagttgagattt

SEQ ID NO: 132831 - DNA, 23 bp, Homo sapiens
tgtttgagctgagacattggtct

SEQ ID NO: 132832 - DNA, 22 bp, Homo sapiens
ctgtcttcagactcagacacag

SEQ ID NO: 132833 - DNA, 22 bp, Homo sapiens
atgtgtaatggtggtgtacttg

SEQ ID NO: 132834 - DNA, 23 bp, Homo sapiens
catatgtgtatatgtatatgtgt

SEQ ID NO: 132835 - DNA, 22 bp, Homo sapiens
catatgtgtatatatacatgtg

SEQ ID NO: 132836 - DNA, 22 bp, Homo sapiens
agtcagtggcatattcatcttt

SEQ ID NO: 132837 - DNA, 22 bp, Homo sapiens
tgagtaaacttaaatgtgaggt

SEQ ID NO: 132838 - DNA, 22 bp, Homo sapiens
atgtgtatatatacgtatatgt

SEQ ID NO: 132839 - DNA, 23 bp, Homo sapiens
ttttttggttccatatgaaattt

SEQ ID NO: 132840 - DNA, 20 bp, Homo sapiens
tatattgtttagaagaatgt

SEQ ID NO: 132841 - DNA, 19 bp, Homo sapiens
agggagagaacaatgctgt

SEQ ID NO: 132842 - DNA, 23 bp, Homo sapiens
atgtgtatatgtatatgtatgca

SEQ ID NO: 132843 - DNA, 23 bp, Homo sapiens
tgtgtatatgtatgcatatatgt

SEQ ID NO: 132844 - DNA, 23 bp, Homo sapiens
tgagttcattgtagattctggat

SEQ ID NO: 132845 - DNA, 23 bp, Homo sapiens
tgagttcattgtagattctggat

SEQ ID NO: 132846 - DNA, 19 bp, Homo sapiens
tggggctctataatcagca

SEQ ID NO: 132847 - DNA, 23 bp, Homo sapiens
cggagtctcgctctgtctcccag

SEQ ID NO: 132848 - DNA, 23 bp, Homo sapiens
atgtgtgtatgtgtgtatagtga

SEQ ID NO: 132849 - DNA, 23 bp, Homo sapiens
tatatgtggatatatatacatat

SEQ ID NO: 132850 - DNA, 23 bp, Homo sapiens
acatctgtttccaaatgttgtct

SEQ ID NO: 132851 - DNA, 22 bp, Homo sapiens
taaggaagaacaattcagtctc

SEQ ID NO: 132852 - DNA, 23 bp, Homo sapiens
caagtgttgtctgctcattgatt

SEQ ID NO: 132853 - DNA, 23 bp, Homo sapiens
agggagagagagagaatcctgta

SEQ ID NO: 132854 - DNA, 23 bp, Homo sapiens
gtgtgtgtgtgtatgtgagagag

SEQ ID NO: 132855 - DNA, 20 bp, Homo sapiens
catctcactctgacactcag

SEQ ID NO: 132856 - DNA, 23 bp, Homo sapiens
taaatgaagcatatctctctcta

SEQ ID NO: 132857 - DNA, 23 bp, Homo sapiens
atgtatgtatatatatgaagaag

SEQ ID NO: 132858 - DNA, 23 bp, Homo sapiens
tgtgtgtgtgcgtgtgcctatgt

SEQ ID NO: 132859 - DNA, 20 bp, Homo sapiens
ggatgaatagtttgcaaata

SEQ ID NO: 132860 - DNA, 23 bp, Homo sapiens
gacagtgagaatgtttatattgg

SEQ ID NO: 132861 - DNA, 19 bp, Homo sapiens
tatgtgtatatatatatgt

SEQ ID NO: 132862 - DNA, 20 bp, Homo sapiens
cagtgtcggtcttcattcta

SEQ ID NO: 132863 - DNA, 22 bp, Homo sapiens
gtgagtctctgtctgcctcccc

SEQ ID NO: 132864 - DNA, 19 bp, Homo sapiens
gtgaccatggctcactgta

SEQ ID NO: 132865 - DNA, 23 bp, Homo sapiens
tgagttcattgtagattctggat

SEQ ID NO: 132866 - DNA, 23 bp, Homo sapiens
tgagttcattgtagattctggat

SEQ ID NO: 132867 - DNA, 23 bp, Homo sapiens
ataaatacacaatatgtaaagat

SEQ ID NO: 132868 - DNA, 23 bp, Homo sapiens
ctcagtgacattctctgtctaag

SEQ ID NO: 132869 - DNA, 23 bp, Homo sapiens
gtgtctctgtgtctctggaagtt

SEQ ID NO: 132870 - DNA, 20 bp, Homo sapiens
tcacagagggataggaggcc

SEQ ID NO: 132871 - DNA, 22 bp, Homo sapiens
agaagtcactttgtgtctctgt

SEQ ID NO: 132872 - DNA, 23 bp, Homo sapiens
ctctgtcactgacagagagccac

SEQ ID NO: 132873 - DNA, 22 bp, Homo sapiens
aacactaagtgaaaagggtgct

SEQ ID NO: 132874 - DNA, 22 bp, Homo sapiens
gagacacagtttcactctgtca

SEQ ID NO: 132875 - DNA, 23 bp, Homo sapiens
tccctctgtctgtctgtgttcaa

SEQ ID NO: 132876 - DNA, 23 bp, Homo sapiens
tccctgtgtccctcactggctaa

SEQ ID NO: 132877 - DNA, 21 bp, Homo sapiens
tgagaggacagaagagtcagg

SEQ ID NO: 132878 - DNA, 23 bp, Homo sapiens
gctgaggtaggaggatcacttga

SEQ ID NO: 132879 - DNA, 23 bp, Homo sapiens
tcagagtctcactctgtcatcca

SEQ ID NO: 132880 - DNA, 22 bp, Homo sapiens
atcatggtcattctctgtctca

SEQ ID NO: 132881 - DNA, 21 bp, Homo sapiens
ttagccttatatagcatatct

SEQ ID NO: 132882 - DNA, 23 bp, Homo sapiens
catatcactgtatatgctatata

SEQ ID NO: 132883 - DNA, 20 bp, Homo sapiens
tctctcattctctcaaacag

SEQ ID NO: 132884 - DNA, 23 bp, Homo sapiens
tcagtcattcactctcagtgaga

SEQ ID NO: 132885 - DNA, 23 bp, Homo sapiens
tcactgttcactgcaatcttgac

SEQ ID NO: 132886 - DNA, 23 bp, Homo sapiens
tgtcagtacagacggaggagaga

SEQ ID NO: 132887 - DNA, 23 bp, Homo sapiens
tacacgtgtatatgtatacatac

SEQ ID NO: 132888 - DNA, 23 bp, Homo sapiens
atatgtatgtatatatacgtgtg

SEQ ID NO: 132889 - DNA, 18 bp, Homo sapiens
caagactctgtctcaaaa

SEQ ID NO: 132890 - DNA, 23 bp, Homo sapiens
tgtctgtcagtgtgccacttacc

SEQ ID NO: 132891 - DNA, 23 bp, Homo sapiens
tggagtctcactctgtcacccag

SEQ ID NO: 132892 - DNA, 23 bp, Homo sapiens
tctcagagaactgtattacttga

SEQ ID NO: 132893 - DNA, 23 bp, Homo sapiens
ttccaagtaccaggccacctgga

SEQ ID NO: 132894 - DNA, 20 bp, Homo sapiens
atcagaagtcaaattcctga

SEQ ID NO: 132895 - DNA, 23 bp, Homo sapiens
tcaagagcaataacgaaaaatgt

SEQ ID NO: 132896 - DNA, 20 bp, Homo sapiens
tattgctcctgacctcctct

SEQ ID NO: 132897 - DNA, 23 bp, Homo sapiens
cagacttctctttctctgtcttg

SEQ ID NO: 132898 - DNA, 23 bp, Homo sapiens
gactgagtctcgctctgtcaccc

SEQ ID NO: 132899 - DNA, 23 bp, Homo sapiens
tgtaagatgattgcacctgagcc

SEQ ID NO: 132900 - DNA, 23 bp, Homo sapiens
tgagttcattgtagattctggat

SEQ ID NO: 132901 - DNA, 23 bp, Homo sapiens
ctactatgcattagaatacataa

SEQ ID NO: 132902 - DNA, 20 bp, Homo sapiens
tgtcagtgttcagagagggc

SEQ ID NO: 132903 - DNA, 23 bp, Homo sapiens
gggtctcactctgtcactcaggc

SEQ ID NO: 132904 - DNA, 23 bp, Homo sapiens
actctgagattctatgattatgg

SEQ ID NO: 132905 - DNA, 22 bp, Homo sapiens
aagacaggaatttttaaggggt

SEQ ID NO: 132906 - DNA, 23 bp, Homo sapiens
ttagactggcttatttttgtttt

SEQ ID NO: 132907 - DNA, 23 bp, Homo sapiens
gggtctcactctgtcacccaggc

SEQ ID NO: 132908 - DNA, 23 bp, Homo sapiens
aggtaataggttgaaaagtcaag

SEQ ID NO: 132909 - DNA, 23 bp, Homo sapiens
gagacagagtctcgctctgtcac

SEQ ID NO: 132910 - DNA, 23 bp, Homo sapiens
gactgagtctcactctgtcgccc

SEQ ID NO: 132911 - DNA, 23 bp, Homo sapiens
cctatcttaattagttacatctg

SEQ ID NO: 132912 - DNA, 23 bp, Homo sapiens
ggctgcctctgtgtgactctctc

SEQ ID NO: 132913 - DNA, 23 bp, Homo sapiens
cataagtcactctctccctctgc

SEQ ID NO: 132914 - DNA, 20 bp, Homo sapiens
tgtgtactcggttctatgca

SEQ ID NO: 132915 - DNA, 23 bp, Homo sapiens
tgctatgggtgtgtacgccactg

SEQ ID NO: 132916 - DNA, 23 bp, Homo sapiens
catgtctcagtattgtgagagca

SEQ ID NO: 132917 - DNA, 23 bp, Homo sapiens
tgtgtctgtgtgtgtgtatgtgt

SEQ ID NO: 132918 - DNA, 23 bp, Homo sapiens
cggagtctcgctctgtcgctcag

SEQ ID NO: 132919 - DNA, 23 bp, Homo sapiens
ccaactgctcctctatcaagact

SEQ ID NO: 132920 - DNA, 20 bp, Homo sapiens
tgagtgatctgagagagcag

SEQ ID NO: 132921 - DNA, 23 bp, Homo sapiens
ttggtccttgtactagagatttt

SEQ ID NO: 132922 - DNA, 21 bp, Homo sapiens
tctctgtaaggcactgtgttg

SEQ ID NO: 132923 - DNA, 23 bp, Homo sapiens
cagtgcttatagtatgttgaatt

SEQ ID NO: 132924 - DNA, 23 bp, Homo sapiens
atatgtatacatacacacacgta

SEQ ID NO: 132925 - DNA, 23 bp, Homo sapiens
tatgtatgtatgtgtgtgtacat

SEQ ID NO: 132926 - DNA, 22 bp, Homo sapiens
tattaggaggaaaaagctgact

SEQ ID NO: 132927 - DNA, 23 bp, Homo sapiens
actctgtcactcagatctttaga

SEQ ID NO: 132928 - DNA, 22 bp, Homo sapiens
ttccatgaagaaagccaatggt

SEQ ID NO: 132929 - DNA, 22 bp, Homo sapiens
aaatttttgaagagacagggtc

SEQ ID NO: 132930 - DNA, 23 bp, Homo sapiens
tccaccagagagtgtgttcagtg

SEQ ID NO: 132931 - DNA, 22 bp, Homo sapiens
tgtcagaagtaaatgagcactt

SEQ ID NO: 132932 - DNA, 23 bp, Homo sapiens
acattcttgtggtcccagctact

SEQ ID NO: 132933 - DNA, 23 bp, Homo sapiens
ggctgaggtaggaggatcacttg

SEQ ID NO: 132934 - DNA, 18 bp, Homo sapiens
acagtgggtacagacccc

SEQ ID NO: 132935 - DNA, 18 bp, Homo sapiens
tgactttctgagtgtctc

SEQ ID NO: 132936 - DNA, 18 bp, Homo sapiens
aatcagagtggctcttct

SEQ ID NO: 132937 - DNA, 19 bp, Homo sapiens
tgtgtgtttgtgtgtgtta

SEQ ID NO: 132938 - DNA, 23 bp, Homo sapiens
tgtgtcagagtctcactctgtcg

SEQ ID NO: 132939 - DNA, 21 bp, Homo sapiens
gacagtgaacacagagctggg

SEQ ID NO: 132940 - DNA, 22 bp, Homo sapiens
aaagtccatgtattatgtatta

SEQ ID NO: 132941 - DNA, 19 bp, Homo sapiens
atatgttacatatattggc

SEQ ID NO: 132942 - DNA, 20 bp, Homo sapiens
atgtactttatatatgtgta

SEQ ID NO: 132943 - DNA, 20 bp, Homo sapiens
ttctggatatatatatctat

SEQ ID NO: 132944 - DNA, 20 bp, Homo sapiens
attctggatatatatatcct

SEQ ID NO: 132945 - DNA, 20 bp, Homo sapiens
ttattctacagaaagtttgt

SEQ ID NO: 132946 - DNA, 23 bp, Homo sapiens
aaatgctgattatgtaatactga

SEQ ID NO: 132947 - DNA, 23 bp, Homo sapiens
tgagttcattgtagattctggat

SEQ ID NO: 132948 - DNA, 23 bp, Homo sapiens
tgagttcattgtagattctggat

SEQ ID NO: 132949 - DNA, 20 bp, Homo sapiens
cacagttcagtgagacctca

SEQ ID NO: 132950 - DNA, 22 bp, Homo sapiens
tacactggtgtctctgcagagt

SEQ ID NO: 132951 - DNA, 23 bp, Homo sapiens
tatgacactcgctgagtcactgc

SEQ ID NO: 132952 - DNA, 23 bp, Homo sapiens
ggtctctctctctcactcttgtc

SEQ ID NO: 132953 - DNA, 21 bp, Homo sapiens
taagtcagaaaacagagacta

SEQ ID NO: 132954 - DNA, 23 bp, Homo sapiens
ttagcaaagtctctgcagtgtct

SEQ ID NO: 132955 - DNA, 23 bp, Homo sapiens
gacagagtctcgctctgtcaccc

SEQ ID NO: 132956 - DNA, 23 bp, Homo sapiens
tttgactatttgaattatgtatg

SEQ ID NO: 132957 - DNA, 23 bp, Homo sapiens
acttactgcaactgcatgttgtc

SEQ ID NO: 132958 - DNA, 23 bp, Homo sapiens
ctgagttctcagctctagagact

SEQ ID NO: 132959 - DNA, 23 bp, Homo sapiens
aaaagtagagaatttgttgttat

SEQ ID NO: 132960 - DNA, 23 bp, Homo sapiens
ccactgtcactcattgtctgtcc

SEQ ID NO: 132961 - DNA, 23 bp, Homo sapiens
aggtgagtctcagaggaggtgtg

SEQ ID NO: 132962 - DNA, 23 bp, Homo sapiens
ctgtctctatttcattttttgaa

SEQ ID NO: 132963 - DNA, 23 bp, Homo sapiens
tgagttcattgtagattctggat

SEQ ID NO: 132964 - DNA, 23 bp, Homo sapiens
tgagttcattgtagattctggat

SEQ ID NO: 132965 - DNA, 19 bp, Homo sapiens
ctctgcctctgacagtctc

SEQ ID NO: 132966 - DNA, 18 bp, Homo sapiens
tcactgcagcctctgtct

SEQ ID NO: 132967 - DNA, 23 bp, Homo sapiens
gtcttgtagaccctctgttaatg

SEQ ID NO: 132968 - DNA, 20 bp, Homo sapiens
agtctcgctctgtcgctcag

SEQ ID NO: 132969 - DNA, 21 bp, Homo sapiens
tgggaggcggagattgccatg

SEQ ID NO: 132970 - DNA, 23 bp, Homo sapiens
ggagtctcactcactctgttgcc

SEQ ID NO: 132971 - DNA, 23 bp, Homo sapiens
acagagtctcgctctgtcaccca

SEQ ID NO: 132972 - DNA, 20 bp, Homo sapiens
atgacagatttttgttttgt

SEQ ID NO: 132973 - DNA, 23 bp, Homo sapiens
tggagtctcactctgtcacccag

SEQ ID NO: 132974 - DNA, 23 bp, Homo sapiens
tgagttcattgtagattctggat

SEQ ID NO: 132975 - DNA, 23 bp, Homo sapiens
tgagttcattgtagattctggat

SEQ ID NO: 132976 - DNA, 21 bp, Homo sapiens
agagctatatatatgtgtgtg

SEQ ID NO: 132977 - DNA, 21 bp, Homo sapiens
gatatgttaagaagttttttg

SEQ ID NO: 132978 - DNA, 23 bp, Homo sapiens
ttaagtcattttgatcatttgtg

SEQ ID NO: 132979 - DNA, 23 bp, Homo sapiens
tgagttcattgtagattctggat

SEQ ID NO: 132980 - DNA, 23 bp, Homo sapiens
tgagttcattgtagattctggat

SEQ ID NO: 132981 - DNA, 20 bp, Homo sapiens
tttcctcttctttggtttat

SEQ ID NO: 132982 - DNA, 23 bp, Homo sapiens
agtgagcagtgaagagtgtagac

SEQ ID NO: 132983 - DNA, 18 bp, Homo sapiens
agatctcagctttacagt

SEQ ID NO: 132984 - DNA, 23 bp, Homo sapiens
tgagttcattgtagattctggat

SEQ ID NO: 132985 - DNA, 23 bp, Homo sapiens
tgagttcattgtagattctggat

SEQ ID NO: 132986 - DNA, 23 bp, Homo sapiens
tggagtctcactctgtcacccag

SEQ ID NO: 132987 - DNA, 23 bp, Homo sapiens
tggagtctcactctgtcacccag

SEQ ID NO: 132988 - DNA, 23 bp, Homo sapiens
ccgagtctcactctgtcacccag

SEQ ID NO: 132989 - DNA, 22 bp, Homo sapiens
aagaacatggaaaaggaagtac

SEQ ID NO: 132990 - DNA, 22 bp, Homo sapiens
tggctgtgtgcatttggatctg

SEQ ID NO: 132991 - DNA, 23 bp, Homo sapiens
gagcctcactctgtcacccaggc

SEQ ID NO: 132992 - DNA, 23 bp, Homo sapiens
cggagtctcactctgtcacccag

SEQ ID NO: 132993 - DNA, 23 bp, Homo sapiens
ctctgactctctgtgtgtgtagc

SEQ ID NO: 132994 - DNA, 23 bp, Homo sapiens
tgagttcattgtagattctggat

SEQ ID NO: 132995 - DNA, 23 bp, Homo sapiens
tgagttcattgtagattctggat

SEQ ID NO: 132996 - DNA, 22 bp, Homo sapiens
aaagctgctgatgaaagagctg

SEQ ID NO: 132997 - DNA, 23 bp, Homo sapiens
tctgtgcttgtgtatatgtgtga

SEQ ID NO: 132998 - DNA, 23 bp, Homo sapiens
tgactctttttctctctgtccta

SEQ ID NO: 132999 - DNA, 21 bp, Homo sapiens
agagatagtaagaagataagt

SEQ ID NO: 133000 - DNA, 18 bp, Homo sapiens
tttagtacaggtgggatt

SEQ ID NO: 133001 - DNA, 20 bp, Homo sapiens
tatgtatatatacatgtatg

SEQ ID NO: 133002 - DNA, 22 bp, Homo sapiens
cagagaagttagagtgctgttg

SEQ ID NO: 133003 - DNA, 21 bp, Homo sapiens
acatgctacacctactgtaac

SEQ ID NO: 133004 - DNA, 23 bp, Homo sapiens
tggctctgtctgtctctcaggta

SEQ ID NO: 133005 - DNA, 23 bp, Homo sapiens
cataagacactgcataaaagctc

SEQ ID NO: 133006 - DNA, 21 bp, Homo sapiens
tagtcagtgtctgtgattctc

SEQ ID NO: 133007 - DNA, 21 bp, Homo sapiens
ctgactgtctttgtctctgag

SEQ ID NO: 133008 - DNA, 23 bp, Homo sapiens
ggtctcaccctgtgactcaggct

SEQ ID NO: 133009 - DNA, 20 bp, Homo sapiens
tgcatgtgtgtatatatata

SEQ ID NO: 133010 - DNA, 22 bp, Homo sapiens
tttactgaatttgtttatcagt

SEQ ID NO: 133011 - DNA, 20 bp, Homo sapiens
ggttttctgtgtataagatc

SEQ ID NO: 133012 - DNA, 21 bp, Homo sapiens
tatctgtctgtctgtcttcta

SEQ ID NO: 133013 - DNA, 23 bp, Homo sapiens
agtctctgtctccctgtcactgc

SEQ ID NO: 133014 - DNA, 23 bp, Homo sapiens
ctcccagagcccctggaactctg

SEQ ID NO: 133015 - DNA, 23 bp, Homo sapiens
tcccagagcccctggaactctgg

SEQ ID NO: 133016 - DNA, 23 bp, Homo sapiens
tcccagagcccctggaactctgg

SEQ ID NO: 133017 - DNA, 23 bp, Homo sapiens
tcccagagcccctggaactctgg

SEQ ID NO: 133018 - DNA, 23 bp, Homo sapiens
tgagttcattgtagattctggat

SEQ ID NO: 133019 - DNA, 23 bp, Homo sapiens
tgagttcattgtagattctggat

SEQ ID NO: 133020 - DNA, 18 bp, Homo sapiens
aatggataaggtggatta

SEQ ID NO: 133021 - DNA, 23 bp, Homo sapiens
gagacagagtctcgctctgtcac

SEQ ID NO: 133022 - DNA, 19 bp, Homo sapiens
ttatggatgatgtattctt

SEQ ID NO: 133023 - DNA, 20 bp, Homo sapiens
tttatagttttgttgctttc

SEQ ID NO: 133024 - DNA, 23 bp, Homo sapiens
tgagttcattgtagattctggat

SEQ ID NO: 133025 - DNA, 23 bp, Homo sapiens
tgagttcattgtagattctggat

SEQ ID NO: 133026 - DNA, 18 bp, Homo sapiens
ataactatgctttattga

SEQ ID NO: 133027 - DNA, 20 bp, Homo sapiens
tgagctacctggacttgggg

SEQ ID NO: 133028 - DNA, 23 bp, Homo sapiens
tatatgatactatatgatagtat

SEQ ID NO: 133029 - DNA, 23 bp, Homo sapiens
taagctatatatgctatatatgt

SEQ ID NO: 133030 - DNA, 23 bp, Homo sapiens
tacgtgtatatatatatttgtgt

SEQ ID NO: 133031 - DNA, 23 bp, Homo sapiens
agagtgtcactctgtcacccagg

SEQ ID NO: 133032 - DNA, 21 bp, Homo sapiens
atcttttctgtgtaaagtgtt

SEQ ID NO: 133033 - DNA, 18 bp, Homo sapiens
attgctgattttatctga

SEQ ID NO: 133034 - DNA, 18 bp, Homo sapiens
gtgtatatatatacacat

SEQ ID NO: 133035 - DNA, 23 bp, Homo sapiens
atgtgtatatgtgtatgtgtgtg

SEQ ID NO: 133036 - DNA, 18 bp, Homo sapiens
taccatctagcagagctg

SEQ ID NO: 133037 - DNA, 23 bp, Homo sapiens
tatttgtatatatcagtagcaag

SEQ ID NO: 133038 - DNA, 23 bp, Homo sapiens
caactcattttataggtttgtct

SEQ ID NO: 133039 - DNA, 19 bp, Homo sapiens
tgtgtatatatatgtgtgt

SEQ ID NO: 133040 - DNA, 23 bp, Homo sapiens
aagaagtccttcacatcgcttgt

SEQ ID NO: 133041 - DNA, 21 bp, Homo sapiens
aattgtgaatgggagttcatt

SEQ ID NO: 133042 - DNA, 23 bp, Homo sapiens
acttgtgtgtctctgtgagtgac

SEQ ID NO: 133043 - DNA, 23 bp, Homo sapiens
ggtctctctgtctctctcagtca

SEQ ID NO: 133044 - DNA, 23 bp, Homo sapiens
ttctcagtgtggctgagttcagg

SEQ ID NO: 133045 - DNA, 23 bp, Homo sapiens
tatatgtatgtgtatatgtgtgt

SEQ ID NO: 133046 - DNA, 22 bp, Homo sapiens
tgtgtgtatatatatatgtgtg

SEQ ID NO: 133047 - DNA, 19 bp, Homo sapiens
atattgttgaagtttagat

SEQ ID NO: 133048 - DNA, 18 bp, Homo sapiens
tctctgcatttaaactgt

SEQ ID NO: 133049 - DNA, 21 bp, Homo sapiens
tgaaacagagtctcgctctgt

SEQ ID NO: 133050 - DNA, 23 bp, Homo sapiens
ctcattgtggttttgatttgcag

SEQ ID NO: 133051 - DNA, 23 bp, Homo sapiens
actgtcccctatgactatctgaa

SEQ ID NO: 133052 - DNA, 22 bp, Homo sapiens
tatatgcatatatatgtgtgtg

SEQ ID NO: 133053 - DNA, 20 bp, Homo sapiens
aacatcataacagaatatga

SEQ ID NO: 133054 - DNA, 22 bp, Homo sapiens
atatatctacatatgtatgtgt

SEQ ID NO: 133055 - DNA, 23 bp, Homo sapiens
actgagtctcactctgtcgccca

SEQ ID NO: 133056 - DNA, 18 bp, Homo sapiens
aaagtgctgggattacag

SEQ ID NO: 133057 - DNA, 23 bp, Homo sapiens
caaggcagagtctcactctgtca

SEQ ID NO: 133058 - DNA, 23 bp, Homo sapiens
tgagttcattgtagattctggat

SEQ ID NO: 133059 - DNA, 23 bp, Homo sapiens
tgagttcattgtagattctggat

SEQ ID NO: 133060 - DNA, 23 bp, Homo sapiens
atttattttactgttggcacaca

SEQ ID NO: 133061 - DNA, 23 bp, Homo sapiens
ctctgtgtgtgtcactgcccctg

SEQ ID NO: 133062 - DNA, 23 bp, Homo sapiens
aggattgagcttcaaatgtgaat

SEQ ID NO: 133063 - DNA, 22 bp, Homo sapiens
ttgttaagcatcaacatagctt

SEQ ID NO: 133064 - DNA, 23 bp, Homo sapiens
agatgagagagaacacaccgccc

SEQ ID NO: 133065 - DNA, 20 bp, Homo sapiens
gaatgtttatcttcagcttc

SEQ ID NO: 133066 - DNA, 21 bp, Homo sapiens
tccacctgatctaggctgtgt

SEQ ID NO: 133067 - DNA, 23 bp, Homo sapiens
aggattacaggattcttttgatt

SEQ ID NO: 133068 - DNA, 23 bp, Homo sapiens
ggatgacagaagatagtctgccg

SEQ ID NO: 133069 - DNA, 23 bp, Homo sapiens
gactgagactctgtctcaaagat

SEQ ID NO: 133070 - DNA, 19 bp, Homo sapiens
tcagtgtgtcagatgtggc

SEQ ID NO: 133071 - DNA, 23 bp, Homo sapiens
aagaggtttggacaaataggaca

SEQ ID NO: 133072 - DNA, 22 bp, Homo sapiens
tcttgaagcttttctgtaggtt

SEQ ID NO: 133073 - DNA, 22 bp, Homo sapiens
agagtctcactctgtcacccag

SEQ ID NO: 133074 - DNA, 18 bp, Homo sapiens
acagtggtgccatctctg

SEQ ID NO: 133075 - DNA, 22 bp, Homo sapiens
gactcctgttgactcactctca

SEQ ID NO: 133076 - DNA, 19 bp, Homo sapiens
tgtccctgtctctgtcttc

SEQ ID NO: 133077 - DNA, 23 bp, Homo sapiens
tctctgtgtctctgtctccatgg

SEQ ID NO: 133078 - DNA, 23 bp, Homo sapiens
ggtgtggttgtagtttgtaaaca

SEQ ID NO: 133079 - DNA, 23 bp, Homo sapiens
gacagagtgagaccgtgtcttta

SEQ ID NO: 133080 - DNA, 23 bp, Homo sapiens
tttgagacagaatctctctctgt

SEQ ID NO: 133081 - DNA, 19 bp, Homo sapiens
tgagagcctctttcttttt

SEQ ID NO: 133082 - DNA, 23 bp, Homo sapiens
tgagacggagagtctcactctgt

SEQ ID NO: 133083 - DNA, 23 bp, Homo sapiens
tgagaccctcactgactccttgc

SEQ ID NO: 133084 - DNA, 22 bp, Homo sapiens
tcactgagtcctgtcattcagt

SEQ ID NO: 133085 - DNA, 21 bp, Homo sapiens
tttggttgttccttcacatga

SEQ ID NO: 133086 - DNA, 22 bp, Homo sapiens
gtctgtgcctcagtgtctccgt

SEQ ID NO: 133087 - DNA, 19 bp, Homo sapiens
tctctctatctctatatag

SEQ ID NO: 133088 - DNA, 21 bp, Homo sapiens
aagcagaggctctgaagatcc

SEQ ID NO: 133089 - DNA, 21 bp, Homo sapiens
tttgtgcttccaataaatgga

SEQ ID NO: 133090 - DNA, 23 bp, Homo sapiens
gagactcactctgtcacccaggc

SEQ ID NO: 133091 - DNA, 23 bp, Homo sapiens
ctgttttccttcaggtccaagtc

SEQ ID NO: 133092 - DNA, 23 bp, Homo sapiens
agtttctctgagaaatacatgcc

SEQ ID NO: 133093 - DNA, 23 bp, Homo sapiens
tgagttcattgtagattctggat

SEQ ID NO: 133094 - DNA, 23 bp, Homo sapiens
tgagttcattgtagattctggat

SEQ ID NO: 133095 - DNA, 23 bp, Homo sapiens
tggagtctcactctgtcacccag

SEQ ID NO: 133096 - DNA, 21 bp, Homo sapiens
tttgtcccctctctctgtgtc

SEQ ID NO: 133097 - DNA, 20 bp, Homo sapiens
atgtgtgtgtgcatgtgcat

SEQ ID NO: 133098 - DNA, 22 bp, Homo sapiens
actcaccgtgtctctcaggctg

SEQ ID NO: 133099 - DNA, 19 bp, Homo sapiens
agaccacatattacctgat

SEQ ID NO: 133100 - DNA, 23 bp, Homo sapiens
tctgtcactcagtttctttccac

SEQ ID NO: 133101 - DNA, 23 bp, Homo sapiens
agaggtagtctcactctgtcacc

SEQ ID NO: 133102 - DNA, 23 bp, Homo sapiens
gccttatctttcctatcagatac

SEQ ID NO: 133103 - DNA, 23 bp, Homo sapiens
ctgagtggctctctctctggctc

SEQ ID NO: 133104 - DNA, 23 bp, Homo sapiens
agtgcctgactccctgtgtccca

SEQ ID NO: 133105 - DNA, 23 bp, Homo sapiens
gatgtatatgtatatgtatatga

SEQ ID NO: 133106 - DNA, 20 bp, Homo sapiens
atatatgtatatgtatatga

SEQ ID NO: 133107 - DNA, 21 bp, Homo sapiens
tatatgtatatgtatatgtat

SEQ ID NO: 133108 - DNA, 23 bp, Homo sapiens
tctgtcagtgtcttttgccattg

SEQ ID NO: 133109 - DNA, 23 bp, Homo sapiens
gatatctatatctaggtctatat

SEQ ID NO: 133110 - DNA, 23 bp, Homo sapiens
gggagtctcactctgtcacccag

SEQ ID NO: 133111 - DNA, 23 bp, Homo sapiens
cagagtctcactctgtcacccag

SEQ ID NO: 133112 - DNA, 21 bp, Homo sapiens
ttgtcagatgattctcaggag

SEQ ID NO: 133113 - DNA, 23 bp, Homo sapiens
tatgtgtatatatatgtgtgtgt

SEQ ID NO: 133114 - DNA, 19 bp, Homo sapiens
gtatatatatgtatgtgta

SEQ ID NO: 133115 - DNA, 23 bp, Homo sapiens
atatgtatatatgtacacataca

SEQ ID NO: 133116 - DNA, 19 bp, Homo sapiens
acacacatgtgtatatgta

SEQ ID NO: 133117 - DNA, 20 bp, Homo sapiens
aggaatgtatggaagaatgt

SEQ ID NO: 133118 - DNA, 23 bp, Homo sapiens
acagagtagatgctcagtaactg

SEQ ID NO: 133119 - DNA, 22 bp, Homo sapiens
tctgtagaatttggaaggaagt

SEQ ID NO: 133120 - DNA, 23 bp, Homo sapiens
tgtctctgtaattctctctcagg

SEQ ID NO: 133121 - DNA, 21 bp, Homo sapiens
tatatgttctgtttatgtata

SEQ ID NO: 133122 - DNA, 23 bp, Homo sapiens
ccctctctctctggctctctgta

SEQ ID NO: 133123 - DNA, 23 bp, Homo sapiens
acaggaagaataataagctcata

SEQ ID NO: 133124 - DNA, 23 bp, Homo sapiens
atgactcagttgtgtctttctat

SEQ ID NO: 133125 - DNA, 20 bp, Homo sapiens
acaggcacatcttaccatgt

SEQ ID NO: 133126 - DNA, 23 bp, Homo sapiens
cacagacacaagaaacatagctc

SEQ ID NO: 133127 - DNA, 23 bp, Homo sapiens
tgttcagctgttacaaagctcgt

SEQ ID NO: 133128 - DNA, 23 bp, Homo sapiens
tcccactgacagtgtgtgagctt

SEQ ID NO: 133129 - DNA, 23 bp, Homo sapiens
ctcccactgacagtgtgtgagct

SEQ ID NO: 133130 - DNA, 21 bp, Homo sapiens
tgggtggctgcctgcctgcca

SEQ ID NO: 133131 - DNA, 23 bp, Homo sapiens
tggagtctcactctgtcacccag

SEQ ID NO: 133132 - DNA, 23 bp, Homo sapiens
tcagctcactgcaagctctgtct

SEQ ID NO: 133133 - DNA, 23 bp, Homo sapiens
tgtcagtcagtctcagttcatgg

SEQ ID NO: 133134 - DNA, 23 bp, Homo sapiens
gttatactgtgaggtataccagt

SEQ ID NO: 133135 - DNA, 23 bp, Homo sapiens
ttaaggcactggcagatttcaca

SEQ ID NO: 133136 - DNA, 18 bp, Homo sapiens
cacttcacattcaggtgt

SEQ ID NO: 133137 - DNA, 18 bp, Homo sapiens
ctccgtggcactctccct

SEQ ID NO: 133138 - DNA, 23 bp, Homo sapiens
ggagtctcgctgtgtcactcagg

SEQ ID NO: 133139 - DNA, 23 bp, Homo sapiens
tctctgtgtctgtgtcttcacac

SEQ ID NO: 133140 - DNA, 21 bp, Homo sapiens
tatgaggtcactgtcattgga

SEQ ID NO: 133141 - DNA, 23 bp, Homo sapiens
gtctctgtgattctctggcagtc

SEQ ID NO: 133142 - DNA, 23 bp, Homo sapiens
ctcagccactgtctctctgaaca

SEQ ID NO: 133143 - DNA, 23 bp, Homo sapiens
ccctctgtgtgtgtctgtgtcct

SEQ ID NO: 133144 - DNA, 21 bp, Homo sapiens
tgcatgactgtgtggagcaga

SEQ ID NO: 133145 - DNA, 23 bp, Homo sapiens
cacatacagctaggtcaatgaga

SEQ ID NO: 133146 - DNA, 23 bp, Homo sapiens
tcacacactctctgaaccttgtg

SEQ ID NO: 133147 - DNA, 23 bp, Homo sapiens
ccgagtctccctctgtcacccag

SEQ ID NO: 133148 - DNA, 20 bp, Homo sapiens
tctggaagtgccttctagtt

SEQ ID NO: 133149 - DNA, 22 bp, Homo sapiens
tatctcttattgtataattgag

SEQ ID NO: 133150 - DNA, 22 bp, Homo sapiens
ctgtcgctctctgaggctcact

SEQ ID NO: 133151 - DNA, 22 bp, Homo sapiens
gcttgccctctgactctctctg

SEQ ID NO: 133152 - DNA, 23 bp, Homo sapiens
tatctgcatctacatctgtattt

SEQ ID NO: 133153 - DNA, 23 bp, Homo sapiens
tctgctagaacacttagcagaaa

SEQ ID NO: 133154 - DNA, 22 bp, Homo sapiens
gctctgtgctgctgtctgtctg

SEQ ID NO: 133155 - DNA, 21 bp, Homo sapiens
tcactgctcactgtgaggact

SEQ ID NO: 133156 - DNA, 21 bp, Homo sapiens
atatacgtcgtgtgtgtgtgt

SEQ ID NO: 133157 - DNA, 22 bp, Homo sapiens
tctgtggcactctctctcttga

SEQ ID NO: 133158 - DNA, 19 bp, Homo sapiens
tccagaaaagcctggaatg

SEQ ID NO: 133159 - DNA, 19 bp, Homo sapiens
tgtggtttaaatatgtata

SEQ ID NO: 133160 - DNA, 23 bp, Homo sapiens
aactttactgaatttgttgatca

SEQ ID NO: 133161 - DNA, 23 bp, Homo sapiens
tgtgtatctgctttacttgtgag

SEQ ID NO: 133162 - DNA, 23 bp, Homo sapiens
actgcctgagtatgctccctgtg

SEQ ID NO: 133163 - DNA, 20 bp, Homo sapiens
tgacccaagagagggagcac

SEQ ID NO: 133164 - DNA, 23 bp, Homo sapiens
ttttgcatacacaggtatgtgta

SEQ ID NO: 133165 - DNA, 23 bp, Homo sapiens
accaagtctcactctgtcactta

SEQ ID NO: 133166 - DNA, 18 bp, Homo sapiens
ggcgtgatcttggctcac

SEQ ID NO: 133167 - DNA, 18 bp, Homo sapiens
tcaacccagctgttgcta

SEQ ID NO: 133168 - DNA, 23 bp, Homo sapiens
acgctcactggctggctcagtgc

SEQ ID NO: 133169 - DNA, 21 bp, Homo sapiens
agtcatcctgattgacagttt

SEQ ID NO: 133170 - DNA, 21 bp, Homo sapiens
acagagaagacactcagcatc

SEQ ID NO: 133171 - DNA, 23 bp, Homo sapiens
tgggtgtctgtgacagtgtctca

SEQ ID NO: 133172 - DNA, 23 bp, Homo sapiens
tcctcactgtgtctctgcctgag

SEQ ID NO: 133173 - DNA, 21 bp, Homo sapiens
acagagaggtcagtgaggact

SEQ ID NO: 133174 - DNA, 23 bp, Homo sapiens
gaccctcacactgactgtgcatg

SEQ ID NO: 133175 - DNA, 23 bp, Homo sapiens
accgtctctgtcagtccctgggt

SEQ ID NO: 133176 - DNA, 23 bp, Homo sapiens
gtctctcactcagtgaatctgca

SEQ ID NO: 133177 - DNA, 23 bp, Homo sapiens
caaaatctcactctgtcacccag

SEQ ID NO: 133178 - DNA, 20 bp, Homo sapiens
ccacaggcacacacagccac

SEQ ID NO: 133179 - DNA, 23 bp, Homo sapiens
caaagaggtttatttttgtttat

SEQ ID NO: 133180 - DNA, 23 bp, Homo sapiens
tgttattgctgtcctagtggatg

SEQ ID NO: 133181 - DNA, 22 bp, Homo sapiens
acacagtctgcacacgttgttg

SEQ ID NO: 133182 - DNA, 23 bp, Homo sapiens
tctgcctctcactgtctgtggtg

SEQ ID NO: 133183 - DNA, 23 bp, Homo sapiens
tgaggtgctaggatgttaagatg

SEQ ID NO: 133184 - DNA, 20 bp, Homo sapiens
tagtgagaccttatctctta

SEQ ID NO: 133185 - DNA, 20 bp, Homo sapiens
tgagacagagtctcgctctg

SEQ ID NO: 133186 - DNA, 23 bp, Homo sapiens
aattactggatcatatggtagtt

SEQ ID NO: 133187 - DNA, 22 bp, Homo sapiens
ttagagtctcacatttctgtga

SEQ ID NO: 133188 - DNA, 23 bp, Homo sapiens
ggagtctctgtcgctgagactgg

SEQ ID NO: 133189 - DNA, 23 bp, Homo sapiens
acagttgctatttatttgaatat

SEQ ID NO: 133190 - DNA, 22 bp, Homo sapiens
gtacgtgctcctgtgtgtgtgt

SEQ ID NO: 133191 - DNA, 23 bp, Homo sapiens
tttatttgctttggttatctgtg

SEQ ID NO: 133192 - DNA, 18 bp, Homo sapiens
gagcatgagtttactgct

SEQ ID NO: 133193 - DNA, 19 bp, Homo sapiens
tgtgtgtgtatatgagtgt

SEQ ID NO: 133194 - DNA, 23 bp, Homo sapiens
tgtgtgtgcatctgtatgtgcat

SEQ ID NO: 133195 - DNA, 19 bp, Homo sapiens
gctgtcactctcagactct

SEQ ID NO: 133196 - DNA, 23 bp, Homo sapiens
tcacacgctcagtgactgcaggc

SEQ ID NO: 133197 - DNA, 18 bp, Homo sapiens
tggcctctccttccctga

SEQ ID NO: 133198 - DNA, 23 bp, Homo sapiens
atttgcagcagtgacagcctctc

SEQ ID NO: 133199 - DNA, 23 bp, Homo sapiens
gccacactctgtcactgtagggg

SEQ ID NO: 133200 - DNA, 23 bp, Homo sapiens
tctctctgagtcactgcattcgg

SEQ ID NO: 133201 - DNA, 20 bp, Homo sapiens
tgcccctggtggaactgctg

SEQ ID NO: 133202 - DNA, 23 bp, Homo sapiens
cgtctgtctgtgtctgaatttcc

SEQ ID NO: 133203 - DNA, 23 bp, Homo sapiens
tgagatggagtttcactctcaca

SEQ ID NO: 133204 - DNA, 23 bp, Homo sapiens
ctgtctgcctgtctgcctgcctg

SEQ ID NO: 133205 - DNA, 23 bp, Homo sapiens
ttgtgatgttgcagctagtaata

SEQ ID NO: 133206 - DNA, 23 bp, Homo sapiens
ttgcatagtcacaaaagtgatca

SEQ ID NO: 133207 - DNA, 20 bp, Homo sapiens
tgtgcacatgcatgtatgtg

SEQ ID NO: 133208 - DNA, 23 bp, Homo sapiens
gtgtctgcctgtctgactggttc

SEQ ID NO: 133209 - DNA, 19 bp, Homo sapiens
tctctgcctctgtcacatg

SEQ ID NO: 133210 - DNA, 23 bp, Homo sapiens
gtgactgagtgtgcatgtgaatg

SEQ ID NO: 133211 - DNA, 23 bp, Homo sapiens
agatggagtctctctctctgtcg

SEQ ID NO: 133212 - DNA, 20 bp, Homo sapiens
acgcagagtagaaaagagac

SEQ ID NO: 133213 - DNA, 23 bp, Homo sapiens
aatggatgtgaaatggtatctga

SEQ ID NO: 133214 - DNA, 23 bp, Homo sapiens
cacggagtctcgctctgtcaccg

SEQ ID NO: 133215 - DNA, 23 bp, Homo sapiens
gacagagtctcgctctgtcaccc

SEQ ID NO: 133216 - DNA, 23 bp, Homo sapiens
acagagtctcgctctgtcaccca

SEQ ID NO: 133217 - DNA, 23 bp, Homo sapiens
acagagtctcgcgctgtcaccca

SEQ ID NO: 133218 - DNA, 22 bp, Homo sapiens
tcagattctgtgtatcattgtt

SEQ ID NO: 133219 - DNA, 23 bp, Homo sapiens
tgatagagtggtgtgtcaggaga

SEQ ID NO: 133220 - DNA, 23 bp, Homo sapiens
tgcatgtgtgtgtgtgtgtgtgt

SEQ ID NO: 133221 - DNA, 23 bp, Homo sapiens
tgtcaccgataagtcagtctgaa

SEQ ID NO: 133222 - DNA, 21 bp, Homo sapiens
ttagatgacagatgattggct

SEQ ID NO: 133223 - DNA, 21 bp, Homo sapiens
tttgcctaattttttgtatct

SEQ ID NO: 133224 - DNA, 23 bp, Homo sapiens
agtggcagtggaaaggtggaaga

SEQ ID NO: 133225 - DNA, 22 bp, Homo sapiens
tccctcggtctcactgtctctg

SEQ ID NO: 133226 - DNA, 23 bp, Homo sapiens
tgagttcattgtagattctggat

SEQ ID NO: 133227 - DNA, 23 bp, Homo sapiens
tgagttcattgtagattctggat

SEQ ID NO: 133228 - DNA, 22 bp, Homo sapiens
tagcacctgctgagtcactgtg

SEQ ID NO: 133229 - DNA, 23 bp, Homo sapiens
gttcactcaccattcactcactg

SEQ ID NO: 133230 - DNA, 22 bp, Homo sapiens
tgttgcaggtttggaaaacagt

SEQ ID NO: 133231 - DNA, 23 bp, Homo sapiens
gggtctcactctgtcacccaggc

SEQ ID NO: 133232 - DNA, 20 bp, Homo sapiens
gtatgtatatatgtgtgtgt

SEQ ID NO: 133233 - DNA, 18 bp, Homo sapiens
tgtgtgcatgtgcatgag

SEQ ID NO: 133234 - DNA, 21 bp, Homo sapiens
tgtatgcgtgtgtgcctgtgt

SEQ ID NO: 133235 - DNA, 21 bp, Homo sapiens
tctcttcctcagggacggcct

SEQ ID NO: 133236 - DNA, 23 bp, Homo sapiens
tatctgctacagcagcagaaggt

SEQ ID NO: 133237 - DNA, 23 bp, Homo sapiens
tttcactctggatttttgttctt

SEQ ID NO: 133238 - DNA, 23 bp, Homo sapiens
tacatgtgcacaatgtgcaggtt

SEQ ID NO: 133239 - DNA, 23 bp, Homo sapiens
aagtgtgagatgtgactgtgggg

SEQ ID NO: 133240 - DNA, 19 bp, Homo sapiens
gcttcagattccctatctg

SEQ ID NO: 133241 - DNA, 23 bp, Homo sapiens
gtgtcactggctgagttcagatg

SEQ ID NO: 133242 - DNA, 23 bp, Homo sapiens
attttggagcttgtggtttgcag

SEQ ID NO: 133243 - DNA, 22 bp, Homo sapiens
tgctcttggttctgcctgaggc

SEQ ID NO: 133244 - DNA, 21 bp, Homo sapiens
agacaaggtctcgctctgttg

SEQ ID NO: 133245 - DNA, 22 bp, Homo sapiens
ttctgtatatatatatgtgtgt

SEQ ID NO: 133246 - DNA, 18 bp, Homo sapiens
tgtatatatatatgtgtg

SEQ ID NO: 133247 - DNA, 23 bp, Homo sapiens
tttagtgagaacagtgactgggc

SEQ ID NO: 133248 - DNA, 18 bp, Homo sapiens
atgcctgtctccttggga

SEQ ID NO: 133249 - DNA, 18 bp, Homo sapiens
agagaagacccagctcag

SEQ ID NO: 133250 - DNA, 22 bp, Homo sapiens
tgttgtctggcttctcttgaag

SEQ ID NO: 133251 - DNA, 22 bp, Homo sapiens
ttaggtcctttgtatttcaata

SEQ ID NO: 133252 - DNA, 23 bp, Homo sapiens
agttgtggtaattaaatgtctat

SEQ ID NO: 133253 - DNA, 23 bp, Homo sapiens
atgtatatagatcatttagccta

SEQ ID NO: 133254 - DNA, 23 bp, Homo sapiens
ccgtgaactttctggagactggg

SEQ ID NO: 133255 - DNA, 23 bp, Homo sapiens
tacaagagagattttgtagtttt

SEQ ID NO: 133256 - DNA, 23 bp, Homo sapiens
tgtactgtctcacttgtacctct

SEQ ID NO: 133257 - DNA, 23 bp, Homo sapiens
atcatggttgtttaatcagatat

SEQ ID NO: 133258 - DNA, 20 bp, Homo sapiens
tcagagggacaaacggtcga

SEQ ID NO: 133259 - DNA, 19 bp, Homo sapiens
acctctgtctgaccttgag

SEQ ID NO: 133260 - DNA, 22 bp, Homo sapiens
tcactgaaagctctgcctcctg

SEQ ID NO: 133261 - DNA, 19 bp, Homo sapiens
tctagaaaggtaaaagagc

SEQ ID NO: 133262 - DNA, 20 bp, Homo sapiens
agtctttttgtattggagtc

SEQ ID NO: 133263 - DNA, 23 bp, Homo sapiens
tgagaccgagtctggctctgtcg

SEQ ID NO: 133264 - DNA, 22 bp, Homo sapiens
tgtgaaccttcgctgtggctgt

SEQ ID NO: 133265 - DNA, 18 bp, Homo sapiens
tctcactctgtcacccag

SEQ ID NO: 133266 - DNA, 23 bp, Homo sapiens
tctcactgcctgtgtgggtcagt

SEQ ID NO: 133267 - DNA, 19 bp, Homo sapiens
attgcttgaactcagaggg

SEQ ID NO: 133268 - DNA, 23 bp, Homo sapiens
ggagtctcactctgtcactcagg

SEQ ID NO: 133269 - DNA, 19 bp, Homo sapiens
ttttttgtatttttagtag

SEQ ID NO: 133270 - DNA, 23 bp, Homo sapiens
gggtctcactctgtcacccaggc

SEQ ID NO: 133271 - DNA, 20 bp, Homo sapiens
atagaccaaggtaaaggtga

SEQ ID NO: 133272 - DNA, 23 bp, Homo sapiens
tgtatgtctgtgtgtgtctgtcc

SEQ ID NO: 133273 - DNA, 20 bp, Homo sapiens
ttttgtttttttgttgttgt

SEQ ID NO: 133274 - DNA, 21 bp, Homo sapiens
aagcagaggctctgaagatcc

SEQ ID NO: 133275 - DNA, 20 bp, Homo sapiens
agtctcgcactgtctccggg

SEQ ID NO: 133276 - DNA, 23 bp, Homo sapiens
tagaagtgtgtggaattggacga

SEQ ID NO: 133277 - DNA, 23 bp, Homo sapiens
agagtctcgctctgttttgtttg

SEQ ID NO: 133278 - DNA, 23 bp, Homo sapiens
gacagtgtctcactctgtcacca

SEQ ID NO: 133279 - DNA, 23 bp, Homo sapiens
tcaagacagagtctcattctgtc

SEQ ID NO: 133280 - DNA, 23 bp, Homo sapiens
actccaatgtttttgtagattga

SEQ ID NO: 133281 - DNA, 19 bp, Homo sapiens
agactgatgacagtgagga

SEQ ID NO: 133282 - DNA, 20 bp, Homo sapiens
agtgagtgaggacactaggt

SEQ ID NO: 133283 - DNA, 23 bp, Homo sapiens
cagtgtcagtgttatgtgtgtgt

SEQ ID NO: 133284 - DNA, 23 bp, Homo sapiens
attcagtgtcacatatatcatgt

SEQ ID NO: 133285 - DNA, 23 bp, Homo sapiens
actgactctctcacagttctgcc

SEQ ID NO: 133286 - DNA, 23 bp, Homo sapiens
gtctctgtggctcagatgctcta

SEQ ID NO: 133287 - DNA, 21 bp, Homo sapiens
tctgtgtgctacagctactca

SEQ ID NO: 133288 - DNA, 23 bp, Homo sapiens
tactcctgtccctctctggctgt

SEQ ID NO: 133289 - DNA, 23 bp, Homo sapiens
agatcacagtggatagtgtggtc

SEQ ID NO: 133290 - DNA, 23 bp, Homo sapiens
agatggagtctcactctgtcacc

SEQ ID NO: 133291 - DNA, 20 bp, Homo sapiens
tttgagacagctctgtcgcc

SEQ ID NO: 133292 - DNA, 23 bp, Homo sapiens
tggagtctcactctgtcacccag

SEQ ID NO: 133293 - DNA, 18 bp, Homo sapiens
gcatgaatgcatgtgtgt

SEQ ID NO: 133294 - DNA, 23 bp, Homo sapiens
gtcactgtgtggactgactgagg

SEQ ID NO: 133295 - DNA, 23 bp, Homo sapiens
tctgcctcccacaggtgctggag

SEQ ID NO: 133296 - DNA, 23 bp, Homo sapiens
cctatgtgtgtctctgtatgtga

SEQ ID NO: 133297 - DNA, 22 bp, Homo sapiens
tatagcacactgatgggtcttg

SEQ ID NO: 133298 - DNA, 22 bp, Homo sapiens
tatatgtatatgtatatatgtg

SEQ ID NO: 133299 - DNA, 23 bp, Homo sapiens
tatgttatacatacacatgtgtg

SEQ ID NO: 133300 - DNA, 23 bp, Homo sapiens
aacatcaccaacagaaaaaccct

SEQ ID NO: 133301 - DNA, 23 bp, Homo sapiens
tgagttcattgtagattctggat

SEQ ID NO: 133302 - DNA, 23 bp, Homo sapiens
tgagttcattgtagattctggat

SEQ ID NO: 133303 - DNA, 23 bp, Homo sapiens
ttcgcttaggattgctttgtcta

SEQ ID NO: 133304 - DNA, 23 bp, Homo sapiens
ttgagacagggtcttgctctgtt

SEQ ID NO: 133305 - DNA, 20 bp, Homo sapiens
cctgggtgacagagtgagtc

SEQ ID NO: 133306 - DNA, 21 bp, Homo sapiens
tgcctgtagtcttagctactt

SEQ ID NO: 133307 - DNA, 23 bp, Homo sapiens
ctgagtggctcactctgtgcctg

SEQ ID NO: 133308 - DNA, 23 bp, Homo sapiens
ctttcagcatcactaactgcagt

SEQ ID NO: 133309 - DNA, 22 bp, Homo sapiens
aactcaggcagaattccttctc

SEQ ID NO: 133310 - DNA, 23 bp, Homo sapiens
cctggaaaataatgaagtgaact

SEQ ID NO: 133311 - DNA, 23 bp, Homo sapiens
tgtgtgtgcctgtgtgtgtgcgt

SEQ ID NO: 133312 - DNA, 23 bp, Homo sapiens
tgagaagttggtagatggttcat

SEQ ID NO: 133313 - DNA, 23 bp, Homo sapiens
tcccactgacagtgtgtgagctt

SEQ ID NO: 133314 - DNA, 23 bp, Homo sapiens
ctcccactgacagtgtgtgagct

SEQ ID NO: 133315 - DNA, 19 bp, Homo sapiens
tagagagatatctatatat

SEQ ID NO: 133316 - DNA, 23 bp, Homo sapiens
cggagtctcactctgtcacccag

SEQ ID NO: 133317 - DNA, 23 bp, Homo sapiens
tcagctcactgcaagctctgtct

SEQ ID NO: 133318 - DNA, 22 bp, Homo sapiens
ttccatttattttaattctgca

SEQ ID NO: 133319 - DNA, 18 bp, Homo sapiens
gtcagatgattctcagga

SEQ ID NO: 133320 - DNA, 23 bp, Homo sapiens
ccctgtgtgggtctgcctggggc

SEQ ID NO: 133321 - DNA, 23 bp, Homo sapiens
agagaggtcagtgtggacagaca

SEQ ID NO: 133322 - DNA, 23 bp, Homo sapiens
aagctctgtctagtctgtgagca

SEQ ID NO: 133323 - DNA, 23 bp, Homo sapiens
ggatccctgtgtgcctgtcaggc

SEQ ID NO: 133324 - DNA, 23 bp, Homo sapiens
agtgactcaagaggctgaggtag

SEQ ID NO: 133325 - DNA, 18 bp, Homo sapiens
aggagtttgaggttacag

SEQ ID NO: 133326 - DNA, 22 bp, Homo sapiens
ttttgagagggagtcttactct

SEQ ID NO: 133327 - DNA, 23 bp, Homo sapiens
cacacagtcacaccgtgtctcct

SEQ ID NO: 133328 - DNA, 19 bp, Homo sapiens
gagtctccagagtacctga

SEQ ID NO: 133329 - DNA, 20 bp, Homo sapiens
tgggagtcctagagatgcag

SEQ ID NO: 133330 - DNA, 22 bp, Homo sapiens
tggagtctctcgctctgtcgcc

SEQ ID NO: 133331 - DNA, 20 bp, Homo sapiens
agagtgagactccatctcaa

SEQ ID NO: 133332 - DNA, 20 bp, Homo sapiens
tttttttgaggaaaagttat

SEQ ID NO: 133333 - DNA, 23 bp, Homo sapiens
acagagtcccactgtgtctccca

SEQ ID NO: 133334 - DNA, 23 bp, Homo sapiens
tcttttcaagtgtagcacatgtc

SEQ ID NO: 133335 - DNA, 23 bp, Homo sapiens
agttataggtctagaagcaaaca

SEQ ID NO: 133336 - DNA, 23 bp, Homo sapiens
aaatggaggctctctctgtctct

SEQ ID NO: 133337 - DNA, 19 bp, Homo sapiens
ctgagctcactctgtctca

SEQ ID NO: 133338 - DNA, 23 bp, Homo sapiens
atgagcttgtgtgtttttgtcat

SEQ ID NO: 133339 - DNA, 20 bp, Homo sapiens
aacattctgtgcaacaagat

SEQ ID NO: 133340 - DNA, 22 bp, Homo sapiens
tcagaacgttcttaaagggaat

SEQ ID NO: 133341 - DNA, 18 bp, Homo sapiens
tagtcccaagctactcag

SEQ ID NO: 133342 - DNA, 18 bp, Homo sapiens
gtgtgtgtgtgtgtacac

SEQ ID NO: 133343 - DNA, 22 bp, Homo sapiens
tctgggccaatttgaactgtta

SEQ ID NO: 133344 - DNA, 22 bp, Homo sapiens
tgagatggagtctcgctctgtt

SEQ ID NO: 133345 - DNA, 23 bp, Homo sapiens
gagatgcagtctcactctgtcgc

SEQ ID NO: 133346 - DNA, 23 bp, Homo sapiens
atatatataggtatgtgtgtgtg

SEQ ID NO: 133347 - DNA, 23 bp, Homo sapiens
tttctctctgcctgagtacatcc

SEQ ID NO: 133348 - DNA, 23 bp, Homo sapiens
agagtctcactctgtcacccagg

SEQ ID NO: 133349 - DNA, 23 bp, Homo sapiens
tgaccttgtgtgtgtgtgtgtgt

SEQ ID NO: 133350 - DNA, 18 bp, Homo sapiens
agagaaaatgtattaatg

SEQ ID NO: 133351 - DNA, 23 bp, Homo sapiens
tacagaggacagagaggacagag

SEQ ID NO: 133352 - DNA, 20 bp, Homo sapiens
tatgcttttatatgttatta

SEQ ID NO: 133353 - DNA, 23 bp, Homo sapiens
tagtttgtagagggctatgaaga

SEQ ID NO: 133354 - DNA, 23 bp, Homo sapiens
cggagtctcgctctgtctcccag

SEQ ID NO: 133355 - DNA, 23 bp, Homo sapiens
gacagagtctcgctctgtcaccc

SEQ ID NO: 133356 - DNA, 18 bp, Homo sapiens
atactgtatatatactgt

SEQ ID NO: 133357 - DNA, 21 bp, Homo sapiens
tatatgtacatatacgtatat

SEQ ID NO: 133358 - DNA, 23 bp, Homo sapiens
aagaatgtataacttataagaat

SEQ ID NO: 133359 - DNA, 23 bp, Homo sapiens
acattttgtatgtagtgtgtgag

SEQ ID NO: 133360 - DNA, 20 bp, Homo sapiens
atatgcacgttatatgtgta

SEQ ID NO: 133361 - DNA, 23 bp, Homo sapiens
gtgtgcatatatatgtgtataca

SEQ ID NO: 133362 - DNA, 21 bp, Homo sapiens
tctttgtgtctgtgctacctt

SEQ ID NO: 133363 - DNA, 23 bp, Homo sapiens
atacatgtgtatatgtatatatg

SEQ ID NO: 133364 - DNA, 23 bp, Homo sapiens
tacatgtgtatatgtatataata

SEQ ID NO: 133365 - DNA, 23 bp, Homo sapiens
gatatagcttgttaagataaggt

SEQ ID NO: 133366 - DNA, 22 bp, Homo sapiens
tgtgtgtgtctctatgttgtga

SEQ ID NO: 133367 - DNA, 21 bp, Homo sapiens
aagacagaagaatgattgaag

SEQ ID NO: 133368 - DNA, 23 bp, Homo sapiens
atttctctctgcaagttttacat

SEQ ID NO: 133369 - DNA, 21 bp, Homo sapiens
attgagtgtcattagcgtttt

SEQ ID NO: 133370 - DNA, 23 bp, Homo sapiens
cacacacacgtgtatatgtgtgt

SEQ ID NO: 133371 - DNA, 23 bp, Homo sapiens
tatgtgtatatatatacgtgtgt

SEQ ID NO: 133372 - DNA, 23 bp, Homo sapiens
tgagttcattgtagattctggat

SEQ ID NO: 133373 - DNA, 23 bp, Homo sapiens
tgagttcattgtagattctggat

SEQ ID NO: 133374 - DNA, 18 bp, Homo sapiens
atatgtatatgtgtatat

SEQ ID NO: 133375 - DNA, 23 bp, Homo sapiens
agagagaacagtgagaggagttg

SEQ ID NO: 133376 - DNA, 23 bp, Homo sapiens
tgtcactagattgaaaccactag

SEQ ID NO: 133377 - DNA, 23 bp, Homo sapiens
tcaaggtctcactctgtctccca

SEQ ID NO: 133378 - DNA, 23 bp, Homo sapiens
tgcagtgacatgatcttgactca

SEQ ID NO: 133379 - DNA, 23 bp, Homo sapiens
agacaaagtctcgctctgtcccc

SEQ ID NO: 133380 - DNA, 20 bp, Homo sapiens
tttgctcatcaagtcatctg

SEQ ID NO: 133381 - DNA, 20 bp, Homo sapiens
atatgttcatatatatgttc

SEQ ID NO: 133382 - DNA, 19 bp, Homo sapiens
tctctgtatgatttctgtt

SEQ ID NO: 133383 - DNA, 20 bp, Homo sapiens
tctatttcaaatctgaatgt

SEQ ID NO: 133384 - DNA, 20 bp, Homo sapiens
taaaatctaaacatgaaagg

SEQ ID NO: 133385 - DNA, 20 bp, Homo sapiens
tgtgtgcatgtgcatgtgta

SEQ ID NO: 133386 - DNA, 20 bp, Homo sapiens
gtgtatatatatacgtgtat

SEQ ID NO: 133387 - DNA, 23 bp, Homo sapiens
ggagtctcactctgtcacccagg

SEQ ID NO: 133388 - DNA, 23 bp, Homo sapiens
taaattgtcattgcatgttatat

SEQ ID NO: 133389 - DNA, 22 bp, Homo sapiens
attactataatatgcaatgaca

SEQ ID NO: 133390 - DNA, 23 bp, Homo sapiens
tggagtctcactctgtcacccag

SEQ ID NO: 133391 - DNA, 23 bp, Homo sapiens
tatgtatatgtgtgtgtatatat

SEQ ID NO: 133392 - DNA, 23 bp, Homo sapiens
gtcggtgggtctctccctgtgtg

SEQ ID NO: 133393 - DNA, 18 bp, Homo sapiens
aatggataaggtggatta

SEQ ID NO: 133394 - DNA, 23 bp, Homo sapiens
gagacagagtctcgctctgtcac

SEQ ID NO: 133395 - DNA, 19 bp, Homo sapiens
ttatggatgatgtattctt

SEQ ID NO: 133396 - DNA, 20 bp, Homo sapiens
tttatagttttgttgctttc

SEQ ID NO: 133397 - DNA, 18 bp, Homo sapiens
cacattgccctttgagtt

SEQ ID NO: 133398 - DNA, 23 bp, Homo sapiens
tgacaggttgagaaagtactctt

SEQ ID NO: 133399 - DNA, 23 bp, Homo sapiens
agtctctgtctccctgtcactgc

SEQ ID NO: 133400 - DNA, 23 bp, Homo sapiens
atttagcttggaaatgttgagaa

SEQ ID NO: 133401 - DNA, 23 bp, Homo sapiens
agtgaggtcagagtgtgaagatc

SEQ ID NO: 133402 - DNA, 23 bp, Homo sapiens
atgatatactgtgaagttatgaa

SEQ ID NO: 133403 - DNA, 23 bp, Homo sapiens
gtacaaggtgatgttttgatgta

SEQ ID NO: 133404 - DNA, 22 bp, Homo sapiens
ttcattatgatgttagctggtt

SEQ ID NO: 133405 - DNA, 22 bp, Homo sapiens
tgagtctcattctgtcacccat

SEQ ID NO: 133406 - DNA, 21 bp, Homo sapiens
gactgatgtcaggctggagat

SEQ ID NO: 133407 - DNA, 23 bp, Homo sapiens
tttggctatatattgagatgtgt

SEQ ID NO: 133408 - DNA, 23 bp, Homo sapiens
aatatctctatatgtttattagt

SEQ ID NO: 133409 - DNA, 23 bp, Homo sapiens
atggtcatatgttttgctcattt

SEQ ID NO: 133410 - DNA, 20 bp, Homo sapiens
tgtgtgtgtgtgtctacgtg

SEQ ID NO: 133411 - DNA, 23 bp, Homo sapiens
tgtctctgtgattaggatatcca

SEQ ID NO: 133412 - DNA, 23 bp, Homo sapiens
tatggtaatgtatgcatatacat

SEQ ID NO: 133413 - DNA, 23 bp, Homo sapiens
agtcagctctctctctctctctc

SEQ ID NO: 133414 - DNA, 23 bp, Homo sapiens
acacacactttggtagtgttgtc

SEQ ID NO: 133415 - DNA, 21 bp, Homo sapiens
atatcatgcagtgacagtaga

SEQ ID NO: 133416 - DNA, 23 bp, Homo sapiens
caaatctcagtgtttctgttgtg

SEQ ID NO: 133417 - DNA, 18 bp, Homo sapiens
acagaaggcagagagctc

SEQ ID NO: 133418 - DNA, 23 bp, Homo sapiens
agagagcagaggcaccaggcaga

SEQ ID NO: 133419 - DNA, 23 bp, Homo sapiens
ttgagacggagtttcactcttgt

SEQ ID NO: 133420 - DNA, 23 bp, Homo sapiens
gacagagtctcgctctgtcaccc

SEQ ID NO: 133421 - DNA, 23 bp, Homo sapiens
tatgtgtgtatatatgtgtgtgt

SEQ ID NO: 133422 - DNA, 23 bp, Homo sapiens
tatgtatgtataaatatgtgtgt

SEQ ID NO: 133423 - DNA, 23 bp, Homo sapiens
tagtagcttttgaaatccttggg

SEQ ID NO: 133424 - DNA, 22 bp, Homo sapiens
tgattgcttatcaaaacaggaa

SEQ ID NO: 133425 - DNA, 23 bp, Homo sapiens
tgacacaggaaaatggaacagac

SEQ ID NO: 133426 - DNA, 19 bp, Homo sapiens
tgagatggagtctcactct

SEQ ID NO: 133427 - DNA, 23 bp, Homo sapiens
acatgtctctctgacatacaggg

SEQ ID NO: 133428 - DNA, 23 bp, Homo sapiens
aaacggggtcaaaaacagctctg

SEQ ID NO: 133429 - DNA, 23 bp, Homo sapiens
acagagtctcgctctgtcaccca

SEQ ID NO: 133430 - DNA, 23 bp, Homo sapiens
cggagtctcactctgtcacccag

SEQ ID NO: 133431 - DNA, 23 bp, Homo sapiens
ccttgtctgaattctgactgaga

SEQ ID NO: 133432 - DNA, 20 bp, Homo sapiens
atactttcaggtttttttca

SEQ ID NO: 133433 - DNA, 23 bp, Homo sapiens
tgagttcattgtagattctggat

SEQ ID NO: 133434 - DNA, 23 bp, Homo sapiens
tgagttcattgtagattctggat

SEQ ID NO: 133435 - DNA, 23 bp, Homo sapiens
gacggagtcgcactctgtcaccc

SEQ ID NO: 133436 - DNA, 18 bp, Homo sapiens
tgcagtgacacaatcttg

SEQ ID NO: 133437 - DNA, 23 bp, Homo sapiens
cagggtctcactctgtcacccag

SEQ ID NO: 133438 - DNA, 23 bp, Homo sapiens
gggtctcactctgtcacccaggc

SEQ ID NO: 133439 - DNA, 23 bp, Homo sapiens
attctggaaaaaaaaaatgtgta

SEQ ID NO: 133440 - DNA, 23 bp, Homo sapiens
tcagtcagaccctcagtgactgc

SEQ ID NO: 133441 - DNA, 21 bp, Homo sapiens
taagacagtaagagaaacctg

SEQ ID NO: 133442 - DNA, 22 bp, Homo sapiens
atatgtatatatagatatgtgt

SEQ ID NO: 133443 - DNA, 21 bp, Homo sapiens
gtggagtaataaagtgaaagc

SEQ ID NO: 133444 - DNA, 20 bp, Homo sapiens
tgacactggctttttttttt

SEQ ID NO: 133445 - DNA, 19 bp, Homo sapiens
tacagagtaaggccttgtt

SEQ ID NO: 133446 - DNA, 23 bp, Homo sapiens
tgagacaggtctcattctgtcac

SEQ ID NO: 133447 - DNA, 23 bp, Homo sapiens
gacagagtctcactctgtcaccc

SEQ ID NO: 133448 - DNA, 19 bp, Homo sapiens
ttaatgcatctataatcac

SEQ ID NO: 133449 - DNA, 23 bp, Homo sapiens
tattttggttcttctttagtttc

SEQ ID NO: 133450 - DNA, 22 bp, Homo sapiens
tttttcctagtacttttttcca

SEQ ID NO: 133451 - DNA, 20 bp, Homo sapiens
agtctggagtcttactctgt

SEQ ID NO: 133452 - DNA, 21 bp, Homo sapiens
tttaatagaggaagctatgga

SEQ ID NO: 133453 - DNA, 23 bp, Homo sapiens
aatgaccttgctgtctctaaggc

SEQ ID NO: 133454 - DNA, 23 bp, Homo sapiens
tgtgtctctctctctggtatttc

SEQ ID NO: 133455 - DNA, 22 bp, Homo sapiens
agagcatgtggtgtgctgtgtc

SEQ ID NO: 133456 - DNA, 23 bp, Homo sapiens
tgtgacacacgttttgtattcga

SEQ ID NO: 133457 - DNA, 22 bp, Homo sapiens
ctgtgtgctttgatgtggcttt

SEQ ID NO: 133458 - DNA, 23 bp, Homo sapiens
tgagacggagtctcgctctgtca

SEQ ID NO: 133459 - DNA, 19 bp, Homo sapiens
agacttttctttactgaaa

SEQ ID NO: 133460 - DNA, 23 bp, Homo sapiens
acagagtctcgctgtcacacagg

SEQ ID NO: 133461 - DNA, 23 bp, Homo sapiens
agcctctgtccttctgtctcagt

SEQ ID NO: 133462 - DNA, 22 bp, Homo sapiens
agacaggagacagacagcagct

SEQ ID NO: 133463 - DNA, 23 bp, Homo sapiens
tgcctgtctgtctgtctgtctgt

SEQ ID NO: 133464 - DNA, 18 bp, Homo sapiens
ctcacacctggaatccca

SEQ ID NO: 133465 - DNA, 21 bp, Homo sapiens
tgaggtaggaggatcacttga

SEQ ID NO: 133466 - DNA, 23 bp, Homo sapiens
attgtgcttccatatattgcact

SEQ ID NO: 133467 - DNA, 22 bp, Homo sapiens
tttggagatggagtctctctct

SEQ ID NO: 133468 - DNA, 18 bp, Homo sapiens
ctgagactacaggtgtgt

SEQ ID NO: 133469 - DNA, 21 bp, Homo sapiens
tatgtctgtgacactttcatt

SEQ ID NO: 133470 - DNA, 23 bp, Homo sapiens
cattctacagtgatttagaacac

SEQ ID NO: 133471 - DNA, 23 bp, Homo sapiens
ttaatactttaagttttagggta

SEQ ID NO: 133472 - DNA, 23 bp, Homo sapiens
tccaaaagtgctgggattacagg

SEQ ID NO: 133473 - DNA, 20 bp, Homo sapiens
tacagttgtgtgccactaca

SEQ ID NO: 133474 - DNA, 23 bp, Homo sapiens
taatgctgggtacagtggctcat

SEQ ID NO: 133475 - DNA, 23 bp, Homo sapiens
catctctgagtcactctctgcca

SEQ ID NO: 133476 - DNA, 23 bp, Homo sapiens
gaatctcactctgtcacccaggc

SEQ ID NO: 133477 - DNA, 23 bp, Homo sapiens
gagagtgattggtttatcatggt

SEQ ID NO: 133478 - DNA, 23 bp, Homo sapiens
gcatatggttgtagacagaattc

SEQ ID NO: 133479 - DNA, 23 bp, Homo sapiens
gcatttgtacatcttctagtggt

SEQ ID NO: 133480 - DNA, 23 bp, Homo sapiens
tgcttgacatgtcttttacttct

SEQ ID NO: 133481 - DNA, 23 bp, Homo sapiens
tatctctctatatagatatctgt

SEQ ID NO: 133482 - DNA, 21 bp, Homo sapiens
tgtcatactgtttacttgccc

SEQ ID NO: 133483 - DNA, 23 bp, Homo sapiens
tggatgagaagtgatttagtaga

SEQ ID NO: 133484 - DNA, 23 bp, Homo sapiens
aaggacaactcactgtttgtttt

SEQ ID NO: 133485 - DNA, 23 bp, Homo sapiens
tttttgagaacttgcagcttgca

SEQ ID NO: 133486 - DNA, 22 bp, Homo sapiens
tggagtctcgctctgtcaccag

SEQ ID NO: 133487 - DNA, 21 bp, Homo sapiens
tgtgtgtgtgtatatatatac

SEQ ID NO: 133488 - DNA, 23 bp, Homo sapiens
tatatgtatatgtatacgtgtac

SEQ ID NO: 133489 - DNA, 23 bp, Homo sapiens
tatatgtgtatatatattcatgt

SEQ ID NO: 133490 - DNA, 18 bp, Homo sapiens
atgagtatatatattcat

SEQ ID NO: 133491 - DNA, 19 bp, Homo sapiens
tgagtatatatattcatat

SEQ ID NO: 133492 - DNA, 19 bp, Homo sapiens
tgtgaatatatatacacat

SEQ ID NO: 133493 - DNA, 19 bp, Homo sapiens
tgtgtgtatatatattcat

SEQ ID NO: 133494 - DNA, 21 bp, Homo sapiens
ttcagttatcagtgagcactt

SEQ ID NO: 133495 - DNA, 23 bp, Homo sapiens
ctaggtaactgaatgtatggtgt

SEQ ID NO: 133496 - DNA, 23 bp, Homo sapiens
agtttggctggatatgaaattct

SEQ ID NO: 133497 - DNA, 19 bp, Homo sapiens
tgtgtatgtgtgtgtatat

SEQ ID NO: 133498 - DNA, 23 bp, Homo sapiens
tatgtgtatatatgtatatatgt

SEQ ID NO: 133499 - DNA, 20 bp, Homo sapiens
acatagatacgtgtgtgtac

SEQ ID NO: 133500 - DNA, 20 bp, Homo sapiens
tatattcattacatatgtgt

SEQ ID NO: 133501 - DNA, 20 bp, Homo sapiens
tatatgtgtgtgtatgacat

SEQ ID NO: 133502 - DNA, 21 bp, Homo sapiens
actatactaactagttttgat

SEQ ID NO: 133503 - DNA, 21 bp, Homo sapiens
atactagtgagtaaggtatta

SEQ ID NO: 133504 - DNA, 23 bp, Homo sapiens
cttttctatttgtattggatcac

SEQ ID NO: 133505 - DNA, 20 bp, Homo sapiens
atgccacaaaaacattaaac

SEQ ID NO: 133506 - DNA, 18 bp, Homo sapiens
tgtgcaacttctgagtca

SEQ ID NO: 133507 - DNA, 22 bp, Homo sapiens
tgtatctggccactgtgtgtgt

SEQ ID NO: 133508 - DNA, 23 bp, Homo sapiens
aattatcactatgtatttgttta

SEQ ID NO: 133509 - DNA, 23 bp, Homo sapiens
agagtctcactctgtcacccagg

SEQ ID NO: 133510 - DNA, 23 bp, Homo sapiens
tgtgtcttcattaggctctgaac

SEQ ID NO: 133511 - DNA, 23 bp, Homo sapiens
tccatgtatgtgtgtgtgtgtgt

SEQ ID NO: 133512 - DNA, 21 bp, Homo sapiens
tctgggtatcattgtctaagt

SEQ ID NO: 133513 - DNA, 23 bp, Homo sapiens
gatctgccactctgtctctttcc

SEQ ID NO: 133514 - DNA, 23 bp, Homo sapiens
gacagtctcgctctgtcactcag

SEQ ID NO: 133515 - DNA, 23 bp, Homo sapiens
caggtgtgagccactatgctgtg

SEQ ID NO: 133516 - DNA, 23 bp, Homo sapiens
gagatggtgtccgactctgtcac

SEQ ID NO: 133517 - DNA, 23 bp, Homo sapiens
caggatatgagttcctggagctg

SEQ ID NO: 133518 - DNA, 23 bp, Homo sapiens
gatgccacggtccctctgtccca

SEQ ID NO: 133519 - DNA, 23 bp, Homo sapiens
gtgcctgtctccctctgtaacag

SEQ ID NO: 133520 - DNA, 23 bp, Homo sapiens
cactgtgatgtgagaatgtgctt

SEQ ID NO: 133521 - DNA, 23 bp, Homo sapiens
gatatcactgtcaatttctgcac

SEQ ID NO: 133522 - DNA, 21 bp, Homo sapiens
tagagtcatcagagagagcac

SEQ ID NO: 133523 - DNA, 23 bp, Homo sapiens
tgactgagtgataaacttatcct

SEQ ID NO: 133524 - DNA, 23 bp, Homo sapiens
ttaggtggagtctcgctctgtca

SEQ ID NO: 133525 - DNA, 20 bp, Homo sapiens
tgactagaagtgatgttttg

SEQ ID NO: 133526 - DNA, 21 bp, Homo sapiens
cagtggcatgatcttggctca

SEQ ID NO: 133527 - DNA, 23 bp, Homo sapiens
tgtgtgagagactgagatgatgg

SEQ ID NO: 133528 - DNA, 23 bp, Homo sapiens
cacactcactgtctccttgggct

SEQ ID NO: 133529 - DNA, 20 bp, Homo sapiens
accttcaacatgtgcagatt

SEQ ID NO: 133530 - DNA, 23 bp, Homo sapiens
tatatatatggagtctcgctctg

SEQ ID NO: 133531 - DNA, 23 bp, Homo sapiens
tttaatccagattttctagttgt

SEQ ID NO: 133532 - DNA, 19 bp, Homo sapiens
tttccagttctgttcccct

SEQ ID NO: 133533 - DNA, 23 bp, Homo sapiens
tctgagaagagtctgtggaaaca

SEQ ID NO: 133534 - DNA, 23 bp, Homo sapiens
agatagagacagggacagattag

SEQ ID NO: 133535 - DNA, 23 bp, Homo sapiens
aattctccaggagctcagaacct

SEQ ID NO: 133536 - DNA, 19 bp, Homo sapiens
agagaggcagctctggtcc

SEQ ID NO: 133537 - DNA, 23 bp, Homo sapiens
gagtgtgtcactggctgttcttt

SEQ ID NO: 133538 - DNA, 22 bp, Homo sapiens
atggctcttgttcaatacacag

SEQ ID NO: 133539 - DNA, 20 bp, Homo sapiens
tatctatatatatatgtgtg

SEQ ID NO: 133540 - DNA, 18 bp, Homo sapiens
tatgtgcatatatttata

SEQ ID NO: 133541 - DNA, 23 bp, Homo sapiens
tagtctgtctgtgtgtctgtgcc

SEQ ID NO: 133542 - DNA, 22 bp, Homo sapiens
tgcttatgattgtcttggctat

SEQ ID NO: 133543 - DNA, 22 bp, Homo sapiens
tagtttttttccaattctgtga

SEQ ID NO: 133544 - DNA, 21 bp, Homo sapiens
tgtgagacgaagagatgatag

SEQ ID NO: 133545 - DNA, 23 bp, Homo sapiens
ctgggtgacagtgtgacactctg

SEQ ID NO: 133546 - DNA, 23 bp, Homo sapiens
acctatgttgttgagtatagcga

SEQ ID NO: 133547 - DNA, 23 bp, Homo sapiens
tttgtctagtcatattgtagttc

SEQ ID NO: 133548 - DNA, 20 bp, Homo sapiens
tttcagtgtgttcctgtact

SEQ ID NO: 133549 - DNA, 23 bp, Homo sapiens
cattctgtcattctctcatgtca

SEQ ID NO: 133550 - DNA, 20 bp, Homo sapiens
atttatgcacatatatattt

SEQ ID NO: 133551 - DNA, 20 bp, Homo sapiens
agagagagagagatacttgt

SEQ ID NO: 133552 - DNA, 23 bp, Homo sapiens
aagagagtgaagatgtgatagac

SEQ ID NO: 133553 - DNA, 21 bp, Homo sapiens
tcagcctagagactcagctct

SEQ ID NO: 133554 - DNA, 23 bp, Homo sapiens
tcagtgagtgtctggttgtgaat

SEQ ID NO: 133555 - DNA, 22 bp, Homo sapiens
taatggctgttaatcatgatca

SEQ ID NO: 133556 - DNA, 22 bp, Homo sapiens
ctgcctcactgagtcactgggg

SEQ ID NO: 133557 - DNA, 20 bp, Homo sapiens
tatgaggaccaatgactggt

SEQ ID NO: 133558 - DNA, 19 bp, Homo sapiens
ttcaattctcaggatccag

SEQ ID NO: 133559 - DNA, 23 bp, Homo sapiens
agcctggctctgtcccactgtca

SEQ ID NO: 133560 - DNA, 23 bp, Homo sapiens
ttcagcctcccaaagttctggga

SEQ ID NO: 133561 - DNA, 23 bp, Homo sapiens
ttgagacagtctcttactctgtg

SEQ ID NO: 133562 - DNA, 23 bp, Homo sapiens
tgagttcattgtagattctggat

SEQ ID NO: 133563 - DNA, 23 bp, Homo sapiens
atccagtctcaggtagttcttta

SEQ ID NO: 133564 - DNA, 23 bp, Homo sapiens
tgacagagtgagaccctgtctca

SEQ ID NO: 133565 - DNA, 19 bp, Homo sapiens
tgagatggagtctcgctct

SEQ ID NO: 133566 - DNA, 20 bp, Homo sapiens
tgtcactatcacgcattgcc

SEQ ID NO: 133567 - DNA, 23 bp, Homo sapiens
actgagtctcgctctgtcactag

SEQ ID NO: 133568 - DNA, 23 bp, Homo sapiens
tctgcattatatatgttaaataa

SEQ ID NO: 133569 - DNA, 23 bp, Homo sapiens
ggcagactgtctctaaaaatttt

SEQ ID NO: 133570 - DNA, 23 bp, Homo sapiens
atatgtgaatatatatgtgtgtg

SEQ ID NO: 133571 - DNA, 23 bp, Homo sapiens
gctctgactgtgtcagtactgcc

SEQ ID NO: 133572 - DNA, 23 bp, Homo sapiens
agactgagtctcgctctgtcgca

SEQ ID NO: 133573 - DNA, 23 bp, Homo sapiens
ctgtgtgacaaaactgagtctaa

SEQ ID NO: 133574 - DNA, 23 bp, Homo sapiens
attttaagtgcatgttctgtgtg

SEQ ID NO: 133575 - DNA, 23 bp, Homo sapiens
ctagcaccatttgaaatcagtgt

SEQ ID NO: 133576 - DNA, 23 bp, Homo sapiens
ctgatttcttttggtgttcagag

SEQ ID NO: 133577 - DNA, 23 bp, Homo sapiens
ctagcaccatctgaaatcggtta

SEQ ID NO: 133578 - DNA, 23 bp, Homo sapiens
tatgtttatgtatatgtttaggt

SEQ ID NO: 133579 - DNA, 19 bp, Homo sapiens
gccacatgtggctaatggc

SEQ ID NO: 133580 - DNA, 23 bp, Homo sapiens
cagggtctcactctgtcacccag

SEQ ID NO: 133581 - DNA, 22 bp, Homo sapiens
tctcaagagccaggtgtggtgg

SEQ ID NO: 133582 - DNA, 23 bp, Homo sapiens
aatgatcatctagtcctgatttc

SEQ ID NO: 133583 - DNA, 21 bp, Homo sapiens
tatcctatagttgtggaatta

SEQ ID NO: 133584 - DNA, 23 bp, Homo sapiens
tttccaaatgtatgcaataatag

SEQ ID NO: 133585 - DNA, 22 bp, Homo sapiens
tgagacagtctcactctgtcgc

SEQ ID NO: 133586 - DNA, 22 bp, Homo sapiens
acacagggtcttactctgtcac

SEQ ID NO: 133587 - DNA, 21 bp, Homo sapiens
tattgagaacttttttgtgtc

SEQ ID NO: 133588 - DNA, 23 bp, Homo sapiens
tgagatggagtctcactctgtcg

SEQ ID NO: 133589 - DNA, 19 bp, Homo sapiens
tgttttgagattgacaatg

SEQ ID NO: 133590 - DNA, 22 bp, Homo sapiens
tatgcagtagcacttattttct

SEQ ID NO: 133591 - DNA, 23 bp, Homo sapiens
tgagaagatatgtgaatctgctg

SEQ ID NO: 133592 - DNA, 23 bp, Homo sapiens
tttggcactagcacatttttgct

SEQ ID NO: 133593 - DNA, 22 bp, Homo sapiens
agtctcgctctgtcactcaggc

SEQ ID NO: 133594 - DNA, 19 bp, Homo sapiens
atatatatgtaaatgtgta

SEQ ID NO: 133595 - DNA, 20 bp, Homo sapiens
ttaacagtggctatatgtag

SEQ ID NO: 133596 - DNA, 23 bp, Homo sapiens
cggagtctcgctctgtctcccag

SEQ ID NO: 133597 - DNA, 23 bp, Homo sapiens
cggagtctcgctctgtctcccag

SEQ ID NO: 133598 - DNA, 23 bp, Homo sapiens
ctatacatatatgtgtgtgtgtg

SEQ ID NO: 133599 - DNA, 23 bp, Homo sapiens
ttgtctcaggctctgatttccag

SEQ ID NO: 133600 - DNA, 19 bp, Homo sapiens
tccctgtgaggagaaggac

SEQ ID NO: 133601 - DNA, 20 bp, Homo sapiens
acttgtacatgtatgtatgt

SEQ ID NO: 133602 - DNA, 23 bp, Homo sapiens
tgtatgtatgcatgtgtgtctgt

SEQ ID NO: 133603 - DNA, 23 bp, Homo sapiens
gacagagtctcgctctgtcaccc

SEQ ID NO: 133604 - DNA, 23 bp, Homo sapiens
agctgtctctctcagagcctttc

SEQ ID NO: 133605 - DNA, 18 bp, Homo sapiens
ttttcttgggaatgggtg

SEQ ID NO: 133606 - DNA, 23 bp, Homo sapiens
gctctctgtcagtgacagagcct

SEQ ID NO: 133607 - DNA, 23 bp, Homo sapiens
ggagtctcactctgtcacctagg

SEQ ID NO: 133608 - DNA, 23 bp, Homo sapiens
aagaccatcttttttcactttgg

SEQ ID NO: 133609 - DNA, 19 bp, Homo sapiens
tgagatggagtctcacttt

SEQ ID NO: 133610 - DNA, 19 bp, Homo sapiens
agcaccaccagaatgccca

SEQ ID NO: 133611 - DNA, 23 bp, Homo sapiens
aagttgtagagctgaaagtccag

SEQ ID NO: 133612 - DNA, 23 bp, Homo sapiens
aattccagaggaagtgttgagaa

SEQ ID NO: 133613 - DNA, 23 bp, Homo sapiens
tgtcagccacatttccacctctt

SEQ ID NO: 133614 - DNA, 21 bp, Homo sapiens
gggtggctctctgtgtctctg

SEQ ID NO: 133615 - DNA, 20 bp, Homo sapiens
aactcagggtgcagaggttg

SEQ ID NO: 133616 - DNA, 23 bp, Homo sapiens
tgagttcattgtagattctggat

SEQ ID NO: 133617 - DNA, 23 bp, Homo sapiens
tgagttcattgtagattctggat

SEQ ID NO: 133618 - DNA, 23 bp, Homo sapiens
tctctgcctctgtgactgttctc

SEQ ID NO: 133619 - DNA, 23 bp, Homo sapiens
ttaggaaaatacagtttatgttg

SEQ ID NO: 133620 - DNA, 21 bp, Homo sapiens
ttgtacagagtctgctctctg

SEQ ID NO: 133621 - DNA, 23 bp, Homo sapiens
cttcttgtggttttgatttgcat

SEQ ID NO: 133622 - DNA, 23 bp, Homo sapiens
ttttttcatatttttgttggctg

SEQ ID NO: 133623 - DNA, 18 bp, Homo sapiens
tgtgtatcttcttttaag

SEQ ID NO: 133624 - DNA, 20 bp, Homo sapiens
atgctctgtggctgctgtct

SEQ ID NO: 133625 - DNA, 23 bp, Homo sapiens
tgtgtagttgcttgctagtgtca

SEQ ID NO: 133626 - DNA, 23 bp, Homo sapiens
tgagaaaacagagtggacatttg

SEQ ID NO: 133627 - DNA, 23 bp, Homo sapiens
aaagggaatggatgatttgaggg

SEQ ID NO: 133628 - DNA, 23 bp, Homo sapiens
ctgagaggaaattatttctgtat

SEQ ID NO: 133629 - DNA, 23 bp, Homo sapiens
tttggtacaaatgtttcctcttt

SEQ ID NO: 133630 - DNA, 23 bp, Homo sapiens
tacatgtgcagaatgtgcaggtt

SEQ ID NO: 133631 - DNA, 23 bp, Homo sapiens
atgtgtgtgcatatatatacaat

SEQ ID NO: 133632 - DNA, 23 bp, Homo sapiens
tgacatgtggatagtgtgactga

SEQ ID NO: 133633 - DNA, 19 bp, Homo sapiens
tatatgtatataagtatag

SEQ ID NO: 133634 - DNA, 23 bp, Homo sapiens
tttgccttgctattggtatgaga

SEQ ID NO: 133635 - DNA, 22 bp, Homo sapiens
ttaagctttatttgttttctta

SEQ ID NO: 133636 - DNA, 23 bp, Homo sapiens
tctgcctcacttctgtatctcta

SEQ ID NO: 133637 - DNA, 23 bp, Homo sapiens
atgtgtgtatatatgtgtgtgta

SEQ ID NO: 133638 - DNA, 22 bp, Homo sapiens
tggagtctcactctgtcaccta

SEQ ID NO: 133639 - DNA, 23 bp, Homo sapiens
tcactgtctcagttataattttg

SEQ ID NO: 133640 - DNA, 18 bp, Homo sapiens
aggttatcattaggggga

SEQ ID NO: 133641 - DNA, 19 bp, Homo sapiens
tctcactgtgatatccagg

SEQ ID NO: 133642 - DNA, 21 bp, Homo sapiens
aatgtgagccattctttatat

SEQ ID NO: 133643 - DNA, 20 bp, Homo sapiens
catacctatagtatagtatt

SEQ ID NO: 133644 - DNA, 23 bp, Homo sapiens
ccagtctcactctcactgtgcct

SEQ ID NO: 133645 - DNA, 20 bp, Homo sapiens
tgctagagaattactggtgt

SEQ ID NO: 133646 - DNA, 23 bp, Homo sapiens
aagtgtcgttttcttcctgtagt

SEQ ID NO: 133647 - DNA, 23 bp, Homo sapiens
aagagttgagtgcagattccata

SEQ ID NO: 133648 - DNA, 19 bp, Homo sapiens
aattcaccatcatttagga

SEQ ID NO: 133649 - DNA, 21 bp, Homo sapiens
tgtgtgtgtgtgtatatgcat

SEQ ID NO: 133650 - DNA, 23 bp, Homo sapiens
tgtatatatgtatatgtatatgt

SEQ ID NO: 133651 - DNA, 21 bp, Homo sapiens
tctggctccatatatttgagt

SEQ ID NO: 133652 - DNA, 23 bp, Homo sapiens
tataaggatgaaactttctatgt

SEQ ID NO: 133653 - DNA, 19 bp, Homo sapiens
atagagagagatatgcttc

SEQ ID NO: 133654 - DNA, 19 bp, Homo sapiens
gtctcgctctgtcacccag

SEQ ID NO: 133655 - DNA, 22 bp, Homo sapiens
atagtgcttttgtacacatgtg

SEQ ID NO: 133656 - DNA, 20 bp, Homo sapiens
aagtgactaatttgaaaggc

SEQ ID NO: 133657 - DNA, 21 bp, Homo sapiens
ttttgtttttcaaatctgtaa

SEQ ID NO: 133658 - DNA, 23 bp, Homo sapiens
tatgtacatgtgtctctctgtgt

SEQ ID NO: 133659 - DNA, 23 bp, Homo sapiens
attctctatttataatagtgtgt

SEQ ID NO: 133660 - DNA, 22 bp, Homo sapiens
tccatgtctgtgtttcttgtct

SEQ ID NO: 133661 - DNA, 19 bp, Homo sapiens
tacatatgtatgtgtatga

SEQ ID NO: 133662 - DNA, 23 bp, Homo sapiens
ttacagctagtctttcattctgt

SEQ ID NO: 133663 - DNA, 22 bp, Homo sapiens
tcttttgaagaatggattgtct

SEQ ID NO: 133664 - DNA, 23 bp, Homo sapiens
gtgtgtgtgtgtcgtatatgtgt

SEQ ID NO: 133665 - DNA, 22 bp, Homo sapiens
tgttacagaggtaaacttgtgt

SEQ ID NO: 133666 - DNA, 20 bp, Homo sapiens
tgtgtgtgtgtttgtgtgtg

SEQ ID NO: 133667 - DNA, 23 bp, Homo sapiens
atctgtgtaaatttgtgtatgta

SEQ ID NO: 133668 - DNA, 23 bp, Homo sapiens
tatcagtcctataaatttcaatt

SEQ ID NO: 133669 - DNA, 23 bp, Homo sapiens
aagaaattgggactgctatttat

SEQ ID NO: 133670 - DNA, 23 bp, Homo sapiens
aatttgacattttcttgttgaac

SEQ ID NO: 133671 - DNA, 22 bp, Homo sapiens
actgtggtattaattgactgtg

SEQ ID NO: 133672 - DNA, 20 bp, Homo sapiens
actctgccaatgcttctcat

SEQ ID NO: 133673 - DNA, 21 bp, Homo sapiens
atgtatctatgcatgtatgtg

SEQ ID NO: 133674 - DNA, 21 bp, Homo sapiens
tttcagagaggcagtgtggtc

SEQ ID NO: 133675 - DNA, 18 bp, Homo sapiens
tggattttaaagaagaaa

SEQ ID NO: 133676 - DNA, 18 bp, Homo sapiens
ttagttaatgattacagt

SEQ ID NO: 133677 - DNA, 19 bp, Homo sapiens
tatatctcaagggaataga

SEQ ID NO: 133678 - DNA, 23 bp, Homo sapiens
actcacttgattgaagtttcttg

SEQ ID NO: 133679 - DNA, 18 bp, Homo sapiens
aggactgaggattaggtg

SEQ ID NO: 133680 - DNA, 23 bp, Homo sapiens
cataacttcagtctgtgtctgag

SEQ ID NO: 133681 - DNA, 21 bp, Homo sapiens
tgaggtaggaggatcacttga

SEQ ID NO: 133682 - DNA, 21 bp, Homo sapiens
acacacacacgtgatgataca

SEQ ID NO: 133683 - DNA, 23 bp, Homo sapiens
tgtgtgcatgcgtgtgtgtgtgt

SEQ ID NO: 133684 - DNA, 22 bp, Homo sapiens
ttatatttgaaggactgcttgc

SEQ ID NO: 133685 - DNA, 23 bp, Homo sapiens
tctgtgtgtgtgtgtgtatatat

SEQ ID NO: 133686 - DNA, 23 bp, Homo sapiens
caccaaatcagagtagctgttca

SEQ ID NO: 133687 - DNA, 23 bp, Homo sapiens
ttcttctagattttccaacttat

SEQ ID NO: 133688 - DNA, 19 bp, Homo sapiens
tccatgacagaaaagatgg

SEQ ID NO: 133689 - DNA, 23 bp, Homo sapiens
attgcctctagatgactttcatt

SEQ ID NO: 133690 - DNA, 23 bp, Homo sapiens
tcttttggttccatatgaaattt

SEQ ID NO: 133691 - DNA, 23 bp, Homo sapiens
tctgtgaagaaagtcaatggtag

SEQ ID NO: 133692 - DNA, 18 bp, Homo sapiens
tgtctttgttcttagtgg

SEQ ID NO: 133693 - DNA, 19 bp, Homo sapiens
ttgagagaggtgagagaag

SEQ ID NO: 133694 - DNA, 22 bp, Homo sapiens
tgtgtgtatatatatatgtatg

SEQ ID NO: 133695 - DNA, 19 bp, Homo sapiens
tatgagcaaggaatatgta

SEQ ID NO: 133696 - DNA, 22 bp, Homo sapiens
ttcatttaggataacattgcaa

SEQ ID NO: 133697 - DNA, 23 bp, Homo sapiens
agagtacagattttgaatatgtc

SEQ ID NO: 133698 - DNA, 18 bp, Homo sapiens
gatgttcatggcatagct

SEQ ID NO: 133699 - DNA, 23 bp, Homo sapiens
attgtagaatctagtaggtgtat

SEQ ID NO: 133700 - DNA, 23 bp, Homo sapiens
ggtaagtccaagtgtagttgcct

SEQ ID NO: 133701 - DNA, 23 bp, Homo sapiens
tgatttatctcagcttctggttt

SEQ ID NO: 133702 - DNA, 22 bp, Homo sapiens
tgttgaatggtattcttgagta

SEQ ID NO: 133703 - DNA, 21 bp, Homo sapiens
aagctactagataaattagtt

SEQ ID NO: 133704 - DNA, 23 bp, Homo sapiens
tttctttgactctctggatatat

SEQ ID NO: 133705 - DNA, 21 bp, Homo sapiens
atgaggaaatatttataaggg

SEQ ID NO: 133706 - DNA, 23 bp, Homo sapiens
ggaagagtgagagaaaacagtgt

SEQ ID NO: 133707 - DNA, 18 bp, Homo sapiens
attcaccaacatctggtc

SEQ ID NO: 133708 - DNA, 23 bp, Homo sapiens
ctcaaagtgtcaggattacaggc

SEQ ID NO: 133709 - DNA, 21 bp, Homo sapiens
tcatgtttaagtggtctgttt

SEQ ID NO: 133710 - DNA, 21 bp, Homo sapiens
tatatctccatatgcatgtga

SEQ ID NO: 133711 - DNA, 23 bp, Homo sapiens
aagagtcactgcaagacatttat

SEQ ID NO: 133712 - DNA, 23 bp, Homo sapiens
atgagatgcttgaagaactctaa

SEQ ID NO: 133713 - DNA, 19 bp, Homo sapiens
tatacacattatatatatg

SEQ ID NO: 133714 - DNA, 21 bp, Homo sapiens
tatatctagatataggtatat

SEQ ID NO: 133715 - DNA, 22 bp, Homo sapiens
ttccaaaatgtggtagctgtta

SEQ ID NO: 133716 - DNA, 23 bp, Homo sapiens
tatgtctaaatataaatatgtgt

SEQ ID NO: 133717 - DNA, 23 bp, Homo sapiens
tatatctgcatttcttgacttgg

SEQ ID NO: 133718 - DNA, 23 bp, Homo sapiens
accgagtctcgctctgtcaccca

SEQ ID NO: 133719 - DNA, 21 bp, Homo sapiens
ttatgtgtatgtatgtatatg

SEQ ID NO: 133720 - DNA, 20 bp, Homo sapiens
tatgtgtatatatatgtgtg

SEQ ID NO: 133721 - DNA, 23 bp, Homo sapiens
agtgctaggattacaggtgtgaa

SEQ ID NO: 133722 - DNA, 23 bp, Homo sapiens
gagagatcactgggtgcagagtt

SEQ ID NO: 133723 - DNA, 23 bp, Homo sapiens
ctgaatagctgatgatacaggat

SEQ ID NO: 133724 - DNA, 23 bp, Homo sapiens
tgagcttcattgagactggctat

SEQ ID NO: 133725 - DNA, 22 bp, Homo sapiens
agagtgttgtgtgtgtgcaggt

SEQ ID NO: 133726 - DNA, 18 bp, Homo sapiens
tatgtatgtatgtgtgtg

SEQ ID NO: 133727 - DNA, 21 bp, Homo sapiens
tttatttgttccatatgaatt

SEQ ID NO: 133728 - DNA, 18 bp, Homo sapiens
tctgtctctctcacttca

SEQ ID NO: 133729 - DNA, 19 bp, Homo sapiens
gtatatatatatgtgtgta

SEQ ID NO: 133730 - DNA, 23 bp, Homo sapiens
tgtatatatgtatgtatatatgt

SEQ ID NO: 133731 - DNA, 23 bp, Homo sapiens
catttcagaaatagttgactttt

SEQ ID NO: 133732 - DNA, 23 bp, Homo sapiens
atagttgtaatagtcatgatagt

SEQ ID NO: 133733 - DNA, 23 bp, Homo sapiens
tgaaagcatttgaattctgtaga

SEQ ID NO: 133734 - DNA, 20 bp, Homo sapiens
atagtgtcagctagttcaag

SEQ ID NO: 133735 - DNA, 23 bp, Homo sapiens
tgtaagcatggtacactcattgc

SEQ ID NO: 133736 - DNA, 20 bp, Homo sapiens
atatgcatttatatacattt

SEQ ID NO: 133737 - DNA, 21 bp, Homo sapiens
ttttcacagttgctgtatgat

SEQ ID NO: 133738 - DNA, 23 bp, Homo sapiens
aaagtcactggagcgttggtgtg

SEQ ID NO: 133739 - DNA, 23 bp, Homo sapiens
tgagttcattgtagattctggat

SEQ ID NO: 133740 - DNA, 23 bp, Homo sapiens
tgagttcattgtagattctggat

SEQ ID NO: 133741 - DNA, 20 bp, Homo sapiens
acacacacacatatatatat

SEQ ID NO: 133742 - DNA, 21 bp, Homo sapiens
ttgagaggtgacagtgtgctg

SEQ ID NO: 133743 - DNA, 23 bp, Homo sapiens
tatgtgtatatatgtgtgtgtgt

SEQ ID NO: 133744 - DNA, 23 bp, Homo sapiens
tgtatgtatgtatgtatgtatgt

SEQ ID NO: 133745 - DNA, 23 bp, Homo sapiens
tctcagtctgttagttcacatga

SEQ ID NO: 133746 - DNA, 21 bp, Homo sapiens
tctgacagaaaatccactgac

SEQ ID NO: 133747 - DNA, 23 bp, Homo sapiens
tgaaagattgaacactgatttgt

SEQ ID NO: 133748 - DNA, 18 bp, Homo sapiens
ttgttgtggctataggtg

SEQ ID NO: 133749 - DNA, 21 bp, Homo sapiens
aaaatgagtttgttgatgtca

SEQ ID NO: 133750 - DNA, 23 bp, Homo sapiens
tagtgtactgttgttgctctagt

SEQ ID NO: 133751 - DNA, 22 bp, Homo sapiens
attgacaaagagaaattgtatg

SEQ ID NO: 133752 - DNA, 23 bp, Homo sapiens
tggcatacagtatgatgttttga

SEQ ID NO: 133753 - DNA, 22 bp, Homo sapiens
agtgagaaatactatatcagtg

SEQ ID NO: 133754 - DNA, 23 bp, Homo sapiens
aattctagacattttcttgaaga

SEQ ID NO: 133755 - DNA, 20 bp, Homo sapiens
ttgatctatgttcttttcat

SEQ ID NO: 133756 - DNA, 19 bp, Homo sapiens
aaggcagcacaacaaatca

SEQ ID NO: 133757 - DNA, 20 bp, Homo sapiens
ctgtggcttattgataactg

SEQ ID NO: 133758 - DNA, 23 bp, Homo sapiens
taagagagtatggcaaatagtgc

SEQ ID NO: 133759 - DNA, 23 bp, Homo sapiens
agtttggttggatatgaaattgt

SEQ ID NO: 133760 - DNA, 20 bp, Homo sapiens
agagagttgaggtagatgaa

SEQ ID NO: 133761 - DNA, 23 bp, Homo sapiens
tctaaatgaattgtccattgttg

SEQ ID NO: 133762 - DNA, 19 bp, Homo sapiens
tattgcactttactcaccc

SEQ ID NO: 133763 - DNA, 22 bp, Homo sapiens
aaaacactaaggtaatgtggaa

SEQ ID NO: 133764 - DNA, 20 bp, Homo sapiens
tccaatacagattttgttgt

SEQ ID NO: 133765 - DNA, 23 bp, Homo sapiens
gtatatgtatgtatatatgtatg

SEQ ID NO: 133766 - DNA, 23 bp, Homo sapiens
agttctgggtctgtcatagcagc

SEQ ID NO: 133767 - DNA, 22 bp, Homo sapiens
atatgtgtatatatgtatatgt

SEQ ID NO: 133768 - DNA, 22 bp, Homo sapiens
acaaaacaatgctattcttctc

SEQ ID NO: 133769 - DNA, 21 bp, Homo sapiens
gtatatatttgtgcatgcata

SEQ ID NO: 133770 - DNA, 18 bp, Homo sapiens
aagtggtatctcattgtg

SEQ ID NO: 133771 - DNA, 23 bp, Homo sapiens
aagtggattttattggtatgaga

SEQ ID NO: 133772 - DNA, 23 bp, Homo sapiens
tgagttcattgtagattctggat

SEQ ID NO: 133773 - DNA, 23 bp, Homo sapiens
tgagttcattgtagattctggat

SEQ ID NO: 133774 - DNA, 23 bp, Homo sapiens
gtcacgtacttgatagatgcaaa

SEQ ID NO: 133775 - DNA, 18 bp, Homo sapiens
tacctgtagtcctagcta

SEQ ID NO: 133776 - DNA, 22 bp, Homo sapiens
gtgagctatgatgatgccattg

SEQ ID NO: 133777 - DNA, 21 bp, Homo sapiens
gtgcagtggcacctgtgtgta

SEQ ID NO: 133778 - DNA, 23 bp, Homo sapiens
gtggtaatcagattgaattgtga

SEQ ID NO: 133779 - DNA, 19 bp, Homo sapiens
aaaaggattttttttctaa

SEQ ID NO: 133780 - DNA, 23 bp, Homo sapiens
tcagggatgagagagagctctgg

SEQ ID NO: 133781 - DNA, 23 bp, Homo sapiens
tgcagtgagccatgattgttcca

SEQ ID NO: 133782 - DNA, 23 bp, Homo sapiens
aatagtatgtagctcatcagatg

SEQ ID NO: 133783 - DNA, 18 bp, Homo sapiens
attgagatggagtcttgc

SEQ ID NO: 133784 - DNA, 22 bp, Homo sapiens
atgaagttaatgagatatggca

SEQ ID NO: 133785 - DNA, 23 bp, Homo sapiens
tgagttcattgtagattctggat

SEQ ID NO: 133786 - DNA, 23 bp, Homo sapiens
tgagttcattgtagattctggat

SEQ ID NO: 133787 - DNA, 23 bp, Homo sapiens
gagatggatttaaattgttattg

SEQ ID NO: 133788 - DNA, 23 bp, Homo sapiens
agtctagagttttagtttagctt

SEQ ID NO: 133789 - DNA, 20 bp, Homo sapiens
agttaaattgttatattgac

SEQ ID NO: 133790 - DNA, 23 bp, Homo sapiens
tacatgtgcacaatgtgcaggtt

SEQ ID NO: 133791 - DNA, 23 bp, Homo sapiens
aatgtgagagaggagtgtgaggc

SEQ ID NO: 133792 - DNA, 23 bp, Homo sapiens
ttatatgtgcatatgttatatat

SEQ ID NO: 133793 - DNA, 21 bp, Homo sapiens
atgctgaatgattactctgtg

SEQ ID NO: 133794 - DNA, 23 bp, Homo sapiens
atacatgtgcagaatgtgcaggt

SEQ ID NO: 133795 - DNA, 18 bp, Homo sapiens
tcccaccaagagtgttca

SEQ ID NO: 133796 - DNA, 22 bp, Homo sapiens
tttttgctttttaaatgattga

SEQ ID NO: 133797 - DNA, 19 bp, Homo sapiens
gtatataaatatgtataca

SEQ ID NO: 133798 - DNA, 19 bp, Homo sapiens
tatgcatatttatatgtat

SEQ ID NO: 133799 - DNA, 20 bp, Homo sapiens
aatgagaggtaaaatggtga

SEQ ID NO: 133800 - DNA, 23 bp, Homo sapiens
gttaggtagtagatacaggattc

SEQ ID NO: 133801 - DNA, 19 bp, Homo sapiens
aatgtcattcaaccttctt

SEQ ID NO: 133802 - DNA, 23 bp, Homo sapiens
gagacagaaatctccataatggt

SEQ ID NO: 133803 - DNA, 22 bp, Homo sapiens
aataggaagaaatgtgggctca

SEQ ID NO: 133804 - DNA, 21 bp, Homo sapiens
tgtgagaagattgtcaggagt

SEQ ID NO: 133805 - DNA, 23 bp, Homo sapiens
aaagttttcagattttgatgaag

SEQ ID NO: 133806 - DNA, 19 bp, Homo sapiens
ctccgagaattgtttgcct

SEQ ID NO: 133807 - DNA, 22 bp, Homo sapiens
tttctttggaaaacatttgttt

SEQ ID NO: 133808 - DNA, 23 bp, Homo sapiens
tgagttcattgtagattctggat

SEQ ID NO: 133809 - DNA, 23 bp, Homo sapiens
tgagttcattgtagattctggat

SEQ ID NO: 133810 - DNA, 22 bp, Homo sapiens
tgtgttttcagtcagttttata

SEQ ID NO: 133811 - DNA, 22 bp, Homo sapiens
ttattggcagataatgttctgt

SEQ ID NO: 133812 - DNA, 21 bp, Homo sapiens
tgcaattttaagaagttttga

SEQ ID NO: 133813 - DNA, 22 bp, Homo sapiens
aaaaaccacaattacttttgca

SEQ ID NO: 133814 - DNA, 22 bp, Homo sapiens
agtggactttttgatgtactga

SEQ ID NO: 133815 - DNA, 19 bp, Homo sapiens
tgtaagtatatacttatgt

SEQ ID NO: 133816 - DNA, 21 bp, Homo sapiens
tatagctatatatacctatat

SEQ ID NO: 133817 - DNA, 23 bp, Homo sapiens
tgtgtgccagccattgttgttct

SEQ ID NO: 133818 - DNA, 20 bp, Homo sapiens
atgtgcacaacgtgcaggtt

SEQ ID NO: 133819 - DNA, 23 bp, Homo sapiens
tacaaaatatgtgtaaatgtagt

SEQ ID NO: 133820 - DNA, 20 bp, Homo sapiens
gttaagagtgtgtgtatata

SEQ ID NO: 133821 - DNA, 23 bp, Homo sapiens
tatatgtatatcatttgtaatag

SEQ ID NO: 133822 - DNA, 23 bp, Homo sapiens
tgtgtgtttctcatatatagaga

SEQ ID NO: 133823 - DNA, 23 bp, Homo sapiens
tgagttcattgtagattctggat

SEQ ID NO: 133824 - DNA, 23 bp, Homo sapiens
tacaggaggagttgagaaccagt

SEQ ID NO: 133825 - DNA, 22 bp, Homo sapiens
taaagctcccaggtgttctgat

SEQ ID NO: 133826 - DNA, 23 bp, Homo sapiens
taagattgttgatctgataagaa

SEQ ID NO: 133827 - DNA, 23 bp, Homo sapiens
atatatgtgtgtgtgtatatgtg

SEQ ID NO: 133828 - DNA, 23 bp, Homo sapiens
atatctatatttttaactgagtc

SEQ ID NO: 133829 - DNA, 23 bp, Homo sapiens
tcactgtgtctgtctgtatccac

SEQ ID NO: 133830 - DNA, 23 bp, Homo sapiens
tctgtcactgtctcccatcaccc

SEQ ID NO: 133831 - DNA, 23 bp, Homo sapiens
aggtctagtgatttaggtgatgt

SEQ ID NO: 133832 - DNA, 23 bp, Homo sapiens
aacacatgtgtatttgttctcct

SEQ ID NO: 133833 - DNA, 19 bp, Homo sapiens
tatttagtatagtacttta

SEQ ID NO: 133834 - DNA, 21 bp, Homo sapiens
agacagggtcttttttctttt

SEQ ID NO: 133835 - DNA, 22 bp, Homo sapiens
tgtgtgtatatatatatgtgta

SEQ ID NO: 133836 - DNA, 23 bp, Homo sapiens
tgagttcattgtagattctggat

SEQ ID NO: 133837 - DNA, 23 bp, Homo sapiens
tgagttcattgtagattctggat

SEQ ID NO: 133838 - DNA, 20 bp, Homo sapiens
ttgaagtctgtattgtgagg

SEQ ID NO: 133839 - DNA, 23 bp, Homo sapiens
tgtatatatgtatatgtatatgt

SEQ ID NO: 133840 - DNA, 23 bp, Homo sapiens
atgtgtatatatgtatatgtgtg

SEQ ID NO: 133841 - DNA, 22 bp, Homo sapiens
acgtgtatatatgtatatgtgt

SEQ ID NO: 133842 - DNA, 23 bp, Homo sapiens
tgtgtatgtatatatatgtgtgt

SEQ ID NO: 133843 - DNA, 23 bp, Homo sapiens
acaggatctcactctgtttctca

SEQ ID NO: 133844 - DNA, 19 bp, Homo sapiens
atctaagaagttggcaaag

SEQ ID NO: 133845 - DNA, 18 bp, Homo sapiens
acgtatatatatgtgtat

SEQ ID NO: 133846 - DNA, 18 bp, Homo sapiens
acgtatatatatgtgtat

SEQ ID NO: 133847 - DNA, 23 bp, Homo sapiens
ttgtgtttaatctgcaatgtgat

SEQ ID NO: 133848 - DNA, 21 bp, Homo sapiens
tttgctgaggttcttggatct

SEQ ID NO: 133849 - DNA, 21 bp, Homo sapiens
ttaaaatctttaggaagacat

SEQ ID NO: 133850 - DNA, 23 bp, Homo sapiens
tctgtgtgtctgtgtggaaagca

SEQ ID NO: 133851 - DNA, 23 bp, Homo sapiens
gacagagtctcgctctgtcaccc

SEQ ID NO: 133852 - DNA, 22 bp, Homo sapiens
aacttcactgaatttgttgatc

SEQ ID NO: 133853 - DNA, 23 bp, Homo sapiens
tgagagagacagacagagaatat

SEQ ID NO: 133854 - DNA, 23 bp, Homo sapiens
tcttccttgttgttgtttccaag

SEQ ID NO: 133855 - DNA, 23 bp, Homo sapiens
tgagttcattgtagattctggat

SEQ ID NO: 133856 - DNA, 23 bp, Homo sapiens
tgagttcattgtagattctggat

SEQ ID NO: 133857 - DNA, 23 bp, Homo sapiens
atggtagtttgttgaatacttga

SEQ ID NO: 133858 - DNA, 23 bp, Homo sapiens
tgaatatttctaattctgttaag

SEQ ID NO: 133859 - DNA, 19 bp, Homo sapiens
ttagaggtagagttttaaa

SEQ ID NO: 133860 - DNA, 21 bp, Homo sapiens
taactggctgtagtcaggggc

SEQ ID NO: 133861 - DNA, 23 bp, Homo sapiens
tatatttgtgttatacttattgt

SEQ ID NO: 133862 - DNA, 23 bp, Homo sapiens
actcagttggaggtttggtgcaa

SEQ ID NO: 133863 - DNA, 21 bp, Homo sapiens
aacttgtgagataggttggtg

SEQ ID NO: 133864 - DNA, 23 bp, Homo sapiens
actcactggcacacactgagtgg

SEQ ID NO: 133865 - DNA, 21 bp, Homo sapiens
taatacacacatgtatataag

SEQ ID NO: 133866 - DNA, 20 bp, Homo sapiens
tgtatataagtatatacgtg

SEQ ID NO: 133867 - DNA, 23 bp, Homo sapiens
gagtctcactctgtcacccaggc

SEQ ID NO: 133868 - DNA, 18 bp, Homo sapiens
ttgtgatttattaggtga

SEQ ID NO: 133869 - DNA, 18 bp, Homo sapiens
aggtttatatatatctgt

SEQ ID NO: 133870 - DNA, 21 bp, Homo sapiens
ccaggcttctgagtgccactg

SEQ ID NO: 133871 - DNA, 21 bp, Homo sapiens
aatctacttgtactttacagt

SEQ ID NO: 133872 - DNA, 19 bp, Homo sapiens
aaaattagatagagtctcc

SEQ ID NO: 133873 - DNA, 20 bp, Homo sapiens
atacgtatatatatgtgtat

SEQ ID NO: 133874 - DNA, 23 bp, Homo sapiens
tatacgtatatatatatatgtgt

SEQ ID NO: 133875 - DNA, 22 bp, Homo sapiens
ttctgttccttgtattcagcat

SEQ ID NO: 133876 - DNA, 22 bp, Homo sapiens
gaatgaaatgttgaatgcagtt

SEQ ID NO: 133877 - DNA, 18 bp, Homo sapiens
agacagaaggcagtgtgg

SEQ ID NO: 133878 - DNA, 23 bp, Homo sapiens
aaatttgggccacattttcatgt

SEQ ID NO: 133879 - DNA, 22 bp, Homo sapiens
atgtatgtatatatgtgtgtat

SEQ ID NO: 133880 - DNA, 20 bp, Homo sapiens
atatatgtatgtatatgtgt

SEQ ID NO: 133881 - DNA, 19 bp, Homo sapiens
tgtgagtgctttataagtg

SEQ ID NO: 133882 - DNA, 23 bp, Homo sapiens
tgtggaatgaagtaactcaaatg

SEQ ID NO: 133883 - DNA, 23 bp, Homo sapiens
gtattgtaatctgtctctccctt

SEQ ID NO: 133884 - DNA, 18 bp, Homo sapiens
aggtttagagtaagtatt

SEQ ID NO: 133885 - DNA, 23 bp, Homo sapiens
ttagaaagagtttatgatttggt

SEQ ID NO: 133886 - DNA, 23 bp, Homo sapiens
tgagttcattgtagattctggat

SEQ ID NO: 133887 - DNA, 23 bp, Homo sapiens
tgagttcattgtagattctggat

SEQ ID NO: 133888 - DNA, 23 bp, Homo sapiens
tgctttaagttctggagtacatg

SEQ ID NO: 133889 - DNA, 22 bp, Homo sapiens
tatatgtatatatatatgacag

SEQ ID NO: 133890 - DNA, 23 bp, Homo sapiens
tatatacacgtatatgtatacat

SEQ ID NO: 133891 - DNA, 23 bp, Homo sapiens
gtacatgtgcaggatgtgcaggt

SEQ ID NO: 133892 - DNA, 23 bp, Homo sapiens
atatgtgtatatatatatgtgtg

SEQ ID NO: 133893 - DNA, 23 bp, Homo sapiens
atttctgcatatagatccagtat

SEQ ID NO: 133894 - DNA, 21 bp, Homo sapiens
tcatgtgtattttattttttg

SEQ ID NO: 133895 - DNA, 20 bp, Homo sapiens
atatatctatatctatatct

SEQ ID NO: 133896 - DNA, 23 bp, Homo sapiens
atatacatgtatgcacatatgta

SEQ ID NO: 133897 - DNA, 23 bp, Homo sapiens
aaagtacttaaacaaaggactat

SEQ ID NO: 133898 - DNA, 23 bp, Homo sapiens
aggtatacatacagatatagata

SEQ ID NO: 133899 - DNA, 23 bp, Homo sapiens
gtatctacatgtgtgcatatgta

SEQ ID NO: 133900 - DNA, 20 bp, Homo sapiens
atttctcttcttgcttatct

SEQ ID NO: 133901 - DNA, 23 bp, Homo sapiens
acacacacatatgtttactaaga

SEQ ID NO: 133902 - DNA, 19 bp, Homo sapiens
tgtgtaaaggatttagaca

SEQ ID NO: 133903 - DNA, 23 bp, Homo sapiens
tttaaatccattggagatgattc

SEQ ID NO: 133904 - DNA, 23 bp, Homo sapiens
tggaatggaaagtagattgttga

SEQ ID NO: 133905 - DNA, 23 bp, Homo sapiens
cttcaaaatagttatctttcctt

SEQ ID NO: 133906 - DNA, 20 bp, Homo sapiens
tgccactctgcctctcttct

SEQ ID NO: 133907 - DNA, 21 bp, Homo sapiens
ttggtctgcttgaaaacactg

SEQ ID NO: 133908 - DNA, 23 bp, Homo sapiens
ctagttctttcagattttgtttt

SEQ ID NO: 133909 - DNA, 23 bp, Homo sapiens
tgagttcattgtagattctggat

SEQ ID NO: 133910 - DNA, 23 bp, Homo sapiens
tgagttcattgtagattctggat

SEQ ID NO: 133911 - DNA, 23 bp, Homo sapiens
ttatccatcattatgatactata

SEQ ID NO: 133912 - DNA, 23 bp, Homo sapiens
tgagttcattgtagattctggat

SEQ ID NO: 133913 - DNA, 23 bp, Homo sapiens
tgagttcattgtagattctggat

SEQ ID NO: 133914 - DNA, 22 bp, Homo sapiens
acacactgtcttgcagacaggt

SEQ ID NO: 133915 - DNA, 23 bp, Homo sapiens
atcacactgtactttgcaacagt

SEQ ID NO: 133916 - DNA, 21 bp, Homo sapiens
tcaaaaattcttgatgttgtg

SEQ ID NO: 133917 - DNA, 21 bp, Homo sapiens
tcacttcagttgatatgtaga

SEQ ID NO: 133918 - DNA, 23 bp, Homo sapiens
atctagatgaaatttgttggtga

SEQ ID NO: 133919 - DNA, 23 bp, Homo sapiens
atttgtatatatgcatgtgtgtg

SEQ ID NO: 133920 - DNA, 23 bp, Homo sapiens
agaggttgcagtgagtgagcaga

SEQ ID NO: 133921 - DNA, 23 bp, Homo sapiens
gtgtgtgcctgtagtcttgactg

SEQ ID NO: 133922 - DNA, 23 bp, Homo sapiens
tttatatttaagtagctgtagaa

SEQ ID NO: 133923 - DNA, 23 bp, Homo sapiens
aagtcactcaatttctctgagct

SEQ ID NO: 133924 - DNA, 23 bp, Homo sapiens
tatttcttcattttgaaaactaa

SEQ ID NO: 133925 - DNA, 20 bp, Homo sapiens
aatactcctaggtaaacaaa

SEQ ID NO: 133926 - DNA, 19 bp, Homo sapiens
ttgtttttgttaagtgcat

SEQ ID NO: 133927 - DNA, 23 bp, Homo sapiens
gttgggacagagatacgagggtg

SEQ ID NO: 133928 - DNA, 18 bp, Homo sapiens
tctttttatttcttgaat

SEQ ID NO: 133929 - DNA, 23 bp, Homo sapiens
aacacctttttcatagtctttga

SEQ ID NO: 133930 - DNA, 23 bp, Homo sapiens
agattctagatgttgcatgtgtt

SEQ ID NO: 133931 - DNA, 23 bp, Homo sapiens
attgttacagtagtacagtatga

SEQ ID NO: 133932 - DNA, 23 bp, Homo sapiens
tacatgtgcagaatgtgcaggtt

SEQ ID NO: 133933 - DNA, 23 bp, Homo sapiens
tgagacagtctcgctgtgtcgcc

SEQ ID NO: 133934 - DNA, 19 bp, Homo sapiens
tgtttatatatgtacagaa

SEQ ID NO: 133935 - DNA, 22 bp, Homo sapiens
gagtgaggtaatctattcaaag

SEQ ID NO: 133936 - DNA, 20 bp, Homo sapiens
atgtgcctgtagtcctggct

SEQ ID NO: 133937 - DNA, 18 bp, Homo sapiens
atacacgtgtgtgtgtac

SEQ ID NO: 133938 - DNA, 23 bp, Homo sapiens
gttctttttgcttaggattgtct

SEQ ID NO: 133939 - DNA, 23 bp, Homo sapiens
tgtgaagaaagtcagtggtagtt

SEQ ID NO: 133940 - DNA, 21 bp, Homo sapiens
ctgacatgaagtggctctgct

SEQ ID NO: 133941 - DNA, 23 bp, Homo sapiens
tgactggctgagtgggtcacatg

SEQ ID NO: 133942 - DNA, 18 bp, Homo sapiens
atactttaagttttaggg

SEQ ID NO: 133943 - DNA, 23 bp, Homo sapiens
tgagttcattgtagattctggat

SEQ ID NO: 133944 - DNA, 23 bp, Homo sapiens
tgagttcattgtagattctggat

SEQ ID NO: 133945 - DNA, 23 bp, Homo sapiens
aggaagacactcagctcttcctg

SEQ ID NO: 133946 - DNA, 23 bp, Homo sapiens
cagagaagacactgagctcttca

SEQ ID NO: 133947 - DNA, 21 bp, Homo sapiens
agagcctggatcagaagagct

SEQ ID NO: 133948 - DNA, 23 bp, Homo sapiens
tacgtacatatatatacatatgt

SEQ ID NO: 133949 - DNA, 23 bp, Homo sapiens
gcctgcctgcctgcctgactgcc

SEQ ID NO: 133950 - DNA, 23 bp, Homo sapiens
cccctgtctctctctcagtggtt

SEQ ID NO: 133951 - DNA, 23 bp, Homo sapiens
gggggactcactgtctctggctt

SEQ ID NO: 133952 - DNA, 23 bp, Homo sapiens
gacagtctcagcctgtcacccag

SEQ ID NO: 133953 - DNA, 21 bp, Homo sapiens
atatactgtgtatatgtatat

SEQ ID NO: 133954 - DNA, 21 bp, Homo sapiens
tgtgtacatatacgggtgtgt

SEQ ID NO: 133955 - DNA, 23 bp, Homo sapiens
agacaagagtctcactctgtccc

SEQ ID NO: 133956 - DNA, 21 bp, Homo sapiens
tggctgttgtttgtgctgtca

SEQ ID NO: 133957 - DNA, 23 bp, Homo sapiens
tgagatggaattttgctcttgtt

SEQ ID NO: 133958 - DNA, 23 bp, Homo sapiens
cagtgtcactgcctctcgctctg

SEQ ID NO: 133959 - DNA, 19 bp, Homo sapiens
tgaggtaggaggatcactt

SEQ ID NO: 133960 - DNA, 23 bp, Homo sapiens
tggagtctcactctgtcacccag

SEQ ID NO: 133961 - DNA, 23 bp, Homo sapiens
tctctctctgtgtatatacacag

SEQ ID NO: 133962 - DNA, 20 bp, Homo sapiens
tatgtgtatatgtatatata

SEQ ID NO: 133963 - DNA, 21 bp, Homo sapiens
atgtgtgtatatgtatatatg

SEQ ID NO: 133964 - DNA, 23 bp, Homo sapiens
tttatttcaacaggtttttgggg

SEQ ID NO: 133965 - DNA, 23 bp, Homo sapiens
actctgtcacagtgacacccagg

SEQ ID NO: 133966 - DNA, 23 bp, Homo sapiens
ttatgcagtctcaggtatgtctt

SEQ ID NO: 133967 - DNA, 22 bp, Homo sapiens
tagcagcatgagaacagactaa

SEQ ID NO: 133968 - DNA, 22 bp, Homo sapiens
attgaagtcgtatcagtctact

SEQ ID NO: 133969 - DNA, 21 bp, Homo sapiens
aatgtgtatatatatatctga

SEQ ID NO: 133970 - DNA, 18 bp, Homo sapiens
agcactagtcaaaccctg

SEQ ID NO: 133971 - DNA, 21 bp, Homo sapiens
gaagttcaaggttgtatacat

SEQ ID NO: 133972 - DNA, 18 bp, Homo sapiens
gggagatggtgattattg

SEQ ID NO: 133973 - DNA, 21 bp, Homo sapiens
agagtctctatctgtcaccca

SEQ ID NO: 133974 - DNA, 22 bp, Homo sapiens
acatactcactgacttggcagt

SEQ ID NO: 133975 - DNA, 22 bp, Homo sapiens
tgaaatgtctctcagttaatgt

SEQ ID NO: 133976 - DNA, 23 bp, Homo sapiens
tttattcattgtgctctgtgtgt

SEQ ID NO: 133977 - DNA, 21 bp, Homo sapiens
tgtgaagaaagtcaatggtag

SEQ ID NO: 133978 - DNA, 23 bp, Homo sapiens
acttggacttactgcaacctctg

SEQ ID NO: 133979 - DNA, 23 bp, Homo sapiens
ggagtctcactctgtctcccagg

SEQ ID NO: 133980 - DNA, 23 bp, Homo sapiens
tcactttcactctgtctcagagt

SEQ ID NO: 133981 - DNA, 23 bp, Homo sapiens
agtgtgtgtgtatatgtgtgtat

SEQ ID NO: 133982 - DNA, 20 bp, Homo sapiens
tataaactatgcatatgtat

SEQ ID NO: 133983 - DNA, 23 bp, Homo sapiens
tgagttcattgtagattctggat

SEQ ID NO: 133984 - DNA, 23 bp, Homo sapiens
tgagttcattgtagattctggat

SEQ ID NO: 133985 - DNA, 20 bp, Homo sapiens
acagtatttttcattatgat

SEQ ID NO: 133986 - DNA, 23 bp, Homo sapiens
agatagttagaaatgcaatgctt

SEQ ID NO: 133987 - DNA, 18 bp, Homo sapiens
agcaagactccatctttt

SEQ ID NO: 133988 - DNA, 23 bp, Homo sapiens
cagagtctcccactgtcacccag

SEQ ID NO: 133989 - DNA, 23 bp, Homo sapiens
gacagatcactcacactctctgg

SEQ ID NO: 133990 - DNA, 18 bp, Homo sapiens
agcaagactccatctttt

SEQ ID NO: 133991 - DNA, 20 bp, Homo sapiens
gcacatgcagggcaccacca

SEQ ID NO: 133992 - DNA, 23 bp, Homo sapiens
tataaatgtgtgctgaaactctg

SEQ ID NO: 133993 - DNA, 23 bp, Homo sapiens
tgtgtatatatacacgtgtgtgt

SEQ ID NO: 133994 - DNA, 23 bp, Homo sapiens
tgctctgtcgctcagactggagt

SEQ ID NO: 133995 - DNA, 22 bp, Homo sapiens
aatggcacagtctcagctcact

SEQ ID NO: 133996 - DNA, 23 bp, Homo sapiens
tgagatggagtctcactctgttt

SEQ ID NO: 133997 - DNA, 23 bp, Homo sapiens
tttacattcatggaggttttgtt

SEQ ID NO: 133998 - DNA, 23 bp, Homo sapiens
gatgactcatgcttgtaatctca

SEQ ID NO: 133999 - DNA, 23 bp, Homo sapiens
agactgaatctgtctctgtcacc

SEQ ID NO: 134000 - DNA, 23 bp, Homo sapiens
aaacagggtctcgctctgtcacc

SEQ ID NO: 134001 - DNA, 23 bp, Homo sapiens
gacagagtctcgctctgtcaccc

SEQ ID NO: 134002 - DNA, 23 bp, Homo sapiens
cggagtctcactctgtcacccag

SEQ ID NO: 134003 - DNA, 18 bp, Homo sapiens
agaatacatgctcctctg

SEQ ID NO: 134004 - DNA, 23 bp, Homo sapiens
tgagatggagtctcactctgtcg

SEQ ID NO: 134005 - DNA, 23 bp, Homo sapiens
ctgcccctctgaggctctgtgtg

SEQ ID NO: 134006 - DNA, 23 bp, Homo sapiens
tgtgagccaccgtgcctggcaca

SEQ ID NO: 134007 - DNA, 23 bp, Homo sapiens
gacagtgtctcactctgttgctc

SEQ ID NO: 134008 - DNA, 20 bp, Homo sapiens
acagtggtgtgatcgcagct

SEQ ID NO: 134009 - DNA, 23 bp, Homo sapiens
agtctcactcactctgacgctca

SEQ ID NO: 134010 - DNA, 23 bp, Homo sapiens
atagaacattctggaaatgcagc

SEQ ID NO: 134011 - DNA, 22 bp, Homo sapiens
acagatctgtgcctccaggact

SEQ ID NO: 134012 - DNA, 21 bp, Homo sapiens
tgaggtaggaggatcacttga

SEQ ID NO: 134013 - DNA, 18 bp, Homo sapiens
ctgagtcttgctctgtca

SEQ ID NO: 134014 - DNA, 21 bp, Homo sapiens
atagtgctagagtattttagg

SEQ ID NO: 134015 - DNA, 22 bp, Homo sapiens
tttgagaccaagtctcactctg

SEQ ID NO: 134016 - DNA, 22 bp, Homo sapiens
tcagccatgtgttgtagtgccc

SEQ ID NO: 134017 - DNA, 21 bp, Homo sapiens
tcaggaggttgaggtaggagg

SEQ ID NO: 134018 - DNA, 23 bp, Homo sapiens
gagacagagtctcactctgtcaa

SEQ ID NO: 134019 - DNA, 21 bp, Homo sapiens
aagactgagcctcactctgtc

SEQ ID NO: 134020 - DNA, 23 bp, Homo sapiens
aacagagtgagattccatctcta

SEQ ID NO: 134021 - DNA, 23 bp, Homo sapiens
agggtctcactctgtcacctagg

SEQ ID NO: 134022 - DNA, 23 bp, Homo sapiens
acagagtctcactctgtcgccca

SEQ ID NO: 134023 - DNA, 23 bp, Homo sapiens
agacggagtctctctctgtcacc

SEQ ID NO: 134024 - DNA, 23 bp, Homo sapiens
tttggaggcagggtctccctctg

SEQ ID NO: 134025 - DNA, 23 bp, Homo sapiens
agagtctcactctgtcacccagg

SEQ ID NO: 134026 - DNA, 23 bp, Homo sapiens
gagtctcactctgtcacccaggc

SEQ ID NO: 134027 - DNA, 23 bp, Homo sapiens
tctgaggagagtcaggagagaca

SEQ ID NO: 134028 - DNA, 18 bp, Homo sapiens
gggctacatagtgagact

SEQ ID NO: 134029 - DNA, 23 bp, Homo sapiens
gagacagagtctcactctgtcgc

SEQ ID NO: 134030 - DNA, 23 bp, Homo sapiens
atgtgtgtatatatatgtgtgtg

SEQ ID NO: 134031 - DNA, 23 bp, Homo sapiens
aactagaactttgacctttgggt

SEQ ID NO: 134032 - DNA, 23 bp, Homo sapiens
ttaaggatcttttggtttgtttc

SEQ ID NO: 134033 - DNA, 23 bp, Homo sapiens
tgagacaaggtcttgctctgctg

SEQ ID NO: 134034 - DNA, 23 bp, Homo sapiens
ttatgatataattgtattgagag

SEQ ID NO: 134035 - DNA, 22 bp, Homo sapiens
ctgcgtgcctccctgccagtct

SEQ ID NO: 134036 - DNA, 23 bp, Homo sapiens
cagggtctcactctgtcacctag

SEQ ID NO: 134037 - DNA, 23 bp, Homo sapiens
tttgagacggagtctcactctgt

SEQ ID NO: 134038 - DNA, 23 bp, Homo sapiens
atcacaactcactgcagcctcag

SEQ ID NO: 134039 - DNA, 23 bp, Homo sapiens
ggaggcagaagttgcagtgaact

SEQ ID NO: 134040 - DNA, 20 bp, Homo sapiens
ctcactgcaaactctgactc

SEQ ID NO: 134041 - DNA, 19 bp, Homo sapiens
atgagagcactgttgtctg

SEQ ID NO: 134042 - DNA, 23 bp, Homo sapiens
aagatctcactctgtcacctagg

SEQ ID NO: 134043 - DNA, 23 bp, Homo sapiens
taaagtgctgacagtgcagatag

SEQ ID NO: 134044 - DNA, 22 bp, Homo sapiens
cgcactgtgggtacttgctgct

SEQ ID NO: 134045 - DNA, 23 bp, Homo sapiens
caaagtgctgttcgtgcaggtag

SEQ ID NO: 134046 - DNA, 22 bp, Homo sapiens
caacctactgctgagctagcac

SEQ ID NO: 134047 - DNA, 23 bp, Homo sapiens
cagtgttgagaggcggagacttg

SEQ ID NO: 134048 - DNA, 23 bp, Homo sapiens
tcagaggctctctctctggcatg

SEQ ID NO: 134049 - DNA, 21 bp, Homo sapiens
tgaggtagaaggatagattga

SEQ ID NO: 134050 - DNA, 19 bp, Homo sapiens
cagtgagctatgattgtgc

SEQ ID NO: 134051 - DNA, 19 bp, Homo sapiens
ttattcatttttcttttga

SEQ ID NO: 134052 - DNA, 21 bp, Homo sapiens
atttggatgatttctgtttct

SEQ ID NO: 134053 - DNA, 23 bp, Homo sapiens
tctcccactctgtttgaacttac

SEQ ID NO: 134054 - DNA, 23 bp, Homo sapiens
attttgctcttgttgctcaaggt

SEQ ID NO: 134055 - DNA, 21 bp, Homo sapiens
acactacagccgctgcagtga

SEQ ID NO: 134056 - DNA, 23 bp, Homo sapiens
cactggctctctgtgaggctgtg

SEQ ID NO: 134057 - DNA, 23 bp, Homo sapiens
tgagttcattgtagattctggat

SEQ ID NO: 134058 - DNA, 23 bp, Homo sapiens
tgagttcattgtagattctggat

SEQ ID NO: 134059 - DNA, 23 bp, Homo sapiens
gagtctcactctgtcacccaggc

SEQ ID NO: 134060 - DNA, 21 bp, Homo sapiens
tctgatgtttgtcctatcatg

SEQ ID NO: 134061 - DNA, 23 bp, Homo sapiens
acacatatgatattgatgaagta

SEQ ID NO: 134062 - DNA, 22 bp, Homo sapiens
tatcacagtgggtgtacatcct

SEQ ID NO: 134063 - DNA, 20 bp, Homo sapiens
tctgtgtgtgtgtatataca

SEQ ID NO: 134064 - DNA, 20 bp, Homo sapiens
tagagtcttgctctgttgcc

SEQ ID NO: 134065 - DNA, 23 bp, Homo sapiens
gtcccagagtcactccgtcagtg

SEQ ID NO: 134066 - DNA, 21 bp, Homo sapiens
tgacagagactccatctcaaa

SEQ ID NO: 134067 - DNA, 23 bp, Homo sapiens
atggagtctcactctgtcactca

SEQ ID NO: 134068 - DNA, 23 bp, Homo sapiens
gcttgatgctcctctgttgctgt

SEQ ID NO: 134069 - DNA, 23 bp, Homo sapiens
tgagacggagtctcactctgtcc

SEQ ID NO: 134070 - DNA, 23 bp, Homo sapiens
gtataactcagtgcttttctttt

SEQ ID NO: 134071 - DNA, 23 bp, Homo sapiens
ttagagactctctgtcacccagg

SEQ ID NO: 134072 - DNA, 23 bp, Homo sapiens
caacacagtgagacttaatcccc

SEQ ID NO: 134073 - DNA, 23 bp, Homo sapiens
agacagagtctcactctgtcacc

SEQ ID NO: 134074 - DNA, 23 bp, Homo sapiens
ggatgacagagtgagtctctgtc

SEQ ID NO: 134075 - DNA, 19 bp, Homo sapiens
ttgtcagaagactgagaag

SEQ ID NO: 134076 - DNA, 23 bp, Homo sapiens
tcactgagtgcttggaagtgtcg

SEQ ID NO: 134077 - DNA, 23 bp, Homo sapiens
cccacactgggtgtcacagtaga

SEQ ID NO: 134078 - DNA, 23 bp, Homo sapiens
taataatgatgatgatgatgatg

SEQ ID NO: 134079 - DNA, 23 bp, Homo sapiens
tatcagagtgcatctggttatag

SEQ ID NO: 134080 - DNA, 23 bp, Homo sapiens
ttgtaaacagggtcttgctgtct

SEQ ID NO: 134081 - DNA, 18 bp, Homo sapiens
gtcctctgcatttcatct

SEQ ID NO: 134082 - DNA, 20 bp, Homo sapiens
tagccaggcatggtagcatg

SEQ ID NO: 134083 - DNA, 23 bp, Homo sapiens
tctcactctgtcactcagactgg

SEQ ID NO: 134084 - DNA, 23 bp, Homo sapiens
agagacagggtctcactccgtca

SEQ ID NO: 134085 - DNA, 22 bp, Homo sapiens
tgagtctcactctgtcgcccag

SEQ ID NO: 134086 - DNA, 20 bp, Homo sapiens
agagtcagtggtgagatact

SEQ ID NO: 134087 - DNA, 23 bp, Homo sapiens
ttgagacagggtctcactgtgtc

SEQ ID NO: 134088 - DNA, 23 bp, Homo sapiens
tcttgctctgtcaccaggctaga

SEQ ID NO: 134089 - DNA, 22 bp, Homo sapiens
tgtatgtctgtgcatgtagaga

SEQ ID NO: 134090 - DNA, 23 bp, Homo sapiens
gtgcatgtctgttgttgtcccag

SEQ ID NO: 134091 - DNA, 23 bp, Homo sapiens
cagagtctccctctgtcacccag

SEQ ID NO: 134092 - DNA, 22 bp, Homo sapiens
tattttggtagaacatgattta

SEQ ID NO: 134093 - DNA, 23 bp, Homo sapiens
tgagatggagtctcactctgtca

SEQ ID NO: 134094 - DNA, 22 bp, Homo sapiens
tatgcttgtgtttagctatctt

SEQ ID NO: 134095 - DNA, 23 bp, Homo sapiens
taagcagcgttaagaagacttag

SEQ ID NO: 134096 - DNA, 23 bp, Homo sapiens
tttgttgaagaacagttggctgt

SEQ ID NO: 134097 - DNA, 23 bp, Homo sapiens
tgagttcattgtagattctggat

SEQ ID NO: 134098 - DNA, 23 bp, Homo sapiens
tgagttcattgtagattctggat

SEQ ID NO: 134099 - DNA, 22 bp, Homo sapiens
atatgcatatataaatgtatgt

SEQ ID NO: 134100 - DNA, 23 bp, Homo sapiens
tgagttcattgtagattctggat

SEQ ID NO: 134101 - DNA, 23 bp, Homo sapiens
tgagttcattgtagattctggat

SEQ ID NO: 134102 - DNA, 23 bp, Homo sapiens
tttttctgcttattattacattg

SEQ ID NO: 134103 - DNA, 19 bp, Homo sapiens
agttcaggaggtgattgga

SEQ ID NO: 134104 - DNA, 18 bp, Homo sapiens
agtggcatgatcttggct

SEQ ID NO: 134105 - DNA, 19 bp, Homo sapiens
aatattgaatttgttatag

SEQ ID NO: 134106 - DNA, 20 bp, Homo sapiens
catgctctttctctctctct

SEQ ID NO: 134107 - DNA, 22 bp, Homo sapiens
cagttgttactggagtgtttga

SEQ ID NO: 134108 - DNA, 23 bp, Homo sapiens
cggagtctcactctgtcacccag

SEQ ID NO: 134109 - DNA, 23 bp, Homo sapiens
gagtctcactctgtcacccaggc

SEQ ID NO: 134110 - DNA, 23 bp, Homo sapiens
gtgactgagcagacagagagttc

SEQ ID NO: 134111 - DNA, 19 bp, Homo sapiens
acccaggatgactgatgct

SEQ ID NO: 134112 - DNA, 23 bp, Homo sapiens
aagtcactctttactgtttctgt

SEQ ID NO: 134113 - DNA, 23 bp, Homo sapiens
tttctctgacaattagatgtgga

SEQ ID NO: 134114 - DNA, 23 bp, Homo sapiens
tgagctagagactcactctgtca

SEQ ID NO: 134115 - DNA, 21 bp, Homo sapiens
actgtctctgtgagggcatgg

SEQ ID NO: 134116 - DNA, 20 bp, Homo sapiens
ttgtctatatatatatatgt

SEQ ID NO: 134117 - DNA, 23 bp, Homo sapiens
tcagagaaaagagtggaggttct

SEQ ID NO: 134118 - DNA, 23 bp, Homo sapiens
aattacttagtttttgatcactt

SEQ ID NO: 134119 - DNA, 23 bp, Homo sapiens
gatacatgtggaggatgtgcagg

SEQ ID NO: 134120 - DNA, 22 bp, Homo sapiens
tgtatgtgtgcatgtgtatatg

SEQ ID NO: 134121 - DNA, 20 bp, Homo sapiens
catacacacatatgtataca

SEQ ID NO: 134122 - DNA, 23 bp, Homo sapiens
agtcaggaagcctaagtagttgg

SEQ ID NO: 134123 - DNA, 21 bp, Homo sapiens
tggaagtttctattattgata

SEQ ID NO: 134124 - DNA, 23 bp, Homo sapiens
tcaatgtcctataattttctttt

SEQ ID NO: 134125 - DNA, 22 bp, Homo sapiens
taatgcttttgtaatgtaaagt

SEQ ID NO: 134126 - DNA, 23 bp, Homo sapiens
tttgttcatgttgaagtagtgtg

SEQ ID NO: 134127 - DNA, 23 bp, Homo sapiens
tacatgtgcacaatgtgcaggtt

SEQ ID NO: 134128 - DNA, 21 bp, Homo sapiens
tgtcctagtaggttgtgttct

SEQ ID NO: 134129 - DNA, 19 bp, Homo sapiens
tgagcctcacccactgggt

SEQ ID NO: 134130 - DNA, 23 bp, Homo sapiens
agtagtgtatgtatgtgtgtgta

SEQ ID NO: 134131 - DNA, 19 bp, Homo sapiens
agaccatatatatatgtct

SEQ ID NO: 134132 - DNA, 22 bp, Homo sapiens
atatgtctatatatatatgtct

SEQ ID NO: 134133 - DNA, 22 bp, Homo sapiens
atatgtctatatatatatgtct

SEQ ID NO: 134134 - DNA, 23 bp, Homo sapiens
aaaaactgtggaattgttctggt

SEQ ID NO: 134135 - DNA, 23 bp, Homo sapiens
ttctcagagtgtatgtattcata

SEQ ID NO: 134136 - DNA, 22 bp, Homo sapiens
tatatatgttagcaaataaatg

SEQ ID NO: 134137 - DNA, 19 bp, Homo sapiens
actgtatatatatactgta

SEQ ID NO: 134138 - DNA, 23 bp, Homo sapiens
gaagacaggatgctgaatccatg

SEQ ID NO: 134139 - DNA, 23 bp, Homo sapiens
actcactgtgcaaagctgacagt

SEQ ID NO: 134140 - DNA, 21 bp, Homo sapiens
gctgtctgtctcagtggttgg

SEQ ID NO: 134141 - DNA, 22 bp, Homo sapiens
atgaaacagcatgaggaagtgt

SEQ ID NO: 134142 - DNA, 22 bp, Homo sapiens
aaatgtctgtggtagtagtgac

SEQ ID NO: 134143 - DNA, 18 bp, Homo sapiens
ttagagcctcgttttatt

SEQ ID NO: 134144 - DNA, 23 bp, Homo sapiens
cttatgaaaccattttaaaagga

SEQ ID NO: 134145 - DNA, 23 bp, Homo sapiens
tcaatagatgtaacttgtgctga

SEQ ID NO: 134146 - DNA, 20 bp, Homo sapiens
tgtgtgtgtgtgtgtgtgtg

SEQ ID NO: 134147 - DNA, 22 bp, Homo sapiens
agatgtctgggacattagctgg

SEQ ID NO: 134148 - DNA, 22 bp, Homo sapiens
tctgaagtatttcaaagattat

SEQ ID NO: 134149 - DNA, 23 bp, Homo sapiens
tgtatttgagacatgttgttgaa

SEQ ID NO: 134150 - DNA, 18 bp, Homo sapiens
gtgtgtgtgtgtgtgtgt

SEQ ID NO: 134151 - DNA, 23 bp, Homo sapiens
tgtgtgatgtatatcaggtgctg

SEQ ID NO: 134152 - DNA, 23 bp, Homo sapiens
taaagtataactgatcctcatta

SEQ ID NO: 134153 - DNA, 20 bp, Homo sapiens
tctcacagttctggaggctg

SEQ ID NO: 134154 - DNA, 23 bp, Homo sapiens
tgatgtaggactgctataactga

SEQ ID NO: 134155 - DNA, 20 bp, Homo sapiens
tcagataatagttagcattt

SEQ ID NO: 134156 - DNA, 23 bp, Homo sapiens
tatgctattacacttaacagaca

SEQ ID NO: 134157 - DNA, 21 bp, Homo sapiens
tgaggtaggaggatcacttga

SEQ ID NO: 134158 - DNA, 21 bp, Homo sapiens
actgcactcctgcctgggtga

SEQ ID NO: 134159 - DNA, 22 bp, Homo sapiens
ggtctcactctgtcacccaggc

SEQ ID NO: 134160 - DNA, 23 bp, Homo sapiens
cagagtctcactctgtcgctcag

SEQ ID NO: 134161 - DNA, 18 bp, Homo sapiens
acagtggtgcgatctcag

SEQ ID NO: 134162 - DNA, 18 bp, Homo sapiens
aatttgcatggtttcgaa

SEQ ID NO: 134163 - DNA, 20 bp, Homo sapiens
tgaggttggaggatcacttg

SEQ ID NO: 134164 - DNA, 22 bp, Homo sapiens
taaacatgtaagatgataggta

SEQ ID NO: 134165 - DNA, 22 bp, Homo sapiens
tcattatagtaaccatttgcta

SEQ ID NO: 134166 - DNA, 21 bp, Homo sapiens
acaagagctagttgtttaaaa

SEQ ID NO: 134167 - DNA, 23 bp, Homo sapiens
gagattactctggataacgtggg

SEQ ID NO: 134168 - DNA, 23 bp, Homo sapiens
agaggtgacagtgtgctggcagt

SEQ ID NO: 134169 - DNA, 23 bp, Homo sapiens
atgtcagaaatgtgtttggagag

SEQ ID NO: 134170 - DNA, 19 bp, Homo sapiens
tctgggagcatgtcatggg

SEQ ID NO: 134171 - DNA, 23 bp, Homo sapiens
cagctgtctctgaactgaggagg

SEQ ID NO: 134172 - DNA, 22 bp, Homo sapiens
cacgctcactcactgcctccct

SEQ ID NO: 134173 - DNA, 23 bp, Homo sapiens
cagaatcagaaactgcatctcct

SEQ ID NO: 134174 - DNA, 23 bp, Homo sapiens
agcaatctctttgttatgctatg

SEQ ID NO: 134175 - DNA, 23 bp, Homo sapiens
gagtctctgactctgtaagaaga

SEQ ID NO: 134176 - DNA, 21 bp, Homo sapiens
tatatgtatatatatacgcgt

SEQ ID NO: 134177 - DNA, 21 bp, Homo sapiens
agagttagtgatattgtgaga

SEQ ID NO: 134178 - DNA, 23 bp, Homo sapiens
gggtctcactctgtcacccaggc

SEQ ID NO: 134179 - DNA, 19 bp, Homo sapiens
tatatagagtatatgtata

SEQ ID NO: 134180 - DNA, 23 bp, Homo sapiens
tgagttcattgtagattctggat

SEQ ID NO: 134181 - DNA, 23 bp, Homo sapiens
tgagttcattgtagattctggat

SEQ ID NO: 134182 - DNA, 23 bp, Homo sapiens
ggagtctcactctgtcactcagg

SEQ ID NO: 134183 - DNA, 19 bp, Homo sapiens
cagatgaactccatgggat

SEQ ID NO: 134184 - DNA, 23 bp, Homo sapiens
ttttgagtggtagatatttgaat

SEQ ID NO: 134185 - DNA, 22 bp, Homo sapiens
tgaggtacaaggatattaagtt

SEQ ID NO: 134186 - DNA, 23 bp, Homo sapiens
tatagaattagttctggtcccag

SEQ ID NO: 134187 - DNA, 23 bp, Homo sapiens
tgagttcattgtagattctggat

SEQ ID NO: 134188 - DNA, 23 bp, Homo sapiens
atgtgtgtgtatatatacacgta

SEQ ID NO: 134189 - DNA, 18 bp, Homo sapiens
tgtatatatgtatatatg

SEQ ID NO: 134190 - DNA, 23 bp, Homo sapiens
actttactgaatttgtttatcag

SEQ ID NO: 134191 - DNA, 19 bp, Homo sapiens
ttgagttttctaggtatac

SEQ ID NO: 134192 - DNA, 20 bp, Homo sapiens
tgtgtgactgctttattttt

SEQ ID NO: 134193 - DNA, 23 bp, Homo sapiens
tgtgtgcctgtgcacgtgcatgt

SEQ ID NO: 134194 - DNA, 21 bp, Homo sapiens
tatatgtatatgtatgtgtgt

SEQ ID NO: 134195 - DNA, 23 bp, Homo sapiens
agtggttctagacagtctagaga

SEQ ID NO: 134196 - DNA, 21 bp, Homo sapiens
tctcactctgtcacccaggct

SEQ ID NO: 134197 - DNA, 23 bp, Homo sapiens
tatgtatgtattctagcagaggg

SEQ ID NO: 134198 - DNA, 18 bp, Homo sapiens
aaatctcaggtatatata

SEQ ID NO: 134199 - DNA, 21 bp, Homo sapiens
tatatatatatcaggtgtgtg

SEQ ID NO: 134200 - DNA, 23 bp, Homo sapiens
tatgtgtgcatgtatatgtgtgt

SEQ ID NO: 134201 - DNA, 22 bp, Homo sapiens
tatcaaaaatttgttagcagtt

SEQ ID NO: 134202 - DNA, 20 bp, Homo sapiens
tatgtgtgtgtgtatatgtg

SEQ ID NO: 134203 - DNA, 23 bp, Homo sapiens
tttggctgtctttgttataacag

SEQ ID NO: 134204 - DNA, 23 bp, Homo sapiens
atttttagatctgctgccctttc

SEQ ID NO: 134205 - DNA, 21 bp, Homo sapiens
ttatagcatgaaatcacttga

SEQ ID NO: 134206 - DNA, 18 bp, Homo sapiens
gtctctctctgtcgccca

SEQ ID NO: 134207 - DNA, 19 bp, Homo sapiens
tttgagatggagtcttgct

SEQ ID NO: 134208 - DNA, 23 bp, Homo sapiens
ctctgggtgagtcagtgagtgag

SEQ ID NO: 134209 - DNA, 23 bp, Homo sapiens
agatggagtctcactctgtcacc

SEQ ID NO: 134210 - DNA, 23 bp, Homo sapiens
gtctgggtgactcagtcattccc

SEQ ID NO: 134211 - DNA, 23 bp, Homo sapiens
acagagtctcactctgtcgccca

SEQ ID NO: 134212 - DNA, 23 bp, Homo sapiens
tggagtctcactctgtcacccag

SEQ ID NO: 134213 - DNA, 18 bp, Homo sapiens
ttagcattaccaggatta

SEQ ID NO: 134214 - DNA, 23 bp, Homo sapiens
tctcacagccagcaatgaggctg

SEQ ID NO: 134215 - DNA, 23 bp, Homo sapiens
tgtgtgcatgagagcaggactgt

SEQ ID NO: 134216 - DNA, 23 bp, Homo sapiens
tacatcactgtggctttaatatg

SEQ ID NO: 134217 - DNA, 23 bp, Homo sapiens
accatgttggccaggctggtatc

SEQ ID NO: 134218 - DNA, 20 bp, Homo sapiens
tagagtttggcctttctttt

SEQ ID NO: 134219 - DNA, 23 bp, Homo sapiens
agacagagtctcgctctgtcacc

SEQ ID NO: 134220 - DNA, 23 bp, Homo sapiens
gacagagtctcgctctgtcaccc

SEQ ID NO: 134221 - DNA, 23 bp, Homo sapiens
tgagttcattgtagattctggat

SEQ ID NO: 134222 - DNA, 23 bp, Homo sapiens
tgagttcattgtagattctggat

SEQ ID NO: 134223 - DNA, 23 bp, Homo sapiens
aacaagtgtgaataagttttata

SEQ ID NO: 134224 - DNA, 18 bp, Homo sapiens
aaatcaagagggacctgt

SEQ ID NO: 134225 - DNA, 23 bp, Homo sapiens
aaagctaagaattgagacagact

SEQ ID NO: 134226 - DNA, 22 bp, Homo sapiens
tgtgagccactgcacctggtcg

SEQ ID NO: 134227 - DNA, 18 bp, Homo sapiens
ttatctaatccaggacag

SEQ ID NO: 134228 - DNA, 23 bp, Homo sapiens
agtgctttgaggatgttttgttt

SEQ ID NO: 134229 - DNA, 23 bp, Homo sapiens
taacagttatgagtgtggtggta

SEQ ID NO: 134230 - DNA, 23 bp, Homo sapiens
agtttggctggatatgaaattct

SEQ ID NO: 134231 - DNA, 23 bp, Homo sapiens
tatatgagagatattctttccat

SEQ ID NO: 134232 - DNA, 21 bp, Homo sapiens
taagaccctgagatagaacac

SEQ ID NO: 134233 - DNA, 23 bp, Homo sapiens
tgagttcattgtagattctggat

SEQ ID NO: 134234 - DNA, 23 bp, Homo sapiens
tgagttcattgtagattctggat

SEQ ID NO: 134235 - DNA, 23 bp, Homo sapiens
ctgtgagatatgtatgtgtgtgt

SEQ ID NO: 134236 - DNA, 23 bp, Homo sapiens
ctcactctgtcacccagactgta

SEQ ID NO: 134237 - DNA, 18 bp, Homo sapiens
tgatatcttggctcactg

SEQ ID NO: 134238 - DNA, 23 bp, Homo sapiens
aatgttctgtcaatccagatgct

SEQ ID NO: 134239 - DNA, 23 bp, Homo sapiens
aagatcagtgaatttcatgagca

SEQ ID NO: 134240 - DNA, 23 bp, Homo sapiens
tgagttcattgtagattctggat

SEQ ID NO: 134241 - DNA, 23 bp, Homo sapiens
tgagttcattgtagattctggat

SEQ ID NO: 134242 - DNA, 20 bp, Homo sapiens
ttgggttttttttggttttt

SEQ ID NO: 134243 - DNA, 18 bp, Homo sapiens
tgttgtttttgctttaaa

SEQ ID NO: 134244 - DNA, 23 bp, Homo sapiens
tcattcaagttgttgctgtatca

SEQ ID NO: 134245 - DNA, 20 bp, Homo sapiens
tttaattgacataaagttgt

SEQ ID NO: 134246 - DNA, 22 bp, Homo sapiens
taaatatcacaaggcaattcat

SEQ ID NO: 134247 - DNA, 22 bp, Homo sapiens
tatatctatctatatatgtgtg

SEQ ID NO: 134248 - DNA, 23 bp, Homo sapiens
tctatatgtaaaaattccattgt

SEQ ID NO: 134249 - DNA, 22 bp, Homo sapiens
aattcccatattgttaaagtgt

SEQ ID NO: 134250 - DNA, 22 bp, Homo sapiens
tatgagttctgtttttgtggat

SEQ ID NO: 134251 - DNA, 23 bp, Homo sapiens
tcaccaagggagagtactaaagt

SEQ ID NO: 134252 - DNA, 23 bp, Homo sapiens
tatacgtatatatacgtatatgt

SEQ ID NO: 134253 - DNA, 21 bp, Homo sapiens
gtgtatatatgtatatatgag

SEQ ID NO: 134254 - DNA, 20 bp, Homo sapiens
tacaatttatataggtatgt

SEQ ID NO: 134255 - DNA, 23 bp, Homo sapiens
tctctctatctctcagtgccttt

SEQ ID NO: 134256 - DNA, 20 bp, Homo sapiens
tgtgcattatatttctatta

SEQ ID NO: 134257 - DNA, 22 bp, Homo sapiens
gccttgtctcagtgtctcacgt

SEQ ID NO: 134258 - DNA, 22 bp, Homo sapiens
tgcgtgtgtgtgtgtgtatata

SEQ ID NO: 134259 - DNA, 22 bp, Homo sapiens
tatgtgtgtatacatgtacaca

SEQ ID NO: 134260 - DNA, 18 bp, Homo sapiens
aatgcatatacatgatgt

SEQ ID NO: 134261 - DNA, 23 bp, Homo sapiens
agtacagtggtatgattagtggc

SEQ ID NO: 134262 - DNA, 23 bp, Homo sapiens
ttgaaaggctgtgattttcttga

SEQ ID NO: 134263 - DNA, 21 bp, Homo sapiens
tcaaatgcagtgtgtgatgac

SEQ ID NO: 134264 - DNA, 23 bp, Homo sapiens
aaagtccagtgcctggaattgaa

SEQ ID NO: 134265 - DNA, 23 bp, Homo sapiens
tagcctatatatgtgtttttgtg

SEQ ID NO: 134266 - DNA, 23 bp, Homo sapiens
tggagtctcactctgtcacccag

SEQ ID NO: 134267 - DNA, 21 bp, Homo sapiens
tttggtggtatggaaaagaaa

SEQ ID NO: 134268 - DNA, 23 bp, Homo sapiens
tgtaaagatgttttagtgaggaa

SEQ ID NO: 134269 - DNA, 22 bp, Homo sapiens
tatgtgtgtgtatatatataca

SEQ ID NO: 134270 - DNA, 22 bp, Homo sapiens
atagacacacacgtatatatgt

SEQ ID NO: 134271 - DNA, 23 bp, Homo sapiens
tgtagctccagaacttcttggag

SEQ ID NO: 134272 - DNA, 23 bp, Homo sapiens
acactcactgagtggctgcattg

SEQ ID NO: 134273 - DNA, 23 bp, Homo sapiens
tttagctttatttaaaaatgttt

SEQ ID NO: 134274 - DNA, 23 bp, Homo sapiens
tatgcatatgtaacatatatatg

SEQ ID NO: 134275 - DNA, 20 bp, Homo sapiens
atatgtatgtaatatgtgct

SEQ ID NO: 134276 - DNA, 23 bp, Homo sapiens
atgtacacacacataaatgtgtc

SEQ ID NO: 134277 - DNA, 22 bp, Homo sapiens
tacatacactttgtcatagggt

SEQ ID NO: 134278 - DNA, 23 bp, Homo sapiens
gtgctatgtggaataggagtggt

SEQ ID NO: 134279 - DNA, 23 bp, Homo sapiens
ttgtgtccatttagtatgatgtt

SEQ ID NO: 134280 - DNA, 21 bp, Homo sapiens
ttttatggacatatgtttgat

SEQ ID NO: 134281 - DNA, 19 bp, Homo sapiens
atgtgcatatatatattat

SEQ ID NO: 134282 - DNA, 23 bp, Homo sapiens
atatatacgtatgtgtgtgtgcg

SEQ ID NO: 134283 - DNA, 23 bp, Homo sapiens
tgtatatgtgtatgtgtacatat

SEQ ID NO: 134284 - DNA, 23 bp, Homo sapiens
atgtgtgtatatatgtttatgtg

SEQ ID NO: 134285 - DNA, 19 bp, Homo sapiens
ctatccatacatatgtgta

SEQ ID NO: 134286 - DNA, 20 bp, Homo sapiens
tggtgcctttctagatggag

SEQ ID NO: 134287 - DNA, 19 bp, Homo sapiens
tgaccctcagtgcctcaga

SEQ ID NO: 134288 - DNA, 22 bp, Homo sapiens
tttagaaccttacacattggtt

SEQ ID NO: 134289 - DNA, 21 bp, Homo sapiens
agtggaaaatatatctatatc

SEQ ID NO: 134290 - DNA, 23 bp, Homo sapiens
atgcttacaactgaatatgttga

SEQ ID NO: 134291 - DNA, 23 bp, Homo sapiens
tttatgtagggaatgcaatataa

SEQ ID NO: 134292 - DNA, 23 bp, Homo sapiens
tgtagctccattagaaaaggctg

SEQ ID NO: 134293 - DNA, 22 bp, Homo sapiens
taggcatttctatcaagagtga

SEQ ID NO: 134294 - DNA, 19 bp, Homo sapiens
acgtatatatgtatgtgtg

SEQ ID NO: 134295 - DNA, 23 bp, Homo sapiens
agagagagacgcctactgctgag

SEQ ID NO: 134296 - DNA, 23 bp, Homo sapiens
tgagttcattgtagattctggat

SEQ ID NO: 134297 - DNA, 23 bp, Homo sapiens
tgagttcattgtagattctggat

SEQ ID NO: 134298 - DNA, 23 bp, Homo sapiens
ctctctcagtgtggctgggtctg

SEQ ID NO: 134299 - DNA, 18 bp, Homo sapiens
atactcacatatacatat

SEQ ID NO: 134300 - DNA, 23 bp, Homo sapiens
tcactcagtgtgtgtacttgcac

SEQ ID NO: 134301 - DNA, 23 bp, Homo sapiens
acaggcacatacacacactggaa

SEQ ID NO: 134302 - DNA, 23 bp, Homo sapiens
tatgatgcatgagtatacatttt

SEQ ID NO: 134303 - DNA, 20 bp, Homo sapiens
tatgcaaatatatggaaaca

SEQ ID NO: 134304 - DNA, 23 bp, Homo sapiens
tatatagtttacatatgtttgta

SEQ ID NO: 134305 - DNA, 18 bp, Homo sapiens
tgtgtgtatgtatgtatg

SEQ ID NO: 134306 - DNA, 18 bp, Homo sapiens
atgaatatatatacgtgt

SEQ ID NO: 134307 - DNA, 23 bp, Homo sapiens
atttcagtggtagttctgtttct

SEQ ID NO: 134308 - DNA, 20 bp, Homo sapiens
ctaagtctagtttttatgtt

SEQ ID NO: 134309 - DNA, 19 bp, Homo sapiens
aactgaaagccactgaaga

SEQ ID NO: 134310 - DNA, 23 bp, Homo sapiens
tgagaccatggagaatctgatga

SEQ ID NO: 134311 - DNA, 23 bp, Homo sapiens
tcactaatagtatatatgtatag

SEQ ID NO: 134312 - DNA, 22 bp, Homo sapiens
aaatgaggttttacgaagttgt

SEQ ID NO: 134313 - DNA, 23 bp, Homo sapiens
tttatttgtgatattgttgcctt

SEQ ID NO: 134314 - DNA, 21 bp, Homo sapiens
tacacacacagatatatatat

SEQ ID NO: 134315 - DNA, 23 bp, Homo sapiens
tgtgtatatatatctatatgtgt

SEQ ID NO: 134316 - DNA, 23 bp, Homo sapiens
agactgagtctcgctctgtcacc

SEQ ID NO: 134317 - DNA, 22 bp, Homo sapiens
gtatctgttttctatgcagtaa

SEQ ID NO: 134318 - DNA, 22 bp, Homo sapiens
tctcaggtagttctttacagca

SEQ ID NO: 134319 - DNA, 22 bp, Homo sapiens
aagtgtatatatatatatgtgt

SEQ ID NO: 134320 - DNA, 23 bp, Homo sapiens
gaatctctctctgtcactcaggc

SEQ ID NO: 134321 - DNA, 23 bp, Homo sapiens
gttaccctgtcacgctgacatga

SEQ ID NO: 134322 - DNA, 23 bp, Homo sapiens
aatagttttgtctagctctagtt

SEQ ID NO: 134323 - DNA, 21 bp, Homo sapiens
ttagagggagaagaattgagt

SEQ ID NO: 134324 - DNA, 20 bp, Homo sapiens
tcagctgagcatattctcat

SEQ ID NO: 134325 - DNA, 20 bp, Homo sapiens
acaggagagtgtggacactg

SEQ ID NO: 134326 - DNA, 19 bp, Homo sapiens
acagcttatcatatatatc

SEQ ID NO: 134327 - DNA, 22 bp, Homo sapiens
atatatgtatatatgtatgtat

SEQ ID NO: 134328 - DNA, 21 bp, Homo sapiens
tttagcattatattccagagt

SEQ ID NO: 134329 - DNA, 23 bp, Homo sapiens
aaattttttttatttgatgctga

SEQ ID NO: 134330 - DNA, 22 bp, Homo sapiens
atttgtgtgtgcatatgtatgt

SEQ ID NO: 134331 - DNA, 20 bp, Homo sapiens
atcacagttaagcaagttgg

SEQ ID NO: 134332 - DNA, 23 bp, Homo sapiens
tatactcattttgttcataagga

SEQ ID NO: 134333 - DNA, 23 bp, Homo sapiens
ctaaatgtcagcaaatgatgtcc

SEQ ID NO: 134334 - DNA, 23 bp, Homo sapiens
tttgagatgggatctcactgtca

SEQ ID NO: 134335 - DNA, 23 bp, Homo sapiens
atgatatgaaatgtatctttatg

SEQ ID NO: 134336 - DNA, 19 bp, Homo sapiens
ttccaggcagtaatatggc

SEQ ID NO: 134337 - DNA, 23 bp, Homo sapiens
gggactcactctgtcactcaggc

SEQ ID NO: 134338 - DNA, 23 bp, Homo sapiens
gcctgggtgacagagtgagttcc

SEQ ID NO: 134339 - DNA, 19 bp, Homo sapiens
tgtgtgtgtgtgtgtgtgt

SEQ ID NO: 134340 - DNA, 23 bp, Homo sapiens
tcctatattttccaaatgctctg

SEQ ID NO: 134341 - DNA, 23 bp, Homo sapiens
aatagtacttaagctactcaaga

SEQ ID NO: 134342 - DNA, 23 bp, Homo sapiens
acttaagtgaatttctagtactg

SEQ ID NO: 134343 - DNA, 23 bp, Homo sapiens
attagattaagtgttgtttgggg

SEQ ID NO: 134344 - DNA, 23 bp, Homo sapiens
ggaaatgcatcaaattcagcaaa

SEQ ID NO: 134345 - DNA, 19 bp, Homo sapiens
tgtaaataggaaacatttg

SEQ ID NO: 134346 - DNA, 20 bp, Homo sapiens
tacttttctgtttttcttca

SEQ ID NO: 134347 - DNA, 23 bp, Homo sapiens
tatttttagtagagacagggtct

SEQ ID NO: 134348 - DNA, 20 bp, Homo sapiens
cacaaaaatatatgtgtata

SEQ ID NO: 134349 - DNA, 23 bp, Homo sapiens
gtgtgtgtatatatatatgtgtg

SEQ ID NO: 134350 - DNA, 22 bp, Homo sapiens
tagaagaggtagaacatacttt

SEQ ID NO: 134351 - DNA, 23 bp, Homo sapiens
tctaatgtgtgtttctttttttc

SEQ ID NO: 134352 - DNA, 22 bp, Homo sapiens
aaagtcctttgtcagatatgtg

SEQ ID NO: 134353 - DNA, 23 bp, Homo sapiens
tgtgtatatatatagcctatata

SEQ ID NO: 134354 - DNA, 18 bp, Homo sapiens
tgtgtgtatatatatatc

SEQ ID NO: 134355 - DNA, 19 bp, Homo sapiens
atgtatgtgtctatgtatg

SEQ ID NO: 134356 - DNA, 23 bp, Homo sapiens
ataagtacatatttgtatgtaca

SEQ ID NO: 134357 - DNA, 22 bp, Homo sapiens
aagagaactgaattccatgact

SEQ ID NO: 134358 - DNA, 23 bp, Homo sapiens
gtctgagtatcactgagtctgac

SEQ ID NO: 134359 - DNA, 21 bp, Homo sapiens
tcagagtgtccagacaggctg

SEQ ID NO: 134360 - DNA, 20 bp, Homo sapiens
aggtagcagtttgaaatgaa

SEQ ID NO: 134361 - DNA, 23 bp, Homo sapiens
cagagctacatgtgtgtatgtgt

SEQ ID NO: 134362 - DNA, 23 bp, Homo sapiens
tttctttttgatgtccagtttcc

SEQ ID NO: 134363 - DNA, 18 bp, Homo sapiens
atggaggatttttgttgg

SEQ ID NO: 134364 - DNA, 23 bp, Homo sapiens
actttagtgtacttatctgtatg

SEQ ID NO: 134365 - DNA, 23 bp, Homo sapiens
tgtgccacaatgactggctgttt

SEQ ID NO: 134366 - DNA, 22 bp, Homo sapiens
agacaggatgggtttggcctgt

SEQ ID NO: 134367 - DNA, 21 bp, Homo sapiens
tctgtctctctgccactcaat

SEQ ID NO: 134368 - DNA, 21 bp, Homo sapiens
atctgggcaatatagtgagac

SEQ ID NO: 134369 - DNA, 23 bp, Homo sapiens
tttggagtctcactctgtcgccc

SEQ ID NO: 134370 - DNA, 22 bp, Homo sapiens
gtctcactctgtcactcaggct

SEQ ID NO: 134371 - DNA, 23 bp, Homo sapiens
tgagacagtgtctggctctgtca

SEQ ID NO: 134372 - DNA, 23 bp, Homo sapiens
atgtgtgtatatgtatgtgtgtg

SEQ ID NO: 134373 - DNA, 23 bp, Homo sapiens
tgagttcattgtagattctggat

SEQ ID NO: 134374 - DNA, 23 bp, Homo sapiens
tgagttcattgtagattctggat

SEQ ID NO: 134375 - DNA, 22 bp, Homo sapiens
tctgtgtgtctcagttttttgg

SEQ ID NO: 134376 - DNA, 23 bp, Homo sapiens
tgtgtgacacaattctgtttttt

SEQ ID NO: 134377 - DNA, 23 bp, Homo sapiens
atagatgcttaacccaatgcttg

SEQ ID NO: 134378 - DNA, 23 bp, Homo sapiens
gacagagtctcgctctgtcaccc

SEQ ID NO: 134379 - DNA, 20 bp, Homo sapiens
tgtatatgtgcatttatgtg

SEQ ID NO: 134380 - DNA, 18 bp, Homo sapiens
gtctgaagaccatagctt

SEQ ID NO: 134381 - DNA, 23 bp, Homo sapiens
gggtctcactctgtcacccaggc

SEQ ID NO: 134382 - DNA, 23 bp, Homo sapiens
agtgtctgccagcttttatgtgt

SEQ ID NO: 134383 - DNA, 19 bp, Homo sapiens
aaaattctaggtttgcagt

SEQ ID NO: 134384 - DNA, 22 bp, Homo sapiens
tatgtgtatatatatgtatgtg

SEQ ID NO: 134385 - DNA, 23 bp, Homo sapiens
atgtgtgtatatatatgtatgtg

SEQ ID NO: 134386 - DNA, 19 bp, Homo sapiens
gagtctggctctgtcaccc

SEQ ID NO: 134387 - DNA, 23 bp, Homo sapiens
tcacacagcctctctgtgtctct

SEQ ID NO: 134388 - DNA, 23 bp, Homo sapiens
ggactacagatgtgtgccaccac

SEQ ID NO: 134389 - DNA, 23 bp, Homo sapiens
attttttgtagagacaggtgtcg

SEQ ID NO: 134390 - DNA, 23 bp, Homo sapiens
cggagtctcactctgtcacccag

SEQ ID NO: 134391 - DNA, 22 bp, Homo sapiens
aaggagtctcactctgtcaccc

SEQ ID NO: 134392 - DNA, 23 bp, Homo sapiens
gtagagacaggtgtttcaccatg

SEQ ID NO: 134393 - DNA, 18 bp, Homo sapiens
gtatatatgtatatatgt

SEQ ID NO: 134394 - DNA, 20 bp, Homo sapiens
tttgagacggagtctcgctc

SEQ ID NO: 134395 - DNA, 23 bp, Homo sapiens
gtgtccctgcctgtctgtctgtc

SEQ ID NO: 134396 - DNA, 20 bp, Homo sapiens
gggtgggagggtggggctgt

SEQ ID NO: 134397 - DNA, 23 bp, Homo sapiens
gagagagtctctctctgtccccc

SEQ ID NO: 134398 - DNA, 23 bp, Homo sapiens
ccgactctcgctctgtcacccag

SEQ ID NO: 134399 - DNA, 20 bp, Homo sapiens
tgagcaagtcatttaactct

SEQ ID NO: 134400 - DNA, 23 bp, Homo sapiens
cggagtctcactctgtcacccag

SEQ ID NO: 134401 - DNA, 23 bp, Homo sapiens
gagtctcactctgtcacccaggc

SEQ ID NO: 134402 - DNA, 23 bp, Homo sapiens
ttttgagacggagtcttgctctg

SEQ ID NO: 134403 - DNA, 23 bp, Homo sapiens
agaggtagagtctgactctgtcg

SEQ ID NO: 134404 - DNA, 23 bp, Homo sapiens
tttgagacggagtctcactctgt

SEQ ID NO: 134405 - DNA, 22 bp, Homo sapiens
tatgtatgtatacgtatacata

SEQ ID NO: 134406 - DNA, 23 bp, Homo sapiens
tgtatatatgtatgtatacgtat

SEQ ID NO: 134407 - DNA, 20 bp, Homo sapiens
tatagtatgtgtatgtatac

SEQ ID NO: 134408 - DNA, 18 bp, Homo sapiens
gtgtatatatatacacat

SEQ ID NO: 134409 - DNA, 23 bp, Homo sapiens
tctctctatctcagtgtccacat

SEQ ID NO: 134410 - DNA, 23 bp, Homo sapiens
actctcagaggcttattcatctc

SEQ ID NO: 134411 - DNA, 23 bp, Homo sapiens
gtgtgtgtgtatatatgtatgtg

SEQ ID NO: 134412 - DNA, 23 bp, Homo sapiens
gggtctcactctgtcacccaggc

SEQ ID NO: 134413 - DNA, 18 bp, Homo sapiens
gccactgtgcctgggcca

SEQ ID NO: 134414 - DNA, 23 bp, Homo sapiens
tgtgtacagccacagcttctagt

SEQ ID NO: 134415 - DNA, 23 bp, Homo sapiens
gagtgtgagaagagagacaggag

SEQ ID NO: 134416 - DNA, 23 bp, Homo sapiens
gaaatctcaggttgtgctcctgg

SEQ ID NO: 134417 - DNA, 23 bp, Homo sapiens
acagagtgaaactctgtctcaaa

SEQ ID NO: 134418 - DNA, 19 bp, Homo sapiens
tgagatggagtctggctct

SEQ ID NO: 134419 - DNA, 22 bp, Homo sapiens
ggagtctcactcactctgtctc

SEQ ID NO: 134420 - DNA, 23 bp, Homo sapiens
tctgggactcagtttcttctttc

SEQ ID NO: 134421 - DNA, 23 bp, Homo sapiens
agatagagtctcgctgttgtcca

SEQ ID NO: 134422 - DNA, 22 bp, Homo sapiens
tttttttcttgagatggcgtct

SEQ ID NO: 134423 - DNA, 21 bp, Homo sapiens
ttgtgttttgttttgaggcag

SEQ ID NO: 134424 - DNA, 19 bp, Homo sapiens
attgtattattattggggt

SEQ ID NO: 134425 - DNA, 23 bp, Homo sapiens
tttgtctccctgtctctgtcaaa

SEQ ID NO: 134426 - DNA, 23 bp, Homo sapiens
acagagtctcactctgtcgccca

SEQ ID NO: 134427 - DNA, 22 bp, Homo sapiens
cagagtctcactctgtcgccca

SEQ ID NO: 134428 - DNA, 23 bp, Homo sapiens
atatatgtatatgtgtttatgta

SEQ ID NO: 134429 - DNA, 23 bp, Homo sapiens
taagtgactcactgtctgggagg

SEQ ID NO: 134430 - DNA, 20 bp, Homo sapiens
gcatatatttgcatttctct

SEQ ID NO: 134431 - DNA, 23 bp, Homo sapiens
gtgtgtctgtgtgtcagagcatg

SEQ ID NO: 134432 - DNA, 23 bp, Homo sapiens
actctgtctgtgaaggtgacaga

SEQ ID NO: 134433 - DNA, 19 bp, Homo sapiens
tatagtcttgtttgtgatg

SEQ ID NO: 134434 - DNA, 22 bp, Homo sapiens
tatgtgtgtatgtatctgtgtg

SEQ ID NO: 134435 - DNA, 19 bp, Homo sapiens
tgagacaaagtctcactct

SEQ ID NO: 134436 - DNA, 23 bp, Homo sapiens
gtctcagtgctagatgtgtgagc

SEQ ID NO: 134437 - DNA, 23 bp, Homo sapiens
tttgagacggagtctcgctctgt

SEQ ID NO: 134438 - DNA, 23 bp, Homo sapiens
agagtctcactctgtcacccagg

SEQ ID NO: 134439 - DNA, 23 bp, Homo sapiens
gagtctcactctgtcacccaggc

SEQ ID NO: 134440 - DNA, 23 bp, Homo sapiens
tgagacagagtctggctgtgtca

SEQ ID NO: 134441 - DNA, 21 bp, Homo sapiens
agagcaagactctattttttt

SEQ ID NO: 134442 - DNA, 23 bp, Homo sapiens
tctcactctgtcacccattctgg

SEQ ID NO: 134443 - DNA, 21 bp, Homo sapiens
agaggtaggtggatcacttga

SEQ ID NO: 134444 - DNA, 21 bp, Homo sapiens
ttgagacagggtctcactcgg

SEQ ID NO: 134445 - DNA, 19 bp, Homo sapiens
tgagatggagtctcattct

SEQ ID NO: 134446 - DNA, 23 bp, Homo sapiens
actccatccagattttgttgttc

SEQ ID NO: 134447 - DNA, 22 bp, Homo sapiens
atagatatcgatatctatagat

SEQ ID NO: 134448 - DNA, 23 bp, Homo sapiens
tatatagatatgtatacatatag

SEQ ID NO: 134449 - DNA, 23 bp, Homo sapiens
tatagatatagatatgtatacat

SEQ ID NO: 134450 - DNA, 23 bp, Homo sapiens
ttgagacagagtctcgctctgtc

SEQ ID NO: 134451 - DNA, 23 bp, Homo sapiens
caaggtctcactctgtcacccag

SEQ ID NO: 134452 - DNA, 23 bp, Homo sapiens
cagcctctgtctcagccacactg

SEQ ID NO: 134453 - DNA, 20 bp, Homo sapiens
tggagcaagactctctctct

SEQ ID NO: 134454 - DNA, 21 bp, Homo sapiens
tctgctcattctgtctctgta

SEQ ID NO: 134455 - DNA, 22 bp, Homo sapiens
gatggagtctcactctgtcacc

SEQ ID NO: 134456 - DNA, 22 bp, Homo sapiens
tgaggcagagtcttactctgtc

SEQ ID NO: 134457 - DNA, 22 bp, Homo sapiens
agagacagggtcttactctgac

SEQ ID NO: 134458 - DNA, 23 bp, Homo sapiens
agatggagtctcactctgtcacc

SEQ ID NO: 134459 - DNA, 20 bp, Homo sapiens
ttttgagacaggatctcact

SEQ ID NO: 134460 - DNA, 23 bp, Homo sapiens
tcagaagcttttttttagattgt

SEQ ID NO: 134461 - DNA, 19 bp, Homo sapiens
tagtggatcccttagctgg

SEQ ID NO: 134462 - DNA, 23 bp, Homo sapiens
aatctctttttgtaatagtggtt

SEQ ID NO: 134463 - DNA, 19 bp, Homo sapiens
gaaaagactgatatattgt

SEQ ID NO: 134464 - DNA, 23 bp, Homo sapiens
ttgagacggagttttgctcttgt

SEQ ID NO: 134465 - DNA, 23 bp, Homo sapiens
gggtctcactctgtcacccaggc

SEQ ID NO: 134466 - DNA, 19 bp, Homo sapiens
agtgcagtggcatgaccct

SEQ ID NO: 134467 - DNA, 19 bp, Homo sapiens
attgtattattattggggt

SEQ ID NO: 134468 - DNA, 23 bp, Homo sapiens
gtctccctgtctctgtcaaaagt

SEQ ID NO: 134469 - DNA, 23 bp, Homo sapiens
acagagtctcactctgtcgccca

SEQ ID NO: 134470 - DNA, 22 bp, Homo sapiens
cagagtctcactctgtcgccca

SEQ ID NO: 134471 - DNA, 23 bp, Homo sapiens
atatgtatatgtgtttatgtata

SEQ ID NO: 134472 - DNA, 21 bp, Homo sapiens
tatatgtatatgtgtatatgt

SEQ ID NO: 134473 - DNA, 21 bp, Homo sapiens
atatgtatatatgtatatatg

SEQ ID NO: 134474 - DNA, 23 bp, Homo sapiens
gggtctcactctgtcacccaggc

SEQ ID NO: 134475 - DNA, 19 bp, Homo sapiens
agtgcagtggcatgaccct

SEQ ID NO: 134476 - DNA, 23 bp, Homo sapiens
atggaggtacaacctgtagtccc

SEQ ID NO: 134477 - DNA, 23 bp, Homo sapiens
tgaggtaggaggatctcttgagc

SEQ ID NO: 134478 - DNA, 18 bp, Homo sapiens
atgagccactgcatctgg

SEQ ID NO: 134479 - DNA, 21 bp, Homo sapiens
tgagatggagtctcactctgt

SEQ ID NO: 134480 - DNA, 21 bp, Homo sapiens
tggaactgtgattttcaagat

SEQ ID NO: 134481 - DNA, 20 bp, Homo sapiens
actttagagattttgatttt

SEQ ID NO: 134482 - DNA, 19 bp, Homo sapiens
gtctcgctctgtcacccag

SEQ ID NO: 134483 - DNA, 20 bp, Homo sapiens
atgtgcctgtagttccagct

SEQ ID NO: 134484 - DNA, 23 bp, Homo sapiens
tgagctatgatggcaccattaca

SEQ ID NO: 134485 - DNA, 23 bp, Homo sapiens
tacatgtgtatatgtagttgtgt

SEQ ID NO: 134486 - DNA, 21 bp, Homo sapiens
aatgagtgattgtgatggtgt

SEQ ID NO: 134487 - DNA, 23 bp, Homo sapiens
acgagatctgatggttttaaaag

SEQ ID NO: 134488 - DNA, 23 bp, Homo sapiens
ggctctcactctctctcttgtct

SEQ ID NO: 134489 - DNA, 23 bp, Homo sapiens
ggaaaaccaagagaattgtgttc

SEQ ID NO: 134490 - DNA, 22 bp, Homo sapiens
actccagcctgggtgagactca

SEQ ID NO: 134491 - DNA, 22 bp, Homo sapiens
gagagagagagggagagatctg

SEQ ID NO: 134492 - DNA, 21 bp, Homo sapiens
aggagaataattaactctaga

SEQ ID NO: 134493 - DNA, 22 bp, Homo sapiens
tctgtcactcactctttgggaa

SEQ ID NO: 134494 - DNA, 23 bp, Homo sapiens
tctcactcacactgaattttccc

SEQ ID NO: 134495 - DNA, 19 bp, Homo sapiens
aggtgcattaatgtgggtt

SEQ ID NO: 134496 - DNA, 21 bp, Homo sapiens
agctactgtctgtcctggtaa

SEQ ID NO: 134497 - DNA, 19 bp, Homo sapiens
tacgtgtatatatacacgt

SEQ ID NO: 134498 - DNA, 19 bp, Homo sapiens
tatagagcagattttcttc

SEQ ID NO: 134499 - DNA, 21 bp, Homo sapiens
tatgtgtctgtatatgtaaat

SEQ ID NO: 134500 - DNA, 23 bp, Homo sapiens
tgagactgagtctcgctcagtcg

SEQ ID NO: 134501 - DNA, 23 bp, Homo sapiens
ttccaggttctctattctgttcc

SEQ ID NO: 134502 - DNA, 18 bp, Homo sapiens
agtataatttgaagttag

SEQ ID NO: 134503 - DNA, 23 bp, Homo sapiens
ttgcatttttcaagttttactat

SEQ ID NO: 134504 - DNA, 23 bp, Homo sapiens
agtgaatatatatatgtgtgtgt

SEQ ID NO: 134505 - DNA, 18 bp, Homo sapiens
tgaggtaggaggatcgtt

SEQ ID NO: 134506 - DNA, 20 bp, Homo sapiens
agtgcagtagtatgatccta

SEQ ID NO: 134507 - DNA, 19 bp, Homo sapiens
tttggttttttttgttttt

SEQ ID NO: 134508 - DNA, 23 bp, Homo sapiens
gtgagttgagagtgttgattggt

SEQ ID NO: 134509 - DNA, 23 bp, Homo sapiens
tgtgtgtgtttgtgtatgtgcat

SEQ ID NO: 134510 - DNA, 23 bp, Homo sapiens
tgaggtaggaggatcacttgagc

SEQ ID NO: 134511 - DNA, 22 bp, Homo sapiens
tcagacagaacagagtttgcag

SEQ ID NO: 134512 - DNA, 21 bp, Homo sapiens
caccctccctgattgtgttct

SEQ ID NO: 134513 - DNA, 20 bp, Homo sapiens
atcacagagggatggctctg

SEQ ID NO: 134514 - DNA, 23 bp, Homo sapiens
aacagagtctctctctgtcgccc

SEQ ID NO: 134515 - DNA, 18 bp, Homo sapiens
acagagccatatctctct

SEQ ID NO: 134516 - DNA, 23 bp, Homo sapiens
gagtctgagatgtgagtcagcac

SEQ ID NO: 134517 - DNA, 21 bp, Homo sapiens
tgtgaagaaagtcaatggtag

SEQ ID NO: 134518 - DNA, 20 bp, Homo sapiens
atatgcagatatatacgtgt

SEQ ID NO: 134519 - DNA, 21 bp, Homo sapiens
ttttgagacggagtctcactc

SEQ ID NO: 134520 - DNA, 23 bp, Homo sapiens
gggtctcactctgtcactcaggc

SEQ ID NO: 134521 - DNA, 21 bp, Homo sapiens
gtgcagtgtagtggcatgatc

SEQ ID NO: 134522 - DNA, 23 bp, Homo sapiens
ttccatgaggatgactttctgtg

SEQ ID NO: 134523 - DNA, 23 bp, Homo sapiens
aacgtggagagagtgcacagtgg

SEQ ID NO: 134524 - DNA, 23 bp, Homo sapiens
tcttgagacagagtctcactctg

SEQ ID NO: 134525 - DNA, 19 bp, Homo sapiens
aatccctgtgtgaggccct

SEQ ID NO: 134526 - DNA, 19 bp, Homo sapiens
tccttatgattgtcttggc

SEQ ID NO: 134527 - DNA, 21 bp, Homo sapiens
tgtgaagaaagtcaatggtag

SEQ ID NO: 134528 - DNA, 20 bp, Homo sapiens
agtctactgcctggactgag

SEQ ID NO: 134529 - DNA, 20 bp, Homo sapiens
acagagtctcgctcagtcgc

SEQ ID NO: 134530 - DNA, 23 bp, Homo sapiens
gacagagtctcgctctgtcaccc

SEQ ID NO: 134531 - DNA, 23 bp, Homo sapiens
tgagttcattgtagattctggat

SEQ ID NO: 134532 - DNA, 23 bp, Homo sapiens
tgagttcattgtagattctggat

SEQ ID NO: 134533 - DNA, 18 bp, Homo sapiens
acacccagctaaattttt

SEQ ID NO: 134534 - DNA, 23 bp, Homo sapiens
tcatgtgaaggtagaccactgta

SEQ ID NO: 134535 - DNA, 23 bp, Homo sapiens
gtattttccattcaaatgttaag

SEQ ID NO: 134536 - DNA, 23 bp, Homo sapiens
tgtcacactgagaagttccaatg

SEQ ID NO: 134537 - DNA, 23 bp, Homo sapiens
tttgaggtggagtctcactctgt

SEQ ID NO: 134538 - DNA, 23 bp, Homo sapiens
gagacagactgagactctgtttc

SEQ ID NO: 134539 - DNA, 21 bp, Homo sapiens
aagagacagggtcttgttctg

SEQ ID NO: 134540 - DNA, 23 bp, Homo sapiens
gtgaatttcagaagctgttattt

SEQ ID NO: 134541 - DNA, 20 bp, Homo sapiens
atgaaagcaatgaatactct

SEQ ID NO: 134542 - DNA, 23 bp, Homo sapiens
tgagtctcactctgtcactcagg

SEQ ID NO: 134543 - DNA, 23 bp, Homo sapiens
aatagtgctatacagaacaatgt

SEQ ID NO: 134544 - DNA, 22 bp, Homo sapiens
taatctgaagcaggttctgata

SEQ ID NO: 134545 - DNA, 22 bp, Homo sapiens
tgtgagaatggagtgcttcctg

SEQ ID NO: 134546 - DNA, 23 bp, Homo sapiens
tgagacagaatctcactctgtcg

SEQ ID NO: 134547 - DNA, 23 bp, Homo sapiens
acagagtctcactctgtcgccca

SEQ ID NO: 134548 - DNA, 23 bp, Homo sapiens
tatatgtttctatgtgtatatgt

SEQ ID NO: 134549 - DNA, 21 bp, Homo sapiens
tacatgtatatatgcatacgt

SEQ ID NO: 134550 - DNA, 23 bp, Homo sapiens
tggagtctcactctgtcacccag

SEQ ID NO: 134551 - DNA, 19 bp, Homo sapiens
tgtgcgtatatatacgtat

SEQ ID NO: 134552 - DNA, 23 bp, Homo sapiens
aatgagacccaaattgatgtctc

SEQ ID NO: 134553 - DNA, 23 bp, Homo sapiens
acagagtctcactctgtggccca

SEQ ID NO: 134554 - DNA, 23 bp, Homo sapiens
tgagttcattgtagattctggat

SEQ ID NO: 134555 - DNA, 23 bp, Homo sapiens
tgagttcattgtagattctggat

SEQ ID NO: 134556 - DNA, 23 bp, Homo sapiens
ttggcaggttttcatttgggtgc

SEQ ID NO: 134557 - DNA, 23 bp, Homo sapiens
tatatgtgtatatgtatatgtat

SEQ ID NO: 134558 - DNA, 23 bp, Homo sapiens
tatatgtgtatatgtatatgtat

SEQ ID NO: 134559 - DNA, 23 bp, Homo sapiens
tggttgagagaaatagttgtgaa

SEQ ID NO: 134560 - DNA, 18 bp, Homo sapiens
tgtgagcacacagtgaga

SEQ ID NO: 134561 - DNA, 22 bp, Homo sapiens
tcacaggggcgacttttgctga

SEQ ID NO: 134562 - DNA, 23 bp, Homo sapiens
atatgtacatacacatatgtgtg

SEQ ID NO: 134563 - DNA, 23 bp, Homo sapiens
atatatacacacatatgtgtgtg

SEQ ID NO: 134564 - DNA, 23 bp, Homo sapiens
ctctgagatcttgctgtctgcct

SEQ ID NO: 134565 - DNA, 23 bp, Homo sapiens
tatctgtagtagaaaccattctg

SEQ ID NO: 134566 - DNA, 22 bp, Homo sapiens
taacttggatttcagtttcagg

SEQ ID NO: 134567 - DNA, 23 bp, Homo sapiens
ctggctgtctccctccctccatc

SEQ ID NO: 134568 - DNA, 18 bp, Homo sapiens
aagaaagaggagtgtggg

SEQ ID NO: 134569 - DNA, 23 bp, Homo sapiens
tgtgtgtatatgtatgtgcatat

SEQ ID NO: 134570 - DNA, 22 bp, Homo sapiens
atatacatgacgtacacatgca

SEQ ID NO: 134571 - DNA, 23 bp, Homo sapiens
ctcactctgtcacacaggctgaa

SEQ ID NO: 134572 - DNA, 21 bp, Homo sapiens
ttatgtccatgtgtataagga

SEQ ID NO: 134573 - DNA, 21 bp, Homo sapiens
agacaggatcttgctctcctg

SEQ ID NO: 134574 - DNA, 22 bp, Homo sapiens
ggctcactgtaagctctgcttc

SEQ ID NO: 134575 - DNA, 19 bp, Homo sapiens
tcactatctctgattgtga

SEQ ID NO: 134576 - DNA, 22 bp, Homo sapiens
tgatagggtcttaaaagaggta

SEQ ID NO: 134577 - DNA, 23 bp, Homo sapiens
tatccacatgttgacttcatttt

SEQ ID NO: 134578 - DNA, 19 bp, Homo sapiens
tacacacacacatacatat

SEQ ID NO: 134579 - DNA, 22 bp, Homo sapiens
tatgtgtgtatatatatgtgtg

SEQ ID NO: 134580 - DNA, 19 bp, Homo sapiens
tgtatatatacatatgtgt

SEQ ID NO: 134581 - DNA, 19 bp, Homo sapiens
tgtgtatatatatacatat

SEQ ID NO: 134582 - DNA, 23 bp, Homo sapiens
cggagtctcactctgtcacccag

SEQ ID NO: 134583 - DNA, 23 bp, Homo sapiens
aactggcctagtaggtgccacat

SEQ ID NO: 134584 - DNA, 23 bp, Homo sapiens
cgcttgctctgtgctatgttatt

SEQ ID NO: 134585 - DNA, 23 bp, Homo sapiens
tctgtgttttactgtctgcttta

SEQ ID NO: 134586 - DNA, 23 bp, Homo sapiens
gtgccaggctgcctgaatggttc

SEQ ID NO: 134587 - DNA, 23 bp, Homo sapiens
tttgagagggagtctcattctgt

SEQ ID NO: 134588 - DNA, 21 bp, Homo sapiens
ttgtcttctgaatttgtggag

SEQ ID NO: 134589 - DNA, 23 bp, Homo sapiens
ttagacaaggtctggctctgttc

SEQ ID NO: 134590 - DNA, 23 bp, Homo sapiens
gagacagtctcactctgtcaccc

SEQ ID NO: 134591 - DNA, 23 bp, Homo sapiens
ggagtctcactctgtcacccagg

SEQ ID NO: 134592 - DNA, 23 bp, Homo sapiens
tggagtctcactctgtcacccag

SEQ ID NO: 134593 - DNA, 20 bp, Homo sapiens
tgatttgagagctttctttt

SEQ ID NO: 134594 - DNA, 23 bp, Homo sapiens
tgagatggagtctcactctgtca

SEQ ID NO: 134595 - DNA, 23 bp, Homo sapiens
agatggagtctcgctctgtctcc

SEQ ID NO: 134596 - DNA, 23 bp, Homo sapiens
gacagagtctcgctctgtcaccc

SEQ ID NO: 134597 - DNA, 23 bp, Homo sapiens
gggtctcactctgtcacccaggc

SEQ ID NO: 134598 - DNA, 23 bp, Homo sapiens
gggtctcactctgtcacccaggc

SEQ ID NO: 134599 - DNA, 23 bp, Homo sapiens
atttttagtagagacggggtgtc

SEQ ID NO: 134600 - DNA, 23 bp, Homo sapiens
tatatgtgtgtgggtgtatacac

SEQ ID NO: 134601 - DNA, 19 bp, Homo sapiens
gtctcgctctgtcacccag

SEQ ID NO: 134602 - DNA, 19 bp, Homo sapiens
gtgagccactgtgtccggc

SEQ ID NO: 134603 - DNA, 23 bp, Homo sapiens
gacagagtctcgctctgtcaccc

SEQ ID NO: 134604 - DNA, 23 bp, Homo sapiens
ggggacagactgagactgtctca

SEQ ID NO: 134605 - DNA, 20 bp, Homo sapiens
tggggtctcagtctgtcagc

SEQ ID NO: 134606 - DNA, 23 bp, Homo sapiens
tcactgtgtcacccaaactggag

SEQ ID NO: 134607 - DNA, 20 bp, Homo sapiens
tgagacagagtctccctgtc

SEQ ID NO: 134608 - DNA, 20 bp, Homo sapiens
agtctccctctgtcacccag

SEQ ID NO: 134609 - DNA, 23 bp, Homo sapiens
agggtctcactctgtcacccagg

SEQ ID NO: 134610 - DNA, 23 bp, Homo sapiens
atatgtgtatatatatgtgtgta

SEQ ID NO: 134611 - DNA, 23 bp, Homo sapiens
tatgtatatatatgtgtgtgtgt

SEQ ID NO: 134612 - DNA, 23 bp, Homo sapiens
tgacatgtggatagtgtgactga

SEQ ID NO: 134613 - DNA, 23 bp, Homo sapiens
tcaggcagcaaaactgttggtaa

SEQ ID NO: 134614 - DNA, 23 bp, Homo sapiens
tggagtctcactctgtcaccgag

SEQ ID NO: 134615 - DNA, 18 bp, Homo sapiens
acagtggtgtgatctcag

SEQ ID NO: 134616 - DNA, 18 bp, Homo sapiens
tgattccatgactttgct

SEQ ID NO: 134617 - DNA, 23 bp, Homo sapiens
aagtcagaaggtgctggtgtgac

SEQ ID NO: 134618 - DNA, 19 bp, Homo sapiens
ttctgagtagtattcaatt

SEQ ID NO: 134619 - DNA, 20 bp, Homo sapiens
acctgctctgtgactctgag

SEQ ID NO: 134620 - DNA, 23 bp, Homo sapiens
gcatgtctgtagtcacagctact

SEQ ID NO: 134621 - DNA, 23 bp, Homo sapiens
agacagagtctcactctcaccca

SEQ ID NO: 134622 - DNA, 18 bp, Homo sapiens
aacttaaagtggcagtgt

SEQ ID NO: 134623 - DNA, 23 bp, Homo sapiens
taacagtgagagctcaagactca

SEQ ID NO: 134624 - DNA, 19 bp, Homo sapiens
tgtttgtttgtctatttat

SEQ ID NO: 134625 - DNA, 23 bp, Homo sapiens
aaagtgagtggctattctgttct

SEQ ID NO: 134626 - DNA, 22 bp, Homo sapiens
cacacatgtgtgtgtgtatata

SEQ ID NO: 134627 - DNA, 18 bp, Homo sapiens
ggagacagtctcactctg

SEQ ID NO: 134628 - DNA, 23 bp, Homo sapiens
gagacggagtctcactctgtcac

SEQ ID NO: 134629 - DNA, 21 bp, Homo sapiens
atgtatgtatgtatgtatgta

SEQ ID NO: 134630 - DNA, 23 bp, Homo sapiens
acagagtctcgctgtcacccagg

SEQ ID NO: 134631 - DNA, 23 bp, Homo sapiens
tgtgagccactgtgcttggctgc

SEQ ID NO: 134632 - DNA, 21 bp, Homo sapiens
tgtatgtatttatggagtggg

SEQ ID NO: 134633 - DNA, 20 bp, Homo sapiens
tcaccctctctgggcctcag

SEQ ID NO: 134634 - DNA, 21 bp, Homo sapiens
atgtgtctgtctctgtgtcca

SEQ ID NO: 134635 - DNA, 23 bp, Homo sapiens
tgcacagaagaaatgtgtcattc

SEQ ID NO: 134636 - DNA, 21 bp, Homo sapiens
aagccatatgataagcctgat

SEQ ID NO: 134637 - DNA, 23 bp, Homo sapiens
gacacagcattttaattgtttat

SEQ ID NO: 134638 - DNA, 23 bp, Homo sapiens
ttctaaaaatatgtgtctgtttg

SEQ ID NO: 134639 - DNA, 20 bp, Homo sapiens
agacacacacatttacatat

SEQ ID NO: 134640 - DNA, 22 bp, Homo sapiens
tgatccaagtgtcattatgtgg

SEQ ID NO: 134641 - DNA, 23 bp, Homo sapiens
atatgtgtatatatgtatatatg

SEQ ID NO: 134642 - DNA, 18 bp, Homo sapiens
tatgtatatatgtgtgta

SEQ ID NO: 134643 - DNA, 23 bp, Homo sapiens
atatgtgtgtatatatgtatgtg

SEQ ID NO: 134644 - DNA, 23 bp, Homo sapiens
cggagtctcactctgtcacccag

SEQ ID NO: 134645 - DNA, 23 bp, Homo sapiens
gagtctcactctgtcacccaggc

SEQ ID NO: 134646 - DNA, 19 bp, Homo sapiens
ttgattggattgaagggtg

SEQ ID NO: 134647 - DNA, 23 bp, Homo sapiens
ataaaatctgatgctaaactgta

SEQ ID NO: 134648 - DNA, 23 bp, Homo sapiens
tcttgatattccatatgatttga

SEQ ID NO: 134649 - DNA, 22 bp, Homo sapiens
tgcagtggtatgatctttgctg

SEQ ID NO: 134650 - DNA, 23 bp, Homo sapiens
tgagttcattgtagattctggat

SEQ ID NO: 134651 - DNA, 23 bp, Homo sapiens
tgagttcattgtagattctggat

SEQ ID NO: 134652 - DNA, 21 bp, Homo sapiens
aagcacgttctcagaaggttt

SEQ ID NO: 134653 - DNA, 22 bp, Homo sapiens
acatgtgcacattgtgcaggtt

SEQ ID NO: 134654 - DNA, 20 bp, Homo sapiens
tgttaactggttattttgct

SEQ ID NO: 134655 - DNA, 22 bp, Homo sapiens
acactctgtttttgtagaatct

SEQ ID NO: 134656 - DNA, 23 bp, Homo sapiens
aaactgcttcatgatgtgtgcat

SEQ ID NO: 134657 - DNA, 19 bp, Homo sapiens
tgagaaacttctttgtgat

SEQ ID NO: 134658 - DNA, 23 bp, Homo sapiens
tgagttcattgtagattctggat

SEQ ID NO: 134659 - DNA, 23 bp, Homo sapiens
tgagttcattgtagattctggat

SEQ ID NO: 134660 - DNA, 23 bp, Homo sapiens
tgagttcattgtagattctggat

SEQ ID NO: 134661 - DNA, 23 bp, Homo sapiens
tgagttcattgtagattctggat

SEQ ID NO: 134662 - DNA, 22 bp, Homo sapiens
tgacacacttaactgtgagtat

SEQ ID NO: 134663 - DNA, 21 bp, Homo sapiens
tttgtcacccaagatggagtg

SEQ ID NO: 134664 - DNA, 23 bp, Homo sapiens
tacatgtgcacattgtgcaggtt

SEQ ID NO: 134665 - DNA, 19 bp, Homo sapiens
acagagcacttgcaaaatc

SEQ ID NO: 134666 - DNA, 20 bp, Homo sapiens
aaagtgctaggactacagga

SEQ ID NO: 134667 - DNA, 18 bp, Homo sapiens
aaattgtatatgttaggc

SEQ ID NO: 134668 - DNA, 23 bp, Homo sapiens
tggaaagaaatcaagtgtgtagt

SEQ ID NO: 134669 - DNA, 19 bp, Homo sapiens
atgtgtatatattaagttg

SEQ ID NO: 134670 - DNA, 23 bp, Homo sapiens
gactctgtgtgtgtgtctgtgtg

SEQ ID NO: 134671 - DNA, 22 bp, Homo sapiens
tggtgacagtggctgtcatggg

SEQ ID NO: 134672 - DNA, 23 bp, Homo sapiens
tatgcatatatatacatgtgtag

SEQ ID NO: 134673 - DNA, 22 bp, Homo sapiens
tctgcctctgtcattcatcaca

SEQ ID NO: 134674 - DNA, 21 bp, Homo sapiens
ctcacagtgctgagcatggag

SEQ ID NO: 134675 - DNA, 23 bp, Homo sapiens
atgagctgacactgtagaaagag

SEQ ID NO: 134676 - DNA, 23 bp, Homo sapiens
tgagttcattgtagattctggat

SEQ ID NO: 134677 - DNA, 23 bp, Homo sapiens
tgagttcattgtagattctggat

SEQ ID NO: 134678 - DNA, 23 bp, Homo sapiens
gacagagtctcgctctgtcaccc

SEQ ID NO: 134679 - DNA, 23 bp, Homo sapiens
acagagtctcgctctgtcaccca

SEQ ID NO: 134680 - DNA, 23 bp, Homo sapiens
tttgtagatggagtctcactctg

SEQ ID NO: 134681 - DNA, 23 bp, Homo sapiens
tgagttcattgtagattctggat

SEQ ID NO: 134682 - DNA, 23 bp, Homo sapiens
tgagttcattgtagattctggat

SEQ ID NO: 134683 - DNA, 19 bp, Homo sapiens
tggaactgggacaggtgga

SEQ ID NO: 134684 - DNA, 20 bp, Homo sapiens
agacagagtctcattctgtc

SEQ ID NO: 134685 - DNA, 22 bp, Homo sapiens
tctctgtgcctcagtcgccctc

SEQ ID NO: 134686 - DNA, 23 bp, Homo sapiens
gtggagtctcactctgtcaccca

SEQ ID NO: 134687 - DNA, 23 bp, Homo sapiens
agatggagtctcactctgtcacc

SEQ ID NO: 134688 - DNA, 21 bp, Homo sapiens
agtgtggtagtgtgatcttgg

SEQ ID NO: 134689 - DNA, 18 bp, Homo sapiens
atgtggcttcagagcagg

SEQ ID NO: 134690 - DNA, 23 bp, Homo sapiens
tgaggtggattctcactctgtca

SEQ ID NO: 134691 - DNA, 21 bp, Homo sapiens
cagaactcagaaaaacagttt

SEQ ID NO: 134692 - DNA, 20 bp, Homo sapiens
atatgtatttatgtataatg

SEQ ID NO: 134693 - DNA, 22 bp, Homo sapiens
tatgtatatatatgtgtgtgta

SEQ ID NO: 134694 - DNA, 21 bp, Homo sapiens
tgcctttattattctatgtgt

SEQ ID NO: 134695 - DNA, 20 bp, Homo sapiens
ggagtgtcactctgtcaccc

SEQ ID NO: 134696 - DNA, 22 bp, Homo sapiens
ttttttttgagacggagtcttg

SEQ ID NO: 134697 - DNA, 23 bp, Homo sapiens
tatgtatgtgtgtgtatgtatat

SEQ ID NO: 134698 - DNA, 19 bp, Homo sapiens
ttaggaggagtgtcactct

SEQ ID NO: 134699 - DNA, 22 bp, Homo sapiens
atcagcagccttaaaatgtgct

SEQ ID NO: 134700 - DNA, 22 bp, Homo sapiens
acatgtgcacattgtgcaggtt

SEQ ID NO: 134701 - DNA, 23 bp, Homo sapiens
tgagttcattgtagattctggat

SEQ ID NO: 134702 - DNA, 23 bp, Homo sapiens
tgagttcattgtagattctggat

SEQ ID NO: 134703 - DNA, 22 bp, Homo sapiens
cagttttaagttgtttgggaaa

SEQ ID NO: 134704 - DNA, 23 bp, Homo sapiens
gggtctcactctgtcacccaggc

SEQ ID NO: 134705 - DNA, 23 bp, Homo sapiens
gggtctcactctgtcacccaggc

SEQ ID NO: 134706 - DNA, 21 bp, Homo sapiens
tttgagatgcagtcttgctct

SEQ ID NO: 134707 - DNA, 23 bp, Homo sapiens
tttatgtatatatacataagtgt

SEQ ID NO: 134708 - DNA, 23 bp, Homo sapiens
tccgtcactctctgactgtactt

SEQ ID NO: 134709 - DNA, 20 bp, Homo sapiens
ttgagatggagtctcactct

SEQ ID NO: 134710 - DNA, 20 bp, Homo sapiens
atttttagtagagacggggt

SEQ ID NO: 134711 - DNA, 21 bp, Homo sapiens
gtgggtggctgtgttcaacag

SEQ ID NO: 134712 - DNA, 23 bp, Homo sapiens
tggagtctcgctctgttatccag

SEQ ID NO: 134713 - DNA, 23 bp, Homo sapiens
gagccggagtctggctgtgtcgc

SEQ ID NO: 134714 - DNA, 23 bp, Homo sapiens
cactctgtcacccagactgcagt

SEQ ID NO: 134715 - DNA, 18 bp, Homo sapiens
acgtatatatatgtgtgt

SEQ ID NO: 134716 - DNA, 23 bp, Homo sapiens
catacacatatacatatatgtgt

SEQ ID NO: 134717 - DNA, 23 bp, Homo sapiens
atatacatatatagtatatgtgt

SEQ ID NO: 134718 - DNA, 22 bp, Homo sapiens
tttcacaatggctgaactaatt

SEQ ID NO: 134719 - DNA, 21 bp, Homo sapiens
gtctgggtgacagagcgggac

SEQ ID NO: 134720 - DNA, 23 bp, Homo sapiens
gttctgtcactgtctctcatcac

SEQ ID NO: 134721 - DNA, 18 bp, Homo sapiens
tgcgataagtacagtaag

SEQ ID NO: 134722 - DNA, 23 bp, Homo sapiens
acacacacatcctatgtgtttgt

SEQ ID NO: 134723 - DNA, 21 bp, Homo sapiens
aacagtacactgcagattgtt

SEQ ID NO: 134724 - DNA, 23 bp, Homo sapiens
tgagtcaaatgagtacaggcagt

SEQ ID NO: 134725 - DNA, 23 bp, Homo sapiens
cacagcctgtcacaatgaccaga

SEQ ID NO: 134726 - DNA, 23 bp, Homo sapiens
tgatcttgtatgtgtctctcttt

SEQ ID NO: 134727 - DNA, 23 bp, Homo sapiens
atcagatggataatgtaagcaga

SEQ ID NO: 134728 - DNA, 23 bp, Homo sapiens
tgagacagggtctggctctgttg

SEQ ID NO: 134729 - DNA, 21 bp, Homo sapiens
tctgacagactgcccatgtcc

SEQ ID NO: 134730 - DNA, 23 bp, Homo sapiens
gagtctcgctctgtcacccagtc

SEQ ID NO: 134731 - DNA, 23 bp, Homo sapiens
cggagtctcactctgtcacccag

SEQ ID NO: 134732 - DNA, 20 bp, Homo sapiens
taacatctacatatacatgt

SEQ ID NO: 134733 - DNA, 18 bp, Homo sapiens
tatatgtgtgtatgtgta

SEQ ID NO: 134734 - DNA, 23 bp, Homo sapiens
tgtatatatgcgtgtgtgtgtgt

SEQ ID NO: 134735 - DNA, 21 bp, Homo sapiens
aggcaagtagctatcaatgtt

SEQ ID NO: 134736 - DNA, 23 bp, Homo sapiens
caagagctacatcttttaaaagt

SEQ ID NO: 134737 - DNA, 23 bp, Homo sapiens
atacatgtgcaggatgtgcaggt

SEQ ID NO: 134738 - DNA, 23 bp, Homo sapiens
ttctccctgtggctcactctctc

SEQ ID NO: 134739 - DNA, 23 bp, Homo sapiens
aactagcagcaaaagataacatt

SEQ ID NO: 134740 - DNA, 18 bp, Homo sapiens
tatgtgtgtgtgtgtaat

SEQ ID NO: 134741 - DNA, 23 bp, Homo sapiens
agagtggttcaagagctgcttct

SEQ ID NO: 134742 - DNA, 23 bp, Homo sapiens
cggagtctcgctctgtctcccag

SEQ ID NO: 134743 - DNA, 20 bp, Homo sapiens
aatccaactgctgggaatgt

SEQ ID NO: 134744 - DNA, 23 bp, Homo sapiens
gcagtgagccatgatcgtcccac

SEQ ID NO: 134745 - DNA, 23 bp, Homo sapiens
ggcattgtcctggacatgttctg

SEQ ID NO: 134746 - DNA, 21 bp, Homo sapiens
gaaaaagataatgtggagatg

SEQ ID NO: 134747 - DNA, 21 bp, Homo sapiens
ttttttctttttgagatggag

SEQ ID NO: 134748 - DNA, 23 bp, Homo sapiens
tctgtgtggctgtgtgtccctgt

SEQ ID NO: 134749 - DNA, 23 bp, Homo sapiens
ttttttcctgttgatcaagttca

SEQ ID NO: 134750 - DNA, 23 bp, Homo sapiens
cagaagtctttttgttcaactag

SEQ ID NO: 134751 - DNA, 22 bp, Homo sapiens
tcactgatgagagagttgatat

SEQ ID NO: 134752 - DNA, 22 bp, Homo sapiens
tatgtgtatatatatacacata

SEQ ID NO: 134753 - DNA, 23 bp, Homo sapiens
tggtattgtggatgttttgccat

SEQ ID NO: 134754 - DNA, 21 bp, Homo sapiens
atatatgtatatatatgtgtg

SEQ ID NO: 134755 - DNA, 23 bp, Homo sapiens
tatatgtatatacatatgtgtgt

SEQ ID NO: 134756 - DNA, 23 bp, Homo sapiens
tatgtgtgtatatatgtatatgc

SEQ ID NO: 134757 - DNA, 20 bp, Homo sapiens
tatatgtgtgtgtatatgta

SEQ ID NO: 134758 - DNA, 23 bp, Homo sapiens
tctctctctctctgaattatgtg

SEQ ID NO: 134759 - DNA, 18 bp, Homo sapiens
gaagtccaagatctgtag

SEQ ID NO: 134760 - DNA, 23 bp, Homo sapiens
tatacatatgtatacatgtatat

SEQ ID NO: 134761 - DNA, 22 bp, Homo sapiens
ggctctctctctgagtcccttc

SEQ ID NO: 134762 - DNA, 23 bp, Homo sapiens
tattgtcattttgaaaatatgag

SEQ ID NO: 134763 - DNA, 23 bp, Homo sapiens
gggtctcactctgtcacccaggc

SEQ ID NO: 134764 - DNA, 23 bp, Homo sapiens
acacagaagagagacagatgtga

SEQ ID NO: 134765 - DNA, 23 bp, Homo sapiens
tcttctgagcctctgagttcagc

SEQ ID NO: 134766 - DNA, 23 bp, Homo sapiens
agacatggtctggctctgtcacc

SEQ ID NO: 134767 - DNA, 20 bp, Homo sapiens
ttatttgttttcctacttgt

SEQ ID NO: 134768 - DNA, 20 bp, Homo sapiens
tcagagaacagaaaaacatc

SEQ ID NO: 134769 - DNA, 23 bp, Homo sapiens
ctgtctgtctgtgtgagagtggg

SEQ ID NO: 134770 - DNA, 23 bp, Homo sapiens
gaggctctcactgcctctctgtg

SEQ ID NO: 134771 - DNA, 23 bp, Homo sapiens
taaatgtagagtcttccctgatg

SEQ ID NO: 134772 - DNA, 20 bp, Homo sapiens
tagcattttaaagcctaaga

SEQ ID NO: 134773 - DNA, 22 bp, Homo sapiens
aagtatcttttttttatgctat

SEQ ID NO: 134774 - DNA, 23 bp, Homo sapiens
ttactgattcgatttcctgactg

SEQ ID NO: 134775 - DNA, 23 bp, Homo sapiens
gagacggagactcactctgtggc

SEQ ID NO: 134776 - DNA, 21 bp, Homo sapiens
atctctgccaggacatcttgt

SEQ ID NO: 134777 - DNA, 18 bp, Homo sapiens
gtgtctgctggtggacag

SEQ ID NO: 134778 - DNA, 22 bp, Homo sapiens
aagagagtgcagtcagtgagct

SEQ ID NO: 134779 - DNA, 20 bp, Homo sapiens
tgtacagccatctctgctgg

SEQ ID NO: 134780 - DNA, 23 bp, Homo sapiens
ttacctgaggttgtactctatgg

SEQ ID NO: 134781 - DNA, 22 bp, Homo sapiens
taggttgtagtaacagtgtgct

SEQ ID NO: 134782 - DNA, 18 bp, Homo sapiens
agagtgctgtgtcagggg

SEQ ID NO: 134783 - DNA, 23 bp, Homo sapiens
tgtgtctgactcagtctcctgtc

SEQ ID NO: 134784 - DNA, 19 bp, Homo sapiens
ccaccagcacctgctgctc

SEQ ID NO: 134785 - DNA, 22 bp, Homo sapiens
acagtgtctcactctgtcgccc

SEQ ID NO: 134786 - DNA, 20 bp, Homo sapiens
tgtacctcgtgtgtatcagt

SEQ ID NO: 134787 - DNA, 21 bp, Homo sapiens
attctgaaaaatgtctactca

SEQ ID NO: 134788 - DNA, 23 bp, Homo sapiens
agaaaaagatatgaatagacgtt

SEQ ID NO: 134789 - DNA, 23 bp, Homo sapiens
atgtgtgtgtgtgtgtgcatgtg

SEQ ID NO: 134790 - DNA, 23 bp, Homo sapiens
tgagaaacgtgtgggtgtgcaca

SEQ ID NO: 134791 - DNA, 19 bp, Homo sapiens
ctcacactaactcactcgc

SEQ ID NO: 134792 - DNA, 18 bp, Homo sapiens
tgatgctggtgtaggcaa

SEQ ID NO: 134793 - DNA, 22 bp, Homo sapiens
atctggtatattatatgagatg

SEQ ID NO: 134794 - DNA, 23 bp, Homo sapiens
ttgtgtatatatgtatatgtgtg

SEQ ID NO: 134795 - DNA, 19 bp, Homo sapiens
tgacatgtatatatatggt

SEQ ID NO: 134796 - DNA, 21 bp, Homo sapiens
tagtcctctcactggaagcag

SEQ ID NO: 134797 - DNA, 23 bp, Homo sapiens
catgatgttgttgatagctgttt

SEQ ID NO: 134798 - DNA, 23 bp, Homo sapiens
tggagtctcactctgtcacccag

SEQ ID NO: 134799 - DNA, 20 bp, Homo sapiens
tagcttctttatcattactt

SEQ ID NO: 134800 - DNA, 21 bp, Homo sapiens
agacagcaatttgtaaacact

SEQ ID NO: 134801 - DNA, 23 bp, Homo sapiens
ttagaggctagtgtttttctagt

SEQ ID NO: 134802 - DNA, 23 bp, Homo sapiens
tgtgtgtgtatatgtatatgtgt

SEQ ID NO: 134803 - DNA, 23 bp, Homo sapiens
tgtgtgtctgatgtctgtgagga

SEQ ID NO: 134804 - DNA, 23 bp, Homo sapiens
agtgggtctcactgactctgggc

SEQ ID NO: 134805 - DNA, 23 bp, Homo sapiens
ctttgcctgactctcactcagcc

SEQ ID NO: 134806 - DNA, 20 bp, Homo sapiens
tgtgccatacatatgagagt

SEQ ID NO: 134807 - DNA, 23 bp, Homo sapiens
taaatgtctgcagttggagagaa

SEQ ID NO: 134808 - DNA, 18 bp, Homo sapiens
atggtgcgatctctgctc

SEQ ID NO: 134809 - DNA, 20 bp, Homo sapiens
taaagtggatgtatttatat

SEQ ID NO: 134810 - DNA, 23 bp, Homo sapiens
tttgctgaaattgatttgattaa

SEQ ID NO: 134811 - DNA, 23 bp, Homo sapiens
tgcatgattgctattcttttaaa

SEQ ID NO: 134812 - DNA, 21 bp, Homo sapiens
ttagtatttcatgtaggcttg

SEQ ID NO: 134813 - DNA, 20 bp, Homo sapiens
tttgtccacatgatcatgct

SEQ ID NO: 134814 - DNA, 19 bp, Homo sapiens
tagagggtgacagaagtgt

SEQ ID NO: 134815 - DNA, 21 bp, Homo sapiens
ttactggcgaatattttgctt

SEQ ID NO: 134816 - DNA, 23 bp, Homo sapiens
tggtttgcaatgtagtcaggaat

SEQ ID NO: 134817 - DNA, 23 bp, Homo sapiens
tgagttcattgtagattctggat

SEQ ID NO: 134818 - DNA, 23 bp, Homo sapiens
tgagttcattgtagattctggat

SEQ ID NO: 134819 - DNA, 23 bp, Homo sapiens
cttaagtgtacagtgtttgcaaa

SEQ ID NO: 134820 - DNA, 23 bp, Homo sapiens
gctttcagatctgagagtggaga

SEQ ID NO: 134821 - DNA, 20 bp, Homo sapiens
actttctatctgtggctctg

SEQ ID NO: 134822 - DNA, 21 bp, Homo sapiens
atgaagaccaatgggcatgag

SEQ ID NO: 134823 - DNA, 18 bp, Homo sapiens
tttttgtttttgtggaga

SEQ ID NO: 134824 - DNA, 23 bp, Homo sapiens
tataatcgatatgtatatgtata

SEQ ID NO: 134825 - DNA, 23 bp, Homo sapiens
ctgtcagcttcagtctgtctctg

SEQ ID NO: 134826 - DNA, 22 bp, Homo sapiens
tttttagatggagtctcgctct

SEQ ID NO: 134827 - DNA, 23 bp, Homo sapiens
tatgtgtatatatatatgtgtgt

SEQ ID NO: 134828 - DNA, 19 bp, Homo sapiens
gtgcagtggtgtgatcaga

SEQ ID NO: 134829 - DNA, 21 bp, Homo sapiens
atctcggctcactgcaggctg

SEQ ID NO: 134830 - DNA, 19 bp, Homo sapiens
tgtgtgtgtatatatgtgt

SEQ ID NO: 134831 - DNA, 19 bp, Homo sapiens
gtgccttctgtgctgactt

SEQ ID NO: 134832 - DNA, 23 bp, Homo sapiens
cactgtggctcagtctctccatc

SEQ ID NO: 134833 - DNA, 23 bp, Homo sapiens
ctgaggctctctgagtctgtgag

SEQ ID NO: 134834 - DNA, 23 bp, Homo sapiens
tgtgtgcttatgtgtatatgtac

SEQ ID NO: 134835 - DNA, 19 bp, Homo sapiens
atctctgtatctttctctc

SEQ ID NO: 134836 - DNA, 21 bp, Homo sapiens
tttgtgactggctgacttcac

SEQ ID NO: 134837 - DNA, 23 bp, Homo sapiens
gaagtcacactctctgggacaca

SEQ ID NO: 134838 - DNA, 18 bp, Homo sapiens
ttaaaagttaagcaaggg

SEQ ID NO: 134839 - DNA, 23 bp, Homo sapiens
agagtctctcatattctgtctcc

SEQ ID NO: 134840 - DNA, 21 bp, Homo sapiens
tgagatgtgtgtgtggacaag

SEQ ID NO: 134841 - DNA, 18 bp, Homo sapiens
tgatcctgtgcatgtggt

SEQ ID NO: 134842 - DNA, 23 bp, Homo sapiens
tccctgactctctctctcagtgg

SEQ ID NO: 134843 - DNA, 23 bp, Homo sapiens
tatatacatatacatatgtgtat

SEQ ID NO: 134844 - DNA, 23 bp, Homo sapiens
aagtgctgggattacaggcataa

SEQ ID NO: 134845 - DNA, 22 bp, Homo sapiens
tgagatggagtttcactcttgt

SEQ ID NO: 134846 - DNA, 19 bp, Homo sapiens
tgtgagccactgtgcccgg

SEQ ID NO: 134847 - DNA, 23 bp, Homo sapiens
agatgggggtctcactgtgttac

SEQ ID NO: 134848 - DNA, 23 bp, Homo sapiens
actgtacagtgcacatacatctt

SEQ ID NO: 134849 - DNA, 23 bp, Homo sapiens
tgagtgtgtgtgtctgtgcatgt

SEQ ID NO: 134850 - DNA, 23 bp, Homo sapiens
ctgctaccctattgttcttttgg

SEQ ID NO: 134851 - DNA, 23 bp, Homo sapiens
aagtctgagatcaaggtgtcagc

SEQ ID NO: 134852 - DNA, 23 bp, Homo sapiens
tgtcactccctctccgtgcgcct

SEQ ID NO: 134853 - DNA, 23 bp, Homo sapiens
ctccctctctgtgtgcctgtctg

SEQ ID NO: 134854 - DNA, 23 bp, Homo sapiens
tcactctgagtttgcacatccac

SEQ ID NO: 134855 - DNA, 22 bp, Homo sapiens
attggcagtggatgaaatcaca

SEQ ID NO: 134856 - DNA, 23 bp, Homo sapiens
atcttcaagcagctgagtcagtt

SEQ ID NO: 134857 - DNA, 20 bp, Homo sapiens
tgtgcgtgggtttgttccca

SEQ ID NO: 134858 - DNA, 20 bp, Homo sapiens
atgtgtgtatatatgtatac

SEQ ID NO: 134859 - DNA, 23 bp, Homo sapiens
tatatgcatatgtataggtatac

SEQ ID NO: 134860 - DNA, 19 bp, Homo sapiens
atatgcataggtataggta

SEQ ID NO: 134861 - DNA, 18 bp, Homo sapiens
agcaagactccatctttt

SEQ ID NO: 134862 - DNA, 23 bp, Homo sapiens
ttttttgcatgtttgatatagtt

SEQ ID NO: 134863 - DNA, 19 bp, Homo sapiens
cacacatacatatgtgtat

SEQ ID NO: 134864 - DNA, 23 bp, Homo sapiens
atatgtgtatatatatgtgtgtg

SEQ ID NO: 134865 - DNA, 23 bp, Homo sapiens
gtattatgtatttaagtatatgt

SEQ ID NO: 134866 - DNA, 23 bp, Homo sapiens
gtatacacatacacatacacaga

SEQ ID NO: 134867 - DNA, 22 bp, Homo sapiens
ttgtccttttactttcagtctg

SEQ ID NO: 134868 - DNA, 23 bp, Homo sapiens
acacagaccctcacactctggct

SEQ ID NO: 134869 - DNA, 21 bp, Homo sapiens
tgtaagaaaatgcagaaaggt

SEQ ID NO: 134870 - DNA, 23 bp, Homo sapiens
tggaagttggtactttagtttgg

SEQ ID NO: 134871 - DNA, 23 bp, Homo sapiens
tatgacaggcagttttcatgacg

SEQ ID NO: 134872 - DNA, 23 bp, Homo sapiens
tgaggtagaaggatcacttgagc

SEQ ID NO: 134873 - DNA, 23 bp, Homo sapiens
tgagtctcactctgtcacccagg

SEQ ID NO: 134874 - DNA, 23 bp, Homo sapiens
agtgcacttctctgctataggat

SEQ ID NO: 134875 - DNA, 23 bp, Homo sapiens
gagtctcactctgtcactcaggc

SEQ ID NO: 134876 - DNA, 23 bp, Homo sapiens
tatacattgtggttttgatttgc

SEQ ID NO: 134877 - DNA, 19 bp, Homo sapiens
atgcactcattcctagagg

SEQ ID NO: 134878 - DNA, 21 bp, Homo sapiens
tggggtagatgcatgtttagt

SEQ ID NO: 134879 - DNA, 23 bp, Homo sapiens
cggagtctctctctgtcgctcag

SEQ ID NO: 134880 - DNA, 23 bp, Homo sapiens
tatcaagttgacaggtttcctat

SEQ ID NO: 134881 - DNA, 23 bp, Homo sapiens
gttgagacttgttctgttttcta

SEQ ID NO: 134882 - DNA, 21 bp, Homo sapiens
aagagcatatttattcctgag

SEQ ID NO: 134883 - DNA, 21 bp, Homo sapiens
ctctctctgagagtctgagaa

SEQ ID NO: 134884 - DNA, 23 bp, Homo sapiens
tctctctctctgtgagtgtcttt

SEQ ID NO: 134885 - DNA, 23 bp, Homo sapiens
aattctctcagcatttgttcatc

SEQ ID NO: 134886 - DNA, 18 bp, Homo sapiens
tcactggatgcaaaattg

SEQ ID NO: 134887 - DNA, 23 bp, Homo sapiens
tcattgtggttttgatttgcatt

SEQ ID NO: 134888 - DNA, 23 bp, Homo sapiens
atacagaagagagagtccagtgg

SEQ ID NO: 134889 - DNA, 23 bp, Homo sapiens
acatgtgcagaatgtgcaggttg

SEQ ID NO: 134890 - DNA, 21 bp, Homo sapiens
tcgaaatatctagtttattct

SEQ ID NO: 134891 - DNA, 23 bp, Homo sapiens
ttgccattgggtgaacagagtag

SEQ ID NO: 134892 - DNA, 23 bp, Homo sapiens
gtggtgtgtttttgatcagctag

SEQ ID NO: 134893 - DNA, 23 bp, Homo sapiens
tgtgtgcgtgtgtctgtgagttt

SEQ ID NO: 134894 - DNA, 19 bp, Homo sapiens
tttgaccttgaaattttaa

SEQ ID NO: 134895 - DNA, 23 bp, Homo sapiens
cagtacagagtagagacaaattt

SEQ ID NO: 134896 - DNA, 21 bp, Homo sapiens
tgtatacatatatgtgtgtgt

SEQ ID NO: 134897 - DNA, 23 bp, Homo sapiens
atgtgtagcaggaccacatatcc

SEQ ID NO: 134898 - DNA, 23 bp, Homo sapiens
aaatttgtgggcaaaagttgtgt

SEQ ID NO: 134899 - DNA, 23 bp, Homo sapiens
acagtggggaaagagagtgtcag

SEQ ID NO: 134900 - DNA, 23 bp, Homo sapiens
tgttaattcttgctctggctgct

SEQ ID NO: 134901 - DNA, 18 bp, Homo sapiens
tatacatagatgtgtgta

SEQ ID NO: 134902 - DNA, 20 bp, Homo sapiens
atgtatatgcatgtatatag

SEQ ID NO: 134903 - DNA, 23 bp, Homo sapiens
catgtatgtgtatgcatatgtat

SEQ ID NO: 134904 - DNA, 23 bp, Homo sapiens
atgtatgtatacatgtatgcaca

SEQ ID NO: 134905 - DNA, 21 bp, Homo sapiens
gaaagcacagtgcctgcagtg

SEQ ID NO: 134906 - DNA, 23 bp, Homo sapiens
tggctgtgtcactcagagcctct

SEQ ID NO: 134907 - DNA, 18 bp, Homo sapiens
gtgttctaagttctatgc

SEQ ID NO: 134908 - DNA, 23 bp, Homo sapiens
aaatgggtgtgacacattttgct

SEQ ID NO: 134909 - DNA, 18 bp, Homo sapiens
tgagaatgttgagtgggt

SEQ ID NO: 134910 - DNA, 20 bp, Homo sapiens
gagaccattcaatatggtga

SEQ ID NO: 134911 - DNA, 21 bp, Homo sapiens
tagtatgtattaaagatagag

SEQ ID NO: 134912 - DNA, 23 bp, Homo sapiens
attgtcagtcaatcagcttacct

SEQ ID NO: 134913 - DNA, 23 bp, Homo sapiens
acagtgattggtacaagactgag

SEQ ID NO: 134914 - DNA, 23 bp, Homo sapiens
cagagactgtgtctgtctgtccc

SEQ ID NO: 134915 - DNA, 22 bp, Homo sapiens
ttgtgatgtacaaaagttttta

SEQ ID NO: 134916 - DNA, 23 bp, Homo sapiens
tgtatgtatgtatatatgagtgt

SEQ ID NO: 134917 - DNA, 23 bp, Homo sapiens
ggagtcagtactgattttgaaga

SEQ ID NO: 134918 - DNA, 22 bp, Homo sapiens
acagaacaactacaaacaagta

SEQ ID NO: 134919 - DNA, 23 bp, Homo sapiens
tgtcactctcagattctctgtct

SEQ ID NO: 134920 - DNA, 23 bp, Homo sapiens
tggaatgtgcctgtcatcccagc

SEQ ID NO: 134921 - DNA, 21 bp, Homo sapiens
tgaggtaggtggatcacttga

SEQ ID NO: 134922 - DNA, 22 bp, Homo sapiens
tcactacaacctccactccctg

SEQ ID NO: 134923 - DNA, 21 bp, Homo sapiens
cagggtctcactgtcatccag

SEQ ID NO: 134924 - DNA, 23 bp, Homo sapiens
aaatgtatatatgtttatgtgtg

SEQ ID NO: 134925 - DNA, 23 bp, Homo sapiens
ttgtcagaagaaactcagaattt

SEQ ID NO: 134926 - DNA, 23 bp, Homo sapiens
aatggaaagttgaattggaagag

SEQ ID NO: 134927 - DNA, 22 bp, Homo sapiens
atatgtaacatatctatacaaa

SEQ ID NO: 134928 - DNA, 23 bp, Homo sapiens
tatgtgtgtgcttgtgtattagc

SEQ ID NO: 134929 - DNA, 23 bp, Homo sapiens
agagagcaaaagaaatgggattg

SEQ ID NO: 134930 - DNA, 23 bp, Homo sapiens
tgtggcaaaaccctgtctcttta

SEQ ID NO: 134931 - DNA, 19 bp, Homo sapiens
gtgagactccatctcttaa

SEQ ID NO: 134932 - DNA, 19 bp, Homo sapiens
ttttttttttgagactggg

SEQ ID NO: 134933 - DNA, 23 bp, Homo sapiens
tgtctgtgtgtctatatttacgt

SEQ ID NO: 134934 - DNA, 21 bp, Homo sapiens
atacacacatatacgtatgtg

SEQ ID NO: 134935 - DNA, 23 bp, Homo sapiens
tacacacgtgtgtgtgtgtgtgt

SEQ ID NO: 134936 - DNA, 22 bp, Homo sapiens
tgagtgtgcatgtgcatgtgtt

SEQ ID NO: 134937 - DNA, 23 bp, Homo sapiens
gcctgcctgcctgactgcctggc

SEQ ID NO: 134938 - DNA, 23 bp, Homo sapiens
ttaagtggagagagaaatctgaa

SEQ ID NO: 134939 - DNA, 18 bp, Homo sapiens
tcatcggtgatcatgcag

SEQ ID NO: 134940 - DNA, 23 bp, Homo sapiens
tgtatctctcactctgatgttgg

SEQ ID NO: 134941 - DNA, 23 bp, Homo sapiens
gcctctgtgacactctctgttga

SEQ ID NO: 134942 - DNA, 22 bp, Homo sapiens
tagtggaaagtattagcaaatg

SEQ ID NO: 134943 - DNA, 23 bp, Homo sapiens
tgagttcattgtagattctggat

SEQ ID NO: 134944 - DNA, 23 bp, Homo sapiens
tgagttcattgtagattctggat

SEQ ID NO: 134945 - DNA, 23 bp, Homo sapiens
tcttttttggttccatatgaaat

SEQ ID NO: 134946 - DNA, 19 bp, Homo sapiens
tgtgaagaaagtcaatagt

SEQ ID NO: 134947 - DNA, 20 bp, Homo sapiens
tcacagtcttaatcatgagg

SEQ ID NO: 134948 - DNA, 18 bp, Homo sapiens
atgtatatatacatgtgt

SEQ ID NO: 134949 - DNA, 23 bp, Homo sapiens
atatacacacgtatatatgtgtg

SEQ ID NO: 134950 - DNA, 21 bp, Homo sapiens
agggtccctctttgccagagt

SEQ ID NO: 134951 - DNA, 23 bp, Homo sapiens
tctctgcctgtgtctcaggaaac

SEQ ID NO: 134952 - DNA, 22 bp, Homo sapiens
ttgcatttctattttataaaca

SEQ ID NO: 134953 - DNA, 23 bp, Homo sapiens
gaaaattagtgatattgttgata

SEQ ID NO: 134954 - DNA, 23 bp, Homo sapiens
aggctgggtctcactctgtcatt

SEQ ID NO: 134955 - DNA, 18 bp, Homo sapiens
ggtagatccaagctttga

SEQ ID NO: 134956 - DNA, 19 bp, Homo sapiens
ttcctgcaatgttaaaatc

SEQ ID NO: 134957 - DNA, 22 bp, Homo sapiens
tgtctcaccctctccatcccca

SEQ ID NO: 134958 - DNA, 18 bp, Homo sapiens
tgggtatacatcctgtga

SEQ ID NO: 134959 - DNA, 23 bp, Homo sapiens
tatcacagtggctgtacactcag

SEQ ID NO: 134960 - DNA, 23 bp, Homo sapiens
ccagagaggcagcctgagtagaa

SEQ ID NO: 134961 - DNA, 23 bp, Homo sapiens
aaatgtgtgtatatgtatattgt

SEQ ID NO: 134962 - DNA, 23 bp, Homo sapiens
atgtgtgtgtgcatgtgttcaga

SEQ ID NO: 134963 - DNA, 19 bp, Homo sapiens
tcactgatgtcctttgctt

SEQ ID NO: 134964 - DNA, 22 bp, Homo sapiens
tgttatgaagctggactgcctg

SEQ ID NO: 134965 - DNA, 23 bp, Homo sapiens
ctctgcctgtgtcactgaatgac

SEQ ID NO: 134966 - DNA, 22 bp, Homo sapiens
ttaaagatgtatgtgcaagggt

SEQ ID NO: 134967 - DNA, 23 bp, Homo sapiens
gtgtgaatacatatgtgtgcata

SEQ ID NO: 134968 - DNA, 23 bp, Homo sapiens
actcggacatgtctgtttcacgt

SEQ ID NO: 134969 - DNA, 23 bp, Homo sapiens
agtcgattttccatcatgtagtt

SEQ ID NO: 134970 - DNA, 23 bp, Homo sapiens
tagtagttaagtacgtggactct

SEQ ID NO: 134971 - DNA, 23 bp, Homo sapiens
cacacagaagacagtcagcacat

SEQ ID NO: 134972 - DNA, 23 bp, Homo sapiens
agacaggatctcactctgttgcc

SEQ ID NO: 134973 - DNA, 23 bp, Homo sapiens
tacagaatgccatttgtgtgtca

SEQ ID NO: 134974 - DNA, 20 bp, Homo sapiens
gatttacagttggttcttct

SEQ ID NO: 134975 - DNA, 19 bp, Homo sapiens
tccagaaggagagatggtg

SEQ ID NO: 134976 - DNA, 18 bp, Homo sapiens
tgttcttgtctatagaat

SEQ ID NO: 134977 - DNA, 23 bp, Homo sapiens
tctcagctcactgtaacctctgc

SEQ ID NO: 134978 - DNA, 23 bp, Homo sapiens
ctctactcacatgtctctgtgac

SEQ ID NO: 134979 - DNA, 19 bp, Homo sapiens
tttggtttattaaagtttt

SEQ ID NO: 134980 - DNA, 19 bp, Homo sapiens
atgagacagtcatatcact

SEQ ID NO: 134981 - DNA, 23 bp, Homo sapiens
acacagacacatatatatgtgtg

SEQ ID NO: 134982 - DNA, 23 bp, Homo sapiens
acagagtctctctctgtcgccca

SEQ ID NO: 134983 - DNA, 23 bp, Homo sapiens
tcagagtctccctctgtctccgc

SEQ ID NO: 134984 - DNA, 19 bp, Homo sapiens
gtatatatacatatgtgta

SEQ ID NO: 134985 - DNA, 18 bp, Homo sapiens
tggcatgcatctgtagtc

SEQ ID NO: 134986 - DNA, 23 bp, Homo sapiens
tcagtgtgagatcatgagaacca

SEQ ID NO: 134987 - DNA, 22 bp, Homo sapiens
acacacacacgtgtgtatgtgt

SEQ ID NO: 134988 - DNA, 22 bp, Homo sapiens
acacacacacacgtgtgtatgt

SEQ ID NO: 134989 - DNA, 22 bp, Homo sapiens
ttatatggttatatatcagtta

SEQ ID NO: 134990 - DNA, 22 bp, Homo sapiens
ctgagatgagggagaggacatg

SEQ ID NO: 134991 - DNA, 22 bp, Homo sapiens
tgtgtatatatatatatgtgtg

SEQ ID NO: 134992 - DNA, 22 bp, Homo sapiens
atgtgtgtgtgtgtgtaaatgc

SEQ ID NO: 134993 - DNA, 23 bp, Homo sapiens
gaacacacacagcatttattaag

SEQ ID NO: 134994 - DNA, 21 bp, Homo sapiens
ttctgaaatggatgtggtttg

SEQ ID NO: 134995 - DNA, 23 bp, Homo sapiens
actggcactgtctctttctacag

SEQ ID NO: 134996 - DNA, 23 bp, Homo sapiens
cttaagtggatgctttttttgac

SEQ ID NO: 134997 - DNA, 23 bp, Homo sapiens
tgtctctctctgagtcccttcct

SEQ ID NO: 134998 - DNA, 23 bp, Homo sapiens
tgagttcattgtagattctggat

SEQ ID NO: 134999 - DNA, 23 bp, Homo sapiens
tgagttcattgtagattctggat

SEQ ID NO: 135000 - DNA, 23 bp, Homo sapiens
tgagttcattgtagattctggat

SEQ ID NO: 135001 - DNA, 23 bp, Homo sapiens
tgagttcattgtagattctggat

SEQ ID NO: 135002 - DNA, 20 bp, Homo sapiens
agtgcagtagtgtgatctct

SEQ ID NO: 135003 - DNA, 23 bp, Homo sapiens
tagattcaggaaagatttctaag

SEQ ID NO: 135004 - DNA, 23 bp, Homo sapiens
tgagttcattgtagattctggat

SEQ ID NO: 135005 - DNA, 23 bp, Homo sapiens
tgagttcattgtagattctggat

SEQ ID NO: 135006 - DNA, 23 bp, Homo sapiens
tatatgtgtgtgcatatgtgtgt

SEQ ID NO: 135007 - DNA, 23 bp, Homo sapiens
atgagtgagaacatgcagtgttt

SEQ ID NO: 135008 - DNA, 23 bp, Homo sapiens
tgagttcattgtagattctggat

SEQ ID NO: 135009 - DNA, 23 bp, Homo sapiens
tgagttcattgtagattctggat

SEQ ID NO: 135010 - DNA, 23 bp, Homo sapiens
ttgtgtatcagcaattgattgct

SEQ ID NO: 135011 - DNA, 23 bp, Homo sapiens
tgagttcattgtagattctggat

SEQ ID NO: 135012 - DNA, 23 bp, Homo sapiens
tgagttcattgtagattctggat

SEQ ID NO: 135013 - DNA, 19 bp, Homo sapiens
tctgcccttccagaatcca

SEQ ID NO: 135014 - DNA, 23 bp, Homo sapiens
acatgtgcagaatgtgcaggatg

SEQ ID NO: 135015 - DNA, 23 bp, Homo sapiens
ttaggtagtatgttgttgagaag

SEQ ID NO: 135016 - DNA, 20 bp, Homo sapiens
agtaggaggaatactggtct

SEQ ID NO: 135017 - DNA, 21 bp, Homo sapiens
attgccggttttgtttctagt

SEQ ID NO: 135018 - DNA, 23 bp, Homo sapiens
aacactctctgtcacttaatagc

SEQ ID NO: 135019 - DNA, 22 bp, Homo sapiens
tatgagtatatatatatgagtg

SEQ ID NO: 135020 - DNA, 20 bp, Homo sapiens
tatgggcgtgtatatataca

SEQ ID NO: 135021 - DNA, 21 bp, Homo sapiens
gtctcgctctgtcaccctggc

SEQ ID NO: 135022 - DNA, 23 bp, Homo sapiens
aagagtttggagtttgcagtggt

SEQ ID NO: 135023 - DNA, 23 bp, Homo sapiens
tttttacctggtttagtactata

SEQ ID NO: 135024 - DNA, 23 bp, Homo sapiens
tgtcagagacagaaatgtgtgag

SEQ ID NO: 135025 - DNA, 22 bp, Homo sapiens
ttaagcactgatatgttcccaa

SEQ ID NO: 135026 - DNA, 22 bp, Homo sapiens
tctctgtcagtcagtctggagt

SEQ ID NO: 135027 - DNA, 23 bp, Homo sapiens
agggtctcactgtgtcacccagg

SEQ ID NO: 135028 - DNA, 23 bp, Homo sapiens
tgagttcattgtagattctggat

SEQ ID NO: 135029 - DNA, 23 bp, Homo sapiens
tgagttcattgtagattctggat

SEQ ID NO: 135030 - DNA, 20 bp, Homo sapiens
agtgcagtagtgtgatctct

SEQ ID NO: 135031 - DNA, 22 bp, Homo sapiens
tcactgcaggctctgctccctg

SEQ ID NO: 135032 - DNA, 23 bp, Homo sapiens
tgagttcattgtagattctggat

SEQ ID NO: 135033 - DNA, 23 bp, Homo sapiens
tgagttcattgtagattctggat

SEQ ID NO: 135034 - DNA, 23 bp, Homo sapiens
ttttgagacggagtctcactctg

SEQ ID NO: 135035 - DNA, 20 bp, Homo sapiens
tatactaaaaaagtatttgt

SEQ ID NO: 135036 - DNA, 23 bp, Homo sapiens
tgagttcattgtagattctggat

SEQ ID NO: 135037 - DNA, 23 bp, Homo sapiens
tgagttcattgtagattctggat

SEQ ID NO: 135038 - DNA, 20 bp, Homo sapiens
atgtatgtatgcatgtctat

SEQ ID NO: 135039 - DNA, 18 bp, Homo sapiens
actttagattttctgaaa

SEQ ID NO: 135040 - DNA, 23 bp, Homo sapiens
gactgagtctcgctctgtcaccc

SEQ ID NO: 135041 - DNA, 23 bp, Homo sapiens
agaagaaatgtttactagtatgt

SEQ ID NO: 135042 - DNA, 22 bp, Homo sapiens
tgactagaacatgatcatcata

SEQ ID NO: 135043 - DNA, 23 bp, Homo sapiens
tctatgtgctataaagttgtatg

SEQ ID NO: 135044 - DNA, 19 bp, Homo sapiens
ttcacaaagcatagctttt

SEQ ID NO: 135045 - DNA, 21 bp, Homo sapiens
tgagcactgtgtctttgctct

SEQ ID NO: 135046 - DNA, 23 bp, Homo sapiens
agtcagagtctggctctgtctct

SEQ ID NO: 135047 - DNA, 18 bp, Homo sapiens
cagtggtatgattttggc

SEQ ID NO: 135048 - DNA, 23 bp, Homo sapiens
tcccagagcccctggaactctgg

SEQ ID NO: 135049 - DNA, 23 bp, Homo sapiens
tcccagagcccctggaactctgg

SEQ ID NO: 135050 - DNA, 23 bp, Homo sapiens
tatacgtgtatatgtatatgtgt

SEQ ID NO: 135051 - DNA, 23 bp, Homo sapiens
atatgtgtatatgtgtatatgta

SEQ ID NO: 135052 - DNA, 23 bp, Homo sapiens
gtatcatgctcactttgtgtgac

SEQ ID NO: 135053 - DNA, 23 bp, Homo sapiens
tatgtatgtgtgtgtgtatatat

SEQ ID NO: 135054 - DNA, 23 bp, Homo sapiens
atgtgtgtgtatatatatgtgtg

SEQ ID NO: 135055 - DNA, 19 bp, Homo sapiens
atatacacacacatacata

SEQ ID NO: 135056 - DNA, 23 bp, Homo sapiens
ttgtgggtggcagttttctctag

SEQ ID NO: 135057 - DNA, 19 bp, Homo sapiens
acagtgttctagaaggaaa

SEQ ID NO: 135058 - DNA, 19 bp, Homo sapiens
tgtgctgtgtgtttgcact

SEQ ID NO: 135059 - DNA, 21 bp, Homo sapiens
aggagaggcaagtgtccagct

SEQ ID NO: 135060 - DNA, 22 bp, Homo sapiens
tgaaggcattttgtaaatgtga

SEQ ID NO: 135061 - DNA, 23 bp, Homo sapiens
tcagtccactgtgaccagcagat

SEQ ID NO: 135062 - DNA, 22 bp, Homo sapiens
gctgtccctgagtccctgtgtg

SEQ ID NO: 135063 - DNA, 23 bp, Homo sapiens
ttgtaggctggtcttgaattcct

SEQ ID NO: 135064 - DNA, 23 bp, Homo sapiens
tttgtctctggttctgcttatat

SEQ ID NO: 135065 - DNA, 18 bp, Homo sapiens
tttgcatatgttgcacca

SEQ ID NO: 135066 - DNA, 23 bp, Homo sapiens
ctgactgtgtgtgactctctctg

SEQ ID NO: 135067 - DNA, 23 bp, Homo sapiens
tgagttcattgtagattctggat

SEQ ID NO: 135068 - DNA, 23 bp, Homo sapiens
tgagttcattgtagattctggat

SEQ ID NO: 135069 - DNA, 22 bp, Homo sapiens
tatatgacatatatatatgtgt

SEQ ID NO: 135070 - DNA, 23 bp, Homo sapiens
tgtctctaaaaataaagagtaca

SEQ ID NO: 135071 - DNA, 20 bp, Homo sapiens
cactgtgatgctatgttgta

SEQ ID NO: 135072 - DNA, 23 bp, Homo sapiens
aattctttgatatttaaggaaaa

SEQ ID NO: 135073 - DNA, 23 bp, Homo sapiens
ggttagaaaggattttaaagtgt

SEQ ID NO: 135074 - DNA, 22 bp, Homo sapiens
tattggactgtagccacaccca

SEQ ID NO: 135075 - DNA, 23 bp, Homo sapiens
cctgtgtctatgtctgtgtccaa

SEQ ID NO: 135076 - DNA, 23 bp, Homo sapiens
tttcctcatgtgtgagtcctgct

SEQ ID NO: 135077 - DNA, 21 bp, Homo sapiens
taatatatttgtgtatgtgtg

SEQ ID NO: 135078 - DNA, 21 bp, Homo sapiens
gagtctcgctctgtctcccag

SEQ ID NO: 135079 - DNA, 19 bp, Homo sapiens
caaatggaagaatgcagta

SEQ ID NO: 135080 - DNA, 19 bp, Homo sapiens
tttcttactgttaggtctt

SEQ ID NO: 135081 - DNA, 20 bp, Homo sapiens
tcagatcaacctctggtgct

SEQ ID NO: 135082 - DNA, 18 bp, Homo sapiens
actgcagtcactgagcac

SEQ ID NO: 135083 - DNA, 23 bp, Homo sapiens
tggagtctcactctgtcacccag

SEQ ID NO: 135084 - DNA, 23 bp, Homo sapiens
ctgtctatttatctatatctgtc

SEQ ID NO: 135085 - DNA, 22 bp, Homo sapiens
atgtgtatatatacgtatgtgt

SEQ ID NO: 135086 - DNA, 22 bp, Homo sapiens
actcactcacacactcccagcc

SEQ ID NO: 135087 - DNA, 23 bp, Homo sapiens
gggtctcactctgtcacccaggc

SEQ ID NO: 135088 - DNA, 23 bp, Homo sapiens
tgaaagtgctgactgagcagaga

SEQ ID NO: 135089 - DNA, 18 bp, Homo sapiens
ctgttcacacactcctca

SEQ ID NO: 135090 - DNA, 22 bp, Homo sapiens
aaagagtgctgttcttccctta

SEQ ID NO: 135091 - DNA, 23 bp, Homo sapiens
agactcatccttgttggagtggt

SEQ ID NO: 135092 - DNA, 23 bp, Homo sapiens
tacatgtgcacaacgtgcaggtt

SEQ ID NO: 135093 - DNA, 23 bp, Homo sapiens
tatacgtacatgtacgtatacat

SEQ ID NO: 135094 - DNA, 18 bp, Homo sapiens
aaaaggatggaaagggta

SEQ ID NO: 135095 - DNA, 23 bp, Homo sapiens
tttgagacagagtctcgctctgt

SEQ ID NO: 135096 - DNA, 21 bp, Homo sapiens
tatatatatatgaactagttg

SEQ ID NO: 135097 - DNA, 23 bp, Homo sapiens
gggtgtctctctgtctctgtgtg

SEQ ID NO: 135098 - DNA, 21 bp, Homo sapiens
aatatgcgtgcatatcaaggc

SEQ ID NO: 135099 - DNA, 22 bp, Homo sapiens
caatcacagtttgcagtctcca

SEQ ID NO: 135100 - DNA, 23 bp, Homo sapiens
ttttttggttccatatgaaattt

SEQ ID NO: 135101 - DNA, 22 bp, Homo sapiens
gtgtgtgagaagactttctgtc

SEQ ID NO: 135102 - DNA, 23 bp, Homo sapiens
gagacggagtctcactctgtcac

SEQ ID NO: 135103 - DNA, 23 bp, Homo sapiens
taaagaaagaagagtaggcagat

SEQ ID NO: 135104 - DNA, 21 bp, Homo sapiens
attgatgttccttgtattgtt

SEQ ID NO: 135105 - DNA, 23 bp, Homo sapiens
cggagtctcactctgtcacccag

SEQ ID NO: 135106 - DNA, 20 bp, Homo sapiens
atgctaacttaggaaagttt

SEQ ID NO: 135107 - DNA, 23 bp, Homo sapiens
agcactttttcttttttgagacg

SEQ ID NO: 135108 - DNA, 20 bp, Homo sapiens
tctatcactcaggctaaagt

SEQ ID NO: 135109 - DNA, 23 bp, Homo sapiens
tcagtccctgtgtcagtctgaga

SEQ ID NO: 135110 - DNA, 21 bp, Homo sapiens
gtcactctgtctcccaggctg

SEQ ID NO: 135111 - DNA, 19 bp, Homo sapiens
acatacaatggaatattgt

SEQ ID NO: 135112 - DNA, 18 bp, Homo sapiens
agcgggactagattgcag

SEQ ID NO: 135113 - DNA, 23 bp, Homo sapiens
gtctctctctgtcacccaggctg

SEQ ID NO: 135114 - DNA, 22 bp, Homo sapiens
tgaggcaaagttctgagacact

SEQ ID NO: 135115 - DNA, 22 bp, Homo sapiens
tcagtgcactacagaactttgt

SEQ ID NO: 135116 - DNA, 18 bp, Homo sapiens
ctgaggaaagttgttttg

SEQ ID NO: 135117 - DNA, 23 bp, Homo sapiens
tgcattttaaggaagtgatactt

SEQ ID NO: 135118 - DNA, 22 bp, Homo sapiens
cactctgtgcctcactctcccc

SEQ ID NO: 135119 - DNA, 23 bp, Homo sapiens
tgagttcattgtagattctggat

SEQ ID NO: 135120 - DNA, 23 bp, Homo sapiens
tgagttcattgtagattctggat

SEQ ID NO: 135121 - DNA, 23 bp, Homo sapiens
tgagttcattgtagattctggat

SEQ ID NO: 135122 - DNA, 23 bp, Homo sapiens
tgagttcattgtagattctggat

SEQ ID NO: 135123 - DNA, 23 bp, Homo sapiens
tgagttcattgtagattctggat

SEQ ID NO: 135124 - DNA, 23 bp, Homo sapiens
tgagttcattgtagattctggat

SEQ ID NO: 135125 - DNA, 23 bp, Homo sapiens
tttgcatggctctcccacactct

SEQ ID NO: 135126 - DNA, 18 bp, Homo sapiens
gagtcagactctgtctca

SEQ ID NO: 135127 - DNA, 19 bp, Homo sapiens
tgtgtgtatataaatgtgt

SEQ ID NO: 135128 - DNA, 23 bp, Homo sapiens
atgtttctccatatctagagaga

SEQ ID NO: 135129 - DNA, 19 bp, Homo sapiens
tcccaggcagcctcttagc

SEQ ID NO: 135130 - DNA, 22 bp, Homo sapiens
atagcttcagtattcttgtctc

SEQ ID NO: 135131 - DNA, 20 bp, Homo sapiens
gtgtgacctagagtattggg

SEQ ID NO: 135132 - DNA, 23 bp, Homo sapiens
cagtgtcacacagttgtttgtaa

SEQ ID NO: 135133 - DNA, 23 bp, Homo sapiens
aatctgtacagtgacaggttttg

SEQ ID NO: 135134 - DNA, 23 bp, Homo sapiens
gaaatagagcaaggattagatga

SEQ ID NO: 135135 - DNA, 23 bp, Homo sapiens
ggagtctcactctgtcactcagg

SEQ ID NO: 135136 - DNA, 20 bp, Homo sapiens
tcactgtaaaatgaagaaag

SEQ ID NO: 135137 - DNA, 18 bp, Homo sapiens
tgtatatatatgtgtgtg

SEQ ID NO: 135138 - DNA, 23 bp, Homo sapiens
tatatgtgtatatgtaaatgtgt

SEQ ID NO: 135139 - DNA, 23 bp, Homo sapiens
tgagacagagtctcgctctgtcg

SEQ ID NO: 135140 - DNA, 18 bp, Homo sapiens
aaaaacatttagaatttg

SEQ ID NO: 135141 - DNA, 22 bp, Homo sapiens
ttctctcagcattttcttgtca

SEQ ID NO: 135142 - DNA, 19 bp, Homo sapiens
agaaactgaactgggagaa

SEQ ID NO: 135143 - DNA, 23 bp, Homo sapiens
cagagtctcactctgtcactcag

SEQ ID NO: 135144 - DNA, 23 bp, Homo sapiens
caggagtcaaattgttgtagaga

SEQ ID NO: 135145 - DNA, 23 bp, Homo sapiens
tctactctgagtgcttgaggtga

SEQ ID NO: 135146 - DNA, 23 bp, Homo sapiens
agacagtgtcttgctctgtcacc

SEQ ID NO: 135147 - DNA, 23 bp, Homo sapiens
gggtctcactctgtcacccaggc

SEQ ID NO: 135148 - DNA, 23 bp, Homo sapiens
tgtgtgtgtgtcagtcagagtct

SEQ ID NO: 135149 - DNA, 21 bp, Homo sapiens
tctcgccctgtcacccaggct

SEQ ID NO: 135150 - DNA, 22 bp, Homo sapiens
taaaatcatggactggctttct

SEQ ID NO: 135151 - DNA, 19 bp, Homo sapiens
aaaagctccttctctcact

SEQ ID NO: 135152 - DNA, 23 bp, Homo sapiens
ttgtgatacagaaatttagaagt

SEQ ID NO: 135153 - DNA, 21 bp, Homo sapiens
acatgtgcacattgtgcaggt

SEQ ID NO: 135154 - DNA, 23 bp, Homo sapiens
tgagttcattgtagattctggat

SEQ ID NO: 135155 - DNA, 23 bp, Homo sapiens
tgagttcattgtagattctggat

SEQ ID NO: 135156 - DNA, 18 bp, Homo sapiens
agtctcgctctgtctccc

SEQ ID NO: 135157 - DNA, 23 bp, Homo sapiens
tagagtctcactctgtcacccag

SEQ ID NO: 135158 - DNA, 22 bp, Homo sapiens
tgaggtagaaggatcagttgag

SEQ ID NO: 135159 - DNA, 23 bp, Homo sapiens
gagatggagtctcactctgtcac

SEQ ID NO: 135160 - DNA, 21 bp, Homo sapiens
gattacatagtaatgtgaagg

SEQ ID NO: 135161 - DNA, 19 bp, Homo sapiens
ttgtagcccattttaatgt

SEQ ID NO: 135162 - DNA, 23 bp, Homo sapiens
ttctaattatcgttctctgattt

SEQ ID NO: 135163 - DNA, 23 bp, Homo sapiens
tgagttcattgtagattctggat

SEQ ID NO: 135164 - DNA, 23 bp, Homo sapiens
tgagttcattgtagattctggat

SEQ ID NO: 135165 - DNA, 23 bp, Homo sapiens
ttgagacagtctcattctgtcac

SEQ ID NO: 135166 - DNA, 19 bp, Homo sapiens
ggtgtgatcatggctcact

SEQ ID NO: 135167 - DNA, 23 bp, Homo sapiens
cagagtctcactctgtggctcag

SEQ ID NO: 135168 - DNA, 20 bp, Homo sapiens
atacacacatacgtgtgtgt

SEQ ID NO: 135169 - DNA, 23 bp, Homo sapiens
tgtgtgcctctgtgtctggctgt

SEQ ID NO: 135170 - DNA, 20 bp, Homo sapiens
atgagtatccttctggagtg

SEQ ID NO: 135171 - DNA, 23 bp, Homo sapiens
gacagagtctcgctctgtcaccc

SEQ ID NO: 135172 - DNA, 23 bp, Homo sapiens
acagagtctcgctctgtcaccca

SEQ ID NO: 135173 - DNA, 23 bp, Homo sapiens
gtcattaccaacacttgttatct

SEQ ID NO: 135174 - DNA, 20 bp, Homo sapiens
tggaactatatctatgtgta

SEQ ID NO: 135175 - DNA, 23 bp, Homo sapiens
gagatggagtctcactctgtcac

SEQ ID NO: 135176 - DNA, 23 bp, Homo sapiens
tattcttcttcatatggatagtt

SEQ ID NO: 135177 - DNA, 23 bp, Homo sapiens
ccatttgttgaagagactatcct

SEQ ID NO: 135178 - DNA, 23 bp, Homo sapiens
ttttttttggagacggagtcttg

SEQ ID NO: 135179 - DNA, 23 bp, Homo sapiens
tttatgtaccataagaaagcaaa

SEQ ID NO: 135180 - DNA, 19 bp, Homo sapiens
tcactgtgaggtaagtagg

SEQ ID NO: 135181 - DNA, 23 bp, Homo sapiens
agagtctcactctgtcatccagg

SEQ ID NO: 135182 - DNA, 21 bp, Homo sapiens
tttgctccttggtgaagccat

SEQ ID NO: 135183 - DNA, 23 bp, Homo sapiens
taaatttgaatttcattgcagtt

SEQ ID NO: 135184 - DNA, 23 bp, Homo sapiens
acagagtctcgctctgtcgctca

SEQ ID NO: 135185 - DNA, 23 bp, Homo sapiens
cactctctcactcttttgcatgt

SEQ ID NO: 135186 - DNA, 19 bp, Homo sapiens
aagagctcctccaggacaa

SEQ ID NO: 135187 - DNA, 19 bp, Homo sapiens
aagagaaagccatatctag

SEQ ID NO: 135188 - DNA, 23 bp, Homo sapiens
tgagttcattgtagattctggat

SEQ ID NO: 135189 - DNA, 23 bp, Homo sapiens
tgagttcattgtagattctggat

SEQ ID NO: 135190 - DNA, 23 bp, Homo sapiens
tatggggtacaaagtgatgttat

SEQ ID NO: 135191 - DNA, 23 bp, Homo sapiens
cacagtgtgtgtgtgtgtgtgtg

SEQ ID NO: 135192 - DNA, 23 bp, Homo sapiens
aaggagagataatttgatgtctt

SEQ ID NO: 135193 - DNA, 23 bp, Homo sapiens
tatgactagagactttttgtttc

SEQ ID NO: 135194 - DNA, 23 bp, Homo sapiens
tttattgtactttaagttctgtg

SEQ ID NO: 135195 - DNA, 23 bp, Homo sapiens
tgagttcattgtagattctggat

SEQ ID NO: 135196 - DNA, 23 bp, Homo sapiens
tgagttcattgtagattctggat

SEQ ID NO: 135197 - DNA, 23 bp, Homo sapiens
tgagttcattgtagattctggat

SEQ ID NO: 135198 - DNA, 19 bp, Homo sapiens
tgattagtgtggatatcca

SEQ ID NO: 135199 - DNA, 22 bp, Homo sapiens
ttcactttggttgatatttggg

SEQ ID NO: 135200 - DNA, 23 bp, Homo sapiens
aaacagagtctcgctctgtcatc

SEQ ID NO: 135201 - DNA, 23 bp, Homo sapiens
aggacagagacttttcagtgttc

SEQ ID NO: 135202 - DNA, 23 bp, Homo sapiens
agaattgatgatgtttgagtgca

SEQ ID NO: 135203 - DNA, 19 bp, Homo sapiens
tgtatatatgtatatctgt

SEQ ID NO: 135204 - DNA, 18 bp, Homo sapiens
tatacacacatacacatg

SEQ ID NO: 135205 - DNA, 23 bp, Homo sapiens
tgtggcagtgtcaccagtgcatg

SEQ ID NO: 135206 - DNA, 21 bp, Homo sapiens
attgtgtgtgtgtgtgtgcat

SEQ ID NO: 135207 - DNA, 19 bp, Homo sapiens
aaatgtgtatatatatatg

SEQ ID NO: 135208 - DNA, 22 bp, Homo sapiens
tatatgcatataaacatatgtg

SEQ ID NO: 135209 - DNA, 19 bp, Homo sapiens
tgtgcatatatttatatgt

SEQ ID NO: 135210 - DNA, 18 bp, Homo sapiens
tcactgcaatcttgctca

SEQ ID NO: 135211 - DNA, 23 bp, Homo sapiens
acagagtctcactctgtcgccca

SEQ ID NO: 135212 - DNA, 23 bp, Homo sapiens
acactcgtggcttctgagctctt

SEQ ID NO: 135213 - DNA, 21 bp, Homo sapiens
acttttctttgattatttatc

SEQ ID NO: 135214 - DNA, 21 bp, Homo sapiens
aaattgctgtatcaggatata

SEQ ID NO: 135215 - DNA, 21 bp, Homo sapiens
atatgttcagttttagtagat

SEQ ID NO: 135216 - DNA, 22 bp, Homo sapiens
atacgtgtatatatatatgtgt

SEQ ID NO: 135217 - DNA, 20 bp, Homo sapiens
actatgttgatcaagctggt

SEQ ID NO: 135218 - DNA, 22 bp, Homo sapiens
tgaggtagtatgtagatatata

SEQ ID NO: 135219 - DNA, 21 bp, Homo sapiens
tattcatatatattgaatagt

SEQ ID NO: 135220 - DNA, 23 bp, Homo sapiens
tatgttaatagttttgatgctaa

SEQ ID NO: 135221 - DNA, 20 bp, Homo sapiens
attatgttcttgagaaaggt

SEQ ID NO: 135222 - DNA, 22 bp, Homo sapiens
gaacagaattttctaaaactgt

SEQ ID NO: 135223 - DNA, 22 bp, Homo sapiens
tcattctgtcacccagactgga

SEQ ID NO: 135224 - DNA, 23 bp, Homo sapiens
tgagacagtgtctcactccgtca

SEQ ID NO: 135225 - DNA, 23 bp, Homo sapiens
agatactaagttgaagtggtctt

SEQ ID NO: 135226 - DNA, 22 bp, Homo sapiens
tgagcttcaaagtagattttta

SEQ ID NO: 135227 - DNA, 23 bp, Homo sapiens
ctatatatcatatcgatctatat

SEQ ID NO: 135228 - DNA, 19 bp, Homo sapiens
aatctgaaacttttgtcct

SEQ ID NO: 135229 - DNA, 18 bp, Homo sapiens
agacaaggtctcactgtc

SEQ ID NO: 135230 - DNA, 20 bp, Homo sapiens
tgaggtaggaggatcacttg

SEQ ID NO: 135231 - DNA, 19 bp, Homo sapiens
agtgaagtgccattagact

SEQ ID NO: 135232 - DNA, 22 bp, Homo sapiens
tagtttttttccaattctgtga

SEQ ID NO: 135233 - DNA, 23 bp, Homo sapiens
gactgagtctcgctctgtcaccc

SEQ ID NO: 135234 - DNA, 21 bp, Homo sapiens
tcacaggactttattactttc

SEQ ID NO: 135235 - DNA, 23 bp, Homo sapiens
attgtctgcctttgatatctcac

SEQ ID NO: 135236 - DNA, 23 bp, Homo sapiens
tatggctctgtgcctgccagcct

SEQ ID NO: 135237 - DNA, 19 bp, Homo sapiens
atctatatatgtatatcta

SEQ ID NO: 135238 - DNA, 23 bp, Homo sapiens
aatgacagcatatgatgatgctt

SEQ ID NO: 135239 - DNA, 23 bp, Homo sapiens
gagagaggaattcatttgcatgc

SEQ ID NO: 135240 - DNA, 23 bp, Homo sapiens
tgagttcattgtagattctggat

SEQ ID NO: 135241 - DNA, 23 bp, Homo sapiens
gtctgagtctcgctgtgtcaccc

SEQ ID NO: 135242 - DNA, 23 bp, Homo sapiens
tatctgtatctgtatatgaatgt

SEQ ID NO: 135243 - DNA, 18 bp, Homo sapiens
tacattcatgtacatgta

SEQ ID NO: 135244 - DNA, 20 bp, Homo sapiens
aaatgtgcaaaatgtataaa

SEQ ID NO: 135245 - DNA, 23 bp, Homo sapiens
tgagttcattgtagattctggat

SEQ ID NO: 135246 - DNA, 23 bp, Homo sapiens
tgagttcattgtagattctggat

SEQ ID NO: 135247 - DNA, 20 bp, Homo sapiens
tagggactctctgtctctct

SEQ ID NO: 135248 - DNA, 23 bp, Homo sapiens
tttgttgtttttgcttaggattg

SEQ ID NO: 135249 - DNA, 22 bp, Homo sapiens
ttctgtgaagaaagtcaatagt

SEQ ID NO: 135250 - DNA, 23 bp, Homo sapiens
tagtgtatatatatatgtgtgtg

SEQ ID NO: 135251 - DNA, 23 bp, Homo sapiens
atacacacacatatatatgacca

SEQ ID NO: 135252 - DNA, 23 bp, Homo sapiens
atacacacatgtgtacatgtgta

SEQ ID NO: 135253 - DNA, 23 bp, Homo sapiens
tgaagacagcacatatttggttt

SEQ ID NO: 135254 - DNA, 22 bp, Homo sapiens
aggaaatgaattcactatggat

SEQ ID NO: 135255 - DNA, 18 bp, Homo sapiens
ttgaaatgatttcctagg

SEQ ID NO: 135256 - DNA, 23 bp, Homo sapiens
gttgtagtgagctatgattgcac

SEQ ID NO: 135257 - DNA, 23 bp, Homo sapiens
atacatgtatacatatgattttg

SEQ ID NO: 135258 - DNA, 23 bp, Homo sapiens
tgagttcattgtagattctggat

SEQ ID NO: 135259 - DNA, 23 bp, Homo sapiens
tgagttcattgtagattctggat

SEQ ID NO: 135260 - DNA, 19 bp, Homo sapiens
gtggttttgatttgcattt

SEQ ID NO: 135261 - DNA, 19 bp, Homo sapiens
atgattagtgatgctgaac

SEQ ID NO: 135262 - DNA, 21 bp, Homo sapiens
tctgagaaatgtctttcagat

SEQ ID NO: 135263 - DNA, 23 bp, Homo sapiens
ttaaggctcaggtagaaatcaga

SEQ ID NO: 135264 - DNA, 22 bp, Homo sapiens
agagtatatatatacatgtgtg

SEQ ID NO: 135265 - DNA, 22 bp, Homo sapiens
tttgagttgagagagattgagg

SEQ ID NO: 135266 - DNA, 21 bp, Homo sapiens
ttttagagggtgaattggtta

SEQ ID NO: 135267 - DNA, 20 bp, Homo sapiens
aatgagaccctgtctttttt

SEQ ID NO: 135268 - DNA, 19 bp, Homo sapiens
tgagatggagtctcactct

SEQ ID NO: 135269 - DNA, 23 bp, Homo sapiens
gtgtgtgagtgtgtgtgcgggtg

SEQ ID NO: 135270 - DNA, 22 bp, Homo sapiens
attctgtgaagaaagtccatgg

SEQ ID NO: 135271 - DNA, 19 bp, Homo sapiens
tgtgtatatacatatgtgt

SEQ ID NO: 135272 - DNA, 20 bp, Homo sapiens
taatgcatattatatatatg

SEQ ID NO: 135273 - DNA, 23 bp, Homo sapiens
taagaggaccaaaatgatagagt

SEQ ID NO: 135274 - DNA, 21 bp, Homo sapiens
tgataacataagcagctttgg

SEQ ID NO: 135275 - DNA, 23 bp, Homo sapiens
ttaaccaaatattttcagaattg

SEQ ID NO: 135276 - DNA, 23 bp, Homo sapiens
ttacagtttaacaaatatggctt

SEQ ID NO: 135277 - DNA, 23 bp, Homo sapiens
tgagatggagtctcactctgtcg

SEQ ID NO: 135278 - DNA, 22 bp, Homo sapiens
atatatatgatgctgtatatgt

SEQ ID NO: 135279 - DNA, 23 bp, Homo sapiens
agtgatagtgtcaggtttgcctt

SEQ ID NO: 135280 - DNA, 22 bp, Homo sapiens
attagcataaaaatagacaatg

SEQ ID NO: 135281 - DNA, 23 bp, Homo sapiens
atctaattttagttcctgaggaa

SEQ ID NO: 135282 - DNA, 23 bp, Homo sapiens
ataagaatacaaacacataaggt

SEQ ID NO: 135283 - DNA, 21 bp, Homo sapiens
tgcaaatgacagggttttgtt

SEQ ID NO: 135284 - DNA, 21 bp, Homo sapiens
tatatgctttttatgtaaggt

SEQ ID NO: 135285 - DNA, 23 bp, Homo sapiens
attgaagttatatacgtttgtga

SEQ ID NO: 135286 - DNA, 23 bp, Homo sapiens
tcactctctctgtgctgagccac

SEQ ID NO: 135287 - DNA, 22 bp, Homo sapiens
atatacacacagatatatgtgt

SEQ ID NO: 135288 - DNA, 23 bp, Homo sapiens
tgagttcattgtagattctggat

SEQ ID NO: 135289 - DNA, 23 bp, Homo sapiens
tgagttcattgtagattctggat

SEQ ID NO: 135290 - DNA, 23 bp, Homo sapiens
tgagttcattgtagattctggat

SEQ ID NO: 135291 - DNA, 23 bp, Homo sapiens
tgagttcattgtagattctggat

SEQ ID NO: 135292 - DNA, 23 bp, Homo sapiens
atattgtggttatgcacctggga

SEQ ID NO: 135293 - DNA, 22 bp, Homo sapiens
ttatctgagatctaggtgacag

SEQ ID NO: 135294 - DNA, 23 bp, Homo sapiens
tctgctgaacatcctgatttctg

SEQ ID NO: 135295 - DNA, 18 bp, Homo sapiens
tatgaatatatttgtaaa

SEQ ID NO: 135296 - DNA, 23 bp, Homo sapiens
tctttgattttgtatctctttgg

SEQ ID NO: 135297 - DNA, 21 bp, Homo sapiens
acaggctctctcagtggctct

SEQ ID NO: 135298 - DNA, 23 bp, Homo sapiens
tatgtctatataggtatgtgtgt

SEQ ID NO: 135299 - DNA, 23 bp, Homo sapiens
atacatctatgtgtatactatgg

SEQ ID NO: 135300 - DNA, 22 bp, Homo sapiens
ttgcatcaatttttagttttga

SEQ ID NO: 135301 - DNA, 23 bp, Homo sapiens
tatatatatatgttttcagaccg

SEQ ID NO: 135302 - DNA, 23 bp, Homo sapiens
tagtgtatagaaatgaaactgat

SEQ ID NO: 135303 - DNA, 23 bp, Homo sapiens
tcagtttcatatctatacactaa

SEQ ID NO: 135304 - DNA, 23 bp, Homo sapiens
agtatgtgtatgtgtatatgtat

SEQ ID NO: 135305 - DNA, 21 bp, Homo sapiens
gtgtccgtgtgtgcatgcgtg

SEQ ID NO: 135306 - DNA, 21 bp, Homo sapiens
atatgtgaatatatatgtgta

SEQ ID NO: 135307 - DNA, 23 bp, Homo sapiens
ttaaatctaaatgagctgattcc

SEQ ID NO: 135308 - DNA, 22 bp, Homo sapiens
actcccctgtccttttgtgtgg

SEQ ID NO: 135309 - DNA, 23 bp, Homo sapiens
ataggctgacagaaaggagagtg

SEQ ID NO: 135310 - DNA, 18 bp, Homo sapiens
cagtggtaacttgatcag

SEQ ID NO: 135311 - DNA, 23 bp, Homo sapiens
tcagagtctcgctctgtctccca

SEQ ID NO: 135312 - DNA, 22 bp, Homo sapiens
aggaggtggagattgcagttag

SEQ ID NO: 135313 - DNA, 22 bp, Homo sapiens
atttgaattttaatgcagaaag

SEQ ID NO: 135314 - DNA, 23 bp, Homo sapiens
atatcatatgtacctgttgattt

SEQ ID NO: 135315 - DNA, 22 bp, Homo sapiens
ttaaatgtgtgctatgaattga

SEQ ID NO: 135316 - DNA, 22 bp, Homo sapiens
gacggactctggctctgtcgcc

SEQ ID NO: 135317 - DNA, 23 bp, Homo sapiens
gaagataagtgactatgtagaag

SEQ ID NO: 135318 - DNA, 19 bp, Homo sapiens
catagctcattattgctga

SEQ ID NO: 135319 - DNA, 23 bp, Homo sapiens
tacgtgtatatatatatgtgtgt

SEQ ID NO: 135320 - DNA, 18 bp, Homo sapiens
atttcacttgcttgtgac

SEQ ID NO: 135321 - DNA, 23 bp, Homo sapiens
gaaatgtagtcagtttctcaaac

SEQ ID NO: 135322 - DNA, 23 bp, Homo sapiens
taaatatacatatgaatacatta

SEQ ID NO: 135323 - DNA, 18 bp, Homo sapiens
acgtatatatacatgtat

SEQ ID NO: 135324 - DNA, 18 bp, Homo sapiens
acgtatatatacatgtat

SEQ ID NO: 135325 - DNA, 18 bp, Homo sapiens
taatgtttgtgaagcatt

SEQ ID NO: 135326 - DNA, 23 bp, Homo sapiens
tcttttttggttccttatgaaat

SEQ ID NO: 135327 - DNA, 18 bp, Homo sapiens
atggtgtgagatactgtt

SEQ ID NO: 135328 - DNA, 23 bp, Homo sapiens
gggtctcactctgtcacccaggc

SEQ ID NO: 135329 - DNA, 23 bp, Homo sapiens
aagatttggacttcttgtcatga

SEQ ID NO: 135330 - DNA, 23 bp, Homo sapiens
tgagttcattgtagattctggat

SEQ ID NO: 135331 - DNA, 23 bp, Homo sapiens
tgagttcattgtagattctggat

SEQ ID NO: 135332 - DNA, 21 bp, Homo sapiens
ttggctctgaattaccatctc

SEQ ID NO: 135333 - DNA, 23 bp, Homo sapiens
ggatggtagtagttttagcagac

SEQ ID NO: 135334 - DNA, 21 bp, Homo sapiens
tctctttctctgcctctgttg

SEQ ID NO: 135335 - DNA, 23 bp, Homo sapiens
attatgtcttggttttgatattt

SEQ ID NO: 135336 - DNA, 23 bp, Homo sapiens
tatatataaactgtatatgttat

SEQ ID NO: 135337 - DNA, 19 bp, Homo sapiens
acatatatacgtagacaca

SEQ ID NO: 135338 - DNA, 21 bp, Homo sapiens
tatgtatatatgtatatatgt

SEQ ID NO: 135339 - DNA, 22 bp, Homo sapiens
tatatacatgtgtatctatgta

SEQ ID NO: 135340 - DNA, 23 bp, Homo sapiens
gtgtgtatatatgtatctattgt

SEQ ID NO: 135341 - DNA, 20 bp, Homo sapiens
tacgtacatgtatgtgtact

SEQ ID NO: 135342 - DNA, 23 bp, Homo sapiens
tatatagcagatatacatgcatg

SEQ ID NO: 135343 - DNA, 22 bp, Homo sapiens
taaatgtctggggaaattatct

SEQ ID NO: 135344 - DNA, 21 bp, Homo sapiens
agcttgaaggttgttttgttc

SEQ ID NO: 135345 - DNA, 23 bp, Homo sapiens
tgagttcattgtagattctggat

SEQ ID NO: 135346 - DNA, 23 bp, Homo sapiens
tgagttcattgtagattctggat

SEQ ID NO: 135347 - DNA, 18 bp, Homo sapiens
atgtaaataaatatatgt

SEQ ID NO: 135348 - DNA, 20 bp, Homo sapiens
atgtgtgtgtgtatatatac

SEQ ID NO: 135349 - DNA, 23 bp, Homo sapiens
tatacgtgtatatatatatgtgt

SEQ ID NO: 135350 - DNA, 19 bp, Homo sapiens
agaaagaacagttacagtt

SEQ ID NO: 135351 - DNA, 23 bp, Homo sapiens
tttctcactacacacactgtcag

SEQ ID NO: 135352 - DNA, 21 bp, Homo sapiens
tatagatatctatatctatct

SEQ ID NO: 135353 - DNA, 21 bp, Homo sapiens
tatatctgtagatatctatag

SEQ ID NO: 135354 - DNA, 22 bp, Homo sapiens
tgtgtgcttggttgtgtgcatt

SEQ ID NO: 135355 - DNA, 23 bp, Homo sapiens
tactatgtactagacaacctcac

SEQ ID NO: 135356 - DNA, 23 bp, Homo sapiens
ttactctctctcatatttatgca

SEQ ID NO: 135357 - DNA, 22 bp, Homo sapiens
ttatattgatctatgtcgttag

SEQ ID NO: 135358 - DNA, 23 bp, Homo sapiens
atatgtatccatatctatagaca

SEQ ID NO: 135359 - DNA, 20 bp, Homo sapiens
tggctggcagcctctgtccc

SEQ ID NO: 135360 - DNA, 23 bp, Homo sapiens
tttccattccatttcaatgtttt

SEQ ID NO: 135361 - DNA, 23 bp, Homo sapiens
acagtggaaaagtttagtagact

SEQ ID NO: 135362 - DNA, 18 bp, Homo sapiens
tgttgcacttgtcaggag

SEQ ID NO: 135363 - DNA, 23 bp, Homo sapiens
atggctttttttttctatttcaa

SEQ ID NO: 135364 - DNA, 23 bp, Homo sapiens
ttgagtgtgatattgatgtttgg

SEQ ID NO: 135365 - DNA, 23 bp, Homo sapiens
ccacacagtatctgtctctgtca

SEQ ID NO: 135366 - DNA, 19 bp, Homo sapiens
tgtgtatatatgtgtgtgt

SEQ ID NO: 135367 - DNA, 19 bp, Homo sapiens
agcacactgatgggtcttg

SEQ ID NO: 135368 - DNA, 19 bp, Homo sapiens
tagagaagtgtcgatactg

SEQ ID NO: 135369 - DNA, 23 bp, Homo sapiens
tctgccttctgtcagtgtcacaa

SEQ ID NO: 135370 - DNA, 23 bp, Homo sapiens
agagtctcactctgtcacccagg

SEQ ID NO: 135371 - DNA, 23 bp, Homo sapiens
gacagagtctcgctctgtcaccc

SEQ ID NO: 135372 - DNA, 23 bp, Homo sapiens
gatggagtctcactctgtcaccc

SEQ ID NO: 135373 - DNA, 21 bp, Homo sapiens
cccctgaagttttctgttagc

SEQ ID NO: 135374 - DNA, 22 bp, Homo sapiens
taacactggcagctttcaagga

SEQ ID NO: 135375 - DNA, 20 bp, Homo sapiens
tagtgcatgaataaattagc

SEQ ID NO: 135376 - DNA, 23 bp, Homo sapiens
atataatgttacatatattatgt

SEQ ID NO: 135377 - DNA, 23 bp, Homo sapiens
tgagttcattgtagattctggat

SEQ ID NO: 135378 - DNA, 23 bp, Homo sapiens
tgagttcattgtagattctggat

SEQ ID NO: 135379 - DNA, 23 bp, Homo sapiens
cctgctcttctcactgtcgtaag

SEQ ID NO: 135380 - DNA, 23 bp, Homo sapiens
ttgacagaagtttgacagctcag

SEQ ID NO: 135381 - DNA, 23 bp, Homo sapiens
ttgaaagacagtagtgtgtagtt

SEQ ID NO: 135382 - DNA, 23 bp, Homo sapiens
aaaactgacttcttggtgttacg

SEQ ID NO: 135383 - DNA, 20 bp, Homo sapiens
gctttttaaatgtttctgta

SEQ ID NO: 135384 - DNA, 23 bp, Homo sapiens
agcgtctctccctcactctgcct

SEQ ID NO: 135385 - DNA, 21 bp, Homo sapiens
tctctgcgtctgtcccgctgt

SEQ ID NO: 135386 - DNA, 23 bp, Homo sapiens
ggagtgtctctctgtcgctcagg

SEQ ID NO: 135387 - DNA, 23 bp, Homo sapiens
gagtctcactctgtcacccaggc

SEQ ID NO: 135388 - DNA, 22 bp, Homo sapiens
tgggatctagaggggaaagtgg

SEQ ID NO: 135389 - DNA, 18 bp, Homo sapiens
acaggaattacatctggt

SEQ ID NO: 135390 - DNA, 21 bp, Homo sapiens
atattcccagctattcaggag

SEQ ID NO: 135391 - DNA, 22 bp, Homo sapiens
ttttgagacagagtctcactct

SEQ ID NO: 135392 - DNA, 23 bp, Homo sapiens
gcagagtctcgctctgtcaccca

SEQ ID NO: 135393 - DNA, 22 bp, Homo sapiens
attctgcattatgacgagttgt

SEQ ID NO: 135394 - DNA, 22 bp, Homo sapiens
ttacctctgctactttaaactc

SEQ ID NO: 135395 - DNA, 19 bp, Homo sapiens
aaaacactaacttacctga

SEQ ID NO: 135396 - DNA, 23 bp, Homo sapiens
tgagacggagtctggctgtgtcg

SEQ ID NO: 135397 - DNA, 23 bp, Homo sapiens
tttgcttcctctacttgtgttaa

SEQ ID NO: 135398 - DNA, 23 bp, Homo sapiens
actgtgagtctctgtgattttgc

SEQ ID NO: 135399 - DNA, 20 bp, Homo sapiens
agagttgatggtttttggtt

SEQ ID NO: 135400 - DNA, 22 bp, Homo sapiens
ttgagacagtcttgctctgtca

SEQ ID NO: 135401 - DNA, 21 bp, Homo sapiens
tctcactctgtcacccaggct

SEQ ID NO: 135402 - DNA, 23 bp, Homo sapiens
ttctgggtatatatatgtgtgtg

SEQ ID NO: 135403 - DNA, 23 bp, Homo sapiens
tatatatgtatttaaggctaggt

SEQ ID NO: 135404 - DNA, 23 bp, Homo sapiens
attttaaaagttacagaaaaaga

SEQ ID NO: 135405 - DNA, 22 bp, Homo sapiens
ctctgtcacccagactagagtg

SEQ ID NO: 135406 - DNA, 23 bp, Homo sapiens
atgcttctttctaagcagcctga

SEQ ID NO: 135407 - DNA, 22 bp, Homo sapiens
gtcagaagtaatctgttgctgg

SEQ ID NO: 135408 - DNA, 23 bp, Homo sapiens
agagtctcgctctgtcaccccca

SEQ ID NO: 135409 - DNA, 21 bp, Homo sapiens
acagtgggacaagattgacat

SEQ ID NO: 135410 - DNA, 22 bp, Homo sapiens
tgagatgaagtctcgctctgtt

SEQ ID NO: 135411 - DNA, 22 bp, Homo sapiens
ttgagacagggtctcactctat

SEQ ID NO: 135412 - DNA, 21 bp, Homo sapiens
atagtctatgtagtttacata

SEQ ID NO: 135413 - DNA, 23 bp, Homo sapiens
tgaatagagtgaaaacagagctg

SEQ ID NO: 135414 - DNA, 20 bp, Homo sapiens
gtaagagcaagtggatttgg

SEQ ID NO: 135415 - DNA, 23 bp, Homo sapiens
tcggagtctcgctctgtcaccca

SEQ ID NO: 135416 - DNA, 23 bp, Homo sapiens
agagtctcactctgtcacccagg

SEQ ID NO: 135417 - DNA, 23 bp, Homo sapiens
agagtctcactctgtcacccagg

SEQ ID NO: 135418 - DNA, 23 bp, Homo sapiens
agacagagtctcgctctgtcacc

SEQ ID NO: 135419 - DNA, 23 bp, Homo sapiens
tgtctcgaaaaaaaaagaaaaat

SEQ ID NO: 135420 - DNA, 20 bp, Homo sapiens
tgagacagagtctccctctg

SEQ ID NO: 135421 - DNA, 23 bp, Homo sapiens
ttcaggtgattctcctgcctcag

SEQ ID NO: 135422 - DNA, 23 bp, Homo sapiens
agagggtctggatgaggagagcc

SEQ ID NO: 135423 - DNA, 23 bp, Homo sapiens
tgtctctccatctctgactgttt

SEQ ID NO: 135424 - DNA, 23 bp, Homo sapiens
actgagtctcactctgtcgccca

SEQ ID NO: 135425 - DNA, 23 bp, Homo sapiens
tcagactacacagtgcctgcttc

SEQ ID NO: 135426 - DNA, 23 bp, Homo sapiens
tcagtgtctcgctgtgtcacccg

SEQ ID NO: 135427 - DNA, 23 bp, Homo sapiens
actgagtctcactctgtcgccca

SEQ ID NO: 135428 - DNA, 23 bp, Homo sapiens
tctaaaagtgctgggattacagg

SEQ ID NO: 135429 - DNA, 23 bp, Homo sapiens
actctgtcacccagtctacagtg

SEQ ID NO: 135430 - DNA, 23 bp, Homo sapiens
actcagtcacccagtctgtgcag

SEQ ID NO: 135431 - DNA, 22 bp, Homo sapiens
ttgacagaagagagacatgtga

SEQ ID NO: 135432 - DNA, 19 bp, Homo sapiens
ttctttttgaagctgaagt

SEQ ID NO: 135433 - DNA, 23 bp, Homo sapiens
gtgccagcctgggtccctgaatc

SEQ ID NO: 135434 - DNA, 21 bp, Homo sapiens
tatgtgtgtatatatatgtat

SEQ ID NO: 135435 - DNA, 22 bp, Homo sapiens
agtttcaggcattttctagtct

SEQ ID NO: 135436 - DNA, 23 bp, Homo sapiens
taatcagagtgtctctttttttt

SEQ ID NO: 135437 - DNA, 23 bp, Homo sapiens
tttgagatggagtcttgctctgt

SEQ ID NO: 135438 - DNA, 21 bp, Homo sapiens
tgtctcagtgattggctttct

SEQ ID NO: 135439 - DNA, 22 bp, Homo sapiens
tctccctctctctctgcatata

SEQ ID NO: 135440 - DNA, 21 bp, Homo sapiens
acacatgcaccatcacataca

SEQ ID NO: 135441 - DNA, 22 bp, Homo sapiens
atcagttggctatagctgtgtg

SEQ ID NO: 135442 - DNA, 23 bp, Homo sapiens
gttgaacaggatgtgttttggag

SEQ ID NO: 135443 - DNA, 19 bp, Homo sapiens
agactgtcttgctctgtca

SEQ ID NO: 135444 - DNA, 23 bp, Homo sapiens
agtgtacaactatatgtgttgaa

SEQ ID NO: 135445 - DNA, 21 bp, Homo sapiens
ttcttgacatatttcagttct

SEQ ID NO: 135446 - DNA, 21 bp, Homo sapiens
atcagctgtgtatcgaggcag

SEQ ID NO: 135447 - DNA, 23 bp, Homo sapiens
actctgcctgagtccctggctgt

SEQ ID NO: 135448 - DNA, 23 bp, Homo sapiens
actctgcctgggtccctggctgt

SEQ ID NO: 135449 - DNA, 23 bp, Homo sapiens
caggtgagacagaggtgggtgtt

SEQ ID NO: 135450 - DNA, 23 bp, Homo sapiens
tttgtgtatggatatctactttt

SEQ ID NO: 135451 - DNA, 18 bp, Homo sapiens
tcaccaccttgtgcactg

SEQ ID NO: 135452 - DNA, 22 bp, Homo sapiens
tagcagcacataatggtttgaa

SEQ ID NO: 135453 - DNA, 22 bp, Homo sapiens
tttgtctgtcaaattattgtgt

SEQ ID NO: 135454 - DNA, 22 bp, Homo sapiens
tgacccagtgagtctctgtctc

SEQ ID NO: 135455 - DNA, 19 bp, Homo sapiens
cagggtgagtgattttttt

SEQ ID NO: 135456 - DNA, 23 bp, Homo sapiens
ttttgagatggattctcactctg

SEQ ID NO: 135457 - DNA, 20 bp, Homo sapiens
agacacaatgcatttctttt

SEQ ID NO: 135458 - DNA, 18 bp, Homo sapiens
tatgtataattatatttg

SEQ ID NO: 135459 - DNA, 21 bp, Homo sapiens
tttcactgtagaatgtgagct

SEQ ID NO: 135460 - DNA, 18 bp, Homo sapiens
tacagtgagctgagatcg

SEQ ID NO: 135461 - DNA, 23 bp, Homo sapiens
tgagttcattgtagattctggat

SEQ ID NO: 135462 - DNA, 23 bp, Homo sapiens
tgagttcattgtagattctggat

SEQ ID NO: 135463 - DNA, 23 bp, Homo sapiens
atatgtgctcatattcctatgta

SEQ ID NO: 135464 - DNA, 22 bp, Homo sapiens
agtctcgctctgtcactcaggc

SEQ ID NO: 135465 - DNA, 23 bp, Homo sapiens
tctctgtctgtctgtctgtctct

SEQ ID NO: 135466 - DNA, 23 bp, Homo sapiens
tgagacagagtctcgctctgtcg

SEQ ID NO: 135467 - DNA, 23 bp, Homo sapiens
agatggagtctcgctctctcacc

SEQ ID NO: 135468 - DNA, 19 bp, Homo sapiens
attgcactccagcctgggt

SEQ ID NO: 135469 - DNA, 20 bp, Homo sapiens
agcgagactgtgtctttttt

SEQ ID NO: 135470 - DNA, 23 bp, Homo sapiens
gagacagagtctcactctgctgc

SEQ ID NO: 135471 - DNA, 23 bp, Homo sapiens
gggtctcactctgtcactcaggc

SEQ ID NO: 135472 - DNA, 23 bp, Homo sapiens
cgcctctctgactctgtctccca

SEQ ID NO: 135473 - DNA, 23 bp, Homo sapiens
ctctctgagcctcagtttctcct

SEQ ID NO: 135474 - DNA, 23 bp, Homo sapiens
tgagtgttgaagtcattttgtgg

SEQ ID NO: 135475 - DNA, 18 bp, Homo sapiens
ttcctatttcttgggaaa

SEQ ID NO: 135476 - DNA, 23 bp, Homo sapiens
ggctctctctgtggctgtgctgc

SEQ ID NO: 135477 - DNA, 22 bp, Homo sapiens
tctctctgggtctcagttctcc

SEQ ID NO: 135478 - DNA, 23 bp, Homo sapiens
tgggtgcctgggtccctgtgtcc

SEQ ID NO: 135479 - DNA, 20 bp, Homo sapiens
tgagagaagtgacagtggtg

SEQ ID NO: 135480 - DNA, 23 bp, Homo sapiens
cagagtctcccagcctgtggaca

SEQ ID NO: 135481 - DNA, 19 bp, Homo sapiens
tggttccctctgtgcttcc

SEQ ID NO: 135482 - DNA, 23 bp, Homo sapiens
gtgcctctgtgggtctgtctgtt

SEQ ID NO: 135483 - DNA, 23 bp, Homo sapiens
tgtgtgtgtgtgtgtgcctctgg

SEQ ID NO: 135484 - DNA, 23 bp, Homo sapiens
tcacagcacagagtctgcagcct

SEQ ID NO: 135485 - DNA, 22 bp, Homo sapiens
tggtgtgtgcctatggtcccag

SEQ ID NO: 135486 - DNA, 18 bp, Homo sapiens
tgaggtaggaggatcact

SEQ ID NO: 135487 - DNA, 19 bp, Homo sapiens
tcactctgacagtctcacg

SEQ ID NO: 135488 - DNA, 18 bp, Homo sapiens
gatctagaggctgtgcag

SEQ ID NO: 135489 - DNA, 21 bp, Homo sapiens
agagacaggctgtcgctctgt

SEQ ID NO: 135490 - DNA, 21 bp, Homo sapiens
tctctgggcctcagtttccct

SEQ ID NO: 135491 - DNA, 20 bp, Homo sapiens
tctcagaactttgagagcag

SEQ ID NO: 135492 - DNA, 23 bp, Homo sapiens
cactgcctctgtgcctctgaggc

SEQ ID NO: 135493 - DNA, 21 bp, Homo sapiens
tagtgagactccattgctgca

SEQ ID NO: 135494 - DNA, 23 bp, Homo sapiens
tttgagacggagtctcgctctgt

SEQ ID NO: 135495 - DNA, 23 bp, Homo sapiens
gggtctcactctgtcacccaggc

SEQ ID NO: 135496 - DNA, 21 bp, Homo sapiens
tccctgtcctccaggagctca

SEQ ID NO: 135497 - DNA, 23 bp, Homo sapiens
tgcctccctctctgtgaggctct

SEQ ID NO: 135498 - DNA, 23 bp, Homo sapiens
ggcactgtctgtctgtaaatcct

SEQ ID NO: 135499 - DNA, 23 bp, Homo sapiens
gcgtgtgtcagaattgtgttgct

SEQ ID NO: 135500 - DNA, 22 bp, Homo sapiens
tggagtctcgctctgtcagcca

SEQ ID NO: 135501 - DNA, 23 bp, Homo sapiens
cttccttctgagagagaactgtg

SEQ ID NO: 135502 - DNA, 23 bp, Homo sapiens
tgagtctctcctgaaggcactga

SEQ ID NO: 135503 - DNA, 23 bp, Homo sapiens
gagagagtgaacagtcgagcaca

SEQ ID NO: 135504 - DNA, 23 bp, Homo sapiens
agagacaagagtgtgagttcaac

SEQ ID NO: 135505 - DNA, 21 bp, Homo sapiens
tagacaggtgagtgtgcacag

SEQ ID NO: 135506 - DNA, 23 bp, Homo sapiens
agcctctgtccctgcctctctgc

SEQ ID NO: 135507 - DNA, 23 bp, Homo sapiens
taaatctcatctggttttgcaca

SEQ ID NO: 135508 - DNA, 23 bp, Homo sapiens
tgttgctggatttgatttgctag

SEQ ID NO: 135509 - DNA, 23 bp, Homo sapiens
tgacatggtctggctctgtcacc

SEQ ID NO: 135510 - DNA, 18 bp, Homo sapiens
tctcggtgtgagttcatg

SEQ ID NO: 135511 - DNA, 19 bp, Homo sapiens
ctctgtgcgtgagtccctg

SEQ ID NO: 135512 - DNA, 19 bp, Homo sapiens
tctcggtgtgagttcatgg

SEQ ID NO: 135513 - DNA, 19 bp, Homo sapiens
ctctgtgcgtgagtccctg

SEQ ID NO: 135514 - DNA, 23 bp, Homo sapiens
agtccctctgtctgtgtgtgcct

SEQ ID NO: 135515 - DNA, 21 bp, Homo sapiens
gatgattagttaaggtcctag

SEQ ID NO: 135516 - DNA, 23 bp, Homo sapiens
tctctagctgtctctgtctgtcc

SEQ ID NO: 135517 - DNA, 23 bp, Homo sapiens
agcttcactgacagtctgactcc

SEQ ID NO: 135518 - DNA, 22 bp, Homo sapiens
agtctggctctctccctggctg

SEQ ID NO: 135519 - DNA, 21 bp, Homo sapiens
tgtgagtagacagagggcaga

SEQ ID NO: 135520 - DNA, 23 bp, Homo sapiens
tgatctctgtgctcatcctacag

SEQ ID NO: 135521 - DNA, 20 bp, Homo sapiens
acagtcggtttatgaagagg

SEQ ID NO: 135522 - DNA, 21 bp, Homo sapiens
atgactgatgagtgtgtgaac

SEQ ID NO: 135523 - DNA, 23 bp, Homo sapiens
tttgagatcagtgtgtggagtga

SEQ ID NO: 135524 - DNA, 22 bp, Homo sapiens
atttcagaattgtaatgacgga

SEQ ID NO: 135525 - DNA, 22 bp, Homo sapiens
tttcctaatattgcaattctca

SEQ ID NO: 135526 - DNA, 23 bp, Homo sapiens
gtcagtgtgtgtgtgtctgtatg

SEQ ID NO: 135527 - DNA, 19 bp, Homo sapiens
gtatatgcatgtattgtgt

SEQ ID NO: 135528 - DNA, 23 bp, Homo sapiens
ctctctgtctgtctgtgacctca

SEQ ID NO: 135529 - DNA, 22 bp, Homo sapiens
ctcacattctctctgacttact

SEQ ID NO: 135530 - DNA, 23 bp, Homo sapiens
gacctcacattctctctgactta

SEQ ID NO: 135531 - DNA, 23 bp, Homo sapiens
gacctcacattctctctgactta

SEQ ID NO: 135532 - DNA, 22 bp, Homo sapiens
tgtatcaggaactgcatatgta

SEQ ID NO: 135533 - DNA, 23 bp, Homo sapiens
tttgtatatatacatgtgtgtgt

SEQ ID NO: 135534 - DNA, 22 bp, Homo sapiens
aggaggtgcactctcactgttt

SEQ ID NO: 135535 - DNA, 22 bp, Homo sapiens
aaaggaggtgcactctcactgt

SEQ ID NO: 135536 - DNA, 23 bp, Homo sapiens
tggatgggtagctaggtgctccc

SEQ ID NO: 135537 - DNA, 22 bp, Homo sapiens
aggaggtgcactctcactgttt

SEQ ID NO: 135538 - DNA, 22 bp, Homo sapiens
aggaggtgcactctcactgttt

SEQ ID NO: 135539 - DNA, 23 bp, Homo sapiens
aaggaggtgcactctcactgttt

SEQ ID NO: 135540 - DNA, 20 bp, Homo sapiens
tcccacacctgagtcagctc

SEQ ID NO: 135541 - DNA, 18 bp, Homo sapiens
gagtcaggttcacctgag

SEQ ID NO: 135542 - DNA, 23 bp, Homo sapiens
cggagtctcactctgtcacccag

SEQ ID NO: 135543 - DNA, 23 bp, Homo sapiens
gaatctcactctgtcacccaggc

SEQ ID NO: 135544 - DNA, 21 bp, Homo sapiens
tgggtgatgtgtgagtgcaca

SEQ ID NO: 135545 - DNA, 22 bp, Homo sapiens
tgattgtgtgtgcttatgcatg

SEQ ID NO: 135546 - DNA, 23 bp, Homo sapiens
tgagttcattgtagattctggat

SEQ ID NO: 135547 - DNA, 23 bp, Homo sapiens
tgagttcattgtagattctggat

SEQ ID NO: 135548 - DNA, 21 bp, Homo sapiens
tgcatatatatattcagctgg

SEQ ID NO: 135549 - DNA, 18 bp, Homo sapiens
atagatagatatatacat

SEQ ID NO: 135550 - DNA, 19 bp, Homo sapiens
tgagcccgagagattgagg

SEQ ID NO: 135551 - DNA, 23 bp, Homo sapiens
acactgtctcaggtagttttcac

SEQ ID NO: 135552 - DNA, 22 bp, Homo sapiens
aatgtgaaaactttcttcatag

SEQ ID NO: 135553 - DNA, 23 bp, Homo sapiens
acagagtctcactctgtcgccca

SEQ ID NO: 135554 - DNA, 23 bp, Homo sapiens
taaacatgtatgtcttcaacaaa

SEQ ID NO: 135555 - DNA, 21 bp, Homo sapiens
ccatcagtctgtgcagggtga

SEQ ID NO: 135556 - DNA, 23 bp, Homo sapiens
cagagtctcacactgtcacccag

SEQ ID NO: 135557 - DNA, 23 bp, Homo sapiens
tgtgacactctgtgacaaactcc

SEQ ID NO: 135558 - DNA, 21 bp, Homo sapiens
atatctatcatgtatagatat

SEQ ID NO: 135559 - DNA, 19 bp, Homo sapiens
atatctatcatgtatagat

SEQ ID NO: 135560 - DNA, 19 bp, Homo sapiens
atatctatcatgtatagat

SEQ ID NO: 135561 - DNA, 22 bp, Homo sapiens
ttttctttttatattaaagtgt

SEQ ID NO: 135562 - DNA, 23 bp, Homo sapiens
taaagtagtgagggctttccatt

SEQ ID NO: 135563 - DNA, 18 bp, Homo sapiens
agtctcactctgtcaccc

SEQ ID NO: 135564 - DNA, 23 bp, Homo sapiens
tatatatgtatgtatatgttctg

SEQ ID NO: 135565 - DNA, 21 bp, Homo sapiens
tatgtgtatatgtttatgtgt

SEQ ID NO: 135566 - DNA, 22 bp, Homo sapiens
tggatatatatgtatatgtaca

SEQ ID NO: 135567 - DNA, 23 bp, Homo sapiens
aggggataggatctgttttggaa

SEQ ID NO: 135568 - DNA, 22 bp, Homo sapiens
tcgatctgtctgtctgtctgtc

SEQ ID NO: 135569 - DNA, 23 bp, Homo sapiens
atactgttggctttctgtctctc

SEQ ID NO: 135570 - DNA, 23 bp, Homo sapiens
ctctccatccttctctgtctcac

SEQ ID NO: 135571 - DNA, 19 bp, Homo sapiens
tgtgtgtgtgtgtgtgtgt

SEQ ID NO: 135572 - DNA, 23 bp, Homo sapiens
aagcaatcaggtatgcatttgtc

SEQ ID NO: 135573 - DNA, 23 bp, Homo sapiens
tgtctacatgtgtgccttgctgt

SEQ ID NO: 135574 - DNA, 23 bp, Homo sapiens
acacatgtgtgtgtgtgcatgtg

SEQ ID NO: 135575 - DNA, 23 bp, Homo sapiens
tgacctactcctttagttgtgat

SEQ ID NO: 135576 - DNA, 23 bp, Homo sapiens
cactggaatgatgaaatgacttg

SEQ ID NO: 135577 - DNA, 23 bp, Homo sapiens
ttttgtggatcatatttgtgtct

SEQ ID NO: 135578 - DNA, 23 bp, Homo sapiens
agaggattgttgtctgagtccag

SEQ ID NO: 135579 - DNA, 19 bp, Homo sapiens
tgtgtatatatacacatgt

SEQ ID NO: 135580 - DNA, 23 bp, Homo sapiens
ctatgtgactgtgtaacacactg

SEQ ID NO: 135581 - DNA, 18 bp, Homo sapiens
agcatcaacttttctggt

SEQ ID NO: 135582 - DNA, 23 bp, Homo sapiens
tgtatatctgtgtgtgcatgtgt

SEQ ID NO: 135583 - DNA, 23 bp, Homo sapiens
tgagttcattgtagattctggat

SEQ ID NO: 135584 - DNA, 23 bp, Homo sapiens
tgagttcattgtagattctggat

SEQ ID NO: 135585 - DNA, 23 bp, Homo sapiens
gagttgttgagacacagatccgt

SEQ ID NO: 135586 - DNA, 23 bp, Homo sapiens
tccctctcagagactctgatcca

SEQ ID NO: 135587 - DNA, 21 bp, Homo sapiens
tttacctaaagattaggttaa

SEQ ID NO: 135588 - DNA, 19 bp, Homo sapiens
atattctttctatatgtat

SEQ ID NO: 135589 - DNA, 23 bp, Homo sapiens
atgactgaggtaagctgtgttgt

SEQ ID NO: 135590 - DNA, 22 bp, Homo sapiens
agcacacaggcaaatctcttat

SEQ ID NO: 135591 - DNA, 23 bp, Homo sapiens
cactctctgaggctgtctggtga

SEQ ID NO: 135592 - DNA, 21 bp, Homo sapiens
agagtgaccagagagggcaga

SEQ ID NO: 135593 - DNA, 22 bp, Homo sapiens
tatgcttgtgtttagctatctt

SEQ ID NO: 135594 - DNA, 20 bp, Homo sapiens
tctggacaatgtcaatcgta

SEQ ID NO: 135595 - DNA, 19 bp, Homo sapiens
atcataatgatgatgatga

SEQ ID NO: 135596 - DNA, 23 bp, Homo sapiens
tcacagtcatatcaggtatgtat

SEQ ID NO: 135597 - DNA, 23 bp, Homo sapiens
gtctgtctgtggtttacttttga

SEQ ID NO: 135598 - DNA, 23 bp, Homo sapiens
tgtgtgtgtgtatgtgtgtgcgt

SEQ ID NO: 135599 - DNA, 23 bp, Homo sapiens
actctagtatatagtatagtata

SEQ ID NO: 135600 - DNA, 23 bp, Homo sapiens
atgtatctctctctatatatgtg

SEQ ID NO: 135601 - DNA, 23 bp, Homo sapiens
ttcattgtggttttgatttgcat

SEQ ID NO: 135602 - DNA, 21 bp, Homo sapiens
tcactctgtgactgtgaagag

SEQ ID NO: 135603 - DNA, 23 bp, Homo sapiens
tcactcagcgtgatgtttccaag

SEQ ID NO: 135604 - DNA, 22 bp, Homo sapiens
agagcccatggagaaggaggag

SEQ ID NO: 135605 - DNA, 21 bp, Homo sapiens
agacagggtctctggctgtgt

SEQ ID NO: 135606 - DNA, 23 bp, Homo sapiens
tctctgtgcctcagttgctccat

SEQ ID NO: 135607 - DNA, 23 bp, Homo sapiens
tctctgtgcctcagttgctccat

SEQ ID NO: 135608 - DNA, 23 bp, Homo sapiens
tggagtctcactctgtcacccag

SEQ ID NO: 135609 - DNA, 23 bp, Homo sapiens
tctgggagttgagagtgtagata

SEQ ID NO: 135610 - DNA, 23 bp, Homo sapiens
ctgtgactcagagcaaaactttt

SEQ ID NO: 135611 - DNA, 22 bp, Homo sapiens
cagtgtctctctctgtcaccca

SEQ ID NO: 135612 - DNA, 23 bp, Homo sapiens
aagtgttttgaattcaaagtgga

SEQ ID NO: 135613 - DNA, 23 bp, Homo sapiens
acacaagactgtctgttgagtgg

SEQ ID NO: 135614 - DNA, 23 bp, Homo sapiens
tgcctggctcagtccgtgtgtct

SEQ ID NO: 135615 - DNA, 23 bp, Homo sapiens
gaggtagagacttcagtgatcct

SEQ ID NO: 135616 - DNA, 23 bp, Homo sapiens
agatttcagctactttactgaac

SEQ ID NO: 135617 - DNA, 23 bp, Homo sapiens
tggctcggtcggtcgctccttcc

SEQ ID NO: 135618 - DNA, 21 bp, Homo sapiens
gctctctctctggctcacatc

SEQ ID NO: 135619 - DNA, 18 bp, Homo sapiens
atcacattaacattttgt

SEQ ID NO: 135620 - DNA, 22 bp, Homo sapiens
tcaaacagtgccagttcttttt

SEQ ID NO: 135621 - DNA, 23 bp, Homo sapiens
tctgacaagacagactgctcttc

SEQ ID NO: 135622 - DNA, 21 bp, Homo sapiens
tctgttgttggagggtttgtt

SEQ ID NO: 135623 - DNA, 23 bp, Homo sapiens
cggagtctcactctgtcacccag

SEQ ID NO: 135624 - DNA, 23 bp, Homo sapiens
gagtctcactctgtcacccaggc

SEQ ID NO: 135625 - DNA, 23 bp, Homo sapiens
tgacttgagtctgggaggttgag

SEQ ID NO: 135626 - DNA, 23 bp, Homo sapiens
gctgtcagacactctgcctgtgc

SEQ ID NO: 135627 - DNA, 23 bp, Homo sapiens
ctgaaactgagtggtaatcatgc

SEQ ID NO: 135628 - DNA, 20 bp, Homo sapiens
ctctcactctgtcgctctcc

SEQ ID NO: 135629 - DNA, 23 bp, Homo sapiens
tctgttactccatgagtgcaggc

SEQ ID NO: 135630 - DNA, 23 bp, Homo sapiens
aaagcatcgtcactcactctctc

SEQ ID NO: 135631 - DNA, 23 bp, Homo sapiens
tgagggagagagacaggctgaga

SEQ ID NO: 135632 - DNA, 23 bp, Homo sapiens
aatctggatctgcatgtgctgga

SEQ ID NO: 135633 - DNA, 23 bp, Homo sapiens
aattcttaaactgtaggctgcct

SEQ ID NO: 135634 - DNA, 23 bp, Homo sapiens
acgctgacactctgagttgcgac

SEQ ID NO: 135635 - DNA, 23 bp, Homo sapiens
tgaagtcagagagctcaccctga

SEQ ID NO: 135636 - DNA, 22 bp, Homo sapiens
aacatgaggaccttgtccactg

SEQ ID NO: 135637 - DNA, 19 bp, Homo sapiens
tctgtgtgtgtctcctggc

SEQ ID NO: 135638 - DNA, 23 bp, Homo sapiens
atgtgagtggaagtgatgtgttt

SEQ ID NO: 135639 - DNA, 21 bp, Homo sapiens
cagttctttcttgagagagag

SEQ ID NO: 135640 - DNA, 20 bp, Homo sapiens
ttgggtacatttgggtatgt

SEQ ID NO: 135641 - DNA, 18 bp, Homo sapiens
ttctcaatagccaaaatg

SEQ ID NO: 135642 - DNA, 20 bp, Homo sapiens
tgagtgcagtcagacctcat

SEQ ID NO: 135643 - DNA, 22 bp, Homo sapiens
agtgtgtgagaccctgtgtgtc

SEQ ID NO: 135644 - DNA, 19 bp, Homo sapiens
tttggtgctcttccagtag

SEQ ID NO: 135645 - DNA, 21 bp, Homo sapiens
tatggtgaagctagagcacag

SEQ ID NO: 135646 - DNA, 23 bp, Homo sapiens
ggctccctcactctgtgactgtg

SEQ ID NO: 135647 - DNA, 19 bp, Homo sapiens
tatgtatatatatacacgt

SEQ ID NO: 135648 - DNA, 22 bp, Homo sapiens
atatacacgtatatatacacgt

SEQ ID NO: 135649 - DNA, 22 bp, Homo sapiens
tatcacagtgggtgtacacaca

SEQ ID NO: 135650 - DNA, 18 bp, Homo sapiens
ccccctcactctgtctct

SEQ ID NO: 135651 - DNA, 23 bp, Homo sapiens
aggctgtacagagtgagcactag

SEQ ID NO: 135652 - DNA, 23 bp, Homo sapiens
agttgagacagtgtctcactctg

SEQ ID NO: 135653 - DNA, 23 bp, Homo sapiens
gtcacttgatgtacatacttctt

SEQ ID NO: 135654 - DNA, 23 bp, Homo sapiens
attctctctctctctttctggac

SEQ ID NO: 135655 - DNA, 22 bp, Homo sapiens
agggtttatgaagggttttagt

SEQ ID NO: 135656 - DNA, 19 bp, Homo sapiens
ttgctagacttaatcattc

SEQ ID NO: 135657 - DNA, 22 bp, Homo sapiens
atgcacctctagacaagtgtgt

SEQ ID NO: 135658 - DNA, 23 bp, Homo sapiens
atgtgtgtgtatatatatatgtg

SEQ ID NO: 135659 - DNA, 20 bp, Homo sapiens
tctctgtctatctgtctgct

SEQ ID NO: 135660 - DNA, 19 bp, Homo sapiens
gtcctttagacattaatgt

SEQ ID NO: 135661 - DNA, 21 bp, Homo sapiens
tatcaggacatgactccgttg

SEQ ID NO: 135662 - DNA, 22 bp, Homo sapiens
atctggttgttcaaaagagtgt

SEQ ID NO: 135663 - DNA, 23 bp, Homo sapiens
ttctttttgcttaggattgtctt

SEQ ID NO: 135664 - DNA, 23 bp, Homo sapiens
tatgtgtctgtatgtatatacat

SEQ ID NO: 135665 - DNA, 23 bp, Homo sapiens
tatacacgtatatgtatatatgt

SEQ ID NO: 135666 - DNA, 23 bp, Homo sapiens
tatacacgtatatgtatatatgt

SEQ ID NO: 135667 - DNA, 18 bp, Homo sapiens
acagaggtttatcttggc

SEQ ID NO: 135668 - DNA, 20 bp, Homo sapiens
ttctgcaagctgtacaggga

SEQ ID NO: 135669 - DNA, 23 bp, Homo sapiens
agtatgtatatgtgtgtatatgt

SEQ ID NO: 135670 - DNA, 23 bp, Homo sapiens
ataagcctgtttaagaattgttt

SEQ ID NO: 135671 - DNA, 19 bp, Homo sapiens
tgtgtatatatatatacgt

SEQ ID NO: 135672 - DNA, 23 bp, Homo sapiens
tgagttcattgtagattctggat

SEQ ID NO: 135673 - DNA, 23 bp, Homo sapiens
tgagttcattgtagattctggat

SEQ ID NO: 135674 - DNA, 23 bp, Homo sapiens
tgagttcattgtagattctggat

SEQ ID NO: 135675 - DNA, 23 bp, Homo sapiens
tgagttcattgtagattctggat

SEQ ID NO: 135676 - DNA, 23 bp, Homo sapiens
ttagggagctagtgcaatccttt

SEQ ID NO: 135677 - DNA, 23 bp, Homo sapiens
gggtctcactctgtcactgctct

SEQ ID NO: 135678 - DNA, 19 bp, Homo sapiens
gtggcaaaatgttggctca

SEQ ID NO: 135679 - DNA, 23 bp, Homo sapiens
tatatatgtctatatgtatgtat

SEQ ID NO: 135680 - DNA, 23 bp, Homo sapiens
atatgtgcatatgtatacgtata

SEQ ID NO: 135681 - DNA, 22 bp, Homo sapiens
tgtgcatgtatgtatatatgta

SEQ ID NO: 135682 - DNA, 23 bp, Homo sapiens
tatatgtgtatatatgtatacat

SEQ ID NO: 135683 - DNA, 18 bp, Homo sapiens
tatatacacacacataca

SEQ ID NO: 135684 - DNA, 23 bp, Homo sapiens
aaaatcagtgatgttgatctttt

SEQ ID NO: 135685 - DNA, 22 bp, Homo sapiens
tcagtgcttaagttttacaacc

SEQ ID NO: 135686 - DNA, 23 bp, Homo sapiens
tacacacccacatatatgtgtgt

SEQ ID NO: 135687 - DNA, 23 bp, Homo sapiens
tatgtggttaggtatatgtaggt

SEQ ID NO: 135688 - DNA, 22 bp, Homo sapiens
agaatttcttttgtttgcacta

SEQ ID NO: 135689 - DNA, 19 bp, Homo sapiens
atgctgtgatgatatcatg

SEQ ID NO: 135690 - DNA, 23 bp, Homo sapiens
gagcctctctctctctctgctga

SEQ ID NO: 135691 - DNA, 19 bp, Homo sapiens
aacagtagtgtcagaccac

SEQ ID NO: 135692 - DNA, 23 bp, Homo sapiens
tctcactccctctgtccctgcca

SEQ ID NO: 135693 - DNA, 23 bp, Homo sapiens
tgtttctaggcagtggatgagca

SEQ ID NO: 135694 - DNA, 18 bp, Homo sapiens
tttcttgtgctggggctg

SEQ ID NO: 135695 - DNA, 23 bp, Homo sapiens
tgtatgagctctgtgaatgtggt

SEQ ID NO: 135696 - DNA, 22 bp, Homo sapiens
tatgtgtatatatatatgacag

SEQ ID NO: 135697 - DNA, 23 bp, Homo sapiens
actgtgaggagactgaggccaca

SEQ ID NO: 135698 - DNA, 21 bp, Homo sapiens
ttaggttgtgggttcttgagt

SEQ ID NO: 135699 - DNA, 22 bp, Homo sapiens
aactttactgaatttgttgatc

SEQ ID NO: 135700 - DNA, 23 bp, Homo sapiens
tccctgtctctctgtatgtcagt

SEQ ID NO: 135701 - DNA, 23 bp, Homo sapiens
tggagtctcactctgtcacccag

SEQ ID NO: 135702 - DNA, 23 bp, Homo sapiens
ttttactgtctgctctttctggc

SEQ ID NO: 135703 - DNA, 23 bp, Homo sapiens
tctgtctgcctgtctgtctgtct

SEQ ID NO: 135704 - DNA, 23 bp, Homo sapiens
tctcactgtggttgtgatttgca

SEQ ID NO: 135705 - DNA, 23 bp, Homo sapiens
tgtgcctgtagtcttagctactt

SEQ ID NO: 135706 - DNA, 23 bp, Homo sapiens
aggttacagtgagctgagaccgt

SEQ ID NO: 135707 - DNA, 21 bp, Homo sapiens
cactgcctcagttcaggtctt

SEQ ID NO: 135708 - DNA, 23 bp, Homo sapiens
gagtctcactctgtcactcaggc

SEQ ID NO: 135709 - DNA, 23 bp, Homo sapiens
tggaaaagctacagtacccgtct

SEQ ID NO: 135710 - DNA, 23 bp, Homo sapiens
acagagtctcactctgtcgccca

SEQ ID NO: 135711 - DNA, 23 bp, Homo sapiens
actgggtctcagtctgtctctca

SEQ ID NO: 135712 - DNA, 23 bp, Homo sapiens
cggagtctcactctgtcacccag

SEQ ID NO: 135713 - DNA, 23 bp, Homo sapiens
gagtctcactctgtcacccaggc

SEQ ID NO: 135714 - DNA, 22 bp, Homo sapiens
tcatgctccatcatgctgtgct

SEQ ID NO: 135715 - DNA, 23 bp, Homo sapiens
ctgtctgcccagactgtgaccaa

SEQ ID NO: 135716 - DNA, 20 bp, Homo sapiens
ttttggcttaggattgtctt

SEQ ID NO: 135717 - DNA, 21 bp, Homo sapiens
tgtctcactctgtcatctagg

SEQ ID NO: 135718 - DNA, 23 bp, Homo sapiens
actatgagttctgattttcaagt

SEQ ID NO: 135719 - DNA, 21 bp, Homo sapiens
aatcagaaggaagtgaggaca

SEQ ID NO: 135720 - DNA, 23 bp, Homo sapiens
actctgcctgtgtgcctgcctgg

SEQ ID NO: 135721 - DNA, 23 bp, Homo sapiens
ggagtctcactctgtcactcagg

SEQ ID NO: 135722 - DNA, 23 bp, Homo sapiens
tctgtctggctgacagcctggtt

SEQ ID NO: 135723 - DNA, 22 bp, Homo sapiens
attcactggcaggaacacagaa

SEQ ID NO: 135724 - DNA, 23 bp, Homo sapiens
atacagacactcagactccagaa

SEQ ID NO: 135725 - DNA, 23 bp, Homo sapiens
tattttgattgcttttgattaac

SEQ ID NO: 135726 - DNA, 23 bp, Homo sapiens
gaggtgacagagctgcagctaaa

SEQ ID NO: 135727 - DNA, 23 bp, Homo sapiens
tcgttgacactcagagtctctga

SEQ ID NO: 135728 - DNA, 23 bp, Homo sapiens
tgtcttgctcactctcaccctct

SEQ ID NO: 135729 - DNA, 23 bp, Homo sapiens
tgtctctgcctgtcactttcctt

SEQ ID NO: 135730 - DNA, 23 bp, Homo sapiens
gacagggtctcactctgtcaccc

SEQ ID NO: 135731 - DNA, 23 bp, Homo sapiens
gactgagtctcactctgtcgccc

SEQ ID NO: 135732 - DNA, 20 bp, Homo sapiens
tcaacctctctgtgtttcag

SEQ ID NO: 135733 - DNA, 23 bp, Homo sapiens
cggagtctcactctgtcacccag

SEQ ID NO: 135734 - DNA, 20 bp, Homo sapiens
tggcagagccaggattcagg

SEQ ID NO: 135735 - DNA, 23 bp, Homo sapiens
gacagagtctcgctctgtcaccc

SEQ ID NO: 135736 - DNA, 23 bp, Homo sapiens
agtctgagcctctgtgtccccat

SEQ ID NO: 135737 - DNA, 18 bp, Homo sapiens
tgtgcaggtctcatcttc

SEQ ID NO: 135738 - DNA, 20 bp, Homo sapiens
agagagaagagagtggccag

SEQ ID NO: 135739 - DNA, 22 bp, Homo sapiens
gtatgtatgtatgtaagtgtgt

SEQ ID NO: 135740 - DNA, 22 bp, Homo sapiens
cacactctcactctgtcgccca

SEQ ID NO: 135741 - DNA, 18 bp, Homo sapiens
tcccaagtagctgggact

SEQ ID NO: 135742 - DNA, 18 bp, Homo sapiens
ggcagagtgagtgggaat

SEQ ID NO: 135743 - DNA, 23 bp, Homo sapiens
tgtagcacttggactctgtcact

SEQ ID NO: 135744 - DNA, 22 bp, Homo sapiens
tgagtgtctgcatgtccatgtg

SEQ ID NO: 135745 - DNA, 23 bp, Homo sapiens
tatgtctctgtgtgtgtgtctct

SEQ ID NO: 135746 - DNA, 23 bp, Homo sapiens
tatgtgtgtatatgtatatatgt

SEQ ID NO: 135747 - DNA, 23 bp, Homo sapiens
tgagttcattgtagattctggat

SEQ ID NO: 135748 - DNA, 23 bp, Homo sapiens
tgagttcattgtagattctggat

SEQ ID NO: 135749 - DNA, 21 bp, Homo sapiens
tctcactgtctgtattgcctt

SEQ ID NO: 135750 - DNA, 22 bp, Homo sapiens
ttactcccagggtctctctctg

SEQ ID NO: 135751 - DNA, 20 bp, Homo sapiens
tagcctgtgggtttcttgag

SEQ ID NO: 135752 - DNA, 21 bp, Homo sapiens
agggtgtgtgagatttgagag

SEQ ID NO: 135753 - DNA, 23 bp, Homo sapiens
aacagaaaagttaataatccaaa

SEQ ID NO: 135754 - DNA, 23 bp, Homo sapiens
tatcagactgagtgacatgtttc

SEQ ID NO: 135755 - DNA, 23 bp, Homo sapiens
aggaatgcttttacactgttggt

SEQ ID NO: 135756 - DNA, 23 bp, Homo sapiens
tgagttcattgtagattctggat

SEQ ID NO: 135757 - DNA, 23 bp, Homo sapiens
tgagttcattgtagattctggat

SEQ ID NO: 135758 - DNA, 23 bp, Homo sapiens
tatgtgtgtgtatatgtatgtgt

SEQ ID NO: 135759 - DNA, 19 bp, Homo sapiens
acacatactcatatatgca

SEQ ID NO: 135760 - DNA, 23 bp, Homo sapiens
aggatgttgaggctgcagtgaac

SEQ ID NO: 135761 - DNA, 19 bp, Homo sapiens
tgctcagccttaatcctgt

SEQ ID NO: 135762 - DNA, 22 bp, Homo sapiens
tatctcactgggctttcattgt

SEQ ID NO: 135763 - DNA, 23 bp, Homo sapiens
accagtgtctagagagtgtccac

SEQ ID NO: 135764 - DNA, 23 bp, Homo sapiens
tgttctctgtcactctgtttctg

SEQ ID NO: 135765 - DNA, 23 bp, Homo sapiens
gggtgtctgtgtgcctccctctg

SEQ ID NO: 135766 - DNA, 23 bp, Homo sapiens
tgtgtgtatatatgtatgtgtat

SEQ ID NO: 135767 - DNA, 21 bp, Homo sapiens
tgaagcatcaactgggataat

SEQ ID NO: 135768 - DNA, 23 bp, Homo sapiens
caagaggttgttatttacagtct

SEQ ID NO: 135769 - DNA, 18 bp, Homo sapiens
acaatgcttgcttaaagt

SEQ ID NO: 135770 - DNA, 19 bp, Homo sapiens
tcagtctcatgagatctga

SEQ ID NO: 135771 - DNA, 23 bp, Homo sapiens
agacgtgagccactgtgcctggc

SEQ ID NO: 135772 - DNA, 23 bp, Homo sapiens
tgcttttgaggcagagtctcact

SEQ ID NO: 135773 - DNA, 18 bp, Homo sapiens
agaggaaggcagttctga

SEQ ID NO: 135774 - DNA, 21 bp, Homo sapiens
agctggatgtggtggtgcatg

SEQ ID NO: 135775 - DNA, 21 bp, Homo sapiens
tgaggtaggaggatctcttga

SEQ ID NO: 135776 - DNA, 23 bp, Homo sapiens
gtcattgtttatcttggtgtctg

SEQ ID NO: 135777 - DNA, 22 bp, Homo sapiens
ggctgtggctatacatgtgttt

SEQ ID NO: 135778 - DNA, 23 bp, Homo sapiens
tgacagtgcatgtgtatgtgttt

SEQ ID NO: 135779 - DNA, 22 bp, Homo sapiens
aagtgtgtgcagcactaggtca

SEQ ID NO: 135780 - DNA, 18 bp, Homo sapiens
agtgcacaacaaatgtaa

SEQ ID NO: 135781 - DNA, 18 bp, Homo sapiens
acatctgatatacgtatg

SEQ ID NO: 135782 - DNA, 22 bp, Homo sapiens
ttgcagctgcagtctcactaca

SEQ ID NO: 135783 - DNA, 18 bp, Homo sapiens
agatttttttttggatgg

SEQ ID NO: 135784 - DNA, 23 bp, Homo sapiens
agagagttagctgtttcaaattg

SEQ ID NO: 135785 - DNA, 19 bp, Homo sapiens
ttttgagacggagtctctc

SEQ ID NO: 135786 - DNA, 22 bp, Homo sapiens
tctcagcatctctattttggag

SEQ ID NO: 135787 - DNA, 22 bp, Homo sapiens
ttctcagaataaacagagctgt

SEQ ID NO: 135788 - DNA, 18 bp, Homo sapiens
tgcaccatgtgatagggc

SEQ ID NO: 135789 - DNA, 23 bp, Homo sapiens
tctctgactagagtgtgtgctct

SEQ ID NO: 135790 - DNA, 23 bp, Homo sapiens
caactgtctgtgtctgtctaacc

SEQ ID NO: 135791 - DNA, 23 bp, Homo sapiens
tggagcattgttttagctctaac

SEQ ID NO: 135792 - DNA, 22 bp, Homo sapiens
aatgagcaagcctattggtgcc

SEQ ID NO: 135793 - DNA, 23 bp, Homo sapiens
tgagtctcgctctgtcacccaag

SEQ ID NO: 135794 - DNA, 22 bp, Homo sapiens
tggtgctgcctccctttccaga

SEQ ID NO: 135795 - DNA, 20 bp, Homo sapiens
gtgtgcgtgtgcgtgtgtgt

SEQ ID NO: 135796 - DNA, 23 bp, Homo sapiens
cggagtctcactctgtcacccag

SEQ ID NO: 135797 - DNA, 23 bp, Homo sapiens
gagtctcactctgtcacccaggc

SEQ ID NO: 135798 - DNA, 23 bp, Homo sapiens
taatgcagtaagtcccacctgac

SEQ ID NO: 135799 - DNA, 23 bp, Homo sapiens
catgtgtgttgtagttttcccta

SEQ ID NO: 135800 - DNA, 23 bp, Homo sapiens
gacagggtctcactgtcgctcag

SEQ ID NO: 135801 - DNA, 23 bp, Homo sapiens
tgcagtggcatgatcctggctca

SEQ ID NO: 135802 - DNA, 19 bp, Homo sapiens
tgtgggaggaatgcagggt

SEQ ID NO: 135803 - DNA, 19 bp, Homo sapiens
ttactgcaagctctgcctc

SEQ ID NO: 135804 - DNA, 23 bp, Homo sapiens
tgcatgcatgtatgtatgtgagt

SEQ ID NO: 135805 - DNA, 23 bp, Homo sapiens
acttcattcctttccataactga

SEQ ID NO: 135806 - DNA, 23 bp, Homo sapiens
tttggaagacagggtctctctct

SEQ ID NO: 135807 - DNA, 23 bp, Homo sapiens
tgagttcattgtagattctggat

SEQ ID NO: 135808 - DNA, 23 bp, Homo sapiens
tgagttcattgtagattctggat

SEQ ID NO: 135809 - DNA, 23 bp, Homo sapiens
tggagtctcactctgtcacccag

SEQ ID NO: 135810 - DNA, 18 bp, Homo sapiens
cagtggtatgatctcagc

SEQ ID NO: 135811 - DNA, 23 bp, Homo sapiens
aatatcacagtgggtgtacaccc

SEQ ID NO: 135812 - DNA, 22 bp, Homo sapiens
attctagggagatgttactttt

SEQ ID NO: 135813 - DNA, 22 bp, Homo sapiens
tatcacagtgggtgtacacaca

SEQ ID NO: 135814 - DNA, 18 bp, Homo sapiens
tatcacagtgggtgtaca

SEQ ID NO: 135815 - DNA, 23 bp, Homo sapiens
tgtctggaattcatgcagtggag

SEQ ID NO: 135816 - DNA, 23 bp, Homo sapiens
tggcatgatcttggctcacttca

SEQ ID NO: 135817 - DNA, 21 bp, Homo sapiens
tcccaagtagctgggattaca

SEQ ID NO: 135818 - DNA, 18 bp, Homo sapiens
aaaagctagattggctta

SEQ ID NO: 135819 - DNA, 23 bp, Homo sapiens
tgagttcattgtagattctggat

SEQ ID NO: 135820 - DNA, 23 bp, Homo sapiens
tgagttcattgtagattctggat

SEQ ID NO: 135821 - DNA, 21 bp, Homo sapiens
tgattcataatgtaccattgt

SEQ ID NO: 135822 - DNA, 23 bp, Homo sapiens
tgtgtgtatgtatatatttctgt

SEQ ID NO: 135823 - DNA, 23 bp, Homo sapiens
tctaggtcactgtcactgctaca

SEQ ID NO: 135824 - DNA, 23 bp, Homo sapiens
atatggtaaaagcatgtttagtt

SEQ ID NO: 135825 - DNA, 23 bp, Homo sapiens
atacacatacatgtacgtgtgtg

SEQ ID NO: 135826 - DNA, 23 bp, Homo sapiens
taagtcacagaagcctgtcaggt

SEQ ID NO: 135827 - DNA, 23 bp, Homo sapiens
tgagatggactctcactctgtcg

SEQ ID NO: 135828 - DNA, 22 bp, Homo sapiens
tgtgagtctctcctactctcag

SEQ ID NO: 135829 - DNA, 23 bp, Homo sapiens
tatatgtatagatatctatctat

SEQ ID NO: 135830 - DNA, 23 bp, Homo sapiens
tcatatgagtggatttctttctt

SEQ ID NO: 135831 - DNA, 23 bp, Homo sapiens
agatggagtctcactctgtcacc

SEQ ID NO: 135832 - DNA, 23 bp, Homo sapiens
agaaagacttcagactgtggcat

SEQ ID NO: 135833 - DNA, 23 bp, Homo sapiens
cttgtttcactttctccatggtt

SEQ ID NO: 135834 - DNA, 21 bp, Homo sapiens
tcaatcttgatgttggcatct

SEQ ID NO: 135835 - DNA, 21 bp, Homo sapiens
acagaatcttgctctgtttcc

SEQ ID NO: 135836 - DNA, 21 bp, Homo sapiens
tgttgagctttttttcatgtt

SEQ ID NO: 135837 - DNA, 23 bp, Homo sapiens
ttcagtgaagaaagtcattggta

SEQ ID NO: 135838 - DNA, 23 bp, Homo sapiens
ccactctccctgtggcacaccct

SEQ ID NO: 135839 - DNA, 21 bp, Homo sapiens
tgtgcagttcctggatttgca

SEQ ID NO: 135840 - DNA, 23 bp, Homo sapiens
tggaatgaaaagatgtcaggaaa

SEQ ID NO: 135841 - DNA, 21 bp, Homo sapiens
tctcttggcttataagaggaa

SEQ ID NO: 135842 - DNA, 18 bp, Homo sapiens
tgagacaggaaagctaga

SEQ ID NO: 135843 - DNA, 23 bp, Homo sapiens
gagtctcactctgtcacccaggc

SEQ ID NO: 135844 - DNA, 18 bp, Homo sapiens
tctcactctgtcaccagg

SEQ ID NO: 135845 - DNA, 23 bp, Homo sapiens
atgtgtgtatatatatgtgtgtg

SEQ ID NO: 135846 - DNA, 23 bp, Homo sapiens
acatggtgcaaggtgtatggatt

SEQ ID NO: 135847 - DNA, 23 bp, Homo sapiens
aagactaaagtccagatttcttt

SEQ ID NO: 135848 - DNA, 23 bp, Homo sapiens
aaaagctcaaggtgcatgctgat

SEQ ID NO: 135849 - DNA, 23 bp, Homo sapiens
gacagcatctcgctctgtcactc

SEQ ID NO: 135850 - DNA, 18 bp, Homo sapiens
agtggtacgattttgact

SEQ ID NO: 135851 - DNA, 23 bp, Homo sapiens
actttggaagatgttgatgtgat

SEQ ID NO: 135852 - DNA, 23 bp, Homo sapiens
catataggattgttattgttgtg

SEQ ID NO: 135853 - DNA, 23 bp, Homo sapiens
tgagttcattgtagattctggat

SEQ ID NO: 135854 - DNA, 23 bp, Homo sapiens
tgagttcattgtagattctggat

SEQ ID NO: 135855 - DNA, 23 bp, Homo sapiens
tgtatgtgtatatgtatatatgt

SEQ ID NO: 135856 - DNA, 20 bp, Homo sapiens
tctctgtgtatgtgtgtgca

SEQ ID NO: 135857 - DNA, 23 bp, Homo sapiens
tgagttcattgtagattctggat

SEQ ID NO: 135858 - DNA, 23 bp, Homo sapiens
tgagttcattgtagattctggat

SEQ ID NO: 135859 - DNA, 23 bp, Homo sapiens
tgttctgtcacccaatctggagt

SEQ ID NO: 135860 - DNA, 20 bp, Homo sapiens
tctgtgggactctgtctcaa

SEQ ID NO: 135861 - DNA, 23 bp, Homo sapiens
ggagaaatatgtgaaattgttgt

SEQ ID NO: 135862 - DNA, 21 bp, Homo sapiens
actatcttgttagagcagtct

SEQ ID NO: 135863 - DNA, 23 bp, Homo sapiens
tgtatatatgcatatgtgtatgt

SEQ ID NO: 135864 - DNA, 23 bp, Homo sapiens
agtctagctacatatgtgtgtgt

SEQ ID NO: 135865 - DNA, 23 bp, Homo sapiens
atatacatgtgtgtgtgtgtgaa

SEQ ID NO: 135866 - DNA, 23 bp, Homo sapiens
tgtgtgtgtgcatgtgtatatgt

SEQ ID NO: 135867 - DNA, 23 bp, Homo sapiens
agacagagtctcgctctgtcacc

SEQ ID NO: 135868 - DNA, 20 bp, Homo sapiens
tgagacagactctggctctg

SEQ ID NO: 135869 - DNA, 18 bp, Homo sapiens
agtggtgagagtgggcat

SEQ ID NO: 135870 - DNA, 23 bp, Homo sapiens
tgtgtgtatatatatatgtgtga

SEQ ID NO: 135871 - DNA, 18 bp, Homo sapiens
tttcttctggcaagactg

SEQ ID NO: 135872 - DNA, 22 bp, Homo sapiens
tgcaactagatcaccaaacatt

SEQ ID NO: 135873 - DNA, 22 bp, Homo sapiens
taatgcatgaaatactatcgtt

SEQ ID NO: 135874 - DNA, 21 bp, Homo sapiens
tatatgcatatatatacatat

SEQ ID NO: 135875 - DNA, 23 bp, Homo sapiens
gacagaggtactagtttctattg

SEQ ID NO: 135876 - DNA, 21 bp, Homo sapiens
tatatgtatatgtatatatgt

SEQ ID NO: 135877 - DNA, 23 bp, Homo sapiens
atcacagtctgtcttgtgttact

SEQ ID NO: 135878 - DNA, 23 bp, Homo sapiens
tatgtgtatatatatttgtgtgt

SEQ ID NO: 135879 - DNA, 21 bp, Homo sapiens
tatagtgtatatatacatatg

SEQ ID NO: 135880 - DNA, 23 bp, Homo sapiens
agagttaccagtctgggcaacat

SEQ ID NO: 135881 - DNA, 22 bp, Homo sapiens
taaagtcattgcaaaccatggg

SEQ ID NO: 135882 - DNA, 23 bp, Homo sapiens
taaacttctttgtcagtaatgtt

SEQ ID NO: 135883 - DNA, 22 bp, Homo sapiens
ttagcttcaactttgctccaaa

SEQ ID NO: 135884 - DNA, 23 bp, Homo sapiens
agagagactgccatttcagtgtg

SEQ ID NO: 135885 - DNA, 23 bp, Homo sapiens
tgagttcattgtagattctggat

SEQ ID NO: 135886 - DNA, 23 bp, Homo sapiens
tgagttcattgtagattctggat

SEQ ID NO: 135887 - DNA, 20 bp, Homo sapiens
atcactgcctctctgtctct

SEQ ID NO: 135888 - DNA, 23 bp, Homo sapiens
tctaggagcagcagcttatgcct

SEQ ID NO: 135889 - DNA, 23 bp, Homo sapiens
aatattgtcatcaaatgatgtta

SEQ ID NO: 135890 - DNA, 23 bp, Homo sapiens
aattcattggttatcttccactt

SEQ ID NO: 135891 - DNA, 23 bp, Homo sapiens
tgagttcattgtagattctggat

SEQ ID NO: 135892 - DNA, 23 bp, Homo sapiens
tagttctccttgaagaggtccct

SEQ ID NO: 135893 - DNA, 18 bp, Homo sapiens
tagcaattgtgaatgggg

SEQ ID NO: 135894 - DNA, 22 bp, Homo sapiens
tatatatgtgtatgtatatata

SEQ ID NO: 135895 - DNA, 23 bp, Homo sapiens
tatgtctgagtgtgtgtgtgtgt

SEQ ID NO: 135896 - DNA, 23 bp, Homo sapiens
tgagttcattgtagattctggat

SEQ ID NO: 135897 - DNA, 23 bp, Homo sapiens
tgagttcattgtagattctggat

SEQ ID NO: 135898 - DNA, 23 bp, Homo sapiens
tgagttcattgtagattctggat

SEQ ID NO: 135899 - DNA, 23 bp, Homo sapiens
tgagttcattgtagattctggat

SEQ ID NO: 135900 - DNA, 23 bp, Homo sapiens
agcagctagtgagtgtgagagaa

SEQ ID NO: 135901 - DNA, 23 bp, Homo sapiens
tctgtcacacagtctagaggcag

SEQ ID NO: 135902 - DNA, 23 bp, Homo sapiens
tgatggagtctcactctgtctcc

SEQ ID NO: 135903 - DNA, 23 bp, Homo sapiens
tgagttcattgtagattctggat

SEQ ID NO: 135904 - DNA, 23 bp, Homo sapiens
tgagttcattgtagattctggat

SEQ ID NO: 135905 - DNA, 18 bp, Homo sapiens
ttaatgtcagctttaggg

SEQ ID NO: 135906 - DNA, 23 bp, Homo sapiens
actgtctgtcactgatatgtcaa

SEQ ID NO: 135907 - DNA, 23 bp, Homo sapiens
aattaatgactggagtgtcaggc

SEQ ID NO: 135908 - DNA, 23 bp, Homo sapiens
tcaaactccaaactgtttctcta

SEQ ID NO: 135909 - DNA, 23 bp, Homo sapiens
gtccagctgtctgtctctgtccc

SEQ ID NO: 135910 - DNA, 23 bp, Homo sapiens
catatcagtgccagctactcagg

SEQ ID NO: 135911 - DNA, 23 bp, Homo sapiens
tggatggatgcatgtatgtatgt

SEQ ID NO: 135912 - DNA, 19 bp, Homo sapiens
tgtgcgcctgcatctgcac

SEQ ID NO: 135913 - DNA, 23 bp, Homo sapiens
tgtgcctgtgtctgtgtgtgtct

SEQ ID NO: 135914 - DNA, 22 bp, Homo sapiens
acagctcctgcttatgggttga

SEQ ID NO: 135915 - DNA, 23 bp, Homo sapiens
tcggtctctctcagtcacttggg

SEQ ID NO: 135916 - DNA, 21 bp, Homo sapiens
tgagagagagtctcactctgg

SEQ ID NO: 135917 - DNA, 23 bp, Homo sapiens
cagttgtccatatgtagatgtgt

SEQ ID NO: 135918 - DNA, 23 bp, Homo sapiens
ttctggacactctattctgttcc

SEQ ID NO: 135919 - DNA, 23 bp, Homo sapiens
agagtctcactctgtcacccagg

SEQ ID NO: 135920 - DNA, 23 bp, Homo sapiens
gagtctcactctgtcacccaggc

SEQ ID NO: 135921 - DNA, 23 bp, Homo sapiens
tatatgtatgcatatgtatgtat

SEQ ID NO: 135922 - DNA, 23 bp, Homo sapiens
tatatatgcatatgtatatgtgt

SEQ ID NO: 135923 - DNA, 23 bp, Homo sapiens
agagtctcactctgtcacccagg

SEQ ID NO: 135924 - DNA, 23 bp, Homo sapiens
ttagattttctagtttgtgtgca

SEQ ID NO: 135925 - DNA, 23 bp, Homo sapiens
ttcacagtagtttctgaggatct

SEQ ID NO: 135926 - DNA, 19 bp, Homo sapiens
tgaggtagtagaatggcgt

SEQ ID NO: 135927 - DNA, 23 bp, Homo sapiens
tgagactgagctcacactctgtc

SEQ ID NO: 135928 - DNA, 23 bp, Homo sapiens
tctcactctgtcacacaggctgg

SEQ ID NO: 135929 - DNA, 23 bp, Homo sapiens
tctgagtccattgcatttctata

SEQ ID NO: 135930 - DNA, 22 bp, Homo sapiens
tattgttttacaatttgtgtct

SEQ ID NO: 135931 - DNA, 22 bp, Homo sapiens
aatgagcacagtcagcacactg

SEQ ID NO: 135932 - DNA, 23 bp, Homo sapiens
ttacaaccagagcatctgacaaa

SEQ ID NO: 135933 - DNA, 23 bp, Homo sapiens
atatgtatatatatgtgtgtgca

SEQ ID NO: 135934 - DNA, 23 bp, Homo sapiens
catatgtatgtatatatgtgtgt

SEQ ID NO: 135935 - DNA, 19 bp, Homo sapiens
tgtatacatacatatatgt

SEQ ID NO: 135936 - DNA, 19 bp, Homo sapiens
tgtatacatacatatatgt

SEQ ID NO: 135937 - DNA, 19 bp, Homo sapiens
tgtatacatacatatatgt

SEQ ID NO: 135938 - DNA, 19 bp, Homo sapiens
tgtatacatacatatatgt

SEQ ID NO: 135939 - DNA, 21 bp, Homo sapiens
tgtgtacacctatacatgtgt

SEQ ID NO: 135940 - DNA, 23 bp, Homo sapiens
caggtagctggttattaagtaga

SEQ ID NO: 135941 - DNA, 19 bp, Homo sapiens
ctatatatatatgtgttca

SEQ ID NO: 135942 - DNA, 23 bp, Homo sapiens
gaagtgaacttgctgtgtcatat

SEQ ID NO: 135943 - DNA, 21 bp, Homo sapiens
tagagtagtctgctgatacga

SEQ ID NO: 135944 - DNA, 23 bp, Homo sapiens
acagagtcgcactctgtcaccca

SEQ ID NO: 135945 - DNA, 23 bp, Homo sapiens
ccagtctcactctgtcactcagg

SEQ ID NO: 135946 - DNA, 21 bp, Homo sapiens
tcaatcttttggttatgcatc

SEQ ID NO: 135947 - DNA, 22 bp, Homo sapiens
tgtctaggaattgaagagttag

SEQ ID NO: 135948 - DNA, 23 bp, Homo sapiens
cttcatagtctgtgcttgtttgt

SEQ ID NO: 135949 - DNA, 23 bp, Homo sapiens
ggagtctcactctgtcactcagg

SEQ ID NO: 135950 - DNA, 20 bp, Homo sapiens
agtacagcagtgggatctca

SEQ ID NO: 135951 - DNA, 22 bp, Homo sapiens
tagtggttgaacagactgggct

SEQ ID NO: 135952 - DNA, 22 bp, Homo sapiens
agaaacctgacagtcactccct

SEQ ID NO: 135953 - DNA, 20 bp, Homo sapiens
gagacagaccaagctgctgc

SEQ ID NO: 135954 - DNA, 23 bp, Homo sapiens
actctgaggttgctgcaagtgct

SEQ ID NO: 135955 - DNA, 19 bp, Homo sapiens
tgagatggagtctcactct

SEQ ID NO: 135956 - DNA, 23 bp, Homo sapiens
tgacagatgagacactggtgact

SEQ ID NO: 135957 - DNA, 22 bp, Homo sapiens
tgtgacacttgtgttctccctg

SEQ ID NO: 135958 - DNA, 22 bp, Homo sapiens
gtgtgttctcagctcattgcaa

SEQ ID NO: 135959 - DNA, 22 bp, Homo sapiens
atgcctgtagttccagctgctt

SEQ ID NO: 135960 - DNA, 23 bp, Homo sapiens
cagtgagccaagatcatgccact

SEQ ID NO: 135961 - DNA, 21 bp, Homo sapiens
agagcaactatgatgtcctgt

SEQ ID NO: 135962 - DNA, 23 bp, Homo sapiens
tgagttcattgtagattctggat

SEQ ID NO: 135963 - DNA, 23 bp, Homo sapiens
tgagttcattgtagattctggat

SEQ ID NO: 135964 - DNA, 21 bp, Homo sapiens
ttttacgtatttatagtgtac

SEQ ID NO: 135965 - DNA, 22 bp, Homo sapiens
atggacttttctttgtaggaat

SEQ ID NO: 135966 - DNA, 23 bp, Homo sapiens
gacagagtctcgctctgtcaccc

SEQ ID NO: 135967 - DNA, 22 bp, Homo sapiens
actcagttgcatttcttttctt

SEQ ID NO: 135968 - DNA, 22 bp, Homo sapiens
tgaggaagaaggtagcattgtt

SEQ ID NO: 135969 - DNA, 23 bp, Homo sapiens
gggtctcactctgtcacccaggc

SEQ ID NO: 135970 - DNA, 23 bp, Homo sapiens
gggtctcactctgtcacccaggc

SEQ ID NO: 135971 - DNA, 23 bp, Homo sapiens
tagaaatgtgattttgttcagca

SEQ ID NO: 135972 - DNA, 21 bp, Homo sapiens
agtctgcagtgatgggagttc

SEQ ID NO: 135973 - DNA, 20 bp, Homo sapiens
tgaggtaggaggatcacttg

SEQ ID NO: 135974 - DNA, 20 bp, Homo sapiens
atgataccagttttacatga

SEQ ID NO: 135975 - DNA, 23 bp, Homo sapiens
taaatgtgtttataaaaatgtgt

SEQ ID NO: 135976 - DNA, 22 bp, Homo sapiens
tctcactgtcactcaggctgga

SEQ ID NO: 135977 - DNA, 18 bp, Homo sapiens
atcatgtggtagttctat

SEQ ID NO: 135978 - DNA, 20 bp, Homo sapiens
taggaaccttcatattgttt

SEQ ID NO: 135979 - DNA, 23 bp, Homo sapiens
aactttactgaatttgttgatca

SEQ ID NO: 135980 - DNA, 23 bp, Homo sapiens
aaactgctttttgatgtgtggat

SEQ ID NO: 135981 - DNA, 22 bp, Homo sapiens
attcagcaggttgaaaagactc

SEQ ID NO: 135982 - DNA, 21 bp, Homo sapiens
agtgtccctgtgtctctcgca

SEQ ID NO: 135983 - DNA, 23 bp, Homo sapiens
ttctgttgttagctctttgagga

SEQ ID NO: 135984 - DNA, 22 bp, Homo sapiens
ttttcacagtggctgaactaat

SEQ ID NO: 135985 - DNA, 23 bp, Homo sapiens
tgagttcattgtagattctggat

SEQ ID NO: 135986 - DNA, 23 bp, Homo sapiens
tgagttcattgtagattctggat

SEQ ID NO: 135987 - DNA, 23 bp, Homo sapiens
tgagatggagtcccactctgtct

SEQ ID NO: 135988 - DNA, 20 bp, Homo sapiens
ttggtgaagttgttagcatt

SEQ ID NO: 135989 - DNA, 23 bp, Homo sapiens
gggtgagtcagtgagtgagtgtt

SEQ ID NO: 135990 - DNA, 23 bp, Homo sapiens
tgagttcattgtagattctggat

SEQ ID NO: 135991 - DNA, 23 bp, Homo sapiens
tgagttcattgtagattctggat

SEQ ID NO: 135992 - DNA, 23 bp, Homo sapiens
agacagtctctctctgtcgccca

SEQ ID NO: 135993 - DNA, 23 bp, Homo sapiens
agagggagtctcactctgtcagc

SEQ ID NO: 135994 - DNA, 18 bp, Homo sapiens
aaagtgttggattacagg

SEQ ID NO: 135995 - DNA, 23 bp, Homo sapiens
tgagacagagtctcactctgtca

SEQ ID NO: 135996 - DNA, 23 bp, Homo sapiens
agagtctcactctgtcacccagg

SEQ ID NO: 135997 - DNA, 23 bp, Homo sapiens
tttttggctccatatgaaattta

SEQ ID NO: 135998 - DNA, 23 bp, Homo sapiens
tgttacagcttcttgatctgtcc

SEQ ID NO: 135999 - DNA, 20 bp, Homo sapiens
acagtatagtaagtgtagta

SEQ ID NO: 136000 - DNA, 23 bp, Homo sapiens
tagtacagtgtggtacagtacag

SEQ ID NO: 136001 - DNA, 23 bp, Homo sapiens
tttctgtgagctgttttgaacaa

SEQ ID NO: 136002 - DNA, 19 bp, Homo sapiens
cctctctgtgcctctctgt

SEQ ID NO: 136003 - DNA, 22 bp, Homo sapiens
gtgtcactctttctctgtatgg

SEQ ID NO: 136004 - DNA, 23 bp, Homo sapiens
aagacgtgtttcttgatgttttt

SEQ ID NO: 136005 - DNA, 23 bp, Homo sapiens
tatgcatgtgtatatgtatgtgt

SEQ ID NO: 136006 - DNA, 23 bp, Homo sapiens
tacagtcacagcatgaggatctg

SEQ ID NO: 136007 - DNA, 23 bp, Homo sapiens
tttgagacggagtctcactctgt

SEQ ID NO: 136008 - DNA, 19 bp, Homo sapiens
acactgttatggcagccct

SEQ ID NO: 136009 - DNA, 23 bp, Homo sapiens
catcccagtgaagacagtaagca

SEQ ID NO: 136010 - DNA, 23 bp, Homo sapiens
gtgtgtgcatgtgtatgcatgtg

SEQ ID NO: 136011 - DNA, 23 bp, Homo sapiens
gtgtgtgcatgtgcaagagtatg

SEQ ID NO: 136012 - DNA, 23 bp, Homo sapiens
tgaacatgtgtatgtgtgtgcat

SEQ ID NO: 136013 - DNA, 23 bp, Homo sapiens
atgtatgtgtgcatgtgcatgtg

SEQ ID NO: 136014 - DNA, 23 bp, Homo sapiens
gacacccactgtgactcacttca

SEQ ID NO: 136015 - DNA, 18 bp, Homo sapiens
aatgtactacttaattgc

SEQ ID NO: 136016 - DNA, 23 bp, Homo sapiens
agaatccttgctaatgtagtttg

SEQ ID NO: 136017 - DNA, 23 bp, Homo sapiens
tctgttttggttccatatgaatt

SEQ ID NO: 136018 - DNA, 23 bp, Homo sapiens
tatatatgtatatgtatacatat

SEQ ID NO: 136019 - DNA, 20 bp, Homo sapiens
tcacctcttgtttgcaatgt

SEQ ID NO: 136020 - DNA, 22 bp, Homo sapiens
gtactgtgtaatctaaattagt

SEQ ID NO: 136021 - DNA, 23 bp, Homo sapiens
atacactctcctatagtgctaat

SEQ ID NO: 136022 - DNA, 20 bp, Homo sapiens
tgaggtaggaggatcacttg

SEQ ID NO: 136023 - DNA, 23 bp, Homo sapiens
tgtgtgtatatatatatgtgtgt

SEQ ID NO: 136024 - DNA, 21 bp, Homo sapiens
tacatattatacatatgtgtg

SEQ ID NO: 136025 - DNA, 23 bp, Homo sapiens
attgtctcactgcctctctgctg

SEQ ID NO: 136026 - DNA, 23 bp, Homo sapiens
tgagttcattgtagattctggat

SEQ ID NO: 136027 - DNA, 23 bp, Homo sapiens
tgagttcattgtagattctggat

SEQ ID NO: 136028 - DNA, 21 bp, Homo sapiens
tagacagttgtgagagagatc

SEQ ID NO: 136029 - DNA, 20 bp, Homo sapiens
ttttctctcaaggtgttatt

SEQ ID NO: 136030 - DNA, 23 bp, Homo sapiens
aaagacagttttgtttttagtga

SEQ ID NO: 136031 - DNA, 23 bp, Homo sapiens
agtcagaagagtgagagcaaatg

SEQ ID NO: 136032 - DNA, 21 bp, Homo sapiens
gtgttctacctgtgtatatat

SEQ ID NO: 136033 - DNA, 23 bp, Homo sapiens
atgtatgtatatgtatatgtgtg

SEQ ID NO: 136034 - DNA, 21 bp, Homo sapiens
atacacacagaacacatatac

SEQ ID NO: 136035 - DNA, 23 bp, Homo sapiens
tataaggatcatgttgaatctgt

SEQ ID NO: 136036 - DNA, 23 bp, Homo sapiens
tgagttcattgtagattctggat

SEQ ID NO: 136037 - DNA, 23 bp, Homo sapiens
tgagttcattgtagattctggat

SEQ ID NO: 136038 - DNA, 18 bp, Homo sapiens
attgcatatgtatatata

SEQ ID NO: 136039 - DNA, 21 bp, Homo sapiens
tgaatgtagtatatgtatact

SEQ ID NO: 136040 - DNA, 23 bp, Homo sapiens
tatgtgtatgtgtataaatgtat

SEQ ID NO: 136041 - DNA, 19 bp, Homo sapiens
tacatatacatacacatat

SEQ ID NO: 136042 - DNA, 22 bp, Homo sapiens
taatctattgatgtttgatcat

SEQ ID NO: 136043 - DNA, 20 bp, Homo sapiens
caggttctgtgttattgtcc

SEQ ID NO: 136044 - DNA, 20 bp, Homo sapiens
taaagtaaacaacgtatgtc

SEQ ID NO: 136045 - DNA, 23 bp, Homo sapiens
atatacgtatatatacgtgtatg

SEQ ID NO: 136046 - DNA, 21 bp, Homo sapiens
tatacgtatatatacgtgtat

SEQ ID NO: 136047 - DNA, 23 bp, Homo sapiens
tatatatgtatatatacgtgtat

SEQ ID NO: 136048 - DNA, 23 bp, Homo sapiens
cactcgctcactctcagcctcag

SEQ ID NO: 136049 - DNA, 23 bp, Homo sapiens
agtagtgtcatgttgatgtagaa

SEQ ID NO: 136050 - DNA, 18 bp, Homo sapiens
acacacacacgtatatgt

SEQ ID NO: 136051 - DNA, 22 bp, Homo sapiens
attggagactgtgagcactgtc

SEQ ID NO: 136052 - DNA, 21 bp, Homo sapiens
agcagagttagaatggtgaca

SEQ ID NO: 136053 - DNA, 18 bp, Homo sapiens
agaggcatgatcatggct

SEQ ID NO: 136054 - DNA, 22 bp, Homo sapiens
tttcatctcagcatctaattca

SEQ ID NO: 136055 - DNA, 23 bp, Homo sapiens
gagatcagagtgagattaatagg

SEQ ID NO: 136056 - DNA, 23 bp, Homo sapiens
agtcattcaactttgttttctgg

SEQ ID NO: 136057 - DNA, 19 bp, Homo sapiens
ttttttttgttttgagata

SEQ ID NO: 136058 - DNA, 23 bp, Homo sapiens
tgtgacagcttcttgatctgtcc

SEQ ID NO: 136059 - DNA, 23 bp, Homo sapiens
tcttttttggttccatatgaaat

SEQ ID NO: 136060 - DNA, 22 bp, Homo sapiens
caattctatgaagaaagtcaat

SEQ ID NO: 136061 - DNA, 21 bp, Homo sapiens
tttgcacatgtttaatttatg

SEQ ID NO: 136062 - DNA, 23 bp, Homo sapiens
tgtcagaaacttatgggagagat

SEQ ID NO: 136063 - DNA, 23 bp, Homo sapiens
attctctgtgaaaccttctggtt

SEQ ID NO: 136064 - DNA, 23 bp, Homo sapiens
agaggtgagagagctctctgggg

SEQ ID NO: 136065 - DNA, 18 bp, Homo sapiens
tgctatatatatgatagt

SEQ ID NO: 136066 - DNA, 22 bp, Homo sapiens
ttagacaggggaattgatgcag

SEQ ID NO: 136067 - DNA, 18 bp, Homo sapiens
aactccttttttttctct

SEQ ID NO: 136068 - DNA, 23 bp, Homo sapiens
taaatgcttctagaatgacagca

SEQ ID NO: 136069 - DNA, 22 bp, Homo sapiens
tatgtgtgtatatatatacatg

SEQ ID NO: 136070 - DNA, 23 bp, Homo sapiens
atatgtgtgtatatatatacatg

SEQ ID NO: 136071 - DNA, 23 bp, Homo sapiens
atatgtgtgtatatatatacatg

SEQ ID NO: 136072 - DNA, 23 bp, Homo sapiens
tgagttcattgtagattctggat

SEQ ID NO: 136073 - DNA, 23 bp, Homo sapiens
tgagttcattgtagattctggat

SEQ ID NO: 136074 - DNA, 23 bp, Homo sapiens
tctgcctcggtttccttatctgt

SEQ ID NO: 136075 - DNA, 23 bp, Homo sapiens
aaagtctcactctgtcacccagg

SEQ ID NO: 136076 - DNA, 21 bp, Homo sapiens
agagcaagtgtggtgatttca

SEQ ID NO: 136077 - DNA, 23 bp, Homo sapiens
actgagtctcgctctgtcaccca

SEQ ID NO: 136078 - DNA, 23 bp, Homo sapiens
tgcagtggcatgatcttggctta

SEQ ID NO: 136079 - DNA, 22 bp, Homo sapiens
tgaatttgtgcgtgctctttgc

SEQ ID NO: 136080 - DNA, 22 bp, Homo sapiens
tcaaagagcaagagcatgtgca

SEQ ID NO: 136081 - DNA, 23 bp, Homo sapiens
acttatcacagtctttttgtgag

SEQ ID NO: 136082 - DNA, 23 bp, Homo sapiens
ctttgaagtaagcaagtctaacc

SEQ ID NO: 136083 - DNA, 23 bp, Homo sapiens
tctctcagtgtaatctggttgag

SEQ ID NO: 136084 - DNA, 21 bp, Homo sapiens
tttgtctcctctgcaaggttt

SEQ ID NO: 136085 - DNA, 18 bp, Homo sapiens
tatgtacacacacacaca

SEQ ID NO: 136086 - DNA, 23 bp, Homo sapiens
agagcaatagaattgaaatagga

SEQ ID NO: 136087 - DNA, 23 bp, Homo sapiens
aaatactttgcatatttaatgtt

SEQ ID NO: 136088 - DNA, 20 bp, Homo sapiens
tcaatggtagcttgatggag

SEQ ID NO: 136089 - DNA, 22 bp, Homo sapiens
tgagatgaaacagagagagaga

SEQ ID NO: 136090 - DNA, 23 bp, Homo sapiens
aatctctctctctgtttcatctc

SEQ ID NO: 136091 - DNA, 23 bp, Homo sapiens
taatgtgtcacgtcctaaaatct

SEQ ID NO: 136092 - DNA, 23 bp, Homo sapiens
tctctgtctgtctctgtctctct

SEQ ID NO: 136093 - DNA, 21 bp, Homo sapiens
tgagtagaagcagagactgtg

SEQ ID NO: 136094 - DNA, 23 bp, Homo sapiens
agagtctcactctgtcacccagg

SEQ ID NO: 136095 - DNA, 21 bp, Homo sapiens
tggttttcatttctaagttca

SEQ ID NO: 136096 - DNA, 20 bp, Homo sapiens
tctctccctctgtgactcat

SEQ ID NO: 136097 - DNA, 21 bp, Homo sapiens
ataaatgtaaatttcctttca

SEQ ID NO: 136098 - DNA, 22 bp, Homo sapiens
atggatagcacatatgtatgta

SEQ ID NO: 136099 - DNA, 20 bp, Homo sapiens
agggctgaatcagatgcaga

SEQ ID NO: 136100 - DNA, 20 bp, Homo sapiens
tatggatatactatctatat

SEQ ID NO: 136101 - DNA, 23 bp, Homo sapiens
ataaagttgttgtcctgctgctg

SEQ ID NO: 136102 - DNA, 19 bp, Homo sapiens
attgcactccagcctgggt

SEQ ID NO: 136103 - DNA, 23 bp, Homo sapiens
tgtatgcatatcatatgttattt

SEQ ID NO: 136104 - DNA, 22 bp, Homo sapiens
aagacagaccctcagtgtggcc

SEQ ID NO: 136105 - DNA, 22 bp, Homo sapiens
atgtatgtatgtatgtgtgtat

SEQ ID NO: 136106 - DNA, 23 bp, Homo sapiens
ccttgcagagtgaacacagagtg

SEQ ID NO: 136107 - DNA, 23 bp, Homo sapiens
cagtctttgtagtattaagagga

SEQ ID NO: 136108 - DNA, 23 bp, Homo sapiens
aacagagaaaactgagtgtggag

SEQ ID NO: 136109 - DNA, 23 bp, Homo sapiens
aaagagcatattatttcaatttc

SEQ ID NO: 136110 - DNA, 22 bp, Homo sapiens
tatatgtgtacatatgttgata

SEQ ID NO: 136111 - DNA, 23 bp, Homo sapiens
acgtacatgtatgtatatgtgtg

SEQ ID NO: 136112 - DNA, 21 bp, Homo sapiens
tgtgtctctgtgtgtgtgtgc

SEQ ID NO: 136113 - DNA, 19 bp, Homo sapiens
tgtgtatatgtgtgtgtgt

SEQ ID NO: 136114 - DNA, 23 bp, Homo sapiens
tgctatgaacaaatgggtatcag

SEQ ID NO: 136115 - DNA, 23 bp, Homo sapiens
atgctgaggaattcatttgttga

SEQ ID NO: 136116 - DNA, 23 bp, Homo sapiens
tgagttcattgtagattctggat

SEQ ID NO: 136117 - DNA, 23 bp, Homo sapiens
tgagttcattgtagattctggat

SEQ ID NO: 136118 - DNA, 23 bp, Homo sapiens
tgtgtgtctgtgtccttatctcc

SEQ ID NO: 136119 - DNA, 22 bp, Homo sapiens
tgtctatatatgtatatatgta

SEQ ID NO: 136120 - DNA, 23 bp, Homo sapiens
agatggagtctcactctgtcacc

SEQ ID NO: 136121 - DNA, 22 bp, Homo sapiens
aggctcacactgactgtctttc

SEQ ID NO: 136122 - DNA, 23 bp, Homo sapiens
atctgactctgcctctgcctctg

SEQ ID NO: 136123 - DNA, 18 bp, Homo sapiens
ctcagtgggcttgcaaga

SEQ ID NO: 136124 - DNA, 22 bp, Homo sapiens
gtctccgttactaatggacaga

SEQ ID NO: 136125 - DNA, 20 bp, Homo sapiens
tgccttctctggacagtgga

SEQ ID NO: 136126 - DNA, 23 bp, Homo sapiens
agagagaagccagagaggtcatc

SEQ ID NO: 136127 - DNA, 23 bp, Homo sapiens
tctttgtgctttgttatttctga

SEQ ID NO: 136128 - DNA, 23 bp, Homo sapiens
agactatagtcattttgtagtag

SEQ ID NO: 136129 - DNA, 22 bp, Homo sapiens
ctgtgtatgtctgtgtcctaat

SEQ ID NO: 136130 - DNA, 20 bp, Homo sapiens
acaccagttgtattggatga

SEQ ID NO: 136131 - DNA, 23 bp, Homo sapiens
tgagttcattgtagattctggat

SEQ ID NO: 136132 - DNA, 23 bp, Homo sapiens
tgagttcattgtagattctggat

SEQ ID NO: 136133 - DNA, 23 bp, Homo sapiens
gagacggagtctcactctgtcac

SEQ ID NO: 136134 - DNA, 23 bp, Homo sapiens
tgagttcattgtagattctggat

SEQ ID NO: 136135 - DNA, 23 bp, Homo sapiens
tgagttcattgtagattctggat

SEQ ID NO: 136136 - DNA, 23 bp, Homo sapiens
tgaaaagttcttgcagtaatgct

SEQ ID NO: 136137 - DNA, 21 bp, Homo sapiens
tgcttgagtgttagcttcctg

SEQ ID NO: 136138 - DNA, 22 bp, Homo sapiens
tgttttcaagtgtttgtgttgt

SEQ ID NO: 136139 - DNA, 23 bp, Homo sapiens
tatgtgtatgtgtgtatacatgt

SEQ ID NO: 136140 - DNA, 23 bp, Homo sapiens
cctatgtgtgtctctgtatgtga

SEQ ID NO: 136141 - DNA, 21 bp, Homo sapiens
aatggttttgttcatagctag

SEQ ID NO: 136142 - DNA, 19 bp, Homo sapiens
tccctgtgtgctcaggacc

SEQ ID NO: 136143 - DNA, 18 bp, Homo sapiens
tacagctatatgtatata

SEQ ID NO: 136144 - DNA, 23 bp, Homo sapiens
atacttggacgtaaagataggaa

SEQ ID NO: 136145 - DNA, 22 bp, Homo sapiens
tcctaggctgggtgtgtgtgtg

SEQ ID NO: 136146 - DNA, 23 bp, Homo sapiens
ttcaagtacattatttttgtatg

SEQ ID NO: 136147 - DNA, 20 bp, Homo sapiens
tgtgtgtgtatatatatatg

SEQ ID NO: 136148 - DNA, 18 bp, Homo sapiens
tatgaaatacatatgtga

SEQ ID NO: 136149 - DNA, 23 bp, Homo sapiens
aaaacctttttgtgcaggttcaa

SEQ ID NO: 136150 - DNA, 22 bp, Homo sapiens
tttatagtatagacagtcttta

SEQ ID NO: 136151 - DNA, 23 bp, Homo sapiens
tgtgtgtgtatatatatactgta

SEQ ID NO: 136152 - DNA, 23 bp, Homo sapiens
tgtgtgtgtatatatatactgta

SEQ ID NO: 136153 - DNA, 23 bp, Homo sapiens
tgtgtgtgtatatatatactgta

SEQ ID NO: 136154 - DNA, 20 bp, Homo sapiens
tgtgtatatatatactgtat

SEQ ID NO: 136155 - DNA, 23 bp, Homo sapiens
tagaggctctgctctccgtgttc

SEQ ID NO: 136156 - DNA, 23 bp, Homo sapiens
taaggcacgcggtgaatgccaag

SEQ ID NO: 136157 - DNA, 23 bp, Homo sapiens
agcatgatgtagtagaaagagct

SEQ ID NO: 136158 - DNA, 20 bp, Homo sapiens
tctcagtggattcgcttttc

SEQ ID NO: 136159 - DNA, 21 bp, Homo sapiens
tgttctcaagcaaagttgtca

SEQ ID NO: 136160 - DNA, 23 bp, Homo sapiens
tttgtgtagagacaggaattgcc

SEQ ID NO: 136161 - DNA, 20 bp, Homo sapiens
tgacagccactctgtctctt

SEQ ID NO: 136162 - DNA, 21 bp, Homo sapiens
aaccatccttgcattacagtg

SEQ ID NO: 136163 - DNA, 23 bp, Homo sapiens
aagtgctgttgaatttggtttgc

SEQ ID NO: 136164 - DNA, 18 bp, Homo sapiens
agtatgaagacactctct

SEQ ID NO: 136165 - DNA, 22 bp, Homo sapiens
tcactgtggttcatcaggaaga

SEQ ID NO: 136166 - DNA, 18 bp, Homo sapiens
tatgatttttgcaaatgt

SEQ ID NO: 136167 - DNA, 19 bp, Homo sapiens
ttcacctgcatttccaagg

SEQ ID NO: 136168 - DNA, 22 bp, Homo sapiens
aggcagatatcactgtgctgag

SEQ ID NO: 136169 - DNA, 19 bp, Homo sapiens
aggcctttagatttcaaga

SEQ ID NO: 136170 - DNA, 23 bp, Homo sapiens
agacagagtctcgctctgtcacc

SEQ ID NO: 136171 - DNA, 23 bp, Homo sapiens
atacaatgtatatatgaatgtat

SEQ ID NO: 136172 - DNA, 22 bp, Homo sapiens
tgtatatatgcatgcatatata

SEQ ID NO: 136173 - DNA, 23 bp, Homo sapiens
tatatgcatgtatatatgcatgt

SEQ ID NO: 136174 - DNA, 22 bp, Homo sapiens
atatacaatgtatatatgtatg

SEQ ID NO: 136175 - DNA, 23 bp, Homo sapiens
aagtctcactctgtcacccaggc

SEQ ID NO: 136176 - DNA, 23 bp, Homo sapiens
tgagttcattgtagattctggat

SEQ ID NO: 136177 - DNA, 23 bp, Homo sapiens
tgagttcattgtagattctggat

SEQ ID NO: 136178 - DNA, 23 bp, Homo sapiens
tgactgtctctgactcactctgc

SEQ ID NO: 136179 - DNA, 22 bp, Homo sapiens
aggctattagtgagtagtgagt

SEQ ID NO: 136180 - DNA, 23 bp, Homo sapiens
aatacagacaagtacagtatcaa

SEQ ID NO: 136181 - DNA, 21 bp, Homo sapiens
tgaggtaggaggatcacttga

SEQ ID NO: 136182 - DNA, 19 bp, Homo sapiens
agcaggagtttaactttat

SEQ ID NO: 136183 - DNA, 21 bp, Homo sapiens
tgagatggagtctcgctctgt

SEQ ID NO: 136184 - DNA, 23 bp, Homo sapiens
agtctcactctgtcacccaggct

SEQ ID NO: 136185 - DNA, 23 bp, Homo sapiens
gctctcagtcactcagtgtgtgc

SEQ ID NO: 136186 - DNA, 21 bp, Homo sapiens
tgaggtagaaggatcacttca

SEQ ID NO: 136187 - DNA, 23 bp, Homo sapiens
ggaacagcatgagaaagtgaagg

SEQ ID NO: 136188 - DNA, 23 bp, Homo sapiens
tagtgtcttcgtttacttgtgct

SEQ ID NO: 136189 - DNA, 21 bp, Homo sapiens
tatacacatatgtgtgtgtgc

SEQ ID NO: 136190 - DNA, 23 bp, Homo sapiens
tctctctgtctatttcttggctt

SEQ ID NO: 136191 - DNA, 23 bp, Homo sapiens
ctcccagagcccctggaactctg

SEQ ID NO: 136192 - DNA, 23 bp, Homo sapiens
tcccagagcccctggaactctgg

SEQ ID NO: 136193 - DNA, 23 bp, Homo sapiens
tcccagagcccctggaactctgg

SEQ ID NO: 136194 - DNA, 23 bp, Homo sapiens
tcccagagcccctggaactctgg

SEQ ID NO: 136195 - DNA, 23 bp, Homo sapiens
gtcggtctcactcccactgtgtc

SEQ ID NO: 136196 - DNA, 23 bp, Homo sapiens
tttgtgtgccagtctccctcact

SEQ ID NO: 136197 - DNA, 23 bp, Homo sapiens
gttgctgtcctatcaatgctgct

SEQ ID NO: 136198 - DNA, 23 bp, Homo sapiens
tgacagatgacggtgagcatagc

SEQ ID NO: 136199 - DNA, 23 bp, Homo sapiens
agacaaagtctcactctgtcacc

SEQ ID NO: 136200 - DNA, 23 bp, Homo sapiens
taagagagtgaactgagagctgt

SEQ ID NO: 136201 - DNA, 23 bp, Homo sapiens
tcagtttcttttcccagctctca

SEQ ID NO: 136202 - DNA, 22 bp, Homo sapiens
actgtatgcatacacacacaca

SEQ ID NO: 136203 - DNA, 19 bp, Homo sapiens
tgtatgtatgtatgtatgt

SEQ ID NO: 136204 - DNA, 23 bp, Homo sapiens
ggagtctcactctgtcaccaaac

SEQ ID NO: 136205 - DNA, 23 bp, Homo sapiens
ggattacagacatgtgccaccac

SEQ ID NO: 136206 - DNA, 21 bp, Homo sapiens
tgaggtagaaggatcacttga

SEQ ID NO: 136207 - DNA, 23 bp, Homo sapiens
tagtaatactgtcaggttttcac

SEQ ID NO: 136208 - DNA, 23 bp, Homo sapiens
gacagagtctcgctctgtcaccc

SEQ ID NO: 136209 - DNA, 18 bp, Homo sapiens
tgccacattttgtttatc

SEQ ID NO: 136210 - DNA, 23 bp, Homo sapiens
atgaatggattgatgaatggata

SEQ ID NO: 136211 - DNA, 23 bp, Homo sapiens
tgcagtggcatgatcttggctca

SEQ ID NO: 136212 - DNA, 19 bp, Homo sapiens
tgtatgtgtgtgtatatat

SEQ ID NO: 136213 - DNA, 22 bp, Homo sapiens
tgtgtgtatatatatgtgtgtg

SEQ ID NO: 136214 - DNA, 23 bp, Homo sapiens
tggagtctcactctgtcacccag

SEQ ID NO: 136215 - DNA, 23 bp, Homo sapiens
gttattcattcagttccagaaag

SEQ ID NO: 136216 - DNA, 23 bp, Homo sapiens
atatcgctgtgtgagaattgagt

SEQ ID NO: 136217 - DNA, 23 bp, Homo sapiens
tcagtcacagcttagtctgtcac

SEQ ID NO: 136218 - DNA, 23 bp, Homo sapiens
tgagttcattgtagattctggat

SEQ ID NO: 136219 - DNA, 23 bp, Homo sapiens
tgagttcattgtagattctggat

SEQ ID NO: 136220 - DNA, 23 bp, Homo sapiens
ggcctctctgtgtctctcatggc

SEQ ID NO: 136221 - DNA, 22 bp, Homo sapiens
tgtctcagtcagggttttatga

SEQ ID NO: 136222 - DNA, 21 bp, Homo sapiens
tagagaggtgtctgaggacac

SEQ ID NO: 136223 - DNA, 22 bp, Homo sapiens
tctctgcctcactgtgtggcca

SEQ ID NO: 136224 - DNA, 23 bp, Homo sapiens
agagtctcactctgtcacccagg

SEQ ID NO: 136225 - DNA, 23 bp, Homo sapiens
gagtctcactctgtcacccaggc

SEQ ID NO: 136226 - DNA, 23 bp, Homo sapiens
tctcagatgagactgtggacttg

SEQ ID NO: 136227 - DNA, 23 bp, Homo sapiens
ctcattggctcactcattgcctc

SEQ ID NO: 136228 - DNA, 22 bp, Homo sapiens
aaatggaggattacaaaatgtt

SEQ ID NO: 136229 - DNA, 20 bp, Homo sapiens
ttgaggtaaaatttacattt

SEQ ID NO: 136230 - DNA, 23 bp, Homo sapiens
ctgtagtccctgctactctggag

SEQ ID NO: 136231 - DNA, 18 bp, Homo sapiens
tagagtggcacaatcctg

SEQ ID NO: 136232 - DNA, 23 bp, Homo sapiens
aggaagttgaggctgcagtgagc

SEQ ID NO: 136233 - DNA, 23 bp, Homo sapiens
agcacagactccaacatcatctg

SEQ ID NO: 136234 - DNA, 23 bp, Homo sapiens
tagagtagcagcatctgaaatga

SEQ ID NO: 136235 - DNA, 22 bp, Homo sapiens
agtctcactctgtcacttaggc

SEQ ID NO: 136236 - DNA, 21 bp, Homo sapiens
aactgttgagtggacattgtt

SEQ ID NO: 136237 - DNA, 23 bp, Homo sapiens
acttttgtcactgtcttggtttt

SEQ ID NO: 136238 - DNA, 23 bp, Homo sapiens
gactgagtctccctctgtcaccc

SEQ ID NO: 136239 - DNA, 23 bp, Homo sapiens
tgagttcattgtagattctggat

SEQ ID NO: 136240 - DNA, 23 bp, Homo sapiens
tgagttcattgtagattctggat

SEQ ID NO: 136241 - DNA, 19 bp, Homo sapiens
tgtgtgtgtgtgtgtgtgt

SEQ ID NO: 136242 - DNA, 22 bp, Homo sapiens
tgtgtatatatgtatgagtgtg

SEQ ID NO: 136243 - DNA, 23 bp, Homo sapiens
atgtgtgtatatgtatatgtgtg

SEQ ID NO: 136244 - DNA, 23 bp, Homo sapiens
tgtgtgtatatatatatgtgtgt

SEQ ID NO: 136245 - DNA, 19 bp, Homo sapiens
tgtgtatatatatatgtgt

SEQ ID NO: 136246 - DNA, 23 bp, Homo sapiens
tgtgtatatatatatgtgtgtgt

SEQ ID NO: 136247 - DNA, 23 bp, Homo sapiens
cataaatgtgtgcatttgtgttt

SEQ ID NO: 136248 - DNA, 21 bp, Homo sapiens
tatgcatgtttgtatctatgt

SEQ ID NO: 136249 - DNA, 23 bp, Homo sapiens
tctgtctctctgagctgaaggct

SEQ ID NO: 136250 - DNA, 19 bp, Homo sapiens
atatatgtatacatagata

SEQ ID NO: 136251 - DNA, 23 bp, Homo sapiens
gagtctcactctgtcacccaggc

SEQ ID NO: 136252 - DNA, 23 bp, Homo sapiens
acagtctcactctgtcacccagg

SEQ ID NO: 136253 - DNA, 23 bp, Homo sapiens
agtttgtcatcttctcatagtga

SEQ ID NO: 136254 - DNA, 23 bp, Homo sapiens
tctgagagaagactgactgctgt

SEQ ID NO: 136255 - DNA, 23 bp, Homo sapiens
tgagttcattgtagattctggat

SEQ ID NO: 136256 - DNA, 23 bp, Homo sapiens
tgagttcattgtagattctggat

SEQ ID NO: 136257 - DNA, 19 bp, Homo sapiens
tatgtgcatgtatttaaat

SEQ ID NO: 136258 - DNA, 21 bp, Homo sapiens
tatgtgtatgtatatatgtgt

SEQ ID NO: 136259 - DNA, 22 bp, Homo sapiens
atacacacacacatacatatac

SEQ ID NO: 136260 - DNA, 23 bp, Homo sapiens
tgagttcattgtagattctggat

SEQ ID NO: 136261 - DNA, 23 bp, Homo sapiens
tgagttcattgtagattctggat

SEQ ID NO: 136262 - DNA, 23 bp, Homo sapiens
tgtgtgtgtgtatgtatatactg

SEQ ID NO: 136263 - DNA, 23 bp, Homo sapiens
taaggtagtagaaagaattcacg

SEQ ID NO: 136264 - DNA, 23 bp, Homo sapiens
tcaagttctgactactacttatt

SEQ ID NO: 136265 - DNA, 20 bp, Homo sapiens
atatagccagaagtagaatt

SEQ ID NO: 136266 - DNA, 20 bp, Homo sapiens
tatttctcagggctattgta

SEQ ID NO: 136267 - DNA, 22 bp, Homo sapiens
tttcagcttctattgagttcaa

SEQ ID NO: 136268 - DNA, 22 bp, Homo sapiens
aaatggatatataggtaagtat

SEQ ID NO: 136269 - DNA, 23 bp, Homo sapiens
ttgaagagattatgaaattgtgt

SEQ ID NO: 136270 - DNA, 23 bp, Homo sapiens
acagagtctcgctctgtctccca

SEQ ID NO: 136271 - DNA, 23 bp, Homo sapiens
atctaagttattatgtacttttg

SEQ ID NO: 136272 - DNA, 22 bp, Homo sapiens
tatatgtatgtgtgtatatgta

SEQ ID NO: 136273 - DNA, 23 bp, Homo sapiens
tgagttcattgtagattctggat

SEQ ID NO: 136274 - DNA, 23 bp, Homo sapiens
tgagttcattgtagattctggat

SEQ ID NO: 136275 - DNA, 23 bp, Homo sapiens
tagagagtgttgtcacagtgcac

SEQ ID NO: 136276 - DNA, 22 bp, Homo sapiens
aagctgacatatgtatatatgt

SEQ ID NO: 136277 - DNA, 23 bp, Homo sapiens
gagagagtgtgtgtgtgcgtgtg

SEQ ID NO: 136278 - DNA, 19 bp, Homo sapiens
taaaacacacacatataaa

SEQ ID NO: 136279 - DNA, 23 bp, Homo sapiens
aaaaagctggtcttgatgtgcta

SEQ ID NO: 136280 - DNA, 22 bp, Homo sapiens
ttagtctgttttcatgctgctg

SEQ ID NO: 136281 - DNA, 21 bp, Homo sapiens
atcactagctgctaaaattgt

SEQ ID NO: 136282 - DNA, 20 bp, Homo sapiens
tagtacagctgcagcagcta

SEQ ID NO: 136283 - DNA, 23 bp, Homo sapiens
tatatgtatatgtatatatgtat

SEQ ID NO: 136284 - DNA, 19 bp, Homo sapiens
tgagaaaaacatgtaagga

SEQ ID NO: 136285 - DNA, 22 bp, Homo sapiens
atccaagagcataacttcccca

SEQ ID NO: 136286 - DNA, 22 bp, Homo sapiens
tttgttctttttgcataggatt

SEQ ID NO: 136287 - DNA, 21 bp, Homo sapiens
tgtgatgaaagtcaatggtag

SEQ ID NO: 136288 - DNA, 23 bp, Homo sapiens
agacacacaactgagtgtgaagt

SEQ ID NO: 136289 - DNA, 23 bp, Homo sapiens
gtatagctagataatagagtttt

SEQ ID NO: 136290 - DNA, 23 bp, Homo sapiens
tgtccctgtgtcagtgctaggca

SEQ ID NO: 136291 - DNA, 21 bp, Homo sapiens
tagaggttcctttggctctgt

SEQ ID NO: 136292 - DNA, 23 bp, Homo sapiens
tcagtcagtcactgcctgtctgg

SEQ ID NO: 136293 - DNA, 23 bp, Homo sapiens
tgtctagtaaatgatttcatttt

SEQ ID NO: 136294 - DNA, 20 bp, Homo sapiens
tctctgggtcattcctgtca

SEQ ID NO: 136295 - DNA, 23 bp, Homo sapiens
ggagtgtgactacacagtgacca

SEQ ID NO: 136296 - DNA, 19 bp, Homo sapiens
tgctctcggcgcttcctct

SEQ ID NO: 136297 - DNA, 23 bp, Homo sapiens
actgagtctcgctctgtcaccca

SEQ ID NO: 136298 - DNA, 23 bp, Homo sapiens
taggagcatagtttatttgattt

SEQ ID NO: 136299 - DNA, 23 bp, Homo sapiens
ccctgtgtgtgtctctctgtttg

SEQ ID NO: 136300 - DNA, 23 bp, Homo sapiens
aaaattctgtttttgtagaactg

SEQ ID NO: 136301 - DNA, 23 bp, Homo sapiens
ggaactgaagatatttctgattc

SEQ ID NO: 136302 - DNA, 21 bp, Homo sapiens
ttctgttttagatgatgtgag

SEQ ID NO: 136303 - DNA, 23 bp, Homo sapiens
aggacatttaagcagaaaccaga

SEQ ID NO: 136304 - DNA, 23 bp, Homo sapiens
tatgtgtgtgtatatctatatat

SEQ ID NO: 136305 - DNA, 23 bp, Homo sapiens
tcagtgtctttgtcagtttgggc

SEQ ID NO: 136306 - DNA, 19 bp, Homo sapiens
ttctcaaagctctggaggc

SEQ ID NO: 136307 - DNA, 23 bp, Homo sapiens
gtgtgtgtgtatatatgtgtgtg

SEQ ID NO: 136308 - DNA, 21 bp, Homo sapiens
acacacatgattaaaatgtgt

SEQ ID NO: 136309 - DNA, 23 bp, Homo sapiens
atggcagaggtagttagttgttt

SEQ ID NO: 136310 - DNA, 21 bp, Homo sapiens
atctgtatatatatacagata

SEQ ID NO: 136311 - DNA, 18 bp, Homo sapiens
atgtatgtatatatgtaa

SEQ ID NO: 136312 - DNA, 23 bp, Homo sapiens
tgagttcattgtagattctggat

SEQ ID NO: 136313 - DNA, 23 bp, Homo sapiens
tgagttcattgtagattctggat

SEQ ID NO: 136314 - DNA, 23 bp, Homo sapiens
tgagttcattgtagattctggat

SEQ ID NO: 136315 - DNA, 23 bp, Homo sapiens
tgagttcattgtagattctggat

SEQ ID NO: 136316 - DNA, 23 bp, Homo sapiens
aaaagagctttccctgcactttc

SEQ ID NO: 136317 - DNA, 23 bp, Homo sapiens
attttggatttgttatgtaaagt

SEQ ID NO: 136318 - DNA, 20 bp, Homo sapiens
atgaactgtatgaaaagtga

SEQ ID NO: 136319 - DNA, 22 bp, Homo sapiens
tgtgtgtgtgtgtgtatatata

SEQ ID NO: 136320 - DNA, 23 bp, Homo sapiens
tatgtgtatacacacacacacat

SEQ ID NO: 136321 - DNA, 23 bp, Homo sapiens
ggagtgagagagaagtcagggag

SEQ ID NO: 136322 - DNA, 18 bp, Homo sapiens
acacatgcacacatactc

SEQ ID NO: 136323 - DNA, 23 bp, Homo sapiens
gtttctttgcttttctacctaaa

SEQ ID NO: 136324 - DNA, 22 bp, Homo sapiens
tcacttgcatcattattgcatt

SEQ ID NO: 136325 - DNA, 23 bp, Homo sapiens
tcttttggcttaggattgactta

SEQ ID NO: 136326 - DNA, 23 bp, Homo sapiens
ctcaggtagttgtttatagcaat

SEQ ID NO: 136327 - DNA, 23 bp, Homo sapiens
tgagttcattgtagattctggat

SEQ ID NO: 136328 - DNA, 23 bp, Homo sapiens
tgagttcattgtagattctggat

SEQ ID NO: 136329 - DNA, 23 bp, Homo sapiens
aagagtctccctcagtcttttac

SEQ ID NO: 136330 - DNA, 21 bp, Homo sapiens
ttataatttgttgctttctga

SEQ ID NO: 136331 - DNA, 20 bp, Homo sapiens
tttttcctttttgagacagg

SEQ ID NO: 136332 - DNA, 19 bp, Homo sapiens
ttcagggtgggagagttta

SEQ ID NO: 136333 - DNA, 23 bp, Homo sapiens
tatttctgttaggaattgttctg

SEQ ID NO: 136334 - DNA, 22 bp, Homo sapiens
attcctttcttttagatgcgat

SEQ ID NO: 136335 - DNA, 22 bp, Homo sapiens
ctgggtgacacagtgactctgt

SEQ ID NO: 136336 - DNA, 23 bp, Homo sapiens
gaatgcttgatagtgtcctcgca

SEQ ID NO: 136337 - DNA, 23 bp, Homo sapiens
agtgtggtcattttgtagttgtt

SEQ ID NO: 136338 - DNA, 20 bp, Homo sapiens
tagactgaaccacattttcc

SEQ ID NO: 136339 - DNA, 22 bp, Homo sapiens
atctgctttatcaccgggctga

SEQ ID NO: 136340 - DNA, 20 bp, Homo sapiens
gtctctgtctagactctgtg

SEQ ID NO: 136341 - DNA, 23 bp, Homo sapiens
tgagttcattgtagattctggat

SEQ ID NO: 136342 - DNA, 23 bp, Homo sapiens
tgagttcattgtagattctggat

SEQ ID NO: 136343 - DNA, 22 bp, Homo sapiens
ctgcatgtgagtgctagaaagc

SEQ ID NO: 136344 - DNA, 21 bp, Homo sapiens
taccacctgattatggtgtgt

SEQ ID NO: 136345 - DNA, 23 bp, Homo sapiens
ttttgatgtactgttagtggttt

SEQ ID NO: 136346 - DNA, 23 bp, Homo sapiens
tgaacaaggtgctctgtgtctgt

SEQ ID NO: 136347 - DNA, 21 bp, Homo sapiens
tcatatgtgtatttgaataca

SEQ ID NO: 136348 - DNA, 23 bp, Homo sapiens
atagctgctatggaaaacagtgt

SEQ ID NO: 136349 - DNA, 23 bp, Homo sapiens
tgagttcattgtagattctggat

SEQ ID NO: 136350 - DNA, 23 bp, Homo sapiens
tgagttcattgtagattctggat

SEQ ID NO: 136351 - DNA, 23 bp, Homo sapiens
tgagttcattgtagattctggat

SEQ ID NO: 136352 - DNA, 23 bp, Homo sapiens
tgagttcattgtagattctggat

SEQ ID NO: 136353 - DNA, 23 bp, Homo sapiens
tgagttcattgtagattctggat

SEQ ID NO: 136354 - DNA, 23 bp, Homo sapiens
tgagttcattgtagattctggat

SEQ ID NO: 136355 - DNA, 23 bp, Homo sapiens
aaaacagccaggaaaccttctct

SEQ ID NO: 136356 - DNA, 21 bp, Homo sapiens
ttgctatttataggatgttgt

SEQ ID NO: 136357 - DNA, 22 bp, Homo sapiens
atgtccttttgtttagagacag

SEQ ID NO: 136358 - DNA, 23 bp, Homo sapiens
gacagagtctcgctctgtcaccc

SEQ ID NO: 136359 - DNA, 20 bp, Homo sapiens
atatgtgtatatgtatatgt

SEQ ID NO: 136360 - DNA, 18 bp, Homo sapiens
atggttctataaagggga

SEQ ID NO: 136361 - DNA, 19 bp, Homo sapiens
tctttgtctgcagccatcc

SEQ ID NO: 136362 - DNA, 19 bp, Homo sapiens
tttgactgtggctgtacaa

SEQ ID NO: 136363 - DNA, 23 bp, Homo sapiens
agtctgtctggctctctcagcta

SEQ ID NO: 136364 - DNA, 22 bp, Homo sapiens
agaaactgcatctacttttgca

SEQ ID NO: 136365 - DNA, 23 bp, Homo sapiens
ttctttggttttcttactgttga

SEQ ID NO: 136366 - DNA, 21 bp, Homo sapiens
atctgtattgtttacgcattc

SEQ ID NO: 136367 - DNA, 21 bp, Homo sapiens
ctctgtgtgtgtgtgtgtctg

SEQ ID NO: 136368 - DNA, 18 bp, Homo sapiens
tacatacactaatagctt

SEQ ID NO: 136369 - DNA, 20 bp, Homo sapiens
atttctatcaatttttatgt

SEQ ID NO: 136370 - DNA, 23 bp, Homo sapiens
gctcactgaaacctctgcctcct

SEQ ID NO: 136371 - DNA, 23 bp, Homo sapiens
agtgcagatttcaggtcctgaat

SEQ ID NO: 136372 - DNA, 23 bp, Homo sapiens
ttctgccttgatgatctgtctaa

SEQ ID NO: 136373 - DNA, 22 bp, Homo sapiens
actgtctcacactgtttgtggt

SEQ ID NO: 136374 - DNA, 23 bp, Homo sapiens
tgaggcaacactgcagtgagtcc

SEQ ID NO: 136375 - DNA, 21 bp, Homo sapiens
tacagtggcgtgatcttggct

SEQ ID NO: 136376 - DNA, 18 bp, Homo sapiens
tatatatgtgtatatgtg

SEQ ID NO: 136377 - DNA, 18 bp, Homo sapiens
tgagacagagtctctctc

SEQ ID NO: 136378 - DNA, 23 bp, Homo sapiens
gagagagtctcactctgtcgccc

SEQ ID NO: 136379 - DNA, 18 bp, Homo sapiens
tgcaagttctgcctcctg

SEQ ID NO: 136380 - DNA, 23 bp, Homo sapiens
cagtatctcactctgtcaccctg

SEQ ID NO: 136381 - DNA, 19 bp, Homo sapiens
aaagggcaaaaagtaagtg

SEQ ID NO: 136382 - DNA, 18 bp, Homo sapiens
agcattctaactggtgtg

SEQ ID NO: 136383 - DNA, 23 bp, Homo sapiens
tctcactgtggttttgatttgca

SEQ ID NO: 136384 - DNA, 19 bp, Homo sapiens
tacgtcattgtaattttga

SEQ ID NO: 136385 - DNA, 23 bp, Homo sapiens
tatgataatgctacattatgaag

SEQ ID NO: 136386 - DNA, 19 bp, Homo sapiens
tcagttgcttgatttgtgc

SEQ ID NO: 136387 - DNA, 23 bp, Homo sapiens
agggatgaagctgacttgatagt

SEQ ID NO: 136388 - DNA, 21 bp, Homo sapiens
tgtgaagatacatgagtctgg

SEQ ID NO: 136389 - DNA, 20 bp, Homo sapiens
taggtgctcagtcaatgctt

SEQ ID NO: 136390 - DNA, 23 bp, Homo sapiens
agggtctcactctgtcactcagg

SEQ ID NO: 136391 - DNA, 22 bp, Homo sapiens
taaatctagatttggatacatg

SEQ ID NO: 136392 - DNA, 18 bp, Homo sapiens
aaatagaagcagtgtaac

SEQ ID NO: 136393 - DNA, 19 bp, Homo sapiens
tcactgaaaccctgttttg

SEQ ID NO: 136394 - DNA, 20 bp, Homo sapiens
atatatagtagagacggggt

SEQ ID NO: 136395 - DNA, 23 bp, Homo sapiens
gacagagtctcgctctgtcaccc

SEQ ID NO: 136396 - DNA, 21 bp, Homo sapiens
ggttatctttcactatgcatt

SEQ ID NO: 136397 - DNA, 19 bp, Homo sapiens
agagaagatggactgcagt

SEQ ID NO: 136398 - DNA, 23 bp, Homo sapiens
ctctgtgtgtgtatatgcatgtg

SEQ ID NO: 136399 - DNA, 23 bp, Homo sapiens
tatctttgtgtcgctcacttgtg

SEQ ID NO: 136400 - DNA, 22 bp, Homo sapiens
tgggtgagacctagattgttag

SEQ ID NO: 136401 - DNA, 23 bp, Homo sapiens
tttgttctgaatttcttcttcag

SEQ ID NO: 136402 - DNA, 19 bp, Homo sapiens
tatgtatatatgtatgtgt

SEQ ID NO: 136403 - DNA, 21 bp, Homo sapiens
atgtgtatatatgtatatatg

SEQ ID NO: 136404 - DNA, 23 bp, Homo sapiens
tgcctgtaaccctaactactcag

SEQ ID NO: 136405 - DNA, 21 bp, Homo sapiens
tggaggacacaattcagttct

SEQ ID NO: 136406 - DNA, 23 bp, Homo sapiens
ttaatgtggatagttggtcttcc

SEQ ID NO: 136407 - DNA, 22 bp, Homo sapiens
tgaatgaatatatatatgtgtg

SEQ ID NO: 136408 - DNA, 23 bp, Homo sapiens
gactgagtctcactctgtcgccc

SEQ ID NO: 136409 - DNA, 20 bp, Homo sapiens
tcagctttctgaggaactgg

SEQ ID NO: 136410 - DNA, 22 bp, Homo sapiens
tgaggtgggaggttgacttgag

SEQ ID NO: 136411 - DNA, 18 bp, Homo sapiens
aggaggttgaggatgcag

SEQ ID NO: 136412 - DNA, 23 bp, Homo sapiens
tgaggtactaggtagtaaatgta

SEQ ID NO: 136413 - DNA, 23 bp, Homo sapiens
gggtctcactctgtcacccaggc

SEQ ID NO: 136414 - DNA, 20 bp, Homo sapiens
tggaagtagttctgtgcata

SEQ ID NO: 136415 - DNA, 23 bp, Homo sapiens
tgagttcattgtagattctggat

SEQ ID NO: 136416 - DNA, 23 bp, Homo sapiens
tgagttcattgtagattctggat

SEQ ID NO: 136417 - DNA, 23 bp, Homo sapiens
acatgtatatatgtatatgtgtg

SEQ ID NO: 136418 - DNA, 23 bp, Homo sapiens
atacatgtatatatgtatatatg

SEQ ID NO: 136419 - DNA, 23 bp, Homo sapiens
tatagtccttgctctcttaggag

SEQ ID NO: 136420 - DNA, 22 bp, Homo sapiens
tgtgtatatatatatgtgtcta

SEQ ID NO: 136421 - DNA, 23 bp, Homo sapiens
tatgtgtgtatatatatatgtgt

SEQ ID NO: 136422 - DNA, 23 bp, Homo sapiens
gagacagagtctctctctgtcac

SEQ ID NO: 136423 - DNA, 23 bp, Homo sapiens
tcaatgaagtcaatgcattttca

SEQ ID NO: 136424 - DNA, 23 bp, Homo sapiens
tgagttcattgtagattctggat

SEQ ID NO: 136425 - DNA, 23 bp, Homo sapiens
tgagttcattgtagattctggat

SEQ ID NO: 136426 - DNA, 20 bp, Homo sapiens
ctctcttcttgccttataga

SEQ ID NO: 136427 - DNA, 23 bp, Homo sapiens
tgttttgtatgcttctctttcct

SEQ ID NO: 136428 - DNA, 22 bp, Homo sapiens
tataagtctttttattttgatg

SEQ ID NO: 136429 - DNA, 19 bp, Homo sapiens
atagagtgtactcttagtg

SEQ ID NO: 136430 - DNA, 23 bp, Homo sapiens
cctaccatttctctgactctgtt

SEQ ID NO: 136431 - DNA, 23 bp, Homo sapiens
ctaaagatggaacacagagattt

SEQ ID NO: 136432 - DNA, 23 bp, Homo sapiens
gggtctcactctgtcacccaggc

SEQ ID NO: 136433 - DNA, 23 bp, Homo sapiens
aagtgcagtgggaggtctgagtt

SEQ ID NO: 136434 - DNA, 21 bp, Homo sapiens
acacttgaccctttgaagctc

SEQ ID NO: 136435 - DNA, 21 bp, Homo sapiens
tgaagagactctcactctgtt

SEQ ID NO: 136436 - DNA, 23 bp, Homo sapiens
tggagtctctctctgtcacccag

SEQ ID NO: 136437 - DNA, 19 bp, Homo sapiens
ttttttggagacagagtct

SEQ ID NO: 136438 - DNA, 23 bp, Homo sapiens
tttctgcagtggaaatgaatttt

SEQ ID NO: 136439 - DNA, 22 bp, Homo sapiens
tatagttgtgtgtacattggtt

SEQ ID NO: 136440 - DNA, 19 bp, Homo sapiens
aacctgagagagatactgg

SEQ ID NO: 136441 - DNA, 19 bp, Homo sapiens
gtcactttctctctgacag

SEQ ID NO: 136442 - DNA, 20 bp, Homo sapiens
tatacacagggtggtagggt

SEQ ID NO: 136443 - DNA, 23 bp, Homo sapiens
actcagtgtgtctctgtgagcat

SEQ ID NO: 136444 - DNA, 23 bp, Homo sapiens
tgagttcattgtagattctggat

SEQ ID NO: 136445 - DNA, 23 bp, Homo sapiens
tgagttcattgtagattctggat

SEQ ID NO: 136446 - DNA, 22 bp, Homo sapiens
tcagagtcacacagatctgggc

SEQ ID NO: 136447 - DNA, 23 bp, Homo sapiens
actgtgctgcttactgtctgtgt

SEQ ID NO: 136448 - DNA, 22 bp, Homo sapiens
ttctaagaagctgtgcgaaagt

SEQ ID NO: 136449 - DNA, 22 bp, Homo sapiens
tctgtttcagcttctccaaatg

SEQ ID NO: 136450 - DNA, 23 bp, Homo sapiens
acagctccctctctgactctcag

SEQ ID NO: 136451 - DNA, 22 bp, Homo sapiens
ggtctcactctgtcacccaggc

SEQ ID NO: 136452 - DNA, 20 bp, Homo sapiens
agtgcagtagcatgatcttg

SEQ ID NO: 136453 - DNA, 23 bp, Homo sapiens
ctcccagagcccctggaactctg

SEQ ID NO: 136454 - DNA, 23 bp, Homo sapiens
tcccagagcccctggaactctgg

SEQ ID NO: 136455 - DNA, 23 bp, Homo sapiens
tcccagagcccctggaactctgg

SEQ ID NO: 136456 - DNA, 23 bp, Homo sapiens
tcccagagcccctggaactctgg

SEQ ID NO: 136457 - DNA, 21 bp, Homo sapiens
acagagtctcactctatcacc

SEQ ID NO: 136458 - DNA, 18 bp, Homo sapiens
tgcaatggcatgatctct

SEQ ID NO: 136459 - DNA, 23 bp, Homo sapiens
atatctgtggatgtttatggatg

SEQ ID NO: 136460 - DNA, 21 bp, Homo sapiens
aaatctaagctcataatttca

SEQ ID NO: 136461 - DNA, 23 bp, Homo sapiens
ggttacagtgagctatgattgtg

SEQ ID NO: 136462 - DNA, 18 bp, Homo sapiens
acaccacctgtcagtctt

SEQ ID NO: 136463 - DNA, 23 bp, Homo sapiens
atttagtgtttgcaaaaatagcc

SEQ ID NO: 136464 - DNA, 23 bp, Homo sapiens
tatgcatgcttatatatgtgcag

SEQ ID NO: 136465 - DNA, 23 bp, Homo sapiens
cagggtctctctctgtcgcccag

SEQ ID NO: 136466 - DNA, 23 bp, Homo sapiens
acacactcactcacatgttcgct

SEQ ID NO: 136467 - DNA, 23 bp, Homo sapiens
agacaccctggactctctctctc

SEQ ID NO: 136468 - DNA, 21 bp, Homo sapiens
agtgcagtagcaccatctcag

SEQ ID NO: 136469 - DNA, 23 bp, Homo sapiens
tctctcactctgactcttctgcc

SEQ ID NO: 136470 - DNA, 21 bp, Homo sapiens
tcacaggcacattaactcccc

SEQ ID NO: 136471 - DNA, 21 bp, Homo sapiens
atacacacatatatagatgtg

SEQ ID NO: 136472 - DNA, 18 bp, Homo sapiens
agtgcatgtggaaaacag

SEQ ID NO: 136473 - DNA, 21 bp, Homo sapiens
gtgtgtgtgtgtgtacacgtg

SEQ ID NO: 136474 - DNA, 23 bp, Homo sapiens
tgaagagattagatgaagcaatt

SEQ ID NO: 136475 - DNA, 21 bp, Homo sapiens
ttctctcaggctctgtccctg

SEQ ID NO: 136476 - DNA, 22 bp, Homo sapiens
tactcaggatgctgaggtggaa

SEQ ID NO: 136477 - DNA, 23 bp, Homo sapiens
tggagtctcactctgtcacccag

SEQ ID NO: 136478 - DNA, 23 bp, Homo sapiens
aagtgtgtgtatatgtatatatg

SEQ ID NO: 136479 - DNA, 23 bp, Homo sapiens
acttgacagttgtattgatcttc

SEQ ID NO: 136480 - DNA, 21 bp, Homo sapiens
gaagggagtagtttgctttaa

SEQ ID NO: 136481 - DNA, 23 bp, Homo sapiens
tctgtctgtgtgtctgttagtgt

SEQ ID NO: 136482 - DNA, 22 bp, Homo sapiens
acaatgttggttgaattggtca

SEQ ID NO: 136483 - DNA, 21 bp, Homo sapiens
aaaagccagtctctgtcactc

SEQ ID NO: 136484 - DNA, 23 bp, Homo sapiens
atttatgacaggttctgagggca

SEQ ID NO: 136485 - DNA, 21 bp, Homo sapiens
ctccatctcaaaaaagagtgc

SEQ ID NO: 136486 - DNA, 21 bp, Homo sapiens
ttttgagacagagtctcactc

SEQ ID NO: 136487 - DNA, 22 bp, Homo sapiens
agagacaaggtctcactgtgtc

SEQ ID NO: 136488 - DNA, 23 bp, Homo sapiens
tctcagcctctgtctctgtctgt

SEQ ID NO: 136489 - DNA, 19 bp, Homo sapiens
tctagaaggtaggatagtt

SEQ ID NO: 136490 - DNA, 23 bp, Homo sapiens
agaaattgtgatgatcctggacg

SEQ ID NO: 136491 - DNA, 23 bp, Homo sapiens
ctctgatgtgtgtgtgtgtgcgt

SEQ ID NO: 136492 - DNA, 23 bp, Homo sapiens
ctgtagttctaagtttatttgtt

SEQ ID NO: 136493 - DNA, 22 bp, Homo sapiens
tatagaaatttaagtggacttt

SEQ ID NO: 136494 - DNA, 23 bp, Homo sapiens
ggtctctgtgtgtgtctaagcag

SEQ ID NO: 136495 - DNA, 23 bp, Homo sapiens
tgagttcattgtagattctggat

SEQ ID NO: 136496 - DNA, 23 bp, Homo sapiens
tgagttcattgtagattctggat

SEQ ID NO: 136497 - DNA, 23 bp, Homo sapiens
tgagttcattgtagattctggat

SEQ ID NO: 136498 - DNA, 23 bp, Homo sapiens
tgagttcattgtagattctggat

SEQ ID NO: 136499 - DNA, 23 bp, Homo sapiens
gttttttcctgttcattgctgaa

SEQ ID NO: 136500 - DNA, 21 bp, Homo sapiens
tttgtggatcatagcgtgggt

SEQ ID NO: 136501 - DNA, 23 bp, Homo sapiens
atgtgtgtgtgcatgtgtatgtg

SEQ ID NO: 136502 - DNA, 20 bp, Homo sapiens
tttgcaatggagtctcactc

SEQ ID NO: 136503 - DNA, 21 bp, Homo sapiens
gtctcactgtcactcaggctg

SEQ ID NO: 136504 - DNA, 20 bp, Homo sapiens
aataactcactgcagccttg

SEQ ID NO: 136505 - DNA, 23 bp, Homo sapiens
tcggctctctacaacctctgtct

SEQ ID NO: 136506 - DNA, 21 bp, Homo sapiens
acacacattcacagacacaca

SEQ ID NO: 136507 - DNA, 23 bp, Homo sapiens
actggcgaaagtctagctctgtt

SEQ ID NO: 136508 - DNA, 23 bp, Homo sapiens
catctgtctctgttatggccact

SEQ ID NO: 136509 - DNA, 23 bp, Homo sapiens
ttaatcctgtcagagtgtcttct

SEQ ID NO: 136510 - DNA, 23 bp, Homo sapiens
ttgacagaagaaatcttattgat

SEQ ID NO: 136511 - DNA, 23 bp, Homo sapiens
tggagtctcactctgtcacccag

SEQ ID NO: 136512 - DNA, 18 bp, Homo sapiens
tagaatgtaaactagtag

SEQ ID NO: 136513 - DNA, 23 bp, Homo sapiens
aacatagtttgcagactgcactt

SEQ ID NO: 136514 - DNA, 23 bp, Homo sapiens
ccttaattttcaccttgagatat

SEQ ID NO: 136515 - DNA, 22 bp, Homo sapiens
gttaagatgtatgtatatatga

SEQ ID NO: 136516 - DNA, 23 bp, Homo sapiens
tgtgtatatatgtacatgtattt

SEQ ID NO: 136517 - DNA, 23 bp, Homo sapiens
tgtacacagtatatgtatctgca

SEQ ID NO: 136518 - DNA, 19 bp, Homo sapiens
tacacacacactgtagtag

SEQ ID NO: 136519 - DNA, 23 bp, Homo sapiens
attcagacaacccaagtacttgg

SEQ ID NO: 136520 - DNA, 19 bp, Homo sapiens
gttcaagctttgtgtgtgt

SEQ ID NO: 136521 - DNA, 23 bp, Homo sapiens
ggagtctcactctgtcacccagg

SEQ ID NO: 136522 - DNA, 22 bp, Homo sapiens
tgttcaggaacaagggagataa

SEQ ID NO: 136523 - DNA, 23 bp, Homo sapiens
tgagttcattgtagattctggat

SEQ ID NO: 136524 - DNA, 23 bp, Homo sapiens
tgagttcattgtagattctggat

SEQ ID NO: 136525 - DNA, 23 bp, Homo sapiens
gataatttatatgtatacttgta

SEQ ID NO: 136526 - DNA, 23 bp, Homo sapiens
tattaatctaggtgagcttagca

SEQ ID NO: 136527 - DNA, 23 bp, Homo sapiens
taaagtgagcatgtattaatgag

SEQ ID NO: 136528 - DNA, 23 bp, Homo sapiens
agtagagacacagtcaaatctgt

SEQ ID NO: 136529 - DNA, 23 bp, Homo sapiens
tgagagacgagtgagtgcttacg

SEQ ID NO: 136530 - DNA, 23 bp, Homo sapiens
cgtatatatacgtatatgtgtat

SEQ ID NO: 136531 - DNA, 22 bp, Homo sapiens
atgtgtatatatacgtatatgt

SEQ ID NO: 136532 - DNA, 23 bp, Homo sapiens
ttctttttgcctaggattgtctt

SEQ ID NO: 136533 - DNA, 20 bp, Homo sapiens
ttctgggaagaaagtcagtg

SEQ ID NO: 136534 - DNA, 23 bp, Homo sapiens
ctctccctctgtgtatgtcaaca

SEQ ID NO: 136535 - DNA, 23 bp, Homo sapiens
tgattgtggtaatcatttcacaa

SEQ ID NO: 136536 - DNA, 23 bp, Homo sapiens
atatatctgtaaatgtatacttt

SEQ ID NO: 136537 - DNA, 21 bp, Homo sapiens
tacaaactacaaagtcgtatg

SEQ ID NO: 136538 - DNA, 23 bp, Homo sapiens
tgtctcgctcagtgagtcccact

SEQ ID NO: 136539 - DNA, 18 bp, Homo sapiens
tggagctcatcgagctaa

SEQ ID NO: 136540 - DNA, 23 bp, Homo sapiens
agtcactccatgatgaaagggca

SEQ ID NO: 136541 - DNA, 18 bp, Homo sapiens
ttgcagaagactctggag

SEQ ID NO: 136542 - DNA, 18 bp, Homo sapiens
aacaccaacagattctaa

SEQ ID NO: 136543 - DNA, 21 bp, Homo sapiens
tatgcatatatatgcatatat

SEQ ID NO: 136544 - DNA, 22 bp, Homo sapiens
atatgtgtatatgtatgcgtat

SEQ ID NO: 136545 - DNA, 23 bp, Homo sapiens
cttgatcctgggctttgaggctc

SEQ ID NO: 136546 - DNA, 23 bp, Homo sapiens
tgttctttttgcttaggattatc

SEQ ID NO: 136547 - DNA, 23 bp, Homo sapiens
ttctgtgaagaaagtcaaaggta

SEQ ID NO: 136548 - DNA, 23 bp, Homo sapiens
tgagttcattgtagattctggat

SEQ ID NO: 136549 - DNA, 23 bp, Homo sapiens
tgagttcattgtagattctggat

SEQ ID NO: 136550 - DNA, 23 bp, Homo sapiens
aagaggtcattcacgtcccttgt

SEQ ID NO: 136551 - DNA, 23 bp, Homo sapiens
tatatatgggtgtgtatgtgagt

SEQ ID NO: 136552 - DNA, 21 bp, Homo sapiens
tatgtgtatatatatacatgt

SEQ ID NO: 136553 - DNA, 20 bp, Homo sapiens
atatgtgtatatatacatgt

SEQ ID NO: 136554 - DNA, 21 bp, Homo sapiens
tatgtgtatatatatacatgt

SEQ ID NO: 136555 - DNA, 21 bp, Homo sapiens
tatgtgtatatatatacatgt

SEQ ID NO: 136556 - DNA, 21 bp, Homo sapiens
tatgtgtatatatatacatgt

SEQ ID NO: 136557 - DNA, 22 bp, Homo sapiens
actgtgtcagacattattcaga

SEQ ID NO: 136558 - DNA, 21 bp, Homo sapiens
tgaatggatgagtaaagtata

SEQ ID NO: 136559 - DNA, 23 bp, Homo sapiens
aaatgtactgaatttgtagattg

SEQ ID NO: 136560 - DNA, 23 bp, Homo sapiens
taggtagagtgtcactctttttt

SEQ ID NO: 136561 - DNA, 21 bp, Homo sapiens
tgagatcgagtctcgctctgt

SEQ ID NO: 136562 - DNA, 22 bp, Homo sapiens
ttgtggttccttatgactttta

SEQ ID NO: 136563 - DNA, 20 bp, Homo sapiens
agaatgactttggtagtttt

SEQ ID NO: 136564 - DNA, 23 bp, Homo sapiens
gactgagtctcgctctgtcaccc

SEQ ID NO: 136565 - DNA, 19 bp, Homo sapiens
tgtgtatatatatatctca

SEQ ID NO: 136566 - DNA, 18 bp, Homo sapiens
atggttaagatggtggtt

SEQ ID NO: 136567 - DNA, 20 bp, Homo sapiens
tttattcagcagcagctctc

SEQ ID NO: 136568 - DNA, 23 bp, Homo sapiens
atgtgtgtatatatatatgtgaa

SEQ ID NO: 136569 - DNA, 23 bp, Homo sapiens
tctgtgttttactgtctgctctt

SEQ ID NO: 136570 - DNA, 21 bp, Homo sapiens
atgtagatgaatgatcaagta

SEQ ID NO: 136571 - DNA, 23 bp, Homo sapiens
cactaaagtgtgggagctaataa

SEQ ID NO: 136572 - DNA, 23 bp, Homo sapiens
gatagagagtagatagagagtag

SEQ ID NO: 136573 - DNA, 23 bp, Homo sapiens
attgatagtttttgtaatcccca

SEQ ID NO: 136574 - DNA, 22 bp, Homo sapiens
tgtgtgtgtgtgatatatatgt

SEQ ID NO: 136575 - DNA, 23 bp, Homo sapiens
ggagtctcactctgtctctcagc

SEQ ID NO: 136576 - DNA, 23 bp, Homo sapiens
ctttgtctcagtgtctgtcctgg

SEQ ID NO: 136577 - DNA, 23 bp, Homo sapiens
tgagttcattgtagattctggat

SEQ ID NO: 136578 - DNA, 23 bp, Homo sapiens
tgagttcattgtagattctggat

SEQ ID NO: 136579 - DNA, 23 bp, Homo sapiens
tgagttcattgtagattctggat

SEQ ID NO: 136580 - DNA, 23 bp, Homo sapiens
tgagttcattgtagattctggat

SEQ ID NO: 136581 - DNA, 23 bp, Homo sapiens
tgagttcattgtagattctggat

SEQ ID NO: 136582 - DNA, 23 bp, Homo sapiens
tgagttcattgtagattctggat

SEQ ID NO: 136583 - DNA, 23 bp, Homo sapiens
tgagttcattgtagattctggat

SEQ ID NO: 136584 - DNA, 23 bp, Homo sapiens
tgagttcattgtagattctggat

SEQ ID NO: 136585 - DNA, 23 bp, Homo sapiens
cgtaagtttttatttctttctga

SEQ ID NO: 136586 - DNA, 19 bp, Homo sapiens
agaagtgaaatcattgggt

SEQ ID NO: 136587 - DNA, 23 bp, Homo sapiens
tgagttcattgtagattctggat

SEQ ID NO: 136588 - DNA, 23 bp, Homo sapiens
tgagttcattgtagattctggat

SEQ ID NO: 136589 - DNA, 23 bp, Homo sapiens
ctcccagagcccctggaactctg

SEQ ID NO: 136590 - DNA, 23 bp, Homo sapiens
tcccagagcccctggaactctgg

SEQ ID NO: 136591 - DNA, 23 bp, Homo sapiens
tcccagagcccctggaactctgg

SEQ ID NO: 136592 - DNA, 23 bp, Homo sapiens
tcccagagcccctggaactctgg

SEQ ID NO: 136593 - DNA, 23 bp, Homo sapiens
tatatgcatatctatctgtaata

SEQ ID NO: 136594 - DNA, 23 bp, Homo sapiens
tataggtatatgaaatagtggtg

SEQ ID NO: 136595 - DNA, 23 bp, Homo sapiens
tgagttcattgtagattctggat

SEQ ID NO: 136596 - DNA, 23 bp, Homo sapiens
tgagttcattgtagattctggat

SEQ ID NO: 136597 - DNA, 20 bp, Homo sapiens
aaggtctcaggctgttttag

SEQ ID NO: 136598 - DNA, 23 bp, Homo sapiens
accaaaacattggtatgccatgc

SEQ ID NO: 136599 - DNA, 23 bp, Homo sapiens
gtgtgtgtctgtgtgtgtccgtg

SEQ ID NO: 136600 - DNA, 19 bp, Homo sapiens
actgaaaaattattcttat

SEQ ID NO: 136601 - DNA, 23 bp, Homo sapiens
caagagaacactgttagaatgag

SEQ ID NO: 136602 - DNA, 23 bp, Homo sapiens
tctctctctctgattttctctct

SEQ ID NO: 136603 - DNA, 20 bp, Homo sapiens
ttttgtttgtttgtttttga

SEQ ID NO: 136604 - DNA, 23 bp, Homo sapiens
ttatgaagacatactgagaactt

SEQ ID NO: 136605 - DNA, 23 bp, Homo sapiens
tgtatgtgtgcatgtgcatgtgt

SEQ ID NO: 136606 - DNA, 19 bp, Homo sapiens
agacacaatccattctgta

SEQ ID NO: 136607 - DNA, 23 bp, Homo sapiens
tatagattgcatatggaatgtat

SEQ ID NO: 136608 - DNA, 18 bp, Homo sapiens
agagcactgatgtgagaa

SEQ ID NO: 136609 - DNA, 23 bp, Homo sapiens
ctcagtctctctctgcttcaggt

SEQ ID NO: 136610 - DNA, 21 bp, Homo sapiens
actcacagcaactccatctct

SEQ ID NO: 136611 - DNA, 20 bp, Homo sapiens
tacacatatgttcatatgag

SEQ ID NO: 136612 - DNA, 18 bp, Homo sapiens
cacacttcagaaaatgag

SEQ ID NO: 136613 - DNA, 20 bp, Homo sapiens
tagtgctttctctcagtcaa

SEQ ID NO: 136614 - DNA, 23 bp, Homo sapiens
tgattagtttggtagctgtgagt

SEQ ID NO: 136615 - DNA, 23 bp, Homo sapiens
tgagtctcactctgtcacccagg

SEQ ID NO: 136616 - DNA, 20 bp, Homo sapiens
ctgagggcatttgcacctgc

SEQ ID NO: 136617 - DNA, 23 bp, Homo sapiens
gtatgtatgtatgtatgtgcatg

SEQ ID NO: 136618 - DNA, 18 bp, Homo sapiens
tagctcagtagatagagg

SEQ ID NO: 136619 - DNA, 21 bp, Homo sapiens
tctgaatatatatatatgtgt

SEQ ID NO: 136620 - DNA, 20 bp, Homo sapiens
tcagtggctcctacctggct

SEQ ID NO: 136621 - DNA, 23 bp, Homo sapiens
atgacattttgtagatgtgacag

SEQ ID NO: 136622 - DNA, 23 bp, Homo sapiens
agtcagtaagtatatatatttgt

SEQ ID NO: 136623 - DNA, 18 bp, Homo sapiens
agagctggtgcacatctg

SEQ ID NO: 136624 - DNA, 21 bp, Homo sapiens
aatgtcacccagctttgttga

SEQ ID NO: 136625 - DNA, 22 bp, Homo sapiens
agtctgtcttctcatttcctct

SEQ ID NO: 136626 - DNA, 20 bp, Homo sapiens
tcagactttgacattctgct

SEQ ID NO: 136627 - DNA, 22 bp, Homo sapiens
atagtttgtaggatgtttacta

SEQ ID NO: 136628 - DNA, 22 bp, Homo sapiens
aacatgtggatttggttttctg

SEQ ID NO: 136629 - DNA, 23 bp, Homo sapiens
ttcagtgtgtggaaaccctactg

SEQ ID NO: 136630 - DNA, 23 bp, Homo sapiens
tgagttcattgtagattctggat

SEQ ID NO: 136631 - DNA, 23 bp, Homo sapiens
tgagttcattgtagattctggat

SEQ ID NO: 136632 - DNA, 23 bp, Homo sapiens
atgtatatgtgtgtatatatgta

SEQ ID NO: 136633 - DNA, 23 bp, Homo sapiens
tgagttcattgtagattctggat

SEQ ID NO: 136634 - DNA, 23 bp, Homo sapiens
tgagttcattgtagattctggat

SEQ ID NO: 136635 - DNA, 23 bp, Homo sapiens
cggagtctccctctgtcactcag

SEQ ID NO: 136636 - DNA, 22 bp, Homo sapiens
ttaaagagcatttcttttgagg

SEQ ID NO: 136637 - DNA, 23 bp, Homo sapiens
cttagagaagtgacagagctgtt

SEQ ID NO: 136638 - DNA, 23 bp, Homo sapiens
tctgtcacttctccaagggtttg

SEQ ID NO: 136639 - DNA, 19 bp, Homo sapiens
ctccatatgattacagtca

SEQ ID NO: 136640 - DNA, 23 bp, Homo sapiens
attgtatgctagagaaggtatgt

SEQ ID NO: 136641 - DNA, 23 bp, Homo sapiens
tatatatttttgtagcggaagtt

SEQ ID NO: 136642 - DNA, 23 bp, Homo sapiens
tgagttcattgtagattctggat

SEQ ID NO: 136643 - DNA, 23 bp, Homo sapiens
tgagttcattgtagattctggat

SEQ ID NO: 136644 - DNA, 23 bp, Homo sapiens
gactgagtacagtgtctgcacac

SEQ ID NO: 136645 - DNA, 21 bp, Homo sapiens
aatagcagtcattatgatcag

SEQ ID NO: 136646 - DNA, 23 bp, Homo sapiens
acttgagagtaattccttatggc

SEQ ID NO: 136647 - DNA, 20 bp, Homo sapiens
ataactatatatacgtatct

SEQ ID NO: 136648 - DNA, 23 bp, Homo sapiens
atgtgtgtatatacatgtgtgta

SEQ ID NO: 136649 - DNA, 23 bp, Homo sapiens
tatatgtgtgtatatatatgtat

SEQ ID NO: 136650 - DNA, 23 bp, Homo sapiens
tgtgtatatatgtatatgtttac

SEQ ID NO: 136651 - DNA, 22 bp, Homo sapiens
tttcactgtcacaatttcctgt

SEQ ID NO: 136652 - DNA, 23 bp, Homo sapiens
ttttggctccatatgaaatttaa

SEQ ID NO: 136653 - DNA, 19 bp, Homo sapiens
atcccatgcctttaggtta

SEQ ID NO: 136654 - DNA, 22 bp, Homo sapiens
tgacacgcactgtgtctgccag

SEQ ID NO: 136655 - DNA, 23 bp, Homo sapiens
tgagtctcactctgtcacccagg

SEQ ID NO: 136656 - DNA, 23 bp, Homo sapiens
tttttttttgtggatggagtctc

SEQ ID NO: 136657 - DNA, 23 bp, Homo sapiens
tgagttcattgtagattctggat

SEQ ID NO: 136658 - DNA, 18 bp, Homo sapiens
aacaaccttgaattcctg

SEQ ID NO: 136659 - DNA, 18 bp, Homo sapiens
tgtgcctaatgtttgttc

SEQ ID NO: 136660 - DNA, 19 bp, Homo sapiens
tgccagaacacagacaggt

SEQ ID NO: 136661 - DNA, 21 bp, Homo sapiens
gtgagctgatttagttgttca

SEQ ID NO: 136662 - DNA, 23 bp, Homo sapiens
atgcatcaaatcacagtcaccgt

SEQ ID NO: 136663 - DNA, 22 bp, Homo sapiens
gttgtgagtgagtagacaaggg

SEQ ID NO: 136664 - DNA, 23 bp, Homo sapiens
tccccctcagtgtctggtatagt

SEQ ID NO: 136665 - DNA, 23 bp, Homo sapiens
tatatgtatgtatatgtatgtgt

SEQ ID NO: 136666 - DNA, 18 bp, Homo sapiens
gagtctcgctctctcacc

SEQ ID NO: 136667 - DNA, 23 bp, Homo sapiens
tggagtctcactctgtcacccag

SEQ ID NO: 136668 - DNA, 23 bp, Homo sapiens
gcactctctctgattctctctgg

SEQ ID NO: 136669 - DNA, 23 bp, Homo sapiens
ccactcagtctgtggctctttgt

SEQ ID NO: 136670 - DNA, 23 bp, Homo sapiens
tgagttcattgtagattctggat

SEQ ID NO: 136671 - DNA, 23 bp, Homo sapiens
tgagttcattgtagattctggat

SEQ ID NO: 136672 - DNA, 23 bp, Homo sapiens
tatagaggtctttcaactccttt

SEQ ID NO: 136673 - DNA, 23 bp, Homo sapiens
tgagttcttgatttggttctctg

SEQ ID NO: 136674 - DNA, 23 bp, Homo sapiens
cacacatgtagttgtatgcatgt

SEQ ID NO: 136675 - DNA, 22 bp, Homo sapiens
tgttttctgaatagctttgggt

SEQ ID NO: 136676 - DNA, 23 bp, Homo sapiens
gagagtagtgagaagtaaggctg

SEQ ID NO: 136677 - DNA, 20 bp, Homo sapiens
tcagagctcacaacagttgc

SEQ ID NO: 136678 - DNA, 23 bp, Homo sapiens
acaggtgagagtgatcagaatcc

SEQ ID NO: 136679 - DNA, 23 bp, Homo sapiens
ttcactgactctcaatctctctt

SEQ ID NO: 136680 - DNA, 23 bp, Homo sapiens
tttgtctgttttagatatctaga

SEQ ID NO: 136681 - DNA, 23 bp, Homo sapiens
tgtgtatatatatacatgaaaga

SEQ ID NO: 136682 - DNA, 23 bp, Homo sapiens
tgtgtgtgtatatatatgtgtat

SEQ ID NO: 136683 - DNA, 23 bp, Homo sapiens
agttacagtgctagctaggtgac

SEQ ID NO: 136684 - DNA, 23 bp, Homo sapiens
aggactggaacaaggttctttag

SEQ ID NO: 136685 - DNA, 22 bp, Homo sapiens
agagagcaagcagtatggatat

SEQ ID NO: 136686 - DNA, 19 bp, Homo sapiens
ttttaaattgatttctaat

SEQ ID NO: 136687 - DNA, 21 bp, Homo sapiens
cacgtatatacacacacacat

SEQ ID NO: 136688 - DNA, 22 bp, Homo sapiens
gctacagtgagctatgattgtg

SEQ ID NO: 136689 - DNA, 23 bp, Homo sapiens
tgagacacagtctcgctctgtca

SEQ ID NO: 136690 - DNA, 23 bp, Homo sapiens
acggagtctcactgtgtcaccag

SEQ ID NO: 136691 - DNA, 22 bp, Homo sapiens
actgcctgtgcctactaggagt

SEQ ID NO: 136692 - DNA, 22 bp, Homo sapiens
agaggttctaggatgtattgct

SEQ ID NO: 136693 - DNA, 21 bp, Homo sapiens
tgagaagaaattggactcacc

SEQ ID NO: 136694 - DNA, 23 bp, Homo sapiens
ggaagagagacttgagtgagcac

SEQ ID NO: 136695 - DNA, 23 bp, Homo sapiens
accctctctgtatctttatttgc

SEQ ID NO: 136696 - DNA, 23 bp, Homo sapiens
gtgactctgtgggtctgtgaccc

SEQ ID NO: 136697 - DNA, 23 bp, Homo sapiens
actcgagtctcgctctgtcaccc

SEQ ID NO: 136698 - DNA, 21 bp, Homo sapiens
tgagagagagtctcgctctgt

SEQ ID NO: 136699 - DNA, 23 bp, Homo sapiens
aaagagcatctgcttctgatatg

SEQ ID NO: 136700 - DNA, 23 bp, Homo sapiens
tgagttcattgtagattctggat

SEQ ID NO: 136701 - DNA, 23 bp, Homo sapiens
tgagttcattgtagattctggat

SEQ ID NO: 136702 - DNA, 23 bp, Homo sapiens
tgagttcattgtagattctggat

SEQ ID NO: 136703 - DNA, 23 bp, Homo sapiens
tgagttcattgtagattctggat

SEQ ID NO: 136704 - DNA, 23 bp, Homo sapiens
aaaatgagtgatgagagagagaa

SEQ ID NO: 136705 - DNA, 23 bp, Homo sapiens
tgagttcattgtagattctggat

SEQ ID NO: 136706 - DNA, 23 bp, Homo sapiens
tgagttcattgtagattctggat

SEQ ID NO: 136707 - DNA, 21 bp, Homo sapiens
agaggcacattcagatttttg

SEQ ID NO: 136708 - DNA, 20 bp, Homo sapiens
tatatacatacgtgtgtgtg

SEQ ID NO: 136709 - DNA, 23 bp, Homo sapiens
tgtcctctctgtctctgtctctg

SEQ ID NO: 136710 - DNA, 20 bp, Homo sapiens
tgtcaacatccatcattctg

SEQ ID NO: 136711 - DNA, 22 bp, Homo sapiens
ctcagtgtctgacacctggtga

SEQ ID NO: 136712 - DNA, 23 bp, Homo sapiens
attaggtgctcactcactgtgtg

SEQ ID NO: 136713 - DNA, 22 bp, Homo sapiens
gtgacagtctctccctccctgt

SEQ ID NO: 136714 - DNA, 20 bp, Homo sapiens
atatgtgtatatatatacgt

SEQ ID NO: 136715 - DNA, 23 bp, Homo sapiens
tgagttcattgtagattctggat

SEQ ID NO: 136716 - DNA, 23 bp, Homo sapiens
tgagttcattgtagattctggat

SEQ ID NO: 136717 - DNA, 23 bp, Homo sapiens
agtgagtctcactctgtcgccca

SEQ ID NO: 136718 - DNA, 18 bp, Homo sapiens
ctgagatagctggtgcaa

SEQ ID NO: 136719 - DNA, 22 bp, Homo sapiens
atgggacttatttgcaatgtgt

SEQ ID NO: 136720 - DNA, 23 bp, Homo sapiens
tgggtgtctgtctctgtgtctct

SEQ ID NO: 136721 - DNA, 19 bp, Homo sapiens
taaagctgaggatctgatg

SEQ ID NO: 136722 - DNA, 22 bp, Homo sapiens
tctatgagtgcacgtgcctgtg

SEQ ID NO: 136723 - DNA, 23 bp, Homo sapiens
aggcacactcccttagttcaggt

SEQ ID NO: 136724 - DNA, 23 bp, Homo sapiens
tgagttcattgtagattctggat

SEQ ID NO: 136725 - DNA, 23 bp, Homo sapiens
tgagttcattgtagattctggat

SEQ ID NO: 136726 - DNA, 23 bp, Homo sapiens
tcaaagtggaaaagatttggtgc

SEQ ID NO: 136727 - DNA, 23 bp, Homo sapiens
aaaaaagtgctattgaattttta

SEQ ID NO: 136728 - DNA, 18 bp, Homo sapiens
aagaagactgggcaacta

SEQ ID NO: 136729 - DNA, 22 bp, Homo sapiens
tggctgtggttgccttcatttg

SEQ ID NO: 136730 - DNA, 22 bp, Homo sapiens
tcagaactttgttgaaagggaa

SEQ ID NO: 136731 - DNA, 23 bp, Homo sapiens
agcagagagattggtcaggtgct

SEQ ID NO: 136732 - DNA, 23 bp, Homo sapiens
ggtgtgacttcagtgtgacctca

SEQ ID NO: 136733 - DNA, 23 bp, Homo sapiens
acagagtctcactctgtcgccca

SEQ ID NO: 136734 - DNA, 22 bp, Homo sapiens
atatacacgtatatatacacac

SEQ ID NO: 136735 - DNA, 23 bp, Homo sapiens
tctgactgtatggagtttctgtt

SEQ ID NO: 136736 - DNA, 20 bp, Homo sapiens
attctcctttttatggaatg

SEQ ID NO: 136737 - DNA, 23 bp, Homo sapiens
atgtctcttgaaatctttcactc

SEQ ID NO: 136738 - DNA, 19 bp, Homo sapiens
tgacaggtgagtgtgcaga

SEQ ID NO: 136739 - DNA, 23 bp, Homo sapiens
acactagagactgatgagatcca

SEQ ID NO: 136740 - DNA, 23 bp, Homo sapiens
gttctgtcggtctgagtctgagt

SEQ ID NO: 136741 - DNA, 23 bp, Homo sapiens
agtcatgctagtgagtgtgaagt

SEQ ID NO: 136742 - DNA, 19 bp, Homo sapiens
tgatatctcactgtggctt

SEQ ID NO: 136743 - DNA, 22 bp, Homo sapiens
aaagtcagttagcatatgtccc

SEQ ID NO: 136744 - DNA, 22 bp, Homo sapiens
tttctttgcatatctaatgatt

SEQ ID NO: 136745 - DNA, 23 bp, Homo sapiens
agactagtaaattccaagtctgt

SEQ ID NO: 136746 - DNA, 23 bp, Homo sapiens
aatggaatggaatgtagtctgaa

SEQ ID NO: 136747 - DNA, 22 bp, Homo sapiens
acatgcatctctctggatcttc

SEQ ID NO: 136748 - DNA, 23 bp, Homo sapiens
tgtatatccaatcatatatatgg

SEQ ID NO: 136749 - DNA, 19 bp, Homo sapiens
gtgtgcatatatgtatgta

SEQ ID NO: 136750 - DNA, 20 bp, Homo sapiens
tctctcaggctggaatgcag

SEQ ID NO: 136751 - DNA, 23 bp, Homo sapiens
aagagtaatgatgatgatgatgg

SEQ ID NO: 136752 - DNA, 23 bp, Homo sapiens
aatcatgatgatgatgatgatgg

SEQ ID NO: 136753 - DNA, 18 bp, Homo sapiens
tgtgttccaggcattgtt

SEQ ID NO: 136754 - DNA, 23 bp, Homo sapiens
aggatctctctctctctctctcg

SEQ ID NO: 136755 - DNA, 23 bp, Homo sapiens
tgagttcattgtagattctggat

SEQ ID NO: 136756 - DNA, 23 bp, Homo sapiens
tgagttcattgtagattctggat

SEQ ID NO: 136757 - DNA, 23 bp, Homo sapiens
gtacacagtctgtgatattctgg

SEQ ID NO: 136758 - DNA, 22 bp, Homo sapiens
ctagagagagtgtttcttgaaa

SEQ ID NO: 136759 - DNA, 23 bp, Homo sapiens
tgtctctctcagtatctgtttgc

SEQ ID NO: 136760 - DNA, 23 bp, Homo sapiens
ggctctctcactgcctttcttaa

SEQ ID NO: 136761 - DNA, 23 bp, Homo sapiens
actcagtctttttgtctcacctt

SEQ ID NO: 136762 - DNA, 19 bp, Homo sapiens
gagacttgtcactttgaga

SEQ ID NO: 136763 - DNA, 22 bp, Homo sapiens
tgtgtgtatatatatatgtgtg

SEQ ID NO: 136764 - DNA, 23 bp, Homo sapiens
tatgtgtatatatatgtatgtgt

SEQ ID NO: 136765 - DNA, 21 bp, Homo sapiens
tcagtctctctatctgtaaaa

SEQ ID NO: 136766 - DNA, 22 bp, Homo sapiens
tacacttagagggttgttttgg

SEQ ID NO: 136767 - DNA, 23 bp, Homo sapiens
gccatgtaaagtctcgatgtcct

SEQ ID NO: 136768 - DNA, 20 bp, Homo sapiens
cactgtctgtctgtccccct

SEQ ID NO: 136769 - DNA, 20 bp, Homo sapiens
tgtagagtgaagacacagtg

SEQ ID NO: 136770 - DNA, 20 bp, Homo sapiens
attatgtgattcatatatgg

SEQ ID NO: 136771 - DNA, 23 bp, Homo sapiens
ggcacagagaattcagtgaggac

SEQ ID NO: 136772 - DNA, 23 bp, Homo sapiens
gtttcactctgatctttgcagga

SEQ ID NO: 136773 - DNA, 23 bp, Homo sapiens
aggtgctgcagttggagaaagag

SEQ ID NO: 136774 - DNA, 23 bp, Homo sapiens
catctcactgtctctgtccctag

SEQ ID NO: 136775 - DNA, 21 bp, Homo sapiens
agaaggtgctaagaaaatgag

SEQ ID NO: 136776 - DNA, 18 bp, Homo sapiens
agacatatatatatagag

SEQ ID NO: 136777 - DNA, 22 bp, Homo sapiens
gtctcgcactgtctgtcacttg

SEQ ID NO: 136778 - DNA, 23 bp, Homo sapiens
tgagttcattgtagattctggat

SEQ ID NO: 136779 - DNA, 23 bp, Homo sapiens
tgagttcattgtagattctggat

SEQ ID NO: 136780 - DNA, 18 bp, Homo sapiens
tggaaggatcacttgagg

SEQ ID NO: 136781 - DNA, 21 bp, Homo sapiens
agaggttggaggttgactaga

SEQ ID NO: 136782 - DNA, 23 bp, Homo sapiens
tgagcagagagtagtcagtgtgg

SEQ ID NO: 136783 - DNA, 21 bp, Homo sapiens
aagtgtctcactctgtcaccc

SEQ ID NO: 136784 - DNA, 21 bp, Homo sapiens
aggaagagatctgaatttgaa

SEQ ID NO: 136785 - DNA, 23 bp, Homo sapiens
agtctggctgcctgtttgccatc

SEQ ID NO: 136786 - DNA, 22 bp, Homo sapiens
tatatgtatatgtacatgtgtg

SEQ ID NO: 136787 - DNA, 23 bp, Homo sapiens
gcctgtcagtgtctctgtctcct

SEQ ID NO: 136788 - DNA, 23 bp, Homo sapiens
gtcaggcagctttgaagtggaat

SEQ ID NO: 136789 - DNA, 23 bp, Homo sapiens
tctcgctgcgtgatattgggcat

SEQ ID NO: 136790 - DNA, 23 bp, Homo sapiens
tgtgtcttattctctctgtatca

SEQ ID NO: 136791 - DNA, 21 bp, Homo sapiens
tcaatcctctaagaccttaga

SEQ ID NO: 136792 - DNA, 20 bp, Homo sapiens
ttgtttattctaggtgttca

SEQ ID NO: 136793 - DNA, 21 bp, Homo sapiens
tgttgaatgaatgaatgaatg

SEQ ID NO: 136794 - DNA, 23 bp, Homo sapiens
cagccactctctgcctgtcacac

SEQ ID NO: 136795 - DNA, 23 bp, Homo sapiens
tgtcttgtttcacctatgcatgt

SEQ ID NO: 136796 - DNA, 22 bp, Homo sapiens
agaggaagttggttgtatgcat

SEQ ID NO: 136797 - DNA, 20 bp, Homo sapiens
tgtgagagcacagagaggac

SEQ ID NO: 136798 - DNA, 19 bp, Homo sapiens
tggtataagttagagtaga

SEQ ID NO: 136799 - DNA, 23 bp, Homo sapiens
taaactgatattttacaagtgac

SEQ ID NO: 136800 - DNA, 23 bp, Homo sapiens
gggtctcactgtgtcacccaggc

SEQ ID NO: 136801 - DNA, 21 bp, Homo sapiens
tgcaatggtgtgatcttggct

SEQ ID NO: 136802 - DNA, 23 bp, Homo sapiens
gacctgagtctctctctctgtgc

SEQ ID NO: 136803 - DNA, 23 bp, Homo sapiens
tggctgtgtctgtctctggcaca

SEQ ID NO: 136804 - DNA, 23 bp, Homo sapiens
ctgtctctgtgtcagtcaggtct

SEQ ID NO: 136805 - DNA, 23 bp, Homo sapiens
ttattctgtcagggtcactgagg

SEQ ID NO: 136806 - DNA, 23 bp, Homo sapiens
ttctgtgcctgagtgcctggctg

SEQ ID NO: 136807 - DNA, 22 bp, Homo sapiens
gtgtgtgtgtctgtgtgtatgt

SEQ ID NO: 136808 - DNA, 23 bp, Homo sapiens
tatgtgtgcatatgtgtgtgtgt

SEQ ID NO: 136809 - DNA, 23 bp, Homo sapiens
cttgtttagtcaatatcttgttc

SEQ ID NO: 136810 - DNA, 23 bp, Homo sapiens
ccatcctgacacagtgtctcact

SEQ ID NO: 136811 - DNA, 23 bp, Homo sapiens
tgagttcattgtagattctggat

SEQ ID NO: 136812 - DNA, 23 bp, Homo sapiens
tgagttcattgtagattctggat

SEQ ID NO: 136813 - DNA, 23 bp, Homo sapiens
gtgactgtgtgtgtgtgtgtgtg

SEQ ID NO: 136814 - DNA, 23 bp, Homo sapiens
tgagttcattgtagattctggat

SEQ ID NO: 136815 - DNA, 23 bp, Homo sapiens
tgagttcattgtagattctggat

SEQ ID NO: 136816 - DNA, 23 bp, Homo sapiens
tgagttcattgtagattctggat

SEQ ID NO: 136817 - DNA, 23 bp, Homo sapiens
tgagttcattgtagattctggat

SEQ ID NO: 136818 - DNA, 20 bp, Homo sapiens
ctctgacgtgtgtgtccaca

SEQ ID NO: 136819 - DNA, 19 bp, Homo sapiens
attgtgactggttgtcctg

SEQ ID NO: 136820 - DNA, 22 bp, Homo sapiens
atatatgtatatatggatatct

SEQ ID NO: 136821 - DNA, 23 bp, Homo sapiens
ctcagttcctctcagtgtctgtg

SEQ ID NO: 136822 - DNA, 21 bp, Homo sapiens
taaagctagagttagtaagca

SEQ ID NO: 136823 - DNA, 23 bp, Homo sapiens
gggtttgcatcataagctagtgt

SEQ ID NO: 136824 - DNA, 19 bp, Homo sapiens
atatgtatatatgtgtgtg

SEQ ID NO: 136825 - DNA, 23 bp, Homo sapiens
tggagtctcactctgtcacccag

SEQ ID NO: 136826 - DNA, 23 bp, Homo sapiens
tatgtgcatgtatgtataattat

SEQ ID NO: 136827 - DNA, 19 bp, Homo sapiens
ttaacgaaggaaaggaaat

SEQ ID NO: 136828 - DNA, 18 bp, Homo sapiens
atgagatgtgtctaagga

SEQ ID NO: 136829 - DNA, 23 bp, Homo sapiens
gtgtttggttatctattgctttg

SEQ ID NO: 136830 - DNA, 23 bp, Homo sapiens
aaagacagacagattatgtggat

SEQ ID NO: 136831 - DNA, 20 bp, Homo sapiens
agcctgactgtataggagga

SEQ ID NO: 136832 - DNA, 18 bp, Homo sapiens
gcggggctgactgggcat

SEQ ID NO: 136833 - DNA, 23 bp, Homo sapiens
agagtctcactctgtcacccagg

SEQ ID NO: 136834 - DNA, 20 bp, Homo sapiens
ctatgagcatgtttactgat

SEQ ID NO: 136835 - DNA, 22 bp, Homo sapiens
tgacccactggctgttcttttt

SEQ ID NO: 136836 - DNA, 23 bp, Homo sapiens
tctccgtcagtgtctgtgtggca

SEQ ID NO: 136837 - DNA, 19 bp, Homo sapiens
ctgcatatatatattcata

SEQ ID NO: 136838 - DNA, 19 bp, Homo sapiens
atgtgtgtgtgtgactttg

SEQ ID NO: 136839 - DNA, 23 bp, Homo sapiens
cacagtgtctgcctgtctgccag

SEQ ID NO: 136840 - DNA, 23 bp, Homo sapiens
tatctgtgtgtctgtgtagatgg

SEQ ID NO: 136841 - DNA, 23 bp, Homo sapiens
tgtgtctgggtcccagtctcctc

SEQ ID NO: 136842 - DNA, 22 bp, Homo sapiens
tgtctctctctctctctatata

SEQ ID NO: 136843 - DNA, 23 bp, Homo sapiens
agcctccctgggtgcctctaatc

SEQ ID NO: 136844 - DNA, 20 bp, Homo sapiens
aagataatatatatttgtgt

SEQ ID NO: 136845 - DNA, 20 bp, Homo sapiens
tgtatacatatatatgtgta

SEQ ID NO: 136846 - DNA, 23 bp, Homo sapiens
gacagagtctcgctctgtcaccc

SEQ ID NO: 136847 - DNA, 23 bp, Homo sapiens
cggagtctcactctgtcacccag

SEQ ID NO: 136848 - DNA, 23 bp, Homo sapiens
gagtctcactctgtcacccaggc

SEQ ID NO: 136849 - DNA, 18 bp, Homo sapiens
caggggctggataatcac

SEQ ID NO: 136850 - DNA, 23 bp, Homo sapiens
gagaacacagtgggtgcaaaggc

SEQ ID NO: 136851 - DNA, 23 bp, Homo sapiens
atgggcctgggtgttgttggacc

SEQ ID NO: 136852 - DNA, 23 bp, Homo sapiens
gtactgagttacttgttctcttt

SEQ ID NO: 136853 - DNA, 23 bp, Homo sapiens
atactgtgagggagaacttgaac

SEQ ID NO: 136854 - DNA, 21 bp, Homo sapiens
agactgtttgggtatgaaccc

SEQ ID NO: 136855 - DNA, 22 bp, Homo sapiens
aggaatgtttgtgttgttaagt

SEQ ID NO: 136856 - DNA, 23 bp, Homo sapiens
gacttctctcagtctctgtgggt

SEQ ID NO: 136857 - DNA, 22 bp, Homo sapiens
actcaggcactcactctatgac

SEQ ID NO: 136858 - DNA, 20 bp, Homo sapiens
tctgcatggacatgctgtgt

SEQ ID NO: 136859 - DNA, 23 bp, Homo sapiens
tgccagtctccctgtctgagctc

SEQ ID NO: 136860 - DNA, 23 bp, Homo sapiens
gtcagcctgactctctgtctgct

SEQ ID NO: 136861 - DNA, 23 bp, Homo sapiens
accctgtctctctctatgtgacc

SEQ ID NO: 136862 - DNA, 23 bp, Homo sapiens
acagtctgtgggtccgtgtgtgc

SEQ ID NO: 136863 - DNA, 23 bp, Homo sapiens
tgcctgggtccctgcctgcctca

SEQ ID NO: 136864 - DNA, 19 bp, Homo sapiens
tatggataatatacaggtg

SEQ ID NO: 136865 - DNA, 23 bp, Homo sapiens
agagctagctcactctctgtctg

SEQ ID NO: 136866 - DNA, 23 bp, Homo sapiens
ggctcgctctgtggctgtcagtc

SEQ ID NO: 136867 - DNA, 23 bp, Homo sapiens
ttctgtgtctcagtctctccatc

SEQ ID NO: 136868 - DNA, 23 bp, Homo sapiens
gtgtctgtcactccgtgtggcct

SEQ ID NO: 136869 - DNA, 20 bp, Homo sapiens
tgtcactctgtgtggcctcc

SEQ ID NO: 136870 - DNA, 21 bp, Homo sapiens
acgtggcttcactgagtgtct

SEQ ID NO: 136871 - DNA, 23 bp, Homo sapiens
gtggtcagtcagtatcctgtggc

SEQ ID NO: 136872 - DNA, 23 bp, Homo sapiens
tgagagaactcagagaccagtgc

SEQ ID NO: 136873 - DNA, 23 bp, Homo sapiens
acactcactctccgactggcact

SEQ ID NO: 136874 - DNA, 23 bp, Homo sapiens
ctgtctcactgtctgcctctgag

SEQ ID NO: 136875 - DNA, 18 bp, Homo sapiens
caggctgcctgtctgcca

SEQ ID NO: 136876 - DNA, 23 bp, Homo sapiens
tctctctctcagtgcttctccac

SEQ ID NO: 136877 - DNA, 21 bp, Homo sapiens
tgggtgagtcagtcagtctct

SEQ ID NO: 136878 - DNA, 23 bp, Homo sapiens
gaccacagtctgtctctgtccct

SEQ ID NO: 136879 - DNA, 23 bp, Homo sapiens
agtccctctgtcggtctgaggtc

SEQ ID NO: 136880 - DNA, 23 bp, Homo sapiens
gacaccatctctgagtctcatca

SEQ ID NO: 136881 - DNA, 23 bp, Homo sapiens
tttgagacggagtctcactctgt

SEQ ID NO: 136882 - DNA, 23 bp, Homo sapiens
agagtctcactctgtctcccagg

SEQ ID NO: 136883 - DNA, 23 bp, Homo sapiens
acagaacagagacaggaaacatt

SEQ ID NO: 136884 - DNA, 21 bp, Homo sapiens
ccgagatgctcatgtgctcct

SEQ ID NO: 136885 - DNA, 23 bp, Homo sapiens
aagacagtaaagacagagttcag

SEQ ID NO: 136886 - DNA, 23 bp, Homo sapiens
gggtctcactctgtcacccaggc

SEQ ID NO: 136887 - DNA, 23 bp, Homo sapiens
tgtcactcccactggaggcgctg

SEQ ID NO: 136888 - DNA, 23 bp, Homo sapiens
tgagacagagtctcgctctgtca

SEQ ID NO: 136889 - DNA, 23 bp, Homo sapiens
gggtctcactctgtcacccaggc

SEQ ID NO: 136890 - DNA, 22 bp, Homo sapiens
tcacactgagttgcatttgcct

SEQ ID NO: 136891 - DNA, 19 bp, Homo sapiens
actcagaaggctgagagga

SEQ ID NO: 136892 - DNA, 23 bp, Homo sapiens
aatggagcctgtgactctgagtc

SEQ ID NO: 136893 - DNA, 21 bp, Homo sapiens
taagtacttttctgaatgcat

SEQ ID NO: 136894 - DNA, 23 bp, Homo sapiens
ctcccagagcccctggaactctg

SEQ ID NO: 136895 - DNA, 18 bp, Homo sapiens
tgtttgtttgttttttgt

SEQ ID NO: 136896 - DNA, 23 bp, Homo sapiens
ttttgagacagagtctcgctctg

SEQ ID NO: 136897 - DNA, 23 bp, Homo sapiens
ggtgacagagcgagactctgtct

SEQ ID NO: 136898 - DNA, 23 bp, Homo sapiens
tgagacagagtctcgctctgtcg

SEQ ID NO: 136899 - DNA, 23 bp, Homo sapiens
tgagatcattgtgaacctccttc

SEQ ID NO: 136900 - DNA, 23 bp, Homo sapiens
agatggagtctcactctgtctcc

SEQ ID NO: 136901 - DNA, 23 bp, Homo sapiens
ggagtctcactctgtctcccagg

SEQ ID NO: 136902 - DNA, 23 bp, Homo sapiens
agagtctcactctgtcacccagg

SEQ ID NO: 136903 - DNA, 23 bp, Homo sapiens
gtgtgtgggtggctcagtccctg

SEQ ID NO: 136904 - DNA, 23 bp, Homo sapiens
gtctgtgtctctgagtatcttct

SEQ ID NO: 136905 - DNA, 23 bp, Homo sapiens
tgagacaagagtctgtctgtcac

SEQ ID NO: 136906 - DNA, 19 bp, Homo sapiens
gtgattgtaggattttggt

SEQ ID NO: 136907 - DNA, 23 bp, Homo sapiens
agacagggtctcggtctgtcact

SEQ ID NO: 136908 - DNA, 18 bp, Homo sapiens
gctctctctctggctctg

SEQ ID NO: 136909 - DNA, 23 bp, Homo sapiens
tgtctgtgtgtctgcatgtctgt

SEQ ID NO: 136910 - DNA, 23 bp, Homo sapiens
gtactgactgaacagtctgtcgc

SEQ ID NO: 136911 - DNA, 20 bp, Homo sapiens
tggctacttgagacccagca

SEQ ID NO: 136912 - DNA, 23 bp, Homo sapiens
tgagggcctcactctgtgccagt

SEQ ID NO: 136913 - DNA, 23 bp, Homo sapiens
tgcctctgtggctgtctccctca

SEQ ID NO: 136914 - DNA, 23 bp, Homo sapiens
gtatgtagttcttgacgtcctgt

SEQ ID NO: 136915 - DNA, 23 bp, Homo sapiens
tctaggagtagactggctgtggt

SEQ ID NO: 136916 - DNA, 23 bp, Homo sapiens
gtgccacccacagcccctccact

SEQ ID NO: 136917 - DNA, 23 bp, Homo sapiens
gccagcctctgtgcctcagtgtg

SEQ ID NO: 136918 - DNA, 22 bp, Homo sapiens
tgtctgtgtgtgtgcatgtgca

SEQ ID NO: 136919 - DNA, 19 bp, Homo sapiens
gggtgtagtgtttgtgcac

SEQ ID NO: 136920 - DNA, 21 bp, Homo sapiens
tgcctgcctccctggaaccca

SEQ ID NO: 136921 - DNA, 23 bp, Homo sapiens
cactccctctctggcagcctggc

SEQ ID NO: 136922 - DNA, 22 bp, Homo sapiens
acacttgatggctgtctcgagg

SEQ ID NO: 136923 - DNA, 23 bp, Homo sapiens
tgactcactttctctctcctgtg

SEQ ID NO: 136924 - DNA, 23 bp, Homo sapiens
gagtgtgtctctgtctctggctt

SEQ ID NO: 136925 - DNA, 20 bp, Homo sapiens
tagagcaagatcttgccttt

SEQ ID NO: 136926 - DNA, 22 bp, Homo sapiens
tttgagacagggtctcttgctc

SEQ ID NO: 136927 - DNA, 18 bp, Homo sapiens
acattttgtacctgtaga

SEQ ID NO: 136928 - DNA, 23 bp, Homo sapiens
gggtctctgtcactgagtggccc

SEQ ID NO: 136929 - DNA, 18 bp, Homo sapiens
actttaagttctgggata

SEQ ID NO: 136930 - DNA, 21 bp, Homo sapiens
ttgtgcagaacgtgcaggttc

SEQ ID NO: 136931 - DNA, 20 bp, Homo sapiens
tgtgcatgtgcatgtatatg

SEQ ID NO: 136932 - DNA, 22 bp, Homo sapiens
atgtgtgtgcatttgcatgtgc

SEQ ID NO: 136933 - DNA, 23 bp, Homo sapiens
tatgtgcatgtgcatttgcatgt

SEQ ID NO: 136934 - DNA, 20 bp, Homo sapiens
tgtatgtgcatacgcatgtg

SEQ ID NO: 136935 - DNA, 23 bp, Homo sapiens
ttcatgtgcgtgtgtatgtgtat

SEQ ID NO: 136936 - DNA, 23 bp, Homo sapiens
tgtgtgtatgtgcatttgcatgt

SEQ ID NO: 136937 - DNA, 23 bp, Homo sapiens
tatgtgtatctgcatgtgcatgt

SEQ ID NO: 136938 - DNA, 21 bp, Homo sapiens
tgaagcatcaggtccaggaga

SEQ ID NO: 136939 - DNA, 23 bp, Homo sapiens
tcccagagtgagttaagtcgatg

SEQ ID NO: 136940 - DNA, 18 bp, Homo sapiens
aggctagtttcaggctca

SEQ ID NO: 136941 - DNA, 21 bp, Homo sapiens
tgtgtgatgaaactgagcaca

SEQ ID NO: 136942 - DNA, 18 bp, Homo sapiens
tcagaccccagagagcac

SEQ ID NO: 136943 - DNA, 23 bp, Homo sapiens
ctctctctcatgttgttgaagtg

SEQ ID NO: 136944 - DNA, 20 bp, Homo sapiens
tgactcagtgactcagaggg

SEQ ID NO: 136945 - DNA, 23 bp, Homo sapiens
gaggggtgtgtgtgtgcctgtgc

SEQ ID NO: 136946 - DNA, 23 bp, Homo sapiens
ctctctgtgcctcagtttcctct

SEQ ID NO: 136947 - DNA, 18 bp, Homo sapiens
agtgaacaacgaggcaaa

SEQ ID NO: 136948 - DNA, 23 bp, Homo sapiens
gcatggcagaagtctgtgagctc

SEQ ID NO: 136949 - DNA, 21 bp, Homo sapiens
agagagtgcagagtgtgcagt

SEQ ID NO: 136950 - DNA, 23 bp, Homo sapiens
tcgaggagctcacagtctagtat

SEQ ID NO: 136951 - DNA, 23 bp, Homo sapiens
actagactgaagctccttgagga

SEQ ID NO: 136952 - DNA, 23 bp, Homo sapiens
acaagtctcactctgtcacccag

SEQ ID NO: 136953 - DNA, 21 bp, Homo sapiens
agttttgtctgtatatgttta

SEQ ID NO: 136954 - DNA, 19 bp, Homo sapiens
aagagtagacagtgaggac

SEQ ID NO: 136955 - DNA, 23 bp, Homo sapiens
ctcagtgtcctttcagaatcatg

SEQ ID NO: 136956 - DNA, 20 bp, Homo sapiens
actcaggactctgtgtctca

SEQ ID NO: 136957 - DNA, 23 bp, Homo sapiens
atgtgtgtatatgtatatatgtg

SEQ ID NO: 136958 - DNA, 23 bp, Homo sapiens
ttgagcttgtaagtgatactgtt

SEQ ID NO: 136959 - DNA, 23 bp, Homo sapiens
attttgtttttgagacggacttt

SEQ ID NO: 136960 - DNA, 23 bp, Homo sapiens
tgagttcattgtagattctggat

SEQ ID NO: 136961 - DNA, 23 bp, Homo sapiens
tgagttcattgtagattctggat

SEQ ID NO: 136962 - DNA, 23 bp, Homo sapiens
ggagtctcactctgtctcccagg

SEQ ID NO: 136963 - DNA, 23 bp, Homo sapiens
ttgagatggagttttgctcttgt

SEQ ID NO: 136964 - DNA, 19 bp, Homo sapiens
actgcagaggctgggttca

SEQ ID NO: 136965 - DNA, 23 bp, Homo sapiens
catatagtgacactatgttatgt

SEQ ID NO: 136966 - DNA, 23 bp, Homo sapiens
attgcatgtacacttgggtagta

SEQ ID NO: 136967 - DNA, 23 bp, Homo sapiens
tttggatatatatatgtgtgtgt

SEQ ID NO: 136968 - DNA, 23 bp, Homo sapiens
tttgacagccgttttgtgtgtgt

SEQ ID NO: 136969 - DNA, 20 bp, Homo sapiens
ttgtccatattcagtatgga

SEQ ID NO: 136970 - DNA, 20 bp, Homo sapiens
acacacacacatatatatat

SEQ ID NO: 136971 - DNA, 18 bp, Homo sapiens
tgccagggacgatgtatg

SEQ ID NO: 136972 - DNA, 23 bp, Homo sapiens
atggagtctcactctgtcaccta

SEQ ID NO: 136973 - DNA, 23 bp, Homo sapiens
ttgtctcaatttattttttagac

SEQ ID NO: 136974 - DNA, 23 bp, Homo sapiens
aataaactggcttgcaaatctgt

SEQ ID NO: 136975 - DNA, 18 bp, Homo sapiens
tgcctgtaatgtcagcac

SEQ ID NO: 136976 - DNA, 23 bp, Homo sapiens
agagtctctctctgtcacccagg

SEQ ID NO: 136977 - DNA, 23 bp, Homo sapiens
gagtgtctcactctgtcacccag

SEQ ID NO: 136978 - DNA, 21 bp, Homo sapiens
tgtgtatatatatatgtgtgt

SEQ ID NO: 136979 - DNA, 18 bp, Homo sapiens
tcagcatggtcagtcagt

SEQ ID NO: 136980 - DNA, 23 bp, Homo sapiens
agagtctcactctgtctccaagg

SEQ ID NO: 136981 - DNA, 23 bp, Homo sapiens
tctctgtctctgtctgtctccac

SEQ ID NO: 136982 - DNA, 22 bp, Homo sapiens
accctcactctctatcagctgt

SEQ ID NO: 136983 - DNA, 21 bp, Homo sapiens
gaagacagtgtgtgaactgtt

SEQ ID NO: 136984 - DNA, 22 bp, Homo sapiens
tgtgtgtatatatatatgtgtg

SEQ ID NO: 136985 - DNA, 20 bp, Homo sapiens
tcacagggttttgtgtgttt

SEQ ID NO: 136986 - DNA, 23 bp, Homo sapiens
aaactctgtgcctcacttttcac

SEQ ID NO: 136987 - DNA, 23 bp, Homo sapiens
agaggaggcagagtctggctctg

SEQ ID NO: 136988 - DNA, 22 bp, Homo sapiens
cagtggcatgatcttggctcat

SEQ ID NO: 136989 - DNA, 21 bp, Homo sapiens
tttttactttttgtttccaga

SEQ ID NO: 136990 - DNA, 23 bp, Homo sapiens
atatgtttctatatcttactgtt

SEQ ID NO: 136991 - DNA, 19 bp, Homo sapiens
tcagtgtggagagagagca

SEQ ID NO: 136992 - DNA, 23 bp, Homo sapiens
atcagagtctgtcttcaacagcc

SEQ ID NO: 136993 - DNA, 23 bp, Homo sapiens
tgtcaattatatatgtatatgtg

SEQ ID NO: 136994 - DNA, 22 bp, Homo sapiens
tatgtatatatggatatctata

SEQ ID NO: 136995 - DNA, 23 bp, Homo sapiens
tgtgtgtctatatctatatatgt

SEQ ID NO: 136996 - DNA, 21 bp, Homo sapiens
tacacatgtgtgcacatatgt

SEQ ID NO: 136997 - DNA, 23 bp, Homo sapiens
aatactatgcatatgtgtgattt

SEQ ID NO: 136998 - DNA, 23 bp, Homo sapiens
tgtaatgtgtgtgtatatatatt

SEQ ID NO: 136999 - DNA, 23 bp, Homo sapiens
acatacacacacacatatgtgta

SEQ ID NO: 137000 - DNA, 23 bp, Homo sapiens
aatcattgttattctcatgccat

SEQ ID NO: 137001 - DNA, 22 bp, Homo sapiens
taaatacagatacagatacata

SEQ ID NO: 137002 - DNA, 23 bp, Homo sapiens
ataggtttgtgtgtgtgtatatg

SEQ ID NO: 137003 - DNA, 23 bp, Homo sapiens
aactatgtatgtgtgtgtgtgta

SEQ ID NO: 137004 - DNA, 22 bp, Homo sapiens
atatacacacacgtatgtatgt

SEQ ID NO: 137005 - DNA, 22 bp, Homo sapiens
catttgcatgtgattctgtatg

SEQ ID NO: 137006 - DNA, 18 bp, Homo sapiens
attctagatgtcactctg

SEQ ID NO: 137007 - DNA, 23 bp, Homo sapiens
gtgtgtgtatatgtaagtgtgtg

SEQ ID NO: 137008 - DNA, 23 bp, Homo sapiens
taaagtagtttctgtttgactgg

SEQ ID NO: 137009 - DNA, 21 bp, Homo sapiens
ttcagattttattccattgtg

SEQ ID NO: 137010 - DNA, 23 bp, Homo sapiens
taagacttgctttgtgacctaac

SEQ ID NO: 137011 - DNA, 23 bp, Homo sapiens
tgtggagagacagaggatagggt

SEQ ID NO: 137012 - DNA, 23 bp, Homo sapiens
agtttcagaggagtgagtgatca

SEQ ID NO: 137013 - DNA, 22 bp, Homo sapiens
tgtatatgcatgtatatatgtg

SEQ ID NO: 137014 - DNA, 23 bp, Homo sapiens
atttatatgtatgtatatgtaca

SEQ ID NO: 137015 - DNA, 23 bp, Homo sapiens
atatgtatatgtacacacatgta

SEQ ID NO: 137016 - DNA, 22 bp, Homo sapiens
taggtggttagatatactgttc

SEQ ID NO: 137017 - DNA, 23 bp, Homo sapiens
aagtccaaaggccatatgctgga

SEQ ID NO: 137018 - DNA, 18 bp, Homo sapiens
atcttcctggagtaccag

SEQ ID NO: 137019 - DNA, 23 bp, Homo sapiens
ttttcaggattgtccaagtggct

SEQ ID NO: 137020 - DNA, 23 bp, Homo sapiens
tgtgatggagtctcactctgtca

SEQ ID NO: 137021 - DNA, 19 bp, Homo sapiens
taatctgtgtgtatatgtg

SEQ ID NO: 137022 - DNA, 23 bp, Homo sapiens
tgagttcattgtagattctggat

SEQ ID NO: 137023 - DNA, 23 bp, Homo sapiens
tgagttcattgtagattctggat

SEQ ID NO: 137024 - DNA, 19 bp, Homo sapiens
agccaagcagcaggacccc

SEQ ID NO: 137025 - DNA, 23 bp, Homo sapiens
actcagagcagagagtgagcttc

SEQ ID NO: 137026 - DNA, 23 bp, Homo sapiens
tgagttcattgtagattctggat

SEQ ID NO: 137027 - DNA, 23 bp, Homo sapiens
tgagttcattgtagattctggat

SEQ ID NO: 137028 - DNA, 23 bp, Homo sapiens
tgagagtcaggacttgtattcat

SEQ ID NO: 137029 - DNA, 23 bp, Homo sapiens
ttttgagtcacagtctcactctg

SEQ ID NO: 137030 - DNA, 23 bp, Homo sapiens
atatcataccctgctttaaacag

SEQ ID NO: 137031 - DNA, 22 bp, Homo sapiens
tggattgaaaacaagaatagag

SEQ ID NO: 137032 - DNA, 23 bp, Homo sapiens
tgtaaacatccccgactggaagc

SEQ ID NO: 137033 - DNA, 23 bp, Homo sapiens
gctttcagtcagatgtttgctgc

SEQ ID NO: 137034 - DNA, 23 bp, Homo sapiens
tgtaaacatcctacactcagctg

SEQ ID NO: 137035 - DNA, 19 bp, Homo sapiens
actgcaaactctgcttcct

SEQ ID NO: 137036 - DNA, 23 bp, Homo sapiens
ttctttttgcttaggattgtctt

SEQ ID NO: 137037 - DNA, 23 bp, Homo sapiens
atagtagtttcttagagtgtagt

SEQ ID NO: 137038 - DNA, 23 bp, Homo sapiens
tctgacactctgagataagtgtg

SEQ ID NO: 137039 - DNA, 23 bp, Homo sapiens
ctggctctgtggctctgtctccc

SEQ ID NO: 137040 - DNA, 21 bp, Homo sapiens
atgtgtctgctttgggatttg

SEQ ID NO: 137041 - DNA, 23 bp, Homo sapiens
tcctgctcatcgtggtgctcact

SEQ ID NO: 137042 - DNA, 23 bp, Homo sapiens
ttgagatgaagtcttactctgtc

SEQ ID NO: 137043 - DNA, 18 bp, Homo sapiens
acgtatatatatgtgtat

SEQ ID NO: 137044 - DNA, 23 bp, Homo sapiens
gcagaggtagaagaatcacttga

SEQ ID NO: 137045 - DNA, 23 bp, Homo sapiens
tgagacgtagtctggctctgtcg

SEQ ID NO: 137046 - DNA, 23 bp, Homo sapiens
atgagccttctcccaccctctct

SEQ ID NO: 137047 - DNA, 19 bp, Homo sapiens
tatgtttatatatatatgt

SEQ ID NO: 137048 - DNA, 22 bp, Homo sapiens
atatgtctatatatatatgtct

SEQ ID NO: 137049 - DNA, 23 bp, Homo sapiens
tatgtctgcatatatatgtctat

SEQ ID NO: 137050 - DNA, 23 bp, Homo sapiens
atatatgtctgcatatatatgtc

SEQ ID NO: 137051 - DNA, 21 bp, Homo sapiens
tatgtctatatatatatgtct

SEQ ID NO: 137052 - DNA, 19 bp, Homo sapiens
tatgtctatatatatgtct

SEQ ID NO: 137053 - DNA, 23 bp, Homo sapiens
atatgtctatatatatatgtctc

SEQ ID NO: 137054 - DNA, 23 bp, Homo sapiens
ttgaagcgtgaggatttgattcg

SEQ ID NO: 137055 - DNA, 20 bp, Homo sapiens
ttaggctgagctaggtttga

SEQ ID NO: 137056 - DNA, 23 bp, Homo sapiens
actctctctgggtgtcaggttcc

SEQ ID NO: 137057 - DNA, 23 bp, Homo sapiens
agacacagcttaggctagtgaag

SEQ ID NO: 137058 - DNA, 23 bp, Homo sapiens
ctcagcctgacactgtgtgtcct

SEQ ID NO: 137059 - DNA, 20 bp, Homo sapiens
atcacagactctggaggtag

SEQ ID NO: 137060 - DNA, 23 bp, Homo sapiens
tctcactctctctcagttaactg

SEQ ID NO: 137061 - DNA, 23 bp, Homo sapiens
tatatgtatatgtgtatacatag

SEQ ID NO: 137062 - DNA, 22 bp, Homo sapiens
tatatatgtatatatgtaagtt

SEQ ID NO: 137063 - DNA, 23 bp, Homo sapiens
atatatgtatatgtatatgtata

SEQ ID NO: 137064 - DNA, 23 bp, Homo sapiens
aatatatgtgattatgtataata

SEQ ID NO: 137065 - DNA, 23 bp, Homo sapiens
atatctgtgggtatgtagaaata

SEQ ID NO: 137066 - DNA, 23 bp, Homo sapiens
tgagttcattgtagattctggat

SEQ ID NO: 137067 - DNA, 23 bp, Homo sapiens
tgagttcattgtagattctggat

SEQ ID NO: 137068 - DNA, 23 bp, Homo sapiens
caagagagtagtcattcccttct

SEQ ID NO: 137069 - DNA, 23 bp, Homo sapiens
tgcctgtgaccctctctgagagg

SEQ ID NO: 137070 - DNA, 23 bp, Homo sapiens
ctggtttgttgttctctgtggct

SEQ ID NO: 137071 - DNA, 23 bp, Homo sapiens
gcaagagttgtcattttgtggtt

SEQ ID NO: 137072 - DNA, 23 bp, Homo sapiens
tttggtcattgacctagctgtgc

SEQ ID NO: 137073 - DNA, 23 bp, Homo sapiens
ctgctctctctttctcacttgtt

SEQ ID NO: 137074 - DNA, 21 bp, Homo sapiens
atagaagaacactaggcctga

SEQ ID NO: 137075 - DNA, 19 bp, Homo sapiens
agctggatcttaaagtggt

SEQ ID NO: 137076 - DNA, 21 bp, Homo sapiens
tatgtttttattttgcattgt

SEQ ID NO: 137077 - DNA, 23 bp, Homo sapiens
tctaaacaaccttctgactctct

SEQ ID NO: 137078 - DNA, 23 bp, Homo sapiens
atgactttttcttattgtgtact

SEQ ID NO: 137079 - DNA, 23 bp, Homo sapiens
ctaagttatgcaatagataagtt

SEQ ID NO: 137080 - DNA, 23 bp, Homo sapiens
cttatttattgctgtatctcctg

SEQ ID NO: 137081 - DNA, 18 bp, Homo sapiens
aactcatgacttatttct

SEQ ID NO: 137082 - DNA, 20 bp, Homo sapiens
acatgtaaaagcaaatgtgt

SEQ ID NO: 137083 - DNA, 23 bp, Homo sapiens
gtgtgtgcatgtgtgtgtgtgtg

SEQ ID NO: 137084 - DNA, 23 bp, Homo sapiens
ttcagagatcatagagagcagta

SEQ ID NO: 137085 - DNA, 18 bp, Homo sapiens
atgtgcttgatgtattat

SEQ ID NO: 137086 - DNA, 23 bp, Homo sapiens
ttgtctcagatgagactgtggac

SEQ ID NO: 137087 - DNA, 23 bp, Homo sapiens
acaggatctgcatgtgctatcaa

SEQ ID NO: 137088 - DNA, 23 bp, Homo sapiens
aaaatctctatccccttccacat

SEQ ID NO: 137089 - DNA, 23 bp, Homo sapiens
tctcaaggacttggaatgtgagc

SEQ ID NO: 137090 - DNA, 18 bp, Homo sapiens
tgtgcaagatgtgcaggt

SEQ ID NO: 137091 - DNA, 23 bp, Homo sapiens
gacagagtctcgctctgtcaccc

SEQ ID NO: 137092 - DNA, 23 bp, Homo sapiens
tataacatgatgttatggatagt

SEQ ID NO: 137093 - DNA, 18 bp, Homo sapiens
agagagagatggggtctc

SEQ ID NO: 137094 - DNA, 23 bp, Homo sapiens
tatgtgcatatgcatgtgtgtgt

SEQ ID NO: 137095 - DNA, 23 bp, Homo sapiens
tatatgtatatatatgtatgtgt

SEQ ID NO: 137096 - DNA, 23 bp, Homo sapiens
tctctctgtgggtgactgtgcac

SEQ ID NO: 137097 - DNA, 21 bp, Homo sapiens
acaggtattgaattcattatt

SEQ ID NO: 137098 - DNA, 20 bp, Homo sapiens
ctctagctctgtctctgttg

SEQ ID NO: 137099 - DNA, 22 bp, Homo sapiens
aacaggaagttgcatgttttca

SEQ ID NO: 137100 - DNA, 23 bp, Homo sapiens
acatcttttgcttagtttgtgtg

SEQ ID NO: 137101 - DNA, 23 bp, Homo sapiens
agatggagtctcactctgtcacc

SEQ ID NO: 137102 - DNA, 18 bp, Homo sapiens
tggcatcaggcatcattc

SEQ ID NO: 137103 - DNA, 23 bp, Homo sapiens
agagtggaattgaaatgttctag

SEQ ID NO: 137104 - DNA, 23 bp, Homo sapiens
actttttctgattatcatgacaa

SEQ ID NO: 137105 - DNA, 23 bp, Homo sapiens
ttcagtgtggcagtgttcttagc

SEQ ID NO: 137106 - DNA, 22 bp, Homo sapiens
acggagtctcgctgtgacagcc

SEQ ID NO: 137107 - DNA, 21 bp, Homo sapiens
atgttcttacgtgtgtgtgtg

SEQ ID NO: 137108 - DNA, 22 bp, Homo sapiens
ttgtgcatatatatatgtatgt

SEQ ID NO: 137109 - DNA, 23 bp, Homo sapiens
ttttgagatggagtctcgctctg

SEQ ID NO: 137110 - DNA, 22 bp, Homo sapiens
acagagccagaccttgtcttga

SEQ ID NO: 137111 - DNA, 21 bp, Homo sapiens
cacaagtgtataggaattcat

SEQ ID NO: 137112 - DNA, 20 bp, Homo sapiens
taattagaactgtgcctggt

SEQ ID NO: 137113 - DNA, 23 bp, Homo sapiens
tgtctgcgtgtgtgtctgtgtaa

SEQ ID NO: 137114 - DNA, 23 bp, Homo sapiens
ttttttggttccatatgaaattt

SEQ ID NO: 137115 - DNA, 22 bp, Homo sapiens
tatctgcaaagtttttttgtct

SEQ ID NO: 137116 - DNA, 21 bp, Homo sapiens
ctggtagtatgtttaatattt

SEQ ID NO: 137117 - DNA, 23 bp, Homo sapiens
ctgatcctgatcctctgtaggtc

SEQ ID NO: 137118 - DNA, 18 bp, Homo sapiens
cttgtgtaatattgtact

SEQ ID NO: 137119 - DNA, 23 bp, Homo sapiens
ttgagatggagtcttgctctgtc

SEQ ID NO: 137120 - DNA, 23 bp, Homo sapiens
agatggagtctcactctgtcacc

SEQ ID NO: 137121 - DNA, 23 bp, Homo sapiens
tggagtctcactctgtcacccag

SEQ ID NO: 137122 - DNA, 23 bp, Homo sapiens
gtcatgtagtaggaagaattgta

SEQ ID NO: 137123 - DNA, 23 bp, Homo sapiens
atatgtgtgtgtatttatatgtg

SEQ ID NO: 137124 - DNA, 23 bp, Homo sapiens
catctctgattttcttgcactta

SEQ ID NO: 137125 - DNA, 23 bp, Homo sapiens
agattctccattcccattgggtc

SEQ ID NO: 137126 - DNA, 23 bp, Homo sapiens
tttgtgcttccctctaccagctt

SEQ ID NO: 137127 - DNA, 23 bp, Homo sapiens
tgcatgcatctatgtatgtatgt

SEQ ID NO: 137128 - DNA, 23 bp, Homo sapiens
aaagaggaacaaattggaactgt

SEQ ID NO: 137129 - DNA, 19 bp, Homo sapiens
tgcattgcacagggttttg

SEQ ID NO: 137130 - DNA, 23 bp, Homo sapiens
tcagtccctctgtctgatgtctc

SEQ ID NO: 137131 - DNA, 23 bp, Homo sapiens
ccgagtctccctctgtcacccag

SEQ ID NO: 137132 - DNA, 21 bp, Homo sapiens
tgtgtgtatatatttatatgt

SEQ ID NO: 137133 - DNA, 19 bp, Homo sapiens
ccaggtatagattgagcac

SEQ ID NO: 137134 - DNA, 23 bp, Homo sapiens
attgttgaaactctaatgctaat

SEQ ID NO: 137135 - DNA, 22 bp, Homo sapiens
ctgtggtagttcttagaggaaa

SEQ ID NO: 137136 - DNA, 23 bp, Homo sapiens
tctacatactgctctgtccctct

SEQ ID NO: 137137 - DNA, 23 bp, Homo sapiens
actcactggctgtgcctcagttt

SEQ ID NO: 137138 - DNA, 18 bp, Homo sapiens
tgcccttccatcgtggag

SEQ ID NO: 137139 - DNA, 20 bp, Homo sapiens
tgaaaaagcgagaccctgtc

SEQ ID NO: 137140 - DNA, 23 bp, Homo sapiens
gatggagtctcactctgtctttc

SEQ ID NO: 137141 - DNA, 23 bp, Homo sapiens
ttcaagtccttactcagactctc

SEQ ID NO: 137142 - DNA, 23 bp, Homo sapiens
tgagttcattgtagattctggat

SEQ ID NO: 137143 - DNA, 23 bp, Homo sapiens
tgagttcattgtagattctggat

SEQ ID NO: 137144 - DNA, 23 bp, Homo sapiens
tacatttgttaagaaaagttgaa

SEQ ID NO: 137145 - DNA, 23 bp, Homo sapiens
gggagtctcactctgtcacccag

SEQ ID NO: 137146 - DNA, 23 bp, Homo sapiens
tgttattcttgctgattatgttt

SEQ ID NO: 137147 - DNA, 20 bp, Homo sapiens
ttgtttgacagttaaggatt

SEQ ID NO: 137148 - DNA, 19 bp, Homo sapiens
gtgaagaacgtcagtggta

SEQ ID NO: 137149 - DNA, 21 bp, Homo sapiens
taaatcattttaaatatgtgt

SEQ ID NO: 137150 - DNA, 22 bp, Homo sapiens
atgcatgtatatatttgtgtgt

SEQ ID NO: 137151 - DNA, 23 bp, Homo sapiens
tgtcatcttctgacactctctgt

SEQ ID NO: 137152 - DNA, 23 bp, Homo sapiens
tgagttcattgtagattctggat

SEQ ID NO: 137153 - DNA, 23 bp, Homo sapiens
ataaatgttctttatcatgttga

SEQ ID NO: 137154 - DNA, 19 bp, Homo sapiens
atctgtgacagcttcttga

SEQ ID NO: 137155 - DNA, 20 bp, Homo sapiens
ttagtggaaatactgataca

SEQ ID NO: 137156 - DNA, 23 bp, Homo sapiens
tgagttcattgtagattctggat

SEQ ID NO: 137157 - DNA, 23 bp, Homo sapiens
tgagttcattgtagattctggat

SEQ ID NO: 137158 - DNA, 23 bp, Homo sapiens
tacacagagcaaagacaacagaa

SEQ ID NO: 137159 - DNA, 23 bp, Homo sapiens
ctgagactgtcccacaattcact

SEQ ID NO: 137160 - DNA, 23 bp, Homo sapiens
ggtagttttcactgctgtgttgt

SEQ ID NO: 137161 - DNA, 23 bp, Homo sapiens
acagagtctcactctgtcgccca

SEQ ID NO: 137162 - DNA, 23 bp, Homo sapiens
ttgagacagggtctcactctgtt

SEQ ID NO: 137163 - DNA, 21 bp, Homo sapiens
aagtttctaggtgatgctcat

SEQ ID NO: 137164 - DNA, 23 bp, Homo sapiens
ataaagttagtgaagacatggtg

SEQ ID NO: 137165 - DNA, 22 bp, Homo sapiens
tatatgctttaacttttgtcac

SEQ ID NO: 137166 - DNA, 23 bp, Homo sapiens
atatgtatgcatttctattgagt

SEQ ID NO: 137167 - DNA, 18 bp, Homo sapiens
gaaggagcaactccattt

SEQ ID NO: 137168 - DNA, 23 bp, Homo sapiens
agacgtgtcacactgtgtgtgtg

SEQ ID NO: 137169 - DNA, 23 bp, Homo sapiens
accatctggaacaaccagtgtat

SEQ ID NO: 137170 - DNA, 22 bp, Homo sapiens
agacagggtctcactctgcctc

SEQ ID NO: 137171 - DNA, 21 bp, Homo sapiens
cccaagtagctgggactacag

SEQ ID NO: 137172 - DNA, 23 bp, Homo sapiens
ggcagacacccttacaaatggag

SEQ ID NO: 137173 - DNA, 21 bp, Homo sapiens
tgtgacagagtctccctctgt

SEQ ID NO: 137174 - DNA, 18 bp, Homo sapiens
gagatatgtttggcagca

SEQ ID NO: 137175 - DNA, 23 bp, Homo sapiens
atggattctctctctgtcaccca

SEQ ID NO: 137176 - DNA, 23 bp, Homo sapiens
aatggtacttcagtatggtttta

SEQ ID NO: 137177 - DNA, 18 bp, Homo sapiens
aggctatttgtggggatt

SEQ ID NO: 137178 - DNA, 23 bp, Homo sapiens
aacattcattgctgtgcatggct

SEQ ID NO: 137179 - DNA, 23 bp, Homo sapiens
gggtctcactctgtcacccaggc

SEQ ID NO: 137180 - DNA, 20 bp, Homo sapiens
tggctgaggcataggaggta

SEQ ID NO: 137181 - DNA, 23 bp, Homo sapiens
gagtctctctcactctgtcaccc

SEQ ID NO: 137182 - DNA, 23 bp, Homo sapiens
ccagagtctcactctgtcgccca

SEQ ID NO: 137183 - DNA, 21 bp, Homo sapiens
tttggtatatgtgctcattgg

SEQ ID NO: 137184 - DNA, 23 bp, Homo sapiens
agcaagaccctgtctctctctct

SEQ ID NO: 137185 - DNA, 22 bp, Homo sapiens
agggctggctctgtgattggct

SEQ ID NO: 137186 - DNA, 23 bp, Homo sapiens
ctgagtctcactctgtcgctcag

SEQ ID NO: 137187 - DNA, 22 bp, Homo sapiens
aagaatggaaagttgtgtgtgt

SEQ ID NO: 137188 - DNA, 23 bp, Homo sapiens
agatggagtctcgctctgtcacc

SEQ ID NO: 137189 - DNA, 23 bp, Homo sapiens
tgtgtgcatgcatgtttgcctgt

SEQ ID NO: 137190 - DNA, 22 bp, Homo sapiens
tagctcctggagtagcagcagg

SEQ ID NO: 137191 - DNA, 19 bp, Homo sapiens
ttgtagagggctttggagt

SEQ ID NO: 137192 - DNA, 18 bp, Homo sapiens
aggaactgagaattactt

SEQ ID NO: 137193 - DNA, 23 bp, Homo sapiens
aagtctactgaggatcatgtcat

SEQ ID NO: 137194 - DNA, 23 bp, Homo sapiens
tgagtgatgagagtgtggaatct

SEQ ID NO: 137195 - DNA, 23 bp, Homo sapiens
tataatctaatgtacctgaaaat

SEQ ID NO: 137196 - DNA, 23 bp, Homo sapiens
tggagtctcactctgtcacccag

SEQ ID NO: 137197 - DNA, 23 bp, Homo sapiens
tttggttaactgcttgtatatgt

SEQ ID NO: 137198 - DNA, 21 bp, Homo sapiens
aattagctacaattagttgtg

SEQ ID NO: 137199 - DNA, 18 bp, Homo sapiens
tctgggtggtagcctggg

SEQ ID NO: 137200 - DNA, 23 bp, Homo sapiens
ggagtctctctctgtcacccagg

SEQ ID NO: 137201 - DNA, 18 bp, Homo sapiens
aatcatgtttgctgtttg

SEQ ID NO: 137202 - DNA, 23 bp, Homo sapiens
ggagtctcactctgtcacccagg

SEQ ID NO: 137203 - DNA, 23 bp, Homo sapiens
agagaagacagtgactaaatggg

SEQ ID NO: 137204 - DNA, 23 bp, Homo sapiens
tatacatgcagaaaatggcttga

SEQ ID NO: 137205 - DNA, 18 bp, Homo sapiens
agtccagatcttctgtga

SEQ ID NO: 137206 - DNA, 22 bp, Homo sapiens
acccagaagttgcaggtgcgag

SEQ ID NO: 137207 - DNA, 23 bp, Homo sapiens
tggagtctcactctgtcacccag

SEQ ID NO: 137208 - DNA, 21 bp, Homo sapiens
atatgtgtgtgtatatatgtg

SEQ ID NO: 137209 - DNA, 20 bp, Homo sapiens
aatgctgatgatgatggttc

SEQ ID NO: 137210 - DNA, 23 bp, Homo sapiens
tttctctgtagttttgatctgta

SEQ ID NO: 137211 - DNA, 18 bp, Homo sapiens
tgtgtgcatgtgtgtatg

SEQ ID NO: 137212 - DNA, 23 bp, Homo sapiens
tagatacgtatatatagttatgt

SEQ ID NO: 137213 - DNA, 23 bp, Homo sapiens
gcctaagttttggtgttggactt

SEQ ID NO: 137214 - DNA, 23 bp, Homo sapiens
tttgagaccgagtcttactctgt

SEQ ID NO: 137215 - DNA, 23 bp, Homo sapiens
cacaatcactcactgcttcccgt

SEQ ID NO: 137216 - DNA, 20 bp, Homo sapiens
gtacagtggcacaatctcgg

SEQ ID NO: 137217 - DNA, 21 bp, Homo sapiens
tccatggtgtgtgtttgtgta

SEQ ID NO: 137218 - DNA, 23 bp, Homo sapiens
gggagtgtaaattagttcaacca

SEQ ID NO: 137219 - DNA, 23 bp, Homo sapiens
ttgagaactgtttatgatgaaaa

SEQ ID NO: 137220 - DNA, 23 bp, Homo sapiens
tatattttagtgcatgcttcaat

SEQ ID NO: 137221 - DNA, 23 bp, Homo sapiens
tgattggaattgcactgattgta

SEQ ID NO: 137222 - DNA, 23 bp, Homo sapiens
tgagacagtcttgctctgtcacc

SEQ ID NO: 137223 - DNA, 22 bp, Homo sapiens
actgagagctgagtttcacagt

SEQ ID NO: 137224 - DNA, 23 bp, Homo sapiens
tgtcagtgtagagtctgcataac

SEQ ID NO: 137225 - DNA, 19 bp, Homo sapiens
acacatatatcttttgtgt

SEQ ID NO: 137226 - DNA, 22 bp, Homo sapiens
acagagtcttgctctgtcacca

SEQ ID NO: 137227 - DNA, 19 bp, Homo sapiens
ttagctttaaatacaaact

SEQ ID NO: 137228 - DNA, 23 bp, Homo sapiens
ttctgtgaagaaagtcagtggta

SEQ ID NO: 137229 - DNA, 22 bp, Homo sapiens
ttagtcattaaccttctgtctt

SEQ ID NO: 137230 - DNA, 23 bp, Homo sapiens
actctcggtctctctctcctgcc

SEQ ID NO: 137231 - DNA, 23 bp, Homo sapiens
agtgtcactgtctcagaccccat

SEQ ID NO: 137232 - DNA, 23 bp, Homo sapiens
tgagttcattgtagattctggat

SEQ ID NO: 137233 - DNA, 23 bp, Homo sapiens
tgagttcattgtagattctggat

SEQ ID NO: 137234 - DNA, 23 bp, Homo sapiens
tagatttgagagccaggtttgaa

SEQ ID NO: 137235 - DNA, 21 bp, Homo sapiens
aacacatttttcttaagtgtc

SEQ ID NO: 137236 - DNA, 23 bp, Homo sapiens
agtcactgactcagaattttgtg

SEQ ID NO: 137237 - DNA, 23 bp, Homo sapiens
gactgactgtctgtcactgagcc

SEQ ID NO: 137238 - DNA, 19 bp, Homo sapiens
agacagaactgacagtcct

SEQ ID NO: 137239 - DNA, 23 bp, Homo sapiens
tagcagagctaggttttgaactc

SEQ ID NO: 137240 - DNA, 22 bp, Homo sapiens
ttcattgagttatacttgacaa

SEQ ID NO: 137241 - DNA, 21 bp, Homo sapiens
tgtaatgttttgatgtttgta

SEQ ID NO: 137242 - DNA, 21 bp, Homo sapiens
tgtacacctattttatgtatg

SEQ ID NO: 137243 - DNA, 23 bp, Homo sapiens
tttacatagatatagatatgtat

SEQ ID NO: 137244 - DNA, 23 bp, Homo sapiens
tcaagagtgtagacagtgggcag

SEQ ID NO: 137245 - DNA, 18 bp, Homo sapiens
ttgctggttttccagagt

SEQ ID NO: 137246 - DNA, 21 bp, Homo sapiens
agcatcttttttattttgtaa

SEQ ID NO: 137247 - DNA, 23 bp, Homo sapiens
actgcttacattttctgccagtt

SEQ ID NO: 137248 - DNA, 22 bp, Homo sapiens
ttcagaatagaattagagctaa

SEQ ID NO: 137249 - DNA, 21 bp, Homo sapiens
taggttatcatactggagtta

SEQ ID NO: 137250 - DNA, 23 bp, Homo sapiens
actgagtctcgctctgtctccca

SEQ ID NO: 137251 - DNA, 18 bp, Homo sapiens
gagtctcactcggtcacc

SEQ ID NO: 137252 - DNA, 19 bp, Homo sapiens
tgtgtgtgtatgtatgtgt

SEQ ID NO: 137253 - DNA, 23 bp, Homo sapiens
tgtatgtggatttcttttctttt

SEQ ID NO: 137254 - DNA, 23 bp, Homo sapiens
tcgctctctgtctctctctgttg

SEQ ID NO: 137255 - DNA, 21 bp, Homo sapiens
tgagtctcactctgtcgccca

SEQ ID NO: 137256 - DNA, 23 bp, Homo sapiens
aatttcacaccatttcattttat

SEQ ID NO: 137257 - DNA, 23 bp, Homo sapiens
tattgtgtgtttaacatgttgtt

SEQ ID NO: 137258 - DNA, 21 bp, Homo sapiens
ttctgactgtactgattaagt

SEQ ID NO: 137259 - DNA, 18 bp, Homo sapiens
tgtgattttggatgcaat

SEQ ID NO: 137260 - DNA, 23 bp, Homo sapiens
tggagtctcactctgtcacccag

SEQ ID NO: 137261 - DNA, 21 bp, Homo sapiens
tttactgagtgaatgattagg

SEQ ID NO: 137262 - DNA, 23 bp, Homo sapiens
gactgagtctcgctctgtcaccc

SEQ ID NO: 137263 - DNA, 23 bp, Homo sapiens
attgtcttagttaagctagtgtg

SEQ ID NO: 137264 - DNA, 19 bp, Homo sapiens
ttttaagttgcagtgttgc

SEQ ID NO: 137265 - DNA, 23 bp, Homo sapiens
tcataggcttctccagctctaac

SEQ ID NO: 137266 - DNA, 22 bp, Homo sapiens
ttgctgggagaatgctgggagt

SEQ ID NO: 137267 - DNA, 19 bp, Homo sapiens
atgtctcatgcttaacagc

SEQ ID NO: 137268 - DNA, 22 bp, Homo sapiens
tatagtgtatacatatgtgtgt

SEQ ID NO: 137269 - DNA, 23 bp, Homo sapiens
tatatatgctatacatatgctat

SEQ ID NO: 137270 - DNA, 22 bp, Homo sapiens
ttgatgcactgattttgatgta

SEQ ID NO: 137271 - DNA, 22 bp, Homo sapiens
aaaaaagttgtacaattggcaa

SEQ ID NO: 137272 - DNA, 23 bp, Homo sapiens
atttctgtgctcatgtttctgtt

SEQ ID NO: 137273 - DNA, 20 bp, Homo sapiens
atgtgtgtgtgtgtgtatat

SEQ ID NO: 137274 - DNA, 18 bp, Homo sapiens
tccattatttaaaggagt

SEQ ID NO: 137275 - DNA, 23 bp, Homo sapiens
agtttcttgtagattctggattg

SEQ ID NO: 137276 - DNA, 23 bp, Homo sapiens
tttgcccttgcataatttctcta

SEQ ID NO: 137277 - DNA, 18 bp, Homo sapiens
tgtgtgtgtgtgtattca

SEQ ID NO: 137278 - DNA, 20 bp, Homo sapiens
aataactgtataatagttgt

SEQ ID NO: 137279 - DNA, 20 bp, Homo sapiens
tgtgtatgtatttatgagac

SEQ ID NO: 137280 - DNA, 23 bp, Homo sapiens
tgagttcattgtagattctggat

SEQ ID NO: 137281 - DNA, 23 bp, Homo sapiens
tgagttcattgtagattctggat

SEQ ID NO: 137282 - DNA, 22 bp, Homo sapiens
gtttggtttactattgctttat

SEQ ID NO: 137283 - DNA, 23 bp, Homo sapiens
tgagttcattgtagattctggat

SEQ ID NO: 137284 - DNA, 23 bp, Homo sapiens
tgagttcattgtagattctggat

SEQ ID NO: 137285 - DNA, 23 bp, Homo sapiens
attcattcagcatttatttactt

SEQ ID NO: 137286 - DNA, 23 bp, Homo sapiens
acaaaactggtaatggaatagat

SEQ ID NO: 137287 - DNA, 23 bp, Homo sapiens
ttttctctagaagattgtggttt

SEQ ID NO: 137288 - DNA, 23 bp, Homo sapiens
tcttttttggttccatatgaatt

SEQ ID NO: 137289 - DNA, 23 bp, Homo sapiens
tgagttcattgtagattctggat

SEQ ID NO: 137290 - DNA, 23 bp, Homo sapiens
tgagttcattgtagattctggat

SEQ ID NO: 137291 - DNA, 23 bp, Homo sapiens
aatacatgtaaatatgggtttgt

SEQ ID NO: 137292 - DNA, 23 bp, Homo sapiens
tgaatggtagttctaagttcttt

SEQ ID NO: 137293 - DNA, 23 bp, Homo sapiens
ttttcacagtggctgaactaatt

SEQ ID NO: 137294 - DNA, 22 bp, Homo sapiens
ctttgtaaactagaatgctcta

SEQ ID NO: 137295 - DNA, 23 bp, Homo sapiens
aatcatctgactttgtagttgag

SEQ ID NO: 137296 - DNA, 23 bp, Homo sapiens
taattcacagtgcaaaacacctg

SEQ ID NO: 137297 - DNA, 23 bp, Homo sapiens
aaattgagactcaaaaagattgt

SEQ ID NO: 137298 - DNA, 19 bp, Homo sapiens
aacatggtggcatagctat

SEQ ID NO: 137299 - DNA, 20 bp, Homo sapiens
attaacctacagaaagtaat

SEQ ID NO: 137300 - DNA, 23 bp, Homo sapiens
agagtcaatgtcttgctctgtca

SEQ ID NO: 137301 - DNA, 20 bp, Homo sapiens
agtctcgctctgtcgctcag

SEQ ID NO: 137302 - DNA, 23 bp, Homo sapiens
aaatatgtatacatgcatacact

SEQ ID NO: 137303 - DNA, 23 bp, Homo sapiens
aatgaattctagagatctgctat

SEQ ID NO: 137304 - DNA, 23 bp, Homo sapiens
atatgtgtatatatatatgtgtg

SEQ ID NO: 137305 - DNA, 20 bp, Homo sapiens
gactttactgtgacagtagt

SEQ ID NO: 137306 - DNA, 23 bp, Homo sapiens
tttaaggttatttagggagctgt

SEQ ID NO: 137307 - DNA, 23 bp, Homo sapiens
tttaggatgtttacattagtatt

SEQ ID NO: 137308 - DNA, 19 bp, Homo sapiens
tatgtgtgtgtgtgtacat

SEQ ID NO: 137309 - DNA, 18 bp, Homo sapiens
gccactcacagacaccaa

SEQ ID NO: 137310 - DNA, 19 bp, Homo sapiens
ttcttttacatagcaatat

SEQ ID NO: 137311 - DNA, 23 bp, Homo sapiens
actccagaatatatatatgtgtg

SEQ ID NO: 137312 - DNA, 18 bp, Homo sapiens
tatgtgtctgtatgtgta

SEQ ID NO: 137313 - DNA, 23 bp, Homo sapiens
actgatatagtttttagcaaatt

SEQ ID NO: 137314 - DNA, 18 bp, Homo sapiens
aggtggtgggactatcaa

SEQ ID NO: 137315 - DNA, 23 bp, Homo sapiens
tttgtacaagaatatgcatagct

SEQ ID NO: 137316 - DNA, 21 bp, Homo sapiens
tgacattcttatactttaggt

SEQ ID NO: 137317 - DNA, 23 bp, Homo sapiens
actctcagtctttcaaaagtgat

SEQ ID NO: 137318 - DNA, 23 bp, Homo sapiens
gagtctctctctgtcaccctggc

SEQ ID NO: 137319 - DNA, 20 bp, Homo sapiens
aagtatggtttgggtggctt

SEQ ID NO: 137320 - DNA, 23 bp, Homo sapiens
ttgcaggtatgctaatcaaaaca

SEQ ID NO: 137321 - DNA, 23 bp, Homo sapiens
tataattttgtgtgctgcattgt

SEQ ID NO: 137322 - DNA, 19 bp, Homo sapiens
ggtgctagcttgtatagta

SEQ ID NO: 137323 - DNA, 21 bp, Homo sapiens
ttgagaaaagattgtgagcag

SEQ ID NO: 137324 - DNA, 23 bp, Homo sapiens
tgagttcattgtagattctggat

SEQ ID NO: 137325 - DNA, 23 bp, Homo sapiens
tgagttcattgtagattctggat

SEQ ID NO: 137326 - DNA, 21 bp, Homo sapiens
aaatagaatttgaaaagacat

SEQ ID NO: 137327 - DNA, 23 bp, Homo sapiens
aatgcgcagaggtagatatgttt

SEQ ID NO: 137328 - DNA, 23 bp, Homo sapiens
ttgtcttatgtttgggagcacta

SEQ ID NO: 137329 - DNA, 21 bp, Homo sapiens
agagttgattgaatttctgat

SEQ ID NO: 137330 - DNA, 18 bp, Homo sapiens
tgtgtatatgtatgttta

SEQ ID NO: 137331 - DNA, 22 bp, Homo sapiens
tatgtatatatgtatatgtgtg

SEQ ID NO: 137332 - DNA, 23 bp, Homo sapiens
atgtatatatgtatatgtgtgtg

SEQ ID NO: 137333 - DNA, 19 bp, Homo sapiens
tgtgtatatatattcatat

SEQ ID NO: 137334 - DNA, 18 bp, Homo sapiens
tccaattctgtagactgt

SEQ ID NO: 137335 - DNA, 21 bp, Homo sapiens
tatgtttttttgctaatgaca

SEQ ID NO: 137336 - DNA, 23 bp, Homo sapiens
ttttagacaatggaaatgatgtt

SEQ ID NO: 137337 - DNA, 23 bp, Homo sapiens
acaatgtattgcttggtgaaaaa

SEQ ID NO: 137338 - DNA, 22 bp, Homo sapiens
gtgtacatatatgtttgtatat

SEQ ID NO: 137339 - DNA, 23 bp, Homo sapiens
atatatgagcatgttatgcatag

SEQ ID NO: 137340 - DNA, 23 bp, Homo sapiens
tgtgtatatatatatgtgtgtgt

SEQ ID NO: 137341 - DNA, 23 bp, Homo sapiens
tgtctcactgtgtcactcaggct

SEQ ID NO: 137342 - DNA, 22 bp, Homo sapiens
atacgtgtgtgtgtgtatgctt

SEQ ID NO: 137343 - DNA, 23 bp, Homo sapiens
tctcagaacacagagaggtgaga

SEQ ID NO: 137344 - DNA, 23 bp, Homo sapiens
tgagttcattgtagattctggat

SEQ ID NO: 137345 - DNA, 23 bp, Homo sapiens
tgagttcattgtagattctggat

SEQ ID NO: 137346 - DNA, 23 bp, Homo sapiens
tattatttgatgaagtacatgat

SEQ ID NO: 137347 - DNA, 21 bp, Homo sapiens
cagctacaataatttattgtt

SEQ ID NO: 137348 - DNA, 19 bp, Homo sapiens
acaatgataatttattgtg

SEQ ID NO: 137349 - DNA, 22 bp, Homo sapiens
agctatatatatgtgtatgtat

SEQ ID NO: 137350 - DNA, 23 bp, Homo sapiens
tatatatatgaaattgttttgct

SEQ ID NO: 137351 - DNA, 23 bp, Homo sapiens
tcactctctctatctttactgat

SEQ ID NO: 137352 - DNA, 23 bp, Homo sapiens
agtgggatgatgaaacaggagag

SEQ ID NO: 137353 - DNA, 22 bp, Homo sapiens
tgtgtctcgctctgtcacccag

SEQ ID NO: 137354 - DNA, 23 bp, Homo sapiens
tctctctgtctgggtgtcaagag

SEQ ID NO: 137355 - DNA, 18 bp, Homo sapiens
tgtgtgtgtgtttgttta

SEQ ID NO: 137356 - DNA, 23 bp, Homo sapiens
tattgtgtcctaatcttctgtgt

SEQ ID NO: 137357 - DNA, 20 bp, Homo sapiens
tgtgcataattatggatgta

SEQ ID NO: 137358 - DNA, 23 bp, Homo sapiens
ataaaggttgtttagttttggga

SEQ ID NO: 137359 - DNA, 23 bp, Homo sapiens
atagaccttggacttctcgaaat

SEQ ID NO: 137360 - DNA, 23 bp, Homo sapiens
ttttgagacggtgtctcactctg

SEQ ID NO: 137361 - DNA, 18 bp, Homo sapiens
gaacagatgcatttctgg

SEQ ID NO: 137362 - DNA, 23 bp, Homo sapiens
tgtaatcagtgagatattcttaa

SEQ ID NO: 137363 - DNA, 23 bp, Homo sapiens
tgtccatgtctcgctctgtcgcc

SEQ ID NO: 137364 - DNA, 20 bp, Homo sapiens
tgacagtgggacttattttc

SEQ ID NO: 137365 - DNA, 20 bp, Homo sapiens
tgtgtgtgtgtgtctgtgcg

SEQ ID NO: 137366 - DNA, 23 bp, Homo sapiens
tgagttcattgtagattctggat

SEQ ID NO: 137367 - DNA, 23 bp, Homo sapiens
tgagttcattgtagattctggat

SEQ ID NO: 137368 - DNA, 18 bp, Homo sapiens
taaaaaaaaatctggggc

SEQ ID NO: 137369 - DNA, 22 bp, Homo sapiens
ttcactcatgatttggctctgt

SEQ ID NO: 137370 - DNA, 23 bp, Homo sapiens
agacagagtcttgctctgtcacc

SEQ ID NO: 137371 - DNA, 23 bp, Homo sapiens
agagtctcactctgtcacccagg

SEQ ID NO: 137372 - DNA, 23 bp, Homo sapiens
gagtctcactctgtcacccaggc

SEQ ID NO: 137373 - DNA, 22 bp, Homo sapiens
tatctctcaagtctgtctggag

SEQ ID NO: 137374 - DNA, 23 bp, Homo sapiens
taaaagctgtaatacaaaaggca

SEQ ID NO: 137375 - DNA, 21 bp, Homo sapiens
tatacgtatatatacatatgt

SEQ ID NO: 137376 - DNA, 23 bp, Homo sapiens
aggatggctcagaataagcttct

SEQ ID NO: 137377 - DNA, 21 bp, Homo sapiens
tatagtatagtatagtatgta

SEQ ID NO: 137378 - DNA, 20 bp, Homo sapiens
tatactatataactatatgt

SEQ ID NO: 137379 - DNA, 23 bp, Homo sapiens
acctatatatctgctgtctatat

SEQ ID NO: 137380 - DNA, 23 bp, Homo sapiens
tgtatgcgtgtgtgtgtgtatat

SEQ ID NO: 137381 - DNA, 18 bp, Homo sapiens
ggtcacagaattttgtca

SEQ ID NO: 137382 - DNA, 19 bp, Homo sapiens
tgacaaaggaatgcattta

SEQ ID NO: 137383 - DNA, 23 bp, Homo sapiens
ttatttttcctaaacttttgaaa

SEQ ID NO: 137384 - DNA, 23 bp, Homo sapiens
agattgtttttcatggtgatatg

SEQ ID NO: 137385 - DNA, 18 bp, Homo sapiens
tagcaattctgaaactat

SEQ ID NO: 137386 - DNA, 23 bp, Homo sapiens
atgtgtgtgtatatgtatatgtg

SEQ ID NO: 137387 - DNA, 20 bp, Homo sapiens
tgagacagagtctcgctctg

SEQ ID NO: 137388 - DNA, 21 bp, Homo sapiens
tatgcaaatatatgtattagt

SEQ ID NO: 137389 - DNA, 23 bp, Homo sapiens
gggtctcactctgtcacccaggc

SEQ ID NO: 137390 - DNA, 23 bp, Homo sapiens
tgtgatcttggttcactgcaacc

SEQ ID NO: 137391 - DNA, 21 bp, Homo sapiens
tgacacatttttaaaaggtgt

SEQ ID NO: 137392 - DNA, 23 bp, Homo sapiens
tttttacattgattttgtactcc

SEQ ID NO: 137393 - DNA, 23 bp, Homo sapiens
atttcatgttagacagggtctct

SEQ ID NO: 137394 - DNA, 23 bp, Homo sapiens
tgttctttttgcttaggattgtc

SEQ ID NO: 137395 - DNA, 23 bp, Homo sapiens
ttctgtgaagaaagtcagtggta

SEQ ID NO: 137396 - DNA, 22 bp, Homo sapiens
aatttctgtctaatagaacaga

SEQ ID NO: 137397 - DNA, 23 bp, Homo sapiens
tctctcaatttctgactgtccta

SEQ ID NO: 137398 - DNA, 21 bp, Homo sapiens
ttagtccacattttgatggga

SEQ ID NO: 137399 - DNA, 23 bp, Homo sapiens
agagtctcactctgtcacccagg

SEQ ID NO: 137400 - DNA, 22 bp, Homo sapiens
acacttatatacacacacgtat

SEQ ID NO: 137401 - DNA, 23 bp, Homo sapiens
tgagtcgatgaaatatcagtggc

SEQ ID NO: 137402 - DNA, 23 bp, Homo sapiens
tggagtctcactctgtcacccag

SEQ ID NO: 137403 - DNA, 21 bp, Homo sapiens
agaggataaaaattctaattg

SEQ ID NO: 137404 - DNA, 23 bp, Homo sapiens
tctgtctatgactgtctagttgt

SEQ ID NO: 137405 - DNA, 22 bp, Homo sapiens
ttctatatatgtattctgtata

SEQ ID NO: 137406 - DNA, 22 bp, Homo sapiens
tttggcaattcttgcaatgttt

SEQ ID NO: 137407 - DNA, 21 bp, Homo sapiens
ttgtgatctgtgatcggtgaa

SEQ ID NO: 137408 - DNA, 20 bp, Homo sapiens
tatgtgtgtgtgtgtttata

SEQ ID NO: 137409 - DNA, 22 bp, Homo sapiens
atcagagaggaaagtgaggtca

SEQ ID NO: 137410 - DNA, 19 bp, Homo sapiens
atacttcctccatctttga

SEQ ID NO: 137411 - DNA, 21 bp, Homo sapiens
aagaatctttagaagttagac

SEQ ID NO: 137412 - DNA, 23 bp, Homo sapiens
tctcttgtactacagaaagctct

SEQ ID NO: 137413 - DNA, 23 bp, Homo sapiens
gatcactgtcagctttgaagttc

SEQ ID NO: 137414 - DNA, 23 bp, Homo sapiens
cacacccacacacactgcattcc

SEQ ID NO: 137415 - DNA, 20 bp, Homo sapiens
tgcgatgagggaagtgtgtg

SEQ ID NO: 137416 - DNA, 22 bp, Homo sapiens
tctctgaagacagagagggctc

SEQ ID NO: 137417 - DNA, 22 bp, Homo sapiens
agtaaatgtgcaaactgtacct

SEQ ID NO: 137418 - DNA, 23 bp, Homo sapiens
tacatgtgcacaatgtgcaggtt

SEQ ID NO: 137419 - DNA, 23 bp, Homo sapiens
gcctctctctgtatctcaaagtc

SEQ ID NO: 137420 - DNA, 23 bp, Homo sapiens
ttttgaggtttgtgtaagctgaa

SEQ ID NO: 137421 - DNA, 19 bp, Homo sapiens
tatcactttggaatattca

SEQ ID NO: 137422 - DNA, 19 bp, Homo sapiens
agttctagctactgggagg

SEQ ID NO: 137423 - DNA, 23 bp, Homo sapiens
tctcagaggttttgttcactctg

SEQ ID NO: 137424 - DNA, 23 bp, Homo sapiens
tctcatggttttgatttgcgttt

SEQ ID NO: 137425 - DNA, 23 bp, Homo sapiens
tttttttctattagaataaagct

SEQ ID NO: 137426 - DNA, 23 bp, Homo sapiens
cctatgcctgtaatcccagcact

SEQ ID NO: 137427 - DNA, 23 bp, Homo sapiens
tggagtctcactctgtcacccag

SEQ ID NO: 137428 - DNA, 22 bp, Homo sapiens
tgcgttgaagctgtgatggata

SEQ ID NO: 137429 - DNA, 19 bp, Homo sapiens
agaggaaaaagaatggaaa

SEQ ID NO: 137430 - DNA, 23 bp, Homo sapiens
ttactgtatttctatctggtaat

SEQ ID NO: 137431 - DNA, 23 bp, Homo sapiens
tttttttgtttttcagatagggt

SEQ ID NO: 137432 - DNA, 23 bp, Homo sapiens
ggcctctctgtgtctgtcaccac

SEQ ID NO: 137433 - DNA, 23 bp, Homo sapiens
agggtctcactctgtcacccagg

SEQ ID NO: 137434 - DNA, 19 bp, Homo sapiens
acatggagtctcactctgt

SEQ ID NO: 137435 - DNA, 23 bp, Homo sapiens
gagtctcactctgtcacccaggc

SEQ ID NO: 137436 - DNA, 21 bp, Homo sapiens
taatgaccttatttttgccct

SEQ ID NO: 137437 - DNA, 21 bp, Homo sapiens
cttctccttgtgctcatgtga

SEQ ID NO: 137438 - DNA, 21 bp, Homo sapiens
acatgtgcacaatgtgcaggt

SEQ ID NO: 137439 - DNA, 19 bp, Homo sapiens
atgtgccttgagagatgga

SEQ ID NO: 137440 - DNA, 23 bp, Homo sapiens
tccactgacagcttgcactgtgt

SEQ ID NO: 137441 - DNA, 23 bp, Homo sapiens
tggagtctcactctgtcacccag

SEQ ID NO: 137442 - DNA, 23 bp, Homo sapiens
gaatgactggttttggtagagct

SEQ ID NO: 137443 - DNA, 23 bp, Homo sapiens
tctttcccagtctctctgttata

SEQ ID NO: 137444 - DNA, 23 bp, Homo sapiens
tgagttcattgtagattctggat

SEQ ID NO: 137445 - DNA, 23 bp, Homo sapiens
tgagttcattgtagattctggat

SEQ ID NO: 137446 - DNA, 23 bp, Homo sapiens
ttaatagagtgaaaacagagctc

SEQ ID NO: 137447 - DNA, 23 bp, Homo sapiens
gggtctcgctatgtactcaggct

SEQ ID NO: 137448 - DNA, 23 bp, Homo sapiens
tttgagacagtcttgcttgtcac

SEQ ID NO: 137449 - DNA, 19 bp, Homo sapiens
tatggtgtatatatgcatg

SEQ ID NO: 137450 - DNA, 23 bp, Homo sapiens
cagggtctcactctgtcacccag

SEQ ID NO: 137451 - DNA, 22 bp, Homo sapiens
acagtggtgagatcatagctca

SEQ ID NO: 137452 - DNA, 23 bp, Homo sapiens
tgagaggtgacagtgtgctggca

SEQ ID NO: 137453 - DNA, 23 bp, Homo sapiens
cacagccagctttcttgtggatg

SEQ ID NO: 137454 - DNA, 23 bp, Homo sapiens
atcttcttcgtgtctttgtgaga

SEQ ID NO: 137455 - DNA, 23 bp, Homo sapiens
gggtctcactctgtcacccaggc

SEQ ID NO: 137456 - DNA, 18 bp, Homo sapiens
cagtggtaagatcacagc

SEQ ID NO: 137457 - DNA, 23 bp, Homo sapiens
agggaaatctagtgttttagttg

SEQ ID NO: 137458 - DNA, 23 bp, Homo sapiens
actgcttctgactcagcctgttt

SEQ ID NO: 137459 - DNA, 23 bp, Homo sapiens
aacaagtgagtctggctatgttc

SEQ ID NO: 137460 - DNA, 23 bp, Homo sapiens
atgtatttgtttatgtaactgaa

SEQ ID NO: 137461 - DNA, 23 bp, Homo sapiens
gttggagacagagtttctctctc

SEQ ID NO: 137462 - DNA, 23 bp, Homo sapiens
aatactcaatttgtaattttcac

SEQ ID NO: 137463 - DNA, 23 bp, Homo sapiens
aagttgcagaataattgaatatg

SEQ ID NO: 137464 - DNA, 20 bp, Homo sapiens
acacacacacatatatatat

SEQ ID NO: 137465 - DNA, 21 bp, Homo sapiens
atggcaggagatggtgagctg

SEQ ID NO: 137466 - DNA, 21 bp, Homo sapiens
agtctgcaagtaaaggttctg

SEQ ID NO: 137467 - DNA, 23 bp, Homo sapiens
aaagcttcctagaggaggggaaa

SEQ ID NO: 137468 - DNA, 23 bp, Homo sapiens
cggagtctcactctgttgccagg

SEQ ID NO: 137469 - DNA, 23 bp, Homo sapiens
cacaatgtgctactatgtgttat

SEQ ID NO: 137470 - DNA, 18 bp, Homo sapiens
atcactatatatatgtgt

SEQ ID NO: 137471 - DNA, 21 bp, Homo sapiens
tacatatattatgtgtatgtg

SEQ ID NO: 137472 - DNA, 18 bp, Homo sapiens
tcactgcaacctctgact

SEQ ID NO: 137473 - DNA, 23 bp, Homo sapiens
acatatgtgtgtgtatgtacttc

SEQ ID NO: 137474 - DNA, 20 bp, Homo sapiens
tatatgtatacattgaaaga

SEQ ID NO: 137475 - DNA, 23 bp, Homo sapiens
acggagtctcactgtctcaccca

SEQ ID NO: 137476 - DNA, 19 bp, Homo sapiens
tgactcaatatatatatgc

SEQ ID NO: 137477 - DNA, 18 bp, Homo sapiens
taggcattaaattgagta

SEQ ID NO: 137478 - DNA, 18 bp, Homo sapiens
cagtatgctataaatcca

SEQ ID NO: 137479 - DNA, 23 bp, Homo sapiens
ctgagaaatctgctgctaatctg

SEQ ID NO: 137480 - DNA, 23 bp, Homo sapiens
tattaggactggtagaattcagc

SEQ ID NO: 137481 - DNA, 20 bp, Homo sapiens
atttctgattgaatcttgtt

SEQ ID NO: 137482 - DNA, 18 bp, Homo sapiens
tatactttaagttttagg

SEQ ID NO: 137483 - DNA, 23 bp, Homo sapiens
tgagttcattgtagattctggat

SEQ ID NO: 137484 - DNA, 23 bp, Homo sapiens
tgagttcattgtagattctggat

SEQ ID NO: 137485 - DNA, 23 bp, Homo sapiens
cggagtctcactgtgtcacccag

SEQ ID NO: 137486 - DNA, 20 bp, Homo sapiens
ttatttcaatggaaatgtat

SEQ ID NO: 137487 - DNA, 23 bp, Homo sapiens
tattgtacaggtacttgaatgag

SEQ ID NO: 137488 - DNA, 23 bp, Homo sapiens
tatatatgtatgtgtatacatct

SEQ ID NO: 137489 - DNA, 20 bp, Homo sapiens
tatattattcatctagttct

SEQ ID NO: 137490 - DNA, 23 bp, Homo sapiens
tgagttcattgtagattctggat

SEQ ID NO: 137491 - DNA, 23 bp, Homo sapiens
tgagttcattgtagattctggat

SEQ ID NO: 137492 - DNA, 23 bp, Homo sapiens
agagacttcagaggtgtcggtac

SEQ ID NO: 137493 - DNA, 20 bp, Homo sapiens
cgcccacccactatgcctgt

SEQ ID NO: 137494 - DNA, 23 bp, Homo sapiens
gagatgttctcactctgtcaccc

SEQ ID NO: 137495 - DNA, 23 bp, Homo sapiens
tatgtatataatggtacacacac

SEQ ID NO: 137496 - DNA, 19 bp, Homo sapiens
tcagtactctttctgctct

SEQ ID NO: 137497 - DNA, 21 bp, Homo sapiens
tggcacagtggttatgggctt

SEQ ID NO: 137498 - DNA, 23 bp, Homo sapiens
agacagggtctccctgtgtctcc

SEQ ID NO: 137499 - DNA, 21 bp, Homo sapiens
tgacaccgcagagtttctgtt

SEQ ID NO: 137500 - DNA, 23 bp, Homo sapiens
tttgagacggagtctcactctgt

SEQ ID NO: 137501 - DNA, 23 bp, Homo sapiens
tgagacagagtcttgctctgtca

SEQ ID NO: 137502 - DNA, 20 bp, Homo sapiens
ccacagagtggaatgtctca

SEQ ID NO: 137503 - DNA, 23 bp, Homo sapiens
tgagacagtctcactctgttgtc

SEQ ID NO: 137504 - DNA, 22 bp, Homo sapiens
tttctgtatttcaataagtgct

SEQ ID NO: 137505 - DNA, 23 bp, Homo sapiens
tatttagctatttattgagatca

SEQ ID NO: 137506 - DNA, 23 bp, Homo sapiens
aaagatgatgatgatgatgatga

SEQ ID NO: 137507 - DNA, 22 bp, Homo sapiens
acagagtgagactctgtctcag

SEQ ID NO: 137508 - DNA, 23 bp, Homo sapiens
atgaggtcatattggattagagt

SEQ ID NO: 137509 - DNA, 23 bp, Homo sapiens
actcagcctgagtgtgtgatcct

SEQ ID NO: 137510 - DNA, 22 bp, Homo sapiens
tcctattagttttgtatgtgta

SEQ ID NO: 137511 - DNA, 23 bp, Homo sapiens
tactcagccaggtttcaagagca

SEQ ID NO: 137512 - DNA, 23 bp, Homo sapiens
tgaccttgtctctgtctctgagt

SEQ ID NO: 137513 - DNA, 18 bp, Homo sapiens
tgaggagtctagggagta

SEQ ID NO: 137514 - DNA, 23 bp, Homo sapiens
tgagttcattgtagattctggat

SEQ ID NO: 137515 - DNA, 23 bp, Homo sapiens
tgagttcattgtagattctggat

SEQ ID NO: 137516 - DNA, 23 bp, Homo sapiens
acactgtcctttagatttgttgt

SEQ ID NO: 137517 - DNA, 22 bp, Homo sapiens
tttatttctgtattctgggggc

SEQ ID NO: 137518 - DNA, 23 bp, Homo sapiens
aggtgatcaaggtgaaagcagaa

SEQ ID NO: 137519 - DNA, 23 bp, Homo sapiens
ctgagtcactctgtcacccaggc

SEQ ID NO: 137520 - DNA, 23 bp, Homo sapiens
aaagaattacatccggttgtcaa

SEQ ID NO: 137521 - DNA, 23 bp, Homo sapiens
tggagtctcactctgtcacccag

SEQ ID NO: 137522 - DNA, 21 bp, Homo sapiens
aggatgaatagtttgcaagta

SEQ ID NO: 137523 - DNA, 20 bp, Homo sapiens
tatgtatatatatacgtatg

SEQ ID NO: 137524 - DNA, 23 bp, Homo sapiens
tcactccctgtcactggctgtgg

SEQ ID NO: 137525 - DNA, 22 bp, Homo sapiens
gtgtgtgtatacacacacacac

SEQ ID NO: 137526 - DNA, 21 bp, Homo sapiens
accatcaaattaaatgtatat

SEQ ID NO: 137527 - DNA, 18 bp, Homo sapiens
tgatacacaaatgtctta

SEQ ID NO: 137528 - DNA, 23 bp, Homo sapiens
tgagttcattgtagattctggat

SEQ ID NO: 137529 - DNA, 23 bp, Homo sapiens
tgagttcattgtagattctggat

SEQ ID NO: 137530 - DNA, 22 bp, Homo sapiens
tgtgtatatatgtatatatgag

SEQ ID NO: 137531 - DNA, 19 bp, Homo sapiens
tactttaagttctgggata

SEQ ID NO: 137532 - DNA, 23 bp, Homo sapiens
tgagttcattgtagattctggat

SEQ ID NO: 137533 - DNA, 23 bp, Homo sapiens
tgagttcattgtagattctggat

SEQ ID NO: 137534 - DNA, 23 bp, Homo sapiens
actcagtgaccctgtgtccctca

SEQ ID NO: 137535 - DNA, 23 bp, Homo sapiens
tcggagtctcgctctgtcaccca

SEQ ID NO: 137536 - DNA, 22 bp, Homo sapiens
acagaacgagaccctgtctttt

SEQ ID NO: 137537 - DNA, 23 bp, Homo sapiens
tcactctgtcacacagattggag

SEQ ID NO: 137538 - DNA, 21 bp, Homo sapiens
agtctcaccatgttgagtgtt

SEQ ID NO: 137539 - DNA, 23 bp, Homo sapiens
tgtcactgctgctgctgctgcca

SEQ ID NO: 137540 - DNA, 18 bp, Homo sapiens
agtggcatgatcttggct

SEQ ID NO: 137541 - DNA, 22 bp, Homo sapiens
agacacggtctcactctgtcac

SEQ ID NO: 137542 - DNA, 21 bp, Homo sapiens
tgaggtaggtggatcacttga

SEQ ID NO: 137543 - DNA, 22 bp, Homo sapiens
tgttgcaggtagtattctgtgt

SEQ ID NO: 137544 - DNA, 23 bp, Homo sapiens
acatcctcaggaacacttgttat

SEQ ID NO: 137545 - DNA, 23 bp, Homo sapiens
tatttcactgtggttctgatttg

SEQ ID NO: 137546 - DNA, 23 bp, Homo sapiens
tgagttcattgtagattctggat

SEQ ID NO: 137547 - DNA, 23 bp, Homo sapiens
tgagttcattgtagattctggat

SEQ ID NO: 137548 - DNA, 21 bp, Homo sapiens
acagagcaagggcaatcctca

SEQ ID NO: 137549 - DNA, 23 bp, Homo sapiens
acagggtctcactctgtcaccca

SEQ ID NO: 137550 - DNA, 19 bp, Homo sapiens
tggcacgatcttgactctg

SEQ ID NO: 137551 - DNA, 23 bp, Homo sapiens
aagtagcatttcatatctaggag

SEQ ID NO: 137552 - DNA, 20 bp, Homo sapiens
gtatatatatatgtgtgtgc

SEQ ID NO: 137553 - DNA, 23 bp, Homo sapiens
acggtcacactcacagtaggcac

SEQ ID NO: 137554 - DNA, 21 bp, Homo sapiens
atatgtatatatgtatatatg

SEQ ID NO: 137555 - DNA, 23 bp, Homo sapiens
tgaccgcgagtgatctgcctgtc

SEQ ID NO: 137556 - DNA, 23 bp, Homo sapiens
actgctattgtttgcatatgaca

SEQ ID NO: 137557 - DNA, 23 bp, Homo sapiens
tgagttcattgtagattctggat

SEQ ID NO: 137558 - DNA, 23 bp, Homo sapiens
tgagttcattgtagattctggat

SEQ ID NO: 137559 - DNA, 23 bp, Homo sapiens
tgtgcaaccactatgatattagc

SEQ ID NO: 137560 - DNA, 19 bp, Homo sapiens
tattctgcataatatcaca

SEQ ID NO: 137561 - DNA, 23 bp, Homo sapiens
acagagttttgctcttgtcgccc

SEQ ID NO: 137562 - DNA, 20 bp, Homo sapiens
acacacacaggattatttgt

SEQ ID NO: 137563 - DNA, 23 bp, Homo sapiens
tgagttcattgtagattctggat

SEQ ID NO: 137564 - DNA, 23 bp, Homo sapiens
tgagttcattgtagattctggat

SEQ ID NO: 137565 - DNA, 22 bp, Homo sapiens
agaggtagttggttcaaatcaa

SEQ ID NO: 137566 - DNA, 23 bp, Homo sapiens
agagcgtctgtgtctgtgcgtgc

SEQ ID NO: 137567 - DNA, 18 bp, Homo sapiens
ctgctccactgcctcctc

SEQ ID NO: 137568 - DNA, 21 bp, Homo sapiens
gtgagaaatgagtcaggtcac

SEQ ID NO: 137569 - DNA, 21 bp, Homo sapiens
agacctggatttgtttggcaa

SEQ ID NO: 137570 - DNA, 20 bp, Homo sapiens
tggcagagaagagaggagag

SEQ ID NO: 137571 - DNA, 23 bp, Homo sapiens
tctctctttctgagtgtgtcagt

SEQ ID NO: 137572 - DNA, 20 bp, Homo sapiens
ataatgtgactggtgatgat

SEQ ID NO: 137573 - DNA, 21 bp, Homo sapiens
aaaaagttgtcaatgaaatca

SEQ ID NO: 137574 - DNA, 23 bp, Homo sapiens
aaatattactgtttgcaattgtt

SEQ ID NO: 137575 - DNA, 23 bp, Homo sapiens
gttttgtgcatgtgcatgtgcat

SEQ ID NO: 137576 - DNA, 23 bp, Homo sapiens
gtgatcacacagccagctgtgat

SEQ ID NO: 137577 - DNA, 23 bp, Homo sapiens
tctgagtgtcatatgcttatgag

SEQ ID NO: 137578 - DNA, 23 bp, Homo sapiens
tttctctgtctctgaattgcagc

SEQ ID NO: 137579 - DNA, 23 bp, Homo sapiens
tttctctgtctctgaattgcagc

SEQ ID NO: 137580 - DNA, 22 bp, Homo sapiens
accctcgctcactctcagtgcc

SEQ ID NO: 137581 - DNA, 21 bp, Homo sapiens
tgcatgtatatatgatatgta

SEQ ID NO: 137582 - DNA, 20 bp, Homo sapiens
atatgtatatatatttatgt

SEQ ID NO: 137583 - DNA, 23 bp, Homo sapiens
tttggagggtaatgactgggaat

SEQ ID NO: 137584 - DNA, 21 bp, Homo sapiens
atatgtatacatgtatacaca

SEQ ID NO: 137585 - DNA, 23 bp, Homo sapiens
tctctgtctcttactcttttctc

SEQ ID NO: 137586 - DNA, 23 bp, Homo sapiens
tttttgctgttgttggacttgtg

SEQ ID NO: 137587 - DNA, 20 bp, Homo sapiens
attcacagtctctcaagttt

SEQ ID NO: 137588 - DNA, 23 bp, Homo sapiens
aaagctgaggttttcattccaac

SEQ ID NO: 137589 - DNA, 23 bp, Homo sapiens
ttttttggttccatatgaaattt

SEQ ID NO: 137590 - DNA, 21 bp, Homo sapiens
tgtgaataaagtcaatggtag

SEQ ID NO: 137591 - DNA, 23 bp, Homo sapiens
tgagttcattgtagattctggat

SEQ ID NO: 137592 - DNA, 23 bp, Homo sapiens
tgagttcattgtagattctggat

SEQ ID NO: 137593 - DNA, 20 bp, Homo sapiens
ataagcttgtaaaaagccat

SEQ ID NO: 137594 - DNA, 19 bp, Homo sapiens
gagatcatctgctatttct

SEQ ID NO: 137595 - DNA, 23 bp, Homo sapiens
tgagttcattgtagattctggat

SEQ ID NO: 137596 - DNA, 23 bp, Homo sapiens
tgagttcattgtagattctggat

SEQ ID NO: 137597 - DNA, 22 bp, Homo sapiens
taactggatttcttaaaatgtg

SEQ ID NO: 137598 - DNA, 23 bp, Homo sapiens
acacacatactatgaaatactgt

SEQ ID NO: 137599 - DNA, 23 bp, Homo sapiens
tgagttcattgtagattctggat

SEQ ID NO: 137600 - DNA, 23 bp, Homo sapiens
tgagttcattgtagattctggat

SEQ ID NO: 137601 - DNA, 23 bp, Homo sapiens
ctctctctctgtcttccagactc

SEQ ID NO: 137602 - DNA, 23 bp, Homo sapiens
acagagtctcactctgtcgccca

SEQ ID NO: 137603 - DNA, 22 bp, Homo sapiens
ttttgagacagagtctcaacgg

SEQ ID NO: 137604 - DNA, 22 bp, Homo sapiens
ctggctggctctgtgcctgcca

SEQ ID NO: 137605 - DNA, 20 bp, Homo sapiens
tgaggaatagaaatggaatc

SEQ ID NO: 137606 - DNA, 23 bp, Homo sapiens
tatgtgtgtgtgtgtatatacac

SEQ ID NO: 137607 - DNA, 18 bp, Homo sapiens
agatatcttattgttaat

SEQ ID NO: 137608 - DNA, 21 bp, Homo sapiens
tgtgggagtatgtttatatat

SEQ ID NO: 137609 - DNA, 23 bp, Homo sapiens
aagtatgtatgtatgataggtat

SEQ ID NO: 137610 - DNA, 23 bp, Homo sapiens
cttttctgcatctattgaggtga

SEQ ID NO: 137611 - DNA, 22 bp, Homo sapiens
aaaaactgtgaagggactgggt

SEQ ID NO: 137612 - DNA, 23 bp, Homo sapiens
aatccacctggaattgattttat

SEQ ID NO: 137613 - DNA, 23 bp, Homo sapiens
tgtgaacagtgtaaggtgggtgt

SEQ ID NO: 137614 - DNA, 22 bp, Homo sapiens
tctggaaattgattgaggacag

SEQ ID NO: 137615 - DNA, 19 bp, Homo sapiens
attagtctttttccacttg

SEQ ID NO: 137616 - DNA, 23 bp, Homo sapiens
caagttccttatagatgctggat

SEQ ID NO: 137617 - DNA, 23 bp, Homo sapiens
tgagttcattgtagattctggat

SEQ ID NO: 137618 - DNA, 23 bp, Homo sapiens
tgagttcattgtagattctggat

SEQ ID NO: 137619 - DNA, 20 bp, Homo sapiens
atgtgcacatcgtgcaggtt

SEQ ID NO: 137620 - DNA, 23 bp, Homo sapiens
tacatgtgccatgttggtgtgct

SEQ ID NO: 137621 - DNA, 19 bp, Homo sapiens
aataacatatcataagttt

SEQ ID NO: 137622 - DNA, 20 bp, Homo sapiens
tattgttgaggagcattcca

SEQ ID NO: 137623 - DNA, 20 bp, Homo sapiens
tatgagtgctttatagtttt

SEQ ID NO: 137624 - DNA, 19 bp, Homo sapiens
tggggcacatgttcaggtt

SEQ ID NO: 137625 - DNA, 23 bp, Homo sapiens
tgcaagtaggtggtattgttgag

SEQ ID NO: 137626 - DNA, 20 bp, Homo sapiens
tgagtgtctctgtgtatgtt

SEQ ID NO: 137627 - DNA, 23 bp, Homo sapiens
tgagttcattgtagattctggat

SEQ ID NO: 137628 - DNA, 23 bp, Homo sapiens
tgagttcattgtagattctggat

SEQ ID NO: 137629 - DNA, 23 bp, Homo sapiens
ctctttttgcttaggattgtctt

SEQ ID NO: 137630 - DNA, 23 bp, Homo sapiens
tgagttcattgtagattctggat

SEQ ID NO: 137631 - DNA, 23 bp, Homo sapiens
tgagttcattgtagattctggat

SEQ ID NO: 137632 - DNA, 21 bp, Homo sapiens
tgtgaagaaagtcattggtag

SEQ ID NO: 137633 - DNA, 19 bp, Homo sapiens
tgagtagctctgggtctgt

SEQ ID NO: 137634 - DNA, 23 bp, Homo sapiens
tcatataatccagaaagctgtag

SEQ ID NO: 137635 - DNA, 23 bp, Homo sapiens
tatgtatgtatgtgtgtatgtgt

SEQ ID NO: 137636 - DNA, 23 bp, Homo sapiens
gtgtgtatagatgtgtgtatatc

SEQ ID NO: 137637 - DNA, 23 bp, Homo sapiens
ttttgagacggagtctcactctg

SEQ ID NO: 137638 - DNA, 19 bp, Homo sapiens
gagtggttaataaatctta

SEQ ID NO: 137639 - DNA, 22 bp, Homo sapiens
ttgagagatgagagagttaact

SEQ ID NO: 137640 - DNA, 23 bp, Homo sapiens
tgagttcattgtagattctggat

SEQ ID NO: 137641 - DNA, 23 bp, Homo sapiens
tgagttcattgtagattctggat

SEQ ID NO: 137642 - DNA, 22 bp, Homo sapiens
aggcagaagagaccctggtcag

SEQ ID NO: 137643 - DNA, 22 bp, Homo sapiens
gggcctcactctgtcgctcagg

SEQ ID NO: 137644 - DNA, 19 bp, Homo sapiens
ttggtgatgatttctgatt

SEQ ID NO: 137645 - DNA, 20 bp, Homo sapiens
aatgtgtctgtgtgtccagt

SEQ ID NO: 137646 - DNA, 21 bp, Homo sapiens
tacacgtatatatatgcatgt

SEQ ID NO: 137647 - DNA, 19 bp, Homo sapiens
tcaggcaaaattttgtggt

SEQ ID NO: 137648 - DNA, 21 bp, Homo sapiens
atcagtgcattgaacagtgtt

SEQ ID NO: 137649 - DNA, 23 bp, Homo sapiens
aatttagctattctttctgttga

SEQ ID NO: 137650 - DNA, 23 bp, Homo sapiens
ttatgtcactgtcacattttggt

SEQ ID NO: 137651 - DNA, 23 bp, Homo sapiens
tacacatacctgagtgtgtgttt

SEQ ID NO: 137652 - DNA, 22 bp, Homo sapiens
tgacaggcttatgtatggagta

SEQ ID NO: 137653 - DNA, 20 bp, Homo sapiens
tatactatgcttactatagt

SEQ ID NO: 137654 - DNA, 23 bp, Homo sapiens
ctatagtaagtgtagtatagtaa

SEQ ID NO: 137655 - DNA, 22 bp, Homo sapiens
tagatagatgatagatagctgt

SEQ ID NO: 137656 - DNA, 22 bp, Homo sapiens
ttgttgcatatgtatacataca

SEQ ID NO: 137657 - DNA, 21 bp, Homo sapiens
ttgcagcacaaaagtttttga

SEQ ID NO: 137658 - DNA, 22 bp, Homo sapiens
tttgtgtctgaaaagggttcgc

SEQ ID NO: 137659 - DNA, 23 bp, Homo sapiens
ttttgtggttccatatgaattta

SEQ ID NO: 137660 - DNA, 18 bp, Homo sapiens
aatagtttttttggtgga

SEQ ID NO: 137661 - DNA, 23 bp, Homo sapiens
gaagacagtgacactgatggtcc

SEQ ID NO: 137662 - DNA, 23 bp, Homo sapiens
ctaggctaatgtctgtgtttgtg

SEQ ID NO: 137663 - DNA, 19 bp, Homo sapiens
acagtatcaggacagtttg

SEQ ID NO: 137664 - DNA, 21 bp, Homo sapiens
tactctttactacatgaagat

SEQ ID NO: 137665 - DNA, 22 bp, Homo sapiens
gtgacagactgagactctgttt

SEQ ID NO: 137666 - DNA, 23 bp, Homo sapiens
cactggttttacattatggtgag

SEQ ID NO: 137667 - DNA, 21 bp, Homo sapiens
gcaataaatgtaatgtgtttg

SEQ ID NO: 137668 - DNA, 21 bp, Homo sapiens
ctatggtacaaaatggtgact

SEQ ID NO: 137669 - DNA, 21 bp, Homo sapiens
taaagagtagattttgtgttc

SEQ ID NO: 137670 - DNA, 19 bp, Homo sapiens
tgtctgtgagtacatgtgt

SEQ ID NO: 137671 - DNA, 20 bp, Homo sapiens
aagaaataagttctagtgtt

SEQ ID NO: 137672 - DNA, 21 bp, Homo sapiens
acctggaatctcagcactttg

SEQ ID NO: 137673 - DNA, 23 bp, Homo sapiens
tgagctcagaagtttgagaccag

SEQ ID NO: 137674 - DNA, 23 bp, Homo sapiens
atttgtctgtatatatatatgta

SEQ ID NO: 137675 - DNA, 23 bp, Homo sapiens
ggactctgagtctctcaatatcc

SEQ ID NO: 137676 - DNA, 22 bp, Homo sapiens
atgtgaggcagcatcacaagtg

SEQ ID NO: 137677 - DNA, 23 bp, Homo sapiens
caacttctctgactctcacttac

SEQ ID NO: 137678 - DNA, 21 bp, Homo sapiens
ttggacctgagtgtctcagtg

SEQ ID NO: 137679 - DNA, 23 bp, Homo sapiens
gaacccagtgtccacatgtgagt

SEQ ID NO: 137680 - DNA, 23 bp, Homo sapiens
ctctgtgtgtgtgtgtgtgtatc

SEQ ID NO: 137681 - DNA, 23 bp, Homo sapiens
tatccatgcatatctatagtaag

SEQ ID NO: 137682 - DNA, 20 bp, Homo sapiens
tctggagtacatttcattta

SEQ ID NO: 137683 - DNA, 21 bp, Homo sapiens
tagtttgataagatgtaatga

SEQ ID NO: 137684 - DNA, 23 bp, Homo sapiens
ggtctcactctgtggctctggct

SEQ ID NO: 137685 - DNA, 23 bp, Homo sapiens
gacagagtctcactctgtcgccc

SEQ ID NO: 137686 - DNA, 21 bp, Homo sapiens
ttcaagtgattctcctgcctc

SEQ ID NO: 137687 - DNA, 23 bp, Homo sapiens
atgctccttgaaggcagtgatca

SEQ ID NO: 137688 - DNA, 22 bp, Homo sapiens
ctgaggtagtagaatcacttga

SEQ ID NO: 137689 - DNA, 23 bp, Homo sapiens
tttgagacaggatttcactttca

SEQ ID NO: 137690 - DNA, 22 bp, Homo sapiens
taaagtggtctgggtcctgggt

SEQ ID NO: 137691 - DNA, 23 bp, Homo sapiens
tgagttcattgtagattctggat

SEQ ID NO: 137692 - DNA, 23 bp, Homo sapiens
tgagttcattgtagattctggat

SEQ ID NO: 137693 - DNA, 23 bp, Homo sapiens
ataaattacatatgatatgtatt

SEQ ID NO: 137694 - DNA, 19 bp, Homo sapiens
tatatataatgtatgctga

SEQ ID NO: 137695 - DNA, 20 bp, Homo sapiens
atacaccatgggatactact

SEQ ID NO: 137696 - DNA, 21 bp, Homo sapiens
aataccatgtgaatgctatgt

SEQ ID NO: 137697 - DNA, 23 bp, Homo sapiens
tgagttcattgtagattctggat

SEQ ID NO: 137698 - DNA, 23 bp, Homo sapiens
tgagttcattgtagattctggat

SEQ ID NO: 137699 - DNA, 23 bp, Homo sapiens
tgagttcattgtagattctggat

SEQ ID NO: 137700 - DNA, 23 bp, Homo sapiens
tgagttcattgtagattctggat

SEQ ID NO: 137701 - DNA, 23 bp, Homo sapiens
ttaccatgtagaaaccctttcct

SEQ ID NO: 137702 - DNA, 23 bp, Homo sapiens
agaagagtgaagacagagatcac

SEQ ID NO: 137703 - DNA, 23 bp, Homo sapiens
tgatcattttgttaggtagtgtc

SEQ ID NO: 137704 - DNA, 23 bp, Homo sapiens
tacgtgtacatatacgtatgtat

SEQ ID NO: 137705 - DNA, 22 bp, Homo sapiens
tatgtatatatgtatatatgta

SEQ ID NO: 137706 - DNA, 23 bp, Homo sapiens
atatgtatatatgtatatgggtg

SEQ ID NO: 137707 - DNA, 21 bp, Homo sapiens
tgtgtgtgtgtatatatacac

SEQ ID NO: 137708 - DNA, 23 bp, Homo sapiens
tggcagagtctttagggttttct

SEQ ID NO: 137709 - DNA, 23 bp, Homo sapiens
tggacaagtgactttgatgatga

SEQ ID NO: 137710 - DNA, 23 bp, Homo sapiens
tattgttatgttccttatgcatg

SEQ ID NO: 137711 - DNA, 23 bp, Homo sapiens
ccaataagtccagcaagaagcaa

SEQ ID NO: 137712 - DNA, 22 bp, Homo sapiens
aagagttttctgctatttgctc

SEQ ID NO: 137713 - DNA, 23 bp, Homo sapiens
tgtgtgtatatatatgtgtgtgt

SEQ ID NO: 137714 - DNA, 21 bp, Homo sapiens
tatactacagaatgaatcatc

SEQ ID NO: 137715 - DNA, 21 bp, Homo sapiens
tggttgctgtaatagtcttga

SEQ ID NO: 137716 - DNA, 23 bp, Homo sapiens
cagagtgagacagagtgagacag

SEQ ID NO: 137717 - DNA, 23 bp, Homo sapiens
tttgaacttctgccagtgtaatt

SEQ ID NO: 137718 - DNA, 23 bp, Homo sapiens
tgagatggagtctcactctgtcg

SEQ ID NO: 137719 - DNA, 23 bp, Homo sapiens
aggctctctgactgactccttcc

SEQ ID NO: 137720 - DNA, 19 bp, Homo sapiens
aagtgctgggattacaggc

SEQ ID NO: 137721 - DNA, 22 bp, Homo sapiens
gagccaccgtgcctggctgact

SEQ ID NO: 137722 - DNA, 23 bp, Homo sapiens
tgtgcatgtgagttaaaatgagt

SEQ ID NO: 137723 - DNA, 18 bp, Homo sapiens
agacaaggtcacactctg

SEQ ID NO: 137724 - DNA, 20 bp, Homo sapiens
aaagtgattatctttgttgt

SEQ ID NO: 137725 - DNA, 18 bp, Homo sapiens
agataaaatgcaagagtc

SEQ ID NO: 137726 - DNA, 23 bp, Homo sapiens
ttagtgagaggttgacttgtgtt

SEQ ID NO: 137727 - DNA, 23 bp, Homo sapiens
ggatgatgagtgaagaactgaaa

SEQ ID NO: 137728 - DNA, 23 bp, Homo sapiens
atgtctctctgagaaatgtgttg

SEQ ID NO: 137729 - DNA, 23 bp, Homo sapiens
atacatgtgtatatgtatatttg

SEQ ID NO: 137730 - DNA, 21 bp, Homo sapiens
tgggactgagctctggagcac

SEQ ID NO: 137731 - DNA, 23 bp, Homo sapiens
atgcagtgctacatttctctgtc

SEQ ID NO: 137732 - DNA, 23 bp, Homo sapiens
tttgcattgatgttcatcaagaa

SEQ ID NO: 137733 - DNA, 23 bp, Homo sapiens
ggttcttatcagtgcaaaggtta

SEQ ID NO: 137734 - DNA, 22 bp, Homo sapiens
aatagaaatgaagttgttcttc

SEQ ID NO: 137735 - DNA, 23 bp, Homo sapiens
tcattttatgttttggatcagaa

SEQ ID NO: 137736 - DNA, 19 bp, Homo sapiens
tgcaacttctgcctcctgg

SEQ ID NO: 137737 - DNA, 23 bp, Homo sapiens
gagacacagtctcactctgtcgc

SEQ ID NO: 137738 - DNA, 22 bp, Homo sapiens
tttatctttacaagcattggca

SEQ ID NO: 137739 - DNA, 23 bp, Homo sapiens
cagtgtctctctgtcactcaggc

SEQ ID NO: 137740 - DNA, 22 bp, Homo sapiens
ttcagtggcaggatcgtagctc

SEQ ID NO: 137741 - DNA, 23 bp, Homo sapiens
gaaaggcagagttgtgattttat

SEQ ID NO: 137742 - DNA, 23 bp, Homo sapiens
tgagatggagtctcactctgtcg

SEQ ID NO: 137743 - DNA, 23 bp, Homo sapiens
gggagtctcactctgtcgcccag

SEQ ID NO: 137744 - DNA, 22 bp, Homo sapiens
tatgtgtatatatatgtgtgtg

SEQ ID NO: 137745 - DNA, 19 bp, Homo sapiens
cgtatagatgtatatatgt

SEQ ID NO: 137746 - DNA, 21 bp, Homo sapiens
atatctatatatgtaaaattg

SEQ ID NO: 137747 - DNA, 23 bp, Homo sapiens
tgaaagtacatattgtaagcttt

SEQ ID NO: 137748 - DNA, 22 bp, Homo sapiens
ttcaaagttatacatacttgta

SEQ ID NO: 137749 - DNA, 23 bp, Homo sapiens
aagtcaactagttcaacaaggtc

SEQ ID NO: 137750 - DNA, 23 bp, Homo sapiens
tattgactgattttcaaatgtca

SEQ ID NO: 137751 - DNA, 23 bp, Homo sapiens
atttgactgtaagctcattgagg

SEQ ID NO: 137752 - DNA, 23 bp, Homo sapiens
tagcagagtgctttgcagatagc

SEQ ID NO: 137753 - DNA, 23 bp, Homo sapiens
aaggctctctgactgactccgtc

SEQ ID NO: 137754 - DNA, 22 bp, Homo sapiens
attaggtcccattggaatcact

SEQ ID NO: 137755 - DNA, 23 bp, Homo sapiens
tgtctgagtctgagcttcagaga

SEQ ID NO: 137756 - DNA, 23 bp, Homo sapiens
caagtgttttctatccttttgac

SEQ ID NO: 137757 - DNA, 18 bp, Homo sapiens
tatatggtagttctattt

SEQ ID NO: 137758 - DNA, 19 bp, Homo sapiens
atatatgtatatgatatgt

SEQ ID NO: 137759 - DNA, 23 bp, Homo sapiens
atgtgtgtatatatatgtgtgtg

SEQ ID NO: 137760 - DNA, 23 bp, Homo sapiens
tccctgtgtgactgtgtttgcag

SEQ ID NO: 137761 - DNA, 18 bp, Homo sapiens
tagatatagatatagata

SEQ ID NO: 137762 - DNA, 23 bp, Homo sapiens
gggtctcactctgtcactcaggc

SEQ ID NO: 137763 - DNA, 18 bp, Homo sapiens
cagtggtatgatcttgtc

SEQ ID NO: 137764 - DNA, 19 bp, Homo sapiens
actgtttaggatttctctt

SEQ ID NO: 137765 - DNA, 18 bp, Homo sapiens
tcactacaacctctgcct

SEQ ID NO: 137766 - DNA, 23 bp, Homo sapiens
tatgtgtatatgtatgtgtgtgt

SEQ ID NO: 137767 - DNA, 22 bp, Homo sapiens
tgtgtgtgtatatatatgtgtg

SEQ ID NO: 137768 - DNA, 23 bp, Homo sapiens
catcaagataccttgcacattgt

SEQ ID NO: 137769 - DNA, 22 bp, Homo sapiens
tttggcaagttatgctttgtct

SEQ ID NO: 137770 - DNA, 22 bp, Homo sapiens
tcactgtttttatgtctctact

SEQ ID NO: 137771 - DNA, 23 bp, Homo sapiens
tcctagattagtgtttttgatga

SEQ ID NO: 137772 - DNA, 22 bp, Homo sapiens
tgtgtatatatatatgtgtgtg

SEQ ID NO: 137773 - DNA, 20 bp, Homo sapiens
tatgtgtgtgtatatatatg

SEQ ID NO: 137774 - DNA, 23 bp, Homo sapiens
tgagttcattgtagattctggat

SEQ ID NO: 137775 - DNA, 23 bp, Homo sapiens
tgagttcattgtagattctggat

SEQ ID NO: 137776 - DNA, 23 bp, Homo sapiens
tcagtgatttagtgtcactaata

SEQ ID NO: 137777 - DNA, 21 bp, Homo sapiens
atttttgtccttcattctgtt

SEQ ID NO: 137778 - DNA, 20 bp, Homo sapiens
tcttagaatgtattttagat

SEQ ID NO: 137779 - DNA, 20 bp, Homo sapiens
atagggaggtatggatattt

SEQ ID NO: 137780 - DNA, 22 bp, Homo sapiens
caatttatttatgtcttcctta

SEQ ID NO: 137781 - DNA, 20 bp, Homo sapiens
taactaatgacattgaacat

SEQ ID NO: 137782 - DNA, 23 bp, Homo sapiens
ttaagcatagtgaggaaagaatg

SEQ ID NO: 137783 - DNA, 19 bp, Homo sapiens
agatatattctatttgtgt

SEQ ID NO: 137784 - DNA, 21 bp, Homo sapiens
atacacagatagtttagtgtc

SEQ ID NO: 137785 - DNA, 23 bp, Homo sapiens
gtatatatatgtgtgtgtatata

SEQ ID NO: 137786 - DNA, 19 bp, Homo sapiens
aaattctgggggaaaatct

SEQ ID NO: 137787 - DNA, 23 bp, Homo sapiens
tgagacagagtctcgctctgttg

SEQ ID NO: 137788 - DNA, 23 bp, Homo sapiens
atagtgtctctcagtctgaggcc

SEQ ID NO: 137789 - DNA, 19 bp, Homo sapiens
ttaggtgtagattctcaag

SEQ ID NO: 137790 - DNA, 23 bp, Homo sapiens
ctgaagtgaatttgtttttgact

SEQ ID NO: 137791 - DNA, 23 bp, Homo sapiens
attttgctagtaaaactaatgca

SEQ ID NO: 137792 - DNA, 18 bp, Homo sapiens
tggcatcatcttggtagt

SEQ ID NO: 137793 - DNA, 21 bp, Homo sapiens
atatttctttatgttttctgg

SEQ ID NO: 137794 - DNA, 20 bp, Homo sapiens
tctggctgggtgagagctgt

SEQ ID NO: 137795 - DNA, 23 bp, Homo sapiens
tgtattttccttgcatctcaatt

SEQ ID NO: 137796 - DNA, 22 bp, Homo sapiens
tattgttagctgcaattaagat

SEQ ID NO: 137797 - DNA, 23 bp, Homo sapiens
tgtctctttatctctctctgtct

SEQ ID NO: 137798 - DNA, 22 bp, Homo sapiens
atatgtgtatatatgtatatat

SEQ ID NO: 137799 - DNA, 23 bp, Homo sapiens
tatgtgtatatatatgtgtgtgt

SEQ ID NO: 137800 - DNA, 23 bp, Homo sapiens
tgagttcattgtagattctggat

SEQ ID NO: 137801 - DNA, 23 bp, Homo sapiens
tgagttcattgtagattctggat

SEQ ID NO: 137802 - DNA, 23 bp, Homo sapiens
tatatatgtggtatatatgtggt

SEQ ID NO: 137803 - DNA, 23 bp, Homo sapiens
tgagttcattgtagattctggat

SEQ ID NO: 137804 - DNA, 23 bp, Homo sapiens
tgagttcattgtagattctggat

SEQ ID NO: 137805 - DNA, 20 bp, Homo sapiens
atttgtgtgtataggtatgt

SEQ ID NO: 137806 - DNA, 23 bp, Homo sapiens
atgtatacatacatatgtgtatg

SEQ ID NO: 137807 - DNA, 23 bp, Homo sapiens
tatacacacacatatatatgtgt

SEQ ID NO: 137808 - DNA, 21 bp, Homo sapiens
tatgtgtatatatacacatgt

SEQ ID NO: 137809 - DNA, 23 bp, Homo sapiens
tctctgggactctgtaatttctg

SEQ ID NO: 137810 - DNA, 22 bp, Homo sapiens
acatgtatgtaggtatgtatgc

SEQ ID NO: 137811 - DNA, 23 bp, Homo sapiens
tgagtttttgtaagttggagtga

SEQ ID NO: 137812 - DNA, 23 bp, Homo sapiens
ttcaaagaatatgaaatcagtat

SEQ ID NO: 137813 - DNA, 23 bp, Homo sapiens
tgagttcattgtagattctggat

SEQ ID NO: 137814 - DNA, 23 bp, Homo sapiens
tgagttcattgtagattctggat

SEQ ID NO: 137815 - DNA, 23 bp, Homo sapiens
cagggtctcactctgtcacccag

SEQ ID NO: 137816 - DNA, 21 bp, Homo sapiens
aaactctgtctgaaaaacaaa

SEQ ID NO: 137817 - DNA, 23 bp, Homo sapiens
ttcctgtatatatatgtgtgtgt

SEQ ID NO: 137818 - DNA, 23 bp, Homo sapiens
tgagttcattgtagattctggat

SEQ ID NO: 137819 - DNA, 23 bp, Homo sapiens
tgagttcattgtagattctggat

SEQ ID NO: 137820 - DNA, 22 bp, Homo sapiens
atatgtgtgtatatatatgtgt

SEQ ID NO: 137821 - DNA, 23 bp, Homo sapiens
tgtgtgtatatatgtatatatgt

SEQ ID NO: 137822 - DNA, 23 bp, Homo sapiens
gagtctcaccctgtcacccaggc

SEQ ID NO: 137823 - DNA, 19 bp, Homo sapiens
atatgtatacaaggtatat

SEQ ID NO: 137824 - DNA, 19 bp, Homo sapiens
acaagatatatattgtata

SEQ ID NO: 137825 - DNA, 21 bp, Homo sapiens
tatgtgtatatatatgtatgt

SEQ ID NO: 137826 - DNA, 23 bp, Homo sapiens
tgtatatacgtatctatatgtgt

SEQ ID NO: 137827 - DNA, 19 bp, Homo sapiens
tatgtgcatgtatatatat

SEQ ID NO: 137828 - DNA, 23 bp, Homo sapiens
tctctatctgtctgtctctgtct

SEQ ID NO: 137829 - DNA, 19 bp, Homo sapiens
aggaatgattaggggaaag

SEQ ID NO: 137830 - DNA, 23 bp, Homo sapiens
agtgtaaaagtattcccttttca

SEQ ID NO: 137831 - DNA, 23 bp, Homo sapiens
taaagtagaacgtctgcatctaa

SEQ ID NO: 137832 - DNA, 20 bp, Homo sapiens
tcagggtgaatgggagactc

SEQ ID NO: 137833 - DNA, 19 bp, Homo sapiens
caggtagagaaatcactaa

SEQ ID NO: 137834 - DNA, 20 bp, Homo sapiens
gtactgcctagagtcaaagt

SEQ ID NO: 137835 - DNA, 23 bp, Homo sapiens
tttaaacaggatcttgctctgtt

SEQ ID NO: 137836 - DNA, 23 bp, Homo sapiens
cagagcctcactccgtcactcac

SEQ ID NO: 137837 - DNA, 23 bp, Homo sapiens
taaaaaattatctgcaggcaggc

SEQ ID NO: 137838 - DNA, 22 bp, Homo sapiens
ttttgagatggagtcttactct

SEQ ID NO: 137839 - DNA, 22 bp, Homo sapiens
actccttctgttatgttgtctg

SEQ ID NO: 137840 - DNA, 23 bp, Homo sapiens
cagtctcactctgtcacccaggc

SEQ ID NO: 137841 - DNA, 23 bp, Homo sapiens
acaccaggtgtgtgtgtgtgcgt

SEQ ID NO: 137842 - DNA, 23 bp, Homo sapiens
atgaaagttacaggtatggatgt

SEQ ID NO: 137843 - DNA, 23 bp, Homo sapiens
tggactctcactctgtcacccag

SEQ ID NO: 137844 - DNA, 23 bp, Homo sapiens
tgagacagagtctcactctgtcg

SEQ ID NO: 137845 - DNA, 23 bp, Homo sapiens
agagtctcactctgtcatccagg

SEQ ID NO: 137846 - DNA, 23 bp, Homo sapiens
tctcactcactgcaaactctgcc

SEQ ID NO: 137847 - DNA, 23 bp, Homo sapiens
gatctctctgtctctgtgaagtc

SEQ ID NO: 137848 - DNA, 23 bp, Homo sapiens
ggaagagtagagtggtcattgtt

SEQ ID NO: 137849 - DNA, 22 bp, Homo sapiens
tgagatcaaggtgtcagcagga

SEQ ID NO: 137850 - DNA, 21 bp, Homo sapiens
tggagagatctgttccaggcc

SEQ ID NO: 137851 - DNA, 23 bp, Homo sapiens
acaatgcaatgactgagtgtgaa

SEQ ID NO: 137852 - DNA, 23 bp, Homo sapiens
agattcaaggagtgcatgtgcag

SEQ ID NO: 137853 - DNA, 23 bp, Homo sapiens
tgagttcattgtagattctggat

SEQ ID NO: 137854 - DNA, 23 bp, Homo sapiens
tgagttcattgtagattctggat

SEQ ID NO: 137855 - DNA, 21 bp, Homo sapiens
aagtctgagatcaaggtgtca

SEQ ID NO: 137856 - DNA, 23 bp, Homo sapiens
tggagtctcactctgtcacccag

SEQ ID NO: 137857 - DNA, 23 bp, Homo sapiens
aatacaggatcctaatattttct

SEQ ID NO: 137858 - DNA, 23 bp, Homo sapiens
gtgtggatatggtatgaaacgta

SEQ ID NO: 137859 - DNA, 23 bp, Homo sapiens
tttagtatttgtgacctttggat

SEQ ID NO: 137860 - DNA, 23 bp, Homo sapiens
tttatgaagaactggatgtggaa

SEQ ID NO: 137861 - DNA, 20 bp, Homo sapiens
ttacagtttgttgagggaca

SEQ ID NO: 137862 - DNA, 23 bp, Homo sapiens
ctgagaagttgttctgtgtctct

SEQ ID NO: 137863 - DNA, 18 bp, Homo sapiens
ccagtgaacagacttcga

SEQ ID NO: 137864 - DNA, 23 bp, Homo sapiens
ccactgactgtctgtgtgtgact

SEQ ID NO: 137865 - DNA, 23 bp, Homo sapiens
gatagggagttgagtgtgtgtag

SEQ ID NO: 137866 - DNA, 23 bp, Homo sapiens
gtgtgtgtgtgtgtatatgtata

SEQ ID NO: 137867 - DNA, 23 bp, Homo sapiens
ttatagcttgatatcacattcat

SEQ ID NO: 137868 - DNA, 23 bp, Homo sapiens
atatatatgtagattcactgtgt

SEQ ID NO: 137869 - DNA, 23 bp, Homo sapiens
ctagatctaggagcttgcttagt

SEQ ID NO: 137870 - DNA, 19 bp, Homo sapiens
gtatatccttgagcatcta

SEQ ID NO: 137871 - DNA, 23 bp, Homo sapiens
tttctgcacagtgagaaaggcgt

SEQ ID NO: 137872 - DNA, 21 bp, Homo sapiens
acattctaaaacttgctgaaa

SEQ ID NO: 137873 - DNA, 20 bp, Homo sapiens
tgacaagttgaccagtggtt

SEQ ID NO: 137874 - DNA, 23 bp, Homo sapiens
agactgagtctcactctgtcgcc

SEQ ID NO: 137875 - DNA, 19 bp, Homo sapiens
gtatatatatatgtgtaca

SEQ ID NO: 137876 - DNA, 19 bp, Homo sapiens
tatatatgtacatatacat

SEQ ID NO: 137877 - DNA, 23 bp, Homo sapiens
tagttaatttgtcatgaagaagc

SEQ ID NO: 137878 - DNA, 22 bp, Homo sapiens
tgtgtatgtgtgcatgtgtgtg

SEQ ID NO: 137879 - DNA, 23 bp, Homo sapiens
aaacctgcacatcctgcacatgt

SEQ ID NO: 137880 - DNA, 23 bp, Homo sapiens
aaagctcaggaaatgatagtggt

SEQ ID NO: 137881 - DNA, 21 bp, Homo sapiens
taattgatccagataacagtt

SEQ ID NO: 137882 - DNA, 23 bp, Homo sapiens
attgtatattattcttttctgta

SEQ ID NO: 137883 - DNA, 23 bp, Homo sapiens
tatagttagaattgcaaatgatg

SEQ ID NO: 137884 - DNA, 23 bp, Homo sapiens
tgagatggagtctcactctgtcg

SEQ ID NO: 137885 - DNA, 23 bp, Homo sapiens
agtgagagtagagattttggagt

SEQ ID NO: 137886 - DNA, 23 bp, Homo sapiens
tgaggacacagtgtaatctcagc

SEQ ID NO: 137887 - DNA, 21 bp, Homo sapiens
tgaggtaggaggatcacttga

SEQ ID NO: 137888 - DNA, 22 bp, Homo sapiens
tggtatcttgtagttttgattt

SEQ ID NO: 137889 - DNA, 23 bp, Homo sapiens
agctctgtttatgaagttcaaag

SEQ ID NO: 137890 - DNA, 22 bp, Homo sapiens
ttcttagaagtatgagtagagc

SEQ ID NO: 137891 - DNA, 23 bp, Homo sapiens
tgtctgtctctcagtgttcttcg

SEQ ID NO: 137892 - DNA, 21 bp, Homo sapiens
agacaagaaactgacaaaaga

SEQ ID NO: 137893 - DNA, 22 bp, Homo sapiens
aatagcacaatctcggctcaca

SEQ ID NO: 137894 - DNA, 23 bp, Homo sapiens
agactctgtctgaaaaaaaccac

SEQ ID NO: 137895 - DNA, 23 bp, Homo sapiens
tgagatggagtctctctctgtca

SEQ ID NO: 137896 - DNA, 23 bp, Homo sapiens
gggtctcactctgtcacccaggc

SEQ ID NO: 137897 - DNA, 23 bp, Homo sapiens
tgagttcattgtagattctggat

SEQ ID NO: 137898 - DNA, 23 bp, Homo sapiens
tgagttcattgtagattctggat

SEQ ID NO: 137899 - DNA, 23 bp, Homo sapiens
tagtgatttgttttgaagcttac

SEQ ID NO: 137900 - DNA, 19 bp, Homo sapiens
gtctccctctgtcactcag

SEQ ID NO: 137901 - DNA, 18 bp, Homo sapiens
gggttgtttatggaatgt

SEQ ID NO: 137902 - DNA, 22 bp, Homo sapiens
tctgtgtcagtgtgttactgca

SEQ ID NO: 137903 - DNA, 21 bp, Homo sapiens
tggagaaggagggctcctgaa

SEQ ID NO: 137904 - DNA, 23 bp, Homo sapiens
ctctgttttggtttcatatgaat

SEQ ID NO: 137905 - DNA, 20 bp, Homo sapiens
atatccatatatattccata

SEQ ID NO: 137906 - DNA, 21 bp, Homo sapiens
attgattcaatacctaacctt

SEQ ID NO: 137907 - DNA, 23 bp, Homo sapiens
tgagttcattgtagattctggat

SEQ ID NO: 137908 - DNA, 23 bp, Homo sapiens
tgagttcattgtagattctggat

SEQ ID NO: 137909 - DNA, 23 bp, Homo sapiens
tgagtggaattctattctataga

SEQ ID NO: 137910 - DNA, 22 bp, Homo sapiens
aactgctgatatgtgttggagt

SEQ ID NO: 137911 - DNA, 23 bp, Homo sapiens
tctcagtatcacattttagtaat

SEQ ID NO: 137912 - DNA, 23 bp, Homo sapiens
ttgacattactattgtaattgtt

SEQ ID NO: 137913 - DNA, 23 bp, Homo sapiens
tggagtctcactctgtcacccag

SEQ ID NO: 137914 - DNA, 23 bp, Homo sapiens
ggtctcactgtgtcacccaaact

SEQ ID NO: 137915 - DNA, 20 bp, Homo sapiens
tcactggagacttcagagtg

SEQ ID NO: 137916 - DNA, 21 bp, Homo sapiens
tgtcagatgtgactgtggtga

SEQ ID NO: 137917 - DNA, 23 bp, Homo sapiens
tgtgtgtgtgcatgtgcatgtgt

SEQ ID NO: 137918 - DNA, 23 bp, Homo sapiens
atttttagtagaggctgtgtttc

SEQ ID NO: 137919 - DNA, 19 bp, Homo sapiens
ctctgatctctttctgtca

SEQ ID NO: 137920 - DNA, 23 bp, Homo sapiens
tgagttcattgtagattctggat

SEQ ID NO: 137921 - DNA, 23 bp, Homo sapiens
tgagttcattgtagattctggat

SEQ ID NO: 137922 - DNA, 21 bp, Homo sapiens
tagtctcagctactcatgagg

SEQ ID NO: 137923 - DNA, 23 bp, Homo sapiens
tatgtacatatatatagtgtctc

SEQ ID NO: 137924 - DNA, 18 bp, Homo sapiens
tgatatggtttggctgtg

SEQ ID NO: 137925 - DNA, 23 bp, Homo sapiens
tgtgtgtatatatatgtgtgtgt

SEQ ID NO: 137926 - DNA, 22 bp, Homo sapiens
taaaggtatacacaatgtgtac

SEQ ID NO: 137927 - DNA, 23 bp, Homo sapiens
atatatgtatgtatacatatatg

SEQ ID NO: 137928 - DNA, 23 bp, Homo sapiens
tctttgtcagaagagggtgagca

SEQ ID NO: 137929 - DNA, 22 bp, Homo sapiens
tctatgtataagatcatgttgt

SEQ ID NO: 137930 - DNA, 23 bp, Homo sapiens
agacagtctcactctgtcaccca

SEQ ID NO: 137931 - DNA, 23 bp, Homo sapiens
cacagtctcactctgtcacccag

SEQ ID NO: 137932 - DNA, 23 bp, Homo sapiens
gtgtgtgtgcataccatttcata

SEQ ID NO: 137933 - DNA, 23 bp, Homo sapiens
gagatagtctccctctgtcaccc

SEQ ID NO: 137934 - DNA, 23 bp, Homo sapiens
cagagtctcactctgtcatccag

SEQ ID NO: 137935 - DNA, 21 bp, Homo sapiens
tgaggtaggaggatcacttga

SEQ ID NO: 137936 - DNA, 23 bp, Homo sapiens
aatagcaagagtttgacagttct

SEQ ID NO: 137937 - DNA, 23 bp, Homo sapiens
ttttttgattagctaagtgtggt

SEQ ID NO: 137938 - DNA, 23 bp, Homo sapiens
tttgagacggagtctggctctgt

SEQ ID NO: 137939 - DNA, 23 bp, Homo sapiens
tgtaaattggaaagaagtctgtt

SEQ ID NO: 137940 - DNA, 21 bp, Homo sapiens
taaatgtagatatttatacgt

SEQ ID NO: 137941 - DNA, 23 bp, Homo sapiens
tatgtatgtatatcatatgtata

SEQ ID NO: 137942 - DNA, 18 bp, Homo sapiens
ttaccttctgaaaggaga

SEQ ID NO: 137943 - DNA, 21 bp, Homo sapiens
tgttggaaatggaagtattct

SEQ ID NO: 137944 - DNA, 22 bp, Homo sapiens
tttcagcatttgattgctatgt

SEQ ID NO: 137945 - DNA, 19 bp, Homo sapiens
gccagaagtttgagaccag

SEQ ID NO: 137946 - DNA, 23 bp, Homo sapiens
ttttgagacaggttctcactctg

SEQ ID NO: 137947 - DNA, 21 bp, Homo sapiens
cataagcaaatcatggcatag

SEQ ID NO: 137948 - DNA, 23 bp, Homo sapiens
agtttcgctattgttgctcaggc

SEQ ID NO: 137949 - DNA, 23 bp, Homo sapiens
tatatgtatgtatgtatatgtgt

SEQ ID NO: 137950 - DNA, 22 bp, Homo sapiens
agtgaacatatatattcatgta

SEQ ID NO: 137951 - DNA, 23 bp, Homo sapiens
aaatcaggatatataatgaaata

SEQ ID NO: 137952 - DNA, 21 bp, Homo sapiens
ttatgtttgcctttcctctct

SEQ ID NO: 137953 - DNA, 20 bp, Homo sapiens
attcagaatggaaaggatat

SEQ ID NO: 137954 - DNA, 18 bp, Homo sapiens
acaaggagcaatccttat

SEQ ID NO: 137955 - DNA, 23 bp, Homo sapiens
atagtcatcatcttgcatttgtt

SEQ ID NO: 137956 - DNA, 22 bp, Homo sapiens
ttgtacttgtagacctggtctg

SEQ ID NO: 137957 - DNA, 23 bp, Homo sapiens
ttataccttgatgaagacttgaa

SEQ ID NO: 137958 - DNA, 20 bp, Homo sapiens
tgactgtttatgtctttgct

SEQ ID NO: 137959 - DNA, 23 bp, Homo sapiens
tggagtctcactctgtcacccag

SEQ ID NO: 137960 - DNA, 21 bp, Homo sapiens
tggatgataattgatatatgt

SEQ ID NO: 137961 - DNA, 21 bp, Homo sapiens
aatgtatagatatctatgtgt

SEQ ID NO: 137962 - DNA, 23 bp, Homo sapiens
ttataaggtgctttatgtttata

SEQ ID NO: 137963 - DNA, 21 bp, Homo sapiens
aaggacatgataaagagagtg

SEQ ID NO: 137964 - DNA, 23 bp, Homo sapiens
tctctctctctctgtaaaagagg

SEQ ID NO: 137965 - DNA, 21 bp, Homo sapiens
tctgtttcagagggtggctgt

SEQ ID NO: 137966 - DNA, 23 bp, Homo sapiens
taagtatttctatatatgactga

SEQ ID NO: 137967 - DNA, 23 bp, Homo sapiens
taaggcagttcatagtaatctgt

SEQ ID NO: 137968 - DNA, 23 bp, Homo sapiens
tgagttcattgtagattctggat

SEQ ID NO: 137969 - DNA, 23 bp, Homo sapiens
tgagttcattgtagattctggat

SEQ ID NO: 137970 - DNA, 21 bp, Homo sapiens
atcagagcaaacttatatgtg

SEQ ID NO: 137971 - DNA, 23 bp, Homo sapiens
ttatctgtattgcaaaatggaat

SEQ ID NO: 137972 - DNA, 23 bp, Homo sapiens
ttagatctggattttttttttca

SEQ ID NO: 137973 - DNA, 18 bp, Homo sapiens
actctctctgccaggttt

SEQ ID NO: 137974 - DNA, 22 bp, Homo sapiens
tagtctgtctgttactcagtcc

SEQ ID NO: 137975 - DNA, 18 bp, Homo sapiens
tttggtataagtatgtcc

SEQ ID NO: 137976 - DNA, 23 bp, Homo sapiens
tgagttcattgtagattctggat

SEQ ID NO: 137977 - DNA, 23 bp, Homo sapiens
tgagttcattgtagattctggat

SEQ ID NO: 137978 - DNA, 18 bp, Homo sapiens
tatatatatgtatagata

SEQ ID NO: 137979 - DNA, 23 bp, Homo sapiens
attgtatacaaaatgatgttttg

SEQ ID NO: 137980 - DNA, 19 bp, Homo sapiens
aatatgtatttagacattg

SEQ ID NO: 137981 - DNA, 22 bp, Homo sapiens
acaagtggttttcagttacatg

SEQ ID NO: 137982 - DNA, 20 bp, Homo sapiens
tgtgtgtgtgtgtgtatata

SEQ ID NO: 137983 - DNA, 23 bp, Homo sapiens
tcttgtgctattgtttggagaga

SEQ ID NO: 137984 - DNA, 23 bp, Homo sapiens
tgcatttcttacataacttttcc

SEQ ID NO: 137985 - DNA, 20 bp, Homo sapiens
gacaggctcagtggcagtgt

SEQ ID NO: 137986 - DNA, 23 bp, Homo sapiens
ataacagtgcggtaattttgtgt

SEQ ID NO: 137987 - DNA, 21 bp, Homo sapiens
catatgtatgtttaattatga

SEQ ID NO: 137988 - DNA, 23 bp, Homo sapiens
tttaggacaaattggattgtgga

SEQ ID NO: 137989 - DNA, 23 bp, Homo sapiens
ttttttttccttttcataggaaa

SEQ ID NO: 137990 - DNA, 21 bp, Homo sapiens
tttgtcctagaggatgaggtt

SEQ ID NO: 137991 - DNA, 19 bp, Homo sapiens
ataggtttcatatatatgt

SEQ ID NO: 137992 - DNA, 22 bp, Homo sapiens
gtgctcactcacacactcactc

SEQ ID NO: 137993 - DNA, 22 bp, Homo sapiens
taaagaggttatagaaatggat

SEQ ID NO: 137994 - DNA, 23 bp, Homo sapiens
agatagagtttcgctcttgttgt

SEQ ID NO: 137995 - DNA, 22 bp, Homo sapiens
atagcatatagtagttctcttc

SEQ ID NO: 137996 - DNA, 23 bp, Homo sapiens
tggttgtaagactgtggggtaac

SEQ ID NO: 137997 - DNA, 22 bp, Homo sapiens
tatatatgtactatatatggtg

SEQ ID NO: 137998 - DNA, 19 bp, Homo sapiens
tctctctatatatagatgt

SEQ ID NO: 137999 - DNA, 23 bp, Homo sapiens
actggatcctctgtctgcctgtc

SEQ ID NO: 138000 - DNA, 19 bp, Homo sapiens
actacctttctttttgtgt

SEQ ID NO: 138001 - DNA, 23 bp, Homo sapiens
tatatgtgtatatatatgtgtgt

SEQ ID NO: 138002 - DNA, 23 bp, Homo sapiens
tatgtgtatatatacatatgtgt

SEQ ID NO: 138003 - DNA, 21 bp, Homo sapiens
tgtgtatatatacatatatgt

SEQ ID NO: 138004 - DNA, 19 bp, Homo sapiens
atatctatgtatatcatat

SEQ ID NO: 138005 - DNA, 23 bp, Homo sapiens
aagcacattgcctattgtatgta

SEQ ID NO: 138006 - DNA, 22 bp, Homo sapiens
ctctcattgtgttgttagctgg

SEQ ID NO: 138007 - DNA, 23 bp, Homo sapiens
aaattctgaatatgttattgtca

SEQ ID NO: 138008 - DNA, 21 bp, Homo sapiens
tttctctctctttcatagtcc

SEQ ID NO: 138009 - DNA, 23 bp, Homo sapiens
taccactgtgggagtatagtctg

SEQ ID NO: 138010 - DNA, 23 bp, Homo sapiens
actttcttctggtactgctggga

SEQ ID NO: 138011 - DNA, 23 bp, Homo sapiens
gcctgagatatgtttatgtactt

SEQ ID NO: 138012 - DNA, 23 bp, Homo sapiens
tacatgtgcattacaaaaggtac

SEQ ID NO: 138013 - DNA, 19 bp, Homo sapiens
tttcagaatttgtttttct

SEQ ID NO: 138014 - DNA, 22 bp, Homo sapiens
agaatcagaaactccatgtgtg

SEQ ID NO: 138015 - DNA, 20 bp, Homo sapiens
ctgtagattcagatgcagtt

SEQ ID NO: 138016 - DNA, 23 bp, Homo sapiens
tatctgacgtacattggtgtatt

SEQ ID NO: 138017 - DNA, 19 bp, Homo sapiens
aatagacagaagaaagata

SEQ ID NO: 138018 - DNA, 18 bp, Homo sapiens
tttaattttttgtgattc

SEQ ID NO: 138019 - DNA, 19 bp, Homo sapiens
tttgagtgatgacagatag

SEQ ID NO: 138020 - DNA, 23 bp, Homo sapiens
tgagttcattgtagattctggat

SEQ ID NO: 138021 - DNA, 23 bp, Homo sapiens
tgagttcattgtagattctggat

SEQ ID NO: 138022 - DNA, 22 bp, Homo sapiens
ctcgctctgtcacacaggctgg

SEQ ID NO: 138023 - DNA, 20 bp, Homo sapiens
tgagtagaaccaaagaatat

SEQ ID NO: 138024 - DNA, 19 bp, Homo sapiens
tgtatgtgtgtatatatgc

SEQ ID NO: 138025 - DNA, 19 bp, Homo sapiens
tctgctggaatatgtggcg

SEQ ID NO: 138026 - DNA, 18 bp, Homo sapiens
aggctacagtgagcctga

SEQ ID NO: 138027 - DNA, 22 bp, Homo sapiens
aaatggacattttcctgaggca

SEQ ID NO: 138028 - DNA, 23 bp, Homo sapiens
tctctgactgactccttcccaga

SEQ ID NO: 138029 - DNA, 20 bp, Homo sapiens
agtgtgtgtgtgtgcaggtg

SEQ ID NO: 138030 - DNA, 23 bp, Homo sapiens
tgttgtgtgtatatatgtgtgtg

SEQ ID NO: 138031 - DNA, 23 bp, Homo sapiens
tgagttcattgtagattctggat

SEQ ID NO: 138032 - DNA, 23 bp, Homo sapiens
tgagttcattgtagattctggat

SEQ ID NO: 138033 - DNA, 23 bp, Homo sapiens
tgagttcattgtagattctggat

SEQ ID NO: 138034 - DNA, 23 bp, Homo sapiens
tgagttcattgtagattctggat

SEQ ID NO: 138035 - DNA, 22 bp, Homo sapiens
tatatgtatttgtatatacgtg

SEQ ID NO: 138036 - DNA, 21 bp, Homo sapiens
atgtgtatatatttatgtgtg

SEQ ID NO: 138037 - DNA, 22 bp, Homo sapiens
tgtgtatatatatgcatatgtg

SEQ ID NO: 138038 - DNA, 23 bp, Homo sapiens
taggaacatttgaaagctgatat

SEQ ID NO: 138039 - DNA, 22 bp, Homo sapiens
ataaagtttgtgacaaaagttg

SEQ ID NO: 138040 - DNA, 18 bp, Homo sapiens
atatttatctagcttact

SEQ ID NO: 138041 - DNA, 22 bp, Homo sapiens
tttaggagtggaactgctggga

SEQ ID NO: 138042 - DNA, 20 bp, Homo sapiens
tcatatgattcatatatatg

SEQ ID NO: 138043 - DNA, 21 bp, Homo sapiens
ttatgtcagtttcatacttag

SEQ ID NO: 138044 - DNA, 18 bp, Homo sapiens
ttcctcatttgtaacatg

SEQ ID NO: 138045 - DNA, 23 bp, Homo sapiens
ttttgagaatttcttattctgag

SEQ ID NO: 138046 - DNA, 23 bp, Homo sapiens
tctgtgtctcagtttctttcttg

SEQ ID NO: 138047 - DNA, 23 bp, Homo sapiens
gagtgtgcatgagatgagaggtg

SEQ ID NO: 138048 - DNA, 21 bp, Homo sapiens
atgctggcttttgtttgtgaa

SEQ ID NO: 138049 - DNA, 23 bp, Homo sapiens
tgagttcattgtagattctggat

SEQ ID NO: 138050 - DNA, 23 bp, Homo sapiens
tgagttcattgtagattctggat

SEQ ID NO: 138051 - DNA, 20 bp, Homo sapiens
aaaatgaccagatagagcag

SEQ ID NO: 138052 - DNA, 19 bp, Homo sapiens
gccgttttcattcattttc

SEQ ID NO: 138053 - DNA, 23 bp, Homo sapiens
tgagttcattgtagattctggat

SEQ ID NO: 138054 - DNA, 23 bp, Homo sapiens
tgagttcattgtagattctggat

SEQ ID NO: 138055 - DNA, 23 bp, Homo sapiens
tgtatatgtatatgtatatgtat

SEQ ID NO: 138056 - DNA, 23 bp, Homo sapiens
aagctgagtttagattttgttgt

SEQ ID NO: 138057 - DNA, 23 bp, Homo sapiens
ccaatggtgtcactctcagtctg

SEQ ID NO: 138058 - DNA, 18 bp, Homo sapiens
tgcttgtcatattcatat

SEQ ID NO: 138059 - DNA, 23 bp, Homo sapiens
taatgtccgttagttttctgaaa

SEQ ID NO: 138060 - DNA, 23 bp, Homo sapiens
tattctctctggttgcttttagt

SEQ ID NO: 138061 - DNA, 19 bp, Homo sapiens
tatagagtttttgaaggtg

SEQ ID NO: 138062 - DNA, 20 bp, Homo sapiens
tttctgttagcttatgtact

SEQ ID NO: 138063 - DNA, 23 bp, Homo sapiens
gactgactgaagagagtcaggtg

SEQ ID NO: 138064 - DNA, 22 bp, Homo sapiens
tctgagaaactggagatggtga

SEQ ID NO: 138065 - DNA, 23 bp, Homo sapiens
tgagtgaggttttcaatttcaga

SEQ ID NO: 138066 - DNA, 19 bp, Homo sapiens
ggctggctgggtgggtgct

SEQ ID NO: 138067 - DNA, 21 bp, Homo sapiens
aggcagagataaaagagcaaa

SEQ ID NO: 138068 - DNA, 23 bp, Homo sapiens
tgacagcaaaaagataccagtct

SEQ ID NO: 138069 - DNA, 19 bp, Homo sapiens
ggactggataaagaaaatg

SEQ ID NO: 138070 - DNA, 19 bp, Homo sapiens
gaattacacttagcaactg

SEQ ID NO: 138071 - DNA, 23 bp, Homo sapiens
tatgtcaatgtattgcttactca

SEQ ID NO: 138072 - DNA, 23 bp, Homo sapiens
tgacaggagacagagttcaggca

SEQ ID NO: 138073 - DNA, 23 bp, Homo sapiens
cacacacgtatatatatatgtat

SEQ ID NO: 138074 - DNA, 20 bp, Homo sapiens
gtgtatatatatatgtgtgt

SEQ ID NO: 138075 - DNA, 23 bp, Homo sapiens
tacacgtatatatatgtatgtgt

SEQ ID NO: 138076 - DNA, 23 bp, Homo sapiens
atatacgtatatatacgtgtatg

SEQ ID NO: 138077 - DNA, 23 bp, Homo sapiens
ggagtctcactctgtcacccagc

SEQ ID NO: 138078 - DNA, 22 bp, Homo sapiens
ttgagatggagtctcactgtgt

SEQ ID NO: 138079 - DNA, 23 bp, Homo sapiens
tgagttcattgtagattctggat

SEQ ID NO: 138080 - DNA, 23 bp, Homo sapiens
tgagttcattgtagattctggat

SEQ ID NO: 138081 - DNA, 23 bp, Homo sapiens
tgttctctctgcctgactgctgt

SEQ ID NO: 138082 - DNA, 23 bp, Homo sapiens
tgagttcattgtagattctggat

SEQ ID NO: 138083 - DNA, 23 bp, Homo sapiens
tgagttcattgtagattctggat

SEQ ID NO: 138084 - DNA, 21 bp, Homo sapiens
gtaagtgctatgtttttgtgg

SEQ ID NO: 138085 - DNA, 23 bp, Homo sapiens
ttcaggttcttttgtgattctat

SEQ ID NO: 138086 - DNA, 20 bp, Homo sapiens
tagtcatccctttcagatgt

SEQ ID NO: 138087 - DNA, 23 bp, Homo sapiens
aactagaaaaaggcaatagatgg

SEQ ID NO: 138088 - DNA, 20 bp, Homo sapiens
actgtcattttctctgtctt

SEQ ID NO: 138089 - DNA, 23 bp, Homo sapiens
actgtctgtctctcattgctgag

SEQ ID NO: 138090 - DNA, 23 bp, Homo sapiens
agagcagggactgacagaagtgt

SEQ ID NO: 138091 - DNA, 20 bp, Homo sapiens
actctgcctctgtcaggcct

SEQ ID NO: 138092 - DNA, 23 bp, Homo sapiens
atatgtgtgtatatatatacatg

SEQ ID NO: 138093 - DNA, 23 bp, Homo sapiens
atatgtatgtatatatatgtatg

SEQ ID NO: 138094 - DNA, 22 bp, Homo sapiens
tatacgtatatatacatacgtg

SEQ ID NO: 138095 - DNA, 19 bp, Homo sapiens
tacacacatatgtgtgtat

SEQ ID NO: 138096 - DNA, 23 bp, Homo sapiens
tacacacatatgtgtgtatatat

SEQ ID NO: 138097 - DNA, 22 bp, Homo sapiens
tatgtgtgtatatatatacatg

SEQ ID NO: 138098 - DNA, 23 bp, Homo sapiens
gagtctcactctgtcacccaggc

SEQ ID NO: 138099 - DNA, 23 bp, Homo sapiens
tgtgacagcttcttgatctgtcc

SEQ ID NO: 138100 - DNA, 23 bp, Homo sapiens
agatttctttcttaagtgtaaga

SEQ ID NO: 138101 - DNA, 23 bp, Homo sapiens
ttagtatgttgaatacaatacat

SEQ ID NO: 138102 - DNA, 23 bp, Homo sapiens
agtcagtgcttttcaagctgatt

SEQ ID NO: 138103 - DNA, 23 bp, Homo sapiens
atacaaagtatatgtatatacgt

SEQ ID NO: 138104 - DNA, 23 bp, Homo sapiens
atatacaatgtgtgtatgtgtgt

SEQ ID NO: 138105 - DNA, 23 bp, Homo sapiens
atggagtctcactctgtcaccca

SEQ ID NO: 138106 - DNA, 22 bp, Homo sapiens
gagtctcactctgtcacccagg

SEQ ID NO: 138107 - DNA, 23 bp, Homo sapiens
gtgcttacaggttgattagagat

SEQ ID NO: 138108 - DNA, 23 bp, Homo sapiens
tgtgacagcttcttgatctgtcc

SEQ ID NO: 138109 - DNA, 23 bp, Homo sapiens
agtctgtcagctcagcttgttct

SEQ ID NO: 138110 - DNA, 23 bp, Homo sapiens
taagtgagtagagtgacaggaga

SEQ ID NO: 138111 - DNA, 23 bp, Homo sapiens
attgtggttttgatttgcatttc

SEQ ID NO: 138112 - DNA, 20 bp, Homo sapiens
tcacagtccaatcaaattag

SEQ ID NO: 138113 - DNA, 23 bp, Homo sapiens
ttgagacagagtcttactctgtc

SEQ ID NO: 138114 - DNA, 21 bp, Homo sapiens
acaagaggtttttatgttgtt

SEQ ID NO: 138115 - DNA, 23 bp, Homo sapiens
tacccagtgtcaggtatgtcttt

SEQ ID NO: 138116 - DNA, 23 bp, Homo sapiens
tcttggtgttgtaagttctatgg

SEQ ID NO: 138117 - DNA, 23 bp, Homo sapiens
tgagttcattgtagattctggat

SEQ ID NO: 138118 - DNA, 23 bp, Homo sapiens
tgagttcattgtagattctggat

SEQ ID NO: 138119 - DNA, 18 bp, Homo sapiens
agagctcaatattccttt

SEQ ID NO: 138120 - DNA, 19 bp, Homo sapiens
gtagagtcagtagaatgca

SEQ ID NO: 138121 - DNA, 19 bp, Homo sapiens
ttactacatgtagtcttat

SEQ ID NO: 138122 - DNA, 23 bp, Homo sapiens
gattttaatgtagtatgttcatg

SEQ ID NO: 138123 - DNA, 23 bp, Homo sapiens
ttgagagatcttcctgtatgctt

SEQ ID NO: 138124 - DNA, 19 bp, Homo sapiens
acctgcttaaagagaagat

SEQ ID NO: 138125 - DNA, 22 bp, Homo sapiens
tagagacagggtctcactctgt

SEQ ID NO: 138126 - DNA, 19 bp, Homo sapiens
atgtaggcacaagaaatga

SEQ ID NO: 138127 - DNA, 23 bp, Homo sapiens
ttattcaaggctttgtattgctc

SEQ ID NO: 138128 - DNA, 23 bp, Homo sapiens
atgaatgtattgaagtgtgcagg

SEQ ID NO: 138129 - DNA, 20 bp, Homo sapiens
tgtgtatgtgtatatgggag

SEQ ID NO: 138130 - DNA, 18 bp, Homo sapiens
aagacacattgtcttccg

SEQ ID NO: 138131 - DNA, 23 bp, Homo sapiens
gtagtttcattgtatttcttttg

SEQ ID NO: 138132 - DNA, 22 bp, Homo sapiens
tatttgtatatatgtatacgta

SEQ ID NO: 138133 - DNA, 18 bp, Homo sapiens
atatgtatacgtatacat

SEQ ID NO: 138134 - DNA, 23 bp, Homo sapiens
actggaagagcttagaggtacct

SEQ ID NO: 138135 - DNA, 23 bp, Homo sapiens
aatcacagtgtctcttctcttta

SEQ ID NO: 138136 - DNA, 23 bp, Homo sapiens
gttctgtggcttttgacttacac

SEQ ID NO: 138137 - DNA, 23 bp, Homo sapiens
tttcatatatttttgctatgtgt

SEQ ID NO: 138138 - DNA, 23 bp, Homo sapiens
acagagctgtgtgtgaacagagg

SEQ ID NO: 138139 - DNA, 23 bp, Homo sapiens
tagagcttcaagtaaacaatcct

SEQ ID NO: 138140 - DNA, 23 bp, Homo sapiens
ctactgcaactggaactgttttg

SEQ ID NO: 138141 - DNA, 23 bp, Homo sapiens
tgagatgagcctgatgacatcat

SEQ ID NO: 138142 - DNA, 22 bp, Homo sapiens
taaacatcctggagtgtgattg

SEQ ID NO: 138143 - DNA, 23 bp, Homo sapiens
tgttactcatctcagaatgatct

SEQ ID NO: 138144 - DNA, 23 bp, Homo sapiens
ataatgtacgacatgatgcttag

SEQ ID NO: 138145 - DNA, 23 bp, Homo sapiens
agagtctcactctgtcacccagg

SEQ ID NO: 138146 - DNA, 19 bp, Homo sapiens
tctgagactgtggtcaccc

SEQ ID NO: 138147 - DNA, 23 bp, Homo sapiens
taatttgtatatgtatatatgtg

SEQ ID NO: 138148 - DNA, 23 bp, Homo sapiens
taatgtgtatatgtatatatgtg

SEQ ID NO: 138149 - DNA, 22 bp, Homo sapiens
ttatatgtgtgtatgtatatgt

SEQ ID NO: 138150 - DNA, 23 bp, Homo sapiens
agtgttcatatgtatataggtgt

SEQ ID NO: 138151 - DNA, 20 bp, Homo sapiens
atgtgtatatgtatatgtgt

SEQ ID NO: 138152 - DNA, 23 bp, Homo sapiens
tgtgtgtgtgtatgtatatgtgt

SEQ ID NO: 138153 - DNA, 23 bp, Homo sapiens
aatgtgtatatgaatatatgtgt

SEQ ID NO: 138154 - DNA, 23 bp, Homo sapiens
tgtgtgtgtctatgtgtgtgtgt

SEQ ID NO: 138155 - DNA, 22 bp, Homo sapiens
atatacgtatatatacgtgtat

SEQ ID NO: 138156 - DNA, 21 bp, Homo sapiens
tgagatctgagagtggacaga

SEQ ID NO: 138157 - DNA, 23 bp, Homo sapiens
ttctggaggctgtcattggctaa

SEQ ID NO: 138158 - DNA, 20 bp, Homo sapiens
tttactcttgataatgtaca

SEQ ID NO: 138159 - DNA, 23 bp, Homo sapiens
aaaacttgaagcttgttttgttt

SEQ ID NO: 138160 - DNA, 21 bp, Homo sapiens
tggatagatatatatggatat

SEQ ID NO: 138161 - DNA, 23 bp, Homo sapiens
tatgtccatatatatagatatat

SEQ ID NO: 138162 - DNA, 23 bp, Homo sapiens
tatgtccatatatatagatatat

SEQ ID NO: 138163 - DNA, 23 bp, Homo sapiens
tatgtccatatatatagatatct

SEQ ID NO: 138164 - DNA, 23 bp, Homo sapiens
tgagttcattgtagattctggat

SEQ ID NO: 138165 - DNA, 23 bp, Homo sapiens
tgagttcattgtagattctggat

SEQ ID NO: 138166 - DNA, 23 bp, Homo sapiens
gacagtcacactctgtcatccag

SEQ ID NO: 138167 - DNA, 20 bp, Homo sapiens
acagtggtgtgatctcagct

SEQ ID NO: 138168 - DNA, 22 bp, Homo sapiens
atatgtatatatgtatatatgt

SEQ ID NO: 138169 - DNA, 23 bp, Homo sapiens
atatgtatatatatgtgtgtgta

SEQ ID NO: 138170 - DNA, 18 bp, Homo sapiens
atgtgtatgtatatgtat

SEQ ID NO: 138171 - DNA, 23 bp, Homo sapiens
tagaagtgcatggtgtgatctta

SEQ ID NO: 138172 - DNA, 21 bp, Homo sapiens
agatgtgttacattactgtaa

SEQ ID NO: 138173 - DNA, 21 bp, Homo sapiens
atacattatatgtatatatat

SEQ ID NO: 138174 - DNA, 22 bp, Homo sapiens
ggaagtttagtaatgggtatga

SEQ ID NO: 138175 - DNA, 19 bp, Homo sapiens
aaatgttttttaaaatgag

SEQ ID NO: 138176 - DNA, 23 bp, Homo sapiens
atatggtttgatatgaatacatt

SEQ ID NO: 138177 - DNA, 21 bp, Homo sapiens
gtctgtctctctctcttatat

SEQ ID NO: 138178 - DNA, 22 bp, Homo sapiens
taggcaagatgtttgaggagag

SEQ ID NO: 138179 - DNA, 23 bp, Homo sapiens
tatgtgtatttatatatgtgtgt

SEQ ID NO: 138180 - DNA, 23 bp, Homo sapiens
tatatgtatgtatatatgtatac

SEQ ID NO: 138181 - DNA, 23 bp, Homo sapiens
atgtgtgtgtgtatctgtgtgtc

SEQ ID NO: 138182 - DNA, 23 bp, Homo sapiens
tgagttcattgtagattctggat

SEQ ID NO: 138183 - DNA, 23 bp, Homo sapiens
tgagttcattgtagattctggat

SEQ ID NO: 138184 - DNA, 23 bp, Homo sapiens
agggtctcactgtgtcacccagg

SEQ ID NO: 138185 - DNA, 23 bp, Homo sapiens
gggtacatgtgcacaatgtgcag

SEQ ID NO: 138186 - DNA, 23 bp, Homo sapiens
tgttaagacacagatatgaatag

SEQ ID NO: 138187 - DNA, 22 bp, Homo sapiens
atatgggtgttcattgggctgt

SEQ ID NO: 138188 - DNA, 23 bp, Homo sapiens
atgtcaatatatatatatgacta

SEQ ID NO: 138189 - DNA, 23 bp, Homo sapiens
acagagtctcactctgtcgccca

SEQ ID NO: 138190 - DNA, 23 bp, Homo sapiens
agtgagaggtacaattctataca

SEQ ID NO: 138191 - DNA, 23 bp, Homo sapiens
atatgtgtgtatatatatgtgtg

SEQ ID NO: 138192 - DNA, 23 bp, Homo sapiens
atatacacacaaatatacatgtg

SEQ ID NO: 138193 - DNA, 18 bp, Homo sapiens
tgacaagcacatgccatg

SEQ ID NO: 138194 - DNA, 19 bp, Homo sapiens
gagcacagagtgaacattc

SEQ ID NO: 138195 - DNA, 21 bp, Homo sapiens
tgagacagagtttcactcttt

SEQ ID NO: 138196 - DNA, 23 bp, Homo sapiens
ttctgtgaagaaagtcaatggta

SEQ ID NO: 138197 - DNA, 18 bp, Homo sapiens
aaggcactgagactgaac

SEQ ID NO: 138198 - DNA, 19 bp, Homo sapiens
tgccagggtgcctgtctcc

SEQ ID NO: 138199 - DNA, 22 bp, Homo sapiens
agctgcagaacagcctccagag

SEQ ID NO: 138200 - DNA, 23 bp, Homo sapiens
tccctctgtccctgactgcctgg

SEQ ID NO: 138201 - DNA, 23 bp, Homo sapiens
gacagagtctcgctctgtcaccc

SEQ ID NO: 138202 - DNA, 23 bp, Homo sapiens
ttcacagtacttcatcaggttgt

SEQ ID NO: 138203 - DNA, 23 bp, Homo sapiens
atgaaacatggttctctgatgtt

SEQ ID NO: 138204 - DNA, 23 bp, Homo sapiens
gtgctcctgcagctgctcctgct

SEQ ID NO: 138205 - DNA, 22 bp, Homo sapiens
ggtatgtatgtatgtatgtgca

SEQ ID NO: 138206 - DNA, 23 bp, Homo sapiens
acagttgtaatgatgatgaagcc

SEQ ID NO: 138207 - DNA, 21 bp, Homo sapiens
aaatgctctcagtgaatgaac

SEQ ID NO: 138208 - DNA, 19 bp, Homo sapiens
ttactgaacagagtgtgca

SEQ ID NO: 138209 - DNA, 23 bp, Homo sapiens
tgagttcattgtagattctggat

SEQ ID NO: 138210 - DNA, 21 bp, Homo sapiens
tatgtagatgttcaggtgttc

SEQ ID NO: 138211 - DNA, 22 bp, Homo sapiens
tggtaattgcatgtttagtctt

SEQ ID NO: 138212 - DNA, 23 bp, Homo sapiens
acatagtgagaccctatgtccac

SEQ ID NO: 138213 - DNA, 23 bp, Homo sapiens
tttgagacggagtctcactctgt

SEQ ID NO: 138214 - DNA, 23 bp, Homo sapiens
ttgattttgtatcctgaaacatt

SEQ ID NO: 138215 - DNA, 21 bp, Homo sapiens
ttagggtttaccaggtataag

SEQ ID NO: 138216 - DNA, 21 bp, Homo sapiens
tgggaacaacattagctgttc

SEQ ID NO: 138217 - DNA, 23 bp, Homo sapiens
tgacagagaacagtgtgtgttca

SEQ ID NO: 138218 - DNA, 19 bp, Homo sapiens
tctctggctgtctcagtcc

SEQ ID NO: 138219 - DNA, 22 bp, Homo sapiens
tgtgacagcttcttgatctgtc

SEQ ID NO: 138220 - DNA, 23 bp, Homo sapiens
tttgcatctccttgaaatgtctt

SEQ ID NO: 138221 - DNA, 23 bp, Homo sapiens
atttgtctgcttttctctccata

SEQ ID NO: 138222 - DNA, 18 bp, Homo sapiens
tgaggtgggcagatcatg

SEQ ID NO: 138223 - DNA, 23 bp, Homo sapiens
attcagctagttgaagcaatcat

SEQ ID NO: 138224 - DNA, 23 bp, Homo sapiens
tggattctaaagaagaaaccaga

SEQ ID NO: 138225 - DNA, 23 bp, Homo sapiens
gcaactccaagacacataattgt

SEQ ID NO: 138226 - DNA, 23 bp, Homo sapiens
tgatcctgtgattatgatgttag

SEQ ID NO: 138227 - DNA, 23 bp, Homo sapiens
agagtctcactctgtcacccagg

SEQ ID NO: 138228 - DNA, 23 bp, Homo sapiens
gacggagtctcgctctgtcaccc

SEQ ID NO: 138229 - DNA, 23 bp, Homo sapiens
ttttgagacagactctccctgtc

SEQ ID NO: 138230 - DNA, 23 bp, Homo sapiens
tttctcacatagttccagtgagt

SEQ ID NO: 138231 - DNA, 19 bp, Homo sapiens
agacagggtctcactctgt

SEQ ID NO: 138232 - DNA, 22 bp, Homo sapiens
acttcaagtcttatctgtgctc

SEQ ID NO: 138233 - DNA, 22 bp, Homo sapiens
ataaagtgtcaggataactgct

SEQ ID NO: 138234 - DNA, 22 bp, Homo sapiens
atccagtcatcagttggaagcc

SEQ ID NO: 138235 - DNA, 21 bp, Homo sapiens
gtggctgcagactcagtgact

SEQ ID NO: 138236 - DNA, 23 bp, Homo sapiens
ccagtctctaaggttctgggtct

SEQ ID NO: 138237 - DNA, 23 bp, Homo sapiens
tggagtctcactctgtcacccag

SEQ ID NO: 138238 - DNA, 18 bp, Homo sapiens
tggaatggtaagtgaaca

SEQ ID NO: 138239 - DNA, 23 bp, Homo sapiens
tgagatgaagttttgttcttgtc

SEQ ID NO: 138240 - DNA, 21 bp, Homo sapiens
tttatgtatgtgtatatgtta

SEQ ID NO: 138241 - DNA, 23 bp, Homo sapiens
attcactttggtttggtagctga

SEQ ID NO: 138242 - DNA, 23 bp, Homo sapiens
ctcacatctgtctccctgtgctg

SEQ ID NO: 138243 - DNA, 23 bp, Homo sapiens
gatgagttcttactctgtcaccc

SEQ ID NO: 138244 - DNA, 20 bp, Homo sapiens
tcgtggtacagtctcagctc

SEQ ID NO: 138245 - DNA, 23 bp, Homo sapiens
ttctctcactctcagaaacacgt

SEQ ID NO: 138246 - DNA, 22 bp, Homo sapiens
aattcaatctctctttctctct

SEQ ID NO: 138247 - DNA, 20 bp, Homo sapiens
tgagcaaaagagtaacatga

SEQ ID NO: 138248 - DNA, 20 bp, Homo sapiens
ttttgagacggagtcttgct

SEQ ID NO: 138249 - DNA, 18 bp, Homo sapiens
ttcagacggagctgtaga

SEQ ID NO: 138250 - DNA, 23 bp, Homo sapiens
tgtctgcgtgtgtgcgtgtgtgt

SEQ ID NO: 138251 - DNA, 23 bp, Homo sapiens
agacagatgtgggtagtgtgtgg

SEQ ID NO: 138252 - DNA, 23 bp, Homo sapiens
tgagtcactgactctgtactttc

SEQ ID NO: 138253 - DNA, 23 bp, Homo sapiens
acatggtctcactctgtcaccca

SEQ ID NO: 138254 - DNA, 22 bp, Homo sapiens
attttttgaaatagcttgccac

SEQ ID NO: 138255 - DNA, 22 bp, Homo sapiens
taatcatactggatgtattctc

SEQ ID NO: 138256 - DNA, 20 bp, Homo sapiens
tgagtgtagacagacaggac

SEQ ID NO: 138257 - DNA, 21 bp, Homo sapiens
tgagcaaaatggttgagtata

SEQ ID NO: 138258 - DNA, 23 bp, Homo sapiens
tgagttcattgtagattctggat

SEQ ID NO: 138259 - DNA, 23 bp, Homo sapiens
tgagttcattgtagattctggat

SEQ ID NO: 138260 - DNA, 19 bp, Homo sapiens
aaacctttatatatatgtg

SEQ ID NO: 138261 - DNA, 22 bp, Homo sapiens
tgtgaagtgtctgtttatgtca

SEQ ID NO: 138262 - DNA, 23 bp, Homo sapiens
tgagttcattgtagattctggat

SEQ ID NO: 138263 - DNA, 23 bp, Homo sapiens
tgagttcattgtagattctggat

SEQ ID NO: 138264 - DNA, 23 bp, Homo sapiens
tagtatagtagtgttattgttct

SEQ ID NO: 138265 - DNA, 23 bp, Homo sapiens
ttcaaatgttctacatatttggt

SEQ ID NO: 138266 - DNA, 22 bp, Homo sapiens
ttaatctctaagtataattgtg

SEQ ID NO: 138267 - DNA, 23 bp, Homo sapiens
atagcctcatcagcatctgttgt

SEQ ID NO: 138268 - DNA, 23 bp, Homo sapiens
ataagtttggttatctatattat

SEQ ID NO: 138269 - DNA, 19 bp, Homo sapiens
tattatagataaatttggt

SEQ ID NO: 138270 - DNA, 21 bp, Homo sapiens
tttcacagtggctgaactaat

SEQ ID NO: 138271 - DNA, 18 bp, Homo sapiens
cctgtagtcctagctact

SEQ ID NO: 138272 - DNA, 21 bp, Homo sapiens
catgtatgtgtgtgtgtacta

SEQ ID NO: 138273 - DNA, 23 bp, Homo sapiens
tatatttgtatacacatacactc

SEQ ID NO: 138274 - DNA, 21 bp, Homo sapiens
atatgtatatatgttcataaa

SEQ ID NO: 138275 - DNA, 18 bp, Homo sapiens
tgaatatatgtatatatg

SEQ ID NO: 138276 - DNA, 20 bp, Homo sapiens
atatgtgtatgtgtatatat

SEQ ID NO: 138277 - DNA, 20 bp, Homo sapiens
tatgtgtatatatatatgtg

SEQ ID NO: 138278 - DNA, 21 bp, Homo sapiens
atatgtgtgtgtatatatgtg

SEQ ID NO: 138279 - DNA, 22 bp, Homo sapiens
tatgagtatatgtatatatgtg

SEQ ID NO: 138280 - DNA, 23 bp, Homo sapiens
atatgtgtatatgtatatatgtg

SEQ ID NO: 138281 - DNA, 23 bp, Homo sapiens
tacactatatatgtatatgtgtg

SEQ ID NO: 138282 - DNA, 22 bp, Homo sapiens
gtctcactctgactatgctccc

SEQ ID NO: 138283 - DNA, 19 bp, Homo sapiens
tagtattagagaaggaatt

SEQ ID NO: 138284 - DNA, 23 bp, Homo sapiens
atgttacagataattgtttgctg

SEQ ID NO: 138285 - DNA, 20 bp, Homo sapiens
catacatatgtatgtgtgca

SEQ ID NO: 138286 - DNA, 21 bp, Homo sapiens
taggagcagtgtttatttact

SEQ ID NO: 138287 - DNA, 23 bp, Homo sapiens
ctgggtgacagagtgagatcttg

SEQ ID NO: 138288 - DNA, 23 bp, Homo sapiens
gagatggagtttcgctcttgttg

SEQ ID NO: 138289 - DNA, 20 bp, Homo sapiens
tgagacagagtctcgctctg

SEQ ID NO: 138290 - DNA, 21 bp, Homo sapiens
ttaatggcttgagagcgcctt

SEQ ID NO: 138291 - DNA, 23 bp, Homo sapiens
gagtgaacagagtgagcacaggg

SEQ ID NO: 138292 - DNA, 23 bp, Homo sapiens
ttatgtcagggtcttgctctgtc

SEQ ID NO: 138293 - DNA, 20 bp, Homo sapiens
atacatacatatgcatacat

SEQ ID NO: 138294 - DNA, 23 bp, Homo sapiens
ttgaaagtggttgcctttagaga

SEQ ID NO: 138295 - DNA, 22 bp, Homo sapiens
atatgtatacatgcatatatat

SEQ ID NO: 138296 - DNA, 18 bp, Homo sapiens
tgtgcatatatgtaattt

SEQ ID NO: 138297 - DNA, 23 bp, Homo sapiens
gggtctcactctgtgactcaggc

SEQ ID NO: 138298 - DNA, 21 bp, Homo sapiens
agatcatgccattgcactcca

SEQ ID NO: 138299 - DNA, 23 bp, Homo sapiens
ctatgtgtgtgtctgtgtccccc

SEQ ID NO: 138300 - DNA, 23 bp, Homo sapiens
atgtgtgtgtgcatgcgtgcatg

SEQ ID NO: 138301 - DNA, 23 bp, Homo sapiens
tgtgcgtgtgtgcctgcgtgcgt

SEQ ID NO: 138302 - DNA, 19 bp, Homo sapiens
cggagtctcactctgtcgc

SEQ ID NO: 138303 - DNA, 23 bp, Homo sapiens
gatggagtctcgctctgtcactc

SEQ ID NO: 138304 - DNA, 22 bp, Homo sapiens
tgtgtgtgtctgcttgaaggtg

SEQ ID NO: 138305 - DNA, 23 bp, Homo sapiens
acctgccagtacttcagaatgta

SEQ ID NO: 138306 - DNA, 23 bp, Homo sapiens
tgtcagtctccgtgtctttactt

SEQ ID NO: 138307 - DNA, 22 bp, Homo sapiens
caaaggactggaccaaggctca

SEQ ID NO: 138308 - DNA, 23 bp, Homo sapiens
ttgtgttttagcttctgctcatc

SEQ ID NO: 138309 - DNA, 18 bp, Homo sapiens
acacacacactgtgcatc

SEQ ID NO: 138310 - DNA, 21 bp, Homo sapiens
tgctggtgcccactgacttgt

SEQ ID NO: 138311 - DNA, 19 bp, Homo sapiens
aaaagagagagaaaaagga

SEQ ID NO: 138312 - DNA, 23 bp, Homo sapiens
ttttgatatgtaactgtagatgt

SEQ ID NO: 138313 - DNA, 23 bp, Homo sapiens
atactgtatatgtatatgtattt

SEQ ID NO: 138314 - DNA, 18 bp, Homo sapiens
ttcagcattatcctatca

SEQ ID NO: 138315 - DNA, 23 bp, Homo sapiens
tatgtcctaattgatgtgataat

SEQ ID NO: 138316 - DNA, 23 bp, Homo sapiens
tttgagagaagtcttgctctgtc

SEQ ID NO: 138317 - DNA, 21 bp, Homo sapiens
tgtccttgcatctatgcctgg

SEQ ID NO: 138318 - DNA, 22 bp, Homo sapiens
ctcacagactctgtctaacccc

SEQ ID NO: 138319 - DNA, 23 bp, Homo sapiens
aaatgtgtatgtatttatgtgtg

SEQ ID NO: 138320 - DNA, 23 bp, Homo sapiens
agacatctatacataagatctat

SEQ ID NO: 138321 - DNA, 20 bp, Homo sapiens
attatctaatgagagtgtag

SEQ ID NO: 138322 - DNA, 20 bp, Homo sapiens
tgtgctactaagttctaaag

SEQ ID NO: 138323 - DNA, 23 bp, Homo sapiens
tttctgttaagaacatatagcaa

SEQ ID NO: 138324 - DNA, 23 bp, Homo sapiens
ctgtctctgtgtgtgtgtgtata

SEQ ID NO: 138325 - DNA, 21 bp, Homo sapiens
gcagtgttggctcaaggtcat

SEQ ID NO: 138326 - DNA, 23 bp, Homo sapiens
actggctggctctgtgcctgcca

SEQ ID NO: 138327 - DNA, 23 bp, Homo sapiens
ggctagagttgtaatcacaacct

SEQ ID NO: 138328 - DNA, 23 bp, Homo sapiens
atatgcatatatatacgtgtgtg

SEQ ID NO: 138329 - DNA, 22 bp, Homo sapiens
tatatgcagtatatatgtgtat

SEQ ID NO: 138330 - DNA, 23 bp, Homo sapiens
ttctgtgaagaaagtcaatggta

SEQ ID NO: 138331 - DNA, 23 bp, Homo sapiens
agtactgtcaactggggaatggc

SEQ ID NO: 138332 - DNA, 22 bp, Homo sapiens
actaaggtagagattgtgtagt

SEQ ID NO: 138333 - DNA, 23 bp, Homo sapiens
tctgtctctgattctatattttt

SEQ ID NO: 138334 - DNA, 22 bp, Homo sapiens
ataaagtgctttctgaatgcca

SEQ ID NO: 138335 - DNA, 23 bp, Homo sapiens
ggtgagacaggagacagagggca

SEQ ID NO: 138336 - DNA, 23 bp, Homo sapiens
tgtatatgtgcatgtgtatatgt

SEQ ID NO: 138337 - DNA, 23 bp, Homo sapiens
tctccatgctgaactttggcgag

SEQ ID NO: 138338 - DNA, 23 bp, Homo sapiens
tgtctctgtgtgtgagttctgcc

SEQ ID NO: 138339 - DNA, 21 bp, Homo sapiens
tgtgtgtatatatatgtgtgt

SEQ ID NO: 138340 - DNA, 23 bp, Homo sapiens
atatatgtatgtatatatgtgtg

SEQ ID NO: 138341 - DNA, 22 bp, Homo sapiens
tatatgcatatatatacatgta

SEQ ID NO: 138342 - DNA, 23 bp, Homo sapiens
atagtgtgtgtgtttctgtgtgt

SEQ ID NO: 138343 - DNA, 19 bp, Homo sapiens
tagagtcttttgtgatttt

SEQ ID NO: 138344 - DNA, 18 bp, Homo sapiens
actggaattttgataagg

SEQ ID NO: 138345 - DNA, 20 bp, Homo sapiens
tttgtctcacttcttggccc

SEQ ID NO: 138346 - DNA, 23 bp, Homo sapiens
gacagtctcgctctgtcacccag

SEQ ID NO: 138347 - DNA, 22 bp, Homo sapiens
ggaattagagaaggagctctac

SEQ ID NO: 138348 - DNA, 21 bp, Homo sapiens
tgaggcaagatttcactctgt

SEQ ID NO: 138349 - DNA, 23 bp, Homo sapiens
tctaccatgatttatctgttttt

SEQ ID NO: 138350 - DNA, 23 bp, Homo sapiens
ctgaggtagatagttttttattt

SEQ ID NO: 138351 - DNA, 19 bp, Homo sapiens
aaactaaaataatatagct

SEQ ID NO: 138352 - DNA, 21 bp, Homo sapiens
aacacgtacatggtatttgct

SEQ ID NO: 138353 - DNA, 23 bp, Homo sapiens
tagtgcttcaagttcacaaactg

SEQ ID NO: 138354 - DNA, 23 bp, Homo sapiens
acagacccactctgtgtcccact

SEQ ID NO: 138355 - DNA, 23 bp, Homo sapiens
tgagttcattgtagattctggat

SEQ ID NO: 138356 - DNA, 23 bp, Homo sapiens
tgagttcattgtagattctggat

SEQ ID NO: 138357 - DNA, 23 bp, Homo sapiens
ttaatctgagttcatggtgaaaa

SEQ ID NO: 138358 - DNA, 19 bp, Homo sapiens
acgtatatatatatgtgta

SEQ ID NO: 138359 - DNA, 23 bp, Homo sapiens
tcaagactgtggttaaggtctca

SEQ ID NO: 138360 - DNA, 21 bp, Homo sapiens
ctttcagtagtttcaatgctg

SEQ ID NO: 138361 - DNA, 23 bp, Homo sapiens
aacattcgtcaagaagggatgca

SEQ ID NO: 138362 - DNA, 23 bp, Homo sapiens
taatgttttcctggaacatgttg

SEQ ID NO: 138363 - DNA, 21 bp, Homo sapiens
tgacttgaagcttaaagcctc

SEQ ID NO: 138364 - DNA, 23 bp, Homo sapiens
gtatatatgtgtacatatgcatg

SEQ ID NO: 138365 - DNA, 20 bp, Homo sapiens
atacatgtacatatgtatat

SEQ ID NO: 138366 - DNA, 23 bp, Homo sapiens
atgaatatatatgtacatgtatg

SEQ ID NO: 138367 - DNA, 22 bp, Homo sapiens
ggctgaggtaggaggatcactt

SEQ ID NO: 138368 - DNA, 23 bp, Homo sapiens
ttgtttgttgttgttgctgcaca

SEQ ID NO: 138369 - DNA, 23 bp, Homo sapiens
attttctctcagctcatgaggca

SEQ ID NO: 138370 - DNA, 23 bp, Homo sapiens
tgagttcattgtagattctggat

SEQ ID NO: 138371 - DNA, 23 bp, Homo sapiens
tgagttcattgtagattctggat

SEQ ID NO: 138372 - DNA, 20 bp, Homo sapiens
tcaatagttatgtgtgtgta

SEQ ID NO: 138373 - DNA, 20 bp, Homo sapiens
atgagtgaatgtgtctgtga

SEQ ID NO: 138374 - DNA, 21 bp, Homo sapiens
tgagatggagtttcactcttg

SEQ ID NO: 138375 - DNA, 19 bp, Homo sapiens
tgactctctgaattgctgg

SEQ ID NO: 138376 - DNA, 23 bp, Homo sapiens
aggatttgactgtggtttttttt

SEQ ID NO: 138377 - DNA, 18 bp, Homo sapiens
tatatcattctatacaca

SEQ ID NO: 138378 - DNA, 23 bp, Homo sapiens
tgagttcattgtagattctggat

SEQ ID NO: 138379 - DNA, 23 bp, Homo sapiens
tgagttcattgtagattctggat

SEQ ID NO: 138380 - DNA, 23 bp, Homo sapiens
tcgcttgagtacagaaggttgag

SEQ ID NO: 138381 - DNA, 22 bp, Homo sapiens
ctctctctgtcactcaggatgg

SEQ ID NO: 138382 - DNA, 22 bp, Homo sapiens
ctccacctcctagtgagagatg

SEQ ID NO: 138383 - DNA, 20 bp, Homo sapiens
atatgtatatgcatatgtgt

SEQ ID NO: 138384 - DNA, 23 bp, Homo sapiens
atgtatatgcatatgtatatgta

SEQ ID NO: 138385 - DNA, 21 bp, Homo sapiens
actctgggtgtcactcaggct

SEQ ID NO: 138386 - DNA, 23 bp, Homo sapiens
gacagagtctcgctctgtcaccc

SEQ ID NO: 138387 - DNA, 21 bp, Homo sapiens
ctgaacactcttttctctttt

SEQ ID NO: 138388 - DNA, 21 bp, Homo sapiens
cagtcgcactctgtcacccag

SEQ ID NO: 138389 - DNA, 22 bp, Homo sapiens
gagtcagagtctcactccatca

SEQ ID NO: 138390 - DNA, 22 bp, Homo sapiens
tgaggtaagaggatgacttgag

SEQ ID NO: 138391 - DNA, 18 bp, Homo sapiens
agtgagactccgtctcaa

SEQ ID NO: 138392 - DNA, 21 bp, Homo sapiens
ttttgagacggagtctcactc

SEQ ID NO: 138393 - DNA, 23 bp, Homo sapiens
agatggagtctcactctgtcacc

SEQ ID NO: 138394 - DNA, 23 bp, Homo sapiens
cggagtctcactctgtcacccag

SEQ ID NO: 138395 - DNA, 23 bp, Homo sapiens
gagtctcactctgtcacccaggc

SEQ ID NO: 138396 - DNA, 23 bp, Homo sapiens
gtgcagtggcacaattgtagctc

SEQ ID NO: 138397 - DNA, 23 bp, Homo sapiens
aacacataggaggcgctcagtta

SEQ ID NO: 138398 - DNA, 23 bp, Homo sapiens
tttaagtctgatgggttactgat

SEQ ID NO: 138399 - DNA, 23 bp, Homo sapiens
cttggcagtgggtctgtgtctgt

SEQ ID NO: 138400 - DNA, 20 bp, Homo sapiens
actgtcagtttcagaaattc

SEQ ID NO: 138401 - DNA, 23 bp, Homo sapiens
agtctcactctgtcacccaagct

SEQ ID NO: 138402 - DNA, 23 bp, Homo sapiens
atatatgtgcatgtgtacacata

SEQ ID NO: 138403 - DNA, 23 bp, Homo sapiens
atatgtgtatatgtgtatatgtg

SEQ ID NO: 138404 - DNA, 19 bp, Homo sapiens
aactcctaacaaataaagt

SEQ ID NO: 138405 - DNA, 23 bp, Homo sapiens
acatctgtaattctagtactttg

SEQ ID NO: 138406 - DNA, 23 bp, Homo sapiens
gaagcaggaagtatagttttggc

SEQ ID NO: 138407 - DNA, 23 bp, Homo sapiens
tgaccaaggtcttaccagctgat

SEQ ID NO: 138408 - DNA, 23 bp, Homo sapiens
ttgagacagggttacactctgtc

SEQ ID NO: 138409 - DNA, 23 bp, Homo sapiens
tttgtggtctgagggcattcttt

SEQ ID NO: 138410 - DNA, 23 bp, Homo sapiens
tgtgagagtgtgttttatggctc

SEQ ID NO: 138411 - DNA, 21 bp, Homo sapiens
gaaatgaaaagaatttgggtc

SEQ ID NO: 138412 - DNA, 23 bp, Homo sapiens
gacactagtgtttttgttctatt

SEQ ID NO: 138413 - DNA, 23 bp, Homo sapiens
gggtcctcagtgactctgagcat

SEQ ID NO: 138414 - DNA, 23 bp, Homo sapiens
ctctctcagtgtctctctctttc

SEQ ID NO: 138415 - DNA, 23 bp, Homo sapiens
atttgtctcattttggatttcta

SEQ ID NO: 138416 - DNA, 22 bp, Homo sapiens
tattagaaattcaaaatgagac

SEQ ID NO: 138417 - DNA, 18 bp, Homo sapiens
gtcctatgagtgccgtta

SEQ ID NO: 138418 - DNA, 22 bp, Homo sapiens
tggctgggagtgtaagagctca

SEQ ID NO: 138419 - DNA, 23 bp, Homo sapiens
tctctgtctggctgagcacgtcc

SEQ ID NO: 138420 - DNA, 21 bp, Homo sapiens
tcttagggagatattactctt

SEQ ID NO: 138421 - DNA, 23 bp, Homo sapiens
tgttgtacacccactgtgatatt

SEQ ID NO: 138422 - DNA, 21 bp, Homo sapiens
atcacagtgggtgtacattat

SEQ ID NO: 138423 - DNA, 23 bp, Homo sapiens
tcagagggtctcgctctgtcaca

SEQ ID NO: 138424 - DNA, 18 bp, Homo sapiens
gccactgtgcctggctgg

SEQ ID NO: 138425 - DNA, 23 bp, Homo sapiens
tgaaatcattttgtaaggacttt

SEQ ID NO: 138426 - DNA, 19 bp, Homo sapiens
agcacttgagaacttagtc

SEQ ID NO: 138427 - DNA, 23 bp, Homo sapiens
tggagtctcactctgtcacccag

SEQ ID NO: 138428 - DNA, 19 bp, Homo sapiens
agcaagtactcttatgaga

SEQ ID NO: 138429 - DNA, 19 bp, Homo sapiens
agtgaaggccaggcacagt

SEQ ID NO: 138430 - DNA, 23 bp, Homo sapiens
ttcactcatgatttggctctcta

SEQ ID NO: 138431 - DNA, 23 bp, Homo sapiens
ttttgagacaggctctcactctg

SEQ ID NO: 138432 - DNA, 23 bp, Homo sapiens
gtgtgtgtgtatatacagtatgt

SEQ ID NO: 138433 - DNA, 23 bp, Homo sapiens
aagacaagccattatgttcttaa

SEQ ID NO: 138434 - DNA, 23 bp, Homo sapiens
cggagtctcacgctgtgtcccag

SEQ ID NO: 138435 - DNA, 23 bp, Homo sapiens
gtgtttcagtaatgggaccagct

SEQ ID NO: 138436 - DNA, 22 bp, Homo sapiens
gaaatggagtttcaccatggtg

SEQ ID NO: 138437 - DNA, 20 bp, Homo sapiens
gcaatgatgatgatgatgat

SEQ ID NO: 138438 - DNA, 21 bp, Homo sapiens
catagttcattctctctcaac

SEQ ID NO: 138439 - DNA, 23 bp, Homo sapiens
tttgagacggagtctggctctgt

SEQ ID NO: 138440 - DNA, 23 bp, Homo sapiens
tcagagagtcatgagtcttgcca

SEQ ID NO: 138441 - DNA, 23 bp, Homo sapiens
atgtgtgcatttgtatatgtgtg

SEQ ID NO: 138442 - DNA, 23 bp, Homo sapiens
tgtgtgtgcaagtgcatttgtat

SEQ ID NO: 138443 - DNA, 19 bp, Homo sapiens
acatggtacatatagtaga

SEQ ID NO: 138444 - DNA, 23 bp, Homo sapiens
gtgtgttggagcctgcgtattca

SEQ ID NO: 138445 - DNA, 23 bp, Homo sapiens
acagtcactcactctcaggtctc

SEQ ID NO: 138446 - DNA, 23 bp, Homo sapiens
actctcagtcacttacttggcta

SEQ ID NO: 138447 - DNA, 23 bp, Homo sapiens
gagtaggtgcacaaagtgagttc

SEQ ID NO: 138448 - DNA, 22 bp, Homo sapiens
atgacttctgtttttgttcata

SEQ ID NO: 138449 - DNA, 23 bp, Homo sapiens
tttgaatgtggatggatattgtt

SEQ ID NO: 138450 - DNA, 23 bp, Homo sapiens
ttgtgtgtgttctggtacacttc

SEQ ID NO: 138451 - DNA, 23 bp, Homo sapiens
agagaagtgtctcactatgttgc

SEQ ID NO: 138452 - DNA, 23 bp, Homo sapiens
tggagtctcactctgtcacccag

SEQ ID NO: 138453 - DNA, 18 bp, Homo sapiens
tatgtatatatatatacg

SEQ ID NO: 138454 - DNA, 22 bp, Homo sapiens
tgagattctaggtagattagaa

SEQ ID NO: 138455 - DNA, 21 bp, Homo sapiens
atggggtctcgctatgttgtc

SEQ ID NO: 138456 - DNA, 23 bp, Homo sapiens
ttaagttttgaaactgttttggt

SEQ ID NO: 138457 - DNA, 23 bp, Homo sapiens
tgagttcattgtagattctggat

SEQ ID NO: 138458 - DNA, 23 bp, Homo sapiens
aattttttgtagagacagggtct

SEQ ID NO: 138459 - DNA, 23 bp, Homo sapiens
tgagttcattgtagattctggat

SEQ ID NO: 138460 - DNA, 23 bp, Homo sapiens
tgagttcattgtagattctggat

SEQ ID NO: 138461 - DNA, 22 bp, Homo sapiens
gatggatgagagttgcacttct

SEQ ID NO: 138462 - DNA, 23 bp, Homo sapiens
aaacactgtcaggtaaagaccag

SEQ ID NO: 138463 - DNA, 20 bp, Homo sapiens
aaaactttctaacatatggt

SEQ ID NO: 138464 - DNA, 23 bp, Homo sapiens
atctgtctccaaatgtaatgaaa

SEQ ID NO: 138465 - DNA, 23 bp, Homo sapiens
ttcctgagacattttgattctgc

SEQ ID NO: 138466 - DNA, 23 bp, Homo sapiens
ttttgagacggagttttgctctt

SEQ ID NO: 138467 - DNA, 18 bp, Homo sapiens
acgtatatatacgtgtat

SEQ ID NO: 138468 - DNA, 23 bp, Homo sapiens
accactgtgtgtctctgtggcac

SEQ ID NO: 138469 - DNA, 23 bp, Homo sapiens
gtccagtgttcactggctgctgt

SEQ ID NO: 138470 - DNA, 23 bp, Homo sapiens
tttgaaaattgcagtgtctgctc

SEQ ID NO: 138471 - DNA, 23 bp, Homo sapiens
gacctctcacactctcccaccgt

SEQ ID NO: 138472 - DNA, 22 bp, Homo sapiens
aagctgctgtgaaaatttgtac

SEQ ID NO: 138473 - DNA, 23 bp, Homo sapiens
tttgttctttttgcttaggattg

SEQ ID NO: 138474 - DNA, 23 bp, Homo sapiens
ttctgtgaagaaagtcaatggta

SEQ ID NO: 138475 - DNA, 21 bp, Homo sapiens
tgagacagggtctcgctctgt

SEQ ID NO: 138476 - DNA, 22 bp, Homo sapiens
tcccaagtagctgggattacag

SEQ ID NO: 138477 - DNA, 23 bp, Homo sapiens
tgtgagccactgtgccaggccct

SEQ ID NO: 138478 - DNA, 19 bp, Homo sapiens
tgcctataattccaaaact

SEQ ID NO: 138479 - DNA, 18 bp, Homo sapiens
acatgtctgtagtcccag

SEQ ID NO: 138480 - DNA, 21 bp, Homo sapiens
agtggaggctacagtgagcca

SEQ ID NO: 138481 - DNA, 23 bp, Homo sapiens
atattgtatgtatacatgtgtat

SEQ ID NO: 138482 - DNA, 23 bp, Homo sapiens
tcagactctgtgtctattgggat

SEQ ID NO: 138483 - DNA, 23 bp, Homo sapiens
tatagattaattttcatatgttg

SEQ ID NO: 138484 - DNA, 23 bp, Homo sapiens
aaagtgagggaccttgtgtctgt

SEQ ID NO: 138485 - DNA, 23 bp, Homo sapiens
aagagacatttacatttatagaa

SEQ ID NO: 138486 - DNA, 23 bp, Homo sapiens
aaggatgagtagaatagtctttt

SEQ ID NO: 138487 - DNA, 23 bp, Homo sapiens
aggcagagacggtctctgcctcc

SEQ ID NO: 138488 - DNA, 23 bp, Homo sapiens
tgagttcattgtagattctggat

SEQ ID NO: 138489 - DNA, 23 bp, Homo sapiens
tgagttcattgtagattctggat

SEQ ID NO: 138490 - DNA, 23 bp, Homo sapiens
ttctagtagaaccgagcctcaca

SEQ ID NO: 138491 - DNA, 23 bp, Homo sapiens
tctgacagtctctgtcttgtaac

SEQ ID NO: 138492 - DNA, 23 bp, Homo sapiens
taaactatttacagttaggacca

SEQ ID NO: 138493 - DNA, 22 bp, Homo sapiens
acttcctttggttttcttgagt

SEQ ID NO: 138494 - DNA, 23 bp, Homo sapiens
attagcctgtagtatgtgtaaac

SEQ ID NO: 138495 - DNA, 23 bp, Homo sapiens
ctagtgttttcttttgaaggtgt

SEQ ID NO: 138496 - DNA, 23 bp, Homo sapiens
tggagtctcactctgtcacccag

SEQ ID NO: 138497 - DNA, 23 bp, Homo sapiens
ttagaagtcattttgttttattg

SEQ ID NO: 138498 - DNA, 21 bp, Homo sapiens
tgtgtatatatgtgtgtgcat

SEQ ID NO: 138499 - DNA, 20 bp, Homo sapiens
tatccttttcaaatggctat

SEQ ID NO: 138500 - DNA, 23 bp, Homo sapiens
tgagctgaaagtacagggagttc

SEQ ID NO: 138501 - DNA, 20 bp, Homo sapiens
tgaggtaggaggatcacttg

SEQ ID NO: 138502 - DNA, 20 bp, Homo sapiens
tctgtctctcagtttcttca

SEQ ID NO: 138503 - DNA, 23 bp, Homo sapiens
tgtgtatgtatatatatgtgtgt

SEQ ID NO: 138504 - DNA, 21 bp, Homo sapiens
atgactctgtgtctgtgtccc

SEQ ID NO: 138505 - DNA, 23 bp, Homo sapiens
tgattgggatttgttgggattct

SEQ ID NO: 138506 - DNA, 23 bp, Homo sapiens
ttctgtctctctcaatttcctgt

SEQ ID NO: 138507 - DNA, 23 bp, Homo sapiens
actgacaccctctgtgtatgtgt

SEQ ID NO: 138508 - DNA, 23 bp, Homo sapiens
tttagctttttgaggaatcacca

SEQ ID NO: 138509 - DNA, 23 bp, Homo sapiens
ttttcacagtggctgtagtattt

SEQ ID NO: 138510 - DNA, 20 bp, Homo sapiens
tcacagagcagacagggtca

SEQ ID NO: 138511 - DNA, 20 bp, Homo sapiens
aggatgtatgaatgtgtgtt

SEQ ID NO: 138512 - DNA, 23 bp, Homo sapiens
atatatgtgtatgtatatctctc

SEQ ID NO: 138513 - DNA, 23 bp, Homo sapiens
gtctctggtcatggtgcaggaac

SEQ ID NO: 138514 - DNA, 23 bp, Homo sapiens
tctgtggtatgcattgtaatgtg

SEQ ID NO: 138515 - DNA, 19 bp, Homo sapiens
tcacagggttcattgatga

SEQ ID NO: 138516 - DNA, 23 bp, Homo sapiens
tactgagagtagagtgggagcag

SEQ ID NO: 138517 - DNA, 23 bp, Homo sapiens
tcaatgcttgttgaatgaatgaa

SEQ ID NO: 138518 - DNA, 23 bp, Homo sapiens
agacatgttcactcagagatgcc

SEQ ID NO: 138519 - DNA, 23 bp, Homo sapiens
tcagttagacgattctttttctt

SEQ ID NO: 138520 - DNA, 20 bp, Homo sapiens
ttttgcattttaaacatagg

SEQ ID NO: 138521 - DNA, 23 bp, Homo sapiens
aaaagctgggttgagagggcgaa

SEQ ID NO: 138522 - DNA, 23 bp, Homo sapiens
tgtcactatatatatatgtcact

SEQ ID NO: 138523 - DNA, 20 bp, Homo sapiens
tgtcactatatatatcgtgt

SEQ ID NO: 138524 - DNA, 19 bp, Homo sapiens
ttttctctttttttttttc

SEQ ID NO: 138525 - DNA, 23 bp, Homo sapiens
tttgaggctgtagtgggctatga

SEQ ID NO: 138526 - DNA, 23 bp, Homo sapiens
tctgcttgttttcagaggaacat

SEQ ID NO: 138527 - DNA, 22 bp, Homo sapiens
agagttcctcaaggtcagttga

SEQ ID NO: 138528 - DNA, 23 bp, Homo sapiens
tgagttcattgtagattctggat

SEQ ID NO: 138529 - DNA, 23 bp, Homo sapiens
tgagttcattgtagattctggat

SEQ ID NO: 138530 - DNA, 18 bp, Homo sapiens
atatctcatgtatatgac

SEQ ID NO: 138531 - DNA, 23 bp, Homo sapiens
tgtcagtgactgtcacatatagg

SEQ ID NO: 138532 - DNA, 23 bp, Homo sapiens
gctgtctctgagaggctatctag

SEQ ID NO: 138533 - DNA, 19 bp, Homo sapiens
tctgcgggctttgctgggt

SEQ ID NO: 138534 - DNA, 23 bp, Homo sapiens
tatgtgtacatgtatatgtgtgt

SEQ ID NO: 138535 - DNA, 23 bp, Homo sapiens
tagttcatgagagagttggttgt

SEQ ID NO: 138536 - DNA, 23 bp, Homo sapiens
tgtatatttggatgtgataggaa

SEQ ID NO: 138537 - DNA, 23 bp, Homo sapiens
aaactgaatgcataccaagggtg

SEQ ID NO: 138538 - DNA, 19 bp, Homo sapiens
tgggagctggcttgatccc

SEQ ID NO: 138539 - DNA, 23 bp, Homo sapiens
ttggtctcggtctctgtctctct

SEQ ID NO: 138540 - DNA, 22 bp, Homo sapiens
cactgccactctctgacaccct

SEQ ID NO: 138541 - DNA, 23 bp, Homo sapiens
tgcatgtgtgtatgtgtgggtgt

SEQ ID NO: 138542 - DNA, 22 bp, Homo sapiens
tatgtttatgcatgcatatgtt

SEQ ID NO: 138543 - DNA, 23 bp, Homo sapiens
tatatatatgtgcacacacacat

SEQ ID NO: 138544 - DNA, 22 bp, Homo sapiens
ttaacccgctttttgatgggat

SEQ ID NO: 138545 - DNA, 23 bp, Homo sapiens
agttcgttgaagattctggatat

SEQ ID NO: 138546 - DNA, 23 bp, Homo sapiens
aaaatcagtctgagtttgcacag

SEQ ID NO: 138547 - DNA, 23 bp, Homo sapiens
tgagagggagtctcgctctgtca

SEQ ID NO: 138548 - DNA, 23 bp, Homo sapiens
gagtggtagaattatgagtgatg

SEQ ID NO: 138549 - DNA, 18 bp, Homo sapiens
tgagatggagtctcgctc

SEQ ID NO: 138550 - DNA, 23 bp, Homo sapiens
cagagtctcactctgtcatccag

SEQ ID NO: 138551 - DNA, 21 bp, Homo sapiens
agtcagagtctcactctgttg

SEQ ID NO: 138552 - DNA, 21 bp, Homo sapiens
aatacagtggtgcgatctcag

SEQ ID NO: 138553 - DNA, 23 bp, Homo sapiens
atggtgtcttgctctgtcactca

SEQ ID NO: 138554 - DNA, 20 bp, Homo sapiens
tgtgtgtgtgtgtgtgtgtg

SEQ ID NO: 138555 - DNA, 23 bp, Homo sapiens
gacagagtctcgctctgtcaccc

SEQ ID NO: 138556 - DNA, 23 bp, Homo sapiens
attattaatgtatagaaatgcta

SEQ ID NO: 138557 - DNA, 20 bp, Homo sapiens
tttgtacattgattttgtgt

SEQ ID NO: 138558 - DNA, 23 bp, Homo sapiens
tgagagtagtgagagtgggcatc

SEQ ID NO: 138559 - DNA, 23 bp, Homo sapiens
tctcaaggagaatgcttccagtt

SEQ ID NO: 138560 - DNA, 23 bp, Homo sapiens
cggagtctcactctgtcgctgag

SEQ ID NO: 138561 - DNA, 23 bp, Homo sapiens
gaaaatagtagtgcttctgttta

SEQ ID NO: 138562 - DNA, 19 bp, Homo sapiens
aagaagaagaaggagaaca

SEQ ID NO: 138563 - DNA, 18 bp, Homo sapiens
ttgtggcaactttgtgtg

SEQ ID NO: 138564 - DNA, 19 bp, Homo sapiens
tggctcaagaacccaattt

SEQ ID NO: 138565 - DNA, 22 bp, Homo sapiens
gtttaactccttggaagagaag

SEQ ID NO: 138566 - DNA, 19 bp, Homo sapiens
tgactgtatttgtttttat

SEQ ID NO: 138567 - DNA, 18 bp, Homo sapiens
actttatatatgtaaaca

SEQ ID NO: 138568 - DNA, 21 bp, Homo sapiens
aagagacctgactgtgctctc

SEQ ID NO: 138569 - DNA, 18 bp, Homo sapiens
tacagttctctgaaatgt

SEQ ID NO: 138570 - DNA, 23 bp, Homo sapiens
ctgtcaccgactctgagtcttta

SEQ ID NO: 138571 - DNA, 23 bp, Homo sapiens
tgagttcattgtagattctggat

SEQ ID NO: 138572 - DNA, 23 bp, Homo sapiens
tgagttcattgtagattctggat

SEQ ID NO: 138573 - DNA, 23 bp, Homo sapiens
acaggtagttggttgttttctgt

SEQ ID NO: 138574 - DNA, 23 bp, Homo sapiens
tgtgtgtatatgtctgtgtattt

SEQ ID NO: 138575 - DNA, 20 bp, Homo sapiens
tgagccaattccttatcaca

SEQ ID NO: 138576 - DNA, 20 bp, Homo sapiens
agtgtatgtatgtgtatgta

SEQ ID NO: 138577 - DNA, 20 bp, Homo sapiens
ttgctcaaaattgctttggc

SEQ ID NO: 138578 - DNA, 23 bp, Homo sapiens
tgagttcattgtagattctggat

SEQ ID NO: 138579 - DNA, 23 bp, Homo sapiens
tgagttcattgtagattctggat

SEQ ID NO: 138580 - DNA, 21 bp, Homo sapiens
agcagtggaattctttttttt

SEQ ID NO: 138581 - DNA, 23 bp, Homo sapiens
acagaagctcactgtgtcaccca

SEQ ID NO: 138582 - DNA, 21 bp, Homo sapiens
tatattattcatggtattctt

SEQ ID NO: 138583 - DNA, 23 bp, Homo sapiens
tctgtctgcttttgtagaaagca

SEQ ID NO: 138584 - DNA, 23 bp, Homo sapiens
tggagtctcactctgtcacccag

SEQ ID NO: 138585 - DNA, 21 bp, Homo sapiens
agagtcatatagagatgcttc

SEQ ID NO: 138586 - DNA, 23 bp, Homo sapiens
atgataggaattctagatgactg

SEQ ID NO: 138587 - DNA, 19 bp, Homo sapiens
tacacgtatatatatgtat

SEQ ID NO: 138588 - DNA, 20 bp, Homo sapiens
atatgttatataacatacgt

SEQ ID NO: 138589 - DNA, 23 bp, Homo sapiens
atatatgttatataacatatgta

SEQ ID NO: 138590 - DNA, 22 bp, Homo sapiens
atatatgttatataacatacgt

SEQ ID NO: 138591 - DNA, 21 bp, Homo sapiens
tatatgttatataacatacgt

SEQ ID NO: 138592 - DNA, 23 bp, Homo sapiens
tgccagggactgtgaattgctgg

SEQ ID NO: 138593 - DNA, 19 bp, Homo sapiens
actgtccaatagaactttc

SEQ ID NO: 138594 - DNA, 23 bp, Homo sapiens
tgtgtcagtgtgtgtgtgtatat

SEQ ID NO: 138595 - DNA, 23 bp, Homo sapiens
gacagagcctcactctgtggttc

SEQ ID NO: 138596 - DNA, 23 bp, Homo sapiens
ttcattagttggacaatatgatg

SEQ ID NO: 138597 - DNA, 23 bp, Homo sapiens
ttatactgtctgtacttggtctg

SEQ ID NO: 138598 - DNA, 22 bp, Homo sapiens
gttgagtagtgattctgatgta

SEQ ID NO: 138599 - DNA, 23 bp, Homo sapiens
tatatgccactatatctatatat

SEQ ID NO: 138600 - DNA, 23 bp, Homo sapiens
aagaaacagatgactcacagtct

SEQ ID NO: 138601 - DNA, 20 bp, Homo sapiens
atgacgtctgtttttgatgt

SEQ ID NO: 138602 - DNA, 19 bp, Homo sapiens
ttcagtatagatgttgagg

SEQ ID NO: 138603 - DNA, 23 bp, Homo sapiens
aaatgctcagcatagtatctggc

SEQ ID NO: 138604 - DNA, 21 bp, Homo sapiens
ttaagacactttggcctaggt

SEQ ID NO: 138605 - DNA, 23 bp, Homo sapiens
tggtgaacttctaatggaacttg

SEQ ID NO: 138606 - DNA, 22 bp, Homo sapiens
acatgtgcacattgtgcaggtt

SEQ ID NO: 138607 - DNA, 22 bp, Homo sapiens
gtcatgaaatccttgcctaagc

SEQ ID NO: 138608 - DNA, 23 bp, Homo sapiens
tgagtgcagtttgagaattgact

SEQ ID NO: 138609 - DNA, 19 bp, Homo sapiens
tgctattttaaaaactgtt

SEQ ID NO: 138610 - DNA, 23 bp, Homo sapiens
actttacatcctgagaaagtgtc

SEQ ID NO: 138611 - DNA, 23 bp, Homo sapiens
tttcaccttcttttcagatgtga

SEQ ID NO: 138612 - DNA, 22 bp, Homo sapiens
aagagagcaactattgacctgt

SEQ ID NO: 138613 - DNA, 19 bp, Homo sapiens
cgagggtagttacctgaaa

SEQ ID NO: 138614 - DNA, 23 bp, Homo sapiens
tatatctgtatatgtatatttct

SEQ ID NO: 138615 - DNA, 23 bp, Homo sapiens
atttcaatgggtttgttttgatc

SEQ ID NO: 138616 - DNA, 23 bp, Homo sapiens
ttaagctttgatttgttttgaca

SEQ ID NO: 138617 - DNA, 21 bp, Homo sapiens
ataaaggtagactaccggaat

SEQ ID NO: 138618 - DNA, 23 bp, Homo sapiens
tgtctgtgtgtgtatatatatac

SEQ ID NO: 138619 - DNA, 23 bp, Homo sapiens
tgagttcattgtagattctggat

SEQ ID NO: 138620 - DNA, 23 bp, Homo sapiens
tgagttcattgtagattctggat

SEQ ID NO: 138621 - DNA, 22 bp, Homo sapiens
gtggtaggatcacttgagtcca

SEQ ID NO: 138622 - DNA, 22 bp, Homo sapiens
tgtcagggagaaaaatacagga

SEQ ID NO: 138623 - DNA, 22 bp, Homo sapiens
tgtgtgtatatgtatatttgtg

SEQ ID NO: 138624 - DNA, 23 bp, Homo sapiens
tatgtgtgtatatgtatatttgt

SEQ ID NO: 138625 - DNA, 22 bp, Homo sapiens
tgtgtacatcttcagaatattt

SEQ ID NO: 138626 - DNA, 23 bp, Homo sapiens
actgatttacatgttgttttggt

SEQ ID NO: 138627 - DNA, 23 bp, Homo sapiens
gatttgtattctcagatggtgca

SEQ ID NO: 138628 - DNA, 23 bp, Homo sapiens
ttctcagagtggtttgttcctat

SEQ ID NO: 138629 - DNA, 23 bp, Homo sapiens
tttatatagtaggatagaaatgg

SEQ ID NO: 138630 - DNA, 23 bp, Homo sapiens
ttcaaggctgtagtgagctatga

SEQ ID NO: 138631 - DNA, 21 bp, Homo sapiens
tgagcaacagactgagactct

SEQ ID NO: 138632 - DNA, 19 bp, Homo sapiens
taacgttaaataggaatcg

SEQ ID NO: 138633 - DNA, 23 bp, Homo sapiens
tatatgtgtgtatatatatgtat

SEQ ID NO: 138634 - DNA, 21 bp, Homo sapiens
atatgtatacatatatatgtg

SEQ ID NO: 138635 - DNA, 23 bp, Homo sapiens
tatatatctatatctatatgtat

SEQ ID NO: 138636 - DNA, 22 bp, Homo sapiens
aaagatttctgtcttaggagat

SEQ ID NO: 138637 - DNA, 18 bp, Homo sapiens
gtggaactatttatgaca

SEQ ID NO: 138638 - DNA, 22 bp, Homo sapiens
tatgtgtgtgtgtataatttgt

SEQ ID NO: 138639 - DNA, 23 bp, Homo sapiens
attcaagtgtagtgtgtgagcac

SEQ ID NO: 138640 - DNA, 23 bp, Homo sapiens
ctctcaatcactgtcaactatgc

SEQ ID NO: 138641 - DNA, 23 bp, Homo sapiens
cacaactcactctgactctggca

SEQ ID NO: 138642 - DNA, 22 bp, Homo sapiens
tctccctagtaggtgtatagat

SEQ ID NO: 138643 - DNA, 23 bp, Homo sapiens
ttgtaagtctgtgtgtgtaattg

SEQ ID NO: 138644 - DNA, 23 bp, Homo sapiens
tatgtgtatttctctgtctctct

SEQ ID NO: 138645 - DNA, 22 bp, Homo sapiens
tttttgactgtacaaccttttg

SEQ ID NO: 138646 - DNA, 18 bp, Homo sapiens
taatacagtataggtttc

SEQ ID NO: 138647 - DNA, 23 bp, Homo sapiens
tttgagacggagtctcgctctgt

SEQ ID NO: 138648 - DNA, 18 bp, Homo sapiens
tgcatatttaaaaagtaa

SEQ ID NO: 138649 - DNA, 19 bp, Homo sapiens
actttactgaatttgttta

SEQ ID NO: 138650 - DNA, 20 bp, Homo sapiens
tcacagctgagagagagggg

SEQ ID NO: 138651 - DNA, 23 bp, Homo sapiens
ctgtctgcctgtctacacttgga

SEQ ID NO: 138652 - DNA, 23 bp, Homo sapiens
accccaaattcctaaagttcctg

SEQ ID NO: 138653 - DNA, 23 bp, Homo sapiens
tgtgtatatatatatgtgtgtgt

SEQ ID NO: 138654 - DNA, 23 bp, Homo sapiens
acatacacaggcacacatatgtc

SEQ ID NO: 138655 - DNA, 23 bp, Homo sapiens
attctactactctgtgtgtgtgt

SEQ ID NO: 138656 - DNA, 22 bp, Homo sapiens
tgcaaaagttattgaatgttaa

SEQ ID NO: 138657 - DNA, 21 bp, Homo sapiens
aagtctgcttataagtgtgtc

SEQ ID NO: 138658 - DNA, 22 bp, Homo sapiens
agaagagcaaataatttactgt

SEQ ID NO: 138659 - DNA, 23 bp, Homo sapiens
tatgtttatatatgtaaatgtgt

SEQ ID NO: 138660 - DNA, 21 bp, Homo sapiens
ttcactcatgatttggctctc

SEQ ID NO: 138661 - DNA, 23 bp, Homo sapiens
tgagttcattgtagattctggat

SEQ ID NO: 138662 - DNA, 23 bp, Homo sapiens
tgagttcattgtagattctggat

SEQ ID NO: 138663 - DNA, 22 bp, Homo sapiens
aaactgtgggaatttcttcagt

SEQ ID NO: 138664 - DNA, 21 bp, Homo sapiens
ttcaaatacatgttcatgtag

SEQ ID NO: 138665 - DNA, 23 bp, Homo sapiens
tgagttcattgtagattctggat

SEQ ID NO: 138666 - DNA, 21 bp, Homo sapiens
aggtactttatatttttgttg

SEQ ID NO: 138667 - DNA, 23 bp, Homo sapiens
aactttctacttgaaactgtgta

SEQ ID NO: 138668 - DNA, 23 bp, Homo sapiens
tgtttcagagattttgttgtact

SEQ ID NO: 138669 - DNA, 23 bp, Homo sapiens
acattcagtcagtcagtcactca

SEQ ID NO: 138670 - DNA, 23 bp, Homo sapiens
ggctgaggtaggaggatcacttg

SEQ ID NO: 138671 - DNA, 23 bp, Homo sapiens
actgtgcatttgaagatgaagat

SEQ ID NO: 138672 - DNA, 23 bp, Homo sapiens
gccccactcagtgactcccagcc

SEQ ID NO: 138673 - DNA, 22 bp, Homo sapiens
caaatgtgagttatacttccca

SEQ ID NO: 138674 - DNA, 22 bp, Homo sapiens
acagtgtgaatgccatgtgttc

SEQ ID NO: 138675 - DNA, 22 bp, Homo sapiens
tctgtctatctctctgtcgcgg

SEQ ID NO: 138676 - DNA, 21 bp, Homo sapiens
gagtctcactctgtgccccag

SEQ ID NO: 138677 - DNA, 20 bp, Homo sapiens
ggggacagagtctcgctctg

SEQ ID NO: 138678 - DNA, 22 bp, Homo sapiens
taatggtaagtttacataactt

SEQ ID NO: 138679 - DNA, 18 bp, Homo sapiens
tagaacacagggagcaca

SEQ ID NO: 138680 - DNA, 23 bp, Homo sapiens
tcacacctgtaatcttagcactt

SEQ ID NO: 138681 - DNA, 23 bp, Homo sapiens
ggctgaggtaggtggatcacttg

SEQ ID NO: 138682 - DNA, 23 bp, Homo sapiens
tcttgtgtcagttagttgttgtc

SEQ ID NO: 138683 - DNA, 23 bp, Homo sapiens
atgctgcataacaagtcactcca

SEQ ID NO: 138684 - DNA, 19 bp, Homo sapiens
aggtgaccttttatctttt

SEQ ID NO: 138685 - DNA, 19 bp, Homo sapiens
tgagatggagtctcactct

SEQ ID NO: 138686 - DNA, 23 bp, Homo sapiens
ggacagagcccatggagaaggag

SEQ ID NO: 138687 - DNA, 23 bp, Homo sapiens
gacagggtctctggctgtgtcac

SEQ ID NO: 138688 - DNA, 23 bp, Homo sapiens
tctctgtgcctcagttgctccat

SEQ ID NO: 138689 - DNA, 23 bp, Homo sapiens
tctctgtgcctcagttgctccat

SEQ ID NO: 138690 - DNA, 21 bp, Homo sapiens
tgtgtatgtatatatgtgtgt

SEQ ID NO: 138691 - DNA, 22 bp, Homo sapiens
atatgtgtgtatatatatatgt

SEQ ID NO: 138692 - DNA, 20 bp, Homo sapiens
tgagagagtctcgctctgtc

SEQ ID NO: 138693 - DNA, 18 bp, Homo sapiens
ttgtgaagagtgagttga

SEQ ID NO: 138694 - DNA, 23 bp, Homo sapiens
aaaaatgtgtccttgagttctat

SEQ ID NO: 138695 - DNA, 20 bp, Homo sapiens
tgagagagtctcgctctgtc

SEQ ID NO: 138696 - DNA, 18 bp, Homo sapiens
ttgtgaagagtgagttga

SEQ ID NO: 138697 - DNA, 23 bp, Homo sapiens
aaaaatgtgtccttgagttctat

SEQ ID NO: 138698 - DNA, 23 bp, Homo sapiens
atgtgtgcttgtgtttagctatc

SEQ ID NO: 138699 - DNA, 21 bp, Homo sapiens
aaaatgtggtttggacaaggt

SEQ ID NO: 138700 - DNA, 18 bp, Homo sapiens
tcagatcactgcaacctc

SEQ ID NO: 138701 - DNA, 23 bp, Homo sapiens
ctctgtcattgattgttattgtt

SEQ ID NO: 138702 - DNA, 18 bp, Homo sapiens
ttaattttcacaagcatt

SEQ ID NO: 138703 - DNA, 23 bp, Homo sapiens
tgtaaactttagaagaatgtgtg

SEQ ID NO: 138704 - DNA, 19 bp, Homo sapiens
ttagcgtctcatttgggtt

SEQ ID NO: 138705 - DNA, 23 bp, Homo sapiens
atgtgtgtggtttacatttgcat

SEQ ID NO: 138706 - DNA, 22 bp, Homo sapiens
tactcagcacacacactctgtc

SEQ ID NO: 138707 - DNA, 21 bp, Homo sapiens
tgtttagaagcagtgccagtg

SEQ ID NO: 138708 - DNA, 23 bp, Homo sapiens
agcactcatctgtctctgagagc

SEQ ID NO: 138709 - DNA, 19 bp, Homo sapiens
tttctgctatttatgcatt

SEQ ID NO: 138710 - DNA, 23 bp, Homo sapiens
tctctgtgtggctgtgagggtgt

SEQ ID NO: 138711 - DNA, 22 bp, Homo sapiens
tctgtgtggctgtgagggtgcc

SEQ ID NO: 138712 - DNA, 19 bp, Homo sapiens
tataggtctgctccccggg

SEQ ID NO: 138713 - DNA, 21 bp, Homo sapiens
tctggagcctgtgactgtggc

SEQ ID NO: 138714 - DNA, 23 bp, Homo sapiens
tctgtgactctgtgggttgtttt

SEQ ID NO: 138715 - DNA, 23 bp, Homo sapiens
tgtggctggctctctttctcact

SEQ ID NO: 138716 - DNA, 18 bp, Homo sapiens
tgtgtctgtatctctgaa

SEQ ID NO: 138717 - DNA, 23 bp, Homo sapiens
tgacacagaactgacagtccaca

SEQ ID NO: 138718 - DNA, 23 bp, Homo sapiens
ttgatcaagtgtcttcaagtatt

SEQ ID NO: 138719 - DNA, 23 bp, Homo sapiens
agactagggactctctggctctg

SEQ ID NO: 138720 - DNA, 23 bp, Homo sapiens
gggtctcactctgtcacccaggc

SEQ ID NO: 138721 - DNA, 21 bp, Homo sapiens
tctctctccgtgttcacagcg

SEQ ID NO: 138722 - DNA, 23 bp, Homo sapiens
taaggcacgcggtgaatgccaag

SEQ ID NO: 138723 - DNA, 23 bp, Homo sapiens
agaggttgcagtgagttgagatt

SEQ ID NO: 138724 - DNA, 23 bp, Homo sapiens
tatcacagtgggtgtacaccctg

SEQ ID NO: 138725 - DNA, 21 bp, Homo sapiens
acagctaataccatagtgtgt

SEQ ID NO: 138726 - DNA, 18 bp, Homo sapiens
tgtgatgatattcgtaag

SEQ ID NO: 138727 - DNA, 19 bp, Homo sapiens
tatcacagtggttgtacac

SEQ ID NO: 138728 - DNA, 23 bp, Homo sapiens
tgagttcattgtagattctggat

SEQ ID NO: 138729 - DNA, 23 bp, Homo sapiens
tgagttcattgtagattctggat

SEQ ID NO: 138730 - DNA, 23 bp, Homo sapiens
tattacaactgcttttggagact

SEQ ID NO: 138731 - DNA, 22 bp, Homo sapiens
ttcactcatgatttggctctct

SEQ ID NO: 138732 - DNA, 21 bp, Homo sapiens
ctgaggttggaggatcacttg

SEQ ID NO: 138733 - DNA, 20 bp, Homo sapiens
tttgacagtctctctgcctc

SEQ ID NO: 138734 - DNA, 22 bp, Homo sapiens
gactgagtctcgctctgtcgcc

SEQ ID NO: 138735 - DNA, 23 bp, Homo sapiens
acactgtcagtctaatcagaggc

SEQ ID NO: 138736 - DNA, 23 bp, Homo sapiens
taaagctctctagccacttagag

SEQ ID NO: 138737 - DNA, 23 bp, Homo sapiens
tgggtccctgagtcactgcgtgg

SEQ ID NO: 138738 - DNA, 21 bp, Homo sapiens
actcactctttctctgtctga

SEQ ID NO: 138739 - DNA, 20 bp, Homo sapiens
tctgaggtgttcctggagag

SEQ ID NO: 138740 - DNA, 20 bp, Homo sapiens
ttctccatgtgcctctccaa

SEQ ID NO: 138741 - DNA, 23 bp, Homo sapiens
tgggagacttctcattttgttct

SEQ ID NO: 138742 - DNA, 21 bp, Homo sapiens
tgccttttaattggaatgcgt

SEQ ID NO: 138743 - DNA, 18 bp, Homo sapiens
ctgcctgtagttccagct

SEQ ID NO: 138744 - DNA, 21 bp, Homo sapiens
tgaggtagaagaatcacttga

SEQ ID NO: 138745 - DNA, 23 bp, Homo sapiens
agtggaagtatacagtatttgtt

SEQ ID NO: 138746 - DNA, 22 bp, Homo sapiens
gtgagtcagagtctcactctgt

SEQ ID NO: 138747 - DNA, 22 bp, Homo sapiens
ttacaaacatgttctcccagtg

SEQ ID NO: 138748 - DNA, 23 bp, Homo sapiens
ctaattctgccaggtatagaggt

SEQ ID NO: 138749 - DNA, 23 bp, Homo sapiens
ttagatcgagtctcactctgtcg

SEQ ID NO: 138750 - DNA, 23 bp, Homo sapiens
tcgaggagaagtgggtgatctgt

SEQ ID NO: 138751 - DNA, 23 bp, Homo sapiens
tgagttcattgtagattctggat

SEQ ID NO: 138752 - DNA, 23 bp, Homo sapiens
tgagttcattgtagattctggat

SEQ ID NO: 138753 - DNA, 22 bp, Homo sapiens
tgacagtagtcagtcagcttgt

SEQ ID NO: 138754 - DNA, 19 bp, Homo sapiens
atcataatgatgatgatga

SEQ ID NO: 138755 - DNA, 23 bp, Homo sapiens
tcacagtcatatcaggtatgtat

SEQ ID NO: 138756 - DNA, 23 bp, Homo sapiens
gtctgtctgtggtttacttttga

SEQ ID NO: 138757 - DNA, 22 bp, Homo sapiens
actctagtatatagcatagtat

SEQ ID NO: 138758 - DNA, 23 bp, Homo sapiens
atgtatctctctctatatatgtg

SEQ ID NO: 138759 - DNA, 23 bp, Homo sapiens
ttcattgtggttttgatttgcat

SEQ ID NO: 138760 - DNA, 23 bp, Homo sapiens
gacagagtctcgctctgtcaccc

SEQ ID NO: 138761 - DNA, 23 bp, Homo sapiens
ggctccctcactctgtgactgtg

SEQ ID NO: 138762 - DNA, 23 bp, Homo sapiens
ttagacacagaggatacatgtgc

SEQ ID NO: 138763 - DNA, 21 bp, Homo sapiens
agtgtgctaagtaaaggtgag

SEQ ID NO: 138764 - DNA, 23 bp, Homo sapiens
tgttttgagatggagtctcactc

SEQ ID NO: 138765 - DNA, 23 bp, Homo sapiens
tcactcagcgtgatgtttccaag

SEQ ID NO: 138766 - DNA, 23 bp, Homo sapiens
atgcatgtatgcatgtatgtatg

SEQ ID NO: 138767 - DNA, 23 bp, Homo sapiens
tggagtctcactctgtcacccag

SEQ ID NO: 138768 - DNA, 23 bp, Homo sapiens
acagggtggctctctctttgcca

SEQ ID NO: 138769 - DNA, 19 bp, Homo sapiens
tacaatgcttaatgtgtat

SEQ ID NO: 138770 - DNA, 23 bp, Homo sapiens
tttctcagtctctccctctccat

SEQ ID NO: 138771 - DNA, 21 bp, Homo sapiens
atgagagtagagagagagaac

SEQ ID NO: 138772 - DNA, 22 bp, Homo sapiens
tataaagaatatgtatatgttt

SEQ ID NO: 138773 - DNA, 20 bp, Homo sapiens
tgtattagacaaaggacttg

SEQ ID NO: 138774 - DNA, 18 bp, Homo sapiens
tttgagacagggtctctt

SEQ ID NO: 138775 - DNA, 23 bp, Homo sapiens
tgagttcattgtagattctggat

SEQ ID NO: 138776 - DNA, 23 bp, Homo sapiens
tgagttcattgtagattctggat

SEQ ID NO: 138777 - DNA, 20 bp, Homo sapiens
tgagacagtctcactgtccc

SEQ ID NO: 138778 - DNA, 21 bp, Homo sapiens
cagtggtgcgatttcagctca

SEQ ID NO: 138779 - DNA, 23 bp, Homo sapiens
ttcacacttttatcctgtgtgtg

SEQ ID NO: 138780 - DNA, 21 bp, Homo sapiens
tcagtgggacagaaacttgtg

SEQ ID NO: 138781 - DNA, 23 bp, Homo sapiens
tagacataagagagtgtgggctg

SEQ ID NO: 138782 - DNA, 23 bp, Homo sapiens
taagatgtccttccagtttgtgg

SEQ ID NO: 138783 - DNA, 23 bp, Homo sapiens
ttcatactgaagactcagagcag

SEQ ID NO: 138784 - DNA, 23 bp, Homo sapiens
tgcgtgtgtgagagtgagttacc

SEQ ID NO: 138785 - DNA, 19 bp, Homo sapiens
ttggaggtctctgtggcat

SEQ ID NO: 138786 - DNA, 23 bp, Homo sapiens
tgtcaaagcttatgttgctcata

SEQ ID NO: 138787 - DNA, 23 bp, Homo sapiens
atatgtgtgttataggagtgtgt

SEQ ID NO: 138788 - DNA, 23 bp, Homo sapiens
ggtacacattatatatatgtgtg

SEQ ID NO: 138789 - DNA, 20 bp, Homo sapiens
acaaagtgagaaggcatctg

SEQ ID NO: 138790 - DNA, 23 bp, Homo sapiens
atgaataacattgtatatgttat

SEQ ID NO: 138791 - DNA, 23 bp, Homo sapiens
ttgtgtgcatatgtatttgtgtg

SEQ ID NO: 138792 - DNA, 20 bp, Homo sapiens
agttggtataatatgtatag

SEQ ID NO: 138793 - DNA, 22 bp, Homo sapiens
tatatggtaatatttagtgtat

SEQ ID NO: 138794 - DNA, 19 bp, Homo sapiens
ttatgatgatatacacatg

SEQ ID NO: 138795 - DNA, 23 bp, Homo sapiens
gataatgtttggaaatggtatgt

SEQ ID NO: 138796 - DNA, 23 bp, Homo sapiens
atcatctattctatttgtatgtc

SEQ ID NO: 138797 - DNA, 23 bp, Homo sapiens
ttttgagacggagtcttgctctc

SEQ ID NO: 138798 - DNA, 22 bp, Homo sapiens
attgtgtgtatatatatgtgtg

SEQ ID NO: 138799 - DNA, 23 bp, Homo sapiens
tatatgtatgtatatgtgtgtgt

SEQ ID NO: 138800 - DNA, 23 bp, Homo sapiens
tatgtgtgtgtatatatacgtgt

SEQ ID NO: 138801 - DNA, 22 bp, Homo sapiens
taggaactagaattaggcatga

SEQ ID NO: 138802 - DNA, 23 bp, Homo sapiens
taatttggatgtgtttatgtgtg

SEQ ID NO: 138803 - DNA, 20 bp, Homo sapiens
ttaggggtttgtgtgtgtgt

SEQ ID NO: 138804 - DNA, 23 bp, Homo sapiens
tatgtatatgtgtatatatgtgt

SEQ ID NO: 138805 - DNA, 23 bp, Homo sapiens
tatatgtgtatatatatgtgtgt

SEQ ID NO: 138806 - DNA, 22 bp, Homo sapiens
atatacacacacacatacatag

SEQ ID NO: 138807 - DNA, 23 bp, Homo sapiens
tcctatcattagtagtttgctga

SEQ ID NO: 138808 - DNA, 22 bp, Homo sapiens
tatcatttgccttctgggtgtg

SEQ ID NO: 138809 - DNA, 21 bp, Homo sapiens
attcttttgaggtagagttgc

SEQ ID NO: 138810 - DNA, 23 bp, Homo sapiens
tatgaaatacatgtgtatgtgta

SEQ ID NO: 138811 - DNA, 22 bp, Homo sapiens
tgggaggatgacttgagcttgg

SEQ ID NO: 138812 - DNA, 19 bp, Homo sapiens
tgagttggactctcactct

SEQ ID NO: 138813 - DNA, 19 bp, Homo sapiens
tgataagagccagaaatct

SEQ ID NO: 138814 - DNA, 23 bp, Homo sapiens
ttgctctgggtgagtctgtgtgt

SEQ ID NO: 138815 - DNA, 19 bp, Homo sapiens
gtctcgctctgtcacccac

SEQ ID NO: 138816 - DNA, 21 bp, Homo sapiens
tgggatgtagcagctgtcttg

SEQ ID NO: 138817 - DNA, 22 bp, Homo sapiens
tgaagagatttgatggtgtagc

SEQ ID NO: 138818 - DNA, 18 bp, Homo sapiens
ttatgacttcaaaagaaa

SEQ ID NO: 138819 - DNA, 22 bp, Homo sapiens
ttatgattttttaaggtgtaag

SEQ ID NO: 138820 - DNA, 23 bp, Homo sapiens
atatcagtaattgatatcaattt

SEQ ID NO: 138821 - DNA, 19 bp, Homo sapiens
tgttatgtatcatatatta

SEQ ID NO: 138822 - DNA, 23 bp, Homo sapiens
acagagtcgcactctgtcaccca

SEQ ID NO: 138823 - DNA, 23 bp, Homo sapiens
tatctatatctatacattagaag

SEQ ID NO: 138824 - DNA, 19 bp, Homo sapiens
atatctatcatgtatggat

SEQ ID NO: 138825 - DNA, 21 bp, Homo sapiens
aatgggttactagcactttga

SEQ ID NO: 138826 - DNA, 23 bp, Homo sapiens
tatgtatgtgtatatatattcat

SEQ ID NO: 138827 - DNA, 19 bp, Homo sapiens
aaagcttctttcagacagt

SEQ ID NO: 138828 - DNA, 23 bp, Homo sapiens
tatatgtgtgtgtatgtataatc

SEQ ID NO: 138829 - DNA, 21 bp, Homo sapiens
cacatacacaaatatggatgt

SEQ ID NO: 138830 - DNA, 20 bp, Homo sapiens
ttgaaaagagaggtaggaga

SEQ ID NO: 138831 - DNA, 22 bp, Homo sapiens
ataccgcattttctttatctga

SEQ ID NO: 138832 - DNA, 20 bp, Homo sapiens
ttacagatgtgagtcaccac

SEQ ID NO: 138833 - DNA, 23 bp, Homo sapiens
ctgggtgagtcagtgagtgagtg

SEQ ID NO: 138834 - DNA, 22 bp, Homo sapiens
tgtgtatatatgtatatatgta

SEQ ID NO: 138835 - DNA, 23 bp, Homo sapiens
tatgtgtatatatacgtgtgtat

SEQ ID NO: 138836 - DNA, 23 bp, Homo sapiens
ctgagtgagtcagagtcttatga

SEQ ID NO: 138837 - DNA, 21 bp, Homo sapiens
atatatctatatctatagata

SEQ ID NO: 138838 - DNA, 22 bp, Homo sapiens
tcactgtaacttctgcttcctg

SEQ ID NO: 138839 - DNA, 23 bp, Homo sapiens
aaagtctcactcactctcttgcc

SEQ ID NO: 138840 - DNA, 21 bp, Homo sapiens
tttgaaactcattgtgttgcc

SEQ ID NO: 138841 - DNA, 22 bp, Homo sapiens
tagatagtcagactcttttttt

SEQ ID NO: 138842 - DNA, 23 bp, Homo sapiens
aaatacagtctggctctgttgcc

SEQ ID NO: 138843 - DNA, 23 bp, Homo sapiens
tgagttcattgtagattctggat

SEQ ID NO: 138844 - DNA, 23 bp, Homo sapiens
tgagttcattgtagattctggat

SEQ ID NO: 138845 - DNA, 22 bp, Homo sapiens
tttctcactgacgaaaccatga

SEQ ID NO: 138846 - DNA, 22 bp, Homo sapiens
atatacacacatgtatatatct

SEQ ID NO: 138847 - DNA, 20 bp, Homo sapiens
tacacatgtgtatatctatt

SEQ ID NO: 138848 - DNA, 21 bp, Homo sapiens
tctcctgcaattgatgtccgt

SEQ ID NO: 138849 - DNA, 19 bp, Homo sapiens
aaatggctcaggtaatgaa

SEQ ID NO: 138850 - DNA, 23 bp, Homo sapiens
agtaatcagtgtgcatagattgt

SEQ ID NO: 138851 - DNA, 21 bp, Homo sapiens
tatttgcaggttcttgtatcg

SEQ ID NO: 138852 - DNA, 23 bp, Homo sapiens
tatgtgtgtatgtatatgtgtgt

SEQ ID NO: 138853 - DNA, 18 bp, Homo sapiens
gctttattttactatgag

SEQ ID NO: 138854 - DNA, 23 bp, Homo sapiens
tgagacagtctcagtctgtcacc

SEQ ID NO: 138855 - DNA, 23 bp, Homo sapiens
ctctgtgtgtgtctctctgtgtc

SEQ ID NO: 138856 - DNA, 19 bp, Homo sapiens
tccaagtctttgctattgt

SEQ ID NO: 138857 - DNA, 18 bp, Homo sapiens
tgtatgtatctttatagc

SEQ ID NO: 138858 - DNA, 21 bp, Homo sapiens
acagtcagtgtgtctctccat

SEQ ID NO: 138859 - DNA, 23 bp, Homo sapiens
tgagttcattgtagattctggat

SEQ ID NO: 138860 - DNA, 23 bp, Homo sapiens
ctgagacagtctcgctctgtcgc

SEQ ID NO: 138861 - DNA, 22 bp, Homo sapiens
tctgcatgtgtgtctgcatgtg

SEQ ID NO: 138862 - DNA, 23 bp, Homo sapiens
aagaaggatgtttcgtgttggac

SEQ ID NO: 138863 - DNA, 20 bp, Homo sapiens
acacgcatatactcacacat

SEQ ID NO: 138864 - DNA, 19 bp, Homo sapiens
tcacctggctttcataatg

SEQ ID NO: 138865 - DNA, 23 bp, Homo sapiens
acgctcgctctctgtgacagcaa

SEQ ID NO: 138866 - DNA, 23 bp, Homo sapiens
ggatttgcaatgtgagaaattag

SEQ ID NO: 138867 - DNA, 22 bp, Homo sapiens
taagttagatgaatcacagggc

SEQ ID NO: 138868 - DNA, 19 bp, Homo sapiens
tctttctgggaccaggatt

SEQ ID NO: 138869 - DNA, 22 bp, Homo sapiens
atgtctctcagaactgagaagg

SEQ ID NO: 138870 - DNA, 23 bp, Homo sapiens
tgtcaagtaccagatcttatgct

SEQ ID NO: 138871 - DNA, 23 bp, Homo sapiens
ttgtatgttgatgttgatggata

SEQ ID NO: 138872 - DNA, 23 bp, Homo sapiens
tctctctttctcactgtctgaag

SEQ ID NO: 138873 - DNA, 18 bp, Homo sapiens
ttcgtgctgagaaagtag

SEQ ID NO: 138874 - DNA, 23 bp, Homo sapiens
acatggttgtatacatatgtata

SEQ ID NO: 138875 - DNA, 21 bp, Homo sapiens
taacctgcatgttgtgcacat

SEQ ID NO: 138876 - DNA, 23 bp, Homo sapiens
gcatgtatatgtatgtgtgtgtg

SEQ ID NO: 138877 - DNA, 23 bp, Homo sapiens
gcatgtatatgtatgtgtgtgtg

SEQ ID NO: 138878 - DNA, 23 bp, Homo sapiens
tatgtgtatatatatgtatgtat

SEQ ID NO: 138879 - DNA, 22 bp, Homo sapiens
cctgtcacagtcagtttgggga

SEQ ID NO: 138880 - DNA, 23 bp, Homo sapiens
cattctggtttcagtggaaagtg

SEQ ID NO: 138881 - DNA, 19 bp, Homo sapiens
gtaaaacgtctacaaggag

SEQ ID NO: 138882 - DNA, 23 bp, Homo sapiens
attgtcaatgaaatagttgattg

SEQ ID NO: 138883 - DNA, 21 bp, Homo sapiens
aagtcagaagtttgagaccag

SEQ ID NO: 138884 - DNA, 21 bp, Homo sapiens
ttcagaggaattttctcagtg

SEQ ID NO: 138885 - DNA, 19 bp, Homo sapiens
aatttgcatttctaacagt

SEQ ID NO: 138886 - DNA, 23 bp, Homo sapiens
acagagtctcacttactctgtca

SEQ ID NO: 138887 - DNA, 22 bp, Homo sapiens
tatgtgtatatatatatgtgtg

SEQ ID NO: 138888 - DNA, 18 bp, Homo sapiens
tttcagacagatacatat

SEQ ID NO: 138889 - DNA, 23 bp, Homo sapiens
acagtctcactcactctgttgcc

SEQ ID NO: 138890 - DNA, 23 bp, Homo sapiens
agacggagtctcactctgtcacc

SEQ ID NO: 138891 - DNA, 23 bp, Homo sapiens
tgcagcggtgtgatcttggctca

SEQ ID NO: 138892 - DNA, 23 bp, Homo sapiens
tgtaaacggtgtacatgtagaca

SEQ ID NO: 138893 - DNA, 18 bp, Homo sapiens
tttttctatttgtaaaac

SEQ ID NO: 138894 - DNA, 18 bp, Homo sapiens
tgagtcagtgtctcgctc

SEQ ID NO: 138895 - DNA, 21 bp, Homo sapiens
ttctaggtgctcagaatgact

SEQ ID NO: 138896 - DNA, 22 bp, Homo sapiens
aagagtctctagcaaacatgtg

SEQ ID NO: 138897 - DNA, 23 bp, Homo sapiens
acagtgtctcattctgtcactga

SEQ ID NO: 138898 - DNA, 23 bp, Homo sapiens
tgagttcattgtagattctggat

SEQ ID NO: 138899 - DNA, 23 bp, Homo sapiens
tgagttcattgtagattctggat

SEQ ID NO: 138900 - DNA, 23 bp, Homo sapiens
ttacagtctgcttcttgtgtcca

SEQ ID NO: 138901 - DNA, 23 bp, Homo sapiens
tatcagactgtgtgtctcagttt

SEQ ID NO: 138902 - DNA, 22 bp, Homo sapiens
tctgtctctgtgacttaactgt

SEQ ID NO: 138903 - DNA, 23 bp, Homo sapiens
caactttactgaatttgtttatc

SEQ ID NO: 138904 - DNA, 22 bp, Homo sapiens
tttttggtggagtatataggtt

SEQ ID NO: 138905 - DNA, 23 bp, Homo sapiens
tcacttgactagtgaaacagatg

SEQ ID NO: 138906 - DNA, 22 bp, Homo sapiens
cttagtggctgaagactgacac

SEQ ID NO: 138907 - DNA, 22 bp, Homo sapiens
tacagtgcaatgtagcctcttc

SEQ ID NO: 138908 - DNA, 19 bp, Homo sapiens
atgtgttcatatacatgtg

SEQ ID NO: 138909 - DNA, 19 bp, Homo sapiens
atgagtatatatgtatata

SEQ ID NO: 138910 - DNA, 19 bp, Homo sapiens
atgagtatatatgtatata

SEQ ID NO: 138911 - DNA, 19 bp, Homo sapiens
atgagtatatatgtatata

SEQ ID NO: 138912 - DNA, 20 bp, Homo sapiens
atgagtatatatgtatatat

SEQ ID NO: 138913 - DNA, 23 bp, Homo sapiens
tttttggttccatatgaattcta

SEQ ID NO: 138914 - DNA, 19 bp, Homo sapiens
cagccaatgaaatgtctct

SEQ ID NO: 138915 - DNA, 22 bp, Homo sapiens
ataattgtctttgcgctgtgtg

SEQ ID NO: 138916 - DNA, 23 bp, Homo sapiens
tagtttgtcactgatgtcatgcc

SEQ ID NO: 138917 - DNA, 22 bp, Homo sapiens
ttttgtgtaaggacatgttttc

SEQ ID NO: 138918 - DNA, 23 bp, Homo sapiens
gcagaggaagaaggttattttga

SEQ ID NO: 138919 - DNA, 23 bp, Homo sapiens
tctgggtgacagagcaatactct

SEQ ID NO: 138920 - DNA, 21 bp, Homo sapiens
tctgagactgaagggtggtcc

SEQ ID NO: 138921 - DNA, 23 bp, Homo sapiens
tgacagtagtgagtcagcttttg

SEQ ID NO: 138922 - DNA, 23 bp, Homo sapiens
gtacagtactgtgataactgaag

SEQ ID NO: 138923 - DNA, 23 bp, Homo sapiens
agtctcactctgtcacccaggct

SEQ ID NO: 138924 - DNA, 23 bp, Homo sapiens
atatgtatatatacatatgtgtg

SEQ ID NO: 138925 - DNA, 23 bp, Homo sapiens
tgtgtatatatacatatgtatgt

SEQ ID NO: 138926 - DNA, 22 bp, Homo sapiens
atctcactagtacttctgtaga

SEQ ID NO: 138927 - DNA, 19 bp, Homo sapiens
ttctggaagagtctgtatt

SEQ ID NO: 138928 - DNA, 21 bp, Homo sapiens
tgaatcagcatctgcatggcc

SEQ ID NO: 138929 - DNA, 23 bp, Homo sapiens
cgagtgtggggtatgtgtgtgag

SEQ ID NO: 138930 - DNA, 21 bp, Homo sapiens
aatagagaagttacagagcac

SEQ ID NO: 138931 - DNA, 22 bp, Homo sapiens
tatgtgtatatatacatatgtg

SEQ ID NO: 138932 - DNA, 22 bp, Homo sapiens
tgtctccctctgtaacaccctc

SEQ ID NO: 138933 - DNA, 19 bp, Homo sapiens
aaacagagtgaactttttt

SEQ ID NO: 138934 - DNA, 23 bp, Homo sapiens
tgagacagagtctggctctgttg

SEQ ID NO: 138935 - DNA, 22 bp, Homo sapiens
ttgtgaggtagtacataattta

SEQ ID NO: 138936 - DNA, 23 bp, Homo sapiens
agactctggtaatcatccttgta

SEQ ID NO: 138937 - DNA, 23 bp, Homo sapiens
tgacaacaagggatgtttgtctt

SEQ ID NO: 138938 - DNA, 23 bp, Homo sapiens
tctccttgaagaggtccttcaca

SEQ ID NO: 138939 - DNA, 21 bp, Homo sapiens
attgtgaatgggacttcactc

SEQ ID NO: 138940 - DNA, 23 bp, Homo sapiens
tggagtctcactctgtcacccag

SEQ ID NO: 138941 - DNA, 23 bp, Homo sapiens
gggagtctcactctgtcacccag

SEQ ID NO: 138942 - DNA, 23 bp, Homo sapiens
acaaggctctggtagatttcagg

SEQ ID NO: 138943 - DNA, 23 bp, Homo sapiens
gtctggctctgtcacccagtgca

SEQ ID NO: 138944 - DNA, 23 bp, Homo sapiens
tgctgagagtggggtgttgaagt

SEQ ID NO: 138945 - DNA, 23 bp, Homo sapiens
gtgagtctgtgtgtgtgccaggg

SEQ ID NO: 138946 - DNA, 22 bp, Homo sapiens
tatgagaggaatctagtcaggt

SEQ ID NO: 138947 - DNA, 21 bp, Homo sapiens
taaagatggagatttgcttga

SEQ ID NO: 138948 - DNA, 21 bp, Homo sapiens
atgtctctgtctctaacacag

SEQ ID NO: 138949 - DNA, 22 bp, Homo sapiens
tgcattgtaaatctgttagaag

SEQ ID NO: 138950 - DNA, 21 bp, Homo sapiens
tcaaaacaatggaagtctgtg

SEQ ID NO: 138951 - DNA, 23 bp, Homo sapiens
atatgtgcatatgtttgcatgta

SEQ ID NO: 138952 - DNA, 23 bp, Homo sapiens
gtatgcatgtatgtatttatcta

SEQ ID NO: 138953 - DNA, 23 bp, Homo sapiens
agtgtctgtgtgtgtgtgtgcat

SEQ ID NO: 138954 - DNA, 21 bp, Homo sapiens
tgaggtaggaggatcatttga

SEQ ID NO: 138955 - DNA, 23 bp, Homo sapiens
gtgtgactgtgtgactctgggcc

SEQ ID NO: 138956 - DNA, 23 bp, Homo sapiens
actctgtttggttttcttggagt

SEQ ID NO: 138957 - DNA, 23 bp, Homo sapiens
aaagtagtgacagagcagaggct

SEQ ID NO: 138958 - DNA, 23 bp, Homo sapiens
tgagactgagtctcgctctgtca

SEQ ID NO: 138959 - DNA, 23 bp, Homo sapiens
tatgtgtatatacatgtgtgtgt

SEQ ID NO: 138960 - DNA, 23 bp, Homo sapiens
atatgtgtatatatatatgtgtg

SEQ ID NO: 138961 - DNA, 22 bp, Homo sapiens
ggaagagtttctcagacttttc

SEQ ID NO: 138962 - DNA, 23 bp, Homo sapiens
tttttctttctttatgaaatgtt

SEQ ID NO: 138963 - DNA, 20 bp, Homo sapiens
tgtcttctctctgtgtcttc

SEQ ID NO: 138964 - DNA, 23 bp, Homo sapiens
gagagagagagcaagtgctagcc

SEQ ID NO: 138965 - DNA, 23 bp, Homo sapiens
acctagagtacagacttttttct

SEQ ID NO: 138966 - DNA, 21 bp, Homo sapiens
ttaaagagaaaatgtttttat

SEQ ID NO: 138967 - DNA, 22 bp, Homo sapiens
tgcaagagaagtgattttattg

SEQ ID NO: 138968 - DNA, 23 bp, Homo sapiens
aaaacagagccagcaaagggaaa

SEQ ID NO: 138969 - DNA, 22 bp, Homo sapiens
atacacgtacatatacatatat

SEQ ID NO: 138970 - DNA, 23 bp, Homo sapiens
tatattgctctatatatagagca

SEQ ID NO: 138971 - DNA, 18 bp, Homo sapiens
atgtagacgggattgtag

SEQ ID NO: 138972 - DNA, 18 bp, Homo sapiens
tgcacagttatgtataca

SEQ ID NO: 138973 - DNA, 21 bp, Homo sapiens
tatatatacatatacatgtac

SEQ ID NO: 138974 - DNA, 18 bp, Homo sapiens
atgttaacatgtaatctg

SEQ ID NO: 138975 - DNA, 20 bp, Homo sapiens
ccaactgaccacatttctgt

SEQ ID NO: 138976 - DNA, 20 bp, Homo sapiens
atatgtatatatgtatatct

SEQ ID NO: 138977 - DNA, 19 bp, Homo sapiens
tgtgtatatatatatacgt

SEQ ID NO: 138978 - DNA, 19 bp, Homo sapiens
tatacacacacgtatatat

SEQ ID NO: 138979 - DNA, 23 bp, Homo sapiens
tgagttcattgtagattctggat

SEQ ID NO: 138980 - DNA, 23 bp, Homo sapiens
tgagttcattgtagattctggat

SEQ ID NO: 138981 - DNA, 23 bp, Homo sapiens
tgagttcattgtagattctggat

SEQ ID NO: 138982 - DNA, 23 bp, Homo sapiens
tgagttcattgtagattctggat

SEQ ID NO: 138983 - DNA, 23 bp, Homo sapiens
aagtgaagtgagagacaagactg

SEQ ID NO: 138984 - DNA, 23 bp, Homo sapiens
ataatttgtgattttctagatgt

SEQ ID NO: 138985 - DNA, 20 bp, Homo sapiens
tcactgcaacctctgcctct

SEQ ID NO: 138986 - DNA, 21 bp, Homo sapiens
tgtgaagaaagtcaatggtag

SEQ ID NO: 138987 - DNA, 23 bp, Homo sapiens
agttaggaagaagcttgtcaagt

SEQ ID NO: 138988 - DNA, 23 bp, Homo sapiens
gtgtgtcctagttatatgacttt

SEQ ID NO: 138989 - DNA, 23 bp, Homo sapiens
tatgtttcttcatcttttagcca

SEQ ID NO: 138990 - DNA, 22 bp, Homo sapiens
tggtagttcttgaagcaaaagt

SEQ ID NO: 138991 - DNA, 23 bp, Homo sapiens
tgagttcattgtagattctggat

SEQ ID NO: 138992 - DNA, 23 bp, Homo sapiens
tgagttcattgtagattctggat

SEQ ID NO: 138993 - DNA, 23 bp, Homo sapiens
tgagttcattgtagattctggat

SEQ ID NO: 138994 - DNA, 23 bp, Homo sapiens
tgagttcattgtagattctggat

SEQ ID NO: 138995 - DNA, 23 bp, Homo sapiens
ggcagggtctcactctgtcaccc

SEQ ID NO: 138996 - DNA, 23 bp, Homo sapiens
agtcagagtctcgctctgtcacc

SEQ ID NO: 138997 - DNA, 23 bp, Homo sapiens
tcacagaagacagtgaggagtaa

SEQ ID NO: 138998 - DNA, 21 bp, Homo sapiens
tgacacaagttgatgagtgct

SEQ ID NO: 138999 - DNA, 23 bp, Homo sapiens
aatttcagactgtaaatgtggtg

SEQ ID NO: 139000 - DNA, 23 bp, Homo sapiens
tttgtgtctcagaattagatctg

SEQ ID NO: 139001 - DNA, 21 bp, Homo sapiens
aggatcacttgatcctgggag

SEQ ID NO: 139002 - DNA, 23 bp, Homo sapiens
cagtgtcagtcacactgtcatct

SEQ ID NO: 139003 - DNA, 21 bp, Homo sapiens
aatggagttgtttgggtcgga

SEQ ID NO: 139004 - DNA, 23 bp, Homo sapiens
cactgtctcagtcacaattttgt

SEQ ID NO: 139005 - DNA, 22 bp, Homo sapiens
tctcagcctccatagtagctgg

SEQ ID NO: 139006 - DNA, 23 bp, Homo sapiens
aatctgttgtactttgtgctatg

SEQ ID NO: 139007 - DNA, 18 bp, Homo sapiens
atttgtctttccatatct

SEQ ID NO: 139008 - DNA, 21 bp, Homo sapiens
tgcattgtaatgaagaaagca

SEQ ID NO: 139009 - DNA, 23 bp, Homo sapiens
aaatacaagtagattatgtttcg

SEQ ID NO: 139010 - DNA, 21 bp, Homo sapiens
aacacttgtcactggaatgag

SEQ ID NO: 139011 - DNA, 23 bp, Homo sapiens
tcttccagcctctcactgtttgt

SEQ ID NO: 139012 - DNA, 23 bp, Homo sapiens
gagtctcactctgtcacccaggc

SEQ ID NO: 139013 - DNA, 23 bp, Homo sapiens
tttgttgtttaattctttagaat

SEQ ID NO: 139014 - DNA, 20 bp, Homo sapiens
acacacacatgctgtctctt

SEQ ID NO: 139015 - DNA, 23 bp, Homo sapiens
cacatgttcaaagtcagagagga

SEQ ID NO: 139016 - DNA, 23 bp, Homo sapiens
acagacagaacagtgtctggaga

SEQ ID NO: 139017 - DNA, 22 bp, Homo sapiens
taaggtcatgtgctactcaaaa

SEQ ID NO: 139018 - DNA, 23 bp, Homo sapiens
tcacagtctggctgttatttgtg

SEQ ID NO: 139019 - DNA, 23 bp, Homo sapiens
gccaattgataaattgtagttgt

SEQ ID NO: 139020 - DNA, 23 bp, Homo sapiens
tgagttcattgtagattctggat

SEQ ID NO: 139021 - DNA, 23 bp, Homo sapiens
tgagttcattgtagattctggat

SEQ ID NO: 139022 - DNA, 23 bp, Homo sapiens
ttgtttctgtgcatctccatgtc

SEQ ID NO: 139023 - DNA, 23 bp, Homo sapiens
aacagttgacagaagataggatg

SEQ ID NO: 139024 - DNA, 21 bp, Homo sapiens
tctgatgagtcagagcacact

SEQ ID NO: 139025 - DNA, 21 bp, Homo sapiens
tttgcttatggaacaagtgac

SEQ ID NO: 139026 - DNA, 23 bp, Homo sapiens
gctgtgtcactgtttgtcttggc

SEQ ID NO: 139027 - DNA, 20 bp, Homo sapiens
tttgagtgggacacatacac

SEQ ID NO: 139028 - DNA, 22 bp, Homo sapiens
gcgacacagtgagactgtctct

SEQ ID NO: 139029 - DNA, 21 bp, Homo sapiens
attatggatatctattattta

SEQ ID NO: 139030 - DNA, 23 bp, Homo sapiens
tggacagtgcaagttttttcatg

SEQ ID NO: 139031 - DNA, 23 bp, Homo sapiens
tgagttcattgtagattctggat

SEQ ID NO: 139032 - DNA, 23 bp, Homo sapiens
tgagttcattgtagattctggat

SEQ ID NO: 139033 - DNA, 23 bp, Homo sapiens
tgagttcattgtagattctggat

SEQ ID NO: 139034 - DNA, 23 bp, Homo sapiens
tgagttcattgtagattctggat

SEQ ID NO: 139035 - DNA, 23 bp, Homo sapiens
tgagttcattgtagattctggat

SEQ ID NO: 139036 - DNA, 23 bp, Homo sapiens
tgagttcattgtagattctggat

SEQ ID NO: 139037 - DNA, 21 bp, Homo sapiens
tactcgataagattactgtat

SEQ ID NO: 139038 - DNA, 20 bp, Homo sapiens
tgtagtactgcgtgacatca

SEQ ID NO: 139039 - DNA, 23 bp, Homo sapiens
caggaagacagtgagaattcact

SEQ ID NO: 139040 - DNA, 23 bp, Homo sapiens
ctgtggcactgagtcagagttgt

SEQ ID NO: 139041 - DNA, 23 bp, Homo sapiens
tgagttcattgtagattctggat

SEQ ID NO: 139042 - DNA, 23 bp, Homo sapiens
tgagttcattgtagattctggat

SEQ ID NO: 139043 - DNA, 20 bp, Homo sapiens
cacagcagtgagtgagcact

SEQ ID NO: 139044 - DNA, 20 bp, Homo sapiens
ttaagagcagaggctgcacc

SEQ ID NO: 139045 - DNA, 23 bp, Homo sapiens
aagctcagcatggagcattagat

SEQ ID NO: 139046 - DNA, 22 bp, Homo sapiens
cttccaagtgagattttgttct

SEQ ID NO: 139047 - DNA, 19 bp, Homo sapiens
tgtgcatatatatatatat

SEQ ID NO: 139048 - DNA, 19 bp, Homo sapiens
tgtctagtccagggctttt

SEQ ID NO: 139049 - DNA, 20 bp, Homo sapiens
agctagaaggttgtagggat

SEQ ID NO: 139050 - DNA, 23 bp, Homo sapiens
tggagtcagtactgaatgagctg

SEQ ID NO: 139051 - DNA, 23 bp, Homo sapiens
agctctgaaaagagagtgagcac

SEQ ID NO: 139052 - DNA, 23 bp, Homo sapiens
atgtcactggaggatttgttatg

SEQ ID NO: 139053 - DNA, 20 bp, Homo sapiens
tcagcgtcactattatcagt

SEQ ID NO: 139054 - DNA, 23 bp, Homo sapiens
gtgggtgggtgtgaatattatct

SEQ ID NO: 139055 - DNA, 20 bp, Homo sapiens
actatactacttcctgtgga

SEQ ID NO: 139056 - DNA, 23 bp, Homo sapiens
cagtggttttatgttgctgtcat

SEQ ID NO: 139057 - DNA, 22 bp, Homo sapiens
actattgctgatgtaacggggt

SEQ ID NO: 139058 - DNA, 23 bp, Homo sapiens
tctcactctgtcactgaggcttc

SEQ ID NO: 139059 - DNA, 21 bp, Homo sapiens
ctgagtcagtgtttgtggatt

SEQ ID NO: 139060 - DNA, 20 bp, Homo sapiens
tcaaataaattctagctcta

SEQ ID NO: 139061 - DNA, 19 bp, Homo sapiens
tgcaatgatgtgtggcatt

SEQ ID NO: 139062 - DNA, 20 bp, Homo sapiens
tcaggtccatcatgtggcca

SEQ ID NO: 139063 - DNA, 23 bp, Homo sapiens
tgagattcagatttagtagttct

SEQ ID NO: 139064 - DNA, 20 bp, Homo sapiens
taacgtttttctaataggtg

SEQ ID NO: 139065 - DNA, 21 bp, Homo sapiens
tcagccagtctcacttgtggg

SEQ ID NO: 139066 - DNA, 20 bp, Homo sapiens
tgtgagccactgtgcctggc

SEQ ID NO: 139067 - DNA, 23 bp, Homo sapiens
atgtatgtgtatatatatacgtg

SEQ ID NO: 139068 - DNA, 23 bp, Homo sapiens
aaatgtgcatttgtaaatactgt

SEQ ID NO: 139069 - DNA, 23 bp, Homo sapiens
tgtctctgaaagtagcttggtga

SEQ ID NO: 139070 - DNA, 23 bp, Homo sapiens
ctccctgtgtccctgtgttctca

SEQ ID NO: 139071 - DNA, 23 bp, Homo sapiens
atatgtgtatatatatgtgtgtg

SEQ ID NO: 139072 - DNA, 23 bp, Homo sapiens
tatgtgtgtgtgtgtgtgcgtat

SEQ ID NO: 139073 - DNA, 22 bp, Homo sapiens
tcatgatttcatgatgccttgc

SEQ ID NO: 139074 - DNA, 23 bp, Homo sapiens
gggtctcactctgtcacccaggc

SEQ ID NO: 139075 - DNA, 23 bp, Homo sapiens
tgagttcattgtagattctggat

SEQ ID NO: 139076 - DNA, 23 bp, Homo sapiens
tgagttcattgtagattctggat

SEQ ID NO: 139077 - DNA, 23 bp, Homo sapiens
aggctgagagattggtgatagag

SEQ ID NO: 139078 - DNA, 23 bp, Homo sapiens
aaatcattctgtcaccctctctg

SEQ ID NO: 139079 - DNA, 23 bp, Homo sapiens
gacagagtctcgctctgtcaccc

SEQ ID NO: 139080 - DNA, 22 bp, Homo sapiens
tcagagaagagtgactgctgaa

SEQ ID NO: 139081 - DNA, 23 bp, Homo sapiens
tgcaagaccagccatctgacttt

SEQ ID NO: 139082 - DNA, 23 bp, Homo sapiens
tgagttcattgtagattctggat

SEQ ID NO: 139083 - DNA, 23 bp, Homo sapiens
tgagttcattgtagattctggat

SEQ ID NO: 139084 - DNA, 23 bp, Homo sapiens
tttgttctttttcattaggattg

SEQ ID NO: 139085 - DNA, 22 bp, Homo sapiens
tgaggttcaaggaagaatgaga

SEQ ID NO: 139086 - DNA, 19 bp, Homo sapiens
tgcatgtgtatttgtatca

SEQ ID NO: 139087 - DNA, 21 bp, Homo sapiens
atatgtccatataaatacata

SEQ ID NO: 139088 - DNA, 23 bp, Homo sapiens
ggctccctgactggtaaagtgat

SEQ ID NO: 139089 - DNA, 19 bp, Homo sapiens
tctctagtgattatgtagt

SEQ ID NO: 139090 - DNA, 18 bp, Homo sapiens
attagttatccatttgtt

SEQ ID NO: 139091 - DNA, 21 bp, Homo sapiens
atgagaattgtagaaattgta

SEQ ID NO: 139092 - DNA, 23 bp, Homo sapiens
ttatccttccttttgctttgcag

SEQ ID NO: 139093 - DNA, 23 bp, Homo sapiens
tatgtctgtgaggtattctggct

SEQ ID NO: 139094 - DNA, 23 bp, Homo sapiens
tctctgtgtctgtctctctctat

SEQ ID NO: 139095 - DNA, 22 bp, Homo sapiens
tgtgtgtatatatatgtatgtg

SEQ ID NO: 139096 - DNA, 23 bp, Homo sapiens
atttctgtgtgaatatacttgtg

SEQ ID NO: 139097 - DNA, 23 bp, Homo sapiens
atatgtatatgaaggcacagtgt

SEQ ID NO: 139098 - DNA, 23 bp, Homo sapiens
gtgtgcgtgtgtgtgtgtatgtg

SEQ ID NO: 139099 - DNA, 23 bp, Homo sapiens
atatatgtacacacacacacaca

SEQ ID NO: 139100 - DNA, 23 bp, Homo sapiens
tatgtatatatatatgtgtgtgt

SEQ ID NO: 139101 - DNA, 21 bp, Homo sapiens
taatgtatatgaatatgtata

SEQ ID NO: 139102 - DNA, 21 bp, Homo sapiens
taagcatgtatataagtgtat

SEQ ID NO: 139103 - DNA, 23 bp, Homo sapiens
tgagtcggtgtctcactctgttg

SEQ ID NO: 139104 - DNA, 23 bp, Homo sapiens
tctgtgtatatatatatgtgtgt

SEQ ID NO: 139105 - DNA, 23 bp, Homo sapiens
cactcttacactgtctcatttgt

SEQ ID NO: 139106 - DNA, 21 bp, Homo sapiens
gagagacgtgtgggagcagat

SEQ ID NO: 139107 - DNA, 21 bp, Homo sapiens
tctgcctcaattcgcttgtca

SEQ ID NO: 139108 - DNA, 23 bp, Homo sapiens
atatatctagatatatatatgtg

SEQ ID NO: 139109 - DNA, 23 bp, Homo sapiens
tgagagtgatgtgttatagttgt

SEQ ID NO: 139110 - DNA, 18 bp, Homo sapiens
agtatagatgcatacaca

SEQ ID NO: 139111 - DNA, 23 bp, Homo sapiens
tggagtctcactctgtcacccag

SEQ ID NO: 139112 - DNA, 18 bp, Homo sapiens
cagtggtatgatctcagc

SEQ ID NO: 139113 - DNA, 21 bp, Homo sapiens
tgtctggcttaatgtgagaga

SEQ ID NO: 139114 - DNA, 22 bp, Homo sapiens
aagtctgatcattttggactgg

SEQ ID NO: 139115 - DNA, 21 bp, Homo sapiens
aaagtatgttttggtaatggt

SEQ ID NO: 139116 - DNA, 21 bp, Homo sapiens
tctgtagatatatatacagat

SEQ ID NO: 139117 - DNA, 21 bp, Homo sapiens
tggtatattaatcagtgttct

SEQ ID NO: 139118 - DNA, 19 bp, Homo sapiens
tcatatctatatatagtga

SEQ ID NO: 139119 - DNA, 23 bp, Homo sapiens
atatgtgtatatgtatatatgcg

SEQ ID NO: 139120 - DNA, 23 bp, Homo sapiens
atctatgtgtatatatatgtatg

SEQ ID NO: 139121 - DNA, 21 bp, Homo sapiens
tgtgtatatatgtgtgtgtat

SEQ ID NO: 139122 - DNA, 23 bp, Homo sapiens
acatgaatatgtttatatgtata

SEQ ID NO: 139123 - DNA, 19 bp, Homo sapiens
acacatacatatgcatact

SEQ ID NO: 139124 - DNA, 19 bp, Homo sapiens
atatgtgtatatatagatg

SEQ ID NO: 139125 - DNA, 19 bp, Homo sapiens
taaagacactagttatatt

SEQ ID NO: 139126 - DNA, 23 bp, Homo sapiens
atatatgtgctatatgtatgtat

SEQ ID NO: 139127 - DNA, 20 bp, Homo sapiens
tatgtgtgtgtatatagatg

SEQ ID NO: 139128 - DNA, 20 bp, Homo sapiens
atatgtgtgtatatagatgt

SEQ ID NO: 139129 - DNA, 23 bp, Homo sapiens
atatgtgtatatatatatgtgta

SEQ ID NO: 139130 - DNA, 23 bp, Homo sapiens
ttatctcaaattgtaattctcac

SEQ ID NO: 139131 - DNA, 23 bp, Homo sapiens
tgtattgatatgtacgtgtgtgt

SEQ ID NO: 139132 - DNA, 21 bp, Homo sapiens
tggtgtctccctctgtctccc

SEQ ID NO: 139133 - DNA, 23 bp, Homo sapiens
gtgtatgtatgtgtacatgtgaa

SEQ ID NO: 139134 - DNA, 23 bp, Homo sapiens
atgtatgtgtgcatgtgttatat

SEQ ID NO: 139135 - DNA, 23 bp, Homo sapiens
actgagtctcactctgtcgccca

SEQ ID NO: 139136 - DNA, 23 bp, Homo sapiens
tggagtctcactctgtcactgag

SEQ ID NO: 139137 - DNA, 22 bp, Homo sapiens
tgacagatagatgatatgtgtt

SEQ ID NO: 139138 - DNA, 23 bp, Homo sapiens
tatcaatatgtatgtatatatgt

SEQ ID NO: 139139 - DNA, 23 bp, Homo sapiens
cacagtagtgtgtagtaaagttc

SEQ ID NO: 139140 - DNA, 23 bp, Homo sapiens
cctctgtctctgtctctgtgtgt

SEQ ID NO: 139141 - DNA, 23 bp, Homo sapiens
tgagttcattgtagattctggat

SEQ ID NO: 139142 - DNA, 23 bp, Homo sapiens
tgagttcattgtagattctggat

SEQ ID NO: 139143 - DNA, 22 bp, Homo sapiens
tactatatatactgtagtgtat

SEQ ID NO: 139144 - DNA, 19 bp, Homo sapiens
tgtgattagagcttcacgg

SEQ ID NO: 139145 - DNA, 22 bp, Homo sapiens
taaagcagttcttgtattgagg

SEQ ID NO: 139146 - DNA, 23 bp, Homo sapiens
atccgcaatagaaagcagttacc

SEQ ID NO: 139147 - DNA, 23 bp, Homo sapiens
gtttatcactaggatatggaatg

SEQ ID NO: 139148 - DNA, 18 bp, Homo sapiens
taccctttatgtatatgt

SEQ ID NO: 139149 - DNA, 23 bp, Homo sapiens
tgagttcattgtagattctggat

SEQ ID NO: 139150 - DNA, 23 bp, Homo sapiens
tgagttcattgtagattctggat

SEQ ID NO: 139151 - DNA, 23 bp, Homo sapiens
cagggtctcactctgtcacccag

SEQ ID NO: 139152 - DNA, 23 bp, Homo sapiens
accaaatcttaggctagtgtttc

SEQ ID NO: 139153 - DNA, 23 bp, Homo sapiens
ggagtctctcactgtcgctgagg

SEQ ID NO: 139154 - DNA, 18 bp, Homo sapiens
acatatatatacacacac

SEQ ID NO: 139155 - DNA, 23 bp, Homo sapiens
tttatgaggaatccgcatctacc

SEQ ID NO: 139156 - DNA, 22 bp, Homo sapiens
tatgtatgcatatatatacaca

SEQ ID NO: 139157 - DNA, 21 bp, Homo sapiens
atgtgtatatatgtatatgta

SEQ ID NO: 139158 - DNA, 22 bp, Homo sapiens
tttggatgtatgtatgtatgta

SEQ ID NO: 139159 - DNA, 23 bp, Homo sapiens
tcttattggttttgattacaggt

SEQ ID NO: 139160 - DNA, 23 bp, Homo sapiens
tgtgtgtgtgtgtatgtgtacat

SEQ ID NO: 139161 - DNA, 22 bp, Homo sapiens
atatatgtaaatatacatatgt

SEQ ID NO: 139162 - DNA, 19 bp, Homo sapiens
tatgtatacacacacacac

SEQ ID NO: 139163 - DNA, 22 bp, Homo sapiens
gtatgtgtatgtgtatgtgtat

SEQ ID NO: 139164 - DNA, 23 bp, Homo sapiens
tgtgtatatgtatgtgtctgtat

SEQ ID NO: 139165 - DNA, 19 bp, Homo sapiens
gcctcactcacaggctgag

SEQ ID NO: 139166 - DNA, 21 bp, Homo sapiens
tggtagaactgaggctggaga

SEQ ID NO: 139167 - DNA, 20 bp, Homo sapiens
atgagctttttttcatatgt

SEQ ID NO: 139168 - DNA, 23 bp, Homo sapiens
ttttttggttccatatgaaattt

SEQ ID NO: 139169 - DNA, 23 bp, Homo sapiens
taattctgtgaggaaagtcagtg

SEQ ID NO: 139170 - DNA, 23 bp, Homo sapiens
agtatgtgtatactatgtgtgtg

SEQ ID NO: 139171 - DNA, 23 bp, Homo sapiens
atgtttcaccatgtgcatgtgct

SEQ ID NO: 139172 - DNA, 23 bp, Homo sapiens
tatgcatatatgtacatatgtat

SEQ ID NO: 139173 - DNA, 22 bp, Homo sapiens
tgaatttgctttctctctctct

SEQ ID NO: 139174 - DNA, 23 bp, Homo sapiens
atgctgtgagatgatgaagtgtt

SEQ ID NO: 139175 - DNA, 18 bp, Homo sapiens
ggatagtttattagtgta

SEQ ID NO: 139176 - DNA, 20 bp, Homo sapiens
gtatatatatatatgtgtgt

SEQ ID NO: 139177 - DNA, 23 bp, Homo sapiens
tagttgctagaatagtttagctt

SEQ ID NO: 139178 - DNA, 21 bp, Homo sapiens
gtttcagtaaatgttaaggta

SEQ ID NO: 139179 - DNA, 18 bp, Homo sapiens
tcacaatatatattgttg

SEQ ID NO: 139180 - DNA, 23 bp, Homo sapiens
tatgtgtatatatatacgtatgt

SEQ ID NO: 139181 - DNA, 23 bp, Homo sapiens
atatgtgtatatgtgtgtgtgtg

SEQ ID NO: 139182 - DNA, 23 bp, Homo sapiens
tgtgcgtgtatgtgtgtgtgtat

SEQ ID NO: 139183 - DNA, 23 bp, Homo sapiens
atgcatgtgtatttatatatatg

SEQ ID NO: 139184 - DNA, 23 bp, Homo sapiens
tgtgtgtgtatatatgtatgtgt

SEQ ID NO: 139185 - DNA, 20 bp, Homo sapiens
tatgttttattagctatatg

SEQ ID NO: 139186 - DNA, 20 bp, Homo sapiens
gtccaattatatatataaat

SEQ ID NO: 139187 - DNA, 23 bp, Homo sapiens
atacatatagttggactacatat

SEQ ID NO: 139188 - DNA, 22 bp, Homo sapiens
tatgtgtatatgtatatattcc

SEQ ID NO: 139189 - DNA, 23 bp, Homo sapiens
acatatgtgtatatgtatatatg

SEQ ID NO: 139190 - DNA, 23 bp, Homo sapiens
atatgtatgtatatatgtgtgta

SEQ ID NO: 139191 - DNA, 23 bp, Homo sapiens
aatggaatctaaagatctgtgat

SEQ ID NO: 139192 - DNA, 23 bp, Homo sapiens
taatatggacatatatcagttcc

SEQ ID NO: 139193 - DNA, 23 bp, Homo sapiens
actgagtcagattaagatccctt

SEQ ID NO: 139194 - DNA, 19 bp, Homo sapiens
tgtgtatatatatacacat

SEQ ID NO: 139195 - DNA, 21 bp, Homo sapiens
ttcacgatctgcacgtcactg

SEQ ID NO: 139196 - DNA, 23 bp, Homo sapiens
caccagactcagagtgccagtgg

SEQ ID NO: 139197 - DNA, 23 bp, Homo sapiens
accattgcattttcagcatgtag

SEQ ID NO: 139198 - DNA, 23 bp, Homo sapiens
tgtatatatgtacatatacttat

SEQ ID NO: 139199 - DNA, 23 bp, Homo sapiens
atatgtgtatgtatatgtgtgtg

SEQ ID NO: 139200 - DNA, 23 bp, Homo sapiens
tgttacactattcataatgttct

SEQ ID NO: 139201 - DNA, 23 bp, Homo sapiens
tgtgtgtactcagtgtggtcaag

SEQ ID NO: 139202 - DNA, 23 bp, Homo sapiens
gagactcagggattcagtatcta

SEQ ID NO: 139203 - DNA, 23 bp, Homo sapiens
gtggtggtgtgtgtgtctctagt

SEQ ID NO: 139204 - DNA, 23 bp, Homo sapiens
tatgtgtagatacatgtgtgtgt

SEQ ID NO: 139205 - DNA, 23 bp, Homo sapiens
tatgcatgtgtgtgtgtatatac

SEQ ID NO: 139206 - DNA, 23 bp, Homo sapiens
gcctcacagtctctgaattgggt

SEQ ID NO: 139207 - DNA, 21 bp, Homo sapiens
gtgggtggatgcgtgcgtctg

SEQ ID NO: 139208 - DNA, 23 bp, Homo sapiens
atgtgtgtgtctctgtgtgtctg

SEQ ID NO: 139209 - DNA, 20 bp, Homo sapiens
tatctgtagtcctagctact

SEQ ID NO: 139210 - DNA, 20 bp, Homo sapiens
acacacacatatatacacgc

SEQ ID NO: 139211 - DNA, 22 bp, Homo sapiens
tgtgtgtatatatatgtatgtg

SEQ ID NO: 139212 - DNA, 23 bp, Homo sapiens
gtctctgggtctctgagccagtg

SEQ ID NO: 139213 - DNA, 23 bp, Homo sapiens
agtagaaggctgagtcctgtaca

SEQ ID NO: 139214 - DNA, 23 bp, Homo sapiens
aaatggaaactgacatttgtata

SEQ ID NO: 139215 - DNA, 23 bp, Homo sapiens
cggagtctcgctctgtcaccctg

SEQ ID NO: 139216 - DNA, 23 bp, Homo sapiens
ggagacaagagtttcgcttttgt

SEQ ID NO: 139217 - DNA, 23 bp, Homo sapiens
gacagtctcgctctgtcacccag

SEQ ID NO: 139218 - DNA, 20 bp, Homo sapiens
tctcactctgtcactaggct

SEQ ID NO: 139219 - DNA, 23 bp, Homo sapiens
tgtatatatgatagtgtgtgtgt

SEQ ID NO: 139220 - DNA, 23 bp, Homo sapiens
tatataagtatgtatatatgtgt

SEQ ID NO: 139221 - DNA, 23 bp, Homo sapiens
agaggttgcagtgagccaagatt

SEQ ID NO: 139222 - DNA, 23 bp, Homo sapiens
tgtctgggccagattgacgtgtg

SEQ ID NO: 139223 - DNA, 21 bp, Homo sapiens
tgaggttggaggatcacttga

SEQ ID NO: 139224 - DNA, 19 bp, Homo sapiens
atcagagtggcactgtcag

SEQ ID NO: 139225 - DNA, 23 bp, Homo sapiens
tgtcttgtctgtgactctcgctg

SEQ ID NO: 139226 - DNA, 23 bp, Homo sapiens
ttctccctctcattcttgtcttc

SEQ ID NO: 139227 - DNA, 23 bp, Homo sapiens
tgagttcattgtagattctggat

SEQ ID NO: 139228 - DNA, 23 bp, Homo sapiens
tgagttcattgtagattctggat

SEQ ID NO: 139229 - DNA, 23 bp, Homo sapiens
ctcactgagacctccacctcctg

SEQ ID NO: 139230 - DNA, 23 bp, Homo sapiens
tgcataacatgtgttaatcttgt

SEQ ID NO: 139231 - DNA, 23 bp, Homo sapiens
gacaggttgtttgctgtttctgg

SEQ ID NO: 139232 - DNA, 23 bp, Homo sapiens
tgagttcattgtagattctggat

SEQ ID NO: 139233 - DNA, 23 bp, Homo sapiens
tgagttcattgtagattctggat

SEQ ID NO: 139234 - DNA, 22 bp, Homo sapiens
aagtgagcttccttgtctcgtt

SEQ ID NO: 139235 - DNA, 23 bp, Homo sapiens
caaagtctcactctgtcacccag

SEQ ID NO: 139236 - DNA, 23 bp, Homo sapiens
ttttgagacggagtctcgctctg

SEQ ID NO: 139237 - DNA, 23 bp, Homo sapiens
ttaaacagtgactggggttctct

SEQ ID NO: 139238 - DNA, 23 bp, Homo sapiens
cttttagtggtgggagcaggctt

SEQ ID NO: 139239 - DNA, 18 bp, Homo sapiens
tagacctccaggaggcat

SEQ ID NO: 139240 - DNA, 23 bp, Homo sapiens
tatatgtgtatgtatatatgtgt

SEQ ID NO: 139241 - DNA, 23 bp, Homo sapiens
tgagtctgtgactgtcacacttg

SEQ ID NO: 139242 - DNA, 18 bp, Homo sapiens
tgagtgaacagacagcgc

SEQ ID NO: 139243 - DNA, 21 bp, Homo sapiens
ttagtgaagagagtgtcctct

SEQ ID NO: 139244 - DNA, 23 bp, Homo sapiens
agacatgacactgattcagctca

SEQ ID NO: 139245 - DNA, 21 bp, Homo sapiens
tgaggtaggaggatcacttga

SEQ ID NO: 139246 - DNA, 22 bp, Homo sapiens
tttctagtctatatgtatatat

SEQ ID NO: 139247 - DNA, 20 bp, Homo sapiens
atatacatatgtataggtgt

SEQ ID NO: 139248 - DNA, 20 bp, Homo sapiens
atatacatatgtataggtgt

SEQ ID NO: 139249 - DNA, 23 bp, Homo sapiens
cctgtgtctgtctctgtgtccaa

SEQ ID NO: 139250 - DNA, 19 bp, Homo sapiens
tcaagctgactgtctcttc

SEQ ID NO: 139251 - DNA, 23 bp, Homo sapiens
acagtgtgtgtgtgtctgtgtgt

SEQ ID NO: 139252 - DNA, 21 bp, Homo sapiens
aatacacacgccagtgtcaga

SEQ ID NO: 139253 - DNA, 21 bp, Homo sapiens
tggtaactattgaagtatgat

SEQ ID NO: 139254 - DNA, 23 bp, Homo sapiens
tggtcagactgaagatgaaatca

SEQ ID NO: 139255 - DNA, 18 bp, Homo sapiens
cacactgcagcctctgcc

SEQ ID NO: 139256 - DNA, 21 bp, Homo sapiens
tctctgccagaatgccttcct

SEQ ID NO: 139257 - DNA, 23 bp, Homo sapiens
ttttcagtacttagctctttgca

SEQ ID NO: 139258 - DNA, 23 bp, Homo sapiens
tgagagtgtgccttgtttatgtg

SEQ ID NO: 139259 - DNA, 21 bp, Homo sapiens
tgaggtaggaggatcacttga

SEQ ID NO: 139260 - DNA, 23 bp, Homo sapiens
aggctgtagtgagctatgattgt

SEQ ID NO: 139261 - DNA, 19 bp, Homo sapiens
caaagtgttgggatgacag

SEQ ID NO: 139262 - DNA, 19 bp, Homo sapiens
tcatatctgtctgaccctt

SEQ ID NO: 139263 - DNA, 22 bp, Homo sapiens
aacacagacagggaaggttttc

SEQ ID NO: 139264 - DNA, 23 bp, Homo sapiens
ctctgagagcctgagtgcgtgag

SEQ ID NO: 139265 - DNA, 22 bp, Homo sapiens
gttggacagactcactctctgc

SEQ ID NO: 139266 - DNA, 23 bp, Homo sapiens
tcagagcagcagcagcagcagca

SEQ ID NO: 139267 - DNA, 20 bp, Homo sapiens
tgaccttgctgtgtctcagt

SEQ ID NO: 139268 - DNA, 23 bp, Homo sapiens
gaggtgcctctgttgtctggcag

SEQ ID NO: 139269 - DNA, 23 bp, Homo sapiens
tacagctctgtctccactcactg

SEQ ID NO: 139270 - DNA, 20 bp, Homo sapiens
tatgtatatgtatacacata

SEQ ID NO: 139271 - DNA, 23 bp, Homo sapiens
tatatatgtatatgtatacacat

SEQ ID NO: 139272 - DNA, 22 bp, Homo sapiens
atgtgtggttgatttcagagta

SEQ ID NO: 139273 - DNA, 19 bp, Homo sapiens
catgttatagttatttgat

SEQ ID NO: 139274 - DNA, 21 bp, Homo sapiens
gaatattcttactgtgcctga

SEQ ID NO: 139275 - DNA, 23 bp, Homo sapiens
gcctctctctgcctcagtctact

SEQ ID NO: 139276 - DNA, 20 bp, Homo sapiens
tgcagtggcgcaatcttgtc

SEQ ID NO: 139277 - DNA, 23 bp, Homo sapiens
ccctctgtctctgtctgaggccc

SEQ ID NO: 139278 - DNA, 18 bp, Homo sapiens
aaagaaagtaacagagtg

SEQ ID NO: 139279 - DNA, 23 bp, Homo sapiens
ccctctgtctctgtctgaggccc

SEQ ID NO: 139280 - DNA, 18 bp, Homo sapiens
aaagaaagtaacagagtg

SEQ ID NO: 139281 - DNA, 19 bp, Homo sapiens
ctcactgcatcctctgtct

SEQ ID NO: 139282 - DNA, 18 bp, Homo sapiens
agtcaaagggataggtaa

SEQ ID NO: 139283 - DNA, 21 bp, Homo sapiens
aattgaatgcaatatgtagga

SEQ ID NO: 139284 - DNA, 22 bp, Homo sapiens
atgtgtggttgatttcagagta

SEQ ID NO: 139285 - DNA, 19 bp, Homo sapiens
catgttatagttatttgat

SEQ ID NO: 139286 - DNA, 21 bp, Homo sapiens
gaatattcttactgtgcctga

SEQ ID NO: 139287 - DNA, 18 bp, Homo sapiens
cagtggcgcaatcttgtc

SEQ ID NO: 139288 - DNA, 19 bp, Homo sapiens
gcatagtattccatggtgt

SEQ ID NO: 139289 - DNA, 23 bp, Homo sapiens
ccctctgtctctgtctgaggccc

SEQ ID NO: 139290 - DNA, 18 bp, Homo sapiens
aaagaaagtaacagagtg

SEQ ID NO: 139291 - DNA, 23 bp, Homo sapiens
tgactcactgtgtgaataatcag

SEQ ID NO: 139292 - DNA, 23 bp, Homo sapiens
tgactcactgtgtgaataatcag

SEQ ID NO: 139293 - DNA, 23 bp, Homo sapiens
aaatctggaaatttttaacattg

SEQ ID NO: 139294 - DNA, 22 bp, Homo sapiens
aagtcaactgctttttatttat

SEQ ID NO: 139295 - DNA, 22 bp, Homo sapiens
agaaatgaaaagtaggatgttt

SEQ ID NO: 139296 - DNA, 23 bp, Homo sapiens
ccctctgtctctgtctgaggccc

SEQ ID NO: 139297 - DNA, 18 bp, Homo sapiens
aaagaaagtaacagagtg

SEQ ID NO: 139298 - DNA, 23 bp, Homo sapiens
actcactgtgtgaataatcagag

SEQ ID NO: 139299 - DNA, 23 bp, Homo sapiens
ccgagtgtcactctgtcacccag

SEQ ID NO: 139300 - DNA, 18 bp, Homo sapiens
agtcaaagggataggtaa

SEQ ID NO: 139301 - DNA, 21 bp, Homo sapiens
aattgaatgcaatatgtagga

SEQ ID NO: 139302 - DNA, 23 bp, Homo sapiens
tggagtctcactctgtcacccag

SEQ ID NO: 139303 - DNA, 19 bp, Homo sapiens
ctcactgcatcctctgtct

SEQ ID NO: 139304 - DNA, 23 bp, Homo sapiens
atgtgtgtgtatatgtatatctt

SEQ ID NO: 139305 - DNA, 23 bp, Homo sapiens
aaatctggaaatttttaacattg

SEQ ID NO: 139306 - DNA, 23 bp, Homo sapiens
tgtgcaatggtcatcttcttcat

SEQ ID NO: 139307 - DNA, 23 bp, Homo sapiens
tgagtgacagagtgagtgagagt

SEQ ID NO: 139308 - DNA, 23 bp, Homo sapiens
cgacagagactgtagtgtggctg

SEQ ID NO: 139309 - DNA, 23 bp, Homo sapiens
tctgtatatagatatgtgtacat

SEQ ID NO: 139310 - DNA, 23 bp, Homo sapiens
agatatgtgtgtatgtacatatt

SEQ ID NO: 139311 - DNA, 23 bp, Homo sapiens
ggatgtgcatctccaagtgcttt

SEQ ID NO: 139312 - DNA, 23 bp, Homo sapiens
tgtgtatatatatatgtgtgtgt

SEQ ID NO: 139313 - DNA, 23 bp, Homo sapiens
tatatgtgtgtatatatgtgtgt

SEQ ID NO: 139314 - DNA, 23 bp, Homo sapiens
tgagttcattgtagattctggat

SEQ ID NO: 139315 - DNA, 23 bp, Homo sapiens
tgagttcattgtagattctggat

SEQ ID NO: 139316 - DNA, 23 bp, Homo sapiens
tctcagtcactatttctttgtgg

SEQ ID NO: 139317 - DNA, 23 bp, Homo sapiens
tgagttcattgtagattctggat

SEQ ID NO: 139318 - DNA, 23 bp, Homo sapiens
tgagttcattgtagattctggat

SEQ ID NO: 139319 - DNA, 22 bp, Homo sapiens
tgtgtatatatatacatatgtg

SEQ ID NO: 139320 - DNA, 19 bp, Homo sapiens
acctatatacatatgtgtg

SEQ ID NO: 139321 - DNA, 23 bp, Homo sapiens
tcccagaagtgtgagattctttt

SEQ ID NO: 139322 - DNA, 23 bp, Homo sapiens
ttgagacagaatttcactcttgt

SEQ ID NO: 139323 - DNA, 19 bp, Homo sapiens
tgagaggtgagactgaagt

SEQ ID NO: 139324 - DNA, 23 bp, Homo sapiens
ttgtaattgttctggagatcctg

SEQ ID NO: 139325 - DNA, 20 bp, Homo sapiens
tgactgatcagactcaggtg

SEQ ID NO: 139326 - DNA, 18 bp, Homo sapiens
aatgtttatgaaatagat

SEQ ID NO: 139327 - DNA, 23 bp, Homo sapiens
tgagttcattgtagattctggat

SEQ ID NO: 139328 - DNA, 23 bp, Homo sapiens
tgagttcattgtagattctggat

SEQ ID NO: 139329 - DNA, 20 bp, Homo sapiens
tctgtctgtctgcctatctg

SEQ ID NO: 139330 - DNA, 23 bp, Homo sapiens
acaagtgtgctcctggtggtctt

SEQ ID NO: 139331 - DNA, 23 bp, Homo sapiens
tggagtctcactctgtcacccag

SEQ ID NO: 139332 - DNA, 23 bp, Homo sapiens
tctgtatatagatatgtgtacat

SEQ ID NO: 139333 - DNA, 23 bp, Homo sapiens
agatatgtgtgtatgtacatatt

SEQ ID NO: 139334 - DNA, 23 bp, Homo sapiens
ggtgtctcactctgtcactcagg

SEQ ID NO: 139335 - DNA, 22 bp, Homo sapiens
tcagtggggactgtgtgtgaag

SEQ ID NO: 139336 - DNA, 19 bp, Homo sapiens
tagaccaagaagatatttt

SEQ ID NO: 139337 - DNA, 23 bp, Homo sapiens
atgtatgtatatatgtgtgtgtg

SEQ ID NO: 139338 - DNA, 22 bp, Homo sapiens
tatatgtgtgtatgtatatatg

SEQ ID NO: 139339 - DNA, 20 bp, Homo sapiens
gagacagtctctctctgtgg

SEQ ID NO: 139340 - DNA, 22 bp, Homo sapiens
attttgtcactaaaagttgtcc

SEQ ID NO: 139341 - DNA, 20 bp, Homo sapiens
ggagtctctctctgtcaccc

SEQ ID NO: 139342 - DNA, 23 bp, Homo sapiens
tgagttcattgtagattctggat

SEQ ID NO: 139343 - DNA, 23 bp, Homo sapiens
tgagttcattgtagattctggat

SEQ ID NO: 139344 - DNA, 23 bp, Homo sapiens
tctcagtcactatttctttgtgg

SEQ ID NO: 139345 - DNA, 22 bp, Homo sapiens
tgagtcagagtctcactccgtc

SEQ ID NO: 139346 - DNA, 23 bp, Homo sapiens
cgagtcacactctgtcttccagg

SEQ ID NO: 139347 - DNA, 23 bp, Homo sapiens
tgagttcattgtagattctggat

SEQ ID NO: 139348 - DNA, 23 bp, Homo sapiens
tgagttcattgtagattctggat

SEQ ID NO: 139349 - DNA, 20 bp, Homo sapiens
tctgtctgtctgcctatctg

SEQ ID NO: 139350 - DNA, 22 bp, Homo sapiens
aagtcaactgctttttatttat

SEQ ID NO: 139351 - DNA, 22 bp, Homo sapiens
agaaatgaaaagtaggatgttt

SEQ ID NO: 139352 - DNA, 23 bp, Homo sapiens
tctcagtcactatttctttgtgg

SEQ ID NO: 139353 - DNA, 22 bp, Homo sapiens
tgagtcagagtctcactccgtc

SEQ ID NO: 139354 - DNA, 19 bp, Homo sapiens
tgagaggtgagactgaagt

SEQ ID NO: 139355 - DNA, 23 bp, Homo sapiens
tgtcaagctgtctctctgaaatc

SEQ ID NO: 139356 - DNA, 19 bp, Homo sapiens
gtaaaacgtctacaaggag

SEQ ID NO: 139357 - DNA, 23 bp, Homo sapiens
gtgagttcatagagatctgattg

SEQ ID NO: 139358 - DNA, 18 bp, Homo sapiens
aatgtttatgaaatagat

SEQ ID NO: 139359 - DNA, 21 bp, Homo sapiens
aaagaacaaacaagaattgat

SEQ ID NO: 139360 - DNA, 20 bp, Homo sapiens
tctgtctgtctgcctatctg

SEQ ID NO: 139361 - DNA, 19 bp, Homo sapiens
gtcactgtggctcacacct

SEQ ID NO: 139362 - DNA, 23 bp, Homo sapiens
ggtgtctcactctgtcactcagg

SEQ ID NO: 139363 - DNA, 22 bp, Homo sapiens
tcagtggggactgtgtgtgaag

SEQ ID NO: 139364 - DNA, 19 bp, Homo sapiens
gtcactgtggctcacacct

SEQ ID NO: 139365 - DNA, 19 bp, Homo sapiens
atatatatgtatgctgata

SEQ ID NO: 139366 - DNA, 20 bp, Homo sapiens
atgtatgtggaagcaatatg

SEQ ID NO: 139367 - DNA, 21 bp, Homo sapiens
tagggtatagtagattaagaa

SEQ ID NO: 139368 - DNA, 23 bp, Homo sapiens
tttcactttcttatgctgcatgt

SEQ ID NO: 139369 - DNA, 22 bp, Homo sapiens
tgtggaagtaagttctatgctt

SEQ ID NO: 139370 - DNA, 22 bp, Homo sapiens
ctgagtcttactctgtcactta

SEQ ID NO: 139371 - DNA, 23 bp, Homo sapiens
taaatgaatttcagaatgggaaa

SEQ ID NO: 139372 - DNA, 23 bp, Homo sapiens
cagagtctcagtatttcatgatg

SEQ ID NO: 139373 - DNA, 18 bp, Homo sapiens
tcacctctgaggctgctc

SEQ ID NO: 139374 - DNA, 22 bp, Homo sapiens
ctgaggtaggaggatcacttga

SEQ ID NO: 139375 - DNA, 23 bp, Homo sapiens
gcaacatagtgagtccctgtctc

SEQ ID NO: 139376 - DNA, 23 bp, Homo sapiens
ctgtagctccaacaccatgtgga

SEQ ID NO: 139377 - DNA, 23 bp, Homo sapiens
acacacactcacatatttgtagg

SEQ ID NO: 139378 - DNA, 23 bp, Homo sapiens
tgagacggagtctcgctctgtca

SEQ ID NO: 139379 - DNA, 23 bp, Homo sapiens
cagggtctcactctctcgctaag

SEQ ID NO: 139380 - DNA, 22 bp, Homo sapiens
acttcattctaggagactgtga

SEQ ID NO: 139381 - DNA, 20 bp, Homo sapiens
aagctgatgaagaaaagatt

SEQ ID NO: 139382 - DNA, 23 bp, Homo sapiens
cagtgtatgactgtatatgtata

SEQ ID NO: 139383 - DNA, 20 bp, Homo sapiens
tgtactcattttgtacttat

SEQ ID NO: 139384 - DNA, 21 bp, Homo sapiens
aaagccagggaatcttgtatc

SEQ ID NO: 139385 - DNA, 23 bp, Homo sapiens
gtggcacagtagagtcttagcac

SEQ ID NO: 139386 - DNA, 21 bp, Homo sapiens
acagcttttcttgctttgggt

SEQ ID NO: 139387 - DNA, 21 bp, Homo sapiens
cagcacagactaagtcactgt

SEQ ID NO: 139388 - DNA, 21 bp, Homo sapiens
aaagctatttggttgctttgt

SEQ ID NO: 139389 - DNA, 23 bp, Homo sapiens
gtgcacagtaaatgtaatgtgct

SEQ ID NO: 139390 - DNA, 22 bp, Homo sapiens
tgacttcactctgaagtgttca

SEQ ID NO: 139391 - DNA, 23 bp, Homo sapiens
agagaatttgtatttctaacagg

SEQ ID NO: 139392 - DNA, 23 bp, Homo sapiens
gacagagtctcgctctgtcaccc

SEQ ID NO: 139393 - DNA, 20 bp, Homo sapiens
tcagaaatagattgccttgt

SEQ ID NO: 139394 - DNA, 23 bp, Homo sapiens
gataagaattgtgaatttgtact

SEQ ID NO: 139395 - DNA, 20 bp, Homo sapiens
tctgtgttttactgtctgct

SEQ ID NO: 139396 - DNA, 23 bp, Homo sapiens
tgtgtgtatatatatgtgtgtat

SEQ ID NO: 139397 - DNA, 22 bp, Homo sapiens
tgtgtagatatgtgtgtgtata

SEQ ID NO: 139398 - DNA, 22 bp, Homo sapiens
tgagagataacagtctgcactc

SEQ ID NO: 139399 - DNA, 23 bp, Homo sapiens
ggagtctcactctgtcacccagg

SEQ ID NO: 139400 - DNA, 21 bp, Homo sapiens
ctcagtttacagtatgtgcac

SEQ ID NO: 139401 - DNA, 23 bp, Homo sapiens
tgtatacgtaagatatattatgt

SEQ ID NO: 139402 - DNA, 23 bp, Homo sapiens
tttgttctttatgcttaggattg

SEQ ID NO: 139403 - DNA, 20 bp, Homo sapiens
tgtgaagaaagtcaatggta

SEQ ID NO: 139404 - DNA, 23 bp, Homo sapiens
ttgagacatgaaagagagctgat

SEQ ID NO: 139405 - DNA, 18 bp, Homo sapiens
acttcttccttttcaatc

SEQ ID NO: 139406 - DNA, 21 bp, Homo sapiens
tgcagtaaaatgttgaataga

SEQ ID NO: 139407 - DNA, 23 bp, Homo sapiens
tccctgaagagtgagagcactac

SEQ ID NO: 139408 - DNA, 22 bp, Homo sapiens
atgtgtatatatatatatgtgt

SEQ ID NO: 139409 - DNA, 23 bp, Homo sapiens
tatatgtatatatactaatgcaa

SEQ ID NO: 139410 - DNA, 21 bp, Homo sapiens
gtgtgtatatatatgcagtta

SEQ ID NO: 139411 - DNA, 23 bp, Homo sapiens
atgtgtgtgtacatacacacaca

SEQ ID NO: 139412 - DNA, 19 bp, Homo sapiens
agaactgagaggttggagc

SEQ ID NO: 139413 - DNA, 23 bp, Homo sapiens
ctaagtgagctgattaacttctt

SEQ ID NO: 139414 - DNA, 23 bp, Homo sapiens
agacagaagagaatgaggtcagg

SEQ ID NO: 139415 - DNA, 23 bp, Homo sapiens
ttgcctcagcttggctttctccc

SEQ ID NO: 139416 - DNA, 23 bp, Homo sapiens
aaaagtggaaaatgtctagatac

SEQ ID NO: 139417 - DNA, 23 bp, Homo sapiens
atatatgtatatgtatgtgtgtg

SEQ ID NO: 139418 - DNA, 23 bp, Homo sapiens
gagttcaggtagacttgcttaga

SEQ ID NO: 139419 - DNA, 23 bp, Homo sapiens
agacaatgccctgacactttctg

SEQ ID NO: 139420 - DNA, 23 bp, Homo sapiens
aaatgggagtgcttgatttcagg

SEQ ID NO: 139421 - DNA, 19 bp, Homo sapiens
tgggagtgacttagctggt

SEQ ID NO: 139422 - DNA, 23 bp, Homo sapiens
ctctgagtctctcacaaagttga

SEQ ID NO: 139423 - DNA, 21 bp, Homo sapiens
agataattgtacatattcatg

SEQ ID NO: 139424 - DNA, 21 bp, Homo sapiens
tctctcaccctctttaatgtc

SEQ ID NO: 139425 - DNA, 23 bp, Homo sapiens
cggagtctcgctctgtctcccag

SEQ ID NO: 139426 - DNA, 19 bp, Homo sapiens
tcactgcctttttacctcc

SEQ ID NO: 139427 - DNA, 19 bp, Homo sapiens
tcagtatttgttcatctgt

SEQ ID NO: 139428 - DNA, 23 bp, Homo sapiens
tgtgtatatatgtgtgtgtgtgt

SEQ ID NO: 139429 - DNA, 23 bp, Homo sapiens
tgagttcattgtagattctggat

SEQ ID NO: 139430 - DNA, 23 bp, Homo sapiens
tgagttcattgtagattctggat

SEQ ID NO: 139431 - DNA, 22 bp, Homo sapiens
tgagatggagtttcactcttgt

SEQ ID NO: 139432 - DNA, 22 bp, Homo sapiens
atggactctcactctgtcaccc

SEQ ID NO: 139433 - DNA, 20 bp, Homo sapiens
atgtgcctgtagttccagct

SEQ ID NO: 139434 - DNA, 20 bp, Homo sapiens
tgaggtagaaagatcacttg

SEQ ID NO: 139435 - DNA, 23 bp, Homo sapiens
aagaatgtgtagtgtctaggttg

SEQ ID NO: 139436 - DNA, 21 bp, Homo sapiens
agttttcttttcttggtaaca

SEQ ID NO: 139437 - DNA, 18 bp, Homo sapiens
gtatatatgtatatgtgt

SEQ ID NO: 139438 - DNA, 23 bp, Homo sapiens
tatatgtatatgtatatgtgtgt

SEQ ID NO: 139439 - DNA, 22 bp, Homo sapiens
attgaagttgtttcttggaaag

SEQ ID NO: 139440 - DNA, 21 bp, Homo sapiens
tttaactaacagcttaagagt

SEQ ID NO: 139441 - DNA, 22 bp, Homo sapiens
tgagcttcttggatgtataaat

SEQ ID NO: 139442 - DNA, 21 bp, Homo sapiens
tggcagagaggttaccactat

SEQ ID NO: 139443 - DNA, 22 bp, Homo sapiens
tggcaagtcaatcctttctctg

SEQ ID NO: 139444 - DNA, 23 bp, Homo sapiens
tctatttcacagtggaaggattt

SEQ ID NO: 139445 - DNA, 21 bp, Homo sapiens
tgaggtaggaggatcacttga

SEQ ID NO: 139446 - DNA, 20 bp, Homo sapiens
gaggtggagaagctctggtc

SEQ ID NO: 139447 - DNA, 23 bp, Homo sapiens
gttctctgtgtctcagtctgaca

SEQ ID NO: 139448 - DNA, 22 bp, Homo sapiens
tatacatatatatagtgtgtgt

SEQ ID NO: 139449 - DNA, 23 bp, Homo sapiens
tatatacatatatatagtgtgtg

SEQ ID NO: 139450 - DNA, 23 bp, Homo sapiens
tggagtctcactctgtcacccag

SEQ ID NO: 139451 - DNA, 19 bp, Homo sapiens
cacatgaaggcattggtct

SEQ ID NO: 139452 - DNA, 23 bp, Homo sapiens
agatgcatcatgatgccattctg

SEQ ID NO: 139453 - DNA, 22 bp, Homo sapiens
actgttgactttaagttgtact

SEQ ID NO: 139454 - DNA, 21 bp, Homo sapiens
tttaactgtcaagtggatggg

SEQ ID NO: 139455 - DNA, 23 bp, Homo sapiens
tgagttcattgtagattctggat

SEQ ID NO: 139456 - DNA, 23 bp, Homo sapiens
tgagttcattgtagattctggat

SEQ ID NO: 139457 - DNA, 23 bp, Homo sapiens
tacagaggtgattttgatgtaca

SEQ ID NO: 139458 - DNA, 22 bp, Homo sapiens
taagatctagtaggtccattag

SEQ ID NO: 139459 - DNA, 23 bp, Homo sapiens
actggcttgtgtctgtgtctgag

SEQ ID NO: 139460 - DNA, 23 bp, Homo sapiens
tcccagagcccctggaactctgg

SEQ ID NO: 139461 - DNA, 18 bp, Homo sapiens
agatcttgccactgcact

SEQ ID NO: 139462 - DNA, 22 bp, Homo sapiens
gtgacagagtaagtctctgttt

SEQ ID NO: 139463 - DNA, 23 bp, Homo sapiens
tacacacacacatatgtatgtgt

SEQ ID NO: 139464 - DNA, 23 bp, Homo sapiens
tatacacacacatatgtatgtgt

SEQ ID NO: 139465 - DNA, 22 bp, Homo sapiens
tatatgtacgtgtatatgtata

SEQ ID NO: 139466 - DNA, 20 bp, Homo sapiens
tatatacgtgtatatgtata

SEQ ID NO: 139467 - DNA, 22 bp, Homo sapiens
tatagtgtatatatatacgtgt

SEQ ID NO: 139468 - DNA, 18 bp, Homo sapiens
tacgtgtataaacacgta

SEQ ID NO: 139469 - DNA, 20 bp, Homo sapiens
tgtgtatatatatacgtgtg

SEQ ID NO: 139470 - DNA, 22 bp, Homo sapiens
agtctaattttaatattgttgt

SEQ ID NO: 139471 - DNA, 19 bp, Homo sapiens
cacctggtagggaattgct

SEQ ID NO: 139472 - DNA, 23 bp, Homo sapiens
ttagtgtgtgatcaacctgaaag

SEQ ID NO: 139473 - DNA, 21 bp, Homo sapiens
ggtggtaggatcacttgaggc

SEQ ID NO: 139474 - DNA, 23 bp, Homo sapiens
caatgacacttcatggatttcta

SEQ ID NO: 139475 - DNA, 23 bp, Homo sapiens
gtttgaagagagtgagctgtcat

SEQ ID NO: 139476 - DNA, 23 bp, Homo sapiens
ttcagtgtggaaaactagtcttt

SEQ ID NO: 139477 - DNA, 23 bp, Homo sapiens
tgtgtgtatatatatatgtgtgt

SEQ ID NO: 139478 - DNA, 23 bp, Homo sapiens
acttcagatagcttgatttctga

SEQ ID NO: 139479 - DNA, 23 bp, Homo sapiens
tgaccaggagtatgattgctgag

SEQ ID NO: 139480 - DNA, 21 bp, Homo sapiens
tttatgaagctgtcaagctgt

SEQ ID NO: 139481 - DNA, 23 bp, Homo sapiens
ttggcactgggtctaatttgtga

SEQ ID NO: 139482 - DNA, 23 bp, Homo sapiens
tatgtctctgtgtgtgtgtacat

SEQ ID NO: 139483 - DNA, 19 bp, Homo sapiens
acacacgatatgtcatgta

SEQ ID NO: 139484 - DNA, 19 bp, Homo sapiens
tgtatgtgtgtatgtgcat

SEQ ID NO: 139485 - DNA, 23 bp, Homo sapiens
tctctcttgctccagcttcacct

SEQ ID NO: 139486 - DNA, 21 bp, Homo sapiens
tatagtatggtatattatact

SEQ ID NO: 139487 - DNA, 23 bp, Homo sapiens
tagtgtgatcagagctcactgtg

SEQ ID NO: 139488 - DNA, 23 bp, Homo sapiens
gtgtgcatgtgtgcgtgtgtgtg

SEQ ID NO: 139489 - DNA, 23 bp, Homo sapiens
tgagttcattgtagattctggat

SEQ ID NO: 139490 - DNA, 21 bp, Homo sapiens
tcgatgtagatatctatatat

SEQ ID NO: 139491 - DNA, 19 bp, Homo sapiens
ctatgcccatcatttctgt

SEQ ID NO: 139492 - DNA, 23 bp, Homo sapiens
aactatgtggatgttcatttcaa

SEQ ID NO: 139493 - DNA, 21 bp, Homo sapiens
tatgctatatatgcatatatg

SEQ ID NO: 139494 - DNA, 23 bp, Homo sapiens
tgtatatatctatatctatatgt

SEQ ID NO: 139495 - DNA, 21 bp, Homo sapiens
atatagctatatatgcatata

SEQ ID NO: 139496 - DNA, 21 bp, Homo sapiens
agcctggctctctgttcctct

SEQ ID NO: 139497 - DNA, 21 bp, Homo sapiens
gagatgttcactatggtcaaa

SEQ ID NO: 139498 - DNA, 22 bp, Homo sapiens
atcaggtaatttgtaaattact

SEQ ID NO: 139499 - DNA, 23 bp, Homo sapiens
cggagtctcgctctgtcgctcag

SEQ ID NO: 139500 - DNA, 19 bp, Homo sapiens
caaacacggctcactgcag

SEQ ID NO: 139501 - DNA, 21 bp, Homo sapiens
ttgaaagttttagttaactgg

SEQ ID NO: 139502 - DNA, 23 bp, Homo sapiens
ctctgtcagtgtctgagtggagt

SEQ ID NO: 139503 - DNA, 23 bp, Homo sapiens
ctgggtgagtcagtgagtgagtg

SEQ ID NO: 139504 - DNA, 23 bp, Homo sapiens
agactgagtctccctctgtcaac

SEQ ID NO: 139505 - DNA, 19 bp, Homo sapiens
acagaggcacgatcttggc

SEQ ID NO: 139506 - DNA, 22 bp, Homo sapiens
acctgtagtcttgctaatcagg

SEQ ID NO: 139507 - DNA, 20 bp, Homo sapiens
tagttaatggcatgcatgtg

SEQ ID NO: 139508 - DNA, 23 bp, Homo sapiens
aatacacacacattaggctatgc

SEQ ID NO: 139509 - DNA, 23 bp, Homo sapiens
gagtctcactctgtcacccaggc

SEQ ID NO: 139510 - DNA, 23 bp, Homo sapiens
tgggtctctcagtgttatttggc

SEQ ID NO: 139511 - DNA, 23 bp, Homo sapiens
ctctcgctcgctgtgacttccct

SEQ ID NO: 139512 - DNA, 23 bp, Homo sapiens
catgaactcactgccacacttct

SEQ ID NO: 139513 - DNA, 22 bp, Homo sapiens
tgtaaagtgagtttcttgttca

SEQ ID NO: 139514 - DNA, 21 bp, Homo sapiens
tggggctttagaaatgtctct

SEQ ID NO: 139515 - DNA, 23 bp, Homo sapiens
tctctgactgactccttcccaca

SEQ ID NO: 139516 - DNA, 23 bp, Homo sapiens
agagtctcactctgtcacccagg

SEQ ID NO: 139517 - DNA, 23 bp, Homo sapiens
gagtctcactctgtcacccaggc

SEQ ID NO: 139518 - DNA, 23 bp, Homo sapiens
acagagtctcactctgtcgccca

SEQ ID NO: 139519 - DNA, 18 bp, Homo sapiens
ctagttttactacactgt

SEQ ID NO: 139520 - DNA, 23 bp, Homo sapiens
tcttactctgtcacccagtgttg

SEQ ID NO: 139521 - DNA, 23 bp, Homo sapiens
tgagttcattgtagattctggat

SEQ ID NO: 139522 - DNA, 23 bp, Homo sapiens
tgagttcattgtagattctggat

SEQ ID NO: 139523 - DNA, 23 bp, Homo sapiens
tggagtctcactctgtcacccag

SEQ ID NO: 139524 - DNA, 22 bp, Homo sapiens
tgagactgagtctcactctgtc

SEQ ID NO: 139525 - DNA, 23 bp, Homo sapiens
tgagtctcactctgtcacccagg

SEQ ID NO: 139526 - DNA, 23 bp, Homo sapiens
ctgatgattagagattttgaaca

SEQ ID NO: 139527 - DNA, 23 bp, Homo sapiens
tctgtttgctatttctatttctt

SEQ ID NO: 139528 - DNA, 23 bp, Homo sapiens
tgagttcattgtagattctggat

SEQ ID NO: 139529 - DNA, 23 bp, Homo sapiens
tgagttcattgtagattctggat

SEQ ID NO: 139530 - DNA, 18 bp, Homo sapiens
ccccacactctctgtgtc

SEQ ID NO: 139531 - DNA, 22 bp, Homo sapiens
tggagtctcactctgtcgctca

SEQ ID NO: 139532 - DNA, 18 bp, Homo sapiens
attgagatgattgtatgg

SEQ ID NO: 139533 - DNA, 23 bp, Homo sapiens
atctcactcaccatctgactgcg

SEQ ID NO: 139534 - DNA, 23 bp, Homo sapiens
ctctgtgtgtgtgtgtgtgcatg

SEQ ID NO: 139535 - DNA, 21 bp, Homo sapiens
ttgtgagatctgagagagcag

SEQ ID NO: 139536 - DNA, 19 bp, Homo sapiens
agacatgtgagtgagctct

SEQ ID NO: 139537 - DNA, 23 bp, Homo sapiens
tatgtactacatatattatgtat

SEQ ID NO: 139538 - DNA, 18 bp, Homo sapiens
atacgtagactttatgaa

SEQ ID NO: 139539 - DNA, 20 bp, Homo sapiens
acctgtcttctcttcctgcc

SEQ ID NO: 139540 - DNA, 23 bp, Homo sapiens
tatatgtatcactatatgtacac

SEQ ID NO: 139541 - DNA, 23 bp, Homo sapiens
tctctgtgtgtatgtctctctga

SEQ ID NO: 139542 - DNA, 23 bp, Homo sapiens
aggatctctctctgtcacccagg

SEQ ID NO: 139543 - DNA, 20 bp, Homo sapiens
cagtggtatgatcatggctc

SEQ ID NO: 139544 - DNA, 21 bp, Homo sapiens
tttactgtctgcattttttgt

SEQ ID NO: 139545 - DNA, 20 bp, Homo sapiens
tatctaaatatgtatgtgta

SEQ ID NO: 139546 - DNA, 23 bp, Homo sapiens
tgtatacatatctagatagacag

SEQ ID NO: 139547 - DNA, 23 bp, Homo sapiens
tggagtctcactctgtcacccag

SEQ ID NO: 139548 - DNA, 23 bp, Homo sapiens
tggagtctcactctgtcacccag

SEQ ID NO: 139549 - DNA, 23 bp, Homo sapiens
cttaaaagagtttggaactgtgg

SEQ ID NO: 139550 - DNA, 23 bp, Homo sapiens
gtttgtgtggatttgaaatgtgc

SEQ ID NO: 139551 - DNA, 23 bp, Homo sapiens
agcacacagatgacagtgtggag

SEQ ID NO: 139552 - DNA, 23 bp, Homo sapiens
atgtctgtctgtgtgtgtgtgct

SEQ ID NO: 139553 - DNA, 23 bp, Homo sapiens
atgcttgttgaagatcagctagc

SEQ ID NO: 139554 - DNA, 23 bp, Homo sapiens
tgatgctggtttcactgcaggtt

SEQ ID NO: 139555 - DNA, 23 bp, Homo sapiens
agagtctcactctgtcacccagg

SEQ ID NO: 139556 - DNA, 23 bp, Homo sapiens
gagtctcactctgtcacccaggc

SEQ ID NO: 139557 - DNA, 22 bp, Homo sapiens
ctgcacatgcatgtgtatgtct

SEQ ID NO: 139558 - DNA, 23 bp, Homo sapiens
tgtgtgagtgcatgtgcatctgc

SEQ ID NO: 139559 - DNA, 23 bp, Homo sapiens
gttactgagcctctctgggcctc

SEQ ID NO: 139560 - DNA, 23 bp, Homo sapiens
gtttctgggtgtgtctgtgagtc

SEQ ID NO: 139561 - DNA, 23 bp, Homo sapiens
tttgaagtaggtacacagcacga

SEQ ID NO: 139562 - DNA, 23 bp, Homo sapiens
tcacactgtctgcctcacagtgg

SEQ ID NO: 139563 - DNA, 22 bp, Homo sapiens
actcagggaggtcacgttctga

SEQ ID NO: 139564 - DNA, 20 bp, Homo sapiens
cattatttctttttgtttcg

SEQ ID NO: 139565 - DNA, 18 bp, Homo sapiens
tgggagattgattttggg

SEQ ID NO: 139566 - DNA, 22 bp, Homo sapiens
catagtctccctctgtctccca

SEQ ID NO: 139567 - DNA, 22 bp, Homo sapiens
agacaaaatgaacagaatcagt

SEQ ID NO: 139568 - DNA, 23 bp, Homo sapiens
tgcatgtatgtgtgtatgcctat

SEQ ID NO: 139569 - DNA, 21 bp, Homo sapiens
ccctctgtgagtctgtgcttc

SEQ ID NO: 139570 - DNA, 23 bp, Homo sapiens
agtaactatatgtgtatgtgtac

SEQ ID NO: 139571 - DNA, 21 bp, Homo sapiens
tatatcattatgtatatgtgt

SEQ ID NO: 139572 - DNA, 22 bp, Homo sapiens
tgtatatcatgtatatatgtat

SEQ ID NO: 139573 - DNA, 23 bp, Homo sapiens
tgtgtagtgtgtgcatgtggtat

SEQ ID NO: 139574 - DNA, 23 bp, Homo sapiens
tgagttcattgtagattctggat

SEQ ID NO: 139575 - DNA, 23 bp, Homo sapiens
tgagttcattgtagattctggat

SEQ ID NO: 139576 - DNA, 22 bp, Homo sapiens
tgtatcagcatctgcttctggt

SEQ ID NO: 139577 - DNA, 20 bp, Homo sapiens
ctgcttcttcttttttgaga

SEQ ID NO: 139578 - DNA, 23 bp, Homo sapiens
aagaaagaaaagtgtacagattg

SEQ ID NO: 139579 - DNA, 23 bp, Homo sapiens
cggagtctctctctgtcgcccag

SEQ ID NO: 139580 - DNA, 18 bp, Homo sapiens
tgcaacttctgcctcctg

SEQ ID NO: 139581 - DNA, 22 bp, Homo sapiens
tcagagacgtcagtgagcacat

SEQ ID NO: 139582 - DNA, 23 bp, Homo sapiens
cttctaagaagtgagagtggaga

SEQ ID NO: 139583 - DNA, 23 bp, Homo sapiens
atgcctgaacaaaccttatctaa

SEQ ID NO: 139584 - DNA, 23 bp, Homo sapiens
tcacttcagcaccatgtgttggg

SEQ ID NO: 139585 - DNA, 21 bp, Homo sapiens
tctcactctgtcacccaggct

SEQ ID NO: 139586 - DNA, 21 bp, Homo sapiens
cttggctcaccctccatctcc

SEQ ID NO: 139587 - DNA, 23 bp, Homo sapiens
ggagacactgtctcactctgttg

SEQ ID NO: 139588 - DNA, 19 bp, Homo sapiens
cagaccttgaaaagtgtcc

SEQ ID NO: 139589 - DNA, 23 bp, Homo sapiens
aggctcggtgggtggctcatgcc

SEQ ID NO: 139590 - DNA, 21 bp, Homo sapiens
cttgagcctgggagttcaagg

SEQ ID NO: 139591 - DNA, 23 bp, Homo sapiens
tatgagatggagtctcactctgt

SEQ ID NO: 139592 - DNA, 23 bp, Homo sapiens
gtcagtctctctgagcctcagtt

SEQ ID NO: 139593 - DNA, 21 bp, Homo sapiens
tgaggtaggaggatcacttga

SEQ ID NO: 139594 - DNA, 20 bp, Homo sapiens
ctcacttgtgtttttcaggg

SEQ ID NO: 139595 - DNA, 18 bp, Homo sapiens
ttagtggctacagagggg

SEQ ID NO: 139596 - DNA, 23 bp, Homo sapiens
gtcactgccagactcagtggctg

SEQ ID NO: 139597 - DNA, 19 bp, Homo sapiens
gacagatgtgagccaccac

SEQ ID NO: 139598 - DNA, 23 bp, Homo sapiens
tgttagcttaactagagcatgag

SEQ ID NO: 139599 - DNA, 23 bp, Homo sapiens
tctgtctctgtgactcttgtagc

SEQ ID NO: 139600 - DNA, 22 bp, Homo sapiens
atgtctctgtgtctgtgccctc

SEQ ID NO: 139601 - DNA, 23 bp, Homo sapiens
tctatttgtgactctgcttatgg

SEQ ID NO: 139602 - DNA, 23 bp, Homo sapiens
gggtctcactctgtcacccaggc

SEQ ID NO: 139603 - DNA, 23 bp, Homo sapiens
ggtgcctcagtctctgtgtctgg

SEQ ID NO: 139604 - DNA, 23 bp, Homo sapiens
tgagttcattgtagattctggat

SEQ ID NO: 139605 - DNA, 23 bp, Homo sapiens
tgagttcattgtagattctggat

SEQ ID NO: 139606 - DNA, 23 bp, Homo sapiens
tgagttcattgtagattctggat

SEQ ID NO: 139607 - DNA, 23 bp, Homo sapiens
tgagttcattgtagattctggat

SEQ ID NO: 139608 - DNA, 23 bp, Homo sapiens
agtgaggtagtagattgtatagt

SEQ ID NO: 139609 - DNA, 23 bp, Homo sapiens
tcagggactcagtgacaatgact

SEQ ID NO: 139610 - DNA, 23 bp, Homo sapiens
cttctggcacagttaaaatacag

SEQ ID NO: 139611 - DNA, 23 bp, Homo sapiens
gatcagactgaagacagtgccct

SEQ ID NO: 139612 - DNA, 23 bp, Homo sapiens
cctttacttgccagactctcagt

SEQ ID NO: 139613 - DNA, 23 bp, Homo sapiens
aaagtgagaccccatctccagac

SEQ ID NO: 139614 - DNA, 23 bp, Homo sapiens
tggttgagttgagtttctgttgt

SEQ ID NO: 139615 - DNA, 20 bp, Homo sapiens
gtacagtttcctaatttgga

SEQ ID NO: 139616 - DNA, 22 bp, Homo sapiens
aaattcttcattaggaagactg

SEQ ID NO: 139617 - DNA, 21 bp, Homo sapiens
tcacaatagtgagtgagttct

SEQ ID NO: 139618 - DNA, 19 bp, Homo sapiens
agctgggattacagacact

SEQ ID NO: 139619 - DNA, 23 bp, Homo sapiens
atcacattgccagggattaccac

SEQ ID NO: 139620 - DNA, 23 bp, Homo sapiens
aggtgcagagcttagctgattgg

SEQ ID NO: 139621 - DNA, 23 bp, Homo sapiens
ttcacagtggctaagttctgcac

SEQ ID NO: 139622 - DNA, 23 bp, Homo sapiens
gtgcctactgagctgatatcagt

SEQ ID NO: 139623 - DNA, 21 bp, Homo sapiens
tggctcagttcagcaggaaca

SEQ ID NO: 139624 - DNA, 23 bp, Homo sapiens
ttacttcatattgttgcattttt

SEQ ID NO: 139625 - DNA, 23 bp, Homo sapiens
catatttatagaaaaaggaatgt

SEQ ID NO: 139626 - DNA, 20 bp, Homo sapiens
tgagatggagtctcactctg

SEQ ID NO: 139627 - DNA, 20 bp, Homo sapiens
agattcgagaagaatgtgtt

SEQ ID NO: 139628 - DNA, 22 bp, Homo sapiens
gtatatttcattttcaaatcaa

SEQ ID NO: 139629 - DNA, 23 bp, Homo sapiens
ttgacagagggtcttgtttttgt

SEQ ID NO: 139630 - DNA, 23 bp, Homo sapiens
ggcagtctgtctctgtcacccag

SEQ ID NO: 139631 - DNA, 20 bp, Homo sapiens
tgatctcagccaatcctgtt

SEQ ID NO: 139632 - DNA, 23 bp, Homo sapiens
ctgtctgagtctctgggaaatgg

SEQ ID NO: 139633 - DNA, 23 bp, Homo sapiens
atggagtctcactctgtcaccca

SEQ ID NO: 139634 - DNA, 23 bp, Homo sapiens
ctgactgcctgtcttgtgatcaa

SEQ ID NO: 139635 - DNA, 23 bp, Homo sapiens
aagtatcagactataaaagaaga

SEQ ID NO: 139636 - DNA, 23 bp, Homo sapiens
caaggtgtgtgagactctgtgtg

SEQ ID NO: 139637 - DNA, 23 bp, Homo sapiens
tcccacagtgcctgagtagtgtg

SEQ ID NO: 139638 - DNA, 23 bp, Homo sapiens
atgtgtatatatgtatatgtatg

SEQ ID NO: 139639 - DNA, 22 bp, Homo sapiens
tatgtatatatgtatatatacg

SEQ ID NO: 139640 - DNA, 23 bp, Homo sapiens
atatgtatatatgtatatatgtg

SEQ ID NO: 139641 - DNA, 21 bp, Homo sapiens
tatacgtatatatgtatatgt

SEQ ID NO: 139642 - DNA, 23 bp, Homo sapiens
cggagtctcactctgtcacccag

SEQ ID NO: 139643 - DNA, 19 bp, Homo sapiens
gacagagtttcgctcttgt

SEQ ID NO: 139644 - DNA, 23 bp, Homo sapiens
ttcagtagtcatttgcttgttaa

SEQ ID NO: 139645 - DNA, 22 bp, Homo sapiens
ttaatactgccttagctgtgtc

SEQ ID NO: 139646 - DNA, 23 bp, Homo sapiens
ggtctaacaggttgagttgaggt

SEQ ID NO: 139647 - DNA, 23 bp, Homo sapiens
tttctgcctcaatgatctaatac

SEQ ID NO: 139648 - DNA, 22 bp, Homo sapiens
tatttcagtttccaattgtttt

SEQ ID NO: 139649 - DNA, 23 bp, Homo sapiens
ttagatggagtctcgctctgtca

SEQ ID NO: 139650 - DNA, 23 bp, Homo sapiens
tgtctgcttttctggctgcttgt

SEQ ID NO: 139651 - DNA, 23 bp, Homo sapiens
ttgagtgactgtgtttccacttt

SEQ ID NO: 139652 - DNA, 23 bp, Homo sapiens
acagagaagagagattgcagagc

SEQ ID NO: 139653 - DNA, 23 bp, Homo sapiens
tgtctctgtctctcacatatcac

SEQ ID NO: 139654 - DNA, 23 bp, Homo sapiens
tgaccacagagagcagagagggc

SEQ ID NO: 139655 - DNA, 21 bp, Homo sapiens
tagcagagagaatcgtgagag

SEQ ID NO: 139656 - DNA, 19 bp, Homo sapiens
tgagatggagtctcactct

SEQ ID NO: 139657 - DNA, 21 bp, Homo sapiens
tgaggtaggaggatcacttga

SEQ ID NO: 139658 - DNA, 20 bp, Homo sapiens
gggcaacatagtgagactct

SEQ ID NO: 139659 - DNA, 23 bp, Homo sapiens
tgaggtaggtggatcacttgagt

SEQ ID NO: 139660 - DNA, 19 bp, Homo sapiens
agatagttgtagatatgcg

SEQ ID NO: 139661 - DNA, 23 bp, Homo sapiens
tctatatctatatctatatctga

SEQ ID NO: 139662 - DNA, 21 bp, Homo sapiens
tcactcacattcactctggga

SEQ ID NO: 139663 - DNA, 20 bp, Homo sapiens
agagtcaagagggagagcac

SEQ ID NO: 139664 - DNA, 23 bp, Homo sapiens
tggagtctcactctgtcacccag

SEQ ID NO: 139665 - DNA, 23 bp, Homo sapiens
taccacactgtgtctatcctttg

SEQ ID NO: 139666 - DNA, 20 bp, Homo sapiens
tctgagtctgtgtctgtctc

SEQ ID NO: 139667 - DNA, 23 bp, Homo sapiens
cggagtctcactctgtcacccag

SEQ ID NO: 139668 - DNA, 23 bp, Homo sapiens
ctgttctgtgtctctctccttgg

SEQ ID NO: 139669 - DNA, 21 bp, Homo sapiens
cagtagactgagcttttcaag

SEQ ID NO: 139670 - DNA, 22 bp, Homo sapiens
tgagatcacggctcactgcagc

SEQ ID NO: 139671 - DNA, 18 bp, Homo sapiens
actgcatgagatagtttt

SEQ ID NO: 139672 - DNA, 23 bp, Homo sapiens
tatgctgtagtttttgtgcatgt

SEQ ID NO: 139673 - DNA, 22 bp, Homo sapiens
tcacagtcacttgctttagtaa

SEQ ID NO: 139674 - DNA, 23 bp, Homo sapiens
tctgcaactttactgaatttgtt

SEQ ID NO: 139675 - DNA, 23 bp, Homo sapiens
tactgaactgtctgtgcagagat

SEQ ID NO: 139676 - DNA, 23 bp, Homo sapiens
aggtcttcagatggaagtttgag

SEQ ID NO: 139677 - DNA, 23 bp, Homo sapiens
ctcccagagcccctggaactctg

SEQ ID NO: 139678 - DNA, 23 bp, Homo sapiens
tcccagagcccctggaactctgg

SEQ ID NO: 139679 - DNA, 23 bp, Homo sapiens
tcccagagcccctggaactctgg

SEQ ID NO: 139680 - DNA, 23 bp, Homo sapiens
tcccagagcccctggaactctgg

SEQ ID NO: 139681 - DNA, 23 bp, Homo sapiens
tgagttcattgtagattctggat

SEQ ID NO: 139682 - DNA, 23 bp, Homo sapiens
tgagttcattgtagattctggat

SEQ ID NO: 139683 - DNA, 22 bp, Homo sapiens
tccacacaggcatacctgtttc

SEQ ID NO: 139684 - DNA, 23 bp, Homo sapiens
tgatgagaagaaggtgaattata

SEQ ID NO: 139685 - DNA, 22 bp, Homo sapiens
acagagtgagaacttgtctctt

SEQ ID NO: 139686 - DNA, 23 bp, Homo sapiens
acagagtctcactctgtcgccca

SEQ ID NO: 139687 - DNA, 22 bp, Homo sapiens
ttatatgcgtggttatgaaggg

SEQ ID NO: 139688 - DNA, 23 bp, Homo sapiens
agggtctcactctgtcattcagg

SEQ ID NO: 139689 - DNA, 21 bp, Homo sapiens
tcacatcctcctagataccct

SEQ ID NO: 139690 - DNA, 22 bp, Homo sapiens
gagcatgtgattagaccaaggg

SEQ ID NO: 139691 - DNA, 23 bp, Homo sapiens
aggcagcatcagttgtaatggtg

SEQ ID NO: 139692 - DNA, 21 bp, Homo sapiens
tgtgtgtatatatgtatgtat

SEQ ID NO: 139693 - DNA, 23 bp, Homo sapiens
tgtgtgtatatatacatatgtat

SEQ ID NO: 139694 - DNA, 23 bp, Homo sapiens
tgagttcattgtagattctggat

SEQ ID NO: 139695 - DNA, 23 bp, Homo sapiens
tgagttcattgtagattctggat

SEQ ID NO: 139696 - DNA, 19 bp, Homo sapiens
agagtagacatgcagatag

SEQ ID NO: 139697 - DNA, 22 bp, Homo sapiens
tgtctctgtctttatgtctctc

SEQ ID NO: 139698 - DNA, 22 bp, Homo sapiens
tagtgtgcatgtgtgtatatat

SEQ ID NO: 139699 - DNA, 18 bp, Homo sapiens
tgtgtgtgtgtgtatata

SEQ ID NO: 139700 - DNA, 23 bp, Homo sapiens
tcagcaaaagtttagtgaatgaa

SEQ ID NO: 139701 - DNA, 23 bp, Homo sapiens
tgtattgtgcattcttgttgttg

SEQ ID NO: 139702 - DNA, 23 bp, Homo sapiens
tattgtacacaattgctaatcag

SEQ ID NO: 139703 - DNA, 23 bp, Homo sapiens
tgcatgtgcatgtgcatgtgcat

SEQ ID NO: 139704 - DNA, 23 bp, Homo sapiens
tgtgtgcctgtgtgcgtgtgtgt

SEQ ID NO: 139705 - DNA, 23 bp, Homo sapiens
ttgataaggattgcattgaattg

SEQ ID NO: 139706 - DNA, 22 bp, Homo sapiens
attgcgaatgggagttcactca

SEQ ID NO: 139707 - DNA, 23 bp, Homo sapiens
tgagttcattgtagattctggat

SEQ ID NO: 139708 - DNA, 23 bp, Homo sapiens
tgagttcattgtagattctggat

SEQ ID NO: 139709 - DNA, 23 bp, Homo sapiens
tttctgcatctattgagatgata

SEQ ID NO: 139710 - DNA, 23 bp, Homo sapiens
tgttttattctgttgatgtagta

SEQ ID NO: 139711 - DNA, 23 bp, Homo sapiens
gacagagtctcgctctgtcaccc

SEQ ID NO: 139712 - DNA, 23 bp, Homo sapiens
acacacacagatataaatgacat

SEQ ID NO: 139713 - DNA, 23 bp, Homo sapiens
tatatgtatatgatatccctcag

SEQ ID NO: 139714 - DNA, 23 bp, Homo sapiens
taatcttgactcattgctgcttc

SEQ ID NO: 139715 - DNA, 23 bp, Homo sapiens
tttgaagaacttccagactgttt

SEQ ID NO: 139716 - DNA, 19 bp, Homo sapiens
taatacacacacgtacata

SEQ ID NO: 139717 - DNA, 20 bp, Homo sapiens
agcctgtctcactgtctcag

SEQ ID NO: 139718 - DNA, 23 bp, Homo sapiens
tgagttcattgtagattctggat

SEQ ID NO: 139719 - DNA, 23 bp, Homo sapiens
tgagttcattgtagattctggat

SEQ ID NO: 139720 - DNA, 23 bp, Homo sapiens
atacacacacattttatgtgtat

SEQ ID NO: 139721 - DNA, 23 bp, Homo sapiens
aaatgcacattgtatgtgtgtgt

SEQ ID NO: 139722 - DNA, 21 bp, Homo sapiens
taaatgcaaatacacattgtg

SEQ ID NO: 139723 - DNA, 23 bp, Homo sapiens
tgagttcattgtagattctggat

SEQ ID NO: 139724 - DNA, 23 bp, Homo sapiens
tgagttcattgtagattctggat

SEQ ID NO: 139725 - DNA, 22 bp, Homo sapiens
attagaggttggtcaaagagtg

SEQ ID NO: 139726 - DNA, 21 bp, Homo sapiens
tatgcatatgtatgtatatat

SEQ ID NO: 139727 - DNA, 23 bp, Homo sapiens
gtcacagtgactcacacctgtaa

SEQ ID NO: 139728 - DNA, 23 bp, Homo sapiens
tttccatggctgtgtagtattcc

SEQ ID NO: 139729 - DNA, 19 bp, Homo sapiens
tatattgatggacacgtag

SEQ ID NO: 139730 - DNA, 23 bp, Homo sapiens
tttgtctcagtgctagttcttct

SEQ ID NO: 139731 - DNA, 22 bp, Homo sapiens
tatatctatatatcctatagat

SEQ ID NO: 139732 - DNA, 21 bp, Homo sapiens
atatctatatatcctatagat

SEQ ID NO: 139733 - DNA, 22 bp, Homo sapiens
tgacagaggtgagagaggtgac

SEQ ID NO: 139734 - DNA, 22 bp, Homo sapiens
tgtgtgtatatatatgtgtgta

SEQ ID NO: 139735 - DNA, 23 bp, Homo sapiens
tctgtgttttactgtctgctctt

SEQ ID NO: 139736 - DNA, 23 bp, Homo sapiens
tctctctgtcacacaaactggag

SEQ ID NO: 139737 - DNA, 19 bp, Homo sapiens
atctcgatatctatctata

SEQ ID NO: 139738 - DNA, 23 bp, Homo sapiens
ctggcacagtcactggctccatg

SEQ ID NO: 139739 - DNA, 23 bp, Homo sapiens
tgagttcattgtagattctggat

SEQ ID NO: 139740 - DNA, 23 bp, Homo sapiens
tgagttcattgtagattctggat

SEQ ID NO: 139741 - DNA, 23 bp, Homo sapiens
agggagtttgcctttcttgtttc

SEQ ID NO: 139742 - DNA, 21 bp, Homo sapiens
tccctcactctttctgtcact

SEQ ID NO: 139743 - DNA, 23 bp, Homo sapiens
tgagttcattgtagattctggat

SEQ ID NO: 139744 - DNA, 23 bp, Homo sapiens
tgagttcattgtagattctggat

SEQ ID NO: 139745 - DNA, 19 bp, Homo sapiens
atgcacacttgtgtgccgg

SEQ ID NO: 139746 - DNA, 23 bp, Homo sapiens
ctgtcacactgtcactgtcagga

SEQ ID NO: 139747 - DNA, 23 bp, Homo sapiens
agtctccaagtctttgctattgt

SEQ ID NO: 139748 - DNA, 22 bp, Homo sapiens
tcagatctttctctttcttgct

SEQ ID NO: 139749 - DNA, 18 bp, Homo sapiens
ctcgctctgtcacccagg

SEQ ID NO: 139750 - DNA, 18 bp, Homo sapiens
cttcagtgagtttgttaa

SEQ ID NO: 139751 - DNA, 20 bp, Homo sapiens
gtacattcacgtgtgtgtgt

SEQ ID NO: 139752 - DNA, 23 bp, Homo sapiens
atatgtatgtacattcacgtgtg

SEQ ID NO: 139753 - DNA, 20 bp, Homo sapiens
tatatgtatatgtttgtgaa

SEQ ID NO: 139754 - DNA, 19 bp, Homo sapiens
agactgggacaatgagttc

SEQ ID NO: 139755 - DNA, 20 bp, Homo sapiens
taagtccatttgcagcaaca

SEQ ID NO: 139756 - DNA, 21 bp, Homo sapiens
attgatcttagagtgggctaa

SEQ ID NO: 139757 - DNA, 23 bp, Homo sapiens
atgagtagagagggtccacactg

SEQ ID NO: 139758 - DNA, 23 bp, Homo sapiens
agagcctcactctgtcacccagg

SEQ ID NO: 139759 - DNA, 20 bp, Homo sapiens
tgcctgtagtcccagccact

SEQ ID NO: 139760 - DNA, 22 bp, Homo sapiens
ttgtgtctgggtgaactcagag

SEQ ID NO: 139761 - DNA, 23 bp, Homo sapiens
tcagagacagtgtctgtgtggga

SEQ ID NO: 139762 - DNA, 23 bp, Homo sapiens
tgaggtaggaggatctcttgagc

SEQ ID NO: 139763 - DNA, 23 bp, Homo sapiens
gtagaggctgtagtgagacctgt

SEQ ID NO: 139764 - DNA, 23 bp, Homo sapiens
ttgtaagctctctgtagccagta

SEQ ID NO: 139765 - DNA, 19 bp, Homo sapiens
ttgaggccacctagttagt

SEQ ID NO: 139766 - DNA, 23 bp, Homo sapiens
ctgtcgctgtctggctgcctccc

SEQ ID NO: 139767 - DNA, 23 bp, Homo sapiens
tctgtgtgtctctgtcttcatgt

SEQ ID NO: 139768 - DNA, 18 bp, Homo sapiens
aaactgtggagggatctg

SEQ ID NO: 139769 - DNA, 23 bp, Homo sapiens
aagcctctggaagaattcaggat

SEQ ID NO: 139770 - DNA, 23 bp, Homo sapiens
taatggttcctagagaatggaat

SEQ ID NO: 139771 - DNA, 23 bp, Homo sapiens
tttggtttggctttgattagaaa

SEQ ID NO: 139772 - DNA, 22 bp, Homo sapiens
aaacagattctgaaatggagag

SEQ ID NO: 139773 - DNA, 23 bp, Homo sapiens
cttgtgcaatgtgtgtgtgtgtg

SEQ ID NO: 139774 - DNA, 18 bp, Homo sapiens
atacatgtttttgagatg

SEQ ID NO: 139775 - DNA, 23 bp, Homo sapiens
gtctgtactgagatgtgtaagtg

SEQ ID NO: 139776 - DNA, 23 bp, Homo sapiens
tacataacagattttgaagatgt

SEQ ID NO: 139777 - DNA, 23 bp, Homo sapiens
tttgatcttgtttcctcatgtgt

SEQ ID NO: 139778 - DNA, 23 bp, Homo sapiens
tgtctgcctgtctcccagtttct

SEQ ID NO: 139779 - DNA, 23 bp, Homo sapiens
acagagtctcactctgtcgccca

SEQ ID NO: 139780 - DNA, 20 bp, Homo sapiens
agtctcgctctgtcgctcag

SEQ ID NO: 139781 - DNA, 20 bp, Homo sapiens
ttcagtggcatgatttcagc

SEQ ID NO: 139782 - DNA, 23 bp, Homo sapiens
tcttaggaagttctcctggtggt

SEQ ID NO: 139783 - DNA, 19 bp, Homo sapiens
tgaggtgccacagcacaaa

SEQ ID NO: 139784 - DNA, 22 bp, Homo sapiens
agcctcaggtagttctttgtag

SEQ ID NO: 139785 - DNA, 23 bp, Homo sapiens
cagagtctcactctgtcacccag

SEQ ID NO: 139786 - DNA, 23 bp, Homo sapiens
tcactgtctcagttacaattgtg

SEQ ID NO: 139787 - DNA, 21 bp, Homo sapiens
cagtttcagctgcattcagtg

SEQ ID NO: 139788 - DNA, 23 bp, Homo sapiens
atgtacacatatacgtaagtgta

SEQ ID NO: 139789 - DNA, 23 bp, Homo sapiens
tatatgtatatatgtatatgtgt

SEQ ID NO: 139790 - DNA, 21 bp, Homo sapiens
ataccttggctattgtgaatg

SEQ ID NO: 139791 - DNA, 22 bp, Homo sapiens
tgctgcaatgaacacgggaatg

SEQ ID NO: 139792 - DNA, 23 bp, Homo sapiens
ataaactgttgttcctggaagtt

SEQ ID NO: 139793 - DNA, 21 bp, Homo sapiens
tgtctccctctgtcacccagg

SEQ ID NO: 139794 - DNA, 23 bp, Homo sapiens
tgtgcctgtagtctcagctactt

SEQ ID NO: 139795 - DNA, 22 bp, Homo sapiens
gactctgtgactgcctcagttt

SEQ ID NO: 139796 - DNA, 23 bp, Homo sapiens
gtctccctctctctgaattgagc

SEQ ID NO: 139797 - DNA, 23 bp, Homo sapiens
tgtgtcacccagtctctgtctct

SEQ ID NO: 139798 - DNA, 21 bp, Homo sapiens
tgaggtacaaggatcacttga

SEQ ID NO: 139799 - DNA, 23 bp, Homo sapiens
ggttgaggttgcagttagctgtg

SEQ ID NO: 139800 - DNA, 18 bp, Homo sapiens
actcactgcagccttgac

SEQ ID NO: 139801 - DNA, 19 bp, Homo sapiens
gtagctgcactgatttttt

SEQ ID NO: 139802 - DNA, 23 bp, Homo sapiens
tgacgtagtttctaaatttttga

SEQ ID NO: 139803 - DNA, 20 bp, Homo sapiens
gaagagtagtcagtatgcac

SEQ ID NO: 139804 - DNA, 23 bp, Homo sapiens
gagtctcactctgtcacccaggc

SEQ ID NO: 139805 - DNA, 19 bp, Homo sapiens
agtgcagtagtgtggtctt

SEQ ID NO: 139806 - DNA, 23 bp, Homo sapiens
tgagttcattgtagattctggat

SEQ ID NO: 139807 - DNA, 23 bp, Homo sapiens
tgagttcattgtagattctggat

SEQ ID NO: 139808 - DNA, 20 bp, Homo sapiens
tagaggtagaggatagggct

SEQ ID NO: 139809 - DNA, 23 bp, Homo sapiens
tcactctttcactgcctctgagt

SEQ ID NO: 139810 - DNA, 23 bp, Homo sapiens
ctcactctcagaggctgagacag

SEQ ID NO: 139811 - DNA, 20 bp, Homo sapiens
gtgcagtggtatagtctctg

SEQ ID NO: 139812 - DNA, 23 bp, Homo sapiens
gggtctcactctgtcacccaggc

SEQ ID NO: 139813 - DNA, 23 bp, Homo sapiens
tgcagtggcatgatcttggctca

SEQ ID NO: 139814 - DNA, 23 bp, Homo sapiens
gggtctcactctgtcacccaggc

SEQ ID NO: 139815 - DNA, 20 bp, Homo sapiens
tgcagtggcatgatcttggc

SEQ ID NO: 139816 - DNA, 22 bp, Homo sapiens
tccctctgtgcgtctgtgtctt

SEQ ID NO: 139817 - DNA, 23 bp, Homo sapiens
agtggttctaggttcatttggac

SEQ ID NO: 139818 - DNA, 21 bp, Homo sapiens
ttcagagaaggaaggaagctg

SEQ ID NO: 139819 - DNA, 23 bp, Homo sapiens
agcctctctgagactgtttcctc

SEQ ID NO: 139820 - DNA, 23 bp, Homo sapiens
aagctgctgacagaggagacaga

SEQ ID NO: 139821 - DNA, 21 bp, Homo sapiens
tctctctctttctgtctccat

SEQ ID NO: 139822 - DNA, 22 bp, Homo sapiens
tgcagtggcatgatcgtggctc

SEQ ID NO: 139823 - DNA, 23 bp, Homo sapiens
actatgcacacagcctggcatgt

SEQ ID NO: 139824 - DNA, 23 bp, Homo sapiens
tgcttgttctcaggtttgctgat

SEQ ID NO: 139825 - DNA, 18 bp, Homo sapiens
agtctcgctctgtcgctc

SEQ ID NO: 139826 - DNA, 22 bp, Homo sapiens
agtccttcttcacatggcagca

SEQ ID NO: 139827 - DNA, 23 bp, Homo sapiens
ggctgaggtaggaggatcacttg

SEQ ID NO: 139828 - DNA, 23 bp, Homo sapiens
aattgagagagattctggtatac

SEQ ID NO: 139829 - DNA, 22 bp, Homo sapiens
gagagatctgagagagctggtg

SEQ ID NO: 139830 - DNA, 23 bp, Homo sapiens
cagagtttattcatgttattgta

SEQ ID NO: 139831 - DNA, 23 bp, Homo sapiens
atttggttgaaaagtttggtcaa

SEQ ID NO: 139832 - DNA, 22 bp, Homo sapiens
ttttttggatgctaaatgagta

SEQ ID NO: 139833 - DNA, 23 bp, Homo sapiens
ttcaaatgattggaagacatccc

SEQ ID NO: 139834 - DNA, 23 bp, Homo sapiens
atctgcatcactgaaagtctact

SEQ ID NO: 139835 - DNA, 23 bp, Homo sapiens
tgagttcattgtagattctggat

SEQ ID NO: 139836 - DNA, 23 bp, Homo sapiens
tgagttcattgtagattctggat

SEQ ID NO: 139837 - DNA, 23 bp, Homo sapiens
catgcacacacacatatatatgt

SEQ ID NO: 139838 - DNA, 22 bp, Homo sapiens
ttgtagctgtatgttgaccact

SEQ ID NO: 139839 - DNA, 23 bp, Homo sapiens
agacagacagacattcaagtctc

SEQ ID NO: 139840 - DNA, 21 bp, Homo sapiens
atacagtttctttatctactc

SEQ ID NO: 139841 - DNA, 23 bp, Homo sapiens
tgagttcattgtagattctggat

SEQ ID NO: 139842 - DNA, 23 bp, Homo sapiens
tgagttcattgtagattctggat

SEQ ID NO: 139843 - DNA, 23 bp, Homo sapiens
gaactttgtggtactgtagggat

SEQ ID NO: 139844 - DNA, 23 bp, Homo sapiens
gtgagacagaacagagtgcggag

SEQ ID NO: 139845 - DNA, 22 bp, Homo sapiens
atggaatgactgcatgtagaga

SEQ ID NO: 139846 - DNA, 23 bp, Homo sapiens
agacagaatctcactctgtcacc

SEQ ID NO: 139847 - DNA, 19 bp, Homo sapiens
cctctagcaaaatgtctct

SEQ ID NO: 139848 - DNA, 18 bp, Homo sapiens
tgaacattatgttaggtg

SEQ ID NO: 139849 - DNA, 23 bp, Homo sapiens
tctcacatagtaggttgttttat

SEQ ID NO: 139850 - DNA, 23 bp, Homo sapiens
tctgacactgtagctctctctaa

SEQ ID NO: 139851 - DNA, 23 bp, Homo sapiens
tggagtctcactctgtcacccag

SEQ ID NO: 139852 - DNA, 21 bp, Homo sapiens
atttgtgtgtgtgtctctgag

SEQ ID NO: 139853 - DNA, 18 bp, Homo sapiens
tcatatggaatcttgtta

SEQ ID NO: 139854 - DNA, 19 bp, Homo sapiens
atgtatgtatgtatgtatg

SEQ ID NO: 139855 - DNA, 23 bp, Homo sapiens
atgtatgtatgtatgtatgtatg

SEQ ID NO: 139856 - DNA, 23 bp, Homo sapiens
tgagttcattgtagattctggat

SEQ ID NO: 139857 - DNA, 23 bp, Homo sapiens
tgagttcattgtagattctggat

SEQ ID NO: 139858 - DNA, 23 bp, Homo sapiens
ttctgtgactgcatcttctcagt

SEQ ID NO: 139859 - DNA, 21 bp, Homo sapiens
attcttacaaattatgtgtgt

SEQ ID NO: 139860 - DNA, 23 bp, Homo sapiens
atatgtacatatacataccttga

SEQ ID NO: 139861 - DNA, 23 bp, Homo sapiens
agtgtgtgtatgtatatacactc

SEQ ID NO: 139862 - DNA, 20 bp, Homo sapiens
tacaatgtatacatgtgtat

SEQ ID NO: 139863 - DNA, 19 bp, Homo sapiens
tgaaagaaaacccctgtgt

SEQ ID NO: 139864 - DNA, 23 bp, Homo sapiens
tctcacagtggttttcttttaaa

SEQ ID NO: 139865 - DNA, 23 bp, Homo sapiens
gcctgtaatctcagcactttgga

SEQ ID NO: 139866 - DNA, 23 bp, Homo sapiens
cagagtctcactctgtcacccag

SEQ ID NO: 139867 - DNA, 23 bp, Homo sapiens
agagtctcactctgtcacccagg

SEQ ID NO: 139868 - DNA, 23 bp, Homo sapiens
ggtgtgtctgtgagtgtgtgtat

SEQ ID NO: 139869 - DNA, 18 bp, Homo sapiens
ataacatacacacacata

SEQ ID NO: 139870 - DNA, 22 bp, Homo sapiens
ggtaaagttcactctgggcaga

SEQ ID NO: 139871 - DNA, 19 bp, Homo sapiens
ttggttcaattttttttgt

SEQ ID NO: 139872 - DNA, 23 bp, Homo sapiens
aactacctctggaaatgatgaag

SEQ ID NO: 139873 - DNA, 20 bp, Homo sapiens
tatcaagatgtttatcttta

SEQ ID NO: 139874 - DNA, 19 bp, Homo sapiens
aagactgccttctctgatg

SEQ ID NO: 139875 - DNA, 18 bp, Homo sapiens
tctcagtgtctcccactc

SEQ ID NO: 139876 - DNA, 22 bp, Homo sapiens
tcacagtggagagacagcagtg

SEQ ID NO: 139877 - DNA, 19 bp, Homo sapiens
ttaagcagatgctggatgt

SEQ ID NO: 139878 - DNA, 23 bp, Homo sapiens
ggttcagtgttgagattgagcac

SEQ ID NO: 139879 - DNA, 20 bp, Homo sapiens
tgtttgtttctctcggtgtg

SEQ ID NO: 139880 - DNA, 23 bp, Homo sapiens
tttttctagagacagggttttgt

SEQ ID NO: 139881 - DNA, 22 bp, Homo sapiens
tgcaatgcatacaagagtgtac

SEQ ID NO: 139882 - DNA, 23 bp, Homo sapiens
ttcttggatctgtgattctttac

SEQ ID NO: 139883 - DNA, 23 bp, Homo sapiens
aatttcaaggacttgcagtcttc

SEQ ID NO: 139884 - DNA, 20 bp, Homo sapiens
ttaggacttaatccacagga

SEQ ID NO: 139885 - DNA, 22 bp, Homo sapiens
attatcctccatctccttgcac

SEQ ID NO: 139886 - DNA, 23 bp, Homo sapiens
cctggtcactctctgtctgtggc

SEQ ID NO: 139887 - DNA, 23 bp, Homo sapiens
agctcactgatcaaactgtcttc

SEQ ID NO: 139888 - DNA, 23 bp, Homo sapiens
tgtatgtgtatatatatgtgtgt

SEQ ID NO: 139889 - DNA, 23 bp, Homo sapiens
tgagatggagtctcactctgtca

SEQ ID NO: 139890 - DNA, 23 bp, Homo sapiens
cagatgagagtcaacaggctcca

SEQ ID NO: 139891 - DNA, 23 bp, Homo sapiens
ctgcctgcctgcctgcctgcctg

SEQ ID NO: 139892 - DNA, 18 bp, Homo sapiens
cagtctctgggtccctca

SEQ ID NO: 139893 - DNA, 20 bp, Homo sapiens
tgtctccctgtctcacagcc

SEQ ID NO: 139894 - DNA, 21 bp, Homo sapiens
tctctgtctctggctctgcct

SEQ ID NO: 139895 - DNA, 23 bp, Homo sapiens
gactgagtctcgctctgtcaccc

SEQ ID NO: 139896 - DNA, 21 bp, Homo sapiens
aatggacttttacagctgtca

SEQ ID NO: 139897 - DNA, 19 bp, Homo sapiens
aattgacgttaacagctgt

SEQ ID NO: 139898 - DNA, 23 bp, Homo sapiens
accaattgtgtgtgtgtatatat

SEQ ID NO: 139899 - DNA, 22 bp, Homo sapiens
actgagttaggatctcttgccc

SEQ ID NO: 139900 - DNA, 23 bp, Homo sapiens
agctgagagaggtgagagagatg

SEQ ID NO: 139901 - DNA, 23 bp, Homo sapiens
tgagttcattgtagattctggat

SEQ ID NO: 139902 - DNA, 23 bp, Homo sapiens
tgagttcattgtagattctggat

SEQ ID NO: 139903 - DNA, 23 bp, Homo sapiens
atcagtgtgggaaactgagtcaa

SEQ ID NO: 139904 - DNA, 21 bp, Homo sapiens
ttcactactgacttcaaatga

SEQ ID NO: 139905 - DNA, 23 bp, Homo sapiens
ccaagtctcgctctgtcaccccg

SEQ ID NO: 139906 - DNA, 23 bp, Homo sapiens
gttaaactgtatttctgatgttg

SEQ ID NO: 139907 - DNA, 23 bp, Homo sapiens
gttggagcatgtggattgtgtgt

SEQ ID NO: 139908 - DNA, 23 bp, Homo sapiens
acggagtctcgctctgtcaccca

SEQ ID NO: 139909 - DNA, 23 bp, Homo sapiens
aagctcacaggaaatgttctgga

SEQ ID NO: 139910 - DNA, 23 bp, Homo sapiens
gatacagattagacagagagcag

SEQ ID NO: 139911 - DNA, 23 bp, Homo sapiens
ctgtctgtctgtctttctccact

SEQ ID NO: 139912 - DNA, 23 bp, Homo sapiens
agagtctcactctgtcgctcagg

SEQ ID NO: 139913 - DNA, 23 bp, Homo sapiens
tctcccagcctctgtgcctttgc

SEQ ID NO: 139914 - DNA, 23 bp, Homo sapiens
cagggtctcactctgtcactcag

SEQ ID NO: 139915 - DNA, 23 bp, Homo sapiens
gggtctcactctgtcactcaggc

SEQ ID NO: 139916 - DNA, 19 bp, Homo sapiens
cagagtcacgactttccag

SEQ ID NO: 139917 - DNA, 23 bp, Homo sapiens
tcagcctgtcagtcagtcagtcc

SEQ ID NO: 139918 - DNA, 19 bp, Homo sapiens
atctcctgttagttctgtc

SEQ ID NO: 139919 - DNA, 23 bp, Homo sapiens
tccttttgtctgggtctggcttt

SEQ ID NO: 139920 - DNA, 19 bp, Homo sapiens
gtggtattctatgctttgt

SEQ ID NO: 139921 - DNA, 23 bp, Homo sapiens
tacctactacactgggaactttg

SEQ ID NO: 139922 - DNA, 20 bp, Homo sapiens
tgaccgtgtgacaagtggct

SEQ ID NO: 139923 - DNA, 23 bp, Homo sapiens
acaaggtctcactctgtcaccca

SEQ ID NO: 139924 - DNA, 23 bp, Homo sapiens
catctgtatttgtttttgagaca

SEQ ID NO: 139925 - DNA, 23 bp, Homo sapiens
aaatgtctctctctgtcagccgt

SEQ ID NO: 139926 - DNA, 21 bp, Homo sapiens
tttgtcagggaccatagaagt

SEQ ID NO: 139927 - DNA, 23 bp, Homo sapiens
taactgctcccagatgatggcac

SEQ ID NO: 139928 - DNA, 23 bp, Homo sapiens
tggagtctctctctgtcacccag

SEQ ID NO: 139929 - DNA, 20 bp, Homo sapiens
agagcaatgcaaaacagaat

SEQ ID NO: 139930 - DNA, 19 bp, Homo sapiens
tctggatgcctatgtgtca

SEQ ID NO: 139931 - DNA, 19 bp, Homo sapiens
ggaagaagacagggagcag

SEQ ID NO: 139932 - DNA, 22 bp, Homo sapiens
atagagtctcgctctgtcactc

SEQ ID NO: 139933 - DNA, 23 bp, Homo sapiens
tgtgtgtgtgtgtgtctgagtat

SEQ ID NO: 139934 - DNA, 23 bp, Homo sapiens
cggagtctcactctgtcacccag

SEQ ID NO: 139935 - DNA, 23 bp, Homo sapiens
gagtctcactctgtcacccaggc

SEQ ID NO: 139936 - DNA, 23 bp, Homo sapiens
tctgtggctctgtctgtgttctg

SEQ ID NO: 139937 - DNA, 23 bp, Homo sapiens
gagatggagtctcgctctgtggc

SEQ ID NO: 139938 - DNA, 19 bp, Homo sapiens
agtctcactctgtcaccca

SEQ ID NO: 139939 - DNA, 23 bp, Homo sapiens
tggtgacagaattcagtgggcac

SEQ ID NO: 139940 - DNA, 23 bp, Homo sapiens
ggagtctcactcactctgtcacc

SEQ ID NO: 139941 - DNA, 23 bp, Homo sapiens
tattttattgttcatgttaagga

SEQ ID NO: 139942 - DNA, 23 bp, Homo sapiens
aaagcatttgtttagaagtttag

SEQ ID NO: 139943 - DNA, 23 bp, Homo sapiens
gagtgtgcaagagcatgtgcatg

SEQ ID NO: 139944 - DNA, 21 bp, Homo sapiens
tgaggctgcagtgagtcatga

SEQ ID NO: 139945 - DNA, 23 bp, Homo sapiens
cagggtctccctctgtcactcag

SEQ ID NO: 139946 - DNA, 23 bp, Homo sapiens
agagggagtctcactctgtcacc

SEQ ID NO: 139947 - DNA, 23 bp, Homo sapiens
gggtctcactctgtcacccaggc

SEQ ID NO: 139948 - DNA, 22 bp, Homo sapiens
tctataaatgcatgttatccat

SEQ ID NO: 139949 - DNA, 23 bp, Homo sapiens
acagaagtgaggcaccaggagga

SEQ ID NO: 139950 - DNA, 18 bp, Homo sapiens
gcctctggctggttcctc

SEQ ID NO: 139951 - DNA, 18 bp, Homo sapiens
tccaaagacagtaaggag

SEQ ID NO: 139952 - DNA, 23 bp, Homo sapiens
gtggtctccctgtgcctcggcct

SEQ ID NO: 139953 - DNA, 23 bp, Homo sapiens
tgaggtaacacagtgttttccca

SEQ ID NO: 139954 - DNA, 23 bp, Homo sapiens
agtctcactctgtcattttcacc

SEQ ID NO: 139955 - DNA, 23 bp, Homo sapiens
tggtcagtcagtctgtctgcctg

SEQ ID NO: 139956 - DNA, 23 bp, Homo sapiens
agagtctcactctgtcacccagg

SEQ ID NO: 139957 - DNA, 22 bp, Homo sapiens
gatggaattgttttcttttttc

SEQ ID NO: 139958 - DNA, 22 bp, Homo sapiens
tgtgccaggagtttgagcagag

SEQ ID NO: 139959 - DNA, 23 bp, Homo sapiens
tgtcactgtccctgtgtctgttc

SEQ ID NO: 139960 - DNA, 23 bp, Homo sapiens
agatggagtctcactctgtcacc

SEQ ID NO: 139961 - DNA, 23 bp, Homo sapiens
tggcaccctctgtgtgtcgctgc

SEQ ID NO: 139962 - DNA, 23 bp, Homo sapiens
gagtcactgtctcgctctgtggc

SEQ ID NO: 139963 - DNA, 18 bp, Homo sapiens
ggtggctctgtgtttagg

SEQ ID NO: 139964 - DNA, 22 bp, Homo sapiens
ttttgagacagagtctcgctct

SEQ ID NO: 139965 - DNA, 23 bp, Homo sapiens
gacctgacccactctgtctgtct

SEQ ID NO: 139966 - DNA, 22 bp, Homo sapiens
tgagacagagtctcactctgtc

SEQ ID NO: 139967 - DNA, 23 bp, Homo sapiens
gacagagtctcgctctgtcaccc

SEQ ID NO: 139968 - DNA, 23 bp, Homo sapiens
acagagtctcgctctgtcaccca

SEQ ID NO: 139969 - DNA, 23 bp, Homo sapiens
cagagtctcgctctgtcacccag

SEQ ID NO: 139970 - DNA, 22 bp, Homo sapiens
agactgggtctcactgtgtcac

SEQ ID NO: 139971 - DNA, 23 bp, Homo sapiens
ttttgagacggagtctcgctctg

SEQ ID NO: 139972 - DNA, 18 bp, Homo sapiens
tcagctgggttctgagag

SEQ ID NO: 139973 - DNA, 20 bp, Homo sapiens
tatatgtacacatacgtgta

SEQ ID NO: 139974 - DNA, 22 bp, Homo sapiens
tgacagagtgagactttttttt

SEQ ID NO: 139975 - DNA, 23 bp, Homo sapiens
ttgacagtctcgctctgtcgctc

SEQ ID NO: 139976 - DNA, 20 bp, Homo sapiens
tgactccagatccaggcggt

SEQ ID NO: 139977 - DNA, 23 bp, Homo sapiens
gtgtctgtgtctgtgagcttatg

SEQ ID NO: 139978 - DNA, 22 bp, Homo sapiens
agtctcgctctgtcactcaggc

SEQ ID NO: 139979 - DNA, 23 bp, Homo sapiens
gtcctttgcttttcttgctgtag

SEQ ID NO: 139980 - DNA, 20 bp, Homo sapiens
tgcctgcctgcctgtctacc

SEQ ID NO: 139981 - DNA, 23 bp, Homo sapiens
cacccactgtcacccagtgggac

SEQ ID NO: 139982 - DNA, 23 bp, Homo sapiens
gacagagtctcgctctgtcaccc

SEQ ID NO: 139983 - DNA, 21 bp, Homo sapiens
cagagtctcgctctgtcgctg

SEQ ID NO: 139984 - DNA, 23 bp, Homo sapiens
tctgacacagagctcggtgtttg

SEQ ID NO: 139985 - DNA, 22 bp, Homo sapiens
tgtcacactgtgttatagtttt

SEQ ID NO: 139986 - DNA, 19 bp, Homo sapiens
tgcctgtaatcccagcagt

SEQ ID NO: 139987 - DNA, 23 bp, Homo sapiens
tcctaaagtgctgggattacagg

SEQ ID NO: 139988 - DNA, 19 bp, Homo sapiens
ctaatctttgtatttttaa

SEQ ID NO: 139989 - DNA, 23 bp, Homo sapiens
cactcgctggctctctccatgcc

SEQ ID NO: 139990 - DNA, 23 bp, Homo sapiens
gagtctcactctgtcactcaggc

SEQ ID NO: 139991 - DNA, 18 bp, Homo sapiens
tgtctagtgggttcgcag

SEQ ID NO: 139992 - DNA, 20 bp, Homo sapiens
tctctccctctctcggactc

SEQ ID NO: 139993 - DNA, 23 bp, Homo sapiens
tcaggctctctgagtgtgtttcc

SEQ ID NO: 139994 - DNA, 23 bp, Homo sapiens
gagtctctgtgtgtcacccaggc

SEQ ID NO: 139995 - DNA, 23 bp, Homo sapiens
tggagtctcactctgtcacccag

SEQ ID NO: 139996 - DNA, 23 bp, Homo sapiens
cggagtctcactctgtcacccag

SEQ ID NO: 139997 - DNA, 23 bp, Homo sapiens
tgtgtctccctgtgtctctgtct

SEQ ID NO: 139998 - DNA, 23 bp, Homo sapiens
actgtcttgttgcatgtgtctcg

SEQ ID NO: 139999 - DNA, 22 bp, Homo sapiens
ctctgcctcactgactgtgagc

SEQ ID NO: 140000 - DNA, 23 bp, Homo sapiens
gagaagttcaacagtgggtaaca

SEQ ID NO: 140001 - DNA, 23 bp, Homo sapiens
tcccagatactctggaggctgag

SEQ ID NO: 140002 - DNA, 23 bp, Homo sapiens
caggtatctgctgatgttctttt

SEQ ID NO: 140003 - DNA, 22 bp, Homo sapiens
agtggcgtgatcttggcttact

SEQ ID NO: 140004 - DNA, 22 bp, Homo sapiens
cccagagcccctggaactctgg

SEQ ID NO: 140005 - DNA, 23 bp, Homo sapiens
actgggtctctgagtcactgtgt

SEQ ID NO: 140006 - DNA, 18 bp, Homo sapiens
atatgtgtgtgtgtatat

SEQ ID NO: 140007 - DNA, 23 bp, Homo sapiens
tggctctcacagaaaggacatgg

SEQ ID NO: 140008 - DNA, 21 bp, Homo sapiens
atacacacatatatacatatg

SEQ ID NO: 140009 - DNA, 23 bp, Homo sapiens
cggagtctcactctgtcacccag

SEQ ID NO: 140010 - DNA, 18 bp, Homo sapiens
tgagagcccctagttttt

SEQ ID NO: 140011 - DNA, 21 bp, Homo sapiens
atacacacacatatatatatg

SEQ ID NO: 140012 - DNA, 23 bp, Homo sapiens
tcttgagacagggtctcactctg

SEQ ID NO: 140013 - DNA, 22 bp, Homo sapiens
gagtctcactctgtcactgagg

SEQ ID NO: 140014 - DNA, 19 bp, Homo sapiens
tctgtgtcattgaccacgg

SEQ ID NO: 140015 - DNA, 21 bp, Homo sapiens
aagccactggttgtgctgaga

SEQ ID NO: 140016 - DNA, 20 bp, Homo sapiens
agacagaaatagacttgctt

SEQ ID NO: 140017 - DNA, 22 bp, Homo sapiens
tgagttgaccctgcagttctac

SEQ ID NO: 140018 - DNA, 20 bp, Homo sapiens
tatgtatatattcatgtatg

SEQ ID NO: 140019 - DNA, 19 bp, Homo sapiens
agacagcagagagagaggc

SEQ ID NO: 140020 - DNA, 20 bp, Homo sapiens
aagtcggcttctaagaggct

SEQ ID NO: 140021 - DNA, 23 bp, Homo sapiens
ctgggtgtctgtgtctctgggtc

SEQ ID NO: 140022 - DNA, 23 bp, Homo sapiens
ttccagctcctggccctgttttc

SEQ ID NO: 140023 - DNA, 20 bp, Homo sapiens
tgacagtagacacggagcag

SEQ ID NO: 140024 - DNA, 23 bp, Homo sapiens
cctcagtgtcactgtctccgtgg

SEQ ID NO: 140025 - DNA, 23 bp, Homo sapiens
ctctgcctgtctctgagcctcag

SEQ ID NO: 140026 - DNA, 23 bp, Homo sapiens
ctgccactcactctctgtccttc

SEQ ID NO: 140027 - DNA, 20 bp, Homo sapiens
acacagaggaggcttggctc

SEQ ID NO: 140028 - DNA, 19 bp, Homo sapiens
cacacacacagagtcacag

SEQ ID NO: 140029 - DNA, 23 bp, Homo sapiens
atacactgtggcccacctgtagc

SEQ ID NO: 140030 - DNA, 21 bp, Homo sapiens
gtcaggttggaagtgacaccg

SEQ ID NO: 140031 - DNA, 23 bp, Homo sapiens
tgttggagtccctgtcttcagtt

SEQ ID NO: 140032 - DNA, 23 bp, Homo sapiens
ctggctgtggagctgcacgtgct

SEQ ID NO: 140033 - DNA, 20 bp, Homo sapiens
tgtctactgagctctcacct

SEQ ID NO: 140034 - DNA, 23 bp, Homo sapiens
tgagttcattgtagattctggat

SEQ ID NO: 140035 - DNA, 23 bp, Homo sapiens
tgagttcattgtagattctggat

SEQ ID NO: 140036 - DNA, 19 bp, Homo sapiens
ctcaggtgagagtctgcag

SEQ ID NO: 140037 - DNA, 23 bp, Homo sapiens
ttctctctctctctcaagtccca

SEQ ID NO: 140038 - DNA, 22 bp, Homo sapiens
tgtgtgtatatatatatatgtg

SEQ ID NO: 140039 - DNA, 23 bp, Homo sapiens
atatgtgtatatatatatgtgtg

SEQ ID NO: 140040 - DNA, 23 bp, Homo sapiens
tatatgtgtatatatatatgtgt

SEQ ID NO: 140041 - DNA, 23 bp, Homo sapiens
atatgtgtatatatatatgtgtg

SEQ ID NO: 140042 - DNA, 19 bp, Homo sapiens
tatgtgtgtgtgtgtatat

SEQ ID NO: 140043 - DNA, 22 bp, Homo sapiens
gggagactctctcacgctcacc

SEQ ID NO: 140044 - DNA, 23 bp, Homo sapiens
gacagagtctcgctctgtcaccc

SEQ ID NO: 140045 - DNA, 23 bp, Homo sapiens
acgtcaaccagctgagtcagttt

SEQ ID NO: 140046 - DNA, 21 bp, Homo sapiens
gattccacttctcccggcctg

SEQ ID NO: 140047 - DNA, 22 bp, Homo sapiens
tgattctggttttcttttcctt

SEQ ID NO: 140048 - DNA, 22 bp, Homo sapiens
tgagagcctgagcctgtgcgtg

SEQ ID NO: 140049 - DNA, 23 bp, Homo sapiens
ctcagactgacagtctcagactg

SEQ ID NO: 140050 - DNA, 23 bp, Homo sapiens
tcattaggtgattttgttgttct

SEQ ID NO: 140051 - DNA, 22 bp, Homo sapiens
tgtgaacaccacagaatgcact

SEQ ID NO: 140052 - DNA, 23 bp, Homo sapiens
gggtgtccctcactcagtggctc

SEQ ID NO: 140053 - DNA, 20 bp, Homo sapiens
agaagtgtgtgtgcacagac

SEQ ID NO: 140054 - DNA, 20 bp, Homo sapiens
gcgttcatgtatgtgtgcac

SEQ ID NO: 140055 - DNA, 23 bp, Homo sapiens
gacagagtctcgctctgtcaccc

SEQ ID NO: 140056 - DNA, 23 bp, Homo sapiens
actgaggagtgtgtgcactgagg

SEQ ID NO: 140057 - DNA, 19 bp, Homo sapiens
cactgagcagtgtgtgcac

SEQ ID NO: 140058 - DNA, 21 bp, Homo sapiens
cattattacttttggtacgcg

SEQ ID NO: 140059 - DNA, 23 bp, Homo sapiens
actcgtaccgtgagtaataatgc

SEQ ID NO: 140060 - DNA, 23 bp, Homo sapiens
atgtgtcacattgtgcagtgtca

SEQ ID NO: 140061 - DNA, 21 bp, Homo sapiens
tgaggtaggaggatcgattga

SEQ ID NO: 140062 - DNA, 23 bp, Homo sapiens
agtctctctccctgttaatagcc

SEQ ID NO: 140063 - DNA, 23 bp, Homo sapiens
taataagaggaactgaatgtatt

SEQ ID NO: 140064 - DNA, 23 bp, Homo sapiens
tctgtgtgtctggttcaggtgac

SEQ ID NO: 140065 - DNA, 20 bp, Homo sapiens
ttcagcttcctgtggtggaa

SEQ ID NO: 140066 - DNA, 23 bp, Homo sapiens
tggacagatgagagagagcacat

SEQ ID NO: 140067 - DNA, 23 bp, Homo sapiens
gtctaatgattgtgaagttttgt

SEQ ID NO: 140068 - DNA, 23 bp, Homo sapiens
tgtatgtgacaggttttgctggg

SEQ ID NO: 140069 - DNA, 20 bp, Homo sapiens
tggcaggcaccctcaaaggc

SEQ ID NO: 140070 - DNA, 23 bp, Homo sapiens
gtgtctgtggctccgtgtgtgac

SEQ ID NO: 140071 - DNA, 19 bp, Homo sapiens
agacaagagtgtgagctct

SEQ ID NO: 140072 - DNA, 23 bp, Homo sapiens
tgagagtagagtatgagatctac

SEQ ID NO: 140073 - DNA, 23 bp, Homo sapiens
ttgtgagtggcagagttgtggtg

SEQ ID NO: 140074 - DNA, 23 bp, Homo sapiens
ctttaggagagtttcttttatgt

SEQ ID NO: 140075 - DNA, 19 bp, Homo sapiens
tgtgagcgactgtgcccgg

SEQ ID NO: 140076 - DNA, 23 bp, Homo sapiens
agtctcaccctgtcacccaggct

SEQ ID NO: 140077 - DNA, 23 bp, Homo sapiens
atctctgtgcctctgtctcccac

SEQ ID NO: 140078 - DNA, 23 bp, Homo sapiens
cagtctcactgtcacccaggatg

SEQ ID NO: 140079 - DNA, 23 bp, Homo sapiens
tgggagggactgtgtctgtgatt

SEQ ID NO: 140080 - DNA, 23 bp, Homo sapiens
ctgacccacactccgtccctcag

SEQ ID NO: 140081 - DNA, 23 bp, Homo sapiens
acagagtctcactctgtcgccca

SEQ ID NO: 140082 - DNA, 23 bp, Homo sapiens
tgagttcattgtagattctggat

SEQ ID NO: 140083 - DNA, 23 bp, Homo sapiens
tgagttcattgtagattctggat

SEQ ID NO: 140084 - DNA, 22 bp, Homo sapiens
taactggaactacatatgtgtg

SEQ ID NO: 140085 - DNA, 23 bp, Homo sapiens
ttatgtagggacagtgtctggct

SEQ ID NO: 140086 - DNA, 22 bp, Homo sapiens
ttttaccatgttgtccaggctg

SEQ ID NO: 140087 - DNA, 22 bp, Homo sapiens
cactctcctgattctctctgct

SEQ ID NO: 140088 - DNA, 22 bp, Homo sapiens
agcggtcactgtcagtcactcc

SEQ ID NO: 140089 - DNA, 23 bp, Homo sapiens
tttgagacggagtctcgctctgt

SEQ ID NO: 140090 - DNA, 19 bp, Homo sapiens
tgtactcaaggacttgatt

SEQ ID NO: 140091 - DNA, 23 bp, Homo sapiens
ttttgagacggagtcttgctctg

SEQ ID NO: 140092 - DNA, 20 bp, Homo sapiens
taaagtcagttttgtctggc

SEQ ID NO: 140093 - DNA, 23 bp, Homo sapiens
tgtgtgtctgcctgtgtgtccgt

SEQ ID NO: 140094 - DNA, 23 bp, Homo sapiens
tcagctcactgcaacctctgtct

SEQ ID NO: 140095 - DNA, 18 bp, Homo sapiens
ggtgacatgacacgggga

SEQ ID NO: 140096 - DNA, 22 bp, Homo sapiens
tcaccttctctcactgtctcct

SEQ ID NO: 140097 - DNA, 20 bp, Homo sapiens
tgtgctttttcttagtcata

SEQ ID NO: 140098 - DNA, 21 bp, Homo sapiens
ttatctgacaggtcaggaagc

SEQ ID NO: 140099 - DNA, 20 bp, Homo sapiens
tggcagagtgtttgcacaga

SEQ ID NO: 140100 - DNA, 18 bp, Homo sapiens
acagagcgatattctgtc

SEQ ID NO: 140101 - DNA, 23 bp, Homo sapiens
tctgagacagagtctcgctctgt

SEQ ID NO: 140102 - DNA, 20 bp, Homo sapiens
gcctctcactgtgcctctgg

SEQ ID NO: 140103 - DNA, 19 bp, Homo sapiens
agacaagagtgtgagctct

SEQ ID NO: 140104 - DNA, 21 bp, Homo sapiens
ctcgctgcctgagttctgggg

SEQ ID NO: 140105 - DNA, 22 bp, Homo sapiens
tggagtctcactctgtcgccca

SEQ ID NO: 140106 - DNA, 23 bp, Homo sapiens
agtgctgtgtgtgtctgtgactc

SEQ ID NO: 140107 - DNA, 23 bp, Homo sapiens
acactcactctgtcggtgtctgt

SEQ ID NO: 140108 - DNA, 23 bp, Homo sapiens
tttcttcctgagacagtgtctca

SEQ ID NO: 140109 - DNA, 19 bp, Homo sapiens
cagcctctctgagtctgtg

SEQ ID NO: 140110 - DNA, 21 bp, Homo sapiens
tggctgatgtagtgtttctgt

SEQ ID NO: 140111 - DNA, 22 bp, Homo sapiens
attgatctgtgtgtctgtgctt

SEQ ID NO: 140112 - DNA, 23 bp, Homo sapiens
taccactgagttagatttcagcc

SEQ ID NO: 140113 - DNA, 18 bp, Homo sapiens
aagcctttgttttgtttt

SEQ ID NO: 140114 - DNA, 18 bp, Homo sapiens
tctgcctctgactcactg

SEQ ID NO: 140115 - DNA, 23 bp, Homo sapiens
tgtgaagaaagtcaatggtagtt

SEQ ID NO: 140116 - DNA, 23 bp, Homo sapiens
gactgtcagtctgagacccatct

SEQ ID NO: 140117 - DNA, 23 bp, Homo sapiens
tctgtctctccttctctgtgtct

SEQ ID NO: 140118 - DNA, 23 bp, Homo sapiens
tgagacagagtctcgctctgtcg

SEQ ID NO: 140119 - DNA, 23 bp, Homo sapiens
ctgtaatgtttttgaatttgtgt

SEQ ID NO: 140120 - DNA, 23 bp, Homo sapiens
ccactcactgcctctctcctgcc

SEQ ID NO: 140121 - DNA, 23 bp, Homo sapiens
accctctctctgcctggctgacc

SEQ ID NO: 140122 - DNA, 20 bp, Homo sapiens
agagctgactcagtctgtgc

SEQ ID NO: 140123 - DNA, 19 bp, Homo sapiens
gacaagatgctgaggctga

SEQ ID NO: 140124 - DNA, 23 bp, Homo sapiens
gttctctctgtctgtcaatcggc

SEQ ID NO: 140125 - DNA, 21 bp, Homo sapiens
tctgtttagtcattctgttga

SEQ ID NO: 140126 - DNA, 23 bp, Homo sapiens
tgagttcattgtagattctggat

SEQ ID NO: 140127 - DNA, 23 bp, Homo sapiens
tgagttcattgtagattctggat

SEQ ID NO: 140128 - DNA, 22 bp, Homo sapiens
actgaccacactttgctctcca

SEQ ID NO: 140129 - DNA, 21 bp, Homo sapiens
agacagtctcactcactccgt

SEQ ID NO: 140130 - DNA, 23 bp, Homo sapiens
atgagtgtatatatatatgtgtg

SEQ ID NO: 140131 - DNA, 23 bp, Homo sapiens
atatgtgtatatatatatgagta

SEQ ID NO: 140132 - DNA, 22 bp, Homo sapiens
tgagtatatatgtgtgcatatg

SEQ ID NO: 140133 - DNA, 23 bp, Homo sapiens
actcagatgagtgtgaggacact

SEQ ID NO: 140134 - DNA, 23 bp, Homo sapiens
tctctcgctctcagtctcgccca

SEQ ID NO: 140135 - DNA, 23 bp, Homo sapiens
ctgcctgcctgcctgcctgcctg

SEQ ID NO: 140136 - DNA, 23 bp, Homo sapiens
tgacggtttcccagactttcctc

SEQ ID NO: 140137 - DNA, 23 bp, Homo sapiens
tgagacagagtctcgctctgtca

SEQ ID NO: 140138 - DNA, 18 bp, Homo sapiens
gctgttgagtgggagcag

SEQ ID NO: 140139 - DNA, 21 bp, Homo sapiens
tgagctcctgcatgtatgtgc

SEQ ID NO: 140140 - DNA, 23 bp, Homo sapiens
ctgtctctggctgtcagtgagac

SEQ ID NO: 140141 - DNA, 23 bp, Homo sapiens
tcgccgagaacacatctgtgtgt

SEQ ID NO: 140142 - DNA, 21 bp, Homo sapiens
attgcactctagcctggggaa

SEQ ID NO: 140143 - DNA, 21 bp, Homo sapiens
agtctcactctggcacccttg

SEQ ID NO: 140144 - DNA, 22 bp, Homo sapiens
tagagaaggagtctcgctctgt

SEQ ID NO: 140145 - DNA, 23 bp, Homo sapiens
tgtatatgtatgtatatatgtgt

SEQ ID NO: 140146 - DNA, 23 bp, Homo sapiens
gggtagtactactgtcatcccat

SEQ ID NO: 140147 - DNA, 23 bp, Homo sapiens
aacaagctctctctctgtgtgcg

SEQ ID NO: 140148 - DNA, 18 bp, Homo sapiens
gtctcttagatttggttc

SEQ ID NO: 140149 - DNA, 18 bp, Homo sapiens
agggtcttactctgtcac

SEQ ID NO: 140150 - DNA, 23 bp, Homo sapiens
cactgtggtagaagctagttata

SEQ ID NO: 140151 - DNA, 23 bp, Homo sapiens
tcaagttactgctgatagtgaac

SEQ ID NO: 140152 - DNA, 23 bp, Homo sapiens
tgagttcattgtagattctggat

SEQ ID NO: 140153 - DNA, 23 bp, Homo sapiens
tgagttcattgtagattctggat

SEQ ID NO: 140154 - DNA, 23 bp, Homo sapiens
tctccctctgtcacccagactgg

SEQ ID NO: 140155 - DNA, 22 bp, Homo sapiens
tgaggatgactgatggtttcta

SEQ ID NO: 140156 - DNA, 23 bp, Homo sapiens
atatctctggtaaccttttgaag

SEQ ID NO: 140157 - DNA, 20 bp, Homo sapiens
acggagtctccctctgtcac

SEQ ID NO: 140158 - DNA, 22 bp, Homo sapiens
atatatgtatgtatatatatgt

SEQ ID NO: 140159 - DNA, 22 bp, Homo sapiens
tctctcagtctgtctttgatga

SEQ ID NO: 140160 - DNA, 22 bp, Homo sapiens
gagtctcactctgtcacccagc

SEQ ID NO: 140161 - DNA, 23 bp, Homo sapiens
ttacgtaacccattcagttgttc

SEQ ID NO: 140162 - DNA, 19 bp, Homo sapiens
aagtgctgggattacaggc

SEQ ID NO: 140163 - DNA, 23 bp, Homo sapiens
tggaactgaactgattttcttga

SEQ ID NO: 140164 - DNA, 23 bp, Homo sapiens
tgagacagtgtctccctctgtcg

SEQ ID NO: 140165 - DNA, 23 bp, Homo sapiens
ttgagacagagtcttgctctgtc

SEQ ID NO: 140166 - DNA, 23 bp, Homo sapiens
ccctctgactctgagcctgtgag

SEQ ID NO: 140167 - DNA, 21 bp, Homo sapiens
atccaagattatgaagatttt

SEQ ID NO: 140168 - DNA, 18 bp, Homo sapiens
agagttctctctgtgtga

SEQ ID NO: 140169 - DNA, 23 bp, Homo sapiens
gcggtgtctctgtggctgtgtga

SEQ ID NO: 140170 - DNA, 22 bp, Homo sapiens
attcactgaggcttttgtttgt

SEQ ID NO: 140171 - DNA, 23 bp, Homo sapiens
actgagtctcactctgtcgccca

SEQ ID NO: 140172 - DNA, 19 bp, Homo sapiens
tgtcgagcaaatggtctct

SEQ ID NO: 140173 - DNA, 23 bp, Homo sapiens
cacacacaggcacagtctgtcct

SEQ ID NO: 140174 - DNA, 22 bp, Homo sapiens
agcaagacactttctcaaaatg

SEQ ID NO: 140175 - DNA, 21 bp, Homo sapiens
tggagtctcgctctgtcaccc

SEQ ID NO: 140176 - DNA, 23 bp, Homo sapiens
actctgagatgtgagctggaact

SEQ ID NO: 140177 - DNA, 23 bp, Homo sapiens
gagacagagtcttgctctgtcac

SEQ ID NO: 140178 - DNA, 21 bp, Homo sapiens
cttgccagtggctgagttgag

SEQ ID NO: 140179 - DNA, 23 bp, Homo sapiens
gtgaccctgtctctgtccttcac

SEQ ID NO: 140180 - DNA, 23 bp, Homo sapiens
atataggtcaaagtcattgtgct

SEQ ID NO: 140181 - DNA, 23 bp, Homo sapiens
ggcacaggcagacaggctgtgtg

SEQ ID NO: 140182 - DNA, 21 bp, Homo sapiens
tctgtgtgtctgtctttcagg

SEQ ID NO: 140183 - DNA, 23 bp, Homo sapiens
tctctggtcacactttctctctc

SEQ ID NO: 140184 - DNA, 23 bp, Homo sapiens
gacagagtctcgctctgtcaccc

SEQ ID NO: 140185 - DNA, 20 bp, Homo sapiens
tccctgtgagtggaacacgt

SEQ ID NO: 140186 - DNA, 19 bp, Homo sapiens
aatgtgagaaatgactgac

SEQ ID NO: 140187 - DNA, 19 bp, Homo sapiens
taggtagttagacataggt

SEQ ID NO: 140188 - DNA, 23 bp, Homo sapiens
tgtctctctctgtgtgtgtgtct

SEQ ID NO: 140189 - DNA, 23 bp, Homo sapiens
tcgagtaactggaactacaggcg

SEQ ID NO: 140190 - DNA, 23 bp, Homo sapiens
gcctctctgagtctctgagcccc

SEQ ID NO: 140191 - DNA, 19 bp, Homo sapiens
cagagtgagactctgtcac

SEQ ID NO: 140192 - DNA, 23 bp, Homo sapiens
tcggagtctcgctctgtcaccca

SEQ ID NO: 140193 - DNA, 22 bp, Homo sapiens
gctacttcatcgcacactcacg

SEQ ID NO: 140194 - DNA, 21 bp, Homo sapiens
gagcctcactctgtggctgtg

SEQ ID NO: 140195 - DNA, 20 bp, Homo sapiens
tgagagagtctcgctctgtc

SEQ ID NO: 140196 - DNA, 18 bp, Homo sapiens
agatagatagatatagat

SEQ ID NO: 140197 - DNA, 23 bp, Homo sapiens
agagtctcactctgtcacccagg

SEQ ID NO: 140198 - DNA, 23 bp, Homo sapiens
gagtctcactctgtcacccaggc

SEQ ID NO: 140199 - DNA, 23 bp, Homo sapiens
cagtctcactctgtcacccaggc

SEQ ID NO: 140200 - DNA, 18 bp, Homo sapiens
tgtgtgacttagcctttt

SEQ ID NO: 140201 - DNA, 23 bp, Homo sapiens
cggagtctcgctctgtctcccag

SEQ ID NO: 140202 - DNA, 23 bp, Homo sapiens
agacagagtctggctctgtcacc

SEQ ID NO: 140203 - DNA, 20 bp, Homo sapiens
tctgtcaccaggctagagtg

SEQ ID NO: 140204 - DNA, 23 bp, Homo sapiens
tgagacggagtctcgcactgtca

SEQ ID NO: 140205 - DNA, 22 bp, Homo sapiens
tggagtctcgctctgtcacccg

SEQ ID NO: 140206 - DNA, 22 bp, Homo sapiens
atgtatgtgtgcatgttggtat

SEQ ID NO: 140207 - DNA, 18 bp, Homo sapiens
cactggtatgtacatgtg

SEQ ID NO: 140208 - DNA, 23 bp, Homo sapiens
tgagatggagtctcactctgtca

SEQ ID NO: 140209 - DNA, 23 bp, Homo sapiens
atatacatgtatatacacgtatg

SEQ ID NO: 140210 - DNA, 23 bp, Homo sapiens
tgagatgtagtcccactctgtca

SEQ ID NO: 140211 - DNA, 23 bp, Homo sapiens
tgattgtccaaacgcaattcttg

SEQ ID NO: 140212 - DNA, 20 bp, Homo sapiens
agaattgtggctggacatct

SEQ ID NO: 140213 - DNA, 22 bp, Homo sapiens
tcaggcactcactgtctcaggc

SEQ ID NO: 140214 - DNA, 19 bp, Homo sapiens
tcaggctggtcttgaaatc

SEQ ID NO: 140215 - DNA, 23 bp, Homo sapiens
tttgagatggagttttgctcttg

SEQ ID NO: 140216 - DNA, 23 bp, Homo sapiens
acagagtctcgcactgtcaccca

SEQ ID NO: 140217 - DNA, 23 bp, Homo sapiens
ctggccactctctctgtgaccct

SEQ ID NO: 140218 - DNA, 23 bp, Homo sapiens
gggtctctgcctctctctgggcc

SEQ ID NO: 140219 - DNA, 23 bp, Homo sapiens
gtgtgcatgtgtgcgtgtgtgtg

SEQ ID NO: 140220 - DNA, 23 bp, Homo sapiens
attttacactgcaactcagtact

SEQ ID NO: 140221 - DNA, 22 bp, Homo sapiens
atctgcctgggatactacactc

SEQ ID NO: 140222 - DNA, 23 bp, Homo sapiens
acacagagtgtcgctctgtctct

SEQ ID NO: 140223 - DNA, 20 bp, Homo sapiens
tttggagatggagtctcact

SEQ ID NO: 140224 - DNA, 23 bp, Homo sapiens
gacagagtctcgctctgtcaccc

SEQ ID NO: 140225 - DNA, 23 bp, Homo sapiens
acaagtgtgagccactgtgactg

SEQ ID NO: 140226 - DNA, 22 bp, Homo sapiens
tttgagatggactcttgctctg

SEQ ID NO: 140227 - DNA, 19 bp, Homo sapiens
tgagatgaagtcttgctct

SEQ ID NO: 140228 - DNA, 22 bp, Homo sapiens
acagggtctctcactctgttgc

SEQ ID NO: 140229 - DNA, 23 bp, Homo sapiens
tgagttcattgtagattctggat

SEQ ID NO: 140230 - DNA, 23 bp, Homo sapiens
tgagttcattgtagattctggat

SEQ ID NO: 140231 - DNA, 23 bp, Homo sapiens
agtgggagtctcgctctgtcacc

SEQ ID NO: 140232 - DNA, 23 bp, Homo sapiens
tgtctgtctgtctgtccctttat

SEQ ID NO: 140233 - DNA, 23 bp, Homo sapiens
tgagatggagtctcactctgtcg

SEQ ID NO: 140234 - DNA, 23 bp, Homo sapiens
actcactcagagacatattctgc

SEQ ID NO: 140235 - DNA, 23 bp, Homo sapiens
cacgcagcctcagtgcctccctg

SEQ ID NO: 140236 - DNA, 23 bp, Homo sapiens
ttcatctggagtaagatgaccca

SEQ ID NO: 140237 - DNA, 23 bp, Homo sapiens
tctcagggtctatctctctgtga

SEQ ID NO: 140238 - DNA, 23 bp, Homo sapiens
tctcagatgatacagagctgatc

SEQ ID NO: 140239 - DNA, 18 bp, Homo sapiens
aggcagtgttgtctgccc

SEQ ID NO: 140240 - DNA, 20 bp, Homo sapiens
atctataaggcaaggcaaga

SEQ ID NO: 140241 - DNA, 23 bp, Homo sapiens
acacacacagatatacacgtata

SEQ ID NO: 140242 - DNA, 23 bp, Homo sapiens
tatatgtgtatatgtatacgtgt

SEQ ID NO: 140243 - DNA, 22 bp, Homo sapiens
tgggagtgggttagttatgatg

SEQ ID NO: 140244 - DNA, 23 bp, Homo sapiens
ctctctctgtctctcacataagc

SEQ ID NO: 140245 - DNA, 23 bp, Homo sapiens
tggaatctcactctgtctcccag

SEQ ID NO: 140246 - DNA, 23 bp, Homo sapiens
atcctttgtaaatgtatgctaat

SEQ ID NO: 140247 - DNA, 21 bp, Homo sapiens
gtggcttcagtctccctgtct

SEQ ID NO: 140248 - DNA, 19 bp, Homo sapiens
tcaggagagtgtgagctga

SEQ ID NO: 140249 - DNA, 20 bp, Homo sapiens
gtgtatatatatgtgtgtgt

SEQ ID NO: 140250 - DNA, 23 bp, Homo sapiens
tgagtactgtcaatagtcatgtg

SEQ ID NO: 140251 - DNA, 23 bp, Homo sapiens
acaggtagtaggtgttttttttg

SEQ ID NO: 140252 - DNA, 23 bp, Homo sapiens
tgggtgtgtaatctgggaacagt

SEQ ID NO: 140253 - DNA, 18 bp, Homo sapiens
cttcaagatagagtggag

SEQ ID NO: 140254 - DNA, 22 bp, Homo sapiens
ctgaatggggatactctttctc

SEQ ID NO: 140255 - DNA, 23 bp, Homo sapiens
tgagacggagtctcgctctgttg

SEQ ID NO: 140256 - DNA, 23 bp, Homo sapiens
tggagtctcactctgtcacccag

SEQ ID NO: 140257 - DNA, 23 bp, Homo sapiens
gtctcactttctctcccaggcta

SEQ ID NO: 140258 - DNA, 21 bp, Homo sapiens
ttgagacagggtctggctctg

SEQ ID NO: 140259 - DNA, 23 bp, Homo sapiens
gacagagcgagactctatctttt

SEQ ID NO: 140260 - DNA, 22 bp, Homo sapiens
atggagtctcgctctgtcaccc

SEQ ID NO: 140261 - DNA, 23 bp, Homo sapiens
gatttgattgtaatcagaagaat

SEQ ID NO: 140262 - DNA, 18 bp, Homo sapiens
tgtgtgtgtatatatgtg

SEQ ID NO: 140263 - DNA, 22 bp, Homo sapiens
tttgtaaatatattggtatgca

SEQ ID NO: 140264 - DNA, 23 bp, Homo sapiens
tgcagtctcgctctgtcacccag

SEQ ID NO: 140265 - DNA, 23 bp, Homo sapiens
tggagtctcactctgtcacccag

SEQ ID NO: 140266 - DNA, 23 bp, Homo sapiens
ttttgagacagagtctcactctg

SEQ ID NO: 140267 - DNA, 21 bp, Homo sapiens
tttaccagctggttgaggatc

SEQ ID NO: 140268 - DNA, 19 bp, Homo sapiens
agtgcagtgatgcgagggt

SEQ ID NO: 140269 - DNA, 23 bp, Homo sapiens
cggagtctcactctgtcacccag

SEQ ID NO: 140270 - DNA, 19 bp, Homo sapiens
tagtgtgccaggcattagg

SEQ ID NO: 140271 - DNA, 23 bp, Homo sapiens
gagacggtgtctggctctgtcac

SEQ ID NO: 140272 - DNA, 20 bp, Homo sapiens
agtctcgctctgtcgctcag

SEQ ID NO: 140273 - DNA, 21 bp, Homo sapiens
tgagtggcccctctgagtctc

SEQ ID NO: 140274 - DNA, 23 bp, Homo sapiens
agagtctcactctgtcacccagg

SEQ ID NO: 140275 - DNA, 23 bp, Homo sapiens
cagagtctcactctgtcccccag

SEQ ID NO: 140276 - DNA, 23 bp, Homo sapiens
tacagagaatgtaagatcacggt

SEQ ID NO: 140277 - DNA, 23 bp, Homo sapiens
ggctttgtctctgtggctctctt

SEQ ID NO: 140278 - DNA, 21 bp, Homo sapiens
cagagggtgaaatgacacatt

SEQ ID NO: 140279 - DNA, 22 bp, Homo sapiens
tggtatgaagacttctttgctg

SEQ ID NO: 140280 - DNA, 23 bp, Homo sapiens
ctcagcctctctgagtctcagtc

SEQ ID NO: 140281 - DNA, 23 bp, Homo sapiens
tgagatggagtctctctctgtcg

SEQ ID NO: 140282 - DNA, 23 bp, Homo sapiens
agggactcacagtgtctctgcca

SEQ ID NO: 140283 - DNA, 23 bp, Homo sapiens
tggagtctcactctgtcacccag

SEQ ID NO: 140284 - DNA, 18 bp, Homo sapiens
taagagaggtggggagtc

SEQ ID NO: 140285 - DNA, 23 bp, Homo sapiens
atcactgtcactcattttgtgtg

SEQ ID NO: 140286 - DNA, 23 bp, Homo sapiens
tgagttcattgtagattctggat

SEQ ID NO: 140287 - DNA, 23 bp, Homo sapiens
tgagttcattgtagattctggat

SEQ ID NO: 140288 - DNA, 22 bp, Homo sapiens
atttgcatttagaggaggcact

SEQ ID NO: 140289 - DNA, 21 bp, Homo sapiens
aatagagaatgcttctatctg

SEQ ID NO: 140290 - DNA, 23 bp, Homo sapiens
agagtctcactctgtcacccagg

SEQ ID NO: 140291 - DNA, 18 bp, Homo sapiens
tacaagttgtttcgtatt

SEQ ID NO: 140292 - DNA, 23 bp, Homo sapiens
atagaggtttcataggaggaatg

SEQ ID NO: 140293 - DNA, 23 bp, Homo sapiens
tttatgtgtaaggaaaacatcag

SEQ ID NO: 140294 - DNA, 19 bp, Homo sapiens
attgatttattaaattggt

SEQ ID NO: 140295 - DNA, 18 bp, Homo sapiens
tatttacagagaacattg

SEQ ID NO: 140296 - DNA, 21 bp, Homo sapiens
ctgtcccagcctgcctgtatc

SEQ ID NO: 140297 - DNA, 22 bp, Homo sapiens
tgtgacgctctgtcagtgctgg

SEQ ID NO: 140298 - DNA, 23 bp, Homo sapiens
tgagctggagtctcgctctgtct

SEQ ID NO: 140299 - DNA, 18 bp, Homo sapiens
ggagaagtctgagatgct

SEQ ID NO: 140300 - DNA, 22 bp, Homo sapiens
tatgtgtatatatatgtatgta

SEQ ID NO: 140301 - DNA, 23 bp, Homo sapiens
ataatgtgtatgtttatatgtgt

SEQ ID NO: 140302 - DNA, 23 bp, Homo sapiens
gtttaaagaatgagtaatggcca

SEQ ID NO: 140303 - DNA, 23 bp, Homo sapiens
acagagtctcgctctgtctccca

SEQ ID NO: 140304 - DNA, 21 bp, Homo sapiens
tttatttgagaacacatggcc

SEQ ID NO: 140305 - DNA, 23 bp, Homo sapiens
aggcatgttctgcggatgtcaca

SEQ ID NO: 140306 - DNA, 21 bp, Homo sapiens
tatgagagtgttttttttaac

SEQ ID NO: 140307 - DNA, 21 bp, Homo sapiens
atatgtgcagaatgtgcaggt

SEQ ID NO: 140308 - DNA, 23 bp, Homo sapiens
tggagtctcactctgtcacccag

SEQ ID NO: 140309 - DNA, 22 bp, Homo sapiens
cacaatctctctgagatgtaga

SEQ ID NO: 140310 - DNA, 23 bp, Homo sapiens
acaggcaacctacagaatgggag

SEQ ID NO: 140311 - DNA, 21 bp, Homo sapiens
ttttgtgatggtgtctcgctc

SEQ ID NO: 140312 - DNA, 23 bp, Homo sapiens
tgtgtgtatatatatatgtgtgt

SEQ ID NO: 140313 - DNA, 19 bp, Homo sapiens
atgtgtgtgtgtgtgtata

SEQ ID NO: 140314 - DNA, 23 bp, Homo sapiens
tctctctgggtgtcaatttctcc

SEQ ID NO: 140315 - DNA, 20 bp, Homo sapiens
ggcaaatgatacccatttga

SEQ ID NO: 140316 - DNA, 23 bp, Homo sapiens
ctctgattgcttgtgtgactaaa

SEQ ID NO: 140317 - DNA, 23 bp, Homo sapiens
tctctgagactcagtttcttcag

SEQ ID NO: 140318 - DNA, 18 bp, Homo sapiens
caggctgagtgtcccgtt

SEQ ID NO: 140319 - DNA, 23 bp, Homo sapiens
tctatacatgtgtgtgcatgtgt

SEQ ID NO: 140320 - DNA, 20 bp, Homo sapiens
agagtgagaccctgtctcca

SEQ ID NO: 140321 - DNA, 18 bp, Homo sapiens
tgacatcattgagaaagg

SEQ ID NO: 140322 - DNA, 18 bp, Homo sapiens
atatgtatatatgtatat

SEQ ID NO: 140323 - DNA, 21 bp, Homo sapiens
tataggttttatattatagtg

SEQ ID NO: 140324 - DNA, 23 bp, Homo sapiens
tatatgtatatgtatatatgtgt

SEQ ID NO: 140325 - DNA, 22 bp, Homo sapiens
cacacacacacatatgtgtata

SEQ ID NO: 140326 - DNA, 21 bp, Homo sapiens
actgtgtctacctgtgtgaca

SEQ ID NO: 140327 - DNA, 23 bp, Homo sapiens
tgtgtgtctgggtgagagtgtgg

SEQ ID NO: 140328 - DNA, 21 bp, Homo sapiens
aaatctgtctcagagaggcag

SEQ ID NO: 140329 - DNA, 23 bp, Homo sapiens
tgtatatgtatgtatatatatgt

SEQ ID NO: 140330 - DNA, 20 bp, Homo sapiens
atgggtatatatacgtatat

SEQ ID NO: 140331 - DNA, 20 bp, Homo sapiens
acaggaaccttgtgagtcca

SEQ ID NO: 140332 - DNA, 23 bp, Homo sapiens
tcccacagaacgcttgagatgag

SEQ ID NO: 140333 - DNA, 23 bp, Homo sapiens
ttcactcactctcgctcacttat

SEQ ID NO: 140334 - DNA, 19 bp, Homo sapiens
gagagtgcacagccttggt

SEQ ID NO: 140335 - DNA, 23 bp, Homo sapiens
tgagacagcctcactgtcaccca

SEQ ID NO: 140336 - DNA, 23 bp, Homo sapiens
tatgtagttgtgttaggtattat

SEQ ID NO: 140337 - DNA, 23 bp, Homo sapiens
gtttcactatgctgtttcactat

SEQ ID NO: 140338 - DNA, 23 bp, Homo sapiens
taaatgcagactcagaaatctca

SEQ ID NO: 140339 - DNA, 20 bp, Homo sapiens
ttttggtttttgttttttgc

SEQ ID NO: 140340 - DNA, 20 bp, Homo sapiens
tgtgtgtatatatatgtgtg

SEQ ID NO: 140341 - DNA, 21 bp, Homo sapiens
atatacatacatacacacaca

SEQ ID NO: 140342 - DNA, 20 bp, Homo sapiens
acacacacacccatagtttt

SEQ ID NO: 140343 - DNA, 19 bp, Homo sapiens
ttgttagaaatgagagaga

SEQ ID NO: 140344 - DNA, 23 bp, Homo sapiens
tttatagaggtaggcattgctgt

SEQ ID NO: 140345 - DNA, 19 bp, Homo sapiens
agagcagtttctttctttt

SEQ ID NO: 140346 - DNA, 23 bp, Homo sapiens
tttgagatggagttttgctcttg

SEQ ID NO: 140347 - DNA, 21 bp, Homo sapiens
tgagacacagtctcgctctgt

SEQ ID NO: 140348 - DNA, 23 bp, Homo sapiens
gggtcacactctgtcacccagcc

SEQ ID NO: 140349 - DNA, 23 bp, Homo sapiens
gcttcacactgccagttttcaaa

SEQ ID NO: 140350 - DNA, 18 bp, Homo sapiens
tgcaatagatatctctct

SEQ ID NO: 140351 - DNA, 23 bp, Homo sapiens
ttgacagagggtctcactctgtc

SEQ ID NO: 140352 - DNA, 23 bp, Homo sapiens
tgagttcattgtagattctggat

SEQ ID NO: 140353 - DNA, 23 bp, Homo sapiens
tgagttcattgtagattctggat

SEQ ID NO: 140354 - DNA, 18 bp, Homo sapiens
taggacgtgcaaagggtt

SEQ ID NO: 140355 - DNA, 20 bp, Homo sapiens
ttctcagctctggctgcgtt

SEQ ID NO: 140356 - DNA, 23 bp, Homo sapiens
tggagtctcactctgtcacccag

SEQ ID NO: 140357 - DNA, 23 bp, Homo sapiens
cagtgtgtggaaatgcttctgct

SEQ ID NO: 140358 - DNA, 23 bp, Homo sapiens
aggcttcagtctctgactgcctc

SEQ ID NO: 140359 - DNA, 18 bp, Homo sapiens
ttggcactggctggattg

SEQ ID NO: 140360 - DNA, 23 bp, Homo sapiens
tgagttcattgtagattctggat

SEQ ID NO: 140361 - DNA, 23 bp, Homo sapiens
tgagttcattgtagattctggat

SEQ ID NO: 140362 - DNA, 20 bp, Homo sapiens
atgtatgtatgtatgtgtgt

SEQ ID NO: 140363 - DNA, 19 bp, Homo sapiens
tatacacacacacatacat

SEQ ID NO: 140364 - DNA, 18 bp, Homo sapiens
actccaacgactaactct

SEQ ID NO: 140365 - DNA, 21 bp, Homo sapiens
gtgcatgaggcttaatgctga

SEQ ID NO: 140366 - DNA, 22 bp, Homo sapiens
ctcagtgtttgtctctgtggct

SEQ ID NO: 140367 - DNA, 23 bp, Homo sapiens
cggagtctcgctctgtcgctcag

SEQ ID NO: 140368 - DNA, 23 bp, Homo sapiens
tcttttttggttccatatgaaat

SEQ ID NO: 140369 - DNA, 22 bp, Homo sapiens
cagagctgtctgtctctgagag

SEQ ID NO: 140370 - DNA, 20 bp, Homo sapiens
tcgtgtaaggtaaaggttga

SEQ ID NO: 140371 - DNA, 23 bp, Homo sapiens
gcacttgtgacagcctctctgcg

SEQ ID NO: 140372 - DNA, 21 bp, Homo sapiens
tataagcataagtaaatgtat

SEQ ID NO: 140373 - DNA, 23 bp, Homo sapiens
tcagatagtaaggaaatgtgagc

SEQ ID NO: 140374 - DNA, 23 bp, Homo sapiens
atctacatttctttggtgtctgt

SEQ ID NO: 140375 - DNA, 23 bp, Homo sapiens
tgagatggaatctcactctgtca

SEQ ID NO: 140376 - DNA, 23 bp, Homo sapiens
tctctgtctctctttcagtctcc

SEQ ID NO: 140377 - DNA, 23 bp, Homo sapiens
tggagtctcactctgtcacccag

SEQ ID NO: 140378 - DNA, 21 bp, Homo sapiens
cagagagcacactgggagaag

SEQ ID NO: 140379 - DNA, 23 bp, Homo sapiens
attgtgtgtagtatacaatgcat

SEQ ID NO: 140380 - DNA, 19 bp, Homo sapiens
tatttactttaagttctag

SEQ ID NO: 140381 - DNA, 20 bp, Homo sapiens
actctgtgaggcattgttat

SEQ ID NO: 140382 - DNA, 22 bp, Homo sapiens
attgctactggcttgtttagta

SEQ ID NO: 140383 - DNA, 21 bp, Homo sapiens
tatgtgtatgtatatacatgt

SEQ ID NO: 140384 - DNA, 22 bp, Homo sapiens
tataggtagatacagatatcta

SEQ ID NO: 140385 - DNA, 23 bp, Homo sapiens
agtaaagatgaatgtatgctgaa

SEQ ID NO: 140386 - DNA, 23 bp, Homo sapiens
agagagagagagaattgacttca

SEQ ID NO: 140387 - DNA, 23 bp, Homo sapiens
tttgaatctgtctctcggagtct

SEQ ID NO: 140388 - DNA, 20 bp, Homo sapiens
actggctttgtttgtgtgac

SEQ ID NO: 140389 - DNA, 23 bp, Homo sapiens
agagacagagcttactgtcttca

SEQ ID NO: 140390 - DNA, 23 bp, Homo sapiens
ctacttctgatatcttctttatg

SEQ ID NO: 140391 - DNA, 19 bp, Homo sapiens
gtggaccacatactctaga

SEQ ID NO: 140392 - DNA, 22 bp, Homo sapiens
tgttccacattttataatctga

SEQ ID NO: 140393 - DNA, 23 bp, Homo sapiens
tctgtatgtctgtgtgtatgtgc

SEQ ID NO: 140394 - DNA, 23 bp, Homo sapiens
tgagtctcactttttcaatctct

SEQ ID NO: 140395 - DNA, 18 bp, Homo sapiens
tggagactgggcatgctg

SEQ ID NO: 140396 - DNA, 23 bp, Homo sapiens
tcggtctgcctgtctctctctca

SEQ ID NO: 140397 - DNA, 18 bp, Homo sapiens
tctacttagggaggatag

SEQ ID NO: 140398 - DNA, 23 bp, Homo sapiens
taattgcttcttttttatagaga

SEQ ID NO: 140399 - DNA, 23 bp, Homo sapiens
aagaaagaagttagaaagcacag

SEQ ID NO: 140400 - DNA, 20 bp, Homo sapiens
aggatagaaatcaagtatct

SEQ ID NO: 140401 - DNA, 22 bp, Homo sapiens
atgtatatatgtgtgtgtgtgt

SEQ ID NO: 140402 - DNA, 21 bp, Homo sapiens
tctccaggctgttcttgggtt

SEQ ID NO: 140403 - DNA, 20 bp, Homo sapiens
ccaacaatgtaaaagtgttt

SEQ ID NO: 140404 - DNA, 22 bp, Homo sapiens
ttgctggagtgaggtagtatta

SEQ ID NO: 140405 - DNA, 23 bp, Homo sapiens
caggatgtctgagttaaaggtgg

SEQ ID NO: 140406 - DNA, 20 bp, Homo sapiens
tatagctatatatacatatg

SEQ ID NO: 140407 - DNA, 22 bp, Homo sapiens
agtagaatttgaggagtggttg

SEQ ID NO: 140408 - DNA, 23 bp, Homo sapiens
tatgtgtgtgcatgtgtatatcc

SEQ ID NO: 140409 - DNA, 21 bp, Homo sapiens
acatgtgcacaatgtgcaggt

SEQ ID NO: 140410 - DNA, 23 bp, Homo sapiens
tccctattggactctatgattct

SEQ ID NO: 140411 - DNA, 22 bp, Homo sapiens
ttaacagtaatgaccttatttg

SEQ ID NO: 140412 - DNA, 21 bp, Homo sapiens
tatattggtccacttgatggt

SEQ ID NO: 140413 - DNA, 22 bp, Homo sapiens
tttttaagatggagtctcgctc

SEQ ID NO: 140414 - DNA, 23 bp, Homo sapiens
tatggtatagtattctgtagttt

SEQ ID NO: 140415 - DNA, 20 bp, Homo sapiens
tgtgtatatatatatatgtg

SEQ ID NO: 140416 - DNA, 20 bp, Homo sapiens
tctgctcctcctgctgtgtg

SEQ ID NO: 140417 - DNA, 23 bp, Homo sapiens
tctctggttcttatttggtttta

SEQ ID NO: 140418 - DNA, 23 bp, Homo sapiens
tgactggtcaactctgtgagctg

SEQ ID NO: 140419 - DNA, 23 bp, Homo sapiens
atgtgactggagattctgagaag

SEQ ID NO: 140420 - DNA, 22 bp, Homo sapiens
aagtctctaatctattttgtgt

SEQ ID NO: 140421 - DNA, 23 bp, Homo sapiens
tgtcacccccactacactgtgag

SEQ ID NO: 140422 - DNA, 23 bp, Homo sapiens
acagtggaatgattacagctcag

SEQ ID NO: 140423 - DNA, 23 bp, Homo sapiens
tttgtgggtgcatagtaggtgtg

SEQ ID NO: 140424 - DNA, 21 bp, Homo sapiens
ctctgccactgactggctgtg

SEQ ID NO: 140425 - DNA, 20 bp, Homo sapiens
tggcagagtcagagctggaa

SEQ ID NO: 140426 - DNA, 22 bp, Homo sapiens
tgttgagtctgagctctcaccg

SEQ ID NO: 140427 - DNA, 19 bp, Homo sapiens
tctctgcctgcttcccctg

SEQ ID NO: 140428 - DNA, 22 bp, Homo sapiens
tcattcgcctttgtcactctca

SEQ ID NO: 140429 - DNA, 23 bp, Homo sapiens
actgcagctcaaagatgtaggct

SEQ ID NO: 140430 - DNA, 22 bp, Homo sapiens
cagacctcagcctcactgtgtc

SEQ ID NO: 140431 - DNA, 23 bp, Homo sapiens
agactgagtcccaattctgagcc

SEQ ID NO: 140432 - DNA, 23 bp, Homo sapiens
gcctcggtctctccctctgttct

SEQ ID NO: 140433 - DNA, 23 bp, Homo sapiens
ctctggctgtgtctctgtctccc

SEQ ID NO: 140434 - DNA, 23 bp, Homo sapiens
aggggctcagtcactgagtatgt

SEQ ID NO: 140435 - DNA, 23 bp, Homo sapiens
atatttcaaagcctaagacaagt

SEQ ID NO: 140436 - DNA, 23 bp, Homo sapiens
gtctcaccctgtcacccaggctg

SEQ ID NO: 140437 - DNA, 21 bp, Homo sapiens
gaaatgttaagatgatttggg

SEQ ID NO: 140438 - DNA, 18 bp, Homo sapiens
actgtacatacgtattgt

SEQ ID NO: 140439 - DNA, 18 bp, Homo sapiens
gtaagatgtgttcattgg

SEQ ID NO: 140440 - DNA, 19 bp, Homo sapiens
aggtggaaggatcatttga

SEQ ID NO: 140441 - DNA, 21 bp, Homo sapiens
tgaggtaggaggatcacttga

SEQ ID NO: 140442 - DNA, 23 bp, Homo sapiens
agggcaagactctgtctcaaaaa

SEQ ID NO: 140443 - DNA, 23 bp, Homo sapiens
tgagacagggtctcgctctgtca

SEQ ID NO: 140444 - DNA, 23 bp, Homo sapiens
cacccactgtgcctgagtctgag

SEQ ID NO: 140445 - DNA, 19 bp, Homo sapiens
acagtgactctcttcttgg

SEQ ID NO: 140446 - DNA, 21 bp, Homo sapiens
tctctcactgtcataatttcc

SEQ ID NO: 140447 - DNA, 23 bp, Homo sapiens
ttaggatagtaaatgttaggtgt

SEQ ID NO: 140448 - DNA, 23 bp, Homo sapiens
atttagcacattttgttcagcaa

SEQ ID NO: 140449 - DNA, 19 bp, Homo sapiens
aaagggggagaataactgg

SEQ ID NO: 140450 - DNA, 21 bp, Homo sapiens
tctgctactagtttgtttttt

SEQ ID NO: 140451 - DNA, 22 bp, Homo sapiens
tcaggtagtaggaactattgat

SEQ ID NO: 140452 - DNA, 23 bp, Homo sapiens
tgagacagggtctcgctctgttg

SEQ ID NO: 140453 - DNA, 23 bp, Homo sapiens
tgtcacactcactttcttcagca

SEQ ID NO: 140454 - DNA, 23 bp, Homo sapiens
tggattttggttgataatgatat

SEQ ID NO: 140455 - DNA, 21 bp, Homo sapiens
gacagagtaagactctgatct

SEQ ID NO: 140456 - DNA, 21 bp, Homo sapiens
tgagggtcttactctgtctct

SEQ ID NO: 140457 - DNA, 22 bp, Homo sapiens
aagatgtccatataaaatgaag

SEQ ID NO: 140458 - DNA, 21 bp, Homo sapiens
acagggtcttgctctgtctta

SEQ ID NO: 140459 - DNA, 22 bp, Homo sapiens
ttttgagatggagtctcactct

SEQ ID NO: 140460 - DNA, 23 bp, Homo sapiens
gtatatttcactgcatgaaagtt

SEQ ID NO: 140461 - DNA, 23 bp, Homo sapiens
aggtctcactctgtcactctgtt

SEQ ID NO: 140462 - DNA, 19 bp, Homo sapiens
cagtgactctgtggctcac

SEQ ID NO: 140463 - DNA, 21 bp, Homo sapiens
tgaatatatatatgtatcctg

SEQ ID NO: 140464 - DNA, 22 bp, Homo sapiens
tgacttgagcctatttagtttt

SEQ ID NO: 140465 - DNA, 23 bp, Homo sapiens
agacagagtcttactctgtcacc

SEQ ID NO: 140466 - DNA, 23 bp, Homo sapiens
ctctgtccctcaataactgcact

SEQ ID NO: 140467 - DNA, 23 bp, Homo sapiens
cactgtccctcagtaactgcact

SEQ ID NO: 140468 - DNA, 22 bp, Homo sapiens
aacagagtggaacatttggtca

SEQ ID NO: 140469 - DNA, 20 bp, Homo sapiens
tatttctggtaggtaaactt

SEQ ID NO: 140470 - DNA, 22 bp, Homo sapiens
agtctcgctctgtcactcaggt

SEQ ID NO: 140471 - DNA, 21 bp, Homo sapiens
ggtgtgatctcagctcattgc

SEQ ID NO: 140472 - DNA, 20 bp, Homo sapiens
atgtatacatatgtatgtgt

SEQ ID NO: 140473 - DNA, 21 bp, Homo sapiens
aggtgtatatatatatatgtg

SEQ ID NO: 140474 - DNA, 23 bp, Homo sapiens
tgaaaagttttgcaatagaggtt

SEQ ID NO: 140475 - DNA, 23 bp, Homo sapiens
tgagttcattgtagattctggat

SEQ ID NO: 140476 - DNA, 23 bp, Homo sapiens
tgagttcattgtagattctggat

SEQ ID NO: 140477 - DNA, 22 bp, Homo sapiens
tcatagtgccatttcattaagt

SEQ ID NO: 140478 - DNA, 23 bp, Homo sapiens
acagtcaggggaagaaatgcagc

SEQ ID NO: 140479 - DNA, 19 bp, Homo sapiens
acacatacatagatgtatg

SEQ ID NO: 140480 - DNA, 22 bp, Homo sapiens
tgtggtacatgagtgtatacat

SEQ ID NO: 140481 - DNA, 23 bp, Homo sapiens
atgtatgtagatatgtatataga

SEQ ID NO: 140482 - DNA, 23 bp, Homo sapiens
agtgatgttgactgttgcttttg

SEQ ID NO: 140483 - DNA, 23 bp, Homo sapiens
tgagttcattgtagattctggat

SEQ ID NO: 140484 - DNA, 23 bp, Homo sapiens
tgagttcattgtagattctggat

SEQ ID NO: 140485 - DNA, 23 bp, Homo sapiens
cggagtctcactctgtcacccag

SEQ ID NO: 140486 - DNA, 22 bp, Homo sapiens
tcactgaaacctctgcctcctg

SEQ ID NO: 140487 - DNA, 23 bp, Homo sapiens
agagtctcactctgtcacccagg

SEQ ID NO: 140488 - DNA, 21 bp, Homo sapiens
tggtagtgtcttttctgaagt

SEQ ID NO: 140489 - DNA, 23 bp, Homo sapiens
agacagagtctcagtctgttgtc

SEQ ID NO: 140490 - DNA, 19 bp, Homo sapiens
gtgcgtgcatgcgtgtgtg

SEQ ID NO: 140491 - DNA, 22 bp, Homo sapiens
accacctgcacagtgtgctcat

SEQ ID NO: 140492 - DNA, 20 bp, Homo sapiens
tttgtttttgttttggggac

SEQ ID NO: 140493 - DNA, 23 bp, Homo sapiens
agtgcatgcctgtagttccagct

SEQ ID NO: 140494 - DNA, 20 bp, Homo sapiens
tgatgttcagtaggttaggt

SEQ ID NO: 140495 - DNA, 23 bp, Homo sapiens
gtcaaggtgtcactctgtcaccc

SEQ ID NO: 140496 - DNA, 23 bp, Homo sapiens
tcagactctctctcagttttccc

SEQ ID NO: 140497 - DNA, 21 bp, Homo sapiens
agtgaatatttttatatgtgt

SEQ ID NO: 140498 - DNA, 22 bp, Homo sapiens
atattgcacattactaagttgc

SEQ ID NO: 140499 - DNA, 23 bp, Homo sapiens
tcaatgcaatttagtgtgtgtga

SEQ ID NO: 140500 - DNA, 19 bp, Homo sapiens
ttcacatgagtgcatgcac

SEQ ID NO: 140501 - DNA, 22 bp, Homo sapiens
tacaatgtataggaaggcatca

SEQ ID NO: 140502 - DNA, 22 bp, Homo sapiens
taataccgagtggaagttttgt

SEQ ID NO: 140503 - DNA, 23 bp, Homo sapiens
tttccattgtactgtgtgtcctg

SEQ ID NO: 140504 - DNA, 23 bp, Homo sapiens
tctgaatggcaaatcattttgat

SEQ ID NO: 140505 - DNA, 22 bp, Homo sapiens
ttacaacttttatgtaggtttc

SEQ ID NO: 140506 - DNA, 23 bp, Homo sapiens
agttaccttttcaaatgaagttt

SEQ ID NO: 140507 - DNA, 23 bp, Homo sapiens
ggagtctcactctgtctcccagg

SEQ ID NO: 140508 - DNA, 23 bp, Homo sapiens
tatgtgtgtatatgtattcgtct

SEQ ID NO: 140509 - DNA, 20 bp, Homo sapiens
taggtggataaaatatcaga

SEQ ID NO: 140510 - DNA, 23 bp, Homo sapiens
agtctctgtgtctcttacttcaa

SEQ ID NO: 140511 - DNA, 23 bp, Homo sapiens
ggtcattgtttatgatttggaag

SEQ ID NO: 140512 - DNA, 23 bp, Homo sapiens
tgagttcattgtagattctggat

SEQ ID NO: 140513 - DNA, 23 bp, Homo sapiens
tgagttcattgtagattctggat

SEQ ID NO: 140514 - DNA, 20 bp, Homo sapiens
ttatgttggttttgtaataa

SEQ ID NO: 140515 - DNA, 23 bp, Homo sapiens
tgagtcagactgttctgacacag

SEQ ID NO: 140516 - DNA, 23 bp, Homo sapiens
tctgtgagtgagtctctccctca

SEQ ID NO: 140517 - DNA, 23 bp, Homo sapiens
ctatatatatagatagtgtgctc

SEQ ID NO: 140518 - DNA, 23 bp, Homo sapiens
agataatgtgctacatatatagt

SEQ ID NO: 140519 - DNA, 18 bp, Homo sapiens
tagtccagggtctgcact

SEQ ID NO: 140520 - DNA, 23 bp, Homo sapiens
ggaagtgagagtgcacaggagct

SEQ ID NO: 140521 - DNA, 23 bp, Homo sapiens
aagagacagtggagatgcagctg

SEQ ID NO: 140522 - DNA, 23 bp, Homo sapiens
atatgtgtatatgtatatatgtc

SEQ ID NO: 140523 - DNA, 18 bp, Homo sapiens
actatgagaaaagcaggt

SEQ ID NO: 140524 - DNA, 23 bp, Homo sapiens
taagatttgttttccattgtttg

SEQ ID NO: 140525 - DNA, 20 bp, Homo sapiens
ttcccagttatgagaggtca

SEQ ID NO: 140526 - DNA, 23 bp, Homo sapiens
atggttcagtggatatttctgtg

SEQ ID NO: 140527 - DNA, 23 bp, Homo sapiens
atctgtgtgtgtatgtgtgtctg

SEQ ID NO: 140528 - DNA, 23 bp, Homo sapiens
tgaggtaggaggatcacttgagc

SEQ ID NO: 140529 - DNA, 20 bp, Homo sapiens
tgagttaagatttggtaagg

SEQ ID NO: 140530 - DNA, 19 bp, Homo sapiens
tgtactgtatttttagaag

SEQ ID NO: 140531 - DNA, 21 bp, Homo sapiens
tgaggtaggaggatcacttga

SEQ ID NO: 140532 - DNA, 20 bp, Homo sapiens
tcagatggaggttgacatgt

SEQ ID NO: 140533 - DNA, 23 bp, Homo sapiens
aggttctgcatctgcatctggga

SEQ ID NO: 140534 - DNA, 23 bp, Homo sapiens
agacagagtctcgctctgtcacc

SEQ ID NO: 140535 - DNA, 23 bp, Homo sapiens
acagagtctcgctctgtcaccca

SEQ ID NO: 140536 - DNA, 22 bp, Homo sapiens
tttcacagggaaagtagttgaa

SEQ ID NO: 140537 - DNA, 23 bp, Homo sapiens
agagtctcactctgtcactcagg

SEQ ID NO: 140538 - DNA, 23 bp, Homo sapiens
tatataagcatatgtatccttat

SEQ ID NO: 140539 - DNA, 20 bp, Homo sapiens
aatgggactagtgtttctca

SEQ ID NO: 140540 - DNA, 23 bp, Homo sapiens
cagagaacacactctgtgatttc

SEQ ID NO: 140541 - DNA, 23 bp, Homo sapiens
agatggagtctcgctctgtcacc

SEQ ID NO: 140542 - DNA, 23 bp, Homo sapiens
tcaatggcattaaaagaagaatg

SEQ ID NO: 140543 - DNA, 19 bp, Homo sapiens
tatgtatatatatatgtgt

SEQ ID NO: 140544 - DNA, 23 bp, Homo sapiens
atgtgtatatatgtatatatgtg

SEQ ID NO: 140545 - DNA, 23 bp, Homo sapiens
gtgtgtgtgtgtatatatatatg

SEQ ID NO: 140546 - DNA, 23 bp, Homo sapiens
agctgtctgcttttcttcagggt

SEQ ID NO: 140547 - DNA, 23 bp, Homo sapiens
ttcattcttgaagaagcctgact

SEQ ID NO: 140548 - DNA, 18 bp, Homo sapiens
tggaaaagaaacagtata

SEQ ID NO: 140549 - DNA, 23 bp, Homo sapiens
agcactgattttgtatatgtgag

SEQ ID NO: 140550 - DNA, 21 bp, Homo sapiens
atcccacttgttgtattacct

SEQ ID NO: 140551 - DNA, 18 bp, Homo sapiens
acatagaaggctggagga

SEQ ID NO: 140552 - DNA, 23 bp, Homo sapiens
agacatggtcttgctgtgttggt

SEQ ID NO: 140553 - DNA, 20 bp, Homo sapiens
agggagtgaagtgatgggga

SEQ ID NO: 140554 - DNA, 23 bp, Homo sapiens
acggagtctcgctctctcaccca

SEQ ID NO: 140555 - DNA, 23 bp, Homo sapiens
acagagtctcgctctgtcgctca

SEQ ID NO: 140556 - DNA, 22 bp, Homo sapiens
atgtatgtatgtatgtgtgtgt

SEQ ID NO: 140557 - DNA, 23 bp, Homo sapiens
gagacagagttccgctctgttgt

SEQ ID NO: 140558 - DNA, 23 bp, Homo sapiens
ctgagatctgtctcactctgttg

SEQ ID NO: 140559 - DNA, 19 bp, Homo sapiens
tctcgactcactgcaacct

SEQ ID NO: 140560 - DNA, 20 bp, Homo sapiens
atgtatatatgcatgtgttt

SEQ ID NO: 140561 - DNA, 23 bp, Homo sapiens
tacctgttttgtgcatgtattta

SEQ ID NO: 140562 - DNA, 18 bp, Homo sapiens
tattggatgttaagtgaa

SEQ ID NO: 140563 - DNA, 22 bp, Homo sapiens
tttgagactgagtctcgctctg

SEQ ID NO: 140564 - DNA, 23 bp, Homo sapiens
ttctcactggcattggatagtct

SEQ ID NO: 140565 - DNA, 23 bp, Homo sapiens
cagtccttctctgactctttcct

SEQ ID NO: 140566 - DNA, 23 bp, Homo sapiens
tcttagaaagtggaagtagttat

SEQ ID NO: 140567 - DNA, 23 bp, Homo sapiens
tgagttcattgtagattctggat

SEQ ID NO: 140568 - DNA, 23 bp, Homo sapiens
tgagttcattgtagattctggat

SEQ ID NO: 140569 - DNA, 21 bp, Homo sapiens
acatgtgcagaatgtgcaggt

SEQ ID NO: 140570 - DNA, 18 bp, Homo sapiens
gaagtgagagtttctgct

SEQ ID NO: 140571 - DNA, 23 bp, Homo sapiens
ttatttgattgctctggctagga

SEQ ID NO: 140572 - DNA, 23 bp, Homo sapiens
ttctagtacaacgtagaatagaa

SEQ ID NO: 140573 - DNA, 18 bp, Homo sapiens
attcagactggatgtact

SEQ ID NO: 140574 - DNA, 23 bp, Homo sapiens
ctttgtcagaacaatgacagctg

SEQ ID NO: 140575 - DNA, 23 bp, Homo sapiens
aatgtgacaaatgtgtgtgtgtg

SEQ ID NO: 140576 - DNA, 23 bp, Homo sapiens
atgtagagtagtgtttgtcatgt

SEQ ID NO: 140577 - DNA, 21 bp, Homo sapiens
aattatgacagcttttgctca

SEQ ID NO: 140578 - DNA, 23 bp, Homo sapiens
ccattgattatgtagaagagttt

SEQ ID NO: 140579 - DNA, 23 bp, Homo sapiens
tgaactttgtgtttatcatttcc

SEQ ID NO: 140580 - DNA, 23 bp, Homo sapiens
tacatgtgcacaacgtgcaggtt

SEQ ID NO: 140581 - DNA, 19 bp, Homo sapiens
atgtgtgtgtgtgtatata

SEQ ID NO: 140582 - DNA, 23 bp, Homo sapiens
tgaagaacttccttgtaaacttg

SEQ ID NO: 140583 - DNA, 22 bp, Homo sapiens
actttgctgaatttagcccttt

SEQ ID NO: 140584 - DNA, 23 bp, Homo sapiens
tgtatatgcctctgtatgtttac

SEQ ID NO: 140585 - DNA, 23 bp, Homo sapiens
aatgtgtgtatatatatatgtgt

SEQ ID NO: 140586 - DNA, 20 bp, Homo sapiens
tgctgaaatgaattgagact

SEQ ID NO: 140587 - DNA, 19 bp, Homo sapiens
acacacacacactacatac

SEQ ID NO: 140588 - DNA, 20 bp, Homo sapiens
tggtagcagaatttgtagaa

SEQ ID NO: 140589 - DNA, 23 bp, Homo sapiens
tgagttcattgtagattctggat

SEQ ID NO: 140590 - DNA, 23 bp, Homo sapiens
tgagttcattgtagattctggat

SEQ ID NO: 140591 - DNA, 23 bp, Homo sapiens
atcatagtatttgaatagagaat

SEQ ID NO: 140592 - DNA, 19 bp, Homo sapiens
tgtttttaatccttcctga

SEQ ID NO: 140593 - DNA, 23 bp, Homo sapiens
agaatcagtatctccttcagtga

SEQ ID NO: 140594 - DNA, 19 bp, Homo sapiens
tctgccagctatcctagtt

SEQ ID NO: 140595 - DNA, 21 bp, Homo sapiens
acatgtgcacaatgtgcaggt

SEQ ID NO: 140596 - DNA, 21 bp, Homo sapiens
atgtatgtttgcatgtgtctg

SEQ ID NO: 140597 - DNA, 23 bp, Homo sapiens
tattatgctgtacatgaggttca

SEQ ID NO: 140598 - DNA, 23 bp, Homo sapiens
ttaatgttactgttctaatcatt

SEQ ID NO: 140599 - DNA, 23 bp, Homo sapiens
tgagttcattgtagattctggat

SEQ ID NO: 140600 - DNA, 23 bp, Homo sapiens
tgagttcattgtagattctggat

SEQ ID NO: 140601 - DNA, 23 bp, Homo sapiens
atgtgtgtgtgtatgtatacatg

SEQ ID NO: 140602 - DNA, 23 bp, Homo sapiens
tatatgcacatatacatacgtat

SEQ ID NO: 140603 - DNA, 23 bp, Homo sapiens
tgtatatgtatgtgtatatatgt

SEQ ID NO: 140604 - DNA, 23 bp, Homo sapiens
atgtgtgtgtatatgtaatgatt

SEQ ID NO: 140605 - DNA, 19 bp, Homo sapiens
tacagcattagctgctctg

SEQ ID NO: 140606 - DNA, 23 bp, Homo sapiens
gatatctataaatatttatgtgt

SEQ ID NO: 140607 - DNA, 23 bp, Homo sapiens
gagtctcactctgtcacccaggc

SEQ ID NO: 140608 - DNA, 23 bp, Homo sapiens
tgtttggaattttagcagttcat

SEQ ID NO: 140609 - DNA, 22 bp, Homo sapiens
atatacacacacgtatataggc

SEQ ID NO: 140610 - DNA, 22 bp, Homo sapiens
tgtgtgtatatatatatgtgtg

SEQ ID NO: 140611 - DNA, 20 bp, Homo sapiens
tacacacacacatatatagc

SEQ ID NO: 140612 - DNA, 22 bp, Homo sapiens
tatgtgtgtatatatatgtgtg

SEQ ID NO: 140613 - DNA, 23 bp, Homo sapiens
tgtgtatatatgtatgtgtgtgt

SEQ ID NO: 140614 - DNA, 18 bp, Homo sapiens
agaggttgcagtgagccc

SEQ ID NO: 140615 - DNA, 23 bp, Homo sapiens
ttaattctatatgtggagtacct

SEQ ID NO: 140616 - DNA, 23 bp, Homo sapiens
atgtatatatgtatgtgtatatg

SEQ ID NO: 140617 - DNA, 23 bp, Homo sapiens
tgagttcattgtagattctggat

SEQ ID NO: 140618 - DNA, 23 bp, Homo sapiens
tgagttcattgtagattctggat

SEQ ID NO: 140619 - DNA, 23 bp, Homo sapiens
ggagtctcactcactctgttgcc

SEQ ID NO: 140620 - DNA, 23 bp, Homo sapiens
aggcactgtgtgattattgaacc

SEQ ID NO: 140621 - DNA, 23 bp, Homo sapiens
gacagtctcactctgtcacccag

SEQ ID NO: 140622 - DNA, 23 bp, Homo sapiens
gttgttggtcagagtgtaaagtg

SEQ ID NO: 140623 - DNA, 18 bp, Homo sapiens
tgtgtgtgtgtatatatt

SEQ ID NO: 140624 - DNA, 23 bp, Homo sapiens
ttgtatgttctatatgcaatgta

SEQ ID NO: 140625 - DNA, 23 bp, Homo sapiens
ttgtgactggcttcctttagcaa

SEQ ID NO: 140626 - DNA, 21 bp, Homo sapiens
tatatatgtgtgtatgctgta

SEQ ID NO: 140627 - DNA, 23 bp, Homo sapiens
tatagaatgcatatgtatacatg

SEQ ID NO: 140628 - DNA, 20 bp, Homo sapiens
gtgaagactctgactttttt

SEQ ID NO: 140629 - DNA, 21 bp, Homo sapiens
tggagtctcactctgtcaccc

SEQ ID NO: 140630 - DNA, 23 bp, Homo sapiens
tggctgacttgtgtatctgtctc

SEQ ID NO: 140631 - DNA, 21 bp, Homo sapiens
agcagattttccatagtcttt

SEQ ID NO: 140632 - DNA, 20 bp, Homo sapiens
agtctcgctctgtcacccag

SEQ ID NO: 140633 - DNA, 22 bp, Homo sapiens
agtacaaagttagaggtggctg

SEQ ID NO: 140634 - DNA, 23 bp, Homo sapiens
gtatatgtatatgtatatgtatg

SEQ ID NO: 140635 - DNA, 23 bp, Homo sapiens
ttgatacatgtggctctgatctt

SEQ ID NO: 140636 - DNA, 23 bp, Homo sapiens
tgagacagagtctcgctcttgtt

SEQ ID NO: 140637 - DNA, 23 bp, Homo sapiens
tttttttttaagtggagccagta

SEQ ID NO: 140638 - DNA, 22 bp, Homo sapiens
aggcaaagtctggctctgtcgc

SEQ ID NO: 140639 - DNA, 19 bp, Homo sapiens
gtctcgctctgtcgctcag

SEQ ID NO: 140640 - DNA, 23 bp, Homo sapiens
gagacggagtctcgctctgtcac

SEQ ID NO: 140641 - DNA, 23 bp, Homo sapiens
agggtacatgtgcacattgtgca

SEQ ID NO: 140642 - DNA, 23 bp, Homo sapiens
atgtgcatatgcatgtgcacgtg

SEQ ID NO: 140643 - DNA, 23 bp, Homo sapiens
tgagttcattgtagattctggat

SEQ ID NO: 140644 - DNA, 23 bp, Homo sapiens
tgagttcattgtagattctggat

SEQ ID NO: 140645 - DNA, 20 bp, Homo sapiens
tcagccagactccctgtccc

SEQ ID NO: 140646 - DNA, 23 bp, Homo sapiens
agacagagtctcgctttgttgcc

SEQ ID NO: 140647 - DNA, 21 bp, Homo sapiens
tgtgcagatgtttgggctgag

SEQ ID NO: 140648 - DNA, 23 bp, Homo sapiens
tgagacggagtctcgctctgttg

SEQ ID NO: 140649 - DNA, 22 bp, Homo sapiens
gttgacagacagactttttttt

SEQ ID NO: 140650 - DNA, 23 bp, Homo sapiens
agtctcactctgtcacccaggct

SEQ ID NO: 140651 - DNA, 18 bp, Homo sapiens
ttttgagacggagtcttg

SEQ ID NO: 140652 - DNA, 21 bp, Homo sapiens
tctgtctccaattcttagcaa

SEQ ID NO: 140653 - DNA, 21 bp, Homo sapiens
agtggcaagaacatggcttac

SEQ ID NO: 140654 - DNA, 22 bp, Homo sapiens
tgcccggctggctgaatgcctc

SEQ ID NO: 140655 - DNA, 21 bp, Homo sapiens
aatacagggagatgaggtgca

SEQ ID NO: 140656 - DNA, 21 bp, Homo sapiens
aaactagagatccgtgtgata

SEQ ID NO: 140657 - DNA, 21 bp, Homo sapiens
ggaatactactgtttaaggaa

SEQ ID NO: 140658 - DNA, 23 bp, Homo sapiens
tgagacagagtctttctctgtca

SEQ ID NO: 140659 - DNA, 23 bp, Homo sapiens
tgagatggaatctcactctgtct

SEQ ID NO: 140660 - DNA, 23 bp, Homo sapiens
cggagtctcactctgtcacccag

SEQ ID NO: 140661 - DNA, 23 bp, Homo sapiens
gagtctcactctgtcacccaggc

SEQ ID NO: 140662 - DNA, 23 bp, Homo sapiens
atatgtataacaaattgtatgta

SEQ ID NO: 140663 - DNA, 23 bp, Homo sapiens
cggagtctcactctgtcacccag

SEQ ID NO: 140664 - DNA, 23 bp, Homo sapiens
gagtctcactctgtcacccaggc

SEQ ID NO: 140665 - DNA, 23 bp, Homo sapiens
tcagggactcagtgacaatgact

SEQ ID NO: 140666 - DNA, 21 bp, Homo sapiens
tgagttgcttctgtaccagtt

SEQ ID NO: 140667 - DNA, 23 bp, Homo sapiens
gagtctcactctgtcacctaggc

SEQ ID NO: 140668 - DNA, 18 bp, Homo sapiens
tgatacggatatgacagt

SEQ ID NO: 140669 - DNA, 19 bp, Homo sapiens
caatatttcatttggtagt

SEQ ID NO: 140670 - DNA, 23 bp, Homo sapiens
gacagagtctcgctctgtcaccc

SEQ ID NO: 140671 - DNA, 20 bp, Homo sapiens
attggtacataattgtacat

SEQ ID NO: 140672 - DNA, 22 bp, Homo sapiens
acatttattcaagttaatggat

SEQ ID NO: 140673 - DNA, 19 bp, Homo sapiens
tttgagatggagtcttgct

SEQ ID NO: 140674 - DNA, 21 bp, Homo sapiens
tgtgtgtgtgtatatatatac

SEQ ID NO: 140675 - DNA, 23 bp, Homo sapiens
acttgagctatatgtggctactg

SEQ ID NO: 140676 - DNA, 23 bp, Homo sapiens
cagcctctcaaagtgctgggatt

SEQ ID NO: 140677 - DNA, 21 bp, Homo sapiens
tgagatggagtctcactttgt

SEQ ID NO: 140678 - DNA, 20 bp, Homo sapiens
agaattgcaattgttgggct

SEQ ID NO: 140679 - DNA, 23 bp, Homo sapiens
ttaggaaactgcaaactcttttc

SEQ ID NO: 140680 - DNA, 23 bp, Homo sapiens
gtctgcgtgtctccctctctggg

SEQ ID NO: 140681 - DNA, 21 bp, Homo sapiens
tcactgcaacctctttctgcc

SEQ ID NO: 140682 - DNA, 23 bp, Homo sapiens
gtctgagatcaaggtgtcagcag

SEQ ID NO: 140683 - DNA, 22 bp, Homo sapiens
atatgtgtatctatgtatatgt

SEQ ID NO: 140684 - DNA, 23 bp, Homo sapiens
gacagagtctcgctctgtcaccc

SEQ ID NO: 140685 - DNA, 23 bp, Homo sapiens
tgagttcattgtagattctggat

SEQ ID NO: 140686 - DNA, 23 bp, Homo sapiens
tgagttcattgtagattctggat

SEQ ID NO: 140687 - DNA, 18 bp, Homo sapiens
agtgttcatattcattcc

SEQ ID NO: 140688 - DNA, 23 bp, Homo sapiens
agaaagcagctgacttatttttg

SEQ ID NO: 140689 - DNA, 23 bp, Homo sapiens
tgtggtacagtctgtctgtctcc

SEQ ID NO: 140690 - DNA, 21 bp, Homo sapiens
agagtgagaccttatctcttt

SEQ ID NO: 140691 - DNA, 23 bp, Homo sapiens
tttgagacggagtctcactctgt

SEQ ID NO: 140692 - DNA, 23 bp, Homo sapiens
tggctggttccctcagtgcctgg

SEQ ID NO: 140693 - DNA, 23 bp, Homo sapiens
aaacacaggcttttaattgtttt

SEQ ID NO: 140694 - DNA, 18 bp, Homo sapiens
tgaggtaggaggatcact

SEQ ID NO: 140695 - DNA, 23 bp, Homo sapiens
tggagtctcactctgtcacccag

SEQ ID NO: 140696 - DNA, 20 bp, Homo sapiens
cctcactctcactcaggctg

SEQ ID NO: 140697 - DNA, 22 bp, Homo sapiens
ataactcagtgagcagacatgg

SEQ ID NO: 140698 - DNA, 23 bp, Homo sapiens
acggagtctcacgctgtcaccca

SEQ ID NO: 140699 - DNA, 23 bp, Homo sapiens
ttagatggagtctcgctctgtca

SEQ ID NO: 140700 - DNA, 23 bp, Homo sapiens
tgtggctcccaatctaccccctg

SEQ ID NO: 140701 - DNA, 19 bp, Homo sapiens
acggtctctcgctctttct

SEQ ID NO: 140702 - DNA, 21 bp, Homo sapiens
gtcttttcttattcaagttga

SEQ ID NO: 140703 - DNA, 21 bp, Homo sapiens
tatctctatatatttatatgt

SEQ ID NO: 140704 - DNA, 19 bp, Homo sapiens
tgtctatatagatacagat

SEQ ID NO: 140705 - DNA, 22 bp, Homo sapiens
acatgtgcagaacatgcaggtt

SEQ ID NO: 140706 - DNA, 18 bp, Homo sapiens
ggagagagagttcagtga

SEQ ID NO: 140707 - DNA, 20 bp, Homo sapiens
acaggtgggacagacaggca

SEQ ID NO: 140708 - DNA, 22 bp, Homo sapiens
tctcactcaggttttgtatttt

SEQ ID NO: 140709 - DNA, 23 bp, Homo sapiens
gagaccgagtctcactctgtcac

SEQ ID NO: 140710 - DNA, 22 bp, Homo sapiens
atttgttgaaaagatgatcttg

SEQ ID NO: 140711 - DNA, 23 bp, Homo sapiens
tgagcatctctgtgcctgtctcc

SEQ ID NO: 140712 - DNA, 21 bp, Homo sapiens
ttggcactagcaggacaaagc

SEQ ID NO: 140713 - DNA, 20 bp, Homo sapiens
agagtgagaccctgtcttaa

SEQ ID NO: 140714 - DNA, 23 bp, Homo sapiens
tatatgctcttttctgtatgtct

SEQ ID NO: 140715 - DNA, 22 bp, Homo sapiens
acatgtgcacaatgtgcaggtt

SEQ ID NO: 140716 - DNA, 23 bp, Homo sapiens
tggagtctcactctgtcacccag

SEQ ID NO: 140717 - DNA, 23 bp, Homo sapiens
aagctgaaggtctgtttgcggga

SEQ ID NO: 140718 - DNA, 23 bp, Homo sapiens
atctgtgtcactttaacaaatca

SEQ ID NO: 140719 - DNA, 23 bp, Homo sapiens
ctttgtctttgttgttgttaagc

SEQ ID NO: 140720 - DNA, 21 bp, Homo sapiens
acagagtctcactctatcacc

SEQ ID NO: 140721 - DNA, 23 bp, Homo sapiens
gaatgtcctttaatttgggtttg

SEQ ID NO: 140722 - DNA, 23 bp, Homo sapiens
gcttagactcaggtaatggacac

SEQ ID NO: 140723 - DNA, 23 bp, Homo sapiens
ggaactgtttgcaaatgtaatct

SEQ ID NO: 140724 - DNA, 23 bp, Homo sapiens
ttgatggttgatggtgtttgcct

SEQ ID NO: 140725 - DNA, 22 bp, Homo sapiens
ataactgtagattgtgagctga

SEQ ID NO: 140726 - DNA, 22 bp, Homo sapiens
aatcactctctcagaatctaat

SEQ ID NO: 140727 - DNA, 23 bp, Homo sapiens
gcatgcaccaacatgttggctaa

SEQ ID NO: 140728 - DNA, 23 bp, Homo sapiens
agtaaagatgggatttcaccgtg

SEQ ID NO: 140729 - DNA, 22 bp, Homo sapiens
tcacacccattatgatggctat

SEQ ID NO: 140730 - DNA, 23 bp, Homo sapiens
tttgtattgaggaatgagagcac

SEQ ID NO: 140731 - DNA, 22 bp, Homo sapiens
gtgggtgatgaaggtgtgttgc

SEQ ID NO: 140732 - DNA, 20 bp, Homo sapiens
tttagttgtggacaaggtct

SEQ ID NO: 140733 - DNA, 23 bp, Homo sapiens
taagccactgtgagaattcaggt

SEQ ID NO: 140734 - DNA, 23 bp, Homo sapiens
gatatattcacgtgtgtgtgcgt

SEQ ID NO: 140735 - DNA, 23 bp, Homo sapiens
tctgttacagcaacaggaaatgg

SEQ ID NO: 140736 - DNA, 19 bp, Homo sapiens
acccagtgagcagggctga

SEQ ID NO: 140737 - DNA, 23 bp, Homo sapiens
tctttgcaataatagctgttaca

SEQ ID NO: 140738 - DNA, 23 bp, Homo sapiens
agatcctgattctctggctgacg

SEQ ID NO: 140739 - DNA, 23 bp, Homo sapiens
atgtgtgcatatgtacacgtgtg

SEQ ID NO: 140740 - DNA, 22 bp, Homo sapiens
aatgcatgtgtgcatgtggatg

SEQ ID NO: 140741 - DNA, 22 bp, Homo sapiens
tatgtgtatgtatatgtacaca

SEQ ID NO: 140742 - DNA, 23 bp, Homo sapiens
tgagtcagagtctcactctgttg

SEQ ID NO: 140743 - DNA, 20 bp, Homo sapiens
tggtgagatcttggctcact

SEQ ID NO: 140744 - DNA, 22 bp, Homo sapiens
tgtcactcactctctctttaat

SEQ ID NO: 140745 - DNA, 20 bp, Homo sapiens
gctggagtgttgtggcatgg

SEQ ID NO: 140746 - DNA, 23 bp, Homo sapiens
tgagttcattgtagattctggat

SEQ ID NO: 140747 - DNA, 23 bp, Homo sapiens
tgagttcattgtagattctggat

SEQ ID NO: 140748 - DNA, 23 bp, Homo sapiens
agaatgaatatctatctgtatct

SEQ ID NO: 140749 - DNA, 20 bp, Homo sapiens
atcctttgaaacttttgtga

SEQ ID NO: 140750 - DNA, 20 bp, Homo sapiens
agagagaggagagagagttg

SEQ ID NO: 140751 - DNA, 18 bp, Homo sapiens
tctcatggtcctggaggc

SEQ ID NO: 140752 - DNA, 22 bp, Homo sapiens
atctgacttgttcatttgtgta

SEQ ID NO: 140753 - DNA, 21 bp, Homo sapiens
acactggattttttttttatc

SEQ ID NO: 140754 - DNA, 23 bp, Homo sapiens
tgagagtgtgcacatgcaggtga

SEQ ID NO: 140755 - DNA, 23 bp, Homo sapiens
tagtaaaagctaatgttgtggtc

SEQ ID NO: 140756 - DNA, 22 bp, Homo sapiens
tttttgagacggagtctttttc

SEQ ID NO: 140757 - DNA, 23 bp, Homo sapiens
attctcactatccagataccttt

SEQ ID NO: 140758 - DNA, 23 bp, Homo sapiens
tctctctatatctctctatatct

SEQ ID NO: 140759 - DNA, 22 bp, Homo sapiens
ttggagctctaagatttgactg

SEQ ID NO: 140760 - DNA, 23 bp, Homo sapiens
cagggtggattcttgtagctggc

SEQ ID NO: 140761 - DNA, 18 bp, Homo sapiens
agttctcacttcctgatg

SEQ ID NO: 140762 - DNA, 23 bp, Homo sapiens
ctcagagtacagacagtggtcct

SEQ ID NO: 140763 - DNA, 22 bp, Homo sapiens
gtgagcctctgtgactgcctca

SEQ ID NO: 140764 - DNA, 23 bp, Homo sapiens
tagaatgcagtagaagtgaacct

SEQ ID NO: 140765 - DNA, 23 bp, Homo sapiens
tcattccgattacctgctctgtg

SEQ ID NO: 140766 - DNA, 22 bp, Homo sapiens
gggtctcactcactctatcacc

SEQ ID NO: 140767 - DNA, 23 bp, Homo sapiens
tctctctctccctgacagctgag

SEQ ID NO: 140768 - DNA, 23 bp, Homo sapiens
ctgtgtgtgtctgtgtcctaatt

SEQ ID NO: 140769 - DNA, 22 bp, Homo sapiens
agttccttgtagattctggata

SEQ ID NO: 140770 - DNA, 23 bp, Homo sapiens
tctctgcctgactgcctttcagc

SEQ ID NO: 140771 - DNA, 22 bp, Homo sapiens
tcacttcacactttgttcttgg

SEQ ID NO: 140772 - DNA, 20 bp, Homo sapiens
tatgtagcatccatatgttt

SEQ ID NO: 140773 - DNA, 21 bp, Homo sapiens
gtgccaggtctgagagagctc

SEQ ID NO: 140774 - DNA, 23 bp, Homo sapiens
ggtgacacagtgagacagtgtct

SEQ ID NO: 140775 - DNA, 23 bp, Homo sapiens
ctgagacagagtctcactctgtt

SEQ ID NO: 140776 - DNA, 23 bp, Homo sapiens
actggttctacattatggtgagt

SEQ ID NO: 140777 - DNA, 19 bp, Homo sapiens
tgagatggagtctctctct

SEQ ID NO: 140778 - DNA, 23 bp, Homo sapiens
tgtgtacaacatgattctatgta

SEQ ID NO: 140779 - DNA, 22 bp, Homo sapiens
tagttgtatctacatatgaata

SEQ ID NO: 140780 - DNA, 23 bp, Homo sapiens
gtctgtgtgtgcatctgcatgtg

SEQ ID NO: 140781 - DNA, 23 bp, Homo sapiens
catctatgtttgctcatggagca

SEQ ID NO: 140782 - DNA, 23 bp, Homo sapiens
gactctgtggaaagattttagag

SEQ ID NO: 140783 - DNA, 21 bp, Homo sapiens
tgtacatttctatgtgtgtat

SEQ ID NO: 140784 - DNA, 23 bp, Homo sapiens
acacacacacacatatgtgtata

SEQ ID NO: 140785 - DNA, 23 bp, Homo sapiens
atgtatgtggtatgtgtgtacat

SEQ ID NO: 140786 - DNA, 21 bp, Homo sapiens
aggcacagtggctcacatctg

SEQ ID NO: 140787 - DNA, 19 bp, Homo sapiens
ctgtctctttcagtgtttg

SEQ ID NO: 140788 - DNA, 22 bp, Homo sapiens
cagacatctctcaagcatatca

SEQ ID NO: 140789 - DNA, 23 bp, Homo sapiens
ggctgagaacagaggctgcacac

SEQ ID NO: 140790 - DNA, 23 bp, Homo sapiens
agactgaagagagactgcattga

SEQ ID NO: 140791 - DNA, 20 bp, Homo sapiens
atttgttggttagaatcctg

SEQ ID NO: 140792 - DNA, 18 bp, Homo sapiens
atactttaagttttaggg

SEQ ID NO: 140793 - DNA, 23 bp, Homo sapiens
tgagttcattgtagattctggat

SEQ ID NO: 140794 - DNA, 23 bp, Homo sapiens
tgagttcattgtagattctggat

SEQ ID NO: 140795 - DNA, 23 bp, Homo sapiens
agtttcagagtgcttttgtaaca

SEQ ID NO: 140796 - DNA, 23 bp, Homo sapiens
ctggagacagagtctcactgtgt

SEQ ID NO: 140797 - DNA, 23 bp, Homo sapiens
tgagagacagtctcgctctgtcg

SEQ ID NO: 140798 - DNA, 23 bp, Homo sapiens
agactctcactctgtcacccagg

SEQ ID NO: 140799 - DNA, 19 bp, Homo sapiens
tccttccttaactagcaga

SEQ ID NO: 140800 - DNA, 23 bp, Homo sapiens
gagtggtagcaggttgttttgtt

SEQ ID NO: 140801 - DNA, 23 bp, Homo sapiens
attggacttgtggctggctgtat

SEQ ID NO: 140802 - DNA, 23 bp, Homo sapiens
actagaagtgttttagatatcag

SEQ ID NO: 140803 - DNA, 20 bp, Homo sapiens
atagatatgattttcttttt

SEQ ID NO: 140804 - DNA, 23 bp, Homo sapiens
ttttgttttcaaggaaaagagac

SEQ ID NO: 140805 - DNA, 23 bp, Homo sapiens
tgtatacatgtatgtgtgtgtgt

SEQ ID NO: 140806 - DNA, 23 bp, Homo sapiens
tctgtatctgttaggtatgcttg

SEQ ID NO: 140807 - DNA, 18 bp, Homo sapiens
cagtgaaaacagtgtggg

SEQ ID NO: 140808 - DNA, 23 bp, Homo sapiens
ttttcaggtagaagcttgtttgg

SEQ ID NO: 140809 - DNA, 22 bp, Homo sapiens
taacatgtggattatagttcaa

SEQ ID NO: 140810 - DNA, 23 bp, Homo sapiens
actgggtggctgggtggctctat

SEQ ID NO: 140811 - DNA, 23 bp, Homo sapiens
ttagatagatgctgagttagaga

SEQ ID NO: 140812 - DNA, 23 bp, Homo sapiens
aagagtagtaattgatttggggt

SEQ ID NO: 140813 - DNA, 20 bp, Homo sapiens
acaccttatttgtaactttc

SEQ ID NO: 140814 - DNA, 23 bp, Homo sapiens
tctgcctctcagtgatttcagtg

SEQ ID NO: 140815 - DNA, 23 bp, Homo sapiens
gtgtgtgcctgtaattccagata

SEQ ID NO: 140816 - DNA, 19 bp, Homo sapiens
ctcagttcactgcgacctc

SEQ ID NO: 140817 - DNA, 18 bp, Homo sapiens
tgccagtgatttcacacc

SEQ ID NO: 140818 - DNA, 23 bp, Homo sapiens
ggagtctcactctgtcacccagg

SEQ ID NO: 140819 - DNA, 19 bp, Homo sapiens
aatactatttcaccacatg

SEQ ID NO: 140820 - DNA, 22 bp, Homo sapiens
tagacttggctgcacaatggta

SEQ ID NO: 140821 - DNA, 23 bp, Homo sapiens
cactgtcactgtgatttggtggt

SEQ ID NO: 140822 - DNA, 23 bp, Homo sapiens
acagtataggttgtgctgtttgc

SEQ ID NO: 140823 - DNA, 23 bp, Homo sapiens
atgagaagaattagaactcatca

SEQ ID NO: 140824 - DNA, 23 bp, Homo sapiens
ttcaacagactttttgttgatct

SEQ ID NO: 140825 - DNA, 19 bp, Homo sapiens
tgaccattttgtttgtcag

SEQ ID NO: 140826 - DNA, 19 bp, Homo sapiens
agaaacaaagatgttatca

SEQ ID NO: 140827 - DNA, 23 bp, Homo sapiens
tggaagactagtgattttgttgt

SEQ ID NO: 140828 - DNA, 22 bp, Homo sapiens
caacaaatcacagtctgccata

SEQ ID NO: 140829 - DNA, 23 bp, Homo sapiens
gagtctcactgtgtcacccaggc

SEQ ID NO: 140830 - DNA, 23 bp, Homo sapiens
tggagtctcactctgtcactcag

SEQ ID NO: 140831 - DNA, 22 bp, Homo sapiens
tatatgcatatatagctatata

SEQ ID NO: 140832 - DNA, 20 bp, Homo sapiens
tagatatagatatagatatc

SEQ ID NO: 140833 - DNA, 18 bp, Homo sapiens
tctatatatctatatctc

SEQ ID NO: 140834 - DNA, 23 bp, Homo sapiens
aactatgtggatgttcatttcaa

SEQ ID NO: 140835 - DNA, 20 bp, Homo sapiens
acgtgtatatatatacgtgt

SEQ ID NO: 140836 - DNA, 19 bp, Homo sapiens
tatgtgtatatatacgtat

SEQ ID NO: 140837 - DNA, 23 bp, Homo sapiens
cagagatgtcagtgtggacttat

SEQ ID NO: 140838 - DNA, 23 bp, Homo sapiens
gcttctgagaacaggctgagcac

SEQ ID NO: 140839 - DNA, 23 bp, Homo sapiens
gtcagggctgtcactctctctgt

SEQ ID NO: 140840 - DNA, 18 bp, Homo sapiens
atgatccatccctgtctg

SEQ ID NO: 140841 - DNA, 23 bp, Homo sapiens
cactgattctacattgtggtaag

SEQ ID NO: 140842 - DNA, 23 bp, Homo sapiens
aatgtgatgtgcttgagtcatcc

SEQ ID NO: 140843 - DNA, 23 bp, Homo sapiens
acacagaagccagtgaccattcc

SEQ ID NO: 140844 - DNA, 23 bp, Homo sapiens
acagtgtctcactctgttctcca

SEQ ID NO: 140845 - DNA, 20 bp, Homo sapiens
gcattggtgtgatcttggct

SEQ ID NO: 140846 - DNA, 22 bp, Homo sapiens
ataagtcttatcattttcatga

SEQ ID NO: 140847 - DNA, 23 bp, Homo sapiens
ctaagggtttgaagtggggtttg

SEQ ID NO: 140848 - DNA, 20 bp, Homo sapiens
ctatctatatctctgtgtat

SEQ ID NO: 140849 - DNA, 20 bp, Homo sapiens
attttcattgttattgttat

SEQ ID NO: 140850 - DNA, 23 bp, Homo sapiens
tactaatctatgcaattgtcagg

SEQ ID NO: 140851 - DNA, 23 bp, Homo sapiens
gacagagtctcgctctgtcaccc

SEQ ID NO: 140852 - DNA, 23 bp, Homo sapiens
acggagtctcgctctctcaccca

SEQ ID NO: 140853 - DNA, 23 bp, Homo sapiens
tgtctcagtctgtctctgggaga

SEQ ID NO: 140854 - DNA, 20 bp, Homo sapiens
accatgagaaggaggattag

SEQ ID NO: 140855 - DNA, 22 bp, Homo sapiens
aaaagcagtttttgtatttgtg

SEQ ID NO: 140856 - DNA, 22 bp, Homo sapiens
ctaatcattactctttctgttc

SEQ ID NO: 140857 - DNA, 23 bp, Homo sapiens
ttttagtagagacagtttcacca

SEQ ID NO: 140858 - DNA, 19 bp, Homo sapiens
atatgcattttctgttgcc

SEQ ID NO: 140859 - DNA, 22 bp, Homo sapiens
tttgttctttttgcttaggatt

SEQ ID NO: 140860 - DNA, 18 bp, Homo sapiens
tggcaactagtgctgata

SEQ ID NO: 140861 - DNA, 20 bp, Homo sapiens
tgtgtgtatatatatgtatg

SEQ ID NO: 140862 - DNA, 19 bp, Homo sapiens
ttttgagagggagtctgac

SEQ ID NO: 140863 - DNA, 23 bp, Homo sapiens
tgcctgcctcactctttggctgt

SEQ ID NO: 140864 - DNA, 19 bp, Homo sapiens
tgaagatacgtttgtgtgt

SEQ ID NO: 140865 - DNA, 23 bp, Homo sapiens
ctctgcctgagtctgtggctctt

SEQ ID NO: 140866 - DNA, 22 bp, Homo sapiens
tgtcagccactttgaagagtgt

SEQ ID NO: 140867 - DNA, 23 bp, Homo sapiens
cagtattcagactaccacattca

SEQ ID NO: 140868 - DNA, 23 bp, Homo sapiens
ctgaggtagaaggatcattagaa

SEQ ID NO: 140869 - DNA, 23 bp, Homo sapiens
agagtctcactctgtcacccagg

SEQ ID NO: 140870 - DNA, 23 bp, Homo sapiens
aatcttgtatcctaatgatgtat

SEQ ID NO: 140871 - DNA, 23 bp, Homo sapiens
atatgtttgtgtgtgtattcatc

SEQ ID NO: 140872 - DNA, 23 bp, Homo sapiens
aaaagatgagatagaatcctgta

SEQ ID NO: 140873 - DNA, 23 bp, Homo sapiens
tgtatttggcattacttggattc

SEQ ID NO: 140874 - DNA, 22 bp, Homo sapiens
tctagccgagaattaccaccta

SEQ ID NO: 140875 - DNA, 19 bp, Homo sapiens
atgcttttgaatgaaaaga

SEQ ID NO: 140876 - DNA, 21 bp, Homo sapiens
tataggaacaatttctaggag

SEQ ID NO: 140877 - DNA, 23 bp, Homo sapiens
tggagtctcactctgtcacccag

SEQ ID NO: 140878 - DNA, 19 bp, Homo sapiens
tcatgtgacataaggttta

SEQ ID NO: 140879 - DNA, 20 bp, Homo sapiens
gtattagtatgtattataca

SEQ ID NO: 140880 - DNA, 21 bp, Homo sapiens
tgttttctagtttgtttatag

SEQ ID NO: 140881 - DNA, 22 bp, Homo sapiens
atgtatatgtatatgtatgcat

SEQ ID NO: 140882 - DNA, 19 bp, Homo sapiens
tgcctggcctatatatgac

SEQ ID NO: 140883 - DNA, 23 bp, Homo sapiens
gagtttcactctgtcgctcagac

SEQ ID NO: 140884 - DNA, 19 bp, Homo sapiens
ttgaacagttgcataggag

SEQ ID NO: 140885 - DNA, 23 bp, Homo sapiens
acacacacgtgtgtgtgtatatg

SEQ ID NO: 140886 - DNA, 21 bp, Homo sapiens
atacacacatgtgtgtgtgtg

SEQ ID NO: 140887 - DNA, 22 bp, Homo sapiens
tatatgtgtgtgtatatataca

SEQ ID NO: 140888 - DNA, 23 bp, Homo sapiens
tacgtgtgtgtgtatatatatac

SEQ ID NO: 140889 - DNA, 23 bp, Homo sapiens
atgacctctatatatatgtgtgt

SEQ ID NO: 140890 - DNA, 22 bp, Homo sapiens
ttctgtgaagaaagtcaatgat

SEQ ID NO: 140891 - DNA, 21 bp, Homo sapiens
ttccaaatgagtgtcagctct

SEQ ID NO: 140892 - DNA, 23 bp, Homo sapiens
acagagtagacccatagtggata

SEQ ID NO: 140893 - DNA, 23 bp, Homo sapiens
atatgtatatgtatatatgtgta

SEQ ID NO: 140894 - DNA, 22 bp, Homo sapiens
ttttatgcaaaattacatatgt

SEQ ID NO: 140895 - DNA, 19 bp, Homo sapiens
tatatatgtacacggatgg

SEQ ID NO: 140896 - DNA, 23 bp, Homo sapiens
tactctctctgtctggaatgttc

SEQ ID NO: 140897 - DNA, 20 bp, Homo sapiens
tttgaggttagaaattgtgt

SEQ ID NO: 140898 - DNA, 23 bp, Homo sapiens
tgagttcattgtagattctggat

SEQ ID NO: 140899 - DNA, 23 bp, Homo sapiens
tgagttcattgtagattctggat

SEQ ID NO: 140900 - DNA, 22 bp, Homo sapiens
acaagaaaataattcataagag

SEQ ID NO: 140901 - DNA, 23 bp, Homo sapiens
tcatctcatgttttcttgtgatt

SEQ ID NO: 140902 - DNA, 23 bp, Homo sapiens
tgaggaagtaccatgaattgatg

SEQ ID NO: 140903 - DNA, 23 bp, Homo sapiens
tgagttcattgtagattctggat

SEQ ID NO: 140904 - DNA, 23 bp, Homo sapiens
tgagttcattgtagattctggat

SEQ ID NO: 140905 - DNA, 23 bp, Homo sapiens
agagtgataaaatgattgtgtga

SEQ ID NO: 140906 - DNA, 22 bp, Homo sapiens
tacttagtttttgataaggtat

SEQ ID NO: 140907 - DNA, 23 bp, Homo sapiens
ttctctctgtctgtcattgagct

SEQ ID NO: 140908 - DNA, 23 bp, Homo sapiens
tgacttgtgcctgaagtcttctt

SEQ ID NO: 140909 - DNA, 23 bp, Homo sapiens
tgagttcattgtagattctggat

SEQ ID NO: 140910 - DNA, 23 bp, Homo sapiens
tgagttcattgtagattctggat

SEQ ID NO: 140911 - DNA, 21 bp, Homo sapiens
aaatgcatgcatatacagtat

SEQ ID NO: 140912 - DNA, 23 bp, Homo sapiens
tataggtagatagatatagatat

SEQ ID NO: 140913 - DNA, 23 bp, Homo sapiens
tctgtatatatgtataattctac

SEQ ID NO: 140914 - DNA, 20 bp, Homo sapiens
tgtgaagaaagtcaatggtg

SEQ ID NO: 140915 - DNA, 23 bp, Homo sapiens
cagcacagagactgcactcaagg

SEQ ID NO: 140916 - DNA, 23 bp, Homo sapiens
gagaaatctcagtggacatatca

SEQ ID NO: 140917 - DNA, 21 bp, Homo sapiens
atatgagtcagggattcagga

SEQ ID NO: 140918 - DNA, 23 bp, Homo sapiens
tagcttgttaagttctatgaatc

SEQ ID NO: 140919 - DNA, 22 bp, Homo sapiens
cttttttggttccatatgaaat

SEQ ID NO: 140920 - DNA, 23 bp, Homo sapiens
tggtagcttgatgaggatggcat

SEQ ID NO: 140921 - DNA, 20 bp, Homo sapiens
gttaatattgttatgtgtga

SEQ ID NO: 140922 - DNA, 23 bp, Homo sapiens
tttctctgtctggcttatttcac

SEQ ID NO: 140923 - DNA, 22 bp, Homo sapiens
gggtctcactctgtcacccagg

SEQ ID NO: 140924 - DNA, 23 bp, Homo sapiens
tgagttcattgtagattctggat

SEQ ID NO: 140925 - DNA, 23 bp, Homo sapiens
tgagttcattgtagattctggat

SEQ ID NO: 140926 - DNA, 22 bp, Homo sapiens
atatatatgtgtgtgcgtatgt

SEQ ID NO: 140927 - DNA, 18 bp, Homo sapiens
tatgtgtatatatatatg

SEQ ID NO: 140928 - DNA, 19 bp, Homo sapiens
atatgtgtatatatatatg

SEQ ID NO: 140929 - DNA, 18 bp, Homo sapiens
tatgtgtatatatatatg

SEQ ID NO: 140930 - DNA, 22 bp, Homo sapiens
aggattacaaataattcagtag

SEQ ID NO: 140931 - DNA, 23 bp, Homo sapiens
tgagtttctgtctcactctggct

SEQ ID NO: 140932 - DNA, 21 bp, Homo sapiens
tctcaatgtctggctttctga

SEQ ID NO: 140933 - DNA, 23 bp, Homo sapiens
gacactggcagagttcagcacct

SEQ ID NO: 140934 - DNA, 18 bp, Homo sapiens
tggaaggatcacttgaac

SEQ ID NO: 140935 - DNA, 23 bp, Homo sapiens
tggagtctcactctgtcacccag

SEQ ID NO: 140936 - DNA, 21 bp, Homo sapiens
tgtcaacttgattggattgaa

SEQ ID NO: 140937 - DNA, 23 bp, Homo sapiens
tgtgagggtgatggcaaaggtga

SEQ ID NO: 140938 - DNA, 23 bp, Homo sapiens
cagcttctgcaaaaactctcctt

SEQ ID NO: 140939 - DNA, 23 bp, Homo sapiens
gtggtctctctctcagtgtggct

SEQ ID NO: 140940 - DNA, 20 bp, Homo sapiens
tctcttgtcaccacattgct

SEQ ID NO: 140941 - DNA, 20 bp, Homo sapiens
agtatggctaagaaacagaa

SEQ ID NO: 140942 - DNA, 23 bp, Homo sapiens
gttactggagtacatttcagaaa

SEQ ID NO: 140943 - DNA, 23 bp, Homo sapiens
tattttttagtggagtgaggtag

SEQ ID NO: 140944 - DNA, 22 bp, Homo sapiens
tacctgattcatttagaagtta

SEQ ID NO: 140945 - DNA, 22 bp, Homo sapiens
actcagtatgtttgttgttggt

SEQ ID NO: 140946 - DNA, 23 bp, Homo sapiens
gtttttcaggaactaagtcattt

SEQ ID NO: 140947 - DNA, 23 bp, Homo sapiens
taattgctggtcattaagtgtaa

SEQ ID NO: 140948 - DNA, 23 bp, Homo sapiens
gagttgaaggaggaaagtttcca

SEQ ID NO: 140949 - DNA, 19 bp, Homo sapiens
tgacaaggtctcactctgt

SEQ ID NO: 140950 - DNA, 23 bp, Homo sapiens
gtgctgtacatagttgtatgtac

SEQ ID NO: 140951 - DNA, 20 bp, Homo sapiens
tatgactggcagcacagtag

SEQ ID NO: 140952 - DNA, 23 bp, Homo sapiens
atgtgtgtctatatgaatacatg

SEQ ID NO: 140953 - DNA, 22 bp, Homo sapiens
tgtcacccacactctgtatcct

SEQ ID NO: 140954 - DNA, 23 bp, Homo sapiens
tgagttcattgtagattctggat

SEQ ID NO: 140955 - DNA, 23 bp, Homo sapiens
tgagttcattgtagattctggat

SEQ ID NO: 140956 - DNA, 23 bp, Homo sapiens
tgagttcattgtagattctggat

SEQ ID NO: 140957 - DNA, 23 bp, Homo sapiens
tgagttcattgtagattctggat

SEQ ID NO: 140958 - DNA, 22 bp, Homo sapiens
tattattgtatgttgaaagggt

SEQ ID NO: 140959 - DNA, 20 bp, Homo sapiens
ataccttgattagctctgaa

SEQ ID NO: 140960 - DNA, 20 bp, Homo sapiens
aatacatattttgctttggg

SEQ ID NO: 140961 - DNA, 23 bp, Homo sapiens
tattcaaagtaaaaaagtatgga

SEQ ID NO: 140962 - DNA, 23 bp, Homo sapiens
tgtgtgtatatgtatatatgtgt

SEQ ID NO: 140963 - DNA, 20 bp, Homo sapiens
acaaagaaaatgcatttctc

SEQ ID NO: 140964 - DNA, 20 bp, Homo sapiens
ttgcattttctgctttgaca

SEQ ID NO: 140965 - DNA, 23 bp, Homo sapiens
acacacatgtgtgtgtgtgtgtg

SEQ ID NO: 140966 - DNA, 23 bp, Homo sapiens
tgagttcattgtagattctggat

SEQ ID NO: 140967 - DNA, 23 bp, Homo sapiens
tgagttcattgtagattctggat

SEQ ID NO: 140968 - DNA, 23 bp, Homo sapiens
tgagttcattgtagattctggat

SEQ ID NO: 140969 - DNA, 18 bp, Homo sapiens
atatttgtgtatgttcat

SEQ ID NO: 140970 - DNA, 23 bp, Homo sapiens
atatttttgtagttgttccacac

SEQ ID NO: 140971 - DNA, 22 bp, Homo sapiens
tctcaagatatagaatctcaat

SEQ ID NO: 140972 - DNA, 22 bp, Homo sapiens
ttatgttgggatgcctgtgttt

SEQ ID NO: 140973 - DNA, 21 bp, Homo sapiens
tatgtgtgtatatgtatatac

SEQ ID NO: 140974 - DNA, 23 bp, Homo sapiens
tatgtgtgtatatgtatacacat

SEQ ID NO: 140975 - DNA, 23 bp, Homo sapiens
tatatgtatatacacatatgtgt

SEQ ID NO: 140976 - DNA, 18 bp, Homo sapiens
tatgtatgtatatatgtg

SEQ ID NO: 140977 - DNA, 23 bp, Homo sapiens
ttaaagctaggatttcactggac

SEQ ID NO: 140978 - DNA, 20 bp, Homo sapiens
atgaggatattttttctatt

SEQ ID NO: 140979 - DNA, 23 bp, Homo sapiens
gttagacagtgagatatatcagt

SEQ ID NO: 140980 - DNA, 23 bp, Homo sapiens
tctctctcactgtgtgttctctg

SEQ ID NO: 140981 - DNA, 23 bp, Homo sapiens
aagtttgatgagcatctgattga

SEQ ID NO: 140982 - DNA, 20 bp, Homo sapiens
tataagactaatgctagtcc

SEQ ID NO: 140983 - DNA, 19 bp, Homo sapiens
tatactgggttgtatactt

SEQ ID NO: 140984 - DNA, 22 bp, Homo sapiens
atacacacataaaatgtgtgtg

SEQ ID NO: 140985 - DNA, 23 bp, Homo sapiens
atgagtctcgctctgtcacccag

SEQ ID NO: 140986 - DNA, 22 bp, Homo sapiens
atgcttttgagattcatctaca

SEQ ID NO: 140987 - DNA, 20 bp, Homo sapiens
attgttgaatagtaacctat

SEQ ID NO: 140988 - DNA, 21 bp, Homo sapiens
tttcataggttttttgtgtgt

SEQ ID NO: 140989 - DNA, 19 bp, Homo sapiens
agggagagagagagaagac

SEQ ID NO: 140990 - DNA, 22 bp, Homo sapiens
tatgtgcttgtatgtgtggtgt

SEQ ID NO: 140991 - DNA, 22 bp, Homo sapiens
agagtctcgctctgtcacccag

SEQ ID NO: 140992 - DNA, 21 bp, Homo sapiens
taagagagaaattgctaggtc

SEQ ID NO: 140993 - DNA, 23 bp, Homo sapiens
ggccatgtgaaaactgtgagcac

SEQ ID NO: 140994 - DNA, 21 bp, Homo sapiens
tcagaggtgggtttttttgtg

SEQ ID NO: 140995 - DNA, 19 bp, Homo sapiens
tcagtagtggtagctatca

SEQ ID NO: 140996 - DNA, 20 bp, Homo sapiens
tattgatggagtctggctct

SEQ ID NO: 140997 - DNA, 19 bp, Homo sapiens
tcaacatagtgagacccca

SEQ ID NO: 140998 - DNA, 18 bp, Homo sapiens
tctctgaagacacaggga

SEQ ID NO: 140999 - DNA, 23 bp, Homo sapiens
ttttttcttcagacagagtctgg

SEQ ID NO: 141000 - DNA, 21 bp, Homo sapiens
acaatatatcatatagttggc

SEQ ID NO: 141001 - DNA, 20 bp, Homo sapiens
tatgctaaaaatttatttgt

SEQ ID NO: 141002 - DNA, 23 bp, Homo sapiens
agggaaagtacaaaggtcttaac

SEQ ID NO: 141003 - DNA, 23 bp, Homo sapiens
aaatgctcttcatcaggccgagt

SEQ ID NO: 141004 - DNA, 23 bp, Homo sapiens
gtggtttttgtgattggaagttt

SEQ ID NO: 141005 - DNA, 23 bp, Homo sapiens
tctgccagtgcattttttcagtc

SEQ ID NO: 141006 - DNA, 20 bp, Homo sapiens
tgcttgagagcctataaagt

SEQ ID NO: 141007 - DNA, 22 bp, Homo sapiens
aggaaggctagtgatattgatg

SEQ ID NO: 141008 - DNA, 23 bp, Homo sapiens
tctctctctcgatgcagtctcgc

SEQ ID NO: 141009 - DNA, 21 bp, Homo sapiens
agaagaagcagtctgtgtcag

SEQ ID NO: 141010 - DNA, 22 bp, Homo sapiens
atttctttcatttgcaaagcca

SEQ ID NO: 141011 - DNA, 19 bp, Homo sapiens
agtgtgtgtattctgtgat

SEQ ID NO: 141012 - DNA, 23 bp, Homo sapiens
atgattaaaccagaggcacagtt

SEQ ID NO: 141013 - DNA, 23 bp, Homo sapiens
ttccctttgtcatcctatgcctg

SEQ ID NO: 141014 - DNA, 23 bp, Homo sapiens
tcagtggtaatgtcatctttgtc

SEQ ID NO: 141015 - DNA, 19 bp, Homo sapiens
tgtgtatatatatgtgtgt

SEQ ID NO: 141016 - DNA, 21 bp, Homo sapiens
tacttgcatctaaagtgaaag

SEQ ID NO: 141017 - DNA, 18 bp, Homo sapiens
aggatagatgtggggttt

SEQ ID NO: 141018 - DNA, 22 bp, Homo sapiens
tggagggagtctcactctgtca

SEQ ID NO: 141019 - DNA, 23 bp, Homo sapiens
aaatagatggatatgtaatcaaa

SEQ ID NO: 141020 - DNA, 23 bp, Homo sapiens
tgagtctcactctgtcacccagg

SEQ ID NO: 141021 - DNA, 19 bp, Homo sapiens
agtggcacggtaagatctc

SEQ ID NO: 141022 - DNA, 23 bp, Homo sapiens
gtctgactctctgggagtgtgtc

SEQ ID NO: 141023 - DNA, 23 bp, Homo sapiens
gagtctcactctgtcacccaggc

SEQ ID NO: 141024 - DNA, 22 bp, Homo sapiens
gatgattagtgatattgaacat

SEQ ID NO: 141025 - DNA, 19 bp, Homo sapiens
tgttttgtgacggagtctt

SEQ ID NO: 141026 - DNA, 23 bp, Homo sapiens
cccagtgagcacacatgcagcag

SEQ ID NO: 141027 - DNA, 23 bp, Homo sapiens
atgtattattgtgtgattagtgt

SEQ ID NO: 141028 - DNA, 23 bp, Homo sapiens
gcatctgtgtgggagtgtggttg

SEQ ID NO: 141029 - DNA, 23 bp, Homo sapiens
tcccagagcccctggaactctgg

SEQ ID NO: 141030 - DNA, 23 bp, Homo sapiens
tcccagagcccctggaactctgg

SEQ ID NO: 141031 - DNA, 23 bp, Homo sapiens
tcccagagcccctggaactctgg

SEQ ID NO: 141032 - DNA, 23 bp, Homo sapiens
tgaggtagaaggatcactgggcc

SEQ ID NO: 141033 - DNA, 23 bp, Homo sapiens
ttgagttcagtctgggcaacatg

SEQ ID NO: 141034 - DNA, 23 bp, Homo sapiens
agacagggtctctcactcttttg

SEQ ID NO: 141035 - DNA, 18 bp, Homo sapiens
tcggatcactgcaagctc

SEQ ID NO: 141036 - DNA, 18 bp, Homo sapiens
agctttgacctggccttc

SEQ ID NO: 141037 - DNA, 23 bp, Homo sapiens
ttatcaaactatttgaaatgtat

SEQ ID NO: 141038 - DNA, 23 bp, Homo sapiens
tcagtacttccaaaactctgtgc

SEQ ID NO: 141039 - DNA, 23 bp, Homo sapiens
ccaagtagctgtgatggcagctg

SEQ ID NO: 141040 - DNA, 19 bp, Homo sapiens
tgtaaaacgtctgcaagga

SEQ ID NO: 141041 - DNA, 23 bp, Homo sapiens
attgtcagtgaaatagttgattg

SEQ ID NO: 141042 - DNA, 23 bp, Homo sapiens
ttttgagacggagtctcattctg

SEQ ID NO: 141043 - DNA, 23 bp, Homo sapiens
cgagtcacactctgtcttccagg

SEQ ID NO: 141044 - DNA, 23 bp, Homo sapiens
cgagtcacactctgtcttccagg

SEQ ID NO: 141045 - DNA, 23 bp, Homo sapiens
acccacacacagatagatgattg

SEQ ID NO: 141046 - DNA, 21 bp, Homo sapiens
tagggtatagtagattaagaa

SEQ ID NO: 141047 - DNA, 23 bp, Homo sapiens
tgagttcattgtagattctggat

SEQ ID NO: 141048 - DNA, 23 bp, Homo sapiens
tgagttcattgtagattctggat

SEQ ID NO: 141049 - DNA, 21 bp, Homo sapiens
tagggtatagtagattaagaa

SEQ ID NO: 141050 - DNA, 23 bp, Homo sapiens
atagttgtgaatatgttgttatg

SEQ ID NO: 141051 - DNA, 23 bp, Homo sapiens
aatggcttttgatgtatagtaag

SEQ ID NO: 141052 - DNA, 23 bp, Homo sapiens
tgagatggagtcttgctctgtca

SEQ ID NO: 141053 - DNA, 23 bp, Homo sapiens
tgagttcattgtagattctggat

SEQ ID NO: 141054 - DNA, 23 bp, Homo sapiens
tgagttcattgtagattctggat

SEQ ID NO: 141055 - DNA, 23 bp, Homo sapiens
tgagttcattgtagattctggat

SEQ ID NO: 141056 - DNA, 23 bp, Homo sapiens
tgagttcattgtagattctggat

SEQ ID NO: 141057 - DNA, 22 bp, Homo sapiens
tgtgtatatatgtgtgtgtgta

SEQ ID NO: 141058 - DNA, 20 bp, Homo sapiens
tctgtctgtctgcctatctg

SEQ ID NO: 141059 - DNA, 19 bp, Homo sapiens
gtcactgtggctcacacct

SEQ ID NO: 141060 - DNA, 23 bp, Homo sapiens
acaagtgtgctcctggtggtctt

SEQ ID NO: 141061 - DNA, 19 bp, Homo sapiens
aatgtgtgtgcatatatat

SEQ ID NO: 141062 - DNA, 23 bp, Homo sapiens
atgtgcatgtgtgtgtgtgtgtg

SEQ ID NO: 141063 - DNA, 22 bp, Homo sapiens
gagatgtagcaggaaggtttct

SEQ ID NO: 141064 - DNA, 23 bp, Homo sapiens
tgtcaagctgtctctctgaaatc

SEQ ID NO: 141065 - DNA, 18 bp, Homo sapiens
tatatgcacatatttatg

SEQ ID NO: 141066 - DNA, 23 bp, Homo sapiens
ggtgtctcactctgtcactcagg

SEQ ID NO: 141067 - DNA, 22 bp, Homo sapiens
tcagtggggactgtgtgtgaag

SEQ ID NO: 141068 - DNA, 23 bp, Homo sapiens
atgtatgtatatatgtgtgtgtg

SEQ ID NO: 141069 - DNA, 22 bp, Homo sapiens
tatatgtgtgtatgtatatatg

SEQ ID NO: 141070 - DNA, 20 bp, Homo sapiens
gagacagtctctctctgtgg

SEQ ID NO: 141071 - DNA, 22 bp, Homo sapiens
attttgtcactaaaagttgtcc

SEQ ID NO: 141072 - DNA, 20 bp, Homo sapiens
ggagtctctctctgtcaccc

SEQ ID NO: 141073 - DNA, 23 bp, Homo sapiens
tggagtctcactctgtcacccag

SEQ ID NO: 141074 - DNA, 23 bp, Homo sapiens
tggagtctcactctgtcacccag

SEQ ID NO: 141075 - DNA, 22 bp, Homo sapiens
atacaggatgctatatttctct

SEQ ID NO: 141076 - DNA, 23 bp, Homo sapiens
aacagagctttatagtattctat

SEQ ID NO: 141077 - DNA, 18 bp, Homo sapiens
aatgtttatgaaatagat

SEQ ID NO: 141078 - DNA, 20 bp, Homo sapiens
ttgagagaagtcagtgtgtt

SEQ ID NO: 141079 - DNA, 22 bp, Homo sapiens
aagattaaagcaggtattttgg

SEQ ID NO: 141080 - DNA, 23 bp, Homo sapiens
atgtgtgtatatatatgtgtgtg

SEQ ID NO: 141081 - DNA, 19 bp, Homo sapiens
tgagaggtgagactgaagt

SEQ ID NO: 141082 - DNA, 23 bp, Homo sapiens
ttgtaattgttctggagatcctg

SEQ ID NO: 141083 - DNA, 20 bp, Homo sapiens
tgactgatcagactcaggtg

SEQ ID NO: 141084 - DNA, 23 bp, Homo sapiens
tctcagtcactatttctttgtgg

SEQ ID NO: 141085 - DNA, 22 bp, Homo sapiens
tgagtcagagtctcactccgtc

SEQ ID NO: 141086 - DNA, 23 bp, Homo sapiens
attatgctgggaaaagatggtat

SEQ ID NO: 141087 - DNA, 22 bp, Homo sapiens
gtgtgcatgtatgtgtgtgtgt

SEQ ID NO: 141088 - DNA, 22 bp, Homo sapiens
gagatgtagcaggaaggtttct

SEQ ID NO: 141089 - DNA, 23 bp, Homo sapiens
tgtcaagctgtctctctgaaatc

SEQ ID NO: 141090 - DNA, 22 bp, Homo sapiens
tgtgtatatatatacatatgtg

SEQ ID NO: 141091 - DNA, 20 bp, Homo sapiens
tataacatatacatatgtgt

SEQ ID NO: 141092 - DNA, 22 bp, Homo sapiens
agtaagttcttgttagttcatt

SEQ ID NO: 141093 - DNA, 23 bp, Homo sapiens
agagtggctgggtcggtggctca

SEQ ID NO: 141094 - DNA, 23 bp, Homo sapiens
tggaaagaaatcaagtgtgtagt

SEQ ID NO: 141095 - DNA, 23 bp, Homo sapiens
cgagtgtcactctgtcacccagg

SEQ ID NO: 141096 - DNA, 23 bp, Homo sapiens
agtacagtggcacaagttcggct

SEQ ID NO: 141097 - DNA, 23 bp, Homo sapiens
tggagtctcactctgtcacccag

SEQ ID NO: 141098 - DNA, 19 bp, Homo sapiens
tgagaggtgagactgaagt

SEQ ID NO: 141099 - DNA, 18 bp, Homo sapiens
cagtggcgcaatcttgtc

SEQ ID NO: 141100 - DNA, 19 bp, Homo sapiens
gcatagtattccatggtgt

SEQ ID NO: 141101 - DNA, 22 bp, Homo sapiens
tgctgcatggtaaagttgcaga

SEQ ID NO: 141102 - DNA, 23 bp, Homo sapiens
tgactcactgtgtgaataatcag

SEQ ID NO: 141103 - DNA, 23 bp, Homo sapiens
tgactcactgtgtgaataatcag

SEQ ID NO: 141104 - DNA, 23 bp, Homo sapiens
cgagtgtcactctgtcacccagg

SEQ ID NO: 141105 - DNA, 23 bp, Homo sapiens
agtacagtggcacaagttcggct

SEQ ID NO: 141106 - DNA, 23 bp, Homo sapiens
tgactcactgtgtgaataatcag

SEQ ID NO: 141107 - DNA, 23 bp, Homo sapiens
ccgagtgtcactctgtcacccag

SEQ ID NO: 141108 - DNA, 22 bp, Homo sapiens
atgtatcaaggtgttggagatt

SEQ ID NO: 141109 - DNA, 23 bp, Homo sapiens
tgactcactgtgtgaataatcag

SEQ ID NO: 141110 - DNA, 23 bp, Homo sapiens
tggagtctcactctgtcacccag

SEQ ID NO: 141111 - DNA, 19 bp, Homo sapiens
ctcactgcatcctctgtct

SEQ ID NO: 141112 - DNA, 18 bp, Homo sapiens
agtcaaagggataggtaa

SEQ ID NO: 141113 - DNA, 21 bp, Homo sapiens
aattgaatgcaatatgtagga

SEQ ID NO: 141114 - DNA, 23 bp, Homo sapiens
tatatggatgtttactttttgga

SEQ ID NO: 141115 - DNA, 23 bp, Homo sapiens
aaatctggaaatttttaacattg

SEQ ID NO: 141116 - DNA, 22 bp, Homo sapiens
atgtgtggttgatttcagagta

SEQ ID NO: 141117 - DNA, 19 bp, Homo sapiens
catgttatagttatttgat

SEQ ID NO: 141118 - DNA, 21 bp, Homo sapiens
gaatattcttactgtgcctga

SEQ ID NO: 141119 - DNA, 19 bp, Homo sapiens
ctcactgcatcctctgtct

SEQ ID NO: 141120 - DNA, 18 bp, Homo sapiens
agtcaaagggataggtaa

SEQ ID NO: 141121 - DNA, 21 bp, Homo sapiens
aattgaatgcaatatgtagga

SEQ ID NO: 141122 - DNA, 23 bp, Homo sapiens
aaatctggaaatttttaacattg

SEQ ID NO: 141123 - DNA, 23 bp, Homo sapiens
ttgagacagagacttgttctttc

SEQ ID NO: 141124 - DNA, 23 bp, Homo sapiens
tgtgcagtggtcatcttcttcat

SEQ ID NO: 141125 - DNA, 23 bp, Homo sapiens
gacagagtctcgctctgtcaccc

SEQ ID NO: 141126 - DNA, 23 bp, Homo sapiens
tgtgtgtgtatgtactatgtact

SEQ ID NO: 141127 - DNA, 23 bp, Homo sapiens
tgagtgacagagtgagtgagagt

SEQ ID NO: 141128 - DNA, 23 bp, Homo sapiens
tgtgatgagtctacagagacccc

SEQ ID NO: 141129 - DNA, 23 bp, Homo sapiens
ataatgtgtgtgtacatgtgtgt

SEQ ID NO: 141130 - DNA, 23 bp, Homo sapiens
tgtgcaatggtcatcttcttcat

SEQ ID NO: 141131 - DNA, 23 bp, Homo sapiens
acagagtctcgctctgtcaccca

SEQ ID NO: 141132 - DNA, 23 bp, Homo sapiens
tgtgtgtgtgtatgtactgtgta

SEQ ID NO: 141133 - DNA, 23 bp, Homo sapiens
atatactatatgtgtgtgtgtgt

SEQ ID NO: 141134 - DNA, 22 bp, Homo sapiens
cggtcagtgtgagtgtgtgtat

SEQ ID NO: 141135 - DNA, 22 bp, Homo sapiens
atacacacacacacatatgtca

SEQ ID NO: 141136 - DNA, 23 bp, Homo sapiens
attatgtgcaactaattaattgt

SEQ ID NO: 141137 - DNA, 21 bp, Homo sapiens
ttaattgtattcaattgatat

SEQ ID NO: 141138 - DNA, 22 bp, Homo sapiens
aagtcaactgctttttatttat

SEQ ID NO: 141139 - DNA, 22 bp, Homo sapiens
agaaatgaaaagtaggatgttt

SEQ ID NO: 141140 - DNA, 23 bp, Homo sapiens
atatgtgtatatatatgtgtgtg

SEQ ID NO: 141141 - DNA, 22 bp, Homo sapiens
acagcgccagaaaactcacttt

SEQ ID NO: 141142 - DNA, 23 bp, Homo sapiens
tttgagacggagtctggctctgt

SEQ ID NO: 141143 - DNA, 21 bp, Homo sapiens
ctgagtgagaccctgtctcta

SEQ ID NO: 141144 - DNA, 23 bp, Homo sapiens
acggagtctccctctgtcaccca

SEQ ID NO: 141145 - DNA, 22 bp, Homo sapiens
agtgagtggagacagagctgta

SEQ ID NO: 141146 - DNA, 23 bp, Homo sapiens
agagagtctcgctctgtcaccca

SEQ ID NO: 141147 - DNA, 23 bp, Homo sapiens
atagtagaaggctgagtcctgta

SEQ ID NO: 141148 - DNA, 23 bp, Homo sapiens
tttattgatgatgcttttgttgt

SEQ ID NO: 141149 - DNA, 19 bp, Homo sapiens
ttatgcttttagagatgag

SEQ ID NO: 141150 - DNA, 23 bp, Homo sapiens
agagtctcactctgtcacccagg

SEQ ID NO: 141151 - DNA, 23 bp, Homo sapiens
gagtctcactctgtcacccaggc

SEQ ID NO: 141152 - DNA, 23 bp, Homo sapiens
agagtctcactctgtcacccagg

SEQ ID NO: 141153 - DNA, 23 bp, Homo sapiens
agaggaggttgaacttgttgccg

SEQ ID NO: 141154 - DNA, 22 bp, Homo sapiens
gacagactgaatctctgtctct

SEQ ID NO: 141155 - DNA, 19 bp, Homo sapiens
acagacagcttggccactc

SEQ ID NO: 141156 - DNA, 19 bp, Homo sapiens
tctcactgtgcctctgggg

SEQ ID NO: 141157 - DNA, 21 bp, Homo sapiens
gagggtctcagtctgtcaccg

SEQ ID NO: 141158 - DNA, 23 bp, Homo sapiens
ctgagaggcagaaatctctgttg

SEQ ID NO: 141159 - DNA, 23 bp, Homo sapiens
tggagtctcactctgtcacccag

SEQ ID NO: 141160 - DNA, 21 bp, Homo sapiens
ctcactggcacacttctgcag

SEQ ID NO: 141161 - DNA, 22 bp, Homo sapiens
gacagggtctggctctgtcacc

SEQ ID NO: 141162 - DNA, 23 bp, Homo sapiens
atgtgtgtatgtatatgtgtgtg

SEQ ID NO: 141163 - DNA, 23 bp, Homo sapiens
gacagagtctccctctgtcaccc

SEQ ID NO: 141164 - DNA, 23 bp, Homo sapiens
tgacagcacttagcacattacat

SEQ ID NO: 141165 - DNA, 23 bp, Homo sapiens
tgtcactagaatgtgtgctcctt

SEQ ID NO: 141166 - DNA, 22 bp, Homo sapiens
tgagagagtctcgctctgtcgc

SEQ ID NO: 141167 - DNA, 23 bp, Homo sapiens
ttatttgcttatgatagagaact

SEQ ID NO: 141168 - DNA, 23 bp, Homo sapiens
taacaatttgtttagctattcat

SEQ ID NO: 141169 - DNA, 23 bp, Homo sapiens
tgtctcgctctctggcggtgtct

SEQ ID NO: 141170 - DNA, 23 bp, Homo sapiens
acactggcgtgtgtatttgtgtg

SEQ ID NO: 141171 - DNA, 22 bp, Homo sapiens
cacagacacacacacactgtgt

SEQ ID NO: 141172 - DNA, 23 bp, Homo sapiens
ctctctgtatctctctggattcc

SEQ ID NO: 141173 - DNA, 21 bp, Homo sapiens
tgcagcacaagtgtttctgtg

SEQ ID NO: 141174 - DNA, 23 bp, Homo sapiens
tcacacagacactccgtgtgaga

SEQ ID NO: 141175 - DNA, 23 bp, Homo sapiens
acttgactgtcactctcattgtc

SEQ ID NO: 141176 - DNA, 23 bp, Homo sapiens
ttgtgtgcctctgtctgtgcctc

SEQ ID NO: 141177 - DNA, 23 bp, Homo sapiens
atggaagatgtgctttgcttccc

SEQ ID NO: 141178 - DNA, 23 bp, Homo sapiens
tgtctgtgtagaaagtagaagac

SEQ ID NO: 141179 - DNA, 18 bp, Homo sapiens
attagacagcattagact

SEQ ID NO: 141180 - DNA, 23 bp, Homo sapiens
tagagacagggttttgctgtgtt

SEQ ID NO: 141181 - DNA, 23 bp, Homo sapiens
aatatccttccagattcagtttt

SEQ ID NO: 141182 - DNA, 23 bp, Homo sapiens
acatctatatatctatgtgtgtg

SEQ ID NO: 141183 - DNA, 19 bp, Homo sapiens
agtgacacaagcatctctg

SEQ ID NO: 141184 - DNA, 23 bp, Homo sapiens
ttgagacggagtgtcactcttgt

SEQ ID NO: 141185 - DNA, 23 bp, Homo sapiens
tctgccttcactttctctcagct

SEQ ID NO: 141186 - DNA, 20 bp, Homo sapiens
tagagaatagaaaaactaga

SEQ ID NO: 141187 - DNA, 22 bp, Homo sapiens
tcacagatgaatgtttgctgaa

SEQ ID NO: 141188 - DNA, 22 bp, Homo sapiens
actaccaggtctgtgaaatcag

SEQ ID NO: 141189 - DNA, 23 bp, Homo sapiens
gggcctcagtctctgccagtctg

SEQ ID NO: 141190 - DNA, 20 bp, Homo sapiens
gcctccctctctcactctgt

SEQ ID NO: 141191 - DNA, 22 bp, Homo sapiens
tatgtgcatgtatagctatgtg

SEQ ID NO: 141192 - DNA, 23 bp, Homo sapiens
tgcatgtatgtatgtatgtgtgt

SEQ ID NO: 141193 - DNA, 21 bp, Homo sapiens
tttgctactactgtccacaga

SEQ ID NO: 141194 - DNA, 21 bp, Homo sapiens
gtgaaatgacagggagcaaac

SEQ ID NO: 141195 - DNA, 21 bp, Homo sapiens
taacacacagataaagacact

SEQ ID NO: 141196 - DNA, 23 bp, Homo sapiens
tgtgtgtatatacacatgtgtgt

SEQ ID NO: 141197 - DNA, 23 bp, Homo sapiens
cactgtctcagtcacaattttgc

SEQ ID NO: 141198 - DNA, 23 bp, Homo sapiens
gctctgtctccttgaacatgggc

SEQ ID NO: 141199 - DNA, 19 bp, Homo sapiens
tatagctggggatgaatag

SEQ ID NO: 141200 - DNA, 22 bp, Homo sapiens
tacctgtaatctcagcactttg

SEQ ID NO: 141201 - DNA, 21 bp, Homo sapiens
tgaggtaggaggatcacttga

SEQ ID NO: 141202 - DNA, 20 bp, Homo sapiens
tccatgtgaagagaccacca

SEQ ID NO: 141203 - DNA, 23 bp, Homo sapiens
tacaagtgcacaatgtgcaggtt

SEQ ID NO: 141204 - DNA, 23 bp, Homo sapiens
gacggagtctcactctgtcaccc

SEQ ID NO: 141205 - DNA, 23 bp, Homo sapiens
cggagtctcactctgtcacccag

SEQ ID NO: 141206 - DNA, 23 bp, Homo sapiens
tgtctccgtctctgtgaggtata

SEQ ID NO: 141207 - DNA, 19 bp, Homo sapiens
tcactcagattcatattgg

SEQ ID NO: 141208 - DNA, 23 bp, Homo sapiens
tgtatgtgactgtcactcactgc

SEQ ID NO: 141209 - DNA, 23 bp, Homo sapiens
tgagtctctctctgtcaccctgg

SEQ ID NO: 141210 - DNA, 23 bp, Homo sapiens
ttgagaccgagtctcactctgtc

SEQ ID NO: 141211 - DNA, 21 bp, Homo sapiens
tcagcagagccattctctctc

SEQ ID NO: 141212 - DNA, 22 bp, Homo sapiens
atgtatgtgttcatttgtgtat

SEQ ID NO: 141213 - DNA, 18 bp, Homo sapiens
atgtatatatatacgtgt

SEQ ID NO: 141214 - DNA, 22 bp, Homo sapiens
agttagagttcacagtgagctg

SEQ ID NO: 141215 - DNA, 19 bp, Homo sapiens
ctgtaggagctgtggtctt

SEQ ID NO: 141216 - DNA, 23 bp, Homo sapiens
agaccctgcctctgtctgtctgt

SEQ ID NO: 141217 - DNA, 23 bp, Homo sapiens
tcactgcagtctcagtctccctg

SEQ ID NO: 141218 - DNA, 23 bp, Homo sapiens
tgtaagtgtgcatgtgcatgtct

SEQ ID NO: 141219 - DNA, 23 bp, Homo sapiens
tgtgtgtgtgcaagtgcatgcac

SEQ ID NO: 141220 - DNA, 23 bp, Homo sapiens
atatgtgtgtatgtatatatatg

SEQ ID NO: 141221 - DNA, 23 bp, Homo sapiens
atatgtgtatatatatgtgtgtg

SEQ ID NO: 141222 - DNA, 23 bp, Homo sapiens
gaaacaggaattgaaaagccact

SEQ ID NO: 141223 - DNA, 23 bp, Homo sapiens
tagtaggaacacagtctcaccat

SEQ ID NO: 141224 - DNA, 23 bp, Homo sapiens
agactgcctgagttcaggagcta

SEQ ID NO: 141225 - DNA, 23 bp, Homo sapiens
cctgtgtgtttgttttctgtccc

SEQ ID NO: 141226 - DNA, 21 bp, Homo sapiens
ttcaccacgttggccaggctg

SEQ ID NO: 141227 - DNA, 23 bp, Homo sapiens
tgtgagccactgtgcctggctgt

SEQ ID NO: 141228 - DNA, 23 bp, Homo sapiens
agtatctttttctttctcagcca

SEQ ID NO: 141229 - DNA, 23 bp, Homo sapiens
tatatggtagattagatttggta

SEQ ID NO: 141230 - DNA, 22 bp, Homo sapiens
tgattctgcaacaccacctcac

SEQ ID NO: 141231 - DNA, 22 bp, Homo sapiens
tgacagaagagacagtgttgct

SEQ ID NO: 141232 - DNA, 23 bp, Homo sapiens
tcttcagagtaactattcttttt

SEQ ID NO: 141233 - DNA, 23 bp, Homo sapiens
gagatggagtctgtctctctgtc

SEQ ID NO: 141234 - DNA, 21 bp, Homo sapiens
agacaggatctcactttgttg

SEQ ID NO: 141235 - DNA, 20 bp, Homo sapiens
agacacatgagagtcaggtg

SEQ ID NO: 141236 - DNA, 22 bp, Homo sapiens
acagaatgagtctctgtctcaa

SEQ ID NO: 141237 - DNA, 23 bp, Homo sapiens
ggagtctcacactgtcacttggg

SEQ ID NO: 141238 - DNA, 18 bp, Homo sapiens
tgctatggtgtggtctct

SEQ ID NO: 141239 - DNA, 23 bp, Homo sapiens
gggagtctcactctgtcacccag

SEQ ID NO: 141240 - DNA, 23 bp, Homo sapiens
tctgagaagacactgtgaactgt

SEQ ID NO: 141241 - DNA, 21 bp, Homo sapiens
tgtgtgtgtgtatatatacac

SEQ ID NO: 141242 - DNA, 21 bp, Homo sapiens
tatgtgtgtgtatatatacac

SEQ ID NO: 141243 - DNA, 21 bp, Homo sapiens
tgtgagccactgtgcctggcc

SEQ ID NO: 141244 - DNA, 22 bp, Homo sapiens
tgatcttgatagttgtattgta

SEQ ID NO: 141245 - DNA, 22 bp, Homo sapiens
tacatgtgcaggatgtgcaggt

SEQ ID NO: 141246 - DNA, 19 bp, Homo sapiens
gatttgagacttttcttta

SEQ ID NO: 141247 - DNA, 23 bp, Homo sapiens
cagtatctgtgagggattggttc

SEQ ID NO: 141248 - DNA, 23 bp, Homo sapiens
gggtctcactctgtcacccaggc

SEQ ID NO: 141249 - DNA, 23 bp, Homo sapiens
gggtctcactctgtcacccaggc

SEQ ID NO: 141250 - DNA, 23 bp, Homo sapiens
gggtctcactctgtcacccaggc

SEQ ID NO: 141251 - DNA, 23 bp, Homo sapiens
tgagttaatgctagaatgagtta

SEQ ID NO: 141252 - DNA, 23 bp, Homo sapiens
agtatttctgaggctgtgttctt

SEQ ID NO: 141253 - DNA, 23 bp, Homo sapiens
ataaggtaggctgagttcactag

SEQ ID NO: 141254 - DNA, 23 bp, Homo sapiens
attatctggaatttaattcttta

SEQ ID NO: 141255 - DNA, 23 bp, Homo sapiens
atatgtatatataggtatgtgtg

SEQ ID NO: 141256 - DNA, 20 bp, Homo sapiens
attggactacatatgtttat

SEQ ID NO: 141257 - DNA, 18 bp, Homo sapiens
aatagctgatgctgatgt

SEQ ID NO: 141258 - DNA, 18 bp, Homo sapiens
agcattgtaatgaagtta

SEQ ID NO: 141259 - DNA, 23 bp, Homo sapiens
ttataaaagctattgaaatgttt

SEQ ID NO: 141260 - DNA, 23 bp, Homo sapiens
ctgagtctcacactctcacccgg

SEQ ID NO: 141261 - DNA, 19 bp, Homo sapiens
atagtactttatatagtac

SEQ ID NO: 141262 - DNA, 21 bp, Homo sapiens
tatgtgtgtatgtatatattg

SEQ ID NO: 141263 - DNA, 23 bp, Homo sapiens
atgtgtatatatatgtatgtgta

SEQ ID NO: 141264 - DNA, 22 bp, Homo sapiens
aaatgtgcagaatgtgcaggtt

SEQ ID NO: 141265 - DNA, 20 bp, Homo sapiens
atacacacacatatacatat

SEQ ID NO: 141266 - DNA, 19 bp, Homo sapiens
tatgtatatatatgtgtgt

SEQ ID NO: 141267 - DNA, 23 bp, Homo sapiens
atgtgtgtatgcatgtgtgtatg

SEQ ID NO: 141268 - DNA, 22 bp, Homo sapiens
atatatgtatgtatatgtgtgt

SEQ ID NO: 141269 - DNA, 20 bp, Homo sapiens
atacacacacatatacgtat

SEQ ID NO: 141270 - DNA, 20 bp, Homo sapiens
gtaatgtggtatttctgtac

SEQ ID NO: 141271 - DNA, 22 bp, Homo sapiens
acactggttcttgacatgatgt

SEQ ID NO: 141272 - DNA, 21 bp, Homo sapiens
aaacctgcttgcatatgtaat

SEQ ID NO: 141273 - DNA, 21 bp, Homo sapiens
tatcagaagcagctttgcatt

SEQ ID NO: 141274 - DNA, 23 bp, Homo sapiens
ttagatccatatgaatactgaat

SEQ ID NO: 141275 - DNA, 22 bp, Homo sapiens
aaactagaggagaaagtgtgtg

SEQ ID NO: 141276 - DNA, 23 bp, Homo sapiens
tacatgtgcaaaacgtgcaggtt

SEQ ID NO: 141277 - DNA, 23 bp, Homo sapiens
tgaatgtatatgtatgtgtatat

SEQ ID NO: 141278 - DNA, 23 bp, Homo sapiens
cgtatgtatacacatgtacatgt

SEQ ID NO: 141279 - DNA, 23 bp, Homo sapiens
catatgattctcatgcatttgat

SEQ ID NO: 141280 - DNA, 23 bp, Homo sapiens
agggaaccatatgttttgagaat

SEQ ID NO: 141281 - DNA, 23 bp, Homo sapiens
tgagttcattgtagattctggat

SEQ ID NO: 141282 - DNA, 23 bp, Homo sapiens
tgagttcattgtagattctggat

SEQ ID NO: 141283 - DNA, 23 bp, Homo sapiens
atttgtgtggctgtgtaacccta

SEQ ID NO: 141284 - DNA, 23 bp, Homo sapiens
cggagtctcgctctgtcgctcag

SEQ ID NO: 141285 - DNA, 19 bp, Homo sapiens
tttgtacaacctatagtgt

SEQ ID NO: 141286 - DNA, 21 bp, Homo sapiens
aattgcagctttgtaagatgc

SEQ ID NO: 141287 - DNA, 18 bp, Homo sapiens
tgagatgatatgatgtat

SEQ ID NO: 141288 - DNA, 22 bp, Homo sapiens
tgtgtgtgtataagtatactgt

SEQ ID NO: 141289 - DNA, 20 bp, Homo sapiens
tgaggttggaggatcacttg

SEQ ID NO: 141290 - DNA, 23 bp, Homo sapiens
agggttaagattgctgtttcctt

SEQ ID NO: 141291 - DNA, 22 bp, Homo sapiens
aatatgtgtgcatatatagtgt

SEQ ID NO: 141292 - DNA, 19 bp, Homo sapiens
acaccataatgtgtgtgta

SEQ ID NO: 141293 - DNA, 22 bp, Homo sapiens
atatgaatatgtatatgtgtgt

SEQ ID NO: 141294 - DNA, 20 bp, Homo sapiens
acacacacacgttaggtaat

SEQ ID NO: 141295 - DNA, 23 bp, Homo sapiens
tatgttgattttgtatcctgcaa

SEQ ID NO: 141296 - DNA, 21 bp, Homo sapiens
tttttggtggagtttagagtt

SEQ ID NO: 141297 - DNA, 18 bp, Homo sapiens
tatcagtgacagataagt

SEQ ID NO: 141298 - DNA, 19 bp, Homo sapiens
acagcctcaccatcatctg

SEQ ID NO: 141299 - DNA, 23 bp, Homo sapiens
aggtcgcagtgagccatgattgt

SEQ ID NO: 141300 - DNA, 23 bp, Homo sapiens
tctttgagtgtgtgcatgtgtct

SEQ ID NO: 141301 - DNA, 23 bp, Homo sapiens
ttcagaattgaacaagagcttat

SEQ ID NO: 141302 - DNA, 23 bp, Homo sapiens
gcctgagatatgtgaatgaggtc

SEQ ID NO: 141303 - DNA, 21 bp, Homo sapiens
atggagtctctttctgtcacc

SEQ ID NO: 141304 - DNA, 23 bp, Homo sapiens
atatgtatgtgtatgtatatatg

SEQ ID NO: 141305 - DNA, 23 bp, Homo sapiens
gtatatagacagcatatgcatac

SEQ ID NO: 141306 - DNA, 23 bp, Homo sapiens
atacacacacacatacacatggg

SEQ ID NO: 141307 - DNA, 23 bp, Homo sapiens
agacagacagagatagaggtatg

SEQ ID NO: 141308 - DNA, 23 bp, Homo sapiens
tatctaggtttggctttgtgtct

SEQ ID NO: 141309 - DNA, 22 bp, Homo sapiens
atctatgtatatatgtatgtat

SEQ ID NO: 141310 - DNA, 22 bp, Homo sapiens
tatgtgtatatatatatgtgtg

SEQ ID NO: 141311 - DNA, 23 bp, Homo sapiens
atatgtgtgtatatatagtgtat

SEQ ID NO: 141312 - DNA, 21 bp, Homo sapiens
tgtatgtgtatagttttacaa

SEQ ID NO: 141313 - DNA, 23 bp, Homo sapiens
taatagtccaaaagctgctgggt

SEQ ID NO: 141314 - DNA, 23 bp, Homo sapiens
atatcacatatacattgctgtat

SEQ ID NO: 141315 - DNA, 22 bp, Homo sapiens
tatatgcatatatattcatata

SEQ ID NO: 141316 - DNA, 22 bp, Homo sapiens
tatttgggttttgtaggcatag

SEQ ID NO: 141317 - DNA, 23 bp, Homo sapiens
tgtgtgtgtgtgtgcatgcacgt

SEQ ID NO: 141318 - DNA, 23 bp, Homo sapiens
tgtggtacgcttatgtatgaatt

SEQ ID NO: 141319 - DNA, 21 bp, Homo sapiens
taaatgcagatggtgttcatg

SEQ ID NO: 141320 - DNA, 23 bp, Homo sapiens
tgagttcattgtagattctggat

SEQ ID NO: 141321 - DNA, 23 bp, Homo sapiens
tgagttcattgtagattctggat

SEQ ID NO: 141322 - DNA, 22 bp, Homo sapiens
tggttgtagatgtgtggtcttc

SEQ ID NO: 141323 - DNA, 20 bp, Homo sapiens
tgtcagaaaaacatgactat

SEQ ID NO: 141324 - DNA, 20 bp, Homo sapiens
tttgacagtatttgatttga

SEQ ID NO: 141325 - DNA, 19 bp, Homo sapiens
tagtatatatacatgtata

SEQ ID NO: 141326 - DNA, 20 bp, Homo sapiens
caggtttatatatgtgtgta

SEQ ID NO: 141327 - DNA, 18 bp, Homo sapiens
atgattgagaagagtgat

SEQ ID NO: 141328 - DNA, 22 bp, Homo sapiens
tgtgaagaatgtcaatggtagt

SEQ ID NO: 141329 - DNA, 22 bp, Homo sapiens
tctgaagtatgtgaaacctgat

SEQ ID NO: 141330 - DNA, 19 bp, Homo sapiens
gtctctgtttctcactcag

SEQ ID NO: 141331 - DNA, 23 bp, Homo sapiens
caggggtgtgagtgtgtgtgtct

SEQ ID NO: 141332 - DNA, 23 bp, Homo sapiens
tgtctgactcaatttcatttcaa

SEQ ID NO: 141333 - DNA, 23 bp, Homo sapiens
tgcaactttactgaatttcttca

SEQ ID NO: 141334 - DNA, 23 bp, Homo sapiens
agtcattaggttttctaaatata

SEQ ID NO: 141335 - DNA, 23 bp, Homo sapiens
aaaggtatcacagtatttgatta

SEQ ID NO: 141336 - DNA, 23 bp, Homo sapiens
tagaaatacttggtggtattaca

SEQ ID NO: 141337 - DNA, 21 bp, Homo sapiens
taactgagaagatttcaagtt

SEQ ID NO: 141338 - DNA, 22 bp, Homo sapiens
taatctctgcattttgtgtctt

SEQ ID NO: 141339 - DNA, 23 bp, Homo sapiens
tttgagacagaatctctctctat

SEQ ID NO: 141340 - DNA, 23 bp, Homo sapiens
tttgttctttttgcttaggattg

SEQ ID NO: 141341 - DNA, 23 bp, Homo sapiens
cagttctatgaagaaagtcaatg

SEQ ID NO: 141342 - DNA, 23 bp, Homo sapiens
tgtaacagtagagattgagctga

SEQ ID NO: 141343 - DNA, 23 bp, Homo sapiens
actctgtttcactttgtttatgt

SEQ ID NO: 141344 - DNA, 21 bp, Homo sapiens
tgaaacggagtctcgctctgt

SEQ ID NO: 141345 - DNA, 21 bp, Homo sapiens
attcaggaataaaatttgtgt

SEQ ID NO: 141346 - DNA, 21 bp, Homo sapiens
caacacaagttttattcttga

SEQ ID NO: 141347 - DNA, 23 bp, Homo sapiens
ggagtcagggtctctgtctcttt

SEQ ID NO: 141348 - DNA, 21 bp, Homo sapiens
actgattgcagttgcaccctc

SEQ ID NO: 141349 - DNA, 23 bp, Homo sapiens
tttcgaagaagatgctctgtagt

SEQ ID NO: 141350 - DNA, 18 bp, Homo sapiens
agagttttgctcttgttg

SEQ ID NO: 141351 - DNA, 23 bp, Homo sapiens
tagggctctggtattattgagga

SEQ ID NO: 141352 - DNA, 23 bp, Homo sapiens
attctgtgataattctggatttc

SEQ ID NO: 141353 - DNA, 20 bp, Homo sapiens
tttgaggcagagtctcgctc

SEQ ID NO: 141354 - DNA, 22 bp, Homo sapiens
tatcagatttctttttcttgtt

SEQ ID NO: 141355 - DNA, 23 bp, Homo sapiens
ttgagacagggtgagatatcaga

SEQ ID NO: 141356 - DNA, 23 bp, Homo sapiens
ttgagagatcttcttggtattga

SEQ ID NO: 141357 - DNA, 23 bp, Homo sapiens
tatggatttgatttgaatttctc

SEQ ID NO: 141358 - DNA, 23 bp, Homo sapiens
gaatgtgtatatatactcatata

SEQ ID NO: 141359 - DNA, 23 bp, Homo sapiens
atatgtgtatatatgtatatatg

SEQ ID NO: 141360 - DNA, 22 bp, Homo sapiens
tgtatatatgtatatatgtgta

SEQ ID NO: 141361 - DNA, 23 bp, Homo sapiens
atctgtgtatacatgtatatgta

SEQ ID NO: 141362 - DNA, 19 bp, Homo sapiens
tccttcttcacatggcagc

SEQ ID NO: 141363 - DNA, 23 bp, Homo sapiens
tgaatatatgtatatatgtgtgt

SEQ ID NO: 141364 - DNA, 23 bp, Homo sapiens
tgagttcattgtagattctggat

SEQ ID NO: 141365 - DNA, 23 bp, Homo sapiens
tgagttcattgtagattctggat

SEQ ID NO: 141366 - DNA, 23 bp, Homo sapiens
tatatatgtgtatgtatatatat

SEQ ID NO: 141367 - DNA, 18 bp, Homo sapiens
attatttttgctttgggt

SEQ ID NO: 141368 - DNA, 23 bp, Homo sapiens
tgagttcattgtagattctggat

SEQ ID NO: 141369 - DNA, 23 bp, Homo sapiens
tgagttcattgtagattctggat

SEQ ID NO: 141370 - DNA, 22 bp, Homo sapiens
agagtctagatctgggactgta

SEQ ID NO: 141371 - DNA, 23 bp, Homo sapiens
tatacatgtgtatatatggtgta

SEQ ID NO: 141372 - DNA, 21 bp, Homo sapiens
tatgtgtgtatatgtatatac

SEQ ID NO: 141373 - DNA, 23 bp, Homo sapiens
atatagtatgcatatgtatgtgt

SEQ ID NO: 141374 - DNA, 23 bp, Homo sapiens
tatagatacatatatatactcct

SEQ ID NO: 141375 - DNA, 23 bp, Homo sapiens
tgcttgtgaataagaacattgtt

SEQ ID NO: 141376 - DNA, 20 bp, Homo sapiens
agtggttagtgacaaaagtg

SEQ ID NO: 141377 - DNA, 22 bp, Homo sapiens
tgtgtgtgtgtataatatgtgt

SEQ ID NO: 141378 - DNA, 21 bp, Homo sapiens
ttcacattaaatgatcttcga

SEQ ID NO: 141379 - DNA, 21 bp, Homo sapiens
aggtggaaggaagtagctttg

SEQ ID NO: 141380 - DNA, 21 bp, Homo sapiens
tagtacaggaaattggtactg

SEQ ID NO: 141381 - DNA, 19 bp, Homo sapiens
tatatacacataatgtata

SEQ ID NO: 141382 - DNA, 21 bp, Homo sapiens
gagaaccttctgacagccaaa

SEQ ID NO: 141383 - DNA, 20 bp, Homo sapiens
ttaagtaaacaagaaatgag

SEQ ID NO: 141384 - DNA, 19 bp, Homo sapiens
attagagagaaatggaatt

SEQ ID NO: 141385 - DNA, 22 bp, Homo sapiens
ttcaacttttattttggattct

SEQ ID NO: 141386 - DNA, 23 bp, Homo sapiens
atgtgtgtatatgtatatgtatg

SEQ ID NO: 141387 - DNA, 22 bp, Homo sapiens
tatatatacacacacatatata

SEQ ID NO: 141388 - DNA, 20 bp, Homo sapiens
atgaatgtatgtatgtgcat

SEQ ID NO: 141389 - DNA, 23 bp, Homo sapiens
attaatgtaccaaatgtattcat

SEQ ID NO: 141390 - DNA, 19 bp, Homo sapiens
tgctgatttttgcactttg

SEQ ID NO: 141391 - DNA, 22 bp, Homo sapiens
taaggtggatcgttcagggttt

SEQ ID NO: 141392 - DNA, 22 bp, Homo sapiens
tgtatacatgtatgtatatgaa

SEQ ID NO: 141393 - DNA, 23 bp, Homo sapiens
tctgtggaacttcattgtggcag

SEQ ID NO: 141394 - DNA, 23 bp, Homo sapiens
atccatgcatatatttccttgat

SEQ ID NO: 141395 - DNA, 23 bp, Homo sapiens
aggcaggcaggctgtggggtttg

SEQ ID NO: 141396 - DNA, 21 bp, Homo sapiens
aatttgggtgaaaatgatgtg

SEQ ID NO: 141397 - DNA, 23 bp, Homo sapiens
atgtgtatatatgtatgtgtata

SEQ ID NO: 141398 - DNA, 23 bp, Homo sapiens
gagacacagtctcgctctgtcgc

SEQ ID NO: 141399 - DNA, 23 bp, Homo sapiens
tagcagtggattacatatattgt

SEQ ID NO: 141400 - DNA, 19 bp, Homo sapiens
tatatagagagatatatat

SEQ ID NO: 141401 - DNA, 22 bp, Homo sapiens
atctctgttagtcaggattctc

SEQ ID NO: 141402 - DNA, 22 bp, Homo sapiens
gtgtatatatatatgtgtgtgt

SEQ ID NO: 141403 - DNA, 19 bp, Homo sapiens
agtggcttcagactgtgag

SEQ ID NO: 141404 - DNA, 23 bp, Homo sapiens
atcttcagtactttgaaagcaga

SEQ ID NO: 141405 - DNA, 23 bp, Homo sapiens
tccgtgtcacactttgtatcttg

SEQ ID NO: 141406 - DNA, 23 bp, Homo sapiens
atatatgttatatatgtatgctc

SEQ ID NO: 141407 - DNA, 23 bp, Homo sapiens
atacgtatgtattactatacgtg

SEQ ID NO: 141408 - DNA, 20 bp, Homo sapiens
gtttatctagtccttcttac

SEQ ID NO: 141409 - DNA, 23 bp, Homo sapiens
gaagagaagaaaatgctttcctg

SEQ ID NO: 141410 - DNA, 23 bp, Homo sapiens
ttgtgttgtgtctaagttctttc

SEQ ID NO: 141411 - DNA, 23 bp, Homo sapiens
gagtctgtctctgtcacccaggc

SEQ ID NO: 141412 - DNA, 23 bp, Homo sapiens
atatgtttgtatatgttcacaca

SEQ ID NO: 141413 - DNA, 23 bp, Homo sapiens
agacaagttcttgctctgtcaca

SEQ ID NO: 141414 - DNA, 20 bp, Homo sapiens
tacagagaacacacagtgat

SEQ ID NO: 141415 - DNA, 23 bp, Homo sapiens
ttttgtgtacttaatagagtgaa

SEQ ID NO: 141416 - DNA, 18 bp, Homo sapiens
ttcactctaatttcttgc

SEQ ID NO: 141417 - DNA, 22 bp, Homo sapiens
tattgtgtatatgtatatggaa

SEQ ID NO: 141418 - DNA, 22 bp, Homo sapiens
atatgcatattgtatatatgta

SEQ ID NO: 141419 - DNA, 23 bp, Homo sapiens
tttctaagaaagcagaagaaggc

SEQ ID NO: 141420 - DNA, 20 bp, Homo sapiens
agtctctgtcacattctggt

SEQ ID NO: 141421 - DNA, 21 bp, Homo sapiens
tacacacactcatatatatgt

SEQ ID NO: 141422 - DNA, 22 bp, Homo sapiens
gtatgtacatatatgtgtgtgt

SEQ ID NO: 141423 - DNA, 19 bp, Homo sapiens
atacatacatatgtgtgtg

SEQ ID NO: 141424 - DNA, 20 bp, Homo sapiens
atgctgtatatattatagag

SEQ ID NO: 141425 - DNA, 21 bp, Homo sapiens
tctgtgtccctttaacatttg

SEQ ID NO: 141426 - DNA, 20 bp, Homo sapiens
ttgctagttggttgttttgt

SEQ ID NO: 141427 - DNA, 21 bp, Homo sapiens
tttctagtctgttgataagat

SEQ ID NO: 141428 - DNA, 21 bp, Homo sapiens
taattgattttaaaatgttga

SEQ ID NO: 141429 - DNA, 23 bp, Homo sapiens
tagtttcagggttacatgtgcat

SEQ ID NO: 141430 - DNA, 23 bp, Homo sapiens
ttcagaagtacatgtgcagggat

SEQ ID NO: 141431 - DNA, 22 bp, Homo sapiens
actgacacagacaaacaggtga

SEQ ID NO: 141432 - DNA, 23 bp, Homo sapiens
tttaaggttggttactaatgcaa

SEQ ID NO: 141433 - DNA, 20 bp, Homo sapiens
ctggcacagaaaaaaagggt

SEQ ID NO: 141434 - DNA, 23 bp, Homo sapiens
gcttttttcttctttagcttgac

SEQ ID NO: 141435 - DNA, 23 bp, Homo sapiens
tagctactgcatgaggtgctgag

SEQ ID NO: 141436 - DNA, 23 bp, Homo sapiens
tttaggttcttaagtaatctgtg

SEQ ID NO: 141437 - DNA, 22 bp, Homo sapiens
gaagacagaggctattcttgag

SEQ ID NO: 141438 - DNA, 22 bp, Homo sapiens
acacacacacacatacatatgt

SEQ ID NO: 141439 - DNA, 23 bp, Homo sapiens
aggcaagatgctggcatagctgt

SEQ ID NO: 141440 - DNA, 19 bp, Homo sapiens
tgccaacatattgccatct

SEQ ID NO: 141441 - DNA, 23 bp, Homo sapiens
tatatatgaatatctagaacttg

SEQ ID NO: 141442 - DNA, 18 bp, Homo sapiens
tatggctatcattttctt

SEQ ID NO: 141443 - DNA, 21 bp, Homo sapiens
tgacctagtaggtgactctta

SEQ ID NO: 141444 - DNA, 21 bp, Homo sapiens
gtactatgttgaatagaagta

SEQ ID NO: 141445 - DNA, 21 bp, Homo sapiens
ttctctgtattttatgttgtc

SEQ ID NO: 141446 - DNA, 20 bp, Homo sapiens
atatccttctctaaaatttg

SEQ ID NO: 141447 - DNA, 20 bp, Homo sapiens
tttaccagtttatgctccca

SEQ ID NO: 141448 - DNA, 23 bp, Homo sapiens
cagtgggagaagactttctattt

SEQ ID NO: 141449 - DNA, 23 bp, Homo sapiens
agctactgacactctcacagtct

SEQ ID NO: 141450 - DNA, 23 bp, Homo sapiens
attctcacatcctaagttgtgag

SEQ ID NO: 141451 - DNA, 23 bp, Homo sapiens
tgagttcattgtagattctggat

SEQ ID NO: 141452 - DNA, 23 bp, Homo sapiens
tgagttcattgtagattctggat

SEQ ID NO: 141453 - DNA, 22 bp, Homo sapiens
ctcactcactcaccgcttccct

SEQ ID NO: 141454 - DNA, 23 bp, Homo sapiens
tatgtgtgtatatatgtgtgtgt

SEQ ID NO: 141455 - DNA, 23 bp, Homo sapiens
tagagacagtggaagtgttgaga

SEQ ID NO: 141456 - DNA, 22 bp, Homo sapiens
ccacatgttcaggcactggtgc

SEQ ID NO: 141457 - DNA, 20 bp, Homo sapiens
ttggtggtggtggtggtggt

SEQ ID NO: 141458 - DNA, 23 bp, Homo sapiens
agagtgaagagagtgaagatttg

SEQ ID NO: 141459 - DNA, 22 bp, Homo sapiens
tttctgctactctgcctccttg

SEQ ID NO: 141460 - DNA, 23 bp, Homo sapiens
taaaactgtgagctaaataactg

SEQ ID NO: 141461 - DNA, 23 bp, Homo sapiens
tcagctcactgaaacctctgcct

SEQ ID NO: 141462 - DNA, 20 bp, Homo sapiens
attctggacctaaaattcag

SEQ ID NO: 141463 - DNA, 23 bp, Homo sapiens
atatgtatatatatatgtgtgta

SEQ ID NO: 141464 - DNA, 23 bp, Homo sapiens
tatatgtatatatatatgtgtgt

SEQ ID NO: 141465 - DNA, 21 bp, Homo sapiens
tatgtttttcattttagctgt

SEQ ID NO: 141466 - DNA, 23 bp, Homo sapiens
gtgtgagtctcgctctgtcaccc

SEQ ID NO: 141467 - DNA, 23 bp, Homo sapiens
acattcatggagtgcttgtgtgc

SEQ ID NO: 141468 - DNA, 20 bp, Homo sapiens
ggaatgataagtagtctagt

SEQ ID NO: 141469 - DNA, 23 bp, Homo sapiens
tgtagttactttgtaattctgtt

SEQ ID NO: 141470 - DNA, 20 bp, Homo sapiens
atggaatttttggactatga

SEQ ID NO: 141471 - DNA, 23 bp, Homo sapiens
ctatcaagttggagtggttcttt

SEQ ID NO: 141472 - DNA, 20 bp, Homo sapiens
aagttcatttggtccaggca

SEQ ID NO: 141473 - DNA, 21 bp, Homo sapiens
agcagtctggatgtggactgg

SEQ ID NO: 141474 - DNA, 23 bp, Homo sapiens
gtctagtgattctgttcttggct

SEQ ID NO: 141475 - DNA, 21 bp, Homo sapiens
tgaggtaggaggatcacttga

SEQ ID NO: 141476 - DNA, 23 bp, Homo sapiens
tgagttcattgtagattctggat

SEQ ID NO: 141477 - DNA, 23 bp, Homo sapiens
tgagttcattgtagattctggat

SEQ ID NO: 141478 - DNA, 23 bp, Homo sapiens
tgagttcattgtagattctggat

SEQ ID NO: 141479 - DNA, 23 bp, Homo sapiens
tgagttcattgtagattctggat

SEQ ID NO: 141480 - DNA, 23 bp, Homo sapiens
tgagttcattgtagattctggat

SEQ ID NO: 141481 - DNA, 23 bp, Homo sapiens
aaggagctcacagtggagataca

SEQ ID NO: 141482 - DNA, 23 bp, Homo sapiens
aattcactgagattttggaggga

SEQ ID NO: 141483 - DNA, 23 bp, Homo sapiens
aactagagagagaggacagacag

SEQ ID NO: 141484 - DNA, 23 bp, Homo sapiens
tggatgactagtgaaaatattgt

SEQ ID NO: 141485 - DNA, 23 bp, Homo sapiens
ttttctcaggatgaaaatgttag

SEQ ID NO: 141486 - DNA, 20 bp, Homo sapiens
accgtgtgtgtgtgtgtgtg

SEQ ID NO: 141487 - DNA, 23 bp, Homo sapiens
aatagctagatgtctataagtta

SEQ ID NO: 141488 - DNA, 23 bp, Homo sapiens
acctcacagcttattatttcctg

SEQ ID NO: 141489 - DNA, 23 bp, Homo sapiens
cggtgtctcgctctgtctcccac

SEQ ID NO: 141490 - DNA, 23 bp, Homo sapiens
gtggaaagtataattctttttca

SEQ ID NO: 141491 - DNA, 21 bp, Homo sapiens
tttgagatggagtcttgctct

SEQ ID NO: 141492 - DNA, 21 bp, Homo sapiens
taatttgtgcgttccctgtag

SEQ ID NO: 141493 - DNA, 23 bp, Homo sapiens
atttgagacccaaattctggtct

SEQ ID NO: 141494 - DNA, 19 bp, Homo sapiens
cagaatttggtacctcatt

SEQ ID NO: 141495 - DNA, 23 bp, Homo sapiens
tgtgtgtgtccctttctccctgt

SEQ ID NO: 141496 - DNA, 23 bp, Homo sapiens
tgagttcattgtagattctggat

SEQ ID NO: 141497 - DNA, 23 bp, Homo sapiens
tgagttcattgtagattctggat

SEQ ID NO: 141498 - DNA, 23 bp, Homo sapiens
agagtctcactctgtcacccagg

SEQ ID NO: 141499 - DNA, 23 bp, Homo sapiens
aaactccatggtaatcatcttgt

SEQ ID NO: 141500 - DNA, 23 bp, Homo sapiens
tgtgtgagtgtgtatatatattg

SEQ ID NO: 141501 - DNA, 23 bp, Homo sapiens
ggaccaagatagaggtgagagtg

SEQ ID NO: 141502 - DNA, 19 bp, Homo sapiens
acactgagattagtgaaag

SEQ ID NO: 141503 - DNA, 23 bp, Homo sapiens
ttataccttgtttatataggcat

SEQ ID NO: 141504 - DNA, 22 bp, Homo sapiens
aacaggctgtatatacctgttt

SEQ ID NO: 141505 - DNA, 23 bp, Homo sapiens
tacagtggcatgatctaggctca

SEQ ID NO: 141506 - DNA, 23 bp, Homo sapiens
tgagacagagtctcgctgtgtcg

SEQ ID NO: 141507 - DNA, 23 bp, Homo sapiens
aactccacttaattgaggacact

SEQ ID NO: 141508 - DNA, 23 bp, Homo sapiens
tttgagatggagttttgctcttg

SEQ ID NO: 141509 - DNA, 21 bp, Homo sapiens
ctatggaagtagaatgtacag

SEQ ID NO: 141510 - DNA, 23 bp, Homo sapiens
aaagcctgtttttcataaagtct

SEQ ID NO: 141511 - DNA, 23 bp, Homo sapiens
gacagagtctcgctctgtcaccc

SEQ ID NO: 141512 - DNA, 23 bp, Homo sapiens
gtctgagtgtgtgtgtgcctgtg

SEQ ID NO: 141513 - DNA, 20 bp, Homo sapiens
tgtatatatgtatatatgta

SEQ ID NO: 141514 - DNA, 23 bp, Homo sapiens
atgtgtatatatgtatatatgtg

SEQ ID NO: 141515 - DNA, 23 bp, Homo sapiens
atgtgtatatatgtatatgtgtg

SEQ ID NO: 141516 - DNA, 22 bp, Homo sapiens
tgtgtatatatgtatatatgtg

SEQ ID NO: 141517 - DNA, 23 bp, Homo sapiens
atatgtatatatgtatatgtgta

SEQ ID NO: 141518 - DNA, 22 bp, Homo sapiens
atgtgtatatatgtatatatgt

SEQ ID NO: 141519 - DNA, 23 bp, Homo sapiens
atgtgtatatatgtatatatgtg

SEQ ID NO: 141520 - DNA, 23 bp, Homo sapiens
atgtgtatatgtgtatatgtgtg

SEQ ID NO: 141521 - DNA, 22 bp, Homo sapiens
atgtgtatatgtgtatatgtgt

SEQ ID NO: 141522 - DNA, 21 bp, Homo sapiens
tatacgtatatatatgtgtat

SEQ ID NO: 141523 - DNA, 22 bp, Homo sapiens
tgtgtatatatgtatatatgtg

SEQ ID NO: 141524 - DNA, 21 bp, Homo sapiens
atgtgtgtatatatgtgtgta

SEQ ID NO: 141525 - DNA, 22 bp, Homo sapiens
tgtgtatatatgtatatatgtg

SEQ ID NO: 141526 - DNA, 22 bp, Homo sapiens
tatgtgtatatatatgtgtgta

SEQ ID NO: 141527 - DNA, 18 bp, Homo sapiens
tggaggctgaggtaggag

SEQ ID NO: 141528 - DNA, 20 bp, Homo sapiens
agccaagatcatgccactgc

SEQ ID NO: 141529 - DNA, 23 bp, Homo sapiens
tgagttcattgtagattctggat

SEQ ID NO: 141530 - DNA, 23 bp, Homo sapiens
tgagttcattgtagattctggat

SEQ ID NO: 141531 - DNA, 23 bp, Homo sapiens
ttgatacacagtatcttacgtat

SEQ ID NO: 141532 - DNA, 20 bp, Homo sapiens
tttcacttcctcactctgct

SEQ ID NO: 141533 - DNA, 23 bp, Homo sapiens
gacagagtctcgctctgtcaccc

SEQ ID NO: 141534 - DNA, 23 bp, Homo sapiens
acagagtctcgctctgtcaccca

SEQ ID NO: 141535 - DNA, 19 bp, Homo sapiens
tgacggagtctcgctctgt

SEQ ID NO: 141536 - DNA, 23 bp, Homo sapiens
tgctggtcctactgtttgcaggt

SEQ ID NO: 141537 - DNA, 23 bp, Homo sapiens
cagtaactcagtttctgtatctg

SEQ ID NO: 141538 - DNA, 21 bp, Homo sapiens
tattcactatgtagttgggta

SEQ ID NO: 141539 - DNA, 23 bp, Homo sapiens
tgtgcatatgtatttatatgtgt

SEQ ID NO: 141540 - DNA, 23 bp, Homo sapiens
atatgtgtatttatatgtgtgtg

SEQ ID NO: 141541 - DNA, 18 bp, Homo sapiens
tgagaagattgactccac

SEQ ID NO: 141542 - DNA, 22 bp, Homo sapiens
tgtgcctgagaaaaattgcata

SEQ ID NO: 141543 - DNA, 23 bp, Homo sapiens
ttacacagtggatgttcttattc

SEQ ID NO: 141544 - DNA, 19 bp, Homo sapiens
aaaggtattatataccctt

SEQ ID NO: 141545 - DNA, 23 bp, Homo sapiens
taggatggatctcaattctgatg

SEQ ID NO: 141546 - DNA, 23 bp, Homo sapiens
tctctgaaactgtgtgtgtcaaa

SEQ ID NO: 141547 - DNA, 23 bp, Homo sapiens
tgaggtagaaggatcacttgagg

SEQ ID NO: 141548 - DNA, 19 bp, Homo sapiens
tctatatatctgtatgtaa

SEQ ID NO: 141549 - DNA, 18 bp, Homo sapiens
ttattatttgttcaaggt

SEQ ID NO: 141550 - DNA, 22 bp, Homo sapiens
attacattcatttggcacagtg

SEQ ID NO: 141551 - DNA, 23 bp, Homo sapiens
ctgatctgtctaatactgtcagt

SEQ ID NO: 141552 - DNA, 23 bp, Homo sapiens
tcctgatagttctagtttcccag

SEQ ID NO: 141553 - DNA, 23 bp, Homo sapiens
ggagtctcactcactctgtcgcc

SEQ ID NO: 141554 - DNA, 21 bp, Homo sapiens
ttgactagccattttgttgta

SEQ ID NO: 141555 - DNA, 21 bp, Homo sapiens
atcagagctcagactgaactt

SEQ ID NO: 141556 - DNA, 23 bp, Homo sapiens
tacatgtgcagaatgtgcaggtt

SEQ ID NO: 141557 - DNA, 23 bp, Homo sapiens
tacactggtgattttgatcttga

SEQ ID NO: 141558 - DNA, 20 bp, Homo sapiens
tggtgtgatcttggctcact

SEQ ID NO: 141559 - DNA, 23 bp, Homo sapiens
gagtctcactctgtcacccaggc

SEQ ID NO: 141560 - DNA, 23 bp, Homo sapiens
gtataatatgtgtgtgtatatgt

SEQ ID NO: 141561 - DNA, 23 bp, Homo sapiens
tgagttcattgtagattctggat

SEQ ID NO: 141562 - DNA, 23 bp, Homo sapiens
tgagttcattgtagattctggat

SEQ ID NO: 141563 - DNA, 23 bp, Homo sapiens
agagtctcactgtgtcacccagg

SEQ ID NO: 141564 - DNA, 20 bp, Homo sapiens
tgtgtatatatatatgtcta

SEQ ID NO: 141565 - DNA, 19 bp, Homo sapiens
atgtctatacatatatatg

SEQ ID NO: 141566 - DNA, 21 bp, Homo sapiens
acatgcatatgtatacatgta

SEQ ID NO: 141567 - DNA, 22 bp, Homo sapiens
tgagaagaatgtgtagtctaca

SEQ ID NO: 141568 - DNA, 22 bp, Homo sapiens
atttttagtcctgcttccctgt

SEQ ID NO: 141569 - DNA, 23 bp, Homo sapiens
ttgagtttccttctaggagttaa

SEQ ID NO: 141570 - DNA, 21 bp, Homo sapiens
tttgcttatgattgtcttagc

SEQ ID NO: 141571 - DNA, 23 bp, Homo sapiens
ttctgtgtagaaagtcaatggta

SEQ ID NO: 141572 - DNA, 18 bp, Homo sapiens
attacaatggttatatat

SEQ ID NO: 141573 - DNA, 19 bp, Homo sapiens
tatgtgtatatatatatgt

SEQ ID NO: 141574 - DNA, 20 bp, Homo sapiens
gtctcactctcactgcgccc

SEQ ID NO: 141575 - DNA, 22 bp, Homo sapiens
taggtccattgtttatctttct

SEQ ID NO: 141576 - DNA, 20 bp, Homo sapiens
gcgtgtgtgtgtacatgtgt

SEQ ID NO: 141577 - DNA, 23 bp, Homo sapiens
gtctgtgtatatgtatatgtgtg

SEQ ID NO: 141578 - DNA, 18 bp, Homo sapiens
atacacacacatatacat

SEQ ID NO: 141579 - DNA, 23 bp, Homo sapiens
atacacacacatatacatataca

SEQ ID NO: 141580 - DNA, 22 bp, Homo sapiens
tctctgggacactgcctgtggt

SEQ ID NO: 141581 - DNA, 22 bp, Homo sapiens
tttttacttaggattgctttgg

SEQ ID NO: 141582 - DNA, 23 bp, Homo sapiens
cttagacaagagagttacctcta

SEQ ID NO: 141583 - DNA, 23 bp, Homo sapiens
gcagagtctcgctctgtcaccca

SEQ ID NO: 141584 - DNA, 20 bp, Homo sapiens
ttcactcatgatttgactct

SEQ ID NO: 141585 - DNA, 23 bp, Homo sapiens
aatctctgctttttaattgtatc

SEQ ID NO: 141586 - DNA, 22 bp, Homo sapiens
taaactgtgagcttctgtagag

SEQ ID NO: 141587 - DNA, 22 bp, Homo sapiens
tgaggttgaatgtatgaagcca

SEQ ID NO: 141588 - DNA, 21 bp, Homo sapiens
tagtgtatagaaatgcaactg

SEQ ID NO: 141589 - DNA, 20 bp, Homo sapiens
tttttggagaacaggtggtg

SEQ ID NO: 141590 - DNA, 23 bp, Homo sapiens
agttgtgctttctctgggaaatc

SEQ ID NO: 141591 - DNA, 22 bp, Homo sapiens
atgcacaatttgaatactgaat

SEQ ID NO: 141592 - DNA, 23 bp, Homo sapiens
tggaacagctctgtttgttttca

SEQ ID NO: 141593 - DNA, 23 bp, Homo sapiens
aagaagagcagagattatcttgt

SEQ ID NO: 141594 - DNA, 23 bp, Homo sapiens
gagtctcactctgtcacccaggc

SEQ ID NO: 141595 - DNA, 22 bp, Homo sapiens
agtgacagtggtgtgatttctg

SEQ ID NO: 141596 - DNA, 23 bp, Homo sapiens
atctggaagacctgctgaaggac

SEQ ID NO: 141597 - DNA, 23 bp, Homo sapiens
aatcactgaagtctgggagatca

SEQ ID NO: 141598 - DNA, 23 bp, Homo sapiens
tgttttggctattcaagatcttt

SEQ ID NO: 141599 - DNA, 23 bp, Homo sapiens
tgagttcattgtagattctggat

SEQ ID NO: 141600 - DNA, 23 bp, Homo sapiens
tgagttcattgtagattctggat

SEQ ID NO: 141601 - DNA, 23 bp, Homo sapiens
tgtttttagctcttggaggaatt

SEQ ID NO: 141602 - DNA, 23 bp, Homo sapiens
tgtctatatatatgtatatctat

SEQ ID NO: 141603 - DNA, 19 bp, Homo sapiens
atatacatagatatacata

SEQ ID NO: 141604 - DNA, 23 bp, Homo sapiens
gaccctcacacagtcagaaatct

SEQ ID NO: 141605 - DNA, 22 bp, Homo sapiens
acttatgattagttgatttcac

SEQ ID NO: 141606 - DNA, 22 bp, Homo sapiens
ttctttgagaatatattgtgct

SEQ ID NO: 141607 - DNA, 23 bp, Homo sapiens
tgagttcattgtagattctggat

SEQ ID NO: 141608 - DNA, 23 bp, Homo sapiens
tgagttcattgtagattctggat

SEQ ID NO: 141609 - DNA, 21 bp, Homo sapiens
tttctctcagggtttgttgtt

SEQ ID NO: 141610 - DNA, 23 bp, Homo sapiens
gtaaccttcctggatgaattctg

SEQ ID NO: 141611 - DNA, 23 bp, Homo sapiens
aggatctctgtcaattttagtca

SEQ ID NO: 141612 - DNA, 19 bp, Homo sapiens
tgacagatgtgagtggaga

SEQ ID NO: 141613 - DNA, 23 bp, Homo sapiens
tatattgctctatatatagagca

SEQ ID NO: 141614 - DNA, 20 bp, Homo sapiens
atattgctctatatatagct

SEQ ID NO: 141615 - DNA, 22 bp, Homo sapiens
aacagtactaactctgctggcc

SEQ ID NO: 141616 - DNA, 21 bp, Homo sapiens
tatatgtatatgtacgtgtat

SEQ ID NO: 141617 - DNA, 23 bp, Homo sapiens
tgcattagaattgtaattgctct

SEQ ID NO: 141618 - DNA, 21 bp, Homo sapiens
tccttgtcactgagcaggaaa

SEQ ID NO: 141619 - DNA, 23 bp, Homo sapiens
gatttctcactcttcttgctttg

SEQ ID NO: 141620 - DNA, 23 bp, Homo sapiens
gatttctctggttcagttgagtg

SEQ ID NO: 141621 - DNA, 19 bp, Homo sapiens
attcaaaagtttaagaagt

SEQ ID NO: 141622 - DNA, 23 bp, Homo sapiens
tgtatatgaggatttctaaatct

SEQ ID NO: 141623 - DNA, 21 bp, Homo sapiens
aagacagaggtgagagagctc

SEQ ID NO: 141624 - DNA, 19 bp, Homo sapiens
agagctatttcaagaagta

SEQ ID NO: 141625 - DNA, 22 bp, Homo sapiens
accctagtttagccaggctttt

SEQ ID NO: 141626 - DNA, 20 bp, Homo sapiens
aagcataactatcaaaattg

SEQ ID NO: 141627 - DNA, 22 bp, Homo sapiens
gactcactcgctgactctcttc

SEQ ID NO: 141628 - DNA, 23 bp, Homo sapiens
ctacagtgcacatgtttaggatg

SEQ ID NO: 141629 - DNA, 23 bp, Homo sapiens
atgaaactgctggttgatgtggt

SEQ ID NO: 141630 - DNA, 23 bp, Homo sapiens
attttgaaagtatttgtattgtg

SEQ ID NO: 141631 - DNA, 18 bp, Homo sapiens
atatagaagtatgcagta

SEQ ID NO: 141632 - DNA, 23 bp, Homo sapiens
tgagtaccttttaaaagctgtgt

SEQ ID NO: 141633 - DNA, 19 bp, Homo sapiens
actaaagttcttcataaag

SEQ ID NO: 141634 - DNA, 23 bp, Homo sapiens
tgtatctctctggaacttaactg

SEQ ID NO: 141635 - DNA, 21 bp, Homo sapiens
agctttttttcatatctttgt

SEQ ID NO: 141636 - DNA, 23 bp, Homo sapiens
tgagttcattgtagattctggat

SEQ ID NO: 141637 - DNA, 23 bp, Homo sapiens
tgagttcattgtagattctggat

SEQ ID NO: 141638 - DNA, 23 bp, Homo sapiens
tcagccactgaagagtatctgta

SEQ ID NO: 141639 - DNA, 23 bp, Homo sapiens
gtgagacacataatgatgctgct

SEQ ID NO: 141640 - DNA, 22 bp, Homo sapiens
tcatgtgtgtctttgtgtaggg

SEQ ID NO: 141641 - DNA, 20 bp, Homo sapiens
taagtctgagttttagataa

SEQ ID NO: 141642 - DNA, 23 bp, Homo sapiens
tcaacatgaagttagagaatggg

SEQ ID NO: 141643 - DNA, 23 bp, Homo sapiens
atactagaaggacttcagctgat

SEQ ID NO: 141644 - DNA, 20 bp, Homo sapiens
tggctgtgactaagtagccc

SEQ ID NO: 141645 - DNA, 19 bp, Homo sapiens
tctgtgtgtcagtgtactt

SEQ ID NO: 141646 - DNA, 23 bp, Homo sapiens
acagagtctcactctgtcgccca

SEQ ID NO: 141647 - DNA, 23 bp, Homo sapiens
tggagtctcactctgtcacccag

SEQ ID NO: 141648 - DNA, 23 bp, Homo sapiens
agagtctcactctgtcactcagg

SEQ ID NO: 141649 - DNA, 20 bp, Homo sapiens
acagatgtgagccaccacac

SEQ ID NO: 141650 - DNA, 23 bp, Homo sapiens
actgagtctcgctctgtctccca

SEQ ID NO: 141651 - DNA, 23 bp, Homo sapiens
acgaaatctctctctgtcaccca

SEQ ID NO: 141652 - DNA, 23 bp, Homo sapiens
gacagagcaaggtagtggcatct

SEQ ID NO: 141653 - DNA, 23 bp, Homo sapiens
gaaatcactggaattgaaacaga

SEQ ID NO: 141654 - DNA, 23 bp, Homo sapiens
tggagtctcactctgtcacccag

SEQ ID NO: 141655 - DNA, 23 bp, Homo sapiens
tgagttcattgtagattctggat

SEQ ID NO: 141656 - DNA, 23 bp, Homo sapiens
tgagttcattgtagattctggat

SEQ ID NO: 141657 - DNA, 19 bp, Homo sapiens
ttgattcaggtaagcatta

SEQ ID NO: 141658 - DNA, 23 bp, Homo sapiens
agagaagtttttgtttgctgtga

SEQ ID NO: 141659 - DNA, 21 bp, Homo sapiens
aaagtcagtcttcaagctctg

SEQ ID NO: 141660 - DNA, 23 bp, Homo sapiens
ctctgtctaaatctctgtttcac

SEQ ID NO: 141661 - DNA, 18 bp, Homo sapiens
ccgacagagtctcactct

SEQ ID NO: 141662 - DNA, 23 bp, Homo sapiens
actgattgtacattatggtgagt

SEQ ID NO: 141663 - DNA, 20 bp, Homo sapiens
tcagggtgtaaaaatggaat

SEQ ID NO: 141664 - DNA, 20 bp, Homo sapiens
atagagtttttcatgctgga

SEQ ID NO: 141665 - DNA, 20 bp, Homo sapiens
atgcttttccattttcactg

SEQ ID NO: 141666 - DNA, 23 bp, Homo sapiens
tatgctcatgtgtctgtgtctat

SEQ ID NO: 141667 - DNA, 18 bp, Homo sapiens
agagttttctacaaggac

SEQ ID NO: 141668 - DNA, 23 bp, Homo sapiens
tgagttcattgtagattctggat

SEQ ID NO: 141669 - DNA, 23 bp, Homo sapiens
tgagttcattgtagattctggat

SEQ ID NO: 141670 - DNA, 23 bp, Homo sapiens
tcacagagtagttacagagctgt

SEQ ID NO: 141671 - DNA, 23 bp, Homo sapiens
atgtgtttggtactctctcagga

SEQ ID NO: 141672 - DNA, 23 bp, Homo sapiens
tttgtggttgtttactggaactt

SEQ ID NO: 141673 - DNA, 20 bp, Homo sapiens
aatagagtcacattcaggat

SEQ ID NO: 141674 - DNA, 23 bp, Homo sapiens
tagacttaaagcagaaagaatat

SEQ ID NO: 141675 - DNA, 18 bp, Homo sapiens
tgcaactggataggttgg

SEQ ID NO: 141676 - DNA, 19 bp, Homo sapiens
agtacacaggttaaggtgt

SEQ ID NO: 141677 - DNA, 23 bp, Homo sapiens
tgactttacaggatcatatgtgg

SEQ ID NO: 141678 - DNA, 18 bp, Homo sapiens
cactgtttctctgtgacc

SEQ ID NO: 141679 - DNA, 23 bp, Homo sapiens
agagtctcactctgtcacccagg

SEQ ID NO: 141680 - DNA, 18 bp, Homo sapiens
atgtgagatggtcctaag

SEQ ID NO: 141681 - DNA, 22 bp, Homo sapiens
tttctttctggttaagatctag

SEQ ID NO: 141682 - DNA, 23 bp, Homo sapiens
atacataatgagagatcttgggg

SEQ ID NO: 141683 - DNA, 23 bp, Homo sapiens
ttcagggatttagatgaatagta

SEQ ID NO: 141684 - DNA, 23 bp, Homo sapiens
tcatgcatgaaatgtaaatctct

SEQ ID NO: 141685 - DNA, 23 bp, Homo sapiens
aagctacttcttgacattgctgt

SEQ ID NO: 141686 - DNA, 23 bp, Homo sapiens
agagtctcactctgtcacccagg

SEQ ID NO: 141687 - DNA, 23 bp, Homo sapiens
agctatgctaatgttttgtgtta

SEQ ID NO: 141688 - DNA, 23 bp, Homo sapiens
agtaatgtttcactgcagctaga

SEQ ID NO: 141689 - DNA, 23 bp, Homo sapiens
tatcacactcctgcctccctgtt

SEQ ID NO: 141690 - DNA, 19 bp, Homo sapiens
taccactaggcctggtgtg

SEQ ID NO: 141691 - DNA, 22 bp, Homo sapiens
acacttctgtttgtcttgtaat

SEQ ID NO: 141692 - DNA, 21 bp, Homo sapiens
aaacacagtggcatttaaaag

SEQ ID NO: 141693 - DNA, 21 bp, Homo sapiens
tctctcagtggctctccatgt

SEQ ID NO: 141694 - DNA, 21 bp, Homo sapiens
tgtgtgttcttacctctgcct

SEQ ID NO: 141695 - DNA, 18 bp, Homo sapiens
aagcctctttctcagtga

SEQ ID NO: 141696 - DNA, 23 bp, Homo sapiens
tggatctgtggaatttttgtcat

SEQ ID NO: 141697 - DNA, 23 bp, Homo sapiens
tagcagtgggattgttggatcat

SEQ ID NO: 141698 - DNA, 21 bp, Homo sapiens
agctgcccagcctgtatggtg

SEQ ID NO: 141699 - DNA, 21 bp, Homo sapiens
tggatgatttttaagtattga

SEQ ID NO: 141700 - DNA, 20 bp, Homo sapiens
ttaagattctgaatcatagt

SEQ ID NO: 141701 - DNA, 23 bp, Homo sapiens
tgtgtgtgtgtgtgattctacat

SEQ ID NO: 141702 - DNA, 23 bp, Homo sapiens
taaaagtgcatctggaactggat

SEQ ID NO: 141703 - DNA, 23 bp, Homo sapiens
acatttgcattgtaaagaagcat

SEQ ID NO: 141704 - DNA, 19 bp, Homo sapiens
tagctgtactgcaggaact

SEQ ID NO: 141705 - DNA, 23 bp, Homo sapiens
tagtcagttctcacagtgctgat

SEQ ID NO: 141706 - DNA, 23 bp, Homo sapiens
tctccctctcacactctatctct

SEQ ID NO: 141707 - DNA, 23 bp, Homo sapiens
acaagaagcagactgtaaggtat

SEQ ID NO: 141708 - DNA, 23 bp, Homo sapiens
ttctgtgaagaaagtcagtggta

SEQ ID NO: 141709 - DNA, 23 bp, Homo sapiens
gtctctgactctctgtggcccag

SEQ ID NO: 141710 - DNA, 23 bp, Homo sapiens
tgagttcattgtagattctggat

SEQ ID NO: 141711 - DNA, 23 bp, Homo sapiens
tgagttcattgtagattctggat

SEQ ID NO: 141712 - DNA, 21 bp, Homo sapiens
ttttggagatctgccggccca

SEQ ID NO: 141713 - DNA, 23 bp, Homo sapiens
gaccgagtctcactcactctgtt

SEQ ID NO: 141714 - DNA, 23 bp, Homo sapiens
gtgtacacacatttgtgtttgta

SEQ ID NO: 141715 - DNA, 19 bp, Homo sapiens
tgtatatattactatgtgt

SEQ ID NO: 141716 - DNA, 23 bp, Homo sapiens
gagtctcactctgtcactcaggc

SEQ ID NO: 141717 - DNA, 23 bp, Homo sapiens
gagatggagtctcgctctgtcac

SEQ ID NO: 141718 - DNA, 22 bp, Homo sapiens
atgtggactatttggattcaga

SEQ ID NO: 141719 - DNA, 23 bp, Homo sapiens
atctctgctgccaactgtctgtg

SEQ ID NO: 141720 - DNA, 23 bp, Homo sapiens
atgtagctaatatctggatcatg

SEQ ID NO: 141721 - DNA, 23 bp, Homo sapiens
agatggagtctcactctgtcacc

SEQ ID NO: 141722 - DNA, 23 bp, Homo sapiens
agagtctcactctgtcacccagg

SEQ ID NO: 141723 - DNA, 23 bp, Homo sapiens
tgagttcattgtagattctggat

SEQ ID NO: 141724 - DNA, 23 bp, Homo sapiens
tgagttcattgtagattctggat

SEQ ID NO: 141725 - DNA, 21 bp, Homo sapiens
tagggtatagtagattaagaa

SEQ ID NO: 141726 - DNA, 22 bp, Homo sapiens
ttgagatggagtcttgctctgt

SEQ ID NO: 141727 - DNA, 23 bp, Homo sapiens
tatgtgtatatatatatgtgtgt

SEQ ID NO: 141728 - DNA, 23 bp, Homo sapiens
atgtgtgtatatatatgtgtgtg

SEQ ID NO: 141729 - DNA, 23 bp, Homo sapiens
tgactgttgacagggtgctcacc

SEQ ID NO: 141730 - DNA, 21 bp, Homo sapiens
cggtggctctgacagtgcctg

SEQ ID NO: 141731 - DNA, 23 bp, Homo sapiens
acacagtggctctgacagagcct

SEQ ID NO: 141732 - DNA, 23 bp, Homo sapiens
aacatgaaccctttctcactcac

SEQ ID NO: 141733 - DNA, 23 bp, Homo sapiens
aacttctaactgatcgcatgtgt

SEQ ID NO: 141734 - DNA, 23 bp, Homo sapiens
gacagagtctcactgtgtccccc

SEQ ID NO: 141735 - DNA, 21 bp, Homo sapiens
tagagcagtgtttttgatgga

SEQ ID NO: 141736 - DNA, 23 bp, Homo sapiens
tcatatgtgtggttctggctcag

SEQ ID NO: 141737 - DNA, 23 bp, Homo sapiens
gagcttgtaggctgtttagatgg

SEQ ID NO: 141738 - DNA, 21 bp, Homo sapiens
gtcaatatggtgaaaccttgt

SEQ ID NO: 141739 - DNA, 19 bp, Homo sapiens
gtcacggcttctgcactgg

SEQ ID NO: 141740 - DNA, 19 bp, Homo sapiens
cagagaagtgactgagctc

SEQ ID NO: 141741 - DNA, 23 bp, Homo sapiens
gcctccgtctctgcgtctctgta

SEQ ID NO: 141742 - DNA, 18 bp, Homo sapiens
agagtcgccatgttgtct

SEQ ID NO: 141743 - DNA, 18 bp, Homo sapiens
ggtcagagtgaaagccgt

SEQ ID NO: 141744 - DNA, 20 bp, Homo sapiens
actctcacacacactgtact

SEQ ID NO: 141745 - DNA, 23 bp, Homo sapiens
ctttgtcactctggctgactcgg

SEQ ID NO: 141746 - DNA, 23 bp, Homo sapiens
gtcacacagacactgcctcccta

SEQ ID NO: 141747 - DNA, 21 bp, Homo sapiens
tgattggtcctctgcttgttg

SEQ ID NO: 141748 - DNA, 23 bp, Homo sapiens
acacacagcagagtcagcactgg

SEQ ID NO: 141749 - DNA, 23 bp, Homo sapiens
atacacacacatatacatataca

SEQ ID NO: 141750 - DNA, 22 bp, Homo sapiens
tatatgtatatgaaaatgcaca

SEQ ID NO: 141751 - DNA, 23 bp, Homo sapiens
tatgtgtatatgtatatgtgtat

SEQ ID NO: 141752 - DNA, 23 bp, Homo sapiens
tcgctctgtcacacagactggag

SEQ ID NO: 141753 - DNA, 22 bp, Homo sapiens
tcagcatggaagatgtttttat

SEQ ID NO: 141754 - DNA, 23 bp, Homo sapiens
agagtcttactctgtctcctagg

SEQ ID NO: 141755 - DNA, 23 bp, Homo sapiens
ctgcgtctgtctctgcctgactt

SEQ ID NO: 141756 - DNA, 23 bp, Homo sapiens
tactcctacttcgtatgtatgta

SEQ ID NO: 141757 - DNA, 23 bp, Homo sapiens
atataagtactatattaatacat

SEQ ID NO: 141758 - DNA, 23 bp, Homo sapiens
tacttatatattgatatagtact

SEQ ID NO: 141759 - DNA, 23 bp, Homo sapiens
ttctccttctttcagtatatcaa

SEQ ID NO: 141760 - DNA, 23 bp, Homo sapiens
gtatgtgtatatatatgtgtgtg

SEQ ID NO: 141761 - DNA, 20 bp, Homo sapiens
ctggggctgtctgtgtctca

SEQ ID NO: 141762 - DNA, 19 bp, Homo sapiens
acatagtatatgtacctat

SEQ ID NO: 141763 - DNA, 23 bp, Homo sapiens
tatacacgttatatatatgtgtg

SEQ ID NO: 141764 - DNA, 21 bp, Homo sapiens
tctcagagaggcttggatgtg

SEQ ID NO: 141765 - DNA, 23 bp, Homo sapiens
ggagtctcactctgtcacccagg

SEQ ID NO: 141766 - DNA, 18 bp, Homo sapiens
tctccctgtgcctctgta

SEQ ID NO: 141767 - DNA, 23 bp, Homo sapiens
gtgtgcatgtatgtttatatgca

SEQ ID NO: 141768 - DNA, 22 bp, Homo sapiens
taagagaagagtgacagcagct

SEQ ID NO: 141769 - DNA, 23 bp, Homo sapiens
acagagtctccctctgtctccca

SEQ ID NO: 141770 - DNA, 23 bp, Homo sapiens
agatggtgcatgacaagtctggc

SEQ ID NO: 141771 - DNA, 22 bp, Homo sapiens
ttagactcataacagacgacca

SEQ ID NO: 141772 - DNA, 20 bp, Homo sapiens
tggtatgagtctatctctgt

SEQ ID NO: 141773 - DNA, 23 bp, Homo sapiens
cactgcctgactccctctgaccc

SEQ ID NO: 141774 - DNA, 23 bp, Homo sapiens
cagagtgaattgacagtgttctt

SEQ ID NO: 141775 - DNA, 19 bp, Homo sapiens
tctgctgatgagaccattg

SEQ ID NO: 141776 - DNA, 18 bp, Homo sapiens
aggaatgtgtggaaggtc

SEQ ID NO: 141777 - DNA, 22 bp, Homo sapiens
tgtgtgtttgtatgtgtgtctg

SEQ ID NO: 141778 - DNA, 21 bp, Homo sapiens
tatacgtatatatacgtatat

SEQ ID NO: 141779 - DNA, 20 bp, Homo sapiens
gatgtgacagtcctgactct

SEQ ID NO: 141780 - DNA, 23 bp, Homo sapiens
tatcactcaggctgtttagtggt

SEQ ID NO: 141781 - DNA, 23 bp, Homo sapiens
tgtatatatgtgtgcatatttgt

SEQ ID NO: 141782 - DNA, 19 bp, Homo sapiens
agacagggtctcactctgt

SEQ ID NO: 141783 - DNA, 19 bp, Homo sapiens
agcatccattttttcctga

SEQ ID NO: 141784 - DNA, 23 bp, Homo sapiens
tattagagcaggtttagatttag

SEQ ID NO: 141785 - DNA, 23 bp, Homo sapiens
aaactggaatggaaagtactcag

SEQ ID NO: 141786 - DNA, 23 bp, Homo sapiens
ctagcagtagtatgttgaataga

SEQ ID NO: 141787 - DNA, 23 bp, Homo sapiens
gtttgtgtgtgtgcatgtgtgta

SEQ ID NO: 141788 - DNA, 23 bp, Homo sapiens
aggtccagggaataacttgagtt

SEQ ID NO: 141789 - DNA, 23 bp, Homo sapiens
accgagtctcgctctgtcaccca

SEQ ID NO: 141790 - DNA, 23 bp, Homo sapiens
atatatgtgtccatgtgtttatg

SEQ ID NO: 141791 - DNA, 23 bp, Homo sapiens
gtgtatgtatattttctagttca

SEQ ID NO: 141792 - DNA, 20 bp, Homo sapiens
tcagatcaattagaaaacat

SEQ ID NO: 141793 - DNA, 23 bp, Homo sapiens
acatatgtatgtgtgcatgtgta

SEQ ID NO: 141794 - DNA, 20 bp, Homo sapiens
tctgtgttttactgtctgct

SEQ ID NO: 141795 - DNA, 23 bp, Homo sapiens
tgagttcattgtagattctggat

SEQ ID NO: 141796 - DNA, 23 bp, Homo sapiens
tgagttcattgtagattctggat

SEQ ID NO: 141797 - DNA, 22 bp, Homo sapiens
atatgtgtgcatatatatacgt

SEQ ID NO: 141798 - DNA, 23 bp, Homo sapiens
tgaggtgtgtatgtgtgtgcatg

SEQ ID NO: 141799 - DNA, 23 bp, Homo sapiens
cggagtctcgctctgtcactggg

SEQ ID NO: 141800 - DNA, 21 bp, Homo sapiens
tgttgattttgtatcctgcaa

SEQ ID NO: 141801 - DNA, 23 bp, Homo sapiens
ttctgttcccaagtcttttggta

SEQ ID NO: 141802 - DNA, 20 bp, Homo sapiens
tgaccatggctctgcctgag

SEQ ID NO: 141803 - DNA, 23 bp, Homo sapiens
gggagtctcactctgtcacccag

SEQ ID NO: 141804 - DNA, 19 bp, Homo sapiens
gcttcctggcttgagtgaa

SEQ ID NO: 141805 - DNA, 23 bp, Homo sapiens
gagcctcactctgtcacccagcc

SEQ ID NO: 141806 - DNA, 19 bp, Homo sapiens
cacagtgttgtgtggcact

SEQ ID NO: 141807 - DNA, 23 bp, Homo sapiens
gagtctcacactgtcacccaggc

SEQ ID NO: 141808 - DNA, 22 bp, Homo sapiens
acatttgttcacatgcatgcac

SEQ ID NO: 141809 - DNA, 20 bp, Homo sapiens
ttgtgtatgtgcatgtgcat

SEQ ID NO: 141810 - DNA, 21 bp, Homo sapiens
ttgtgtgtgtgcacatgtgtg

SEQ ID NO: 141811 - DNA, 23 bp, Homo sapiens
tgagttcattgtagattctggat

SEQ ID NO: 141812 - DNA, 23 bp, Homo sapiens
tgagttcattgtagattctggat

SEQ ID NO: 141813 - DNA, 23 bp, Homo sapiens
gagtcagagtctcactctgtcac

SEQ ID NO: 141814 - DNA, 20 bp, Homo sapiens
tatgtggatatacatatgta

SEQ ID NO: 141815 - DNA, 22 bp, Homo sapiens
atatatgtacatatagatgtat

SEQ ID NO: 141816 - DNA, 21 bp, Homo sapiens
ctcactctgtcactcaggctg

SEQ ID NO: 141817 - DNA, 22 bp, Homo sapiens
caggctctctctctttgtctgc

SEQ ID NO: 141818 - DNA, 23 bp, Homo sapiens
tgagttcattgtagattctggat

SEQ ID NO: 141819 - DNA, 23 bp, Homo sapiens
tgagttcattgtagattctggat

SEQ ID NO: 141820 - DNA, 23 bp, Homo sapiens
catatttatgtgcttgtatatgt

SEQ ID NO: 141821 - DNA, 21 bp, Homo sapiens
atatatgtatgcatgtgtgta

SEQ ID NO: 141822 - DNA, 21 bp, Homo sapiens
tgcagtgagctatgattgcac

SEQ ID NO: 141823 - DNA, 22 bp, Homo sapiens
gggtctcactctggcactcaag

SEQ ID NO: 141824 - DNA, 23 bp, Homo sapiens
atatatgtatatgtatgtgtgtg

SEQ ID NO: 141825 - DNA, 21 bp, Homo sapiens
acagtctctgtatttgatgtt

SEQ ID NO: 141826 - DNA, 19 bp, Homo sapiens
aatgtgtcaatagataaca

SEQ ID NO: 141827 - DNA, 20 bp, Homo sapiens
tgtataacatgatgtttttg

SEQ ID NO: 141828 - DNA, 20 bp, Homo sapiens
atacagtatgtatatatatg

SEQ ID NO: 141829 - DNA, 19 bp, Homo sapiens
atacagtatgtatatatat

SEQ ID NO: 141830 - DNA, 21 bp, Homo sapiens
ttttgagacggagtctcactc

SEQ ID NO: 141831 - DNA, 22 bp, Homo sapiens
tatcaactcattttgatgttta

SEQ ID NO: 141832 - DNA, 23 bp, Homo sapiens
tttgtgaggttggtattattgtt

SEQ ID NO: 141833 - DNA, 23 bp, Homo sapiens
actgtgtatgtgtttatgtatat

SEQ ID NO: 141834 - DNA, 23 bp, Homo sapiens
cggagtctcgctctgtctcccag

SEQ ID NO: 141835 - DNA, 23 bp, Homo sapiens
tggaagtcttgtgtttttctttg

SEQ ID NO: 141836 - DNA, 23 bp, Homo sapiens
ataatgttcgatatgtagtgtat

SEQ ID NO: 141837 - DNA, 19 bp, Homo sapiens
aatgtgtattaaatatgca

SEQ ID NO: 141838 - DNA, 23 bp, Homo sapiens
tggagtctcactctgtcgctcag

SEQ ID NO: 141839 - DNA, 20 bp, Homo sapiens
tgtatatatgtatatgtgtg

SEQ ID NO: 141840 - DNA, 23 bp, Homo sapiens
tttctgactgtggaggctgtgag

SEQ ID NO: 141841 - DNA, 22 bp, Homo sapiens
atttactcctcttggtcctgat

SEQ ID NO: 141842 - DNA, 19 bp, Homo sapiens
attccagactagcctggac

SEQ ID NO: 141843 - DNA, 22 bp, Homo sapiens
gtgggaagatggagggtgtgct

SEQ ID NO: 141844 - DNA, 22 bp, Homo sapiens
aagttcttctgaatgtttttga

SEQ ID NO: 141845 - DNA, 23 bp, Homo sapiens
tgagttcattgtagattctggat

SEQ ID NO: 141846 - DNA, 23 bp, Homo sapiens
tgagttcattgtagattctggat

SEQ ID NO: 141847 - DNA, 22 bp, Homo sapiens
tgtagtcttgtgagtttcttga

SEQ ID NO: 141848 - DNA, 23 bp, Homo sapiens
tcatttcttgtatctctgaattt

SEQ ID NO: 141849 - DNA, 23 bp, Homo sapiens
tgagttcattgtagattctggat

SEQ ID NO: 141850 - DNA, 23 bp, Homo sapiens
tgagttcattgtagattctggat

SEQ ID NO: 141851 - DNA, 23 bp, Homo sapiens
ttggagagatgtcactttgttca

SEQ ID NO: 141852 - DNA, 20 bp, Homo sapiens
gtgagcggcacagaataaac

SEQ ID NO: 141853 - DNA, 23 bp, Homo sapiens
ttgtcattggtaaagaagcaatt

SEQ ID NO: 141854 - DNA, 20 bp, Homo sapiens
tgtttctttctcttgttcca

SEQ ID NO: 141855 - DNA, 23 bp, Homo sapiens
tatatgtaagattatatatgtat

SEQ ID NO: 141856 - DNA, 23 bp, Homo sapiens
tcactgtgtcactctctggtaag

SEQ ID NO: 141857 - DNA, 18 bp, Homo sapiens
acttaagttatctttctt

SEQ ID NO: 141858 - DNA, 23 bp, Homo sapiens
gacagagtctcgctctgtcaccc

SEQ ID NO: 141859 - DNA, 20 bp, Homo sapiens
attgcactccagcctgggcg

SEQ ID NO: 141860 - DNA, 23 bp, Homo sapiens
acagagtctcactctgtcgccca

SEQ ID NO: 141861 - DNA, 23 bp, Homo sapiens
agaaggaagatgaagcatttctc

SEQ ID NO: 141862 - DNA, 20 bp, Homo sapiens
tgcagtgagctatgatcctg

SEQ ID NO: 141863 - DNA, 18 bp, Homo sapiens
cagttcactgcaacctct

SEQ ID NO: 141864 - DNA, 21 bp, Homo sapiens
aaattagccaggtatggtggt

SEQ ID NO: 141865 - DNA, 19 bp, Homo sapiens
gtgacactctgtggctcac

SEQ ID NO: 141866 - DNA, 23 bp, Homo sapiens
ctgtgagtgagaacatacgatgt

SEQ ID NO: 141867 - DNA, 18 bp, Homo sapiens
gtggaaggatctcttgag

SEQ ID NO: 141868 - DNA, 18 bp, Homo sapiens
gatcaattataatgatca

SEQ ID NO: 141869 - DNA, 20 bp, Homo sapiens
tcaccgccagacagacagca

SEQ ID NO: 141870 - DNA, 21 bp, Homo sapiens
tagatagaacagaggggggac

SEQ ID NO: 141871 - DNA, 20 bp, Homo sapiens
atgatttctcagactttcct

SEQ ID NO: 141872 - DNA, 20 bp, Homo sapiens
atcctctgtgggtcagttgt

SEQ ID NO: 141873 - DNA, 23 bp, Homo sapiens
gtgtcaggctctctgtcccactc

SEQ ID NO: 141874 - DNA, 23 bp, Homo sapiens
tgcatccctctgtgtgtctgtgg

SEQ ID NO: 141875 - DNA, 23 bp, Homo sapiens
aaagtcaggggttatgatgtaaa

SEQ ID NO: 141876 - DNA, 18 bp, Homo sapiens
tcttgtcagaaggctgtg

SEQ ID NO: 141877 - DNA, 19 bp, Homo sapiens
tgaggacgcatttcaaaga

SEQ ID NO: 141878 - DNA, 23 bp, Homo sapiens
ttgtgtgtgtgtctgagtctcct

SEQ ID NO: 141879 - DNA, 20 bp, Homo sapiens
ttagaccctcattatggagt

SEQ ID NO: 141880 - DNA, 21 bp, Homo sapiens
actgtcactctaagtctaaag

SEQ ID NO: 141881 - DNA, 23 bp, Homo sapiens
tatatgtgtgtatatatatgtgt

SEQ ID NO: 141882 - DNA, 23 bp, Homo sapiens
gtagtgatgtctctgcaatggga

SEQ ID NO: 141883 - DNA, 23 bp, Homo sapiens
gacagtctctctgtcacccaggc

SEQ ID NO: 141884 - DNA, 21 bp, Homo sapiens
tggcacagtggctcacatctg

SEQ ID NO: 141885 - DNA, 19 bp, Homo sapiens
ctcactgcaacctctatct

SEQ ID NO: 141886 - DNA, 22 bp, Homo sapiens
aacagattggtacttttttttt

SEQ ID NO: 141887 - DNA, 21 bp, Homo sapiens
aaaaaagagctaccgatttga

SEQ ID NO: 141888 - DNA, 23 bp, Homo sapiens
agtatagaagtttgtgtatgcag

SEQ ID NO: 141889 - DNA, 23 bp, Homo sapiens
tctcactctgtcactctatcgcc

SEQ ID NO: 141890 - DNA, 19 bp, Homo sapiens
ggtcacagaaacattaagc

SEQ ID NO: 141891 - DNA, 23 bp, Homo sapiens
tttaatgtttttgaaaagcgtat

SEQ ID NO: 141892 - DNA, 23 bp, Homo sapiens
agtttggctggatatgaaattct

SEQ ID NO: 141893 - DNA, 18 bp, Homo sapiens
agtggttcatgtactttg

SEQ ID NO: 141894 - DNA, 22 bp, Homo sapiens
atttcattttgttaatgtgatg

SEQ ID NO: 141895 - DNA, 23 bp, Homo sapiens
ctctgtgactctctggaacacgt

SEQ ID NO: 141896 - DNA, 23 bp, Homo sapiens
tatgtgtatatacacatatgtgt

SEQ ID NO: 141897 - DNA, 23 bp, Homo sapiens
tatgtgtatatacatatatgtgt

SEQ ID NO: 141898 - DNA, 23 bp, Homo sapiens
tatgtgtatatacatatatgtgt

SEQ ID NO: 141899 - DNA, 23 bp, Homo sapiens
tatgtgtatatacatatatgtgt

SEQ ID NO: 141900 - DNA, 22 bp, Homo sapiens
tatgtgtatatacatatatgtg

SEQ ID NO: 141901 - DNA, 20 bp, Homo sapiens
tcactgggtcactcaggctg

SEQ ID NO: 141902 - DNA, 23 bp, Homo sapiens
tgagttcattgtagattctggat

SEQ ID NO: 141903 - DNA, 23 bp, Homo sapiens
tgagttcattgtagattctggat

SEQ ID NO: 141904 - DNA, 18 bp, Homo sapiens
atctcctttagaacggaa

SEQ ID NO: 141905 - DNA, 23 bp, Homo sapiens
acagatgtgtgtttgtgtgtttc

SEQ ID NO: 141906 - DNA, 23 bp, Homo sapiens
atatgtatatgtatatatgtata

SEQ ID NO: 141907 - DNA, 22 bp, Homo sapiens
agtctcgctctgtcactcaggc

SEQ ID NO: 141908 - DNA, 23 bp, Homo sapiens
tgtgtggctctcacagtgcctgt

SEQ ID NO: 141909 - DNA, 23 bp, Homo sapiens
gtttgtgggagagcaatcgttga

SEQ ID NO: 141910 - DNA, 23 bp, Homo sapiens
atgacttcatattatttgcattg

SEQ ID NO: 141911 - DNA, 23 bp, Homo sapiens
tatcattagatttggttttgaaa

SEQ ID NO: 141912 - DNA, 23 bp, Homo sapiens
aaagtgcatcttaagagggcgct

SEQ ID NO: 141913 - DNA, 19 bp, Homo sapiens
tctctttgtatttcattgt

SEQ ID NO: 141914 - DNA, 23 bp, Homo sapiens
atatatgtatatatgtgtgtgta

SEQ ID NO: 141915 - DNA, 23 bp, Homo sapiens
atatatgtatacatgtgtgtgtg

SEQ ID NO: 141916 - DNA, 23 bp, Homo sapiens
ataaatgcagtgcttctcttctc

SEQ ID NO: 141917 - DNA, 23 bp, Homo sapiens
ggagtctcacactgtcacccagg

SEQ ID NO: 141918 - DNA, 23 bp, Homo sapiens
ctcactgacccactcaaattcct

SEQ ID NO: 141919 - DNA, 23 bp, Homo sapiens
tggttaagagaagctctgactca

SEQ ID NO: 141920 - DNA, 18 bp, Homo sapiens
gtactgggttgaatagtt

SEQ ID NO: 141921 - DNA, 23 bp, Homo sapiens
tatgtcagcctaaacctcagtat

SEQ ID NO: 141922 - DNA, 19 bp, Homo sapiens
tactgcagcttctgcctcc

SEQ ID NO: 141923 - DNA, 22 bp, Homo sapiens
tatgtatatatataggtatgtg

SEQ ID NO: 141924 - DNA, 23 bp, Homo sapiens
tgagttcattgtagattctggat

SEQ ID NO: 141925 - DNA, 23 bp, Homo sapiens
tgagttcattgtagattctggat

SEQ ID NO: 141926 - DNA, 18 bp, Homo sapiens
tagacctatttctgtgac

SEQ ID NO: 141927 - DNA, 22 bp, Homo sapiens
atgtgtattcatgtattttgat

SEQ ID NO: 141928 - DNA, 22 bp, Homo sapiens
atataccttatatatactgtat

SEQ ID NO: 141929 - DNA, 23 bp, Homo sapiens
accgagtctcgctctgtcaccca

SEQ ID NO: 141930 - DNA, 18 bp, Homo sapiens
tatacatgtgtatatgta

SEQ ID NO: 141931 - DNA, 18 bp, Homo sapiens
atacatattttatatatg

SEQ ID NO: 141932 - DNA, 19 bp, Homo sapiens
acaactagttagtatagac

SEQ ID NO: 141933 - DNA, 22 bp, Homo sapiens
gcagtgagaacagagtgaccat

SEQ ID NO: 141934 - DNA, 18 bp, Homo sapiens
tttagaacattctgtgtc

SEQ ID NO: 141935 - DNA, 18 bp, Homo sapiens
tccttccagggctgtttc

SEQ ID NO: 141936 - DNA, 20 bp, Homo sapiens
tacaattgcattgtcacaaa

SEQ ID NO: 141937 - DNA, 23 bp, Homo sapiens
ttgtgtgtgtgcatttgcatgtg

SEQ ID NO: 141938 - DNA, 19 bp, Homo sapiens
tacacacatatatatgtgt

SEQ ID NO: 141939 - DNA, 19 bp, Homo sapiens
gtctcgctctgtcacccag

SEQ ID NO: 141940 - DNA, 23 bp, Homo sapiens
ctggttgtcacggtgagattctg

SEQ ID NO: 141941 - DNA, 20 bp, Homo sapiens
atgtgcttgtgatctcagct

SEQ ID NO: 141942 - DNA, 23 bp, Homo sapiens
ggagtctcactctgtctcccagg

SEQ ID NO: 141943 - DNA, 23 bp, Homo sapiens
atatctatatatgtatatctaga

SEQ ID NO: 141944 - DNA, 21 bp, Homo sapiens
tatatgcatatatatggatat

SEQ ID NO: 141945 - DNA, 23 bp, Homo sapiens
gaatgtgcaactgcaagtgtaca

SEQ ID NO: 141946 - DNA, 23 bp, Homo sapiens
ggtgcacacttgtagttccagct

SEQ ID NO: 141947 - DNA, 23 bp, Homo sapiens
gatggagtctcactctgtcaccc

SEQ ID NO: 141948 - DNA, 20 bp, Homo sapiens
aagtatgtgtgtatgtgtgt

SEQ ID NO: 141949 - DNA, 22 bp, Homo sapiens
aatgtgtgtgtttatatacaca

SEQ ID NO: 141950 - DNA, 23 bp, Homo sapiens
gttgtgtctgtgtgtgcatgtgt

SEQ ID NO: 141951 - DNA, 20 bp, Homo sapiens
ggcagagggagtttacacag

SEQ ID NO: 141952 - DNA, 23 bp, Homo sapiens
aggaggcagaggttgcagtgagc

SEQ ID NO: 141953 - DNA, 20 bp, Homo sapiens
atatgcatataaatacgtat

SEQ ID NO: 141954 - DNA, 23 bp, Homo sapiens
tgagttcattgtagattctggat

SEQ ID NO: 141955 - DNA, 23 bp, Homo sapiens
tgagttcattgtagattctggat

SEQ ID NO: 141956 - DNA, 23 bp, Homo sapiens
tggagtctcactctgtcacccag

SEQ ID NO: 141957 - DNA, 20 bp, Homo sapiens
tgtctccctctcacactctg

SEQ ID NO: 141958 - DNA, 22 bp, Homo sapiens
atgtacatgtatacatatgtgt

SEQ ID NO: 141959 - DNA, 20 bp, Homo sapiens
tgtatgtatgtatgtatgta

SEQ ID NO: 141960 - DNA, 22 bp, Homo sapiens
tgactgtagacagactggattc

SEQ ID NO: 141961 - DNA, 22 bp, Homo sapiens
tatctgtgtggctgttctttta

SEQ ID NO: 141962 - DNA, 23 bp, Homo sapiens
gggtctcactctgtcacccaggc

SEQ ID NO: 141963 - DNA, 23 bp, Homo sapiens
atggtgtgatcttggctcactgt

SEQ ID NO: 141964 - DNA, 23 bp, Homo sapiens
atatgtatgtatatatgtgtgtg

SEQ ID NO: 141965 - DNA, 23 bp, Homo sapiens
tatgtatatatgtatatgtatgt

SEQ ID NO: 141966 - DNA, 20 bp, Homo sapiens
atatgtatatatgtatgtgt

SEQ ID NO: 141967 - DNA, 23 bp, Homo sapiens
tgtatatatgtatatgtatgtgt

SEQ ID NO: 141968 - DNA, 21 bp, Homo sapiens
atatgtatatatgtatatgtg

SEQ ID NO: 141969 - DNA, 23 bp, Homo sapiens
actgattggtccactatgggtaa

SEQ ID NO: 141970 - DNA, 18 bp, Homo sapiens
tatatatacatctatgga

SEQ ID NO: 141971 - DNA, 23 bp, Homo sapiens
acagagtctcgctctgtcgctca

SEQ ID NO: 141972 - DNA, 23 bp, Homo sapiens
atgtgtgtgtgtgtatatgtcta

SEQ ID NO: 141973 - DNA, 23 bp, Homo sapiens
tatatgtatatgtatatatgtgt

SEQ ID NO: 141974 - DNA, 23 bp, Homo sapiens
tgagttcattgtagattctggat

SEQ ID NO: 141975 - DNA, 23 bp, Homo sapiens
tgagttcattgtagattctggat

SEQ ID NO: 141976 - DNA, 23 bp, Homo sapiens
tgggtctcagagttagaagaccc

SEQ ID NO: 141977 - DNA, 23 bp, Homo sapiens
agattagaagttgactgcagtga

SEQ ID NO: 141978 - DNA, 20 bp, Homo sapiens
acaatcatggcagaaggtga

SEQ ID NO: 141979 - DNA, 23 bp, Homo sapiens
gccagagtgtcactctgtcaccc

SEQ ID NO: 141980 - DNA, 22 bp, Homo sapiens
tttgcttttattacttatgtat

SEQ ID NO: 141981 - DNA, 21 bp, Homo sapiens
tctcactcacggtcagtttcc

SEQ ID NO: 141982 - DNA, 22 bp, Homo sapiens
tcagagggtctataagtgccct

SEQ ID NO: 141983 - DNA, 23 bp, Homo sapiens
ctcagtcagattgaattgcaatg

SEQ ID NO: 141984 - DNA, 23 bp, Homo sapiens
tgtaaaagaccagatgctggagt

SEQ ID NO: 141985 - DNA, 20 bp, Homo sapiens
tagaagtcaatatgttgtag

SEQ ID NO: 141986 - DNA, 23 bp, Homo sapiens
agagtctcactctgtcacccagg

SEQ ID NO: 141987 - DNA, 21 bp, Homo sapiens
tgcagtgaacaggctaccttc

SEQ ID NO: 141988 - DNA, 23 bp, Homo sapiens
tctgagatcaaggtgtcagcaag

SEQ ID NO: 141989 - DNA, 23 bp, Homo sapiens
taacaacaacaaccgctgcagca

SEQ ID NO: 141990 - DNA, 23 bp, Homo sapiens
tgtactctttctagatacgtaga

SEQ ID NO: 141991 - DNA, 23 bp, Homo sapiens
gtgtgtgtatatatatatgtgtg

SEQ ID NO: 141992 - DNA, 20 bp, Homo sapiens
atatgtatataaaatggaaa

SEQ ID NO: 141993 - DNA, 23 bp, Homo sapiens
tgtatatatgtatgtgtgcatac

SEQ ID NO: 141994 - DNA, 23 bp, Homo sapiens
aatgtcagtatatatgtgtgaga

SEQ ID NO: 141995 - DNA, 18 bp, Homo sapiens
atatatcacaggtactga

SEQ ID NO: 141996 - DNA, 23 bp, Homo sapiens
cagggtctcactgtgtcacccag

SEQ ID NO: 141997 - DNA, 22 bp, Homo sapiens
agctcactgcactctcagtctc

SEQ ID NO: 141998 - DNA, 23 bp, Homo sapiens
agctcactacactctcagtctcc

SEQ ID NO: 141999 - DNA, 23 bp, Homo sapiens
gacagagtctcgctctgtcaccc

SEQ ID NO: 142000 - DNA, 23 bp, Homo sapiens
agatggagtctcactctgtcacc

SEQ ID NO: 142001 - DNA, 23 bp, Homo sapiens
agaagctggatgcagttgagcaa

SEQ ID NO: 142002 - DNA, 23 bp, Homo sapiens
cccaacagatcagtgggagcaga

SEQ ID NO: 142003 - DNA, 23 bp, Homo sapiens
cagtggcaagatcttggctcacc

SEQ ID NO: 142004 - DNA, 22 bp, Homo sapiens
tgtggtctcacatagctcttag

SEQ ID NO: 142005 - DNA, 23 bp, Homo sapiens
tctgtcagcgtctcactgccact

SEQ ID NO: 142006 - DNA, 23 bp, Homo sapiens
tgacccttcaagaatgtgaggtg

SEQ ID NO: 142007 - DNA, 23 bp, Homo sapiens
attccacttctctgggtctgaca

SEQ ID NO: 142008 - DNA, 23 bp, Homo sapiens
gagtctccctctgtcactcaggc

SEQ ID NO: 142009 - DNA, 20 bp, Homo sapiens
gagaccctgtctctccctct

SEQ ID NO: 142010 - DNA, 20 bp, Homo sapiens
tagagagagagagagatcat

SEQ ID NO: 142011 - DNA, 23 bp, Homo sapiens
tctctctctctctggcttttatc

SEQ ID NO: 142012 - DNA, 18 bp, Homo sapiens
tgaaaagagggaagaatg

SEQ ID NO: 142013 - DNA, 23 bp, Homo sapiens
cactcactagctctgtcatcttg

SEQ ID NO: 142014 - DNA, 22 bp, Homo sapiens
tggtcattgtttgcaggatgtc

SEQ ID NO: 142015 - DNA, 23 bp, Homo sapiens
aagtctcagagactttctgctca

SEQ ID NO: 142016 - DNA, 20 bp, Homo sapiens
tgtgcctggatgtgtgcagt

SEQ ID NO: 142017 - DNA, 23 bp, Homo sapiens
gctcactcacacactcctagcca

SEQ ID NO: 142018 - DNA, 22 bp, Homo sapiens
atgtcgatgttgtatcctgaaa

SEQ ID NO: 142019 - DNA, 19 bp, Homo sapiens
tgaaaggttatttttcaca

SEQ ID NO: 142020 - DNA, 23 bp, Homo sapiens
tggtgctattctattgagtggaa

SEQ ID NO: 142021 - DNA, 23 bp, Homo sapiens
acttctctgtgcctcacaatctg

SEQ ID NO: 142022 - DNA, 23 bp, Homo sapiens
cggtgtcttactctgtcactcag

SEQ ID NO: 142023 - DNA, 23 bp, Homo sapiens
gacagagtctcactctgtcgccc

SEQ ID NO: 142024 - DNA, 23 bp, Homo sapiens
gagtctcacactgccactcaggc

SEQ ID NO: 142025 - DNA, 23 bp, Homo sapiens
gtgcaatggtgtgatctcagctc

SEQ ID NO: 142026 - DNA, 23 bp, Homo sapiens
attctgctagttaatatctctct

SEQ ID NO: 142027 - DNA, 23 bp, Homo sapiens
ctatttatacatatgttacatat

SEQ ID NO: 142028 - DNA, 23 bp, Homo sapiens
gactgagtctcgctctgtctccc

SEQ ID NO: 142029 - DNA, 22 bp, Homo sapiens
ctgtctcagacactttttggtt

SEQ ID NO: 142030 - DNA, 21 bp, Homo sapiens
tgtgtctttaagtgtgtgcct

SEQ ID NO: 142031 - DNA, 22 bp, Homo sapiens
tctcagtctcattgtaggctga

SEQ ID NO: 142032 - DNA, 23 bp, Homo sapiens
tatgtgtgtgtacatatgtgtgt

SEQ ID NO: 142033 - DNA, 23 bp, Homo sapiens
tgagttcattgtagattctggat

SEQ ID NO: 142034 - DNA, 23 bp, Homo sapiens
tgagttcattgtagattctggat

SEQ ID NO: 142035 - DNA, 23 bp, Homo sapiens
tgtgtgtgcctgtgtgtgtctct

SEQ ID NO: 142036 - DNA, 19 bp, Homo sapiens
tgtgcttacacatacacaa

SEQ ID NO: 142037 - DNA, 23 bp, Homo sapiens
ttttatgaggtggaatctcacac

SEQ ID NO: 142038 - DNA, 23 bp, Homo sapiens
ttaagattaaaaaaaaaggtgca

SEQ ID NO: 142039 - DNA, 22 bp, Homo sapiens
agttgtataattacgtgttatc

SEQ ID NO: 142040 - DNA, 18 bp, Homo sapiens
tccattaggaatgtgtat

SEQ ID NO: 142041 - DNA, 23 bp, Homo sapiens
tgtgtgtctctgtgtgtcttgag

SEQ ID NO: 142042 - DNA, 23 bp, Homo sapiens
atgtgaatgggaattcactcacg

SEQ ID NO: 142043 - DNA, 19 bp, Homo sapiens
atacacacatatatatgtg

SEQ ID NO: 142044 - DNA, 21 bp, Homo sapiens
atacacacatatatatatgtg

SEQ ID NO: 142045 - DNA, 23 bp, Homo sapiens
tgagttcattgtagattctggat

SEQ ID NO: 142046 - DNA, 23 bp, Homo sapiens
tgagttcattgtagattctggat

SEQ ID NO: 142047 - DNA, 23 bp, Homo sapiens
tgcctgtctgtgtgtctctggaa

SEQ ID NO: 142048 - DNA, 23 bp, Homo sapiens
tggagtctcactctgtcacccag

SEQ ID NO: 142049 - DNA, 20 bp, Homo sapiens
atatctgtgtatatatgtat

SEQ ID NO: 142050 - DNA, 21 bp, Homo sapiens
tactccaacatgaaagctttc

SEQ ID NO: 142051 - DNA, 23 bp, Homo sapiens
tcctaaagttgaaagtgtatttg

SEQ ID NO: 142052 - DNA, 18 bp, Homo sapiens
tctcagcaacacattctg

SEQ ID NO: 142053 - DNA, 22 bp, Homo sapiens
ttgctcctactgcaggaggtga

SEQ ID NO: 142054 - DNA, 23 bp, Homo sapiens
tgagacacagtctcactctgtcg

SEQ ID NO: 142055 - DNA, 20 bp, Homo sapiens
ataactttatatatatgtgt

SEQ ID NO: 142056 - DNA, 18 bp, Homo sapiens
tcactactcactacacct

SEQ ID NO: 142057 - DNA, 23 bp, Homo sapiens
tggcacagagaggctgttcattt

SEQ ID NO: 142058 - DNA, 22 bp, Homo sapiens
tgataagtcttttagcattatg

SEQ ID NO: 142059 - DNA, 18 bp, Homo sapiens
ctttatttttattctgaa

SEQ ID NO: 142060 - DNA, 20 bp, Homo sapiens
gtctcactctgtcacctggg

SEQ ID NO: 142061 - DNA, 23 bp, Homo sapiens
tggctccatcacagatgcagtac

SEQ ID NO: 142062 - DNA, 21 bp, Homo sapiens
tgaggtaggaggatcacttga

SEQ ID NO: 142063 - DNA, 23 bp, Homo sapiens
tgtctctgtgtcacattttggta

SEQ ID NO: 142064 - DNA, 23 bp, Homo sapiens
tgagacagagtctcgctctgttg

SEQ ID NO: 142065 - DNA, 23 bp, Homo sapiens
attttttgtggagacagagtctc

SEQ ID NO: 142066 - DNA, 23 bp, Homo sapiens
agtgtctgtcactcactctgtcg

SEQ ID NO: 142067 - DNA, 23 bp, Homo sapiens
agtgagtctcactgtgtcgccca

SEQ ID NO: 142068 - DNA, 23 bp, Homo sapiens
atgcctgagtagtattctgtgac

SEQ ID NO: 142069 - DNA, 19 bp, Homo sapiens
tccctgtgtccttggtacc

SEQ ID NO: 142070 - DNA, 23 bp, Homo sapiens
ctcactctgtgtgtctgtggggg

SEQ ID NO: 142071 - DNA, 23 bp, Homo sapiens
tcaaactgcatctgcatcagtgt

SEQ ID NO: 142072 - DNA, 23 bp, Homo sapiens
tccttcactcacaatttcatttc

SEQ ID NO: 142073 - DNA, 23 bp, Homo sapiens
ataaatgaggaaatgaaagctct

SEQ ID NO: 142074 - DNA, 23 bp, Homo sapiens
tgacagtgagtgagttctcacag

SEQ ID NO: 142075 - DNA, 22 bp, Homo sapiens
tatgtgtgtatatatatgtgtg

SEQ ID NO: 142076 - DNA, 23 bp, Homo sapiens
gtgtgtgcctgtagtttcagcta

SEQ ID NO: 142077 - DNA, 23 bp, Homo sapiens
gctgaggtaggaggatcacttga

SEQ ID NO: 142078 - DNA, 20 bp, Homo sapiens
tgagagagatgggacttctt

SEQ ID NO: 142079 - DNA, 23 bp, Homo sapiens
tacttgcatgaactatgcgctgt

SEQ ID NO: 142080 - DNA, 23 bp, Homo sapiens
tgagttcattgtagattctggat

SEQ ID NO: 142081 - DNA, 21 bp, Homo sapiens
tgtgtatatatatatgtgtgt

SEQ ID NO: 142082 - DNA, 23 bp, Homo sapiens
atatatgtttgcatgtgtttgtg

SEQ ID NO: 142083 - DNA, 18 bp, Homo sapiens
agagcatgtatatataat

SEQ ID NO: 142084 - DNA, 22 bp, Homo sapiens
tatattctacatattgcatata

SEQ ID NO: 142085 - DNA, 22 bp, Homo sapiens
atatattgcatatgcatcagtt

SEQ ID NO: 142086 - DNA, 23 bp, Homo sapiens
taatttgttgttgaattcagttt

SEQ ID NO: 142087 - DNA, 20 bp, Homo sapiens
cattggagttcattgagtat

SEQ ID NO: 142088 - DNA, 18 bp, Homo sapiens
tagcgactgaggatccca

SEQ ID NO: 142089 - DNA, 23 bp, Homo sapiens
acggactctcactctgtccccca

SEQ ID NO: 142090 - DNA, 21 bp, Homo sapiens
aagaaagctagtaagttgcaa

SEQ ID NO: 142091 - DNA, 22 bp, Homo sapiens
attctctcacatactcttgtgt

SEQ ID NO: 142092 - DNA, 22 bp, Homo sapiens
cataaaggtgttcttctgaatc

SEQ ID NO: 142093 - DNA, 20 bp, Homo sapiens
actacatatgtatgtatcca

SEQ ID NO: 142094 - DNA, 22 bp, Homo sapiens
aagaaactttttgtaaatgtgt

SEQ ID NO: 142095 - DNA, 23 bp, Homo sapiens
tgacactctgtatctaggtgctc

SEQ ID NO: 142096 - DNA, 23 bp, Homo sapiens
ggagtctcactctgtcactaggc

SEQ ID NO: 142097 - DNA, 18 bp, Homo sapiens
gtccatcagggcttggct

SEQ ID NO: 142098 - DNA, 23 bp, Homo sapiens
atctcagttcttagctcagtgtc

SEQ ID NO: 142099 - DNA, 23 bp, Homo sapiens
aaagaaggaagatgaagcgtttt

SEQ ID NO: 142100 - DNA, 23 bp, Homo sapiens
ttgtctgcctttggtttaggtgt

SEQ ID NO: 142101 - DNA, 22 bp, Homo sapiens
ctccctgtgtgcctgggtctgt

SEQ ID NO: 142102 - DNA, 23 bp, Homo sapiens
ttgaacacagttttttgggttgt

SEQ ID NO: 142103 - DNA, 19 bp, Homo sapiens
tgtgtatgtatatatgtgt

SEQ ID NO: 142104 - DNA, 22 bp, Homo sapiens
tgtgtatatatctatatatgtg

SEQ ID NO: 142105 - DNA, 23 bp, Homo sapiens
acatcagagaacacacacagggg

SEQ ID NO: 142106 - DNA, 23 bp, Homo sapiens
aagccctatggatgtaatgagtg

SEQ ID NO: 142107 - DNA, 23 bp, Homo sapiens
tgagttcattgtagattctggat

SEQ ID NO: 142108 - DNA, 23 bp, Homo sapiens
tgagttcattgtagattctggat

SEQ ID NO: 142109 - DNA, 23 bp, Homo sapiens
acagggtctcactctgtcaccca

SEQ ID NO: 142110 - DNA, 23 bp, Homo sapiens
gggtctcactctgtcacccaggc

SEQ ID NO: 142111 - DNA, 23 bp, Homo sapiens
gggtctcactctgtcacccaggc

SEQ ID NO: 142112 - DNA, 22 bp, Homo sapiens
tctgaatatatatatatgtgtg

SEQ ID NO: 142113 - DNA, 21 bp, Homo sapiens
tatgtgtatatatatatatgt

SEQ ID NO: 142114 - DNA, 23 bp, Homo sapiens
atgctctgactctgtctcagcct

SEQ ID NO: 142115 - DNA, 23 bp, Homo sapiens
agaacacttgtgtctctctcacc

SEQ ID NO: 142116 - DNA, 23 bp, Homo sapiens
tatacgtatatatgtatatgtgt

SEQ ID NO: 142117 - DNA, 22 bp, Homo sapiens
atatattgtatatgtatgtgta

SEQ ID NO: 142118 - DNA, 23 bp, Homo sapiens
tcagtgacagcttcttgatctgt

SEQ ID NO: 142119 - DNA, 23 bp, Homo sapiens
actgtctctgttagtctttgagc

SEQ ID NO: 142120 - DNA, 22 bp, Homo sapiens
acacctgtagttccagctgctt

SEQ ID NO: 142121 - DNA, 20 bp, Homo sapiens
tgtgtgtgtatgtgtgtgca

SEQ ID NO: 142122 - DNA, 20 bp, Homo sapiens
tgtatgtgtgcatgtgtatg

SEQ ID NO: 142123 - DNA, 19 bp, Homo sapiens
ttcgctgtagattctggat

SEQ ID NO: 142124 - DNA, 23 bp, Homo sapiens
agcctctctgagcctctgtctcc

SEQ ID NO: 142125 - DNA, 19 bp, Homo sapiens
agtggtctaggagggggca

SEQ ID NO: 142126 - DNA, 19 bp, Homo sapiens
attgttgttgttgggggat

SEQ ID NO: 142127 - DNA, 20 bp, Homo sapiens
tcagtggggtttcaccatgt

SEQ ID NO: 142128 - DNA, 21 bp, Homo sapiens
tatatgcacatttatacagat

SEQ ID NO: 142129 - DNA, 23 bp, Homo sapiens
acagtagttgtttgctctttggt

SEQ ID NO: 142130 - DNA, 23 bp, Homo sapiens
agccagactccctctctgggtga

SEQ ID NO: 142131 - DNA, 23 bp, Homo sapiens
tctgtgggactctgactccctct

SEQ ID NO: 142132 - DNA, 23 bp, Homo sapiens
actcattttgtttttgtcaccct

SEQ ID NO: 142133 - DNA, 20 bp, Homo sapiens
acccttgctaagggttactt

SEQ ID NO: 142134 - DNA, 23 bp, Homo sapiens
aggtggtatcttgttttgatttg

SEQ ID NO: 142135 - DNA, 23 bp, Homo sapiens
gtgcttgtctgcctgcctctctg

SEQ ID NO: 142136 - DNA, 19 bp, Homo sapiens
gggtccctgtgtgcctctc

SEQ ID NO: 142137 - DNA, 23 bp, Homo sapiens
tgagttcattgtagattctggat

SEQ ID NO: 142138 - DNA, 22 bp, Homo sapiens
ctcagtctgtttatctctccca

SEQ ID NO: 142139 - DNA, 20 bp, Homo sapiens
atgtatatatacgtgtgtgt

SEQ ID NO: 142140 - DNA, 21 bp, Homo sapiens
acacatatgtgtgtgtgtgta

SEQ ID NO: 142141 - DNA, 21 bp, Homo sapiens
atgaaagagcacccggacctg

SEQ ID NO: 142142 - DNA, 19 bp, Homo sapiens
tatcacactcagcagttag

SEQ ID NO: 142143 - DNA, 23 bp, Homo sapiens
agtaaatctgcttcaataagtgt

SEQ ID NO: 142144 - DNA, 23 bp, Homo sapiens
tctctctgtgtgatgttcaaggg

SEQ ID NO: 142145 - DNA, 23 bp, Homo sapiens
tcacgtatgtatagatgtaacac

SEQ ID NO: 142146 - DNA, 23 bp, Homo sapiens
agtctttgcaaatgtattgaaac

SEQ ID NO: 142147 - DNA, 23 bp, Homo sapiens
tatctatgagtgtgtgtgtgtat

SEQ ID NO: 142148 - DNA, 18 bp, Homo sapiens
ttgtatgtatataaatgt

SEQ ID NO: 142149 - DNA, 23 bp, Homo sapiens
ttttctaactgaatgtgcatatg

SEQ ID NO: 142150 - DNA, 22 bp, Homo sapiens
tgcagtgagccaagattgcacc

SEQ ID NO: 142151 - DNA, 23 bp, Homo sapiens
agtgaggttcttggttcttgaga

SEQ ID NO: 142152 - DNA, 20 bp, Homo sapiens
tctgatagttcaatggatct

SEQ ID NO: 142153 - DNA, 22 bp, Homo sapiens
tttgagtctcagattccatagt

SEQ ID NO: 142154 - DNA, 23 bp, Homo sapiens
gtctctggtaaacctggtgaatg

SEQ ID NO: 142155 - DNA, 22 bp, Homo sapiens
ggagtctcactctgtcacctag

SEQ ID NO: 142156 - DNA, 23 bp, Homo sapiens
tctgaccctgtctccctccttca

SEQ ID NO: 142157 - DNA, 23 bp, Homo sapiens
agagacactgagtgacttgctag

SEQ ID NO: 142158 - DNA, 23 bp, Homo sapiens
agtggagtgatcttggctcactg

SEQ ID NO: 142159 - DNA, 21 bp, Homo sapiens
agaatcaggcctaggcagaga

SEQ ID NO: 142160 - DNA, 23 bp, Homo sapiens
agagacactgagtgacttgctag

SEQ ID NO: 142161 - DNA, 23 bp, Homo sapiens
tatctgagaacagagggtgctca

SEQ ID NO: 142162 - DNA, 23 bp, Homo sapiens
tagtttggtaagttgttaccatt

SEQ ID NO: 142163 - DNA, 19 bp, Homo sapiens
ctggggtacaaggatctct

SEQ ID NO: 142164 - DNA, 23 bp, Homo sapiens
agagtctctctctgtcacccagg

SEQ ID NO: 142165 - DNA, 22 bp, Homo sapiens
ggagtctcactctgtcacctag

SEQ ID NO: 142166 - DNA, 20 bp, Homo sapiens
tagactgagggatcagaaga

SEQ ID NO: 142167 - DNA, 21 bp, Homo sapiens
tgagacagagtctcgctctgt

SEQ ID NO: 142168 - DNA, 23 bp, Homo sapiens
ttcttggctgtgtctggtggtga

SEQ ID NO: 142169 - DNA, 22 bp, Homo sapiens
ggcaccgactctctctgactgt

SEQ ID NO: 142170 - DNA, 23 bp, Homo sapiens
tgtctctctctctccgtgtcagt

SEQ ID NO: 142171 - DNA, 23 bp, Homo sapiens
atcaaaagtgattttgatgcaat

SEQ ID NO: 142172 - DNA, 23 bp, Homo sapiens
tatatgtatatatacatatgtaa

SEQ ID NO: 142173 - DNA, 23 bp, Homo sapiens
tatgtgtatatatacatatgtaa

SEQ ID NO: 142174 - DNA, 23 bp, Homo sapiens
aattgagtgtgtgcacagagtga

SEQ ID NO: 142175 - DNA, 23 bp, Homo sapiens
cagactgtcacactgagagggcc

SEQ ID NO: 142176 - DNA, 23 bp, Homo sapiens
gtgtctcccactggctgtctgac

SEQ ID NO: 142177 - DNA, 18 bp, Homo sapiens
tcatgaactacagggtga

SEQ ID NO: 142178 - DNA, 23 bp, Homo sapiens
ccgtgactgtcactgtgtcatcc

SEQ ID NO: 142179 - DNA, 23 bp, Homo sapiens
tatatgtgggtgtatatgtatat

SEQ ID NO: 142180 - DNA, 19 bp, Homo sapiens
ttcactctgatgttcactg

SEQ ID NO: 142181 - DNA, 22 bp, Homo sapiens
gttttcatcttacacttcagct

SEQ ID NO: 142182 - DNA, 21 bp, Homo sapiens
taatgagactcggtctctaca

SEQ ID NO: 142183 - DNA, 23 bp, Homo sapiens
tgagacggagtctcactctgtca

SEQ ID NO: 142184 - DNA, 18 bp, Homo sapiens
gtgtatatatatacacat

SEQ ID NO: 142185 - DNA, 23 bp, Homo sapiens
catagtgagactcggtctctaca

SEQ ID NO: 142186 - DNA, 23 bp, Homo sapiens
tttgagacggagtctcactctgt

SEQ ID NO: 142187 - DNA, 23 bp, Homo sapiens
aaggtgaaagtggacttcactct

SEQ ID NO: 142188 - DNA, 20 bp, Homo sapiens
tggagtctcgctctgtcgct

SEQ ID NO: 142189 - DNA, 23 bp, Homo sapiens
agtggagtgatcttggctcactg

SEQ ID NO: 142190 - DNA, 23 bp, Homo sapiens
tttgttgatatgaacataatgca

SEQ ID NO: 142191 - DNA, 23 bp, Homo sapiens
cagggtctcactctgtcgcccag

SEQ ID NO: 142192 - DNA, 18 bp, Homo sapiens
tacagcaccaaactcctg

SEQ ID NO: 142193 - DNA, 20 bp, Homo sapiens
tggaggagccatgtgtctag

SEQ ID NO: 142194 - DNA, 23 bp, Homo sapiens
gacagagtctcgctctgtctccc

SEQ ID NO: 142195 - DNA, 21 bp, Homo sapiens
tttgaactatttctgagcaca

SEQ ID NO: 142196 - DNA, 21 bp, Homo sapiens
tgtgatgaaggagggagataa

SEQ ID NO: 142197 - DNA, 22 bp, Homo sapiens
tatatcaaattctttttgtttc

SEQ ID NO: 142198 - DNA, 23 bp, Homo sapiens
tggaccaagtgttgccacagaaa

SEQ ID NO: 142199 - DNA, 23 bp, Homo sapiens
tgaaatagtcacaggtatacagc

SEQ ID NO: 142200 - DNA, 21 bp, Homo sapiens
atgtgtatatatatatatgtg

SEQ ID NO: 142201 - DNA, 23 bp, Homo sapiens
ttcacactagatgtaagtgggtc

SEQ ID NO: 142202 - DNA, 23 bp, Homo sapiens
atgtgtgtgtatatatatacata

SEQ ID NO: 142203 - DNA, 23 bp, Homo sapiens
cattgaaagtgtgttgttagccc

SEQ ID NO: 142204 - DNA, 23 bp, Homo sapiens
atatatgtgtgcatatcgtatat

SEQ ID NO: 142205 - DNA, 23 bp, Homo sapiens
ttttttggttccatatgaaattt

SEQ ID NO: 142206 - DNA, 23 bp, Homo sapiens
tacatttgtagatgttttatctt

SEQ ID NO: 142207 - DNA, 22 bp, Homo sapiens
attgcccaccatttcttttttt

SEQ ID NO: 142208 - DNA, 22 bp, Homo sapiens
aggtttgtcacataagtgaaca

SEQ ID NO: 142209 - DNA, 23 bp, Homo sapiens
aatttttgttgttgtaatctcat

SEQ ID NO: 142210 - DNA, 22 bp, Homo sapiens
agagtctcgctctgtcacccag

SEQ ID NO: 142211 - DNA, 22 bp, Homo sapiens
attgtgagactgcagaaagttg

SEQ ID NO: 142212 - DNA, 23 bp, Homo sapiens
ctgtgtgaatcctggttctgctt

SEQ ID NO: 142213 - DNA, 19 bp, Homo sapiens
tgtaaagtattgatcctgg

SEQ ID NO: 142214 - DNA, 19 bp, Homo sapiens
ctaatcttgtgttgcaggt

SEQ ID NO: 142215 - DNA, 21 bp, Homo sapiens
tttttcattttgaaaatgtct

SEQ ID NO: 142216 - DNA, 23 bp, Homo sapiens
tatatatgtgtatgtgtatatgt

SEQ ID NO: 142217 - DNA, 23 bp, Homo sapiens
tttttctcctttttaatgctgat

SEQ ID NO: 142218 - DNA, 23 bp, Homo sapiens
actgagtctcactctgtcgccca

SEQ ID NO: 142219 - DNA, 20 bp, Homo sapiens
tgcagtggcatgaacaagac

SEQ ID NO: 142220 - DNA, 19 bp, Homo sapiens
tcagtcactagcaatgtga

SEQ ID NO: 142221 - DNA, 23 bp, Homo sapiens
tgtaatcactatgcatatgatat

SEQ ID NO: 142222 - DNA, 23 bp, Homo sapiens
gaactactacagattgctttgtc

SEQ ID NO: 142223 - DNA, 22 bp, Homo sapiens
tgggctctgctacttattacct

SEQ ID NO: 142224 - DNA, 19 bp, Homo sapiens
tgtgatgaggatcagatga

SEQ ID NO: 142225 - DNA, 23 bp, Homo sapiens
tctcagagagccctttatttatg

SEQ ID NO: 142226 - DNA, 22 bp, Homo sapiens
acatacacacacatatacatat

SEQ ID NO: 142227 - DNA, 23 bp, Homo sapiens
tgagttcattgtagattctggat

SEQ ID NO: 142228 - DNA, 23 bp, Homo sapiens
tgagttcattgtagattctggat

SEQ ID NO: 142229 - DNA, 20 bp, Homo sapiens
atttcacaggttttggtagg

SEQ ID NO: 142230 - DNA, 23 bp, Homo sapiens
taagtgtttgcataagttttgat

SEQ ID NO: 142231 - DNA, 23 bp, Homo sapiens
atttgtgcttaatttgtagtagc

SEQ ID NO: 142232 - DNA, 19 bp, Homo sapiens
gtctatagtttcaggcctg

SEQ ID NO: 142233 - DNA, 23 bp, Homo sapiens
aagtactgcctggaaatgttgtg

SEQ ID NO: 142234 - DNA, 19 bp, Homo sapiens
atatgtatacatacataca

SEQ ID NO: 142235 - DNA, 23 bp, Homo sapiens
tatgtgtatatgtgtgtgtatat

SEQ ID NO: 142236 - DNA, 19 bp, Homo sapiens
tgtatacatgtatacccat

SEQ ID NO: 142237 - DNA, 23 bp, Homo sapiens
tcagagtctcactgtcacccagg

SEQ ID NO: 142238 - DNA, 20 bp, Homo sapiens
tgcagtggcacaatcttgac

SEQ ID NO: 142239 - DNA, 19 bp, Homo sapiens
ttgattttgtatcctgtga

SEQ ID NO: 142240 - DNA, 22 bp, Homo sapiens
attctccctggctatgttatgt

SEQ ID NO: 142241 - DNA, 23 bp, Homo sapiens
ctgagagacaggactagctggat

SEQ ID NO: 142242 - DNA, 23 bp, Homo sapiens
aggactttgcttcctctttctgg

SEQ ID NO: 142243 - DNA, 18 bp, Homo sapiens
atgtgtatatatatacgt

SEQ ID NO: 142244 - DNA, 18 bp, Homo sapiens
gtgtatatatatacacat

SEQ ID NO: 142245 - DNA, 21 bp, Homo sapiens
tatgtgtatatatatacgtgt

SEQ ID NO: 142246 - DNA, 23 bp, Homo sapiens
tgtaaacttcttagtctgagaat

SEQ ID NO: 142247 - DNA, 23 bp, Homo sapiens
atgttgcctggaacttgctctca

SEQ ID NO: 142248 - DNA, 18 bp, Homo sapiens
cagatgtgcatgttaggt

SEQ ID NO: 142249 - DNA, 23 bp, Homo sapiens
tctcatttagtctctcctagatc

SEQ ID NO: 142250 - DNA, 23 bp, Homo sapiens
ttttagcttctacatataagtga

SEQ ID NO: 142251 - DNA, 23 bp, Homo sapiens
tccctctgagggtgtgttctctg

SEQ ID NO: 142252 - DNA, 19 bp, Homo sapiens
acacttgagttttagttca

SEQ ID NO: 142253 - DNA, 22 bp, Homo sapiens
ttaagttgtagcttgttttgta

SEQ ID NO: 142254 - DNA, 22 bp, Homo sapiens
tacagatgtgtgcatatatgtg

SEQ ID NO: 142255 - DNA, 23 bp, Homo sapiens
actgcatatatatatatgtgtgt

SEQ ID NO: 142256 - DNA, 23 bp, Homo sapiens
tatatgtccatatatatgtgtgt

SEQ ID NO: 142257 - DNA, 21 bp, Homo sapiens
tatatatgtccatgtatatat

SEQ ID NO: 142258 - DNA, 20 bp, Homo sapiens
tatgtccatatatatgtgta

SEQ ID NO: 142259 - DNA, 22 bp, Homo sapiens
atatgtccatatatatgtgtgt

SEQ ID NO: 142260 - DNA, 22 bp, Homo sapiens
acacacacacacatatatgtat

SEQ ID NO: 142261 - DNA, 23 bp, Homo sapiens
atacatatatgtgtgtgtgtgtg

SEQ ID NO: 142262 - DNA, 21 bp, Homo sapiens
aagcaagttcatccattctct

SEQ ID NO: 142263 - DNA, 21 bp, Homo sapiens
tatgaatgaggcattgttctg

SEQ ID NO: 142264 - DNA, 20 bp, Homo sapiens
ccctaactctttgaatgcgg

SEQ ID NO: 142265 - DNA, 23 bp, Homo sapiens
aagtgactgaggtgacagagctg

SEQ ID NO: 142266 - DNA, 22 bp, Homo sapiens
atatgtatatgtatacacatac

SEQ ID NO: 142267 - DNA, 19 bp, Homo sapiens
atatgtgtgtgtatatata

SEQ ID NO: 142268 - DNA, 22 bp, Homo sapiens
tgtggtagtaggaagaattttt

SEQ ID NO: 142269 - DNA, 23 bp, Homo sapiens
tttgatgtgactatcgtgattgt

SEQ ID NO: 142270 - DNA, 21 bp, Homo sapiens
aaggttgttgtgagctatgat

SEQ ID NO: 142271 - DNA, 23 bp, Homo sapiens
agtgtctgtctctcaatatgtcc

SEQ ID NO: 142272 - DNA, 23 bp, Homo sapiens
tatgtatatatgtatatctataa

SEQ ID NO: 142273 - DNA, 23 bp, Homo sapiens
cagagtctctcactctgttgtcc

SEQ ID NO: 142274 - DNA, 23 bp, Homo sapiens
tatcatctgtctatctattgtta

SEQ ID NO: 142275 - DNA, 21 bp, Homo sapiens
tatatgtatatgtatatgtat

SEQ ID NO: 142276 - DNA, 23 bp, Homo sapiens
tggagtctcactctgtcactcag

SEQ ID NO: 142277 - DNA, 23 bp, Homo sapiens
gggtctcactctgtcacttaggc

SEQ ID NO: 142278 - DNA, 18 bp, Homo sapiens
tcagtggtgggatctcag

SEQ ID NO: 142279 - DNA, 21 bp, Homo sapiens
agtgagtcataatctttttgc

SEQ ID NO: 142280 - DNA, 21 bp, Homo sapiens
tgactgatcagagtgtggctg

SEQ ID NO: 142281 - DNA, 23 bp, Homo sapiens
agagtctcactctgtcacccagg

SEQ ID NO: 142282 - DNA, 23 bp, Homo sapiens
acagggtctcactcactctgttg

SEQ ID NO: 142283 - DNA, 23 bp, Homo sapiens
caattctctgagatagctaattg

SEQ ID NO: 142284 - DNA, 23 bp, Homo sapiens
tgagtcagagtctcactctgtca

SEQ ID NO: 142285 - DNA, 22 bp, Homo sapiens
taagatgactgtggaaccccaa

SEQ ID NO: 142286 - DNA, 23 bp, Homo sapiens
tgtgtggctctctgtgtggctct

SEQ ID NO: 142287 - DNA, 23 bp, Homo sapiens
ttttggttccgtatgaattcttt

SEQ ID NO: 142288 - DNA, 23 bp, Homo sapiens
agacggagtctcactctgtctcc

SEQ ID NO: 142289 - DNA, 23 bp, Homo sapiens
tgtgtgtatatatgtatatgtgt

SEQ ID NO: 142290 - DNA, 22 bp, Homo sapiens
agaggcagtatgtataatggta

SEQ ID NO: 142291 - DNA, 18 bp, Homo sapiens
tatatactgtacttttgt

SEQ ID NO: 142292 - DNA, 23 bp, Homo sapiens
atatgtatatatgtaggtcaagt

SEQ ID NO: 142293 - DNA, 23 bp, Homo sapiens
acaaggtctcactctgtcaccca

SEQ ID NO: 142294 - DNA, 21 bp, Homo sapiens
gacactgcaacatcatttatg

SEQ ID NO: 142295 - DNA, 23 bp, Homo sapiens
tcagctagactcagacactcact

SEQ ID NO: 142296 - DNA, 23 bp, Homo sapiens
gacagagtctcgctctgtcaccc

SEQ ID NO: 142297 - DNA, 23 bp, Homo sapiens
acagagtctcgctctgtcaccca

SEQ ID NO: 142298 - DNA, 23 bp, Homo sapiens
tccatttttagtagagacggggt

SEQ ID NO: 142299 - DNA, 23 bp, Homo sapiens
agacttcagtaaggatttgttga

SEQ ID NO: 142300 - DNA, 23 bp, Homo sapiens
gcaaacacagtcagcaatactgt

SEQ ID NO: 142301 - DNA, 22 bp, Homo sapiens
ataattactggagcttttttat

SEQ ID NO: 142302 - DNA, 23 bp, Homo sapiens
agtctcgctctctcgctccgtca

SEQ ID NO: 142303 - DNA, 23 bp, Homo sapiens
gggtctcactctgtcacccaggc

SEQ ID NO: 142304 - DNA, 20 bp, Homo sapiens
ggtaagaatagaagtaggaa

SEQ ID NO: 142305 - DNA, 23 bp, Homo sapiens
tctgtcactgtctctcatcaccc

SEQ ID NO: 142306 - DNA, 23 bp, Homo sapiens
tgattttctcttgagattatgtt

SEQ ID NO: 142307 - DNA, 23 bp, Homo sapiens
acaattgacattgtgaatgttgt

SEQ ID NO: 142308 - DNA, 19 bp, Homo sapiens
catgtgcatataaatctat

SEQ ID NO: 142309 - DNA, 23 bp, Homo sapiens
atagtcctaatacacttgggagt

SEQ ID NO: 142310 - DNA, 22 bp, Homo sapiens
atcagcattgaagagggcaatc

SEQ ID NO: 142311 - DNA, 23 bp, Homo sapiens
atacacacagatgtatttgtgtg

SEQ ID NO: 142312 - DNA, 23 bp, Homo sapiens
atatgtgtacatatcaaatgcat

SEQ ID NO: 142313 - DNA, 23 bp, Homo sapiens
tgagttcattgtagattctggat

SEQ ID NO: 142314 - DNA, 23 bp, Homo sapiens
tgagttcattgtagattctggat

SEQ ID NO: 142315 - DNA, 23 bp, Homo sapiens
gcctgacactctgttttggaaga

SEQ ID NO: 142316 - DNA, 23 bp, Homo sapiens
ttgagtgtttcttcttgtgtgag

SEQ ID NO: 142317 - DNA, 19 bp, Homo sapiens
cacccacacacacacacac

SEQ ID NO: 142318 - DNA, 21 bp, Homo sapiens
gagttcactgtaacttgtttg

SEQ ID NO: 142319 - DNA, 23 bp, Homo sapiens
agtcttttcatcataatctgcac

SEQ ID NO: 142320 - DNA, 22 bp, Homo sapiens
tactctcatcttccttcagtca

SEQ ID NO: 142321 - DNA, 23 bp, Homo sapiens
agaattactgtgagtttacctta

SEQ ID NO: 142322 - DNA, 23 bp, Homo sapiens
tgaggagcactaaaatagtctct

SEQ ID NO: 142323 - DNA, 23 bp, Homo sapiens
cggagtctcactctgtcacccag

SEQ ID NO: 142324 - DNA, 22 bp, Homo sapiens
atctgtatatatatgtgtgtgt

SEQ ID NO: 142325 - DNA, 23 bp, Homo sapiens
tgtgtgtatatatgtatatgtgt

SEQ ID NO: 142326 - DNA, 22 bp, Homo sapiens
tatgtgtatatatgtatatatg

SEQ ID NO: 142327 - DNA, 22 bp, Homo sapiens
tgtgcgtatatgtatatatgtg

SEQ ID NO: 142328 - DNA, 19 bp, Homo sapiens
agagcaaacattaaagggg

SEQ ID NO: 142329 - DNA, 23 bp, Homo sapiens
atgaaagtgtatatgtatgtgta

SEQ ID NO: 142330 - DNA, 20 bp, Homo sapiens
ctccggtcactacaagctct

SEQ ID NO: 142331 - DNA, 23 bp, Homo sapiens
acagagtctcactgtgtcgccca

SEQ ID NO: 142332 - DNA, 20 bp, Homo sapiens
aatgacacacctgtcagccc

SEQ ID NO: 142333 - DNA, 19 bp, Homo sapiens
agtgagctgtgattgcact

SEQ ID NO: 142334 - DNA, 23 bp, Homo sapiens
gtgtgtgtctgtgtgtctgcgtg

SEQ ID NO: 142335 - DNA, 23 bp, Homo sapiens
tcagtggtagcttgatggggata

SEQ ID NO: 142336 - DNA, 19 bp, Homo sapiens
tataggtagagtttaagtt

SEQ ID NO: 142337 - DNA, 19 bp, Homo sapiens
atgatcatgccactgcact

SEQ ID NO: 142338 - DNA, 20 bp, Homo sapiens
acagagtctctccgtcactc

SEQ ID NO: 142339 - DNA, 23 bp, Homo sapiens
gagtctcactctgtcactgaagc

SEQ ID NO: 142340 - DNA, 21 bp, Homo sapiens
tatatgtgtgtgcatatatat

SEQ ID NO: 142341 - DNA, 23 bp, Homo sapiens
agagcatgttttaggtactctat

SEQ ID NO: 142342 - DNA, 21 bp, Homo sapiens
taggcctggcactggtggctc

SEQ ID NO: 142343 - DNA, 23 bp, Homo sapiens
acagagtctcactctgtcgccca

SEQ ID NO: 142344 - DNA, 20 bp, Homo sapiens
agagtggtacgattttggct

SEQ ID NO: 142345 - DNA, 23 bp, Homo sapiens
acagagtctcactctgtcgccca

SEQ ID NO: 142346 - DNA, 23 bp, Homo sapiens
tggagtctcactctgtcacccag

SEQ ID NO: 142347 - DNA, 20 bp, Homo sapiens
tctttccagtaccacagttc

SEQ ID NO: 142348 - DNA, 20 bp, Homo sapiens
tcagctaagagtactctgtc

SEQ ID NO: 142349 - DNA, 23 bp, Homo sapiens
agacagagtctcgctctgtcacc

SEQ ID NO: 142350 - DNA, 23 bp, Homo sapiens
ttaatgtgattatattgatctgt

SEQ ID NO: 142351 - DNA, 20 bp, Homo sapiens
tctcttaaaatatgtgtgtg

SEQ ID NO: 142352 - DNA, 23 bp, Homo sapiens
gacagagtctcactctgtgcccc

SEQ ID NO: 142353 - DNA, 23 bp, Homo sapiens
tcagagtgaatagactgtggtct

SEQ ID NO: 142354 - DNA, 21 bp, Homo sapiens
agaggaacctgctttgagtgt

SEQ ID NO: 142355 - DNA, 23 bp, Homo sapiens
ccgcctctcactgcctgtctgtg

SEQ ID NO: 142356 - DNA, 22 bp, Homo sapiens
acagcagagagtgagatcagag

SEQ ID NO: 142357 - DNA, 23 bp, Homo sapiens
agatcagatattgtagatgtgtg

SEQ ID NO: 142358 - DNA, 22 bp, Homo sapiens
ctgtcactccctctgtctgcct

SEQ ID NO: 142359 - DNA, 19 bp, Homo sapiens
actgctcagactcctcttg

SEQ ID NO: 142360 - DNA, 22 bp, Homo sapiens
tcagagaggttaagcagcttgc

SEQ ID NO: 142361 - DNA, 23 bp, Homo sapiens
agtgtgtgccaggcaccctgtta

SEQ ID NO: 142362 - DNA, 23 bp, Homo sapiens
ttcattcaccaacagttttatga

SEQ ID NO: 142363 - DNA, 23 bp, Homo sapiens
agatggagtctctgtctgtcacc

SEQ ID NO: 142364 - DNA, 23 bp, Homo sapiens
tctgtgtgtctgtgaattaggac

SEQ ID NO: 142365 - DNA, 23 bp, Homo sapiens
agagtctcactctgtcacccagg

SEQ ID NO: 142366 - DNA, 22 bp, Homo sapiens
tgaggcagaggaaaagagcact

SEQ ID NO: 142367 - DNA, 22 bp, Homo sapiens
gcgtgcctgcctgcctgcctct

SEQ ID NO: 142368 - DNA, 19 bp, Homo sapiens
ttcgcaatcttgtttgcag

SEQ ID NO: 142369 - DNA, 23 bp, Homo sapiens
cagcctctctgtgcctcagtttc

SEQ ID NO: 142370 - DNA, 23 bp, Homo sapiens
ctcagggtctctggctctctcag

SEQ ID NO: 142371 - DNA, 23 bp, Homo sapiens
attctgtgttgtgtatgtgagca

SEQ ID NO: 142372 - DNA, 23 bp, Homo sapiens
tctctgtatatgtctgtgtgtgt

SEQ ID NO: 142373 - DNA, 23 bp, Homo sapiens
tcacagtctcatctgcgactgat

SEQ ID NO: 142374 - DNA, 20 bp, Homo sapiens
acagtgcctgacatcttgcg

SEQ ID NO: 142375 - DNA, 21 bp, Homo sapiens
gttattgccacagttatccaa

SEQ ID NO: 142376 - DNA, 23 bp, Homo sapiens
gtctggctgtctgtctgtatgtc

SEQ ID NO: 142377 - DNA, 23 bp, Homo sapiens
gcaagtgcaagtatatgtgagtg

SEQ ID NO: 142378 - DNA, 23 bp, Homo sapiens
atgtgagagtgcatgaatctgtg

SEQ ID NO: 142379 - DNA, 20 bp, Homo sapiens
aacacagacagcacagcgcg

SEQ ID NO: 142380 - DNA, 20 bp, Homo sapiens
ctagtcacaccctctgtggg

SEQ ID NO: 142381 - DNA, 22 bp, Homo sapiens
aactgtttttcattttctgagt

SEQ ID NO: 142382 - DNA, 23 bp, Homo sapiens
ttctctgtcactcagtgatgggg

SEQ ID NO: 142383 - DNA, 23 bp, Homo sapiens
tgggacagagtctcgctctgtca

SEQ ID NO: 142384 - DNA, 23 bp, Homo sapiens
gtcagcctgtctgtctgcctgcc

SEQ ID NO: 142385 - DNA, 23 bp, Homo sapiens
tctgtccctctgagcctccctct

SEQ ID NO: 142386 - DNA, 23 bp, Homo sapiens
cagggtctcactctgtcacccag

SEQ ID NO: 142387 - DNA, 20 bp, Homo sapiens
gcaatggtgtgatcttggct

SEQ ID NO: 142388 - DNA, 23 bp, Homo sapiens
ctgacagagaaaggtgtccagga

SEQ ID NO: 142389 - DNA, 23 bp, Homo sapiens
cggagtctcactctgtcacccag

SEQ ID NO: 142390 - DNA, 19 bp, Homo sapiens
tgactgtaatcccagcact

SEQ ID NO: 142391 - DNA, 20 bp, Homo sapiens
tgaggtagttggattattag

SEQ ID NO: 142392 - DNA, 23 bp, Homo sapiens
gacagagtctcgctctgtcaccc

SEQ ID NO: 142393 - DNA, 23 bp, Homo sapiens
ggagtgtcactcactctgtcgcc

SEQ ID NO: 142394 - DNA, 23 bp, Homo sapiens
aacacagtgaggagactgtctcc

SEQ ID NO: 142395 - DNA, 23 bp, Homo sapiens
tgctctctgcagtctctgtctcc

SEQ ID NO: 142396 - DNA, 21 bp, Homo sapiens
tgagacagagtctcactctgt

SEQ ID NO: 142397 - DNA, 23 bp, Homo sapiens
ctgtcctgagtagtatggtgaga

SEQ ID NO: 142398 - DNA, 23 bp, Homo sapiens
tcacaccatcctacactctccca

SEQ ID NO: 142399 - DNA, 19 bp, Homo sapiens
atacagagaattgtggttg

SEQ ID NO: 142400 - DNA, 23 bp, Homo sapiens
gggtctcactctgtcacccaggc

SEQ ID NO: 142401 - DNA, 23 bp, Homo sapiens
ttgtggttttgatttgcatttct

SEQ ID NO: 142402 - DNA, 23 bp, Homo sapiens
atggagtctcactctgtctccca

SEQ ID NO: 142403 - DNA, 23 bp, Homo sapiens
atcacaatttgtttatctgttga

SEQ ID NO: 142404 - DNA, 23 bp, Homo sapiens
tgttctctgtcactgagaacgga

SEQ ID NO: 142405 - DNA, 21 bp, Homo sapiens
tctgagggcaaagagtatccg

SEQ ID NO: 142406 - DNA, 23 bp, Homo sapiens
aaggacagacttgtttggtagac

SEQ ID NO: 142407 - DNA, 23 bp, Homo sapiens
ctaaactgacaaaacagtttctg

SEQ ID NO: 142408 - DNA, 18 bp, Homo sapiens
atatggatgtacgtgtgt

SEQ ID NO: 142409 - DNA, 20 bp, Homo sapiens
tacatgcacacatagataca

SEQ ID NO: 142410 - DNA, 23 bp, Homo sapiens
agagtctcactctgtcacccagg

SEQ ID NO: 142411 - DNA, 23 bp, Homo sapiens
gagtctcactctgtcacccaggc

SEQ ID NO: 142412 - DNA, 23 bp, Homo sapiens
tgggaagtttctaaggagaagga

SEQ ID NO: 142413 - DNA, 21 bp, Homo sapiens
tgagacagagtctcgctctgt

SEQ ID NO: 142414 - DNA, 22 bp, Homo sapiens
accagacccagctaacttttta

SEQ ID NO: 142415 - DNA, 19 bp, Homo sapiens
agtctcccactgtcaccca

SEQ ID NO: 142416 - DNA, 21 bp, Homo sapiens
tggtgtgatctctgctgactg

SEQ ID NO: 142417 - DNA, 22 bp, Homo sapiens
tgccagtcacgattcttggatg

SEQ ID NO: 142418 - DNA, 23 bp, Homo sapiens
tcttgtgctgtttttgtagttca

SEQ ID NO: 142419 - DNA, 23 bp, Homo sapiens
tatatagataacatatgtattgt

SEQ ID NO: 142420 - DNA, 23 bp, Homo sapiens
atatacatgtgtttagttgagaa

SEQ ID NO: 142421 - DNA, 21 bp, Homo sapiens
tttgaacactgtgattctgct

SEQ ID NO: 142422 - DNA, 23 bp, Homo sapiens
gaaggatcacttgagcccagagt

SEQ ID NO: 142423 - DNA, 22 bp, Homo sapiens
tgggcaacatagtgagactcta

SEQ ID NO: 142424 - DNA, 23 bp, Homo sapiens
agagtgtagtgagtgagcatttg

SEQ ID NO: 142425 - DNA, 21 bp, Homo sapiens
tgaggtagtaggctcacttga

SEQ ID NO: 142426 - DNA, 21 bp, Homo sapiens
tgagtcagtctctctaagacc

SEQ ID NO: 142427 - DNA, 23 bp, Homo sapiens
tcccacagactgtctgagaggct

SEQ ID NO: 142428 - DNA, 23 bp, Homo sapiens
tgtgggatgatgagctgagagga

SEQ ID NO: 142429 - DNA, 22 bp, Homo sapiens
acactgagtgtctaagttgtgt

SEQ ID NO: 142430 - DNA, 22 bp, Homo sapiens
tagtttagctgggtatagaatt

SEQ ID NO: 142431 - DNA, 23 bp, Homo sapiens
ctatgactggcattgatgtggtt

SEQ ID NO: 142432 - DNA, 20 bp, Homo sapiens
ggtctctcttagtctctctc

SEQ ID NO: 142433 - DNA, 19 bp, Homo sapiens
atgtacatagatatataga

SEQ ID NO: 142434 - DNA, 21 bp, Homo sapiens
gagtgtgtgtgtgtgtgtgcg

SEQ ID NO: 142435 - DNA, 19 bp, Homo sapiens
tgtgtgcatgtgcatgcat

SEQ ID NO: 142436 - DNA, 23 bp, Homo sapiens
ccctctcagtgagtgactccctg

SEQ ID NO: 142437 - DNA, 23 bp, Homo sapiens
tctgccatgcttttctgaatctt

SEQ ID NO: 142438 - DNA, 18 bp, Homo sapiens
tgactgaagtttgagacc

SEQ ID NO: 142439 - DNA, 23 bp, Homo sapiens
tggattgtttttgaaaggggaat

SEQ ID NO: 142440 - DNA, 23 bp, Homo sapiens
atagcaagtttagagattaagat

SEQ ID NO: 142441 - DNA, 23 bp, Homo sapiens
gatgagcactttttgttcttaaa

SEQ ID NO: 142442 - DNA, 23 bp, Homo sapiens
tgagttcattgtagattctggat

SEQ ID NO: 142443 - DNA, 23 bp, Homo sapiens
tgagttcattgtagattctggat

SEQ ID NO: 142444 - DNA, 23 bp, Homo sapiens
cggagtctcactctgtcacccag

SEQ ID NO: 142445 - DNA, 23 bp, Homo sapiens
agagtctcacactgtcaccccgg

SEQ ID NO: 142446 - DNA, 23 bp, Homo sapiens
tatacatacacaagcatatgtcg

SEQ ID NO: 142447 - DNA, 18 bp, Homo sapiens
gttagtgaatgattaagg

SEQ ID NO: 142448 - DNA, 23 bp, Homo sapiens
tcagcagtgtctgtctgactggg

SEQ ID NO: 142449 - DNA, 23 bp, Homo sapiens
tcctgtaatctctgagtgttttg

SEQ ID NO: 142450 - DNA, 18 bp, Homo sapiens
aagttttagatgttgcac

SEQ ID NO: 142451 - DNA, 19 bp, Homo sapiens
tgtgtgtatgtgtgtgtat

SEQ ID NO: 142452 - DNA, 23 bp, Homo sapiens
cagggtgactctgtgcctctgaa

SEQ ID NO: 142453 - DNA, 23 bp, Homo sapiens
ctctgattctctgtgactctgtg

SEQ ID NO: 142454 - DNA, 21 bp, Homo sapiens
aaaccacaggtgctgcagacc

SEQ ID NO: 142455 - DNA, 18 bp, Homo sapiens
cagtgaagcctgtgccac

SEQ ID NO: 142456 - DNA, 23 bp, Homo sapiens
tacgtttgctaaaatattcacct

SEQ ID NO: 142457 - DNA, 19 bp, Homo sapiens
tgtgtgtgtgtgtatatac

SEQ ID NO: 142458 - DNA, 20 bp, Homo sapiens
atgagtatatatatgtatgt

SEQ ID NO: 142459 - DNA, 22 bp, Homo sapiens
ttggtccatgttaactgtctga

SEQ ID NO: 142460 - DNA, 23 bp, Homo sapiens
ccgagcaagactctgtctcaaaa

SEQ ID NO: 142461 - DNA, 23 bp, Homo sapiens
gggggtctctctctgtcacccag

SEQ ID NO: 142462 - DNA, 22 bp, Homo sapiens
ctctgagagtctgagagcctgt

SEQ ID NO: 142463 - DNA, 18 bp, Homo sapiens
tgtgtgtgggattgctgt

SEQ ID NO: 142464 - DNA, 21 bp, Homo sapiens
acaccagctctgtctctcact

SEQ ID NO: 142465 - DNA, 23 bp, Homo sapiens
aggctgagtggtctcccaggtct

SEQ ID NO: 142466 - DNA, 23 bp, Homo sapiens
tcaccggctctgtctctctgctc

SEQ ID NO: 142467 - DNA, 22 bp, Homo sapiens
ttattgcatctgctaggactct

SEQ ID NO: 142468 - DNA, 23 bp, Homo sapiens
ttgtcaatttgtagatcacttac

SEQ ID NO: 142469 - DNA, 18 bp, Homo sapiens
acagttcatgatgaggca

SEQ ID NO: 142470 - DNA, 19 bp, Homo sapiens
agtcatggtcactcagtca

SEQ ID NO: 142471 - DNA, 23 bp, Homo sapiens
ccgcctgcctgccagcctctctg

SEQ ID NO: 142472 - DNA, 23 bp, Homo sapiens
tttcctcctgtagctgggtgcct

SEQ ID NO: 142473 - DNA, 23 bp, Homo sapiens
ctgcctgtctctgggcctcagtt

SEQ ID NO: 142474 - DNA, 23 bp, Homo sapiens
ctgtctcaccctccctgtctgtg

SEQ ID NO: 142475 - DNA, 23 bp, Homo sapiens
tgtctgccagcctctgagcctct

SEQ ID NO: 142476 - DNA, 19 bp, Homo sapiens
cagatgtgtgagtgactgg

SEQ ID NO: 142477 - DNA, 23 bp, Homo sapiens
gcctgcctctgtctgtccctgtc

SEQ ID NO: 142478 - DNA, 23 bp, Homo sapiens
ggcacatctaggcagtttctgac

SEQ ID NO: 142479 - DNA, 23 bp, Homo sapiens
ctgtgtctgtctgtctgtctgca

SEQ ID NO: 142480 - DNA, 23 bp, Homo sapiens
tgcctctctctgtcattatgctt

SEQ ID NO: 142481 - DNA, 23 bp, Homo sapiens
agagtgccagagaatctccactg

SEQ ID NO: 142482 - DNA, 21 bp, Homo sapiens
tgagtcctgacagagcacagt

SEQ ID NO: 142483 - DNA, 19 bp, Homo sapiens
taagaagtgagagtggaga

SEQ ID NO: 142484 - DNA, 23 bp, Homo sapiens
ggcagagtctctcgctctgtcac

SEQ ID NO: 142485 - DNA, 22 bp, Homo sapiens
agagtagtgagtgagttctcta

SEQ ID NO: 142486 - DNA, 23 bp, Homo sapiens
tgtgcctctgtgtctctgtgctt

SEQ ID NO: 142487 - DNA, 23 bp, Homo sapiens
tgcctctctctgtcattatgctt

SEQ ID NO: 142488 - DNA, 23 bp, Homo sapiens
agagtgccagagaatctccactg

SEQ ID NO: 142489 - DNA, 21 bp, Homo sapiens
tgagtcctgacagagcacagt

SEQ ID NO: 142490 - DNA, 19 bp, Homo sapiens
taagaagtgagagtggaga

SEQ ID NO: 142491 - DNA, 23 bp, Homo sapiens
ggcagagtctctcgctctgtcac

SEQ ID NO: 142492 - DNA, 22 bp, Homo sapiens
agagtagtgagtgagttctcta

SEQ ID NO: 142493 - DNA, 23 bp, Homo sapiens
aggtagtcagtcattctcagtca

SEQ ID NO: 142494 - DNA, 21 bp, Homo sapiens
tgtgtctctctctaagtggtg

SEQ ID NO: 142495 - DNA, 23 bp, Homo sapiens
agagtctcactctgtcacccagg

SEQ ID NO: 142496 - DNA, 23 bp, Homo sapiens
agagtctcactctgtcacccagg

SEQ ID NO: 142497 - DNA, 23 bp, Homo sapiens
gagtctcactctgtcacccaggc

SEQ ID NO: 142498 - DNA, 21 bp, Homo sapiens
tgtgtgcttgtgtgcatatct

SEQ ID NO: 142499 - DNA, 23 bp, Homo sapiens
tctgtgtgtgttctctgtgtgta

SEQ ID NO: 142500 - DNA, 19 bp, Homo sapiens
tagttaagtctggaattag

SEQ ID NO: 142501 - DNA, 23 bp, Homo sapiens
tgagttcattgtagattctggat

SEQ ID NO: 142502 - DNA, 23 bp, Homo sapiens
tgagttcattgtagattctggat

SEQ ID NO: 142503 - DNA, 20 bp, Homo sapiens
atgcaacatatatatgcagt

SEQ ID NO: 142504 - DNA, 23 bp, Homo sapiens
tgagttcattgtagattctggat

SEQ ID NO: 142505 - DNA, 23 bp, Homo sapiens
tgagttcattgtagattctggat

SEQ ID NO: 142506 - DNA, 21 bp, Homo sapiens
tgtgaagaaagacaatggtag

SEQ ID NO: 142507 - DNA, 23 bp, Homo sapiens
attaatgtgtttttcttatctaa

SEQ ID NO: 142508 - DNA, 22 bp, Homo sapiens
atcatggactatatatatatca

SEQ ID NO: 142509 - DNA, 22 bp, Homo sapiens
atcatggactatatatatatca

SEQ ID NO: 142510 - DNA, 22 bp, Homo sapiens
gagcctctgtgtgtctctgtat

SEQ ID NO: 142511 - DNA, 21 bp, Homo sapiens
acagcacactgatgggtcttg

SEQ ID NO: 142512 - DNA, 19 bp, Homo sapiens
gagaggtgacagtgtgctg

SEQ ID NO: 142513 - DNA, 23 bp, Homo sapiens
aatgcatatatatacgtatgtgt

SEQ ID NO: 142514 - DNA, 19 bp, Homo sapiens
ctcctcaacatttctgtga

SEQ ID NO: 142515 - DNA, 20 bp, Homo sapiens
ttcacagaagaaactgaggc

SEQ ID NO: 142516 - DNA, 21 bp, Homo sapiens
tgctctatttgtatagagaca

SEQ ID NO: 142517 - DNA, 23 bp, Homo sapiens
ttttagaggcaggaaaagatctt

SEQ ID NO: 142518 - DNA, 23 bp, Homo sapiens
ttgtcagatgaaatgttgctttc

SEQ ID NO: 142519 - DNA, 19 bp, Homo sapiens
aggaagtagggagctgtga

SEQ ID NO: 142520 - DNA, 22 bp, Homo sapiens
ctctccatttaatttgctgtgg

SEQ ID NO: 142521 - DNA, 23 bp, Homo sapiens
acctctgtgagtctcagtttatt

SEQ ID NO: 142522 - DNA, 22 bp, Homo sapiens
tcttttcatggaagtgtgtctg

SEQ ID NO: 142523 - DNA, 23 bp, Homo sapiens
agctctgctacttactaaccagc

SEQ ID NO: 142524 - DNA, 22 bp, Homo sapiens
ttgacttctcatttagttcatg

SEQ ID NO: 142525 - DNA, 23 bp, Homo sapiens
tgtcagtgtgtttggtacatgct

SEQ ID NO: 142526 - DNA, 23 bp, Homo sapiens
tgagttcattgtagattctggat

SEQ ID NO: 142527 - DNA, 23 bp, Homo sapiens
tgagttcattgtagattctggat

SEQ ID NO: 142528 - DNA, 23 bp, Homo sapiens
tgagttcattgtagattctggat

SEQ ID NO: 142529 - DNA, 23 bp, Homo sapiens
tgagttcattgtagattctggat

SEQ ID NO: 142530 - DNA, 23 bp, Homo sapiens
tgtagttctcagtggaagttctt

SEQ ID NO: 142531 - DNA, 23 bp, Homo sapiens
aagatcatgcaagtgtctcagta

SEQ ID NO: 142532 - DNA, 23 bp, Homo sapiens
cctctctgtctgtctcactttcc

SEQ ID NO: 142533 - DNA, 18 bp, Homo sapiens
agacaccctctgactctc

SEQ ID NO: 142534 - DNA, 20 bp, Homo sapiens
aggttgtatggtatagtcta

SEQ ID NO: 142535 - DNA, 23 bp, Homo sapiens
tgagttcattgtagattctggat

SEQ ID NO: 142536 - DNA, 23 bp, Homo sapiens
agcagcgaggatgaactagatga

SEQ ID NO: 142537 - DNA, 23 bp, Homo sapiens
ctctcactcactcaccttttcct

SEQ ID NO: 142538 - DNA, 21 bp, Homo sapiens
tatttgtacatgacatatgtt

SEQ ID NO: 142539 - DNA, 23 bp, Homo sapiens
gagtctcactctgtcactcaggc

SEQ ID NO: 142540 - DNA, 23 bp, Homo sapiens
tggagtctcactctgtcacccag

SEQ ID NO: 142541 - DNA, 23 bp, Homo sapiens
ttgaacttagtgctaggagtgag

SEQ ID NO: 142542 - DNA, 23 bp, Homo sapiens
atgtggtagttgcatatttagtt

SEQ ID NO: 142543 - DNA, 23 bp, Homo sapiens
tgagttcattgtagattctggat

SEQ ID NO: 142544 - DNA, 23 bp, Homo sapiens
tgagttcattgtagattctggat

SEQ ID NO: 142545 - DNA, 20 bp, Homo sapiens
tggtagtgtcttttttcttg

SEQ ID NO: 142546 - DNA, 20 bp, Homo sapiens
ctgtggctgtgaccccctca

SEQ ID NO: 142547 - DNA, 22 bp, Homo sapiens
atgtccttcttcacatggcgac

SEQ ID NO: 142548 - DNA, 18 bp, Homo sapiens
agttttcttctgttgcag

SEQ ID NO: 142549 - DNA, 23 bp, Homo sapiens
tgagttcattgtagattctggat

SEQ ID NO: 142550 - DNA, 23 bp, Homo sapiens
tgagttcattgtagattctggat

SEQ ID NO: 142551 - DNA, 23 bp, Homo sapiens
tcagtctgagtccatctgcattc

SEQ ID NO: 142552 - DNA, 23 bp, Homo sapiens
tcactgctcagtctgagtccatc

SEQ ID NO: 142553 - DNA, 23 bp, Homo sapiens
tatgactcttgatcttttgaggt

SEQ ID NO: 142554 - DNA, 20 bp, Homo sapiens
aagtactggcgattgttgag

SEQ ID NO: 142555 - DNA, 19 bp, Homo sapiens
aatacacatgtattcatct

SEQ ID NO: 142556 - DNA, 23 bp, Homo sapiens
agacagtgggtgatgtgtctgta

SEQ ID NO: 142557 - DNA, 23 bp, Homo sapiens
agaggtgtctctctccctgggtc

SEQ ID NO: 142558 - DNA, 23 bp, Homo sapiens
tctgtctttctgacataaagagg

SEQ ID NO: 142559 - DNA, 20 bp, Homo sapiens
ccctcactctgtgcctgacc

SEQ ID NO: 142560 - DNA, 23 bp, Homo sapiens
agagtctcactcactcttgtcac

SEQ ID NO: 142561 - DNA, 19 bp, Homo sapiens
tgaattagttttggtaagt

SEQ ID NO: 142562 - DNA, 19 bp, Homo sapiens
tgttttgcaaggaattcgt

SEQ ID NO: 142563 - DNA, 23 bp, Homo sapiens
tcttttgcacaataagaagtacg

SEQ ID NO: 142564 - DNA, 23 bp, Homo sapiens
aaacgtatatatgtatatgtatg

SEQ ID NO: 142565 - DNA, 23 bp, Homo sapiens
ggattgtgattttgatgtagtga

SEQ ID NO: 142566 - DNA, 22 bp, Homo sapiens
ctctcacctcacagtcactctc

SEQ ID NO: 142567 - DNA, 23 bp, Homo sapiens
gacaggatcagggttcaggctca

SEQ ID NO: 142568 - DNA, 23 bp, Homo sapiens
gagcctcaatctgacactctctg

SEQ ID NO: 142569 - DNA, 20 bp, Homo sapiens
tgcaatctcagctcatggca

SEQ ID NO: 142570 - DNA, 19 bp, Homo sapiens
tgtgtgtgtgtgtgtgtat

SEQ ID NO: 142571 - DNA, 22 bp, Homo sapiens
agagtagtgagtgagttctcta

SEQ ID NO: 142572 - DNA, 23 bp, Homo sapiens
ttagagtgttctgttttccttgt

SEQ ID NO: 142573 - DNA, 18 bp, Homo sapiens
agctacatgtggcttgtg

SEQ ID NO: 142574 - DNA, 22 bp, Homo sapiens
aagacagcacagatacagaaca

SEQ ID NO: 142575 - DNA, 23 bp, Homo sapiens
tgtatatatgtacctatccatct

SEQ ID NO: 142576 - DNA, 23 bp, Homo sapiens
ataaatgtgtgggtatgtatgca

SEQ ID NO: 142577 - DNA, 23 bp, Homo sapiens
tgtgtatatatatacgtatgtgt

SEQ ID NO: 142578 - DNA, 20 bp, Homo sapiens
gagtgtgggtgtggtgagtg

SEQ ID NO: 142579 - DNA, 21 bp, Homo sapiens
cagaaatctgcacaatctctt

SEQ ID NO: 142580 - DNA, 23 bp, Homo sapiens
aattaggttggaaagtattgcct

SEQ ID NO: 142581 - DNA, 23 bp, Homo sapiens
ctgtgtgtgtcagcttctggatg

SEQ ID NO: 142582 - DNA, 23 bp, Homo sapiens
gacacaagagtgtatccagaatg

SEQ ID NO: 142583 - DNA, 22 bp, Homo sapiens
tcactgcctggtactgaggatg

SEQ ID NO: 142584 - DNA, 21 bp, Homo sapiens
gagtcacactctgtcccacag

SEQ ID NO: 142585 - DNA, 20 bp, Homo sapiens
tatatatacgtatatatacg

SEQ ID NO: 142586 - DNA, 23 bp, Homo sapiens
tatgtgtatatatacgtatgtat

SEQ ID NO: 142587 - DNA, 21 bp, Homo sapiens
tatatgtatatgtatatatgt

SEQ ID NO: 142588 - DNA, 23 bp, Homo sapiens
tgagttcattgtagattctggat

SEQ ID NO: 142589 - DNA, 23 bp, Homo sapiens
tgagttcattgtagattctggat

SEQ ID NO: 142590 - DNA, 23 bp, Homo sapiens
acatatgtacatatctatacata

SEQ ID NO: 142591 - DNA, 18 bp, Homo sapiens
atctagatatatattgat

SEQ ID NO: 142592 - DNA, 21 bp, Homo sapiens
tatatctataatagaaaccag

SEQ ID NO: 142593 - DNA, 23 bp, Homo sapiens
ggtttctctctgtcactcaggct

SEQ ID NO: 142594 - DNA, 18 bp, Homo sapiens
agtcctttgatctctctg

SEQ ID NO: 142595 - DNA, 23 bp, Homo sapiens
gtctgatttcactatttgtttat

SEQ ID NO: 142596 - DNA, 23 bp, Homo sapiens
acacacacacagtcagtgtgtgt

SEQ ID NO: 142597 - DNA, 23 bp, Homo sapiens
taagtttggtctacatgttggat

SEQ ID NO: 142598 - DNA, 23 bp, Homo sapiens
ttcaattgtactaactgtgttct

SEQ ID NO: 142599 - DNA, 23 bp, Homo sapiens
tgtgtcagtcagtgaagacagtg

SEQ ID NO: 142600 - DNA, 23 bp, Homo sapiens
tgcctgcctgcctgcctgccttg

SEQ ID NO: 142601 - DNA, 23 bp, Homo sapiens
tgagttcattgtagattctggat

SEQ ID NO: 142602 - DNA, 23 bp, Homo sapiens
tgagttcattgtagattctggat

SEQ ID NO: 142603 - DNA, 23 bp, Homo sapiens
tcgcttgaacctgagtgtgagac

SEQ ID NO: 142604 - DNA, 23 bp, Homo sapiens
tagaatctttaagagaatggatt

SEQ ID NO: 142605 - DNA, 23 bp, Homo sapiens
acaaaagtaggtcaagaaaccat

SEQ ID NO: 142606 - DNA, 23 bp, Homo sapiens
cagggtcactcgctctgtcaccc

SEQ ID NO: 142607 - DNA, 20 bp, Homo sapiens
tgcagtggcatgatcttggc

SEQ ID NO: 142608 - DNA, 22 bp, Homo sapiens
atcacaatgccttttttgagac

SEQ ID NO: 142609 - DNA, 23 bp, Homo sapiens
gactgagtctcgctctgtcaccc

SEQ ID NO: 142610 - DNA, 23 bp, Homo sapiens
tcactacagagtagacattcaaa

SEQ ID NO: 142611 - DNA, 21 bp, Homo sapiens
tctcaaaagaaaaatgtctca

SEQ ID NO: 142612 - DNA, 23 bp, Homo sapiens
ttatggttttgtatgtcttatag

SEQ ID NO: 142613 - DNA, 23 bp, Homo sapiens
gagacagagtctctctctgtcac

SEQ ID NO: 142614 - DNA, 23 bp, Homo sapiens
tatctcaggcagctttgtgcagg

SEQ ID NO: 142615 - DNA, 19 bp, Homo sapiens
acatagtgagtccttgcct

SEQ ID NO: 142616 - DNA, 23 bp, Homo sapiens
cagagtctcactctgtcacccag

SEQ ID NO: 142617 - DNA, 23 bp, Homo sapiens
agagtctcactctgtcacccagg

SEQ ID NO: 142618 - DNA, 20 bp, Homo sapiens
tccaagtaacttgtattcta

SEQ ID NO: 142619 - DNA, 21 bp, Homo sapiens
tggagtcaggtagacctgggg

SEQ ID NO: 142620 - DNA, 18 bp, Homo sapiens
tatgtgtgtatatatgtg

SEQ ID NO: 142621 - DNA, 23 bp, Homo sapiens
tgagttcattgtagattctggat

SEQ ID NO: 142622 - DNA, 23 bp, Homo sapiens
tgagttcattgtagattctggat

SEQ ID NO: 142623 - DNA, 22 bp, Homo sapiens
ttggatgaagaatgctttgtat

SEQ ID NO: 142624 - DNA, 22 bp, Homo sapiens
tgaggatgtaggaagtataatt

SEQ ID NO: 142625 - DNA, 23 bp, Homo sapiens
tctctctttctctctctaatggc

SEQ ID NO: 142626 - DNA, 18 bp, Homo sapiens
acgctgttccacacattg

SEQ ID NO: 142627 - DNA, 23 bp, Homo sapiens
aagtctctcactttgtttcatgt

SEQ ID NO: 142628 - DNA, 23 bp, Homo sapiens
gagacagagtctcactctgtcgc

SEQ ID NO: 142629 - DNA, 18 bp, Homo sapiens
ttcagtggagttccgatg

SEQ ID NO: 142630 - DNA, 23 bp, Homo sapiens
agagtctcactctgtcacccagg

SEQ ID NO: 142631 - DNA, 23 bp, Homo sapiens
gtgtgtctgtgtcctaatctcct

SEQ ID NO: 142632 - DNA, 23 bp, Homo sapiens
aacaaggtctcactctgtcaccc

SEQ ID NO: 142633 - DNA, 21 bp, Homo sapiens
cagtggtatgatcatggctca

SEQ ID NO: 142634 - DNA, 23 bp, Homo sapiens
tctctctttctgtctctatatca

SEQ ID NO: 142635 - DNA, 23 bp, Homo sapiens
tgggagacttctcattttgttct

SEQ ID NO: 142636 - DNA, 23 bp, Homo sapiens
atatgtatgtatatgtatacata

SEQ ID NO: 142637 - DNA, 18 bp, Homo sapiens
acgtatatatatgtgtgt

SEQ ID NO: 142638 - DNA, 23 bp, Homo sapiens
catgtctgtctctcacttatttc

SEQ ID NO: 142639 - DNA, 20 bp, Homo sapiens
tgaggtaggtggatcacttg

SEQ ID NO: 142640 - DNA, 20 bp, Homo sapiens
ctgggtcgaatagtagttct

SEQ ID NO: 142641 - DNA, 19 bp, Homo sapiens
taagttctttgagaagtct

SEQ ID NO: 142642 - DNA, 23 bp, Homo sapiens
cttttcacagtggctgaactaat

SEQ ID NO: 142643 - DNA, 23 bp, Homo sapiens
tcagactgtcttcacagagatga

SEQ ID NO: 142644 - DNA, 20 bp, Homo sapiens
atgtatgtatttatgtatca

SEQ ID NO: 142645 - DNA, 23 bp, Homo sapiens
aaatacataccatatgcattctt

SEQ ID NO: 142646 - DNA, 18 bp, Homo sapiens
atatatgtgtaagtgcat

SEQ ID NO: 142647 - DNA, 19 bp, Homo sapiens
acatatctatgtatattta

SEQ ID NO: 142648 - DNA, 23 bp, Homo sapiens
taaatgtgtgtggttatgtgtct

SEQ ID NO: 142649 - DNA, 19 bp, Homo sapiens
agtctcattctgtcactca

SEQ ID NO: 142650 - DNA, 23 bp, Homo sapiens
cagagtctcactgtgtcttccag

SEQ ID NO: 142651 - DNA, 20 bp, Homo sapiens
acagtggcacgatcttggct

SEQ ID NO: 142652 - DNA, 20 bp, Homo sapiens
atttgtgtatatatgtgtat

SEQ ID NO: 142653 - DNA, 20 bp, Homo sapiens
tatgcatatatatagatatg

SEQ ID NO: 142654 - DNA, 18 bp, Homo sapiens
ctggctaatttttctgtt

SEQ ID NO: 142655 - DNA, 22 bp, Homo sapiens
taaagcagccatgtctggagga

SEQ ID NO: 142656 - DNA, 23 bp, Homo sapiens
tgagttcattgtagattctggat

SEQ ID NO: 142657 - DNA, 23 bp, Homo sapiens
tgagttcattgtagattctggat

SEQ ID NO: 142658 - DNA, 23 bp, Homo sapiens
tgagttcattgtagattctggat

SEQ ID NO: 142659 - DNA, 23 bp, Homo sapiens
tgagttcattgtagattctggat

SEQ ID NO: 142660 - DNA, 20 bp, Homo sapiens
ctgttgattccagtttggga

SEQ ID NO: 142661 - DNA, 18 bp, Homo sapiens
agtgtctcacagtgtgtg

SEQ ID NO: 142662 - DNA, 21 bp, Homo sapiens
tgagagtgctgagagtggaca

SEQ ID NO: 142663 - DNA, 23 bp, Homo sapiens
ttgtatatgtatgtttatgtagg

SEQ ID NO: 142664 - DNA, 23 bp, Homo sapiens
tgaatatacatatgtataggtat

SEQ ID NO: 142665 - DNA, 23 bp, Homo sapiens
cttgagacagagtctcgctctgt

SEQ ID NO: 142666 - DNA, 23 bp, Homo sapiens
tgtgaagtcagagagcacagagt

SEQ ID NO: 142667 - DNA, 18 bp, Homo sapiens
ttgtgtgttgtggatgga

SEQ ID NO: 142668 - DNA, 23 bp, Homo sapiens
tggctcagtcactcagtctcacc

SEQ ID NO: 142669 - DNA, 18 bp, Homo sapiens
ttgaccaataagtggagg

SEQ ID NO: 142670 - DNA, 21 bp, Homo sapiens
aagtatccttggatctctcta

SEQ ID NO: 142671 - DNA, 23 bp, Homo sapiens
actcccagagcccctggaactct

SEQ ID NO: 142672 - DNA, 23 bp, Homo sapiens
actcccagagcccctggaactct

SEQ ID NO: 142673 - DNA, 23 bp, Homo sapiens
actcccagagcccctggaactct

SEQ ID NO: 142674 - DNA, 23 bp, Homo sapiens
cactgagcaaatctattggtacg

SEQ ID NO: 142675 - DNA, 23 bp, Homo sapiens
tgaggtaggaggatcatttgagt

SEQ ID NO: 142676 - DNA, 23 bp, Homo sapiens
agagtctcactctgtcatccagg

SEQ ID NO: 142677 - DNA, 22 bp, Homo sapiens
tgtgtatatatgtatatatgta

SEQ ID NO: 142678 - DNA, 23 bp, Homo sapiens
atgtgtatatatgttcatatatg

SEQ ID NO: 142679 - DNA, 22 bp, Homo sapiens
gactctgtgcctgagtctcttg

SEQ ID NO: 142680 - DNA, 22 bp, Homo sapiens
ttgaaatgagaatagtgagagg

SEQ ID NO: 142681 - DNA, 21 bp, Homo sapiens
tcctccatttgaaaagcccat

SEQ ID NO: 142682 - DNA, 23 bp, Homo sapiens
tgtccatctgtctgtctctggct

SEQ ID NO: 142683 - DNA, 23 bp, Homo sapiens
tgactgagtctggctctgtcttc

SEQ ID NO: 142684 - DNA, 21 bp, Homo sapiens
cagaggcatgatcttggctca

SEQ ID NO: 142685 - DNA, 21 bp, Homo sapiens
tatacgtatatatatgtgtgt

SEQ ID NO: 142686 - DNA, 20 bp, Homo sapiens
ttagttcttgtaggtttggg

SEQ ID NO: 142687 - DNA, 23 bp, Homo sapiens
agagtctcactctgtcacccagg

SEQ ID NO: 142688 - DNA, 23 bp, Homo sapiens
gagtctcactctgtcacccaggc

SEQ ID NO: 142689 - DNA, 21 bp, Homo sapiens
gaggctgtctctgtggcactc

SEQ ID NO: 142690 - DNA, 20 bp, Homo sapiens
actctgcctccatctgtatg

SEQ ID NO: 142691 - DNA, 22 bp, Homo sapiens
actgtcaccctgagtcactgcc

SEQ ID NO: 142692 - DNA, 21 bp, Homo sapiens
aatacctaaactcatagggtt

SEQ ID NO: 142693 - DNA, 19 bp, Homo sapiens
acgtatatatatgtgtgtg

SEQ ID NO: 142694 - DNA, 23 bp, Homo sapiens
tgagttcattgtagattctggat

SEQ ID NO: 142695 - DNA, 23 bp, Homo sapiens
tgagttcattgtagattctggat

SEQ ID NO: 142696 - DNA, 19 bp, Homo sapiens
tagaagtagctagtgcaca

SEQ ID NO: 142697 - DNA, 19 bp, Homo sapiens
aaacaggctcttcaagtgg

SEQ ID NO: 142698 - DNA, 20 bp, Homo sapiens
aagtgctgggattacaggca

SEQ ID NO: 142699 - DNA, 20 bp, Homo sapiens
gaccatctgaatttcttctt

SEQ ID NO: 142700 - DNA, 19 bp, Homo sapiens
tatgtgtgtatatatatgt

SEQ ID NO: 142701 - DNA, 22 bp, Homo sapiens
tatgtgtgtatatatgtgtgta

SEQ ID NO: 142702 - DNA, 22 bp, Homo sapiens
tgtgtatatatgtatatatgtg

SEQ ID NO: 142703 - DNA, 23 bp, Homo sapiens
tgtgtacgatctatgtgttgggg

SEQ ID NO: 142704 - DNA, 23 bp, Homo sapiens
ctgacaccctcactgactcctga

SEQ ID NO: 142705 - DNA, 23 bp, Homo sapiens
catctgtgattatgaaggtctag

SEQ ID NO: 142706 - DNA, 23 bp, Homo sapiens
ataattgtatatctgtctgtgtt

SEQ ID NO: 142707 - DNA, 23 bp, Homo sapiens
tgtttggggaagtattttgggat

SEQ ID NO: 142708 - DNA, 23 bp, Homo sapiens
aacagacctcactctctctgtgc

SEQ ID NO: 142709 - DNA, 23 bp, Homo sapiens
atgaagtctcactctgtcaccca

SEQ ID NO: 142710 - DNA, 22 bp, Homo sapiens
aaggactgcggattgttgtgga

SEQ ID NO: 142711 - DNA, 23 bp, Homo sapiens
tgtgacaccgtgtctgtgtgtga

SEQ ID NO: 142712 - DNA, 23 bp, Homo sapiens
aggtgtgagacaaaagagaggtc

SEQ ID NO: 142713 - DNA, 23 bp, Homo sapiens
tgctgtgtcttatgtgactgcac

SEQ ID NO: 142714 - DNA, 19 bp, Homo sapiens
tctgtgtaactgagtgcct

SEQ ID NO: 142715 - DNA, 23 bp, Homo sapiens
ctctttcacaggtatactgggtg

SEQ ID NO: 142716 - DNA, 23 bp, Homo sapiens
ccaagtctcactctgtcgctcag

SEQ ID NO: 142717 - DNA, 19 bp, Homo sapiens
atggtgtgatcttggctca

SEQ ID NO: 142718 - DNA, 22 bp, Homo sapiens
ccagagcctgtgtctcagtctc

SEQ ID NO: 142719 - DNA, 18 bp, Homo sapiens
aatgtatatatacgtgta

SEQ ID NO: 142720 - DNA, 21 bp, Homo sapiens
atatgtgtgtatatatatacg

SEQ ID NO: 142721 - DNA, 21 bp, Homo sapiens
tacacatatatgtatacatgt

SEQ ID NO: 142722 - DNA, 19 bp, Homo sapiens
tagaggctagagtgaacca

SEQ ID NO: 142723 - DNA, 23 bp, Homo sapiens
tcagtgctctagagagggagctc

SEQ ID NO: 142724 - DNA, 23 bp, Homo sapiens
tcactgttctattacttctcctg

SEQ ID NO: 142725 - DNA, 23 bp, Homo sapiens
tttttctttttgaaatgggtaag

SEQ ID NO: 142726 - DNA, 23 bp, Homo sapiens
agcagagtgataagtgtgaggac

SEQ ID NO: 142727 - DNA, 23 bp, Homo sapiens
gtctcactgtgtcactgaggctg

SEQ ID NO: 142728 - DNA, 23 bp, Homo sapiens
ataactcactgcagccttgactg

SEQ ID NO: 142729 - DNA, 23 bp, Homo sapiens
agactgtagagagactggtatgc

SEQ ID NO: 142730 - DNA, 23 bp, Homo sapiens
gacagagtctcgctctgtcaccc

SEQ ID NO: 142731 - DNA, 23 bp, Homo sapiens
agagtctcactctgtcacccagg

SEQ ID NO: 142732 - DNA, 23 bp, Homo sapiens
gagtctcactctgtcacccaggc

SEQ ID NO: 142733 - DNA, 19 bp, Homo sapiens
tcagaggagaagttgacta

SEQ ID NO: 142734 - DNA, 20 bp, Homo sapiens
agtgtctcattttgtttgtg

SEQ ID NO: 142735 - DNA, 23 bp, Homo sapiens
ataactgcatgtcatatatgtgt

SEQ ID NO: 142736 - DNA, 23 bp, Homo sapiens
gtatgtctgtatgtctgtgtgtt

SEQ ID NO: 142737 - DNA, 22 bp, Homo sapiens
gtctcgctgtgtcactcaggct

SEQ ID NO: 142738 - DNA, 23 bp, Homo sapiens
acccaagtagctgggattacagg

SEQ ID NO: 142739 - DNA, 23 bp, Homo sapiens
taacacagtggtttgcaactata

SEQ ID NO: 142740 - DNA, 23 bp, Homo sapiens
agggtctcactgtgtcacccagg

SEQ ID NO: 142741 - DNA, 19 bp, Homo sapiens
gtcactctcagacaccggg

SEQ ID NO: 142742 - DNA, 23 bp, Homo sapiens
aagagctgactcagcacagagtg

SEQ ID NO: 142743 - DNA, 23 bp, Homo sapiens
tatatgtacatgtgctacattta

SEQ ID NO: 142744 - DNA, 23 bp, Homo sapiens
tgtgtgcatatacatatgtgtat

SEQ ID NO: 142745 - DNA, 23 bp, Homo sapiens
atatgtgtatatatatgtatgta

SEQ ID NO: 142746 - DNA, 23 bp, Homo sapiens
atagagttcatgctcctctgaga

SEQ ID NO: 142747 - DNA, 23 bp, Homo sapiens
gcctcgctgactcagtggctgtc

SEQ ID NO: 142748 - DNA, 20 bp, Homo sapiens
ctgagagcaagtggagagtc

SEQ ID NO: 142749 - DNA, 21 bp, Homo sapiens
tgagaagaacctgctttagtg

SEQ ID NO: 142750 - DNA, 22 bp, Homo sapiens
tgaggctggttatgaaagcttt

SEQ ID NO: 142751 - DNA, 23 bp, Homo sapiens
acatgtgtgcctgtgtgtctctg

SEQ ID NO: 142752 - DNA, 20 bp, Homo sapiens
aacctggtgtacatgttcat

SEQ ID NO: 142753 - DNA, 23 bp, Homo sapiens
aggatgtgtgatctacattctgg

SEQ ID NO: 142754 - DNA, 23 bp, Homo sapiens
attgaggatctactatgtaccca

SEQ ID NO: 142755 - DNA, 23 bp, Homo sapiens
tgactggttctctctgtgacaga

SEQ ID NO: 142756 - DNA, 23 bp, Homo sapiens
gtgagcacatcctacactcacgg

SEQ ID NO: 142757 - DNA, 21 bp, Homo sapiens
cagctacatccttgcattgta

SEQ ID NO: 142758 - DNA, 23 bp, Homo sapiens
tgagttcattgtagattctggat

SEQ ID NO: 142759 - DNA, 23 bp, Homo sapiens
tgagttcattgtagattctggat

SEQ ID NO: 142760 - DNA, 20 bp, Homo sapiens
tctctccctgagggtctctg

SEQ ID NO: 142761 - DNA, 23 bp, Homo sapiens
tgagttcattgtagattctggat

SEQ ID NO: 142762 - DNA, 23 bp, Homo sapiens
tgagttcattgtagattctggat

SEQ ID NO: 142763 - DNA, 23 bp, Homo sapiens
ttttgagatggagtctctctctg

SEQ ID NO: 142764 - DNA, 23 bp, Homo sapiens
ttagtcctgctctaaatgtggct

SEQ ID NO: 142765 - DNA, 23 bp, Homo sapiens
tgtgtatatgtatgtatatgtgt

SEQ ID NO: 142766 - DNA, 23 bp, Homo sapiens
tatctgtctgtctgtcatctacc

SEQ ID NO: 142767 - DNA, 18 bp, Homo sapiens
taataacatgggatagga

SEQ ID NO: 142768 - DNA, 23 bp, Homo sapiens
tttatcagtagtgtgaaagcaga

SEQ ID NO: 142769 - DNA, 18 bp, Homo sapiens
agagaagagttgcagccc

SEQ ID NO: 142770 - DNA, 23 bp, Homo sapiens
ctccctgagtgagggctgtgaca

SEQ ID NO: 142771 - DNA, 23 bp, Homo sapiens
tttttgtttcaatcctggttttg

SEQ ID NO: 142772 - DNA, 18 bp, Homo sapiens
atgtgtgtgtgtagatag

SEQ ID NO: 142773 - DNA, 19 bp, Homo sapiens
tcacacactcattctctca

SEQ ID NO: 142774 - DNA, 19 bp, Homo sapiens
agacaggtatgtgtataca

SEQ ID NO: 142775 - DNA, 23 bp, Homo sapiens
atatatgtatggatatgtatgtg

SEQ ID NO: 142776 - DNA, 19 bp, Homo sapiens
tatgtgtgtttgtatgtgt

SEQ ID NO: 142777 - DNA, 23 bp, Homo sapiens
cggagtctcgctctgtctcccag

SEQ ID NO: 142778 - DNA, 23 bp, Homo sapiens
gactgagtctcgctctgtcaccc

SEQ ID NO: 142779 - DNA, 23 bp, Homo sapiens
tgagttcattgtagattctggat

SEQ ID NO: 142780 - DNA, 23 bp, Homo sapiens
tgagttcattgtagattctggat

SEQ ID NO: 142781 - DNA, 23 bp, Homo sapiens
gtatgactgactctgcatttagt

SEQ ID NO: 142782 - DNA, 23 bp, Homo sapiens
actgaagagtgtgtgctcatcta

SEQ ID NO: 142783 - DNA, 23 bp, Homo sapiens
taagtgtgaggtgatgatcgatt

SEQ ID NO: 142784 - DNA, 22 bp, Homo sapiens
atgattagtgattttgaacatc

SEQ ID NO: 142785 - DNA, 23 bp, Homo sapiens
tgtgtgcatgtgcatatgcttgt

SEQ ID NO: 142786 - DNA, 23 bp, Homo sapiens
tatcacacacatatatgtatgca

SEQ ID NO: 142787 - DNA, 20 bp, Homo sapiens
acacacacacacatatatgt

SEQ ID NO: 142788 - DNA, 21 bp, Homo sapiens
tatatgtatatgtatacatat

SEQ ID NO: 142789 - DNA, 19 bp, Homo sapiens
acaactagcagctgaatca

SEQ ID NO: 142790 - DNA, 23 bp, Homo sapiens
tatatgtgtatatgtatatgtat

SEQ ID NO: 142791 - DNA, 23 bp, Homo sapiens
gtctgtcactgtgtttgctgcag

SEQ ID NO: 142792 - DNA, 23 bp, Homo sapiens
ggttcaggtcctgatgctgcaga

SEQ ID NO: 142793 - DNA, 22 bp, Homo sapiens
tgtctgtatatatgtatatatg

SEQ ID NO: 142794 - DNA, 22 bp, Homo sapiens
tcttagctctatttgttgtttt

SEQ ID NO: 142795 - DNA, 23 bp, Homo sapiens
ggagtctcactctgtcactcagg

SEQ ID NO: 142796 - DNA, 23 bp, Homo sapiens
tttgtttggatttcatgcaagta

SEQ ID NO: 142797 - DNA, 23 bp, Homo sapiens
tgagttcattgtagattctggat

SEQ ID NO: 142798 - DNA, 23 bp, Homo sapiens
tgagttcattgtagattctggat

SEQ ID NO: 142799 - DNA, 18 bp, Homo sapiens
agctacacttggttgctc

SEQ ID NO: 142800 - DNA, 23 bp, Homo sapiens
ctaggtgcactgattggtttctg

SEQ ID NO: 142801 - DNA, 22 bp, Homo sapiens
agagtctcgctctgtcacccag

SEQ ID NO: 142802 - DNA, 23 bp, Homo sapiens
tatgtgtgtgtatatgtatatat

SEQ ID NO: 142803 - DNA, 21 bp, Homo sapiens
tgaggtaggaggatcacttga

SEQ ID NO: 142804 - DNA, 18 bp, Homo sapiens
ctcagtttctttctctgt

SEQ ID NO: 142805 - DNA, 22 bp, Homo sapiens
tctgagacttgagcgttccata

SEQ ID NO: 142806 - DNA, 20 bp, Homo sapiens
gagtcagcaatccttactca

SEQ ID NO: 142807 - DNA, 21 bp, Homo sapiens
tctcacactctttctggggaa

SEQ ID NO: 142808 - DNA, 18 bp, Homo sapiens
agagtagagagagaatgt

SEQ ID NO: 142809 - DNA, 23 bp, Homo sapiens
gtggagtctgtctctgtcaccca

SEQ ID NO: 142810 - DNA, 23 bp, Homo sapiens
caaagacatgtcataatgttctt

SEQ ID NO: 142811 - DNA, 22 bp, Homo sapiens
agagtcagaggatagagtgcag

SEQ ID NO: 142812 - DNA, 19 bp, Homo sapiens
taaagttttgatttttaac

SEQ ID NO: 142813 - DNA, 23 bp, Homo sapiens
cacagtcaggcacaccagctgct

SEQ ID NO: 142814 - DNA, 21 bp, Homo sapiens
cactggctctctgtgaggctg

SEQ ID NO: 142815 - DNA, 19 bp, Homo sapiens
ccatgacttgggttaatca

SEQ ID NO: 142816 - DNA, 20 bp, Homo sapiens
atatctctgcttcaagagtg

SEQ ID NO: 142817 - DNA, 23 bp, Homo sapiens
agagagggctatgtgtctgtgta

SEQ ID NO: 142818 - DNA, 20 bp, Homo sapiens
agccgctgcaaaacttccag

SEQ ID NO: 142819 - DNA, 21 bp, Homo sapiens
tcagaaatgtgcatgggatgg

SEQ ID NO: 142820 - DNA, 23 bp, Homo sapiens
ctgatccactctctcactctgct

SEQ ID NO: 142821 - DNA, 23 bp, Homo sapiens
acagagtctcactctgtccccca

SEQ ID NO: 142822 - DNA, 18 bp, Homo sapiens
cactgggagataaacatt

SEQ ID NO: 142823 - DNA, 21 bp, Homo sapiens
agggtagatgcagagatttga

SEQ ID NO: 142824 - DNA, 18 bp, Homo sapiens
ttatgtaagtttttcata

SEQ ID NO: 142825 - DNA, 23 bp, Homo sapiens
aagcagttcaggagctattttgt

SEQ ID NO: 142826 - DNA, 21 bp, Homo sapiens
tcctgaagccaatgccacacc

SEQ ID NO: 142827 - DNA, 20 bp, Homo sapiens
ctcactgtatctctctgcag

SEQ ID NO: 142828 - DNA, 18 bp, Homo sapiens
tatgtgtgtatgtgtata

SEQ ID NO: 142829 - DNA, 20 bp, Homo sapiens
tgacaaaagacacagagctg

SEQ ID NO: 142830 - DNA, 18 bp, Homo sapiens
tgtctgcccactgcctgt

SEQ ID NO: 142831 - DNA, 21 bp, Homo sapiens
attgtggatcctggaagtgtt

SEQ ID NO: 142832 - DNA, 23 bp, Homo sapiens
gcactatctcagttcactgcagc

SEQ ID NO: 142833 - DNA, 23 bp, Homo sapiens
acacggtctcactctgtcaccca

SEQ ID NO: 142834 - DNA, 23 bp, Homo sapiens
agatggcactggatgattacagg

SEQ ID NO: 142835 - DNA, 21 bp, Homo sapiens
atatgcatgggaatagagagt

SEQ ID NO: 142836 - DNA, 20 bp, Homo sapiens
agagagctgagagtcagcag

SEQ ID NO: 142837 - DNA, 23 bp, Homo sapiens
tgtgtgtttgctattcctgctgc

SEQ ID NO: 142838 - DNA, 18 bp, Homo sapiens
tagtccacatgtatgcgc

SEQ ID NO: 142839 - DNA, 23 bp, Homo sapiens
tgtatacatgtatgtgtgtgtgt

SEQ ID NO: 142840 - DNA, 23 bp, Homo sapiens
tggagtgcaagacttctgaattt

SEQ ID NO: 142841 - DNA, 23 bp, Homo sapiens
tgagttcattgtagattctggat

SEQ ID NO: 142842 - DNA, 23 bp, Homo sapiens
tgagttcattgtagattctggat

SEQ ID NO: 142843 - DNA, 20 bp, Homo sapiens
tgagacatcatagtgagctc

SEQ ID NO: 142844 - DNA, 23 bp, Homo sapiens
tgttttgagaagattgtgtggag

SEQ ID NO: 142845 - DNA, 22 bp, Homo sapiens
tcttcagacaagtgattgagct

SEQ ID NO: 142846 - DNA, 23 bp, Homo sapiens
tctctccctctctgtgtggtctc

SEQ ID NO: 142847 - DNA, 23 bp, Homo sapiens
tctgtttctctctgaagatgacc

SEQ ID NO: 142848 - DNA, 21 bp, Homo sapiens
tcagagttttgctttattagg

SEQ ID NO: 142849 - DNA, 21 bp, Homo sapiens
tctggtggtgaactgctgcaa

SEQ ID NO: 142850 - DNA, 18 bp, Homo sapiens
agcatctcgccatagctg

SEQ ID NO: 142851 - DNA, 20 bp, Homo sapiens
tcaccctgactttggcctta

SEQ ID NO: 142852 - DNA, 23 bp, Homo sapiens
ctgtctctctgtctccgtgtgcc

SEQ ID NO: 142853 - DNA, 23 bp, Homo sapiens
tgagttcattgtagattctggat

SEQ ID NO: 142854 - DNA, 23 bp, Homo sapiens
tgagttcattgtagattctggat

SEQ ID NO: 142855 - DNA, 22 bp, Homo sapiens
ctcttcagtccctgcctcttaa

SEQ ID NO: 142856 - DNA, 21 bp, Homo sapiens
aacacatcctaatgcaatgtc

SEQ ID NO: 142857 - DNA, 22 bp, Homo sapiens
tatatggagttatatatgtaca

SEQ ID NO: 142858 - DNA, 23 bp, Homo sapiens
tatttatcttgatattgatatag

SEQ ID NO: 142859 - DNA, 20 bp, Homo sapiens
tgcatgtatgtttatattga

SEQ ID NO: 142860 - DNA, 22 bp, Homo sapiens
tcagactcagactcagactctc

SEQ ID NO: 142861 - DNA, 23 bp, Homo sapiens
gagtcgctgtcagcctgggtctc

SEQ ID NO: 142862 - DNA, 21 bp, Homo sapiens
tgatagcaagcaacattctcc

SEQ ID NO: 142863 - DNA, 21 bp, Homo sapiens
tggctggctgcctgcatggct

SEQ ID NO: 142864 - DNA, 23 bp, Homo sapiens
taagcctgtctgcctgcctctct

SEQ ID NO: 142865 - DNA, 23 bp, Homo sapiens
acagagtctcgcactgtcaccca

SEQ ID NO: 142866 - DNA, 23 bp, Homo sapiens
tgagtaaagaggatgtgtaatag

SEQ ID NO: 142867 - DNA, 20 bp, Homo sapiens
ctgggggtgtgtcactggct

SEQ ID NO: 142868 - DNA, 20 bp, Homo sapiens
tcaccatctggatgaggcag

SEQ ID NO: 142869 - DNA, 23 bp, Homo sapiens
cacactggctgtctctttgcctg

SEQ ID NO: 142870 - DNA, 18 bp, Homo sapiens
cagcccgtgcttctgagt

SEQ ID NO: 142871 - DNA, 18 bp, Homo sapiens
ttgagaaatctgtcttct

SEQ ID NO: 142872 - DNA, 22 bp, Homo sapiens
aaagagacagaagaagaaatct

SEQ ID NO: 142873 - DNA, 23 bp, Homo sapiens
tggatgtacaggttcaggtgacg

SEQ ID NO: 142874 - DNA, 23 bp, Homo sapiens
tctctgtctctctgagtattggc

SEQ ID NO: 142875 - DNA, 23 bp, Homo sapiens
tacctggtcttgggtatgtctgt

SEQ ID NO: 142876 - DNA, 23 bp, Homo sapiens
tgtagtgtttatttgttaatggt

SEQ ID NO: 142877 - DNA, 23 bp, Homo sapiens
tgcatagatgtatatatgtatat

SEQ ID NO: 142878 - DNA, 19 bp, Homo sapiens
acacacatcctgtcactca

SEQ ID NO: 142879 - DNA, 23 bp, Homo sapiens
gctgtggatcattgctgtgcttg

SEQ ID NO: 142880 - DNA, 23 bp, Homo sapiens
tggagtctcactctgtcacccag

SEQ ID NO: 142881 - DNA, 18 bp, Homo sapiens
cagtggtatgatctcagc

SEQ ID NO: 142882 - DNA, 23 bp, Homo sapiens
cggagtctcactctgtcacccag

SEQ ID NO: 142883 - DNA, 23 bp, Homo sapiens
gagactctcactctgtcacccag

SEQ ID NO: 142884 - DNA, 21 bp, Homo sapiens
tcagtcactcagagccgctgt

SEQ ID NO: 142885 - DNA, 18 bp, Homo sapiens
cagtctcattttctcatt

SEQ ID NO: 142886 - DNA, 23 bp, Homo sapiens
atgtgtgcctatatgtatgtata

SEQ ID NO: 142887 - DNA, 21 bp, Homo sapiens
acacacagatacacacacata

SEQ ID NO: 142888 - DNA, 23 bp, Homo sapiens
tgtcttgtttttgtttccagaat

SEQ ID NO: 142889 - DNA, 23 bp, Homo sapiens
accttctcacgctgacttcatgc

SEQ ID NO: 142890 - DNA, 22 bp, Homo sapiens
ctgaagaggagtttgttgtgtg

SEQ ID NO: 142891 - DNA, 23 bp, Homo sapiens
agtttgagcactcactcactgtg

SEQ ID NO: 142892 - DNA, 21 bp, Homo sapiens
ttagcagagtacgcagcacct

SEQ ID NO: 142893 - DNA, 23 bp, Homo sapiens
gacagagtctcgctctgtcaccc

SEQ ID NO: 142894 - DNA, 21 bp, Homo sapiens
atggagctgacaaacttttct

SEQ ID NO: 142895 - DNA, 23 bp, Homo sapiens
acacagtcttactctgtcaccca

SEQ ID NO: 142896 - DNA, 23 bp, Homo sapiens
agtctctccctgtcttttatgac

SEQ ID NO: 142897 - DNA, 18 bp, Homo sapiens
ggatcatgtgggtgagtt

SEQ ID NO: 142898 - DNA, 19 bp, Homo sapiens
caggcatgatcctaggtga

SEQ ID NO: 142899 - DNA, 23 bp, Homo sapiens
cagagtctcactctgtcacccag

SEQ ID NO: 142900 - DNA, 23 bp, Homo sapiens
tgagttcattgtagattctggat

SEQ ID NO: 142901 - DNA, 23 bp, Homo sapiens
tgagttcattgtagattctggat

SEQ ID NO: 142902 - DNA, 20 bp, Homo sapiens
atatgtgtatatatatatgt

SEQ ID NO: 142903 - DNA, 23 bp, Homo sapiens
tatatgcatgtatatatacgtat

SEQ ID NO: 142904 - DNA, 22 bp, Homo sapiens
ttctctctggatctgatctttt

SEQ ID NO: 142905 - DNA, 21 bp, Homo sapiens
aaaagtagccatagcactctg

SEQ ID NO: 142906 - DNA, 23 bp, Homo sapiens
ttctgcaatttcattgtgatatg

SEQ ID NO: 142907 - DNA, 22 bp, Homo sapiens
gagtagacacagattaagcatc

SEQ ID NO: 142908 - DNA, 19 bp, Homo sapiens
tctctctctgtcagccctc

SEQ ID NO: 142909 - DNA, 19 bp, Homo sapiens
tggctgggagctcaggtgt

SEQ ID NO: 142910 - DNA, 23 bp, Homo sapiens
cagagacagaagagtgagagagc

SEQ ID NO: 142911 - DNA, 23 bp, Homo sapiens
catttgaccctcactgaggccca

SEQ ID NO: 142912 - DNA, 23 bp, Homo sapiens
tagtttctggaactggaagtgga

SEQ ID NO: 142913 - DNA, 20 bp, Homo sapiens
catgtcactgtgatgccaag

SEQ ID NO: 142914 - DNA, 23 bp, Homo sapiens
tttgagacaagagtcttgctctg

SEQ ID NO: 142915 - DNA, 18 bp, Homo sapiens
ctctctcagactcactcc

SEQ ID NO: 142916 - DNA, 23 bp, Homo sapiens
agagcctgtcagtcagtcagtca

SEQ ID NO: 142917 - DNA, 21 bp, Homo sapiens
tcccagccagcctgtatccct

SEQ ID NO: 142918 - DNA, 21 bp, Homo sapiens
tgtggctccaacacccctctc

SEQ ID NO: 142919 - DNA, 19 bp, Homo sapiens
cgcactctctttgcctgtg

SEQ ID NO: 142920 - DNA, 22 bp, Homo sapiens
atagtccatttgttgttctgag

SEQ ID NO: 142921 - DNA, 23 bp, Homo sapiens
tatgtgtatatatatgtgtgtgt

SEQ ID NO: 142922 - DNA, 23 bp, Homo sapiens
ttagtagagacagtttcagcatg

SEQ ID NO: 142923 - DNA, 23 bp, Homo sapiens
tactggtgtaggtacttgcattg

SEQ ID NO: 142924 - DNA, 23 bp, Homo sapiens
actcacagtccctctggacctgg

SEQ ID NO: 142925 - DNA, 23 bp, Homo sapiens
gagatggactctcactctgtcac

SEQ ID NO: 142926 - DNA, 23 bp, Homo sapiens
cgctgtgtgtgtctgtgccctaa

SEQ ID NO: 142927 - DNA, 20 bp, Homo sapiens
ttgtattttgatgctggaga

SEQ ID NO: 142928 - DNA, 22 bp, Homo sapiens
acttctctgcttggtgattggg

SEQ ID NO: 142929 - DNA, 23 bp, Homo sapiens
tgagacaaggtcaagctctgtca

SEQ ID NO: 142930 - DNA, 23 bp, Homo sapiens
tctctcactctcagttccctgcc

SEQ ID NO: 142931 - DNA, 18 bp, Homo sapiens
tgtgtgtgggtgagctaa

SEQ ID NO: 142932 - DNA, 22 bp, Homo sapiens
ctgtgtgtgttaccttctattt

SEQ ID NO: 142933 - DNA, 18 bp, Homo sapiens
cctttgttttatagcact

SEQ ID NO: 142934 - DNA, 19 bp, Homo sapiens
gagagcaggatcatttgtg

SEQ ID NO: 142935 - DNA, 19 bp, Homo sapiens
tttctctggggttttcccg

SEQ ID NO: 142936 - DNA, 23 bp, Homo sapiens
tacagggagcctcagataagagt

SEQ ID NO: 142937 - DNA, 23 bp, Homo sapiens
actctcagtgctttagcacgagc

SEQ ID NO: 142938 - DNA, 23 bp, Homo sapiens
ttgtgtgtgtgcatgtgcatggg

SEQ ID NO: 142939 - DNA, 23 bp, Homo sapiens
tgcatgtgtatatatgcatgtgt

SEQ ID NO: 142940 - DNA, 23 bp, Homo sapiens
gagtcactctgggtcaggtattc

SEQ ID NO: 142941 - DNA, 23 bp, Homo sapiens
tcagggtctcactgtgtctccca

SEQ ID NO: 142942 - DNA, 23 bp, Homo sapiens
atattctcaccaaaagtatgcaa

SEQ ID NO: 142943 - DNA, 22 bp, Homo sapiens
aagtctctcgctctgtcaccag

SEQ ID NO: 142944 - DNA, 23 bp, Homo sapiens
ccatgagcatctccatctgcact

SEQ ID NO: 142945 - DNA, 18 bp, Homo sapiens
ttctcgaagttatccggt

SEQ ID NO: 142946 - DNA, 22 bp, Homo sapiens
atgtacacacacatttacatgt

SEQ ID NO: 142947 - DNA, 20 bp, Homo sapiens
ccatggctgggagggtgagt

SEQ ID NO: 142948 - DNA, 19 bp, Homo sapiens
tctgagaggagacagagag

SEQ ID NO: 142949 - DNA, 23 bp, Homo sapiens
tggagtctcactctgtcacccag

SEQ ID NO: 142950 - DNA, 18 bp, Homo sapiens
ttaggagtggctctgttc

SEQ ID NO: 142951 - DNA, 21 bp, Homo sapiens
tagcactctccttaaggtcag

SEQ ID NO: 142952 - DNA, 18 bp, Homo sapiens
ttctcacaggctttggac

SEQ ID NO: 142953 - DNA, 23 bp, Homo sapiens
agagaagacactcagcaaacatt

SEQ ID NO: 142954 - DNA, 23 bp, Homo sapiens
ccatctctcacactctctgcatc

SEQ ID NO: 142955 - DNA, 23 bp, Homo sapiens
cttgataaagaacagtttttctg

SEQ ID NO: 142956 - DNA, 23 bp, Homo sapiens
tggagagctgtttttgatgttga

SEQ ID NO: 142957 - DNA, 23 bp, Homo sapiens
actgagtctcgctctgtctccca

SEQ ID NO: 142958 - DNA, 23 bp, Homo sapiens
agaatgtgactgtatttagagac

SEQ ID NO: 142959 - DNA, 21 bp, Homo sapiens
ctttaagaaggtagttaagtt

SEQ ID NO: 142960 - DNA, 23 bp, Homo sapiens
aattagcaacagaagatgcaaga

SEQ ID NO: 142961 - DNA, 22 bp, Homo sapiens
gctctctctctctgattctggc

SEQ ID NO: 142962 - DNA, 21 bp, Homo sapiens
tgaggtaggaggatctcttga

SEQ ID NO: 142963 - DNA, 23 bp, Homo sapiens
ctgtccctctctgacccaagctt

SEQ ID NO: 142964 - DNA, 23 bp, Homo sapiens
gagttcagtgagatgtgatggca

SEQ ID NO: 142965 - DNA, 23 bp, Homo sapiens
agacagaagagtgagttcttttg

SEQ ID NO: 142966 - DNA, 23 bp, Homo sapiens
taagttccactggatatgaagtg

SEQ ID NO: 142967 - DNA, 23 bp, Homo sapiens
tgagcatggttgtgagtgagatg

SEQ ID NO: 142968 - DNA, 23 bp, Homo sapiens
aacagttgtgtttttcttaaaga

SEQ ID NO: 142969 - DNA, 22 bp, Homo sapiens
aggaagtgatgagtctgagcac

SEQ ID NO: 142970 - DNA, 23 bp, Homo sapiens
gacagagtctcgctctgtcaccc

SEQ ID NO: 142971 - DNA, 23 bp, Homo sapiens
tcagctcactgtaacctctacct

SEQ ID NO: 142972 - DNA, 23 bp, Homo sapiens
aagctctgtctctgtgcctctgg

SEQ ID NO: 142973 - DNA, 23 bp, Homo sapiens
tgcatgtgcatgtgtgtatatgt

SEQ ID NO: 142974 - DNA, 23 bp, Homo sapiens
gtgtgtgtgtgcaaatgcatgtg

SEQ ID NO: 142975 - DNA, 20 bp, Homo sapiens
tctcagcctctgagtgaggg

SEQ ID NO: 142976 - DNA, 23 bp, Homo sapiens
gtctctgtgtgtgtccagtttct

SEQ ID NO: 142977 - DNA, 21 bp, Homo sapiens
atatgtatatgtatacacata

SEQ ID NO: 142978 - DNA, 21 bp, Homo sapiens
tgctgtggtttgaatatctgt

SEQ ID NO: 142979 - DNA, 23 bp, Homo sapiens
actcactggtagatcacgtgctc

SEQ ID NO: 142980 - DNA, 22 bp, Homo sapiens
aaaaagagtttctttgctgtga

SEQ ID NO: 142981 - DNA, 23 bp, Homo sapiens
actgtctgtctgagttttcagtg

SEQ ID NO: 142982 - DNA, 23 bp, Homo sapiens
ttctttcctttgaggtgagaatg

SEQ ID NO: 142983 - DNA, 23 bp, Homo sapiens
tctctgtgacctctcctgcttct

SEQ ID NO: 142984 - DNA, 23 bp, Homo sapiens
tgagatggagtctcactctaaca

SEQ ID NO: 142985 - DNA, 23 bp, Homo sapiens
agtcaggctctctgactgtgact

SEQ ID NO: 142986 - DNA, 23 bp, Homo sapiens
tgtctgtgtctgtggctgtgtct

SEQ ID NO: 142987 - DNA, 19 bp, Homo sapiens
gctgttgtctctgcctctt

SEQ ID NO: 142988 - DNA, 21 bp, Homo sapiens
atgagagaagggacagagcac

SEQ ID NO: 142989 - DNA, 23 bp, Homo sapiens
gttgctctgtctgtggctctcgt

SEQ ID NO: 142990 - DNA, 23 bp, Homo sapiens
ctctgcctctgactcactgtgcc

SEQ ID NO: 142991 - DNA, 21 bp, Homo sapiens
atgtctgcatgtgtatgtgtg

SEQ ID NO: 142992 - DNA, 23 bp, Homo sapiens
tgtgtgcatgtgagtgcatgtgc

SEQ ID NO: 142993 - DNA, 19 bp, Homo sapiens
atgtgtgtgcatgtgcatg

SEQ ID NO: 142994 - DNA, 23 bp, Homo sapiens
gacactgtgtctctgtgcgtgtg

SEQ ID NO: 142995 - DNA, 23 bp, Homo sapiens
tatgcctgtctgtgtgcatccat

SEQ ID NO: 142996 - DNA, 21 bp, Homo sapiens
cccactctgtctgtgggtctg

SEQ ID NO: 142997 - DNA, 23 bp, Homo sapiens
tgtgtgtctgtgtgtgtgaggga

SEQ ID NO: 142998 - DNA, 23 bp, Homo sapiens
tttttttgaacttctgataagtt

SEQ ID NO: 142999 - DNA, 23 bp, Homo sapiens
tcgtgtgtgagcaagtgcgtgtg

SEQ ID NO: 143000 - DNA, 23 bp, Homo sapiens
ttaaagtgtttggttatggtgtg

SEQ ID NO: 143001 - DNA, 19 bp, Homo sapiens
cacctggcagaggtgcctg

SEQ ID NO: 143002 - DNA, 23 bp, Homo sapiens
gcctcactctctgactgcctgac

SEQ ID NO: 143003 - DNA, 23 bp, Homo sapiens
agccactggctctgttcagttgt

SEQ ID NO: 143004 - DNA, 23 bp, Homo sapiens
tgcctgtgtccctgcctgtgtcc

SEQ ID NO: 143005 - DNA, 20 bp, Homo sapiens
gtgaggcactctgggggcct

SEQ ID NO: 143006 - DNA, 23 bp, Homo sapiens
tgtgcttgcctgtgtgcctccgt

SEQ ID NO: 143007 - DNA, 22 bp, Homo sapiens
tgcctgtgtgcctgtgtgtgtg

SEQ ID NO: 143008 - DNA, 23 bp, Homo sapiens
tctgtctctctgtgtgtgtctct

SEQ ID NO: 143009 - DNA, 23 bp, Homo sapiens
ccgtctctccctggctctgcctc

SEQ ID NO: 143010 - DNA, 21 bp, Homo sapiens
ctctgggtctgtctgcgcctg

SEQ ID NO: 143011 - DNA, 23 bp, Homo sapiens
tgagttcattgtagattctggat

SEQ ID NO: 143012 - DNA, 23 bp, Homo sapiens
tgagttcattgtagattctggat

SEQ ID NO: 143013 - DNA, 21 bp, Homo sapiens
tcacagtctgacagaactggg

SEQ ID NO: 143014 - DNA, 21 bp, Homo sapiens
ctctgggtctgtctgcgcctg

SEQ ID NO: 143015 - DNA, 23 bp, Homo sapiens
atgtgcattttgattttatctgt

SEQ ID NO: 143016 - DNA, 18 bp, Homo sapiens
tgtgcagctgcatgtgta

SEQ ID NO: 143017 - DNA, 23 bp, Homo sapiens
tctgtctctctgtgtgtgtctct

SEQ ID NO: 143018 - DNA, 23 bp, Homo sapiens
tgtctgcctgcctgtgtggtctc

SEQ ID NO: 143019 - DNA, 23 bp, Homo sapiens
tgtcagggtctgtctcagggtca

SEQ ID NO: 143020 - DNA, 21 bp, Homo sapiens
tgaggtaggaggatctcttga

SEQ ID NO: 143021 - DNA, 19 bp, Homo sapiens
tgtcccacaccctggctct

SEQ ID NO: 143022 - DNA, 23 bp, Homo sapiens
cctctctgtgtctgcggcactct

SEQ ID NO: 143023 - DNA, 23 bp, Homo sapiens
tcagtcctgtgcgtcctctgtct

SEQ ID NO: 143024 - DNA, 22 bp, Homo sapiens
gtgcgtgtctgtgtccgtgcat

SEQ ID NO: 143025 - DNA, 18 bp, Homo sapiens
tgcctggctccgtggctg

SEQ ID NO: 143026 - DNA, 23 bp, Homo sapiens
cactgtgcctcagacacaggcag

SEQ ID NO: 143027 - DNA, 23 bp, Homo sapiens
atctttctggaatgccattgggt

SEQ ID NO: 143028 - DNA, 23 bp, Homo sapiens
tcactgtgtctgtgtgagcctgt

SEQ ID NO: 143029 - DNA, 22 bp, Homo sapiens
taatctgactgggtatgagttt

SEQ ID NO: 143030 - DNA, 20 bp, Homo sapiens
ctttctggactttgggtatg

SEQ ID NO: 143031 - DNA, 23 bp, Homo sapiens
ctcagtgacaagacagggaggac

SEQ ID NO: 143032 - DNA, 23 bp, Homo sapiens
ccatcttcgtcaagttgccttgt

SEQ ID NO: 143033 - DNA, 23 bp, Homo sapiens
tatacatagtgtgtatatgtagt

SEQ ID NO: 143034 - DNA, 23 bp, Homo sapiens
acaccacttccagggaatgtcag

SEQ ID NO: 143035 - DNA, 20 bp, Homo sapiens
tcactggattcttctctgct

SEQ ID NO: 143036 - DNA, 23 bp, Homo sapiens
tgatgtcagttgtgagtgtgtgc

SEQ ID NO: 143037 - DNA, 23 bp, Homo sapiens
tgatgtcagttgtgagtgtgtgc

SEQ ID NO: 143038 - DNA, 20 bp, Homo sapiens
tgtgtatatatatatgtgtg

SEQ ID NO: 143039 - DNA, 23 bp, Homo sapiens
tctctttttcattgtaatcctta

SEQ ID NO: 143040 - DNA, 19 bp, Homo sapiens
tgaggtaggaggatcacaa

SEQ ID NO: 143041 - DNA, 23 bp, Homo sapiens
tctactgagtttcctgttgtgat

SEQ ID NO: 143042 - DNA, 23 bp, Homo sapiens
tatcacaagcagattcttgaacg

SEQ ID NO: 143043 - DNA, 23 bp, Homo sapiens
gtctctgtgtgtgtgtctgtgtc

SEQ ID NO: 143044 - DNA, 23 bp, Homo sapiens
tgagttcattgtagattctggat

SEQ ID NO: 143045 - DNA, 23 bp, Homo sapiens
tgagttcattgtagattctggat

SEQ ID NO: 143046 - DNA, 23 bp, Homo sapiens
agtgtccctcagtgtgtgtgttg

SEQ ID NO: 143047 - DNA, 23 bp, Homo sapiens
atggctctgtcagtggctctgtc

SEQ ID NO: 143048 - DNA, 20 bp, Homo sapiens
ttggctgtgggagtgatgag

SEQ ID NO: 143049 - DNA, 21 bp, Homo sapiens
tccctgtgtcgtttccatcct

SEQ ID NO: 143050 - DNA, 23 bp, Homo sapiens
ttcatcttcttcttcatgtagct

SEQ ID NO: 143051 - DNA, 23 bp, Homo sapiens
gaacacagagaacacagtgacca

SEQ ID NO: 143052 - DNA, 23 bp, Homo sapiens
caactcactgggtgattctctga

SEQ ID NO: 143053 - DNA, 22 bp, Homo sapiens
atgcaggtaagaatgtacattc

SEQ ID NO: 143054 - DNA, 23 bp, Homo sapiens
tctgtgtctgtctcattttctgc

SEQ ID NO: 143055 - DNA, 23 bp, Homo sapiens
gaccctctctgtcgctgtccctg

SEQ ID NO: 143056 - DNA, 23 bp, Homo sapiens
tcagttctctttgtctctcatca

SEQ ID NO: 143057 - DNA, 23 bp, Homo sapiens
tgtgtgtacatgggcatgtgtgt

SEQ ID NO: 143058 - DNA, 22 bp, Homo sapiens
tgtgcatgtgtgtttatgtaga

SEQ ID NO: 143059 - DNA, 23 bp, Homo sapiens
aaacagaagagtctgagttcaga

SEQ ID NO: 143060 - DNA, 18 bp, Homo sapiens
ggcacagggactcatgtc

SEQ ID NO: 143061 - DNA, 23 bp, Homo sapiens
ttcagagtggtagctgtttcttt

SEQ ID NO: 143062 - DNA, 21 bp, Homo sapiens
atggaggatatcaaacagttt

SEQ ID NO: 143063 - DNA, 23 bp, Homo sapiens
tgtctccctgtctgtctgcctcc

SEQ ID NO: 143064 - DNA, 20 bp, Homo sapiens
ttcagtggcatgatctcagc

SEQ ID NO: 143065 - DNA, 18 bp, Homo sapiens
ctctgcctctgagtctca

SEQ ID NO: 143066 - DNA, 23 bp, Homo sapiens
agcctggcacacagtaggcactt

SEQ ID NO: 143067 - DNA, 23 bp, Homo sapiens
tcagaagagagacaggaatagat

SEQ ID NO: 143068 - DNA, 20 bp, Homo sapiens
ttctgacatgactatgggtt

SEQ ID NO: 143069 - DNA, 23 bp, Homo sapiens
tatttctgtcagaatttcaaatg

SEQ ID NO: 143070 - DNA, 19 bp, Homo sapiens
attaagtaagacattagtt

SEQ ID NO: 143071 - DNA, 18 bp, Homo sapiens
tatactttaagttttagg

SEQ ID NO: 143072 - DNA, 23 bp, Homo sapiens
atggagtctcactctgtcaccca

SEQ ID NO: 143073 - DNA, 23 bp, Homo sapiens
tggagtctcactctgtcacccag

SEQ ID NO: 143074 - DNA, 23 bp, Homo sapiens
atgacagtgagtgagttctcatg

SEQ ID NO: 143075 - DNA, 23 bp, Homo sapiens
tgtgcgggtctctctgtctctcc

SEQ ID NO: 143076 - DNA, 23 bp, Homo sapiens
catgtcactgtctttatgtctca

SEQ ID NO: 143077 - DNA, 23 bp, Homo sapiens
cctctgtctgtgtgtctttctcc

SEQ ID NO: 143078 - DNA, 23 bp, Homo sapiens
tgtctaacttcttgaatctatag

SEQ ID NO: 143079 - DNA, 23 bp, Homo sapiens
actgagtctcactctgacgccca

SEQ ID NO: 143080 - DNA, 23 bp, Homo sapiens
aggctccgtgagtgggtctcttg

SEQ ID NO: 143081 - DNA, 23 bp, Homo sapiens
gaagagagaagctcgctatctct

SEQ ID NO: 143082 - DNA, 23 bp, Homo sapiens
ggctctcaccctgtctgtgccag

SEQ ID NO: 143083 - DNA, 23 bp, Homo sapiens
caatctctgtgtctgtcagcctg

SEQ ID NO: 143084 - DNA, 23 bp, Homo sapiens
gctctctctgtatgtgacttccc

SEQ ID NO: 143085 - DNA, 18 bp, Homo sapiens
gtggctggctctctgcag

SEQ ID NO: 143086 - DNA, 22 bp, Homo sapiens
tgtgtatatatatatatgtgtg

SEQ ID NO: 143087 - DNA, 23 bp, Homo sapiens
caatctcactctgtaagtcgctc

SEQ ID NO: 143088 - DNA, 18 bp, Homo sapiens
tttgttttttatctttgg

SEQ ID NO: 143089 - DNA, 23 bp, Homo sapiens
gcaggcactgtctgtgagtgtgg

SEQ ID NO: 143090 - DNA, 23 bp, Homo sapiens
tcagcgcctctcactgtgtgtcc

SEQ ID NO: 143091 - DNA, 21 bp, Homo sapiens
taactcattgaataatttctg

SEQ ID NO: 143092 - DNA, 21 bp, Homo sapiens
tgaggtaggtggatcacttga

SEQ ID NO: 143093 - DNA, 23 bp, Homo sapiens
gtatgtgtgcatgagcatgtgca

SEQ ID NO: 143094 - DNA, 23 bp, Homo sapiens
gtgtgcatggctgtttgcacatg

SEQ ID NO: 143095 - DNA, 18 bp, Homo sapiens
agtctccctctgtggccc

SEQ ID NO: 143096 - DNA, 21 bp, Homo sapiens
tcactgggagtgtgtttcaac

SEQ ID NO: 143097 - DNA, 23 bp, Homo sapiens
atgaaagagaaactgcatgtgct

SEQ ID NO: 143098 - DNA, 19 bp, Homo sapiens
gacagagaaaaatcactga

SEQ ID NO: 143099 - DNA, 23 bp, Homo sapiens
aatctcagtctatgtctctcccc

SEQ ID NO: 143100 - DNA, 18 bp, Homo sapiens
tttggtgtccttcatttt

SEQ ID NO: 143101 - DNA, 22 bp, Homo sapiens
taaatgtgcatttttgatctat

SEQ ID NO: 143102 - DNA, 23 bp, Homo sapiens
tctcttgtctgattgctctggct

SEQ ID NO: 143103 - DNA, 22 bp, Homo sapiens
taccaggaaatcttaagagaat

SEQ ID NO: 143104 - DNA, 19 bp, Homo sapiens
ttcagtcatgttggaaatg

SEQ ID NO: 143105 - DNA, 23 bp, Homo sapiens
aggtagagtctcactctgtcacc

SEQ ID NO: 143106 - DNA, 23 bp, Homo sapiens
taatgtatattttataatgtgta

SEQ ID NO: 143107 - DNA, 23 bp, Homo sapiens
aggcaaagagttcctttcttttt

SEQ ID NO: 143108 - DNA, 23 bp, Homo sapiens
cagggtctcactctgtcatacag

SEQ ID NO: 143109 - DNA, 23 bp, Homo sapiens
tgtgtgtctatatgtatatctga

SEQ ID NO: 143110 - DNA, 23 bp, Homo sapiens
ttccactcatgactgtaggacac

SEQ ID NO: 143111 - DNA, 23 bp, Homo sapiens
tgtctctgtctgcctgtctggtt

SEQ ID NO: 143112 - DNA, 23 bp, Homo sapiens
attttctttttgaaaattagagg

SEQ ID NO: 143113 - DNA, 23 bp, Homo sapiens
cctgtgcttgttctttctgcagt

SEQ ID NO: 143114 - DNA, 21 bp, Homo sapiens
cactggctgtgtctgcctggg

SEQ ID NO: 143115 - DNA, 22 bp, Homo sapiens
atgtgcttgtatgtatgtgtct

SEQ ID NO: 143116 - DNA, 20 bp, Homo sapiens
cagaagtgcttgcagtgttc

SEQ ID NO: 143117 - DNA, 22 bp, Homo sapiens
caccatcttaactgttctgtct

SEQ ID NO: 143118 - DNA, 23 bp, Homo sapiens
tgtgtatgtatgtgtgtgtatat

SEQ ID NO: 143119 - DNA, 23 bp, Homo sapiens
tctgtggttgttggatgaaatgt

SEQ ID NO: 143120 - DNA, 19 bp, Homo sapiens
ctgtggattgtactttggg

SEQ ID NO: 143121 - DNA, 23 bp, Homo sapiens
tctgtgtgagtgtgtctgcatga

SEQ ID NO: 143122 - DNA, 23 bp, Homo sapiens
ggctgtctctctctcaggctgag

SEQ ID NO: 143123 - DNA, 23 bp, Homo sapiens
gcatttggaattcttccagtaat

SEQ ID NO: 143124 - DNA, 23 bp, Homo sapiens
agaagagtgtgaatgctttttga

SEQ ID NO: 143125 - DNA, 19 bp, Homo sapiens
taggacacaaacttgtgtg

SEQ ID NO: 143126 - DNA, 23 bp, Homo sapiens
tctgtctcactgtcatttgagct

SEQ ID NO: 143127 - DNA, 19 bp, Homo sapiens
caaagttcgctggagctga

SEQ ID NO: 143128 - DNA, 18 bp, Homo sapiens
ttattgctggtcaactgc

SEQ ID NO: 143129 - DNA, 18 bp, Homo sapiens
acagtcagatttgaaggc

SEQ ID NO: 143130 - DNA, 21 bp, Homo sapiens
ttaatggttcttttcaggtct

SEQ ID NO: 143131 - DNA, 23 bp, Homo sapiens
cggagtctcactctgtcacccag

SEQ ID NO: 143132 - DNA, 23 bp, Homo sapiens
gagtctcactctgtcacccaggc

SEQ ID NO: 143133 - DNA, 23 bp, Homo sapiens
tctctgcctccctctgtgcttcc

SEQ ID NO: 143134 - DNA, 23 bp, Homo sapiens
ttatgacgtatttatttggatga

SEQ ID NO: 143135 - DNA, 23 bp, Homo sapiens
tatttcagagcttttcattatta

SEQ ID NO: 143136 - DNA, 23 bp, Homo sapiens
ctattgtaattgttttggcgtgc

SEQ ID NO: 143137 - DNA, 22 bp, Homo sapiens
tgggtgcgactagagtagctct

SEQ ID NO: 143138 - DNA, 23 bp, Homo sapiens
cactgtctcagcctctgtcctgt

SEQ ID NO: 143139 - DNA, 20 bp, Homo sapiens
tcattctgaggagaaggctg

SEQ ID NO: 143140 - DNA, 18 bp, Homo sapiens
gactctgtttcttttttc

SEQ ID NO: 143141 - DNA, 19 bp, Homo sapiens
cattaataaaaaagctttg

SEQ ID NO: 143142 - DNA, 22 bp, Homo sapiens
tgacacggtgactcagtgacac

SEQ ID NO: 143143 - DNA, 23 bp, Homo sapiens
tggctgtcactgtcactgtttac

SEQ ID NO: 143144 - DNA, 23 bp, Homo sapiens
atgaggtctccttatgttgccca

SEQ ID NO: 143145 - DNA, 20 bp, Homo sapiens
tgagagaactgagagagccc

SEQ ID NO: 143146 - DNA, 21 bp, Homo sapiens
tgtctgagtgctttcactgtc

SEQ ID NO: 143147 - DNA, 23 bp, Homo sapiens
agggtgtctcactctgtcaccca

SEQ ID NO: 143148 - DNA, 23 bp, Homo sapiens
agccagggtccctgttagggagt

SEQ ID NO: 143149 - DNA, 18 bp, Homo sapiens
agccagggtccctgttag

SEQ ID NO: 143150 - DNA, 18 bp, Homo sapiens
acctccaagagcctatgt

SEQ ID NO: 143151 - DNA, 22 bp, Homo sapiens
tcatgtgtgcttctgttaggaa

SEQ ID NO: 143152 - DNA, 21 bp, Homo sapiens
tggagtctctctctgtcaccc

SEQ ID NO: 143153 - DNA, 23 bp, Homo sapiens
tgtgcccctgtgtgcctgtgtct

SEQ ID NO: 143154 - DNA, 20 bp, Homo sapiens
atgtgtgtatatgtatatat

SEQ ID NO: 143155 - DNA, 23 bp, Homo sapiens
aggtctctctctgtcacccaggc

SEQ ID NO: 143156 - DNA, 19 bp, Homo sapiens
tctgtgtgtgtgtgtgtat

SEQ ID NO: 143157 - DNA, 21 bp, Homo sapiens
atacacacacacacatatatg

SEQ ID NO: 143158 - DNA, 23 bp, Homo sapiens
acagtctgtcagcctaactaagc

SEQ ID NO: 143159 - DNA, 23 bp, Homo sapiens
gtatgtatatgtatatgtttaag

SEQ ID NO: 143160 - DNA, 23 bp, Homo sapiens
caggtgtcagagactggctggaa

SEQ ID NO: 143161 - DNA, 23 bp, Homo sapiens
tctttcacaaaggttgacttcag

SEQ ID NO: 143162 - DNA, 21 bp, Homo sapiens
tctcagccccatcactctctc

SEQ ID NO: 143163 - DNA, 23 bp, Homo sapiens
tgcaccaaatgtactgtattttt

SEQ ID NO: 143164 - DNA, 21 bp, Homo sapiens
tatgcgtatatatacgtatat

SEQ ID NO: 143165 - DNA, 23 bp, Homo sapiens
atacgtgtatatatatatgtgtg

SEQ ID NO: 143166 - DNA, 20 bp, Homo sapiens
atgtatgtatatatatgtat

SEQ ID NO: 143167 - DNA, 19 bp, Homo sapiens
ctgcaaataggttacatga

SEQ ID NO: 143168 - DNA, 23 bp, Homo sapiens
actctgactctgtcatacctctg

SEQ ID NO: 143169 - DNA, 23 bp, Homo sapiens
cggagtctcactctgtcacccag

SEQ ID NO: 143170 - DNA, 23 bp, Homo sapiens
gagtctcactctgtcacccaggc

SEQ ID NO: 143171 - DNA, 20 bp, Homo sapiens
aatttgtatattagcttttg

SEQ ID NO: 143172 - DNA, 22 bp, Homo sapiens
aaggtgtctgtatgtcttctgt

SEQ ID NO: 143173 - DNA, 23 bp, Homo sapiens
ttttgagacggagtcttgctctg

SEQ ID NO: 143174 - DNA, 23 bp, Homo sapiens
aaggtctcactctgtcacttagg

SEQ ID NO: 143175 - DNA, 23 bp, Homo sapiens
caaggtctcactctgtcacccag

SEQ ID NO: 143176 - DNA, 18 bp, Homo sapiens
tcactgcagtctctgtct

SEQ ID NO: 143177 - DNA, 19 bp, Homo sapiens
ttggcttggagggagaaaa

SEQ ID NO: 143178 - DNA, 19 bp, Homo sapiens
ttgagtacatgtggttctg

SEQ ID NO: 143179 - DNA, 23 bp, Homo sapiens
tgaccatgtctttattttgcatt

SEQ ID NO: 143180 - DNA, 23 bp, Homo sapiens
tagtcttacaggaaatgtgcaaa

SEQ ID NO: 143181 - DNA, 19 bp, Homo sapiens
gtctcgcactgtcgctcag

SEQ ID NO: 143182 - DNA, 23 bp, Homo sapiens
tgtgtgtgtatctgtgtgtatga

SEQ ID NO: 143183 - DNA, 18 bp, Homo sapiens
gaggaacaccagcagaag

SEQ ID NO: 143184 - DNA, 23 bp, Homo sapiens
tgagttcattgtagattctggat

SEQ ID NO: 143185 - DNA, 23 bp, Homo sapiens
tgagttcattgtagattctggat

SEQ ID NO: 143186 - DNA, 23 bp, Homo sapiens
tgagttcattgtagattctggat

SEQ ID NO: 143187 - DNA, 23 bp, Homo sapiens
tgagttcattgtagattctggat

SEQ ID NO: 143188 - DNA, 23 bp, Homo sapiens
tgactgtgtgactgtgtggttta

SEQ ID NO: 143189 - DNA, 23 bp, Homo sapiens
aagtgcactatatttattgtgta

SEQ ID NO: 143190 - DNA, 22 bp, Homo sapiens
tgtgtagtgtgtgtacacacat

SEQ ID NO: 143191 - DNA, 23 bp, Homo sapiens
cggagtctcactctgtcacccag

SEQ ID NO: 143192 - DNA, 23 bp, Homo sapiens
gagtctcactctgtcacccaggc

SEQ ID NO: 143193 - DNA, 23 bp, Homo sapiens
gacagagtctcgctctgtcaccc

SEQ ID NO: 143194 - DNA, 22 bp, Homo sapiens
acagtctcactctgtcgccctg

SEQ ID NO: 143195 - DNA, 23 bp, Homo sapiens
aggtttgagtggatttatctatg

SEQ ID NO: 143196 - DNA, 21 bp, Homo sapiens
tgagagtgaagcacaatgaat

SEQ ID NO: 143197 - DNA, 23 bp, Homo sapiens
tttcaaattttctacaaaaacga

SEQ ID NO: 143198 - DNA, 22 bp, Homo sapiens
ttgagacagggtctcgctgtgt

SEQ ID NO: 143199 - DNA, 23 bp, Homo sapiens
tcagtccgtccgtctgtccgtcc

SEQ ID NO: 143200 - DNA, 18 bp, Homo sapiens
atgtatgtatgtgtgtgc

SEQ ID NO: 143201 - DNA, 21 bp, Homo sapiens
atatgtgtatatatatgtgtg

SEQ ID NO: 143202 - DNA, 23 bp, Homo sapiens
tattacttgaagaactgcaggac

SEQ ID NO: 143203 - DNA, 21 bp, Homo sapiens
tctgcctctctgcctggctca

SEQ ID NO: 143204 - DNA, 18 bp, Homo sapiens
ggctgcctctgagtcttg

SEQ ID NO: 143205 - DNA, 23 bp, Homo sapiens
gtgctcacacactcacagcctgg

SEQ ID NO: 143206 - DNA, 22 bp, Homo sapiens
gcatgaagaggcgagaggctct

SEQ ID NO: 143207 - DNA, 19 bp, Homo sapiens
tgagtgtttttccatctcc

SEQ ID NO: 143208 - DNA, 23 bp, Homo sapiens
gctctctgagtctcagtgcctgc

SEQ ID NO: 143209 - DNA, 23 bp, Homo sapiens
gtcagagtctcactctgtcgccc

SEQ ID NO: 143210 - DNA, 23 bp, Homo sapiens
ttgactcccactctctatcatta

SEQ ID NO: 143211 - DNA, 23 bp, Homo sapiens
aggtgaccctggagtgttagtgt

SEQ ID NO: 143212 - DNA, 23 bp, Homo sapiens
acaaatacatacctgagactagg

SEQ ID NO: 143213 - DNA, 23 bp, Homo sapiens
agagaacacaggctccacacagc

SEQ ID NO: 143214 - DNA, 23 bp, Homo sapiens
atttccacttttttcctgtctgt

SEQ ID NO: 143215 - DNA, 23 bp, Homo sapiens
taggtgctcagtctctctgggac

SEQ ID NO: 143216 - DNA, 19 bp, Homo sapiens
aacagcagggacactcacc

SEQ ID NO: 143217 - DNA, 18 bp, Homo sapiens
tgtcaccaggctagagtg

SEQ ID NO: 143218 - DNA, 22 bp, Homo sapiens
tgtgagacagagtctccctctg

SEQ ID NO: 143219 - DNA, 23 bp, Homo sapiens
ccactctctgtctccctcagatc

SEQ ID NO: 143220 - DNA, 23 bp, Homo sapiens
tgacagatgacactgactgtcac

SEQ ID NO: 143221 - DNA, 18 bp, Homo sapiens
aaagtgggagctcattat

SEQ ID NO: 143222 - DNA, 23 bp, Homo sapiens
tgacccagaagatagcatcatgt

SEQ ID NO: 143223 - DNA, 23 bp, Homo sapiens
tctgcctctctggctgcctcaga

SEQ ID NO: 143224 - DNA, 23 bp, Homo sapiens
ttaaagagtctggatatgagacc

SEQ ID NO: 143225 - DNA, 22 bp, Homo sapiens
tggctgagtggttcttctttga

SEQ ID NO: 143226 - DNA, 23 bp, Homo sapiens
ttaacaagtgatattgtagaaga

SEQ ID NO: 143227 - DNA, 23 bp, Homo sapiens
acagtgagattcagttagaagtg

SEQ ID NO: 143228 - DNA, 19 bp, Homo sapiens
tattctatgtatatcatat

SEQ ID NO: 143229 - DNA, 23 bp, Homo sapiens
aagactgggaggaaaccaattgt

SEQ ID NO: 143230 - DNA, 23 bp, Homo sapiens
gaatacaagtgattttcttttat

SEQ ID NO: 143231 - DNA, 23 bp, Homo sapiens
aactgtgtgtgcgtgtgaatatg

SEQ ID NO: 143232 - DNA, 18 bp, Homo sapiens
ttactcagcttttatttt

SEQ ID NO: 143233 - DNA, 23 bp, Homo sapiens
aaggtccatttgttcacgtgtag

SEQ ID NO: 143234 - DNA, 23 bp, Homo sapiens
cctctgtgtctgtgtccttgcct

SEQ ID NO: 143235 - DNA, 23 bp, Homo sapiens
atgtctgtatgtatatgtgtgta

SEQ ID NO: 143236 - DNA, 20 bp, Homo sapiens
cgagaccctctctctcactg

SEQ ID NO: 143237 - DNA, 22 bp, Homo sapiens
gtcagagtctcactctgtcgcc

SEQ ID NO: 143238 - DNA, 23 bp, Homo sapiens
tatgcttccttctgtttgggaaa

SEQ ID NO: 143239 - DNA, 23 bp, Homo sapiens
agtctcagcctcagtctctctca

SEQ ID NO: 143240 - DNA, 23 bp, Homo sapiens
gtcagatgtcacagagcagaagc

SEQ ID NO: 143241 - DNA, 22 bp, Homo sapiens
tatacacatactatatatgtgt

SEQ ID NO: 143242 - DNA, 22 bp, Homo sapiens
tatacacatactatatatgtgt

SEQ ID NO: 143243 - DNA, 23 bp, Homo sapiens
tgggagagcttcttatatgcaac

SEQ ID NO: 143244 - DNA, 21 bp, Homo sapiens
tgaggtaggaggatcatttga

SEQ ID NO: 143245 - DNA, 23 bp, Homo sapiens
ccctgtgtgcctctttctctgcc

SEQ ID NO: 143246 - DNA, 23 bp, Homo sapiens
actgcattttttaggagaattca

SEQ ID NO: 143247 - DNA, 23 bp, Homo sapiens
tacaaaactacttgtacatatgt

SEQ ID NO: 143248 - DNA, 20 bp, Homo sapiens
tgggtgagtgaattcaggaa

SEQ ID NO: 143249 - DNA, 23 bp, Homo sapiens
ttctctctgagcttaagagttcc

SEQ ID NO: 143250 - DNA, 23 bp, Homo sapiens
taaggtattttattctttttgta

SEQ ID NO: 143251 - DNA, 23 bp, Homo sapiens
acagagtctcactctgtcaccca

SEQ ID NO: 143252 - DNA, 23 bp, Homo sapiens
aaaatactgatataatgatgtta

SEQ ID NO: 143253 - DNA, 23 bp, Homo sapiens
tgagatggagtctctctctgtca

SEQ ID NO: 143254 - DNA, 23 bp, Homo sapiens
gcactgtaatacaattctgatag

SEQ ID NO: 143255 - DNA, 20 bp, Homo sapiens
agctgtaaaagaagtggata

SEQ ID NO: 143256 - DNA, 18 bp, Homo sapiens
tgtgtgtgtgtatatata

SEQ ID NO: 143257 - DNA, 23 bp, Homo sapiens
tctctctgtggctcagtgtcctt

SEQ ID NO: 143258 - DNA, 21 bp, Homo sapiens
tcagtccctgtgagtcactgt

SEQ ID NO: 143259 - DNA, 19 bp, Homo sapiens
tctagacaaaataagtaaa

SEQ ID NO: 143260 - DNA, 23 bp, Homo sapiens
tggagtctctctctgtcgctcag

SEQ ID NO: 143261 - DNA, 23 bp, Homo sapiens
tgtctgtggctctgtgtctcctt

SEQ ID NO: 143262 - DNA, 23 bp, Homo sapiens
tggacttcctgcatccttagggt

SEQ ID NO: 143263 - DNA, 23 bp, Homo sapiens
ttgttgagtctctctgtgcctca

SEQ ID NO: 143264 - DNA, 23 bp, Homo sapiens
gtcagagatgtgtgacaactgag

SEQ ID NO: 143265 - DNA, 23 bp, Homo sapiens
attcatcctcatcatcttcttca

SEQ ID NO: 143266 - DNA, 23 bp, Homo sapiens
tggcagagttgagtagttgtgac

SEQ ID NO: 143267 - DNA, 22 bp, Homo sapiens
ctgcctcagtgactctgtccat

SEQ ID NO: 143268 - DNA, 22 bp, Homo sapiens
tttgcctcagaaaactctggtg

SEQ ID NO: 143269 - DNA, 23 bp, Homo sapiens
ttatgtgtcagggttttttgttt

SEQ ID NO: 143270 - DNA, 23 bp, Homo sapiens
agctggtctcaaactcctagact

SEQ ID NO: 143271 - DNA, 19 bp, Homo sapiens
acatgatatatatacatga

SEQ ID NO: 143272 - DNA, 18 bp, Homo sapiens
tttgtctcataaaaggaa

SEQ ID NO: 143273 - DNA, 19 bp, Homo sapiens
tttgaaatggagtctttct

SEQ ID NO: 143274 - DNA, 23 bp, Homo sapiens
tttgagatggagtcattctctgt

SEQ ID NO: 143275 - DNA, 23 bp, Homo sapiens
cggagtctcactctgtcacccag

SEQ ID NO: 143276 - DNA, 23 bp, Homo sapiens
tgcacagcatattttttctttat

SEQ ID NO: 143277 - DNA, 23 bp, Homo sapiens
gtatctgtgtgtgtgtgcgtgtg

SEQ ID NO: 143278 - DNA, 18 bp, Homo sapiens
tatgtgtgagtgtgatgt

SEQ ID NO: 143279 - DNA, 18 bp, Homo sapiens
tggtagtttgtctggagc

SEQ ID NO: 143280 - DNA, 23 bp, Homo sapiens
tgagttcattgtagattctggat

SEQ ID NO: 143281 - DNA, 23 bp, Homo sapiens
tgagttcattgtagattctggat

SEQ ID NO: 143282 - DNA, 23 bp, Homo sapiens
tgagttcattgtagattctggat

SEQ ID NO: 143283 - DNA, 23 bp, Homo sapiens
tgagttcattgtagattctggat

SEQ ID NO: 143284 - DNA, 23 bp, Homo sapiens
tgagttcattgtagattctggat

SEQ ID NO: 143285 - DNA, 23 bp, Homo sapiens
tgagttcattgtagattctggat

SEQ ID NO: 143286 - DNA, 23 bp, Homo sapiens
ctctctctctctgtctcgatggg

SEQ ID NO: 143287 - DNA, 23 bp, Homo sapiens
actctgcaactacaagctctgtg

SEQ ID NO: 143288 - DNA, 23 bp, Homo sapiens
tgagacagagtctcactgttgct

SEQ ID NO: 143289 - DNA, 23 bp, Homo sapiens
tgagttcattgtagattctggat

SEQ ID NO: 143290 - DNA, 23 bp, Homo sapiens
tgagttcattgtagattctggat

SEQ ID NO: 143291 - DNA, 23 bp, Homo sapiens
tgagttcattgtagattctggat

SEQ ID NO: 143292 - DNA, 23 bp, Homo sapiens
tgagttcattgtagattctggat

SEQ ID NO: 143293 - DNA, 23 bp, Homo sapiens
tgagttcattgtagattctggat

SEQ ID NO: 143294 - DNA, 23 bp, Homo sapiens
tgagttcattgtagattctggat

SEQ ID NO: 143295 - DNA, 22 bp, Homo sapiens
tgtgtcactctgagataaggga

SEQ ID NO: 143296 - DNA, 20 bp, Homo sapiens
aaatgcttgtgcaattcatg

SEQ ID NO: 143297 - DNA, 23 bp, Homo sapiens
tacatgtgcacaatgtgcaggtt

SEQ ID NO: 143298 - DNA, 23 bp, Homo sapiens
tgtctctgtctgtctcactgcca

SEQ ID NO: 143299 - DNA, 21 bp, Homo sapiens
tatacgtatatattgtataca

SEQ ID NO: 143300 - DNA, 21 bp, Homo sapiens
ttattgcacttctttcattac

SEQ ID NO: 143301 - DNA, 23 bp, Homo sapiens
gggctctctctctctcacctgac

SEQ ID NO: 143302 - DNA, 23 bp, Homo sapiens
aaatcagatgttcccagagtctt

SEQ ID NO: 143303 - DNA, 21 bp, Homo sapiens
tatgtgtatatatatgtatgt

SEQ ID NO: 143304 - DNA, 23 bp, Homo sapiens
tggagtctcactctgtcacccag

SEQ ID NO: 143305 - DNA, 23 bp, Homo sapiens
gtgtgtgtatatatatatgtgtg

SEQ ID NO: 143306 - DNA, 23 bp, Homo sapiens
tagtatgtgtacatatgtatcta

SEQ ID NO: 143307 - DNA, 23 bp, Homo sapiens
tgagttcattgtagattctggat

SEQ ID NO: 143308 - DNA, 23 bp, Homo sapiens
tgagttcattgtagattctggat

SEQ ID NO: 143309 - DNA, 23 bp, Homo sapiens
gagtctcacactgtgtcccaggc

SEQ ID NO: 143310 - DNA, 23 bp, Homo sapiens
tttgagacagtctcgctctgtta

SEQ ID NO: 143311 - DNA, 23 bp, Homo sapiens
gtgtgtgtgtctgtgagtgggag

SEQ ID NO: 143312 - DNA, 22 bp, Homo sapiens
ttattatgtatgtatacatgta

SEQ ID NO: 143313 - DNA, 18 bp, Homo sapiens
atcagggatcactgtagc

SEQ ID NO: 143314 - DNA, 23 bp, Homo sapiens
ggctgacagatcagcctgtgctc

SEQ ID NO: 143315 - DNA, 23 bp, Homo sapiens
agagtctcactctgtcacccagg

SEQ ID NO: 143316 - DNA, 20 bp, Homo sapiens
ctgtgggcgtatacacacac

SEQ ID NO: 143317 - DNA, 21 bp, Homo sapiens
atgtgcatatatttatgtgag

SEQ ID NO: 143318 - DNA, 23 bp, Homo sapiens
cggagtctcactctgtcacccag

SEQ ID NO: 143319 - DNA, 23 bp, Homo sapiens
atctcggctcactgcaacctctg

SEQ ID NO: 143320 - DNA, 23 bp, Homo sapiens
gagtctcactctgtcacccaggc

SEQ ID NO: 143321 - DNA, 23 bp, Homo sapiens
ggtctcatctgttgcacaggctg

SEQ ID NO: 143322 - DNA, 23 bp, Homo sapiens
aaaatgtcaggaatattttgcct

SEQ ID NO: 143323 - DNA, 23 bp, Homo sapiens
tgagttcattgtagattctggat

SEQ ID NO: 143324 - DNA, 23 bp, Homo sapiens
tgagttcattgtagattctggat

SEQ ID NO: 143325 - DNA, 22 bp, Homo sapiens
tttgttctttttgcttaggatt

SEQ ID NO: 143326 - DNA, 23 bp, Homo sapiens
actgtatgaagaatgtcaatggt

SEQ ID NO: 143327 - DNA, 23 bp, Homo sapiens
tgagttcattgtagattctggat

SEQ ID NO: 143328 - DNA, 23 bp, Homo sapiens
tgagttcattgtagattctggat

SEQ ID NO: 143329 - DNA, 23 bp, Homo sapiens
gagagcaaaatggcttctgtagt

SEQ ID NO: 143330 - DNA, 23 bp, Homo sapiens
aggtcagtcactgagtgcctctg

SEQ ID NO: 143331 - DNA, 18 bp, Homo sapiens
ttggctcactgtaagctc

SEQ ID NO: 143332 - DNA, 23 bp, Homo sapiens
tttattttaagaagtgccagggt

SEQ ID NO: 143333 - DNA, 23 bp, Homo sapiens
atatatacatatgtgtgtgtata

SEQ ID NO: 143334 - DNA, 22 bp, Homo sapiens
agagtagtgtttttgctgaagg

SEQ ID NO: 143335 - DNA, 23 bp, Homo sapiens
cttcctctagatttgttcatgtt

SEQ ID NO: 143336 - DNA, 22 bp, Homo sapiens
ttagactttccttgtttttgta

SEQ ID NO: 143337 - DNA, 23 bp, Homo sapiens
tggcaagtctctgagtctgtgct

SEQ ID NO: 143338 - DNA, 20 bp, Homo sapiens
tacacagtagagtgtgtgca

SEQ ID NO: 143339 - DNA, 23 bp, Homo sapiens
tggtggcccattttattgtgtta

SEQ ID NO: 143340 - DNA, 23 bp, Homo sapiens
tgagttcattgtagattctggat

SEQ ID NO: 143341 - DNA, 23 bp, Homo sapiens
tgagttcattgtagattctggat

SEQ ID NO: 143342 - DNA, 19 bp, Homo sapiens
ttttatgctctctttctca

SEQ ID NO: 143343 - DNA, 23 bp, Homo sapiens
tgagttcattgtagattctggat

SEQ ID NO: 143344 - DNA, 23 bp, Homo sapiens
tgagttcattgtagattctggat

SEQ ID NO: 143345 - DNA, 23 bp, Homo sapiens
attatgtcagctattctttatga

SEQ ID NO: 143346 - DNA, 18 bp, Homo sapiens
tataattttagttttggg

SEQ ID NO: 143347 - DNA, 19 bp, Homo sapiens
ggagttttgtaaggtacta

SEQ ID NO: 143348 - DNA, 23 bp, Homo sapiens
agagagttgagtgtgagctgcag

SEQ ID NO: 143349 - DNA, 23 bp, Homo sapiens
taacagtgcttcttcttgacagt

SEQ ID NO: 143350 - DNA, 19 bp, Homo sapiens
agagggtggcagggtgggt

SEQ ID NO: 143351 - DNA, 23 bp, Homo sapiens
acggagtgtgattggtggtggta

SEQ ID NO: 143352 - DNA, 20 bp, Homo sapiens
cagccagacagtctctcact

SEQ ID NO: 143353 - DNA, 23 bp, Homo sapiens
tggagtctcactctgtcacccag

SEQ ID NO: 143354 - DNA, 19 bp, Homo sapiens
tctatcagtgatttagttt

SEQ ID NO: 143355 - DNA, 23 bp, Homo sapiens
aaggaaaaagagaaaccagttag

SEQ ID NO: 143356 - DNA, 22 bp, Homo sapiens
tctcaagctcgctctctctctt

SEQ ID NO: 143357 - DNA, 22 bp, Homo sapiens
attcatatgtcctggctgccta

SEQ ID NO: 143358 - DNA, 21 bp, Homo sapiens
tatgcatatatacatatatgt

SEQ ID NO: 143359 - DNA, 23 bp, Homo sapiens
catatatgtatatatgtatatca

SEQ ID NO: 143360 - DNA, 20 bp, Homo sapiens
tcagcaccaccctgagtgtg

SEQ ID NO: 143361 - DNA, 23 bp, Homo sapiens
tattgagtgaagtcattcagttc

SEQ ID NO: 143362 - DNA, 19 bp, Homo sapiens
tttcctccagttaaactcc

SEQ ID NO: 143363 - DNA, 23 bp, Homo sapiens
tgagttcattgtagattctggat

SEQ ID NO: 143364 - DNA, 23 bp, Homo sapiens
tgagttcattgtagattctggat

SEQ ID NO: 143365 - DNA, 23 bp, Homo sapiens
gtgtgtgtgtgcatgtgcatgtg

SEQ ID NO: 143366 - DNA, 23 bp, Homo sapiens
tgagatggagtctcactctgtcg

SEQ ID NO: 143367 - DNA, 23 bp, Homo sapiens
ttttgagactgagtctcactctg

SEQ ID NO: 143368 - DNA, 20 bp, Homo sapiens
ggctttgaatgctaaagtga

SEQ ID NO: 143369 - DNA, 21 bp, Homo sapiens
tttcagcaacatttccttcct

SEQ ID NO: 143370 - DNA, 18 bp, Homo sapiens
ttaagcttcttgcatact

SEQ ID NO: 143371 - DNA, 21 bp, Homo sapiens
atgagtatgtatatgtataga

SEQ ID NO: 143372 - DNA, 19 bp, Homo sapiens
tgggagtgaagccacctgg

SEQ ID NO: 143373 - DNA, 19 bp, Homo sapiens
aaaatggactttctcatat

SEQ ID NO: 143374 - DNA, 22 bp, Homo sapiens
ttttctggaatacaaagtgaac

SEQ ID NO: 143375 - DNA, 19 bp, Homo sapiens
tgctctaggcatagctatg

SEQ ID NO: 143376 - DNA, 23 bp, Homo sapiens
tttctctctgtgtaacttctgtc

SEQ ID NO: 143377 - DNA, 18 bp, Homo sapiens
tacagcaagacaagaaat

SEQ ID NO: 143378 - DNA, 21 bp, Homo sapiens
tttagcttatattggtttaca

SEQ ID NO: 143379 - DNA, 23 bp, Homo sapiens
tatcagtgaattgtttcatatat

SEQ ID NO: 143380 - DNA, 18 bp, Homo sapiens
aagggaactggaattgaa

SEQ ID NO: 143381 - DNA, 22 bp, Homo sapiens
tttctcagtcccttactagagt

SEQ ID NO: 143382 - DNA, 23 bp, Homo sapiens
atatgtgtgtatatatatgtgtg

SEQ ID NO: 143383 - DNA, 20 bp, Homo sapiens
tataaatctaggtatagata

SEQ ID NO: 143384 - DNA, 23 bp, Homo sapiens
tctatctgtatctagatatgtat

SEQ ID NO: 143385 - DNA, 20 bp, Homo sapiens
taatctctcctgtatatgtg

SEQ ID NO: 143386 - DNA, 18 bp, Homo sapiens
ttaggaggtacaagtaag

SEQ ID NO: 143387 - DNA, 20 bp, Homo sapiens
ttttgggaggcaaagaaggg

SEQ ID NO: 143388 - DNA, 18 bp, Homo sapiens
tatgcaatttttatcatt

SEQ ID NO: 143389 - DNA, 21 bp, Homo sapiens
attgcagaaaagttaggcgtt

SEQ ID NO: 143390 - DNA, 23 bp, Homo sapiens
ttttttgttttagaaagagcatt

SEQ ID NO: 143391 - DNA, 23 bp, Homo sapiens
atatgtgtgtatatatatatgtg

SEQ ID NO: 143392 - DNA, 23 bp, Homo sapiens
tgagagggagtctcgctgtgtca

SEQ ID NO: 143393 - DNA, 21 bp, Homo sapiens
tctgcctctgtctttgcctgg

SEQ ID NO: 143394 - DNA, 23 bp, Homo sapiens
tccttgtgtgtgtgcctgtgtct

SEQ ID NO: 143395 - DNA, 23 bp, Homo sapiens
tatgtgtgtgtgtgtaactctct

SEQ ID NO: 143396 - DNA, 23 bp, Homo sapiens
tatggtgtatatatatggtgtat

SEQ ID NO: 143397 - DNA, 23 bp, Homo sapiens
tgagttcattgtagattctggat

SEQ ID NO: 143398 - DNA, 23 bp, Homo sapiens
tgagttcattgtagattctggat

SEQ ID NO: 143399 - DNA, 23 bp, Homo sapiens
tgacttctctgtctctgtgcttc

SEQ ID NO: 143400 - DNA, 23 bp, Homo sapiens
aggtaatcttagaagagagtcag

SEQ ID NO: 143401 - DNA, 23 bp, Homo sapiens
gagagacatgtacctctaactat

SEQ ID NO: 143402 - DNA, 21 bp, Homo sapiens
ctgttagaccagtgtgtgctc

SEQ ID NO: 143403 - DNA, 23 bp, Homo sapiens
aggaaatcacatcctgtaatcca

SEQ ID NO: 143404 - DNA, 18 bp, Homo sapiens
tatatgtacatatatatg

SEQ ID NO: 143405 - DNA, 23 bp, Homo sapiens
aacacacatatatacacacatac

SEQ ID NO: 143406 - DNA, 20 bp, Homo sapiens
tctccctgtgtgtgtctgtc

SEQ ID NO: 143407 - DNA, 23 bp, Homo sapiens
tttgagacggagtctcgctctgt

SEQ ID NO: 143408 - DNA, 21 bp, Homo sapiens
aaaaggacttgactgggtgtg

SEQ ID NO: 143409 - DNA, 22 bp, Homo sapiens
gtgcttatcatgtgacctggtg

SEQ ID NO: 143410 - DNA, 23 bp, Homo sapiens
gcctccctctgtgcctcagttgc

SEQ ID NO: 143411 - DNA, 23 bp, Homo sapiens
tacactgtatatgtgtgtgtgta

SEQ ID NO: 143412 - DNA, 23 bp, Homo sapiens
aagatgaggtctcattatgttgt

SEQ ID NO: 143413 - DNA, 18 bp, Homo sapiens
ctgtgacaatgaagcatg

SEQ ID NO: 143414 - DNA, 23 bp, Homo sapiens
gacagagtctcgctctgtcaccc

SEQ ID NO: 143415 - DNA, 23 bp, Homo sapiens
acagagtctcactctgtcgccca

SEQ ID NO: 143416 - DNA, 22 bp, Homo sapiens
tacagggaagactttctcagtt

SEQ ID NO: 143417 - DNA, 21 bp, Homo sapiens
tgagagagtctcactctgttg

SEQ ID NO: 143418 - DNA, 20 bp, Homo sapiens
gtgagaggatcacttgagcc

SEQ ID NO: 143419 - DNA, 23 bp, Homo sapiens
agacagtctcgctctgtctccca

SEQ ID NO: 143420 - DNA, 19 bp, Homo sapiens
tctcagtctgtcaaccagg

SEQ ID NO: 143421 - DNA, 23 bp, Homo sapiens
tgagacagggtctcactctgtca

SEQ ID NO: 143422 - DNA, 23 bp, Homo sapiens
tcagagcctcagtctctccatct

SEQ ID NO: 143423 - DNA, 23 bp, Homo sapiens
agaaaagtgcttgtggtttagga

SEQ ID NO: 143424 - DNA, 23 bp, Homo sapiens
tggtagggatatgtgtctcgtgt

SEQ ID NO: 143425 - DNA, 23 bp, Homo sapiens
agtggagtgaagtgactgtccac

SEQ ID NO: 143426 - DNA, 22 bp, Homo sapiens
tgattctatttttatgaaatgt

SEQ ID NO: 143427 - DNA, 23 bp, Homo sapiens
tagacaaatctatagagacagaa

SEQ ID NO: 143428 - DNA, 22 bp, Homo sapiens
tcccaaagtactgggattgcag

SEQ ID NO: 143429 - DNA, 23 bp, Homo sapiens
tgcgggaaaagtgtctcctcctc

SEQ ID NO: 143430 - DNA, 23 bp, Homo sapiens
gacgaagtctcgctctgtcaccc

SEQ ID NO: 143431 - DNA, 22 bp, Homo sapiens
gagacactctctctcgctctct

SEQ ID NO: 143432 - DNA, 18 bp, Homo sapiens
acctgcagatcatcccct

SEQ ID NO: 143433 - DNA, 23 bp, Homo sapiens
agacggagtctggctctggctct

SEQ ID NO: 143434 - DNA, 19 bp, Homo sapiens
ttttgagacggagtcttgc

SEQ ID NO: 143435 - DNA, 21 bp, Homo sapiens
tgaggtagatggatcacttga

SEQ ID NO: 143436 - DNA, 18 bp, Homo sapiens
gtgagccactgtgcctgg

SEQ ID NO: 143437 - DNA, 19 bp, Homo sapiens
agagatggggttgctctgt

SEQ ID NO: 143438 - DNA, 23 bp, Homo sapiens
tgtactgaatttgttattgtctg

SEQ ID NO: 143439 - DNA, 21 bp, Homo sapiens
cattgtcctttttgtggtgca

SEQ ID NO: 143440 - DNA, 23 bp, Homo sapiens
cagttcctggtacttactgggtg

SEQ ID NO: 143441 - DNA, 22 bp, Homo sapiens
atttttgaatatatgtttgggg

SEQ ID NO: 143442 - DNA, 20 bp, Homo sapiens
tgtgcctctgacagtgcctg

SEQ ID NO: 143443 - DNA, 21 bp, Homo sapiens
tccctgcctccctgctagcct

SEQ ID NO: 143444 - DNA, 23 bp, Homo sapiens
gaactgttgtcattttcttgtca

SEQ ID NO: 143445 - DNA, 22 bp, Homo sapiens
atgaggatggcagttgtgttct

SEQ ID NO: 143446 - DNA, 23 bp, Homo sapiens
tctgtgcgtgtgacagccccagt

SEQ ID NO: 143447 - DNA, 23 bp, Homo sapiens
tctctccctctgtcactggctcg

SEQ ID NO: 143448 - DNA, 23 bp, Homo sapiens
actctctgcctcacaggttccct

SEQ ID NO: 143449 - DNA, 22 bp, Homo sapiens
aaggtggattgcaagtcaatga

SEQ ID NO: 143450 - DNA, 23 bp, Homo sapiens
tgagactcggtctcactaagttg

SEQ ID NO: 143451 - DNA, 23 bp, Homo sapiens
gtttttgtgactgtctctgtgtg

SEQ ID NO: 143452 - DNA, 23 bp, Homo sapiens
acagagtctcactctgtcgccca

SEQ ID NO: 143453 - DNA, 23 bp, Homo sapiens
tccgtgggtctgtcagtgtctcg

SEQ ID NO: 143454 - DNA, 23 bp, Homo sapiens
tgtagtcctagctactctggagg

SEQ ID NO: 143455 - DNA, 23 bp, Homo sapiens
aggttacagtgagctatgattgt

SEQ ID NO: 143456 - DNA, 23 bp, Homo sapiens
aagactggcatcaagaaaggtat

SEQ ID NO: 143457 - DNA, 23 bp, Homo sapiens
gccagagttcttgcagagttgtt

SEQ ID NO: 143458 - DNA, 23 bp, Homo sapiens
ggcctcactctgtcacgctggct

SEQ ID NO: 143459 - DNA, 23 bp, Homo sapiens
gctctttgttgttgagacagggt

SEQ ID NO: 143460 - DNA, 20 bp, Homo sapiens
tcactcaggctggattgcag

SEQ ID NO: 143461 - DNA, 23 bp, Homo sapiens
atgtgtgtatatatgtgtgtgta

SEQ ID NO: 143462 - DNA, 20 bp, Homo sapiens
tatatgtgtgtatatatgta

SEQ ID NO: 143463 - DNA, 23 bp, Homo sapiens
tcttggtgctcagactgaagtgc

SEQ ID NO: 143464 - DNA, 23 bp, Homo sapiens
tgagttcattgtagattctggat

SEQ ID NO: 143465 - DNA, 23 bp, Homo sapiens
tgagttcattgtagattctggat

SEQ ID NO: 143466 - DNA, 20 bp, Homo sapiens
atggccattcatgcaggagt

SEQ ID NO: 143467 - DNA, 23 bp, Homo sapiens
gtggtatcacattgtggttttga

SEQ ID NO: 143468 - DNA, 23 bp, Homo sapiens
gagtctcactctgtcacccaggc

SEQ ID NO: 143469 - DNA, 23 bp, Homo sapiens
agagtctcactctgtcacccagg

SEQ ID NO: 143470 - DNA, 23 bp, Homo sapiens
ccctctgtctgtgtccttggctc

SEQ ID NO: 143471 - DNA, 21 bp, Homo sapiens
ttgtgaagtctttgccaaagc

SEQ ID NO: 143472 - DNA, 20 bp, Homo sapiens
agtctcaggcagttctttat

SEQ ID NO: 143473 - DNA, 23 bp, Homo sapiens
tgagttcattgtagattctggat

SEQ ID NO: 143474 - DNA, 23 bp, Homo sapiens
tgagttcattgtagattctggat

SEQ ID NO: 143475 - DNA, 22 bp, Homo sapiens
aatgtctgttcagttcctctgc

SEQ ID NO: 143476 - DNA, 23 bp, Homo sapiens
tgtgtctctctctgccaccccct

SEQ ID NO: 143477 - DNA, 23 bp, Homo sapiens
tgagttcattgtagattctggat

SEQ ID NO: 143478 - DNA, 23 bp, Homo sapiens
tgagttcattgtagattctggat

SEQ ID NO: 143479 - DNA, 23 bp, Homo sapiens
tgagttcattgtagattctggat

SEQ ID NO: 143480 - DNA, 23 bp, Homo sapiens
tgagttcattgtagattctggat

SEQ ID NO: 143481 - DNA, 22 bp, Homo sapiens
aaatgaagaaagagagctgatg

SEQ ID NO: 143482 - DNA, 23 bp, Homo sapiens
tggctctctggctctctgtcacc

SEQ ID NO: 143483 - DNA, 22 bp, Homo sapiens
tttttttctttaagaatgctga

SEQ ID NO: 143484 - DNA, 19 bp, Homo sapiens
caggtgcccagtctcttct

SEQ ID NO: 143485 - DNA, 21 bp, Homo sapiens
tatatgcatatatatatctgt

SEQ ID NO: 143486 - DNA, 18 bp, Homo sapiens
acacgcatgtatatctgt

SEQ ID NO: 143487 - DNA, 19 bp, Homo sapiens
tatcaacctgataatgaac

SEQ ID NO: 143488 - DNA, 18 bp, Homo sapiens
tgagacggagcctcactc

SEQ ID NO: 143489 - DNA, 23 bp, Homo sapiens
gtttatgtatgtatatatgtgtg

SEQ ID NO: 143490 - DNA, 23 bp, Homo sapiens
actcaatgcaacagtatgggtat

SEQ ID NO: 143491 - DNA, 23 bp, Homo sapiens
agacggagtctccctctgtcacc

SEQ ID NO: 143492 - DNA, 19 bp, Homo sapiens
tatgtgtgtgtgtacatgt

SEQ ID NO: 143493 - DNA, 23 bp, Homo sapiens
tatatatatgtatatgtgttacg

SEQ ID NO: 143494 - DNA, 23 bp, Homo sapiens
tttgagaccgagtcttgctctgt

SEQ ID NO: 143495 - DNA, 23 bp, Homo sapiens
tttgctgtttatgcttccagaaa

SEQ ID NO: 143496 - DNA, 23 bp, Homo sapiens
tgagttcattgtagattctggat

SEQ ID NO: 143497 - DNA, 23 bp, Homo sapiens
tgagttcattgtagattctggat

SEQ ID NO: 143498 - DNA, 21 bp, Homo sapiens
tctgagggtagagactgtcca

SEQ ID NO: 143499 - DNA, 18 bp, Homo sapiens
atggtggtgatggtgacg

SEQ ID NO: 143500 - DNA, 23 bp, Homo sapiens
tggagtctcactctgtcacccag

SEQ ID NO: 143501 - DNA, 23 bp, Homo sapiens
gtcagagtctcgctctgtcaccc

SEQ ID NO: 143502 - DNA, 22 bp, Homo sapiens
ccagtggcatgatcttggctca

SEQ ID NO: 143503 - DNA, 23 bp, Homo sapiens
acagggtctcactgtgccactca

SEQ ID NO: 143504 - DNA, 23 bp, Homo sapiens
gtgcagtggtatgatcatggctc

SEQ ID NO: 143505 - DNA, 23 bp, Homo sapiens
tttaggaaatctttgtaatctgt

SEQ ID NO: 143506 - DNA, 23 bp, Homo sapiens
ccctcactggctgcctgtgaccc

SEQ ID NO: 143507 - DNA, 19 bp, Homo sapiens
gtgtgtgtgtgtgtgtgtg

SEQ ID NO: 143508 - DNA, 19 bp, Homo sapiens
gttggtcgtctcagagagt

SEQ ID NO: 143509 - DNA, 23 bp, Homo sapiens
tggagactcactctgtcacccag

SEQ ID NO: 143510 - DNA, 18 bp, Homo sapiens
agactcagaactttccag

SEQ ID NO: 143511 - DNA, 23 bp, Homo sapiens
tggctcagagtctattcagtata

SEQ ID NO: 143512 - DNA, 22 bp, Homo sapiens
atctcgactcactgcaacctct

SEQ ID NO: 143513 - DNA, 23 bp, Homo sapiens
gacagagtctcactctgttaccc

SEQ ID NO: 143514 - DNA, 22 bp, Homo sapiens
ttttcagagtggtagacttgag

SEQ ID NO: 143515 - DNA, 22 bp, Homo sapiens
atttcacttaggtaatgtttga

SEQ ID NO: 143516 - DNA, 23 bp, Homo sapiens
aatgatttgcttttctctctcta

SEQ ID NO: 143517 - DNA, 23 bp, Homo sapiens
taggatagagacctaggagatga

SEQ ID NO: 143518 - DNA, 20 bp, Homo sapiens
gcagatgctgggatgcaaga

SEQ ID NO: 143519 - DNA, 22 bp, Homo sapiens
gtctccctctgactggctggct

SEQ ID NO: 143520 - DNA, 21 bp, Homo sapiens
tgatagagctgatagagcaca

SEQ ID NO: 143521 - DNA, 23 bp, Homo sapiens
tgagttcattgtagattctggat

SEQ ID NO: 143522 - DNA, 23 bp, Homo sapiens
tgagttcattgtagattctggat

SEQ ID NO: 143523 - DNA, 22 bp, Homo sapiens
taggctctgggtgaagacaggg

SEQ ID NO: 143524 - DNA, 23 bp, Homo sapiens
caaatcagagtggctgttctatg

SEQ ID NO: 143525 - DNA, 19 bp, Homo sapiens
tatcaactgtaagtggtgt

SEQ ID NO: 143526 - DNA, 19 bp, Homo sapiens
tggtctgtaattgtgtaag

SEQ ID NO: 143527 - DNA, 19 bp, Homo sapiens
agacagtctcggttggttg

SEQ ID NO: 143528 - DNA, 23 bp, Homo sapiens
tttgagatggaatctcactctgt

SEQ ID NO: 143529 - DNA, 19 bp, Homo sapiens
tcttggtcttactatgtgc

SEQ ID NO: 143530 - DNA, 22 bp, Homo sapiens
ctcactgacaggattttaggct

SEQ ID NO: 143531 - DNA, 20 bp, Homo sapiens
tttctgctttgtctgtctca

SEQ ID NO: 143532 - DNA, 22 bp, Homo sapiens
tttttagtttttgagatagggt

SEQ ID NO: 143533 - DNA, 23 bp, Homo sapiens
tcacagaggagactgaggaccct

SEQ ID NO: 143534 - DNA, 20 bp, Homo sapiens
tttttttttcttcaaaatgg

SEQ ID NO: 143535 - DNA, 19 bp, Homo sapiens
agtatctcttttggctaac

SEQ ID NO: 143536 - DNA, 23 bp, Homo sapiens
gtacactctgagactgtgtggta

SEQ ID NO: 143537 - DNA, 21 bp, Homo sapiens
tatactttaagttttagggta

SEQ ID NO: 143538 - DNA, 20 bp, Homo sapiens
atagtctcagctactcaggg

SEQ ID NO: 143539 - DNA, 23 bp, Homo sapiens
agaaacaaggtatcgctctgttg

SEQ ID NO: 143540 - DNA, 22 bp, Homo sapiens
aagtctctgaaattagcaagtg

SEQ ID NO: 143541 - DNA, 20 bp, Homo sapiens
agggagagactccgtctcat

SEQ ID NO: 143542 - DNA, 20 bp, Homo sapiens
tggaaggatcacttgagccc

SEQ ID NO: 143543 - DNA, 23 bp, Homo sapiens
tactcactggtagcattgttgtc

SEQ ID NO: 143544 - DNA, 23 bp, Homo sapiens
tacagaaaagttgcaaaagacag

SEQ ID NO: 143545 - DNA, 21 bp, Homo sapiens
atcagagtcggagaattcatc

SEQ ID NO: 143546 - DNA, 18 bp, Homo sapiens
atatttttgattagccag

SEQ ID NO: 143547 - DNA, 23 bp, Homo sapiens
atttgcctcaggatgaattgtac

SEQ ID NO: 143548 - DNA, 23 bp, Homo sapiens
ccgagtctcactctgtcacccag

SEQ ID NO: 143549 - DNA, 23 bp, Homo sapiens
tctctgtgtctgtcttcatggcc

SEQ ID NO: 143550 - DNA, 23 bp, Homo sapiens
atatgtgtgaatgagtatatggc

SEQ ID NO: 143551 - DNA, 20 bp, Homo sapiens
acacacacactttctctctc

SEQ ID NO: 143552 - DNA, 23 bp, Homo sapiens
tatagttcacctaggaaaagcaa

SEQ ID NO: 143553 - DNA, 23 bp, Homo sapiens
agtgagccataattgtgccactt

SEQ ID NO: 143554 - DNA, 23 bp, Homo sapiens
gacagagtctcgctctgtcaccc

SEQ ID NO: 143555 - DNA, 23 bp, Homo sapiens
ggaatctcactctgtcacccagg

SEQ ID NO: 143556 - DNA, 23 bp, Homo sapiens
gtgagcactcagtgagaagacag

SEQ ID NO: 143557 - DNA, 23 bp, Homo sapiens
acttatctgtgtttggagatgtg

SEQ ID NO: 143558 - DNA, 19 bp, Homo sapiens
tgagacggagtttcgctct

SEQ ID NO: 143559 - DNA, 19 bp, Homo sapiens
tgtgagctaccatgactgg

SEQ ID NO: 143560 - DNA, 23 bp, Homo sapiens
tttgttgttcagacagggtctca

SEQ ID NO: 143561 - DNA, 19 bp, Homo sapiens
tgagggtgatttaggggat

SEQ ID NO: 143562 - DNA, 23 bp, Homo sapiens
gagagagtctcactgtcacccag

SEQ ID NO: 143563 - DNA, 23 bp, Homo sapiens
cggagtctcgctctgtctcccag

SEQ ID NO: 143564 - DNA, 21 bp, Homo sapiens
gggcctcactctgtcacccag

SEQ ID NO: 143565 - DNA, 23 bp, Homo sapiens
tgagttcattgtagattctggat

SEQ ID NO: 143566 - DNA, 23 bp, Homo sapiens
tgagttcattgtagattctggat

SEQ ID NO: 143567 - DNA, 22 bp, Homo sapiens
ttatatgtacatgtatatatgt

SEQ ID NO: 143568 - DNA, 23 bp, Homo sapiens
tgagatgtagtctcgctctgtgg

SEQ ID NO: 143569 - DNA, 23 bp, Homo sapiens
tgagttcattgtagattctggat

SEQ ID NO: 143570 - DNA, 23 bp, Homo sapiens
tgagttcattgtagattctggat

SEQ ID NO: 143571 - DNA, 23 bp, Homo sapiens
atgagactagatgatgagcaagg

SEQ ID NO: 143572 - DNA, 23 bp, Homo sapiens
ttctgtgtgtctgtatctgtgtc

SEQ ID NO: 143573 - DNA, 23 bp, Homo sapiens
tgacgaagaaagactctgtctca

SEQ ID NO: 143574 - DNA, 22 bp, Homo sapiens
atgaggtctcgctctctcaccc

SEQ ID NO: 143575 - DNA, 23 bp, Homo sapiens
tctctgtcacagtctctcctttg

SEQ ID NO: 143576 - DNA, 23 bp, Homo sapiens
tggagtctcactctgtcacccag

SEQ ID NO: 143577 - DNA, 23 bp, Homo sapiens
agtgcagtcagtagacagtctcc

SEQ ID NO: 143578 - DNA, 23 bp, Homo sapiens
tgagttcattgtagattctggat

SEQ ID NO: 143579 - DNA, 23 bp, Homo sapiens
tgagttcattgtagattctggat

SEQ ID NO: 143580 - DNA, 18 bp, Homo sapiens
atggatatatatgtgtat

SEQ ID NO: 143581 - DNA, 23 bp, Homo sapiens
cacacacatatatatatgtgtgt

SEQ ID NO: 143582 - DNA, 23 bp, Homo sapiens
atatgtgtatatgtatatatgtg

SEQ ID NO: 143583 - DNA, 20 bp, Homo sapiens
agactgtgagctaagaatgt

SEQ ID NO: 143584 - DNA, 19 bp, Homo sapiens
atgaccaatgtgtggtgaa

SEQ ID NO: 143585 - DNA, 23 bp, Homo sapiens
atactgtgcttcattcttgaatt

SEQ ID NO: 143586 - DNA, 23 bp, Homo sapiens
tgagatggagtctcactctgtcg

SEQ ID NO: 143587 - DNA, 23 bp, Homo sapiens
tatttcagtgttgtcttcctgta

SEQ ID NO: 143588 - DNA, 23 bp, Homo sapiens
agtgcaagctgttgacattggcc

SEQ ID NO: 143589 - DNA, 23 bp, Homo sapiens
gtgtgtgtgtgtgtgtatcatgt

SEQ ID NO: 143590 - DNA, 19 bp, Homo sapiens
tggaggtgactgactcaca

SEQ ID NO: 143591 - DNA, 23 bp, Homo sapiens
tggagtctcactctgtcacccag

SEQ ID NO: 143592 - DNA, 20 bp, Homo sapiens
tgtatatatgtatacatatg

SEQ ID NO: 143593 - DNA, 23 bp, Homo sapiens
gtctgtgtgtgatttatgtgtgt

SEQ ID NO: 143594 - DNA, 22 bp, Homo sapiens
ttattccttcttgtagatctga

SEQ ID NO: 143595 - DNA, 20 bp, Homo sapiens
agtggggttggcatagttct

SEQ ID NO: 143596 - DNA, 23 bp, Homo sapiens
tgactgagcatgtgcttgatttt

SEQ ID NO: 143597 - DNA, 22 bp, Homo sapiens
tgtgatcatggttcactgcagc

SEQ ID NO: 143598 - DNA, 23 bp, Homo sapiens
ctcccagagcccctggaactctg

SEQ ID NO: 143599 - DNA, 23 bp, Homo sapiens
tcccagagcccctggaactctgg

SEQ ID NO: 143600 - DNA, 23 bp, Homo sapiens
tcccagagcccctggaactctgg

SEQ ID NO: 143601 - DNA, 23 bp, Homo sapiens
tcccagagcccctggaactctgg

SEQ ID NO: 143602 - DNA, 18 bp, Homo sapiens
atagatagatatatagat

SEQ ID NO: 143603 - DNA, 22 bp, Homo sapiens
aggtagatagatagatagatag

SEQ ID NO: 143604 - DNA, 22 bp, Homo sapiens
atagctagattgatagatgtag

SEQ ID NO: 143605 - DNA, 22 bp, Homo sapiens
gatatctgtgtctatatctaca

SEQ ID NO: 143606 - DNA, 19 bp, Homo sapiens
aaatacaagatcatatcat

SEQ ID NO: 143607 - DNA, 23 bp, Homo sapiens
tctgctttcagcttctttacagt

SEQ ID NO: 143608 - DNA, 23 bp, Homo sapiens
agcagcattgtacagggctatca

SEQ ID NO: 143609 - DNA, 23 bp, Homo sapiens
tatgtgtatatatacatatctgt

SEQ ID NO: 143610 - DNA, 21 bp, Homo sapiens
tgttcactcctgcaggtcacc

SEQ ID NO: 143611 - DNA, 23 bp, Homo sapiens
gtgacagtgaagtgtgagtgcag

SEQ ID NO: 143612 - DNA, 23 bp, Homo sapiens
atttagcttgtaaagaatagatt

SEQ ID NO: 143613 - DNA, 22 bp, Homo sapiens
tataatagatatgtaatgatat

SEQ ID NO: 143614 - DNA, 20 bp, Homo sapiens
atctaatgacatgatgttga

SEQ ID NO: 143615 - DNA, 20 bp, Homo sapiens
tgtgcgtgtgtgtatgaagt

SEQ ID NO: 143616 - DNA, 20 bp, Homo sapiens
atgtatgtgtgtgtgtacat

SEQ ID NO: 143617 - DNA, 19 bp, Homo sapiens
aagagcaacatacatatag

SEQ ID NO: 143618 - DNA, 22 bp, Homo sapiens
tttaacctacttttctgccgtc

SEQ ID NO: 143619 - DNA, 19 bp, Homo sapiens
tgtgaaagtatgaatatag

SEQ ID NO: 143620 - DNA, 18 bp, Homo sapiens
tctgtcacccagactgga

SEQ ID NO: 143621 - DNA, 23 bp, Homo sapiens
acatagtatgtgtgtgtgtgtat

SEQ ID NO: 143622 - DNA, 22 bp, Homo sapiens
atagtgcatccatattatggaa

SEQ ID NO: 143623 - DNA, 23 bp, Homo sapiens
atgagacagatgtttgtgtccag

SEQ ID NO: 143624 - DNA, 23 bp, Homo sapiens
tgagacggagtctggctctgtcg

SEQ ID NO: 143625 - DNA, 23 bp, Homo sapiens
tttgttacacaggtaaacatgag

SEQ ID NO: 143626 - DNA, 18 bp, Homo sapiens
tgagaccccgtctcttga

SEQ ID NO: 143627 - DNA, 21 bp, Homo sapiens
tgaggcagaatctcactctgt

SEQ ID NO: 143628 - DNA, 23 bp, Homo sapiens
aagacagtcaggggaagaggttg

SEQ ID NO: 143629 - DNA, 23 bp, Homo sapiens
agtcagtctcagtctataagccc

SEQ ID NO: 143630 - DNA, 19 bp, Homo sapiens
tgtgtgtgtgtgtgtgtat

SEQ ID NO: 143631 - DNA, 23 bp, Homo sapiens
acagagtctcactatgttgtcca

SEQ ID NO: 143632 - DNA, 23 bp, Homo sapiens
agtcagtctcagtctataagccc

SEQ ID NO: 143633 - DNA, 23 bp, Homo sapiens
agaccttccactgtgactctgac

SEQ ID NO: 143634 - DNA, 23 bp, Homo sapiens
gctgaggtaggaggatcaattga

SEQ ID NO: 143635 - DNA, 20 bp, Homo sapiens
tcaagaatttatatgctatg

SEQ ID NO: 143636 - DNA, 23 bp, Homo sapiens
aatgtttggtagtcactgggtta

SEQ ID NO: 143637 - DNA, 23 bp, Homo sapiens
tcactgtctcagtgatttccttc

SEQ ID NO: 143638 - DNA, 20 bp, Homo sapiens
ctggaacagtgcctggcaca

SEQ ID NO: 143639 - DNA, 23 bp, Homo sapiens
tgaggtggactctcactctgtca

SEQ ID NO: 143640 - DNA, 19 bp, Homo sapiens
tacatatatatacatttgt

SEQ ID NO: 143641 - DNA, 20 bp, Homo sapiens
agtcagcagtcagtgagcag

SEQ ID NO: 143642 - DNA, 23 bp, Homo sapiens
cggagtctcactctgtcacccag

SEQ ID NO: 143643 - DNA, 23 bp, Homo sapiens
tgagacagggtctcactctctca

SEQ ID NO: 143644 - DNA, 22 bp, Homo sapiens
ccaccgagcctctctctgtgag

SEQ ID NO: 143645 - DNA, 18 bp, Homo sapiens
agtagagatttgcagagg

SEQ ID NO: 143646 - DNA, 23 bp, Homo sapiens
ttttggttccatatgaattgtaa

SEQ ID NO: 143647 - DNA, 19 bp, Homo sapiens
tacacacatatgtgtgtgt

SEQ ID NO: 143648 - DNA, 22 bp, Homo sapiens
atatggttgtatatatatgaat

SEQ ID NO: 143649 - DNA, 22 bp, Homo sapiens
tgtctcacagttctggaggctg

SEQ ID NO: 143650 - DNA, 19 bp, Homo sapiens
aaagagaaattattgagca

SEQ ID NO: 143651 - DNA, 23 bp, Homo sapiens
tcagagtgtacagttctatgctt

SEQ ID NO: 143652 - DNA, 23 bp, Homo sapiens
tttaaagcagctttacatttaca

SEQ ID NO: 143653 - DNA, 23 bp, Homo sapiens
tgagttcattgtagattctggat

SEQ ID NO: 143654 - DNA, 23 bp, Homo sapiens
tgagttcattgtagattctggat

SEQ ID NO: 143655 - DNA, 23 bp, Homo sapiens
tgggaggtaaataattgtatatg

SEQ ID NO: 143656 - DNA, 23 bp, Homo sapiens
tatttggctctatatgtatacac

SEQ ID NO: 143657 - DNA, 21 bp, Homo sapiens
ttcactgcagtgagtgagctc

SEQ ID NO: 143658 - DNA, 20 bp, Homo sapiens
atagtttgaaatcaggtagt

SEQ ID NO: 143659 - DNA, 21 bp, Homo sapiens
atttctatttttattgcactg

SEQ ID NO: 143660 - DNA, 23 bp, Homo sapiens
atgactgaatatgtaattgaacc

SEQ ID NO: 143661 - DNA, 23 bp, Homo sapiens
atatgattatatgtatatgtgat

SEQ ID NO: 143662 - DNA, 23 bp, Homo sapiens
tgagttcattgtagattctggat

SEQ ID NO: 143663 - DNA, 23 bp, Homo sapiens
tgagttcattgtagattctggat

SEQ ID NO: 143664 - DNA, 21 bp, Homo sapiens
tagtacacatagatgtgttaa

SEQ ID NO: 143665 - DNA, 23 bp, Homo sapiens
acagagtctcactctgtcgccca

SEQ ID NO: 143666 - DNA, 23 bp, Homo sapiens
ataatcatcatgatgatgatgtt

SEQ ID NO: 143667 - DNA, 23 bp, Homo sapiens
tggtggagatgatgatgatgatg

SEQ ID NO: 143668 - DNA, 23 bp, Homo sapiens
tgtatgtatatatgtatatatgt

SEQ ID NO: 143669 - DNA, 23 bp, Homo sapiens
tatatgtgtatatgtatgtatgt

SEQ ID NO: 143670 - DNA, 20 bp, Homo sapiens
tgtgtatatatgtatgtgta

SEQ ID NO: 143671 - DNA, 23 bp, Homo sapiens
tgagttcattgtagattctggat

SEQ ID NO: 143672 - DNA, 23 bp, Homo sapiens
tgagttcattgtagattctggat

SEQ ID NO: 143673 - DNA, 21 bp, Homo sapiens
gagagagagagagagctgtta

SEQ ID NO: 143674 - DNA, 19 bp, Homo sapiens
tgagatggagtctcgctct

SEQ ID NO: 143675 - DNA, 23 bp, Homo sapiens
agtacagtgcctctgactgcctc

SEQ ID NO: 143676 - DNA, 21 bp, Homo sapiens
accttgtactggtggtgcagg

SEQ ID NO: 143677 - DNA, 23 bp, Homo sapiens
tagagacaaggtctcactctgtt

SEQ ID NO: 143678 - DNA, 23 bp, Homo sapiens
acatttacaattggcagacttta

SEQ ID NO: 143679 - DNA, 23 bp, Homo sapiens
tgagttcattgtagattctggat

SEQ ID NO: 143680 - DNA, 22 bp, Homo sapiens
gccagaactgagggagctgaga

SEQ ID NO: 143681 - DNA, 23 bp, Homo sapiens
cttgagaactcattttcttcatc

SEQ ID NO: 143682 - DNA, 23 bp, Homo sapiens
acttggagctctggttctctctg

SEQ ID NO: 143683 - DNA, 23 bp, Homo sapiens
tgagttcattgtagattctggat

SEQ ID NO: 143684 - DNA, 23 bp, Homo sapiens
tgagttcattgtagattctggat

SEQ ID NO: 143685 - DNA, 23 bp, Homo sapiens
tattttgattaagatgatgttga

SEQ ID NO: 143686 - DNA, 23 bp, Homo sapiens
ggttttcagtgagtttttcttca

SEQ ID NO: 143687 - DNA, 20 bp, Homo sapiens
tacatgtgcacattgtgcag

SEQ ID NO: 143688 - DNA, 20 bp, Homo sapiens
atctgtgatttatttgtcta

SEQ ID NO: 143689 - DNA, 22 bp, Homo sapiens
tatggtagttgcatgtttagtt

SEQ ID NO: 143690 - DNA, 22 bp, Homo sapiens
tttcacaatggctgtactgttt

SEQ ID NO: 143691 - DNA, 23 bp, Homo sapiens
tttctgttgatagatgtatggcc

SEQ ID NO: 143692 - DNA, 19 bp, Homo sapiens
tattagtctcctaggattg

SEQ ID NO: 143693 - DNA, 23 bp, Homo sapiens
tacttctgtatgggagaattgtc

SEQ ID NO: 143694 - DNA, 23 bp, Homo sapiens
tatatctgtgtgtgtgtatatat

SEQ ID NO: 143695 - DNA, 19 bp, Homo sapiens
tatacatatatatgatatg

SEQ ID NO: 143696 - DNA, 22 bp, Homo sapiens
tatatagctgttcttggtgtta

SEQ ID NO: 143697 - DNA, 21 bp, Homo sapiens
atgagagaaataaacttctgt

SEQ ID NO: 143698 - DNA, 20 bp, Homo sapiens
tgatatgaggcttttctctt

SEQ ID NO: 143699 - DNA, 20 bp, Homo sapiens
ctctggctgtgagagaggct

SEQ ID NO: 143700 - DNA, 23 bp, Homo sapiens
acttgagacacagcaaaggaggt

SEQ ID NO: 143701 - DNA, 18 bp, Homo sapiens
actgccttagcagcagct

SEQ ID NO: 143702 - DNA, 21 bp, Homo sapiens
tgagatcaaggtgacagcagg

SEQ ID NO: 143703 - DNA, 22 bp, Homo sapiens
tatatagtactatatgtatagt

SEQ ID NO: 143704 - DNA, 23 bp, Homo sapiens
cagcagagtgtgataacagtaga

SEQ ID NO: 143705 - DNA, 23 bp, Homo sapiens
agacggactctcgctctgtcacc

SEQ ID NO: 143706 - DNA, 23 bp, Homo sapiens
ttcttgaacaggtatttgtagtg

SEQ ID NO: 143707 - DNA, 23 bp, Homo sapiens
agactgagtctggctctgtcacc

SEQ ID NO: 143708 - DNA, 23 bp, Homo sapiens
atctgtcattttctttttctgac

SEQ ID NO: 143709 - DNA, 23 bp, Homo sapiens
ttgtgtgtgcatgtgtatacata

SEQ ID NO: 143710 - DNA, 20 bp, Homo sapiens
atttgtgtatactatacatg

SEQ ID NO: 143711 - DNA, 23 bp, Homo sapiens
atgtgattctattagtttcctgt

SEQ ID NO: 143712 - DNA, 20 bp, Homo sapiens
tttttgtagagacggcatct

SEQ ID NO: 143713 - DNA, 23 bp, Homo sapiens
tatgcatatgtagatatgcatac

SEQ ID NO: 143714 - DNA, 20 bp, Homo sapiens
agacaaggtttggctctgtt

SEQ ID NO: 143715 - DNA, 23 bp, Homo sapiens
tgagttcattgtagattctggat

SEQ ID NO: 143716 - DNA, 23 bp, Homo sapiens
tgagttcattgtagattctggat

SEQ ID NO: 143717 - DNA, 23 bp, Homo sapiens
tttgagacagagtctcaccctgt

SEQ ID NO: 143718 - DNA, 21 bp, Homo sapiens
tttacaatatatatgtattca

SEQ ID NO: 143719 - DNA, 23 bp, Homo sapiens
cttgttgatctgtgtagttgttc

SEQ ID NO: 143720 - DNA, 23 bp, Homo sapiens
atctccaaatattcttgtagaac

SEQ ID NO: 143721 - DNA, 22 bp, Homo sapiens
ccctctctctgtcagacctgcc

SEQ ID NO: 143722 - DNA, 23 bp, Homo sapiens
tgagtgtcagtgagtcttcatcc

SEQ ID NO: 143723 - DNA, 23 bp, Homo sapiens
tttgttgtccttcaagagttgtt

SEQ ID NO: 143724 - DNA, 19 bp, Homo sapiens
ttttgcattttctccattg

SEQ ID NO: 143725 - DNA, 22 bp, Homo sapiens
tttcacagtgggagttgttaca

SEQ ID NO: 143726 - DNA, 22 bp, Homo sapiens
tgcctgtgttgtttctccagtg

SEQ ID NO: 143727 - DNA, 23 bp, Homo sapiens
tctcaggctctctgtctggtctg

SEQ ID NO: 143728 - DNA, 23 bp, Homo sapiens
agtcagtgttcactcaaggaatt

SEQ ID NO: 143729 - DNA, 19 bp, Homo sapiens
gtctcgctctgtcacccag

SEQ ID NO: 143730 - DNA, 20 bp, Homo sapiens
tgaccagcagcattccatca

SEQ ID NO: 143731 - DNA, 18 bp, Homo sapiens
tggcttgagcctgggagt

SEQ ID NO: 143732 - DNA, 22 bp, Homo sapiens
tataatgtgttacgtgtgtgta

SEQ ID NO: 143733 - DNA, 22 bp, Homo sapiens
cagggtctcactctgtcgcaca

SEQ ID NO: 143734 - DNA, 23 bp, Homo sapiens
tctcagcgtgcctctatgcctgt

SEQ ID NO: 143735 - DNA, 19 bp, Homo sapiens
atagcttatatatagctta

SEQ ID NO: 143736 - DNA, 19 bp, Homo sapiens
atagcttatatatagctta

SEQ ID NO: 143737 - DNA, 23 bp, Homo sapiens
tgaaaagttctataagatttgat

SEQ ID NO: 143738 - DNA, 23 bp, Homo sapiens
gtattctgtgtcatgtatatgtg

SEQ ID NO: 143739 - DNA, 20 bp, Homo sapiens
atatctatatatgtatatct

SEQ ID NO: 143740 - DNA, 21 bp, Homo sapiens
tgagtcctgacagagcacagt

SEQ ID NO: 143741 - DNA, 23 bp, Homo sapiens
tctcatggtgtctgtctctttct

SEQ ID NO: 143742 - DNA, 23 bp, Homo sapiens
ttcagacacctttagaaccacat

SEQ ID NO: 143743 - DNA, 23 bp, Homo sapiens
cggagtctcactctgtcacccag

SEQ ID NO: 143744 - DNA, 23 bp, Homo sapiens
gtattctgtgtcatgtatatgtg

SEQ ID NO: 143745 - DNA, 20 bp, Homo sapiens
atatctatatatgtatatct

SEQ ID NO: 143746 - DNA, 21 bp, Homo sapiens
tgagtcctgacagagcacagt

SEQ ID NO: 143747 - DNA, 23 bp, Homo sapiens
tctcatggtgtctgtctctttct

SEQ ID NO: 143748 - DNA, 23 bp, Homo sapiens
ttcagacacctttagaaccacat

SEQ ID NO: 143749 - DNA, 23 bp, Homo sapiens
cggagtctcactctgtcacccag

SEQ ID NO: 143750 - DNA, 19 bp, Homo sapiens
ggagtctcactctgtcacc

SEQ ID NO: 143751 - DNA, 23 bp, Homo sapiens
tgtgtgaccttgaaaaagtctct

SEQ ID NO: 143752 - DNA, 23 bp, Homo sapiens
gtgagcagagtgtggacacaccc

SEQ ID NO: 143753 - DNA, 23 bp, Homo sapiens
ccactgctcactctctgtatgcc

SEQ ID NO: 143754 - DNA, 23 bp, Homo sapiens
ctctctgcctcagtttctccaat

SEQ ID NO: 143755 - DNA, 20 bp, Homo sapiens
tcccagagctgagtgagcac

SEQ ID NO: 143756 - DNA, 23 bp, Homo sapiens
ctctgtgaggctctgtgctaagc

SEQ ID NO: 143757 - DNA, 23 bp, Homo sapiens
cagtagagacagagcagtgatgg

SEQ ID NO: 143758 - DNA, 23 bp, Homo sapiens
tatgtatatatgaagaggcagag

SEQ ID NO: 143759 - DNA, 23 bp, Homo sapiens
tctctgtccctctgtggctgagt

SEQ ID NO: 143760 - DNA, 23 bp, Homo sapiens
ggagatcagtgtgtgcagaggct

SEQ ID NO: 143761 - DNA, 23 bp, Homo sapiens
tggtagcttgatgtggatagcat

SEQ ID NO: 143762 - DNA, 23 bp, Homo sapiens
tctcttcatctctctgtctctgg

SEQ ID NO: 143763 - DNA, 23 bp, Homo sapiens
ggccacactctgtccctctggtg

SEQ ID NO: 143764 - DNA, 23 bp, Homo sapiens
tctctgtgactctgtaaatgggg

SEQ ID NO: 143765 - DNA, 19 bp, Homo sapiens
actctcacaggattgttgg

SEQ ID NO: 143766 - DNA, 23 bp, Homo sapiens
caggctctcagactctcagagca

SEQ ID NO: 143767 - DNA, 23 bp, Homo sapiens
ctgaatctgcatttggaaaagag

SEQ ID NO: 143768 - DNA, 22 bp, Homo sapiens
tcaggtacatagactgttccaa

SEQ ID NO: 143769 - DNA, 23 bp, Homo sapiens
ctgctgactctcacccagacaca

SEQ ID NO: 143770 - DNA, 23 bp, Homo sapiens
tcacagagctgtgagtggaggct

SEQ ID NO: 143771 - DNA, 23 bp, Homo sapiens
ttctttctacttaggattgtctt

SEQ ID NO: 143772 - DNA, 23 bp, Homo sapiens
tgagttcattgtagattctggat

SEQ ID NO: 143773 - DNA, 23 bp, Homo sapiens
tgagttcattgtagattctggat

SEQ ID NO: 143774 - DNA, 23 bp, Homo sapiens
acagagtctctttctgtcaccca

SEQ ID NO: 143775 - DNA, 23 bp, Homo sapiens
gagacagattctcactctgtcac

SEQ ID NO: 143776 - DNA, 23 bp, Homo sapiens
caggcaggcagagtgcagtgctc

SEQ ID NO: 143777 - DNA, 19 bp, Homo sapiens
aggatgggtctgtactgtc

SEQ ID NO: 143778 - DNA, 22 bp, Homo sapiens
gtgtgtgtgtgtgtgtgcgcac

SEQ ID NO: 143779 - DNA, 20 bp, Homo sapiens
tgtatgtggataatgatcag

SEQ ID NO: 143780 - DNA, 22 bp, Homo sapiens
ttgagatctagtcttgctctgt

SEQ ID NO: 143781 - DNA, 22 bp, Homo sapiens
agtctgcctctctgcctctctc

SEQ ID NO: 143782 - DNA, 22 bp, Homo sapiens
tctgtgcctgttctaagcatga

SEQ ID NO: 143783 - DNA, 23 bp, Homo sapiens
ctatgacagacatgagagtgctc

SEQ ID NO: 143784 - DNA, 20 bp, Homo sapiens
agtcagagactgaatggcgt

SEQ ID NO: 143785 - DNA, 22 bp, Homo sapiens
ttctgtttttgatgttctaagt

SEQ ID NO: 143786 - DNA, 23 bp, Homo sapiens
agacagtgtctcgctctgtcacc

SEQ ID NO: 143787 - DNA, 19 bp, Homo sapiens
ttgtgcatcaggaagtgaa

SEQ ID NO: 143788 - DNA, 23 bp, Homo sapiens
atcttgttccattacttgtctaa

SEQ ID NO: 143789 - DNA, 23 bp, Homo sapiens
tcactctgactggctctatgaag

SEQ ID NO: 143790 - DNA, 18 bp, Homo sapiens
aggggcttcagagatgtt

SEQ ID NO: 143791 - DNA, 22 bp, Homo sapiens
agagatgaggtctggctctgtt

SEQ ID NO: 143792 - DNA, 23 bp, Homo sapiens
tctctccctctgtctctgggcct

SEQ ID NO: 143793 - DNA, 20 bp, Homo sapiens
tctctaaactttggcaatca

SEQ ID NO: 143794 - DNA, 23 bp, Homo sapiens
gaggtgagtgtagagagtcgcca

SEQ ID NO: 143795 - DNA, 21 bp, Homo sapiens
agctatcaatagaagtctgaa

SEQ ID NO: 143796 - DNA, 23 bp, Homo sapiens
tcatatcagagagagcttaggtc

SEQ ID NO: 143797 - DNA, 22 bp, Homo sapiens
tgtgtgtgtatgtatatatgtt

SEQ ID NO: 143798 - DNA, 23 bp, Homo sapiens
tttgcaaaactatggagaaagca

SEQ ID NO: 143799 - DNA, 19 bp, Homo sapiens
ctcactgcaacctctgact

SEQ ID NO: 143800 - DNA, 23 bp, Homo sapiens
tatatgtatatatatatgtgtgt

SEQ ID NO: 143801 - DNA, 21 bp, Homo sapiens
acagcacactgatgggtcttg

SEQ ID NO: 143802 - DNA, 22 bp, Homo sapiens
agtgagttcagagtgatttggg

SEQ ID NO: 143803 - DNA, 23 bp, Homo sapiens
tgagttcattgtagattctggat

SEQ ID NO: 143804 - DNA, 23 bp, Homo sapiens
tgagttcattgtagattctggat

SEQ ID NO: 143805 - DNA, 20 bp, Homo sapiens
tgtgtgtgtgtgtgtgcatg

SEQ ID NO: 143806 - DNA, 21 bp, Homo sapiens
atgatgatgatgatgatcatg

SEQ ID NO: 143807 - DNA, 21 bp, Homo sapiens
tctgtgtttatgactgtggca

SEQ ID NO: 143808 - DNA, 23 bp, Homo sapiens
aggtgaagtgttggaccaatgga

SEQ ID NO: 143809 - DNA, 23 bp, Homo sapiens
tctgtgagtgggtgagttagagg

SEQ ID NO: 143810 - DNA, 20 bp, Homo sapiens
aaaaatcctcaggtaggtga

SEQ ID NO: 143811 - DNA, 19 bp, Homo sapiens
cagtgtctgtcacacgcac

SEQ ID NO: 143812 - DNA, 21 bp, Homo sapiens
tcttttgttatgagtggaatc

SEQ ID NO: 143813 - DNA, 19 bp, Homo sapiens
tcaggttctaaaaagaaaa

SEQ ID NO: 143814 - DNA, 23 bp, Homo sapiens
tgtgtctcagtcactgttctaag

SEQ ID NO: 143815 - DNA, 23 bp, Homo sapiens
atatgtgtatatatatatgtgtg

SEQ ID NO: 143816 - DNA, 18 bp, Homo sapiens
atgtacatagatatatag

SEQ ID NO: 143817 - DNA, 18 bp, Homo sapiens
taggagtgaagaaagtag

SEQ ID NO: 143818 - DNA, 23 bp, Homo sapiens
agtgcctctagttttccttctct

SEQ ID NO: 143819 - DNA, 18 bp, Homo sapiens
tatgaaacatttggaaag

SEQ ID NO: 143820 - DNA, 23 bp, Homo sapiens
gagagtctcgctctgtcacccag

SEQ ID NO: 143821 - DNA, 23 bp, Homo sapiens
aaaagcaacacaatcatttccct

SEQ ID NO: 143822 - DNA, 23 bp, Homo sapiens
atttctctgcgagcttttgtggg

SEQ ID NO: 143823 - DNA, 23 bp, Homo sapiens
attcacctactaaatatttgaca

SEQ ID NO: 143824 - DNA, 23 bp, Homo sapiens
aatatctatatgtttttaggtga

SEQ ID NO: 143825 - DNA, 23 bp, Homo sapiens
aggaaaaccatgggacacagagc

SEQ ID NO: 143826 - DNA, 22 bp, Homo sapiens
gaagttctttctctgtcactga

SEQ ID NO: 143827 - DNA, 19 bp, Homo sapiens
gtcttcctctatcacccag

SEQ ID NO: 143828 - DNA, 23 bp, Homo sapiens
gagacagagtctccctctgtggc

SEQ ID NO: 143829 - DNA, 19 bp, Homo sapiens
agtgcagtagcaagatctt

SEQ ID NO: 143830 - DNA, 21 bp, Homo sapiens
tgagacagaatctcactctgt

SEQ ID NO: 143831 - DNA, 23 bp, Homo sapiens
tgtgtgtgtctgtgtgtatatgt

SEQ ID NO: 143832 - DNA, 23 bp, Homo sapiens
tttgcatctgttgcaattatgag

SEQ ID NO: 143833 - DNA, 22 bp, Homo sapiens
attaagtccatttctttagttt

SEQ ID NO: 143834 - DNA, 23 bp, Homo sapiens
ccagagtggctgtgtcattttcc

SEQ ID NO: 143835 - DNA, 23 bp, Homo sapiens
tcatgctctatttctaatctttc

SEQ ID NO: 143836 - DNA, 20 bp, Homo sapiens
tttgtcactcagactagggt

SEQ ID NO: 143837 - DNA, 23 bp, Homo sapiens
atcacattttgtttatctgttca

SEQ ID NO: 143838 - DNA, 20 bp, Homo sapiens
catttagttggatgtttcca

SEQ ID NO: 143839 - DNA, 23 bp, Homo sapiens
ttttctctctgttaatctctgtc

SEQ ID NO: 143840 - DNA, 23 bp, Homo sapiens
tttgagacggtgtctcgctctgt

SEQ ID NO: 143841 - DNA, 23 bp, Homo sapiens
atttggaggcatatctatactaa

SEQ ID NO: 143842 - DNA, 23 bp, Homo sapiens
tctctcacactctttcttgaggc

SEQ ID NO: 143843 - DNA, 23 bp, Homo sapiens
agagatgagttgtcactgtgttg

SEQ ID NO: 143844 - DNA, 23 bp, Homo sapiens
agagtctcactctgtcacccagg

SEQ ID NO: 143845 - DNA, 19 bp, Homo sapiens
gagtctcgctctgtcaccc

SEQ ID NO: 143846 - DNA, 23 bp, Homo sapiens
tgagttcattgtagattctggat

SEQ ID NO: 143847 - DNA, 23 bp, Homo sapiens
tgagttcattgtagattctggat

SEQ ID NO: 143848 - DNA, 18 bp, Homo sapiens
gacaagtagggattctat

SEQ ID NO: 143849 - DNA, 23 bp, Homo sapiens
ttcgctttcttgaagcacagcag

SEQ ID NO: 143850 - DNA, 23 bp, Homo sapiens
ggctttgtgagagtagtgagagc

SEQ ID NO: 143851 - DNA, 23 bp, Homo sapiens
atatctatatatgtagatctgta

SEQ ID NO: 143852 - DNA, 23 bp, Homo sapiens
agggtctctctgtcactcaggct

SEQ ID NO: 143853 - DNA, 23 bp, Homo sapiens
tgacaggcaagaccctgtctctt

SEQ ID NO: 143854 - DNA, 21 bp, Homo sapiens
tggagtctcgctctgtcaccc

SEQ ID NO: 143855 - DNA, 23 bp, Homo sapiens
atagtgagaccctgtctttacca

SEQ ID NO: 143856 - DNA, 23 bp, Homo sapiens
tgagacagagtcttgctctgtca

SEQ ID NO: 143857 - DNA, 23 bp, Homo sapiens
agtttgacagcatctgcaaatcc

SEQ ID NO: 143858 - DNA, 22 bp, Homo sapiens
ttttagatggagttttgctctt

SEQ ID NO: 143859 - DNA, 20 bp, Homo sapiens
ttgtgtccggaattggtggg

SEQ ID NO: 143860 - DNA, 23 bp, Homo sapiens
attggatggagctgaattaaatt

SEQ ID NO: 143861 - DNA, 22 bp, Homo sapiens
ataagttcttggtcatatctgg

SEQ ID NO: 143862 - DNA, 23 bp, Homo sapiens
cagggtctcactctgtcacccag

SEQ ID NO: 143863 - DNA, 19 bp, Homo sapiens
aggtggatcttgaccccat

SEQ ID NO: 143864 - DNA, 23 bp, Homo sapiens
agatggagtctcactctgtcacc

SEQ ID NO: 143865 - DNA, 22 bp, Homo sapiens
gggaatctctctcgctctgtgg

SEQ ID NO: 143866 - DNA, 23 bp, Homo sapiens
atgtatgtatgtgtgtgtgtata

SEQ ID NO: 143867 - DNA, 22 bp, Homo sapiens
acacagaattcacagtggagag

SEQ ID NO: 143868 - DNA, 23 bp, Homo sapiens
gggtctcactctgtcactcaggc

SEQ ID NO: 143869 - DNA, 22 bp, Homo sapiens
ttgagcctagtgtggtgcagct

SEQ ID NO: 143870 - DNA, 22 bp, Homo sapiens
taatgctcttgtctggggctct

SEQ ID NO: 143871 - DNA, 21 bp, Homo sapiens
actctgtatgtctaggacttg

SEQ ID NO: 143872 - DNA, 21 bp, Homo sapiens
agtcagattgcttggactggg

SEQ ID NO: 143873 - DNA, 23 bp, Homo sapiens
agggagtagaaagagctgttgga

SEQ ID NO: 143874 - DNA, 23 bp, Homo sapiens
gacatggagtctcgctctgtcac

SEQ ID NO: 143875 - DNA, 23 bp, Homo sapiens
gctgaagtagagaaagtctgtct

SEQ ID NO: 143876 - DNA, 23 bp, Homo sapiens
tcattgctgactgactctctcac

SEQ ID NO: 143877 - DNA, 23 bp, Homo sapiens
tgtgagcctctctgagcctctgt

SEQ ID NO: 143878 - DNA, 23 bp, Homo sapiens
ggctgagagtacagactctggag

SEQ ID NO: 143879 - DNA, 19 bp, Homo sapiens
atcttaggtgtcccacagt

SEQ ID NO: 143880 - DNA, 22 bp, Homo sapiens
cagtctctgacactcagtggca

SEQ ID NO: 143881 - DNA, 18 bp, Homo sapiens
gtgtgtcagaggtgtttg

SEQ ID NO: 143882 - DNA, 23 bp, Homo sapiens
tggagtctcactctgtcacccag

SEQ ID NO: 143883 - DNA, 23 bp, Homo sapiens
agacagagtcttgctctgtctcc

SEQ ID NO: 143884 - DNA, 23 bp, Homo sapiens
taccattcagtcccactctctca

SEQ ID NO: 143885 - DNA, 20 bp, Homo sapiens
atgagagttctcccttggcc

SEQ ID NO: 143886 - DNA, 23 bp, Homo sapiens
aacattcattccagtgggagcca

SEQ ID NO: 143887 - DNA, 23 bp, Homo sapiens
ggctgtggctctgactgtgctgc

SEQ ID NO: 143888 - DNA, 23 bp, Homo sapiens
tgactggagattgtgttttgttt

SEQ ID NO: 143889 - DNA, 23 bp, Homo sapiens
acagagtctcactctgtcaccca

SEQ ID NO: 143890 - DNA, 23 bp, Homo sapiens
tttgtgtgtgtgcatgtcttcag

SEQ ID NO: 143891 - DNA, 23 bp, Homo sapiens
accctctcagcctctttcttgtg

SEQ ID NO: 143892 - DNA, 23 bp, Homo sapiens
agaaactcactggtattggtccc

SEQ ID NO: 143893 - DNA, 22 bp, Homo sapiens
tatggtctatcttgatgaatgt

SEQ ID NO: 143894 - DNA, 21 bp, Homo sapiens
tgcagtggcacaatcatgtct

SEQ ID NO: 143895 - DNA, 18 bp, Homo sapiens
tcagtactgagtgtgggc

SEQ ID NO: 143896 - DNA, 23 bp, Homo sapiens
tctgtctgtgcctctgtttcccc

SEQ ID NO: 143897 - DNA, 23 bp, Homo sapiens
taggatctcactctgttgcctag

SEQ ID NO: 143898 - DNA, 23 bp, Homo sapiens
tgtggaactggaagtgcatgtgg

SEQ ID NO: 143899 - DNA, 20 bp, Homo sapiens
aatcatggctcactgcagcc

SEQ ID NO: 143900 - DNA, 23 bp, Homo sapiens
agacagagtctcgctctgtcacc

SEQ ID NO: 143901 - DNA, 21 bp, Homo sapiens
tcagcaacagagtgagactct

SEQ ID NO: 143902 - DNA, 23 bp, Homo sapiens
ctgggtgacagagtcaatcactg

SEQ ID NO: 143903 - DNA, 23 bp, Homo sapiens
gtgacagagcaagactatctcaa

SEQ ID NO: 143904 - DNA, 18 bp, Homo sapiens
acagtctttctgtcaccc

SEQ ID NO: 143905 - DNA, 21 bp, Homo sapiens
ttgcagtgaactgagattgtg

SEQ ID NO: 143906 - DNA, 23 bp, Homo sapiens
gacagggtctcactctgtcaccc

SEQ ID NO: 143907 - DNA, 23 bp, Homo sapiens
tggagtctcactctgtcacccag

SEQ ID NO: 143908 - DNA, 22 bp, Homo sapiens
cacttgtaatctcagcactttg

SEQ ID NO: 143909 - DNA, 23 bp, Homo sapiens
tttaagcagaaaatgagagtcag

SEQ ID NO: 143910 - DNA, 18 bp, Homo sapiens
tgagatgaagtctcactc

SEQ ID NO: 143911 - DNA, 23 bp, Homo sapiens
agagagaggggtctcactctgtc

SEQ ID NO: 143912 - DNA, 20 bp, Homo sapiens
aggagaatatgtatacgtgt

SEQ ID NO: 143913 - DNA, 18 bp, Homo sapiens
tatatagtagtactacta

SEQ ID NO: 143914 - DNA, 23 bp, Homo sapiens
ctgagcaacatagtgagatctca

SEQ ID NO: 143915 - DNA, 23 bp, Homo sapiens
tgtgtgaggtaatacgtatgttc

SEQ ID NO: 143916 - DNA, 20 bp, Homo sapiens
tatttcaaaacatcatgttg

SEQ ID NO: 143917 - DNA, 23 bp, Homo sapiens
acggtctcactctgtcacccagg

SEQ ID NO: 143918 - DNA, 23 bp, Homo sapiens
cagtggtgtgatcttggctcact

SEQ ID NO: 143919 - DNA, 23 bp, Homo sapiens
gttttactgtctgctctttctgg

SEQ ID NO: 143920 - DNA, 22 bp, Homo sapiens
tatatctgatatctaatgatat

SEQ ID NO: 143921 - DNA, 21 bp, Homo sapiens
tatatatcattagatatcaga

SEQ ID NO: 143922 - DNA, 21 bp, Homo sapiens
atcacgactcactgcagcctc

SEQ ID NO: 143923 - DNA, 23 bp, Homo sapiens
agtgactgagtggctctctgctc

SEQ ID NO: 143924 - DNA, 23 bp, Homo sapiens
ctctgtctctgactgaaagtgct

SEQ ID NO: 143925 - DNA, 23 bp, Homo sapiens
attgtgaaatagtattccattgt

SEQ ID NO: 143926 - DNA, 23 bp, Homo sapiens
agtacttaggattagaaaagaaa

SEQ ID NO: 143927 - DNA, 19 bp, Homo sapiens
gcatgtgtgtatatatgta

SEQ ID NO: 143928 - DNA, 22 bp, Homo sapiens
atacacatatgtagatatatgt

SEQ ID NO: 143929 - DNA, 23 bp, Homo sapiens
tcagttctatagatgatgacaga

SEQ ID NO: 143930 - DNA, 18 bp, Homo sapiens
acgtatatatatatgtgt

SEQ ID NO: 143931 - DNA, 22 bp, Homo sapiens
aacttgcattaaaaaactgtaa

SEQ ID NO: 143932 - DNA, 23 bp, Homo sapiens
tacagtaaccctgaatttgtagt

SEQ ID NO: 143933 - DNA, 23 bp, Homo sapiens
gttgactcttctttggaatgtga

SEQ ID NO: 143934 - DNA, 23 bp, Homo sapiens
taaagaaggcattaggtagcttt

SEQ ID NO: 143935 - DNA, 22 bp, Homo sapiens
gtcatttctggatcttttctac

SEQ ID NO: 143936 - DNA, 22 bp, Homo sapiens
aaaagtcctgggatttttatgt

SEQ ID NO: 143937 - DNA, 23 bp, Homo sapiens
aaaagtgtctgttcatgtccttt

SEQ ID NO: 143938 - DNA, 22 bp, Homo sapiens
aagttccttgtagatggtggat

SEQ ID NO: 143939 - DNA, 21 bp, Homo sapiens
tcaagaggtttttggggagca

SEQ ID NO: 143940 - DNA, 23 bp, Homo sapiens
tattatgtattgttgttcatctc

SEQ ID NO: 143941 - DNA, 23 bp, Homo sapiens
attttgtcactttttaaaactgt

SEQ ID NO: 143942 - DNA, 18 bp, Homo sapiens
atgctttaagttttaggg

SEQ ID NO: 143943 - DNA, 21 bp, Homo sapiens
acatgtgcacaatgtgcaggt

SEQ ID NO: 143944 - DNA, 23 bp, Homo sapiens
tattctgaatttggaattcagac

SEQ ID NO: 143945 - DNA, 23 bp, Homo sapiens
tctcactgagtccctctcatgac

SEQ ID NO: 143946 - DNA, 22 bp, Homo sapiens
tagcaggtttccatatctgtgt

SEQ ID NO: 143947 - DNA, 23 bp, Homo sapiens
cagttctgtcactgaaaattcac

SEQ ID NO: 143948 - DNA, 23 bp, Homo sapiens
tgagttcattgtagattctggat

SEQ ID NO: 143949 - DNA, 23 bp, Homo sapiens
tgagttcattgtagattctggat

SEQ ID NO: 143950 - DNA, 23 bp, Homo sapiens
gcaagatttactaggattcttgg

SEQ ID NO: 143951 - DNA, 23 bp, Homo sapiens
aaatcctagatttggtaatgttc

SEQ ID NO: 143952 - DNA, 23 bp, Homo sapiens
catgagtgattttgtagatgagt

SEQ ID NO: 143953 - DNA, 22 bp, Homo sapiens
aaaatgcttgtgcatgtgtgtg

SEQ ID NO: 143954 - DNA, 23 bp, Homo sapiens
gtttagtgagatattgcagttta

SEQ ID NO: 143955 - DNA, 23 bp, Homo sapiens
tcagaatgaaaatgatatgcgat

SEQ ID NO: 143956 - DNA, 20 bp, Homo sapiens
tgatctgagctttggcagtg

SEQ ID NO: 143957 - DNA, 23 bp, Homo sapiens
tgagttcattgtagattctggat

SEQ ID NO: 143958 - DNA, 23 bp, Homo sapiens
tgagttcattgtagattctggat

SEQ ID NO: 143959 - DNA, 21 bp, Homo sapiens
ctgagggaagaagctcagttg

SEQ ID NO: 143960 - DNA, 20 bp, Homo sapiens
aaaggaacggtgagagtggg

SEQ ID NO: 143961 - DNA, 22 bp, Homo sapiens
ttttggctgttcatcgtgatgt

SEQ ID NO: 143962 - DNA, 20 bp, Homo sapiens
taagcttcctcagcaaagga

SEQ ID NO: 143963 - DNA, 20 bp, Homo sapiens
tcccagggttttaggaggct

SEQ ID NO: 143964 - DNA, 23 bp, Homo sapiens
tgtcattatctccagatgggtga

SEQ ID NO: 143965 - DNA, 19 bp, Homo sapiens
tgagattggactaagtttt

SEQ ID NO: 143966 - DNA, 23 bp, Homo sapiens
cagggtctcactctgtcacccag

SEQ ID NO: 143967 - DNA, 23 bp, Homo sapiens
tgtgtatgtatatgtatatgtgt

SEQ ID NO: 143968 - DNA, 20 bp, Homo sapiens
agtctcattctgtcactcag

SEQ ID NO: 143969 - DNA, 19 bp, Homo sapiens
tgcaatggtgagatctcag

SEQ ID NO: 143970 - DNA, 20 bp, Homo sapiens
tgacaattatttgaaaagtg

SEQ ID NO: 143971 - DNA, 21 bp, Homo sapiens
tagtttgtatgctattgatct

SEQ ID NO: 143972 - DNA, 22 bp, Homo sapiens
atatacatacacgtattcatgt

SEQ ID NO: 143973 - DNA, 22 bp, Homo sapiens
aacagtttttaatggtatgcta

SEQ ID NO: 143974 - DNA, 18 bp, Homo sapiens
tgaggtagaaggattgat

SEQ ID NO: 143975 - DNA, 23 bp, Homo sapiens
tgagttcattgtagattctggat

SEQ ID NO: 143976 - DNA, 23 bp, Homo sapiens
tgagttcattgtagattctggat

SEQ ID NO: 143977 - DNA, 23 bp, Homo sapiens
attgtggtttaaatttgtattga

SEQ ID NO: 143978 - DNA, 23 bp, Homo sapiens
ggttattgctatataactatagt

SEQ ID NO: 143979 - DNA, 22 bp, Homo sapiens
atgtgtcacaggtaagaatccc

SEQ ID NO: 143980 - DNA, 21 bp, Homo sapiens
agtctcgctctcactgcccca

SEQ ID NO: 143981 - DNA, 23 bp, Homo sapiens
tcaccctctcacactctgcctgt

SEQ ID NO: 143982 - DNA, 23 bp, Homo sapiens
aactgtgggagagtgaattcgct

SEQ ID NO: 143983 - DNA, 21 bp, Homo sapiens
ttgcagtgaactgggatggtg

SEQ ID NO: 143984 - DNA, 23 bp, Homo sapiens
gtgacacagtgagactctgtctc

SEQ ID NO: 143985 - DNA, 23 bp, Homo sapiens
aggctctgagtgcctgggtgcct

SEQ ID NO: 143986 - DNA, 23 bp, Homo sapiens
atagtctgtaaggtattgattct

SEQ ID NO: 143987 - DNA, 19 bp, Homo sapiens
tgaaagttggttgtgtagt

SEQ ID NO: 143988 - DNA, 23 bp, Homo sapiens
tgctactttgtttttgtaaaggg

SEQ ID NO: 143989 - DNA, 23 bp, Homo sapiens
atatggtgccagttgatccagat

SEQ ID NO: 143990 - DNA, 18 bp, Homo sapiens
atgagatagtcttatctg

SEQ ID NO: 143991 - DNA, 23 bp, Homo sapiens
atcatcaggaattagattctcat

SEQ ID NO: 143992 - DNA, 23 bp, Homo sapiens
tacatgtgcacaatgtgcaggtt

SEQ ID NO: 143993 - DNA, 23 bp, Homo sapiens
tggctgttgtaagaattgagtgt

SEQ ID NO: 143994 - DNA, 21 bp, Homo sapiens
atctcactctgtctcccaggc

SEQ ID NO: 143995 - DNA, 21 bp, Homo sapiens
atgctgttgataaaggtgaag

SEQ ID NO: 143996 - DNA, 21 bp, Homo sapiens
atttatcaggcacttactgtc

SEQ ID NO: 143997 - DNA, 23 bp, Homo sapiens
tttgtgtgcaagtgcatgtgtat

SEQ ID NO: 143998 - DNA, 23 bp, Homo sapiens
tgagttcattgtagattctggat

SEQ ID NO: 143999 - DNA, 23 bp, Homo sapiens
tgagttcattgtagattctggat

SEQ ID NO: 144000 - DNA, 19 bp, Homo sapiens
tacattagcctagtggctc

SEQ ID NO: 144001 - DNA, 23 bp, Homo sapiens
gtcgagtggatttcatagcatat

SEQ ID NO: 144002 - DNA, 23 bp, Homo sapiens
aatgtctgtgggtgtctatagac

SEQ ID NO: 144003 - DNA, 21 bp, Homo sapiens
tgcctgggtccctgtttgact

SEQ ID NO: 144004 - DNA, 21 bp, Homo sapiens
cactagaaggaaaagagagta

SEQ ID NO: 144005 - DNA, 23 bp, Homo sapiens
tttttgacactggtctcactgtc

SEQ ID NO: 144006 - DNA, 23 bp, Homo sapiens
tgtgtgcgtgcatgtgtgtgtgt

SEQ ID NO: 144007 - DNA, 21 bp, Homo sapiens
tatgtgtgtatatatatgtat

SEQ ID NO: 144008 - DNA, 18 bp, Homo sapiens
atgtatatatatgtgtat

SEQ ID NO: 144009 - DNA, 19 bp, Homo sapiens
aagggactaggtgttcttt

SEQ ID NO: 144010 - DNA, 23 bp, Homo sapiens
gatggagtctctctctgtcacca

SEQ ID NO: 144011 - DNA, 23 bp, Homo sapiens
tgtgtctgtgtgtctgcctcagc

SEQ ID NO: 144012 - DNA, 19 bp, Homo sapiens
tctctgggctttccatctc

SEQ ID NO: 144013 - DNA, 19 bp, Homo sapiens
cagcctgggtttaatctcc

SEQ ID NO: 144014 - DNA, 23 bp, Homo sapiens
tctgagagcagagagagaggtga

SEQ ID NO: 144015 - DNA, 22 bp, Homo sapiens
tgtacacccattttgatgcctt

SEQ ID NO: 144016 - DNA, 21 bp, Homo sapiens
aacacttaacttcattctgtt

SEQ ID NO: 144017 - DNA, 22 bp, Homo sapiens
ttcagcaccagtttcatgtttg

SEQ ID NO: 144018 - DNA, 22 bp, Homo sapiens
tttgagagtggaggctgtgtct

SEQ ID NO: 144019 - DNA, 21 bp, Homo sapiens
agtctttagtgtgtgtgtgta

SEQ ID NO: 144020 - DNA, 22 bp, Homo sapiens
gtgaacacattttgttgttgac

SEQ ID NO: 144021 - DNA, 22 bp, Homo sapiens
attactgaaggtatactggagt

SEQ ID NO: 144022 - DNA, 18 bp, Homo sapiens
atgtgcccaacgtgcagg

SEQ ID NO: 144023 - DNA, 21 bp, Homo sapiens
atacttgtttctggttgttga

SEQ ID NO: 144024 - DNA, 23 bp, Homo sapiens
tgttttctagcctctttgtacag

SEQ ID NO: 144025 - DNA, 21 bp, Homo sapiens
catttatttattagcttacag

SEQ ID NO: 144026 - DNA, 22 bp, Homo sapiens
taggtcagaaatgtgggtggac

SEQ ID NO: 144027 - DNA, 23 bp, Homo sapiens
tcaggctgactcactttcacctg

SEQ ID NO: 144028 - DNA, 18 bp, Homo sapiens
agactgcttggagtgctg

SEQ ID NO: 144029 - DNA, 19 bp, Homo sapiens
tgcgtatatatacgtgtat

SEQ ID NO: 144030 - DNA, 22 bp, Homo sapiens
tctagagtttatttgattatag

SEQ ID NO: 144031 - DNA, 23 bp, Homo sapiens
aatattttgctttgggagagaga

SEQ ID NO: 144032 - DNA, 21 bp, Homo sapiens
tgtgtatatatatatgtgtgt

SEQ ID NO: 144033 - DNA, 23 bp, Homo sapiens
atgtgtgtgtatatatatatgtg

SEQ ID NO: 144034 - DNA, 23 bp, Homo sapiens
gttgatgttggtaatcataactt

SEQ ID NO: 144035 - DNA, 23 bp, Homo sapiens
aacagtactcagcttcttgaatg

SEQ ID NO: 144036 - DNA, 23 bp, Homo sapiens
acagagtctcactctgtcgccca

SEQ ID NO: 144037 - DNA, 23 bp, Homo sapiens
atatgtgtgtatatatgtgtgtg

SEQ ID NO: 144038 - DNA, 21 bp, Homo sapiens
tggaacatattaatacagaat

SEQ ID NO: 144039 - DNA, 23 bp, Homo sapiens
attcagtaagtagtttcaagttg

SEQ ID NO: 144040 - DNA, 20 bp, Homo sapiens
tgttactgtgtagtgtcgcc

SEQ ID NO: 144041 - DNA, 20 bp, Homo sapiens
agtctcgctctgtcgctcag

SEQ ID NO: 144042 - DNA, 23 bp, Homo sapiens
tcttcttctcattttgtcctcac

SEQ ID NO: 144043 - DNA, 20 bp, Homo sapiens
tgagagcagagagagaggtg

SEQ ID NO: 144044 - DNA, 23 bp, Homo sapiens
gtatgtatacataaatgtgtaca

SEQ ID NO: 144045 - DNA, 20 bp, Homo sapiens
aattgtatatatgtatatct

SEQ ID NO: 144046 - DNA, 23 bp, Homo sapiens
tgtaactgcatcagaaactgaca

SEQ ID NO: 144047 - DNA, 23 bp, Homo sapiens
attatttttgaagtggttgcacc

SEQ ID NO: 144048 - DNA, 21 bp, Homo sapiens
tatagagagtgctacatatat

SEQ ID NO: 144049 - DNA, 22 bp, Homo sapiens
ttcagagaggtttatttggcct

SEQ ID NO: 144050 - DNA, 22 bp, Homo sapiens
taagcaagtctctgaggcactg

SEQ ID NO: 144051 - DNA, 23 bp, Homo sapiens
ctgaaagtcacagattttttttt

SEQ ID NO: 144052 - DNA, 21 bp, Homo sapiens
ttttgagcatgagatttagag

SEQ ID NO: 144053 - DNA, 23 bp, Homo sapiens
tgtttttgatgactttggcagtt

SEQ ID NO: 144054 - DNA, 23 bp, Homo sapiens
ttgtctaactttgttttttcatc

SEQ ID NO: 144055 - DNA, 19 bp, Homo sapiens
aaaactctgttctgttaag

SEQ ID NO: 144056 - DNA, 20 bp, Homo sapiens
agacagagagcgaatgttga

SEQ ID NO: 144057 - DNA, 19 bp, Homo sapiens
tggtgtatatatatacaca

SEQ ID NO: 144058 - DNA, 23 bp, Homo sapiens
gacagagtctcgctctgtcaccc

SEQ ID NO: 144059 - DNA, 22 bp, Homo sapiens
aggcatgaaaacatgtatgtac

SEQ ID NO: 144060 - DNA, 23 bp, Homo sapiens
ttgtgtgcatttgtgtgtgtgtg

SEQ ID NO: 144061 - DNA, 23 bp, Homo sapiens
tgagttcattgtagattctggat

SEQ ID NO: 144062 - DNA, 23 bp, Homo sapiens
tgagttcattgtagattctggat

SEQ ID NO: 144063 - DNA, 22 bp, Homo sapiens
tgtaacagaagacagaatggag

SEQ ID NO: 144064 - DNA, 22 bp, Homo sapiens
agagacattttgttttggagaa

SEQ ID NO: 144065 - DNA, 20 bp, Homo sapiens
ttttttttgagacggagtct

SEQ ID NO: 144066 - DNA, 23 bp, Homo sapiens
tgagttcattgtagattctggat

SEQ ID NO: 144067 - DNA, 23 bp, Homo sapiens
tgagttcattgtagattctggat

SEQ ID NO: 144068 - DNA, 20 bp, Homo sapiens
atagtatatgatgtatagtt

SEQ ID NO: 144069 - DNA, 23 bp, Homo sapiens
tttttactccatttcatgtgtct

SEQ ID NO: 144070 - DNA, 23 bp, Homo sapiens
tgtgacctagagtagaaagaagg

SEQ ID NO: 144071 - DNA, 20 bp, Homo sapiens
tatgcatatatatacacgta

SEQ ID NO: 144072 - DNA, 21 bp, Homo sapiens
atgtgtataattatatatgtg

SEQ ID NO: 144073 - DNA, 22 bp, Homo sapiens
atatttctatctttttgtagtg

SEQ ID NO: 144074 - DNA, 23 bp, Homo sapiens
tgagttcattgtagattctggat

SEQ ID NO: 144075 - DNA, 23 bp, Homo sapiens
tgagttcattgtagattctggat

SEQ ID NO: 144076 - DNA, 23 bp, Homo sapiens
cctttatgtagatactcagctgt

SEQ ID NO: 144077 - DNA, 23 bp, Homo sapiens
tgagaaatctccattctgttttc

SEQ ID NO: 144078 - DNA, 23 bp, Homo sapiens
gttttagacactggctgttgtgt

SEQ ID NO: 144079 - DNA, 23 bp, Homo sapiens
tttgagacggagtctcgctctgt

SEQ ID NO: 144080 - DNA, 20 bp, Homo sapiens
gatagtagtgttggtggtgg

SEQ ID NO: 144081 - DNA, 23 bp, Homo sapiens
tgagttcattgtagattctggat

SEQ ID NO: 144082 - DNA, 23 bp, Homo sapiens
tgagttcattgtagattctggat

SEQ ID NO: 144083 - DNA, 23 bp, Homo sapiens
tgtcagagagaacatgtattctg

SEQ ID NO: 144084 - DNA, 19 bp, Homo sapiens
ctgtgttttactctctgct

SEQ ID NO: 144085 - DNA, 23 bp, Homo sapiens
tttgtgtgggttagaaatgacaa

SEQ ID NO: 144086 - DNA, 23 bp, Homo sapiens
gccactctgcctctctgcctctg

SEQ ID NO: 144087 - DNA, 22 bp, Homo sapiens
tcagcaacttactagcaaattt

SEQ ID NO: 144088 - DNA, 23 bp, Homo sapiens
ttaaagactggtagttctatgta

SEQ ID NO: 144089 - DNA, 23 bp, Homo sapiens
gcagacagtagtgatatcctagc

SEQ ID NO: 144090 - DNA, 20 bp, Homo sapiens
attgcctagaaattctagta

SEQ ID NO: 144091 - DNA, 22 bp, Homo sapiens
atgtgtatatatatatatgtgt

SEQ ID NO: 144092 - DNA, 23 bp, Homo sapiens
tatgtgtatatatatatgtgtgt

SEQ ID NO: 144093 - DNA, 22 bp, Homo sapiens
tatatgtatatgtgtgtgtatg

SEQ ID NO: 144094 - DNA, 18 bp, Homo sapiens
gctatatatatgtgtgtg

SEQ ID NO: 144095 - DNA, 23 bp, Homo sapiens
tgagttcattgtagattctggat

SEQ ID NO: 144096 - DNA, 23 bp, Homo sapiens
tgagttcattgtagattctggat

SEQ ID NO: 144097 - DNA, 23 bp, Homo sapiens
actctgtcacccagactgaagtg

SEQ ID NO: 144098 - DNA, 23 bp, Homo sapiens
tgagttcattgtagattctggat

SEQ ID NO: 144099 - DNA, 23 bp, Homo sapiens
tgagttcattgtagattctggat

SEQ ID NO: 144100 - DNA, 23 bp, Homo sapiens
aggtttgttttgtatagttgaat

SEQ ID NO: 144101 - DNA, 23 bp, Homo sapiens
cactgtgtgtctgtgtgtctata

SEQ ID NO: 144102 - DNA, 23 bp, Homo sapiens
ttagagagtgaaaaagattagca

SEQ ID NO: 144103 - DNA, 18 bp, Homo sapiens
ttgctactagtttgaata

SEQ ID NO: 144104 - DNA, 21 bp, Homo sapiens
ataaacttcatgataagattc

SEQ ID NO: 144105 - DNA, 22 bp, Homo sapiens
ttgtgtaaatatacatatgtat

SEQ ID NO: 144106 - DNA, 19 bp, Homo sapiens
tcactttttggaaatgtaa

SEQ ID NO: 144107 - DNA, 23 bp, Homo sapiens
atatatagatatcttacgaaaag

SEQ ID NO: 144108 - DNA, 23 bp, Homo sapiens
tgtgtatatatatgtatgtgtgt

SEQ ID NO: 144109 - DNA, 23 bp, Homo sapiens
tagtattctcattttgtacttga

SEQ ID NO: 144110 - DNA, 20 bp, Homo sapiens
ctagtgggatatgtggagct

SEQ ID NO: 144111 - DNA, 23 bp, Homo sapiens
tggagtctcactctgtcacccag

SEQ ID NO: 144112 - DNA, 23 bp, Homo sapiens
atgcagggtagattgttgattat

SEQ ID NO: 144113 - DNA, 22 bp, Homo sapiens
aatcaggctacaaattgggaga

SEQ ID NO: 144114 - DNA, 19 bp, Homo sapiens
agacaaggtctcactctgt

SEQ ID NO: 144115 - DNA, 22 bp, Homo sapiens
tgaaaagttagcttgtatgtgg

SEQ ID NO: 144116 - DNA, 20 bp, Homo sapiens
atatgtatgtatatatatgt

SEQ ID NO: 144117 - DNA, 20 bp, Homo sapiens
atatgtatgtatatatatgt

SEQ ID NO: 144118 - DNA, 22 bp, Homo sapiens
tatgtatatatgtatatgtgtg

SEQ ID NO: 144119 - DNA, 22 bp, Homo sapiens
aaatttccttagaaaactatag

SEQ ID NO: 144120 - DNA, 23 bp, Homo sapiens
aaatttctacagtcaatgtgttc

SEQ ID NO: 144121 - DNA, 18 bp, Homo sapiens
attgttcaatcatagcac

SEQ ID NO: 144122 - DNA, 20 bp, Homo sapiens
taaatatgtgctatagttga

SEQ ID NO: 144123 - DNA, 19 bp, Homo sapiens
gtatgtgtatataatatgt

SEQ ID NO: 144124 - DNA, 18 bp, Homo sapiens
actccagcaggagcagag

SEQ ID NO: 144125 - DNA, 21 bp, Homo sapiens
ttccaagtagttgggactata

SEQ ID NO: 144126 - DNA, 23 bp, Homo sapiens
attggtttacatgcagtttttgt

SEQ ID NO: 144127 - DNA, 23 bp, Homo sapiens
agacaaggtctctctctgttacc

SEQ ID NO: 144128 - DNA, 21 bp, Homo sapiens
ttaggtctgggggtggtgaga

SEQ ID NO: 144129 - DNA, 23 bp, Homo sapiens
tgtgtatatttattctatactgt

SEQ ID NO: 144130 - DNA, 23 bp, Homo sapiens
tttacttcctgttgaaaatccaa

SEQ ID NO: 144131 - DNA, 23 bp, Homo sapiens
ttaagattaccatcagttgttct

SEQ ID NO: 144132 - DNA, 23 bp, Homo sapiens
tttaagtgcctggtagattccag

SEQ ID NO: 144133 - DNA, 18 bp, Homo sapiens
tctcactctgtcacccag

SEQ ID NO: 144134 - DNA, 23 bp, Homo sapiens
atatctatacatatgtatacata

SEQ ID NO: 144135 - DNA, 23 bp, Homo sapiens
agacagtgtctcgctctgtcacc

SEQ ID NO: 144136 - DNA, 23 bp, Homo sapiens
agtcagtctcagtctataagccc

SEQ ID NO: 144137 - DNA, 23 bp, Homo sapiens
gtattctgtgtcatgtatatgtg

SEQ ID NO: 144138 - DNA, 22 bp, Homo sapiens
cagatatagatatgtatatgta

SEQ ID NO: 144139 - DNA, 19 bp, Homo sapiens
atatctatacatgtatatc

SEQ ID NO: 144140 - DNA, 23 bp, Homo sapiens
atatctatgtgtgtatatgatat

SEQ ID NO: 144141 - DNA, 23 bp, Homo sapiens
tttcagtggtatgcttctctgtg

SEQ ID NO: 144142 - DNA, 22 bp, Homo sapiens
atatatgtaacatatattatgt

SEQ ID NO: 144143 - DNA, 23 bp, Homo sapiens
ggaaatctgtgtggcatagatga

SEQ ID NO: 144144 - DNA, 22 bp, Homo sapiens
tgtttctagatgttttatgctt

SEQ ID NO: 144145 - DNA, 21 bp, Homo sapiens
aacaggctcccaacacttggc

SEQ ID NO: 144146 - DNA, 23 bp, Homo sapiens
caaaaagatcatcttcttcgtct

SEQ ID NO: 144147 - DNA, 23 bp, Homo sapiens
tcaaagagactggtctttttcac

SEQ ID NO: 144148 - DNA, 18 bp, Homo sapiens
agcagttttggcaagaat

SEQ ID NO: 144149 - DNA, 23 bp, Homo sapiens
tggagtctcactctgtcacctag

SEQ ID NO: 144150 - DNA, 23 bp, Homo sapiens
catagtgagactcggtctctaca

SEQ ID NO: 144151 - DNA, 23 bp, Homo sapiens
tttgagacggagtctcactctgt

SEQ ID NO: 144152 - DNA, 19 bp, Homo sapiens
accctgtctcggaaaaagg

SEQ ID NO: 144153 - DNA, 23 bp, Homo sapiens
tgagacagagtctcgctctgtcg

SEQ ID NO: 144154 - DNA, 23 bp, Homo sapiens
gtgtgcatctgtcactgtctccc

SEQ ID NO: 144155 - DNA, 20 bp, Homo sapiens
tgtgtatatatatacacgta

SEQ ID NO: 144156 - DNA, 23 bp, Homo sapiens
agacaaagtctcactctgtcgcc

SEQ ID NO: 144157 - DNA, 23 bp, Homo sapiens
ctgtctgtctgtgtgtggtctcc

SEQ ID NO: 144158 - DNA, 22 bp, Homo sapiens
cctgggtgactgcatggaaaag

SEQ ID NO: 144159 - DNA, 22 bp, Homo sapiens
tgtcactcgctgagtgcctggg

SEQ ID NO: 144160 - DNA, 23 bp, Homo sapiens
aaaagagagtttgccttactgga

SEQ ID NO: 144161 - DNA, 19 bp, Homo sapiens
ttacaaaaagagatggggt

SEQ ID NO: 144162 - DNA, 18 bp, Homo sapiens
gttcttggcacagcccca

SEQ ID NO: 144163 - DNA, 23 bp, Homo sapiens
tgagcctgtcagctaaagatggc

SEQ ID NO: 144164 - DNA, 23 bp, Homo sapiens
tctgactgcgtctgtctctgcct

SEQ ID NO: 144165 - DNA, 19 bp, Homo sapiens
tgaggtttattttagtttt

SEQ ID NO: 144166 - DNA, 23 bp, Homo sapiens
tgagcttgcacacacacacacac

SEQ ID NO: 144167 - DNA, 22 bp, Homo sapiens
tgggatgtggatgtgtacccaa

SEQ ID NO: 144168 - DNA, 20 bp, Homo sapiens
tgaggaacattctgtccatg

SEQ ID NO: 144169 - DNA, 23 bp, Homo sapiens
tctcactcagactgagatggaag

SEQ ID NO: 144170 - DNA, 23 bp, Homo sapiens
cctgtctctctctctgtgtcagt

SEQ ID NO: 144171 - DNA, 23 bp, Homo sapiens
ctcagaagtgactctccacagtg

SEQ ID NO: 144172 - DNA, 22 bp, Homo sapiens
atgaataactttctgtcttcgt

SEQ ID NO: 144173 - DNA, 23 bp, Homo sapiens
atagtctcagattttgtgtttag

SEQ ID NO: 144174 - DNA, 18 bp, Homo sapiens
gttgtgacacattgttta

SEQ ID NO: 144175 - DNA, 22 bp, Homo sapiens
tgtgaagaaagtcaatggtact

SEQ ID NO: 144176 - DNA, 21 bp, Homo sapiens
acactgataggtcttgactct

SEQ ID NO: 144177 - DNA, 21 bp, Homo sapiens
ttaaggttaatattgttatgt

SEQ ID NO: 144178 - DNA, 18 bp, Homo sapiens
tgactgattgctctagct

SEQ ID NO: 144179 - DNA, 22 bp, Homo sapiens
caatcaatcctttgtttggagt

SEQ ID NO: 144180 - DNA, 23 bp, Homo sapiens
aagatttatttctgttgatttct

SEQ ID NO: 144181 - DNA, 21 bp, Homo sapiens
agaatcaggcctaggcagaga

SEQ ID NO: 144182 - DNA, 23 bp, Homo sapiens
agagacactgagtgacttgctag

SEQ ID NO: 144183 - DNA, 21 bp, Homo sapiens
actgcacttcagtctgagtaa

SEQ ID NO: 144184 - DNA, 22 bp, Homo sapiens
ttttgctcttgtcacccagtct

SEQ ID NO: 144185 - DNA, 18 bp, Homo sapiens
atcacagtgattcttttt

SEQ ID NO: 144186 - DNA, 23 bp, Homo sapiens
agacaaagtctcgctctgtcacc

SEQ ID NO: 144187 - DNA, 21 bp, Homo sapiens
agaatcaggcctaggcagaga

SEQ ID NO: 144188 - DNA, 23 bp, Homo sapiens
gtgtgcatctgtcactgtctccc

SEQ ID NO: 144189 - DNA, 23 bp, Homo sapiens
tgagacagagtctcgctctgtcg

SEQ ID NO: 144190 - DNA, 22 bp, Homo sapiens
cctctctcagtccctgtgtctt

SEQ ID NO: 144191 - DNA, 20 bp, Homo sapiens
gagatggagtctcactcatt

SEQ ID NO: 144192 - DNA, 23 bp, Homo sapiens
tgagttcattgtagattctggat

SEQ ID NO: 144193 - DNA, 23 bp, Homo sapiens
tgagttcattgtagattctggat

SEQ ID NO: 144194 - DNA, 23 bp, Homo sapiens
actgtgtgggtgtgtcaggggga

SEQ ID NO: 144195 - DNA, 21 bp, Homo sapiens
tgatgcagtgtgtgcacactg

SEQ ID NO: 144196 - DNA, 22 bp, Homo sapiens
tgagtgatgtgtgtgcacactg

SEQ ID NO: 144197 - DNA, 22 bp, Homo sapiens
ggagtctcactctgtcacctag

SEQ ID NO: 144198 - DNA, 21 bp, Homo sapiens
aacaggctcccaacacttggc

SEQ ID NO: 144199 - DNA, 23 bp, Homo sapiens
caaaaagatcatcttcttcgtct

SEQ ID NO: 144200 - DNA, 23 bp, Homo sapiens
tcaaagagactggtctttttcac

SEQ ID NO: 144201 - DNA, 23 bp, Homo sapiens
tggagtctcactctgtcacctag

SEQ ID NO: 144202 - DNA, 23 bp, Homo sapiens
ctctcaccgtctgtgttttctgt

SEQ ID NO: 144203 - DNA, 23 bp, Homo sapiens
gtgtgcatctgtcactgtctccc

SEQ ID NO: 144204 - DNA, 21 bp, Homo sapiens
actgcacttcagtctgagtaa

SEQ ID NO: 144205 - DNA, 22 bp, Homo sapiens
ttttgctcttgtcacccagtct

SEQ ID NO: 144206 - DNA, 21 bp, Homo sapiens
agaatcaggcctaggcagaga

SEQ ID NO: 144207 - DNA, 23 bp, Homo sapiens
agagacactgagtgacttgctag

SEQ ID NO: 144208 - DNA, 19 bp, Homo sapiens
ttcacacaggtgcgacctg

SEQ ID NO: 144209 - DNA, 18 bp, Homo sapiens
gtcatggcagtggtccct

SEQ ID NO: 144210 - DNA, 23 bp, Homo sapiens
aaactgcatctccaggtgcttct

SEQ ID NO: 144211 - DNA, 21 bp, Homo sapiens
actgcacttcagtctgagtaa

SEQ ID NO: 144212 - DNA, 22 bp, Homo sapiens
ttttgctcttgtcacccagtct

SEQ ID NO: 144213 - DNA, 21 bp, Homo sapiens
agaatcaggcctaggcagaga

SEQ ID NO: 144214 - DNA, 23 bp, Homo sapiens
gtgtgcatctgtcactgtctccc

SEQ ID NO: 144215 - DNA, 23 bp, Homo sapiens
tttgagacggagtctcgctctgt

SEQ ID NO: 144216 - DNA, 22 bp, Homo sapiens
cctctctcagtccctgtgtctt

SEQ ID NO: 144217 - DNA, 23 bp, Homo sapiens
aagatttatttctgttgatttct

SEQ ID NO: 144218 - DNA, 20 bp, Homo sapiens
gagatggagtctcactcatt

SEQ ID NO: 144219 - DNA, 23 bp, Homo sapiens
actgtgtgggtgtgtcaggggga

SEQ ID NO: 144220 - DNA, 21 bp, Homo sapiens
aacaggctcccaacacttggc

SEQ ID NO: 144221 - DNA, 19 bp, Homo sapiens
agtgccactcactgtccct

SEQ ID NO: 144222 - DNA, 23 bp, Homo sapiens
catattcacatacaaaagtcata

SEQ ID NO: 144223 - DNA, 22 bp, Homo sapiens
aatatgcatgtaaatatgtatg

SEQ ID NO: 144224 - DNA, 23 bp, Homo sapiens
taaagtggaagcatttattatgt

SEQ ID NO: 144225 - DNA, 23 bp, Homo sapiens
ttaatgtgaagcactttactatc

SEQ ID NO: 144226 - DNA, 23 bp, Homo sapiens
tgtgtcaatagggtagtgtggtg

SEQ ID NO: 144227 - DNA, 20 bp, Homo sapiens
tcttactatgctgcccagac

SEQ ID NO: 144228 - DNA, 22 bp, Homo sapiens
ctctgacaccctagaatgtgag

SEQ ID NO: 144229 - DNA, 23 bp, Homo sapiens
ctctgcctctgtcttagttggct

SEQ ID NO: 144230 - DNA, 23 bp, Homo sapiens
ttttgttcctgtgacaggggctg

SEQ ID NO: 144231 - DNA, 21 bp, Homo sapiens
aaaagtaccattcagatttgt

SEQ ID NO: 144232 - DNA, 21 bp, Homo sapiens
gaggtattcagacacaggttg

SEQ ID NO: 144233 - DNA, 22 bp, Homo sapiens
tctgagcctcagtgtttctctc

SEQ ID NO: 144234 - DNA, 23 bp, Homo sapiens
ggctcacacttgcaatcccagtg

SEQ ID NO: 144235 - DNA, 21 bp, Homo sapiens
tgaggtaggaggatcacttga

SEQ ID NO: 144236 - DNA, 22 bp, Homo sapiens
gactgagttcacacagagcaga

SEQ ID NO: 144237 - DNA, 23 bp, Homo sapiens
acactcacacaggcacactccag

SEQ ID NO: 144238 - DNA, 21 bp, Homo sapiens
tgaggtggcagagtcttggac

SEQ ID NO: 144239 - DNA, 23 bp, Homo sapiens
aagaggtaggtggttggattctg

SEQ ID NO: 144240 - DNA, 23 bp, Homo sapiens
tgcatatctgtgtgtgtctatgt

SEQ ID NO: 144241 - DNA, 23 bp, Homo sapiens
cagagcaagactctttttttttt

SEQ ID NO: 144242 - DNA, 23 bp, Homo sapiens
agatggagtctcactctgtcacc

SEQ ID NO: 144243 - DNA, 22 bp, Homo sapiens
tttgagacggagtctcgctgtg

SEQ ID NO: 144244 - DNA, 23 bp, Homo sapiens
agtctcgctcactcagtgctcaa

SEQ ID NO: 144245 - DNA, 23 bp, Homo sapiens
gggtcactctctccatgtcacag

SEQ ID NO: 144246 - DNA, 23 bp, Homo sapiens
gggtctcactctgtcacccaggc

SEQ ID NO: 144247 - DNA, 23 bp, Homo sapiens
agtcagtctgtccctccttcagc

SEQ ID NO: 144248 - DNA, 18 bp, Homo sapiens
tatactttaagttctagg

SEQ ID NO: 144249 - DNA, 23 bp, Homo sapiens
tacatgtgcacaatgtgcaggtt

SEQ ID NO: 144250 - DNA, 21 bp, Homo sapiens
tttgtgtatatatatgtgtgt

SEQ ID NO: 144251 - DNA, 23 bp, Homo sapiens
agagagtctcgctctgtcaccca

SEQ ID NO: 144252 - DNA, 20 bp, Homo sapiens
tgtcagaagaaagacgtcac

SEQ ID NO: 144253 - DNA, 22 bp, Homo sapiens
gtgtgagtcactgtgcccggca

SEQ ID NO: 144254 - DNA, 21 bp, Homo sapiens
tgtgcatatatatatgtatgt

SEQ ID NO: 144255 - DNA, 18 bp, Homo sapiens
cgggacttgtttctccta

SEQ ID NO: 144256 - DNA, 18 bp, Homo sapiens
tgatgatttaatctgtag

SEQ ID NO: 144257 - DNA, 21 bp, Homo sapiens
atctcggctcactgcaggctg

SEQ ID NO: 144258 - DNA, 23 bp, Homo sapiens
ggactctcactctgtcactcagg

SEQ ID NO: 144259 - DNA, 23 bp, Homo sapiens
tatacgtattgtatacatttgta

SEQ ID NO: 144260 - DNA, 21 bp, Homo sapiens
tggactaatacatatgtgtat

SEQ ID NO: 144261 - DNA, 21 bp, Homo sapiens
tgtaagagaggcctaatcatg

SEQ ID NO: 144262 - DNA, 23 bp, Homo sapiens
ttaattgtgaatttcatgtgatg

SEQ ID NO: 144263 - DNA, 22 bp, Homo sapiens
ttattgcaaatattccagttct

SEQ ID NO: 144264 - DNA, 23 bp, Homo sapiens
ttttagtagagacagggtttgat

SEQ ID NO: 144265 - DNA, 20 bp, Homo sapiens
agcctcaacatgacttttgg

SEQ ID NO: 144266 - DNA, 23 bp, Homo sapiens
aggctgaggttggaggatcactt

SEQ ID NO: 144267 - DNA, 23 bp, Homo sapiens
tgagttcattgtagattctggat

SEQ ID NO: 144268 - DNA, 23 bp, Homo sapiens
tgagttcattgtagattctggat

SEQ ID NO: 144269 - DNA, 23 bp, Homo sapiens
tgagttcattgtagattctggat

SEQ ID NO: 144270 - DNA, 23 bp, Homo sapiens
tgagttcattgtagattctggat

SEQ ID NO: 144271 - DNA, 18 bp, Homo sapiens
tacacacagataggtgta

SEQ ID NO: 144272 - DNA, 22 bp, Homo sapiens
acagagagcagtgtgtgcagat

SEQ ID NO: 144273 - DNA, 23 bp, Homo sapiens
cagagtctcccactgtcacccag

SEQ ID NO: 144274 - DNA, 18 bp, Homo sapiens
atgtgcagaatatgcagg

SEQ ID NO: 144275 - DNA, 22 bp, Homo sapiens
atgtgtatatatacacgtgtgt

SEQ ID NO: 144276 - DNA, 23 bp, Homo sapiens
tgagttcattgtagattctggat

SEQ ID NO: 144277 - DNA, 23 bp, Homo sapiens
tgagttcattgtagattctggat

SEQ ID NO: 144278 - DNA, 23 bp, Homo sapiens
tggagtctcactctgtcacccag

SEQ ID NO: 144279 - DNA, 23 bp, Homo sapiens
gggtctcactctgtcacccaggc

SEQ ID NO: 144280 - DNA, 23 bp, Homo sapiens
attgtgtgtatgcaattgtgtgt

SEQ ID NO: 144281 - DNA, 23 bp, Homo sapiens
tggagtctcactctgtcacccag

SEQ ID NO: 144282 - DNA, 21 bp, Homo sapiens
tgcaagactgattcttgtttc

SEQ ID NO: 144283 - DNA, 19 bp, Homo sapiens
tttagaatcatgttttgat

SEQ ID NO: 144284 - DNA, 23 bp, Homo sapiens
acagagtctcgcactgtcaccca

SEQ ID NO: 144285 - DNA, 19 bp, Homo sapiens
gtctcgctctgtcacccag

SEQ ID NO: 144286 - DNA, 23 bp, Homo sapiens
gacagagtctcgctctgtcaccc

SEQ ID NO: 144287 - DNA, 23 bp, Homo sapiens
gtgtctctgtgtgtgtatgagca

SEQ ID NO: 144288 - DNA, 23 bp, Homo sapiens
tattgcacatgcaggaattgtga

SEQ ID NO: 144289 - DNA, 23 bp, Homo sapiens
aaatttgtgcatgtgtaagtgca

SEQ ID NO: 144290 - DNA, 18 bp, Homo sapiens
acactagtgtctgggcag

SEQ ID NO: 144291 - DNA, 21 bp, Homo sapiens
aggaatatatatatgtatgta

SEQ ID NO: 144292 - DNA, 23 bp, Homo sapiens
atatgtatgtatatgtattccta

SEQ ID NO: 144293 - DNA, 21 bp, Homo sapiens
tagtatgtatatattatatgg

SEQ ID NO: 144294 - DNA, 23 bp, Homo sapiens
agagtctcactctgtcacccagg

SEQ ID NO: 144295 - DNA, 23 bp, Homo sapiens
tgttgttgtggtgtgagagctga

SEQ ID NO: 144296 - DNA, 23 bp, Homo sapiens
ttgagttgttccacatacacaca

SEQ ID NO: 144297 - DNA, 23 bp, Homo sapiens
ctggctgtctctcagaatgcatc

SEQ ID NO: 144298 - DNA, 18 bp, Homo sapiens
gtcagtctagagggaggg

SEQ ID NO: 144299 - DNA, 23 bp, Homo sapiens
agagtacaattgaattggttgag

SEQ ID NO: 144300 - DNA, 22 bp, Homo sapiens
tgtgtctctatgtctctccctg

SEQ ID NO: 144301 - DNA, 23 bp, Homo sapiens
tgagtctcactctgtcacccagg

SEQ ID NO: 144302 - DNA, 23 bp, Homo sapiens
tgagttcattgtagattctggat

SEQ ID NO: 144303 - DNA, 21 bp, Homo sapiens
tgaggtaggaggatcacttga

SEQ ID NO: 144304 - DNA, 23 bp, Homo sapiens
tcaaattgtcacacagttctctc

SEQ ID NO: 144305 - DNA, 21 bp, Homo sapiens
tgtctgtgtcacagccagtgg

SEQ ID NO: 144306 - DNA, 23 bp, Homo sapiens
taagccagctttgtttcttgttt

SEQ ID NO: 144307 - DNA, 23 bp, Homo sapiens
tatcagtgtctgcaaaacttggt

SEQ ID NO: 144308 - DNA, 19 bp, Homo sapiens
tgtctcacactctccctat

SEQ ID NO: 144309 - DNA, 21 bp, Homo sapiens
aaaccctgtcacgtttccttc

SEQ ID NO: 144310 - DNA, 23 bp, Homo sapiens
ttgttctcttctctgtggctcag

SEQ ID NO: 144311 - DNA, 21 bp, Homo sapiens
gacaagaactacaggaagctg

SEQ ID NO: 144312 - DNA, 21 bp, Homo sapiens
ttgagacaacatagccaggcc

SEQ ID NO: 144313 - DNA, 20 bp, Homo sapiens
agcaggagctaggtgtggtg

SEQ ID NO: 144314 - DNA, 20 bp, Homo sapiens
gactctcactctgtcgccca

SEQ ID NO: 144315 - DNA, 21 bp, Homo sapiens
aaaatgtactttaaaatgtac

SEQ ID NO: 144316 - DNA, 20 bp, Homo sapiens
gtacattttaaaagtacatt

SEQ ID NO: 144317 - DNA, 18 bp, Homo sapiens
aaaagtacattttaaaag

SEQ ID NO: 144318 - DNA, 18 bp, Homo sapiens
tatatgcatgtatatata

SEQ ID NO: 144319 - DNA, 23 bp, Homo sapiens
ctcttgctccctctctctccatg

SEQ ID NO: 144320 - DNA, 23 bp, Homo sapiens
agagtctggctgtgtctctggtt

SEQ ID NO: 144321 - DNA, 22 bp, Homo sapiens
ttttgatttttttagagatagg

SEQ ID NO: 144322 - DNA, 23 bp, Homo sapiens
agatggagtctcgctctgtcacc

SEQ ID NO: 144323 - DNA, 22 bp, Homo sapiens
tgtgaaggtactgatggccttt

SEQ ID NO: 144324 - DNA, 23 bp, Homo sapiens
agtgggagtccctcagtccctga

SEQ ID NO: 144325 - DNA, 22 bp, Homo sapiens
ttataggcagatgttgatttta

SEQ ID NO: 144326 - DNA, 22 bp, Homo sapiens
tggagtctcattctgtcaccga

SEQ ID NO: 144327 - DNA, 23 bp, Homo sapiens
agatggagtctccctctgtcacc

SEQ ID NO: 144328 - DNA, 22 bp, Homo sapiens
gtgcgccaccacaaccagctca

SEQ ID NO: 144329 - DNA, 18 bp, Homo sapiens
tacttgtgtttcacctgc

SEQ ID NO: 144330 - DNA, 23 bp, Homo sapiens
gtctcacactgtcacccaggctg

SEQ ID NO: 144331 - DNA, 23 bp, Homo sapiens
atgtcacacaggatgtgcctgtc

SEQ ID NO: 144332 - DNA, 22 bp, Homo sapiens
aaccacatccacctagctgacg

SEQ ID NO: 144333 - DNA, 23 bp, Homo sapiens
ctctgtcacagacaagtgaggtg

SEQ ID NO: 144334 - DNA, 21 bp, Homo sapiens
tttgcatgtagattctttttt

SEQ ID NO: 144335 - DNA, 18 bp, Homo sapiens
tggaagtttgttacatgg

SEQ ID NO: 144336 - DNA, 23 bp, Homo sapiens
agagagtgtcctgagtgtggtca

SEQ ID NO: 144337 - DNA, 23 bp, Homo sapiens
taagagagcggttttgtttttgg

SEQ ID NO: 144338 - DNA, 23 bp, Homo sapiens
ggatgtgcagactgagcacagtg

SEQ ID NO: 144339 - DNA, 21 bp, Homo sapiens
tctctctgtctctctctcgaa

SEQ ID NO: 144340 - DNA, 19 bp, Homo sapiens
cacacctttcattccagca

SEQ ID NO: 144341 - DNA, 20 bp, Homo sapiens
tgaggtaggtggatcacttg

SEQ ID NO: 144342 - DNA, 23 bp, Homo sapiens
tgcatgtatatgtgtaaatgtgt

SEQ ID NO: 144343 - DNA, 21 bp, Homo sapiens
ctgaggtaggaggatcacttg

SEQ ID NO: 144344 - DNA, 19 bp, Homo sapiens
cagagaagagggtctgctc

SEQ ID NO: 144345 - DNA, 18 bp, Homo sapiens
tcttgacacagatttgtc

SEQ ID NO: 144346 - DNA, 23 bp, Homo sapiens
tgagacagtgtctctctctgttg

SEQ ID NO: 144347 - DNA, 23 bp, Homo sapiens
tattcacagaacagagagaccaa

SEQ ID NO: 144348 - DNA, 23 bp, Homo sapiens
tcacactctgtgattctaccacg

SEQ ID NO: 144349 - DNA, 18 bp, Homo sapiens
ttcacagccaactaattt

SEQ ID NO: 144350 - DNA, 23 bp, Homo sapiens
ttgtaaaacatgtagttgatgtg

SEQ ID NO: 144351 - DNA, 21 bp, Homo sapiens
tgagtctcattctgtcaccca

SEQ ID NO: 144352 - DNA, 21 bp, Homo sapiens
taagaaattgatattgctaca

SEQ ID NO: 144353 - DNA, 19 bp, Homo sapiens
agggactgagaaaaaagtg

SEQ ID NO: 144354 - DNA, 23 bp, Homo sapiens
tctgtcagactgtttttgagctg

SEQ ID NO: 144355 - DNA, 23 bp, Homo sapiens
tgtggtaggtgcttgtttactgg

SEQ ID NO: 144356 - DNA, 18 bp, Homo sapiens
tgactcaagcctacagtc

SEQ ID NO: 144357 - DNA, 21 bp, Homo sapiens
tgaggtaggaggatcacttga

SEQ ID NO: 144358 - DNA, 23 bp, Homo sapiens
atttaatggtcattgtggtggta

SEQ ID NO: 144359 - DNA, 19 bp, Homo sapiens
tttctttgttaatatagct

SEQ ID NO: 144360 - DNA, 23 bp, Homo sapiens
ggagtctcactgtgtcactcagg

SEQ ID NO: 144361 - DNA, 21 bp, Homo sapiens
tgcagtggcacaatgttgtct

SEQ ID NO: 144362 - DNA, 23 bp, Homo sapiens
acactccctgactgcctgggaat

SEQ ID NO: 144363 - DNA, 22 bp, Homo sapiens
atgttggatctggttgtgaatt

SEQ ID NO: 144364 - DNA, 23 bp, Homo sapiens
tttaattgagcttagattggtgg

SEQ ID NO: 144365 - DNA, 19 bp, Homo sapiens
ttttttatcatttagttct

SEQ ID NO: 144366 - DNA, 18 bp, Homo sapiens
atatatatgtatgcagat

SEQ ID NO: 144367 - DNA, 23 bp, Homo sapiens
gaagctgtgtgtgtgtgtgtgtg

SEQ ID NO: 144368 - DNA, 22 bp, Homo sapiens
tcattggttatctagctcaatt

SEQ ID NO: 144369 - DNA, 21 bp, Homo sapiens
tggagtctcgctctgtcaccc

SEQ ID NO: 144370 - DNA, 19 bp, Homo sapiens
ttaacatctagctgtctct

SEQ ID NO: 144371 - DNA, 20 bp, Homo sapiens
tgtgtgtatatgtaaatacg

SEQ ID NO: 144372 - DNA, 19 bp, Homo sapiens
tgtgtgtgtatatatatgc

SEQ ID NO: 144373 - DNA, 23 bp, Homo sapiens
tgaagaggcactagaagaggaag

SEQ ID NO: 144374 - DNA, 23 bp, Homo sapiens
gttctgtgtatctctctctgctt

SEQ ID NO: 144375 - DNA, 20 bp, Homo sapiens
tcactgggctttctaataca

SEQ ID NO: 144376 - DNA, 23 bp, Homo sapiens
atgcgtatttgtttttctgttgc

SEQ ID NO: 144377 - DNA, 21 bp, Homo sapiens
tgaggtaggtggatcacttga

SEQ ID NO: 144378 - DNA, 23 bp, Homo sapiens
tgtgatggagttttgctcttgtc

SEQ ID NO: 144379 - DNA, 23 bp, Homo sapiens
aattaagtgcttggtgaagtgct

SEQ ID NO: 144380 - DNA, 23 bp, Homo sapiens
tctctttctgtggctctgtctta

SEQ ID NO: 144381 - DNA, 18 bp, Homo sapiens
actatcaggtgttgggag

SEQ ID NO: 144382 - DNA, 23 bp, Homo sapiens
tatcgctttgtcttgctttgtca

SEQ ID NO: 144383 - DNA, 21 bp, Homo sapiens
tacatgtatattatatttgat

SEQ ID NO: 144384 - DNA, 23 bp, Homo sapiens
ttttctgagaccataacaagaca

SEQ ID NO: 144385 - DNA, 23 bp, Homo sapiens
agaatcttattctttttgtttca

SEQ ID NO: 144386 - DNA, 21 bp, Homo sapiens
actgcagcctctgtctccctg

SEQ ID NO: 144387 - DNA, 23 bp, Homo sapiens
tagacattgggtaaatactctca

SEQ ID NO: 144388 - DNA, 20 bp, Homo sapiens
acagagtctcactatgttga

SEQ ID NO: 144389 - DNA, 22 bp, Homo sapiens
agacttgctgctcaccttgtgt

SEQ ID NO: 144390 - DNA, 23 bp, Homo sapiens
ttttagtaattgtagtgctgtca

SEQ ID NO: 144391 - DNA, 23 bp, Homo sapiens
gttaacacactgcttctactgag

SEQ ID NO: 144392 - DNA, 22 bp, Homo sapiens
atagatgcatgtgtgtgtgata

SEQ ID NO: 144393 - DNA, 19 bp, Homo sapiens
ctctgaaactctgtgattt

SEQ ID NO: 144394 - DNA, 23 bp, Homo sapiens
acagagtctcgctctgtcgctca

SEQ ID NO: 144395 - DNA, 23 bp, Homo sapiens
tacatgtgcacgttgtgcaggtt

SEQ ID NO: 144396 - DNA, 23 bp, Homo sapiens
tgagttcattgtagattctggat

SEQ ID NO: 144397 - DNA, 23 bp, Homo sapiens
tgagttcattgtagattctggat

SEQ ID NO: 144398 - DNA, 23 bp, Homo sapiens
gtgagagtctgttttactggagt

SEQ ID NO: 144399 - DNA, 19 bp, Homo sapiens
tgagacagagtctcactct

SEQ ID NO: 144400 - DNA, 23 bp, Homo sapiens
agagtctcactctgtcacccagg

SEQ ID NO: 144401 - DNA, 23 bp, Homo sapiens
gagtctcactctgtcacccaggc

SEQ ID NO: 144402 - DNA, 23 bp, Homo sapiens
acagagtctcgctctgtcgctca

SEQ ID NO: 144403 - DNA, 21 bp, Homo sapiens
gataaggtctggctctgctgt

SEQ ID NO: 144404 - DNA, 22 bp, Homo sapiens
aaagtgcttggattacaggtgt

SEQ ID NO: 144405 - DNA, 23 bp, Homo sapiens
tatgtgtgtgtatgtgtatatac

SEQ ID NO: 144406 - DNA, 23 bp, Homo sapiens
accagagagtgcactcactctct

SEQ ID NO: 144407 - DNA, 21 bp, Homo sapiens
agtgccacggtgtgatctctg

SEQ ID NO: 144408 - DNA, 18 bp, Homo sapiens
tacttcaacctctgcctc

SEQ ID NO: 144409 - DNA, 18 bp, Homo sapiens
acctgcgttcatgtccca

SEQ ID NO: 144410 - DNA, 23 bp, Homo sapiens
tacaagacacgttttgatcagta

SEQ ID NO: 144411 - DNA, 23 bp, Homo sapiens
acaccacgcccagtctttttctt

SEQ ID NO: 144412 - DNA, 23 bp, Homo sapiens
taggctgagggtgatggctcaca

SEQ ID NO: 144413 - DNA, 23 bp, Homo sapiens
ttttgagatggagtctcactgta

SEQ ID NO: 144414 - DNA, 22 bp, Homo sapiens
tacacatacgtttatattggat

SEQ ID NO: 144415 - DNA, 23 bp, Homo sapiens
atgtatgtgtgcatgtgtgtgtg

SEQ ID NO: 144416 - DNA, 23 bp, Homo sapiens
ttactttatggtagagaaaggtt

SEQ ID NO: 144417 - DNA, 20 bp, Homo sapiens
acagaatctcgctctgtctc

SEQ ID NO: 144418 - DNA, 21 bp, Homo sapiens
aggggttgcagtgagctatga

SEQ ID NO: 144419 - DNA, 21 bp, Homo sapiens
aaagtgctgggattacaggca

SEQ ID NO: 144420 - DNA, 23 bp, Homo sapiens
cctgtaattctagcactttagga

SEQ ID NO: 144421 - DNA, 21 bp, Homo sapiens
tctgctacagttagcgttcag

SEQ ID NO: 144422 - DNA, 23 bp, Homo sapiens
ggtatgatctctctctctctcta

SEQ ID NO: 144423 - DNA, 23 bp, Homo sapiens
tctcaccgtgtgtgtgtgtgtgt

SEQ ID NO: 144424 - DNA, 18 bp, Homo sapiens
atctgtaatcccagcact

SEQ ID NO: 144425 - DNA, 20 bp, Homo sapiens
atgtatgtatgcatgtgtat

SEQ ID NO: 144426 - DNA, 21 bp, Homo sapiens
tgaggtaggaggatcacttga

SEQ ID NO: 144427 - DNA, 23 bp, Homo sapiens
acagcattgtctccattgcttca

SEQ ID NO: 144428 - DNA, 21 bp, Homo sapiens
tgtgcatatatatatgtgtgt

SEQ ID NO: 144429 - DNA, 23 bp, Homo sapiens
atatgtgtgtatatatatgtgtg

SEQ ID NO: 144430 - DNA, 23 bp, Homo sapiens
gtcactaactgactcctttacat

SEQ ID NO: 144431 - DNA, 20 bp, Homo sapiens
agctagagagttgattttat

SEQ ID NO: 144432 - DNA, 23 bp, Homo sapiens
tggagtctcactctgtcacccag

SEQ ID NO: 144433 - DNA, 23 bp, Homo sapiens
taagatatatatcttaacatgat

SEQ ID NO: 144434 - DNA, 23 bp, Homo sapiens
tgagatggagtctcactctgtcg

SEQ ID NO: 144435 - DNA, 22 bp, Homo sapiens
tctgtgcatgtgtatacatata

SEQ ID NO: 144436 - DNA, 18 bp, Homo sapiens
atgtctgtacatgtatat

SEQ ID NO: 144437 - DNA, 22 bp, Homo sapiens
tatgtgtgtatgtaaatatgag

SEQ ID NO: 144438 - DNA, 20 bp, Homo sapiens
tgagacagagtctcgctctg

SEQ ID NO: 144439 - DNA, 22 bp, Homo sapiens
tgagtgttattggaaatgatga

SEQ ID NO: 144440 - DNA, 23 bp, Homo sapiens
aatcgttttcatagctatgtcat

SEQ ID NO: 144441 - DNA, 23 bp, Homo sapiens
gtgtactgtttttcttaatgtga

SEQ ID NO: 144442 - DNA, 22 bp, Homo sapiens
aatacacctagaaaatgttgct

SEQ ID NO: 144443 - DNA, 18 bp, Homo sapiens
tgaggtacaaggatggat

SEQ ID NO: 144444 - DNA, 23 bp, Homo sapiens
atatatgtgtgtgtatatgtgtg

SEQ ID NO: 144445 - DNA, 23 bp, Homo sapiens
agtgagtccaagtattttgtagt

SEQ ID NO: 144446 - DNA, 22 bp, Homo sapiens
tgtgtgtgtgtgtgtatgccca

SEQ ID NO: 144447 - DNA, 23 bp, Homo sapiens
aaatctatgtggttatgtatgtt

SEQ ID NO: 144448 - DNA, 23 bp, Homo sapiens
atatacagaggaatacatgttca

SEQ ID NO: 144449 - DNA, 23 bp, Homo sapiens
atctcgtctcactgcaacctcca

SEQ ID NO: 144450 - DNA, 23 bp, Homo sapiens
tttgagatggagttttgctcttg

SEQ ID NO: 144451 - DNA, 23 bp, Homo sapiens
atattccttgcattttacatgtt

SEQ ID NO: 144452 - DNA, 20 bp, Homo sapiens
ctatggatttagtttctgtt

SEQ ID NO: 144453 - DNA, 23 bp, Homo sapiens
tgagacagaatctcactctgtcg

SEQ ID NO: 144454 - DNA, 23 bp, Homo sapiens
tgaggcaaggtctggctctgttg

SEQ ID NO: 144455 - DNA, 20 bp, Homo sapiens
tgaggcagagtctcgttctg

SEQ ID NO: 144456 - DNA, 22 bp, Homo sapiens
tgcctgacttttttttctcttg

SEQ ID NO: 144457 - DNA, 23 bp, Homo sapiens
ttgagatggagttttgctcttgt

SEQ ID NO: 144458 - DNA, 20 bp, Homo sapiens
cccaccctcactgtcactgt

SEQ ID NO: 144459 - DNA, 23 bp, Homo sapiens
gcattttcttctctcttcctgag

SEQ ID NO: 144460 - DNA, 23 bp, Homo sapiens
ggaatggaagatgaagaattgtt

SEQ ID NO: 144461 - DNA, 22 bp, Homo sapiens
acagggtctctctctgcccttc

SEQ ID NO: 144462 - DNA, 23 bp, Homo sapiens
tcccaatgtgagtctctccgtgt

SEQ ID NO: 144463 - DNA, 23 bp, Homo sapiens
attactttccaaatctatgcata

SEQ ID NO: 144464 - DNA, 18 bp, Homo sapiens
atgacttaggttttgatg

SEQ ID NO: 144465 - DNA, 22 bp, Homo sapiens
tgaggtaggaggatgacttgaa

SEQ ID NO: 144466 - DNA, 23 bp, Homo sapiens
tcaggagttcgatgctacagtga

SEQ ID NO: 144467 - DNA, 23 bp, Homo sapiens
tgtgagactgctttttgtatttg

SEQ ID NO: 144468 - DNA, 23 bp, Homo sapiens
tcttttttggttccatatgaatt

SEQ ID NO: 144469 - DNA, 23 bp, Homo sapiens
atagagagaggtatatataggtg

SEQ ID NO: 144470 - DNA, 23 bp, Homo sapiens
acagagtctcactctgtcgccca

SEQ ID NO: 144471 - DNA, 21 bp, Homo sapiens
tataggtacttgaggatgctg

SEQ ID NO: 144472 - DNA, 18 bp, Homo sapiens
tgtgtgtatatatgtgtg

SEQ ID NO: 144473 - DNA, 23 bp, Homo sapiens
acacacacacatatacatgaata

SEQ ID NO: 144474 - DNA, 23 bp, Homo sapiens
gagagtctcgctctgtcacccag

SEQ ID NO: 144475 - DNA, 21 bp, Homo sapiens
ttgatttttaaactgtcacca

SEQ ID NO: 144476 - DNA, 20 bp, Homo sapiens
aatacagtgagacttcatct

SEQ ID NO: 144477 - DNA, 23 bp, Homo sapiens
tgagatggagtctcgctctgtca

SEQ ID NO: 144478 - DNA, 23 bp, Homo sapiens
ctcagataagacaagtaggtttc

SEQ ID NO: 144479 - DNA, 23 bp, Homo sapiens
tgtattgtgcatggagtggtcag

SEQ ID NO: 144480 - DNA, 23 bp, Homo sapiens
tatgtgtatatatatgtatgtgt

SEQ ID NO: 144481 - DNA, 19 bp, Homo sapiens
accatattatatatgtgtg

SEQ ID NO: 144482 - DNA, 18 bp, Homo sapiens
cagtggcatgatcttggc

SEQ ID NO: 144483 - DNA, 23 bp, Homo sapiens
gagacagagtctcactctgtcgc

SEQ ID NO: 144484 - DNA, 23 bp, Homo sapiens
acagagtctcgctctgtcaccca

SEQ ID NO: 144485 - DNA, 19 bp, Homo sapiens
tctagctttttaaaacttt

SEQ ID NO: 144486 - DNA, 20 bp, Homo sapiens
atattgggagtttatgtaga

SEQ ID NO: 144487 - DNA, 22 bp, Homo sapiens
gaaactatagtgatttacttga

SEQ ID NO: 144488 - DNA, 23 bp, Homo sapiens
atacacatatgtatacatgtaca

SEQ ID NO: 144489 - DNA, 20 bp, Homo sapiens
catatgtatatatgtacatg

SEQ ID NO: 144490 - DNA, 23 bp, Homo sapiens
atgtatatatgcacatgtatatg

SEQ ID NO: 144491 - DNA, 21 bp, Homo sapiens
tatatgtatatatgtatatgt

SEQ ID NO: 144492 - DNA, 18 bp, Homo sapiens
gtgtatatgcatatgtgt

SEQ ID NO: 144493 - DNA, 21 bp, Homo sapiens
atatgtgtatatgtatatgtg

SEQ ID NO: 144494 - DNA, 23 bp, Homo sapiens
tatacatgtatatgtatatgtgt

SEQ ID NO: 144495 - DNA, 23 bp, Homo sapiens
atgtatatgcatatgtatatgta

SEQ ID NO: 144496 - DNA, 23 bp, Homo sapiens
tgtgtgccactgtgcctggctaa

SEQ ID NO: 144497 - DNA, 23 bp, Homo sapiens
tggtatcaggatgatgttggctt

SEQ ID NO: 144498 - DNA, 22 bp, Homo sapiens
tgaggctccctctctggctctg

SEQ ID NO: 144499 - DNA, 20 bp, Homo sapiens
agacattattcaaagcagaa

SEQ ID NO: 144500 - DNA, 22 bp, Homo sapiens
ttacactctttctttgtgtgag

SEQ ID NO: 144501 - DNA, 23 bp, Homo sapiens
aaatgagagcctggaaaagaagt

SEQ ID NO: 144502 - DNA, 23 bp, Homo sapiens
aagttaactgatgacagtgaact

SEQ ID NO: 144503 - DNA, 23 bp, Homo sapiens
gacagagtctcgctctgtcaccc

SEQ ID NO: 144504 - DNA, 22 bp, Homo sapiens
tatatatgtgtgcatatgcatc

SEQ ID NO: 144505 - DNA, 23 bp, Homo sapiens
tggagtctcactctgtcacccag

SEQ ID NO: 144506 - DNA, 23 bp, Homo sapiens
atatctatcatatattatgttat

SEQ ID NO: 144507 - DNA, 22 bp, Homo sapiens
taatatctatcatatattatgt

SEQ ID NO: 144508 - DNA, 22 bp, Homo sapiens
gctctacttggagtctggctct

SEQ ID NO: 144509 - DNA, 22 bp, Homo sapiens
tatgttggttcacttctggcat

SEQ ID NO: 144510 - DNA, 23 bp, Homo sapiens
agagaaaacaaattgaggagggg

SEQ ID NO: 144511 - DNA, 22 bp, Homo sapiens
ttgagttctgagattgatgaag

SEQ ID NO: 144512 - DNA, 21 bp, Homo sapiens
tctgcatatggagcattctct

SEQ ID NO: 144513 - DNA, 19 bp, Homo sapiens
atgtgcacaacgtgcaggt

SEQ ID NO: 144514 - DNA, 23 bp, Homo sapiens
tagatctgtatatgtaaatgtgt

SEQ ID NO: 144515 - DNA, 18 bp, Homo sapiens
atttttctatttttagga

SEQ ID NO: 144516 - DNA, 19 bp, Homo sapiens
atagagtttcatagttttt

SEQ ID NO: 144517 - DNA, 23 bp, Homo sapiens
atcaactggttgtaatatgtgaa

SEQ ID NO: 144518 - DNA, 23 bp, Homo sapiens
tgtgtggtgaactgtttttgaat

SEQ ID NO: 144519 - DNA, 20 bp, Homo sapiens
atatgtatatatatatatgt

SEQ ID NO: 144520 - DNA, 20 bp, Homo sapiens
atatgtatatatatatatgt

SEQ ID NO: 144521 - DNA, 22 bp, Homo sapiens
atatatgtatatatacatatgt

SEQ ID NO: 144522 - DNA, 23 bp, Homo sapiens
tgtctgagtccctgagtgagacc

SEQ ID NO: 144523 - DNA, 23 bp, Homo sapiens
cacttttgaactgataggtgcag

SEQ ID NO: 144524 - DNA, 19 bp, Homo sapiens
tgatgacacagtttggggt

SEQ ID NO: 144525 - DNA, 23 bp, Homo sapiens
atatgtacatatttatatgtgtg

SEQ ID NO: 144526 - DNA, 23 bp, Homo sapiens
aatatgtacatatttatgtgtgt

SEQ ID NO: 144527 - DNA, 23 bp, Homo sapiens
aaatatgtacatatttatgtgtg

SEQ ID NO: 144528 - DNA, 23 bp, Homo sapiens
aatatgtacatatttatgtgtgt

SEQ ID NO: 144529 - DNA, 23 bp, Homo sapiens
atatgtacatatttatatgtgtg

SEQ ID NO: 144530 - DNA, 23 bp, Homo sapiens
atatgtacatatttatatgtgtg

SEQ ID NO: 144531 - DNA, 23 bp, Homo sapiens
atatgtacatatttatatgtgtg

SEQ ID NO: 144532 - DNA, 23 bp, Homo sapiens
atatgtacatatttatatgtgtg

SEQ ID NO: 144533 - DNA, 23 bp, Homo sapiens
atatgtacatatttatatgtgtg

SEQ ID NO: 144534 - DNA, 23 bp, Homo sapiens
atatgtacatatttatatgtgtg

SEQ ID NO: 144535 - DNA, 23 bp, Homo sapiens
aatatgtacatatttatatgtgt

SEQ ID NO: 144536 - DNA, 22 bp, Homo sapiens
cagtggcaattctgtatttctt

SEQ ID NO: 144537 - DNA, 20 bp, Homo sapiens
tttgagatggagtcttgctc

SEQ ID NO: 144538 - DNA, 20 bp, Homo sapiens
agtagagcctgacagtagtt

SEQ ID NO: 144539 - DNA, 23 bp, Homo sapiens
agacttcagtcactgtatcttga

SEQ ID NO: 144540 - DNA, 23 bp, Homo sapiens
ttctgacagagtctcactctgtt

SEQ ID NO: 144541 - DNA, 23 bp, Homo sapiens
tttgagacggactctcactctgt

SEQ ID NO: 144542 - DNA, 23 bp, Homo sapiens
tctctcagtctgacttttcagta

SEQ ID NO: 144543 - DNA, 23 bp, Homo sapiens
gacagagtctcgctctgtcaccc

SEQ ID NO: 144544 - DNA, 21 bp, Homo sapiens
aacagtggtagtgtgtgcctg

SEQ ID NO: 144545 - DNA, 20 bp, Homo sapiens
tgcctggcaccatgcctggc

SEQ ID NO: 144546 - DNA, 22 bp, Homo sapiens
tgtgagccactacagcaggtgt

SEQ ID NO: 144547 - DNA, 20 bp, Homo sapiens
tatccatatatatgcatata

SEQ ID NO: 144548 - DNA, 20 bp, Homo sapiens
tatccatatatatgcatata

SEQ ID NO: 144549 - DNA, 21 bp, Homo sapiens
atatgcatatatatgcattta

SEQ ID NO: 144550 - DNA, 19 bp, Homo sapiens
tgtaatatatatctatatg

SEQ ID NO: 144551 - DNA, 20 bp, Homo sapiens
atatgtaacataataaatca

SEQ ID NO: 144552 - DNA, 23 bp, Homo sapiens
actctgagaccctgagtctgagt

SEQ ID NO: 144553 - DNA, 23 bp, Homo sapiens
gtgtgcatgtgtgtatgtatgta

SEQ ID NO: 144554 - DNA, 20 bp, Homo sapiens
atctatgtaaaagaggaaga

SEQ ID NO: 144555 - DNA, 23 bp, Homo sapiens
gtcagtgggtctctctggccctg

SEQ ID NO: 144556 - DNA, 22 bp, Homo sapiens
tgtgtgtgtgtgcatgtacatg

SEQ ID NO: 144557 - DNA, 22 bp, Homo sapiens
tgggacagtgtatcgctctgtt

SEQ ID NO: 144558 - DNA, 23 bp, Homo sapiens
agagtgagctgagagagagtgag

SEQ ID NO: 144559 - DNA, 22 bp, Homo sapiens
acccctcttctaccccatgtca

SEQ ID NO: 144560 - DNA, 23 bp, Homo sapiens
tgagttcattgtagattctggat

SEQ ID NO: 144561 - DNA, 23 bp, Homo sapiens
attgtggttgtacatgtgattga

SEQ ID NO: 144562 - DNA, 22 bp, Homo sapiens
atctatctatatcgtgctctat

SEQ ID NO: 144563 - DNA, 21 bp, Homo sapiens
aagagttttcaggaagaactc

SEQ ID NO: 144564 - DNA, 23 bp, Homo sapiens
tatgtgtatatatatatatgtgt

SEQ ID NO: 144565 - DNA, 23 bp, Homo sapiens
tatgtgtgtgtatatatatgtgt

SEQ ID NO: 144566 - DNA, 21 bp, Homo sapiens
tgggctacatatatatgtgta

SEQ ID NO: 144567 - DNA, 23 bp, Homo sapiens
tatgtgtatatatatatatgtgt

SEQ ID NO: 144568 - DNA, 21 bp, Homo sapiens
ataacgtatatgtatatatgt

SEQ ID NO: 144569 - DNA, 23 bp, Homo sapiens
agacagggtttcaccatgttggt

SEQ ID NO: 144570 - DNA, 22 bp, Homo sapiens
gagtctcgctctgtctcccagg

SEQ ID NO: 144571 - DNA, 18 bp, Homo sapiens
gtatacatatatatgtga

SEQ ID NO: 144572 - DNA, 20 bp, Homo sapiens
tacatttattatatatgtgt

SEQ ID NO: 144573 - DNA, 22 bp, Homo sapiens
tggctgatacacatatatgtgt

SEQ ID NO: 144574 - DNA, 19 bp, Homo sapiens
gaaggcatgaggatgtgta

SEQ ID NO: 144575 - DNA, 21 bp, Homo sapiens
acatttttattaccaaagctt

SEQ ID NO: 144576 - DNA, 20 bp, Homo sapiens
tcctagagcagggatgtcac

SEQ ID NO: 144577 - DNA, 23 bp, Homo sapiens
ggagtctcactctgtcacccagg

SEQ ID NO: 144578 - DNA, 23 bp, Homo sapiens
tcttttttggttccatatgaaat

SEQ ID NO: 144579 - DNA, 23 bp, Homo sapiens
ttccctgtcacagtctgtgccac

SEQ ID NO: 144580 - DNA, 20 bp, Homo sapiens
aatgataaatatggaattct

SEQ ID NO: 144581 - DNA, 22 bp, Homo sapiens
atgtgtatatatatgtatatgt

SEQ ID NO: 144582 - DNA, 23 bp, Homo sapiens
tatatgtgtatatgtatatgcat

SEQ ID NO: 144583 - DNA, 21 bp, Homo sapiens
tttggttatatgatgaattgt

SEQ ID NO: 144584 - DNA, 23 bp, Homo sapiens
agagtctcactctgtcacccagg

SEQ ID NO: 144585 - DNA, 22 bp, Homo sapiens
ttttcagtttccaagttaaagc

SEQ ID NO: 144586 - DNA, 22 bp, Homo sapiens
gtgtgtgtatatatatgtgtgt

SEQ ID NO: 144587 - DNA, 23 bp, Homo sapiens
atatgtgcgtgtgtgtgtgtata

SEQ ID NO: 144588 - DNA, 23 bp, Homo sapiens
ctttacattttgttgaattcatg

SEQ ID NO: 144589 - DNA, 23 bp, Homo sapiens
tgtgtatatatgtgtgtgtgtat

SEQ ID NO: 144590 - DNA, 20 bp, Homo sapiens
acagagtctttttttgtcac

SEQ ID NO: 144591 - DNA, 19 bp, Homo sapiens
attgtttgtatatttaact

SEQ ID NO: 144592 - DNA, 22 bp, Homo sapiens
agaaaggttggttttgtttctt

SEQ ID NO: 144593 - DNA, 23 bp, Homo sapiens
tcaagagacaggatctcactctg

SEQ ID NO: 144594 - DNA, 21 bp, Homo sapiens
tttttgttttttgagaaagag

SEQ ID NO: 144595 - DNA, 23 bp, Homo sapiens
ctcttgtacttgctctgtgtctc

SEQ ID NO: 144596 - DNA, 21 bp, Homo sapiens
atgtcatgacacagcagtaag

SEQ ID NO: 144597 - DNA, 22 bp, Homo sapiens
ttagactgtcctaaggagcatg

SEQ ID NO: 144598 - DNA, 23 bp, Homo sapiens
agttcacagtagagtttgtgctc

SEQ ID NO: 144599 - DNA, 23 bp, Homo sapiens
ctttttctgtgtggcagatgaga

SEQ ID NO: 144600 - DNA, 23 bp, Homo sapiens
aatctcactctgtcacccagact

SEQ ID NO: 144601 - DNA, 23 bp, Homo sapiens
tgattcactgtctgtgtagcacc

SEQ ID NO: 144602 - DNA, 23 bp, Homo sapiens
tgagatggagtctctctctctgt

SEQ ID NO: 144603 - DNA, 21 bp, Homo sapiens
tacagatgtgtgccaccacac

SEQ ID NO: 144604 - DNA, 23 bp, Homo sapiens
ccctcagagaacaatgactgctg

SEQ ID NO: 144605 - DNA, 23 bp, Homo sapiens
acagagtctcattctgtcaccta

SEQ ID NO: 144606 - DNA, 19 bp, Homo sapiens
tgagcatcttttttttttt

SEQ ID NO: 144607 - DNA, 23 bp, Homo sapiens
agacagagttttgctcttgttgc

SEQ ID NO: 144608 - DNA, 21 bp, Homo sapiens
actctagtttcttgtaatgta

SEQ ID NO: 144609 - DNA, 23 bp, Homo sapiens
taggtgtggattttctttctttt

SEQ ID NO: 144610 - DNA, 23 bp, Homo sapiens
gagacagagtcactctgtcgccc

SEQ ID NO: 144611 - DNA, 21 bp, Homo sapiens
actctagtttcttgtaatgta

SEQ ID NO: 144612 - DNA, 21 bp, Homo sapiens
actccgtctcaaaaactaaat

SEQ ID NO: 144613 - DNA, 23 bp, Homo sapiens
taggtgtggattttctttctttt

SEQ ID NO: 144614 - DNA, 23 bp, Homo sapiens
gagacagagtcactctgtcgccc

SEQ ID NO: 144615 - DNA, 23 bp, Homo sapiens
ttctgtgactgcatcttcttttg

SEQ ID NO: 144616 - DNA, 22 bp, Homo sapiens
atatgtgcagaatgtgcaggtt

SEQ ID NO: 144617 - DNA, 23 bp, Homo sapiens
caaagagaaacctgctgttattg

SEQ ID NO: 144618 - DNA, 23 bp, Homo sapiens
cagagtctcactctgtcacccag

SEQ ID NO: 144619 - DNA, 21 bp, Homo sapiens
tgtgtgtatatgtatatgtgt

SEQ ID NO: 144620 - DNA, 19 bp, Homo sapiens
atgctatatattctgtaca

SEQ ID NO: 144621 - DNA, 22 bp, Homo sapiens
acatgtgcataatgtgcaggtt

SEQ ID NO: 144622 - DNA, 22 bp, Homo sapiens
gtattctgtttggcaaaggtct

SEQ ID NO: 144623 - DNA, 21 bp, Homo sapiens
ttacttcactgcaaagtattt

SEQ ID NO: 144624 - DNA, 23 bp, Homo sapiens
aaaacaacttttgccaatctgat

SEQ ID NO: 144625 - DNA, 20 bp, Homo sapiens
tttatagttccttaggtgga

SEQ ID NO: 144626 - DNA, 23 bp, Homo sapiens
tttgtacacacaggacaccttga

SEQ ID NO: 144627 - DNA, 23 bp, Homo sapiens
gtgtgtgtatatatataccctat

SEQ ID NO: 144628 - DNA, 23 bp, Homo sapiens
tacacactatatatggtgtgtgt

SEQ ID NO: 144629 - DNA, 20 bp, Homo sapiens
atacacactatatatggtgt

SEQ ID NO: 144630 - DNA, 19 bp, Homo sapiens
tgtctatatgcatatatgt

SEQ ID NO: 144631 - DNA, 22 bp, Homo sapiens
tatacatatatgtatatgtgtg

SEQ ID NO: 144632 - DNA, 22 bp, Homo sapiens
tatacatatatgtatatgtgtg

SEQ ID NO: 144633 - DNA, 22 bp, Homo sapiens
tatacatatatgtatatgtgtg

SEQ ID NO: 144634 - DNA, 22 bp, Homo sapiens
tatacatatatgtatatgtgtg

SEQ ID NO: 144635 - DNA, 23 bp, Homo sapiens
aaacatgtagtacctgtggactg

SEQ ID NO: 144636 - DNA, 23 bp, Homo sapiens
tgtactttgtgcaagttgtagtt

SEQ ID NO: 144637 - DNA, 23 bp, Homo sapiens
ggaatctcactcactctgtcgcc

SEQ ID NO: 144638 - DNA, 22 bp, Homo sapiens
agagtgcagtggcacgatctag

SEQ ID NO: 144639 - DNA, 22 bp, Homo sapiens
attaaggtagcttacctaatga

SEQ ID NO: 144640 - DNA, 23 bp, Homo sapiens
gggtctcactctgtcacccaggc

SEQ ID NO: 144641 - DNA, 23 bp, Homo sapiens
acactgggtgtacatcagaattt

SEQ ID NO: 144642 - DNA, 23 bp, Homo sapiens
atgaatggatttatctgtgttcc

SEQ ID NO: 144643 - DNA, 23 bp, Homo sapiens
agtcacacacacacaatcgtgtt

SEQ ID NO: 144644 - DNA, 19 bp, Homo sapiens
tggttgatggctttggctc

SEQ ID NO: 144645 - DNA, 23 bp, Homo sapiens
atatacaggatgaactaaggtct

SEQ ID NO: 144646 - DNA, 23 bp, Homo sapiens
tatatgtatgtgtatgtgtatat

SEQ ID NO: 144647 - DNA, 23 bp, Homo sapiens
aggaagattaaaccttttgatgt

SEQ ID NO: 144648 - DNA, 23 bp, Homo sapiens
tcaagacttgagacactttctag

SEQ ID NO: 144649 - DNA, 20 bp, Homo sapiens
aatagtgtgatgatcatggc

SEQ ID NO: 144650 - DNA, 23 bp, Homo sapiens
atagcccatttcttttcattgct

SEQ ID NO: 144651 - DNA, 23 bp, Homo sapiens
tgagatggtgtctcactctgtca

SEQ ID NO: 144652 - DNA, 21 bp, Homo sapiens
agctccagagtagctgggact

SEQ ID NO: 144653 - DNA, 23 bp, Homo sapiens
agtgactgtggaatgcatttagg

SEQ ID NO: 144654 - DNA, 23 bp, Homo sapiens
tagtaaggtaagtatagttgtat

SEQ ID NO: 144655 - DNA, 22 bp, Homo sapiens
acacacacacacatatgtgtgt

SEQ ID NO: 144656 - DNA, 23 bp, Homo sapiens
cacacactgtgatggttagtttt

SEQ ID NO: 144657 - DNA, 18 bp, Homo sapiens
atcatattttattaatga

SEQ ID NO: 144658 - DNA, 23 bp, Homo sapiens
atgccacatggagatttctttct

SEQ ID NO: 144659 - DNA, 23 bp, Homo sapiens
ggctgaggtaggaggatcacttg

SEQ ID NO: 144660 - DNA, 23 bp, Homo sapiens
agtgacagagtgacatcttgcct

SEQ ID NO: 144661 - DNA, 23 bp, Homo sapiens
actgagtctcactctgtcgccca

SEQ ID NO: 144662 - DNA, 21 bp, Homo sapiens
ttgcagtgagcagagattgtg

SEQ ID NO: 144663 - DNA, 23 bp, Homo sapiens
gcctgcgtgacacagtgagactc

SEQ ID NO: 144664 - DNA, 20 bp, Homo sapiens
gatgaggtctcactctgtca

SEQ ID NO: 144665 - DNA, 18 bp, Homo sapiens
agagaagagactgtagtc

SEQ ID NO: 144666 - DNA, 19 bp, Homo sapiens
tgggactgcatttcttttc

SEQ ID NO: 144667 - DNA, 23 bp, Homo sapiens
gggtctcactctgtcacccaggc

SEQ ID NO: 144668 - DNA, 23 bp, Homo sapiens
gggtctcactctgtcacccaggc

SEQ ID NO: 144669 - DNA, 23 bp, Homo sapiens
acaaggtctcactctgtcaccca

SEQ ID NO: 144670 - DNA, 22 bp, Homo sapiens
taaagacagggttttgccatgt

SEQ ID NO: 144671 - DNA, 19 bp, Homo sapiens
cagattggtcttgaacgcc

SEQ ID NO: 144672 - DNA, 23 bp, Homo sapiens
tatttcagagaagagacagagga

SEQ ID NO: 144673 - DNA, 23 bp, Homo sapiens
gtcttaagtctggagtacctgtc

SEQ ID NO: 144674 - DNA, 23 bp, Homo sapiens
tgagttcattgtagattctggat

SEQ ID NO: 144675 - DNA, 23 bp, Homo sapiens
tgagttcattgtagattctggat

SEQ ID NO: 144676 - DNA, 22 bp, Homo sapiens
aaagggtctgtgtcagttgtta

SEQ ID NO: 144677 - DNA, 18 bp, Homo sapiens
tatttgaagaccatctta

SEQ ID NO: 144678 - DNA, 23 bp, Homo sapiens
agcaggttctggcagacaacctg

SEQ ID NO: 144679 - DNA, 21 bp, Homo sapiens
atttgctgacattaacttggg

SEQ ID NO: 144680 - DNA, 23 bp, Homo sapiens
gacactgtctcgctctgtcacca

SEQ ID NO: 144681 - DNA, 23 bp, Homo sapiens
tgcttgttccacaggtatgtgaa

SEQ ID NO: 144682 - DNA, 20 bp, Homo sapiens
gtgtgtgtgtgtgtgtgtat

SEQ ID NO: 144683 - DNA, 22 bp, Homo sapiens
tgacttctaccagcatagttga

SEQ ID NO: 144684 - DNA, 22 bp, Homo sapiens
tgagatgatgcagtatatgtgt

SEQ ID NO: 144685 - DNA, 23 bp, Homo sapiens
tttctgtgtctgacatttttcac

SEQ ID NO: 144686 - DNA, 23 bp, Homo sapiens
gagtctctgtctgtcacccaggc

SEQ ID NO: 144687 - DNA, 23 bp, Homo sapiens
actctcactctcattgacagagc

SEQ ID NO: 144688 - DNA, 23 bp, Homo sapiens
agagtctcactctgtcacccagg

SEQ ID NO: 144689 - DNA, 19 bp, Homo sapiens
tgagatggagtctcactct

SEQ ID NO: 144690 - DNA, 21 bp, Homo sapiens
ttttgctacaattttgaatgt

SEQ ID NO: 144691 - DNA, 23 bp, Homo sapiens
agacagcggtctcagtcactgac

SEQ ID NO: 144692 - DNA, 19 bp, Homo sapiens
atttgagacggagtctcac

SEQ ID NO: 144693 - DNA, 22 bp, Homo sapiens
cagtggcatgatcatggcttac

SEQ ID NO: 144694 - DNA, 23 bp, Homo sapiens
tctgctagagatgtgtttatctt

SEQ ID NO: 144695 - DNA, 23 bp, Homo sapiens
tgagttcattgtagattctggat

SEQ ID NO: 144696 - DNA, 23 bp, Homo sapiens
tgagttcattgtagattctggat

SEQ ID NO: 144697 - DNA, 23 bp, Homo sapiens
ggagacagagtctcgctctgtca

SEQ ID NO: 144698 - DNA, 23 bp, Homo sapiens
tgagttcattgtagattctggat

SEQ ID NO: 144699 - DNA, 23 bp, Homo sapiens
tgagttcattgtagattctggat

SEQ ID NO: 144700 - DNA, 23 bp, Homo sapiens
agttcctagtgtcttcttgttga

SEQ ID NO: 144701 - DNA, 19 bp, Homo sapiens
tgagacagagtctcactct

SEQ ID NO: 144702 - DNA, 21 bp, Homo sapiens
tagtgaggaagagatagccca

SEQ ID NO: 144703 - DNA, 22 bp, Homo sapiens
ccctgtctctctttgtgctgac

SEQ ID NO: 144704 - DNA, 23 bp, Homo sapiens
tgtgtgtatatatatacgtgtat

SEQ ID NO: 144705 - DNA, 22 bp, Homo sapiens
atctctctgaagtgagtgggca

SEQ ID NO: 144706 - DNA, 18 bp, Homo sapiens
tgtgtgtatataatgtgt

SEQ ID NO: 144707 - DNA, 23 bp, Homo sapiens
tatgtgtattgtatacatgtata

SEQ ID NO: 144708 - DNA, 23 bp, Homo sapiens
ttctccaatgtaagctattctga

SEQ ID NO: 144709 - DNA, 19 bp, Homo sapiens
agagagagagagagagaga

SEQ ID NO: 144710 - DNA, 23 bp, Homo sapiens
tttgagacggagtctcactctgt

SEQ ID NO: 144711 - DNA, 22 bp, Homo sapiens
acacaggggagattttatctca

SEQ ID NO: 144712 - DNA, 20 bp, Homo sapiens
agaaaaaagaaagtgctccc

SEQ ID NO: 144713 - DNA, 22 bp, Homo sapiens
agtctcgctctgtcactcaggc

SEQ ID NO: 144714 - DNA, 23 bp, Homo sapiens
gggtctcactctgtcacccaggc

SEQ ID NO: 144715 - DNA, 23 bp, Homo sapiens
agcctctcagtatctgggactat

SEQ ID NO: 144716 - DNA, 21 bp, Homo sapiens
tggactctgcttctgctgtac

SEQ ID NO: 144717 - DNA, 23 bp, Homo sapiens
cagtctctcactctgtctcccag

SEQ ID NO: 144718 - DNA, 23 bp, Homo sapiens
ctgagccagtgcatcaggatctg

SEQ ID NO: 144719 - DNA, 23 bp, Homo sapiens
gacatggagtctctctctgtcac

SEQ ID NO: 144720 - DNA, 23 bp, Homo sapiens
cgtgagaagagtgtatgtgtaga

SEQ ID NO: 144721 - DNA, 23 bp, Homo sapiens
atgagggctgtgtgaggtcatgt

SEQ ID NO: 144722 - DNA, 23 bp, Homo sapiens
actcacacagtgcctgccacact

SEQ ID NO: 144723 - DNA, 23 bp, Homo sapiens
tggagtctcactctgtcacccag

SEQ ID NO: 144724 - DNA, 23 bp, Homo sapiens
tgactgtctggttctctctcagt

SEQ ID NO: 144725 - DNA, 23 bp, Homo sapiens
tgaggtagtctttctgtgtctgt

SEQ ID NO: 144726 - DNA, 22 bp, Homo sapiens
tcatagagtcatgaagattgag

SEQ ID NO: 144727 - DNA, 23 bp, Homo sapiens
gactggcactgttactgataatg

SEQ ID NO: 144728 - DNA, 22 bp, Homo sapiens
caagttagtgggctgcttttga

SEQ ID NO: 144729 - DNA, 21 bp, Homo sapiens
ttataagaagtggctcaagct

SEQ ID NO: 144730 - DNA, 18 bp, Homo sapiens
atgaatatgtataggtat

SEQ ID NO: 144731 - DNA, 22 bp, Homo sapiens
aaacactgtttactgacatcga

SEQ ID NO: 144732 - DNA, 23 bp, Homo sapiens
cggagtctcgctctgtcactcag

SEQ ID NO: 144733 - DNA, 23 bp, Homo sapiens
tgcaccaccatgtccagctaatt

SEQ ID NO: 144734 - DNA, 23 bp, Homo sapiens
tgagttcattgtagattctggat

SEQ ID NO: 144735 - DNA, 23 bp, Homo sapiens
tgagttcattgtagattctggat

SEQ ID NO: 144736 - DNA, 21 bp, Homo sapiens
tggagtctggctctgtctccc

SEQ ID NO: 144737 - DNA, 18 bp, Homo sapiens
tattatcttcttttctgt

SEQ ID NO: 144738 - DNA, 22 bp, Homo sapiens
aatatgtgtgtatatgtatgtc

SEQ ID NO: 144739 - DNA, 23 bp, Homo sapiens
gttactgatgtagaaggttgaat

SEQ ID NO: 144740 - DNA, 23 bp, Homo sapiens
agagtggtatgagacacgtaaga

SEQ ID NO: 144741 - DNA, 20 bp, Homo sapiens
tatacctacacatacataga

SEQ ID NO: 144742 - DNA, 18 bp, Homo sapiens
tgtgtgtgtatgtgtatc

SEQ ID NO: 144743 - DNA, 23 bp, Homo sapiens
gtgtgtctgagagggtgtttctt

SEQ ID NO: 144744 - DNA, 23 bp, Homo sapiens
tgagttcattgtagattctggat

SEQ ID NO: 144745 - DNA, 23 bp, Homo sapiens
tgagttcattgtagattctggat

SEQ ID NO: 144746 - DNA, 23 bp, Homo sapiens
tatgtgataactatctcagatat

SEQ ID NO: 144747 - DNA, 21 bp, Homo sapiens
atataatgtacgtgtgtgcat

SEQ ID NO: 144748 - DNA, 23 bp, Homo sapiens
acaaagtatttggtgcatatttt

SEQ ID NO: 144749 - DNA, 23 bp, Homo sapiens
tgaaaactaaagttgtatggact

SEQ ID NO: 144750 - DNA, 23 bp, Homo sapiens
tggtacagtagtgtttgtgttca

SEQ ID NO: 144751 - DNA, 21 bp, Homo sapiens
tttattttgttttgagatgga

SEQ ID NO: 144752 - DNA, 23 bp, Homo sapiens
gtgtgtctgtgtgtgtatctgtg

SEQ ID NO: 144753 - DNA, 23 bp, Homo sapiens
ttgttcttcctgtgtgagtctgt

SEQ ID NO: 144754 - DNA, 23 bp, Homo sapiens
tgagttcattgtagattctggat

SEQ ID NO: 144755 - DNA, 23 bp, Homo sapiens
tgagttcattgtagattctggat

SEQ ID NO: 144756 - DNA, 22 bp, Homo sapiens
tgtctgcctctgtgtgtgggag

SEQ ID NO: 144757 - DNA, 23 bp, Homo sapiens
ctcacagtctctgagtgtcttct

SEQ ID NO: 144758 - DNA, 21 bp, Homo sapiens
aaaatagagactatggttgag

SEQ ID NO: 144759 - DNA, 22 bp, Homo sapiens
tagagttctgatttagatgtgt

SEQ ID NO: 144760 - DNA, 23 bp, Homo sapiens
acaaggtcttgctctgtcactca

SEQ ID NO: 144761 - DNA, 23 bp, Homo sapiens
caacaaagtgagatcccatctct

SEQ ID NO: 144762 - DNA, 20 bp, Homo sapiens
tgaccaaaaataatgtgctg

SEQ ID NO: 144763 - DNA, 20 bp, Homo sapiens
gaattatttttagtaaggag

SEQ ID NO: 144764 - DNA, 18 bp, Homo sapiens
aagcaagcaatggctctc

SEQ ID NO: 144765 - DNA, 23 bp, Homo sapiens
agactctctccgactctccctgc

SEQ ID NO: 144766 - DNA, 20 bp, Homo sapiens
tctttctttttctctctcca

SEQ ID NO: 144767 - DNA, 23 bp, Homo sapiens
tctccctcagtctctctgtccct

SEQ ID NO: 144768 - DNA, 23 bp, Homo sapiens
gtctctgtgtgactgtctatcat

SEQ ID NO: 144769 - DNA, 23 bp, Homo sapiens
gagtctctcactctgtcagccag

SEQ ID NO: 144770 - DNA, 23 bp, Homo sapiens
agatggagtctcactctgtcact

SEQ ID NO: 144771 - DNA, 22 bp, Homo sapiens
tatgtatgtatatgtgtgtgtg

SEQ ID NO: 144772 - DNA, 23 bp, Homo sapiens
gagcgtcactctgtggctcagac

SEQ ID NO: 144773 - DNA, 21 bp, Homo sapiens
aatggcatgatcttggcttac

SEQ ID NO: 144774 - DNA, 23 bp, Homo sapiens
tttgagacacattttcactctgt

SEQ ID NO: 144775 - DNA, 22 bp, Homo sapiens
tatgtatgtatgtgtgtgtgta

SEQ ID NO: 144776 - DNA, 23 bp, Homo sapiens
atgtatgtgtgcatgatatgtgt

SEQ ID NO: 144777 - DNA, 21 bp, Homo sapiens
gtctgtgtatgtatatatata

SEQ ID NO: 144778 - DNA, 23 bp, Homo sapiens
cagtctgtatatgtatgtgtgtg

SEQ ID NO: 144779 - DNA, 20 bp, Homo sapiens
tgtgtatatgtatatgtatg

SEQ ID NO: 144780 - DNA, 21 bp, Homo sapiens
tggagtctcgctctgtcaccc

SEQ ID NO: 144781 - DNA, 19 bp, Homo sapiens
tgacagagagagtaggtat

SEQ ID NO: 144782 - DNA, 23 bp, Homo sapiens
tgagatggagtctcactgtgtca

SEQ ID NO: 144783 - DNA, 23 bp, Homo sapiens
agagtctcgctctgtctcccagg

SEQ ID NO: 144784 - DNA, 23 bp, Homo sapiens
ttgtcagtggctaaggtggggct

SEQ ID NO: 144785 - DNA, 23 bp, Homo sapiens
gacactaggtcttactctgtcac

SEQ ID NO: 144786 - DNA, 18 bp, Homo sapiens
cacagacattcagactct

SEQ ID NO: 144787 - DNA, 23 bp, Homo sapiens
tatctcacagtttctttatccac

SEQ ID NO: 144788 - DNA, 23 bp, Homo sapiens
gtgtctctgtgtgacattccttc

SEQ ID NO: 144789 - DNA, 23 bp, Homo sapiens
tgagttcattgtagattctggat

SEQ ID NO: 144790 - DNA, 23 bp, Homo sapiens
tgagttcattgtagattctggat

SEQ ID NO: 144791 - DNA, 19 bp, Homo sapiens
tttacatgcatagacatat

SEQ ID NO: 144792 - DNA, 23 bp, Homo sapiens
atatgtgtatacatgtacatgca

SEQ ID NO: 144793 - DNA, 23 bp, Homo sapiens
agactacagatgtgtgccaccac

SEQ ID NO: 144794 - DNA, 20 bp, Homo sapiens
tggatgactcataactcttg

SEQ ID NO: 144795 - DNA, 22 bp, Homo sapiens
actctctgcctctctgcgacag

SEQ ID NO: 144796 - DNA, 23 bp, Homo sapiens
tgagttcattgtagattctggat

SEQ ID NO: 144797 - DNA, 23 bp, Homo sapiens
tgagttcattgtagattctggat

SEQ ID NO: 144798 - DNA, 23 bp, Homo sapiens
gtgtctgcatgtgtacacgtgtg

SEQ ID NO: 144799 - DNA, 23 bp, Homo sapiens
tgtgcatatgtgtatgtgtgtgt

SEQ ID NO: 144800 - DNA, 20 bp, Homo sapiens
tacacacacacacatatatg

SEQ ID NO: 144801 - DNA, 23 bp, Homo sapiens
attgagacggagttttgctcttg

SEQ ID NO: 144802 - DNA, 23 bp, Homo sapiens
tgtgtgtgtgtatatatatatgt

SEQ ID NO: 144803 - DNA, 18 bp, Homo sapiens
tgcttattatatatctgt

SEQ ID NO: 144804 - DNA, 21 bp, Homo sapiens
taaaatgaagattgagagcac

SEQ ID NO: 144805 - DNA, 23 bp, Homo sapiens
ggagtctcactctgtcacccagg

SEQ ID NO: 144806 - DNA, 23 bp, Homo sapiens
gtttgcctgcgtgggtgtttgcc

SEQ ID NO: 144807 - DNA, 23 bp, Homo sapiens
tgtgtgtatgtgtgtatgtgcat

SEQ ID NO: 144808 - DNA, 22 bp, Homo sapiens
tagtctctatatttttatgtgt

SEQ ID NO: 144809 - DNA, 23 bp, Homo sapiens
tctctctgcctcagtctcctcaa

SEQ ID NO: 144810 - DNA, 23 bp, Homo sapiens
tgagttcattgtagattctggat

SEQ ID NO: 144811 - DNA, 23 bp, Homo sapiens
tgagttcattgtagattctggat

SEQ ID NO: 144812 - DNA, 23 bp, Homo sapiens
tatgtatattttctagttcatct

SEQ ID NO: 144813 - DNA, 21 bp, Homo sapiens
tcagatcaattagaaaacata

SEQ ID NO: 144814 - DNA, 21 bp, Homo sapiens
aatagctgaatttaggtatgt

SEQ ID NO: 144815 - DNA, 18 bp, Homo sapiens
tccatttttattctgtta

SEQ ID NO: 144816 - DNA, 23 bp, Homo sapiens
tatgaatctttttttgagtgtga

SEQ ID NO: 144817 - DNA, 23 bp, Homo sapiens
gacggagtctcactctgtctcct

SEQ ID NO: 144818 - DNA, 23 bp, Homo sapiens
tgtctctgtcgctctctgagggg

SEQ ID NO: 144819 - DNA, 19 bp, Homo sapiens
tgtgtatatacatatatgt

SEQ ID NO: 144820 - DNA, 23 bp, Homo sapiens
aataaggtgcttggtgtttggat

SEQ ID NO: 144821 - DNA, 23 bp, Homo sapiens
ctaattagtctttttgaagttca

SEQ ID NO: 144822 - DNA, 21 bp, Homo sapiens
cagagtgcctctgttcagtag

SEQ ID NO: 144823 - DNA, 20 bp, Homo sapiens
tttgcatgcaagaggatact

SEQ ID NO: 144824 - DNA, 23 bp, Homo sapiens
tagagacaggattttgttctgtt

SEQ ID NO: 144825 - DNA, 21 bp, Homo sapiens
tatacgtatatatacgtatat

SEQ ID NO: 144826 - DNA, 18 bp, Homo sapiens
tatctgatttttttttag

SEQ ID NO: 144827 - DNA, 22 bp, Homo sapiens
acttcaactgcatgtggaactg

SEQ ID NO: 144828 - DNA, 23 bp, Homo sapiens
tatgtgtgcaatatatatgtata

SEQ ID NO: 144829 - DNA, 21 bp, Homo sapiens
tgagatggagtctcactctgt

SEQ ID NO: 144830 - DNA, 18 bp, Homo sapiens
aatgcttccatttcttgc

SEQ ID NO: 144831 - DNA, 23 bp, Homo sapiens
tgtgtgtcagtgtatgtagtgtg

SEQ ID NO: 144832 - DNA, 23 bp, Homo sapiens
tggagtctcactctgtcacccag

SEQ ID NO: 144833 - DNA, 21 bp, Homo sapiens
tacacctttgagtggtttgac

SEQ ID NO: 144834 - DNA, 19 bp, Homo sapiens
aagtgctgggattacagcc

SEQ ID NO: 144835 - DNA, 23 bp, Homo sapiens
atcttttcctgtagctggaatga

SEQ ID NO: 144836 - DNA, 23 bp, Homo sapiens
taagagtttctagaatgcagcag

SEQ ID NO: 144837 - DNA, 23 bp, Homo sapiens
tctgacttttatatcgtaagaca

SEQ ID NO: 144838 - DNA, 19 bp, Homo sapiens
aatctatatctatatgtat

SEQ ID NO: 144839 - DNA, 23 bp, Homo sapiens
gatgtatatgtatatgtatatgt

SEQ ID NO: 144840 - DNA, 19 bp, Homo sapiens
agggtgagagtaagatgtc

SEQ ID NO: 144841 - DNA, 23 bp, Homo sapiens
tctctctcaccaactctatagac

SEQ ID NO: 144842 - DNA, 23 bp, Homo sapiens
tcagggtctcactcactcaccta

SEQ ID NO: 144843 - DNA, 23 bp, Homo sapiens
agagtctcactctgtcacccagg

SEQ ID NO: 144844 - DNA, 23 bp, Homo sapiens
acacagagagaaaaggctctgaa

SEQ ID NO: 144845 - DNA, 20 bp, Homo sapiens
tatataaactgtatgtaata

SEQ ID NO: 144846 - DNA, 19 bp, Homo sapiens
agagcattgagaccaccca

SEQ ID NO: 144847 - DNA, 23 bp, Homo sapiens
gtctggtctagtgatttgctcta

SEQ ID NO: 144848 - DNA, 22 bp, Homo sapiens
tacatgtgcacattgtgcaggt

SEQ ID NO: 144849 - DNA, 23 bp, Homo sapiens
atatctgtatctatctatatctg

SEQ ID NO: 144850 - DNA, 20 bp, Homo sapiens
tgtatgtgtgcatgtgcatg

SEQ ID NO: 144851 - DNA, 18 bp, Homo sapiens
tatccctatatgattctg

SEQ ID NO: 144852 - DNA, 21 bp, Homo sapiens
actcactgagttttggaagaa

SEQ ID NO: 144853 - DNA, 23 bp, Homo sapiens
tgagagggagtctcactctgtcg

SEQ ID NO: 144854 - DNA, 23 bp, Homo sapiens
attgagatgacacagtctgagga

SEQ ID NO: 144855 - DNA, 23 bp, Homo sapiens
tgtgtagacctgcaagagaccac

SEQ ID NO: 144856 - DNA, 23 bp, Homo sapiens
tgagttcattgtagattctggat

SEQ ID NO: 144857 - DNA, 23 bp, Homo sapiens
tgagttcattgtagattctggat

SEQ ID NO: 144858 - DNA, 22 bp, Homo sapiens
tactatgtatgtatgtatatgt

SEQ ID NO: 144859 - DNA, 20 bp, Homo sapiens
tgtctgagctctgccttctg

SEQ ID NO: 144860 - DNA, 23 bp, Homo sapiens
cacagtggcattagattcctata

SEQ ID NO: 144861 - DNA, 23 bp, Homo sapiens
tgagttcattgtagattctggat

SEQ ID NO: 144862 - DNA, 23 bp, Homo sapiens
tgagttcattgtagattctggat

SEQ ID NO: 144863 - DNA, 23 bp, Homo sapiens
tcacaggcaggtttgttatgcag

SEQ ID NO: 144864 - DNA, 23 bp, Homo sapiens
tgtgcatgtgtgtgtgtgtgtat

SEQ ID NO: 144865 - DNA, 23 bp, Homo sapiens
cactgtctctgtttcgctctgtc

SEQ ID NO: 144866 - DNA, 23 bp, Homo sapiens
aggcgtacatctctgtgccaaga

SEQ ID NO: 144867 - DNA, 19 bp, Homo sapiens
acatcctgcctgtcctggc

SEQ ID NO: 144868 - DNA, 23 bp, Homo sapiens
gctaaagagatgtttggccaaag

SEQ ID NO: 144869 - DNA, 23 bp, Homo sapiens
tctggctgttttcacagttcact

SEQ ID NO: 144870 - DNA, 23 bp, Homo sapiens
atctctgtttcatacacagagct

SEQ ID NO: 144871 - DNA, 18 bp, Homo sapiens
tgacgtctgtttctgtca

SEQ ID NO: 144872 - DNA, 23 bp, Homo sapiens
gatggagtctcactctgtcaccc

SEQ ID NO: 144873 - DNA, 23 bp, Homo sapiens
agacagcctcactgaatgtgtgg

SEQ ID NO: 144874 - DNA, 18 bp, Homo sapiens
tgcatttttctaatgacc

SEQ ID NO: 144875 - DNA, 23 bp, Homo sapiens
gttctttttgcttaggattgtct

SEQ ID NO: 144876 - DNA, 23 bp, Homo sapiens
ttctgtgaagaaagtcaatggta

SEQ ID NO: 144877 - DNA, 21 bp, Homo sapiens
aatctctgccttgatgttgcc

SEQ ID NO: 144878 - DNA, 23 bp, Homo sapiens
tatgaaattggttatgattttct

SEQ ID NO: 144879 - DNA, 21 bp, Homo sapiens
tttgagacagactcttgctcg

SEQ ID NO: 144880 - DNA, 19 bp, Homo sapiens
caactcactacaacctccg

SEQ ID NO: 144881 - DNA, 23 bp, Homo sapiens
catgactcactgcagtctcagcc

SEQ ID NO: 144882 - DNA, 23 bp, Homo sapiens
atggagtctcactctgtcaccca

SEQ ID NO: 144883 - DNA, 23 bp, Homo sapiens
tggagtctcactctgtcacccag

SEQ ID NO: 144884 - DNA, 19 bp, Homo sapiens
aaagaccttccttaaggag

SEQ ID NO: 144885 - DNA, 23 bp, Homo sapiens
ctgggaagtttccaggttcttct

SEQ ID NO: 144886 - DNA, 21 bp, Homo sapiens
gtctgtcacagtgtgtgtgac

SEQ ID NO: 144887 - DNA, 18 bp, Homo sapiens
tgcctggccctgtctttg

SEQ ID NO: 144888 - DNA, 23 bp, Homo sapiens
ctgcgtgtcactgtgtgcctgag

SEQ ID NO: 144889 - DNA, 19 bp, Homo sapiens
cacatctgtctgggtgaaa

SEQ ID NO: 144890 - DNA, 23 bp, Homo sapiens
tgtgtgtgcatgtccatgtgcag

SEQ ID NO: 144891 - DNA, 23 bp, Homo sapiens
gtgtgtgcgtgcgtgcctgcctg

SEQ ID NO: 144892 - DNA, 18 bp, Homo sapiens
aaacgtgtgtgcgcatgt

SEQ ID NO: 144893 - DNA, 23 bp, Homo sapiens
tacagacagggtttcatcatgtc

SEQ ID NO: 144894 - DNA, 19 bp, Homo sapiens
cactccctgtcagccactg

SEQ ID NO: 144895 - DNA, 18 bp, Homo sapiens
acacacacgtatgtatat

SEQ ID NO: 144896 - DNA, 20 bp, Homo sapiens
atgtgtatatatatacatgt

SEQ ID NO: 144897 - DNA, 21 bp, Homo sapiens
tatgtgtatatatatacatgt

SEQ ID NO: 144898 - DNA, 21 bp, Homo sapiens
tatgtgtatatatatacatgt

SEQ ID NO: 144899 - DNA, 21 bp, Homo sapiens
tatgtgtatatatatacatgt

SEQ ID NO: 144900 - DNA, 23 bp, Homo sapiens
tacatgtatatgtgtatatatgt

SEQ ID NO: 144901 - DNA, 19 bp, Homo sapiens
tatcactgtgtaataaatc

SEQ ID NO: 144902 - DNA, 21 bp, Homo sapiens
actgtctgagtgactgggtct

SEQ ID NO: 144903 - DNA, 23 bp, Homo sapiens
ggatgatgttgctccttatgtgt

SEQ ID NO: 144904 - DNA, 21 bp, Homo sapiens
tggctccgtggctccgtggct

SEQ ID NO: 144905 - DNA, 23 bp, Homo sapiens
cggactctctctctcacgctgtg

SEQ ID NO: 144906 - DNA, 23 bp, Homo sapiens
cactctgtgagtctctggttctc

SEQ ID NO: 144907 - DNA, 23 bp, Homo sapiens
ccgagtctcgctctgtcacccag

SEQ ID NO: 144908 - DNA, 22 bp, Homo sapiens
tcagcctcaaaaaggaaggaca

SEQ ID NO: 144909 - DNA, 18 bp, Homo sapiens
gaggtgaacagaaggatg

SEQ ID NO: 144910 - DNA, 23 bp, Homo sapiens
acactgtgtgagtgcatgtgtgt

SEQ ID NO: 144911 - DNA, 23 bp, Homo sapiens
tgtgtgtgtgtggatgctgtgtc

SEQ ID NO: 144912 - DNA, 22 bp, Homo sapiens
tatatgtgtatgtatatgtata

SEQ ID NO: 144913 - DNA, 23 bp, Homo sapiens
actttgttgtgattcctgaatct

SEQ ID NO: 144914 - DNA, 23 bp, Homo sapiens
gtctgagatcaaggtgtcagcaa

SEQ ID NO: 144915 - DNA, 22 bp, Homo sapiens
taacacagaggctgtaccattt

SEQ ID NO: 144916 - DNA, 23 bp, Homo sapiens
ttcctcagagggttgttaggagg

SEQ ID NO: 144917 - DNA, 23 bp, Homo sapiens
gcctgtctcacaggctgtcaccc

SEQ ID NO: 144918 - DNA, 23 bp, Homo sapiens
acacactcaccctcagtgcctgc

SEQ ID NO: 144919 - DNA, 21 bp, Homo sapiens
tgagccactgtgcctggccct

SEQ ID NO: 144920 - DNA, 23 bp, Homo sapiens
tgacaggatctggctctctggct

SEQ ID NO: 144921 - DNA, 20 bp, Homo sapiens
gcctgggtgcctgtcaggca

SEQ ID NO: 144922 - DNA, 19 bp, Homo sapiens
cagtgagaccccatctttt

SEQ ID NO: 144923 - DNA, 23 bp, Homo sapiens
gacagtctcactgtcacccaggc

SEQ ID NO: 144924 - DNA, 23 bp, Homo sapiens
gcagtgtcactctgtgtccccca

SEQ ID NO: 144925 - DNA, 20 bp, Homo sapiens
atggacaccctgagtgtggc

SEQ ID NO: 144926 - DNA, 23 bp, Homo sapiens
tctggctctgtctgcctgtctct

SEQ ID NO: 144927 - DNA, 23 bp, Homo sapiens
cctctgtgcctgtctctgcccta

SEQ ID NO: 144928 - DNA, 23 bp, Homo sapiens
gtatgcatgcatgtatgtatgta

SEQ ID NO: 144929 - DNA, 19 bp, Homo sapiens
tgaggtaggaggatcactt

SEQ ID NO: 144930 - DNA, 23 bp, Homo sapiens
gcagagcaagacctgtctctctt

SEQ ID NO: 144931 - DNA, 19 bp, Homo sapiens
tgagatggagtctcactct

SEQ ID NO: 144932 - DNA, 22 bp, Homo sapiens
cagagagaagtgtctgtccaca

SEQ ID NO: 144933 - DNA, 23 bp, Homo sapiens
tctcaagagactcattaagctga

SEQ ID NO: 144934 - DNA, 23 bp, Homo sapiens
agagaggagtgagaagaaaacat

SEQ ID NO: 144935 - DNA, 23 bp, Homo sapiens
tttgctagactagagtttttgct

SEQ ID NO: 144936 - DNA, 20 bp, Homo sapiens
acacacacacatatgtatat

SEQ ID NO: 144937 - DNA, 23 bp, Homo sapiens
tgtctgtgtggttgtatataggt

SEQ ID NO: 144938 - DNA, 19 bp, Homo sapiens
acagcggtatgtaattctg

SEQ ID NO: 144939 - DNA, 23 bp, Homo sapiens
acctattagcttgaaatgtctgc

SEQ ID NO: 144940 - DNA, 22 bp, Homo sapiens
gatttcatggtagacacaggta

SEQ ID NO: 144941 - DNA, 22 bp, Homo sapiens
ttattactgtctttcttgttga

SEQ ID NO: 144942 - DNA, 22 bp, Homo sapiens
tcaggagcaagaatcagctgtg

SEQ ID NO: 144943 - DNA, 21 bp, Homo sapiens
accacacagttattattgtct

SEQ ID NO: 144944 - DNA, 22 bp, Homo sapiens
aacagtgtatcttgtccagaat

SEQ ID NO: 144945 - DNA, 23 bp, Homo sapiens
tgactctgacagacactggctgt

SEQ ID NO: 144946 - DNA, 23 bp, Homo sapiens
tggagtctcactctgtcacccag

SEQ ID NO: 144947 - DNA, 23 bp, Homo sapiens
ttgaagtcttgttggtttcatgt

SEQ ID NO: 144948 - DNA, 23 bp, Homo sapiens
gtgaatgtgcaaaagcatgtgta

SEQ ID NO: 144949 - DNA, 20 bp, Homo sapiens
atatatatgtgcgtgtgtat

SEQ ID NO: 144950 - DNA, 19 bp, Homo sapiens
gtctcgctctgtcacccag

SEQ ID NO: 144951 - DNA, 23 bp, Homo sapiens
tccctcagagccttccaagagtg

SEQ ID NO: 144952 - DNA, 23 bp, Homo sapiens
ctgtgtctgactctcactttttg

SEQ ID NO: 144953 - DNA, 23 bp, Homo sapiens
tgcctggcactctctctcatgct

SEQ ID NO: 144954 - DNA, 23 bp, Homo sapiens
gatggactctcactctgtcaccc

SEQ ID NO: 144955 - DNA, 22 bp, Homo sapiens
ccatcagagattgtttattggc

SEQ ID NO: 144956 - DNA, 19 bp, Homo sapiens
ttactggggaatatttctc

SEQ ID NO: 144957 - DNA, 23 bp, Homo sapiens
ggtcactcagtgtctgtttgccc

SEQ ID NO: 144958 - DNA, 23 bp, Homo sapiens
gggtattttttgacaaaatgaag

SEQ ID NO: 144959 - DNA, 21 bp, Homo sapiens
tattcttcagattttgttgta

SEQ ID NO: 144960 - DNA, 23 bp, Homo sapiens
tctctctgaccttgacttccctt

SEQ ID NO: 144961 - DNA, 23 bp, Homo sapiens
tgtggatacatagtaggtgttta

SEQ ID NO: 144962 - DNA, 18 bp, Homo sapiens
gacagggtctggctctct

SEQ ID NO: 144963 - DNA, 23 bp, Homo sapiens
tctctgcaaaatagaccctgaga

SEQ ID NO: 144964 - DNA, 18 bp, Homo sapiens
aattggtagatgctcaat

SEQ ID NO: 144965 - DNA, 22 bp, Homo sapiens
attgcatgtatgtatgaatgaa

SEQ ID NO: 144966 - DNA, 23 bp, Homo sapiens
tgagttcattgtagattctggat

SEQ ID NO: 144967 - DNA, 23 bp, Homo sapiens
tgagttcattgtagattctggat

SEQ ID NO: 144968 - DNA, 23 bp, Homo sapiens
atgtgtcactctctgtgaggggc

SEQ ID NO: 144969 - DNA, 19 bp, Homo sapiens
tatatatatatggatccag

SEQ ID NO: 144970 - DNA, 23 bp, Homo sapiens
gctcctgactcagtctgtccctc

SEQ ID NO: 144971 - DNA, 19 bp, Homo sapiens
actatttgtatatgtgtgc

SEQ ID NO: 144972 - DNA, 23 bp, Homo sapiens
atataagtactatttcttttaca

SEQ ID NO: 144973 - DNA, 20 bp, Homo sapiens
cagtcaagaatgagaggaca

SEQ ID NO: 144974 - DNA, 23 bp, Homo sapiens
gtaaagatgcaactttgtggtca

SEQ ID NO: 144975 - DNA, 23 bp, Homo sapiens
actctgtgactgtgactataagc

SEQ ID NO: 144976 - DNA, 23 bp, Homo sapiens
agcctcatcttgccctggtctct

SEQ ID NO: 144977 - DNA, 23 bp, Homo sapiens
tggagtctcactctgtcacccag

SEQ ID NO: 144978 - DNA, 23 bp, Homo sapiens
tgggaggcagagattgcagtgag

SEQ ID NO: 144979 - DNA, 21 bp, Homo sapiens
tcagtagaagcctcattctgt

SEQ ID NO: 144980 - DNA, 19 bp, Homo sapiens
attacaatggtgctgactg

SEQ ID NO: 144981 - DNA, 23 bp, Homo sapiens
gctgtctgagtctgtgcctcggt

SEQ ID NO: 144982 - DNA, 23 bp, Homo sapiens
gactgagtctcgctctgtcaccc

SEQ ID NO: 144983 - DNA, 23 bp, Homo sapiens
actgagtctcgctctgtcaccca

SEQ ID NO: 144984 - DNA, 23 bp, Homo sapiens
ggtggagtctcacactgtcaccc

SEQ ID NO: 144985 - DNA, 23 bp, Homo sapiens
tgattaaatgcatgtgtgtgtgt

SEQ ID NO: 144986 - DNA, 20 bp, Homo sapiens
aatttgtgcactttactgtc

SEQ ID NO: 144987 - DNA, 23 bp, Homo sapiens
tgattgcttcttagagagtcaga

SEQ ID NO: 144988 - DNA, 23 bp, Homo sapiens
tgagagagtctcgctctgtcacc

SEQ ID NO: 144989 - DNA, 21 bp, Homo sapiens
tgagatggagtctcactctgt

SEQ ID NO: 144990 - DNA, 23 bp, Homo sapiens
tagcatcttctgaggcctgtatt

SEQ ID NO: 144991 - DNA, 23 bp, Homo sapiens
agacaggtgtctcactctgtcac

SEQ ID NO: 144992 - DNA, 20 bp, Homo sapiens
agtctcgctctgtcgctcag

SEQ ID NO: 144993 - DNA, 23 bp, Homo sapiens
tatctatgtatatctctgtctca

SEQ ID NO: 144994 - DNA, 23 bp, Homo sapiens
taacttgatttgcaattggattg

SEQ ID NO: 144995 - DNA, 22 bp, Homo sapiens
aatacaactgattgtcatgttg

SEQ ID NO: 144996 - DNA, 23 bp, Homo sapiens
taagtgcttccatcttctcatga

SEQ ID NO: 144997 - DNA, 20 bp, Homo sapiens
tgtaagtgcaactacatctg

SEQ ID NO: 144998 - DNA, 20 bp, Homo sapiens
tggaaagaaaagcagtatgt

SEQ ID NO: 144999 - DNA, 21 bp, Homo sapiens
ttctcatatgatcatgctgta

SEQ ID NO: 145000 - DNA, 23 bp, Homo sapiens
gactcgctgggtggctagatcca

SEQ ID NO: 145001 - DNA, 23 bp, Homo sapiens
gacagagtctcgctctgtcaccc

SEQ ID NO: 145002 - DNA, 23 bp, Homo sapiens
tatacgtatatatacatatgtgt

SEQ ID NO: 145003 - DNA, 23 bp, Homo sapiens
tatatgtatatatacatatgtgt

SEQ ID NO: 145004 - DNA, 23 bp, Homo sapiens
tatatgtatatatacatatgtgt

SEQ ID NO: 145005 - DNA, 23 bp, Homo sapiens
atatgtgtgtatatatatgtgtg

SEQ ID NO: 145006 - DNA, 23 bp, Homo sapiens
tatgtatatatatatgtgtgtat

SEQ ID NO: 145007 - DNA, 23 bp, Homo sapiens
agaggtagaagaatcacttgaac

SEQ ID NO: 145008 - DNA, 22 bp, Homo sapiens
gctttgacattgtttttctttc

SEQ ID NO: 145009 - DNA, 23 bp, Homo sapiens
acagagtctcactctgtcaccca

SEQ ID NO: 145010 - DNA, 19 bp, Homo sapiens
acagctgtaagtggtgaaa

SEQ ID NO: 145011 - DNA, 19 bp, Homo sapiens
ggaatctatagaactaaca

SEQ ID NO: 145012 - DNA, 18 bp, Homo sapiens
tctctcactgacttcatg

SEQ ID NO: 145013 - DNA, 23 bp, Homo sapiens
acagatacaaaatatgcgtgtgt

SEQ ID NO: 145014 - DNA, 23 bp, Homo sapiens
atacacaaaatatacatatgtgt

SEQ ID NO: 145015 - DNA, 19 bp, Homo sapiens
ataagtgagactttttgtt

SEQ ID NO: 145016 - DNA, 23 bp, Homo sapiens
agagtctcactctgtcacccagg

SEQ ID NO: 145017 - DNA, 22 bp, Homo sapiens
aaaatttgaagctttttgagtg

SEQ ID NO: 145018 - DNA, 23 bp, Homo sapiens
attttctgcaatagatttctttt

SEQ ID NO: 145019 - DNA, 19 bp, Homo sapiens
agaggaagagtgttctaga

SEQ ID NO: 145020 - DNA, 23 bp, Homo sapiens
atgagatgtaactcctttcccag

SEQ ID NO: 145021 - DNA, 23 bp, Homo sapiens
acttgtgaatttcatgctgtgga

SEQ ID NO: 145022 - DNA, 23 bp, Homo sapiens
ctgtcagacagcctctgttctgg

SEQ ID NO: 145023 - DNA, 22 bp, Homo sapiens
tagtggacatgtgagggcctga

SEQ ID NO: 145024 - DNA, 22 bp, Homo sapiens
aagttccttctgagaatagcat

SEQ ID NO: 145025 - DNA, 21 bp, Homo sapiens
agtcagggtctgtgtggtgtg

SEQ ID NO: 145026 - DNA, 19 bp, Homo sapiens
aagtggaaaaaagattaga

SEQ ID NO: 145027 - DNA, 21 bp, Homo sapiens
atacacacatatatagtgtct

SEQ ID NO: 145028 - DNA, 23 bp, Homo sapiens
acacacacatatatactgtgtat

SEQ ID NO: 145029 - DNA, 18 bp, Homo sapiens
tctcatctctgtctctca

SEQ ID NO: 145030 - DNA, 23 bp, Homo sapiens
gatggctgagatgttggagaggg

SEQ ID NO: 145031 - DNA, 23 bp, Homo sapiens
agagtccttccaaatctcagatt

SEQ ID NO: 145032 - DNA, 23 bp, Homo sapiens
atttgaatgtatatgtattcata

SEQ ID NO: 145033 - DNA, 23 bp, Homo sapiens
ttttaagagtgcatgctattcat

SEQ ID NO: 145034 - DNA, 21 bp, Homo sapiens
catgcctcataattggcatca

SEQ ID NO: 145035 - DNA, 23 bp, Homo sapiens
taaccagaagtttatcagcagtg

SEQ ID NO: 145036 - DNA, 23 bp, Homo sapiens
ctgtagtcccagctatgtgagag

SEQ ID NO: 145037 - DNA, 23 bp, Homo sapiens
tggaatctcactatgcttctctc

SEQ ID NO: 145038 - DNA, 23 bp, Homo sapiens
agagagatcacagtgcccagaca

SEQ ID NO: 145039 - DNA, 22 bp, Homo sapiens
ccagtgttctgcctttcagtcc

SEQ ID NO: 145040 - DNA, 23 bp, Homo sapiens
aaggagatctgaccctctttctc

SEQ ID NO: 145041 - DNA, 21 bp, Homo sapiens
acagagcacgtgaaaaggctt

SEQ ID NO: 145042 - DNA, 23 bp, Homo sapiens
tgagttcattgtagattctggat

SEQ ID NO: 145043 - DNA, 23 bp, Homo sapiens
tgagttcattgtagattctggat

SEQ ID NO: 145044 - DNA, 21 bp, Homo sapiens
tccgtgtgaagagaccaccaa

SEQ ID NO: 145045 - DNA, 23 bp, Homo sapiens
gtgagcaacatggttgtttattt

SEQ ID NO: 145046 - DNA, 21 bp, Homo sapiens
tgagtcattcagactccttgg

SEQ ID NO: 145047 - DNA, 23 bp, Homo sapiens
catcagtccgtgtgactccctct

SEQ ID NO: 145048 - DNA, 23 bp, Homo sapiens
gatcactgcctcctggaatctgt

SEQ ID NO: 145049 - DNA, 23 bp, Homo sapiens
tctgggtgtctcactctgtctat

SEQ ID NO: 145050 - DNA, 22 bp, Homo sapiens
tagtttgaacatttccagaaat

SEQ ID NO: 145051 - DNA, 23 bp, Homo sapiens
actctcactcactgacagttgaa

SEQ ID NO: 145052 - DNA, 23 bp, Homo sapiens
tgaggtaggtggatcacttgaac

SEQ ID NO: 145053 - DNA, 23 bp, Homo sapiens
aatcacttttctctgctagtgat

SEQ ID NO: 145054 - DNA, 23 bp, Homo sapiens
tgacaggacttctgtgcactgtg

SEQ ID NO: 145055 - DNA, 23 bp, Homo sapiens
tgagttcattgtagattctggat

SEQ ID NO: 145056 - DNA, 23 bp, Homo sapiens
tgagttcattgtagattctggat

SEQ ID NO: 145057 - DNA, 20 bp, Homo sapiens
tatcacagtgggtgtacaca

SEQ ID NO: 145058 - DNA, 19 bp, Homo sapiens
ctgtcaccctcactgcagt

SEQ ID NO: 145059 - DNA, 21 bp, Homo sapiens
tgcctgggtggcagagtgaga

SEQ ID NO: 145060 - DNA, 23 bp, Homo sapiens
tctcagtctgtcacctaagctgg

SEQ ID NO: 145061 - DNA, 23 bp, Homo sapiens
ctttgacagtgcctggattggtg

SEQ ID NO: 145062 - DNA, 23 bp, Homo sapiens
acagagtctcactctgtcgccca

SEQ ID NO: 145063 - DNA, 23 bp, Homo sapiens
gaagtgtgtgtgttctgtaggtg

SEQ ID NO: 145064 - DNA, 22 bp, Homo sapiens
tgagaggctgtgcaatatttgt

SEQ ID NO: 145065 - DNA, 23 bp, Homo sapiens
tattgcacagggtcatttttgtg

SEQ ID NO: 145066 - DNA, 19 bp, Homo sapiens
tccctgagagcagaggagc

SEQ ID NO: 145067 - DNA, 23 bp, Homo sapiens
ctgtagtcccagcttctccagag

SEQ ID NO: 145068 - DNA, 21 bp, Homo sapiens
aatgttttataaattgagtgt

SEQ ID NO: 145069 - DNA, 18 bp, Homo sapiens
gagtgaaacgctgtctca

SEQ ID NO: 145070 - DNA, 23 bp, Homo sapiens
tgtctgtctctttccctgtgagt

SEQ ID NO: 145071 - DNA, 23 bp, Homo sapiens
gtgtctgcgtgtgtccctgcttg

SEQ ID NO: 145072 - DNA, 22 bp, Homo sapiens
tttactgaatttgtttatcagt

SEQ ID NO: 145073 - DNA, 23 bp, Homo sapiens
tggtggagtatttcagtttgctt

SEQ ID NO: 145074 - DNA, 23 bp, Homo sapiens
tgagttcattgtagattctggat

SEQ ID NO: 145075 - DNA, 23 bp, Homo sapiens
tgagttcattgtagattctggat

SEQ ID NO: 145076 - DNA, 21 bp, Homo sapiens
agggcttcttctgcaggaatg

SEQ ID NO: 145077 - DNA, 23 bp, Homo sapiens
aatgcctgtgacctaagcatctg

SEQ ID NO: 145078 - DNA, 23 bp, Homo sapiens
cactgtcactgtgtcatgtctcc

SEQ ID NO: 145079 - DNA, 21 bp, Homo sapiens
aggaagagaaaagtctaggca

SEQ ID NO: 145080 - DNA, 23 bp, Homo sapiens
gatctggttgtttaaaagtgtgt

SEQ ID NO: 145081 - DNA, 23 bp, Homo sapiens
ggagactcactctgtcactcagg

SEQ ID NO: 145082 - DNA, 19 bp, Homo sapiens
gtgacttgtctggcacctg

SEQ ID NO: 145083 - DNA, 23 bp, Homo sapiens
ctcccagtcactctctaagcact

SEQ ID NO: 145084 - DNA, 23 bp, Homo sapiens
ctctgactgtctacagtggggaa

SEQ ID NO: 145085 - DNA, 23 bp, Homo sapiens
tatggattcgcatgaatagatta

SEQ ID NO: 145086 - DNA, 23 bp, Homo sapiens
gtctgtgtgcaaacatgtgtgca

SEQ ID NO: 145087 - DNA, 23 bp, Homo sapiens
tgagtgtctcactcacaggcacc

SEQ ID NO: 145088 - DNA, 21 bp, Homo sapiens
cagggagcatgtcatatgcct

SEQ ID NO: 145089 - DNA, 23 bp, Homo sapiens
tgtctcactgtctctcttgttag

SEQ ID NO: 145090 - DNA, 23 bp, Homo sapiens
gggtctcactctgtcacccaggc

SEQ ID NO: 145091 - DNA, 20 bp, Homo sapiens
acagacaaaagagagtgtcc

SEQ ID NO: 145092 - DNA, 19 bp, Homo sapiens
agaagtggaacatgctaca

SEQ ID NO: 145093 - DNA, 23 bp, Homo sapiens
taactcactgcttgaattctcag

SEQ ID NO: 145094 - DNA, 23 bp, Homo sapiens
ctctctctccatgtgtgttcacc

SEQ ID NO: 145095 - DNA, 18 bp, Homo sapiens
attactcagatgttttgt

SEQ ID NO: 145096 - DNA, 19 bp, Homo sapiens
tgagcaacttgtaggttag

SEQ ID NO: 145097 - DNA, 23 bp, Homo sapiens
ctcccagagcccctggaactctg

SEQ ID NO: 145098 - DNA, 23 bp, Homo sapiens
atgtcagaaagtctttctggtct

SEQ ID NO: 145099 - DNA, 23 bp, Homo sapiens
actctctctggatctgttttcct

SEQ ID NO: 145100 - DNA, 22 bp, Homo sapiens
agtctcgctctgtcactcaggc

SEQ ID NO: 145101 - DNA, 22 bp, Homo sapiens
ctggaggtaatttttggagttt

SEQ ID NO: 145102 - DNA, 22 bp, Homo sapiens
acacgtacatatatatgtgtat

SEQ ID NO: 145103 - DNA, 23 bp, Homo sapiens
tatacacatgtacatatgtgtgt

SEQ ID NO: 145104 - DNA, 23 bp, Homo sapiens
atatgtgtgtatatatacatatc

SEQ ID NO: 145105 - DNA, 23 bp, Homo sapiens
tcactatctgactcaccacttgc

SEQ ID NO: 145106 - DNA, 22 bp, Homo sapiens
tgtatggatatctacctgttgg

SEQ ID NO: 145107 - DNA, 23 bp, Homo sapiens
gagatgaagtctctctctgtcac

SEQ ID NO: 145108 - DNA, 23 bp, Homo sapiens
ggctggctcggtggatgagtcag

SEQ ID NO: 145109 - DNA, 18 bp, Homo sapiens
tcagctggggctatcaac

SEQ ID NO: 145110 - DNA, 22 bp, Homo sapiens
gttttttggttccatatgaaat

SEQ ID NO: 145111 - DNA, 22 bp, Homo sapiens
attgtaaggcaaggttagctta

SEQ ID NO: 145112 - DNA, 22 bp, Homo sapiens
tgttatgtaaactagcttaggc

SEQ ID NO: 145113 - DNA, 22 bp, Homo sapiens
atgactctttgtctcactgtaa

SEQ ID NO: 145114 - DNA, 23 bp, Homo sapiens
agtgactacatcacattgtgaga

SEQ ID NO: 145115 - DNA, 23 bp, Homo sapiens
tctgtatgaacaacaggaagtga

SEQ ID NO: 145116 - DNA, 23 bp, Homo sapiens
ttttggatggaatggaaatattt

SEQ ID NO: 145117 - DNA, 22 bp, Homo sapiens
atacatgttgaactggtttcag

SEQ ID NO: 145118 - DNA, 23 bp, Homo sapiens
aagtgactgtcacttgaattctg

SEQ ID NO: 145119 - DNA, 23 bp, Homo sapiens
tgagttcattgtagattctggat

SEQ ID NO: 145120 - DNA, 23 bp, Homo sapiens
tgagttcattgtagattctggat

SEQ ID NO: 145121 - DNA, 19 bp, Homo sapiens
ttgagtgtctgcagctttt

SEQ ID NO: 145122 - DNA, 23 bp, Homo sapiens
tttgagtcacacagtctgtgggt

SEQ ID NO: 145123 - DNA, 23 bp, Homo sapiens
agagatctatagttgaaaaggga

SEQ ID NO: 145124 - DNA, 18 bp, Homo sapiens
attgaaaggatgagtaag

SEQ ID NO: 145125 - DNA, 20 bp, Homo sapiens
tttgtttttctaggactaga

SEQ ID NO: 145126 - DNA, 20 bp, Homo sapiens
tatactctatatgtatttat

SEQ ID NO: 145127 - DNA, 23 bp, Homo sapiens
tatgtgcatatatatagtatatg

SEQ ID NO: 145128 - DNA, 23 bp, Homo sapiens
tctatgtttatctatctgtatct

SEQ ID NO: 145129 - DNA, 23 bp, Homo sapiens
tgagttcattgtagattctggat

SEQ ID NO: 145130 - DNA, 23 bp, Homo sapiens
tgagttcattgtagattctggat

SEQ ID NO: 145131 - DNA, 23 bp, Homo sapiens
tgagttcattgtagattctggat

SEQ ID NO: 145132 - DNA, 23 bp, Homo sapiens
tgagttcattgtagattctggat

SEQ ID NO: 145133 - DNA, 23 bp, Homo sapiens
gggtctcactctgtcacccaggc

SEQ ID NO: 145134 - DNA, 23 bp, Homo sapiens
tgagttcattgtagattctggat

SEQ ID NO: 145135 - DNA, 23 bp, Homo sapiens
tgagttcattgtagattctggat

SEQ ID NO: 145136 - DNA, 23 bp, Homo sapiens
gacagagtctcgctctgtcaccc

SEQ ID NO: 145137 - DNA, 23 bp, Homo sapiens
ctgagtaaccatgtatatgatat

SEQ ID NO: 145138 - DNA, 23 bp, Homo sapiens
gggtctcactctgtcacccaggc

SEQ ID NO: 145139 - DNA, 23 bp, Homo sapiens
tgagttcattgtagattctggat

SEQ ID NO: 145140 - DNA, 23 bp, Homo sapiens
tgagttcattgtagattctggat

SEQ ID NO: 145141 - DNA, 21 bp, Homo sapiens
aggaatgtagtgagctatgat

SEQ ID NO: 145142 - DNA, 23 bp, Homo sapiens
attcaggttccatatgaatttta

SEQ ID NO: 145143 - DNA, 23 bp, Homo sapiens
atatgtgtatatgtatacatgta

SEQ ID NO: 145144 - DNA, 22 bp, Homo sapiens
atatgtatatatgtatatatgt

SEQ ID NO: 145145 - DNA, 22 bp, Homo sapiens
tcagtacattggatttgagtgt

SEQ ID NO: 145146 - DNA, 23 bp, Homo sapiens
tttttctttgtattgaaatccaa

SEQ ID NO: 145147 - DNA, 23 bp, Homo sapiens
ggatgggtttctcattgtaatct

SEQ ID NO: 145148 - DNA, 19 bp, Homo sapiens
aaaatagagcaaactggtt

SEQ ID NO: 145149 - DNA, 23 bp, Homo sapiens
agttactctgttgcacaaagagg

SEQ ID NO: 145150 - DNA, 23 bp, Homo sapiens
tatgtgtgtgtatatatatacgt

SEQ ID NO: 145151 - DNA, 23 bp, Homo sapiens
tgagttcattgtagattctggat

SEQ ID NO: 145152 - DNA, 23 bp, Homo sapiens
tgagttcattgtagattctggat

SEQ ID NO: 145153 - DNA, 23 bp, Homo sapiens
gacagagtctcactctgttaccc

SEQ ID NO: 145154 - DNA, 20 bp, Homo sapiens
aagactatatatatatctga

SEQ ID NO: 145155 - DNA, 23 bp, Homo sapiens
tcagatacatatgtagtctgagg

SEQ ID NO: 145156 - DNA, 21 bp, Homo sapiens
tgaagaggtgtatgagaagct

SEQ ID NO: 145157 - DNA, 19 bp, Homo sapiens
tctgtggatctgcatgcaa

SEQ ID NO: 145158 - DNA, 23 bp, Homo sapiens
ctcaacctcctggactcaagtga

SEQ ID NO: 145159 - DNA, 21 bp, Homo sapiens
aatacgtatatttatatatgt

SEQ ID NO: 145160 - DNA, 22 bp, Homo sapiens
tatgcatatatgtatatatgtg

SEQ ID NO: 145161 - DNA, 21 bp, Homo sapiens
ttgtgtacttaatactttgtg

SEQ ID NO: 145162 - DNA, 23 bp, Homo sapiens
agatggagtctcactctgtcacc

SEQ ID NO: 145163 - DNA, 23 bp, Homo sapiens
tgtctctgtctgtgtcatgtgat

SEQ ID NO: 145164 - DNA, 23 bp, Homo sapiens
acacattcactcactgcttccct

SEQ ID NO: 145165 - DNA, 21 bp, Homo sapiens
agctacttaagattacagaaa

SEQ ID NO: 145166 - DNA, 23 bp, Homo sapiens
tcacagtcactgtaaatcttgtc

SEQ ID NO: 145167 - DNA, 19 bp, Homo sapiens
ctgggaaggtgtgtacact

SEQ ID NO: 145168 - DNA, 23 bp, Homo sapiens
actacactgagtaaggagacaga

SEQ ID NO: 145169 - DNA, 23 bp, Homo sapiens
acatagagaagagagagtcctca

SEQ ID NO: 145170 - DNA, 22 bp, Homo sapiens
atttgacctcatgcaagttcct

SEQ ID NO: 145171 - DNA, 23 bp, Homo sapiens
cagagtctcactctgtcacccag

SEQ ID NO: 145172 - DNA, 23 bp, Homo sapiens
tctgtcagtctgtctcttctgag

SEQ ID NO: 145173 - DNA, 22 bp, Homo sapiens
tttctccttcatgttttgagtg

SEQ ID NO: 145174 - DNA, 22 bp, Homo sapiens
gttttttggttccatatgaaat

SEQ ID NO: 145175 - DNA, 23 bp, Homo sapiens
ttctatgaagaaagtcaatggta

SEQ ID NO: 145176 - DNA, 23 bp, Homo sapiens
tgcatgtggtccccaatagactc

SEQ ID NO: 145177 - DNA, 23 bp, Homo sapiens
tgagttcattgtagattctggat

SEQ ID NO: 145178 - DNA, 23 bp, Homo sapiens
tgagttcattgtagattctggat

SEQ ID NO: 145179 - DNA, 23 bp, Homo sapiens
tgagttcattgtagattctggat

SEQ ID NO: 145180 - DNA, 23 bp, Homo sapiens
tgagttcattgtagattctggat

SEQ ID NO: 145181 - DNA, 23 bp, Homo sapiens
tctgatgtgtttcaaactttttt

SEQ ID NO: 145182 - DNA, 21 bp, Homo sapiens
tttaagaagatttgattgtca

SEQ ID NO: 145183 - DNA, 18 bp, Homo sapiens
atttctttcttatatttg

SEQ ID NO: 145184 - DNA, 21 bp, Homo sapiens
ggagtctccctctgtctccca

SEQ ID NO: 145185 - DNA, 23 bp, Homo sapiens
tctcagatttctgtttttcaagt

SEQ ID NO: 145186 - DNA, 22 bp, Homo sapiens
tgaaaagttattatgctatgtc

SEQ ID NO: 145187 - DNA, 23 bp, Homo sapiens
atatgtgtatgtatatatgtatg

SEQ ID NO: 145188 - DNA, 23 bp, Homo sapiens
tgagttcattgtagattctggat

SEQ ID NO: 145189 - DNA, 23 bp, Homo sapiens
tgagttcattgtagattctggat

SEQ ID NO: 145190 - DNA, 20 bp, Homo sapiens
atatatgcatatatatacat

SEQ ID NO: 145191 - DNA, 20 bp, Homo sapiens
taggttggaatttggtatct

SEQ ID NO: 145192 - DNA, 20 bp, Homo sapiens
aagatatctgtttttgtagt

SEQ ID NO: 145193 - DNA, 20 bp, Homo sapiens
tgagatggagagtattttcc

SEQ ID NO: 145194 - DNA, 23 bp, Homo sapiens
tgaatatatgttgtaatatatac

SEQ ID NO: 145195 - DNA, 23 bp, Homo sapiens
tatatatgtgtgtatatatatgt

SEQ ID NO: 145196 - DNA, 18 bp, Homo sapiens
tatgtgtatatgtatgtg

SEQ ID NO: 145197 - DNA, 22 bp, Homo sapiens
agcatgttttctattgatgctt

SEQ ID NO: 145198 - DNA, 22 bp, Homo sapiens
ttaaagcatttccagctgtttc

SEQ ID NO: 145199 - DNA, 23 bp, Homo sapiens
gacagggagagttttggtcttgc

SEQ ID NO: 145200 - DNA, 23 bp, Homo sapiens
tgagttcattgtagattctggat

SEQ ID NO: 145201 - DNA, 23 bp, Homo sapiens
tgagttcattgtagattctggat

SEQ ID NO: 145202 - DNA, 18 bp, Homo sapiens
atctgtgtatatatgtgt

SEQ ID NO: 145203 - DNA, 23 bp, Homo sapiens
tatgtgtgtgtatatatacacat

SEQ ID NO: 145204 - DNA, 23 bp, Homo sapiens
tgttccatgtagaagggaatgag

SEQ ID NO: 145205 - DNA, 23 bp, Homo sapiens
tcgctccctcactggctcagtct

SEQ ID NO: 145206 - DNA, 19 bp, Homo sapiens
tgcgtgtgtgtgtgtgtgt

SEQ ID NO: 145207 - DNA, 23 bp, Homo sapiens
tataccatctagatctgtttcta

SEQ ID NO: 145208 - DNA, 20 bp, Homo sapiens
tacagatatgataactgagc

SEQ ID NO: 145209 - DNA, 23 bp, Homo sapiens
tgagttcattgtagattctggat

SEQ ID NO: 145210 - DNA, 23 bp, Homo sapiens
tgagttcattgtagattctggat

SEQ ID NO: 145211 - DNA, 23 bp, Homo sapiens
tgagttcattgtagattctggat

SEQ ID NO: 145212 - DNA, 23 bp, Homo sapiens
tgagttcattgtagattctggat

SEQ ID NO: 145213 - DNA, 23 bp, Homo sapiens
aataagactgttaatctattctt

SEQ ID NO: 145214 - DNA, 23 bp, Homo sapiens
tcgtggatgtgtgattttcattt

SEQ ID NO: 145215 - DNA, 22 bp, Homo sapiens
tgtggtaggtgcttgtgttgag

SEQ ID NO: 145216 - DNA, 22 bp, Homo sapiens
tgttctttggcttaggattgtc

SEQ ID NO: 145217 - DNA, 22 bp, Homo sapiens
aaagtcactggtagcttgatgg

SEQ ID NO: 145218 - DNA, 22 bp, Homo sapiens
tcagtactcagcacaatgaatc

SEQ ID NO: 145219 - DNA, 23 bp, Homo sapiens
tgtgaactgtatcccagctgttg

SEQ ID NO: 145220 - DNA, 22 bp, Homo sapiens
gactgtcatctgttgaacatct

SEQ ID NO: 145221 - DNA, 21 bp, Homo sapiens
cactcttgaactaatcactgt

SEQ ID NO: 145222 - DNA, 23 bp, Homo sapiens
tcagagtacactgattggtcaag

SEQ ID NO: 145223 - DNA, 23 bp, Homo sapiens
agtcatgtgttcaacctcaagcc

SEQ ID NO: 145224 - DNA, 23 bp, Homo sapiens
attgtcacactctgtcatatgga

SEQ ID NO: 145225 - DNA, 21 bp, Homo sapiens
taactccaatcgcattgtgac

SEQ ID NO: 145226 - DNA, 20 bp, Homo sapiens
tgtgtacatgtttatatgtg

SEQ ID NO: 145227 - DNA, 23 bp, Homo sapiens
gacacagtctcgctctgtcaccc

SEQ ID NO: 145228 - DNA, 23 bp, Homo sapiens
atatctccatatatatgtgtgtg

SEQ ID NO: 145229 - DNA, 23 bp, Homo sapiens
atatctccatatatatgtgtgtg

SEQ ID NO: 145230 - DNA, 23 bp, Homo sapiens
tgtcagacgattcccagctgtct

SEQ ID NO: 145231 - DNA, 23 bp, Homo sapiens
caaaagcagggggactgttctag

SEQ ID NO: 145232 - DNA, 23 bp, Homo sapiens
atgatgatgatgatgatgatgat

SEQ ID NO: 145233 - DNA, 23 bp, Homo sapiens
atgatgatgatgatgatgatgat

SEQ ID NO: 145234 - DNA, 22 bp, Homo sapiens
atgatgatgatgatgatgatga

SEQ ID NO: 145235 - DNA, 22 bp, Homo sapiens
agagtctcactctgtcacccag

SEQ ID NO: 145236 - DNA, 23 bp, Homo sapiens
tgagttcattgtagattctggat

SEQ ID NO: 145237 - DNA, 23 bp, Homo sapiens
tgagttcattgtagattctggat

SEQ ID NO: 145238 - DNA, 23 bp, Homo sapiens
acggagtctcactctctcaccca

SEQ ID NO: 145239 - DNA, 23 bp, Homo sapiens
accctgagtcactgtctgtctgc

SEQ ID NO: 145240 - DNA, 23 bp, Homo sapiens
tatatgcatatataatggtgtat

SEQ ID NO: 145241 - DNA, 23 bp, Homo sapiens
cttctctgtgtctgtgacacttt

SEQ ID NO: 145242 - DNA, 23 bp, Homo sapiens
tcacctccaggatgtcagtggtg

SEQ ID NO: 145243 - DNA, 23 bp, Homo sapiens
tacagatactgcatcatcatctg

SEQ ID NO: 145244 - DNA, 23 bp, Homo sapiens
agcctggctctctcgcagtctca

SEQ ID NO: 145245 - DNA, 23 bp, Homo sapiens
tagctattgtgactgaagaactg

SEQ ID NO: 145246 - DNA, 22 bp, Homo sapiens
tggggtctcactgtcactcagg

SEQ ID NO: 145247 - DNA, 23 bp, Homo sapiens
gcctctctgtatctcagtttctt

SEQ ID NO: 145248 - DNA, 23 bp, Homo sapiens
tgtctctatctgtctctgtctct

SEQ ID NO: 145249 - DNA, 23 bp, Homo sapiens
acacaggcatttgtaatcatata

SEQ ID NO: 145250 - DNA, 23 bp, Homo sapiens
tgagttcattgtagattctggat

SEQ ID NO: 145251 - DNA, 23 bp, Homo sapiens
tgagttcattgtagattctggat

SEQ ID NO: 145252 - DNA, 22 bp, Homo sapiens
tatatacatgtatacatatgta

SEQ ID NO: 145253 - DNA, 18 bp, Homo sapiens
atgtataactatatatgt

SEQ ID NO: 145254 - DNA, 22 bp, Homo sapiens
tatatatgtatagttatacatg

SEQ ID NO: 145255 - DNA, 23 bp, Homo sapiens
tgagttcattgtagattctggat

SEQ ID NO: 145256 - DNA, 23 bp, Homo sapiens
tgagttcattgtagattctggat

SEQ ID NO: 145257 - DNA, 18 bp, Homo sapiens
gagccagtatgagccact

SEQ ID NO: 145258 - DNA, 23 bp, Homo sapiens
cacaggcactgtgtttgatgatt

SEQ ID NO: 145259 - DNA, 21 bp, Homo sapiens
tttaatcctcatactcatcct

SEQ ID NO: 145260 - DNA, 23 bp, Homo sapiens
agattctcactctgtcacccagg

SEQ ID NO: 145261 - DNA, 23 bp, Homo sapiens
cgtgacagtgtgatgggcagtgt

SEQ ID NO: 145262 - DNA, 23 bp, Homo sapiens
tgagttcattgtagattctggat

SEQ ID NO: 145263 - DNA, 23 bp, Homo sapiens
tgagttcattgtagattctggat

SEQ ID NO: 145264 - DNA, 22 bp, Homo sapiens
aggagaagatcaagctgtgtga

SEQ ID NO: 145265 - DNA, 21 bp, Homo sapiens
atatgtatatatacgtgtata

SEQ ID NO: 145266 - DNA, 23 bp, Homo sapiens
tgagttcattgtagattctggat

SEQ ID NO: 145267 - DNA, 23 bp, Homo sapiens
tgagttcattgtagattctggat

SEQ ID NO: 145268 - DNA, 22 bp, Homo sapiens
tctcagaatctctgtgtctcct

SEQ ID NO: 145269 - DNA, 23 bp, Homo sapiens
tgcaatcaaaagaacagtgtcca

SEQ ID NO: 145270 - DNA, 22 bp, Homo sapiens
atagatgtacctctatggatgt

SEQ ID NO: 145271 - DNA, 23 bp, Homo sapiens
tctctgcatctctctctctctct

SEQ ID NO: 145272 - DNA, 18 bp, Homo sapiens
actcagcttctggtgagg

SEQ ID NO: 145273 - DNA, 23 bp, Homo sapiens
tctcactctgtctcctaggcttg

SEQ ID NO: 145274 - DNA, 23 bp, Homo sapiens
tatgtatatatatacatatgtgt

SEQ ID NO: 145275 - DNA, 23 bp, Homo sapiens
tatgtgtatatatacatatgtgt

SEQ ID NO: 145276 - DNA, 23 bp, Homo sapiens
tatgtgtatatatacatatgtgt

SEQ ID NO: 145277 - DNA, 23 bp, Homo sapiens
tatgtgtatatatacatatgtgt

SEQ ID NO: 145278 - DNA, 21 bp, Homo sapiens
tatatgtgtatgtatgtgtat

SEQ ID NO: 145279 - DNA, 23 bp, Homo sapiens
tatgtgtatatatacatatgtgt

SEQ ID NO: 145280 - DNA, 23 bp, Homo sapiens
tatgtgtatatatacatatgtgt

SEQ ID NO: 145281 - DNA, 23 bp, Homo sapiens
tatgtgtatatatacatatgtgt

SEQ ID NO: 145282 - DNA, 23 bp, Homo sapiens
tatgtgtatatatacatatgtgt

SEQ ID NO: 145283 - DNA, 23 bp, Homo sapiens
tatacgtatatatacatatgtgt

SEQ ID NO: 145284 - DNA, 20 bp, Homo sapiens
tatgtatgtgtatatataca

SEQ ID NO: 145285 - DNA, 23 bp, Homo sapiens
tgtctatgtatatgtatatatgt

SEQ ID NO: 145286 - DNA, 22 bp, Homo sapiens
tatatggatatatatcatatgt

SEQ ID NO: 145287 - DNA, 23 bp, Homo sapiens
ttgtgcatgtagtacagctacca

SEQ ID NO: 145288 - DNA, 23 bp, Homo sapiens
ataacattcattttgttgttatt

SEQ ID NO: 145289 - DNA, 21 bp, Homo sapiens
tcagctacttggatgtaatat

SEQ ID NO: 145290 - DNA, 23 bp, Homo sapiens
gccagagtctcgctctgtcaccc

SEQ ID NO: 145291 - DNA, 22 bp, Homo sapiens
tatgtgtattgtgtatgcatac

SEQ ID NO: 145292 - DNA, 22 bp, Homo sapiens
ctattctagggaaaagatttaa

SEQ ID NO: 145293 - DNA, 21 bp, Homo sapiens
gttaaatactgttttagaaat

SEQ ID NO: 145294 - DNA, 21 bp, Homo sapiens
atgtgtatatatttatatgtg

SEQ ID NO: 145295 - DNA, 23 bp, Homo sapiens
ttgctttggactgccttggttat

SEQ ID NO: 145296 - DNA, 23 bp, Homo sapiens
tatatgtattctgaatatcatat

SEQ ID NO: 145297 - DNA, 23 bp, Homo sapiens
tgagttcattgtagattctggat

SEQ ID NO: 145298 - DNA, 23 bp, Homo sapiens
tgagttcattgtagattctggat

SEQ ID NO: 145299 - DNA, 22 bp, Homo sapiens
tctttgagacggagtctggctc

SEQ ID NO: 145300 - DNA, 23 bp, Homo sapiens
tatatgcatatgtatatgtgtgt

SEQ ID NO: 145301 - DNA, 23 bp, Homo sapiens
tggagtctcactctgtcacccag

SEQ ID NO: 145302 - DNA, 23 bp, Homo sapiens
gtgtgtgtgtgtatgtagataga

SEQ ID NO: 145303 - DNA, 23 bp, Homo sapiens
agatctgatggttttataagggg

SEQ ID NO: 145304 - DNA, 23 bp, Homo sapiens
tgaattctcactctgtcactcag

SEQ ID NO: 145305 - DNA, 23 bp, Homo sapiens
tgagttcattgtagattctggat

SEQ ID NO: 145306 - DNA, 23 bp, Homo sapiens
tgagttcattgtagattctggat

SEQ ID NO: 145307 - DNA, 23 bp, Homo sapiens
aaatatgtatatgtatatatgtg

SEQ ID NO: 145308 - DNA, 20 bp, Homo sapiens
atatctatttgatttagttt

SEQ ID NO: 145309 - DNA, 23 bp, Homo sapiens
gggtctcactctgtcactctgtt

SEQ ID NO: 145310 - DNA, 23 bp, Homo sapiens
agtagagagtgtggatagaatgt

SEQ ID NO: 145311 - DNA, 19 bp, Homo sapiens
actggtttatttaaaaatg

SEQ ID NO: 145312 - DNA, 23 bp, Homo sapiens
tgagttcattgtagattctggat

SEQ ID NO: 145313 - DNA, 23 bp, Homo sapiens
tgagttcattgtagattctggat

SEQ ID NO: 145314 - DNA, 20 bp, Homo sapiens
cactgtggaagaagctagtt

SEQ ID NO: 145315 - DNA, 23 bp, Homo sapiens
atgtatgtatgtatgtgtgtgtg

SEQ ID NO: 145316 - DNA, 20 bp, Homo sapiens
tcactgtatatatattcact

SEQ ID NO: 145317 - DNA, 23 bp, Homo sapiens
cagagtctcactctgtcacccag

SEQ ID NO: 145318 - DNA, 21 bp, Homo sapiens
atctcgctctgtcactcaggc

SEQ ID NO: 145319 - DNA, 23 bp, Homo sapiens
tgtggaatgtagtttggtgattc

SEQ ID NO: 145320 - DNA, 21 bp, Homo sapiens
agtgagagttaatattgactg

SEQ ID NO: 145321 - DNA, 19 bp, Homo sapiens
tggaaattcccatcctatg

SEQ ID NO: 145322 - DNA, 19 bp, Homo sapiens
tctcactggtttggttatt

SEQ ID NO: 145323 - DNA, 19 bp, Homo sapiens
attacaggtgaatatgttg

SEQ ID NO: 145324 - DNA, 23 bp, Homo sapiens
caatactatgttgaatagaagtg

SEQ ID NO: 145325 - DNA, 18 bp, Homo sapiens
agggtgagtttggtctat

SEQ ID NO: 145326 - DNA, 23 bp, Homo sapiens
ttttttggttccatatgaaattt

SEQ ID NO: 145327 - DNA, 23 bp, Homo sapiens
aatgtcaatggtaatttaatgag

SEQ ID NO: 145328 - DNA, 18 bp, Homo sapiens
accttgaagaaagtcttg

SEQ ID NO: 145329 - DNA, 20 bp, Homo sapiens
tggtgtatatatatatgtgt

SEQ ID NO: 145330 - DNA, 20 bp, Homo sapiens
tagtctgttagctttccgta

SEQ ID NO: 145331 - DNA, 21 bp, Homo sapiens
tgccaagctgagtggctggtt

SEQ ID NO: 145332 - DNA, 22 bp, Homo sapiens
cattggtctgtctgtctgtctg

SEQ ID NO: 145333 - DNA, 22 bp, Homo sapiens
tatacatatatgtatatatgta

SEQ ID NO: 145334 - DNA, 23 bp, Homo sapiens
agaggagtgtgagcacatggagc

SEQ ID NO: 145335 - DNA, 23 bp, Homo sapiens
gattgtgagtccaagttctattt

SEQ ID NO: 145336 - DNA, 22 bp, Homo sapiens
ttaatataagatgatgatgatg

SEQ ID NO: 145337 - DNA, 21 bp, Homo sapiens
tctcagcaacatattaggtga

SEQ ID NO: 145338 - DNA, 23 bp, Homo sapiens
ctttttgcggtctgggcttgctg

SEQ ID NO: 145339 - DNA, 22 bp, Homo sapiens
aagcccttaccccaaaaagcat

SEQ ID NO: 145340 - DNA, 22 bp, Homo sapiens
tctgcaatccctatcatacttg

SEQ ID NO: 145341 - DNA, 19 bp, Homo sapiens
agaagaaggaaggctggaa

SEQ ID NO: 145342 - DNA, 23 bp, Homo sapiens
tgagactgagtctcactctgtcg

SEQ ID NO: 145343 - DNA, 23 bp, Homo sapiens
aatggtgtaatctacatgtgagt

SEQ ID NO: 145344 - DNA, 23 bp, Homo sapiens
cactcactcactgtgactttaga

SEQ ID NO: 145345 - DNA, 20 bp, Homo sapiens
cagaggtatgtagtttgggg

SEQ ID NO: 145346 - DNA, 19 bp, Homo sapiens
ctgtctctgtttctgactc

SEQ ID NO: 145347 - DNA, 22 bp, Homo sapiens
gctgtgtttacaccattgcact

SEQ ID NO: 145348 - DNA, 23 bp, Homo sapiens
tggtgacagagcagagtgaggtc

SEQ ID NO: 145349 - DNA, 23 bp, Homo sapiens
atggagtctctctctgtcaccta

SEQ ID NO: 145350 - DNA, 21 bp, Homo sapiens
tctgtggctgtgtgatatggg

SEQ ID NO: 145351 - DNA, 22 bp, Homo sapiens
cacagcctgtcactgtcactac

SEQ ID NO: 145352 - DNA, 22 bp, Homo sapiens
tgattcttctgtgtctctcaca

SEQ ID NO: 145353 - DNA, 23 bp, Homo sapiens
gacagagtctcgctctgtcaccc

SEQ ID NO: 145354 - DNA, 21 bp, Homo sapiens
agcacctgaagctgcatcatc

SEQ ID NO: 145355 - DNA, 20 bp, Homo sapiens
tcagagaagggtgtgagctt

SEQ ID NO: 145356 - DNA, 22 bp, Homo sapiens
aagagagtgagcaaagatgacc

SEQ ID NO: 145357 - DNA, 20 bp, Homo sapiens
tttgggagaatgagtattct

SEQ ID NO: 145358 - DNA, 23 bp, Homo sapiens
gagatggagtctcactctgtcac

SEQ ID NO: 145359 - DNA, 23 bp, Homo sapiens
cttcttcctgtgtgtctgtctct

SEQ ID NO: 145360 - DNA, 23 bp, Homo sapiens
gggtctcactctgtcacccaggc

SEQ ID NO: 145361 - DNA, 23 bp, Homo sapiens
tgcagtggcatgatcttggctca

SEQ ID NO: 145362 - DNA, 23 bp, Homo sapiens
gggtctcactctgtcacccaggc

SEQ ID NO: 145363 - DNA, 20 bp, Homo sapiens
tgcagtggcatgatcttggc

SEQ ID NO: 145364 - DNA, 23 bp, Homo sapiens
ggctctctgagtgtgtgaaaggt

SEQ ID NO: 145365 - DNA, 23 bp, Homo sapiens
ctgaggaatgagattgagctcag

SEQ ID NO: 145366 - DNA, 20 bp, Homo sapiens
tgtacttccctgaccctcac

SEQ ID NO: 145367 - DNA, 23 bp, Homo sapiens
acaaggtctcactctgtcaccca

SEQ ID NO: 145368 - DNA, 23 bp, Homo sapiens
tggagtctcactctgtcacccag

SEQ ID NO: 145369 - DNA, 23 bp, Homo sapiens
taatagtgtctggaaaagaatgc

SEQ ID NO: 145370 - DNA, 23 bp, Homo sapiens
acagagtctcgctctgtcaccca

SEQ ID NO: 145371 - DNA, 18 bp, Homo sapiens
tcactgcagccttgactc

SEQ ID NO: 145372 - DNA, 23 bp, Homo sapiens
tcacagtctccctctgtgccaaa

SEQ ID NO: 145373 - DNA, 19 bp, Homo sapiens
agaggtctgagaggagagg

SEQ ID NO: 145374 - DNA, 22 bp, Homo sapiens
atcctcctcatctacactgaga

SEQ ID NO: 145375 - DNA, 23 bp, Homo sapiens
caggatcttgctctgtcactcag

SEQ ID NO: 145376 - DNA, 23 bp, Homo sapiens
tgagttcattgtagattctggat

SEQ ID NO: 145377 - DNA, 23 bp, Homo sapiens
tgagttcattgtagattctggat

SEQ ID NO: 145378 - DNA, 19 bp, Homo sapiens
cagtatctgtgttcacatt

SEQ ID NO: 145379 - DNA, 23 bp, Homo sapiens
tttttttgagatggagtctctct

SEQ ID NO: 145380 - DNA, 23 bp, Homo sapiens
gggtctcactctgtcacccaggc

SEQ ID NO: 145381 - DNA, 23 bp, Homo sapiens
gagtctcactctgtcacccaggc

SEQ ID NO: 145382 - DNA, 23 bp, Homo sapiens
atgtctggcactgtcactcaggc

SEQ ID NO: 145383 - DNA, 23 bp, Homo sapiens
tttgacagggtctctctctgtct

SEQ ID NO: 145384 - DNA, 23 bp, Homo sapiens
aagagtctcgctctgtcacccag

SEQ ID NO: 145385 - DNA, 23 bp, Homo sapiens
gagacggactctcgctctgtcac

SEQ ID NO: 145386 - DNA, 23 bp, Homo sapiens
ttcactttgtggaagatttctgt

SEQ ID NO: 145387 - DNA, 23 bp, Homo sapiens
gacagagtctcgctctgtcaccc

SEQ ID NO: 145388 - DNA, 23 bp, Homo sapiens
ttctgagacagactctcgctctg

SEQ ID NO: 145389 - DNA, 23 bp, Homo sapiens
gactcggactctggctctgttgc

SEQ ID NO: 145390 - DNA, 20 bp, Homo sapiens
atgtacctgtagttccagct

SEQ ID NO: 145391 - DNA, 22 bp, Homo sapiens
agaggttgcagtgagctgagaa

SEQ ID NO: 145392 - DNA, 23 bp, Homo sapiens
gtcagagtctcgctctgtcaccc

SEQ ID NO: 145393 - DNA, 19 bp, Homo sapiens
tgggacttgagttaggctt

SEQ ID NO: 145394 - DNA, 22 bp, Homo sapiens
tgtgatcatagatcactgtaag

SEQ ID NO: 145395 - DNA, 23 bp, Homo sapiens
gattcatgatgttctaggttttt

SEQ ID NO: 145396 - DNA, 20 bp, Homo sapiens
tatgtgtgtgtgtatgttca

SEQ ID NO: 145397 - DNA, 23 bp, Homo sapiens
gacattgaatcctgctgtgcctg

SEQ ID NO: 145398 - DNA, 23 bp, Homo sapiens
ggagactctgtctgtgagtgcta

SEQ ID NO: 145399 - DNA, 23 bp, Homo sapiens
tgagttcattgtagattctggat

SEQ ID NO: 145400 - DNA, 23 bp, Homo sapiens
tgagttcattgtagattctggat

SEQ ID NO: 145401 - DNA, 23 bp, Homo sapiens
aggctctctgcctctgagcctca

SEQ ID NO: 145402 - DNA, 23 bp, Homo sapiens
ttcttgtagaatctgcaaaggga

SEQ ID NO: 145403 - DNA, 23 bp, Homo sapiens
tgagttcattgtagattctggat

SEQ ID NO: 145404 - DNA, 23 bp, Homo sapiens
tgagttcattgtagattctggat

SEQ ID NO: 145405 - DNA, 23 bp, Homo sapiens
tgagttcattgtagattctggat

SEQ ID NO: 145406 - DNA, 23 bp, Homo sapiens
tgagttcattgtagattctggat

SEQ ID NO: 145407 - DNA, 23 bp, Homo sapiens
cagcaaacagagcaggctcttgt

SEQ ID NO: 145408 - DNA, 23 bp, Homo sapiens
acatctcctttgtctctctgtgc

SEQ ID NO: 145409 - DNA, 23 bp, Homo sapiens
agtctctcactctgtctcccagg

SEQ ID NO: 145410 - DNA, 23 bp, Homo sapiens
atatgtgtatatgtatgtgtgtg

SEQ ID NO: 145411 - DNA, 23 bp, Homo sapiens
tgagttcattgtagattctggat

SEQ ID NO: 145412 - DNA, 23 bp, Homo sapiens
tgagttcattgtagattctggat

SEQ ID NO: 145413 - DNA, 23 bp, Homo sapiens
tatatatatgatctattatatgt

SEQ ID NO: 145414 - DNA, 23 bp, Homo sapiens
tatatgtgtgtatatctatacac

SEQ ID NO: 145415 - DNA, 23 bp, Homo sapiens
atctatctgtctctctgtctgtc

SEQ ID NO: 145416 - DNA, 23 bp, Homo sapiens
tgagttcattgtagattctggat

SEQ ID NO: 145417 - DNA, 23 bp, Homo sapiens
tgagttcattgtagattctggat

SEQ ID NO: 145418 - DNA, 23 bp, Homo sapiens
tgagttcattgtagattctggat

SEQ ID NO: 145419 - DNA, 23 bp, Homo sapiens
tgagttcattgtagattctggat

SEQ ID NO: 145420 - DNA, 22 bp, Homo sapiens
caagtcactgcagtctctgtct

SEQ ID NO: 145421 - DNA, 21 bp, Homo sapiens
tgaggtaggaggatcacttga

SEQ ID NO: 145422 - DNA, 23 bp, Homo sapiens
tgacattctgtgactctgaacag

SEQ ID NO: 145423 - DNA, 21 bp, Homo sapiens
ctgaacaaagcatttgtcaga

SEQ ID NO: 145424 - DNA, 23 bp, Homo sapiens
ttttttggttccatatgaaattt

SEQ ID NO: 145425 - DNA, 23 bp, Homo sapiens
gaaagtcaatggtagcttgatag

SEQ ID NO: 145426 - DNA, 23 bp, Homo sapiens
tgagttcattgtagattctggat

SEQ ID NO: 145427 - DNA, 23 bp, Homo sapiens
tgtgaagcagaggctgtgttgag

SEQ ID NO: 145428 - DNA, 23 bp, Homo sapiens
tcacagagttaaatctttctttt

SEQ ID NO: 145429 - DNA, 23 bp, Homo sapiens
tgagttcattgtagattctggat

SEQ ID NO: 145430 - DNA, 23 bp, Homo sapiens
tgagttcattgtagattctggat

SEQ ID NO: 145431 - DNA, 23 bp, Homo sapiens
cataaattgtgaagttttcatgg

SEQ ID NO: 145432 - DNA, 23 bp, Homo sapiens
gagtctcactctgacacccaggc

SEQ ID NO: 145433 - DNA, 23 bp, Homo sapiens
tgagttcattgtagattctggat

SEQ ID NO: 145434 - DNA, 23 bp, Homo sapiens
tgagttcattgtagattctggat

SEQ ID NO: 145435 - DNA, 23 bp, Homo sapiens
tgagttcattgtagattctggat

SEQ ID NO: 145436 - DNA, 23 bp, Homo sapiens
tgagttcattgtagattctggat

SEQ ID NO: 145437 - DNA, 23 bp, Homo sapiens
tgagttcattgtagattctggat

SEQ ID NO: 145438 - DNA, 23 bp, Homo sapiens
tgagttcattgtagattctggat

SEQ ID NO: 145439 - DNA, 23 bp, Homo sapiens
aaattgcatatatacacatgtgt

SEQ ID NO: 145440 - DNA, 23 bp, Homo sapiens
tctcactgtgtatacgtgtgtgt

SEQ ID NO: 145441 - DNA, 22 bp, Homo sapiens
aaattatgtatagtgaaaccaa

SEQ ID NO: 145442 - DNA, 23 bp, Homo sapiens
aacagtggtgttggaggacctac

SEQ ID NO: 145443 - DNA, 23 bp, Homo sapiens
atgtagcgtgtgtgtatgtatat

SEQ ID NO: 145444 - DNA, 23 bp, Homo sapiens
tatatatgtgtgtgtgtgtgtat

SEQ ID NO: 145445 - DNA, 23 bp, Homo sapiens
tgtgtgtgtatatatatacagaa

SEQ ID NO: 145446 - DNA, 23 bp, Homo sapiens
tatgtgtatatatgtatatatgt

SEQ ID NO: 145447 - DNA, 23 bp, Homo sapiens
catgaggaatagaaatgttgatc

SEQ ID NO: 145448 - DNA, 23 bp, Homo sapiens
tccagacagtagacagagacaag

SEQ ID NO: 145449 - DNA, 22 bp, Homo sapiens
aagtggagatgatggagtaggg

SEQ ID NO: 145450 - DNA, 18 bp, Homo sapiens
tgagtcacctactgtatg

SEQ ID NO: 145451 - DNA, 23 bp, Homo sapiens
tttacctagcatttcttgtgatg

SEQ ID NO: 145452 - DNA, 22 bp, Homo sapiens
aaaatgctatgtaaagaaatca

SEQ ID NO: 145453 - DNA, 22 bp, Homo sapiens
tgtttttgacatggataacttt

SEQ ID NO: 145454 - DNA, 23 bp, Homo sapiens
cagagtctcactctgtcgcccag

SEQ ID NO: 145455 - DNA, 21 bp, Homo sapiens
tgtgtgtatatatatacgtat

SEQ ID NO: 145456 - DNA, 22 bp, Homo sapiens
atacgtatatatgtatatgtgt

SEQ ID NO: 145457 - DNA, 22 bp, Homo sapiens
tatgtatatatgtatatgtgtg

SEQ ID NO: 145458 - DNA, 23 bp, Homo sapiens
ctacaaatgacagttttatttat

SEQ ID NO: 145459 - DNA, 23 bp, Homo sapiens
tttgttcaacagcatgtggtatg

SEQ ID NO: 145460 - DNA, 21 bp, Homo sapiens
ttatgtgtggaataagcatgt

SEQ ID NO: 145461 - DNA, 23 bp, Homo sapiens
attacagagggtgtacattcact

SEQ ID NO: 145462 - DNA, 19 bp, Homo sapiens
atacacacacacatatatg

SEQ ID NO: 145463 - DNA, 20 bp, Homo sapiens
acacacacacatatatatat

SEQ ID NO: 145464 - DNA, 22 bp, Homo sapiens
agagatacatggatgtttagta

SEQ ID NO: 145465 - DNA, 21 bp, Homo sapiens
attagttatgcagctatggaa

SEQ ID NO: 145466 - DNA, 23 bp, Homo sapiens
atcttggatcactgcaacctctg

SEQ ID NO: 145467 - DNA, 21 bp, Homo sapiens
aaactgagtgaagttcaaccc

SEQ ID NO: 145468 - DNA, 23 bp, Homo sapiens
tgagttcattgtagattctggat

SEQ ID NO: 145469 - DNA, 23 bp, Homo sapiens
tgagttcattgtagattctggat

SEQ ID NO: 145470 - DNA, 18 bp, Homo sapiens
atccatgctacagtctgg

SEQ ID NO: 145471 - DNA, 23 bp, Homo sapiens
cagagtctcgctcactcagtgct

SEQ ID NO: 145472 - DNA, 23 bp, Homo sapiens
aagtctgagatcaaggtgtcagc

SEQ ID NO: 145473 - DNA, 19 bp, Homo sapiens
ctcagcctcctgagtagct

SEQ ID NO: 145474 - DNA, 23 bp, Homo sapiens
atagaccatgtatatagtagaca

SEQ ID NO: 145475 - DNA, 18 bp, Homo sapiens
aaacctagacctggtttg

SEQ ID NO: 145476 - DNA, 19 bp, Homo sapiens
tttcatgagcccctccagc

SEQ ID NO: 145477 - DNA, 20 bp, Homo sapiens
tgaggtaggaggatggtttg

SEQ ID NO: 145478 - DNA, 23 bp, Homo sapiens
tctgagaccagccttgactccag

SEQ ID NO: 145479 - DNA, 23 bp, Homo sapiens
ctgtagtgagctatgtttgtacc

SEQ ID NO: 145480 - DNA, 23 bp, Homo sapiens
tctgatgaagttgcttgtattgt

SEQ ID NO: 145481 - DNA, 19 bp, Homo sapiens
catgagtgagaggatccct

SEQ ID NO: 145482 - DNA, 22 bp, Homo sapiens
tctgtcagtctgtctgtccggt

SEQ ID NO: 145483 - DNA, 22 bp, Homo sapiens
tttctctccctctgtgacttgg

SEQ ID NO: 145484 - DNA, 23 bp, Homo sapiens
agaggcagagactgggctttgcg

SEQ ID NO: 145485 - DNA, 23 bp, Homo sapiens
aggtggcagctattgatgacttt

SEQ ID NO: 145486 - DNA, 23 bp, Homo sapiens
ggtctcactctgtcacccagact

SEQ ID NO: 145487 - DNA, 21 bp, Homo sapiens
attcctgtggcttgcttttgt

SEQ ID NO: 145488 - DNA, 21 bp, Homo sapiens
tgcagtgagctgagattgcac

SEQ ID NO: 145489 - DNA, 23 bp, Homo sapiens
tcggagtctcgctctgtcaccca

SEQ ID NO: 145490 - DNA, 19 bp, Homo sapiens
tgaggtaggaggatcactt

SEQ ID NO: 145491 - DNA, 19 bp, Homo sapiens
taatgtactctagttcatc

SEQ ID NO: 145492 - DNA, 21 bp, Homo sapiens
aatcagaggttttccaggggc

SEQ ID NO: 145493 - DNA, 23 bp, Homo sapiens
tctctgcctggctgcctctgagt

SEQ ID NO: 145494 - DNA, 20 bp, Homo sapiens
gcttgtcagtgttttcccat

SEQ ID NO: 145495 - DNA, 18 bp, Homo sapiens
ctgaacattcagagcact

SEQ ID NO: 145496 - DNA, 23 bp, Homo sapiens
agacagagtctcgctctgtcacc

SEQ ID NO: 145497 - DNA, 21 bp, Homo sapiens
tgggacttcaagtagcctttt

SEQ ID NO: 145498 - DNA, 21 bp, Homo sapiens
gagacaagtctcgaggtggta

SEQ ID NO: 145499 - DNA, 23 bp, Homo sapiens
agcaggttttgttgttgttgttg

SEQ ID NO: 145500 - DNA, 22 bp, Homo sapiens
ttttgagacagagtctcactct

SEQ ID NO: 145501 - DNA, 20 bp, Homo sapiens
agggtgtgagcttggacgtt

SEQ ID NO: 145502 - DNA, 21 bp, Homo sapiens
agcagtctcactctgtcaccc

SEQ ID NO: 145503 - DNA, 23 bp, Homo sapiens
tctcagtctgtctgtctttctgg

SEQ ID NO: 145504 - DNA, 19 bp, Homo sapiens
gagaggcagaggaagaggt

SEQ ID NO: 145505 - DNA, 23 bp, Homo sapiens
cctatgtgtgtctctgtatgtga

SEQ ID NO: 145506 - DNA, 19 bp, Homo sapiens
agcacactgatgggtcttg

SEQ ID NO: 145507 - DNA, 23 bp, Homo sapiens
ggctctctgtgtgtctgttattg

SEQ ID NO: 145508 - DNA, 23 bp, Homo sapiens
acagtggtatagaatactatgtg

SEQ ID NO: 145509 - DNA, 23 bp, Homo sapiens
tgagttcattgtagattctggat

SEQ ID NO: 145510 - DNA, 23 bp, Homo sapiens
tgagttcattgtagattctggat

SEQ ID NO: 145511 - DNA, 20 bp, Homo sapiens
tgaagacagccactggtagc

SEQ ID NO: 145512 - DNA, 23 bp, Homo sapiens
tatgtgtgtatatatatgtgtgt

SEQ ID NO: 145513 - DNA, 23 bp, Homo sapiens
tatgtgtgtgtatatatatgtgt

SEQ ID NO: 145514 - DNA, 19 bp, Homo sapiens
tgtgtatatatatgtgtgt

SEQ ID NO: 145515 - DNA, 23 bp, Homo sapiens
atgtgtgtatatatatgtgtgca

SEQ ID NO: 145516 - DNA, 21 bp, Homo sapiens
tatatgtgtgtatatgtgtgt

SEQ ID NO: 145517 - DNA, 23 bp, Homo sapiens
cagacagagtctcactctgtcgc

SEQ ID NO: 145518 - DNA, 19 bp, Homo sapiens
acaggaagtggggctcctt

SEQ ID NO: 145519 - DNA, 19 bp, Homo sapiens
ataaaggctcttaatctag

SEQ ID NO: 145520 - DNA, 23 bp, Homo sapiens
tcacagtccctgagtcccactat

SEQ ID NO: 145521 - DNA, 23 bp, Homo sapiens
ccctgtctgtctcagtctgtccg

SEQ ID NO: 145522 - DNA, 23 bp, Homo sapiens
actgaagtctgcagactgggaag

SEQ ID NO: 145523 - DNA, 20 bp, Homo sapiens
gagagagagagagagagtag

SEQ ID NO: 145524 - DNA, 23 bp, Homo sapiens
tttcctgatcttcctcttgtttg

SEQ ID NO: 145525 - DNA, 22 bp, Homo sapiens
tcacacaggtgtgagtgcacac

SEQ ID NO: 145526 - DNA, 21 bp, Homo sapiens
tcacacaggtgtgagtgcaca

SEQ ID NO: 145527 - DNA, 22 bp, Homo sapiens
atcacaggtgtgagtgcacact

SEQ ID NO: 145528 - DNA, 21 bp, Homo sapiens
tcacacatgtgtgagtgcaca

SEQ ID NO: 145529 - DNA, 22 bp, Homo sapiens
aagagctccttacactctagct

SEQ ID NO: 145530 - DNA, 23 bp, Homo sapiens
tgggactcagtcactcattcacc

SEQ ID NO: 145531 - DNA, 23 bp, Homo sapiens
tctgagacagagtctcgctctgt

SEQ ID NO: 145532 - DNA, 23 bp, Homo sapiens
tcagagtgtctgtgtcactggca

SEQ ID NO: 145533 - DNA, 18 bp, Homo sapiens
acctgggtagtgactgag

SEQ ID NO: 145534 - DNA, 23 bp, Homo sapiens
tttctgcttcttcatctgcactt

SEQ ID NO: 145535 - DNA, 23 bp, Homo sapiens
gactgagtctcgctctgtcaccc

SEQ ID NO: 145536 - DNA, 23 bp, Homo sapiens
cattgtctcactctgtcaccccg

SEQ ID NO: 145537 - DNA, 18 bp, Homo sapiens
tgaggtaggaggatcact

SEQ ID NO: 145538 - DNA, 23 bp, Homo sapiens
gacagggtctgtctgtcactcag

SEQ ID NO: 145539 - DNA, 23 bp, Homo sapiens
cagtgctatgttgaatggaaata

SEQ ID NO: 145540 - DNA, 23 bp, Homo sapiens
agatggagtctcactctgtcacc

SEQ ID NO: 145541 - DNA, 23 bp, Homo sapiens
tgaggtagaaggatcacttgagc

SEQ ID NO: 145542 - DNA, 19 bp, Homo sapiens
tttgtaattccagcacttt

SEQ ID NO: 145543 - DNA, 23 bp, Homo sapiens
ctgccagtctctgcctctgtctc

SEQ ID NO: 145544 - DNA, 23 bp, Homo sapiens
acgggtctcactctctcacccag

SEQ ID NO: 145545 - DNA, 23 bp, Homo sapiens
gacagagtctcgctctgtcaccc

SEQ ID NO: 145546 - DNA, 20 bp, Homo sapiens
tctctcacactctgcgtgtc

SEQ ID NO: 145547 - DNA, 18 bp, Homo sapiens
tgaatgtgctgacttttt

SEQ ID NO: 145548 - DNA, 23 bp, Homo sapiens
gagacagagtctcactctgtcgc

SEQ ID NO: 145549 - DNA, 18 bp, Homo sapiens
aggttggggaagaaggag

SEQ ID NO: 145550 - DNA, 20 bp, Homo sapiens
gtggttggaggatcacttga

SEQ ID NO: 145551 - DNA, 18 bp, Homo sapiens
tctcgatggctcaggagt

SEQ ID NO: 145552 - DNA, 23 bp, Homo sapiens
tcagactcatctgggagcagtct

SEQ ID NO: 145553 - DNA, 23 bp, Homo sapiens
aaccatgattctcaatacctttg

SEQ ID NO: 145554 - DNA, 21 bp, Homo sapiens
tgagacagtgtctcactctgt

SEQ ID NO: 145555 - DNA, 23 bp, Homo sapiens
cggagtctcactctgtcacccag

SEQ ID NO: 145556 - DNA, 23 bp, Homo sapiens
acagagtctcactctgtcgccca

SEQ ID NO: 145557 - DNA, 23 bp, Homo sapiens
ttttgaggaagaagatacctatt

SEQ ID NO: 145558 - DNA, 23 bp, Homo sapiens
atctgtattcttgaaaaggagct

SEQ ID NO: 145559 - DNA, 23 bp, Homo sapiens
acctggcatgaaacgcctgtgtt

SEQ ID NO: 145560 - DNA, 21 bp, Homo sapiens
tgagtctcactctgtcgccca

SEQ ID NO: 145561 - DNA, 23 bp, Homo sapiens
ggagtctcactctgtcactcagg

SEQ ID NO: 145562 - DNA, 23 bp, Homo sapiens
taggtctctcactctcagtagcc

SEQ ID NO: 145563 - DNA, 23 bp, Homo sapiens
ggagtctcactctgtcactcagg

SEQ ID NO: 145564 - DNA, 18 bp, Homo sapiens
ttttgagacggagtctca

SEQ ID NO: 145565 - DNA, 19 bp, Homo sapiens
attgaggggagacagcatg

SEQ ID NO: 145566 - DNA, 18 bp, Homo sapiens
ccctcactcgctcgctca

SEQ ID NO: 145567 - DNA, 18 bp, Homo sapiens
acagacactgacatggat

SEQ ID NO: 145568 - DNA, 23 bp, Homo sapiens
catgcacttgaagggttaaagac

SEQ ID NO: 145569 - DNA, 20 bp, Homo sapiens
tctcaccctcactgagttct

SEQ ID NO: 145570 - DNA, 22 bp, Homo sapiens
aagccccacttctttcctgtgt

SEQ ID NO: 145571 - DNA, 22 bp, Homo sapiens
tcactctataaacacagcaggt

SEQ ID NO: 145572 - DNA, 23 bp, Homo sapiens
atgtgtgtgactcacagcctctc

SEQ ID NO: 145573 - DNA, 20 bp, Homo sapiens
gtctcactctgtcgctcagg

SEQ ID NO: 145574 - DNA, 20 bp, Homo sapiens
ggaggcctggatctctctgc

SEQ ID NO: 145575 - DNA, 23 bp, Homo sapiens
attctggtatatatatatgtgta

SEQ ID NO: 145576 - DNA, 19 bp, Homo sapiens
atgtatatatatatgtgta

SEQ ID NO: 145577 - DNA, 23 bp, Homo sapiens
tatatgtatatatatatgtgtgt

SEQ ID NO: 145578 - DNA, 21 bp, Homo sapiens
atatatgtatatatatatgtg

SEQ ID NO: 145579 - DNA, 23 bp, Homo sapiens
ggctgaggtaggaggatcatttg

SEQ ID NO: 145580 - DNA, 20 bp, Homo sapiens
tgacaaactcactcactcac

SEQ ID NO: 145581 - DNA, 23 bp, Homo sapiens
tgtcaccatctctctctcgaatt

SEQ ID NO: 145582 - DNA, 23 bp, Homo sapiens
tggccaggttgtcctcccttgag

SEQ ID NO: 145583 - DNA, 19 bp, Homo sapiens
gtctcgctctgtcacccag

SEQ ID NO: 145584 - DNA, 20 bp, Homo sapiens
ttagtgtagactgtgtgctc

SEQ ID NO: 145585 - DNA, 23 bp, Homo sapiens
cccagagtctcgctctgtcaccc

SEQ ID NO: 145586 - DNA, 20 bp, Homo sapiens
ggagtctcactctgtcgctc

SEQ ID NO: 145587 - DNA, 20 bp, Homo sapiens
ttgaagtgtgacaagggatg

SEQ ID NO: 145588 - DNA, 23 bp, Homo sapiens
tgagtctctccccttcttctctg

SEQ ID NO: 145589 - DNA, 22 bp, Homo sapiens
ctctgtctctgtccctctgggc

SEQ ID NO: 145590 - DNA, 23 bp, Homo sapiens
tgtctgtcttgctctctgtcttg

SEQ ID NO: 145591 - DNA, 23 bp, Homo sapiens
ctctgggactctcagactctgcc

SEQ ID NO: 145592 - DNA, 23 bp, Homo sapiens
tgtctggctcagtgcttcccaaa

SEQ ID NO: 145593 - DNA, 23 bp, Homo sapiens
cctcactctgggtgagaccttgg

SEQ ID NO: 145594 - DNA, 23 bp, Homo sapiens
attctgaccctcagtcttctcat

SEQ ID NO: 145595 - DNA, 21 bp, Homo sapiens
acacagccaggtttgatgagc

SEQ ID NO: 145596 - DNA, 22 bp, Homo sapiens
tgaatggatggatggatggatg

SEQ ID NO: 145597 - DNA, 23 bp, Homo sapiens
cctttactcatgtcattcccttt

SEQ ID NO: 145598 - DNA, 23 bp, Homo sapiens
tggagagagaactctgactgcac

SEQ ID NO: 145599 - DNA, 23 bp, Homo sapiens
agtggttactgtggaggaggagg

SEQ ID NO: 145600 - DNA, 23 bp, Homo sapiens
tgtgacgctgtctgtctccctgt

SEQ ID NO: 145601 - DNA, 23 bp, Homo sapiens
tattagggtgggctaaacatctg

SEQ ID NO: 145602 - DNA, 23 bp, Homo sapiens
gacagtctcgctctgtcacccag

SEQ ID NO: 145603 - DNA, 19 bp, Homo sapiens
gtgttcctctctctgtctc

SEQ ID NO: 145604 - DNA, 20 bp, Homo sapiens
agagacttgagagttggtcg

SEQ ID NO: 145605 - DNA, 18 bp, Homo sapiens
tgtctgtctctctgtctc

SEQ ID NO: 145606 - DNA, 23 bp, Homo sapiens
tctgagccactgtctctccatgt

SEQ ID NO: 145607 - DNA, 22 bp, Homo sapiens
ctgtaattcctgcactttgtga

SEQ ID NO: 145608 - DNA, 23 bp, Homo sapiens
ctctctgtgtgtctgtgtcctca

SEQ ID NO: 145609 - DNA, 22 bp, Homo sapiens
cctcagcctcactctctctgtg

SEQ ID NO: 145610 - DNA, 21 bp, Homo sapiens
tttgctaatgtatatttattc

SEQ ID NO: 145611 - DNA, 21 bp, Homo sapiens
tttcagaagacagtgtggcct

SEQ ID NO: 145612 - DNA, 23 bp, Homo sapiens
ccctgggtctgtctgtgggtcac

SEQ ID NO: 145613 - DNA, 20 bp, Homo sapiens
gctctgcattgcttttgtag

SEQ ID NO: 145614 - DNA, 23 bp, Homo sapiens
cggagtctcactctgtcacccag

SEQ ID NO: 145615 - DNA, 19 bp, Homo sapiens
acgtatatatatgtgtata

SEQ ID NO: 145616 - DNA, 21 bp, Homo sapiens
ctcatggtctctctctctcat

SEQ ID NO: 145617 - DNA, 23 bp, Homo sapiens
gagagagagtccatctggagcag

SEQ ID NO: 145618 - DNA, 19 bp, Homo sapiens
tgagtcaagttagagagct

SEQ ID NO: 145619 - DNA, 23 bp, Homo sapiens
gtacactcactctgatattggaa

SEQ ID NO: 145620 - DNA, 23 bp, Homo sapiens
tgagccccaaagtttgaggttac

SEQ ID NO: 145621 - DNA, 23 bp, Homo sapiens
tggcagatgatgcagctgctcct

SEQ ID NO: 145622 - DNA, 23 bp, Homo sapiens
gagaccctgtctctctctttttt

SEQ ID NO: 145623 - DNA, 23 bp, Homo sapiens
tcaccttcttggttgttgagttt

SEQ ID NO: 145624 - DNA, 23 bp, Homo sapiens
tcagagcctctctccgtctctcc

SEQ ID NO: 145625 - DNA, 23 bp, Homo sapiens
gcctctgtgtgtctgtgcctggg

SEQ ID NO: 145626 - DNA, 23 bp, Homo sapiens
gggtctcactctgtcactcaggc

SEQ ID NO: 145627 - DNA, 18 bp, Homo sapiens
aaaaagtcagtctcttct

SEQ ID NO: 145628 - DNA, 23 bp, Homo sapiens
tgactaaatgcaatgtggtaccc

SEQ ID NO: 145629 - DNA, 23 bp, Homo sapiens
aaaaacagcaccttctactgact

SEQ ID NO: 145630 - DNA, 21 bp, Homo sapiens
tgagccacacactgcctctca

SEQ ID NO: 145631 - DNA, 23 bp, Homo sapiens
aggctgtcagatgggtgtgagca

SEQ ID NO: 145632 - DNA, 20 bp, Homo sapiens
actgaggtctggctccaggt

SEQ ID NO: 145633 - DNA, 22 bp, Homo sapiens
tatgactctggagccaagccac

SEQ ID NO: 145634 - DNA, 23 bp, Homo sapiens
agcctgaccttgtctgtctctgt

SEQ ID NO: 145635 - DNA, 23 bp, Homo sapiens
cagggtccgtctgtctgtccatc

SEQ ID NO: 145636 - DNA, 21 bp, Homo sapiens
tctatctatatatcgatatct

SEQ ID NO: 145637 - DNA, 23 bp, Homo sapiens
tatagatagatatagatatgtat

SEQ ID NO: 145638 - DNA, 21 bp, Homo sapiens
tagaccatacgtatacagtta

SEQ ID NO: 145639 - DNA, 23 bp, Homo sapiens
aggctcactgtgtctgtgtatgt

SEQ ID NO: 145640 - DNA, 23 bp, Homo sapiens
gacagagtctcgctctgtcaccc

SEQ ID NO: 145641 - DNA, 23 bp, Homo sapiens
agatggagtctcactctgtcacc

SEQ ID NO: 145642 - DNA, 23 bp, Homo sapiens
tgagacggagtctcgctctgtca

SEQ ID NO: 145643 - DNA, 23 bp, Homo sapiens
taagacagtggctatgatgactg

SEQ ID NO: 145644 - DNA, 23 bp, Homo sapiens
agcctcagtctctcagttattcc

SEQ ID NO: 145645 - DNA, 23 bp, Homo sapiens
agctgagtgcctgagtccctgtc

SEQ ID NO: 145646 - DNA, 23 bp, Homo sapiens
gagatggagtctcactctgtcac

SEQ ID NO: 145647 - DNA, 22 bp, Homo sapiens
gaagacttgtgattgtgttctg

SEQ ID NO: 145648 - DNA, 23 bp, Homo sapiens
tcacaagctatttctgtataagc

SEQ ID NO: 145649 - DNA, 20 bp, Homo sapiens
gaggtgggaggatgaattga

SEQ ID NO: 145650 - DNA, 19 bp, Homo sapiens
tggttctgcaagttctcta

SEQ ID NO: 145651 - DNA, 23 bp, Homo sapiens
atgcatatatgtatgtatatata

SEQ ID NO: 145652 - DNA, 23 bp, Homo sapiens
ctgtgaatctcagtgtttctctt

SEQ ID NO: 145653 - DNA, 21 bp, Homo sapiens
tctcactctgtcacccaggct

SEQ ID NO: 145654 - DNA, 23 bp, Homo sapiens
agagagagagagagttttgaagc

SEQ ID NO: 145655 - DNA, 18 bp, Homo sapiens
aagctgctatgcaaaatt

SEQ ID NO: 145656 - DNA, 23 bp, Homo sapiens
tcagtcctattctaagcttacag

SEQ ID NO: 145657 - DNA, 23 bp, Homo sapiens
tgagttcattgtagattctggat

SEQ ID NO: 145658 - DNA, 23 bp, Homo sapiens
tgagttcattgtagattctggat

SEQ ID NO: 145659 - DNA, 22 bp, Homo sapiens
ctgtgggtctgagagggacaga

SEQ ID NO: 145660 - DNA, 21 bp, Homo sapiens
tgagttcatcatctgttactg

SEQ ID NO: 145661 - DNA, 22 bp, Homo sapiens
ccagagagaagtcagcctggag

SEQ ID NO: 145662 - DNA, 23 bp, Homo sapiens
tgagttcattgtagattctggat

SEQ ID NO: 145663 - DNA, 23 bp, Homo sapiens
tgagttcattgtagattctggat

SEQ ID NO: 145664 - DNA, 18 bp, Homo sapiens
cagtggctcacatcccag

SEQ ID NO: 145665 - DNA, 23 bp, Homo sapiens
tgaggtagaaggatcatttgaac

SEQ ID NO: 145666 - DNA, 20 bp, Homo sapiens
tagtgtgttgtgggaagtca

SEQ ID NO: 145667 - DNA, 23 bp, Homo sapiens
ctgggtcttcattttgtcatctg

SEQ ID NO: 145668 - DNA, 23 bp, Homo sapiens
tctcaggcagtctcactctctct

SEQ ID NO: 145669 - DNA, 20 bp, Homo sapiens
atgtgtatatgtgtatatct

SEQ ID NO: 145670 - DNA, 23 bp, Homo sapiens
gacagtctcgctctgtcacccag

SEQ ID NO: 145671 - DNA, 23 bp, Homo sapiens
cctctgtggctctctggcagtct

SEQ ID NO: 145672 - DNA, 22 bp, Homo sapiens
tgtcgcccagattatttagggt

SEQ ID NO: 145673 - DNA, 19 bp, Homo sapiens
tatgtggaagagctggtgg

SEQ ID NO: 145674 - DNA, 23 bp, Homo sapiens
tgagtcttgcctgtgacagatta

SEQ ID NO: 145675 - DNA, 21 bp, Homo sapiens
ctctggctgtcacagggcctg

SEQ ID NO: 145676 - DNA, 22 bp, Homo sapiens
acaggggcagtgttgctgcacg

SEQ ID NO: 145677 - DNA, 23 bp, Homo sapiens
ctccctcacacagtgtaggctgt

SEQ ID NO: 145678 - DNA, 21 bp, Homo sapiens
tcagggtctaactcactctgt

SEQ ID NO: 145679 - DNA, 23 bp, Homo sapiens
tgcagtggcatgatcttggctca

SEQ ID NO: 145680 - DNA, 23 bp, Homo sapiens
tctcacacactctcttcctggga

SEQ ID NO: 145681 - DNA, 22 bp, Homo sapiens
aggtcagaagtttgagaccagt

SEQ ID NO: 145682 - DNA, 21 bp, Homo sapiens
tggcaaaactctgtctctact

SEQ ID NO: 145683 - DNA, 20 bp, Homo sapiens
tgaggtaggaggatcacttg

SEQ ID NO: 145684 - DNA, 18 bp, Homo sapiens
acctcctttattttaggc

SEQ ID NO: 145685 - DNA, 23 bp, Homo sapiens
tacagaatcaggaactcattgtc

SEQ ID NO: 145686 - DNA, 23 bp, Homo sapiens
tcactctgtccctcagtcaggcc

SEQ ID NO: 145687 - DNA, 23 bp, Homo sapiens
gacagagtctccctctgtcaccc

SEQ ID NO: 145688 - DNA, 18 bp, Homo sapiens
tcccactctgagtgtagt

SEQ ID NO: 145689 - DNA, 20 bp, Homo sapiens
tctctctctctctgtactga

SEQ ID NO: 145690 - DNA, 18 bp, Homo sapiens
atagagaggtatggtaat

SEQ ID NO: 145691 - DNA, 23 bp, Homo sapiens
gggtctcactctgtcacccaggc

SEQ ID NO: 145692 - DNA, 21 bp, Homo sapiens
gagtctattctgccactgtga

SEQ ID NO: 145693 - DNA, 23 bp, Homo sapiens
atgtgtgtgtgtatatgtatgtc

SEQ ID NO: 145694 - DNA, 22 bp, Homo sapiens
aagtgaggagtcagaggacaca

SEQ ID NO: 145695 - DNA, 23 bp, Homo sapiens
ctgagtctcactgtgtcgcccag

SEQ ID NO: 145696 - DNA, 19 bp, Homo sapiens
tgaggtaggaggatcaatt

SEQ ID NO: 145697 - DNA, 23 bp, Homo sapiens
gtgagtgactgtgtccctgtcac

SEQ ID NO: 145698 - DNA, 23 bp, Homo sapiens
tctctggatctcgattgtctcat

SEQ ID NO: 145699 - DNA, 21 bp, Homo sapiens
gacttaagagagtctgagctg

SEQ ID NO: 145700 - DNA, 23 bp, Homo sapiens
tgagttcattgtagattctggat

SEQ ID NO: 145701 - DNA, 23 bp, Homo sapiens
tgagttcattgtagattctggat

SEQ ID NO: 145702 - DNA, 23 bp, Homo sapiens
atacatatacatatgtatgtgtg

SEQ ID NO: 145703 - DNA, 21 bp, Homo sapiens
tgcctggctttgggagtgaag

SEQ ID NO: 145704 - DNA, 23 bp, Homo sapiens
ctcagcgtctctcccagcctcag

SEQ ID NO: 145705 - DNA, 18 bp, Homo sapiens
acagtacagaactgggtg

SEQ ID NO: 145706 - DNA, 23 bp, Homo sapiens
atcactgtcctctctctgtctcg

SEQ ID NO: 145707 - DNA, 23 bp, Homo sapiens
ttctcactgtctgacacaaagtg

SEQ ID NO: 145708 - DNA, 19 bp, Homo sapiens
tatgtatatgtatgtgtat

SEQ ID NO: 145709 - DNA, 23 bp, Homo sapiens
tatatgtatatgtatgtgtgtgt

SEQ ID NO: 145710 - DNA, 23 bp, Homo sapiens
atatatgtatatgtatatgtgtg

SEQ ID NO: 145711 - DNA, 21 bp, Homo sapiens
cacacacatatatatatgtat

SEQ ID NO: 145712 - DNA, 18 bp, Homo sapiens
cctagagtagagagtttc

SEQ ID NO: 145713 - DNA, 23 bp, Homo sapiens
gtctagtgggtaatttctgacct

SEQ ID NO: 145714 - DNA, 23 bp, Homo sapiens
accttttgtgtggaaagttcact

SEQ ID NO: 145715 - DNA, 22 bp, Homo sapiens
tcagcccctgtgtctctggctc

SEQ ID NO: 145716 - DNA, 23 bp, Homo sapiens
gggtctcactctgtcacccaggc

SEQ ID NO: 145717 - DNA, 23 bp, Homo sapiens
cagctctgaaactctctctctca

SEQ ID NO: 145718 - DNA, 21 bp, Homo sapiens
actggaattacttcactcagt

SEQ ID NO: 145719 - DNA, 23 bp, Homo sapiens
atgagctaggttttgttgcagta

SEQ ID NO: 145720 - DNA, 20 bp, Homo sapiens
aaattatgtagtatccacaa

SEQ ID NO: 145721 - DNA, 23 bp, Homo sapiens
taactcagcctgcataggagtct

SEQ ID NO: 145722 - DNA, 23 bp, Homo sapiens
atacacacacacatacatgaatc

SEQ ID NO: 145723 - DNA, 20 bp, Homo sapiens
tgtgtgtgtgtgtgtgtgtg

SEQ ID NO: 145724 - DNA, 21 bp, Homo sapiens
agccctcgctctctctgggtg

SEQ ID NO: 145725 - DNA, 23 bp, Homo sapiens
tgaggcagagattgcagtgagca

SEQ ID NO: 145726 - DNA, 23 bp, Homo sapiens
tgcacttcagcctgggtgacaga

SEQ ID NO: 145727 - DNA, 23 bp, Homo sapiens
taaagttcatctgcccctgctgt

SEQ ID NO: 145728 - DNA, 23 bp, Homo sapiens
ttttagttcctttcctagtgttt

SEQ ID NO: 145729 - DNA, 22 bp, Homo sapiens
tgtatatgtatgtatatgtgtg

SEQ ID NO: 145730 - DNA, 23 bp, Homo sapiens
atatgtgcatatatatgcataaa

SEQ ID NO: 145731 - DNA, 22 bp, Homo sapiens
tatgtgtatatatgtacagata

SEQ ID NO: 145732 - DNA, 23 bp, Homo sapiens
aatatgtatatatatgaatgtgt

SEQ ID NO: 145733 - DNA, 23 bp, Homo sapiens
atatggtatgtatgcatgtgtgt

SEQ ID NO: 145734 - DNA, 23 bp, Homo sapiens
tacatatacatacatgtatacag

SEQ ID NO: 145735 - DNA, 23 bp, Homo sapiens
agtgtgtgtgtgtgtatctacat

SEQ ID NO: 145736 - DNA, 23 bp, Homo sapiens
tgagttcattgtagattctggat

SEQ ID NO: 145737 - DNA, 23 bp, Homo sapiens
tgagttcattgtagattctggat

SEQ ID NO: 145738 - DNA, 23 bp, Homo sapiens
tcagtcagtcagtaaaggcactc

SEQ ID NO: 145739 - DNA, 23 bp, Homo sapiens
tatgaaactggttaatttttgca

SEQ ID NO: 145740 - DNA, 21 bp, Homo sapiens
tatatatgtgtatgtatatgt

SEQ ID NO: 145741 - DNA, 19 bp, Homo sapiens
tatacatacatatacaata

SEQ ID NO: 145742 - DNA, 23 bp, Homo sapiens
aggtgctcactgtcagctaattt

SEQ ID NO: 145743 - DNA, 23 bp, Homo sapiens
tatggaatgtatagaagacataa

SEQ ID NO: 145744 - DNA, 23 bp, Homo sapiens
agtttaagcaactaaatcttgtc

SEQ ID NO: 145745 - DNA, 22 bp, Homo sapiens
tatatgaatatatatatgagag

SEQ ID NO: 145746 - DNA, 19 bp, Homo sapiens
tatttctatacatgtttat

SEQ ID NO: 145747 - DNA, 23 bp, Homo sapiens
tgtgtaaacatgcttatatatac

SEQ ID NO: 145748 - DNA, 23 bp, Homo sapiens
tatgtctgagtatatctatatgt

SEQ ID NO: 145749 - DNA, 22 bp, Homo sapiens
agagtctcgctctgtcacccag

SEQ ID NO: 145750 - DNA, 23 bp, Homo sapiens
aagggtagtctgctgcatgtttc

SEQ ID NO: 145751 - DNA, 23 bp, Homo sapiens
tgtgggtgtgtgtctgtgcatgt

SEQ ID NO: 145752 - DNA, 22 bp, Homo sapiens
tctggcttgcaaagccactctt

SEQ ID NO: 145753 - DNA, 22 bp, Homo sapiens
agagtacaagcagtgatcaaat

SEQ ID NO: 145754 - DNA, 23 bp, Homo sapiens
tatgcatatgtgtgtgtgtgtat

SEQ ID NO: 145755 - DNA, 19 bp, Homo sapiens
acgcatatgtatatgtgtg

SEQ ID NO: 145756 - DNA, 23 bp, Homo sapiens
tgtatatgtatatgtatacgtat

SEQ ID NO: 145757 - DNA, 20 bp, Homo sapiens
tatgtgtatatatatgtgtg

SEQ ID NO: 145758 - DNA, 22 bp, Homo sapiens
cctgtctcactcccactgtgcc

SEQ ID NO: 145759 - DNA, 19 bp, Homo sapiens
aaatttggctgcattggaa

SEQ ID NO: 145760 - DNA, 23 bp, Homo sapiens
tgagacagtctcactccgtcacc

SEQ ID NO: 145761 - DNA, 23 bp, Homo sapiens
caagtctgtagtgcatacctgtg

SEQ ID NO: 145762 - DNA, 19 bp, Homo sapiens
atgcatatgtgtatgtgta

SEQ ID NO: 145763 - DNA, 22 bp, Homo sapiens
atatgtgtatatatatgtgtgt

SEQ ID NO: 145764 - DNA, 23 bp, Homo sapiens
tggctcactgaaacctctgcctc

SEQ ID NO: 145765 - DNA, 23 bp, Homo sapiens
acagagtctcactctgtcgccca

SEQ ID NO: 145766 - DNA, 23 bp, Homo sapiens
cccacactgtttcagcagggtct

SEQ ID NO: 145767 - DNA, 20 bp, Homo sapiens
tctcagggtcattatgagca

SEQ ID NO: 145768 - DNA, 21 bp, Homo sapiens
caccacatggtgaatgctgaa

SEQ ID NO: 145769 - DNA, 22 bp, Homo sapiens
tgtgatctcaacatcttctatt

SEQ ID NO: 145770 - DNA, 21 bp, Homo sapiens
taggtgcatttaaatgcattt

SEQ ID NO: 145771 - DNA, 23 bp, Homo sapiens
ggtttatcaggatgttactccaa

SEQ ID NO: 145772 - DNA, 23 bp, Homo sapiens
tgagttcattgtagattctggat

SEQ ID NO: 145773 - DNA, 23 bp, Homo sapiens
tgagttcattgtagattctggat

SEQ ID NO: 145774 - DNA, 20 bp, Homo sapiens
aacacagtgaggtaatgtcc

SEQ ID NO: 145775 - DNA, 19 bp, Homo sapiens
gtgagaccccgtttctttt

SEQ ID NO: 145776 - DNA, 23 bp, Homo sapiens
tgagacagagtctcgctctgtca

SEQ ID NO: 145777 - DNA, 22 bp, Homo sapiens
gggtctcactctgtcgctcagg

SEQ ID NO: 145778 - DNA, 21 bp, Homo sapiens
cagtggtatgatcttggctca

SEQ ID NO: 145779 - DNA, 23 bp, Homo sapiens
tcagtgtgcctgtgtctggggct

SEQ ID NO: 145780 - DNA, 18 bp, Homo sapiens
ttggctcactgcaacctt

SEQ ID NO: 145781 - DNA, 22 bp, Homo sapiens
tgcaaatcaccttggtataatt

SEQ ID NO: 145782 - DNA, 23 bp, Homo sapiens
atggtgctagtcacactattagg

SEQ ID NO: 145783 - DNA, 22 bp, Homo sapiens
taataggtagtattatattgtt

SEQ ID NO: 145784 - DNA, 23 bp, Homo sapiens
tgagttcattgtagattctggat

SEQ ID NO: 145785 - DNA, 23 bp, Homo sapiens
tgagttcattgtagattctggat

SEQ ID NO: 145786 - DNA, 23 bp, Homo sapiens
tgagttcattgtagattctggat

SEQ ID NO: 145787 - DNA, 23 bp, Homo sapiens
tgagttcattgtagattctggat

SEQ ID NO: 145788 - DNA, 21 bp, Homo sapiens
agcttcctctggaaactgtat

SEQ ID NO: 145789 - DNA, 23 bp, Homo sapiens
tatctgtgtatatagataacagt

SEQ ID NO: 145790 - DNA, 23 bp, Homo sapiens
tcctgtggtaagcaagtctattg

SEQ ID NO: 145791 - DNA, 23 bp, Homo sapiens
ggtctctgtcatttgggaagtgt

SEQ ID NO: 145792 - DNA, 23 bp, Homo sapiens
taatggtgagtaattcaagaggt

SEQ ID NO: 145793 - DNA, 23 bp, Homo sapiens
acagagtctcgctctgtcgctca

SEQ ID NO: 145794 - DNA, 23 bp, Homo sapiens
gagatgatgatggacatgacgtg

SEQ ID NO: 145795 - DNA, 22 bp, Homo sapiens
tatatatgtaagatatatagtt

SEQ ID NO: 145796 - DNA, 23 bp, Homo sapiens
ttaatgtcttgtggctccaggga

SEQ ID NO: 145797 - DNA, 18 bp, Homo sapiens
agcagagattgcaatgag

SEQ ID NO: 145798 - DNA, 22 bp, Homo sapiens
ctggataatgtccaggttttag

SEQ ID NO: 145799 - DNA, 23 bp, Homo sapiens
ttgattctcagcttggttgctgt

SEQ ID NO: 145800 - DNA, 22 bp, Homo sapiens
aattccagaggttttgataggt

SEQ ID NO: 145801 - DNA, 23 bp, Homo sapiens
tgagttcattgtagattctggat

SEQ ID NO: 145802 - DNA, 23 bp, Homo sapiens
tgagttcattgtagattctggat

SEQ ID NO: 145803 - DNA, 23 bp, Homo sapiens
atacacatacatatatatgtgta

SEQ ID NO: 145804 - DNA, 23 bp, Homo sapiens
tatatacatatatgtggaccatg

SEQ ID NO: 145805 - DNA, 23 bp, Homo sapiens
tatgaatatgtatgtgtatctgg

SEQ ID NO: 145806 - DNA, 23 bp, Homo sapiens
tatacacacacacagatacacgt

SEQ ID NO: 145807 - DNA, 23 bp, Homo sapiens
ttttaagatcatcaacaggtaga

SEQ ID NO: 145808 - DNA, 22 bp, Homo sapiens
agactctctgtgtgagattttt

SEQ ID NO: 145809 - DNA, 22 bp, Homo sapiens
tacagaagaaatagtttgctgt

SEQ ID NO: 145810 - DNA, 23 bp, Homo sapiens
tatcacagtgtgtgtactctttg

SEQ ID NO: 145811 - DNA, 23 bp, Homo sapiens
ctattagagcaataacgaagaat

SEQ ID NO: 145812 - DNA, 23 bp, Homo sapiens
ggtttgaggtaggggtcagtatt

SEQ ID NO: 145813 - DNA, 23 bp, Homo sapiens
tgagttcattgtagattctggat

SEQ ID NO: 145814 - DNA, 23 bp, Homo sapiens
tgagttcattgtagattctggat

SEQ ID NO: 145815 - DNA, 23 bp, Homo sapiens
tgagttcattgtagattctggat

SEQ ID NO: 145816 - DNA, 23 bp, Homo sapiens
tgagttcattgtagattctggat

SEQ ID NO: 145817 - DNA, 23 bp, Homo sapiens
ctttcactgtattttgctgagtg

SEQ ID NO: 145818 - DNA, 23 bp, Homo sapiens
agtcactctgtcagtctcctcat

SEQ ID NO: 145819 - DNA, 18 bp, Homo sapiens
atgacagaagaaggattg

SEQ ID NO: 145820 - DNA, 23 bp, Homo sapiens
ttcacctggatgatatcttgaag

SEQ ID NO: 145821 - DNA, 23 bp, Homo sapiens
cattctctctgtctctttcaggt

SEQ ID NO: 145822 - DNA, 23 bp, Homo sapiens
tgagttcattgtagattctggat

SEQ ID NO: 145823 - DNA, 23 bp, Homo sapiens
tgagttcattgtagattctggat

SEQ ID NO: 145824 - DNA, 20 bp, Homo sapiens
taaaggaagtgaaggaatgt

SEQ ID NO: 145825 - DNA, 23 bp, Homo sapiens
tgtattgtatagttgtatataca

SEQ ID NO: 145826 - DNA, 23 bp, Homo sapiens
atatacacagacatatatgcagc

SEQ ID NO: 145827 - DNA, 21 bp, Homo sapiens
attccagctgagggtgcagat

SEQ ID NO: 145828 - DNA, 23 bp, Homo sapiens
tgagttcattgtagattctggat

SEQ ID NO: 145829 - DNA, 23 bp, Homo sapiens
tgagttcattgtagattctggat

SEQ ID NO: 145830 - DNA, 23 bp, Homo sapiens
tctgtatacatgtatatgtgtgt

SEQ ID NO: 145831 - DNA, 18 bp, Homo sapiens
tatgcgtatatatacata

SEQ ID NO: 145832 - DNA, 23 bp, Homo sapiens
tgtgtgtgtgtgtatatatacac

SEQ ID NO: 145833 - DNA, 23 bp, Homo sapiens
tgaatacagattttgaagtagaa

SEQ ID NO: 145834 - DNA, 23 bp, Homo sapiens
ctacagtgaaatctggttatgtg

SEQ ID NO: 145835 - DNA, 23 bp, Homo sapiens
atgtgtatatatatatgtatgtg

SEQ ID NO: 145836 - DNA, 23 bp, Homo sapiens
tcagagaagtgagtgtagagtct

SEQ ID NO: 145837 - DNA, 23 bp, Homo sapiens
gcaagaacaagtagtgttcagat

SEQ ID NO: 145838 - DNA, 18 bp, Homo sapiens
attaacataggaaaacat

SEQ ID NO: 145839 - DNA, 22 bp, Homo sapiens
acctctgaaatctatttttgat

SEQ ID NO: 145840 - DNA, 23 bp, Homo sapiens
aaacagcgtgactccctctctct

SEQ ID NO: 145841 - DNA, 23 bp, Homo sapiens
agcagctcagtgtctatctctga

SEQ ID NO: 145842 - DNA, 23 bp, Homo sapiens
tgagagagcacagagtggtggaa

SEQ ID NO: 145843 - DNA, 22 bp, Homo sapiens
ctttcagtgcctcattacactc

SEQ ID NO: 145844 - DNA, 23 bp, Homo sapiens
acagtctcaatgtgtctgtctct

SEQ ID NO: 145845 - DNA, 23 bp, Homo sapiens
agtgactgtaatgcaggcttcag

SEQ ID NO: 145846 - DNA, 23 bp, Homo sapiens
ttatgcctctgagactctcttct

SEQ ID NO: 145847 - DNA, 18 bp, Homo sapiens
tctgagggagggtggcag

SEQ ID NO: 145848 - DNA, 23 bp, Homo sapiens
atacacacacgtatatatgtgta

SEQ ID NO: 145849 - DNA, 23 bp, Homo sapiens
atgtgtgtgtatatatatgtgtg

SEQ ID NO: 145850 - DNA, 23 bp, Homo sapiens
gttatgctgtccctgtgtctgtg

SEQ ID NO: 145851 - DNA, 23 bp, Homo sapiens
gagacactctgtggctgtccctg

SEQ ID NO: 145852 - DNA, 23 bp, Homo sapiens
tttatctagaacatcttgccttt

SEQ ID NO: 145853 - DNA, 23 bp, Homo sapiens
tgagttcattgtagattctggat

SEQ ID NO: 145854 - DNA, 23 bp, Homo sapiens
tgagttcattgtagattctggat

SEQ ID NO: 145855 - DNA, 22 bp, Homo sapiens
tcccaagtagctgggactacag

SEQ ID NO: 145856 - DNA, 23 bp, Homo sapiens
atagattgtgggtgtcattgatt

SEQ ID NO: 145857 - DNA, 21 bp, Homo sapiens
aagttagtctgtaatccttca

SEQ ID NO: 145858 - DNA, 23 bp, Homo sapiens
tctgtcactgagtcagtgcttcc

SEQ ID NO: 145859 - DNA, 23 bp, Homo sapiens
tatgttcattttcattgcagcat

SEQ ID NO: 145860 - DNA, 23 bp, Homo sapiens
tcagatgagactcagcacattac

SEQ ID NO: 145861 - DNA, 23 bp, Homo sapiens
ggagtctcactctgtcacctagg

SEQ ID NO: 145862 - DNA, 20 bp, Homo sapiens
atatgtatataattatatgt

SEQ ID NO: 145863 - DNA, 19 bp, Homo sapiens
gtatatatttatatgttga

SEQ ID NO: 145864 - DNA, 20 bp, Homo sapiens
tcactgtccctgtctatctg

SEQ ID NO: 145865 - DNA, 23 bp, Homo sapiens
gaactgtctgtgtcagtgttata

SEQ ID NO: 145866 - DNA, 23 bp, Homo sapiens
gacagagtctcgctctgtcaccc

SEQ ID NO: 145867 - DNA, 22 bp, Homo sapiens
tgtgattattttcatgtcttag

SEQ ID NO: 145868 - DNA, 20 bp, Homo sapiens
acagaaagttataaatggtg

SEQ ID NO: 145869 - DNA, 20 bp, Homo sapiens
acataggaattttaaaggta

SEQ ID NO: 145870 - DNA, 23 bp, Homo sapiens
atttggaaaggaaacttctgtct

SEQ ID NO: 145871 - DNA, 18 bp, Homo sapiens
tgcctcatttaagattca

SEQ ID NO: 145872 - DNA, 23 bp, Homo sapiens
tgagttcattgtagattctggat

SEQ ID NO: 145873 - DNA, 23 bp, Homo sapiens
tgagttcattgtagattctggat

SEQ ID NO: 145874 - DNA, 22 bp, Homo sapiens
gtatgacaaagatataccagag

SEQ ID NO: 145875 - DNA, 23 bp, Homo sapiens
tgtcaatgattccaggtatccat

SEQ ID NO: 145876 - DNA, 21 bp, Homo sapiens
cattgcatatcatcctgtagc

SEQ ID NO: 145877 - DNA, 23 bp, Homo sapiens
tgatatgttcaagaacatacatg

SEQ ID NO: 145878 - DNA, 18 bp, Homo sapiens
tatgagttcttatgaata

SEQ ID NO: 145879 - DNA, 21 bp, Homo sapiens
ttctctttgcatcagatgacc

SEQ ID NO: 145880 - DNA, 23 bp, Homo sapiens
atatgtgtgtatatgtatgtgta

SEQ ID NO: 145881 - DNA, 23 bp, Homo sapiens
tcagtgagtttctagtttcttga

SEQ ID NO: 145882 - DNA, 22 bp, Homo sapiens
tagcatatataggtacaagtat

SEQ ID NO: 145883 - DNA, 19 bp, Homo sapiens
gtatatatgtatatgtgtg

SEQ ID NO: 145884 - DNA, 20 bp, Homo sapiens
tatgatacatatattgtagt

SEQ ID NO: 145885 - DNA, 22 bp, Homo sapiens
tgttaactacaatatattgtag

SEQ ID NO: 145886 - DNA, 22 bp, Homo sapiens
gacagagtctcactctctttcc

SEQ ID NO: 145887 - DNA, 23 bp, Homo sapiens
tgtgtgtatatatatgtgtgtgt

SEQ ID NO: 145888 - DNA, 23 bp, Homo sapiens
aagaagtaggaagatttaatatc

SEQ ID NO: 145889 - DNA, 23 bp, Homo sapiens
gtgtgtgtgtatatatatagtgt

SEQ ID NO: 145890 - DNA, 23 bp, Homo sapiens
tgagttcattgtagattctggat

SEQ ID NO: 145891 - DNA, 23 bp, Homo sapiens
tgagttcattgtagattctggat

SEQ ID NO: 145892 - DNA, 23 bp, Homo sapiens
tgagttcattgtagattctggat

SEQ ID NO: 145893 - DNA, 23 bp, Homo sapiens
tgagttcattgtagattctggat

SEQ ID NO: 145894 - DNA, 23 bp, Homo sapiens
actcagagataaggcatggagag

SEQ ID NO: 145895 - DNA, 23 bp, Homo sapiens
tctgtcacactctgagttttcac

SEQ ID NO: 145896 - DNA, 23 bp, Homo sapiens
tgagaacactatttgtaagagag

SEQ ID NO: 145897 - DNA, 23 bp, Homo sapiens
tgtctctatctatagatatctat

SEQ ID NO: 145898 - DNA, 21 bp, Homo sapiens
tatagagtctattatacatgt

SEQ ID NO: 145899 - DNA, 23 bp, Homo sapiens
tatgtgtatatatatgtgtgtgt

SEQ ID NO: 145900 - DNA, 18 bp, Homo sapiens
tctggttccatatggatt

SEQ ID NO: 145901 - DNA, 22 bp, Homo sapiens
aaagtcagtggtagcttgatgg

SEQ ID NO: 145902 - DNA, 21 bp, Homo sapiens
ttacttcttcattatggatgt

SEQ ID NO: 145903 - DNA, 22 bp, Homo sapiens
taaaactgtgtattaaaaagtg

SEQ ID NO: 145904 - DNA, 18 bp, Homo sapiens
ccatatgtttcactgtac

SEQ ID NO: 145905 - DNA, 19 bp, Homo sapiens
tttttggtctaggaggtgt

SEQ ID NO: 145906 - DNA, 23 bp, Homo sapiens
tttgtatgtgcatttcttcccaa

SEQ ID NO: 145907 - DNA, 21 bp, Homo sapiens
atgatagatgtacaggtgctc

SEQ ID NO: 145908 - DNA, 23 bp, Homo sapiens
cagagactgtggagctggtactg

SEQ ID NO: 145909 - DNA, 23 bp, Homo sapiens
tgagttcattgtagattctggat

SEQ ID NO: 145910 - DNA, 23 bp, Homo sapiens
tgagttcattgtagattctggat

SEQ ID NO: 145911 - DNA, 23 bp, Homo sapiens
ttttgaaagtatttgataagtat

SEQ ID NO: 145912 - DNA, 22 bp, Homo sapiens
ataaatgtcttcttttgcaaag

SEQ ID NO: 145913 - DNA, 23 bp, Homo sapiens
tgagttcattgtagattctggat

SEQ ID NO: 145914 - DNA, 23 bp, Homo sapiens
tgagttcattgtagattctggat

SEQ ID NO: 145915 - DNA, 23 bp, Homo sapiens
tttatcagcaaggtctttgtgaa

SEQ ID NO: 145916 - DNA, 22 bp, Homo sapiens
actaactgcctggaaatgtagc

SEQ ID NO: 145917 - DNA, 20 bp, Homo sapiens
agagttaagataatcagtac

SEQ ID NO: 145918 - DNA, 18 bp, Homo sapiens
aaatctgtctgcaaaggt

SEQ ID NO: 145919 - DNA, 23 bp, Homo sapiens
ttttgctagtttgcatatgtgtg

SEQ ID NO: 145920 - DNA, 19 bp, Homo sapiens
atgtgtgtatatatatatg

SEQ ID NO: 145921 - DNA, 23 bp, Homo sapiens
gggtctcactctgtcacccaggc

SEQ ID NO: 145922 - DNA, 22 bp, Homo sapiens
aatcagtggctccctggttgcc

SEQ ID NO: 145923 - DNA, 23 bp, Homo sapiens
gtcaatatcgatatctaaggatt

SEQ ID NO: 145924 - DNA, 23 bp, Homo sapiens
ctgtaaggcctgttcagttgttt

SEQ ID NO: 145925 - DNA, 23 bp, Homo sapiens
cacacacactcacaataggcttg

SEQ ID NO: 145926 - DNA, 23 bp, Homo sapiens
tgagttcattgtagattctggat

SEQ ID NO: 145927 - DNA, 23 bp, Homo sapiens
tgagttcattgtagattctggat

SEQ ID NO: 145928 - DNA, 21 bp, Homo sapiens
ttgttctttttgcttaggatt

SEQ ID NO: 145929 - DNA, 21 bp, Homo sapiens
atacacacatatatatatgtg

SEQ ID NO: 145930 - DNA, 21 bp, Homo sapiens
tacacgtatatatacatatgt

SEQ ID NO: 145931 - DNA, 23 bp, Homo sapiens
atatgtatgtatatatacgtgta

SEQ ID NO: 145932 - DNA, 23 bp, Homo sapiens
atatgtatgtatatatacgtgta

SEQ ID NO: 145933 - DNA, 21 bp, Homo sapiens
tatacgtatatatacgtgtat

SEQ ID NO: 145934 - DNA, 20 bp, Homo sapiens
tcagtgtgtgtatatatgta

SEQ ID NO: 145935 - DNA, 21 bp, Homo sapiens
atatatgtgtgtatatgtata

SEQ ID NO: 145936 - DNA, 23 bp, Homo sapiens
acagtttcctgtttatgttgttc

SEQ ID NO: 145937 - DNA, 23 bp, Homo sapiens
tgagttcattgtagattctggat

SEQ ID NO: 145938 - DNA, 23 bp, Homo sapiens
tgagttcattgtagattctggat

SEQ ID NO: 145939 - DNA, 22 bp, Homo sapiens
atgactcagacaatatcaggaa

SEQ ID NO: 145940 - DNA, 23 bp, Homo sapiens
aatcttgcagtttgtctctgtgt

SEQ ID NO: 145941 - DNA, 19 bp, Homo sapiens
ttatctcagctatccaaca

SEQ ID NO: 145942 - DNA, 23 bp, Homo sapiens
attagaataggttttggaatgta

SEQ ID NO: 145943 - DNA, 23 bp, Homo sapiens
tgtccttgttcattcctgggtgt

SEQ ID NO: 145944 - DNA, 23 bp, Homo sapiens
acagagcagtgtgtggagactca

SEQ ID NO: 145945 - DNA, 20 bp, Homo sapiens
aaaatatatatgtatatgtg

SEQ ID NO: 145946 - DNA, 23 bp, Homo sapiens
ttctcaggcctatgccagtcatg

SEQ ID NO: 145947 - DNA, 21 bp, Homo sapiens
ttaggagtagttaagacaaac

SEQ ID NO: 145948 - DNA, 18 bp, Homo sapiens
tcccaagtagctgggact

SEQ ID NO: 145949 - DNA, 23 bp, Homo sapiens
tgagttcattgtagattctggat

SEQ ID NO: 145950 - DNA, 23 bp, Homo sapiens
tgagttcattgtagattctggat

SEQ ID NO: 145951 - DNA, 23 bp, Homo sapiens
tccctctctctgtgactttgggg

SEQ ID NO: 145952 - DNA, 23 bp, Homo sapiens
tgagttcattgtagattctggat

SEQ ID NO: 145953 - DNA, 23 bp, Homo sapiens
tgagttcattgtagattctggat

SEQ ID NO: 145954 - DNA, 23 bp, Homo sapiens
tctctgtatatgtctgtgtgcaa

SEQ ID NO: 145955 - DNA, 23 bp, Homo sapiens
aactgagttagatgttgagattg

SEQ ID NO: 145956 - DNA, 23 bp, Homo sapiens
cgaggctcactctgtcactcagg

SEQ ID NO: 145957 - DNA, 18 bp, Homo sapiens
gtgtgtgtgtgtgtgtgt

SEQ ID NO: 145958 - DNA, 18 bp, Homo sapiens
acacaacagaataccatg

SEQ ID NO: 145959 - DNA, 23 bp, Homo sapiens
tgagttcattgtagattctggat

SEQ ID NO: 145960 - DNA, 23 bp, Homo sapiens
tgagttcattgtagattctggat

SEQ ID NO: 145961 - DNA, 18 bp, Homo sapiens
tacagaagtgattaaggt

SEQ ID NO: 145962 - DNA, 23 bp, Homo sapiens
acacacacacatatacatgtgtg

SEQ ID NO: 145963 - DNA, 19 bp, Homo sapiens
tgagtatatatatatatgt

SEQ ID NO: 145964 - DNA, 22 bp, Homo sapiens
tatatctatctatatatatctc

SEQ ID NO: 145965 - DNA, 23 bp, Homo sapiens
agagagagagttatggttgtggt

SEQ ID NO: 145966 - DNA, 22 bp, Homo sapiens
gtccttttgaagtaccactgag

SEQ ID NO: 145967 - DNA, 20 bp, Homo sapiens
tgcaagattagtgttagaag

SEQ ID NO: 145968 - DNA, 18 bp, Homo sapiens
cattttttattttgctat

SEQ ID NO: 145969 - DNA, 22 bp, Homo sapiens
actgagcatttgtttccaacag

SEQ ID NO: 145970 - DNA, 23 bp, Homo sapiens
tgagttcattgtagattctggat

SEQ ID NO: 145971 - DNA, 23 bp, Homo sapiens
tgagttcattgtagattctggat

SEQ ID NO: 145972 - DNA, 23 bp, Homo sapiens
tgtcagacttgacattttgttca

SEQ ID NO: 145973 - DNA, 23 bp, Homo sapiens
aatgtcaacttgattagattgaa

SEQ ID NO: 145974 - DNA, 21 bp, Homo sapiens
aagctggaagttaagattgcc

SEQ ID NO: 145975 - DNA, 18 bp, Homo sapiens
acagacacagaaacaaat

SEQ ID NO: 145976 - DNA, 22 bp, Homo sapiens
tatgcctctcttattaaattgt

SEQ ID NO: 145977 - DNA, 23 bp, Homo sapiens
tatatatgtatatatatacatgt

SEQ ID NO: 145978 - DNA, 23 bp, Homo sapiens
tatatgtatatatacgtgtgtgt

SEQ ID NO: 145979 - DNA, 23 bp, Homo sapiens
tatatgtatatatacgtgtgtgt

SEQ ID NO: 145980 - DNA, 22 bp, Homo sapiens
tatgtgtatatatatacgtgtg

SEQ ID NO: 145981 - DNA, 23 bp, Homo sapiens
atatgtatatatatacgtgtgtg

SEQ ID NO: 145982 - DNA, 23 bp, Homo sapiens
atatgtatatatacatgtgtgtg

SEQ ID NO: 145983 - DNA, 23 bp, Homo sapiens
ccatgtctgtgtgactgagtctc

SEQ ID NO: 145984 - DNA, 20 bp, Homo sapiens
tccttgactctgtctctctc

SEQ ID NO: 145985 - DNA, 20 bp, Homo sapiens
atatctatatatgtatagac

SEQ ID NO: 145986 - DNA, 23 bp, Homo sapiens
tgaggtaattggatcacttgagc

SEQ ID NO: 145987 - DNA, 21 bp, Homo sapiens
aaggctgcagtgagtcgagat

SEQ ID NO: 145988 - DNA, 23 bp, Homo sapiens
agttcaagtgattctcctgcctc

SEQ ID NO: 145989 - DNA, 23 bp, Homo sapiens
gcctgtcatctcagcactttggt

SEQ ID NO: 145990 - DNA, 19 bp, Homo sapiens
agccaaggtgggaggattg

SEQ ID NO: 145991 - DNA, 23 bp, Homo sapiens
tctgtatctggcagtgtctgtct

SEQ ID NO: 145992 - DNA, 22 bp, Homo sapiens
tgccattgtaaggactttggat

SEQ ID NO: 145993 - DNA, 23 bp, Homo sapiens
tgagttcattgtagattctggat

SEQ ID NO: 145994 - DNA, 23 bp, Homo sapiens
tgagttcattgtagattctggat

SEQ ID NO: 145995 - DNA, 20 bp, Homo sapiens
gtgtgtgtgtgtgtgtgtgt

SEQ ID NO: 145996 - DNA, 19 bp, Homo sapiens
ataggtccattttgtctac

SEQ ID NO: 145997 - DNA, 23 bp, Homo sapiens
agatggagtctcactctgtcacc

SEQ ID NO: 145998 - DNA, 23 bp, Homo sapiens
tgagttcattgtagattctggat

SEQ ID NO: 145999 - DNA, 23 bp, Homo sapiens
tgagttcattgtagattctggat

SEQ ID NO: 146000 - DNA, 20 bp, Homo sapiens
tgcagtggcatgattccagc

SEQ ID NO: 146001 - DNA, 22 bp, Homo sapiens
atgtgtacatatagatgtgtgt

SEQ ID NO: 146002 - DNA, 20 bp, Homo sapiens
atgtgtatatatatacatgt

SEQ ID NO: 146003 - DNA, 23 bp, Homo sapiens
aaaggatgtttttgtatcatttt

SEQ ID NO: 146004 - DNA, 23 bp, Homo sapiens
tgtgtgtctctgtgtctgaattt

SEQ ID NO: 146005 - DNA, 23 bp, Homo sapiens
tgagttcattgtagattctggat

SEQ ID NO: 146006 - DNA, 23 bp, Homo sapiens
tgagttcattgtagattctggat

SEQ ID NO: 146007 - DNA, 23 bp, Homo sapiens
gctctccctgtgtctctgtccca

SEQ ID NO: 146008 - DNA, 23 bp, Homo sapiens
tcacacagtgagaaggcaactgt

SEQ ID NO: 146009 - DNA, 22 bp, Homo sapiens
tcttctgggtgtgtcaaatctc

SEQ ID NO: 146010 - DNA, 23 bp, Homo sapiens
agagtctcactctgtcacccagg

SEQ ID NO: 146011 - DNA, 23 bp, Homo sapiens
tacatgtgcaggatgtgcaggtt

SEQ ID NO: 146012 - DNA, 18 bp, Homo sapiens
tgccatggtggttagctg

SEQ ID NO: 146013 - DNA, 20 bp, Homo sapiens
acaggtcaacctattaccta

SEQ ID NO: 146014 - DNA, 23 bp, Homo sapiens
tgagttcattgtagattctggat

SEQ ID NO: 146015 - DNA, 23 bp, Homo sapiens
tgagttcattgtagattctggat

SEQ ID NO: 146016 - DNA, 23 bp, Homo sapiens
tgagttcattgtagattctggat

SEQ ID NO: 146017 - DNA, 23 bp, Homo sapiens
tgagttcattgtagattctggat

SEQ ID NO: 146018 - DNA, 22 bp, Homo sapiens
tctgtatatatgtatatgtatg

SEQ ID NO: 146019 - DNA, 21 bp, Homo sapiens
tatgtgtatgtatacgtatgt

SEQ ID NO: 146020 - DNA, 21 bp, Homo sapiens
catatgcatatgtatacgtat

SEQ ID NO: 146021 - DNA, 23 bp, Homo sapiens
gtgacaggagaaactgagctcat

SEQ ID NO: 146022 - DNA, 18 bp, Homo sapiens
taggtcttttcctggaga

SEQ ID NO: 146023 - DNA, 23 bp, Homo sapiens
agtcttcttctacaggacaagaa

SEQ ID NO: 146024 - DNA, 22 bp, Homo sapiens
aggcagtgtcattagctgattg

SEQ ID NO: 146025 - DNA, 23 bp, Homo sapiens
aggcagtgtagttagctgattgc

SEQ ID NO: 146026 - DNA, 18 bp, Homo sapiens
acacggccaggtaaaaag

SEQ ID NO: 146027 - DNA, 23 bp, Homo sapiens
ctgtcactctgtgtgtgtgtgtg

SEQ ID NO: 146028 - DNA, 23 bp, Homo sapiens
gagagttggaattttctgtggac

SEQ ID NO: 146029 - DNA, 18 bp, Homo sapiens
atgtatgtatgtatgtgt

SEQ ID NO: 146030 - DNA, 23 bp, Homo sapiens
atatgtatgtatgtatatgtatg

SEQ ID NO: 146031 - DNA, 22 bp, Homo sapiens
tgtgtatatatatatatgtgtg

SEQ ID NO: 146032 - DNA, 22 bp, Homo sapiens
agagttctagtcttcttcttct

SEQ ID NO: 146033 - DNA, 23 bp, Homo sapiens
agacagagtctcgctctgtcacc

SEQ ID NO: 146034 - DNA, 23 bp, Homo sapiens
gacagagtctcgctctgtcaccc

SEQ ID NO: 146035 - DNA, 23 bp, Homo sapiens
acagagtctcgctctgtcaccca

SEQ ID NO: 146036 - DNA, 19 bp, Homo sapiens
actgcaatgtctgcttcct

SEQ ID NO: 146037 - DNA, 23 bp, Homo sapiens
gcagaacacagggagctgtgaag

SEQ ID NO: 146038 - DNA, 23 bp, Homo sapiens
tcctagacagaacagacagaggt

SEQ ID NO: 146039 - DNA, 19 bp, Homo sapiens
cgtgccatgctagtagcag

SEQ ID NO: 146040 - DNA, 23 bp, Homo sapiens
tgagttcattgtagattctggat

SEQ ID NO: 146041 - DNA, 23 bp, Homo sapiens
tgagttcattgtagattctggat

SEQ ID NO: 146042 - DNA, 21 bp, Homo sapiens
tatatacattatatatatgtg

SEQ ID NO: 146043 - DNA, 23 bp, Homo sapiens
cctcagaactgaccacattgcct

SEQ ID NO: 146044 - DNA, 23 bp, Homo sapiens
agtcagtgcttgttcattgtgat

SEQ ID NO: 146045 - DNA, 23 bp, Homo sapiens
gttctccctgtctggctctctgt

SEQ ID NO: 146046 - DNA, 22 bp, Homo sapiens
tctgtctctatctcactctctt

SEQ ID NO: 146047 - DNA, 23 bp, Homo sapiens
taaaatgtacataacattgatac

SEQ ID NO: 146048 - DNA, 21 bp, Homo sapiens
tgaggttggaggatcacttga

SEQ ID NO: 146049 - DNA, 23 bp, Homo sapiens
accgagtctcgctctgtcaccca

SEQ ID NO: 146050 - DNA, 23 bp, Homo sapiens
tgtttggttccatatgaaattta

SEQ ID NO: 146051 - DNA, 23 bp, Homo sapiens
gtggctgctcagagcctgagaag

SEQ ID NO: 146052 - DNA, 20 bp, Homo sapiens
aaatgtatatgtatatatgt

SEQ ID NO: 146053 - DNA, 22 bp, Homo sapiens
tattatgtatatgtatacttta

SEQ ID NO: 146054 - DNA, 23 bp, Homo sapiens
tgagttcattgtagattctggat

SEQ ID NO: 146055 - DNA, 23 bp, Homo sapiens
tgagttcattgtagattctggat

SEQ ID NO: 146056 - DNA, 18 bp, Homo sapiens
tgcatggggatgcattga

SEQ ID NO: 146057 - DNA, 22 bp, Homo sapiens
aaagactgagctctaatgcact

SEQ ID NO: 146058 - DNA, 23 bp, Homo sapiens
gacagagctggatgaaatctggg

SEQ ID NO: 146059 - DNA, 18 bp, Homo sapiens
tactcctgcaatatcagc

SEQ ID NO: 146060 - DNA, 23 bp, Homo sapiens
atctgtttctgcaactgcatttg

SEQ ID NO: 146061 - DNA, 23 bp, Homo sapiens
atttctatttatgtaattctagc

SEQ ID NO: 146062 - DNA, 23 bp, Homo sapiens
atgtagagaagtgtttttgttca

SEQ ID NO: 146063 - DNA, 18 bp, Homo sapiens
cttgagattcaatctgct

SEQ ID NO: 146064 - DNA, 23 bp, Homo sapiens
tgaggtacaaggttgttaaaatg

SEQ ID NO: 146065 - DNA, 22 bp, Homo sapiens
attggagcgctacaaaaatgtg

SEQ ID NO: 146066 - DNA, 23 bp, Homo sapiens
gagtctgtctgtgactcagtgca

SEQ ID NO: 146067 - DNA, 23 bp, Homo sapiens
gtttgtgtgtgcttgaggactgt

SEQ ID NO: 146068 - DNA, 18 bp, Homo sapiens
acacacgtgtgtgtctga

SEQ ID NO: 146069 - DNA, 23 bp, Homo sapiens
ttttgtgatggtgtctcactctg

SEQ ID NO: 146070 - DNA, 23 bp, Homo sapiens
atttcataggtatatagatatgt

SEQ ID NO: 146071 - DNA, 23 bp, Homo sapiens
cttgtggtacaggaacttaaggg

SEQ ID NO: 146072 - DNA, 23 bp, Homo sapiens
actccacatctgtgagtctgtcc

SEQ ID NO: 146073 - DNA, 23 bp, Homo sapiens
gggtgtctctcagcctcagcctc

SEQ ID NO: 146074 - DNA, 23 bp, Homo sapiens
ctgtctgtctctctcagatcact

SEQ ID NO: 146075 - DNA, 23 bp, Homo sapiens
atatgtgtgtgtgtatatataca

SEQ ID NO: 146076 - DNA, 23 bp, Homo sapiens
agagtctcactctgtcacccagg

SEQ ID NO: 146077 - DNA, 23 bp, Homo sapiens
gagtctcactctgtcacccaggc

SEQ ID NO: 146078 - DNA, 23 bp, Homo sapiens
acagggtctcactctgtcaccca

SEQ ID NO: 146079 - DNA, 23 bp, Homo sapiens
tttttttatatgaggaaactaga

SEQ ID NO: 146080 - DNA, 23 bp, Homo sapiens
gggtctcactctgtcacccaggc

SEQ ID NO: 146081 - DNA, 23 bp, Homo sapiens
tttgagacaaggtctcactctgt

SEQ ID NO: 146082 - DNA, 21 bp, Homo sapiens
tcactgcagtctcagtctcct

SEQ ID NO: 146083 - DNA, 21 bp, Homo sapiens
tggtgtgaacttggcttattg

SEQ ID NO: 146084 - DNA, 23 bp, Homo sapiens
gacagagtctcgctctgtcaccc

SEQ ID NO: 146085 - DNA, 23 bp, Homo sapiens
acagagtctcgctctgtcaccca

SEQ ID NO: 146086 - DNA, 23 bp, Homo sapiens
gtcactctcagtgaccgtgacac

SEQ ID NO: 146087 - DNA, 23 bp, Homo sapiens
tgtgagtatagtgtgtggacacc

SEQ ID NO: 146088 - DNA, 18 bp, Homo sapiens
cttattttgatctcgtac

SEQ ID NO: 146089 - DNA, 23 bp, Homo sapiens
agagtctcactctgtcacccagg

SEQ ID NO: 146090 - DNA, 23 bp, Homo sapiens
gagtctcactctgtcacccaggc

SEQ ID NO: 146091 - DNA, 21 bp, Homo sapiens
tatagttacttttcctttcct

SEQ ID NO: 146092 - DNA, 18 bp, Homo sapiens
ctctctctggctctcatg

SEQ ID NO: 146093 - DNA, 21 bp, Homo sapiens
tccatgatcatgctagttgga

SEQ ID NO: 146094 - DNA, 18 bp, Homo sapiens
agctctccctcctctctg

SEQ ID NO: 146095 - DNA, 20 bp, Homo sapiens
tctggtctcctaagtgccac

SEQ ID NO: 146096 - DNA, 19 bp, Homo sapiens
tctgggagaggaactgggt

SEQ ID NO: 146097 - DNA, 23 bp, Homo sapiens
tatgtgagcctttgtgtcagtgg

SEQ ID NO: 146098 - DNA, 23 bp, Homo sapiens
catattttgtagttgatgaggag

SEQ ID NO: 146099 - DNA, 21 bp, Homo sapiens
agacagggttgaaagcattat

SEQ ID NO: 146100 - DNA, 23 bp, Homo sapiens
agagtcaagtgagacgatttgat

SEQ ID NO: 146101 - DNA, 23 bp, Homo sapiens
tctggcagagctagaattggaac

SEQ ID NO: 146102 - DNA, 19 bp, Homo sapiens
tctgactctttctgagact

SEQ ID NO: 146103 - DNA, 23 bp, Homo sapiens
gagactgagtctcactctgtcgc

SEQ ID NO: 146104 - DNA, 23 bp, Homo sapiens
atgcagactggctttgttctggg

SEQ ID NO: 146105 - DNA, 23 bp, Homo sapiens
tttgagactacagtgagcgacaa

SEQ ID NO: 146106 - DNA, 23 bp, Homo sapiens
catgtgtgggtgcctctgtgcgt

SEQ ID NO: 146107 - DNA, 23 bp, Homo sapiens
tgcttcctcactgatttgtcaca

SEQ ID NO: 146108 - DNA, 23 bp, Homo sapiens
cactgtggttttgatttgcattt

SEQ ID NO: 146109 - DNA, 21 bp, Homo sapiens
taaatgtcaattcaagttctg

SEQ ID NO: 146110 - DNA, 23 bp, Homo sapiens
gggtctcactctgtcacccaggc

SEQ ID NO: 146111 - DNA, 18 bp, Homo sapiens
ggaggaagaggttgcagt

SEQ ID NO: 146112 - DNA, 23 bp, Homo sapiens
ttctactctcagctgatgatgtc

SEQ ID NO: 146113 - DNA, 23 bp, Homo sapiens
tgtctcactgagaaaatagaagc

SEQ ID NO: 146114 - DNA, 23 bp, Homo sapiens
ggagtctcactctgtcacccagg

SEQ ID NO: 146115 - DNA, 23 bp, Homo sapiens
tggagtctcactctgtcacccag

SEQ ID NO: 146116 - DNA, 23 bp, Homo sapiens
ctctcactgtcaccctcccactg

SEQ ID NO: 146117 - DNA, 23 bp, Homo sapiens
aggaagaagacagtgagcacagc

SEQ ID NO: 146118 - DNA, 23 bp, Homo sapiens
cctgtccctctgtccgactgtcc

SEQ ID NO: 146119 - DNA, 23 bp, Homo sapiens
gtcagtgtgcaagaccatctgca

SEQ ID NO: 146120 - DNA, 23 bp, Homo sapiens
gtctgtctgtctgtctcctagtt

SEQ ID NO: 146121 - DNA, 19 bp, Homo sapiens
gttagaactaggagagcag

SEQ ID NO: 146122 - DNA, 22 bp, Homo sapiens
tctctggcttctgtctgtgtca

SEQ ID NO: 146123 - DNA, 20 bp, Homo sapiens
gggtcactgcccctctgtca

SEQ ID NO: 146124 - DNA, 23 bp, Homo sapiens
ccactcaccctctgtgcctgagt

SEQ ID NO: 146125 - DNA, 21 bp, Homo sapiens
cactggactcagagtcaggag

SEQ ID NO: 146126 - DNA, 23 bp, Homo sapiens
cctggctctgccactgtgtgact

SEQ ID NO: 146127 - DNA, 23 bp, Homo sapiens
aaggtctcactctgtcactcagg

SEQ ID NO: 146128 - DNA, 23 bp, Homo sapiens
tctgtctctctctggctgtgtct

SEQ ID NO: 146129 - DNA, 23 bp, Homo sapiens
attagtgtccttctcatttcttc

SEQ ID NO: 146130 - DNA, 18 bp, Homo sapiens
tgagagtgttcctgtctg

SEQ ID NO: 146131 - DNA, 23 bp, Homo sapiens
aactctgtttctcatgatggtgg

SEQ ID NO: 146132 - DNA, 23 bp, Homo sapiens
ctgtgtgtgagtgcctgcctgtt

SEQ ID NO: 146133 - DNA, 23 bp, Homo sapiens
tctgcctgtcactgcctctcttg

SEQ ID NO: 146134 - DNA, 23 bp, Homo sapiens
cctctcactgtgtggctctgggt

SEQ ID NO: 146135 - DNA, 23 bp, Homo sapiens
atagtcattttattcaaatgtct

SEQ ID NO: 146136 - DNA, 23 bp, Homo sapiens
atgaagtctttgaccatgcctat

SEQ ID NO: 146137 - DNA, 23 bp, Homo sapiens
tgagttcattgtagattctggat

SEQ ID NO: 146138 - DNA, 23 bp, Homo sapiens
tgagttcattgtagattctggat

SEQ ID NO: 146139 - DNA, 18 bp, Homo sapiens
atctgggctcactgtctc

SEQ ID NO: 146140 - DNA, 20 bp, Homo sapiens
tacatgtgagattcatttgt

SEQ ID NO: 146141 - DNA, 22 bp, Homo sapiens
agagacaggagacagagaccac

SEQ ID NO: 146142 - DNA, 23 bp, Homo sapiens
tgtctcagtctcccagtggtcag

SEQ ID NO: 146143 - DNA, 23 bp, Homo sapiens
agtgcgtatatatacataagtgt

SEQ ID NO: 146144 - DNA, 23 bp, Homo sapiens
tgggtggctccctgtgtgtcttt

SEQ ID NO: 146145 - DNA, 22 bp, Homo sapiens
aattctgtgaaaaaaaaagtca

SEQ ID NO: 146146 - DNA, 22 bp, Homo sapiens
tggtagcttgatgagaatagca

SEQ ID NO: 146147 - DNA, 22 bp, Homo sapiens
tatgatcatgtgtgtgttactg

SEQ ID NO: 146148 - DNA, 19 bp, Homo sapiens
ttgttgttgttttgagaca

SEQ ID NO: 146149 - DNA, 23 bp, Homo sapiens
aattgctgagattacaggcatgg

SEQ ID NO: 146150 - DNA, 23 bp, Homo sapiens
tggatgtggtacttgtttgttct

SEQ ID NO: 146151 - DNA, 22 bp, Homo sapiens
atgtgtgaaattgctaatgaga

SEQ ID NO: 146152 - DNA, 23 bp, Homo sapiens
tgtgagacactgtgcctggccct

SEQ ID NO: 146153 - DNA, 23 bp, Homo sapiens
cagggtctcactctgtggctcag

SEQ ID NO: 146154 - DNA, 23 bp, Homo sapiens
tctctgtctgtctgtcttgttaa

SEQ ID NO: 146155 - DNA, 22 bp, Homo sapiens
cactctgtgtctctccctctgg

SEQ ID NO: 146156 - DNA, 23 bp, Homo sapiens
atagccactggaagacatgagcc

SEQ ID NO: 146157 - DNA, 23 bp, Homo sapiens
agacatggtggtatgcacctgtt

SEQ ID NO: 146158 - DNA, 20 bp, Homo sapiens
tgtcactcacacaaactggg

SEQ ID NO: 146159 - DNA, 19 bp, Homo sapiens
gagtcaagtgacagagcag

SEQ ID NO: 146160 - DNA, 22 bp, Homo sapiens
agttgttctgcttctgctttac

SEQ ID NO: 146161 - DNA, 23 bp, Homo sapiens
tggtagaagaaacagtggagagt

SEQ ID NO: 146162 - DNA, 23 bp, Homo sapiens
ttctcttttgttaagatagggtt

SEQ ID NO: 146163 - DNA, 23 bp, Homo sapiens
tcactctcagtcacttttgcaag

SEQ ID NO: 146164 - DNA, 22 bp, Homo sapiens
tgatcacagaaaatgattactc

SEQ ID NO: 146165 - DNA, 23 bp, Homo sapiens
ttttttggttccatatgaaattt

SEQ ID NO: 146166 - DNA, 23 bp, Homo sapiens
gactgagtctcgctctgtcaccc

SEQ ID NO: 146167 - DNA, 23 bp, Homo sapiens
tgagttcattgtagattctggat

SEQ ID NO: 146168 - DNA, 23 bp, Homo sapiens
ttgtctcactgctcttgctcctg

SEQ ID NO: 146169 - DNA, 18 bp, Homo sapiens
tataaatctgttggaagg

SEQ ID NO: 146170 - DNA, 23 bp, Homo sapiens
agaatagctctttatgtagatct

SEQ ID NO: 146171 - DNA, 23 bp, Homo sapiens
aaactagtttcttctagttctgt

SEQ ID NO: 146172 - DNA, 23 bp, Homo sapiens
tatgtgtgtgtatatgtatatat

SEQ ID NO: 146173 - DNA, 22 bp, Homo sapiens
gacgtcagtcagtttcagtgtg

SEQ ID NO: 146174 - DNA, 23 bp, Homo sapiens
tgtctgtctcactgtcacactgc

SEQ ID NO: 146175 - DNA, 23 bp, Homo sapiens
agcaagtctctctcactccatgt

SEQ ID NO: 146176 - DNA, 23 bp, Homo sapiens
accgagtctctctctctcaccca

SEQ ID NO: 146177 - DNA, 22 bp, Homo sapiens
attgtgtggttgattttagagt

SEQ ID NO: 146178 - DNA, 23 bp, Homo sapiens
agtctcagcctccctgtttcaga

SEQ ID NO: 146179 - DNA, 19 bp, Homo sapiens
tctcagtactgagtgagga

SEQ ID NO: 146180 - DNA, 23 bp, Homo sapiens
actgaaattcaggctggtctgga

SEQ ID NO: 146181 - DNA, 23 bp, Homo sapiens
gtccctctcactctgcgtgtgca

SEQ ID NO: 146182 - DNA, 23 bp, Homo sapiens
ctgaggagacagagcagagtgtc

SEQ ID NO: 146183 - DNA, 22 bp, Homo sapiens
agccagagagcagagtgagggc

SEQ ID NO: 146184 - DNA, 23 bp, Homo sapiens
tgtagtcccagctatttgtgggc

SEQ ID NO: 146185 - DNA, 20 bp, Homo sapiens
aagagggaggattgaaagag

SEQ ID NO: 146186 - DNA, 23 bp, Homo sapiens
ctgaggttctaagatgtattaat

SEQ ID NO: 146187 - DNA, 22 bp, Homo sapiens
actttctccctggaagacttta

SEQ ID NO: 146188 - DNA, 22 bp, Homo sapiens
agacagtctccctctgtcaccc

SEQ ID NO: 146189 - DNA, 19 bp, Homo sapiens
tgtctggctgcctccaacc

SEQ ID NO: 146190 - DNA, 20 bp, Homo sapiens
agtgagaagccactgagctc

SEQ ID NO: 146191 - DNA, 23 bp, Homo sapiens
tagatggagtctcactctgtcac

SEQ ID NO: 146192 - DNA, 23 bp, Homo sapiens
gtgtgtatctgtttcctctttgt

SEQ ID NO: 146193 - DNA, 23 bp, Homo sapiens
cctgtcacagagtaagcactcag

SEQ ID NO: 146194 - DNA, 22 bp, Homo sapiens
taccttgtctgcttatgttgcc

SEQ ID NO: 146195 - DNA, 23 bp, Homo sapiens
atgtgtgtgtgcatgtgtatgtg

SEQ ID NO: 146196 - DNA, 23 bp, Homo sapiens
tgtgtatgtatatgtgtgtgtgc

SEQ ID NO: 146197 - DNA, 23 bp, Homo sapiens
tgagttcattgtagattctggat

SEQ ID NO: 146198 - DNA, 23 bp, Homo sapiens
tgagttcattgtagattctggat

SEQ ID NO: 146199 - DNA, 22 bp, Homo sapiens
gagtctcgctctgtcgctcagg

SEQ ID NO: 146200 - DNA, 21 bp, Homo sapiens
tcaggagcataagtctcccag

SEQ ID NO: 146201 - DNA, 23 bp, Homo sapiens
tttatgtatatatgatgaaaatc

SEQ ID NO: 146202 - DNA, 22 bp, Homo sapiens
aaatgctgggctgggaggggga

SEQ ID NO: 146203 - DNA, 23 bp, Homo sapiens
tgagttcattgtagattctggat

SEQ ID NO: 146204 - DNA, 23 bp, Homo sapiens
tgagttcattgtagattctggat

SEQ ID NO: 146205 - DNA, 23 bp, Homo sapiens
gagtctctctctgtcacccaagc

SEQ ID NO: 146206 - DNA, 23 bp, Homo sapiens
tgagttcattgtagattctggat

SEQ ID NO: 146207 - DNA, 23 bp, Homo sapiens
tgagttcattgtagattctggat

SEQ ID NO: 146208 - DNA, 18 bp, Homo sapiens
aaagaaacatgacagaag

SEQ ID NO: 146209 - DNA, 23 bp, Homo sapiens
tgagacggtgtctcgctctgtca

SEQ ID NO: 146210 - DNA, 20 bp, Homo sapiens
ctgtactctggacatagctt

SEQ ID NO: 146211 - DNA, 18 bp, Homo sapiens
agtctatttctattcctc

SEQ ID NO: 146212 - DNA, 19 bp, Homo sapiens
aagtcaacagagagagctc

SEQ ID NO: 146213 - DNA, 20 bp, Homo sapiens
agtctcgctctgtcgctcag

SEQ ID NO: 146214 - DNA, 23 bp, Homo sapiens
agagtctcactctgtcacccagg

SEQ ID NO: 146215 - DNA, 23 bp, Homo sapiens
agacagaacagtgtgtggagaac

SEQ ID NO: 146216 - DNA, 23 bp, Homo sapiens
tgagttcattgtagattctggat

SEQ ID NO: 146217 - DNA, 23 bp, Homo sapiens
tgagttcattgtagattctggat

SEQ ID NO: 146218 - DNA, 22 bp, Homo sapiens
acacacacacatatacacgtat

SEQ ID NO: 146219 - DNA, 23 bp, Homo sapiens
tacgtgtatatatacatatgtgt

SEQ ID NO: 146220 - DNA, 23 bp, Homo sapiens
agagtctcactctgtcacccagg

SEQ ID NO: 146221 - DNA, 22 bp, Homo sapiens
gtcaccctctctctcagggttt

SEQ ID NO: 146222 - DNA, 23 bp, Homo sapiens
tgtgtgtgtgcatgtgcatgcac

SEQ ID NO: 146223 - DNA, 23 bp, Homo sapiens
tgcgtgtgcatgtgcacacagaa

SEQ ID NO: 146224 - DNA, 23 bp, Homo sapiens
cctccctctcacccagccacatt

SEQ ID NO: 146225 - DNA, 23 bp, Homo sapiens
ctgtgagacatgtgattttcttc

SEQ ID NO: 146226 - DNA, 23 bp, Homo sapiens
actgtgagtctgttattgctggc

SEQ ID NO: 146227 - DNA, 18 bp, Homo sapiens
tgtctctgtttctgtccc

SEQ ID NO: 146228 - DNA, 23 bp, Homo sapiens
gcagagagtcagaacactctggg

SEQ ID NO: 146229 - DNA, 19 bp, Homo sapiens
ggctctctctctgtgggct

SEQ ID NO: 146230 - DNA, 23 bp, Homo sapiens
tcagtgttcatggtgacttgaca

SEQ ID NO: 146231 - DNA, 19 bp, Homo sapiens
tgagactgagctcagaggg

SEQ ID NO: 146232 - DNA, 21 bp, Homo sapiens
tctctgaggaagccaaagtga

SEQ ID NO: 146233 - DNA, 22 bp, Homo sapiens
aaagcctgtgtagtatggagaa

SEQ ID NO: 146234 - DNA, 18 bp, Homo sapiens
tcttggctattcaggctc

SEQ ID NO: 146235 - DNA, 21 bp, Homo sapiens
tgtgaagaaagtcaatggtag

SEQ ID NO: 146236 - DNA, 22 bp, Homo sapiens
atgtttgtatattcctatctgt

SEQ ID NO: 146237 - DNA, 18 bp, Homo sapiens
ggaggctgagacagccct

SEQ ID NO: 146238 - DNA, 23 bp, Homo sapiens
tcagaggttaactggctgacaac

SEQ ID NO: 146239 - DNA, 18 bp, Homo sapiens
tgtgtgcatatgtttgca

SEQ ID NO: 146240 - DNA, 23 bp, Homo sapiens
tgagtgcctgtgtgtgtgtgtgt

SEQ ID NO: 146241 - DNA, 20 bp, Homo sapiens
tcaccacgaggacgtcctga

SEQ ID NO: 146242 - DNA, 23 bp, Homo sapiens
acagtgactctctctggctctgc

SEQ ID NO: 146243 - DNA, 23 bp, Homo sapiens
aggttctgagcttagctggttgt

SEQ ID NO: 146244 - DNA, 23 bp, Homo sapiens
aacctcattgagactcaggttac

SEQ ID NO: 146245 - DNA, 23 bp, Homo sapiens
acagagtctcgctctgtcaccca

SEQ ID NO: 146246 - DNA, 18 bp, Homo sapiens
tgcaacttctgcctcctg

SEQ ID NO: 146247 - DNA, 19 bp, Homo sapiens
tgacaagtgagtcagctct

SEQ ID NO: 146248 - DNA, 21 bp, Homo sapiens
tttccttatttgtaaacatga

SEQ ID NO: 146249 - DNA, 23 bp, Homo sapiens
ctgtagagtggatagatgtaagg

SEQ ID NO: 146250 - DNA, 23 bp, Homo sapiens
tggaaggatctcttgagctcagt

SEQ ID NO: 146251 - DNA, 18 bp, Homo sapiens
gcactagatggcattgtg

SEQ ID NO: 146252 - DNA, 22 bp, Homo sapiens
atatacacacatatatatgtgt

SEQ ID NO: 146253 - DNA, 23 bp, Homo sapiens
tcaagagaattgagagtgcacat

SEQ ID NO: 146254 - DNA, 23 bp, Homo sapiens
agagattcttgagtttgtggttt

SEQ ID NO: 146255 - DNA, 23 bp, Homo sapiens
tgagttcattgtagattctggat

SEQ ID NO: 146256 - DNA, 23 bp, Homo sapiens
tgagttcattgtagattctggat

SEQ ID NO: 146257 - DNA, 23 bp, Homo sapiens
gtgcgtgcgtgcctgcgtgcgtg

SEQ ID NO: 146258 - DNA, 23 bp, Homo sapiens
atctactggacatttgatgtctt

SEQ ID NO: 146259 - DNA, 23 bp, Homo sapiens
aactcaggacacatctgtctctg

SEQ ID NO: 146260 - DNA, 20 bp, Homo sapiens
agaggaaaagttttcagtct

SEQ ID NO: 146261 - DNA, 23 bp, Homo sapiens
tgtgcctctgaaaatgtcgtcca

SEQ ID NO: 146262 - DNA, 23 bp, Homo sapiens
gcatgtgtgtgcatctgcatgtg

SEQ ID NO: 146263 - DNA, 23 bp, Homo sapiens
tggagtctcactctgtcacccag

SEQ ID NO: 146264 - DNA, 22 bp, Homo sapiens
tctcagagagttgaatggggtc

SEQ ID NO: 146265 - DNA, 23 bp, Homo sapiens
tgtgtgtatgtgcctctctctct

SEQ ID NO: 146266 - DNA, 23 bp, Homo sapiens
tatgtgtgtgtatatgtatacta

SEQ ID NO: 146267 - DNA, 22 bp, Homo sapiens
tattatataggtgtgtgtgtgt

SEQ ID NO: 146268 - DNA, 21 bp, Homo sapiens
tgtgtatatatgtgtgtgtat

SEQ ID NO: 146269 - DNA, 20 bp, Homo sapiens
tcacctccttcaggaggcac

SEQ ID NO: 146270 - DNA, 21 bp, Homo sapiens
tcaccattctaactggtgtga

SEQ ID NO: 146271 - DNA, 22 bp, Homo sapiens
tcaccgtgtgcatgggcttgac

SEQ ID NO: 146272 - DNA, 23 bp, Homo sapiens
gactctgctcttgctgagacagg

SEQ ID NO: 146273 - DNA, 20 bp, Homo sapiens
tccgtctgcatcagcagctg

SEQ ID NO: 146274 - DNA, 23 bp, Homo sapiens
ttgagggtgacaagatttgagag

SEQ ID NO: 146275 - DNA, 23 bp, Homo sapiens
tgtgtctgtgtgtgtgtatgcgt

SEQ ID NO: 146276 - DNA, 19 bp, Homo sapiens
agtactagcatatatgtgt

SEQ ID NO: 146277 - DNA, 22 bp, Homo sapiens
agatgtatgttagaattgagag

SEQ ID NO: 146278 - DNA, 23 bp, Homo sapiens
gaccacactcactgagtccctgg

SEQ ID NO: 146279 - DNA, 23 bp, Homo sapiens
ctgtctctatctgtgtgtgcgta

SEQ ID NO: 146280 - DNA, 19 bp, Homo sapiens
actggggatagttaatggg

SEQ ID NO: 146281 - DNA, 22 bp, Homo sapiens
attgcctctgttgtttgctgct

SEQ ID NO: 146282 - DNA, 22 bp, Homo sapiens
cacctcactagtgagtgtgccc

SEQ ID NO: 146283 - DNA, 23 bp, Homo sapiens
tcatctcactagtgagtgtgcag

SEQ ID NO: 146284 - DNA, 23 bp, Homo sapiens
atctcacaagtgagtgtgctgct

SEQ ID NO: 146285 - DNA, 23 bp, Homo sapiens
tcatctcacaagtgagtgtgcag

SEQ ID NO: 146286 - DNA, 21 bp, Homo sapiens
atctcacaagtgagtgtgcag

SEQ ID NO: 146287 - DNA, 20 bp, Homo sapiens
atgtcacaagtgagtatgta

SEQ ID NO: 146288 - DNA, 23 bp, Homo sapiens
atgtcacaagtgagtgtgcagct

SEQ ID NO: 146289 - DNA, 23 bp, Homo sapiens
tgtgtgtggagcacctgctgtat

SEQ ID NO: 146290 - DNA, 23 bp, Homo sapiens
tgcctctgtgtcgcactgtgtct

SEQ ID NO: 146291 - DNA, 23 bp, Homo sapiens
acagtctctctgacattgcattg

SEQ ID NO: 146292 - DNA, 23 bp, Homo sapiens
tggatgacatgtctgtttgtttt

SEQ ID NO: 146293 - DNA, 18 bp, Homo sapiens
aatggacatcttagtcta

SEQ ID NO: 146294 - DNA, 23 bp, Homo sapiens
tctgtgtctgagtgactcaggct

SEQ ID NO: 146295 - DNA, 21 bp, Homo sapiens
gcctgagtgactatatcgtct

SEQ ID NO: 146296 - DNA, 23 bp, Homo sapiens
tgagttcattgtagattctggat

SEQ ID NO: 146297 - DNA, 23 bp, Homo sapiens
tgagttcattgtagattctggat

SEQ ID NO: 146298 - DNA, 23 bp, Homo sapiens
ttatatggtgtatttctaagtga

SEQ ID NO: 146299 - DNA, 21 bp, Homo sapiens
tgtcctatgagagaaaagagt

SEQ ID NO: 146300 - DNA, 21 bp, Homo sapiens
ttgagacagatctgggttggg

SEQ ID NO: 146301 - DNA, 23 bp, Homo sapiens
ccaccctgcctctgtctgtccct

SEQ ID NO: 146302 - DNA, 23 bp, Homo sapiens
atacacacacatatatatatgtg

SEQ ID NO: 146303 - DNA, 23 bp, Homo sapiens
ctcattgtggttttgatttgcat

SEQ ID NO: 146304 - DNA, 22 bp, Homo sapiens
aatgtcttcttttgagaatgag

SEQ ID NO: 146305 - DNA, 23 bp, Homo sapiens
gtgtgtgtatatgtatatgtgtg

SEQ ID NO: 146306 - DNA, 23 bp, Homo sapiens
cacacacgtgtatatatgtgtat

SEQ ID NO: 146307 - DNA, 23 bp, Homo sapiens
cacacacgtgtatatatgtgtat

SEQ ID NO: 146308 - DNA, 23 bp, Homo sapiens
cacacacgtgtatatatgtgtat

SEQ ID NO: 146309 - DNA, 23 bp, Homo sapiens
cacacacgtgtatatatgtgtat

SEQ ID NO: 146310 - DNA, 23 bp, Homo sapiens
cacacacgtgtatatatgtgtat

SEQ ID NO: 146311 - DNA, 23 bp, Homo sapiens
attatgatgatgatttcccttct

SEQ ID NO: 146312 - DNA, 22 bp, Homo sapiens
tatctgtatgtctatgtcctag

SEQ ID NO: 146313 - DNA, 23 bp, Homo sapiens
ctgacttttttttatgttattca

SEQ ID NO: 146314 - DNA, 18 bp, Homo sapiens
tgtatatatacgtgtgtc

SEQ ID NO: 146315 - DNA, 23 bp, Homo sapiens
catgtgtctatatatacatgtgt

SEQ ID NO: 146316 - DNA, 19 bp, Homo sapiens
acacacacatgctctcaca

SEQ ID NO: 146317 - DNA, 23 bp, Homo sapiens
agcaggagcagagtcagtgtctc

SEQ ID NO: 146318 - DNA, 18 bp, Homo sapiens
ctgttgaaccttccttag

SEQ ID NO: 146319 - DNA, 23 bp, Homo sapiens
tgtgaggctgagtgaagattcag

SEQ ID NO: 146320 - DNA, 23 bp, Homo sapiens
ttatgttcagaatttgtagttca

SEQ ID NO: 146321 - DNA, 23 bp, Homo sapiens
gatgttgtaactggatcacaaag

SEQ ID NO: 146322 - DNA, 23 bp, Homo sapiens
caagctggatatgtatacatcat

SEQ ID NO: 146323 - DNA, 20 bp, Homo sapiens
agtctgtatatatgctcttt

SEQ ID NO: 146324 - DNA, 18 bp, Homo sapiens
tcagttgtttctatcctt

SEQ ID NO: 146325 - DNA, 21 bp, Homo sapiens
tttgacagacaacggtagtct

SEQ ID NO: 146326 - DNA, 23 bp, Homo sapiens
cgtacatagtcactgcatgtata

SEQ ID NO: 146327 - DNA, 20 bp, Homo sapiens
tctgggttttttttgttttt

SEQ ID NO: 146328 - DNA, 22 bp, Homo sapiens
gtctctctcagtaaaatgcaat

SEQ ID NO: 146329 - DNA, 23 bp, Homo sapiens
tgaacatggtaaactgagagagg

SEQ ID NO: 146330 - DNA, 22 bp, Homo sapiens
tgtgtggttgatcttagagtat

SEQ ID NO: 146331 - DNA, 23 bp, Homo sapiens
agccacagtatctacctcaaagt

SEQ ID NO: 146332 - DNA, 22 bp, Homo sapiens
ctctctcagtgaaggctgtctc

SEQ ID NO: 146333 - DNA, 22 bp, Homo sapiens
taatgattgctttgccaaacat

SEQ ID NO: 146334 - DNA, 22 bp, Homo sapiens
tctgacattgagttagcaagtg

SEQ ID NO: 146335 - DNA, 18 bp, Homo sapiens
aatcagtgtggcctgttt

SEQ ID NO: 146336 - DNA, 18 bp, Homo sapiens
tgtctcattttctctctc

SEQ ID NO: 146337 - DNA, 22 bp, Homo sapiens
ggtgagtctgtctgtgactgga

SEQ ID NO: 146338 - DNA, 23 bp, Homo sapiens
tccctctgagcctccctcccagc

SEQ ID NO: 146339 - DNA, 22 bp, Homo sapiens
tacactgcatatatctgtatat

SEQ ID NO: 146340 - DNA, 21 bp, Homo sapiens
tttgggactattgtggggtca

SEQ ID NO: 146341 - DNA, 23 bp, Homo sapiens
tgagttcattgtagattctggat

SEQ ID NO: 146342 - DNA, 23 bp, Homo sapiens
tgagttcattgtagattctggat

SEQ ID NO: 146343 - DNA, 21 bp, Homo sapiens
atctcggctcactgcagcctc

SEQ ID NO: 146344 - DNA, 23 bp, Homo sapiens
tgtctctgtctctgtgcttatgt

SEQ ID NO: 146345 - DNA, 18 bp, Homo sapiens
tctcacacatgcctacac

SEQ ID NO: 146346 - DNA, 21 bp, Homo sapiens
aaaatgcacatgttgtaagtg

SEQ ID NO: 146347 - DNA, 22 bp, Homo sapiens
ctgcctcccacactggctctct

SEQ ID NO: 146348 - DNA, 22 bp, Homo sapiens
tgaggtaggaggatcacttgag

SEQ ID NO: 146349 - DNA, 23 bp, Homo sapiens
gtaatctacagtgacccgtgatc

SEQ ID NO: 146350 - DNA, 22 bp, Homo sapiens
acagagtctcactctgttgcct

SEQ ID NO: 146351 - DNA, 23 bp, Homo sapiens
taggagcttttcaaatgaatctt

SEQ ID NO: 146352 - DNA, 22 bp, Homo sapiens
tttctcactggcttatgttttt

SEQ ID NO: 146353 - DNA, 23 bp, Homo sapiens
tgtgcatatatatgtgtgtgtat

SEQ ID NO: 146354 - DNA, 23 bp, Homo sapiens
tatatgtgtatatattctgctgt

SEQ ID NO: 146355 - DNA, 23 bp, Homo sapiens
ccttctgagttgacgggggactg

SEQ ID NO: 146356 - DNA, 21 bp, Homo sapiens
tcacagtcttgcactgcctgt

SEQ ID NO: 146357 - DNA, 23 bp, Homo sapiens
taaggtgtgtaatgtaatgattt

SEQ ID NO: 146358 - DNA, 23 bp, Homo sapiens
tagggttctctgcatcttggtta

SEQ ID NO: 146359 - DNA, 18 bp, Homo sapiens
accagaacaaggttttga

SEQ ID NO: 146360 - DNA, 23 bp, Homo sapiens
ttctctatgtgaagaagtgctgc

SEQ ID NO: 146361 - DNA, 23 bp, Homo sapiens
agatggagtctcgctctgtcgca

SEQ ID NO: 146362 - DNA, 19 bp, Homo sapiens
aagtgagtagagggagaag

SEQ ID NO: 146363 - DNA, 19 bp, Homo sapiens
tttgagtccgtctcacttt

SEQ ID NO: 146364 - DNA, 18 bp, Homo sapiens
catatgtatatatgtact

SEQ ID NO: 146365 - DNA, 23 bp, Homo sapiens
gtatatatatatgtatatgtgtg

SEQ ID NO: 146366 - DNA, 23 bp, Homo sapiens
tgagttcattgtagattctggat

SEQ ID NO: 146367 - DNA, 23 bp, Homo sapiens
tgagttcattgtagattctggat

SEQ ID NO: 146368 - DNA, 22 bp, Homo sapiens
ttaaaggctgaggctgaataat

SEQ ID NO: 146369 - DNA, 22 bp, Homo sapiens
tgtctcagtctctgacctcggg

SEQ ID NO: 146370 - DNA, 23 bp, Homo sapiens
gtaagtggttgatctggagttga

SEQ ID NO: 146371 - DNA, 23 bp, Homo sapiens
ttttgagacggagtcttgctctg

SEQ ID NO: 146372 - DNA, 19 bp, Homo sapiens
atgttactgtttatgtatc

SEQ ID NO: 146373 - DNA, 20 bp, Homo sapiens
actcttctcagagtgctact

SEQ ID NO: 146374 - DNA, 23 bp, Homo sapiens
aactggcatgagatagagaaagg

SEQ ID NO: 146375 - DNA, 23 bp, Homo sapiens
agaggagtcaattttatgtgtgc

SEQ ID NO: 146376 - DNA, 23 bp, Homo sapiens
tatacgtgtgtattgtgatggtg

SEQ ID NO: 146377 - DNA, 21 bp, Homo sapiens
tatatgtatatatgtatatgt

SEQ ID NO: 146378 - DNA, 23 bp, Homo sapiens
tgagttcattgtagattctggat

SEQ ID NO: 146379 - DNA, 20 bp, Homo sapiens
ctcagccaggaaatgaaggc

SEQ ID NO: 146380 - DNA, 21 bp, Homo sapiens
tgtgtatatatgtatatatgt

SEQ ID NO: 146381 - DNA, 23 bp, Homo sapiens
atgtgtatatatgtatatatgtg

SEQ ID NO: 146382 - DNA, 23 bp, Homo sapiens
tatatgtgtatatgtatatatgt

SEQ ID NO: 146383 - DNA, 23 bp, Homo sapiens
agtggtagagagaaatggtgttt

SEQ ID NO: 146384 - DNA, 23 bp, Homo sapiens
agagtctcactctgtcacccagg

SEQ ID NO: 146385 - DNA, 22 bp, Homo sapiens
attattagtttggtatggattt

SEQ ID NO: 146386 - DNA, 22 bp, Homo sapiens
tgtcagtgagagatattcgtct

SEQ ID NO: 146387 - DNA, 23 bp, Homo sapiens
tgtgtgcatatatatagtatgtt

SEQ ID NO: 146388 - DNA, 22 bp, Homo sapiens
ctcaagagtgtgagcagtgatg

SEQ ID NO: 146389 - DNA, 20 bp, Homo sapiens
tgacaactgccaaagcagaa

SEQ ID NO: 146390 - DNA, 23 bp, Homo sapiens
aagactaccattttttttcaata

SEQ ID NO: 146391 - DNA, 20 bp, Homo sapiens
acagtcctctctctctctct

SEQ ID NO: 146392 - DNA, 23 bp, Homo sapiens
tgtctgtttgctgttgatgtcaa

SEQ ID NO: 146393 - DNA, 22 bp, Homo sapiens
atgatgtccaaatataatgttg

SEQ ID NO: 146394 - DNA, 23 bp, Homo sapiens
tctgtgtgagtcactgccagtga

SEQ ID NO: 146395 - DNA, 23 bp, Homo sapiens
aaagtaattgcaggttttgctgt

SEQ ID NO: 146396 - DNA, 23 bp, Homo sapiens
taaggaaccttcattgtgttatc

SEQ ID NO: 146397 - DNA, 21 bp, Homo sapiens
ttccttgcatttgcattgtta

SEQ ID NO: 146398 - DNA, 22 bp, Homo sapiens
ttttgagaccgagtctcactct

SEQ ID NO: 146399 - DNA, 19 bp, Homo sapiens
cacctctctgtctctctgc

SEQ ID NO: 146400 - DNA, 23 bp, Homo sapiens
gacagagtctcgctctgtcaccc

SEQ ID NO: 146401 - DNA, 23 bp, Homo sapiens
gtgatgtgtgtgttatagtgggt

SEQ ID NO: 146402 - DNA, 20 bp, Homo sapiens
ggctgtgctgcaggtgctgt

SEQ ID NO: 146403 - DNA, 23 bp, Homo sapiens
tgtgagacagtctcactctgtgg

SEQ ID NO: 146404 - DNA, 18 bp, Homo sapiens
ctggccctgagtgccgtg

SEQ ID NO: 146405 - DNA, 23 bp, Homo sapiens
actgtagtttggtatctgttcag

SEQ ID NO: 146406 - DNA, 20 bp, Homo sapiens
tgagacagaatctcactctg

SEQ ID NO: 146407 - DNA, 22 bp, Homo sapiens
tgtcttcatgttcatggtcttt

SEQ ID NO: 146408 - DNA, 23 bp, Homo sapiens
tgactgagatcttggtgatagca

SEQ ID NO: 146409 - DNA, 23 bp, Homo sapiens
tgagttcattgtagattctggat

SEQ ID NO: 146410 - DNA, 23 bp, Homo sapiens
tgagttcattgtagattctggat

SEQ ID NO: 146411 - DNA, 20 bp, Homo sapiens
taccactgtggtattatggt

SEQ ID NO: 146412 - DNA, 23 bp, Homo sapiens
agctggatctttgtctgggtggt

SEQ ID NO: 146413 - DNA, 21 bp, Homo sapiens
atgtgcatatatatgtgtgtg

SEQ ID NO: 146414 - DNA, 23 bp, Homo sapiens
tgtgtgtatatatatatgtgtgt

SEQ ID NO: 146415 - DNA, 19 bp, Homo sapiens
ttcctgccaggatgatcaa

SEQ ID NO: 146416 - DNA, 19 bp, Homo sapiens
atatatgtatatgtaaatc

SEQ ID NO: 146417 - DNA, 22 bp, Homo sapiens
tagattcaccctcagattggcc

SEQ ID NO: 146418 - DNA, 23 bp, Homo sapiens
agggtggacttcgctatgtcttt

SEQ ID NO: 146419 - DNA, 23 bp, Homo sapiens
tgcaaaaggatgtatacatgtat

SEQ ID NO: 146420 - DNA, 21 bp, Homo sapiens
cttttgcatatatatacatat

SEQ ID NO: 146421 - DNA, 23 bp, Homo sapiens
tatacatatatgtgtatatgtgt

SEQ ID NO: 146422 - DNA, 23 bp, Homo sapiens
tgagttcattgtagattctggat

SEQ ID NO: 146423 - DNA, 23 bp, Homo sapiens
tgagttcattgtagattctggat

SEQ ID NO: 146424 - DNA, 18 bp, Homo sapiens
agttcttcacatccttac

SEQ ID NO: 146425 - DNA, 23 bp, Homo sapiens
cagtgtcactcagtatcatgata

SEQ ID NO: 146426 - DNA, 22 bp, Homo sapiens
tatgagcttcttactatactgg

SEQ ID NO: 146427 - DNA, 23 bp, Homo sapiens
tctgtgttttactgtctgctctt

SEQ ID NO: 146428 - DNA, 23 bp, Homo sapiens
atatgtgtgtatatatgtatgta

SEQ ID NO: 146429 - DNA, 21 bp, Homo sapiens
tactgagcaagactttctttt

SEQ ID NO: 146430 - DNA, 22 bp, Homo sapiens
tggagtctcactcagtcactca

SEQ ID NO: 146431 - DNA, 18 bp, Homo sapiens
agtgtagtggctattcac

SEQ ID NO: 146432 - DNA, 23 bp, Homo sapiens
ttctatctatatgtatatgtgtg

SEQ ID NO: 146433 - DNA, 22 bp, Homo sapiens
agaaaggttgctagaaaatgga

SEQ ID NO: 146434 - DNA, 20 bp, Homo sapiens
agagcaggaggaagagagag

SEQ ID NO: 146435 - DNA, 23 bp, Homo sapiens
tctctcagcctcactggctgcct

SEQ ID NO: 146436 - DNA, 23 bp, Homo sapiens
aaacgtttatgtttctgcatgta

SEQ ID NO: 146437 - DNA, 19 bp, Homo sapiens
actctgcctcggtctatcc

SEQ ID NO: 146438 - DNA, 19 bp, Homo sapiens
agtcactgatcttagcacg

SEQ ID NO: 146439 - DNA, 18 bp, Homo sapiens
tgagacagagtctcgctc

SEQ ID NO: 146440 - DNA, 23 bp, Homo sapiens
agtcttgctctgtctcccagact

SEQ ID NO: 146441 - DNA, 18 bp, Homo sapiens
acaggagtgagagagggc

SEQ ID NO: 146442 - DNA, 23 bp, Homo sapiens
tttcgagacagagtctggctctg

SEQ ID NO: 146443 - DNA, 23 bp, Homo sapiens
ctatgtgtctctcactggctctc

SEQ ID NO: 146444 - DNA, 23 bp, Homo sapiens
ctatcagctttatatgttgggag

SEQ ID NO: 146445 - DNA, 23 bp, Homo sapiens
acagagtctcactctgtcgccca

SEQ ID NO: 146446 - DNA, 20 bp, Homo sapiens
ttttgagacagggtctcatt

SEQ ID NO: 146447 - DNA, 23 bp, Homo sapiens
tgagttcattgtagattctggat

SEQ ID NO: 146448 - DNA, 23 bp, Homo sapiens
tgagttcattgtagattctggat

SEQ ID NO: 146449 - DNA, 23 bp, Homo sapiens
acagaagacagtcaccactgagc

SEQ ID NO: 146450 - DNA, 19 bp, Homo sapiens
tgtgaatttttatttctgt

SEQ ID NO: 146451 - DNA, 23 bp, Homo sapiens
tgagttcattgtagattctggat

SEQ ID NO: 146452 - DNA, 23 bp, Homo sapiens
tgagttcattgtagattctggat

SEQ ID NO: 146453 - DNA, 23 bp, Homo sapiens
taggaagagaaggcactctggag

SEQ ID NO: 146454 - DNA, 22 bp, Homo sapiens
aacccgtagatccgaacttgtg

SEQ ID NO: 146455 - DNA, 23 bp, Homo sapiens
tatctataggtatgtgtctgtta

SEQ ID NO: 146456 - DNA, 22 bp, Homo sapiens
tgaggtagtaggttgtatagtt

SEQ ID NO: 146457 - DNA, 23 bp, Homo sapiens
gcagccacttcatgctgctatgt

SEQ ID NO: 146458 - DNA, 22 bp, Homo sapiens
tccctgagaccctaacttgtga

SEQ ID NO: 146459 - DNA, 21 bp, Homo sapiens
tgtgtgtcatgtctgtttgtt

SEQ ID NO: 146460 - DNA, 23 bp, Homo sapiens
tttgagattgatatggctagtct

SEQ ID NO: 146461 - DNA, 23 bp, Homo sapiens
tgagttcattgtagattctggat

SEQ ID NO: 146462 - DNA, 23 bp, Homo sapiens
tgagttcattgtagattctggat

SEQ ID NO: 146463 - DNA, 21 bp, Homo sapiens
ttgagctctctgttaattgac

SEQ ID NO: 146464 - DNA, 23 bp, Homo sapiens
ttgaaaagtttagattgtggact

SEQ ID NO: 146465 - DNA, 23 bp, Homo sapiens
accgtcactgaacacagtctgga

SEQ ID NO: 146466 - DNA, 20 bp, Homo sapiens
agaggagcaaaagagaaatt

SEQ ID NO: 146467 - DNA, 19 bp, Homo sapiens
tacagtagcacgaagatag

SEQ ID NO: 146468 - DNA, 20 bp, Homo sapiens
ttacagaaaacagtcagctc

SEQ ID NO: 146469 - DNA, 23 bp, Homo sapiens
agatggagtctcactctgtcacc

SEQ ID NO: 146470 - DNA, 23 bp, Homo sapiens
atgtgtatgtgtgtgtctgtcta

SEQ ID NO: 146471 - DNA, 23 bp, Homo sapiens
tgtctctgagcctctgtctttct

SEQ ID NO: 146472 - DNA, 22 bp, Homo sapiens
tgagaatacagtagcagagatg

SEQ ID NO: 146473 - DNA, 23 bp, Homo sapiens
ctccatcactgactcattcttct

SEQ ID NO: 146474 - DNA, 23 bp, Homo sapiens
tcactgccagtctgcctctcact

SEQ ID NO: 146475 - DNA, 18 bp, Homo sapiens
agaccgtgtctgtagttc

SEQ ID NO: 146476 - DNA, 22 bp, Homo sapiens
tgacacagcttctccatgtgct

SEQ ID NO: 146477 - DNA, 21 bp, Homo sapiens
tgtctgggtccctccttccct

SEQ ID NO: 146478 - DNA, 21 bp, Homo sapiens
tctctcgctgagtggctgggt

SEQ ID NO: 146479 - DNA, 21 bp, Homo sapiens
gagagggtagtctgagaaatg

SEQ ID NO: 146480 - DNA, 20 bp, Homo sapiens
acagagaagccagtgcacag

SEQ ID NO: 146481 - DNA, 23 bp, Homo sapiens
tccctcactccctgtgtttgaaa

SEQ ID NO: 146482 - DNA, 23 bp, Homo sapiens
acacgctgggtgactgaatttga

SEQ ID NO: 146483 - DNA, 22 bp, Homo sapiens
ttcacttactagctgtgtgatt

SEQ ID NO: 146484 - DNA, 23 bp, Homo sapiens
ttgtgtgtgcatgtgtatgcctg

SEQ ID NO: 146485 - DNA, 18 bp, Homo sapiens
tggaccagatgtgatttt

SEQ ID NO: 146486 - DNA, 18 bp, Homo sapiens
tctcactctctcacccag

SEQ ID NO: 146487 - DNA, 23 bp, Homo sapiens
tgtgtcactgtctgtgtttctcc

SEQ ID NO: 146488 - DNA, 22 bp, Homo sapiens
tgtcaagtgcctattgtcccag

SEQ ID NO: 146489 - DNA, 20 bp, Homo sapiens
tgaggtaggaggatcacttg

SEQ ID NO: 146490 - DNA, 23 bp, Homo sapiens
ggagtctcactctgtcactcagg

SEQ ID NO: 146491 - DNA, 23 bp, Homo sapiens
tttgagatggagttttgctcttg

SEQ ID NO: 146492 - DNA, 23 bp, Homo sapiens
tatatgtaagatgtacattggtt

SEQ ID NO: 146493 - DNA, 23 bp, Homo sapiens
agacagagtctcgctgtgtcacc

SEQ ID NO: 146494 - DNA, 19 bp, Homo sapiens
tagccagatgtagtggcac

SEQ ID NO: 146495 - DNA, 23 bp, Homo sapiens
ctctgtgtgactctgtccctggc

SEQ ID NO: 146496 - DNA, 21 bp, Homo sapiens
tgtgtatatatatatgtgtgt

SEQ ID NO: 146497 - DNA, 23 bp, Homo sapiens
tggtttcagaagagacagagggc

SEQ ID NO: 146498 - DNA, 23 bp, Homo sapiens
tgtgtccctctcagcctccctga

SEQ ID NO: 146499 - DNA, 21 bp, Homo sapiens
acactgggtgccacagggctt

SEQ ID NO: 146500 - DNA, 23 bp, Homo sapiens
ttgagacaagttttgctctgtca

SEQ ID NO: 146501 - DNA, 23 bp, Homo sapiens
agtatatttacaagcctgtggaa

SEQ ID NO: 146502 - DNA, 23 bp, Homo sapiens
ggactctcactcactctgttgcc

SEQ ID NO: 146503 - DNA, 21 bp, Homo sapiens
tcacagtgaacaccaatctct

SEQ ID NO: 146504 - DNA, 23 bp, Homo sapiens
gctctgaggtaaagtgatccatg

SEQ ID NO: 146505 - DNA, 22 bp, Homo sapiens
gcaacatagtgagtctttacag

SEQ ID NO: 146506 - DNA, 22 bp, Homo sapiens
cagtgctcactctgtcactcag

SEQ ID NO: 146507 - DNA, 20 bp, Homo sapiens
tgtgtgtgtgtaagggtggg

SEQ ID NO: 146508 - DNA, 18 bp, Homo sapiens
ttactgtcttggcaggga

SEQ ID NO: 146509 - DNA, 23 bp, Homo sapiens
acactgcagctctgtttttctct

SEQ ID NO: 146510 - DNA, 23 bp, Homo sapiens
gtgagccaagatcttgccactgc

SEQ ID NO: 146511 - DNA, 23 bp, Homo sapiens
tcagttagttatgatggagtctc

SEQ ID NO: 146512 - DNA, 23 bp, Homo sapiens
cggagtctcactctgtcacccag

SEQ ID NO: 146513 - DNA, 21 bp, Homo sapiens
tgaggttgtagtgagccgtga

SEQ ID NO: 146514 - DNA, 22 bp, Homo sapiens
tatgagtgagagcatgtggtat

SEQ ID NO: 146515 - DNA, 23 bp, Homo sapiens
tcactaccttcaggactctcagg

SEQ ID NO: 146516 - DNA, 23 bp, Homo sapiens
gagtctcactctgtctcccagct

SEQ ID NO: 146517 - DNA, 23 bp, Homo sapiens
tgttaacttacgttatgtaatga

SEQ ID NO: 146518 - DNA, 23 bp, Homo sapiens
attttgtatgcattttttttcct

SEQ ID NO: 146519 - DNA, 21 bp, Homo sapiens
ttactctgtcacccaggctag

SEQ ID NO: 146520 - DNA, 23 bp, Homo sapiens
acaggcagatgaaagtgtccact

SEQ ID NO: 146521 - DNA, 19 bp, Homo sapiens
gtagttacttacgagatcg

SEQ ID NO: 146522 - DNA, 23 bp, Homo sapiens
tcaggtagttggtagaattgctt

SEQ ID NO: 146523 - DNA, 22 bp, Homo sapiens
tttgagggtacatagtaggtgt

SEQ ID NO: 146524 - DNA, 23 bp, Homo sapiens
tatagtcagggtctcactctgtc

SEQ ID NO: 146525 - DNA, 21 bp, Homo sapiens
tacatgaatagaatcatattg

SEQ ID NO: 146526 - DNA, 23 bp, Homo sapiens
ataacttaggattagtatctgtt

SEQ ID NO: 146527 - DNA, 20 bp, Homo sapiens
agtttgagtattgcgagcag

SEQ ID NO: 146528 - DNA, 23 bp, Homo sapiens
ggttcctacttgattgtgagctc

SEQ ID NO: 146529 - DNA, 19 bp, Homo sapiens
ttcttcttgaggacctcag

SEQ ID NO: 146530 - DNA, 23 bp, Homo sapiens
gacagggtctcggtctgtctccc

SEQ ID NO: 146531 - DNA, 19 bp, Homo sapiens
gcaatggtgtgatcttggc

SEQ ID NO: 146532 - DNA, 23 bp, Homo sapiens
gtctcacgctgtcacccaggctg

SEQ ID NO: 146533 - DNA, 19 bp, Homo sapiens
tgaatgtgcatatgcatgt

SEQ ID NO: 146534 - DNA, 23 bp, Homo sapiens
agtgtttactcttggtttccaag

SEQ ID NO: 146535 - DNA, 22 bp, Homo sapiens
tagtatgtacatgatagtatag

SEQ ID NO: 146536 - DNA, 23 bp, Homo sapiens
gcactctcacccacttggtccca

SEQ ID NO: 146537 - DNA, 23 bp, Homo sapiens
gatcagacagcgtgacttgtgcc

SEQ ID NO: 146538 - DNA, 23 bp, Homo sapiens
tgagttcattgtagattctggat

SEQ ID NO: 146539 - DNA, 23 bp, Homo sapiens
tgagttcattgtagattctggat

SEQ ID NO: 146540 - DNA, 23 bp, Homo sapiens
tatcttttctgagagaagagtgt

SEQ ID NO: 146541 - DNA, 23 bp, Homo sapiens
cgctttaaaattcagcatgaggg

SEQ ID NO: 146542 - DNA, 22 bp, Homo sapiens
agtgactgtacagtgagtgtac

SEQ ID NO: 146543 - DNA, 21 bp, Homo sapiens
atgtatgtatatatgtataca

SEQ ID NO: 146544 - DNA, 21 bp, Homo sapiens
tgggtgagctgagggtgctca

SEQ ID NO: 146545 - DNA, 23 bp, Homo sapiens
ctcagatttagatttctacagtt

SEQ ID NO: 146546 - DNA, 23 bp, Homo sapiens
tagcagtagaactggttctgtat

SEQ ID NO: 146547 - DNA, 20 bp, Homo sapiens
atttagtcactggtttggag

SEQ ID NO: 146548 - DNA, 18 bp, Homo sapiens
tgaggaaggtgagactta

SEQ ID NO: 146549 - DNA, 20 bp, Homo sapiens
aaagtcacacaccaaatgaa

SEQ ID NO: 146550 - DNA, 18 bp, Homo sapiens
tctgagaaatgcatgagt

SEQ ID NO: 146551 - DNA, 23 bp, Homo sapiens
tggtgtagtcattatgttcttga

SEQ ID NO: 146552 - DNA, 23 bp, Homo sapiens
tacatgtgctttatatatctttt

SEQ ID NO: 146553 - DNA, 22 bp, Homo sapiens
tgtctccctgtgaccctggcat

SEQ ID NO: 146554 - DNA, 19 bp, Homo sapiens
tggtccaagaatgagtaga

SEQ ID NO: 146555 - DNA, 23 bp, Homo sapiens
agtcactactctctctgacacct

SEQ ID NO: 146556 - DNA, 23 bp, Homo sapiens
agtcagtcatggctatgggtgag

SEQ ID NO: 146557 - DNA, 23 bp, Homo sapiens
tgtgtctatcactctcacctacc

SEQ ID NO: 146558 - DNA, 21 bp, Homo sapiens
aatgaccttgcctcttttttc

SEQ ID NO: 146559 - DNA, 23 bp, Homo sapiens
tggaaggttctatttgaagaagt

SEQ ID NO: 146560 - DNA, 20 bp, Homo sapiens
ttgagatggagtctcactct

SEQ ID NO: 146561 - DNA, 18 bp, Homo sapiens
actgtggcatggagtagg

SEQ ID NO: 146562 - DNA, 23 bp, Homo sapiens
tgtgagttcatgctgagagatga

SEQ ID NO: 146563 - DNA, 23 bp, Homo sapiens
agtgtaatagttgctgaataaga

SEQ ID NO: 146564 - DNA, 23 bp, Homo sapiens
ttatttcaaggtgtgaatctcgt

SEQ ID NO: 146565 - DNA, 20 bp, Homo sapiens
tctctctttctttttttctt

SEQ ID NO: 146566 - DNA, 23 bp, Homo sapiens
aggagacagatgagtgagggcag

SEQ ID NO: 146567 - DNA, 21 bp, Homo sapiens
aagctcccggtttttaatctg

SEQ ID NO: 146568 - DNA, 23 bp, Homo sapiens
gcgggactcactctctgaaactg

SEQ ID NO: 146569 - DNA, 23 bp, Homo sapiens
acaaagtctcactctgtcgccta

SEQ ID NO: 146570 - DNA, 21 bp, Homo sapiens
tgagacagagtctcactcttt

SEQ ID NO: 146571 - DNA, 23 bp, Homo sapiens
agtagaaatgatcttgtgggtaa

SEQ ID NO: 146572 - DNA, 22 bp, Homo sapiens
aactctgggatgaattctctgt

SEQ ID NO: 146573 - DNA, 23 bp, Homo sapiens
tctctgaatctcacagtgtcatg

SEQ ID NO: 146574 - DNA, 23 bp, Homo sapiens
catctgtccgtctgtctctcttt

SEQ ID NO: 146575 - DNA, 23 bp, Homo sapiens
tgtcttctaaaggtggttttgaa

SEQ ID NO: 146576 - DNA, 20 bp, Homo sapiens
ttggcttttcaagagattat

SEQ ID NO: 146577 - DNA, 21 bp, Homo sapiens
agttatctctctctctgtaac

SEQ ID NO: 146578 - DNA, 23 bp, Homo sapiens
gatgcctgtggaagtactttata

SEQ ID NO: 146579 - DNA, 22 bp, Homo sapiens
aagattcacctactcgaagtca

SEQ ID NO: 146580 - DNA, 23 bp, Homo sapiens
tactgtcagtgtctgtttcatat

SEQ ID NO: 146581 - DNA, 20 bp, Homo sapiens
tatatgtatctatatccagg

SEQ ID NO: 146582 - DNA, 23 bp, Homo sapiens
agacttctgcttgttttaagagt

SEQ ID NO: 146583 - DNA, 22 bp, Homo sapiens
ttacttagaattctgaagtcat

SEQ ID NO: 146584 - DNA, 23 bp, Homo sapiens
tctcactctgtctgtcacccagc

SEQ ID NO: 146585 - DNA, 21 bp, Homo sapiens
atatatgtatgtatatatgtg

SEQ ID NO: 146586 - DNA, 23 bp, Homo sapiens
agagtctcactctgtcacctagg

SEQ ID NO: 146587 - DNA, 21 bp, Homo sapiens
tgaggtagtaggatcacttga

SEQ ID NO: 146588 - DNA, 23 bp, Homo sapiens
gtcagagtctcgctctgtctccc

SEQ ID NO: 146589 - DNA, 20 bp, Homo sapiens
agtggcgtgatcttggctca

SEQ ID NO: 146590 - DNA, 19 bp, Homo sapiens
tatagagttagattctttt

SEQ ID NO: 146591 - DNA, 23 bp, Homo sapiens
tgagacggagtctcgctctgtca

SEQ ID NO: 146592 - DNA, 23 bp, Homo sapiens
tgaggtctcactctgttgttcag

SEQ ID NO: 146593 - DNA, 23 bp, Homo sapiens
tattttcttctgcagcatgggag

SEQ ID NO: 146594 - DNA, 23 bp, Homo sapiens
agatgtgtctctgtctctctggg

SEQ ID NO: 146595 - DNA, 23 bp, Homo sapiens
ttgagatggagttttgctcttgt

SEQ ID NO: 146596 - DNA, 21 bp, Homo sapiens
atgtgtatatatgtataacta

SEQ ID NO: 146597 - DNA, 19 bp, Homo sapiens
ttcatactttttgatatag

SEQ ID NO: 146598 - DNA, 20 bp, Homo sapiens
atgtacttcatattctcaga

SEQ ID NO: 146599 - DNA, 23 bp, Homo sapiens
acacatagatatattgagatgga

SEQ ID NO: 146600 - DNA, 20 bp, Homo sapiens
aattcctacatgaatatttt

SEQ ID NO: 146601 - DNA, 21 bp, Homo sapiens
agatgagcaataagcattaca

SEQ ID NO: 146602 - DNA, 23 bp, Homo sapiens
gagacagagtctcgctctgttgc

SEQ ID NO: 146603 - DNA, 19 bp, Homo sapiens
tatgaatgaatatatatga

SEQ ID NO: 146604 - DNA, 20 bp, Homo sapiens
aaatgttagattttaatgct

SEQ ID NO: 146605 - DNA, 23 bp, Homo sapiens
aagattctctctttcttgagagt

SEQ ID NO: 146606 - DNA, 21 bp, Homo sapiens
atgaaaagagaatttgttctt

SEQ ID NO: 146607 - DNA, 23 bp, Homo sapiens
aggaagcatgagtatatttgtgg

SEQ ID NO: 146608 - DNA, 23 bp, Homo sapiens
gggtctcactctgtcactcaggc

SEQ ID NO: 146609 - DNA, 23 bp, Homo sapiens
tgcagtggtatgatcctggctca

SEQ ID NO: 146610 - DNA, 23 bp, Homo sapiens
gtatgtctatgtgtatacatgta

SEQ ID NO: 146611 - DNA, 20 bp, Homo sapiens
agaggtaggaggatcgcttg

SEQ ID NO: 146612 - DNA, 22 bp, Homo sapiens
aagtgctggattacaggcgtga

SEQ ID NO: 146613 - DNA, 23 bp, Homo sapiens
ctctgtcacccagtcttgagtgc

SEQ ID NO: 146614 - DNA, 22 bp, Homo sapiens
aacaatgtcagtgacattgtag

SEQ ID NO: 146615 - DNA, 23 bp, Homo sapiens
tgagttcattgtagattctggat

SEQ ID NO: 146616 - DNA, 21 bp, Homo sapiens
agaagtacatgagttatcttg

SEQ ID NO: 146617 - DNA, 21 bp, Homo sapiens
agggcctaatttttctcctct

SEQ ID NO: 146618 - DNA, 23 bp, Homo sapiens
tttgttcttctgcatgtggatgt

SEQ ID NO: 146619 - DNA, 23 bp, Homo sapiens
agagatgacactgaccagagagg

SEQ ID NO: 146620 - DNA, 22 bp, Homo sapiens
tttctcttgcctgatgttgtag

SEQ ID NO: 146621 - DNA, 23 bp, Homo sapiens
gatctcagcatgtagtttcatcc

SEQ ID NO: 146622 - DNA, 22 bp, Homo sapiens
tatttctctctggaatgattat

SEQ ID NO: 146623 - DNA, 22 bp, Homo sapiens
aagtgcttgttcaggttgcact

SEQ ID NO: 146624 - DNA, 21 bp, Homo sapiens
actctcatttactcactgaca

SEQ ID NO: 146625 - DNA, 19 bp, Homo sapiens
gtagtgaatactagttgca

SEQ ID NO: 146626 - DNA, 18 bp, Homo sapiens
tgagtatatgtatatatg

SEQ ID NO: 146627 - DNA, 22 bp, Homo sapiens
atatgtgtatatgtatatgtgt

SEQ ID NO: 146628 - DNA, 20 bp, Homo sapiens
tgtgtatatatatacacgtg

SEQ ID NO: 146629 - DNA, 19 bp, Homo sapiens
cacgtgtatatatatgtgt

SEQ ID NO: 146630 - DNA, 23 bp, Homo sapiens
atgtgtatatatatatatgtata

SEQ ID NO: 146631 - DNA, 23 bp, Homo sapiens
attgagacaggatttcactctgt

SEQ ID NO: 146632 - DNA, 21 bp, Homo sapiens
tcaatgctagcttgataggga

SEQ ID NO: 146633 - DNA, 20 bp, Homo sapiens
acacacatctatatgtacac

SEQ ID NO: 146634 - DNA, 23 bp, Homo sapiens
cttagtaagttgtatgtgtctag

SEQ ID NO: 146635 - DNA, 23 bp, Homo sapiens
ctgaatgtggttttgatttgcat

SEQ ID NO: 146636 - DNA, 23 bp, Homo sapiens
cttctgagaagtgtctgtttatg

SEQ ID NO: 146637 - DNA, 23 bp, Homo sapiens
tcagattatttgattatttactg

SEQ ID NO: 146638 - DNA, 23 bp, Homo sapiens
tgagctccttagatattctgatt

SEQ ID NO: 146639 - DNA, 23 bp, Homo sapiens
aatattgaggttcttgatttttt

SEQ ID NO: 146640 - DNA, 20 bp, Homo sapiens
tcaagctgagcctcaattct

SEQ ID NO: 146641 - DNA, 23 bp, Homo sapiens
agacagagcaactccatctcaaa

SEQ ID NO: 146642 - DNA, 23 bp, Homo sapiens
tgagttcattgtagattctggat

SEQ ID NO: 146643 - DNA, 23 bp, Homo sapiens
tgagttcattgtagattctggat

SEQ ID NO: 146644 - DNA, 23 bp, Homo sapiens
gggtaactgagtgttttttttgt

SEQ ID NO: 146645 - DNA, 23 bp, Homo sapiens
gagacagagtctcactctgtcgc

SEQ ID NO: 146646 - DNA, 19 bp, Homo sapiens
aaaggacttgaatggtttt

SEQ ID NO: 146647 - DNA, 22 bp, Homo sapiens
agccctccaagtcttcattctt

SEQ ID NO: 146648 - DNA, 23 bp, Homo sapiens
tgagttcattgtagattctggat

SEQ ID NO: 146649 - DNA, 23 bp, Homo sapiens
tgagttcattgtagattctggat

SEQ ID NO: 146650 - DNA, 23 bp, Homo sapiens
gtttgttgttgtcttagctgttg

SEQ ID NO: 146651 - DNA, 23 bp, Homo sapiens
tgagagtcttgctctatctccca

SEQ ID NO: 146652 - DNA, 21 bp, Homo sapiens
tatatgcatgtattttgcttt

SEQ ID NO: 146653 - DNA, 23 bp, Homo sapiens
tgttgtgacaggtgggtttttct

SEQ ID NO: 146654 - DNA, 23 bp, Homo sapiens
tatgtgtgtatatatatgtgtgt

SEQ ID NO: 146655 - DNA, 23 bp, Homo sapiens
gactgagtctggctctgtcaccc

SEQ ID NO: 146656 - DNA, 23 bp, Homo sapiens
aactgtctgtgtcttaatttcct

SEQ ID NO: 146657 - DNA, 23 bp, Homo sapiens
tgacagagtctcattctgtcacc

SEQ ID NO: 146658 - DNA, 23 bp, Homo sapiens
aaatgccaggtttagatgtcaca

SEQ ID NO: 146659 - DNA, 23 bp, Homo sapiens
tgtgtatcagatgtgggatttga

SEQ ID NO: 146660 - DNA, 21 bp, Homo sapiens
gagaacaggtagtgtttggtt

SEQ ID NO: 146661 - DNA, 21 bp, Homo sapiens
gagagaaaaactgaaggtttt

SEQ ID NO: 146662 - DNA, 22 bp, Homo sapiens
tgacttgattgttttctatggt

SEQ ID NO: 146663 - DNA, 19 bp, Homo sapiens
tgcactgttgtggggaatg

SEQ ID NO: 146664 - DNA, 23 bp, Homo sapiens
gcttatggtagaaatgtgaaaga

SEQ ID NO: 146665 - DNA, 23 bp, Homo sapiens
ttaagatctgcctctgtctgtgt

SEQ ID NO: 146666 - DNA, 20 bp, Homo sapiens
tttgtagatgaagtcttgct

SEQ ID NO: 146667 - DNA, 18 bp, Homo sapiens
atggtgcctgatgattcc

SEQ ID NO: 146668 - DNA, 23 bp, Homo sapiens
gtctcagtctgtcactcaggctg

SEQ ID NO: 146669 - DNA, 22 bp, Homo sapiens
actgtgtgtcagagatgttgct

SEQ ID NO: 146670 - DNA, 23 bp, Homo sapiens
tggatttgatttgtgaatatata

SEQ ID NO: 146671 - DNA, 22 bp, Homo sapiens
taatactttaagtcttagggta

SEQ ID NO: 146672 - DNA, 20 bp, Homo sapiens
atgtgcacaacgtgcaggtt

SEQ ID NO: 146673 - DNA, 21 bp, Homo sapiens
actcctgtaaatctgtctcat

SEQ ID NO: 146674 - DNA, 21 bp, Homo sapiens
taacacaggagtgtgtgctca

SEQ ID NO: 146675 - DNA, 23 bp, Homo sapiens
ttctgtgtagatgaagtaggtaa

SEQ ID NO: 146676 - DNA, 22 bp, Homo sapiens
atattccatgtatacagaattt

SEQ ID NO: 146677 - DNA, 23 bp, Homo sapiens
tcatacctatagttttgtgcgag

SEQ ID NO: 146678 - DNA, 18 bp, Homo sapiens
caccagtattttttttct

SEQ ID NO: 146679 - DNA, 23 bp, Homo sapiens
ttctgatggtgcagcagctggag

SEQ ID NO: 146680 - DNA, 19 bp, Homo sapiens
actcactactctctcactg

SEQ ID NO: 146681 - DNA, 23 bp, Homo sapiens
actatatacttgtatatgtgttt

SEQ ID NO: 146682 - DNA, 20 bp, Homo sapiens
tgctatagtgattttgtgct

SEQ ID NO: 146683 - DNA, 18 bp, Homo sapiens
agcttaatgagcctaaac

SEQ ID NO: 146684 - DNA, 23 bp, Homo sapiens
atgtgatggaattagtatgtatt

SEQ ID NO: 146685 - DNA, 23 bp, Homo sapiens
atgtgtgtatatatatgtatgtg

SEQ ID NO: 146686 - DNA, 18 bp, Homo sapiens
tatatagatagatataga

SEQ ID NO: 146687 - DNA, 22 bp, Homo sapiens
tgtgtgtgtgtgtatatgtata

SEQ ID NO: 146688 - DNA, 23 bp, Homo sapiens
tacatgtgcacattgtgcaggtt

SEQ ID NO: 146689 - DNA, 22 bp, Homo sapiens
tctgtgtgtgtgtaagttttga

SEQ ID NO: 146690 - DNA, 20 bp, Homo sapiens
tttattgtagtaaatgataa

SEQ ID NO: 146691 - DNA, 23 bp, Homo sapiens
tgtgtgtgtatatataatggtgt

SEQ ID NO: 146692 - DNA, 23 bp, Homo sapiens
agagtctcactctgtcacccagg

SEQ ID NO: 146693 - DNA, 22 bp, Homo sapiens
tgtgtatatatgtatatgtgtg

SEQ ID NO: 146694 - DNA, 23 bp, Homo sapiens
tatatatgcatgtgtagatatgt

SEQ ID NO: 146695 - DNA, 21 bp, Homo sapiens
tgtgtatatatgcatgtgtat

SEQ ID NO: 146696 - DNA, 21 bp, Homo sapiens
tatatgcatgtgtaaacatgt

SEQ ID NO: 146697 - DNA, 22 bp, Homo sapiens
tatatgcatgtgtaaacatgta

SEQ ID NO: 146698 - DNA, 19 bp, Homo sapiens
tgtgtatatatatgcatgt

SEQ ID NO: 146699 - DNA, 21 bp, Homo sapiens
aatatgattgttatctggtgt

SEQ ID NO: 146700 - DNA, 22 bp, Homo sapiens
gaggattaatattgagtgtcca

SEQ ID NO: 146701 - DNA, 23 bp, Homo sapiens
ttgtatgttgattttgtatcctt

SEQ ID NO: 146702 - DNA, 23 bp, Homo sapiens
ctcatagtggttttgatttgcat

SEQ ID NO: 146703 - DNA, 23 bp, Homo sapiens
tctgttggccatttgtaagtctt

SEQ ID NO: 146704 - DNA, 21 bp, Homo sapiens
tgtgtgtaaatatgtatgtgt

SEQ ID NO: 146705 - DNA, 18 bp, Homo sapiens
cagcagtgatggcagctg

SEQ ID NO: 146706 - DNA, 22 bp, Homo sapiens
tgtgtgtatgtatgtatatgta

SEQ ID NO: 146707 - DNA, 23 bp, Homo sapiens
aaagggtattgttgataagtgaa

SEQ ID NO: 146708 - DNA, 22 bp, Homo sapiens
tcagtcagtcagtgttatggga

SEQ ID NO: 146709 - DNA, 22 bp, Homo sapiens
tatgtgtgtatatatatatgtg

SEQ ID NO: 146710 - DNA, 23 bp, Homo sapiens
atatgtgtatatatatgtgtgta

SEQ ID NO: 146711 - DNA, 22 bp, Homo sapiens
agcaatgtttagtgctatgaag

SEQ ID NO: 146712 - DNA, 23 bp, Homo sapiens
aaaggagtagtagagtttgtgtg

SEQ ID NO: 146713 - DNA, 23 bp, Homo sapiens
acacacacacatattcttttcta

SEQ ID NO: 146714 - DNA, 23 bp, Homo sapiens
actttgcaaaatactgactctct

SEQ ID NO: 146715 - DNA, 23 bp, Homo sapiens
ttctcagggtcttcttttagaga

SEQ ID NO: 146716 - DNA, 23 bp, Homo sapiens
cagtctctctcagtgatccctgg

SEQ ID NO: 146717 - DNA, 20 bp, Homo sapiens
tgaggtagcacgttgtgttc

SEQ ID NO: 146718 - DNA, 23 bp, Homo sapiens
gatctctctctctctctaccatg

SEQ ID NO: 146719 - DNA, 23 bp, Homo sapiens
ttaatgtgaggagttaagctgag

SEQ ID NO: 146720 - DNA, 23 bp, Homo sapiens
aattcacacagctttggaaaatg

SEQ ID NO: 146721 - DNA, 22 bp, Homo sapiens
tttaagtctgactgagaattcc

SEQ ID NO: 146722 - DNA, 21 bp, Homo sapiens
tgtgtatatatatatgtgtgt

SEQ ID NO: 146723 - DNA, 21 bp, Homo sapiens
tgtgtgtatatatatatatgt

SEQ ID NO: 146724 - DNA, 23 bp, Homo sapiens
ttaagcagagtagacagaaggaa

SEQ ID NO: 146725 - DNA, 19 bp, Homo sapiens
tttggcttaggattgtctt

SEQ ID NO: 146726 - DNA, 23 bp, Homo sapiens
agaagtatgtgaatgctgatatt

SEQ ID NO: 146727 - DNA, 18 bp, Homo sapiens
agttgttgccagtaatga

SEQ ID NO: 146728 - DNA, 22 bp, Homo sapiens
tcactcattcactctctgtgca

SEQ ID NO: 146729 - DNA, 22 bp, Homo sapiens
ttatatctatgtaaaaatctgt

SEQ ID NO: 146730 - DNA, 18 bp, Homo sapiens
tttacatagatatagatt

SEQ ID NO: 146731 - DNA, 22 bp, Homo sapiens
atatgtgtagaaaaatttgtgt

SEQ ID NO: 146732 - DNA, 23 bp, Homo sapiens
tgtatatgtatgttcagtgtgtg

SEQ ID NO: 146733 - DNA, 23 bp, Homo sapiens
tgtgtgtatatatgtatgtgtgt

SEQ ID NO: 146734 - DNA, 20 bp, Homo sapiens
atacacacatatatacgtgt

SEQ ID NO: 146735 - DNA, 20 bp, Homo sapiens
atacacacatatatacgtgt

SEQ ID NO: 146736 - DNA, 22 bp, Homo sapiens
tatgtgtgtatatatgtgtgtg

SEQ ID NO: 146737 - DNA, 23 bp, Homo sapiens
tatatgtatgtgtatatatgtat

SEQ ID NO: 146738 - DNA, 22 bp, Homo sapiens
gtgactggttatacaaagtcca

SEQ ID NO: 146739 - DNA, 23 bp, Homo sapiens
tgtgactcactgtgtgatcttag

SEQ ID NO: 146740 - DNA, 23 bp, Homo sapiens
atatataacttgtgtgtgtgtgt

SEQ ID NO: 146741 - DNA, 23 bp, Homo sapiens
aaacctgaagaacctcttgtcat

SEQ ID NO: 146742 - DNA, 23 bp, Homo sapiens
tacagatactgctttagaatatc

SEQ ID NO: 146743 - DNA, 20 bp, Homo sapiens
tgactgacgtgtgtgaccag

SEQ ID NO: 146744 - DNA, 20 bp, Homo sapiens
gtttttgttcttgtttttgt

SEQ ID NO: 146745 - DNA, 18 bp, Homo sapiens
tggaatgtttacgcaaag

SEQ ID NO: 146746 - DNA, 23 bp, Homo sapiens
tacatgtgcacaatgtgcaggtt

SEQ ID NO: 146747 - DNA, 20 bp, Homo sapiens
agtacttaatgttagcaata

SEQ ID NO: 146748 - DNA, 20 bp, Homo sapiens
ttgttcaggatcagatgact

SEQ ID NO: 146749 - DNA, 22 bp, Homo sapiens
tatccacatcgttaagtcacac

SEQ ID NO: 146750 - DNA, 21 bp, Homo sapiens
tatacacacacatatatatgt

SEQ ID NO: 146751 - DNA, 23 bp, Homo sapiens
ctgagtctcactctgttgctcag

SEQ ID NO: 146752 - DNA, 19 bp, Homo sapiens
tacagtggtatgatctcag

SEQ ID NO: 146753 - DNA, 19 bp, Homo sapiens
tatatagaaagagaattcc

SEQ ID NO: 146754 - DNA, 20 bp, Homo sapiens
actcagtctgtgtgcctcag

SEQ ID NO: 146755 - DNA, 23 bp, Homo sapiens
gagtctctcactctgtcacccag

SEQ ID NO: 146756 - DNA, 18 bp, Homo sapiens
tgtgcatttttatataaa

SEQ ID NO: 146757 - DNA, 20 bp, Homo sapiens
ttagcttgattataattata

SEQ ID NO: 146758 - DNA, 23 bp, Homo sapiens
tgtgatgtatgaacagtgatctt

SEQ ID NO: 146759 - DNA, 19 bp, Homo sapiens
gagaaagtttcctaagggt

SEQ ID NO: 146760 - DNA, 21 bp, Homo sapiens
taaaatgtatttcttaatgcg

SEQ ID NO: 146761 - DNA, 23 bp, Homo sapiens
tatacgtatatatacgtatgtat

SEQ ID NO: 146762 - DNA, 23 bp, Homo sapiens
acgtgtatatatgtgtgtgtgtg

SEQ ID NO: 146763 - DNA, 19 bp, Homo sapiens
ctcactgcaacctctgtct

SEQ ID NO: 146764 - DNA, 23 bp, Homo sapiens
tttgagacggactctccctctgt

SEQ ID NO: 146765 - DNA, 23 bp, Homo sapiens
tgagttcattgtagattctggat

SEQ ID NO: 146766 - DNA, 23 bp, Homo sapiens
tgagttcattgtagattctggat

SEQ ID NO: 146767 - DNA, 23 bp, Homo sapiens
tgagttcattgtagattctggat

SEQ ID NO: 146768 - DNA, 23 bp, Homo sapiens
tgagttcattgtagattctggat

SEQ ID NO: 146769 - DNA, 23 bp, Homo sapiens
gttgtatgtgtgcatatgtgtgt

SEQ ID NO: 146770 - DNA, 23 bp, Homo sapiens
atccaggctgtgtgtatatatgt

SEQ ID NO: 146771 - DNA, 19 bp, Homo sapiens
gtctgcagaatgtgtgaca

SEQ ID NO: 146772 - DNA, 22 bp, Homo sapiens
tgtacacttgtctgtatgcaga

SEQ ID NO: 146773 - DNA, 22 bp, Homo sapiens
aagactctgagaaaagtgtagt

SEQ ID NO: 146774 - DNA, 23 bp, Homo sapiens
catgacacagtctctcacagctt

SEQ ID NO: 146775 - DNA, 18 bp, Homo sapiens
tccgaccccctatgcttc

SEQ ID NO: 146776 - DNA, 23 bp, Homo sapiens
ggatcatgtttcttgtgggagtg

SEQ ID NO: 146777 - DNA, 20 bp, Homo sapiens
atacacacatatatacacac

SEQ ID NO: 146778 - DNA, 22 bp, Homo sapiens
acattgcatactggttttgatg

SEQ ID NO: 146779 - DNA, 20 bp, Homo sapiens
actatgtacatataatctct

SEQ ID NO: 146780 - DNA, 21 bp, Homo sapiens
tgacagagaagagactgggca

SEQ ID NO: 146781 - DNA, 23 bp, Homo sapiens
tgagttcattgtagattctggat

SEQ ID NO: 146782 - DNA, 23 bp, Homo sapiens
tgagttcattgtagattctggat

SEQ ID NO: 146783 - DNA, 23 bp, Homo sapiens
acatatgtatgtatatatgtgtg

SEQ ID NO: 146784 - DNA, 22 bp, Homo sapiens
atatatgtgtatatgtatatgt

SEQ ID NO: 146785 - DNA, 18 bp, Homo sapiens
tgacattttcttgtgctg

SEQ ID NO: 146786 - DNA, 22 bp, Homo sapiens
ttttctttgagggacagtatac

SEQ ID NO: 146787 - DNA, 23 bp, Homo sapiens
acccagttctgcattgttgtgtc

SEQ ID NO: 146788 - DNA, 23 bp, Homo sapiens
atatctcaatttgttattttaat

SEQ ID NO: 146789 - DNA, 23 bp, Homo sapiens
aatactctgtttcttaatctgtg

SEQ ID NO: 146790 - DNA, 20 bp, Homo sapiens
tacagtgtgttactgttctg

SEQ ID NO: 146791 - DNA, 21 bp, Homo sapiens
tagaaaaggtaatacattgtg

SEQ ID NO: 146792 - DNA, 23 bp, Homo sapiens
aaagacaggcttactgtgacatt

SEQ ID NO: 146793 - DNA, 20 bp, Homo sapiens
tgacacagggacactctgtc

SEQ ID NO: 146794 - DNA, 23 bp, Homo sapiens
tttggctctggttgatttgaatg

SEQ ID NO: 146795 - DNA, 22 bp, Homo sapiens
gagtatagtgtgtgtatgtata

SEQ ID NO: 146796 - DNA, 18 bp, Homo sapiens
tacatactctctctctat

SEQ ID NO: 146797 - DNA, 22 bp, Homo sapiens
tatatgcatatatacttataca

SEQ ID NO: 146798 - DNA, 22 bp, Homo sapiens
atgtgtatatatgtatatatgt

SEQ ID NO: 146799 - DNA, 22 bp, Homo sapiens
ataagatgtgttagagaggagt

SEQ ID NO: 146800 - DNA, 23 bp, Homo sapiens
tttgtgcctctggtagaattcag

SEQ ID NO: 146801 - DNA, 23 bp, Homo sapiens
ggagtctcactctgtcacctagg

SEQ ID NO: 146802 - DNA, 23 bp, Homo sapiens
cacctctcacaatcacaaatgtt

SEQ ID NO: 146803 - DNA, 23 bp, Homo sapiens
tacatgtgcagaatgtgcaggtt

SEQ ID NO: 146804 - DNA, 18 bp, Homo sapiens
tgcatatgaaatatatgt

SEQ ID NO: 146805 - DNA, 23 bp, Homo sapiens
catcatattatatgatgtataca

SEQ ID NO: 146806 - DNA, 21 bp, Homo sapiens
agtagtattctatgctatata

SEQ ID NO: 146807 - DNA, 23 bp, Homo sapiens
atatatcaatgtgatatatgtga

SEQ ID NO: 146808 - DNA, 19 bp, Homo sapiens
gagacactcacacagtctg

SEQ ID NO: 146809 - DNA, 23 bp, Homo sapiens
ggcaggttcagagatgctgttca

SEQ ID NO: 146810 - DNA, 23 bp, Homo sapiens
tgagttcattgtagattctggat

SEQ ID NO: 146811 - DNA, 23 bp, Homo sapiens
tgagttcattgtagattctggat

SEQ ID NO: 146812 - DNA, 23 bp, Homo sapiens
agatggagtctcactctgccact

SEQ ID NO: 146813 - DNA, 23 bp, Homo sapiens
aaagtacaagacagcctcaagtt

SEQ ID NO: 146814 - DNA, 19 bp, Homo sapiens
tcctaatatttccagaatg

SEQ ID NO: 146815 - DNA, 23 bp, Homo sapiens
ggtgtctcatagagtctactgac

SEQ ID NO: 146816 - DNA, 23 bp, Homo sapiens
atttttctctttgatattgttac

SEQ ID NO: 146817 - DNA, 23 bp, Homo sapiens
tctctctctctcagaaatgagcc

SEQ ID NO: 146818 - DNA, 23 bp, Homo sapiens
agcaggattgtagagggctttgc

SEQ ID NO: 146819 - DNA, 19 bp, Homo sapiens
tgtgtatatgtatacatat

SEQ ID NO: 146820 - DNA, 23 bp, Homo sapiens
tatgtatgtatttatatgttgag

SEQ ID NO: 146821 - DNA, 23 bp, Homo sapiens
tagacagagaagagactgagtcc

SEQ ID NO: 146822 - DNA, 23 bp, Homo sapiens
tgagttcattgtagattctggat

SEQ ID NO: 146823 - DNA, 23 bp, Homo sapiens
tgagttcattgtagattctggat

SEQ ID NO: 146824 - DNA, 20 bp, Homo sapiens
taaatgttagggtttcatga

SEQ ID NO: 146825 - DNA, 23 bp, Homo sapiens
tgtgaagaaagtcaatggtagcc

SEQ ID NO: 146826 - DNA, 23 bp, Homo sapiens
tgaggtctcactctgtcacctgg

SEQ ID NO: 146827 - DNA, 23 bp, Homo sapiens
agtaaagcaaaagaaagcagttt

SEQ ID NO: 146828 - DNA, 23 bp, Homo sapiens
tggagctcagtggaaagcacatg

SEQ ID NO: 146829 - DNA, 23 bp, Homo sapiens
agagaagagagtcagatgatgac

SEQ ID NO: 146830 - DNA, 23 bp, Homo sapiens
ttataggtggagtctcactctgt

SEQ ID NO: 146831 - DNA, 23 bp, Homo sapiens
tggctctgtcacagtctcagatg

SEQ ID NO: 146832 - DNA, 21 bp, Homo sapiens
cactcttgtcagtctgtgtgc

SEQ ID NO: 146833 - DNA, 21 bp, Homo sapiens
ttccttgttgattgatgattg

SEQ ID NO: 146834 - DNA, 23 bp, Homo sapiens
agggtctcactctgtcactcagg

SEQ ID NO: 146835 - DNA, 23 bp, Homo sapiens
cacaccctcactccgtcattcaa

SEQ ID NO: 146836 - DNA, 21 bp, Homo sapiens
tttactgaagattaacttgtg

SEQ ID NO: 146837 - DNA, 21 bp, Homo sapiens
ctctttctttctctctgtaga

SEQ ID NO: 146838 - DNA, 23 bp, Homo sapiens
tcagtgactttctcacacattat

SEQ ID NO: 146839 - DNA, 23 bp, Homo sapiens
cggagtctcgctctgtctcccag

SEQ ID NO: 146840 - DNA, 23 bp, Homo sapiens
tggagtctctcgctctgtcgccg

SEQ ID NO: 146841 - DNA, 23 bp, Homo sapiens
tgagttcattgtagattctggat

SEQ ID NO: 146842 - DNA, 23 bp, Homo sapiens
tgagttcattgtagattctggat

SEQ ID NO: 146843 - DNA, 23 bp, Homo sapiens
actgtgtctgtcagtcttacacc

SEQ ID NO: 146844 - DNA, 23 bp, Homo sapiens
tttttgtagcaattgtgaatagg

SEQ ID NO: 146845 - DNA, 18 bp, Homo sapiens
acaagagtgagtgaacta

SEQ ID NO: 146846 - DNA, 23 bp, Homo sapiens
aactgtgactaaatgttttcagc

SEQ ID NO: 146847 - DNA, 23 bp, Homo sapiens
gtcccactctcattctctgtgct

SEQ ID NO: 146848 - DNA, 23 bp, Homo sapiens
tgagttcattgtagattctggat

SEQ ID NO: 146849 - DNA, 23 bp, Homo sapiens
tgagttcattgtagattctggat

SEQ ID NO: 146850 - DNA, 21 bp, Homo sapiens
tattgtgtgtgtatatgtata

SEQ ID NO: 146851 - DNA, 20 bp, Homo sapiens
agttatcagcaggcaaatga

SEQ ID NO: 146852 - DNA, 23 bp, Homo sapiens
aatggtagcttgatggggatagc

SEQ ID NO: 146853 - DNA, 23 bp, Homo sapiens
atgtgtatatatttatgtgtggt

SEQ ID NO: 146854 - DNA, 18 bp, Homo sapiens
taaggagttacatgtgca

SEQ ID NO: 146855 - DNA, 22 bp, Homo sapiens
tatatgtatatatacctatatg

SEQ ID NO: 146856 - DNA, 23 bp, Homo sapiens
tgagttcattgtagattctggat

SEQ ID NO: 146857 - DNA, 23 bp, Homo sapiens
tgagttcattgtagattctggat

SEQ ID NO: 146858 - DNA, 23 bp, Homo sapiens
gactgagtctcactctgtgccag

SEQ ID NO: 146859 - DNA, 23 bp, Homo sapiens
cttaggtagagttctgaatttgg

SEQ ID NO: 146860 - DNA, 21 bp, Homo sapiens
tatatacacgtatatatatgt

SEQ ID NO: 146861 - DNA, 23 bp, Homo sapiens
tacatgtgcacattgtgcaggtt

SEQ ID NO: 146862 - DNA, 23 bp, Homo sapiens
tgagttcattgtagattctggat

SEQ ID NO: 146863 - DNA, 23 bp, Homo sapiens
tgagttcattgtagattctggat

SEQ ID NO: 146864 - DNA, 23 bp, Homo sapiens
tatattgtagtagacatggacta

SEQ ID NO: 146865 - DNA, 23 bp, Homo sapiens
tgacagtagtgagagaggacagg

SEQ ID NO: 146866 - DNA, 23 bp, Homo sapiens
agagtctcactctgtcacccagg

SEQ ID NO: 146867 - DNA, 23 bp, Homo sapiens
acactctgtctgagactcagcct

SEQ ID NO: 146868 - DNA, 22 bp, Homo sapiens
ttcctggttcacatagctcaga

SEQ ID NO: 146869 - DNA, 18 bp, Homo sapiens
ttcagccagctgaacgtg

SEQ ID NO: 146870 - DNA, 23 bp, Homo sapiens
gagttgatacacattcagcatga

SEQ ID NO: 146871 - DNA, 23 bp, Homo sapiens
gaagttccttttgaaaactcttt

SEQ ID NO: 146872 - DNA, 23 bp, Homo sapiens
caagcattctcagaatgtcattt

SEQ ID NO: 146873 - DNA, 23 bp, Homo sapiens
taaaaggcagtggttgcaatgag

SEQ ID NO: 146874 - DNA, 23 bp, Homo sapiens
tgtgtgtgtgtatatgtacacat

SEQ ID NO: 146875 - DNA, 21 bp, Homo sapiens
atgtgtgtgtatatatatgtg

SEQ ID NO: 146876 - DNA, 23 bp, Homo sapiens
taggatctcactctgtcactcag

SEQ ID NO: 146877 - DNA, 23 bp, Homo sapiens
cgtattgtaaatgttatggtaat

SEQ ID NO: 146878 - DNA, 21 bp, Homo sapiens
tgtgtgtgtgtattagtatct

SEQ ID NO: 146879 - DNA, 22 bp, Homo sapiens
ttgacctggtcatgcatgtaga

SEQ ID NO: 146880 - DNA, 21 bp, Homo sapiens
tttcagtctgatgagatggtc

SEQ ID NO: 146881 - DNA, 23 bp, Homo sapiens
tgctgagtctagttccagcatcg

SEQ ID NO: 146882 - DNA, 21 bp, Homo sapiens
tgacagatgagtgagaactgg

SEQ ID NO: 146883 - DNA, 22 bp, Homo sapiens
ctggataagttatctttgtgag

SEQ ID NO: 146884 - DNA, 23 bp, Homo sapiens
tggaatgaattcaacttttcccc

SEQ ID NO: 146885 - DNA, 23 bp, Homo sapiens
tgagttcattgtagattctggat

SEQ ID NO: 146886 - DNA, 23 bp, Homo sapiens
tgagttcattgtagattctggat

SEQ ID NO: 146887 - DNA, 21 bp, Homo sapiens
tctctgtgtgtatatatctgt

SEQ ID NO: 146888 - DNA, 18 bp, Homo sapiens
gaggtgtcccagtaagaa

SEQ ID NO: 146889 - DNA, 23 bp, Homo sapiens
tgagatggagtctcactctgtcg

SEQ ID NO: 146890 - DNA, 23 bp, Homo sapiens
tgagttcattgtagattctggat

SEQ ID NO: 146891 - DNA, 23 bp, Homo sapiens
tgagttcattgtagattctggat

SEQ ID NO: 146892 - DNA, 23 bp, Homo sapiens
tcagtctcagtctctttttacag

SEQ ID NO: 146893 - DNA, 18 bp, Homo sapiens
gtagtgatagatatggga

SEQ ID NO: 146894 - DNA, 21 bp, Homo sapiens
taattgggaataaattgaaga

SEQ ID NO: 146895 - DNA, 19 bp, Homo sapiens
tgcttcagtatatattttc

SEQ ID NO: 146896 - DNA, 23 bp, Homo sapiens
ataaacagagacaatgatgttcg

SEQ ID NO: 146897 - DNA, 22 bp, Homo sapiens
aatagttttgagatttagtagt

SEQ ID NO: 146898 - DNA, 23 bp, Homo sapiens
tatatgcatatatatgcttatct

SEQ ID NO: 146899 - DNA, 23 bp, Homo sapiens
ttagtacatcttataagcagaag

SEQ ID NO: 146900 - DNA, 21 bp, Homo sapiens
tatatctatatctatatctat

SEQ ID NO: 146901 - DNA, 23 bp, Homo sapiens
atatatgtatgtatagatagatg

SEQ ID NO: 146902 - DNA, 18 bp, Homo sapiens
atgtatgtatatgtgtat

SEQ ID NO: 146903 - DNA, 22 bp, Homo sapiens
tatatatgtgtgtgtatatgta

SEQ ID NO: 146904 - DNA, 19 bp, Homo sapiens
tgtgtatatgtgtatatat

SEQ ID NO: 146905 - DNA, 22 bp, Homo sapiens
tatgcgtatatatacatatatg

SEQ ID NO: 146906 - DNA, 23 bp, Homo sapiens
accacatacacacacgtgtatat

SEQ ID NO: 146907 - DNA, 22 bp, Homo sapiens
tatgtgtatatatatatgtgtg

SEQ ID NO: 146908 - DNA, 18 bp, Homo sapiens
tgtaaaagaaaactctta

SEQ ID NO: 146909 - DNA, 21 bp, Homo sapiens
ttatctatatcttaagagttt

SEQ ID NO: 146910 - DNA, 19 bp, Homo sapiens
cacaaatagtattgctatc

SEQ ID NO: 146911 - DNA, 23 bp, Homo sapiens
tttttctgcagctattgatatga

SEQ ID NO: 146912 - DNA, 23 bp, Homo sapiens
agctttcaaatgttgaattagca

SEQ ID NO: 146913 - DNA, 23 bp, Homo sapiens
tcaggttgttctttatggcaatg

SEQ ID NO: 146914 - DNA, 23 bp, Homo sapiens
agagtctcactctgtcacccagg

SEQ ID NO: 146915 - DNA, 20 bp, Homo sapiens
tcactgaaacctctgcctcc

SEQ ID NO: 146916 - DNA, 21 bp, Homo sapiens
tttagcactatccacttggta

SEQ ID NO: 146917 - DNA, 21 bp, Homo sapiens
tgcagcagtttttagaaagct

SEQ ID NO: 146918 - DNA, 18 bp, Homo sapiens
ttagtagagcttttctat

SEQ ID NO: 146919 - DNA, 18 bp, Homo sapiens
taatcttctttaccatgc

SEQ ID NO: 146920 - DNA, 23 bp, Homo sapiens
tatgacattggttaagtagctta

SEQ ID NO: 146921 - DNA, 18 bp, Homo sapiens
tacatatattatgtatac

SEQ ID NO: 146922 - DNA, 23 bp, Homo sapiens
tatatacatatatgtggaccatg

SEQ ID NO: 146923 - DNA, 23 bp, Homo sapiens
tatgaatatgtatgtgtatctgg

SEQ ID NO: 146924 - DNA, 23 bp, Homo sapiens
tatacacacacacagatacacgt

SEQ ID NO: 146925 - DNA, 22 bp, Homo sapiens
agactctctgtgtgagattttt

SEQ ID NO: 146926 - DNA, 22 bp, Homo sapiens
tacagaagaaatagtttgctgt

SEQ ID NO: 146927 - DNA, 23 bp, Homo sapiens
tatcacagtgtgtgtactctttg

SEQ ID NO: 146928 - DNA, 23 bp, Homo sapiens
ctattagagcaataacgaagaat

SEQ ID NO: 146929 - DNA, 23 bp, Homo sapiens
tgagttcattgtagattctggat

SEQ ID NO: 146930 - DNA, 23 bp, Homo sapiens
tgagttcattgtagattctggat

SEQ ID NO: 146931 - DNA, 23 bp, Homo sapiens
tttgcatcaatatttatcagaca

SEQ ID NO: 146932 - DNA, 19 bp, Homo sapiens
atatgtatgtgtatatatg

SEQ ID NO: 146933 - DNA, 21 bp, Homo sapiens
acgtgtatatgtatatatgtg

SEQ ID NO: 146934 - DNA, 23 bp, Homo sapiens
tacatgtgcacaatgtgcaggtt

SEQ ID NO: 146935 - DNA, 23 bp, Homo sapiens
tatgtgtgtgtatatgtatgtat

SEQ ID NO: 146936 - DNA, 21 bp, Homo sapiens
tggaatatatatatgtgtgtg

SEQ ID NO: 146937 - DNA, 22 bp, Homo sapiens
gactaggattagttgggattgt

SEQ ID NO: 146938 - DNA, 23 bp, Homo sapiens
ttaccccaaataaattctgtact

SEQ ID NO: 146939 - DNA, 23 bp, Homo sapiens
actctctctgtttgatttgggac

SEQ ID NO: 146940 - DNA, 21 bp, Homo sapiens
agagattgtgtgaaatttaga

SEQ ID NO: 146941 - DNA, 22 bp, Homo sapiens
tatttgatctacatatcctttg

SEQ ID NO: 146942 - DNA, 23 bp, Homo sapiens
tgtgtgtgtatatacatatgtgt

SEQ ID NO: 146943 - DNA, 22 bp, Homo sapiens
gtagtgaactgaatttgatgtt

SEQ ID NO: 146944 - DNA, 23 bp, Homo sapiens
tctcaggattttatatatgtgtg

SEQ ID NO: 146945 - DNA, 19 bp, Homo sapiens
aaaccagtggtttggttat

SEQ ID NO: 146946 - DNA, 23 bp, Homo sapiens
atacttctgatttggttgtataa

SEQ ID NO: 146947 - DNA, 23 bp, Homo sapiens
tgctagatctctccctctgtcgc

SEQ ID NO: 146948 - DNA, 23 bp, Homo sapiens
tttcactctcatagttttctcac

SEQ ID NO: 146949 - DNA, 23 bp, Homo sapiens
tcaatcttggcagattgtgtgtt

SEQ ID NO: 146950 - DNA, 22 bp, Homo sapiens
taatgaaaaaggtcattctgat

SEQ ID NO: 146951 - DNA, 22 bp, Homo sapiens
tgtaaagtaaaaatgtatgttg

SEQ ID NO: 146952 - DNA, 19 bp, Homo sapiens
cccaggtaccctgtatggc

SEQ ID NO: 146953 - DNA, 19 bp, Homo sapiens
cttctctctgagtctcagg

SEQ ID NO: 146954 - DNA, 23 bp, Homo sapiens
tttggagatgtcatcttcttgtt

SEQ ID NO: 146955 - DNA, 23 bp, Homo sapiens
tctgtgtgtgtatatgttctaat

SEQ ID NO: 146956 - DNA, 19 bp, Homo sapiens
aagtgctgggataagaggc

SEQ ID NO: 146957 - DNA, 23 bp, Homo sapiens
tgagttcattgtagattctggat

SEQ ID NO: 146958 - DNA, 23 bp, Homo sapiens
tgagttcattgtagattctggat

SEQ ID NO: 146959 - DNA, 23 bp, Homo sapiens
tggagtctcactctgtcacccag

SEQ ID NO: 146960 - DNA, 23 bp, Homo sapiens
tacagtgtgtgtaatggctgcag

SEQ ID NO: 146961 - DNA, 23 bp, Homo sapiens
tctcaaggccattctctcagtgt

SEQ ID NO: 146962 - DNA, 23 bp, Homo sapiens
ctttggctctgtgtctctgtctc

SEQ ID NO: 146963 - DNA, 20 bp, Homo sapiens
acgtatatatacgtgtatgt

SEQ ID NO: 146964 - DNA, 23 bp, Homo sapiens
atatgtatatatacatgtatgtg

SEQ ID NO: 146965 - DNA, 23 bp, Homo sapiens
gtgtatatatgtatatatgtata

SEQ ID NO: 146966 - DNA, 23 bp, Homo sapiens
tatgtgtatatatgtatatgtgt

SEQ ID NO: 146967 - DNA, 20 bp, Homo sapiens
tatatgtatgtgtatatgtg

SEQ ID NO: 146968 - DNA, 18 bp, Homo sapiens
tatgtatatatacgtgta

SEQ ID NO: 146969 - DNA, 22 bp, Homo sapiens
atatagacacatatacatgtat

SEQ ID NO: 146970 - DNA, 21 bp, Homo sapiens
tgacagatgagaaaaccgagg

SEQ ID NO: 146971 - DNA, 21 bp, Homo sapiens
attgagcaatagacatgtacc

SEQ ID NO: 146972 - DNA, 23 bp, Homo sapiens
tgagttcattgtagattctggat

SEQ ID NO: 146973 - DNA, 23 bp, Homo sapiens
tgagttcattgtagattctggat

SEQ ID NO: 146974 - DNA, 23 bp, Homo sapiens
tgagttcattgtagattctggat

SEQ ID NO: 146975 - DNA, 23 bp, Homo sapiens
tgagttcattgtagattctggat

SEQ ID NO: 146976 - DNA, 23 bp, Homo sapiens
gacagagtctcgctctgtcaccc

SEQ ID NO: 146977 - DNA, 18 bp, Homo sapiens
gagcctcagtggctgcct

SEQ ID NO: 146978 - DNA, 23 bp, Homo sapiens
tgtgtgcgtgtatgtgtgtgtgt

SEQ ID NO: 146979 - DNA, 21 bp, Homo sapiens
tagagacacagttttgctctt

SEQ ID NO: 146980 - DNA, 23 bp, Homo sapiens
gagtctcactctgtcacccaggc

SEQ ID NO: 146981 - DNA, 23 bp, Homo sapiens
tttttgacttgaggcaaatgatt

SEQ ID NO: 146982 - DNA, 19 bp, Homo sapiens
tgagccactaacttctcaa

SEQ ID NO: 146983 - DNA, 22 bp, Homo sapiens
aaactccatctcaaaacaaaca

SEQ ID NO: 146984 - DNA, 23 bp, Homo sapiens
ttctgcatgaggaactgttttcc

SEQ ID NO: 146985 - DNA, 23 bp, Homo sapiens
tctttctgtgttaagtgatgtga

SEQ ID NO: 146986 - DNA, 19 bp, Homo sapiens
atgcctgtagttgcagctc

SEQ ID NO: 146987 - DNA, 23 bp, Homo sapiens
tataagtccatttgtttacaagt

SEQ ID NO: 146988 - DNA, 20 bp, Homo sapiens
acacctgagtagctgggact

SEQ ID NO: 146989 - DNA, 23 bp, Homo sapiens
tcttttatggttgcatatgaaat

SEQ ID NO: 146990 - DNA, 23 bp, Homo sapiens
aagtcagtggtaacttgatgggg

SEQ ID NO: 146991 - DNA, 23 bp, Homo sapiens
tgagttcattgtagattctggat

SEQ ID NO: 146992 - DNA, 23 bp, Homo sapiens
tgagttcattgtagattctggat

SEQ ID NO: 146993 - DNA, 20 bp, Homo sapiens
tatgtatacacacacatata

SEQ ID NO: 146994 - DNA, 23 bp, Homo sapiens
tgagttcattgtagattctggat

SEQ ID NO: 146995 - DNA, 23 bp, Homo sapiens
tgagttcattgtagattctggat

SEQ ID NO: 146996 - DNA, 23 bp, Homo sapiens
catttgtgagatgttcttgtttt

SEQ ID NO: 146997 - DNA, 22 bp, Homo sapiens
aaagagagagagattggactga

SEQ ID NO: 146998 - DNA, 22 bp, Homo sapiens
ctagagtctagactatgtgaac

SEQ ID NO: 146999 - DNA, 19 bp, Homo sapiens
aatgacactggttctaatt

SEQ ID NO: 147000 - DNA, 23 bp, Homo sapiens
atgtgtgtgtataaatatgtgtg

SEQ ID NO: 147001 - DNA, 23 bp, Homo sapiens
gtatatgtgtgtgcatttatgtg

SEQ ID NO: 147002 - DNA, 21 bp, Homo sapiens
agaaatgatcctgttgtgtgc

SEQ ID NO: 147003 - DNA, 20 bp, Homo sapiens
attggattacagttttaagg

SEQ ID NO: 147004 - DNA, 23 bp, Homo sapiens
tgtgagttgagagagaccagatg

SEQ ID NO: 147005 - DNA, 23 bp, Homo sapiens
ttggattttgctgaagagttgca

SEQ ID NO: 147006 - DNA, 23 bp, Homo sapiens
atatgtgtatatatatatgtatg

SEQ ID NO: 147007 - DNA, 22 bp, Homo sapiens
tgagaagtgaggtattgtgggt

SEQ ID NO: 147008 - DNA, 22 bp, Homo sapiens
ttgtctaagagatcatgacaat

SEQ ID NO: 147009 - DNA, 23 bp, Homo sapiens
accttgttggttctatacaattt

SEQ ID NO: 147010 - DNA, 23 bp, Homo sapiens
ggcagtggaagatttgagttttt

SEQ ID NO: 147011 - DNA, 23 bp, Homo sapiens
aatgtgtatatatatgtgtgtgt

SEQ ID NO: 147012 - DNA, 22 bp, Homo sapiens
ccgtatgttgtctccctggtgt

SEQ ID NO: 147013 - DNA, 22 bp, Homo sapiens
tattagactgaaaacagatgga

SEQ ID NO: 147014 - DNA, 23 bp, Homo sapiens
tacgtatgcatgtgtgtgtgtgt

SEQ ID NO: 147015 - DNA, 19 bp, Homo sapiens
tataagcatgtttacacat

SEQ ID NO: 147016 - DNA, 23 bp, Homo sapiens
agagagagagatatatatatcct

SEQ ID NO: 147017 - DNA, 21 bp, Homo sapiens
agaggagagatgagagagcaa

SEQ ID NO: 147018 - DNA, 20 bp, Homo sapiens
tgtatactgcatgtatatga

SEQ ID NO: 147019 - DNA, 22 bp, Homo sapiens
aaagacagtcagtgcttctgct

SEQ ID NO: 147020 - DNA, 23 bp, Homo sapiens
attggtgcaaaagtaatcacggt

SEQ ID NO: 147021 - DNA, 22 bp, Homo sapiens
aaccactattacttttgcacca

SEQ ID NO: 147022 - DNA, 19 bp, Homo sapiens
tatatgtatgtatatgtat

SEQ ID NO: 147023 - DNA, 23 bp, Homo sapiens
gacagagtctcgctctgtcaccc

SEQ ID NO: 147024 - DNA, 18 bp, Homo sapiens
agatgttgctgaggttat

SEQ ID NO: 147025 - DNA, 22 bp, Homo sapiens
gcgtctcactctgacacccagg

SEQ ID NO: 147026 - DNA, 19 bp, Homo sapiens
tctgaagctctttgccact

SEQ ID NO: 147027 - DNA, 19 bp, Homo sapiens
tcccactgcgtctctcttt

SEQ ID NO: 147028 - DNA, 22 bp, Homo sapiens
tgtgaagagcttcctttttttt

SEQ ID NO: 147029 - DNA, 23 bp, Homo sapiens
tgtgtgtgtgtgtttatatacac

SEQ ID NO: 147030 - DNA, 19 bp, Homo sapiens
tatgtgtgtttatatacac

SEQ ID NO: 147031 - DNA, 23 bp, Homo sapiens
tgagttcattgtagattctggat

SEQ ID NO: 147032 - DNA, 23 bp, Homo sapiens
tgagttcattgtagattctggat

SEQ ID NO: 147033 - DNA, 22 bp, Homo sapiens
agagtctcgctctgtcacccag

SEQ ID NO: 147034 - DNA, 23 bp, Homo sapiens
acaagtcattggtgatgttgaag

SEQ ID NO: 147035 - DNA, 22 bp, Homo sapiens
agtaatgtttgtatttttagta

SEQ ID NO: 147036 - DNA, 23 bp, Homo sapiens
catgagccactgtgcttggcaca

SEQ ID NO: 147037 - DNA, 23 bp, Homo sapiens
tcactgggtctctgagtgggaat

SEQ ID NO: 147038 - DNA, 23 bp, Homo sapiens
ttgggatgcttatgttatgatac

SEQ ID NO: 147039 - DNA, 23 bp, Homo sapiens
atatatctttgcatgtgtatttc

SEQ ID NO: 147040 - DNA, 20 bp, Homo sapiens
tctgtcacccagactggagt

SEQ ID NO: 147041 - DNA, 21 bp, Homo sapiens
agaagtgtttaggaggaggtc

SEQ ID NO: 147042 - DNA, 23 bp, Homo sapiens
gctctctcagtgtctcttccagc

SEQ ID NO: 147043 - DNA, 18 bp, Homo sapiens
tgcctggctgtgcgcagt

SEQ ID NO: 147044 - DNA, 23 bp, Homo sapiens
caagctcactcgctcactcacac

SEQ ID NO: 147045 - DNA, 22 bp, Homo sapiens
tctatgctattttaagtgttga

SEQ ID NO: 147046 - DNA, 20 bp, Homo sapiens
tgtagttcaaccaaacatgt

SEQ ID NO: 147047 - DNA, 23 bp, Homo sapiens
gtacatgtgcaggatgtgctggt

SEQ ID NO: 147048 - DNA, 18 bp, Homo sapiens
tttgtgggtggtgtaaga

SEQ ID NO: 147049 - DNA, 18 bp, Homo sapiens
aacaccatttattgatga

SEQ ID NO: 147050 - DNA, 23 bp, Homo sapiens
tatgtgtatatatatgtgtgtat

SEQ ID NO: 147051 - DNA, 23 bp, Homo sapiens
ttgatgtgcactttgaacagtgt

SEQ ID NO: 147052 - DNA, 23 bp, Homo sapiens
tgcttcactgttttcccagggct

SEQ ID NO: 147053 - DNA, 23 bp, Homo sapiens
gttttctaggtgtgtgtctgtct

SEQ ID NO: 147054 - DNA, 19 bp, Homo sapiens
tttcacacagagagagaaa

SEQ ID NO: 147055 - DNA, 23 bp, Homo sapiens
tgagttcattgtagattctggat

SEQ ID NO: 147056 - DNA, 23 bp, Homo sapiens
tgagttcattgtagattctggat

SEQ ID NO: 147057 - DNA, 20 bp, Homo sapiens
atagaaatgaaattggtaag

SEQ ID NO: 147058 - DNA, 22 bp, Homo sapiens
actctgagtactggatccaata

SEQ ID NO: 147059 - DNA, 22 bp, Homo sapiens
tctcacagcaattttgatcaga

SEQ ID NO: 147060 - DNA, 23 bp, Homo sapiens
ttgaacagatgggaaaactaggg

SEQ ID NO: 147061 - DNA, 23 bp, Homo sapiens
tgtgtctgtgtgagtatctgctt

SEQ ID NO: 147062 - DNA, 20 bp, Homo sapiens
tatcctctatatccatgagt

SEQ ID NO: 147063 - DNA, 23 bp, Homo sapiens
tatgaatgagaatatgtgatatt

SEQ ID NO: 147064 - DNA, 23 bp, Homo sapiens
tgaagaggttgtaggtttttaag

SEQ ID NO: 147065 - DNA, 23 bp, Homo sapiens
tgagttcattgtagattctggat

SEQ ID NO: 147066 - DNA, 23 bp, Homo sapiens
tgagttcattgtagattctggat

SEQ ID NO: 147067 - DNA, 23 bp, Homo sapiens
actctgtctatatctgtctgcct

SEQ ID NO: 147068 - DNA, 19 bp, Homo sapiens
tatgtatatatacatatgt

SEQ ID NO: 147069 - DNA, 18 bp, Homo sapiens
tatctatatgtatatttc

SEQ ID NO: 147070 - DNA, 23 bp, Homo sapiens
ttctcatcatcctgatacctgta

SEQ ID NO: 147071 - DNA, 20 bp, Homo sapiens
ttatactttaagttctgggg

SEQ ID NO: 147072 - DNA, 21 bp, Homo sapiens
cagtggttcctaccttttcaa

SEQ ID NO: 147073 - DNA, 21 bp, Homo sapiens
ttggtggtagttgtatctatg

SEQ ID NO: 147074 - DNA, 23 bp, Homo sapiens
tatgatgaagatgatgttgaaga

SEQ ID NO: 147075 - DNA, 23 bp, Homo sapiens
tatatgaagattcatgtgtgtgt

SEQ ID NO: 147076 - DNA, 22 bp, Homo sapiens
tatatgaagattcatgtgtgtg

SEQ ID NO: 147077 - DNA, 22 bp, Homo sapiens
tcttattcagattgtatgctgg

SEQ ID NO: 147078 - DNA, 22 bp, Homo sapiens
tgtgaactgaatttgtttatca

SEQ ID NO: 147079 - DNA, 23 bp, Homo sapiens
tatatgcatgtatatacatatgt

SEQ ID NO: 147080 - DNA, 21 bp, Homo sapiens
gagagcgatgactatctgatg

SEQ ID NO: 147081 - DNA, 18 bp, Homo sapiens
tatcagtagaatctgtac

SEQ ID NO: 147082 - DNA, 23 bp, Homo sapiens
atgtgtgtgtatatatatatgtg

SEQ ID NO: 147083 - DNA, 20 bp, Homo sapiens
aatgcttcagtatatataga

SEQ ID NO: 147084 - DNA, 23 bp, Homo sapiens
cacatacactcactctcttacac

SEQ ID NO: 147085 - DNA, 23 bp, Homo sapiens
aatgtgtgtcaggttttgtggaa

SEQ ID NO: 147086 - DNA, 23 bp, Homo sapiens
ctctgactgagacactgagtgac

SEQ ID NO: 147087 - DNA, 23 bp, Homo sapiens
attaatcacacaggaaagctggt

SEQ ID NO: 147088 - DNA, 21 bp, Homo sapiens
ctcacacctgtaatcccagca

SEQ ID NO: 147089 - DNA, 23 bp, Homo sapiens
atatcagtctggttgagatggct

SEQ ID NO: 147090 - DNA, 18 bp, Homo sapiens
atcaaaggtaggtgtctg

SEQ ID NO: 147091 - DNA, 23 bp, Homo sapiens
aaacattggtcatattggtgagt

SEQ ID NO: 147092 - DNA, 23 bp, Homo sapiens
tcatttgtcaccttttgtcatga

SEQ ID NO: 147093 - DNA, 23 bp, Homo sapiens
acacctttgcaattgacagtgca

SEQ ID NO: 147094 - DNA, 23 bp, Homo sapiens
ctgaggtggagtctggctctgtc

SEQ ID NO: 147095 - DNA, 20 bp, Homo sapiens
ggaatgtattgaagtgtgaa

SEQ ID NO: 147096 - DNA, 20 bp, Homo sapiens
gctgttgaatagaatgtgta

SEQ ID NO: 147097 - DNA, 20 bp, Homo sapiens
actattaagtccatttgttc

SEQ ID NO: 147098 - DNA, 20 bp, Homo sapiens
atcctccagaaagtggtgaa

SEQ ID NO: 147099 - DNA, 18 bp, Homo sapiens
attcagtgtatgtatatg

SEQ ID NO: 147100 - DNA, 23 bp, Homo sapiens
cagactgactgtgcctgtggcaa

SEQ ID NO: 147101 - DNA, 23 bp, Homo sapiens
tctcagcctcactgtttgctagc

SEQ ID NO: 147102 - DNA, 23 bp, Homo sapiens
ttgactgtgagcttttcaattta

SEQ ID NO: 147103 - DNA, 23 bp, Homo sapiens
aagacagttatctattggaaagg

SEQ ID NO: 147104 - DNA, 19 bp, Homo sapiens
atctgtgacattaaaatgt

SEQ ID NO: 147105 - DNA, 23 bp, Homo sapiens
tatactgatttttgctgtatgct

SEQ ID NO: 147106 - DNA, 23 bp, Homo sapiens
tacatgtgcaggatgtgcaggtt

SEQ ID NO: 147107 - DNA, 22 bp, Homo sapiens
tctctcagcatttctagtgggt

SEQ ID NO: 147108 - DNA, 23 bp, Homo sapiens
tgtctctctgtctgtctgtgccc

SEQ ID NO: 147109 - DNA, 23 bp, Homo sapiens
tccagcctctgtctctgggtgac

SEQ ID NO: 147110 - DNA, 23 bp, Homo sapiens
caggcagcaaaactgttggtaag

SEQ ID NO: 147111 - DNA, 23 bp, Homo sapiens
tgagttcattgtagattctggat

SEQ ID NO: 147112 - DNA, 23 bp, Homo sapiens
tgagttcattgtagattctggat

SEQ ID NO: 147113 - DNA, 18 bp, Homo sapiens
ttttgagacggagtctca

SEQ ID NO: 147114 - DNA, 18 bp, Homo sapiens
tctggcctaggaactctc

SEQ ID NO: 147115 - DNA, 23 bp, Homo sapiens
aaagtagaagaggaggagcagga

SEQ ID NO: 147116 - DNA, 22 bp, Homo sapiens
aaggtttatgctctgtctccag

SEQ ID NO: 147117 - DNA, 22 bp, Homo sapiens
cattacagagtgattctgctag

SEQ ID NO: 147118 - DNA, 23 bp, Homo sapiens
gtctcgctctctcgctctgtctc

SEQ ID NO: 147119 - DNA, 23 bp, Homo sapiens
gacagagtctcgctctgtcaccc

SEQ ID NO: 147120 - DNA, 23 bp, Homo sapiens
acagagtctcgctctgtcaccca

SEQ ID NO: 147121 - DNA, 23 bp, Homo sapiens
tttgagagggattatgttgaatc

SEQ ID NO: 147122 - DNA, 23 bp, Homo sapiens
gggtctgtctctggctgtgctgc

SEQ ID NO: 147123 - DNA, 21 bp, Homo sapiens
atgtctctctgtatctctctc

SEQ ID NO: 147124 - DNA, 20 bp, Homo sapiens
tgtgactggagagagtgaag

SEQ ID NO: 147125 - DNA, 21 bp, Homo sapiens
tggtacagagaaggcagacag

SEQ ID NO: 147126 - DNA, 19 bp, Homo sapiens
tgagccaggaaccgtggat

SEQ ID NO: 147127 - DNA, 19 bp, Homo sapiens
tatgtgcatatattaagaa

SEQ ID NO: 147128 - DNA, 21 bp, Homo sapiens
tctgagcctcagtttccccct

SEQ ID NO: 147129 - DNA, 22 bp, Homo sapiens
atcactggattgttgtaaggat

SEQ ID NO: 147130 - DNA, 23 bp, Homo sapiens
acagagtctccctctgacaccca

SEQ ID NO: 147131 - DNA, 23 bp, Homo sapiens
agatggagtctcactctgtctcc

SEQ ID NO: 147132 - DNA, 23 bp, Homo sapiens
ttagagactacagtgagccatga

SEQ ID NO: 147133 - DNA, 20 bp, Homo sapiens
agagcctggattttcttctt

SEQ ID NO: 147134 - DNA, 18 bp, Homo sapiens
tgtgagccactgcgcctg

SEQ ID NO: 147135 - DNA, 23 bp, Homo sapiens
tgctaggtgcttgtattgtattc

SEQ ID NO: 147136 - DNA, 22 bp, Homo sapiens
atacacacacatgtatatgtgt

SEQ ID NO: 147137 - DNA, 20 bp, Homo sapiens
gtacagccattgcacttctt

SEQ ID NO: 147138 - DNA, 23 bp, Homo sapiens
cacactgtctctgtccatgttct

SEQ ID NO: 147139 - DNA, 23 bp, Homo sapiens
gtgtatgtatgtatgtgtgtgtg

SEQ ID NO: 147140 - DNA, 18 bp, Homo sapiens
tcagagggattgagtggc

SEQ ID NO: 147141 - DNA, 22 bp, Homo sapiens
ctctgactatgtgactctcact

SEQ ID NO: 147142 - DNA, 23 bp, Homo sapiens
cactggtgatgtcagcctgggtt

SEQ ID NO: 147143 - DNA, 23 bp, Homo sapiens
agatggagtctcactctgtcacg

SEQ ID NO: 147144 - DNA, 23 bp, Homo sapiens
ggcacagtctgtgcctctcacag

SEQ ID NO: 147145 - DNA, 21 bp, Homo sapiens
tgaggaaggctgtcatcaatc

SEQ ID NO: 147146 - DNA, 21 bp, Homo sapiens
ataaagtctctgtgaattgtc

SEQ ID NO: 147147 - DNA, 23 bp, Homo sapiens
gttttcacagacacatttcaggc

SEQ ID NO: 147148 - DNA, 23 bp, Homo sapiens
agatggagtgtcgctctgtcacc

SEQ ID NO: 147149 - DNA, 23 bp, Homo sapiens
tatatacacacatatagatgtac

SEQ ID NO: 147150 - DNA, 23 bp, Homo sapiens
ggagtctcactctgtcacccagg

SEQ ID NO: 147151 - DNA, 19 bp, Homo sapiens
tacagtggtgtgatctctg

SEQ ID NO: 147152 - DNA, 20 bp, Homo sapiens
ttaatcagtgagaaagaaga

SEQ ID NO: 147153 - DNA, 23 bp, Homo sapiens
aaagtctcactctgtgtcccagg

SEQ ID NO: 147154 - DNA, 23 bp, Homo sapiens
ttctctctgcctgtgctcctgtt

SEQ ID NO: 147155 - DNA, 23 bp, Homo sapiens
agggtcatactctgtcagccagg

SEQ ID NO: 147156 - DNA, 23 bp, Homo sapiens
gggcgacagtgagaccctgtctc

SEQ ID NO: 147157 - DNA, 23 bp, Homo sapiens
tgagacagagtctcactctgtca

SEQ ID NO: 147158 - DNA, 23 bp, Homo sapiens
agacaaggtctcactctgtcacc

SEQ ID NO: 147159 - DNA, 23 bp, Homo sapiens
tgagacagagtctcgctctgtcg

SEQ ID NO: 147160 - DNA, 23 bp, Homo sapiens
attttctggatatcttttagttg

SEQ ID NO: 147161 - DNA, 23 bp, Homo sapiens
cagagtctcactgtgtcgcccag

SEQ ID NO: 147162 - DNA, 20 bp, Homo sapiens
agtacagtaacataatcatg

SEQ ID NO: 147163 - DNA, 21 bp, Homo sapiens
tacatgggactctatgtacta

SEQ ID NO: 147164 - DNA, 21 bp, Homo sapiens
tatgtactatttttgcagctt

SEQ ID NO: 147165 - DNA, 18 bp, Homo sapiens
tgcaagctctgcctcctg

SEQ ID NO: 147166 - DNA, 23 bp, Homo sapiens
gacagagtctcgctctgtcaccc

SEQ ID NO: 147167 - DNA, 18 bp, Homo sapiens
atcacagcattgtactct

SEQ ID NO: 147168 - DNA, 19 bp, Homo sapiens
tgtaatcatggctcactgt

SEQ ID NO: 147169 - DNA, 23 bp, Homo sapiens
cagttgaaaatgcatagcttgca

SEQ ID NO: 147170 - DNA, 18 bp, Homo sapiens
tatagatagatatcgata

SEQ ID NO: 147171 - DNA, 23 bp, Homo sapiens
atagaacaagaccctgtctctta

SEQ ID NO: 147172 - DNA, 22 bp, Homo sapiens
agatggagtctcactctgtcac

SEQ ID NO: 147173 - DNA, 23 bp, Homo sapiens
gttcagactctggctctgtcact

SEQ ID NO: 147174 - DNA, 22 bp, Homo sapiens
tgagagagtgagaccctgcctc

SEQ ID NO: 147175 - DNA, 23 bp, Homo sapiens
gagacggagtctcgctctgtcac

SEQ ID NO: 147176 - DNA, 18 bp, Homo sapiens
ggagtgtagagttccacc

SEQ ID NO: 147177 - DNA, 23 bp, Homo sapiens
ctgggcattctcactctcacgta

SEQ ID NO: 147178 - DNA, 23 bp, Homo sapiens
tctgtcaccctgagttcagtcac

SEQ ID NO: 147179 - DNA, 19 bp, Homo sapiens
actcaccctgacagcctgg

SEQ ID NO: 147180 - DNA, 21 bp, Homo sapiens
ttcaccatgttggccaggctg

SEQ ID NO: 147181 - DNA, 23 bp, Homo sapiens
tctgtgacagaagagactgactt

SEQ ID NO: 147182 - DNA, 23 bp, Homo sapiens
aatgctgtcttctctgtgggtga

SEQ ID NO: 147183 - DNA, 21 bp, Homo sapiens
tagagaacctaatcatttgta

SEQ ID NO: 147184 - DNA, 23 bp, Homo sapiens
tctcaggtagttcattatagcaa

SEQ ID NO: 147185 - DNA, 23 bp, Homo sapiens
aaactgggtgatgaagacatgag

SEQ ID NO: 147186 - DNA, 22 bp, Homo sapiens
ttattcctagttaagaattagt

SEQ ID NO: 147187 - DNA, 19 bp, Homo sapiens
agtcccagatttcaaggct

SEQ ID NO: 147188 - DNA, 20 bp, Homo sapiens
aaactgtactgagtcaggac

SEQ ID NO: 147189 - DNA, 23 bp, Homo sapiens
ttgagaagcctcactctgtctct

SEQ ID NO: 147190 - DNA, 19 bp, Homo sapiens
cagaccctgtcactgcctc

SEQ ID NO: 147191 - DNA, 18 bp, Homo sapiens
acttctcagtagctgctt

SEQ ID NO: 147192 - DNA, 23 bp, Homo sapiens
acagagcagacactgactgagtc

SEQ ID NO: 147193 - DNA, 23 bp, Homo sapiens
tgagtgtccttttttttagttta

SEQ ID NO: 147194 - DNA, 21 bp, Homo sapiens
aatgagttaggaatagctgtg

SEQ ID NO: 147195 - DNA, 19 bp, Homo sapiens
gggagagatgtctggtgct

SEQ ID NO: 147196 - DNA, 23 bp, Homo sapiens
gtgtgacttgctctctctctgac

SEQ ID NO: 147197 - DNA, 18 bp, Homo sapiens
tctacagtgcacgtgtct

SEQ ID NO: 147198 - DNA, 18 bp, Homo sapiens
taacaactgaagccggag

SEQ ID NO: 147199 - DNA, 23 bp, Homo sapiens
ctgagagagtggacagagagcca

SEQ ID NO: 147200 - DNA, 22 bp, Homo sapiens
agccattcaggttcttagttgt

SEQ ID NO: 147201 - DNA, 23 bp, Homo sapiens
atacaagtggatttcttttcttt

SEQ ID NO: 147202 - DNA, 23 bp, Homo sapiens
gagatggagtctcactctgtcac

SEQ ID NO: 147203 - DNA, 22 bp, Homo sapiens
ttttgagacagagtctcactct

SEQ ID NO: 147204 - DNA, 19 bp, Homo sapiens
gagctgagcgtggacacag

SEQ ID NO: 147205 - DNA, 21 bp, Homo sapiens
gtcatcctgccactctctctc

SEQ ID NO: 147206 - DNA, 22 bp, Homo sapiens
atagtgagaccctgtctcttaa

SEQ ID NO: 147207 - DNA, 23 bp, Homo sapiens
tgagacagagtctcgctctgtcg

SEQ ID NO: 147208 - DNA, 21 bp, Homo sapiens
tttagtgcttttgctcgaccc

SEQ ID NO: 147209 - DNA, 23 bp, Homo sapiens
agaatgtcactctctgacagacc

SEQ ID NO: 147210 - DNA, 23 bp, Homo sapiens
tccgtctgtgtctttctccatgt

SEQ ID NO: 147211 - DNA, 21 bp, Homo sapiens
agattgaagtgagtgagttca

SEQ ID NO: 147212 - DNA, 23 bp, Homo sapiens
tctgtgtggtattttcttcttta

SEQ ID NO: 147213 - DNA, 18 bp, Homo sapiens
ccttgtgacaaatctgta

SEQ ID NO: 147214 - DNA, 22 bp, Homo sapiens
ttatttatgaatgttcaagtga

SEQ ID NO: 147215 - DNA, 23 bp, Homo sapiens
tgtatgcatgcatgtatgtatgt

SEQ ID NO: 147216 - DNA, 22 bp, Homo sapiens
cagtcctatagataggtttttg

SEQ ID NO: 147217 - DNA, 19 bp, Homo sapiens
tgtatgtgtgcatatgtat

SEQ ID NO: 147218 - DNA, 23 bp, Homo sapiens
ctgtccctgtgactgtgtgtctg

SEQ ID NO: 147219 - DNA, 18 bp, Homo sapiens
tgttgatcacgtgcaggc

SEQ ID NO: 147220 - DNA, 23 bp, Homo sapiens
aaggaaatgaatgaggaactggc

SEQ ID NO: 147221 - DNA, 23 bp, Homo sapiens
tgagtggatgagtgttgatattg

SEQ ID NO: 147222 - DNA, 23 bp, Homo sapiens
aggcatgagccactgtgaccagc

SEQ ID NO: 147223 - DNA, 23 bp, Homo sapiens
acagtgtctcactctgtcacccc

SEQ ID NO: 147224 - DNA, 20 bp, Homo sapiens
cactcagcctcactgcagcc

SEQ ID NO: 147225 - DNA, 23 bp, Homo sapiens
ggtgagtgggtgggtggctgact

SEQ ID NO: 147226 - DNA, 23 bp, Homo sapiens
tgagacgaaatctcgctctgtca

SEQ ID NO: 147227 - DNA, 23 bp, Homo sapiens
gcctgtctctgtctctcactccc

SEQ ID NO: 147228 - DNA, 23 bp, Homo sapiens
gggtctctcagtgtctggggagt

SEQ ID NO: 147229 - DNA, 20 bp, Homo sapiens
tttgagacggagtctcgctc

SEQ ID NO: 147230 - DNA, 23 bp, Homo sapiens
cagcgtctctctctgtcgcccag

SEQ ID NO: 147231 - DNA, 22 bp, Homo sapiens
aatggtgcgatcacaggacact

SEQ ID NO: 147232 - DNA, 23 bp, Homo sapiens
atgtgaatctgcatctggctgtg

SEQ ID NO: 147233 - DNA, 22 bp, Homo sapiens
gaggtgctggtgctgcaggtcc

SEQ ID NO: 147234 - DNA, 18 bp, Homo sapiens
ttttcggtttttttttga

SEQ ID NO: 147235 - DNA, 23 bp, Homo sapiens
ctgtgtgtctgtgtgtccagatt

SEQ ID NO: 147236 - DNA, 20 bp, Homo sapiens
agacacactcacacttccca

SEQ ID NO: 147237 - DNA, 22 bp, Homo sapiens
gttgcaatgactgtgtcacaac

SEQ ID NO: 147238 - DNA, 18 bp, Homo sapiens
aggcttcagtgtgagctc

SEQ ID NO: 147239 - DNA, 21 bp, Homo sapiens
ttggaggatcattaatctgct

SEQ ID NO: 147240 - DNA, 23 bp, Homo sapiens
ttttctaatgttcattgattctg

SEQ ID NO: 147241 - DNA, 23 bp, Homo sapiens
taagagcatgcaggtattgggaa

SEQ ID NO: 147242 - DNA, 23 bp, Homo sapiens
ctcatgctgtctctgtggaagga

SEQ ID NO: 147243 - DNA, 23 bp, Homo sapiens
taaaaggacacagtcatatggga

SEQ ID NO: 147244 - DNA, 23 bp, Homo sapiens
gagtctcactctgtcacccaggc

SEQ ID NO: 147245 - DNA, 23 bp, Homo sapiens
tttgcatgtgattatctgtgcat

SEQ ID NO: 147246 - DNA, 23 bp, Homo sapiens
tgtgtatgtgcatgatgatgtgt

SEQ ID NO: 147247 - DNA, 23 bp, Homo sapiens
tgagatggagtctcactctgtcg

SEQ ID NO: 147248 - DNA, 20 bp, Homo sapiens
acagaggtgagggagctctg

SEQ ID NO: 147249 - DNA, 23 bp, Homo sapiens
gagatggagtctcactctgtccc

SEQ ID NO: 147250 - DNA, 23 bp, Homo sapiens
ttctgcctcatgatagcaagtga

SEQ ID NO: 147251 - DNA, 23 bp, Homo sapiens
acagtgtgcaggatgtgctgtga

SEQ ID NO: 147252 - DNA, 22 bp, Homo sapiens
tactgtgactgctttgccagtg

SEQ ID NO: 147253 - DNA, 23 bp, Homo sapiens
tgagatggagtctctctctgtcc

SEQ ID NO: 147254 - DNA, 23 bp, Homo sapiens
gacactgtcagggacactgtctc

SEQ ID NO: 147255 - DNA, 23 bp, Homo sapiens
gagatggagtctcactctgtggc

SEQ ID NO: 147256 - DNA, 23 bp, Homo sapiens
taaatcagacaggtgtggtggtg

SEQ ID NO: 147257 - DNA, 22 bp, Homo sapiens
acagaatgagactctgtctcaa

SEQ ID NO: 147258 - DNA, 20 bp, Homo sapiens
tgagacagagtctcactctg

SEQ ID NO: 147259 - DNA, 23 bp, Homo sapiens
tggagtctcactctgtcacccag

SEQ ID NO: 147260 - DNA, 18 bp, Homo sapiens
tggcaagatctcggctca

SEQ ID NO: 147261 - DNA, 19 bp, Homo sapiens
gcatgaggaagctctggag

SEQ ID NO: 147262 - DNA, 23 bp, Homo sapiens
tgggactctgtcagtgcctctca

SEQ ID NO: 147263 - DNA, 23 bp, Homo sapiens
ctcactcagcatgttgtttccaa

SEQ ID NO: 147264 - DNA, 23 bp, Homo sapiens
ctctgtcacccaggctgagtaca

SEQ ID NO: 147265 - DNA, 22 bp, Homo sapiens
agcgtctctccctcactctgcc

SEQ ID NO: 147266 - DNA, 23 bp, Homo sapiens
tatatgtatatatacatatgtgt

SEQ ID NO: 147267 - DNA, 23 bp, Homo sapiens
tatatgtatatatacatatgtgt

SEQ ID NO: 147268 - DNA, 23 bp, Homo sapiens
tatatgtatatatacatatgtgt

SEQ ID NO: 147269 - DNA, 23 bp, Homo sapiens
tatatatacatatgtgtatatat

SEQ ID NO: 147270 - DNA, 19 bp, Homo sapiens
acatagaagctgtcggtga

SEQ ID NO: 147271 - DNA, 23 bp, Homo sapiens
tatatacaccatagtgtgtgtgt

SEQ ID NO: 147272 - DNA, 23 bp, Homo sapiens
tacacagtactgtgtgtgtgtat

SEQ ID NO: 147273 - DNA, 22 bp, Homo sapiens
aatagtgtcaaaaggattggta

SEQ ID NO: 147274 - DNA, 23 bp, Homo sapiens
tctctgtttctctctgtggtttc

SEQ ID NO: 147275 - DNA, 21 bp, Homo sapiens
ttttgagacggagtcttactc

SEQ ID NO: 147276 - DNA, 23 bp, Homo sapiens
gaagtggttctaccattttattt

SEQ ID NO: 147277 - DNA, 19 bp, Homo sapiens
tttgagatggagtattgct

SEQ ID NO: 147278 - DNA, 23 bp, Homo sapiens
cagggtctccctctgtcactcag

SEQ ID NO: 147279 - DNA, 23 bp, Homo sapiens
tgcagtggcatgatcatgggtca

SEQ ID NO: 147280 - DNA, 23 bp, Homo sapiens
ggtctcactctgtcgctgaggct

SEQ ID NO: 147281 - DNA, 23 bp, Homo sapiens
agggtctcactgtgtcacccagg

SEQ ID NO: 147282 - DNA, 19 bp, Homo sapiens
ttccacagggttgtatgag

SEQ ID NO: 147283 - DNA, 19 bp, Homo sapiens
agtgagactccatctcaaa

SEQ ID NO: 147284 - DNA, 23 bp, Homo sapiens
tctctcactcactcactactgtt

SEQ ID NO: 147285 - DNA, 19 bp, Homo sapiens
tacaggcatgagccaccgt

SEQ ID NO: 147286 - DNA, 23 bp, Homo sapiens
aaatggagtctcactctgtctcc

SEQ ID NO: 147287 - DNA, 21 bp, Homo sapiens
gaagacttaggctacagttgg

SEQ ID NO: 147288 - DNA, 23 bp, Homo sapiens
ttatgtacttgatgtgcagtact

SEQ ID NO: 147289 - DNA, 23 bp, Homo sapiens
atggagtctcactctgtcaccca

SEQ ID NO: 147290 - DNA, 23 bp, Homo sapiens
tggagtctcactctgtcacccag

SEQ ID NO: 147291 - DNA, 22 bp, Homo sapiens
aggacaaagtgagaccttgtct

SEQ ID NO: 147292 - DNA, 23 bp, Homo sapiens
gctctgtcacactctgccttcct

SEQ ID NO: 147293 - DNA, 20 bp, Homo sapiens
cctgtcactctctctgtgcg

SEQ ID NO: 147294 - DNA, 23 bp, Homo sapiens
tgagacggagtctcgctctgtca

SEQ ID NO: 147295 - DNA, 23 bp, Homo sapiens
catctctctgacactccatttcc

SEQ ID NO: 147296 - DNA, 23 bp, Homo sapiens
tctgtctcagcctctccttggga

SEQ ID NO: 147297 - DNA, 19 bp, Homo sapiens
ctgggtccctgtatgccag

SEQ ID NO: 147298 - DNA, 23 bp, Homo sapiens
tgtgtccctctgtgtctggctta

SEQ ID NO: 147299 - DNA, 23 bp, Homo sapiens
ggagtctcactctgtcacccaag

SEQ ID NO: 147300 - DNA, 22 bp, Homo sapiens
tgtgagctcacagtgagctctg

SEQ ID NO: 147301 - DNA, 20 bp, Homo sapiens
attccagcctggacaacagt

SEQ ID NO: 147302 - DNA, 23 bp, Homo sapiens
tttttgagatggagtctcgctct

SEQ ID NO: 147303 - DNA, 23 bp, Homo sapiens
tgtgtgtgtgtatatgtatatct

SEQ ID NO: 147304 - DNA, 23 bp, Homo sapiens
acactctgtctcgctctgttgcc

SEQ ID NO: 147305 - DNA, 21 bp, Homo sapiens
acagtggcgagatcttggctc

SEQ ID NO: 147306 - DNA, 23 bp, Homo sapiens
tgtgtgtctgtatgtgtctgtgt

SEQ ID NO: 147307 - DNA, 23 bp, Homo sapiens
agacagagtctcgcattgttgcc

SEQ ID NO: 147308 - DNA, 23 bp, Homo sapiens
gacagagtctcgctctgtcaccc

SEQ ID NO: 147309 - DNA, 23 bp, Homo sapiens
gacagagtctcgctctgtcaccc

SEQ ID NO: 147310 - DNA, 23 bp, Homo sapiens
tctcagtctctggctttcttctg

SEQ ID NO: 147311 - DNA, 23 bp, Homo sapiens
ttcacacttgtgtgtgtgttcag

SEQ ID NO: 147312 - DNA, 22 bp, Homo sapiens
tgtgctagtgactcctgtgtgc

SEQ ID NO: 147313 - DNA, 23 bp, Homo sapiens
tgtttttgagacagtctcactct

SEQ ID NO: 147314 - DNA, 23 bp, Homo sapiens
gtcagtgacactccctttttttt

SEQ ID NO: 147315 - DNA, 23 bp, Homo sapiens
gacggagtctcgctgtgtctgtc

SEQ ID NO: 147316 - DNA, 23 bp, Homo sapiens
gctcggtctctgtctccgaggaa

SEQ ID NO: 147317 - DNA, 18 bp, Homo sapiens
actcagtatctgtctggc

SEQ ID NO: 147318 - DNA, 23 bp, Homo sapiens
tggctggctggctggctgactgt

SEQ ID NO: 147319 - DNA, 21 bp, Homo sapiens
tgcctgggtgcctgcttgcct

SEQ ID NO: 147320 - DNA, 23 bp, Homo sapiens
aagttggagtctcactctgtcgc

SEQ ID NO: 147321 - DNA, 22 bp, Homo sapiens
tgtgtgcctgtagtcatagctt

SEQ ID NO: 147322 - DNA, 20 bp, Homo sapiens
atttttttgttttgcaatgg

SEQ ID NO: 147323 - DNA, 23 bp, Homo sapiens
gtctgtagtcagagtgatgacca

SEQ ID NO: 147324 - DNA, 23 bp, Homo sapiens
tctggcacagcaacaggaaaaga

SEQ ID NO: 147325 - DNA, 23 bp, Homo sapiens
tgagacggagtctcgctctgtca

SEQ ID NO: 147326 - DNA, 23 bp, Homo sapiens
aaaagtattctgaaagcatcctc

SEQ ID NO: 147327 - DNA, 21 bp, Homo sapiens
tctcactctgtcacccaggct

SEQ ID NO: 147328 - DNA, 23 bp, Homo sapiens
tggtgtctcactctgtcacccag

SEQ ID NO: 147329 - DNA, 23 bp, Homo sapiens
gtctggctctctcagacactgtg

SEQ ID NO: 147330 - DNA, 23 bp, Homo sapiens
actgagcttttgataagttgtgt

SEQ ID NO: 147331 - DNA, 23 bp, Homo sapiens
tgagttcattgtagattctggat

SEQ ID NO: 147332 - DNA, 23 bp, Homo sapiens
tgagttcattgtagattctggat

SEQ ID NO: 147333 - DNA, 23 bp, Homo sapiens
gcctgtgtgtgtctctgcatgtg

SEQ ID NO: 147334 - DNA, 19 bp, Homo sapiens
agcacactgatgggtcttg

SEQ ID NO: 147335 - DNA, 22 bp, Homo sapiens
cttcctctgcctctccatgctg

SEQ ID NO: 147336 - DNA, 23 bp, Homo sapiens
tgtctgtctgcctgtctgtcttc

SEQ ID NO: 147337 - DNA, 21 bp, Homo sapiens
tagaggctgcctcacttgtca

SEQ ID NO: 147338 - DNA, 23 bp, Homo sapiens
tgacacagtatctcactcacaga

SEQ ID NO: 147339 - DNA, 18 bp, Homo sapiens
tggcatgatctcggctca

SEQ ID NO: 147340 - DNA, 22 bp, Homo sapiens
tttttggatggagtcttgctct

SEQ ID NO: 147341 - DNA, 23 bp, Homo sapiens
agagttttgaacccagtgggtgt

SEQ ID NO: 147342 - DNA, 21 bp, Homo sapiens
ttggtagaactgggtcaggaa

SEQ ID NO: 147343 - DNA, 23 bp, Homo sapiens
tgcagtcactcactgagtcactt

SEQ ID NO: 147344 - DNA, 23 bp, Homo sapiens
tgagactgagtctggctctgtcg

SEQ ID NO: 147345 - DNA, 23 bp, Homo sapiens
gacagagtctcgctctgtcaccc

SEQ ID NO: 147346 - DNA, 19 bp, Homo sapiens
aagagttggtggattgatg

SEQ ID NO: 147347 - DNA, 23 bp, Homo sapiens
tgtgtgaagaaagtcattggtag

SEQ ID NO: 147348 - DNA, 21 bp, Homo sapiens
tgtgtatatatgtatatatgt

SEQ ID NO: 147349 - DNA, 19 bp, Homo sapiens
tatgtatatatgtgtgtat

SEQ ID NO: 147350 - DNA, 23 bp, Homo sapiens
tgacagacagagtgagacctgat

SEQ ID NO: 147351 - DNA, 21 bp, Homo sapiens
cagagtctcactctgtcaccc

SEQ ID NO: 147352 - DNA, 21 bp, Homo sapiens
catatgtatatgaaatgcata

SEQ ID NO: 147353 - DNA, 22 bp, Homo sapiens
ttgctctgtgcttattctttcg

SEQ ID NO: 147354 - DNA, 23 bp, Homo sapiens
tcaggtttgtatacatgtattcg

SEQ ID NO: 147355 - DNA, 23 bp, Homo sapiens
tatttatgtcaggtatgtttatg

SEQ ID NO: 147356 - DNA, 20 bp, Homo sapiens
ttttttgtttttgtttttgt

SEQ ID NO: 147357 - DNA, 23 bp, Homo sapiens
cacagtggctcatacttgtaatt

SEQ ID NO: 147358 - DNA, 21 bp, Homo sapiens
tgaggtaggaggatcacttga

SEQ ID NO: 147359 - DNA, 23 bp, Homo sapiens
acagagtctcgctctgtctccca

SEQ ID NO: 147360 - DNA, 23 bp, Homo sapiens
ctgggactctctgagcctctgtg

SEQ ID NO: 147361 - DNA, 23 bp, Homo sapiens
tacactgtagttcccaagaagac

SEQ ID NO: 147362 - DNA, 23 bp, Homo sapiens
gggcaacatagagactggaaagg

SEQ ID NO: 147363 - DNA, 21 bp, Homo sapiens
aggagctctcagagttaattc

SEQ ID NO: 147364 - DNA, 18 bp, Homo sapiens
gagggtctctgtatgcca

SEQ ID NO: 147365 - DNA, 19 bp, Homo sapiens
aatggctgtgcagccttag

SEQ ID NO: 147366 - DNA, 23 bp, Homo sapiens
ttgagactcaggaagagccagtg

SEQ ID NO: 147367 - DNA, 23 bp, Homo sapiens
atggagtctcactctgtcaccca

SEQ ID NO: 147368 - DNA, 23 bp, Homo sapiens
tcagttcagtgagtaaagttggg

SEQ ID NO: 147369 - DNA, 22 bp, Homo sapiens
acacagggtctacctctgtcac

SEQ ID NO: 147370 - DNA, 23 bp, Homo sapiens
tcactctgttggtctctgcctct

SEQ ID NO: 147371 - DNA, 23 bp, Homo sapiens
tgcatgtatgtgtgtgtgtatgt

SEQ ID NO: 147372 - DNA, 23 bp, Homo sapiens
tgagttcattgtagattctggat

SEQ ID NO: 147373 - DNA, 23 bp, Homo sapiens
tgagttcattgtagattctggat

SEQ ID NO: 147374 - DNA, 21 bp, Homo sapiens
tggcacagtgcaagtgtgtgg

SEQ ID NO: 147375 - DNA, 19 bp, Homo sapiens
agagcctgtgacacccggt

SEQ ID NO: 147376 - DNA, 23 bp, Homo sapiens
gattggtctgacaggtcttctgt

SEQ ID NO: 147377 - DNA, 18 bp, Homo sapiens
tgtattttactgtctgct

SEQ ID NO: 147378 - DNA, 19 bp, Homo sapiens
tttccatgaaattagggga

SEQ ID NO: 147379 - DNA, 23 bp, Homo sapiens
tgagttcattgtagattctggat

SEQ ID NO: 147380 - DNA, 23 bp, Homo sapiens
tgagttcattgtagattctggat

SEQ ID NO: 147381 - DNA, 23 bp, Homo sapiens
tccatatgaatagatatatagat

SEQ ID NO: 147382 - DNA, 23 bp, Homo sapiens
agacagagtctcgctctgtcacc

SEQ ID NO: 147383 - DNA, 23 bp, Homo sapiens
tttgacttgactctgaatgtgct

SEQ ID NO: 147384 - DNA, 23 bp, Homo sapiens
caaagagattctgtttcctgtgt

SEQ ID NO: 147385 - DNA, 23 bp, Homo sapiens
aagactctctttctctttctcag

SEQ ID NO: 147386 - DNA, 23 bp, Homo sapiens
tgagttcattgtagattctggat

SEQ ID NO: 147387 - DNA, 23 bp, Homo sapiens
tgagttcattgtagattctggat

SEQ ID NO: 147388 - DNA, 23 bp, Homo sapiens
ttgagcatcaactatatatgtat

SEQ ID NO: 147389 - DNA, 19 bp, Homo sapiens
tgtatatgtatacatatac

SEQ ID NO: 147390 - DNA, 22 bp, Homo sapiens
tatgtgtatatgtatatatgta

SEQ ID NO: 147391 - DNA, 20 bp, Homo sapiens
acaccctgtgatattttttg

SEQ ID NO: 147392 - DNA, 23 bp, Homo sapiens
tatcacagtgggtgtacactctg

SEQ ID NO: 147393 - DNA, 18 bp, Homo sapiens
aaacactgtgatattttt

SEQ ID NO: 147394 - DNA, 23 bp, Homo sapiens
tatcacagtgggtgtacacacat

SEQ ID NO: 147395 - DNA, 20 bp, Homo sapiens
agaggaagagaattgagaaa

SEQ ID NO: 147396 - DNA, 20 bp, Homo sapiens
atactttaagttctggtgta

SEQ ID NO: 147397 - DNA, 23 bp, Homo sapiens
tattttggttccatatgaaattt

SEQ ID NO: 147398 - DNA, 23 bp, Homo sapiens
tgagttcattgtagattctggat

SEQ ID NO: 147399 - DNA, 23 bp, Homo sapiens
tgagttcattgtagattctggat

SEQ ID NO: 147400 - DNA, 23 bp, Homo sapiens
actctctcagatatcccagccct

SEQ ID NO: 147401 - DNA, 19 bp, Homo sapiens
tgtgcaaattttttttagt

SEQ ID NO: 147402 - DNA, 23 bp, Homo sapiens
atgaatgtattttactgtatgta

SEQ ID NO: 147403 - DNA, 23 bp, Homo sapiens
ttttgagacggagtcttgctctg

SEQ ID NO: 147404 - DNA, 23 bp, Homo sapiens
ggagtctcacactgtcacccagg

SEQ ID NO: 147405 - DNA, 23 bp, Homo sapiens
ggtaatggtcttgatgcagggca

SEQ ID NO: 147406 - DNA, 23 bp, Homo sapiens
ttttaagtgtagactgtgaggtc

SEQ ID NO: 147407 - DNA, 23 bp, Homo sapiens
tgaatctcacattttgcctctgt

SEQ ID NO: 147408 - DNA, 19 bp, Homo sapiens
tatacacccacgtatatat

SEQ ID NO: 147409 - DNA, 21 bp, Homo sapiens
tatgtgtatatacatatgtgt

SEQ ID NO: 147410 - DNA, 19 bp, Homo sapiens
aaatggtggcacaaacagt

SEQ ID NO: 147411 - DNA, 23 bp, Homo sapiens
tagaacagggcttagaagtcaga

SEQ ID NO: 147412 - DNA, 23 bp, Homo sapiens
ttcagtccatgtgcttcttcttt

SEQ ID NO: 147413 - DNA, 23 bp, Homo sapiens
tgagttcattgtagattctggat

SEQ ID NO: 147414 - DNA, 23 bp, Homo sapiens
tgagttcattgtagattctggat

SEQ ID NO: 147415 - DNA, 19 bp, Homo sapiens
tatgtagacacacacacac

SEQ ID NO: 147416 - DNA, 23 bp, Homo sapiens
acactgatgtggtttggctctgt

SEQ ID NO: 147417 - DNA, 22 bp, Homo sapiens
aaaatggtaatttttaaagaga

SEQ ID NO: 147418 - DNA, 23 bp, Homo sapiens
atttttttctttatgattccatt

SEQ ID NO: 147419 - DNA, 18 bp, Homo sapiens
aaagttctgtgggtggag

SEQ ID NO: 147420 - DNA, 23 bp, Homo sapiens
tgtatatatgtgtgtacatatgt

SEQ ID NO: 147421 - DNA, 19 bp, Homo sapiens
atgtctatacatatgtgtg

SEQ ID NO: 147422 - DNA, 23 bp, Homo sapiens
atatacacacacctatatgtata

SEQ ID NO: 147423 - DNA, 23 bp, Homo sapiens
ttatctgtgaagtgagtttcttg

SEQ ID NO: 147424 - DNA, 18 bp, Homo sapiens
taatggtttcaaggctta

SEQ ID NO: 147425 - DNA, 20 bp, Homo sapiens
atgtgctatatatatgtaca

SEQ ID NO: 147426 - DNA, 23 bp, Homo sapiens
ttgtctctatttgtgtatgtgtt

SEQ ID NO: 147427 - DNA, 18 bp, Homo sapiens
tgtggttatgatgacata

SEQ ID NO: 147428 - DNA, 23 bp, Homo sapiens
agagtctcactctgtcactcagg

SEQ ID NO: 147429 - DNA, 23 bp, Homo sapiens
atatgtgtgcatatgtttgtgtg

SEQ ID NO: 147430 - DNA, 23 bp, Homo sapiens
gagactgacatgggttcacatct

SEQ ID NO: 147431 - DNA, 22 bp, Homo sapiens
tcagtcactctcagttacatgt

SEQ ID NO: 147432 - DNA, 20 bp, Homo sapiens
tgaggaatatatatgtgtat

SEQ ID NO: 147433 - DNA, 22 bp, Homo sapiens
tgtatgtgcatgtgtattcata

SEQ ID NO: 147434 - DNA, 23 bp, Homo sapiens
ctcaatcgttatgtaggtctatg

SEQ ID NO: 147435 - DNA, 21 bp, Homo sapiens
tacatgtatatgtacatgtat

SEQ ID NO: 147436 - DNA, 23 bp, Homo sapiens
tgagttcattgtagattctggat

SEQ ID NO: 147437 - DNA, 23 bp, Homo sapiens
tgagttcattgtagattctggat

SEQ ID NO: 147438 - DNA, 19 bp, Homo sapiens
tgtgagaagaatgtcacca

SEQ ID NO: 147439 - DNA, 22 bp, Homo sapiens
atccactaacagcttgcgctat

SEQ ID NO: 147440 - DNA, 23 bp, Homo sapiens
tatttctaactttttgatgtggg

SEQ ID NO: 147441 - DNA, 21 bp, Homo sapiens
cctgggtctctgtgtgtgtct

SEQ ID NO: 147442 - DNA, 18 bp, Homo sapiens
aatggacatttgggagct

SEQ ID NO: 147443 - DNA, 23 bp, Homo sapiens
gagtctcactctgacacccaggc

SEQ ID NO: 147444 - DNA, 23 bp, Homo sapiens
aaactgcttcatgatgtgagcat

SEQ ID NO: 147445 - DNA, 23 bp, Homo sapiens
atctcacagagttgaacatttct

SEQ ID NO: 147446 - DNA, 23 bp, Homo sapiens
ttaattgtgaaagctatgcattt

SEQ ID NO: 147447 - DNA, 23 bp, Homo sapiens
tgtgaagcagaggctgtgttgag

SEQ ID NO: 147448 - DNA, 22 bp, Homo sapiens
attatttgtttttcaatcctgt

SEQ ID NO: 147449 - DNA, 22 bp, Homo sapiens
aagactctctttgtgtatgaat

SEQ ID NO: 147450 - DNA, 22 bp, Homo sapiens
ctggataatgtccaggttttag

SEQ ID NO: 147451 - DNA, 20 bp, Homo sapiens
tatgtgtgtgtatatgtata

SEQ ID NO: 147452 - DNA, 21 bp, Homo sapiens
tgtgtatatatacatatatgt

SEQ ID NO: 147453 - DNA, 20 bp, Homo sapiens
atatatacagatatagatga

SEQ ID NO: 147454 - DNA, 22 bp, Homo sapiens
aagtatgtgagtgtgagacaga

SEQ ID NO: 147455 - DNA, 22 bp, Homo sapiens
tctgtgccacactgtgttatct

SEQ ID NO: 147456 - DNA, 23 bp, Homo sapiens
aaaagaaaagttagcaagtgata

SEQ ID NO: 147457 - DNA, 23 bp, Homo sapiens
tcacagtgggtgtacatcatgtg

SEQ ID NO: 147458 - DNA, 20 bp, Homo sapiens
ctgactgcgagtgatctgcc

SEQ ID NO: 147459 - DNA, 20 bp, Homo sapiens
ggagtctctctcactcagtg

SEQ ID NO: 147460 - DNA, 23 bp, Homo sapiens
tgcattgttctcacagtgctgaa

SEQ ID NO: 147461 - DNA, 23 bp, Homo sapiens
atgcacacacccaaagttgtttc

SEQ ID NO: 147462 - DNA, 21 bp, Homo sapiens
acatgtgcacaatgtgcaggt

SEQ ID NO: 147463 - DNA, 23 bp, Homo sapiens
tatatgtgtatatacatatgtgt

SEQ ID NO: 147464 - DNA, 23 bp, Homo sapiens
atgtgtgtatatatgtacgtgta

SEQ ID NO: 147465 - DNA, 20 bp, Homo sapiens
atatgtttatatgtatacat

SEQ ID NO: 147466 - DNA, 23 bp, Homo sapiens
catgtgtcagtagtgtgatgtaa

SEQ ID NO: 147467 - DNA, 23 bp, Homo sapiens
tgagatggagtctggctctgtcg

SEQ ID NO: 147468 - DNA, 21 bp, Homo sapiens
tgagatagagtcgctctgttg

SEQ ID NO: 147469 - DNA, 22 bp, Homo sapiens
acagtagtgaaatacatcaact

SEQ ID NO: 147470 - DNA, 22 bp, Homo sapiens
aactgtttttgtttttgagacg

SEQ ID NO: 147471 - DNA, 23 bp, Homo sapiens
tgacagagtgagaccctgtctga

SEQ ID NO: 147472 - DNA, 23 bp, Homo sapiens
ttgtttgtgagagaatgttgatg

SEQ ID NO: 147473 - DNA, 23 bp, Homo sapiens
ggagtctcactctgtcacccaag

SEQ ID NO: 147474 - DNA, 22 bp, Homo sapiens
tgagatggagtttcgctcttgt

SEQ ID NO: 147475 - DNA, 20 bp, Homo sapiens
agacaggctctctctcagtt

SEQ ID NO: 147476 - DNA, 23 bp, Homo sapiens
acaaggtcttgctctgtcagcca

SEQ ID NO: 147477 - DNA, 23 bp, Homo sapiens
cttctgtctggatgtcttctgtt

SEQ ID NO: 147478 - DNA, 23 bp, Homo sapiens
ttagagacggagtcttactctgt

SEQ ID NO: 147479 - DNA, 23 bp, Homo sapiens
acagactgagactctgtctcaaa

SEQ ID NO: 147480 - DNA, 19 bp, Homo sapiens
tgagattccatctcaattt

SEQ ID NO: 147481 - DNA, 19 bp, Homo sapiens
ggagtctcactctgtcacc

SEQ ID NO: 147482 - DNA, 23 bp, Homo sapiens
tggagtctcactctgtcacccag

SEQ ID NO: 147483 - DNA, 18 bp, Homo sapiens
aaacagagtctcacactt

SEQ ID NO: 147484 - DNA, 18 bp, Homo sapiens
tggctgtgtcccttgggc

SEQ ID NO: 147485 - DNA, 23 bp, Homo sapiens
tctaagtctcagtttctcatctg

SEQ ID NO: 147486 - DNA, 23 bp, Homo sapiens
aagtgacactgacacttctcagg

SEQ ID NO: 147487 - DNA, 23 bp, Homo sapiens
gtctcgctgtctcgctctgttgc

SEQ ID NO: 147488 - DNA, 23 bp, Homo sapiens
gagtcttactctgtcactctgtt

SEQ ID NO: 147489 - DNA, 23 bp, Homo sapiens
cttcctcactgcctgcctctgag

SEQ ID NO: 147490 - DNA, 21 bp, Homo sapiens
tgaggtagcaggatcacttga

SEQ ID NO: 147491 - DNA, 23 bp, Homo sapiens
gtctgtgtctgtcactgttcttg

SEQ ID NO: 147492 - DNA, 23 bp, Homo sapiens
tcaatgagctggttgtggtggct

SEQ ID NO: 147493 - DNA, 21 bp, Homo sapiens
tgaggtaggaggatcacttga

SEQ ID NO: 147494 - DNA, 23 bp, Homo sapiens
actgagtctcactctgtcgccct

SEQ ID NO: 147495 - DNA, 23 bp, Homo sapiens
agacagtgtctcgctctgtcgct

SEQ ID NO: 147496 - DNA, 23 bp, Homo sapiens
tttttgtagagtctgggtctcac

SEQ ID NO: 147497 - DNA, 23 bp, Homo sapiens
aagtctcactctgtcacccaggc

SEQ ID NO: 147498 - DNA, 19 bp, Homo sapiens
agtagtgcgatctcagctc

SEQ ID NO: 147499 - DNA, 23 bp, Homo sapiens
tttgagacagagtcttgcactgt

SEQ ID NO: 147500 - DNA, 23 bp, Homo sapiens
tctcgactcactgcaacctctgc

SEQ ID NO: 147501 - DNA, 21 bp, Homo sapiens
aagtgtgttttcttcatctgg

SEQ ID NO: 147502 - DNA, 20 bp, Homo sapiens
agaggtacaggattccaagt

SEQ ID NO: 147503 - DNA, 23 bp, Homo sapiens
tctgccactcactggctctgtga

SEQ ID NO: 147504 - DNA, 21 bp, Homo sapiens
tgagacagagtctcactctgt

SEQ ID NO: 147505 - DNA, 23 bp, Homo sapiens
tgagaactaacatagatttggtt

SEQ ID NO: 147506 - DNA, 20 bp, Homo sapiens
agtctgagagcacatgggag

SEQ ID NO: 147507 - DNA, 19 bp, Homo sapiens
acactgagcagacacagac

SEQ ID NO: 147508 - DNA, 23 bp, Homo sapiens
cagtgactctgagactctcatct

SEQ ID NO: 147509 - DNA, 23 bp, Homo sapiens
tggctcactctctgtcactttgg

SEQ ID NO: 147510 - DNA, 21 bp, Homo sapiens
tcacagtcctagctttctgtt

SEQ ID NO: 147511 - DNA, 22 bp, Homo sapiens
tgagccaggcagagtagagtgg

SEQ ID NO: 147512 - DNA, 23 bp, Homo sapiens
tgagatggagtttcactctgtca

SEQ ID NO: 147513 - DNA, 23 bp, Homo sapiens
ctcagagagaggacagagggcac

SEQ ID NO: 147514 - DNA, 23 bp, Homo sapiens
tgactacctgctggagagatttg

SEQ ID NO: 147515 - DNA, 22 bp, Homo sapiens
tacctgggtgatagtgtggagt

SEQ ID NO: 147516 - DNA, 23 bp, Homo sapiens
tgactgacagacagacttgatgc

SEQ ID NO: 147517 - DNA, 22 bp, Homo sapiens
tcactagcaccttttgttaatt

SEQ ID NO: 147518 - DNA, 18 bp, Homo sapiens
tagcagaaaacagtgctg

SEQ ID NO: 147519 - DNA, 23 bp, Homo sapiens
agggtctcactctgtctcccagg

SEQ ID NO: 147520 - DNA, 18 bp, Homo sapiens
acagtggtgcgatctcag

SEQ ID NO: 147521 - DNA, 20 bp, Homo sapiens
agccggagttcagtggcatg

SEQ ID NO: 147522 - DNA, 20 bp, Homo sapiens
atatgttatatattatatgt

SEQ ID NO: 147523 - DNA, 23 bp, Homo sapiens
gtagtagcaagtgcaagcgtttt

SEQ ID NO: 147524 - DNA, 21 bp, Homo sapiens
taaacaacttactttctctct

SEQ ID NO: 147525 - DNA, 21 bp, Homo sapiens
acttgtgcagaatgtgcaggt

SEQ ID NO: 147526 - DNA, 23 bp, Homo sapiens
gtgtgactgtctgcctgtgttgt

SEQ ID NO: 147527 - DNA, 23 bp, Homo sapiens
tagctcactgcagcctcagtctc

SEQ ID NO: 147528 - DNA, 23 bp, Homo sapiens
agtctgagatcaaggtgtgagca

SEQ ID NO: 147529 - DNA, 22 bp, Homo sapiens
gctgcctctctccttggcttgt

SEQ ID NO: 147530 - DNA, 22 bp, Homo sapiens
tggattttgttcccattgtgat

SEQ ID NO: 147531 - DNA, 23 bp, Homo sapiens
tcactgcctgtgtgtgtctgggt

SEQ ID NO: 147532 - DNA, 21 bp, Homo sapiens
acacacgtatacatacacaac

SEQ ID NO: 147533 - DNA, 18 bp, Homo sapiens
tatgtgtatatatacatg

SEQ ID NO: 147534 - DNA, 23 bp, Homo sapiens
ttggtgacacatgaattcactgt

SEQ ID NO: 147535 - DNA, 23 bp, Homo sapiens
ctcacttgtctctgtctctgtcc

SEQ ID NO: 147536 - DNA, 18 bp, Homo sapiens
gtagtgatgtttttgctg

SEQ ID NO: 147537 - DNA, 22 bp, Homo sapiens
aaagtcacacacacaaatctga

SEQ ID NO: 147538 - DNA, 23 bp, Homo sapiens
gtcagagtctcgctctgtcactc

SEQ ID NO: 147539 - DNA, 22 bp, Homo sapiens
gtgcaatggtgtgatcttggct

SEQ ID NO: 147540 - DNA, 23 bp, Homo sapiens
agagtctcactctgtcacccagg

SEQ ID NO: 147541 - DNA, 23 bp, Homo sapiens
ggcagtggaagtagcttgtcctc

SEQ ID NO: 147542 - DNA, 23 bp, Homo sapiens
acacacacttgggtagttttctg

SEQ ID NO: 147543 - DNA, 23 bp, Homo sapiens
actcagcatcatgtttctgagaa

SEQ ID NO: 147544 - DNA, 19 bp, Homo sapiens
acagattgaaactccgtct

SEQ ID NO: 147545 - DNA, 22 bp, Homo sapiens
gtgggctcactctgtcactcag

SEQ ID NO: 147546 - DNA, 23 bp, Homo sapiens
attttgattgggattgctttgag

SEQ ID NO: 147547 - DNA, 23 bp, Homo sapiens
acacagcctgtttagtagctgag

SEQ ID NO: 147548 - DNA, 23 bp, Homo sapiens
ttgagatggagttttgctcttgt

SEQ ID NO: 147549 - DNA, 23 bp, Homo sapiens
ggtctcactctgtcacccagcct

SEQ ID NO: 147550 - DNA, 19 bp, Homo sapiens
taagcatttaggttgttct

SEQ ID NO: 147551 - DNA, 22 bp, Homo sapiens
gttagcactgtctgtgcctctc

SEQ ID NO: 147552 - DNA, 22 bp, Homo sapiens
ctctcactctgtctaatgcccc

SEQ ID NO: 147553 - DNA, 23 bp, Homo sapiens
tgagttcattgtagattctggat

SEQ ID NO: 147554 - DNA, 23 bp, Homo sapiens
tgagttcattgtagattctggat

SEQ ID NO: 147555 - DNA, 23 bp, Homo sapiens
tgagttcattgtagattctggat

SEQ ID NO: 147556 - DNA, 23 bp, Homo sapiens
tgagttcattgtagattctggat

SEQ ID NO: 147557 - DNA, 23 bp, Homo sapiens
ggacatggtatctctcacaggct

SEQ ID NO: 147558 - DNA, 23 bp, Homo sapiens
tgaacacagaacatatgacctcc

SEQ ID NO: 147559 - DNA, 21 bp, Homo sapiens
actctatttcaaatattgctt

SEQ ID NO: 147560 - DNA, 19 bp, Homo sapiens
agttgatattgaatggaga

SEQ ID NO: 147561 - DNA, 23 bp, Homo sapiens
aggatttctgattttgtagatga

SEQ ID NO: 147562 - DNA, 20 bp, Homo sapiens
acccagactcctttgcttct

SEQ ID NO: 147563 - DNA, 23 bp, Homo sapiens
tgtgaaacagtttgcttatgagg

SEQ ID NO: 147564 - DNA, 23 bp, Homo sapiens
tctgtctttcacatttttctgcc

SEQ ID NO: 147565 - DNA, 20 bp, Homo sapiens
ttcacattcccaaatgctgg

SEQ ID NO: 147566 - DNA, 22 bp, Homo sapiens
tttgagattcaagattgttttg

SEQ ID NO: 147567 - DNA, 19 bp, Homo sapiens
tgtatgtgtgtgtgtatac

SEQ ID NO: 147568 - DNA, 21 bp, Homo sapiens
acacagcctgtaaaggtggaa

SEQ ID NO: 147569 - DNA, 23 bp, Homo sapiens
gaccacacagactgtaaaggtgg

SEQ ID NO: 147570 - DNA, 19 bp, Homo sapiens
ttgtcagaaggatagttta

SEQ ID NO: 147571 - DNA, 23 bp, Homo sapiens
tgagttcattgtagattctggat

SEQ ID NO: 147572 - DNA, 23 bp, Homo sapiens
tgagttcattgtagattctggat

SEQ ID NO: 147573 - DNA, 22 bp, Homo sapiens
tatgagtgtgtgtgtgtatgtg

SEQ ID NO: 147574 - DNA, 23 bp, Homo sapiens
aggaaatttctgtgcatccaggt

SEQ ID NO: 147575 - DNA, 23 bp, Homo sapiens
aagtgagaggtgacagtgtgctg

SEQ ID NO: 147576 - DNA, 22 bp, Homo sapiens
tgcagccctcgctcactctcgg

SEQ ID NO: 147577 - DNA, 21 bp, Homo sapiens
tatatatgtatgtatatatgt

SEQ ID NO: 147578 - DNA, 23 bp, Homo sapiens
atatgtgtgtgtatatgtgtgta

SEQ ID NO: 147579 - DNA, 23 bp, Homo sapiens
tatgtgtgtatatctgtatgtgc

SEQ ID NO: 147580 - DNA, 23 bp, Homo sapiens
tgtatatgtgtgtatttatgtgt

SEQ ID NO: 147581 - DNA, 23 bp, Homo sapiens
tgagttcattgtagattctggat

SEQ ID NO: 147582 - DNA, 23 bp, Homo sapiens
tgagttcattgtagattctggat

SEQ ID NO: 147583 - DNA, 23 bp, Homo sapiens
gggagaacttggtgaaaggtaca

SEQ ID NO: 147584 - DNA, 20 bp, Homo sapiens
atatatgtagtacatttgcc

SEQ ID NO: 147585 - DNA, 22 bp, Homo sapiens
agagagccgtatctctgtcaca

SEQ ID NO: 147586 - DNA, 19 bp, Homo sapiens
tgtgtgtatatgtatatat

SEQ ID NO: 147587 - DNA, 23 bp, Homo sapiens
tgtgtgtgtgtctcactcaccca

SEQ ID NO: 147588 - DNA, 21 bp, Homo sapiens
aaagagcctcgctctgttgcc

SEQ ID NO: 147589 - DNA, 22 bp, Homo sapiens
actggttctacattatggtgag

SEQ ID NO: 147590 - DNA, 23 bp, Homo sapiens
aagtgcatcacaatacatgtaat

SEQ ID NO: 147591 - DNA, 23 bp, Homo sapiens
tctcactgtgactttgtgcttct

SEQ ID NO: 147592 - DNA, 18 bp, Homo sapiens
cagtgaatatatatacag

SEQ ID NO: 147593 - DNA, 19 bp, Homo sapiens
attccttaatatttgaagt

SEQ ID NO: 147594 - DNA, 19 bp, Homo sapiens
atactttaagttttagggt

SEQ ID NO: 147595 - DNA, 22 bp, Homo sapiens
tatctatatctatctgtatgtc

SEQ ID NO: 147596 - DNA, 23 bp, Homo sapiens
atgtgtgtgtgcatgtccatgtg

SEQ ID NO: 147597 - DNA, 23 bp, Homo sapiens
tggagtctcactctgtcacccag

SEQ ID NO: 147598 - DNA, 22 bp, Homo sapiens
tctgtgattacttgtactcagt

SEQ ID NO: 147599 - DNA, 18 bp, Homo sapiens
ttttgagacggagtctta

SEQ ID NO: 147600 - DNA, 23 bp, Homo sapiens
tatgaagaaagtgaatggtagtt

SEQ ID NO: 147601 - DNA, 23 bp, Homo sapiens
tttagtgtgagtgagattcttgt

SEQ ID NO: 147602 - DNA, 22 bp, Homo sapiens
tgagatcaaggtgtcagcagga

SEQ ID NO: 147603 - DNA, 19 bp, Homo sapiens
gtttcctctgagacttttt

SEQ ID NO: 147604 - DNA, 23 bp, Homo sapiens
gtctgtgtgtctgtttctgtata

SEQ ID NO: 147605 - DNA, 23 bp, Homo sapiens
aaatgtatatctgtatgaaaaag

SEQ ID NO: 147606 - DNA, 21 bp, Homo sapiens
acacacacacacacatatctg

SEQ ID NO: 147607 - DNA, 22 bp, Homo sapiens
gactgagtctcactctgtcgcc

SEQ ID NO: 147608 - DNA, 23 bp, Homo sapiens
gttatcttcagtctctgtctgat

SEQ ID NO: 147609 - DNA, 23 bp, Homo sapiens
tcttagagtaaggttttgtttta

SEQ ID NO: 147610 - DNA, 23 bp, Homo sapiens
ctgtgtgtgtgcatgtgcatgtg

SEQ ID NO: 147611 - DNA, 18 bp, Homo sapiens
gctgggactacaggcaca

SEQ ID NO: 147612 - DNA, 23 bp, Homo sapiens
tgacacagacagagtctcactag

SEQ ID NO: 147613 - DNA, 21 bp, Homo sapiens
ttgagaattcatgttgttaat

SEQ ID NO: 147614 - DNA, 21 bp, Homo sapiens
ttgtgtatttatgtatatgta

SEQ ID NO: 147615 - DNA, 23 bp, Homo sapiens
cattcttttacctttgcctttgt

SEQ ID NO: 147616 - DNA, 23 bp, Homo sapiens
atatgtgtgtgtgcttaacagct

SEQ ID NO: 147617 - DNA, 21 bp, Homo sapiens
tatgcatatatatagatatgt

SEQ ID NO: 147618 - DNA, 22 bp, Homo sapiens
ttatatgtagatgtatatagat

SEQ ID NO: 147619 - DNA, 21 bp, Homo sapiens
atcaacttggtctctgagttt

SEQ ID NO: 147620 - DNA, 21 bp, Homo sapiens
atcagtgctcagttacctgag

SEQ ID NO: 147621 - DNA, 23 bp, Homo sapiens
tgtagaaatgtatagatgatagt

SEQ ID NO: 147622 - DNA, 21 bp, Homo sapiens
tttgtagttcacataggtttt

SEQ ID NO: 147623 - DNA, 23 bp, Homo sapiens
tatgtggctgtccttgaactttt

SEQ ID NO: 147624 - DNA, 19 bp, Homo sapiens
ttgcacagagggcagctgc

SEQ ID NO: 147625 - DNA, 22 bp, Homo sapiens
atgaatgtatgtatatgtgtat

SEQ ID NO: 147626 - DNA, 22 bp, Homo sapiens
atatgtatttgtatacgtgtgc

SEQ ID NO: 147627 - DNA, 22 bp, Homo sapiens
taatgtatatatgtatatgtca

SEQ ID NO: 147628 - DNA, 23 bp, Homo sapiens
tgtgtgtgtttctttatatgtgt

SEQ ID NO: 147629 - DNA, 23 bp, Homo sapiens
ggtcacagactcacttcagaact

SEQ ID NO: 147630 - DNA, 23 bp, Homo sapiens
gtggagttctgtatctctcagtc

SEQ ID NO: 147631 - DNA, 23 bp, Homo sapiens
acagagtgaccaaatcatttgtc

SEQ ID NO: 147632 - DNA, 19 bp, Homo sapiens
atctagaattgggatcaaa

SEQ ID NO: 147633 - DNA, 23 bp, Homo sapiens
tttgaccttgtttattattattt

SEQ ID NO: 147634 - DNA, 18 bp, Homo sapiens
tatcatcgtgtgtgtgta

SEQ ID NO: 147635 - DNA, 23 bp, Homo sapiens
tatgtgtgtgcatatatatactt

SEQ ID NO: 147636 - DNA, 20 bp, Homo sapiens
tcctacagtaattatcatct

SEQ ID NO: 147637 - DNA, 23 bp, Homo sapiens
tgtgatgttgttactgtctgtgt

SEQ ID NO: 147638 - DNA, 23 bp, Homo sapiens
acggtgtctcgctctgtcaccca

SEQ ID NO: 147639 - DNA, 23 bp, Homo sapiens
tctaacactcagtttcttctctg

SEQ ID NO: 147640 - DNA, 22 bp, Homo sapiens
agtcagagcggttgggatgtga

SEQ ID NO: 147641 - DNA, 23 bp, Homo sapiens
tcacaacctctctgactgcttct

SEQ ID NO: 147642 - DNA, 23 bp, Homo sapiens
tgagttcattgtagattctggat

SEQ ID NO: 147643 - DNA, 23 bp, Homo sapiens
tgagttcattgtagattctggat

SEQ ID NO: 147644 - DNA, 21 bp, Homo sapiens
tatatgcatgtatacacgtat

SEQ ID NO: 147645 - DNA, 23 bp, Homo sapiens
tgagttcattgtagattctggat

SEQ ID NO: 147646 - DNA, 23 bp, Homo sapiens
tgagttcattgtagattctggat

SEQ ID NO: 147647 - DNA, 23 bp, Homo sapiens
tgcagagagaagagtctgagagt

SEQ ID NO: 147648 - DNA, 20 bp, Homo sapiens
ctatgcatgcatgtgtgtgt

SEQ ID NO: 147649 - DNA, 19 bp, Homo sapiens
atatagcatgtatacatat

SEQ ID NO: 147650 - DNA, 23 bp, Homo sapiens
cctctgtgagtgtctgtgtaccc

SEQ ID NO: 147651 - DNA, 23 bp, Homo sapiens
tgagatggagtctcactccgtca

SEQ ID NO: 147652 - DNA, 23 bp, Homo sapiens
tggagtctcactctgtcacccag

SEQ ID NO: 147653 - DNA, 23 bp, Homo sapiens
cacaagtgtgtgtgtgacagcga

SEQ ID NO: 147654 - DNA, 23 bp, Homo sapiens
tgagttcattgtagattctggat

SEQ ID NO: 147655 - DNA, 23 bp, Homo sapiens
tgagttcattgtagattctggat

SEQ ID NO: 147656 - DNA, 18 bp, Homo sapiens
cacagcacattcagaaag

SEQ ID NO: 147657 - DNA, 22 bp, Homo sapiens
ggatgttgtcaccttgcagctt

SEQ ID NO: 147658 - DNA, 23 bp, Homo sapiens
gtggtctcaaagtctcacagtct

SEQ ID NO: 147659 - DNA, 23 bp, Homo sapiens
tcacagcttcccagtcttgtagt

SEQ ID NO: 147660 - DNA, 22 bp, Homo sapiens
atggtagtttgtatttctgtgg

SEQ ID NO: 147661 - DNA, 23 bp, Homo sapiens
ttttgctgaggttgaattgtatg

SEQ ID NO: 147662 - DNA, 22 bp, Homo sapiens
tatatacatgtataactataca

SEQ ID NO: 147663 - DNA, 21 bp, Homo sapiens
ttatacatgtatacctataca

SEQ ID NO: 147664 - DNA, 23 bp, Homo sapiens
tttgtgtccctgtgtcagtcatt

SEQ ID NO: 147665 - DNA, 23 bp, Homo sapiens
atatgtatacactgttatgtgta

SEQ ID NO: 147666 - DNA, 23 bp, Homo sapiens
atatgtacatatgtatacatgta

SEQ ID NO: 147667 - DNA, 19 bp, Homo sapiens
ccactctctgactgtcttg

SEQ ID NO: 147668 - DNA, 18 bp, Homo sapiens
agcacacggagacttcag

SEQ ID NO: 147669 - DNA, 23 bp, Homo sapiens
ctctctctggctgtctctctccg

SEQ ID NO: 147670 - DNA, 22 bp, Homo sapiens
tacagtacagtgcagtatagtt

SEQ ID NO: 147671 - DNA, 21 bp, Homo sapiens
aagtggtaagagtgggcattc

SEQ ID NO: 147672 - DNA, 19 bp, Homo sapiens
ctgggagtgagacagcaga

SEQ ID NO: 147673 - DNA, 23 bp, Homo sapiens
attagagtacagagagagaagaa

SEQ ID NO: 147674 - DNA, 23 bp, Homo sapiens
tggagtctcactctgtcacccag

SEQ ID NO: 147675 - DNA, 23 bp, Homo sapiens
ggtcctgagaagttgtcatgctt

SEQ ID NO: 147676 - DNA, 22 bp, Homo sapiens
gaagacactgaagagacacagg

SEQ ID NO: 147677 - DNA, 19 bp, Homo sapiens
actggcagctgaagtaggg

SEQ ID NO: 147678 - DNA, 23 bp, Homo sapiens
atatgtatgtacatgtatacgtg

SEQ ID NO: 147679 - DNA, 21 bp, Homo sapiens
ttttgagacggagtcttgctc

SEQ ID NO: 147680 - DNA, 23 bp, Homo sapiens
agactcagactcactccttgtac

SEQ ID NO: 147681 - DNA, 19 bp, Homo sapiens
tttggcttaggattgtctt

SEQ ID NO: 147682 - DNA, 23 bp, Homo sapiens
tctgtgcctgtcactgaccctgg

SEQ ID NO: 147683 - DNA, 23 bp, Homo sapiens
gagaacctgtgactttttctttt

SEQ ID NO: 147684 - DNA, 23 bp, Homo sapiens
tggagtctcagtctcactctgtc

SEQ ID NO: 147685 - DNA, 22 bp, Homo sapiens
tctctcagtctcttagaatcgc

SEQ ID NO: 147686 - DNA, 23 bp, Homo sapiens
taagacagcgagagaaagagctc

SEQ ID NO: 147687 - DNA, 23 bp, Homo sapiens
acagagtctcactctgtcgccca

SEQ ID NO: 147688 - DNA, 19 bp, Homo sapiens
tggctcacacccataatcc

SEQ ID NO: 147689 - DNA, 22 bp, Homo sapiens
agagtgtctcactctgtcactc

SEQ ID NO: 147690 - DNA, 22 bp, Homo sapiens
taccagtttgtgttaaggttga

SEQ ID NO: 147691 - DNA, 23 bp, Homo sapiens
tgagacggagtctcgctctgtca

SEQ ID NO: 147692 - DNA, 19 bp, Homo sapiens
tccttgagactgtctttta

SEQ ID NO: 147693 - DNA, 23 bp, Homo sapiens
tgagatggagtctcactctgtcg

SEQ ID NO: 147694 - DNA, 19 bp, Homo sapiens
tgaggtaggaggatcactt

SEQ ID NO: 147695 - DNA, 20 bp, Homo sapiens
ttatgaagagcagattggta

SEQ ID NO: 147696 - DNA, 23 bp, Homo sapiens
gtcttctgacttcctgttgagct

SEQ ID NO: 147697 - DNA, 20 bp, Homo sapiens
aaagagactgggtgaattaa

SEQ ID NO: 147698 - DNA, 23 bp, Homo sapiens
actgtcactttttgtctgtgatt

SEQ ID NO: 147699 - DNA, 22 bp, Homo sapiens
caggggctcactctgtcactca

SEQ ID NO: 147700 - DNA, 22 bp, Homo sapiens
aagacagaagtgagtgtccaga

SEQ ID NO: 147701 - DNA, 22 bp, Homo sapiens
caggaatccagagggaattgac

SEQ ID NO: 147702 - DNA, 23 bp, Homo sapiens
gaactgagtgaaaagagtgagca

SEQ ID NO: 147703 - DNA, 23 bp, Homo sapiens
gtacagtggcactgtcacagctc

SEQ ID NO: 147704 - DNA, 23 bp, Homo sapiens
aacactagtcattatcaagtttt

SEQ ID NO: 147705 - DNA, 19 bp, Homo sapiens
tatatatatatatatgtgt

SEQ ID NO: 147706 - DNA, 23 bp, Homo sapiens
attacaggtgttagatactgcat

SEQ ID NO: 147707 - DNA, 23 bp, Homo sapiens
agtgttaaagatgatagtgtgct

SEQ ID NO: 147708 - DNA, 20 bp, Homo sapiens
tgtagtatagaaaagagttt

SEQ ID NO: 147709 - DNA, 23 bp, Homo sapiens
tatctatatctatatgtatctag

SEQ ID NO: 147710 - DNA, 23 bp, Homo sapiens
catatgtatatatgcatatgtgt

SEQ ID NO: 147711 - DNA, 23 bp, Homo sapiens
atatgtgtgtatatatatgtgtg

SEQ ID NO: 147712 - DNA, 23 bp, Homo sapiens
aagagtgtctgcttttgctgagt

SEQ ID NO: 147713 - DNA, 23 bp, Homo sapiens
actagactcacattgagcatgaa

SEQ ID NO: 147714 - DNA, 23 bp, Homo sapiens
atgccaatgcgaaactatggaac

SEQ ID NO: 147715 - DNA, 21 bp, Homo sapiens
tatatctgggagaagatttct

SEQ ID NO: 147716 - DNA, 23 bp, Homo sapiens
ttttttggttccatatgaaattt

SEQ ID NO: 147717 - DNA, 23 bp, Homo sapiens
gaaatggaattgatgagaaagct

SEQ ID NO: 147718 - DNA, 23 bp, Homo sapiens
tgtgtgtgtatgtatatatgtgt

SEQ ID NO: 147719 - DNA, 21 bp, Homo sapiens
atatgtaactatattttagtg

SEQ ID NO: 147720 - DNA, 22 bp, Homo sapiens
atcacaggcagattcctgggaa

SEQ ID NO: 147721 - DNA, 21 bp, Homo sapiens
atgaccttaatttggtatctg

SEQ ID NO: 147722 - DNA, 23 bp, Homo sapiens
atttactgagactctacatgaat

SEQ ID NO: 147723 - DNA, 21 bp, Homo sapiens
tatatatagtttagcatagtg

SEQ ID NO: 147724 - DNA, 23 bp, Homo sapiens
atttacagatgtgagccaccaca

SEQ ID NO: 147725 - DNA, 21 bp, Homo sapiens
tggctcatacctgtaatccca

SEQ ID NO: 147726 - DNA, 23 bp, Homo sapiens
ttgtgagtctcactttgtccctg

SEQ ID NO: 147727 - DNA, 23 bp, Homo sapiens
tggagtctcactctgtcacccag

SEQ ID NO: 147728 - DNA, 23 bp, Homo sapiens
ctttccctcatatgtctggagga

SEQ ID NO: 147729 - DNA, 20 bp, Homo sapiens
atatgtaagtttatatatgt

SEQ ID NO: 147730 - DNA, 23 bp, Homo sapiens
tacatgtgcagaaagtgcaggtt

SEQ ID NO: 147731 - DNA, 21 bp, Homo sapiens
tatactttaagttttagggta

SEQ ID NO: 147732 - DNA, 20 bp, Homo sapiens
atgtgcacaacgtgcaggtt

SEQ ID NO: 147733 - DNA, 23 bp, Homo sapiens
tgtgtgtatatgtatgtgtgtgt

SEQ ID NO: 147734 - DNA, 19 bp, Homo sapiens
aagaacttgtgtgccatgt

SEQ ID NO: 147735 - DNA, 23 bp, Homo sapiens
aatatgtgtgcatttgtatattt

SEQ ID NO: 147736 - DNA, 23 bp, Homo sapiens
tgtgtatatatatatatgtgtgt

SEQ ID NO: 147737 - DNA, 23 bp, Homo sapiens
tgtgtgtatatatatatatgtgt

SEQ ID NO: 147738 - DNA, 23 bp, Homo sapiens
tgtgtatatgtatatatatctgt

SEQ ID NO: 147739 - DNA, 21 bp, Homo sapiens
ctgtctcttctctgtacctgt

SEQ ID NO: 147740 - DNA, 23 bp, Homo sapiens
tgagttcattgtagattctggat

SEQ ID NO: 147741 - DNA, 21 bp, Homo sapiens
atatatgtacgtatgctatgt

SEQ ID NO: 147742 - DNA, 20 bp, Homo sapiens
catacacatgctatgtgtgt

SEQ ID NO: 147743 - DNA, 23 bp, Homo sapiens
gtgtgtgtgtgcatatgtatatg

SEQ ID NO: 147744 - DNA, 23 bp, Homo sapiens
atatgtgcatatgtatatatatg

SEQ ID NO: 147745 - DNA, 21 bp, Homo sapiens
atacgtacatatatatgtgta

SEQ ID NO: 147746 - DNA, 23 bp, Homo sapiens
tatatgtgtgtatatatatgtgt

SEQ ID NO: 147747 - DNA, 20 bp, Homo sapiens
atgtgtacacatatatatgt

SEQ ID NO: 147748 - DNA, 23 bp, Homo sapiens
ttgtctcagatgtgaccttggac

SEQ ID NO: 147749 - DNA, 22 bp, Homo sapiens
acatgtgcacattgtgcaggtt

SEQ ID NO: 147750 - DNA, 23 bp, Homo sapiens
agtctgtctctgttgctctgatt

SEQ ID NO: 147751 - DNA, 21 bp, Homo sapiens
catatatacataatgtatatg

SEQ ID NO: 147752 - DNA, 21 bp, Homo sapiens
tgtatatttatgtgtatgtgt

SEQ ID NO: 147753 - DNA, 23 bp, Homo sapiens
tgtgtgtgtgcatgtgcatgtgc

SEQ ID NO: 147754 - DNA, 23 bp, Homo sapiens
tatgactgccagctttccactac

SEQ ID NO: 147755 - DNA, 21 bp, Homo sapiens
tataatatacatgtttatgta

SEQ ID NO: 147756 - DNA, 21 bp, Homo sapiens
tataatatacatgtttatgta

SEQ ID NO: 147757 - DNA, 22 bp, Homo sapiens
atgtttgtatatatttacatgt

SEQ ID NO: 147758 - DNA, 23 bp, Homo sapiens
tgctggtgtgtaatgaggtaagc

SEQ ID NO: 147759 - DNA, 23 bp, Homo sapiens
agagaacaaagtcaggagagaga

SEQ ID NO: 147760 - DNA, 19 bp, Homo sapiens
gagtgtgattgtgtgtgtg

SEQ ID NO: 147761 - DNA, 20 bp, Homo sapiens
atgtgcacaacgtgcaggtt

SEQ ID NO: 147762 - DNA, 23 bp, Homo sapiens
tccacattttcaagtaccagctt

SEQ ID NO: 147763 - DNA, 20 bp, Homo sapiens
cattttgtgactggtcctta

SEQ ID NO: 147764 - DNA, 22 bp, Homo sapiens
acatgtgcagaatgtgcaggtt

SEQ ID NO: 147765 - DNA, 22 bp, Homo sapiens
gaattgaccttctttatttcag

SEQ ID NO: 147766 - DNA, 22 bp, Homo sapiens
tgaaatctgaaggaagagggtg

SEQ ID NO: 147767 - DNA, 23 bp, Homo sapiens
tgagttcattgtagattctggat

SEQ ID NO: 147768 - DNA, 23 bp, Homo sapiens
tgagttcattgtagattctggat

SEQ ID NO: 147769 - DNA, 22 bp, Homo sapiens
cattttatttcagattggaaaa

SEQ ID NO: 147770 - DNA, 23 bp, Homo sapiens
tgagttcattgtagattctggat

SEQ ID NO: 147771 - DNA, 23 bp, Homo sapiens
tgagttcattgtagattctggat

SEQ ID NO: 147772 - DNA, 20 bp, Homo sapiens
tattgactggtagcattttg

SEQ ID NO: 147773 - DNA, 20 bp, Homo sapiens
agccactgtggaaagcagtt

SEQ ID NO: 147774 - DNA, 18 bp, Homo sapiens
atggaatctcactctttt

SEQ ID NO: 147775 - DNA, 22 bp, Homo sapiens
taatttttaatgtgctgacaga

SEQ ID NO: 147776 - DNA, 23 bp, Homo sapiens
tatgtatgtacgtgtgtgtgtgt

SEQ ID NO: 147777 - DNA, 20 bp, Homo sapiens
ttagagctgttttcatgtga

SEQ ID NO: 147778 - DNA, 23 bp, Homo sapiens
cttcaagtgtctggttttgaagt

SEQ ID NO: 147779 - DNA, 22 bp, Homo sapiens
tgagtcattttgaaaatctgtt

SEQ ID NO: 147780 - DNA, 23 bp, Homo sapiens
aacacatacctacatatatctct

SEQ ID NO: 147781 - DNA, 23 bp, Homo sapiens
ttttgagacggagtcttgctctg

SEQ ID NO: 147782 - DNA, 22 bp, Homo sapiens
tagatacctgtagaacacttca

SEQ ID NO: 147783 - DNA, 23 bp, Homo sapiens
tacttctgtgagtgtctgtatat

SEQ ID NO: 147784 - DNA, 23 bp, Homo sapiens
gtgtgtgtgtgtgtgtctgtata

SEQ ID NO: 147785 - DNA, 21 bp, Homo sapiens
agtcaatactgatttacttgt

SEQ ID NO: 147786 - DNA, 21 bp, Homo sapiens
agagtataattggattgcttg

SEQ ID NO: 147787 - DNA, 23 bp, Homo sapiens
tgagttcattgtagattctggat

SEQ ID NO: 147788 - DNA, 23 bp, Homo sapiens
tgagttcattgtagattctggat

SEQ ID NO: 147789 - DNA, 20 bp, Homo sapiens
acacacacacctatatatat

SEQ ID NO: 147790 - DNA, 20 bp, Homo sapiens
attctatatatgtatatatg

SEQ ID NO: 147791 - DNA, 21 bp, Homo sapiens
taagtgtgaagaagaacctct

SEQ ID NO: 147792 - DNA, 23 bp, Homo sapiens
tatatgatgtatggatagggtct

SEQ ID NO: 147793 - DNA, 23 bp, Homo sapiens
tgagttcattgtagattctggat

SEQ ID NO: 147794 - DNA, 23 bp, Homo sapiens
tgagttcattgtagattctggat

SEQ ID NO: 147795 - DNA, 23 bp, Homo sapiens
gtgacagagtgagagactccctc

SEQ ID NO: 147796 - DNA, 23 bp, Homo sapiens
aaagagggagctaaacattgagc

SEQ ID NO: 147797 - DNA, 22 bp, Homo sapiens
tatatgtatatgtatatgtatg

SEQ ID NO: 147798 - DNA, 19 bp, Homo sapiens
gtatatgcatgtatatgta

SEQ ID NO: 147799 - DNA, 22 bp, Homo sapiens
tgtatatgaatgtatatgtata

SEQ ID NO: 147800 - DNA, 19 bp, Homo sapiens
tatgtgtatatatacgtat

SEQ ID NO: 147801 - DNA, 20 bp, Homo sapiens
ggaatgattacaggagtgtg

SEQ ID NO: 147802 - DNA, 21 bp, Homo sapiens
atataggcacgtatacatatg

SEQ ID NO: 147803 - DNA, 23 bp, Homo sapiens
tctcagactctgtgatttgactg

SEQ ID NO: 147804 - DNA, 23 bp, Homo sapiens
tatatgtatgtatatgtatatgt

SEQ ID NO: 147805 - DNA, 23 bp, Homo sapiens
tacgctaatgtgttgatgtctaa

SEQ ID NO: 147806 - DNA, 19 bp, Homo sapiens
tgtgtatatatatagtgta

SEQ ID NO: 147807 - DNA, 20 bp, Homo sapiens
tgactttttgctaatgactt

SEQ ID NO: 147808 - DNA, 23 bp, Homo sapiens
ttattttagactatggaagtgat

SEQ ID NO: 147809 - DNA, 23 bp, Homo sapiens
tgattagtgcaacacttactttt

SEQ ID NO: 147810 - DNA, 23 bp, Homo sapiens
gatttctatacttgtataatgat

SEQ ID NO: 147811 - DNA, 23 bp, Homo sapiens
aatccttagatctgagattctct

SEQ ID NO: 147812 - DNA, 23 bp, Homo sapiens
gagtgaatatttcattgcttctg

SEQ ID NO: 147813 - DNA, 23 bp, Homo sapiens
gaagagagaagaatgagagctga

SEQ ID NO: 147814 - DNA, 22 bp, Homo sapiens
tcatgatgtaactttttttgtt

SEQ ID NO: 147815 - DNA, 23 bp, Homo sapiens
aatagtcattttgtttaactgac

SEQ ID NO: 147816 - DNA, 22 bp, Homo sapiens
tacacgtactatatatgagtgt

SEQ ID NO: 147817 - DNA, 23 bp, Homo sapiens
tattctttataaatatgtgtgtg

SEQ ID NO: 147818 - DNA, 23 bp, Homo sapiens
tctgtgtcagtctctctggtgga

SEQ ID NO: 147819 - DNA, 22 bp, Homo sapiens
cactcactgacatattcttgac

SEQ ID NO: 147820 - DNA, 22 bp, Homo sapiens
atatgtgtgtatatatgtatgt

SEQ ID NO: 147821 - DNA, 23 bp, Homo sapiens
aatgcatctgaaaaagagtcttt

SEQ ID NO: 147822 - DNA, 23 bp, Homo sapiens
tgtgtgtgtgtgtgtatatctat

SEQ ID NO: 147823 - DNA, 21 bp, Homo sapiens
tatgtgtatacatatacacac

SEQ ID NO: 147824 - DNA, 23 bp, Homo sapiens
ttttcacagtggctgaactaatt

SEQ ID NO: 147825 - DNA, 21 bp, Homo sapiens
taaaccaaaatttttagtgca

SEQ ID NO: 147826 - DNA, 23 bp, Homo sapiens
tgtgggtgtgtgtgtgcatggtt

SEQ ID NO: 147827 - DNA, 23 bp, Homo sapiens
tgagttcattgtagattctggat

SEQ ID NO: 147828 - DNA, 23 bp, Homo sapiens
tgagttcattgtagattctggat

SEQ ID NO: 147829 - DNA, 22 bp, Homo sapiens
aggtattttattctctttgaag

SEQ ID NO: 147830 - DNA, 20 bp, Homo sapiens
tgtgtataagaagaatgctt

SEQ ID NO: 147831 - DNA, 20 bp, Homo sapiens
tgatagtttttaatgtgaag

SEQ ID NO: 147832 - DNA, 18 bp, Homo sapiens
aggatttattagaaatgt

SEQ ID NO: 147833 - DNA, 23 bp, Homo sapiens
tttatgttgtacttctctttgct

SEQ ID NO: 147834 - DNA, 20 bp, Homo sapiens
tgacactcattctctctcct

SEQ ID NO: 147835 - DNA, 23 bp, Homo sapiens
acagtggtgtatatatgtgtgtg

SEQ ID NO: 147836 - DNA, 22 bp, Homo sapiens
tatacagtggtgtatatatgtg

SEQ ID NO: 147837 - DNA, 18 bp, Homo sapiens
gtgtatatgtgtttgtat

SEQ ID NO: 147838 - DNA, 20 bp, Homo sapiens
tttgcttatagacatctatg

SEQ ID NO: 147839 - DNA, 23 bp, Homo sapiens
atatatgtctgtaggtgtgtatt

SEQ ID NO: 147840 - DNA, 23 bp, Homo sapiens
ttgtggatatgtatatgtatgtg

SEQ ID NO: 147841 - DNA, 22 bp, Homo sapiens
tagtgaacagacagtgctcact

SEQ ID NO: 147842 - DNA, 23 bp, Homo sapiens
ttatcttctaattgcagtagtgt

SEQ ID NO: 147843 - DNA, 19 bp, Homo sapiens
tgctcatctcctgctgtgt

SEQ ID NO: 147844 - DNA, 23 bp, Homo sapiens
atgtgtatatatatgtatatgta

SEQ ID NO: 147845 - DNA, 20 bp, Homo sapiens
tatgtgtatatatgtgtgtg

SEQ ID NO: 147846 - DNA, 23 bp, Homo sapiens
tatgtgtatgtacatatatgtgt

SEQ ID NO: 147847 - DNA, 23 bp, Homo sapiens
attctattaagtgcaaggtggaa

SEQ ID NO: 147848 - DNA, 23 bp, Homo sapiens
atgacagatgatactgagcactt

SEQ ID NO: 147849 - DNA, 23 bp, Homo sapiens
tgtgtgtgtgtatgtatatatat

SEQ ID NO: 147850 - DNA, 22 bp, Homo sapiens
tatatgtgctatatatatattt

SEQ ID NO: 147851 - DNA, 23 bp, Homo sapiens
caactgtgtgtgtgtgtgtgtgc

SEQ ID NO: 147852 - DNA, 23 bp, Homo sapiens
tgagttcattgtagattctggat

SEQ ID NO: 147853 - DNA, 23 bp, Homo sapiens
tgagttcattgtagattctggat

SEQ ID NO: 147854 - DNA, 23 bp, Homo sapiens
gaggtgaggaagctgaagtatgg

SEQ ID NO: 147855 - DNA, 21 bp, Homo sapiens
tatgtatatatatgtgtgtgt

SEQ ID NO: 147856 - DNA, 21 bp, Homo sapiens
tatgcatatatatgtatttgt

SEQ ID NO: 147857 - DNA, 23 bp, Homo sapiens
tttctctgcatgtccatctgcta

SEQ ID NO: 147858 - DNA, 20 bp, Homo sapiens
ctcagtaaggaggaagatca

SEQ ID NO: 147859 - DNA, 23 bp, Homo sapiens
agtcttgtcactttattgtagag

SEQ ID NO: 147860 - DNA, 20 bp, Homo sapiens
acacacacatatatgtatgt

SEQ ID NO: 147861 - DNA, 22 bp, Homo sapiens
tctaagtcttgtcaattccatg

SEQ ID NO: 147862 - DNA, 23 bp, Homo sapiens
cttcacagagcataggtttttgt

SEQ ID NO: 147863 - DNA, 23 bp, Homo sapiens
atatgtttgcaatttaagcaagg

SEQ ID NO: 147864 - DNA, 23 bp, Homo sapiens
tgaaacagggtctggttctgttg

SEQ ID NO: 147865 - DNA, 20 bp, Homo sapiens
atgaatttgaatatgcttct

SEQ ID NO: 147866 - DNA, 23 bp, Homo sapiens
actgttgagtatttctttataag

SEQ ID NO: 147867 - DNA, 19 bp, Homo sapiens
agattcagaaggcatatgt

SEQ ID NO: 147868 - DNA, 23 bp, Homo sapiens
gtaacacaattcaatttctctgt

SEQ ID NO: 147869 - DNA, 23 bp, Homo sapiens
atacacacatatgtacatgtgta

SEQ ID NO: 147870 - DNA, 23 bp, Homo sapiens
cactttgcttttctaggtatgca

SEQ ID NO: 147871 - DNA, 23 bp, Homo sapiens
tgagatggagtctcgctctgttg

SEQ ID NO: 147872 - DNA, 23 bp, Homo sapiens
ctagctcactctgtgacactcgg

SEQ ID NO: 147873 - DNA, 23 bp, Homo sapiens
ggtctcagtttccttatgtgatg

SEQ ID NO: 147874 - DNA, 23 bp, Homo sapiens
ttttgattcatgtgataggcact

SEQ ID NO: 147875 - DNA, 23 bp, Homo sapiens
tctctctgcctcagtttcatcaa

SEQ ID NO: 147876 - DNA, 23 bp, Homo sapiens
taaggtactgtgtggttaacatg

SEQ ID NO: 147877 - DNA, 23 bp, Homo sapiens
tcttttctagacattgcttacca

SEQ ID NO: 147878 - DNA, 23 bp, Homo sapiens
agagtctcactctgtcacccagg

SEQ ID NO: 147879 - DNA, 23 bp, Homo sapiens
aaatgctccttccttatcagttg

SEQ ID NO: 147880 - DNA, 23 bp, Homo sapiens
agcctgaagatgtatttctatga

SEQ ID NO: 147881 - DNA, 23 bp, Homo sapiens
tgtgacagctactgcttctgtct

SEQ ID NO: 147882 - DNA, 23 bp, Homo sapiens
tctgccactgtctgtcactgtgc

SEQ ID NO: 147883 - DNA, 22 bp, Homo sapiens
tggatgttcaaggcaatccctg

SEQ ID NO: 147884 - DNA, 20 bp, Homo sapiens
aagtatgttgggatgtgtta

SEQ ID NO: 147885 - DNA, 20 bp, Homo sapiens
agaaaggatatatagcagaa

SEQ ID NO: 147886 - DNA, 23 bp, Homo sapiens
acacattggttttgaaatgtatc

SEQ ID NO: 147887 - DNA, 23 bp, Homo sapiens
tctgagactgtgagtccctggga

SEQ ID NO: 147888 - DNA, 23 bp, Homo sapiens
tctctgtgtgtatgtgtgtgtcc

SEQ ID NO: 147889 - DNA, 23 bp, Homo sapiens
acagcctcactcactgctagcag

SEQ ID NO: 147890 - DNA, 20 bp, Homo sapiens
agtctcgctctgtcgctcag

SEQ ID NO: 147891 - DNA, 23 bp, Homo sapiens
ttttttggttccttatgaaattt

SEQ ID NO: 147892 - DNA, 23 bp, Homo sapiens
gtagacagtgagtagagaccggt

SEQ ID NO: 147893 - DNA, 23 bp, Homo sapiens
ctctgtatgactgtctggtatca

SEQ ID NO: 147894 - DNA, 18 bp, Homo sapiens
tgtctgtttatatatatc

SEQ ID NO: 147895 - DNA, 19 bp, Homo sapiens
tgaacatacttcatgatca

SEQ ID NO: 147896 - DNA, 22 bp, Homo sapiens
tctctgtgcctcagtggctccc

SEQ ID NO: 147897 - DNA, 23 bp, Homo sapiens
atattggatgaatataggatatg

SEQ ID NO: 147898 - DNA, 19 bp, Homo sapiens
atatgatatacatatccta

SEQ ID NO: 147899 - DNA, 23 bp, Homo sapiens
tgagtctcactctgtcacccagg

SEQ ID NO: 147900 - DNA, 23 bp, Homo sapiens
tatcacagggtattaccatgtaa

SEQ ID NO: 147901 - DNA, 23 bp, Homo sapiens
tttggagatggagtctcgctgtg

SEQ ID NO: 147902 - DNA, 19 bp, Homo sapiens
tatgtatatatatatacgt

SEQ ID NO: 147903 - DNA, 20 bp, Homo sapiens
atatgcatatatatacgtat

SEQ ID NO: 147904 - DNA, 21 bp, Homo sapiens
tttgagacagagtttcattcc

SEQ ID NO: 147905 - DNA, 23 bp, Homo sapiens
gggtctcactctgtcacccaggc

SEQ ID NO: 147906 - DNA, 23 bp, Homo sapiens
tgtcagtcactgtgtgtggccta

SEQ ID NO: 147907 - DNA, 23 bp, Homo sapiens
tcaccctggtttgatgtgcttct

SEQ ID NO: 147908 - DNA, 20 bp, Homo sapiens
acttgattctggagccaggg

SEQ ID NO: 147909 - DNA, 22 bp, Homo sapiens
agctccttgcagagaagttaga

SEQ ID NO: 147910 - DNA, 23 bp, Homo sapiens
ttctccatgttttccaggctggt

SEQ ID NO: 147911 - DNA, 20 bp, Homo sapiens
tgtgtgtatatatatgtgtg

SEQ ID NO: 147912 - DNA, 23 bp, Homo sapiens
tcagaccatttctctgacaccct

SEQ ID NO: 147913 - DNA, 19 bp, Homo sapiens
ttctgggtgagtcagtgag

SEQ ID NO: 147914 - DNA, 21 bp, Homo sapiens
aaccaccatatgaagtgggta

SEQ ID NO: 147915 - DNA, 19 bp, Homo sapiens
aagagtacagaggaatctg

SEQ ID NO: 147916 - DNA, 23 bp, Homo sapiens
tctctacgtcagtccctccctgt

SEQ ID NO: 147917 - DNA, 23 bp, Homo sapiens
actgtctctctctgtgattccct

SEQ ID NO: 147918 - DNA, 23 bp, Homo sapiens
tcaccctctctctgtccctagct

SEQ ID NO: 147919 - DNA, 21 bp, Homo sapiens
gtgcatctgtctgtctgtctt

SEQ ID NO: 147920 - DNA, 23 bp, Homo sapiens
agacagctgacagacaggagaag

SEQ ID NO: 147921 - DNA, 23 bp, Homo sapiens
tggctctctgtgtctcaaatttg

SEQ ID NO: 147922 - DNA, 23 bp, Homo sapiens
tttgagacgcagtctcgctctgt

SEQ ID NO: 147923 - DNA, 21 bp, Homo sapiens
tatgaggacatcagtcggatt

SEQ ID NO: 147924 - DNA, 18 bp, Homo sapiens
tcactgaaacttttgcct

SEQ ID NO: 147925 - DNA, 23 bp, Homo sapiens
tatcctagaagtagattactcct

SEQ ID NO: 147926 - DNA, 23 bp, Homo sapiens
tatcacagtgggtgtacactatg

SEQ ID NO: 147927 - DNA, 21 bp, Homo sapiens
tacacccactgtgatgttatt

SEQ ID NO: 147928 - DNA, 21 bp, Homo sapiens
ctatcactgccacctatgtgg

SEQ ID NO: 147929 - DNA, 23 bp, Homo sapiens
ccctgagtccaacccagatctgt

SEQ ID NO: 147930 - DNA, 23 bp, Homo sapiens
gtctgcctctgtctctgtgtttg

SEQ ID NO: 147931 - DNA, 23 bp, Homo sapiens
aaggctaacaagaccccatatct

SEQ ID NO: 147932 - DNA, 21 bp, Homo sapiens
ctcactttctgtctcacacat

SEQ ID NO: 147933 - DNA, 23 bp, Homo sapiens
ggactcagtctcactgagacctt

SEQ ID NO: 147934 - DNA, 22 bp, Homo sapiens
agaggttggacttttctttctt

SEQ ID NO: 147935 - DNA, 23 bp, Homo sapiens
tcatgcttctaggttggattgtt

SEQ ID NO: 147936 - DNA, 23 bp, Homo sapiens
tatgaatcagataaagatttctg

SEQ ID NO: 147937 - DNA, 20 bp, Homo sapiens
tgagatggagtttcactctg

SEQ ID NO: 147938 - DNA, 23 bp, Homo sapiens
ttgagactgtttatttttgctcc

SEQ ID NO: 147939 - DNA, 23 bp, Homo sapiens
gtagtgtagagattttgtagtag

SEQ ID NO: 147940 - DNA, 20 bp, Homo sapiens
acagggtgttactgagactg

SEQ ID NO: 147941 - DNA, 23 bp, Homo sapiens
cggagtctcgctctgtcgctcag

SEQ ID NO: 147942 - DNA, 19 bp, Homo sapiens
atgagacatcttaggcttg

SEQ ID NO: 147943 - DNA, 23 bp, Homo sapiens
tttttagtctgcatttgaatttt

SEQ ID NO: 147944 - DNA, 23 bp, Homo sapiens
tgaggcaatggtagaagttactg

SEQ ID NO: 147945 - DNA, 23 bp, Homo sapiens
tacatgtgcacaatgtgcaggtt

SEQ ID NO: 147946 - DNA, 23 bp, Homo sapiens
tgagttcattgtagattctggat

SEQ ID NO: 147947 - DNA, 23 bp, Homo sapiens
tgagttcattgtagattctggat

SEQ ID NO: 147948 - DNA, 22 bp, Homo sapiens
aattccatcaggcaatgaaaag

SEQ ID NO: 147949 - DNA, 22 bp, Homo sapiens
ccaagtgttataaatttgtaga

SEQ ID NO: 147950 - DNA, 19 bp, Homo sapiens
tgaggtaggaggatcactt

SEQ ID NO: 147951 - DNA, 19 bp, Homo sapiens
aggctgagtgcagatgtgt

SEQ ID NO: 147952 - DNA, 19 bp, Homo sapiens
tgggtctgattacacattc

SEQ ID NO: 147953 - DNA, 18 bp, Homo sapiens
tatcagtaacttatatgg

SEQ ID NO: 147954 - DNA, 22 bp, Homo sapiens
tagtaaatgtcatgtaagtgct

SEQ ID NO: 147955 - DNA, 23 bp, Homo sapiens
gcactgagctagttgtttgtata

SEQ ID NO: 147956 - DNA, 23 bp, Homo sapiens
tctagcttttattactaaagagt

SEQ ID NO: 147957 - DNA, 22 bp, Homo sapiens
tttctagttctgtgaagagtct

SEQ ID NO: 147958 - DNA, 19 bp, Homo sapiens
aaccttcattattttgtct

SEQ ID NO: 147959 - DNA, 23 bp, Homo sapiens
tgataagtttgcaaatctaagga

SEQ ID NO: 147960 - DNA, 20 bp, Homo sapiens
actgaacctctctgtgcctc

SEQ ID NO: 147961 - DNA, 23 bp, Homo sapiens
tgagttcattgtagattctggat

SEQ ID NO: 147962 - DNA, 23 bp, Homo sapiens
tgagttcattgtagattctggat

SEQ ID NO: 147963 - DNA, 22 bp, Homo sapiens
aattgtttctttttattgctga

SEQ ID NO: 147964 - DNA, 23 bp, Homo sapiens
tctatgaagaaagtcaaatggta

SEQ ID NO: 147965 - DNA, 23 bp, Homo sapiens
atacacagtatatatgtgtgtgt

SEQ ID NO: 147966 - DNA, 19 bp, Homo sapiens
tgtgtgtatatatatatgt

SEQ ID NO: 147967 - DNA, 21 bp, Homo sapiens
tgtgtgtatatatatatatgt

SEQ ID NO: 147968 - DNA, 23 bp, Homo sapiens
tctgtgactctgtgaggctaact

SEQ ID NO: 147969 - DNA, 18 bp, Homo sapiens
acgaagtctcattctgtc

SEQ ID NO: 147970 - DNA, 23 bp, Homo sapiens
gaatgtgcatgtgcatgtgcatg

SEQ ID NO: 147971 - DNA, 23 bp, Homo sapiens
agagttcagagtgagcagaccaa

SEQ ID NO: 147972 - DNA, 23 bp, Homo sapiens
ctcgcattggaactcattctctt

SEQ ID NO: 147973 - DNA, 19 bp, Homo sapiens
ttgagcatttgtgattatg

SEQ ID NO: 147974 - DNA, 21 bp, Homo sapiens
ttgtcagatgtttgtcagcac

SEQ ID NO: 147975 - DNA, 23 bp, Homo sapiens
tgagagaggagacagagcttttc

SEQ ID NO: 147976 - DNA, 23 bp, Homo sapiens
tggcatgttaagaagtttgtcct

SEQ ID NO: 147977 - DNA, 20 bp, Homo sapiens
attggtttttctatctgtat

SEQ ID NO: 147978 - DNA, 23 bp, Homo sapiens
atacacacacatactctctctct

SEQ ID NO: 147979 - DNA, 23 bp, Homo sapiens
tgacagacacactgcctctgttg

SEQ ID NO: 147980 - DNA, 19 bp, Homo sapiens
tgcagtgagctgatttgtg

SEQ ID NO: 147981 - DNA, 23 bp, Homo sapiens
tgcctcgctgcctccctgtgtga

SEQ ID NO: 147982 - DNA, 23 bp, Homo sapiens
acagagtctcgcactgtcaccca

SEQ ID NO: 147983 - DNA, 23 bp, Homo sapiens
tgagggaggtggtgaggctgctg

SEQ ID NO: 147984 - DNA, 23 bp, Homo sapiens
ctgtgcctgtgactttgcaggat

SEQ ID NO: 147985 - DNA, 23 bp, Homo sapiens
tggtaatgcaagatataagcagt

SEQ ID NO: 147986 - DNA, 22 bp, Homo sapiens
acatgtgcacattgtgcaggtt

SEQ ID NO: 147987 - DNA, 23 bp, Homo sapiens
ctttgtcagtagagtctgaggac

SEQ ID NO: 147988 - DNA, 23 bp, Homo sapiens
cggagtctcactctgtcacccag

SEQ ID NO: 147989 - DNA, 20 bp, Homo sapiens
ctcactgcaaactctgtctc

SEQ ID NO: 147990 - DNA, 23 bp, Homo sapiens
tgtgtgtatgtatgtatatgtgt

SEQ ID NO: 147991 - DNA, 23 bp, Homo sapiens
gcctgactctctggctctctgtg

SEQ ID NO: 147992 - DNA, 23 bp, Homo sapiens
tctgtgtgtgtgtgagtgcgtgt

SEQ ID NO: 147993 - DNA, 23 bp, Homo sapiens
atctgtgttcagagtgagcactg

SEQ ID NO: 147994 - DNA, 21 bp, Homo sapiens
aaaaacattttgtaaaagtga

SEQ ID NO: 147995 - DNA, 23 bp, Homo sapiens
agagaggagagtgaggactgctg

SEQ ID NO: 147996 - DNA, 20 bp, Homo sapiens
aaacctatacatatgtgtgt

SEQ ID NO: 147997 - DNA, 21 bp, Homo sapiens
tgtctggatattgtttcttga

SEQ ID NO: 147998 - DNA, 21 bp, Homo sapiens
ggttgtggaaggtctgagaat

SEQ ID NO: 147999 - DNA, 23 bp, Homo sapiens
tgagacagtcttcctctgtcacc

SEQ ID NO: 148000 - DNA, 23 bp, Homo sapiens
tctgggtatctctcactctgaga

SEQ ID NO: 148001 - DNA, 23 bp, Homo sapiens
taggctgtgagtaaatgttgaat

SEQ ID NO: 148002 - DNA, 23 bp, Homo sapiens
atacattcatcatgtatacattt

SEQ ID NO: 148003 - DNA, 23 bp, Homo sapiens
tcactgagatttcatgagctgca

SEQ ID NO: 148004 - DNA, 23 bp, Homo sapiens
tctagttcttgctctgtcattta

SEQ ID NO: 148005 - DNA, 18 bp, Homo sapiens
tgtttttgtttttgagac

SEQ ID NO: 148006 - DNA, 23 bp, Homo sapiens
gggtctcactctgtcacccaggc

SEQ ID NO: 148007 - DNA, 18 bp, Homo sapiens
cagtggtgtgatcattgc

SEQ ID NO: 148008 - DNA, 23 bp, Homo sapiens
ataaactgttgttcctggaagtt

SEQ ID NO: 148009 - DNA, 19 bp, Homo sapiens
aattgtgttcctaatattg

SEQ ID NO: 148010 - DNA, 22 bp, Homo sapiens
agtctacgagtttatgtgattt

SEQ ID NO: 148011 - DNA, 23 bp, Homo sapiens
tgagtctcactgtgtcacccagg

SEQ ID NO: 148012 - DNA, 23 bp, Homo sapiens
atttagtatttttacaactgtgt

SEQ ID NO: 148013 - DNA, 23 bp, Homo sapiens
gttttcaccattatgaatctgta

SEQ ID NO: 148014 - DNA, 22 bp, Homo sapiens
agggacattgtggaggctcatt

SEQ ID NO: 148015 - DNA, 22 bp, Homo sapiens
tctgtctatatgattcaaaaca

SEQ ID NO: 148016 - DNA, 23 bp, Homo sapiens
tttgtgtaggcagtacctcagtg

SEQ ID NO: 148017 - DNA, 23 bp, Homo sapiens
tttagtctgtaatccatcttgag

SEQ ID NO: 148018 - DNA, 20 bp, Homo sapiens
tttcagatgagagtgagctc

SEQ ID NO: 148019 - DNA, 23 bp, Homo sapiens
atttcagactggtaatgtgctga

SEQ ID NO: 148020 - DNA, 20 bp, Homo sapiens
tgagggaggcacatttcaca

SEQ ID NO: 148021 - DNA, 23 bp, Homo sapiens
tgttatgtatagcagcaagtgaa

SEQ ID NO: 148022 - DNA, 23 bp, Homo sapiens
gggcctgactcagtggctcacac

SEQ ID NO: 148023 - DNA, 20 bp, Homo sapiens
gggggagacagagtctcact

SEQ ID NO: 148024 - DNA, 23 bp, Homo sapiens
tttgagacggagtctcactctgt

SEQ ID NO: 148025 - DNA, 23 bp, Homo sapiens
agacagagtctcactctgtcgcc

SEQ ID NO: 148026 - DNA, 18 bp, Homo sapiens
tttttgagatgggagtct

SEQ ID NO: 148027 - DNA, 23 bp, Homo sapiens
tgagacagagtctcgctgtgtcg

SEQ ID NO: 148028 - DNA, 21 bp, Homo sapiens
tgagacagagtctcgctctgt

SEQ ID NO: 148029 - DNA, 23 bp, Homo sapiens
atgtgtgtgtatgcatgtgtgtg

SEQ ID NO: 148030 - DNA, 21 bp, Homo sapiens
tatatctatatatagataaga

SEQ ID NO: 148031 - DNA, 22 bp, Homo sapiens
tgtctcgctgtcactctggaag

SEQ ID NO: 148032 - DNA, 23 bp, Homo sapiens
gggtctcactctgtcacccaggc

SEQ ID NO: 148033 - DNA, 19 bp, Homo sapiens
tgtcctgagcctccagcga

SEQ ID NO: 148034 - DNA, 23 bp, Homo sapiens
aggtactctgtctctctgtctgc

SEQ ID NO: 148035 - DNA, 23 bp, Homo sapiens
tggagtctcactctgtcacccag

SEQ ID NO: 148036 - DNA, 22 bp, Homo sapiens
tgttcttgctcactgtctgagt

SEQ ID NO: 148037 - DNA, 23 bp, Homo sapiens
ttttgatactgtctggctctgcc

SEQ ID NO: 148038 - DNA, 20 bp, Homo sapiens
tgggaagaaaatcaatggta

SEQ ID NO: 148039 - DNA, 23 bp, Homo sapiens
atgtatatatatgtgtgtgtgta

SEQ ID NO: 148040 - DNA, 22 bp, Homo sapiens
tggaaaatgttctgtatactga

SEQ ID NO: 148041 - DNA, 23 bp, Homo sapiens
ttttgctagatgttgcctttggg

SEQ ID NO: 148042 - DNA, 20 bp, Homo sapiens
atgtgtgcatgtgtgtgtat

SEQ ID NO: 148043 - DNA, 23 bp, Homo sapiens
tgagttcattgtagattctggat

SEQ ID NO: 148044 - DNA, 23 bp, Homo sapiens
tgagttcattgtagattctggat

SEQ ID NO: 148045 - DNA, 23 bp, Homo sapiens
tctgcaaagttttttcaggtatc

SEQ ID NO: 148046 - DNA, 18 bp, Homo sapiens
acatgtgcagaatgtgca

SEQ ID NO: 148047 - DNA, 23 bp, Homo sapiens
tgagttcattgtagattctggat

SEQ ID NO: 148048 - DNA, 23 bp, Homo sapiens
tgagttcattgtagattctggat

SEQ ID NO: 148049 - DNA, 23 bp, Homo sapiens
cttcaatctctctgagcctcagt

SEQ ID NO: 148050 - DNA, 23 bp, Homo sapiens
aagagaaagatgtgagagtggag

SEQ ID NO: 148051 - DNA, 23 bp, Homo sapiens
ttgaggtggagtctcactctgtt

SEQ ID NO: 148052 - DNA, 21 bp, Homo sapiens
tatacgtatatatacatatgt

SEQ ID NO: 148053 - DNA, 21 bp, Homo sapiens
atcacgtatatatacacgtat

SEQ ID NO: 148054 - DNA, 23 bp, Homo sapiens
atatgtgtatatatatgtgtgtg

SEQ ID NO: 148055 - DNA, 20 bp, Homo sapiens
atgtgcagaatgtgcagctt

SEQ ID NO: 148056 - DNA, 22 bp, Homo sapiens
acatgtgcacaatgtgcaggtt

SEQ ID NO: 148057 - DNA, 23 bp, Homo sapiens
atgtgtgtgtatatatatgtgtg

SEQ ID NO: 148058 - DNA, 23 bp, Homo sapiens
tatatctatatatgtatttatgt

SEQ ID NO: 148059 - DNA, 22 bp, Homo sapiens
agaggtacttgctagattagta

SEQ ID NO: 148060 - DNA, 21 bp, Homo sapiens
attagaccagcacagtggctg

SEQ ID NO: 148061 - DNA, 23 bp, Homo sapiens
ggtctcactctgtcacccaggct

SEQ ID NO: 148062 - DNA, 20 bp, Homo sapiens
tacagtggtgtgacagctca

SEQ ID NO: 148063 - DNA, 18 bp, Homo sapiens
ctatcttacagtcacaga

SEQ ID NO: 148064 - DNA, 20 bp, Homo sapiens
tggacttgtgtttttgttgt

SEQ ID NO: 148065 - DNA, 21 bp, Homo sapiens
attgctctagagaaaggtatc

SEQ ID NO: 148066 - DNA, 18 bp, Homo sapiens
tggttgaaagatatattt

SEQ ID NO: 148067 - DNA, 23 bp, Homo sapiens
agagcaatgtggaacttaattca

SEQ ID NO: 148068 - DNA, 19 bp, Homo sapiens
atatgagtcaacatggagt

SEQ ID NO: 148069 - DNA, 23 bp, Homo sapiens
tacagtgctatgatcacagctca

SEQ ID NO: 148070 - DNA, 22 bp, Homo sapiens
tcactgagtcacttcctgctat

SEQ ID NO: 148071 - DNA, 20 bp, Homo sapiens
tttcacaagtgtgtgcacac

SEQ ID NO: 148072 - DNA, 22 bp, Homo sapiens
tatgactgtcagcatatgtgtg

SEQ ID NO: 148073 - DNA, 23 bp, Homo sapiens
aggtgcatgactgaatgtgtata

SEQ ID NO: 148074 - DNA, 21 bp, Homo sapiens
ttgagtattgacttacatctg

SEQ ID NO: 148075 - DNA, 21 bp, Homo sapiens
acactggtggaggtatccatg

SEQ ID NO: 148076 - DNA, 23 bp, Homo sapiens
tgggtgcctcagtctcagtgtct

SEQ ID NO: 148077 - DNA, 23 bp, Homo sapiens
gtatgtatgtatgtgtgtgtgtg

SEQ ID NO: 148078 - DNA, 19 bp, Homo sapiens
gttacatatgcaggtttgg

SEQ ID NO: 148079 - DNA, 23 bp, Homo sapiens
gagtctcactctgtcacccaggc

SEQ ID NO: 148080 - DNA, 19 bp, Homo sapiens
ttttctcttcaagaaaaag

SEQ ID NO: 148081 - DNA, 23 bp, Homo sapiens
tgtgcttctgagaggttaagatc

SEQ ID NO: 148082 - DNA, 23 bp, Homo sapiens
tacatgtgcacaatgtgcaggtt

SEQ ID NO: 148083 - DNA, 21 bp, Homo sapiens
tgtcagaatatctgtaacata

SEQ ID NO: 148084 - DNA, 21 bp, Homo sapiens
tataatagtgtatgggtatgt

SEQ ID NO: 148085 - DNA, 23 bp, Homo sapiens
tgtctcactgtgtcttagccagt

SEQ ID NO: 148086 - DNA, 18 bp, Homo sapiens
tagtatgaaaagttagga

SEQ ID NO: 148087 - DNA, 21 bp, Homo sapiens
tacatatgtgtgtgtgtgtgt

SEQ ID NO: 148088 - DNA, 23 bp, Homo sapiens
ttatttggttccatatgaaattt

SEQ ID NO: 148089 - DNA, 23 bp, Homo sapiens
cattcattttatggctgaatagt

SEQ ID NO: 148090 - DNA, 22 bp, Homo sapiens
actctgaatggaaaagaagttt

SEQ ID NO: 148091 - DNA, 19 bp, Homo sapiens
atcactgacacctagggct

SEQ ID NO: 148092 - DNA, 23 bp, Homo sapiens
tgtgtcactctcagatactacag

SEQ ID NO: 148093 - DNA, 19 bp, Homo sapiens
tgagatggagtctcactct

SEQ ID NO: 148094 - DNA, 23 bp, Homo sapiens
tgagatggagtttcactcttgtt

SEQ ID NO: 148095 - DNA, 19 bp, Homo sapiens
catctgtgctctgttctct

SEQ ID NO: 148096 - DNA, 23 bp, Homo sapiens
cggagtctcgctctgtctcccag

SEQ ID NO: 148097 - DNA, 23 bp, Homo sapiens
gctgagtctctctctgtcgccca

SEQ ID NO: 148098 - DNA, 19 bp, Homo sapiens
agtggtgtgactgcagcct

SEQ ID NO: 148099 - DNA, 20 bp, Homo sapiens
ttacagacgtgagccaccgc

SEQ ID NO: 148100 - DNA, 23 bp, Homo sapiens
gcctgcctgccagtgagatttct

SEQ ID NO: 148101 - DNA, 22 bp, Homo sapiens
ctctgtttctgtctgcatctgc

SEQ ID NO: 148102 - DNA, 23 bp, Homo sapiens
tatgtatacatatgtatacgtat

SEQ ID NO: 148103 - DNA, 22 bp, Homo sapiens
tatgcttgtgtttagctatctt

SEQ ID NO: 148104 - DNA, 19 bp, Homo sapiens
ctggacaatgtcaatcgta

SEQ ID NO: 148105 - DNA, 23 bp, Homo sapiens
gagacggaatctctctctgtcat

SEQ ID NO: 148106 - DNA, 22 bp, Homo sapiens
tgagaaggagtctcactctgtt

SEQ ID NO: 148107 - DNA, 23 bp, Homo sapiens
tctctgtgactcggtgtgtcctc

SEQ ID NO: 148108 - DNA, 23 bp, Homo sapiens
tctctgtgcctcagttgctccat

SEQ ID NO: 148109 - DNA, 23 bp, Homo sapiens
tctctgtgcctcagttgctccat

SEQ ID NO: 148110 - DNA, 20 bp, Homo sapiens
tgagagagtctcgctctgtc

SEQ ID NO: 148111 - DNA, 21 bp, Homo sapiens
tctctgcgtctgtcccgctgt

SEQ ID NO: 148112 - DNA, 23 bp, Homo sapiens
tatgtgtgcatatgtatatatgt

SEQ ID NO: 148113 - DNA, 22 bp, Homo sapiens
tgagatggagtttcactcttat

SEQ ID NO: 148114 - DNA, 22 bp, Homo sapiens
tgagatggagtttcactcttat

SEQ ID NO: 148115 - DNA, 23 bp, Homo sapiens
gtctccctctgtgcgtccctctg

SEQ ID NO: 148116 - DNA, 18 bp, Homo sapiens
tctgtctgtctgtggtgc

SEQ ID NO: 148117 - DNA, 23 bp, Homo sapiens
cttatgtgaaactggaaagcaga

SEQ ID NO: 148118 - DNA, 23 bp, Homo sapiens
caccagtcacactctctctctgg

SEQ ID NO: 148119 - DNA, 23 bp, Homo sapiens
tgggaggctccctgtgtccctct

SEQ ID NO: 148120 - DNA, 22 bp, Homo sapiens
ggtgtctctctctctgtcttgg

SEQ ID NO: 148121 - DNA, 23 bp, Homo sapiens
gctgtgtgtctgtgtgtgtacgt

SEQ ID NO: 148122 - DNA, 18 bp, Homo sapiens
cactggcttcaaattctc

SEQ ID NO: 148123 - DNA, 23 bp, Homo sapiens
cctgagtctctgcctctcactca

SEQ ID NO: 148124 - DNA, 23 bp, Homo sapiens
actctcagactcactgtcgtgca

SEQ ID NO: 148125 - DNA, 20 bp, Homo sapiens
tctgggacagtgtcaggcac

SEQ ID NO: 148126 - DNA, 23 bp, Homo sapiens
cactcactcactcgttcactcag

SEQ ID NO: 148127 - DNA, 19 bp, Homo sapiens
acagacagacctcttctct

SEQ ID NO: 148128 - DNA, 23 bp, Homo sapiens
tgagacagagttacgctcttgtt

SEQ ID NO: 148129 - DNA, 23 bp, Homo sapiens
actgagtctcactctgtcgccca

SEQ ID NO: 148130 - DNA, 21 bp, Homo sapiens
atatatacacatatacatgta

SEQ ID NO: 148131 - DNA, 20 bp, Homo sapiens
atatatacacatatacatgt

SEQ ID NO: 148132 - DNA, 21 bp, Homo sapiens
taaaagtcattaagttgtaca

SEQ ID NO: 148133 - DNA, 23 bp, Homo sapiens
atgagtgagacctgaggctgagt

SEQ ID NO: 148134 - DNA, 19 bp, Homo sapiens
cactccctgtcagccactg

SEQ ID NO: 148135 - DNA, 22 bp, Homo sapiens
atatacacacacatacgtgtgt

SEQ ID NO: 148136 - DNA, 20 bp, Homo sapiens
atgtgtacatatatatatgt

SEQ ID NO: 148137 - DNA, 20 bp, Homo sapiens
atatgtatatatatatatga

SEQ ID NO: 148138 - DNA, 23 bp, Homo sapiens
tgtctgtccgtctgtccgtccct

SEQ ID NO: 148139 - DNA, 23 bp, Homo sapiens
attttgtttgcatatctagaaaa

SEQ ID NO: 148140 - DNA, 23 bp, Homo sapiens
tttttttctaattgttggcagaa

SEQ ID NO: 148141 - DNA, 23 bp, Homo sapiens
gggtctcactctgtcacccaggc

SEQ ID NO: 148142 - DNA, 23 bp, Homo sapiens
gcctctgggtgtgactgaggctg

SEQ ID NO: 148143 - DNA, 21 bp, Homo sapiens
cctcagcactgctttgactgt

SEQ ID NO: 148144 - DNA, 18 bp, Homo sapiens
tttgtgtgcatgtgcacc

SEQ ID NO: 148145 - DNA, 23 bp, Homo sapiens
tgtgtactgtgtacactgtgtgc

SEQ ID NO: 148146 - DNA, 23 bp, Homo sapiens
tttcacagatgagagagagagca

SEQ ID NO: 148147 - DNA, 23 bp, Homo sapiens
cgcttgtagtcccagtgactccg

SEQ ID NO: 148148 - DNA, 20 bp, Homo sapiens
gtggtaggatcacttgaggt

SEQ ID NO: 148149 - DNA, 23 bp, Homo sapiens
tgtgatgagtgtgtccactggcc

SEQ ID NO: 148150 - DNA, 23 bp, Homo sapiens
tgagtctcactctgtcacccagg

SEQ ID NO: 148151 - DNA, 23 bp, Homo sapiens
tggagtctcactctgtcacccag

SEQ ID NO: 148152 - DNA, 23 bp, Homo sapiens
ctgtgcgtgtgacagcggctgat

SEQ ID NO: 148153 - DNA, 21 bp, Homo sapiens
acacagtgagcacacacgcgc

SEQ ID NO: 148154 - DNA, 19 bp, Homo sapiens
acagtgagcacacacgcgc

SEQ ID NO: 148155 - DNA, 23 bp, Homo sapiens
ctggctgtgtgtgtcagggggtg

SEQ ID NO: 148156 - DNA, 19 bp, Homo sapiens
tctggctgtgtgagtcggg

SEQ ID NO: 148157 - DNA, 22 bp, Homo sapiens
gtgtcgctgtgtctgtctcccc

SEQ ID NO: 148158 - DNA, 23 bp, Homo sapiens
tgtgtccctgtgtctgtctcccc

SEQ ID NO: 148159 - DNA, 23 bp, Homo sapiens
tgtgtctctgtgtctgtctcccc

SEQ ID NO: 148160 - DNA, 23 bp, Homo sapiens
tctctctgtctctgagctgatat

SEQ ID NO: 148161 - DNA, 22 bp, Homo sapiens
catttgtaatctcagcactttg

SEQ ID NO: 148162 - DNA, 20 bp, Homo sapiens
gagtctcattctgtcactca

SEQ ID NO: 148163 - DNA, 22 bp, Homo sapiens
atcatggtcattctctgtctca

SEQ ID NO: 148164 - DNA, 20 bp, Homo sapiens
tatgtgtatatatatacaca

SEQ ID NO: 148165 - DNA, 23 bp, Homo sapiens
tgagttcattgtagattctggat

SEQ ID NO: 148166 - DNA, 23 bp, Homo sapiens
tgagttcattgtagattctggat

SEQ ID NO: 148167 - DNA, 19 bp, Homo sapiens
tgcagtgtcagagttctgg

SEQ ID NO: 148168 - DNA, 23 bp, Homo sapiens
cctcagaatgtgactgcaccaga

SEQ ID NO: 148169 - DNA, 23 bp, Homo sapiens
tccctgacaccctgtatccctgc

SEQ ID NO: 148170 - DNA, 23 bp, Homo sapiens
cgccctctgtctgtgtcacaggg

SEQ ID NO: 148171 - DNA, 23 bp, Homo sapiens
acttaggttggataggaaaggaa

SEQ ID NO: 148172 - DNA, 23 bp, Homo sapiens
gagtctcactgtgtcacccaggc

SEQ ID NO: 148173 - DNA, 20 bp, Homo sapiens
tgccaagagatagggaaaag

SEQ ID NO: 148174 - DNA, 23 bp, Homo sapiens
gacagagtctcgctctgtcaccc

SEQ ID NO: 148175 - DNA, 22 bp, Homo sapiens
aaacatgcgtatgtgtgactct

SEQ ID NO: 148176 - DNA, 23 bp, Homo sapiens
acagagtctcactctgtcgccct

SEQ ID NO: 148177 - DNA, 23 bp, Homo sapiens
gactccctgacagcctcagaggg

SEQ ID NO: 148178 - DNA, 23 bp, Homo sapiens
cttttcccactcactgtctctga

SEQ ID NO: 148179 - DNA, 23 bp, Homo sapiens
tgtagagtggatttctttcacat

SEQ ID NO: 148180 - DNA, 23 bp, Homo sapiens
tctgcagcttttccatccctttc

SEQ ID NO: 148181 - DNA, 19 bp, Homo sapiens
tagcttgataaggatagca

SEQ ID NO: 148182 - DNA, 22 bp, Homo sapiens
tgtcagtctgactttcttgtga

SEQ ID NO: 148183 - DNA, 20 bp, Homo sapiens
agcagctctcacagccgctg

SEQ ID NO: 148184 - DNA, 23 bp, Homo sapiens
tatcactcactctgacactggca

SEQ ID NO: 148185 - DNA, 21 bp, Homo sapiens
tctgtgtggcagaactcggcc

SEQ ID NO: 148186 - DNA, 22 bp, Homo sapiens
tggaggcaagaaaagggcatag

SEQ ID NO: 148187 - DNA, 23 bp, Homo sapiens
tgactccctctgtgtctcttccc

SEQ ID NO: 148188 - DNA, 23 bp, Homo sapiens
ggcagagtctcactctgtggccc

SEQ ID NO: 148189 - DNA, 23 bp, Homo sapiens
tgagacagagcctcactctgtca

SEQ ID NO: 148190 - DNA, 22 bp, Homo sapiens
attgtcaccgctctgcctgact

SEQ ID NO: 148191 - DNA, 23 bp, Homo sapiens
ttttcactctggctctgtctggc

SEQ ID NO: 148192 - DNA, 22 bp, Homo sapiens
acactgggctttgtgtgactgt

SEQ ID NO: 148193 - DNA, 23 bp, Homo sapiens
ctcactttgtctgtgtctcagag

SEQ ID NO: 148194 - DNA, 23 bp, Homo sapiens
tgagttcattgtagattctggat

SEQ ID NO: 148195 - DNA, 23 bp, Homo sapiens
tgagttcattgtagattctggat

SEQ ID NO: 148196 - DNA, 19 bp, Homo sapiens
tgaggtaggaggatcattt

SEQ ID NO: 148197 - DNA, 23 bp, Homo sapiens
acagagtctcgcactgtcaccca

SEQ ID NO: 148198 - DNA, 23 bp, Homo sapiens
ctcccagagcccctggaactctg

SEQ ID NO: 148199 - DNA, 23 bp, Homo sapiens
tcccagagcccctggaactctgg

SEQ ID NO: 148200 - DNA, 23 bp, Homo sapiens
tcccagagcccctggaactctgg

SEQ ID NO: 148201 - DNA, 23 bp, Homo sapiens
tcccagagcccctggaactctgg

SEQ ID NO: 148202 - DNA, 23 bp, Homo sapiens
ctgtggctgtgtacaggtggatc

SEQ ID NO: 148203 - DNA, 23 bp, Homo sapiens
gacatcactgtgattctttaccc

SEQ ID NO: 148204 - DNA, 21 bp, Homo sapiens
ctcagtgaagttagtgacctg

SEQ ID NO: 148205 - DNA, 21 bp, Homo sapiens
acccaggcacccacaatggca

SEQ ID NO: 148206 - DNA, 22 bp, Homo sapiens
attcacacctgtaatcttagca

SEQ ID NO: 148207 - DNA, 23 bp, Homo sapiens
tgaggtaggaggatcacttgagc

SEQ ID NO: 148208 - DNA, 19 bp, Homo sapiens
agtgcacgcctgtagtccc

SEQ ID NO: 148209 - DNA, 22 bp, Homo sapiens
tcataacttgcaagaggcagtc

SEQ ID NO: 148210 - DNA, 23 bp, Homo sapiens
tgagttcattgtagattctggat

SEQ ID NO: 148211 - DNA, 23 bp, Homo sapiens
tgagttcattgtagattctggat

SEQ ID NO: 148212 - DNA, 23 bp, Homo sapiens
tgagttcattgtagattctggat

SEQ ID NO: 148213 - DNA, 23 bp, Homo sapiens
tgagttcattgtagattctggat

SEQ ID NO: 148214 - DNA, 22 bp, Homo sapiens
tctgtctgtgagtgtgggtgaa

SEQ ID NO: 148215 - DNA, 23 bp, Homo sapiens
tgggctctgacactgactccctc

SEQ ID NO: 148216 - DNA, 23 bp, Homo sapiens
tgacagactactgagtgtgcaga

SEQ ID NO: 148217 - DNA, 23 bp, Homo sapiens
tcttttggttccatatgaaattt

SEQ ID NO: 148218 - DNA, 23 bp, Homo sapiens
taattctgtgaggaaggtcaatg

SEQ ID NO: 148219 - DNA, 23 bp, Homo sapiens
tacacacacacacatatacatat

SEQ ID NO: 148220 - DNA, 23 bp, Homo sapiens
agacggagtctcgctctgtcgct

SEQ ID NO: 148221 - DNA, 23 bp, Homo sapiens
caactctggctctgtctgtgctt

SEQ ID NO: 148222 - DNA, 23 bp, Homo sapiens
agagtctcactctgtcacccagg

SEQ ID NO: 148223 - DNA, 23 bp, Homo sapiens
cggagtctcgctctgtctcccag

SEQ ID NO: 148224 - DNA, 21 bp, Homo sapiens
tgcaattctgagcattctgta

SEQ ID NO: 148225 - DNA, 23 bp, Homo sapiens
ttgagacggagtctcactctgtc

SEQ ID NO: 148226 - DNA, 23 bp, Homo sapiens
taatactgccgggtaatgatgga

SEQ ID NO: 148227 - DNA, 21 bp, Homo sapiens
tccagtacagtgttggatggt

SEQ ID NO: 148228 - DNA, 23 bp, Homo sapiens
taacactgtctggtaaagatggc

SEQ ID NO: 148229 - DNA, 23 bp, Homo sapiens
agacggagtctcactctgtcacc

SEQ ID NO: 148230 - DNA, 20 bp, Homo sapiens
tgcaatcttgtttcactgca

SEQ ID NO: 148231 - DNA, 18 bp, Homo sapiens
atatatactgtatatcta

SEQ ID NO: 148232 - DNA, 21 bp, Homo sapiens
tctgtctctctctctacatac

SEQ ID NO: 148233 - DNA, 23 bp, Homo sapiens
agttgagactacaggcatagggc

SEQ ID NO: 148234 - DNA, 23 bp, Homo sapiens
actgcttttggagtctgaagaac

SEQ ID NO: 148235 - DNA, 22 bp, Homo sapiens
aagagatgtgacttaggagact

SEQ ID NO: 148236 - DNA, 23 bp, Homo sapiens
agagtctcactctgtcacccagg

SEQ ID NO: 148237 - DNA, 23 bp, Homo sapiens
ctcgctctgtcacccagtctgga

SEQ ID NO: 148238 - DNA, 23 bp, Homo sapiens
tggagtctcactctgtcgctcag

SEQ ID NO: 148239 - DNA, 23 bp, Homo sapiens
attcacaggcataaacattaacc

SEQ ID NO: 148240 - DNA, 23 bp, Homo sapiens
tggagtctcactctgtcacccag

SEQ ID NO: 148241 - DNA, 20 bp, Homo sapiens
tgcaacttctgcctcctggc

SEQ ID NO: 148242 - DNA, 23 bp, Homo sapiens
gggtctcactctgtcacccagac

SEQ ID NO: 148243 - DNA, 19 bp, Homo sapiens
gagtgcaggtgtgatctcg

SEQ ID NO: 148244 - DNA, 23 bp, Homo sapiens
gacagagtctcgctctgtcaccc

SEQ ID NO: 148245 - DNA, 23 bp, Homo sapiens
agtgtctccgtgtctcagtgttt

SEQ ID NO: 148246 - DNA, 20 bp, Homo sapiens
tctagctttgtctgcatact

SEQ ID NO: 148247 - DNA, 21 bp, Homo sapiens
agtgtcctttcattatgagac

SEQ ID NO: 148248 - DNA, 21 bp, Homo sapiens
ttttttccagagtctcgttct

SEQ ID NO: 148249 - DNA, 23 bp, Homo sapiens
aaacagagtctcgctctgtcacc

SEQ ID NO: 148250 - DNA, 18 bp, Homo sapiens
tcatagaggtacctcctt

SEQ ID NO: 148251 - DNA, 23 bp, Homo sapiens
aggatcacttgagtctgggaggt

SEQ ID NO: 148252 - DNA, 19 bp, Homo sapiens
tcactctttcactcactgc

SEQ ID NO: 148253 - DNA, 23 bp, Homo sapiens
cagggtgtctccctctgtctgag

SEQ ID NO: 148254 - DNA, 23 bp, Homo sapiens
taagactctctgtttttctgtct

SEQ ID NO: 148255 - DNA, 23 bp, Homo sapiens
actggctttctctctccatcaca

SEQ ID NO: 148256 - DNA, 23 bp, Homo sapiens
tttttgaaacaatcaatatgaaa

SEQ ID NO: 148257 - DNA, 23 bp, Homo sapiens
actgttgtttcacatacagcttg

SEQ ID NO: 148258 - DNA, 22 bp, Homo sapiens
tataacttcatttactaaaaga

SEQ ID NO: 148259 - DNA, 22 bp, Homo sapiens
atagtcccacttcttcatgtat

SEQ ID NO: 148260 - DNA, 21 bp, Homo sapiens
tatacacacatgtatatatgt

SEQ ID NO: 148261 - DNA, 22 bp, Homo sapiens
atgtgtgtacacgtgtgtgtct

SEQ ID NO: 148262 - DNA, 21 bp, Homo sapiens
atacacacatatatatatctc

SEQ ID NO: 148263 - DNA, 23 bp, Homo sapiens
gatgtgtgtgtatatgatgtata

SEQ ID NO: 148264 - DNA, 23 bp, Homo sapiens
tgtctccctccatctctgtcaag

SEQ ID NO: 148265 - DNA, 21 bp, Homo sapiens
ttttcctaccaaaagcattca

SEQ ID NO: 148266 - DNA, 21 bp, Homo sapiens
aatttccaggacaaaagccaa

SEQ ID NO: 148267 - DNA, 21 bp, Homo sapiens
attgtggtattacaaatttgt

SEQ ID NO: 148268 - DNA, 20 bp, Homo sapiens
ataattgtggtattacaaat

SEQ ID NO: 148269 - DNA, 23 bp, Homo sapiens
aagactagagattatctacttga

SEQ ID NO: 148270 - DNA, 22 bp, Homo sapiens
tgtgatcttgttactctctgtc

SEQ ID NO: 148271 - DNA, 23 bp, Homo sapiens
tgtgtgtatatatatatgtgtgt

SEQ ID NO: 148272 - DNA, 23 bp, Homo sapiens
gatggagtctcactctgtcaccc

SEQ ID NO: 148273 - DNA, 23 bp, Homo sapiens
agacagtctcgctctgtcaccca

SEQ ID NO: 148274 - DNA, 21 bp, Homo sapiens
ctcactctgtcacacaggctg

SEQ ID NO: 148275 - DNA, 22 bp, Homo sapiens
tctcaactgatggctgtttacc

SEQ ID NO: 148276 - DNA, 18 bp, Homo sapiens
tggcacacatgtgttctc

SEQ ID NO: 148277 - DNA, 23 bp, Homo sapiens
tgagttcattgtagattctggat

SEQ ID NO: 148278 - DNA, 23 bp, Homo sapiens
tgagttcattgtagattctggat

SEQ ID NO: 148279 - DNA, 19 bp, Homo sapiens
agtgcataatccaaaaatg

SEQ ID NO: 148280 - DNA, 23 bp, Homo sapiens
aggcactgagtgagtcacttcat

SEQ ID NO: 148281 - DNA, 18 bp, Homo sapiens
agagaggagtgagagagc

SEQ ID NO: 148282 - DNA, 23 bp, Homo sapiens
gagacggagtctccctctgtcgc

SEQ ID NO: 148283 - DNA, 18 bp, Homo sapiens
cttaacactcccttagct

SEQ ID NO: 148284 - DNA, 20 bp, Homo sapiens
gtagtctctggattgtatct

SEQ ID NO: 148285 - DNA, 23 bp, Homo sapiens
gtatctcactctgacactcaggc

SEQ ID NO: 148286 - DNA, 20 bp, Homo sapiens
tgagaataagtaaataagtg

SEQ ID NO: 148287 - DNA, 23 bp, Homo sapiens
ctaatctaatatgactgcaggtc

SEQ ID NO: 148288 - DNA, 18 bp, Homo sapiens
acagagcaagaccctgtc

SEQ ID NO: 148289 - DNA, 23 bp, Homo sapiens
atggactctcactctgtctccaa

SEQ ID NO: 148290 - DNA, 19 bp, Homo sapiens
cagtgacgcaatctcgtct

SEQ ID NO: 148291 - DNA, 23 bp, Homo sapiens
tgagttcattgtagattctggat

SEQ ID NO: 148292 - DNA, 23 bp, Homo sapiens
tgagttcattgtagattctggat

SEQ ID NO: 148293 - DNA, 19 bp, Homo sapiens
tgacagattgagatcctgc

SEQ ID NO: 148294 - DNA, 23 bp, Homo sapiens
agctgggactgcaggtgcaccac

SEQ ID NO: 148295 - DNA, 23 bp, Homo sapiens
ggatctccctgctctgtctctgt

SEQ ID NO: 148296 - DNA, 23 bp, Homo sapiens
tcagtctgtttatgtctctttga

SEQ ID NO: 148297 - DNA, 22 bp, Homo sapiens
tttatgtatatatatgtgtgtg

SEQ ID NO: 148298 - DNA, 23 bp, Homo sapiens
atatatatgcactttattcagag

SEQ ID NO: 148299 - DNA, 23 bp, Homo sapiens
gacagagtctcgctctgtcaccc

SEQ ID NO: 148300 - DNA, 23 bp, Homo sapiens
tatgtgtgtgtgcgtatgtttag

SEQ ID NO: 148301 - DNA, 23 bp, Homo sapiens
tgagttcattgtagattctggat

SEQ ID NO: 148302 - DNA, 23 bp, Homo sapiens
tgagttcattgtagattctggat

SEQ ID NO: 148303 - DNA, 20 bp, Homo sapiens
atttatgattttctagccta

SEQ ID NO: 148304 - DNA, 19 bp, Homo sapiens
attccagggaagactctgc

SEQ ID NO: 148305 - DNA, 20 bp, Homo sapiens
taccctgtgaactctagcag

SEQ ID NO: 148306 - DNA, 23 bp, Homo sapiens
tgagtgcctgcctctctggaaag

SEQ ID NO: 148307 - DNA, 22 bp, Homo sapiens
atttctccttcaagaggaagac

SEQ ID NO: 148308 - DNA, 23 bp, Homo sapiens
tgagttcattgtagattctggat

SEQ ID NO: 148309 - DNA, 23 bp, Homo sapiens
tgagttcattgtagattctggat

SEQ ID NO: 148310 - DNA, 23 bp, Homo sapiens
gacagagtctcgctctgtcaccc

SEQ ID NO: 148311 - DNA, 20 bp, Homo sapiens
atgctagtatttgtgccgat

SEQ ID NO: 148312 - DNA, 21 bp, Homo sapiens
tctcttcagtaaatggtgctg

SEQ ID NO: 148313 - DNA, 23 bp, Homo sapiens
cacactcactgtcacaccccttg

SEQ ID NO: 148314 - DNA, 18 bp, Homo sapiens
tatatgtgtatatatgca

SEQ ID NO: 148315 - DNA, 23 bp, Homo sapiens
atgtatgtatatatgtatgtgtg

SEQ ID NO: 148316 - DNA, 21 bp, Homo sapiens
ataatttgtatgtatgtatgt

SEQ ID NO: 148317 - DNA, 22 bp, Homo sapiens
tagcagcatatgaaattccttt

SEQ ID NO: 148318 - DNA, 22 bp, Homo sapiens
taaggcagaagttctaaattcg

SEQ ID NO: 148319 - DNA, 23 bp, Homo sapiens
tatatgtggttatatatagtttt

SEQ ID NO: 148320 - DNA, 23 bp, Homo sapiens
tagcatcttccaggcattttctg

SEQ ID NO: 148321 - DNA, 23 bp, Homo sapiens
actgctattgctgtgagtaatga

SEQ ID NO: 148322 - DNA, 23 bp, Homo sapiens
atatatgacagctaaggatcact

SEQ ID NO: 148323 - DNA, 23 bp, Homo sapiens
ttatttctaagtaattgaattct

SEQ ID NO: 148324 - DNA, 23 bp, Homo sapiens
gacacagagaagagacttaggag

SEQ ID NO: 148325 - DNA, 23 bp, Homo sapiens
atgtgtatatatatatatgtgtc

SEQ ID NO: 148326 - DNA, 23 bp, Homo sapiens
tatatgtgtatatgtatgtgtgt

SEQ ID NO: 148327 - DNA, 20 bp, Homo sapiens
tatacacacacacacacata

SEQ ID NO: 148328 - DNA, 22 bp, Homo sapiens
tttagggtcattatgaacatca

SEQ ID NO: 148329 - DNA, 23 bp, Homo sapiens
ctaatagagagttctggtttgga

SEQ ID NO: 148330 - DNA, 23 bp, Homo sapiens
tgtgtttctctcagtgtgtccca

SEQ ID NO: 148331 - DNA, 23 bp, Homo sapiens
tttgttctttttgcttaggattt

SEQ ID NO: 148332 - DNA, 23 bp, Homo sapiens
tttttggttccatatgaaattta

SEQ ID NO: 148333 - DNA, 21 bp, Homo sapiens
acacctccttcacaggggtgt

SEQ ID NO: 148334 - DNA, 23 bp, Homo sapiens
gtgtgtatgtgcatgtgcatgtg

SEQ ID NO: 148335 - DNA, 23 bp, Homo sapiens
ttgctgtgtcactgtcactcagg

SEQ ID NO: 148336 - DNA, 23 bp, Homo sapiens
cagtggcatgatcatagctcact

SEQ ID NO: 148337 - DNA, 18 bp, Homo sapiens
agtgcagtggctgtgatc

SEQ ID NO: 148338 - DNA, 23 bp, Homo sapiens
tactgtattgttcatgctgcgag

SEQ ID NO: 148339 - DNA, 20 bp, Homo sapiens
tgggtgtctgctaagttttt

SEQ ID NO: 148340 - DNA, 23 bp, Homo sapiens
tatttctgtctttaccttgtagc

SEQ ID NO: 148341 - DNA, 19 bp, Homo sapiens
tggaatagtttatatgtat

SEQ ID NO: 148342 - DNA, 23 bp, Homo sapiens
tgagttcattgtagattctggat

SEQ ID NO: 148343 - DNA, 23 bp, Homo sapiens
tgagttcattgtagattctggat

SEQ ID NO: 148344 - DNA, 23 bp, Homo sapiens
gtgtgtgtatatatatatgtgtg

SEQ ID NO: 148345 - DNA, 23 bp, Homo sapiens
acacacactatgtatatgtgtgt

SEQ ID NO: 148346 - DNA, 23 bp, Homo sapiens
gggtctcactctgtcacccaggc

SEQ ID NO: 148347 - DNA, 23 bp, Homo sapiens
ttgaaccagtactatgctgtttg

SEQ ID NO: 148348 - DNA, 20 bp, Homo sapiens
gtgtgtacatatatatgtgt

SEQ ID NO: 148349 - DNA, 23 bp, Homo sapiens
tgtgtgtagatatatgtgtgtgt

SEQ ID NO: 148350 - DNA, 23 bp, Homo sapiens
tgtgtgtatatatatatgtgtgt

SEQ ID NO: 148351 - DNA, 23 bp, Homo sapiens
tgtgaggaataatatagcattgt

SEQ ID NO: 148352 - DNA, 23 bp, Homo sapiens
atttttcttactggtttagaatt

SEQ ID NO: 148353 - DNA, 23 bp, Homo sapiens
attagtctgccacttgatagtac

SEQ ID NO: 148354 - DNA, 23 bp, Homo sapiens
tgagttcattgtagattctggat

SEQ ID NO: 148355 - DNA, 23 bp, Homo sapiens
tgagttcattgtagattctggat

SEQ ID NO: 148356 - DNA, 22 bp, Homo sapiens
tactatcgtcaagttcctggag

SEQ ID NO: 148357 - DNA, 22 bp, Homo sapiens
atgtgtatatatatgtgtgtat

SEQ ID NO: 148358 - DNA, 21 bp, Homo sapiens
tgtgtatatatagacatgtgt

SEQ ID NO: 148359 - DNA, 23 bp, Homo sapiens
tgtgagaacatagagtgcacgtc

SEQ ID NO: 148360 - DNA, 19 bp, Homo sapiens
aggaagtgacttctaaact

SEQ ID NO: 148361 - DNA, 23 bp, Homo sapiens
gggtctcactctgtcacccagcc

SEQ ID NO: 148362 - DNA, 19 bp, Homo sapiens
acagaggcacgatcttggc

SEQ ID NO: 148363 - DNA, 23 bp, Homo sapiens
aacactttgcatatgttatctta

SEQ ID NO: 148364 - DNA, 23 bp, Homo sapiens
cagtagtcagcctcacattccca

SEQ ID NO: 148365 - DNA, 23 bp, Homo sapiens
gtgagtgactgactcaatggagt

SEQ ID NO: 148366 - DNA, 23 bp, Homo sapiens
tgagttcattgtagattctggat

SEQ ID NO: 148367 - DNA, 23 bp, Homo sapiens
tgagttcattgtagattctggat

SEQ ID NO: 148368 - DNA, 23 bp, Homo sapiens
atgtgtatatatgtatatatgta

SEQ ID NO: 148369 - DNA, 21 bp, Homo sapiens
atgtgtgtgtgtatgtatata

SEQ ID NO: 148370 - DNA, 21 bp, Homo sapiens
catgtgtgtgtctatatagac

SEQ ID NO: 148371 - DNA, 18 bp, Homo sapiens
aatgtggtgacataccag

SEQ ID NO: 148372 - DNA, 23 bp, Homo sapiens
gagggggtcttatagtgctcttt

SEQ ID NO: 148373 - DNA, 23 bp, Homo sapiens
tttgtcacaatttgtatttatgt

SEQ ID NO: 148374 - DNA, 21 bp, Homo sapiens
tctctcctatcttgtaagggc

SEQ ID NO: 148375 - DNA, 23 bp, Homo sapiens
catatgtgtatatatatacatgt

SEQ ID NO: 148376 - DNA, 22 bp, Homo sapiens
tctctcactgggtccctcccac

SEQ ID NO: 148377 - DNA, 18 bp, Homo sapiens
gagctacaagatgagatt

SEQ ID NO: 148378 - DNA, 22 bp, Homo sapiens
tggtcagatgtttgtgactttg

SEQ ID NO: 148379 - DNA, 23 bp, Homo sapiens
aacagtttggtacaagtttctat

SEQ ID NO: 148380 - DNA, 23 bp, Homo sapiens
tgtctcagttactctgcctctta

SEQ ID NO: 148381 - DNA, 22 bp, Homo sapiens
atatatatacacatatacatat

SEQ ID NO: 148382 - DNA, 22 bp, Homo sapiens
ataaaatcttgaaaatgccatc

SEQ ID NO: 148383 - DNA, 23 bp, Homo sapiens
tcttgagtgtggtagaatagagt

SEQ ID NO: 148384 - DNA, 23 bp, Homo sapiens
taaatcaaaatggaaatgtttct

SEQ ID NO: 148385 - DNA, 23 bp, Homo sapiens
tgtgagcatgcatgtgtgatgca

SEQ ID NO: 148386 - DNA, 23 bp, Homo sapiens
ctcactcacacaagtgtgtgtgt

SEQ ID NO: 148387 - DNA, 20 bp, Homo sapiens
agacagggtattactctgtg

SEQ ID NO: 148388 - DNA, 19 bp, Homo sapiens
ctgcttttctcagtctact

SEQ ID NO: 148389 - DNA, 23 bp, Homo sapiens
atggagtctcactctgtcaccca

SEQ ID NO: 148390 - DNA, 23 bp, Homo sapiens
tgagttcattgtagattctggat

SEQ ID NO: 148391 - DNA, 23 bp, Homo sapiens
tgagttcattgtagattctggat

SEQ ID NO: 148392 - DNA, 21 bp, Homo sapiens
ttgagtgagtttcttaatcct

SEQ ID NO: 148393 - DNA, 23 bp, Homo sapiens
acaggcaagagagagagctgacc

SEQ ID NO: 148394 - DNA, 23 bp, Homo sapiens
aacttgagagaatttgttgttaa

SEQ ID NO: 148395 - DNA, 19 bp, Homo sapiens
tgacacagcgagactccgt

SEQ ID NO: 148396 - DNA, 23 bp, Homo sapiens
actctcactctgacacccaggct

SEQ ID NO: 148397 - DNA, 23 bp, Homo sapiens
atttcttctgattttctagtagt

SEQ ID NO: 148398 - DNA, 22 bp, Homo sapiens
ctgaggtagaagaatcacttga

SEQ ID NO: 148399 - DNA, 23 bp, Homo sapiens
aagtgagagaagagtgtgccctg

SEQ ID NO: 148400 - DNA, 22 bp, Homo sapiens
agtatgtatatgtatatgtgtg

SEQ ID NO: 148401 - DNA, 21 bp, Homo sapiens
tctgcatctatgtatctatgt

SEQ ID NO: 148402 - DNA, 21 bp, Homo sapiens
ctgtctgcctgagagaggccc

SEQ ID NO: 148403 - DNA, 23 bp, Homo sapiens
ggagtctcactctgtcacccagg

SEQ ID NO: 148404 - DNA, 20 bp, Homo sapiens
tgagaggtgacagtgtgctg

SEQ ID NO: 148405 - DNA, 22 bp, Homo sapiens
aaaagccaatctcaaaaggtgg

SEQ ID NO: 148406 - DNA, 21 bp, Homo sapiens
gtcacacatcagaaactgcca

SEQ ID NO: 148407 - DNA, 23 bp, Homo sapiens
tctgtactatctctgtaactctc

SEQ ID NO: 148408 - DNA, 23 bp, Homo sapiens
gtggagctgacagagctcattgt

SEQ ID NO: 148409 - DNA, 18 bp, Homo sapiens
atagtgcctgatatgcag

SEQ ID NO: 148410 - DNA, 23 bp, Homo sapiens
ttgagccccaggcatctaggagt

SEQ ID NO: 148411 - DNA, 18 bp, Homo sapiens
tgaggctgcagtgagcta

SEQ ID NO: 148412 - DNA, 23 bp, Homo sapiens
tttgaagtaaaagcttgtaaact

SEQ ID NO: 148413 - DNA, 23 bp, Homo sapiens
aatgtctttttatttttaagtgt

SEQ ID NO: 148414 - DNA, 22 bp, Homo sapiens
tgagatgtgtctgtgtgaggcc

SEQ ID NO: 148415 - DNA, 21 bp, Homo sapiens
taaaagacctaaccatttttt

SEQ ID NO: 148416 - DNA, 23 bp, Homo sapiens
tggtttttgaccatggatttctc

SEQ ID NO: 148417 - DNA, 23 bp, Homo sapiens
ttcttaggtctattagtaattgt

SEQ ID NO: 148418 - DNA, 18 bp, Homo sapiens
ttctgatacttccctgtt

SEQ ID NO: 148419 - DNA, 23 bp, Homo sapiens
tctagttgcttgtgtctcaaatt

SEQ ID NO: 148420 - DNA, 18 bp, Homo sapiens
tctggaatgtagtcaggc

SEQ ID NO: 148421 - DNA, 18 bp, Homo sapiens
tttagtaactatatccag

SEQ ID NO: 148422 - DNA, 23 bp, Homo sapiens
tatatcgatatctatatctatct

SEQ ID NO: 148423 - DNA, 22 bp, Homo sapiens
tatctatatatctatatctatc

SEQ ID NO: 148424 - DNA, 21 bp, Homo sapiens
tctagatagatggacagatag

SEQ ID NO: 148425 - DNA, 23 bp, Homo sapiens
tatattatgtgtgtttatgaaaa

SEQ ID NO: 148426 - DNA, 23 bp, Homo sapiens
aaatggcagcttaataattcaaa

SEQ ID NO: 148427 - DNA, 21 bp, Homo sapiens
tgactggctccctctagccct

SEQ ID NO: 148428 - DNA, 23 bp, Homo sapiens
agagtctcactctgtcacccagg

SEQ ID NO: 148429 - DNA, 23 bp, Homo sapiens
gagtctcactctgtcacccaggc

SEQ ID NO: 148430 - DNA, 22 bp, Homo sapiens
acagactctttctctgtgccat

SEQ ID NO: 148431 - DNA, 18 bp, Homo sapiens
tttagcaggaaaaaggaa

SEQ ID NO: 148432 - DNA, 23 bp, Homo sapiens
cggagtctcactctgtcacccag

SEQ ID NO: 148433 - DNA, 23 bp, Homo sapiens
gtgacaactgactgtggactctt

SEQ ID NO: 148434 - DNA, 18 bp, Homo sapiens
agacacaccactgtgagg

SEQ ID NO: 148435 - DNA, 21 bp, Homo sapiens
tgaggtaggaggatcacttga

SEQ ID NO: 148436 - DNA, 22 bp, Homo sapiens
taggactttttattatgtgtaa

SEQ ID NO: 148437 - DNA, 23 bp, Homo sapiens
tttctttacactagaaagtgagc

SEQ ID NO: 148438 - DNA, 20 bp, Homo sapiens
acgtatgtatacatgtgtgt

SEQ ID NO: 148439 - DNA, 18 bp, Homo sapiens
ttttgctgagtttgctga

SEQ ID NO: 148440 - DNA, 23 bp, Homo sapiens
acacacagagtggatgaggatga

SEQ ID NO: 148441 - DNA, 22 bp, Homo sapiens
atatacatacacatattgtagg

SEQ ID NO: 148442 - DNA, 19 bp, Homo sapiens
tgtgtatacatgtatgtat

SEQ ID NO: 148443 - DNA, 23 bp, Homo sapiens
atgtgttttgagacagagtctca

SEQ ID NO: 148444 - DNA, 23 bp, Homo sapiens
agatctgagagccagctttgttg

SEQ ID NO: 148445 - DNA, 21 bp, Homo sapiens
acttcagacttcttgctgtgc

SEQ ID NO: 148446 - DNA, 21 bp, Homo sapiens
tgaggtaggaggatcacttga

SEQ ID NO: 148447 - DNA, 23 bp, Homo sapiens
tggagtctcactctgtcacccag

SEQ ID NO: 148448 - DNA, 23 bp, Homo sapiens
agagtctcactctgtcacccagg

SEQ ID NO: 148449 - DNA, 21 bp, Homo sapiens
tgactctagagtctgtgctgt

SEQ ID NO: 148450 - DNA, 21 bp, Homo sapiens
ttatatgtttacaacctatgt

SEQ ID NO: 148451 - DNA, 22 bp, Homo sapiens
tatatcttaataaacctatgtg

SEQ ID NO: 148452 - DNA, 23 bp, Homo sapiens
ctgtctgtgtgactgtcagggag

SEQ ID NO: 148453 - DNA, 22 bp, Homo sapiens
tgaggtagaaggatcacttgaa

SEQ ID NO: 148454 - DNA, 21 bp, Homo sapiens
tgtatgtatatatatgtgtat

SEQ ID NO: 148455 - DNA, 23 bp, Homo sapiens
atatgtgtatatgtgtatatgtg

SEQ ID NO: 148456 - DNA, 18 bp, Homo sapiens
tgaggtaggaggatcaat

SEQ ID NO: 148457 - DNA, 23 bp, Homo sapiens
tgtgaagaaagtcagtggtagtt

SEQ ID NO: 148458 - DNA, 23 bp, Homo sapiens
agaggttgcagtgagccaagatt

SEQ ID NO: 148459 - DNA, 18 bp, Homo sapiens
gagagaacagagactgga

SEQ ID NO: 148460 - DNA, 23 bp, Homo sapiens
tgtctgtttttgtgtccatggca

SEQ ID NO: 148461 - DNA, 23 bp, Homo sapiens
tttgagacggagtctcactctgt

SEQ ID NO: 148462 - DNA, 23 bp, Homo sapiens
gtttacaagtttttgtgtgaatg

SEQ ID NO: 148463 - DNA, 19 bp, Homo sapiens
tcacacaggctggaatgca

SEQ ID NO: 148464 - DNA, 23 bp, Homo sapiens
gtgtctcactctgtcacccaggc

SEQ ID NO: 148465 - DNA, 20 bp, Homo sapiens
tcagactctgagattcatat

SEQ ID NO: 148466 - DNA, 23 bp, Homo sapiens
ccctcttgtctctggaatacaat

SEQ ID NO: 148467 - DNA, 23 bp, Homo sapiens
gacagagtctcgctctgtcaccc

SEQ ID NO: 148468 - DNA, 23 bp, Homo sapiens
gttcttcttgcttagaattgtct

SEQ ID NO: 148469 - DNA, 23 bp, Homo sapiens
ctgcagttgttggaaagaatgtt

SEQ ID NO: 148470 - DNA, 23 bp, Homo sapiens
tatcaagtctatttgttgtagag

SEQ ID NO: 148471 - DNA, 23 bp, Homo sapiens
tgtatatatgtgtgtgtgtatat

SEQ ID NO: 148472 - DNA, 22 bp, Homo sapiens
atatatgtaatgtatgtgtgtg

SEQ ID NO: 148473 - DNA, 18 bp, Homo sapiens
ttcagactcccatatatc

SEQ ID NO: 148474 - DNA, 23 bp, Homo sapiens
tcagtcatgtagtgtgtgtgtat

SEQ ID NO: 148475 - DNA, 23 bp, Homo sapiens
tgagttcattgtagattctggat

SEQ ID NO: 148476 - DNA, 18 bp, Homo sapiens
atatacctgtatatatac

SEQ ID NO: 148477 - DNA, 23 bp, Homo sapiens
tgaacctttcttttgatagagca

SEQ ID NO: 148478 - DNA, 18 bp, Homo sapiens
tgagagagtagttttgag

SEQ ID NO: 148479 - DNA, 23 bp, Homo sapiens
gttacatgtttactctgtgtctg

SEQ ID NO: 148480 - DNA, 23 bp, Homo sapiens
tatatatgtcaggatttgtttat

SEQ ID NO: 148481 - DNA, 23 bp, Homo sapiens
tcagtgtacaccgatgtgagtga

SEQ ID NO: 148482 - DNA, 22 bp, Homo sapiens
aaaaagaggaaatgtttttatt

SEQ ID NO: 148483 - DNA, 22 bp, Homo sapiens
tctaaacattgaaagctgtgtg

SEQ ID NO: 148484 - DNA, 23 bp, Homo sapiens
agcattactttctgtgtagccat

SEQ ID NO: 148485 - DNA, 23 bp, Homo sapiens
actgaggaaaaatattgaggaag

SEQ ID NO: 148486 - DNA, 21 bp, Homo sapiens
tgtgattttgaaaatatgtag

SEQ ID NO: 148487 - DNA, 23 bp, Homo sapiens
tatgtgtatatatatatatgtac

SEQ ID NO: 148488 - DNA, 23 bp, Homo sapiens
atatatgtacatatatatgtgtg

SEQ ID NO: 148489 - DNA, 23 bp, Homo sapiens
tatatgtacatatatatgtgtgt

SEQ ID NO: 148490 - DNA, 21 bp, Homo sapiens
tatatgtacatatatatgtgt

SEQ ID NO: 148491 - DNA, 22 bp, Homo sapiens
ttaagagcttctgctattattg

SEQ ID NO: 148492 - DNA, 23 bp, Homo sapiens
tatctcacttttctagttctcag

SEQ ID NO: 148493 - DNA, 23 bp, Homo sapiens
ttatgtgtatatgtatatgtgtg

SEQ ID NO: 148494 - DNA, 19 bp, Homo sapiens
atatgtatataagtatgta

SEQ ID NO: 148495 - DNA, 23 bp, Homo sapiens
tgtctgaatatatgtatatgtgt

SEQ ID NO: 148496 - DNA, 23 bp, Homo sapiens
tgagttcattgtagattctggat

SEQ ID NO: 148497 - DNA, 23 bp, Homo sapiens
tgagttcattgtagattctggat

SEQ ID NO: 148498 - DNA, 23 bp, Homo sapiens
aggagtctcactctgtcacccag

SEQ ID NO: 148499 - DNA, 21 bp, Homo sapiens
tacatgtatgtatatgtgtgt

SEQ ID NO: 148500 - DNA, 22 bp, Homo sapiens
tgtatatgtatgtatatatgta

SEQ ID NO: 148501 - DNA, 19 bp, Homo sapiens
gtatatatgcatatatgtg

SEQ ID NO: 148502 - DNA, 18 bp, Homo sapiens
tatacacacacatataca

SEQ ID NO: 148503 - DNA, 23 bp, Homo sapiens
tatttgtatacagtgcagcaaga

SEQ ID NO: 148504 - DNA, 21 bp, Homo sapiens
attattttttttgcataggtt

SEQ ID NO: 148505 - DNA, 23 bp, Homo sapiens
aatcacagtaaacttgctcaggg

SEQ ID NO: 148506 - DNA, 23 bp, Homo sapiens
caaagtgtggattcactctcaaa

SEQ ID NO: 148507 - DNA, 22 bp, Homo sapiens
aattcagagtcctaaagtttga

SEQ ID NO: 148508 - DNA, 23 bp, Homo sapiens
agagtctcactctgtcacccagg

SEQ ID NO: 148509 - DNA, 23 bp, Homo sapiens
tgagttcattgtagattctggat

SEQ ID NO: 148510 - DNA, 23 bp, Homo sapiens
tgagttcattgtagattctggat

SEQ ID NO: 148511 - DNA, 23 bp, Homo sapiens
tgagttcattgtagattctggat

SEQ ID NO: 148512 - DNA, 23 bp, Homo sapiens
tgagttcattgtagattctggat

SEQ ID NO: 148513 - DNA, 18 bp, Homo sapiens
catacctgtagtcccagc

SEQ ID NO: 148514 - DNA, 19 bp, Homo sapiens
gcaagtaggtggtatagta

SEQ ID NO: 148515 - DNA, 18 bp, Homo sapiens
gttactattttactttgt

SEQ ID NO: 148516 - DNA, 23 bp, Homo sapiens
tgtctgggtctaatctctctctg

SEQ ID NO: 148517 - DNA, 18 bp, Homo sapiens
tcactgcagcctctgcct

SEQ ID NO: 148518 - DNA, 23 bp, Homo sapiens
acagagtctcactctgtcgccca

SEQ ID NO: 148519 - DNA, 23 bp, Homo sapiens
tagagctggaaaattatagtgtt

SEQ ID NO: 148520 - DNA, 23 bp, Homo sapiens
tgagacagagtctctcgctctgt

SEQ ID NO: 148521 - DNA, 22 bp, Homo sapiens
tatatgtacatgtatatatgtg

SEQ ID NO: 148522 - DNA, 23 bp, Homo sapiens
atatatgtacatgtatatgtgtg

SEQ ID NO: 148523 - DNA, 23 bp, Homo sapiens
ttattgctagagttttgtggtag

SEQ ID NO: 148524 - DNA, 23 bp, Homo sapiens
acacacacactcatacacatgag

SEQ ID NO: 148525 - DNA, 23 bp, Homo sapiens
ccgagtctcgctctgtcacccag

SEQ ID NO: 148526 - DNA, 23 bp, Homo sapiens
gagttctgactgttgggatctgc

SEQ ID NO: 148527 - DNA, 23 bp, Homo sapiens
gctctgtctgtgtgtgggtgcca

SEQ ID NO: 148528 - DNA, 23 bp, Homo sapiens
ttatgtatctgtttatgtgtatg

SEQ ID NO: 148529 - DNA, 23 bp, Homo sapiens
gaggagaaggtgctgattctggg

SEQ ID NO: 148530 - DNA, 23 bp, Homo sapiens
tgagttcattgtagattctggat

SEQ ID NO: 148531 - DNA, 23 bp, Homo sapiens
tgagttcattgtagattctggat

SEQ ID NO: 148532 - DNA, 23 bp, Homo sapiens
tgagttcattgtagattctggat

SEQ ID NO: 148533 - DNA, 23 bp, Homo sapiens
tgagttcattgtagattctggat

SEQ ID NO: 148534 - DNA, 23 bp, Homo sapiens
tgagttcattgtagattctggat

SEQ ID NO: 148535 - DNA, 23 bp, Homo sapiens
tgagttcattgtagattctggat

SEQ ID NO: 148536 - DNA, 19 bp, Homo sapiens
tcttgatgagaatcactga

SEQ ID NO: 148537 - DNA, 23 bp, Homo sapiens
tgtgtgcatatatatacacacac

SEQ ID NO: 148538 - DNA, 23 bp, Homo sapiens
aaaaaatctgattttcttgaact

SEQ ID NO: 148539 - DNA, 22 bp, Homo sapiens
ttatggtgtctttgtataatag

SEQ ID NO: 148540 - DNA, 23 bp, Homo sapiens
aactgtatttctttatgtgtgca

SEQ ID NO: 148541 - DNA, 23 bp, Homo sapiens
tgtgaagaaagtcaattgtagct

SEQ ID NO: 148542 - DNA, 19 bp, Homo sapiens
atttttagattaggacccc

SEQ ID NO: 148543 - DNA, 23 bp, Homo sapiens
tatgtgaggattattgtactatt

SEQ ID NO: 148544 - DNA, 18 bp, Homo sapiens
gtcccctagaattgattg

SEQ ID NO: 148545 - DNA, 21 bp, Homo sapiens
tctctgagcctgtttcttcag

SEQ ID NO: 148546 - DNA, 19 bp, Homo sapiens
aacagagagaatttctttt

SEQ ID NO: 148547 - DNA, 20 bp, Homo sapiens
tgaggtaggaggatcacttg

SEQ ID NO: 148548 - DNA, 23 bp, Homo sapiens
tctctgccacactgcctgtgtca

SEQ ID NO: 148549 - DNA, 22 bp, Homo sapiens
tgggcatcttactgcactgagt

SEQ ID NO: 148550 - DNA, 22 bp, Homo sapiens
acaacatgattcttaaattgaa

SEQ ID NO: 148551 - DNA, 23 bp, Homo sapiens
caactacttcatcaggtgcccag

SEQ ID NO: 148552 - DNA, 22 bp, Homo sapiens
aagctgctttggaatgttgtgt

SEQ ID NO: 148553 - DNA, 21 bp, Homo sapiens
ggcactgtctgtgtgtctcaa

SEQ ID NO: 148554 - DNA, 23 bp, Homo sapiens
atttcggacatgagccacaacac

SEQ ID NO: 148555 - DNA, 19 bp, Homo sapiens
cagtggcaagatcccagct

SEQ ID NO: 148556 - DNA, 23 bp, Homo sapiens
tgtatatatgtatacatatgtgt

SEQ ID NO: 148557 - DNA, 20 bp, Homo sapiens
acatatgtgtgcatatgcat

SEQ ID NO: 148558 - DNA, 22 bp, Homo sapiens
ttgattctacattatggtgagt

SEQ ID NO: 148559 - DNA, 21 bp, Homo sapiens
tatacatgtacatgtgtatac

SEQ ID NO: 148560 - DNA, 23 bp, Homo sapiens
ggtctcactctgtgcaatggttg

SEQ ID NO: 148561 - DNA, 23 bp, Homo sapiens
tgagttcattgtagattctggat

SEQ ID NO: 148562 - DNA, 23 bp, Homo sapiens
tgagttcattgtagattctggat

SEQ ID NO: 148563 - DNA, 23 bp, Homo sapiens
aaaactattgtagaggtctatga

SEQ ID NO: 148564 - DNA, 23 bp, Homo sapiens
agtgtacatgtatgtatgtgtgt

SEQ ID NO: 148565 - DNA, 20 bp, Homo sapiens
cagaggacttgattgagatc

SEQ ID NO: 148566 - DNA, 23 bp, Homo sapiens
cactctctgtcaccttctctgtg

SEQ ID NO: 148567 - DNA, 21 bp, Homo sapiens
tctctccctgtctcacattta

SEQ ID NO: 148568 - DNA, 23 bp, Homo sapiens
tatgtcagtgtcatatatatgtg

SEQ ID NO: 148569 - DNA, 23 bp, Homo sapiens
tgtgtgggactttgcagagagaa

SEQ ID NO: 148570 - DNA, 21 bp, Homo sapiens
agagctcccactctgtgtctc

SEQ ID NO: 148571 - DNA, 19 bp, Homo sapiens
tagcttgtgactaagcaac

SEQ ID NO: 148572 - DNA, 22 bp, Homo sapiens
acacatatgtgtatgtgtatat

SEQ ID NO: 148573 - DNA, 20 bp, Homo sapiens
gtgtatatatttacacgtgt

SEQ ID NO: 148574 - DNA, 22 bp, Homo sapiens
tgtgtaaatatatacacgtgtg

SEQ ID NO: 148575 - DNA, 23 bp, Homo sapiens
ctgcctctgtccctcagtgcttt

SEQ ID NO: 148576 - DNA, 23 bp, Homo sapiens
tacctcctggctctgcatggttt

SEQ ID NO: 148577 - DNA, 22 bp, Homo sapiens
ctgggactctctctgcctcttt

SEQ ID NO: 148578 - DNA, 23 bp, Homo sapiens
acagtatatgtgtgtgtgtgtgt

SEQ ID NO: 148579 - DNA, 19 bp, Homo sapiens
atacacacacatatactgt

SEQ ID NO: 148580 - DNA, 23 bp, Homo sapiens
gactccctggctctctggttccc

SEQ ID NO: 148581 - DNA, 19 bp, Homo sapiens
gccaggctcagaggggcag

SEQ ID NO: 148582 - DNA, 23 bp, Homo sapiens
aaagtctcactctgtcacccagg

SEQ ID NO: 148583 - DNA, 19 bp, Homo sapiens
tatgtgtatatatatacgt

SEQ ID NO: 148584 - DNA, 19 bp, Homo sapiens
tatgtgtatatatatacgt

SEQ ID NO: 148585 - DNA, 23 bp, Homo sapiens
tgagttcattgtagattctggat

SEQ ID NO: 148586 - DNA, 23 bp, Homo sapiens
tgagttcattgtagattctggat

SEQ ID NO: 148587 - DNA, 23 bp, Homo sapiens
tgagttcattgtagattctggat

SEQ ID NO: 148588 - DNA, 23 bp, Homo sapiens
tgagttcattgtagattctggat

SEQ ID NO: 148589 - DNA, 23 bp, Homo sapiens
atggtctcactctgtcactcagg

SEQ ID NO: 148590 - DNA, 23 bp, Homo sapiens
ggaagttggttgagaggttcaca

SEQ ID NO: 148591 - DNA, 23 bp, Homo sapiens
tgtgaggtaaagtaaggaatgga

SEQ ID NO: 148592 - DNA, 19 bp, Homo sapiens
tcactgcaacctctgctac

SEQ ID NO: 148593 - DNA, 21 bp, Homo sapiens
gtgcaatggtgagatcttggc

SEQ ID NO: 148594 - DNA, 21 bp, Homo sapiens
tttgctcttgttgctcaggct

SEQ ID NO: 148595 - DNA, 22 bp, Homo sapiens
ctgtgggtgtgacagccactgg

SEQ ID NO: 148596 - DNA, 23 bp, Homo sapiens
tcactggaatgttgtgaggccta

SEQ ID NO: 148597 - DNA, 21 bp, Homo sapiens
tatcactcaggatagttggag

SEQ ID NO: 148598 - DNA, 23 bp, Homo sapiens
attcagggggttttctttctttt

SEQ ID NO: 148599 - DNA, 23 bp, Homo sapiens
tatgtgcatgtgtatatgtgtgt

SEQ ID NO: 148600 - DNA, 18 bp, Homo sapiens
tgtttgtgtatgtgcatg

SEQ ID NO: 148601 - DNA, 18 bp, Homo sapiens
tgtttgtgtatgtgcatg

SEQ ID NO: 148602 - DNA, 21 bp, Homo sapiens
caaagtgttaggattacaggc

SEQ ID NO: 148603 - DNA, 22 bp, Homo sapiens
agacaaacaaaacagtgtgtcc

SEQ ID NO: 148604 - DNA, 23 bp, Homo sapiens
atacgtgtgtgtgtgtgtgtgtg

SEQ ID NO: 148605 - DNA, 21 bp, Homo sapiens
agagtggttcatatttgtaat

SEQ ID NO: 148606 - DNA, 23 bp, Homo sapiens
agtggatgacatctgtgtttgtt

SEQ ID NO: 148607 - DNA, 18 bp, Homo sapiens
cagcaagactctgtctca

SEQ ID NO: 148608 - DNA, 20 bp, Homo sapiens
tgagacagagtctcgctctg

SEQ ID NO: 148609 - DNA, 21 bp, Homo sapiens
tatgtgtatatatatgtgtgt

SEQ ID NO: 148610 - DNA, 23 bp, Homo sapiens
ttgtaagaggaacagaatgttta

SEQ ID NO: 148611 - DNA, 19 bp, Homo sapiens
tgagatataaggttgaatc

SEQ ID NO: 148612 - DNA, 19 bp, Homo sapiens
ttcttatgttagatgatag

SEQ ID NO: 148613 - DNA, 23 bp, Homo sapiens
acagagtctcactctgtcaccca

SEQ ID NO: 148614 - DNA, 23 bp, Homo sapiens
ccgagtctcgctctgtcacccag

SEQ ID NO: 148615 - DNA, 22 bp, Homo sapiens
ggctgaggtaggaggatcactt

SEQ ID NO: 148616 - DNA, 23 bp, Homo sapiens
gtcagagtctcgctctgtcaccc

SEQ ID NO: 148617 - DNA, 22 bp, Homo sapiens
tgaaatgaaggactctctttct

SEQ ID NO: 148618 - DNA, 20 bp, Homo sapiens
atgtgatgaaaagtagaatg

SEQ ID NO: 148619 - DNA, 23 bp, Homo sapiens
tgagttcattgtagattctggat

SEQ ID NO: 148620 - DNA, 23 bp, Homo sapiens
tgagttcattgtagattctggat

SEQ ID NO: 148621 - DNA, 21 bp, Homo sapiens
ttagctccttgtttcaggatt

SEQ ID NO: 148622 - DNA, 21 bp, Homo sapiens
tgttcttttttattgctgagt

SEQ ID NO: 148623 - DNA, 23 bp, Homo sapiens
tgtcaacctgttcgtctgttgaa

SEQ ID NO: 148624 - DNA, 19 bp, Homo sapiens
ttatctgatagaatgctga

SEQ ID NO: 148625 - DNA, 23 bp, Homo sapiens
tatggtcttgttctgctgctcat

SEQ ID NO: 148626 - DNA, 20 bp, Homo sapiens
tctggctgagtcagggtctg

SEQ ID NO: 148627 - DNA, 23 bp, Homo sapiens
ttctctgtggctccatgaggctg

SEQ ID NO: 148628 - DNA, 23 bp, Homo sapiens
tgtgatgagactgagctgtcact

SEQ ID NO: 148629 - DNA, 23 bp, Homo sapiens
ctcacgctctctgccactctttc

SEQ ID NO: 148630 - DNA, 20 bp, Homo sapiens
ggacaacaaggttttcacag

SEQ ID NO: 148631 - DNA, 23 bp, Homo sapiens
tctgggtgtctccctctgtctct

SEQ ID NO: 148632 - DNA, 22 bp, Homo sapiens
tatcacagtgggtgtacacaca

SEQ ID NO: 148633 - DNA, 23 bp, Homo sapiens
tgtggtattatttgtactttctt

SEQ ID NO: 148634 - DNA, 23 bp, Homo sapiens
cagcctcccactgtggagtccag

SEQ ID NO: 148635 - DNA, 23 bp, Homo sapiens
tgccaccctctgtgcctggctgt

SEQ ID NO: 148636 - DNA, 19 bp, Homo sapiens
tagcagcttagtgacctgg

SEQ ID NO: 148637 - DNA, 21 bp, Homo sapiens
ggagctggaacttaaagtggt

SEQ ID NO: 148638 - DNA, 23 bp, Homo sapiens
ctgtctgtgtgtctgtgtgcctc

SEQ ID NO: 148639 - DNA, 23 bp, Homo sapiens
gacagagtctcgctctgtcaccc

SEQ ID NO: 148640 - DNA, 23 bp, Homo sapiens
gagacaagagagcgtgcaggagt

SEQ ID NO: 148641 - DNA, 23 bp, Homo sapiens
cagtttgtgcatgtccatctgct

SEQ ID NO: 148642 - DNA, 23 bp, Homo sapiens
acactcaaagtctctctctttaa

SEQ ID NO: 148643 - DNA, 19 bp, Homo sapiens
aagcagccttgtgaagccc

SEQ ID NO: 148644 - DNA, 23 bp, Homo sapiens
gtgtctctgtgtctgcctctcac

SEQ ID NO: 148645 - DNA, 23 bp, Homo sapiens
tggagtctcactctgtcacccag

SEQ ID NO: 148646 - DNA, 23 bp, Homo sapiens
tatatgtatgtatatatgtgtgt

SEQ ID NO: 148647 - DNA, 23 bp, Homo sapiens
tatatgcatgtatacgtgtgtat

SEQ ID NO: 148648 - DNA, 20 bp, Homo sapiens
aggaggaggtcattcttaga

SEQ ID NO: 148649 - DNA, 23 bp, Homo sapiens
taggtagtttcatgttgttggga

SEQ ID NO: 148650 - DNA, 22 bp, Homo sapiens
aaactgcctgagttacatcagt

SEQ ID NO: 148651 - DNA, 23 bp, Homo sapiens
tctggtactgctagtgctgggtg

SEQ ID NO: 148652 - DNA, 23 bp, Homo sapiens
tcagtgcatcacagaactttgtc

SEQ ID NO: 148653 - DNA, 23 bp, Homo sapiens
tggagtctcactctgtcacccag

SEQ ID NO: 148654 - DNA, 22 bp, Homo sapiens
atatcctttttcagtctccaca

SEQ ID NO: 148655 - DNA, 23 bp, Homo sapiens
agagtctcactctgtcacccagg

SEQ ID NO: 148656 - DNA, 23 bp, Homo sapiens
gagtctcactctgtcacccaggc

SEQ ID NO: 148657 - DNA, 23 bp, Homo sapiens
gagtctcactctgtcacccaggc

SEQ ID NO: 148658 - DNA, 23 bp, Homo sapiens
tgagttcattgtagattctggat

SEQ ID NO: 148659 - DNA, 23 bp, Homo sapiens
tgagttcattgtagattctggat

SEQ ID NO: 148660 - DNA, 23 bp, Homo sapiens
tgagttcattgtagattctggat

SEQ ID NO: 148661 - DNA, 23 bp, Homo sapiens
tgagttcattgtagattctggat

SEQ ID NO: 148662 - DNA, 22 bp, Homo sapiens
tggggttgaaggatcactagag

SEQ ID NO: 148663 - DNA, 23 bp, Homo sapiens
gacagtctcactctgtcacccag

SEQ ID NO: 148664 - DNA, 23 bp, Homo sapiens
tacacatattatttgtgtgtgtg

SEQ ID NO: 148665 - DNA, 23 bp, Homo sapiens
tatgtgtatatatatgtatgtgt

SEQ ID NO: 148666 - DNA, 23 bp, Homo sapiens
ggagtctcactctgtcacccagg

SEQ ID NO: 148667 - DNA, 23 bp, Homo sapiens
tgtcaggtgtattgatgtcaaac

SEQ ID NO: 148668 - DNA, 22 bp, Homo sapiens
tgagtgaagacacaatgctgta

SEQ ID NO: 148669 - DNA, 23 bp, Homo sapiens
tagtcataacatttggagcagtt

SEQ ID NO: 148670 - DNA, 23 bp, Homo sapiens
acagagtctcgctctgtcaccca

SEQ ID NO: 148671 - DNA, 19 bp, Homo sapiens
ggtccctccctctctgaca

SEQ ID NO: 148672 - DNA, 23 bp, Homo sapiens
gacagagtctcgctctgtcaccc

SEQ ID NO: 148673 - DNA, 23 bp, Homo sapiens
cagcttgactgttccaccacttg

SEQ ID NO: 148674 - DNA, 21 bp, Homo sapiens
agacaagagtctcattctgtt

SEQ ID NO: 148675 - DNA, 19 bp, Homo sapiens
gtcctgctcagtgtgctgt

SEQ ID NO: 148676 - DNA, 23 bp, Homo sapiens
atgtgtgtatatatatgtgtgtg

SEQ ID NO: 148677 - DNA, 19 bp, Homo sapiens
tatgtgtgtgtgtgtgtgc

SEQ ID NO: 148678 - DNA, 23 bp, Homo sapiens
tgagttcattgtagattctggat

SEQ ID NO: 148679 - DNA, 23 bp, Homo sapiens
tgagttcattgtagattctggat

SEQ ID NO: 148680 - DNA, 22 bp, Homo sapiens
taaatgcatatctatgtatata

SEQ ID NO: 148681 - DNA, 22 bp, Homo sapiens
tcagaaggttaagattcagcaa

SEQ ID NO: 148682 - DNA, 22 bp, Homo sapiens
tgtatgtatatgtatatatgta

SEQ ID NO: 148683 - DNA, 22 bp, Homo sapiens
tatgtatatatgtgtatatgta

SEQ ID NO: 148684 - DNA, 22 bp, Homo sapiens
agcaagagcatgtacatgtgca

SEQ ID NO: 148685 - DNA, 22 bp, Homo sapiens
tctatatctatatctatatatg

SEQ ID NO: 148686 - DNA, 21 bp, Homo sapiens
ttagccttggattcttaacct

SEQ ID NO: 148687 - DNA, 23 bp, Homo sapiens
tggaatatatatgtgtgtgtgtg

SEQ ID NO: 148688 - DNA, 22 bp, Homo sapiens
acacacacatatattctaattg

SEQ ID NO: 148689 - DNA, 20 bp, Homo sapiens
tatatgtgtatatattgtgt

SEQ ID NO: 148690 - DNA, 20 bp, Homo sapiens
tatatgtgtatatattgtgt

SEQ ID NO: 148691 - DNA, 23 bp, Homo sapiens
gaggcagggtctcactgtgtcac

SEQ ID NO: 148692 - DNA, 23 bp, Homo sapiens
tgtgtgtgtgcatgtgtgtgtgt

SEQ ID NO: 148693 - DNA, 23 bp, Homo sapiens
tgtacaccctgtgatattattca

SEQ ID NO: 148694 - DNA, 23 bp, Homo sapiens
tatcacagtgggtgtacaacctg

SEQ ID NO: 148695 - DNA, 23 bp, Homo sapiens
tttgtggtagtttacaattgtct

SEQ ID NO: 148696 - DNA, 19 bp, Homo sapiens
ctatagaagccagtttgtg

SEQ ID NO: 148697 - DNA, 23 bp, Homo sapiens
tgtgtgtgtatatatatatgtgt

SEQ ID NO: 148698 - DNA, 23 bp, Homo sapiens
taatgtgtatatgtatatatgtg

SEQ ID NO: 148699 - DNA, 23 bp, Homo sapiens
atatgtgtatatgtatatatgta

SEQ ID NO: 148700 - DNA, 23 bp, Homo sapiens
atatgtgtatatgtatatatgta

SEQ ID NO: 148701 - DNA, 23 bp, Homo sapiens
atatgtgtatatgtatatatgtg

SEQ ID NO: 148702 - DNA, 20 bp, Homo sapiens
atatacgtatatatatgtgt

SEQ ID NO: 148703 - DNA, 22 bp, Homo sapiens
atatacgtatatatatgtgtat

SEQ ID NO: 148704 - DNA, 22 bp, Homo sapiens
atatacgtatatatatgtgtat

SEQ ID NO: 148705 - DNA, 23 bp, Homo sapiens
tgagttcattgtagattctggat

SEQ ID NO: 148706 - DNA, 23 bp, Homo sapiens
tgagttcattgtagattctggat

SEQ ID NO: 148707 - DNA, 23 bp, Homo sapiens
tgtatgtgtatttgtatatgtga

SEQ ID NO: 148708 - DNA, 23 bp, Homo sapiens
tgtgtgtatgtacatgtgtgttt

SEQ ID NO: 148709 - DNA, 20 bp, Homo sapiens
acatgtgtatatatatttgt

SEQ ID NO: 148710 - DNA, 23 bp, Homo sapiens
agagtgctatagatatgtcagct

SEQ ID NO: 148711 - DNA, 23 bp, Homo sapiens
tgtatgtgtgcatgtgtatgtga

SEQ ID NO: 148712 - DNA, 19 bp, Homo sapiens
tctatgggagagattctgg

SEQ ID NO: 148713 - DNA, 23 bp, Homo sapiens
tcactttctgtctaatgtggtga

SEQ ID NO: 148714 - DNA, 22 bp, Homo sapiens
aatgtctatttgtaattctcag

SEQ ID NO: 148715 - DNA, 23 bp, Homo sapiens
tgagttcattgtagattctggat

SEQ ID NO: 148716 - DNA, 23 bp, Homo sapiens
tgagttcattgtagattctggat

SEQ ID NO: 148717 - DNA, 18 bp, Homo sapiens
ttcactcatgatttgggt

SEQ ID NO: 148718 - DNA, 23 bp, Homo sapiens
tgagttcattgtagattctggat

SEQ ID NO: 148719 - DNA, 23 bp, Homo sapiens
tgagttcattgtagattctggat

SEQ ID NO: 148720 - DNA, 18 bp, Homo sapiens
tggcaatttcatgtggtt

SEQ ID NO: 148721 - DNA, 23 bp, Homo sapiens
gtgatgtgcacctgtagtcccag

SEQ ID NO: 148722 - DNA, 22 bp, Homo sapiens
tgaggtagaagaatcatctgag

SEQ ID NO: 148723 - DNA, 23 bp, Homo sapiens
tgtatgtatgtatgcatgtgcat

SEQ ID NO: 148724 - DNA, 23 bp, Homo sapiens
ccagtctcactctgtcacccagg

SEQ ID NO: 148725 - DNA, 19 bp, Homo sapiens
gtatatatatatgtgtgtg

SEQ ID NO: 148726 - DNA, 23 bp, Homo sapiens
gtttgtgtctctgtgtctctgcc

SEQ ID NO: 148727 - DNA, 23 bp, Homo sapiens
aaagtgctagaagttgttttact

SEQ ID NO: 148728 - DNA, 21 bp, Homo sapiens
gtctcgctctgtcaccctggc

SEQ ID NO: 148729 - DNA, 19 bp, Homo sapiens
tggaccagccattgattgg

SEQ ID NO: 148730 - DNA, 20 bp, Homo sapiens
tgggacaagatagtgagctg

SEQ ID NO: 148731 - DNA, 23 bp, Homo sapiens
ctgaggtagtagtttgtgctgtt

SEQ ID NO: 148732 - DNA, 18 bp, Homo sapiens
aactgcgcaagctactgc

SEQ ID NO: 148733 - DNA, 19 bp, Homo sapiens
aagtgaatacattgggatg

SEQ ID NO: 148734 - DNA, 22 bp, Homo sapiens
tatattaatcagtttaagatgt

SEQ ID NO: 148735 - DNA, 23 bp, Homo sapiens
gatggaatctcactctgtcactc

SEQ ID NO: 148736 - DNA, 23 bp, Homo sapiens
gtaagtggtagtacttgagttca

SEQ ID NO: 148737 - DNA, 21 bp, Homo sapiens
tacatactgcctgcaagtttt

SEQ ID NO: 148738 - DNA, 22 bp, Homo sapiens
tatacatatgtatacatgtata

SEQ ID NO: 148739 - DNA, 22 bp, Homo sapiens
taagacagtagacatagaggtc

SEQ ID NO: 148740 - DNA, 22 bp, Homo sapiens
atagttaagttccatctctagc

SEQ ID NO: 148741 - DNA, 23 bp, Homo sapiens
tagtgtctcactctgtcacccag

SEQ ID NO: 148742 - DNA, 23 bp, Homo sapiens
cagagtctcactctctctctcgc

SEQ ID NO: 148743 - DNA, 23 bp, Homo sapiens
actgaacattcaaagcagacttt

SEQ ID NO: 148744 - DNA, 18 bp, Homo sapiens
aaccacagtctgtctgga

SEQ ID NO: 148745 - DNA, 23 bp, Homo sapiens
gggtctcactctgtcacccaggc

SEQ ID NO: 148746 - DNA, 23 bp, Homo sapiens
gggtctcactctgtcacccaggc

SEQ ID NO: 148747 - DNA, 22 bp, Homo sapiens
tggggttgaattttaagcagga

SEQ ID NO: 148748 - DNA, 23 bp, Homo sapiens
actcagactctgtctgttctgcc

SEQ ID NO: 148749 - DNA, 19 bp, Homo sapiens
tgtttggatgctaaacagt

SEQ ID NO: 148750 - DNA, 19 bp, Homo sapiens
aggcagaggttgcagtaag

SEQ ID NO: 148751 - DNA, 22 bp, Homo sapiens
tgacttgctttagctgagcatt

SEQ ID NO: 148752 - DNA, 23 bp, Homo sapiens
cagagcctcagtctgtggctcag

SEQ ID NO: 148753 - DNA, 22 bp, Homo sapiens
tctgccgcagagatagttgttt

SEQ ID NO: 148754 - DNA, 21 bp, Homo sapiens
actctgtcacccagactggag

SEQ ID NO: 148755 - DNA, 21 bp, Homo sapiens
aaataagtttgtttatgatgg

SEQ ID NO: 148756 - DNA, 22 bp, Homo sapiens
acagggacttggttgttttgtt

SEQ ID NO: 148757 - DNA, 21 bp, Homo sapiens
gacagcaatcctactgaagtc

SEQ ID NO: 148758 - DNA, 19 bp, Homo sapiens
tatgtgtatatatatatgt

SEQ ID NO: 148759 - DNA, 20 bp, Homo sapiens
agccactagtgcccagcttg

SEQ ID NO: 148760 - DNA, 23 bp, Homo sapiens
ttttggaacatatttgaaagttg

SEQ ID NO: 148761 - DNA, 21 bp, Homo sapiens
ttctgagcaaatttgtgtctc

SEQ ID NO: 148762 - DNA, 23 bp, Homo sapiens
acagagtctcactctgtcgccca

SEQ ID NO: 148763 - DNA, 20 bp, Homo sapiens
tcaaatgacgttgagttgag

SEQ ID NO: 148764 - DNA, 23 bp, Homo sapiens
tctccctcactgtcagtttagaa

SEQ ID NO: 148765 - DNA, 22 bp, Homo sapiens
acagtctgtgcaaatgaagaca

SEQ ID NO: 148766 - DNA, 23 bp, Homo sapiens
ttgacactggtagagagagagat

SEQ ID NO: 148767 - DNA, 23 bp, Homo sapiens
atcagttctgattttctagtttc

SEQ ID NO: 148768 - DNA, 23 bp, Homo sapiens
acagagtctcactctgtcgccca

SEQ ID NO: 148769 - DNA, 23 bp, Homo sapiens
tatgcatgtatgtatgtatgtat

SEQ ID NO: 148770 - DNA, 21 bp, Homo sapiens
ttctttttggttaggattgtc

SEQ ID NO: 148771 - DNA, 20 bp, Homo sapiens
agagctttctgttctcagtg

SEQ ID NO: 148772 - DNA, 23 bp, Homo sapiens
gactctcactctgtcacccaggc

SEQ ID NO: 148773 - DNA, 18 bp, Homo sapiens
actgaagagtgagaccac

SEQ ID NO: 148774 - DNA, 23 bp, Homo sapiens
taagatgcatttgtaatcatatg

SEQ ID NO: 148775 - DNA, 20 bp, Homo sapiens
taggtaatcacagtgctctt

SEQ ID NO: 148776 - DNA, 23 bp, Homo sapiens
cctgcagtcctagctactaaggg

SEQ ID NO: 148777 - DNA, 18 bp, Homo sapiens
ggttgcagtgagtcatga

SEQ ID NO: 148778 - DNA, 22 bp, Homo sapiens
atcatcatcatcttcttcatct

SEQ ID NO: 148779 - DNA, 21 bp, Homo sapiens
caagagacaggaactgatggg

SEQ ID NO: 148780 - DNA, 23 bp, Homo sapiens
tctgactgtctccattgcctaag

SEQ ID NO: 148781 - DNA, 20 bp, Homo sapiens
cagtcagggttaatattgag

SEQ ID NO: 148782 - DNA, 19 bp, Homo sapiens
tactttattgatgatattc

SEQ ID NO: 148783 - DNA, 23 bp, Homo sapiens
atatttggtctaattcttgttta

SEQ ID NO: 148784 - DNA, 23 bp, Homo sapiens
tgagttcattgtagattctggat

SEQ ID NO: 148785 - DNA, 23 bp, Homo sapiens
tgagttcattgtagattctggat

SEQ ID NO: 148786 - DNA, 22 bp, Homo sapiens
tactggctcccactctcttctg

SEQ ID NO: 148787 - DNA, 18 bp, Homo sapiens
tatagaaatgctgctgat

SEQ ID NO: 148788 - DNA, 23 bp, Homo sapiens
agggtctcactgtgtcacccagg

SEQ ID NO: 148789 - DNA, 18 bp, Homo sapiens
aagtgctgggattacagg

SEQ ID NO: 148790 - DNA, 18 bp, Homo sapiens
tgagccactgtgcccggc

SEQ ID NO: 148791 - DNA, 22 bp, Homo sapiens
atgcacatctacagctactctg

SEQ ID NO: 148792 - DNA, 20 bp, Homo sapiens
tcggatcactgcaacctctg

SEQ ID NO: 148793 - DNA, 23 bp, Homo sapiens
cagggagcagagtcacaactgtt

SEQ ID NO: 148794 - DNA, 18 bp, Homo sapiens
acagttctgagtgtgttg

SEQ ID NO: 148795 - DNA, 23 bp, Homo sapiens
gggtctcactctgtcacccaggc

SEQ ID NO: 148796 - DNA, 18 bp, Homo sapiens
agttcaaggctatagtgt

SEQ ID NO: 148797 - DNA, 23 bp, Homo sapiens
tttagcagtctttttgttgttca

SEQ ID NO: 148798 - DNA, 23 bp, Homo sapiens
tgagttcattgtagattctggat

SEQ ID NO: 148799 - DNA, 23 bp, Homo sapiens
tgagttcattgtagattctggat

SEQ ID NO: 148800 - DNA, 23 bp, Homo sapiens
tgagttcattgtagattctggat

SEQ ID NO: 148801 - DNA, 23 bp, Homo sapiens
tgagttcattgtagattctggat

SEQ ID NO: 148802 - DNA, 23 bp, Homo sapiens
tggagactcactctgtcaccctg

SEQ ID NO: 148803 - DNA, 18 bp, Homo sapiens
actctgggggctttgctt

SEQ ID NO: 148804 - DNA, 23 bp, Homo sapiens
tacagtgactagactgtgagctc

SEQ ID NO: 148805 - DNA, 23 bp, Homo sapiens
tgtgtatatatatgtatgtgtgt

SEQ ID NO: 148806 - DNA, 23 bp, Homo sapiens
ctcccagagcccctggaactctg

SEQ ID NO: 148807 - DNA, 23 bp, Homo sapiens
tcccagagcccctggaactctgg

SEQ ID NO: 148808 - DNA, 23 bp, Homo sapiens
tcccagagcccctggaactctgg

SEQ ID NO: 148809 - DNA, 23 bp, Homo sapiens
tcccagagcccctggaactctgg

SEQ ID NO: 148810 - DNA, 23 bp, Homo sapiens
agagttctctgctcttaggtctg

SEQ ID NO: 148811 - DNA, 23 bp, Homo sapiens
gtgtatatatatgtatgtgtatg

SEQ ID NO: 148812 - DNA, 23 bp, Homo sapiens
aaattcttgatgatgctcctcag

SEQ ID NO: 148813 - DNA, 23 bp, Homo sapiens
tatgtgtatatatacgtatgtgt

SEQ ID NO: 148814 - DNA, 19 bp, Homo sapiens
tgtgagtggtaagggaagg

SEQ ID NO: 148815 - DNA, 20 bp, Homo sapiens
atttgtgcagttgtttgcat

SEQ ID NO: 148816 - DNA, 23 bp, Homo sapiens
aatggataactatacttaaatga

SEQ ID NO: 148817 - DNA, 19 bp, Homo sapiens
tgagctagatgattatata

SEQ ID NO: 148818 - DNA, 23 bp, Homo sapiens
tgagtctcactctgtcacccagg

SEQ ID NO: 148819 - DNA, 23 bp, Homo sapiens
tgtgagaagatgccattgtctgt

SEQ ID NO: 148820 - DNA, 23 bp, Homo sapiens
tacaatgttgtgatgttctacta

SEQ ID NO: 148821 - DNA, 18 bp, Homo sapiens
acctaatgagagtaataa

SEQ ID NO: 148822 - DNA, 23 bp, Homo sapiens
tgtcaatttctatttttgttgca

SEQ ID NO: 148823 - DNA, 23 bp, Homo sapiens
tgttttcaatttgttttggtata

SEQ ID NO: 148824 - DNA, 23 bp, Homo sapiens
aataggattagtataggtatact

SEQ ID NO: 148825 - DNA, 23 bp, Homo sapiens
attacatagtattagtatactag

SEQ ID NO: 148826 - DNA, 23 bp, Homo sapiens
tatactagtactattagtatgct

SEQ ID NO: 148827 - DNA, 23 bp, Homo sapiens
atagtactgatatactagtacta

SEQ ID NO: 148828 - DNA, 22 bp, Homo sapiens
aatagtgctgatatactagtac

SEQ ID NO: 148829 - DNA, 18 bp, Homo sapiens
gttgaaagttatattgtt

SEQ ID NO: 148830 - DNA, 23 bp, Homo sapiens
tgagttcattgtagattctggat

SEQ ID NO: 148831 - DNA, 23 bp, Homo sapiens
gagtctcactctgtcacccaggc

SEQ ID NO: 148832 - DNA, 20 bp, Homo sapiens
tctacttaggattgtctcag

SEQ ID NO: 148833 - DNA, 23 bp, Homo sapiens
ttatcagtagagggtgctggaga

SEQ ID NO: 148834 - DNA, 21 bp, Homo sapiens
atacacactatatatatgtgt

SEQ ID NO: 148835 - DNA, 22 bp, Homo sapiens
tactcagtcccagatgtcatta

SEQ ID NO: 148836 - DNA, 23 bp, Homo sapiens
tctgtgactctgacttcttggtg

SEQ ID NO: 148837 - DNA, 20 bp, Homo sapiens
ctatcctcttgtgtttgtat

SEQ ID NO: 148838 - DNA, 21 bp, Homo sapiens
tgagctacttagtctcaggca

SEQ ID NO: 148839 - DNA, 23 bp, Homo sapiens
tgagattacacagagaagagaca

SEQ ID NO: 148840 - DNA, 18 bp, Homo sapiens
agcaaatattatgtgtgt

SEQ ID NO: 148841 - DNA, 21 bp, Homo sapiens
tggttaccactgtacagtgtt

SEQ ID NO: 148842 - DNA, 23 bp, Homo sapiens
tctgtggttcaatgtcaggctct

SEQ ID NO: 148843 - DNA, 23 bp, Homo sapiens
tgtgtatatatgtatatgtatgt

SEQ ID NO: 148844 - DNA, 23 bp, Homo sapiens
tgttgtgtgtgagtcagtgagtg

SEQ ID NO: 148845 - DNA, 23 bp, Homo sapiens
tcttctgagagggcaagaagtga

SEQ ID NO: 148846 - DNA, 23 bp, Homo sapiens
gggtctcactctgtcacccaggc

SEQ ID NO: 148847 - DNA, 23 bp, Homo sapiens
actgagtctcactctgtcaccaa

SEQ ID NO: 148848 - DNA, 18 bp, Homo sapiens
agtgagataaccttctct

SEQ ID NO: 148849 - DNA, 22 bp, Homo sapiens
actgacagtagattgacaggag

SEQ ID NO: 148850 - DNA, 22 bp, Homo sapiens
atatatgtgtgtatatatatgt

SEQ ID NO: 148851 - DNA, 23 bp, Homo sapiens
agacactctgctttgattcagtc

SEQ ID NO: 148852 - DNA, 23 bp, Homo sapiens
gactagagattttcatgtacttt

SEQ ID NO: 148853 - DNA, 23 bp, Homo sapiens
gagtctctgtcactctgttgccc

SEQ ID NO: 148854 - DNA, 20 bp, Homo sapiens
agtggagagtagcaggctga

SEQ ID NO: 148855 - DNA, 23 bp, Homo sapiens
tgacacaagaggctgaggtgaga

SEQ ID NO: 148856 - DNA, 22 bp, Homo sapiens
atgaggtataggtggaaagtca

SEQ ID NO: 148857 - DNA, 21 bp, Homo sapiens
tcgtgtgtagtatcttccatg

SEQ ID NO: 148858 - DNA, 23 bp, Homo sapiens
atgatgggtgttcatggtgctct

SEQ ID NO: 148859 - DNA, 21 bp, Homo sapiens
tgagtctcactctgtcgccca

SEQ ID NO: 148860 - DNA, 23 bp, Homo sapiens
tgtctctgtgcctgagtaccagc

SEQ ID NO: 148861 - DNA, 23 bp, Homo sapiens
gacagagtctcgctctgtcaccc

SEQ ID NO: 148862 - DNA, 23 bp, Homo sapiens
tgcagagtgtggaagatggcact

SEQ ID NO: 148863 - DNA, 23 bp, Homo sapiens
tgagttcattgtagattctggat

SEQ ID NO: 148864 - DNA, 23 bp, Homo sapiens
tgagttcattgtagattctggat

SEQ ID NO: 148865 - DNA, 23 bp, Homo sapiens
tatgtgtatgtgtatatgtatgt

SEQ ID NO: 148866 - DNA, 23 bp, Homo sapiens
attagtctctaattgtttacaaa

SEQ ID NO: 148867 - DNA, 23 bp, Homo sapiens
aaaactttgtataccaattgggg

SEQ ID NO: 148868 - DNA, 21 bp, Homo sapiens
tctcactctgtcacataggcg

SEQ ID NO: 148869 - DNA, 23 bp, Homo sapiens
aaacacattgacccattttgtac

SEQ ID NO: 148870 - DNA, 23 bp, Homo sapiens
atgtaggttcttgatcagggctt

SEQ ID NO: 148871 - DNA, 20 bp, Homo sapiens
aacagttgctaaatccttct

SEQ ID NO: 148872 - DNA, 23 bp, Homo sapiens
agtggaattgttagatgacagta

SEQ ID NO: 148873 - DNA, 22 bp, Homo sapiens
ttaggtataagtatgtatatat

SEQ ID NO: 148874 - DNA, 23 bp, Homo sapiens
tatgtgtctgtatatctatgtat

SEQ ID NO: 148875 - DNA, 23 bp, Homo sapiens
tatatgtgtacatattgttttga

SEQ ID NO: 148876 - DNA, 22 bp, Homo sapiens
ttctttggtatttatctacttc

SEQ ID NO: 148877 - DNA, 21 bp, Homo sapiens
aggtttcgatagttctctgat

SEQ ID NO: 148878 - DNA, 21 bp, Homo sapiens
acctagttagatctgcagttt

SEQ ID NO: 148879 - DNA, 22 bp, Homo sapiens
aacagagtagagagaggacaga

SEQ ID NO: 148880 - DNA, 23 bp, Homo sapiens
gatggagtctcactctgtcaccc

SEQ ID NO: 148881 - DNA, 19 bp, Homo sapiens
agtagtgcgatctcagctc

SEQ ID NO: 148882 - DNA, 22 bp, Homo sapiens
tgtgaatctatatatgtgtgta

SEQ ID NO: 148883 - DNA, 20 bp, Homo sapiens
tactgtatatatgtactggg

SEQ ID NO: 148884 - DNA, 19 bp, Homo sapiens
tatgtatatatatttttga

SEQ ID NO: 148885 - DNA, 22 bp, Homo sapiens
atatgtgtgtgtgtgtatgtgc

SEQ ID NO: 148886 - DNA, 23 bp, Homo sapiens
tcctatgtactagaatagttagt

SEQ ID NO: 148887 - DNA, 22 bp, Homo sapiens
acacccactgtgatattaggaa

SEQ ID NO: 148888 - DNA, 20 bp, Homo sapiens
ttaaggagatatttgttcta

SEQ ID NO: 148889 - DNA, 23 bp, Homo sapiens
tcacagtgggtgtacactctggg

SEQ ID NO: 148890 - DNA, 21 bp, Homo sapiens
tatcacagtgggtgtacttcc

SEQ ID NO: 148891 - DNA, 23 bp, Homo sapiens
attctgtggagatattactccta

SEQ ID NO: 148892 - DNA, 22 bp, Homo sapiens
caaagatcatactctccaggga

SEQ ID NO: 148893 - DNA, 20 bp, Homo sapiens
tgagcagagtgagaggtgac

SEQ ID NO: 148894 - DNA, 21 bp, Homo sapiens
ttgtagtcccaactgcttggg

SEQ ID NO: 148895 - DNA, 20 bp, Homo sapiens
aggatttgaggctgcagtga

SEQ ID NO: 148896 - DNA, 20 bp, Homo sapiens
tgggggactgatagaagata

SEQ ID NO: 148897 - DNA, 23 bp, Homo sapiens
ctctggctctgtcagtgcctcaa

SEQ ID NO: 148898 - DNA, 23 bp, Homo sapiens
gggtctcactcactctgtcgccc

SEQ ID NO: 148899 - DNA, 23 bp, Homo sapiens
tgagttcattgtagattctggat

SEQ ID NO: 148900 - DNA, 23 bp, Homo sapiens
tgagttcattgtagattctggat

SEQ ID NO: 148901 - DNA, 20 bp, Homo sapiens
tgcgtcagtcactattttat

SEQ ID NO: 148902 - DNA, 23 bp, Homo sapiens
agaatagtgattttgatcttatt

SEQ ID NO: 148903 - DNA, 23 bp, Homo sapiens
tgagttcattgtagattctggat

SEQ ID NO: 148904 - DNA, 23 bp, Homo sapiens
tgagttcattgtagattctggat

SEQ ID NO: 148905 - DNA, 23 bp, Homo sapiens
tgagttcattgtagattctggat

SEQ ID NO: 148906 - DNA, 23 bp, Homo sapiens
tgagttcattgtagattctggat

SEQ ID NO: 148907 - DNA, 23 bp, Homo sapiens
gaatgagagtgatgagagtgggc

SEQ ID NO: 148908 - DNA, 22 bp, Homo sapiens
tgtcttgttccacttctcagtg

SEQ ID NO: 148909 - DNA, 23 bp, Homo sapiens
gtgactgacagtgtcactctccc

SEQ ID NO: 148910 - DNA, 23 bp, Homo sapiens
agacggagtctcactctgtcacc

SEQ ID NO: 148911 - DNA, 20 bp, Homo sapiens
tcagacaacattgagtgcag

SEQ ID NO: 148912 - DNA, 23 bp, Homo sapiens
tgagttcattgtagattctggat

SEQ ID NO: 148913 - DNA, 23 bp, Homo sapiens
tgagttcattgtagattctggat

SEQ ID NO: 148914 - DNA, 23 bp, Homo sapiens
atatgtgtgtatgtatatgtgtg

SEQ ID NO: 148915 - DNA, 23 bp, Homo sapiens
taataggatgtgtatatgtacat

SEQ ID NO: 148916 - DNA, 23 bp, Homo sapiens
aaactggaaataaaaagacaatg

SEQ ID NO: 148917 - DNA, 23 bp, Homo sapiens
tatgtgtacattgtggaatggtt

SEQ ID NO: 148918 - DNA, 23 bp, Homo sapiens
cctcttgtctgggtctgagactg

SEQ ID NO: 148919 - DNA, 22 bp, Homo sapiens
atatgtgtgtatgtatatatac

SEQ ID NO: 148920 - DNA, 23 bp, Homo sapiens
tcactctctctctctgcctcagc

SEQ ID NO: 148921 - DNA, 23 bp, Homo sapiens
tgtatgtatgtatttatgtgtat

SEQ ID NO: 148922 - DNA, 23 bp, Homo sapiens
aatcagagtggctgttcagcagc

SEQ ID NO: 148923 - DNA, 23 bp, Homo sapiens
tgagttcattgtagattctggat

SEQ ID NO: 148924 - DNA, 23 bp, Homo sapiens
tgagttcattgtagattctggat

SEQ ID NO: 148925 - DNA, 23 bp, Homo sapiens
atttcaggtacagtgagtcagtc

SEQ ID NO: 148926 - DNA, 20 bp, Homo sapiens
attctgaggcagaatgatgt

SEQ ID NO: 148927 - DNA, 22 bp, Homo sapiens
tttgtggttctgatttgcttgt

SEQ ID NO: 148928 - DNA, 23 bp, Homo sapiens
agtcaagtgattttcaagtttct

SEQ ID NO: 148929 - DNA, 23 bp, Homo sapiens
tcatttgtgcttctgtttatggt

SEQ ID NO: 148930 - DNA, 21 bp, Homo sapiens
agcttcagtgaaaattgactg

SEQ ID NO: 148931 - DNA, 21 bp, Homo sapiens
cataagtcactgagattttgt

SEQ ID NO: 148932 - DNA, 22 bp, Homo sapiens
ttcaagttattcagctttggga

SEQ ID NO: 148933 - DNA, 23 bp, Homo sapiens
tgtgtgagtctctgagacttcat

SEQ ID NO: 148934 - DNA, 20 bp, Homo sapiens
cttcagttgagactcagcac

SEQ ID NO: 148935 - DNA, 18 bp, Homo sapiens
tatgtatatatgtatctg

SEQ ID NO: 148936 - DNA, 23 bp, Homo sapiens
tgagttcattgtagattctggat

SEQ ID NO: 148937 - DNA, 23 bp, Homo sapiens
tgagttcattgtagattctggat

SEQ ID NO: 148938 - DNA, 20 bp, Homo sapiens
atatgcatgtatacaagtat

SEQ ID NO: 148939 - DNA, 23 bp, Homo sapiens
tgtgtatatatatacttgtatac

SEQ ID NO: 148940 - DNA, 23 bp, Homo sapiens
attgttggattagatttgctaat

SEQ ID NO: 148941 - DNA, 23 bp, Homo sapiens
ttgtaactatgttgatgaggata

SEQ ID NO: 148942 - DNA, 23 bp, Homo sapiens
atgtagatttaatttgtaaatgc

SEQ ID NO: 148943 - DNA, 23 bp, Homo sapiens
tgaatttgtgcttctttatgatg

SEQ ID NO: 148944 - DNA, 21 bp, Homo sapiens
agagtgtgttttgatgtaaac

SEQ ID NO: 148945 - DNA, 23 bp, Homo sapiens
taactgtatatgtatgtgtgaat

SEQ ID NO: 148946 - DNA, 23 bp, Homo sapiens
agtaaaactggatatttttttct

SEQ ID NO: 148947 - DNA, 23 bp, Homo sapiens
ctgtttattctgaggagtcttat

SEQ ID NO: 148948 - DNA, 20 bp, Homo sapiens
ttttgtgggtacatagtagg

SEQ ID NO: 148949 - DNA, 22 bp, Homo sapiens
ttatgtgcattaatataagtga

SEQ ID NO: 148950 - DNA, 19 bp, Homo sapiens
tgtatatatgtatatatgt

SEQ ID NO: 148951 - DNA, 20 bp, Homo sapiens
tctctctatatatatatgta

SEQ ID NO: 148952 - DNA, 21 bp, Homo sapiens
tatatgtgtgtggcagtaata

SEQ ID NO: 148953 - DNA, 21 bp, Homo sapiens
tgaggtaggaggatctattga

SEQ ID NO: 148954 - DNA, 23 bp, Homo sapiens
tgagttcattgtagattctggat

SEQ ID NO: 148955 - DNA, 23 bp, Homo sapiens
tgagttcattgtagattctggat

SEQ ID NO: 148956 - DNA, 19 bp, Homo sapiens
ttgggtatattttcagcaa

SEQ ID NO: 148957 - DNA, 22 bp, Homo sapiens
gtctcactctcactgtgcccct

SEQ ID NO: 148958 - DNA, 23 bp, Homo sapiens
aactgtcagcaaaggtagtcttg

SEQ ID NO: 148959 - DNA, 19 bp, Homo sapiens
tttatttaagaagcttttg

SEQ ID NO: 148960 - DNA, 18 bp, Homo sapiens
gagtagtgattaagagca

SEQ ID NO: 148961 - DNA, 19 bp, Homo sapiens
atatatgtatatgtacaca

SEQ ID NO: 148962 - DNA, 23 bp, Homo sapiens
tgtgtgtgtatatatatgtgtgt

SEQ ID NO: 148963 - DNA, 22 bp, Homo sapiens
tgtttagtggctccaccatttc

SEQ ID NO: 148964 - DNA, 22 bp, Homo sapiens
aattctctcaagacagtgagct

SEQ ID NO: 148965 - DNA, 20 bp, Homo sapiens
tatatgtattctaagttact

SEQ ID NO: 148966 - DNA, 20 bp, Homo sapiens
tgtgtatatatgtatatatg

SEQ ID NO: 148967 - DNA, 23 bp, Homo sapiens
tgagttcattgtagattctggat

SEQ ID NO: 148968 - DNA, 23 bp, Homo sapiens
tgagttcattgtagattctggat

SEQ ID NO: 148969 - DNA, 23 bp, Homo sapiens
tgagttcattgtagattctggat

SEQ ID NO: 148970 - DNA, 23 bp, Homo sapiens
tgagttcattgtagattctggat

SEQ ID NO: 148971 - DNA, 23 bp, Homo sapiens
gtacttacagagagtctaagtgg

SEQ ID NO: 148972 - DNA, 23 bp, Homo sapiens
tgagttcattgtagattctggat

SEQ ID NO: 148973 - DNA, 23 bp, Homo sapiens
tgagttcattgtagattctggat

SEQ ID NO: 148974 - DNA, 23 bp, Homo sapiens
agagtgagaccctatctccacac

SEQ ID NO: 148975 - DNA, 21 bp, Homo sapiens
tgtttacaagctactcagtct

SEQ ID NO: 148976 - DNA, 23 bp, Homo sapiens
gaagagtgtgactaaaggttgag

SEQ ID NO: 148977 - DNA, 19 bp, Homo sapiens
atgtacatattatatgtat

SEQ ID NO: 148978 - DNA, 22 bp, Homo sapiens
atatattacatattatatgtat

SEQ ID NO: 148979 - DNA, 20 bp, Homo sapiens
atatgttatatattatatgt

SEQ ID NO: 148980 - DNA, 23 bp, Homo sapiens
tgtgtgtatatatatgtgtgtgt

SEQ ID NO: 148981 - DNA, 23 bp, Homo sapiens
tatgtgtgcatatatatatgtgt

SEQ ID NO: 148982 - DNA, 21 bp, Homo sapiens
tatacacacacatatacatat

SEQ ID NO: 148983 - DNA, 23 bp, Homo sapiens
tgagttcattgtagattctggat

SEQ ID NO: 148984 - DNA, 21 bp, Homo sapiens
tgactgtagtgagagagatga

SEQ ID NO: 148985 - DNA, 21 bp, Homo sapiens
tctgacaggagagagagctca

SEQ ID NO: 148986 - DNA, 23 bp, Homo sapiens
tgttcacctcctgctcttcagcc

SEQ ID NO: 148987 - DNA, 19 bp, Homo sapiens
tatgtatatataaatacgt

SEQ ID NO: 148988 - DNA, 19 bp, Homo sapiens
tatgtgtatatatatatgt

SEQ ID NO: 148989 - DNA, 22 bp, Homo sapiens
tgtgtatatatgaatatgtgtg

SEQ ID NO: 148990 - DNA, 23 bp, Homo sapiens
gaggaaagagttgtgaatatctt

SEQ ID NO: 148991 - DNA, 20 bp, Homo sapiens
cagtagtggcatttgagttg

SEQ ID NO: 148992 - DNA, 23 bp, Homo sapiens
taaatatctctatttgattatca

SEQ ID NO: 148993 - DNA, 22 bp, Homo sapiens
taaaaaacaggtgcatctggag

SEQ ID NO: 148994 - DNA, 21 bp, Homo sapiens
tcagagagagaacactggggc

SEQ ID NO: 148995 - DNA, 23 bp, Homo sapiens
gtgtgtatatgatatgtgtttgt

SEQ ID NO: 148996 - DNA, 21 bp, Homo sapiens
atatgtacatatatatgtgtg

SEQ ID NO: 148997 - DNA, 23 bp, Homo sapiens
tatgcacaacatgcaggtttgtt

SEQ ID NO: 148998 - DNA, 22 bp, Homo sapiens
tgtgaagttaccttgttggatg

SEQ ID NO: 148999 - DNA, 23 bp, Homo sapiens
agttctgtatttctaaatgtgta

SEQ ID NO: 149000 - DNA, 18 bp, Homo sapiens
atacacacatctatacac

SEQ ID NO: 149001 - DNA, 20 bp, Homo sapiens
atgactatatatatatatga

SEQ ID NO: 149002 - DNA, 19 bp, Homo sapiens
tgactatatatatatatga

SEQ ID NO: 149003 - DNA, 18 bp, Homo sapiens
tatgtcttagtatactag

SEQ ID NO: 149004 - DNA, 23 bp, Homo sapiens
tttacaggtaattaaggacatca

SEQ ID NO: 149005 - DNA, 23 bp, Homo sapiens
atattgcttcgttttcttctgag

SEQ ID NO: 149006 - DNA, 23 bp, Homo sapiens
caccattagagaactttgtttgt

SEQ ID NO: 149007 - DNA, 23 bp, Homo sapiens
tgggagaggaatagtagacagac

SEQ ID NO: 149008 - DNA, 22 bp, Homo sapiens
tctgtttctgtgattttcctgt

SEQ ID NO: 149009 - DNA, 23 bp, Homo sapiens
atatgtgtcatgttggtgtgctg

SEQ ID NO: 149010 - DNA, 23 bp, Homo sapiens
ctaagtgtgtgtatatgggtgtg

SEQ ID NO: 149011 - DNA, 21 bp, Homo sapiens
gtgtatatgtgtatatgtgta

SEQ ID NO: 149012 - DNA, 18 bp, Homo sapiens
gtgaatctggagggacaa

SEQ ID NO: 149013 - DNA, 23 bp, Homo sapiens
acacacacgcatatatatgtgtg

SEQ ID NO: 149014 - DNA, 23 bp, Homo sapiens
ctactgtgtctgtgacatcaccc

SEQ ID NO: 149015 - DNA, 22 bp, Homo sapiens
acagtctcactctgtcacccag

SEQ ID NO: 149016 - DNA, 21 bp, Homo sapiens
atggcaaattaacctgtatgt

SEQ ID NO: 149017 - DNA, 23 bp, Homo sapiens
tgtggctgtctgtctgtctgtct

SEQ ID NO: 149018 - DNA, 23 bp, Homo sapiens
tctgtcagactggctgtctgtct

SEQ ID NO: 149019 - DNA, 23 bp, Homo sapiens
tcgctctgtcgctcagtctgaag

SEQ ID NO: 149020 - DNA, 21 bp, Homo sapiens
tgaggtaggaggatcacttga

SEQ ID NO: 149021 - DNA, 22 bp, Homo sapiens
atacctgtatatgtaaatatgt

SEQ ID NO: 149022 - DNA, 23 bp, Homo sapiens
tggaaggatcatttgaacatagg

SEQ ID NO: 149023 - DNA, 19 bp, Homo sapiens
agagtcttaggtggcagtg

SEQ ID NO: 149024 - DNA, 23 bp, Homo sapiens
ctctctctctctctgtgtgtgtg

SEQ ID NO: 149025 - DNA, 19 bp, Homo sapiens
tgggtctgtgataatctga

SEQ ID NO: 149026 - DNA, 23 bp, Homo sapiens
agagtctcactctgtcacccagg

SEQ ID NO: 149027 - DNA, 23 bp, Homo sapiens
cggagtctcactctgtcacccag

SEQ ID NO: 149028 - DNA, 23 bp, Homo sapiens
tggagtctcactctgtcacccag

SEQ ID NO: 149029 - DNA, 20 bp, Homo sapiens
agacaagagtctcgctctgt

SEQ ID NO: 149030 - DNA, 21 bp, Homo sapiens
gcccctgggcctatcctagaa

SEQ ID NO: 149031 - DNA, 23 bp, Homo sapiens
atgtgtatatatgtatatatgtg

SEQ ID NO: 149032 - DNA, 21 bp, Homo sapiens
gtatatatgtatatatgtgtg

SEQ ID NO: 149033 - DNA, 23 bp, Homo sapiens
gaaatgttcagagataaagttct

SEQ ID NO: 149034 - DNA, 19 bp, Homo sapiens
ctcactgcaacctctgtct

SEQ ID NO: 149035 - DNA, 23 bp, Homo sapiens
tcccagagcccctggaactctgg

SEQ ID NO: 149036 - DNA, 23 bp, Homo sapiens
tcccagagcccctggaactctgg

SEQ ID NO: 149037 - DNA, 23 bp, Homo sapiens
tcccagagcccctggaactctgg

SEQ ID NO: 149038 - DNA, 23 bp, Homo sapiens
gggtctcactctgtcacccaggc

SEQ ID NO: 149039 - DNA, 18 bp, Homo sapiens
acagtggtgtgatctcag

SEQ ID NO: 149040 - DNA, 23 bp, Homo sapiens
cggagtctcactctgtcacccag

SEQ ID NO: 149041 - DNA, 23 bp, Homo sapiens
tctttcactccttaacatcagac

SEQ ID NO: 149042 - DNA, 23 bp, Homo sapiens
ctctggtagatggtattattgtt

SEQ ID NO: 149043 - DNA, 21 bp, Homo sapiens
tctctgtgccagaaaccaggg

SEQ ID NO: 149044 - DNA, 23 bp, Homo sapiens
agacggagtctcactctgtcagc

SEQ ID NO: 149045 - DNA, 23 bp, Homo sapiens
aagtctcactctgtcacccaggc

SEQ ID NO: 149046 - DNA, 21 bp, Homo sapiens
agagattacagagagcacaag

SEQ ID NO: 149047 - DNA, 23 bp, Homo sapiens
gtgtgtgtgtgtgtgtatacaca

SEQ ID NO: 149048 - DNA, 23 bp, Homo sapiens
tatgtgtgtatatatatgtgtgt

SEQ ID NO: 149049 - DNA, 23 bp, Homo sapiens
cacacacacatatgtgtgtgtat

SEQ ID NO: 149050 - DNA, 18 bp, Homo sapiens
tctggcagaacttttggg

SEQ ID NO: 149051 - DNA, 22 bp, Homo sapiens
atgatttgagagacattctggt

SEQ ID NO: 149052 - DNA, 23 bp, Homo sapiens
ggataggttgaactgtagattcg

SEQ ID NO: 149053 - DNA, 23 bp, Homo sapiens
tcttttgcacattgatctacctc

SEQ ID NO: 149054 - DNA, 23 bp, Homo sapiens
agagtctcactctgtcacccagg

SEQ ID NO: 149055 - DNA, 23 bp, Homo sapiens
gagtctcactctgtcacccaggc

SEQ ID NO: 149056 - DNA, 21 bp, Homo sapiens
tctctctctttttctcaaggt

SEQ ID NO: 149057 - DNA, 20 bp, Homo sapiens
ttgccagaagaatgagagct

SEQ ID NO: 149058 - DNA, 23 bp, Homo sapiens
ggttatcctccagaaaatcaagg

SEQ ID NO: 149059 - DNA, 23 bp, Homo sapiens
tatggctttttattcctatgtga

SEQ ID NO: 149060 - DNA, 23 bp, Homo sapiens
cgtctgtcactcgctcagtccct

SEQ ID NO: 149061 - DNA, 23 bp, Homo sapiens
atgttgtcagcttaacttctgtt

SEQ ID NO: 149062 - DNA, 23 bp, Homo sapiens
gaagcaggataactaaataatat

SEQ ID NO: 149063 - DNA, 23 bp, Homo sapiens
agagagtctcactctgtcgccca

SEQ ID NO: 149064 - DNA, 23 bp, Homo sapiens
ataactgggactgcaagtgtgga

SEQ ID NO: 149065 - DNA, 23 bp, Homo sapiens
agaaatgaggtcttgctatgttg

SEQ ID NO: 149066 - DNA, 23 bp, Homo sapiens
tggctcactgtaacctctgcctc

SEQ ID NO: 149067 - DNA, 21 bp, Homo sapiens
aatgactggctttcttctgat

SEQ ID NO: 149068 - DNA, 23 bp, Homo sapiens
ttgagtgactggcagtctgcctg

SEQ ID NO: 149069 - DNA, 23 bp, Homo sapiens
gtttcactctgtgaatgtgtgtg

SEQ ID NO: 149070 - DNA, 19 bp, Homo sapiens
tcatgggagtgggactggt

SEQ ID NO: 149071 - DNA, 23 bp, Homo sapiens
actcccagagcccctggaactct

SEQ ID NO: 149072 - DNA, 22 bp, Homo sapiens
ctgaggtaggaggatcatttga

SEQ ID NO: 149073 - DNA, 21 bp, Homo sapiens
tcactagagaatttgatgttg

SEQ ID NO: 149074 - DNA, 22 bp, Homo sapiens
gacagggtctcgctctgacaca

SEQ ID NO: 149075 - DNA, 23 bp, Homo sapiens
tcacagtggctcactcccataat

SEQ ID NO: 149076 - DNA, 21 bp, Homo sapiens
acgtatgtatatatgtgtata

SEQ ID NO: 149077 - DNA, 23 bp, Homo sapiens
tatgtatgtatatatagtggtgt

SEQ ID NO: 149078 - DNA, 23 bp, Homo sapiens
tggtactcaacctgaaacactga

SEQ ID NO: 149079 - DNA, 21 bp, Homo sapiens
agggttccagagaacagagat

SEQ ID NO: 149080 - DNA, 23 bp, Homo sapiens
agacagtgtctcgctctgtcacc

SEQ ID NO: 149081 - DNA, 23 bp, Homo sapiens
tgagttcattgtagattctggat

SEQ ID NO: 149082 - DNA, 23 bp, Homo sapiens
tgagttcattgtagattctggat

SEQ ID NO: 149083 - DNA, 23 bp, Homo sapiens
tggagtctcactctgtcacccag

SEQ ID NO: 149084 - DNA, 23 bp, Homo sapiens
gggtctcactctgtcaccctagc

SEQ ID NO: 149085 - DNA, 23 bp, Homo sapiens
tgagttcattgtagattctggat

SEQ ID NO: 149086 - DNA, 23 bp, Homo sapiens
tgagttcattgtagattctggat

SEQ ID NO: 149087 - DNA, 23 bp, Homo sapiens
ggagtctcactctgtcacccagg

SEQ ID NO: 149088 - DNA, 22 bp, Homo sapiens
tgttaaactgttacttttctgg

SEQ ID NO: 149089 - DNA, 21 bp, Homo sapiens
aggtggatcagtgagctggtt

SEQ ID NO: 149090 - DNA, 22 bp, Homo sapiens
atttcaagtctcctctttggat

SEQ ID NO: 149091 - DNA, 23 bp, Homo sapiens
ggagtctctctctgtcactcagg

SEQ ID NO: 149092 - DNA, 23 bp, Homo sapiens
ggtctctctctctcatttgtgag

SEQ ID NO: 149093 - DNA, 23 bp, Homo sapiens
tgagttcattgtagattctggat

SEQ ID NO: 149094 - DNA, 23 bp, Homo sapiens
tgagttcattgtagattctggat

SEQ ID NO: 149095 - DNA, 18 bp, Homo sapiens
tacacctatatatatgta

SEQ ID NO: 149096 - DNA, 20 bp, Homo sapiens
actccttgtgctggtgtctg

SEQ ID NO: 149097 - DNA, 21 bp, Homo sapiens
tctctgtgtctcagttcctcc

SEQ ID NO: 149098 - DNA, 23 bp, Homo sapiens
cagctctctgtctgtggctcagc

SEQ ID NO: 149099 - DNA, 23 bp, Homo sapiens
acatattgcatatgtaaatgtgt

SEQ ID NO: 149100 - DNA, 23 bp, Homo sapiens
tcttgaaagaactgtgtgagcac

SEQ ID NO: 149101 - DNA, 23 bp, Homo sapiens
aaaaatatgatgtgcctgtcact

SEQ ID NO: 149102 - DNA, 23 bp, Homo sapiens
aaacaggatctcactctgtcact

SEQ ID NO: 149103 - DNA, 23 bp, Homo sapiens
gatgctcacactcagtcagtctg

SEQ ID NO: 149104 - DNA, 23 bp, Homo sapiens
aaactgagatgtcttgtgtgagg

SEQ ID NO: 149105 - DNA, 23 bp, Homo sapiens
cggagtctcgctctgtcgctcag

SEQ ID NO: 149106 - DNA, 23 bp, Homo sapiens
tatcagccacgaatagcagtgtt

SEQ ID NO: 149107 - DNA, 22 bp, Homo sapiens
attatgggcaatgtaaatatgt

SEQ ID NO: 149108 - DNA, 21 bp, Homo sapiens
aatggaattgtttgggtcaga

SEQ ID NO: 149109 - DNA, 23 bp, Homo sapiens
tcactgtctcagtcacaattttg

SEQ ID NO: 149110 - DNA, 23 bp, Homo sapiens
gtcggtgggtctctccctgtgtg

SEQ ID NO: 149111 - DNA, 21 bp, Homo sapiens
tatgtgcatcccaatgaggtt

SEQ ID NO: 149112 - DNA, 23 bp, Homo sapiens
tccctgtgtgtgtctctgtgggt

SEQ ID NO: 149113 - DNA, 20 bp, Homo sapiens
tgggactgtggttacaagtt

SEQ ID NO: 149114 - DNA, 23 bp, Homo sapiens
tcactctgtcccactgtgtccca

SEQ ID NO: 149115 - DNA, 21 bp, Homo sapiens
tagagatgcagaaaatgttct

SEQ ID NO: 149116 - DNA, 19 bp, Homo sapiens
agcacattaatatatgtgt

SEQ ID NO: 149117 - DNA, 18 bp, Homo sapiens
atgtttatctgtgttgat

SEQ ID NO: 149118 - DNA, 23 bp, Homo sapiens
gactgagtctggctctgtctccc

SEQ ID NO: 149119 - DNA, 19 bp, Homo sapiens
cagtggcacagtctcagct

SEQ ID NO: 149120 - DNA, 18 bp, Homo sapiens
acagaagacggttctgtt

SEQ ID NO: 149121 - DNA, 21 bp, Homo sapiens
gtagtgagataagagactgcg

SEQ ID NO: 149122 - DNA, 23 bp, Homo sapiens
tgctacagtggagagtgagcaga

SEQ ID NO: 149123 - DNA, 23 bp, Homo sapiens
agtctctgcctctgagtggagga

SEQ ID NO: 149124 - DNA, 22 bp, Homo sapiens
cagagttctgatattcttcttg

SEQ ID NO: 149125 - DNA, 20 bp, Homo sapiens
tccagcatttttaaaggtaa

SEQ ID NO: 149126 - DNA, 23 bp, Homo sapiens
tggcacacacctgtagtcctagc

SEQ ID NO: 149127 - DNA, 23 bp, Homo sapiens
tgagttcattgtagattctggat

SEQ ID NO: 149128 - DNA, 23 bp, Homo sapiens
tgagttcattgtagattctggat

SEQ ID NO: 149129 - DNA, 23 bp, Homo sapiens
gttagtgcaactgcaactgctcc

SEQ ID NO: 149130 - DNA, 23 bp, Homo sapiens
aaatgcatgtttctgattggctc

SEQ ID NO: 149131 - DNA, 20 bp, Homo sapiens
ttcttcagcacaaggcaaga

SEQ ID NO: 149132 - DNA, 23 bp, Homo sapiens
tgtcaagattttgctatgctgct

SEQ ID NO: 149133 - DNA, 19 bp, Homo sapiens
aactcacatgtctgggaca

SEQ ID NO: 149134 - DNA, 19 bp, Homo sapiens
atagtagtgaccgtgatga

SEQ ID NO: 149135 - DNA, 20 bp, Homo sapiens
aatggtgtagtgacggtgat

SEQ ID NO: 149136 - DNA, 21 bp, Homo sapiens
taactcacagtgtctttgagg

SEQ ID NO: 149137 - DNA, 23 bp, Homo sapiens
acagcctcacacacagagtgaca

SEQ ID NO: 149138 - DNA, 23 bp, Homo sapiens
agagggctctctctctctctgta

SEQ ID NO: 149139 - DNA, 23 bp, Homo sapiens
tcactcactctcactgttgtttg

SEQ ID NO: 149140 - DNA, 23 bp, Homo sapiens
accttcaactctcattctgaaaa

SEQ ID NO: 149141 - DNA, 23 bp, Homo sapiens
atgtgtgtatatatatgtgtgta

SEQ ID NO: 149142 - DNA, 23 bp, Homo sapiens
catcactactgatgatgatgatg

SEQ ID NO: 149143 - DNA, 22 bp, Homo sapiens
agatgagtactatgctaagtgt

SEQ ID NO: 149144 - DNA, 23 bp, Homo sapiens
tatcttcaaaacatcccagtgag

SEQ ID NO: 149145 - DNA, 22 bp, Homo sapiens
tgtgtgtatatatatatgtgtg

SEQ ID NO: 149146 - DNA, 23 bp, Homo sapiens
atgtgtgtatatatatatgtgtg

SEQ ID NO: 149147 - DNA, 21 bp, Homo sapiens
tatagtagatgctcagtaaat

SEQ ID NO: 149148 - DNA, 20 bp, Homo sapiens
ccggtcactcagtccctggg

SEQ ID NO: 149149 - DNA, 19 bp, Homo sapiens
tctgtgcttccgtggctgc

SEQ ID NO: 149150 - DNA, 23 bp, Homo sapiens
tctgtgcctctgtggctgccagt

SEQ ID NO: 149151 - DNA, 23 bp, Homo sapiens
tggagtctcactctgtcacccag

SEQ ID NO: 149152 - DNA, 23 bp, Homo sapiens
cagggctctgtctctctctcttt

SEQ ID NO: 149153 - DNA, 23 bp, Homo sapiens
tgagacggagtctcactctgtca

SEQ ID NO: 149154 - DNA, 20 bp, Homo sapiens
tctgtgttttactgtctgct

SEQ ID NO: 149155 - DNA, 21 bp, Homo sapiens
cttattagctcttgttgtttt

SEQ ID NO: 149156 - DNA, 23 bp, Homo sapiens
tggagtctcactctgtcacccag

SEQ ID NO: 149157 - DNA, 18 bp, Homo sapiens
cagtggtatgatctcagc

SEQ ID NO: 149158 - DNA, 22 bp, Homo sapiens
gacagactctcgctctgtcgcc

SEQ ID NO: 149159 - DNA, 20 bp, Homo sapiens
atacacacacgtgtgtatat

SEQ ID NO: 149160 - DNA, 21 bp, Homo sapiens
atacacgtacatgtatgtgtg

SEQ ID NO: 149161 - DNA, 23 bp, Homo sapiens
cacacgtgtgtatatgtatatat

SEQ ID NO: 149162 - DNA, 22 bp, Homo sapiens
atgtgtgtatatgtatatatgt

SEQ ID NO: 149163 - DNA, 22 bp, Homo sapiens
ttaagtggttatgaagctgcag

SEQ ID NO: 149164 - DNA, 20 bp, Homo sapiens
aatgcaaggcttaggaatct

SEQ ID NO: 149165 - DNA, 20 bp, Homo sapiens
taccaccacatgcagctaat

SEQ ID NO: 149166 - DNA, 23 bp, Homo sapiens
gtcagagtctcgctctgtcaccc

SEQ ID NO: 149167 - DNA, 21 bp, Homo sapiens
attgcactccagcctgggtga

SEQ ID NO: 149168 - DNA, 20 bp, Homo sapiens
cctctgactttcctgtttgt

SEQ ID NO: 149169 - DNA, 19 bp, Homo sapiens
agagtagctgctatggttg

SEQ ID NO: 149170 - DNA, 22 bp, Homo sapiens
agactgtgtgtgacacttcccc

SEQ ID NO: 149171 - DNA, 21 bp, Homo sapiens
acagagtctcgctttgttgcc

SEQ ID NO: 149172 - DNA, 23 bp, Homo sapiens
tgcctctcagtgtctttgttccc

SEQ ID NO: 149173 - DNA, 19 bp, Homo sapiens
tgtggtatactcacttgta

SEQ ID NO: 149174 - DNA, 23 bp, Homo sapiens
agacagtcttactctgtcaccca

SEQ ID NO: 149175 - DNA, 22 bp, Homo sapiens
atatagatctatatctatcgat

SEQ ID NO: 149176 - DNA, 23 bp, Homo sapiens
acagagtctcgctctgtcaccca

SEQ ID NO: 149177 - DNA, 22 bp, Homo sapiens
atgtcaaacttcaggtgccagc

SEQ ID NO: 149178 - DNA, 23 bp, Homo sapiens
tattgagcacctagtgtgtgtca

SEQ ID NO: 149179 - DNA, 22 bp, Homo sapiens
ctcaccctgtctgactggtctc

SEQ ID NO: 149180 - DNA, 23 bp, Homo sapiens
ttggaggagtctcactctgtcac

SEQ ID NO: 149181 - DNA, 23 bp, Homo sapiens
tgaagtcactgaactcagctgga

SEQ ID NO: 149182 - DNA, 23 bp, Homo sapiens
tgaactgactgcttcagctcacc

SEQ ID NO: 149183 - DNA, 21 bp, Homo sapiens
ttgcacagctgcttgatggag

SEQ ID NO: 149184 - DNA, 19 bp, Homo sapiens
tgactgtagagtctgtgct

SEQ ID NO: 149185 - DNA, 23 bp, Homo sapiens
ctgtctgtctctctgtctctcta

SEQ ID NO: 149186 - DNA, 23 bp, Homo sapiens
caccctcttttcatatatgtgtg

SEQ ID NO: 149187 - DNA, 23 bp, Homo sapiens
cacagcatttctactttaggaga

SEQ ID NO: 149188 - DNA, 23 bp, Homo sapiens
tttgagactcactctttcactca

SEQ ID NO: 149189 - DNA, 23 bp, Homo sapiens
agacaggatctctctctgtcacc

SEQ ID NO: 149190 - DNA, 23 bp, Homo sapiens
agagtctcactctgtcacccagg

SEQ ID NO: 149191 - DNA, 23 bp, Homo sapiens
gagtctcactctgtcacccaggc

SEQ ID NO: 149192 - DNA, 23 bp, Homo sapiens
accctgagagaaattactgtgct

SEQ ID NO: 149193 - DNA, 19 bp, Homo sapiens
tcagcatagtaattctctc

SEQ ID NO: 149194 - DNA, 23 bp, Homo sapiens
gagtttgcagtgagtgagcagag

SEQ ID NO: 149195 - DNA, 19 bp, Homo sapiens
tatgcacatgaacatacgt

SEQ ID NO: 149196 - DNA, 22 bp, Homo sapiens
atatacaaggttgtgggtttgt

SEQ ID NO: 149197 - DNA, 23 bp, Homo sapiens
agggtctcactgtgtcactcagg

SEQ ID NO: 149198 - DNA, 20 bp, Homo sapiens
cagtggaatgatcttggctc

SEQ ID NO: 149199 - DNA, 20 bp, Homo sapiens
ttcaggtgcttctcccacct

SEQ ID NO: 149200 - DNA, 23 bp, Homo sapiens
tggagtctcactctgtcacctag

SEQ ID NO: 149201 - DNA, 22 bp, Homo sapiens
ttgctgtgggcatagctgagct

SEQ ID NO: 149202 - DNA, 21 bp, Homo sapiens
tgatacaagaacttgctgctt

SEQ ID NO: 149203 - DNA, 23 bp, Homo sapiens
atagacatgtagtactgctaccc

SEQ ID NO: 149204 - DNA, 23 bp, Homo sapiens
atatgtcagctactgttgttgtt

SEQ ID NO: 149205 - DNA, 19 bp, Homo sapiens
tctcactctggggctctct

SEQ ID NO: 149206 - DNA, 22 bp, Homo sapiens
tcagttgtctctcccactttcc

SEQ ID NO: 149207 - DNA, 23 bp, Homo sapiens
tatcactgaagtgtaagctgtta

SEQ ID NO: 149208 - DNA, 23 bp, Homo sapiens
tgacttgacactcaatgtgctta

SEQ ID NO: 149209 - DNA, 23 bp, Homo sapiens
tgtttctgtggatgtggatctcc

SEQ ID NO: 149210 - DNA, 23 bp, Homo sapiens
tgggtgacagtgagactctgtct

SEQ ID NO: 149211 - DNA, 22 bp, Homo sapiens
tctggttgtttgacagagtgta

SEQ ID NO: 149212 - DNA, 23 bp, Homo sapiens
gtgagttcagtgggttgtatcaa

SEQ ID NO: 149213 - DNA, 23 bp, Homo sapiens
aagaaagtgacttggcaattgat

SEQ ID NO: 149214 - DNA, 23 bp, Homo sapiens
tgtctggctggctctctccctgg

SEQ ID NO: 149215 - DNA, 23 bp, Homo sapiens
gactagacacagaatcacattgg

SEQ ID NO: 149216 - DNA, 23 bp, Homo sapiens
tcagggacactgtctgagtctcc

SEQ ID NO: 149217 - DNA, 21 bp, Homo sapiens
tgaggtaggaggatcatttga

SEQ ID NO: 149218 - DNA, 23 bp, Homo sapiens
cgctgttctgtggtttgtaggtt

SEQ ID NO: 149219 - DNA, 23 bp, Homo sapiens
aggattctctgtcttctgttcag

SEQ ID NO: 149220 - DNA, 22 bp, Homo sapiens
tgtctgtctgcttctgtatagg

SEQ ID NO: 149221 - DNA, 21 bp, Homo sapiens
aggcagatttctcactcttca

SEQ ID NO: 149222 - DNA, 22 bp, Homo sapiens
atatatgtatatatacgtgtat

SEQ ID NO: 149223 - DNA, 23 bp, Homo sapiens
atgtgtatatatgtatatatgtg

SEQ ID NO: 149224 - DNA, 23 bp, Homo sapiens
atgtgtatatatatgtgtgtgtg

SEQ ID NO: 149225 - DNA, 23 bp, Homo sapiens
tggagtctcactctgtcacccag

SEQ ID NO: 149226 - DNA, 23 bp, Homo sapiens
gacagagtctcgctctgtcaccc

SEQ ID NO: 149227 - DNA, 21 bp, Homo sapiens
tatctgttgtacacttgggtt

SEQ ID NO: 149228 - DNA, 23 bp, Homo sapiens
gagtctcactctgtcacccaggc

SEQ ID NO: 149229 - DNA, 23 bp, Homo sapiens
aaggtctcactctgtcactcagg

SEQ ID NO: 149230 - DNA, 23 bp, Homo sapiens
tgcagtggcatgatcttggctca

SEQ ID NO: 149231 - DNA, 20 bp, Homo sapiens
tgcatgtgtgtatatatata

SEQ ID NO: 149232 - DNA, 22 bp, Homo sapiens
attttcctctcccagtttcttg

SEQ ID NO: 149233 - DNA, 23 bp, Homo sapiens
tttgcataactgtctctatcagt

SEQ ID NO: 149234 - DNA, 23 bp, Homo sapiens
taagagagtgatgtggtttggat

SEQ ID NO: 149235 - DNA, 18 bp, Homo sapiens
tcacacagcaaataagtg

SEQ ID NO: 149236 - DNA, 21 bp, Homo sapiens
atgtctactgtcccacttgaa

SEQ ID NO: 149237 - DNA, 19 bp, Homo sapiens
aaagtgctgggattacagg

SEQ ID NO: 149238 - DNA, 20 bp, Homo sapiens
ttgacatggtgtcttgctct

SEQ ID NO: 149239 - DNA, 23 bp, Homo sapiens
gctctgtccctgaggcactgcca

SEQ ID NO: 149240 - DNA, 21 bp, Homo sapiens
tggcgtgatcttggctcactg

SEQ ID NO: 149241 - DNA, 23 bp, Homo sapiens
ctgtgtgtgtgtcacccactcag

SEQ ID NO: 149242 - DNA, 23 bp, Homo sapiens
tggagtctcactctgtcacccag

SEQ ID NO: 149243 - DNA, 23 bp, Homo sapiens
agacagagtctccctctgtcacc

SEQ ID NO: 149244 - DNA, 23 bp, Homo sapiens
gatgaagtctcactctgtcaccc

SEQ ID NO: 149245 - DNA, 23 bp, Homo sapiens
ctccctgacactcttaagtctgg

SEQ ID NO: 149246 - DNA, 21 bp, Homo sapiens
tgaggtaggtggatcacttga

SEQ ID NO: 149247 - DNA, 18 bp, Homo sapiens
agagcgaacttagagggg

SEQ ID NO: 149248 - DNA, 23 bp, Homo sapiens
acagagtctcactctgtcgctca

SEQ ID NO: 149249 - DNA, 23 bp, Homo sapiens
atggagtctcactctgtctccca

SEQ ID NO: 149250 - DNA, 23 bp, Homo sapiens
tgagagtctcactgtgtcgccca

SEQ ID NO: 149251 - DNA, 21 bp, Homo sapiens
ttttgagacggagtctcactc

SEQ ID NO: 149252 - DNA, 23 bp, Homo sapiens
ggtcagtgagtctctccttatcc

SEQ ID NO: 149253 - DNA, 21 bp, Homo sapiens
gatgagatctcattctgcggc

SEQ ID NO: 149254 - DNA, 20 bp, Homo sapiens
tagacagtagatagataggt

SEQ ID NO: 149255 - DNA, 23 bp, Homo sapiens
agagatgtctcctattgcttctg

SEQ ID NO: 149256 - DNA, 22 bp, Homo sapiens
tcagaccgaggttcctgccagt

SEQ ID NO: 149257 - DNA, 23 bp, Homo sapiens
agatctcagtgagctaatgtgga

SEQ ID NO: 149258 - DNA, 23 bp, Homo sapiens
cggagtctcgctctgtcgctcag

SEQ ID NO: 149259 - DNA, 21 bp, Homo sapiens
tctcagactctcagtgccggc

SEQ ID NO: 149260 - DNA, 18 bp, Homo sapiens
tcacacctgtaatcccag

SEQ ID NO: 149261 - DNA, 23 bp, Homo sapiens
acagagtctcgcactgtcaccca

SEQ ID NO: 149262 - DNA, 23 bp, Homo sapiens
tatgtgtgtatatatatgtatgt

SEQ ID NO: 149263 - DNA, 23 bp, Homo sapiens
atctggaagacattgcacagaag

SEQ ID NO: 149264 - DNA, 23 bp, Homo sapiens
atttgtgattatgtatttctgtg

SEQ ID NO: 149265 - DNA, 23 bp, Homo sapiens
tagggttaatattgttatgtgtg

SEQ ID NO: 149266 - DNA, 20 bp, Homo sapiens
tttctctctgacaatggcca

SEQ ID NO: 149267 - DNA, 22 bp, Homo sapiens
tgattacagtgtaagcagagag

SEQ ID NO: 149268 - DNA, 23 bp, Homo sapiens
ataagtgagagaaaagtgtttga

SEQ ID NO: 149269 - DNA, 23 bp, Homo sapiens
gcaattgttgatggacagaagga

SEQ ID NO: 149270 - DNA, 21 bp, Homo sapiens
aaagttgttgtggccattgta

SEQ ID NO: 149271 - DNA, 18 bp, Homo sapiens
tgcaacttctgcctcctg

SEQ ID NO: 149272 - DNA, 23 bp, Homo sapiens
acagagtctcgctctgtcaccca

SEQ ID NO: 149273 - DNA, 21 bp, Homo sapiens
atcacaggcattcagaacagt

SEQ ID NO: 149274 - DNA, 23 bp, Homo sapiens
tgaatgaatgaataagcagagtg

SEQ ID NO: 149275 - DNA, 22 bp, Homo sapiens
gtatgcatacatgtgtgtatat

SEQ ID NO: 149276 - DNA, 23 bp, Homo sapiens
tcagagtctctctctgtcaccca

SEQ ID NO: 149277 - DNA, 23 bp, Homo sapiens
tgcagaggcatgatcatggctca

SEQ ID NO: 149278 - DNA, 19 bp, Homo sapiens
gtgagtagaccctcagcac

SEQ ID NO: 149279 - DNA, 23 bp, Homo sapiens
caaggtctcactctgtcacccag

SEQ ID NO: 149280 - DNA, 18 bp, Homo sapiens
cagtggtgtgatcatagc

SEQ ID NO: 149281 - DNA, 23 bp, Homo sapiens
cagagtctcactctgtcgcctag

SEQ ID NO: 149282 - DNA, 18 bp, Homo sapiens
tctcattcactctgtggc

SEQ ID NO: 149283 - DNA, 18 bp, Homo sapiens
atacattatatatatgtg

SEQ ID NO: 149284 - DNA, 23 bp, Homo sapiens
gagagtctcgctctgtctcccag

SEQ ID NO: 149285 - DNA, 23 bp, Homo sapiens
agacagtctcactgtgtcgccca

SEQ ID NO: 149286 - DNA, 23 bp, Homo sapiens
tgcaatgagccatgatcgtgcca

SEQ ID NO: 149287 - DNA, 22 bp, Homo sapiens
ttggaaatgaaagtgaaattct

SEQ ID NO: 149288 - DNA, 18 bp, Homo sapiens
tcacagcaggtccaaagc

SEQ ID NO: 149289 - DNA, 23 bp, Homo sapiens
cggagtctcactctgtcacccag

SEQ ID NO: 149290 - DNA, 23 bp, Homo sapiens
gagtctcactctgtcacccaggc

SEQ ID NO: 149291 - DNA, 23 bp, Homo sapiens
acgtagagaagagagtgaggtgt

SEQ ID NO: 149292 - DNA, 23 bp, Homo sapiens
agagatatctagaagacactccc

SEQ ID NO: 149293 - DNA, 18 bp, Homo sapiens
tggcatgatctcggctca

SEQ ID NO: 149294 - DNA, 23 bp, Homo sapiens
agagggactctcgctctgtcgct

SEQ ID NO: 149295 - DNA, 22 bp, Homo sapiens
tatgtgtatatatgtgtgtgtg

SEQ ID NO: 149296 - DNA, 23 bp, Homo sapiens
cttctgtctctgtctgggtgtgg

SEQ ID NO: 149297 - DNA, 23 bp, Homo sapiens
acagagtctcactctgtcaccca

SEQ ID NO: 149298 - DNA, 23 bp, Homo sapiens
cggagtctcactctgtcacccag

SEQ ID NO: 149299 - DNA, 21 bp, Homo sapiens
tgaggtaggaggatcacttga

SEQ ID NO: 149300 - DNA, 23 bp, Homo sapiens
gtgagccatgatcctgccactgc

SEQ ID NO: 149301 - DNA, 23 bp, Homo sapiens
agacagggtctcactctgtcacc

SEQ ID NO: 149302 - DNA, 22 bp, Homo sapiens
catctgtctgtctgtctgttgt

SEQ ID NO: 149303 - DNA, 18 bp, Homo sapiens
tgagacagagtctcactc

SEQ ID NO: 149304 - DNA, 22 bp, Homo sapiens
agtctcgctctgtcactcaggc

SEQ ID NO: 149305 - DNA, 23 bp, Homo sapiens
tttggagacagagtctcgctctg

SEQ ID NO: 149306 - DNA, 23 bp, Homo sapiens
gacaaggtctcactctgtcaccc

SEQ ID NO: 149307 - DNA, 22 bp, Homo sapiens
ttttgagaccaagtctcactct

SEQ ID NO: 149308 - DNA, 23 bp, Homo sapiens
agagtctcactctgtcacccagg

SEQ ID NO: 149309 - DNA, 23 bp, Homo sapiens
cggagtctcactctgtcacccag

SEQ ID NO: 149310 - DNA, 23 bp, Homo sapiens
gagtctcactctgtcacccaggc

SEQ ID NO: 149311 - DNA, 22 bp, Homo sapiens
caagtagctgggactacatttt

SEQ ID NO: 149312 - DNA, 23 bp, Homo sapiens
gcctccctgtgtcgctgtctcac

SEQ ID NO: 149313 - DNA, 23 bp, Homo sapiens
gatggctgtctgtctgtctgtgt

SEQ ID NO: 149314 - DNA, 23 bp, Homo sapiens
cgctctgtgtgtctgtctgtctg

SEQ ID NO: 149315 - DNA, 19 bp, Homo sapiens
ttcctgtctgtccgtctca

SEQ ID NO: 149316 - DNA, 23 bp, Homo sapiens
ggagtctcactctgtcacctagg

SEQ ID NO: 149317 - DNA, 23 bp, Homo sapiens
tctaggagagaatttgttgttgt

SEQ ID NO: 149318 - DNA, 18 bp, Homo sapiens
acagtggacagtgaggcc

SEQ ID NO: 149319 - DNA, 23 bp, Homo sapiens
tcttagtcaggtagtaatagagg

SEQ ID NO: 149320 - DNA, 23 bp, Homo sapiens
ctcagccactgtctgtgggacag

SEQ ID NO: 149321 - DNA, 23 bp, Homo sapiens
tctctgcctgagtctctgtgtgt

SEQ ID NO: 149322 - DNA, 22 bp, Homo sapiens
tctctgtgcctcagtttcctca

SEQ ID NO: 149323 - DNA, 23 bp, Homo sapiens
tctcacccagggtctgaccttgg

SEQ ID NO: 149324 - DNA, 18 bp, Homo sapiens
cagctggagctggaggca

SEQ ID NO: 149325 - DNA, 18 bp, Homo sapiens
tatgtgtttgtatgcata

SEQ ID NO: 149326 - DNA, 23 bp, Homo sapiens
tccctgcctgcctgactggctgg

SEQ ID NO: 149327 - DNA, 22 bp, Homo sapiens
atcactttttttttttttgaga

SEQ ID NO: 149328 - DNA, 18 bp, Homo sapiens
gtgacagtgagaccctgt

SEQ ID NO: 149329 - DNA, 23 bp, Homo sapiens
tctctctctggctctgcttctgg

SEQ ID NO: 149330 - DNA, 21 bp, Homo sapiens
gccctggatctaggtcaggag

SEQ ID NO: 149331 - DNA, 22 bp, Homo sapiens
aatctggtgccatctattggag

SEQ ID NO: 149332 - DNA, 22 bp, Homo sapiens
gtctgcctgtctgcctggcagt

SEQ ID NO: 149333 - DNA, 23 bp, Homo sapiens
gctcgctcgctcactctctcgct

SEQ ID NO: 149334 - DNA, 23 bp, Homo sapiens
gcctctctgtctgtctccatgtg

SEQ ID NO: 149335 - DNA, 23 bp, Homo sapiens
attatctcagaatcctcgcactg

SEQ ID NO: 149336 - DNA, 22 bp, Homo sapiens
gatctatgtggaggtgctgagt

SEQ ID NO: 149337 - DNA, 23 bp, Homo sapiens
actccaaagcaaagatgtcagaa

SEQ ID NO: 149338 - DNA, 18 bp, Homo sapiens
atatgtaagccactgttt

SEQ ID NO: 149339 - DNA, 20 bp, Homo sapiens
aatgacagtagctgctctgg

SEQ ID NO: 149340 - DNA, 23 bp, Homo sapiens
cagtctcaggtatgtctttgtta

SEQ ID NO: 149341 - DNA, 18 bp, Homo sapiens
atttttagattttgttgg

SEQ ID NO: 149342 - DNA, 23 bp, Homo sapiens
atgtgtgtgactgtgtgtgtgtg

SEQ ID NO: 149343 - DNA, 23 bp, Homo sapiens
caaggtctcactctgtcacccac

SEQ ID NO: 149344 - DNA, 18 bp, Homo sapiens
tgagatggtgtctcactc

SEQ ID NO: 149345 - DNA, 23 bp, Homo sapiens
attttgtcactggctgttttctt

SEQ ID NO: 149346 - DNA, 23 bp, Homo sapiens
tgagttcattgtagattctggat

SEQ ID NO: 149347 - DNA, 23 bp, Homo sapiens
tgagttcattgtagattctggat

SEQ ID NO: 149348 - DNA, 21 bp, Homo sapiens
agtggagttcttaggaaaaag

SEQ ID NO: 149349 - DNA, 20 bp, Homo sapiens
tgtgtgtgggtgtgtatata

SEQ ID NO: 149350 - DNA, 20 bp, Homo sapiens
atatatgtatgtatatgtat

SEQ ID NO: 149351 - DNA, 23 bp, Homo sapiens
tatgtatgcatgtgtgtatatgt

SEQ ID NO: 149352 - DNA, 23 bp, Homo sapiens
atgtgtgtgagtatatgcatgtg

SEQ ID NO: 149353 - DNA, 19 bp, Homo sapiens
tatgtgtatgcatgtgtat

SEQ ID NO: 149354 - DNA, 21 bp, Homo sapiens
tatgcatgtatatatgtatgt

SEQ ID NO: 149355 - DNA, 23 bp, Homo sapiens
ggagtctcactctgtcactcagg

SEQ ID NO: 149356 - DNA, 23 bp, Homo sapiens
atgtgtgtgtgcgtgtgtcctac

SEQ ID NO: 149357 - DNA, 23 bp, Homo sapiens
gtgtggctctgtgactgggtcct

SEQ ID NO: 149358 - DNA, 23 bp, Homo sapiens
acggagtctcactctgtcgctca

SEQ ID NO: 149359 - DNA, 23 bp, Homo sapiens
actgtgtgtatataggtatgtgt

SEQ ID NO: 149360 - DNA, 23 bp, Homo sapiens
atatctgtgtgtatatctgtgtg

SEQ ID NO: 149361 - DNA, 22 bp, Homo sapiens
tcagcacagaagacagtgagca

SEQ ID NO: 149362 - DNA, 23 bp, Homo sapiens
tccatctgtctatatcttgacat

SEQ ID NO: 149363 - DNA, 23 bp, Homo sapiens
agtgtgtgcatatatatactata

SEQ ID NO: 149364 - DNA, 23 bp, Homo sapiens
cagggtctcactctgtcacccag

SEQ ID NO: 149365 - DNA, 19 bp, Homo sapiens
tcactcacatgctccctcc

SEQ ID NO: 149366 - DNA, 23 bp, Homo sapiens
tgactgagtctggctctgtcacc

SEQ ID NO: 149367 - DNA, 23 bp, Homo sapiens
ttgttagtggatgaattttcaat

SEQ ID NO: 149368 - DNA, 20 bp, Homo sapiens
aggaagaaagtgtttttcgc

SEQ ID NO: 149369 - DNA, 23 bp, Homo sapiens
tctctcagtgtgtctgagtctgg

SEQ ID NO: 149370 - DNA, 23 bp, Homo sapiens
agcttgctctcactctgtctcac

SEQ ID NO: 149371 - DNA, 23 bp, Homo sapiens
atgcactctgatgatgaagggac

SEQ ID NO: 149372 - DNA, 21 bp, Homo sapiens
tgcacatgtatgtatatatgt

SEQ ID NO: 149373 - DNA, 18 bp, Homo sapiens
tctggagccacactgtcg

SEQ ID NO: 149374 - DNA, 22 bp, Homo sapiens
ttgcagtaatctaggtgagaga

SEQ ID NO: 149375 - DNA, 23 bp, Homo sapiens
acgcagtgaagagagatgcttag

SEQ ID NO: 149376 - DNA, 23 bp, Homo sapiens
ctcaggcagacatatgttcttca

SEQ ID NO: 149377 - DNA, 22 bp, Homo sapiens
ctctcccactgtgcctggcaca

SEQ ID NO: 149378 - DNA, 23 bp, Homo sapiens
tgtttctagtggatgctggaatc

SEQ ID NO: 149379 - DNA, 21 bp, Homo sapiens
tgaggtggtaggatcatttga

SEQ ID NO: 149380 - DNA, 23 bp, Homo sapiens
ctcagtgactgtgtctctggttc

SEQ ID NO: 149381 - DNA, 23 bp, Homo sapiens
tgagttcattgtagattctggat

SEQ ID NO: 149382 - DNA, 23 bp, Homo sapiens
tgagttcattgtagattctggat

SEQ ID NO: 149383 - DNA, 23 bp, Homo sapiens
agagagaggctgttctttcctgg

SEQ ID NO: 149384 - DNA, 23 bp, Homo sapiens
attcagaactcgtttttgtttca

SEQ ID NO: 149385 - DNA, 21 bp, Homo sapiens
ttgtatgtgtgcatctggttg

SEQ ID NO: 149386 - DNA, 19 bp, Homo sapiens
attgatatgtacatatggc

SEQ ID NO: 149387 - DNA, 23 bp, Homo sapiens
tatgtgcacatatatgtatagat

SEQ ID NO: 149388 - DNA, 22 bp, Homo sapiens
tattgtgtgtgtgtgtgtctgt

SEQ ID NO: 149389 - DNA, 22 bp, Homo sapiens
gatctgagtggaaagatacagg

SEQ ID NO: 149390 - DNA, 20 bp, Homo sapiens
gtctcactcactctgttgcc

SEQ ID NO: 149391 - DNA, 22 bp, Homo sapiens
agaacgtggcacagagtcactg

SEQ ID NO: 149392 - DNA, 23 bp, Homo sapiens
acggctctggctgacttcacatg

SEQ ID NO: 149393 - DNA, 23 bp, Homo sapiens
ttttggagacagggtctcactct

SEQ ID NO: 149394 - DNA, 23 bp, Homo sapiens
agagtcacactctgtcacccagg

SEQ ID NO: 149395 - DNA, 23 bp, Homo sapiens
tcagttagagattctttttcttt

SEQ ID NO: 149396 - DNA, 23 bp, Homo sapiens
agatggagtctcactctgtcacc

SEQ ID NO: 149397 - DNA, 22 bp, Homo sapiens
ctgtctgtcgctgtgactgaag

SEQ ID NO: 149398 - DNA, 23 bp, Homo sapiens
tgtcactgtctgtgtttcctgat

SEQ ID NO: 149399 - DNA, 23 bp, Homo sapiens
gggtctcactctgtcacccaggc

SEQ ID NO: 149400 - DNA, 18 bp, Homo sapiens
agtggtgtgatcttagct

SEQ ID NO: 149401 - DNA, 23 bp, Homo sapiens
gtctgggtgtgagtgacaggccc

SEQ ID NO: 149402 - DNA, 22 bp, Homo sapiens
tgagagttcacacagaggactt

SEQ ID NO: 149403 - DNA, 23 bp, Homo sapiens
actggactccttgctgactctgt

SEQ ID NO: 149404 - DNA, 21 bp, Homo sapiens
tgtgtgcctgtgtgtgagtgt

SEQ ID NO: 149405 - DNA, 23 bp, Homo sapiens
aattatgttgatgatgatgatca

SEQ ID NO: 149406 - DNA, 23 bp, Homo sapiens
tgtctgcctgcctgcctgcctgc

SEQ ID NO: 149407 - DNA, 23 bp, Homo sapiens
attgagagtgcctgtgttcagga

SEQ ID NO: 149408 - DNA, 23 bp, Homo sapiens
tgtcacatgagagatagcaggcc

SEQ ID NO: 149409 - DNA, 23 bp, Homo sapiens
acagggtctctcgctctgtcacc

SEQ ID NO: 149410 - DNA, 23 bp, Homo sapiens
aggatcgcttgagtctgggagtt

SEQ ID NO: 149411 - DNA, 23 bp, Homo sapiens
gtttgttttggaagctgaatgag

SEQ ID NO: 149412 - DNA, 23 bp, Homo sapiens
gacagagtctcgctctgtcaccc

SEQ ID NO: 149413 - DNA, 22 bp, Homo sapiens
cagctgtcgctgtgtcagtgac

SEQ ID NO: 149414 - DNA, 23 bp, Homo sapiens
tcagacacactggatcaggtgac

SEQ ID NO: 149415 - DNA, 23 bp, Homo sapiens
acagtctcactcactctgtcgcc

SEQ ID NO: 149416 - DNA, 23 bp, Homo sapiens
ccagcctgtgtctgtctgtctgc

SEQ ID NO: 149417 - DNA, 23 bp, Homo sapiens
tcatgtgtcccactctctccctg

SEQ ID NO: 149418 - DNA, 23 bp, Homo sapiens
ctcactgtctccctgtgactgcc

SEQ ID NO: 149419 - DNA, 23 bp, Homo sapiens
tggagtctcactctgtcacccag

SEQ ID NO: 149420 - DNA, 23 bp, Homo sapiens
tcctgacaagaaaagtgacacct

SEQ ID NO: 149421 - DNA, 21 bp, Homo sapiens
ttaagagtttcgctcttgtcg

SEQ ID NO: 149422 - DNA, 18 bp, Homo sapiens
aggcctgtagttccagct

SEQ ID NO: 149423 - DNA, 23 bp, Homo sapiens
atcacttgagtctgggaggttga

SEQ ID NO: 149424 - DNA, 23 bp, Homo sapiens
ttccaaagtgattgtaccatttt

SEQ ID NO: 149425 - DNA, 23 bp, Homo sapiens
tgaggctgtagttggccatgact

SEQ ID NO: 149426 - DNA, 22 bp, Homo sapiens
atggagtctcactctgtcaccc

SEQ ID NO: 149427 - DNA, 23 bp, Homo sapiens
tggagtctcactctgtcacccag

SEQ ID NO: 149428 - DNA, 18 bp, Homo sapiens
acagtggtgcgatctcag

SEQ ID NO: 149429 - DNA, 23 bp, Homo sapiens
cggagtctcgctctgtcgctcag

SEQ ID NO: 149430 - DNA, 21 bp, Homo sapiens
agtctcgctctgtcacccagg

SEQ ID NO: 149431 - DNA, 21 bp, Homo sapiens
tttgtgcttgtctcccaggct

SEQ ID NO: 149432 - DNA, 21 bp, Homo sapiens
tggccctgtctgggcataaca

SEQ ID NO: 149433 - DNA, 23 bp, Homo sapiens
gacagagtctcgctctgtcaccc

SEQ ID NO: 149434 - DNA, 18 bp, Homo sapiens
tgcagcacttggtatgtg

SEQ ID NO: 149435 - DNA, 23 bp, Homo sapiens
taagcacctctgagtgctgttac

SEQ ID NO: 149436 - DNA, 23 bp, Homo sapiens
gatgtaggttggttagtcttagg

SEQ ID NO: 149437 - DNA, 23 bp, Homo sapiens
ttctgtgtctgtctgtctgcatg

SEQ ID NO: 149438 - DNA, 23 bp, Homo sapiens
tgagacaaggtctcgctctgttg

SEQ ID NO: 149439 - DNA, 18 bp, Homo sapiens
tgagctctctgtgtctca

SEQ ID NO: 149440 - DNA, 21 bp, Homo sapiens
tctggttcccctaacagaccc

SEQ ID NO: 149441 - DNA, 19 bp, Homo sapiens
atggatgtttacttttgat

SEQ ID NO: 149442 - DNA, 23 bp, Homo sapiens
ctcagggtctctgtctctttcgg

SEQ ID NO: 149443 - DNA, 20 bp, Homo sapiens
tagaggttctatttggttca

SEQ ID NO: 149444 - DNA, 23 bp, Homo sapiens
tgcatctcacactcatcattgcc

SEQ ID NO: 149445 - DNA, 23 bp, Homo sapiens
tactgaatgtttaataaggtagc

SEQ ID NO: 149446 - DNA, 23 bp, Homo sapiens
tgagacagagtctcgctctgtcg

SEQ ID NO: 149447 - DNA, 19 bp, Homo sapiens
actgcaacctctgcttcct

SEQ ID NO: 149448 - DNA, 23 bp, Homo sapiens
gacagagtctcgctctgtcaccc

SEQ ID NO: 149449 - DNA, 23 bp, Homo sapiens
tgtgataatttgtgcttttgaag

SEQ ID NO: 149450 - DNA, 23 bp, Homo sapiens
tggagtctcactctgtcacccag

SEQ ID NO: 149451 - DNA, 21 bp, Homo sapiens
gctgacacacactgactgtct

SEQ ID NO: 149452 - DNA, 23 bp, Homo sapiens
ccagtctcactgtcttattccag

SEQ ID NO: 149453 - DNA, 22 bp, Homo sapiens
tgtagaatttagaagtaaaagg

SEQ ID NO: 149454 - DNA, 21 bp, Homo sapiens
ctgtgagtgacagagggacag

SEQ ID NO: 149455 - DNA, 18 bp, Homo sapiens
attcgtgtatgctgtttg

SEQ ID NO: 149456 - DNA, 21 bp, Homo sapiens
ttgacacacaggtaaggaaag

SEQ ID NO: 149457 - DNA, 21 bp, Homo sapiens
aaggatgaagatggtgatgag

SEQ ID NO: 149458 - DNA, 18 bp, Homo sapiens
actcactcactgtgtcct

SEQ ID NO: 149459 - DNA, 21 bp, Homo sapiens
tcccagcctcccagtatccat

SEQ ID NO: 149460 - DNA, 23 bp, Homo sapiens
ttctgtgccagcaaaagaaggta

SEQ ID NO: 149461 - DNA, 23 bp, Homo sapiens
tgtgtgcatgtgcatgtgcatgt

SEQ ID NO: 149462 - DNA, 23 bp, Homo sapiens
tgtcaagttaatcttacatttct

SEQ ID NO: 149463 - DNA, 22 bp, Homo sapiens
acagtacatactgtgtgtatat

SEQ ID NO: 149464 - DNA, 23 bp, Homo sapiens
tgagacgtgagtgagctgaggag

SEQ ID NO: 149465 - DNA, 22 bp, Homo sapiens
tgtgtgtatatatatctgtgtg

SEQ ID NO: 149466 - DNA, 21 bp, Homo sapiens
tgtctctctctgtgtccatga

SEQ ID NO: 149467 - DNA, 21 bp, Homo sapiens
tcacaagactgtgagcagagc

SEQ ID NO: 149468 - DNA, 23 bp, Homo sapiens
tgagttcattgtagattctggat

SEQ ID NO: 149469 - DNA, 23 bp, Homo sapiens
tgagttcattgtagattctggat

SEQ ID NO: 149470 - DNA, 18 bp, Homo sapiens
atgaacaaggacagcttg

SEQ ID NO: 149471 - DNA, 22 bp, Homo sapiens
agatctctttcactgtctcagt

SEQ ID NO: 149472 - DNA, 23 bp, Homo sapiens
agcaggtgttcagtgtgagctgt

SEQ ID NO: 149473 - DNA, 18 bp, Homo sapiens
tcattgctagtgtgtaga

SEQ ID NO: 149474 - DNA, 19 bp, Homo sapiens
acacatgtgactttgttgt

SEQ ID NO: 149475 - DNA, 21 bp, Homo sapiens
taagtatgtgtgtgtgtgtat

SEQ ID NO: 149476 - DNA, 23 bp, Homo sapiens
accactcagtcaagatactgctg

SEQ ID NO: 149477 - DNA, 23 bp, Homo sapiens
ttatttcttttgcacatctttgc

SEQ ID NO: 149478 - DNA, 23 bp, Homo sapiens
tgagttcattgtagattctggat

SEQ ID NO: 149479 - DNA, 23 bp, Homo sapiens
tgagttcattgtagattctggat

SEQ ID NO: 149480 - DNA, 20 bp, Homo sapiens
atatacctacatatacatat

SEQ ID NO: 149481 - DNA, 19 bp, Homo sapiens
gtctcgctctgtcacccag

SEQ ID NO: 149482 - DNA, 23 bp, Homo sapiens
tagagagagtgcagaatcagcgc

SEQ ID NO: 149483 - DNA, 23 bp, Homo sapiens
tgtgtgtgtgtgtgcatgttcat

SEQ ID NO: 149484 - DNA, 23 bp, Homo sapiens
atatgtgtgtgcatgttcatata

SEQ ID NO: 149485 - DNA, 23 bp, Homo sapiens
tcaagagacagaatctgcatcag

SEQ ID NO: 149486 - DNA, 23 bp, Homo sapiens
tgagttcattgtagattctggat

SEQ ID NO: 149487 - DNA, 23 bp, Homo sapiens
tgagttcattgtagattctggat

SEQ ID NO: 149488 - DNA, 23 bp, Homo sapiens
tatatctctgtactgtgtcggtt

SEQ ID NO: 149489 - DNA, 20 bp, Homo sapiens
tctacgcacatgtatgtgta

SEQ ID NO: 149490 - DNA, 22 bp, Homo sapiens
tgtgtatatatctatatatgtg

SEQ ID NO: 149491 - DNA, 23 bp, Homo sapiens
tagtgtgtatatatgtatactta

SEQ ID NO: 149492 - DNA, 23 bp, Homo sapiens
tatatgtatatatacatatgtgt

SEQ ID NO: 149493 - DNA, 21 bp, Homo sapiens
tacacacacacatatgtatat

SEQ ID NO: 149494 - DNA, 20 bp, Homo sapiens
tgacagagcaagatgtctca

SEQ ID NO: 149495 - DNA, 21 bp, Homo sapiens
ttttgagaccaagtctcactc

SEQ ID NO: 149496 - DNA, 23 bp, Homo sapiens
tgagatggagtctcactctgtcg

SEQ ID NO: 149497 - DNA, 23 bp, Homo sapiens
aagaccatgtttcttcttgtttc

SEQ ID NO: 149498 - DNA, 22 bp, Homo sapiens
tgagtgcctgtgtgtgtgcctg

SEQ ID NO: 149499 - DNA, 23 bp, Homo sapiens
tgtgtgcctgtgtgcgtgcatgt

SEQ ID NO: 149500 - DNA, 23 bp, Homo sapiens
tgtgttctaggtccagaaggtgt

SEQ ID NO: 149501 - DNA, 21 bp, Homo sapiens
caaagctttggctctgtctct

SEQ ID NO: 149502 - DNA, 23 bp, Homo sapiens
aaatgtacacacatatgtgtatg

SEQ ID NO: 149503 - DNA, 22 bp, Homo sapiens
tatgtgtgcatttatgtgtgtg

SEQ ID NO: 149504 - DNA, 22 bp, Homo sapiens
tttaaggtaaaataagaaaaca

SEQ ID NO: 149505 - DNA, 22 bp, Homo sapiens
ttcctggttacattttctgatg

SEQ ID NO: 149506 - DNA, 23 bp, Homo sapiens
tctctctgtgtcaggtgctgttt

SEQ ID NO: 149507 - DNA, 23 bp, Homo sapiens
tgagttcattgtagattctggat

SEQ ID NO: 149508 - DNA, 23 bp, Homo sapiens
tgagttcattgtagattctggat

SEQ ID NO: 149509 - DNA, 23 bp, Homo sapiens
tgagttcattgtagattctggat

SEQ ID NO: 149510 - DNA, 23 bp, Homo sapiens
tgagttcattgtagattctggat

SEQ ID NO: 149511 - DNA, 23 bp, Homo sapiens
gtatgcatgcatgtgtatacatg

SEQ ID NO: 149512 - DNA, 22 bp, Homo sapiens
gaaacttcagatccaggtgcat

SEQ ID NO: 149513 - DNA, 23 bp, Homo sapiens
ttccagacttttaaaggtgtcag

SEQ ID NO: 149514 - DNA, 20 bp, Homo sapiens
tcacacccactgtggctcag

SEQ ID NO: 149515 - DNA, 22 bp, Homo sapiens
cacactgtctcagtgtgtaagc

SEQ ID NO: 149516 - DNA, 23 bp, Homo sapiens
ctctacctggttgattcagttct

SEQ ID NO: 149517 - DNA, 23 bp, Homo sapiens
tgagagggagtctcgctctgtca

SEQ ID NO: 149518 - DNA, 20 bp, Homo sapiens
agtatatatgtatatatgta

SEQ ID NO: 149519 - DNA, 22 bp, Homo sapiens
atatatgtacataagcatatat

SEQ ID NO: 149520 - DNA, 23 bp, Homo sapiens
cagagtctcactctgtcacccag

SEQ ID NO: 149521 - DNA, 23 bp, Homo sapiens
gtgtctctctctggtaatggtcc

SEQ ID NO: 149522 - DNA, 21 bp, Homo sapiens
tatgtgacagcttagacagtg

SEQ ID NO: 149523 - DNA, 23 bp, Homo sapiens
tgtggctgtcagtctccctctgt

SEQ ID NO: 149524 - DNA, 23 bp, Homo sapiens
ttctgtgaagaaagtcattggta

SEQ ID NO: 149525 - DNA, 21 bp, Homo sapiens
tatacacacacgtatacatat

SEQ ID NO: 149526 - DNA, 23 bp, Homo sapiens
tatgtatgtctgtgtgtgtgtgt

SEQ ID NO: 149527 - DNA, 23 bp, Homo sapiens
ccgtcagtctatggtggatgtca

SEQ ID NO: 149528 - DNA, 21 bp, Homo sapiens
aggtgacactagtgagtgagg

SEQ ID NO: 149529 - DNA, 20 bp, Homo sapiens
agaaaatatgtatatatgta

SEQ ID NO: 149530 - DNA, 21 bp, Homo sapiens
tgaggtaggaggatcacttga

SEQ ID NO: 149531 - DNA, 23 bp, Homo sapiens
tatgtatatatatgtatatgtgt

SEQ ID NO: 149532 - DNA, 20 bp, Homo sapiens
atatatgtatatatgtatat

SEQ ID NO: 149533 - DNA, 23 bp, Homo sapiens
ctgtgcctgcctcactgcgtggg

SEQ ID NO: 149534 - DNA, 22 bp, Homo sapiens
tgcaagtgctggtggagctgtt

SEQ ID NO: 149535 - DNA, 21 bp, Homo sapiens
tatatatgtgtgtgtgtgtat

SEQ ID NO: 149536 - DNA, 21 bp, Homo sapiens
tttacacaggcatatgtgtgt

SEQ ID NO: 149537 - DNA, 22 bp, Homo sapiens
tatgtgtgtagtatttatgtgt

SEQ ID NO: 149538 - DNA, 23 bp, Homo sapiens
tcacacacacaatctgagtgtaa

SEQ ID NO: 149539 - DNA, 19 bp, Homo sapiens
gtaagttcaaagaaagcag

SEQ ID NO: 149540 - DNA, 23 bp, Homo sapiens
ttatattttagtcgagacagggt

SEQ ID NO: 149541 - DNA, 23 bp, Homo sapiens
tatatgtgtgtatatctatatct

SEQ ID NO: 149542 - DNA, 23 bp, Homo sapiens
atacacacacatatatgtgtgtg

SEQ ID NO: 149543 - DNA, 23 bp, Homo sapiens
acacacacacgggtatatgtatg

SEQ ID NO: 149544 - DNA, 23 bp, Homo sapiens
tatgcgtttatatacatctgggt

SEQ ID NO: 149545 - DNA, 23 bp, Homo sapiens
tttgagacggagtctcgctctgt

SEQ ID NO: 149546 - DNA, 19 bp, Homo sapiens
tgtttcccactcagtctct

SEQ ID NO: 149547 - DNA, 23 bp, Homo sapiens
agagtttgtaatgttctgacagg

SEQ ID NO: 149548 - DNA, 23 bp, Homo sapiens
aaggtcacagaacagtcagagtt

SEQ ID NO: 149549 - DNA, 23 bp, Homo sapiens
tgtgggtctgaccctgactctga

SEQ ID NO: 149550 - DNA, 23 bp, Homo sapiens
agatggagtctcactgtgtcacc

SEQ ID NO: 149551 - DNA, 19 bp, Homo sapiens
attgcagtgaactgtgatc

SEQ ID NO: 149552 - DNA, 22 bp, Homo sapiens
aaacaagtgaatgtgaagagaa

SEQ ID NO: 149553 - DNA, 22 bp, Homo sapiens
aacaaagtgaaatcccatctct

SEQ ID NO: 149554 - DNA, 23 bp, Homo sapiens
ttgagacggagtctggctctgtc

SEQ ID NO: 149555 - DNA, 23 bp, Homo sapiens
gaaggcactgtggtaagcaggtt

SEQ ID NO: 149556 - DNA, 23 bp, Homo sapiens
acttcctggctgtgtgaccttgg

SEQ ID NO: 149557 - DNA, 23 bp, Homo sapiens
tctcagcctcagtctctctgttt

SEQ ID NO: 149558 - DNA, 19 bp, Homo sapiens
tgagacagagtctctctct

SEQ ID NO: 149559 - DNA, 19 bp, Homo sapiens
tgagactctgagaatgtgg

SEQ ID NO: 149560 - DNA, 20 bp, Homo sapiens
tggctgccagtttggtcact

SEQ ID NO: 149561 - DNA, 22 bp, Homo sapiens
taaaggtgtgagacataggtca

SEQ ID NO: 149562 - DNA, 21 bp, Homo sapiens
aaagaaaggttttggactgtg

SEQ ID NO: 149563 - DNA, 18 bp, Homo sapiens
attgggcaggctctgaag

SEQ ID NO: 149564 - DNA, 23 bp, Homo sapiens
tttgagacggagttttgctcttg

SEQ ID NO: 149565 - DNA, 23 bp, Homo sapiens
tgttcctgggattgtcagtgtat

SEQ ID NO: 149566 - DNA, 21 bp, Homo sapiens
atttttcttgagacggagtct

SEQ ID NO: 149567 - DNA, 23 bp, Homo sapiens
acacactgcttgctctttctcct

SEQ ID NO: 149568 - DNA, 22 bp, Homo sapiens
agtctcgctctgtcactcaggc

SEQ ID NO: 149569 - DNA, 23 bp, Homo sapiens
gactctgtcactcactctatcac

SEQ ID NO: 149570 - DNA, 23 bp, Homo sapiens
ttagagagaggatttttgctgtg

SEQ ID NO: 149571 - DNA, 18 bp, Homo sapiens
tgacagtgcgagactcca

SEQ ID NO: 149572 - DNA, 23 bp, Homo sapiens
tgagacagagtctcgctctgtcg

SEQ ID NO: 149573 - DNA, 23 bp, Homo sapiens
gcgggtctctctctggctgtcct

SEQ ID NO: 149574 - DNA, 23 bp, Homo sapiens
tgcctgagtgcatggcatttcag

SEQ ID NO: 149575 - DNA, 20 bp, Homo sapiens
tatatgtatatgaatgtgca

SEQ ID NO: 149576 - DNA, 19 bp, Homo sapiens
tttaattttatctggagag

SEQ ID NO: 149577 - DNA, 22 bp, Homo sapiens
ctgagtctcactctgtcgccca

SEQ ID NO: 149578 - DNA, 23 bp, Homo sapiens
tttttggtggagtctcactctgt

SEQ ID NO: 149579 - DNA, 20 bp, Homo sapiens
tgtgtggagacagagtgcac

SEQ ID NO: 149580 - DNA, 21 bp, Homo sapiens
acagtggcatgatcttggctc

SEQ ID NO: 149581 - DNA, 18 bp, Homo sapiens
tgccgagtacttgggact

SEQ ID NO: 149582 - DNA, 23 bp, Homo sapiens
tgtagtgtctgggtctcgctctg

SEQ ID NO: 149583 - DNA, 20 bp, Homo sapiens
cagacaaattgtctctcaga

SEQ ID NO: 149584 - DNA, 21 bp, Homo sapiens
gaggctgaggtaggaggatca

SEQ ID NO: 149585 - DNA, 21 bp, Homo sapiens
ttttgagacagggtctcactc

SEQ ID NO: 149586 - DNA, 23 bp, Homo sapiens
gagacagagtctcgctctgtggc

SEQ ID NO: 149587 - DNA, 23 bp, Homo sapiens
aggcagagtcccactgtgtcacc

SEQ ID NO: 149588 - DNA, 23 bp, Homo sapiens
aagagtctcgctctgtcacccag

SEQ ID NO: 149589 - DNA, 22 bp, Homo sapiens
tgggtctgagtcagtttttggt

SEQ ID NO: 149590 - DNA, 23 bp, Homo sapiens
caggcatgagccactgtgtccgg

SEQ ID NO: 149591 - DNA, 19 bp, Homo sapiens
tgagacagagtttcactct

SEQ ID NO: 149592 - DNA, 20 bp, Homo sapiens
tgaggtaggaggatcacttg

SEQ ID NO: 149593 - DNA, 18 bp, Homo sapiens
tggcatgatcttggctca

SEQ ID NO: 149594 - DNA, 23 bp, Homo sapiens
tggagttagcttcttgatgtgtc

SEQ ID NO: 149595 - DNA, 22 bp, Homo sapiens
tcactgcagtctcagtctcctg

SEQ ID NO: 149596 - DNA, 23 bp, Homo sapiens
ttttgagacggtctcttgctctg

SEQ ID NO: 149597 - DNA, 19 bp, Homo sapiens
agaccctgtctctcaaata

SEQ ID NO: 149598 - DNA, 23 bp, Homo sapiens
agagagtgactgttgtctgtgac

SEQ ID NO: 149599 - DNA, 23 bp, Homo sapiens
gacagagtctcgctctgtcaccc

SEQ ID NO: 149600 - DNA, 19 bp, Homo sapiens
tatgtatatatatgtgtgt

SEQ ID NO: 149601 - DNA, 23 bp, Homo sapiens
acacagtgtggctctgtgaggcc

SEQ ID NO: 149602 - DNA, 22 bp, Homo sapiens
agctttgtgactctagtgaaga

SEQ ID NO: 149603 - DNA, 22 bp, Homo sapiens
gagatgaagtctcactctgttg

SEQ ID NO: 149604 - DNA, 20 bp, Homo sapiens
aaagtgttaggattactggt

SEQ ID NO: 149605 - DNA, 23 bp, Homo sapiens
tggagtctcactctgtcacccag

SEQ ID NO: 149606 - DNA, 21 bp, Homo sapiens
attcatccctttgcctggctt

SEQ ID NO: 149607 - DNA, 18 bp, Homo sapiens
agtctcgctgtcgcccag

SEQ ID NO: 149608 - DNA, 19 bp, Homo sapiens
actccttctcaaaagaaaa

SEQ ID NO: 149609 - DNA, 23 bp, Homo sapiens
agaaggagtctcgctctgtcacc

SEQ ID NO: 149610 - DNA, 23 bp, Homo sapiens
gggtctcactctgtcgcacaggc

SEQ ID NO: 149611 - DNA, 23 bp, Homo sapiens
taagtgactgaattcagttctct

SEQ ID NO: 149612 - DNA, 20 bp, Homo sapiens
ggctcggtctctctctgact

SEQ ID NO: 149613 - DNA, 23 bp, Homo sapiens
tgagactgagttgggatgagtgt

SEQ ID NO: 149614 - DNA, 19 bp, Homo sapiens
tcaggtgcaaatttatttt

SEQ ID NO: 149615 - DNA, 20 bp, Homo sapiens
tgagctatgttctcactttg

SEQ ID NO: 149616 - DNA, 22 bp, Homo sapiens
tgttaggtgtggtaaacttggg

SEQ ID NO: 149617 - DNA, 23 bp, Homo sapiens
taaaattcaaaggaaatcttctc

SEQ ID NO: 149618 - DNA, 23 bp, Homo sapiens
aactttgtagaagttggtattga

SEQ ID NO: 149619 - DNA, 21 bp, Homo sapiens
aaagtgacaggagtgagggtg

SEQ ID NO: 149620 - DNA, 23 bp, Homo sapiens
cccctgaccttgttctaacttct

SEQ ID NO: 149621 - DNA, 23 bp, Homo sapiens
gcagctgtgtctatatctgtctg

SEQ ID NO: 149622 - DNA, 22 bp, Homo sapiens
agttgtctgtgaatggtgtgag

SEQ ID NO: 149623 - DNA, 23 bp, Homo sapiens
tgagacagtctggttctgtcacc

SEQ ID NO: 149624 - DNA, 23 bp, Homo sapiens
gagacggagtctcactctgtcac

SEQ ID NO: 149625 - DNA, 21 bp, Homo sapiens
ttttgagatggagtcttactc

SEQ ID NO: 149626 - DNA, 19 bp, Homo sapiens
agtttgagatgggttgtct

SEQ ID NO: 149627 - DNA, 19 bp, Homo sapiens
agagcaagacttttttttt

SEQ ID NO: 149628 - DNA, 23 bp, Homo sapiens
ttttgagacggagtcttactctg

SEQ ID NO: 149629 - DNA, 23 bp, Homo sapiens
agacagagtctcgctctgtcacc

SEQ ID NO: 149630 - DNA, 22 bp, Homo sapiens
agtggcgtgatcttggcttact

SEQ ID NO: 149631 - DNA, 19 bp, Homo sapiens
tcagtgaaggatacatggg

SEQ ID NO: 149632 - DNA, 23 bp, Homo sapiens
actgcttaattctctgtgtctca

SEQ ID NO: 149633 - DNA, 23 bp, Homo sapiens
agaaagtagtacctacctcataa

SEQ ID NO: 149634 - DNA, 23 bp, Homo sapiens
tccgttcactctctctgcctctc

SEQ ID NO: 149635 - DNA, 23 bp, Homo sapiens
tgtgtgtgtatgtatatatgtgt

SEQ ID NO: 149636 - DNA, 23 bp, Homo sapiens
agagtctcactgtgtcacccagg

SEQ ID NO: 149637 - DNA, 21 bp, Homo sapiens
tgcaatggtgagatcttggct

SEQ ID NO: 149638 - DNA, 23 bp, Homo sapiens
tgagacggagtctcactctgtca

SEQ ID NO: 149639 - DNA, 23 bp, Homo sapiens
gagacagagtctctgtcacccag

SEQ ID NO: 149640 - DNA, 21 bp, Homo sapiens
tatggttgaatagtactccat

SEQ ID NO: 149641 - DNA, 23 bp, Homo sapiens
gttgtatctgtaccacattttct

SEQ ID NO: 149642 - DNA, 23 bp, Homo sapiens
tacatgtgcaggatgtgcaggtt

SEQ ID NO: 149643 - DNA, 23 bp, Homo sapiens
tttctagtacttagagtggtgtc

SEQ ID NO: 149644 - DNA, 23 bp, Homo sapiens
ggagtctcactctgtcacccagg

SEQ ID NO: 149645 - DNA, 23 bp, Homo sapiens
tggagtctcactctgtcacccag

SEQ ID NO: 149646 - DNA, 21 bp, Homo sapiens
aataagaggtgaaaatgctga

SEQ ID NO: 149647 - DNA, 23 bp, Homo sapiens
tggagtctcactctgtcacccag

SEQ ID NO: 149648 - DNA, 19 bp, Homo sapiens
aaagctactattttatttt

SEQ ID NO: 149649 - DNA, 23 bp, Homo sapiens
ataagtctagtgggtattgttta

SEQ ID NO: 149650 - DNA, 23 bp, Homo sapiens
tatacattgtcaatctatgtatt

SEQ ID NO: 149651 - DNA, 23 bp, Homo sapiens
atatacataggtatacatgttta

SEQ ID NO: 149652 - DNA, 23 bp, Homo sapiens
atatgtatacatgtttatacatg

SEQ ID NO: 149653 - DNA, 23 bp, Homo sapiens
tcctgaatgtggaacttttgatg

SEQ ID NO: 149654 - DNA, 21 bp, Homo sapiens
gagacccactcactgtgactc

SEQ ID NO: 149655 - DNA, 23 bp, Homo sapiens
atacatgtgcaggatgtgcaggt

SEQ ID NO: 149656 - DNA, 22 bp, Homo sapiens
tcagccccagagaatgaattga

SEQ ID NO: 149657 - DNA, 23 bp, Homo sapiens
ggtctctgtttctgactctcgga

SEQ ID NO: 149658 - DNA, 20 bp, Homo sapiens
aaacagacagtaaatgaaac

SEQ ID NO: 149659 - DNA, 23 bp, Homo sapiens
tgtgtctgcatatgtatatgtgt

SEQ ID NO: 149660 - DNA, 21 bp, Homo sapiens
tgtttgtaagttgtatatgta

SEQ ID NO: 149661 - DNA, 18 bp, Homo sapiens
tgtatgtgtgcatgtgca

SEQ ID NO: 149662 - DNA, 18 bp, Homo sapiens
tctctgcctcagagtctg

SEQ ID NO: 149663 - DNA, 22 bp, Homo sapiens
accttgaagctgctagactctg

SEQ ID NO: 149664 - DNA, 23 bp, Homo sapiens
taagacagacggaaacctgtcta

SEQ ID NO: 149665 - DNA, 23 bp, Homo sapiens
gagtctggctctgtcacccagac

SEQ ID NO: 149666 - DNA, 23 bp, Homo sapiens
aattctgtgtgcaattgtaagat

SEQ ID NO: 149667 - DNA, 21 bp, Homo sapiens
tatgagaaactatatatgtgt

SEQ ID NO: 149668 - DNA, 20 bp, Homo sapiens
tgagacagagtctcgctgtg

SEQ ID NO: 149669 - DNA, 23 bp, Homo sapiens
tggagtctcactctgtcacccag

SEQ ID NO: 149670 - DNA, 23 bp, Homo sapiens
caaggtctcactctgtcacccag

SEQ ID NO: 149671 - DNA, 23 bp, Homo sapiens
acagggtctcgctctgtcactca

SEQ ID NO: 149672 - DNA, 23 bp, Homo sapiens
ctgattgggtgtgcatgatcttt

SEQ ID NO: 149673 - DNA, 21 bp, Homo sapiens
tgagacagagtcccgctctgt

SEQ ID NO: 149674 - DNA, 22 bp, Homo sapiens
atgactgtgtgtgtgtacgtgt

SEQ ID NO: 149675 - DNA, 23 bp, Homo sapiens
tgagtgcacacagacacacacac

SEQ ID NO: 149676 - DNA, 21 bp, Homo sapiens
cagagatgttaagagagttgc

SEQ ID NO: 149677 - DNA, 23 bp, Homo sapiens
tcactcagcttgaagtgactgtg

SEQ ID NO: 149678 - DNA, 23 bp, Homo sapiens
tgactctcttactcactgggcta

SEQ ID NO: 149679 - DNA, 23 bp, Homo sapiens
tctgagaagaaagtcaatggtag

SEQ ID NO: 149680 - DNA, 21 bp, Homo sapiens
aggagtgatgaaggagtggag

SEQ ID NO: 149681 - DNA, 23 bp, Homo sapiens
ctctctgtgcgtgtctctgtgtc

SEQ ID NO: 149682 - DNA, 23 bp, Homo sapiens
ctctgagtgtagaatgtcagcac

SEQ ID NO: 149683 - DNA, 23 bp, Homo sapiens
gggattagatgtgataatgatga

SEQ ID NO: 149684 - DNA, 22 bp, Homo sapiens
tgtcgttcctttttctgaatcc

SEQ ID NO: 149685 - DNA, 20 bp, Homo sapiens
gtctggcagctttctagggg

SEQ ID NO: 149686 - DNA, 23 bp, Homo sapiens
aggagtgtgcttaacgtgtttga

SEQ ID NO: 149687 - DNA, 22 bp, Homo sapiens
gcaagactatctcaaaagagaa

SEQ ID NO: 149688 - DNA, 21 bp, Homo sapiens
cctgactctgacaaaattaag

SEQ ID NO: 149689 - DNA, 23 bp, Homo sapiens
tctatctgtctgtgccagagtgt

SEQ ID NO: 149690 - DNA, 22 bp, Homo sapiens
aatcatgaagcacagataggga

SEQ ID NO: 149691 - DNA, 21 bp, Homo sapiens
tcactctgtcactcaggctgg

SEQ ID NO: 149692 - DNA, 18 bp, Homo sapiens
tctgacacagtgactgag

SEQ ID NO: 149693 - DNA, 23 bp, Homo sapiens
tgtatatgtatatgtatatgtgt

SEQ ID NO: 149694 - DNA, 23 bp, Homo sapiens
gccagtgtctctgagtcagtcgg

SEQ ID NO: 149695 - DNA, 20 bp, Homo sapiens
caacatactgagacatcatc

SEQ ID NO: 149696 - DNA, 23 bp, Homo sapiens
gagacagagtctcgctctgtttc

SEQ ID NO: 149697 - DNA, 21 bp, Homo sapiens
atttgctgggtgtgctggcac

SEQ ID NO: 149698 - DNA, 21 bp, Homo sapiens
gttaagcatgagattaccatt

SEQ ID NO: 149699 - DNA, 23 bp, Homo sapiens
actgtttcttacattgctgctta

SEQ ID NO: 149700 - DNA, 22 bp, Homo sapiens
gtcttcattcttgtctgtacta

SEQ ID NO: 149701 - DNA, 23 bp, Homo sapiens
gttaatatgtatggttatgatta

SEQ ID NO: 149702 - DNA, 23 bp, Homo sapiens
ttgtttgtatctatatatgtgtg

SEQ ID NO: 149703 - DNA, 23 bp, Homo sapiens
tataatcttagcatatagatagt

SEQ ID NO: 149704 - DNA, 23 bp, Homo sapiens
tattaatcagattttgtagttgt

SEQ ID NO: 149705 - DNA, 23 bp, Homo sapiens
atatgtgtgtgtatatgttatat

SEQ ID NO: 149706 - DNA, 22 bp, Homo sapiens
tgtgtgtctgtgtgtgtatata

SEQ ID NO: 149707 - DNA, 22 bp, Homo sapiens
gagatggagtctcactctgtca

SEQ ID NO: 149708 - DNA, 23 bp, Homo sapiens
tgggtttcttaggagtgagaaca

SEQ ID NO: 149709 - DNA, 22 bp, Homo sapiens
agacattcacctttggagcttt

SEQ ID NO: 149710 - DNA, 20 bp, Homo sapiens
actgacaccctctgtctggc

SEQ ID NO: 149711 - DNA, 23 bp, Homo sapiens
cacaggctctctgtctctctgag

SEQ ID NO: 149712 - DNA, 23 bp, Homo sapiens
tgagttcattgtagattctggat

SEQ ID NO: 149713 - DNA, 23 bp, Homo sapiens
tgagttcattgtagattctggat

SEQ ID NO: 149714 - DNA, 23 bp, Homo sapiens
tacatgtgcaggatgtgcaggtt

SEQ ID NO: 149715 - DNA, 23 bp, Homo sapiens
aaatacacacatatagttgttga

SEQ ID NO: 149716 - DNA, 23 bp, Homo sapiens
tggagtctcactctgtcacccag

SEQ ID NO: 149717 - DNA, 23 bp, Homo sapiens
tacagtcatgtcccttgactgat

SEQ ID NO: 149718 - DNA, 23 bp, Homo sapiens
agtccattaaacttctatttgtt

SEQ ID NO: 149719 - DNA, 22 bp, Homo sapiens
taaggttgctctgagaattcac

SEQ ID NO: 149720 - DNA, 23 bp, Homo sapiens
acgaagtctcactctgtcaccca

SEQ ID NO: 149721 - DNA, 18 bp, Homo sapiens
aacaagtgtcagagctga

SEQ ID NO: 149722 - DNA, 23 bp, Homo sapiens
acagagtctcgctctgtcaccca

SEQ ID NO: 149723 - DNA, 23 bp, Homo sapiens
tcagggtctcacactgtcaccca

SEQ ID NO: 149724 - DNA, 22 bp, Homo sapiens
attctcagaagtgtgtgagccc

SEQ ID NO: 149725 - DNA, 23 bp, Homo sapiens
agtatatatgtttatatgaatgt

SEQ ID NO: 149726 - DNA, 23 bp, Homo sapiens
agggtctcactctgtcgctcagg

SEQ ID NO: 149727 - DNA, 19 bp, Homo sapiens
aggccagaagtcggctttg

SEQ ID NO: 149728 - DNA, 23 bp, Homo sapiens
tgaggcagattattgctctgtca

SEQ ID NO: 149729 - DNA, 18 bp, Homo sapiens
gacagggtctcactctgt

SEQ ID NO: 149730 - DNA, 23 bp, Homo sapiens
tgtgagtcagatgttagctgctg

SEQ ID NO: 149731 - DNA, 23 bp, Homo sapiens
tatatagtacttgtgctgatctt

SEQ ID NO: 149732 - DNA, 18 bp, Homo sapiens
acacacacagatgcatat

SEQ ID NO: 149733 - DNA, 19 bp, Homo sapiens
tctgaactgtcactctgac

SEQ ID NO: 149734 - DNA, 22 bp, Homo sapiens
agacagggtctggctctgtcac

SEQ ID NO: 149735 - DNA, 22 bp, Homo sapiens
atggttttcaggaactggattg

SEQ ID NO: 149736 - DNA, 23 bp, Homo sapiens
tgtctctgcgtctctggccgcct

SEQ ID NO: 149737 - DNA, 22 bp, Homo sapiens
tttgacaagaagcagactagct

SEQ ID NO: 149738 - DNA, 23 bp, Homo sapiens
gacagaggtctcactctgtcacc

SEQ ID NO: 149739 - DNA, 22 bp, Homo sapiens
tagagacaaggtcttgcactgt

SEQ ID NO: 149740 - DNA, 23 bp, Homo sapiens
gtcacttactctgtcagtttctt

SEQ ID NO: 149741 - DNA, 19 bp, Homo sapiens
ctgagatgtgccagctgtg

SEQ ID NO: 149742 - DNA, 22 bp, Homo sapiens
gcttcagcaacagcatctccaa

SEQ ID NO: 149743 - DNA, 19 bp, Homo sapiens
tccttgccttcttccagct

SEQ ID NO: 149744 - DNA, 18 bp, Homo sapiens
tgcttgtagtcccagcaa

SEQ ID NO: 149745 - DNA, 23 bp, Homo sapiens
atatatgtgtatatatatatgtg

SEQ ID NO: 149746 - DNA, 23 bp, Homo sapiens
atgtgtatatatgtatatatgtg

SEQ ID NO: 149747 - DNA, 22 bp, Homo sapiens
tatatgtgtatatgtgtgtgtg

SEQ ID NO: 149748 - DNA, 23 bp, Homo sapiens
acagagtctcactgtcacccagg

SEQ ID NO: 149749 - DNA, 23 bp, Homo sapiens
tccctctgtctgtgtctgtggca

SEQ ID NO: 149750 - DNA, 23 bp, Homo sapiens
tgtctctgagcctcagtttcccc

SEQ ID NO: 149751 - DNA, 22 bp, Homo sapiens
taaaattgaagctgaaacagta

SEQ ID NO: 149752 - DNA, 23 bp, Homo sapiens
tatgcactgtgtgtatatacact

SEQ ID NO: 149753 - DNA, 21 bp, Homo sapiens
tttgagatggagtctctctct

SEQ ID NO: 149754 - DNA, 19 bp, Homo sapiens
ttgagatttgcccatgtgg

SEQ ID NO: 149755 - DNA, 21 bp, Homo sapiens
tgaggtaggaggatcacttga

SEQ ID NO: 149756 - DNA, 22 bp, Homo sapiens
tatgtgtgcttatatattcata

SEQ ID NO: 149757 - DNA, 23 bp, Homo sapiens
tgagttcattgtagattctggat

SEQ ID NO: 149758 - DNA, 23 bp, Homo sapiens
tgagttcattgtagattctggat

SEQ ID NO: 149759 - DNA, 23 bp, Homo sapiens
taaaagtgaattgatttaagggg

SEQ ID NO: 149760 - DNA, 23 bp, Homo sapiens
gtgtcagagtgagtttctctttt

SEQ ID NO: 149761 - DNA, 23 bp, Homo sapiens
tttgagacggagtcttgctctgt

SEQ ID NO: 149762 - DNA, 21 bp, Homo sapiens
tgtcactcaataagatctgtc

SEQ ID NO: 149763 - DNA, 23 bp, Homo sapiens
gaagtgtcttgaagagtatggag

SEQ ID NO: 149764 - DNA, 23 bp, Homo sapiens
tttacttgttgataaaggaaagt

SEQ ID NO: 149765 - DNA, 21 bp, Homo sapiens
aagaagtcaacaaagtctgag

SEQ ID NO: 149766 - DNA, 23 bp, Homo sapiens
tatgtctttatatatctatgttt

SEQ ID NO: 149767 - DNA, 19 bp, Homo sapiens
agagcaagactctgtctca

SEQ ID NO: 149768 - DNA, 21 bp, Homo sapiens
tagagacagggtctctctctg

SEQ ID NO: 149769 - DNA, 23 bp, Homo sapiens
tggagtctcactctgtcacccag

SEQ ID NO: 149770 - DNA, 23 bp, Homo sapiens
gacagagtctcgctctgtcaccc

SEQ ID NO: 149771 - DNA, 19 bp, Homo sapiens
tgagatggagtctcactct

SEQ ID NO: 149772 - DNA, 22 bp, Homo sapiens
aacatttgttgctgtttttttg

SEQ ID NO: 149773 - DNA, 19 bp, Homo sapiens
agtaatagccatcctaatg

SEQ ID NO: 149774 - DNA, 23 bp, Homo sapiens
tataaagtggtatctcattgtgc

SEQ ID NO: 149775 - DNA, 22 bp, Homo sapiens
tgtgattgaggaattgaatttt

SEQ ID NO: 149776 - DNA, 19 bp, Homo sapiens
tccatttcatctcttatca

SEQ ID NO: 149777 - DNA, 23 bp, Homo sapiens
tcttttatggttccatataaatt

SEQ ID NO: 149778 - DNA, 23 bp, Homo sapiens
ctatgaagaatgtcattgatatt

SEQ ID NO: 149779 - DNA, 22 bp, Homo sapiens
atagggattgcatgaaatctgt

SEQ ID NO: 149780 - DNA, 23 bp, Homo sapiens
tgagatggagtctcgctctgtca

SEQ ID NO: 149781 - DNA, 23 bp, Homo sapiens
gggtctcactctgtcacccaggc

SEQ ID NO: 149782 - DNA, 23 bp, Homo sapiens
agagactgagtctctctttttcg

SEQ ID NO: 149783 - DNA, 23 bp, Homo sapiens
agagtcagtgtaacttttgaggg

SEQ ID NO: 149784 - DNA, 23 bp, Homo sapiens
tataatgtctggctgtctgtctc

SEQ ID NO: 149785 - DNA, 23 bp, Homo sapiens
agatggagtctcactctgtcacc

SEQ ID NO: 149786 - DNA, 23 bp, Homo sapiens
atggagtctcactctgtcaccca

SEQ ID NO: 149787 - DNA, 23 bp, Homo sapiens
ttttttttttgagacagagtctt

SEQ ID NO: 149788 - DNA, 19 bp, Homo sapiens
agagaagtgaattggttct

SEQ ID NO: 149789 - DNA, 18 bp, Homo sapiens
aaagtcaagaaactttct

SEQ ID NO: 149790 - DNA, 23 bp, Homo sapiens
tggagtctcactctgtcacccag

SEQ ID NO: 149791 - DNA, 23 bp, Homo sapiens
cagagttttgctcttgtcactca

SEQ ID NO: 149792 - DNA, 21 bp, Homo sapiens
agagtcaaggtctccctctgt

SEQ ID NO: 149793 - DNA, 19 bp, Homo sapiens
tgtggtggtggtggtggtg

SEQ ID NO: 149794 - DNA, 23 bp, Homo sapiens
acagggtctcgctctgtcactca

SEQ ID NO: 149795 - DNA, 23 bp, Homo sapiens
tccagtggcatgatcctggctca

SEQ ID NO: 149796 - DNA, 23 bp, Homo sapiens
gattacagatgtgagccacctca

SEQ ID NO: 149797 - DNA, 23 bp, Homo sapiens
acagcgtgtaacagaggtgttca

SEQ ID NO: 149798 - DNA, 23 bp, Homo sapiens
tttgagacagactcttgctctgt

SEQ ID NO: 149799 - DNA, 23 bp, Homo sapiens
acggagtctcgctctgtcaccca

SEQ ID NO: 149800 - DNA, 23 bp, Homo sapiens
agagtctcactctgtcacccagg

SEQ ID NO: 149801 - DNA, 20 bp, Homo sapiens
tttttcctgtacttttcggt

SEQ ID NO: 149802 - DNA, 18 bp, Homo sapiens
tggccctcactctcctcc

SEQ ID NO: 149803 - DNA, 23 bp, Homo sapiens
gaggcagagtctcgctttgtctg

SEQ ID NO: 149804 - DNA, 23 bp, Homo sapiens
ttttgagatggagtcttactctg

SEQ ID NO: 149805 - DNA, 20 bp, Homo sapiens
agtctcgctctgtcgctcag

SEQ ID NO: 149806 - DNA, 23 bp, Homo sapiens
tagaagactgaagacagtgaggt

SEQ ID NO: 149807 - DNA, 23 bp, Homo sapiens
ggagtctcactctgtcacccagg

SEQ ID NO: 149808 - DNA, 23 bp, Homo sapiens
acagagtcacactctgtggccca

SEQ ID NO: 149809 - DNA, 23 bp, Homo sapiens
tatgtatgtgtatatgtatgtat

SEQ ID NO: 149810 - DNA, 23 bp, Homo sapiens
gagtctcactctgtcacccaggc

SEQ ID NO: 149811 - DNA, 21 bp, Homo sapiens
actctcgctctgtcacccaag

SEQ ID NO: 149812 - DNA, 23 bp, Homo sapiens
acaggtagtttcttaaattgcgt

SEQ ID NO: 149813 - DNA, 23 bp, Homo sapiens
tagatctatatatagatatgtag

SEQ ID NO: 149814 - DNA, 23 bp, Homo sapiens
actgagtctcactctgccaccca

SEQ ID NO: 149815 - DNA, 21 bp, Homo sapiens
aaattccagttcatgctttct

SEQ ID NO: 149816 - DNA, 22 bp, Homo sapiens
taaatttagagtagcctaagtg

SEQ ID NO: 149817 - DNA, 21 bp, Homo sapiens
tgattctttcttgtgttgctg

SEQ ID NO: 149818 - DNA, 22 bp, Homo sapiens
tctagactgtcatcggaaatgt

SEQ ID NO: 149819 - DNA, 23 bp, Homo sapiens
agcctcactgcctgttctattag

SEQ ID NO: 149820 - DNA, 21 bp, Homo sapiens
aagccacagaacaaacaaggt

SEQ ID NO: 149821 - DNA, 23 bp, Homo sapiens
agtttatttgtttttctacgtgc

SEQ ID NO: 149822 - DNA, 21 bp, Homo sapiens
tgtttggcactgctggttttg

SEQ ID NO: 149823 - DNA, 21 bp, Homo sapiens
tacacagctacagtaaccaga

SEQ ID NO: 149824 - DNA, 21 bp, Homo sapiens
ctgaggctgtcacagcctctc

SEQ ID NO: 149825 - DNA, 23 bp, Homo sapiens
aagggagtagagtcaggctgact

SEQ ID NO: 149826 - DNA, 23 bp, Homo sapiens
atggagtctcactctgtctccca

SEQ ID NO: 149827 - DNA, 19 bp, Homo sapiens
tgtttgtagtcctggcttc

SEQ ID NO: 149828 - DNA, 23 bp, Homo sapiens
tgaggttggaggatcacttgagc

SEQ ID NO: 149829 - DNA, 23 bp, Homo sapiens
acagagtctcactctgtcgccca

SEQ ID NO: 149830 - DNA, 21 bp, Homo sapiens
cacacacacacgcatatatat

SEQ ID NO: 149831 - DNA, 19 bp, Homo sapiens
tgcgtgtgtgtgtgtgtgt

SEQ ID NO: 149832 - DNA, 23 bp, Homo sapiens
aaatgtgtgtgcatgtgcatgtg

SEQ ID NO: 149833 - DNA, 23 bp, Homo sapiens
tcagctcactgactcactctgcc

SEQ ID NO: 149834 - DNA, 21 bp, Homo sapiens
acacagatatgtgtgtgtata

SEQ ID NO: 149835 - DNA, 22 bp, Homo sapiens
tatacacacagatatgtgtgtg

SEQ ID NO: 149836 - DNA, 23 bp, Homo sapiens
tgggtgacagagcaagatctttt

SEQ ID NO: 149837 - DNA, 23 bp, Homo sapiens
tctgtcacccaggctagagtgta

SEQ ID NO: 149838 - DNA, 19 bp, Homo sapiens
acgtatatatatatgtgta

SEQ ID NO: 149839 - DNA, 23 bp, Homo sapiens
tactacaggaagctactcaggag

SEQ ID NO: 149840 - DNA, 23 bp, Homo sapiens
ctcaccctctctgagtcttgcct

SEQ ID NO: 149841 - DNA, 23 bp, Homo sapiens
acaaagcctcctagtatctggca

SEQ ID NO: 149842 - DNA, 23 bp, Homo sapiens
tggagtctcactctgtcacccag

SEQ ID NO: 149843 - DNA, 23 bp, Homo sapiens
agatggagtctctcactctgtcg

SEQ ID NO: 149844 - DNA, 23 bp, Homo sapiens
tgaagtgggtctgtctgcctctc

SEQ ID NO: 149845 - DNA, 19 bp, Homo sapiens
tgagacagagtctcgccct

SEQ ID NO: 149846 - DNA, 23 bp, Homo sapiens
gagtctcactctgtcaccgaggc

SEQ ID NO: 149847 - DNA, 23 bp, Homo sapiens
tgagcagggcagtgtctgtctta

SEQ ID NO: 149848 - DNA, 21 bp, Homo sapiens
aatagcactagggcctggcac

SEQ ID NO: 149849 - DNA, 23 bp, Homo sapiens
agacactgtgtggtttccaggtt

SEQ ID NO: 149850 - DNA, 23 bp, Homo sapiens
agagtctcactctgtcacccagg

SEQ ID NO: 149851 - DNA, 23 bp, Homo sapiens
actgtgtctctgtgactgtgctg

SEQ ID NO: 149852 - DNA, 23 bp, Homo sapiens
tgagagtctggctgtgttctctg

SEQ ID NO: 149853 - DNA, 23 bp, Homo sapiens
tgtccttgaatcttcataacact

SEQ ID NO: 149854 - DNA, 23 bp, Homo sapiens
ttactgaggctcagagaacttaa

SEQ ID NO: 149855 - DNA, 22 bp, Homo sapiens
attctgtgaagaaagtcaatag

SEQ ID NO: 149856 - DNA, 23 bp, Homo sapiens
ttgacttgcttatgttgaaccag

SEQ ID NO: 149857 - DNA, 20 bp, Homo sapiens
aaactgaatatattaatctg

SEQ ID NO: 149858 - DNA, 23 bp, Homo sapiens
tgttttgttttgttttgagacgg

SEQ ID NO: 149859 - DNA, 18 bp, Homo sapiens
tgtgcaaatatttaaaat

SEQ ID NO: 149860 - DNA, 18 bp, Homo sapiens
actgatgctggtggtctt

SEQ ID NO: 149861 - DNA, 22 bp, Homo sapiens
ttttttcttcagagagtctcac

SEQ ID NO: 149862 - DNA, 22 bp, Homo sapiens
tgacagagctgagactgcacct

SEQ ID NO: 149863 - DNA, 21 bp, Homo sapiens
cttagatgctcttcctggatg

SEQ ID NO: 149864 - DNA, 23 bp, Homo sapiens
tgagctcagtgagcacagaggcg

SEQ ID NO: 149865 - DNA, 21 bp, Homo sapiens
aaagggtaagacagttctgtg

SEQ ID NO: 149866 - DNA, 18 bp, Homo sapiens
ttggtatttggaattgag

SEQ ID NO: 149867 - DNA, 20 bp, Homo sapiens
atactttaagttttagggta

SEQ ID NO: 149868 - DNA, 23 bp, Homo sapiens
tttatgggttgcaaagtgatgct

SEQ ID NO: 149869 - DNA, 23 bp, Homo sapiens
tcttagtctgttgtgtgctgcta

SEQ ID NO: 149870 - DNA, 23 bp, Homo sapiens
tcattcactcaatttattctgtt

SEQ ID NO: 149871 - DNA, 23 bp, Homo sapiens
ataaggagtagattcaggaatgg

SEQ ID NO: 149872 - DNA, 23 bp, Homo sapiens
acagtctcactctgtcacccagg

SEQ ID NO: 149873 - DNA, 23 bp, Homo sapiens
agacagagtctcactctgtcatc

SEQ ID NO: 149874 - DNA, 22 bp, Homo sapiens
tgacagtgagactctgtctcta

SEQ ID NO: 149875 - DNA, 22 bp, Homo sapiens
tttagatgaagtctcgctctgt

SEQ ID NO: 149876 - DNA, 20 bp, Homo sapiens
agtgtggttgatcataattt

SEQ ID NO: 149877 - DNA, 23 bp, Homo sapiens
ctgaggctgtgtgtgtgtttcta

SEQ ID NO: 149878 - DNA, 23 bp, Homo sapiens
agagatcacagtatcttgtacca

SEQ ID NO: 149879 - DNA, 22 bp, Homo sapiens
ttcttttgttatcttgctgtag

SEQ ID NO: 149880 - DNA, 23 bp, Homo sapiens
gggtctcactctgtcacccaggc

SEQ ID NO: 149881 - DNA, 23 bp, Homo sapiens
gggtctcactctgtcacccaggc

SEQ ID NO: 149882 - DNA, 23 bp, Homo sapiens
tatgtgtgtatatatgtgtgtgt

SEQ ID NO: 149883 - DNA, 21 bp, Homo sapiens
acacacacacacatacatgta

SEQ ID NO: 149884 - DNA, 21 bp, Homo sapiens
tatggttttatatacatatat

SEQ ID NO: 149885 - DNA, 22 bp, Homo sapiens
tatatggttatctatctatatg

SEQ ID NO: 149886 - DNA, 23 bp, Homo sapiens
atatatctttctatgagtgtgtg

SEQ ID NO: 149887 - DNA, 23 bp, Homo sapiens
tgagttcattgtagattctggat

SEQ ID NO: 149888 - DNA, 23 bp, Homo sapiens
tgagttcattgtagattctggat

SEQ ID NO: 149889 - DNA, 19 bp, Homo sapiens
aggcatatgtggttcttat

SEQ ID NO: 149890 - DNA, 21 bp, Homo sapiens
aggctgggtccctggatgaca

SEQ ID NO: 149891 - DNA, 23 bp, Homo sapiens
agagtctcactctgtcacccagg

SEQ ID NO: 149892 - DNA, 20 bp, Homo sapiens
atgtgcagaacgtgcaggtt

SEQ ID NO: 149893 - DNA, 21 bp, Homo sapiens
tcacctgctctctgtctgcta

SEQ ID NO: 149894 - DNA, 22 bp, Homo sapiens
atatgtatgtatatatgtgtat

SEQ ID NO: 149895 - DNA, 23 bp, Homo sapiens
tgagttcattgtagattctggat

SEQ ID NO: 149896 - DNA, 23 bp, Homo sapiens
tgagttcattgtagattctggat

SEQ ID NO: 149897 - DNA, 22 bp, Homo sapiens
tcttaaccagagtatggctaaa

SEQ ID NO: 149898 - DNA, 23 bp, Homo sapiens
tgagttcattgtagattctggat

SEQ ID NO: 149899 - DNA, 23 bp, Homo sapiens
tgagttcattgtagattctggat

SEQ ID NO: 149900 - DNA, 20 bp, Homo sapiens
atacatatatatgtgtttgt

SEQ ID NO: 149901 - DNA, 23 bp, Homo sapiens
tttcttgctattgagttgtttta

SEQ ID NO: 149902 - DNA, 21 bp, Homo sapiens
ttttgagacggagtctcactc

SEQ ID NO: 149903 - DNA, 19 bp, Homo sapiens
aagcttcccctgggtctct

SEQ ID NO: 149904 - DNA, 23 bp, Homo sapiens
ttagtagattatgaaatccagtg

SEQ ID NO: 149905 - DNA, 21 bp, Homo sapiens
tgctctccccttgagctttgg

SEQ ID NO: 149906 - DNA, 23 bp, Homo sapiens
acaaggtctcactctgtcaccca

SEQ ID NO: 149907 - DNA, 22 bp, Homo sapiens
atagcaacatagaaaatttgta

SEQ ID NO: 149908 - DNA, 23 bp, Homo sapiens
agatggaggtctcattatgttgt

SEQ ID NO: 149909 - DNA, 18 bp, Homo sapiens
tgtagatatatatagtat

SEQ ID NO: 149910 - DNA, 23 bp, Homo sapiens
tgcaaagcagtatgtccaatatg

SEQ ID NO: 149911 - DNA, 23 bp, Homo sapiens
tatgtgtgtctgatagtactgtg

SEQ ID NO: 149912 - DNA, 22 bp, Homo sapiens
tctgagaggcaaaatgttgatt

SEQ ID NO: 149913 - DNA, 20 bp, Homo sapiens
aaggtagtatcatggtgatc

SEQ ID NO: 149914 - DNA, 23 bp, Homo sapiens
atctgatgactgatgatagtgac

SEQ ID NO: 149915 - DNA, 23 bp, Homo sapiens
tatgttttctactgcaaagagct

SEQ ID NO: 149916 - DNA, 21 bp, Homo sapiens
ttgcagcagaaaatgtattct

SEQ ID NO: 149917 - DNA, 23 bp, Homo sapiens
ttttgagacagtcttgctctgtc

SEQ ID NO: 149918 - DNA, 23 bp, Homo sapiens
acagagaagagtatgtccaacag

SEQ ID NO: 149919 - DNA, 22 bp, Homo sapiens
tttttttggagacagggtctta

SEQ ID NO: 149920 - DNA, 21 bp, Homo sapiens
tgagatggagtttcactcttg

SEQ ID NO: 149921 - DNA, 23 bp, Homo sapiens
ctccctgtgtgtctgtctcttct

SEQ ID NO: 149922 - DNA, 23 bp, Homo sapiens
ttttgagacggtgtctcattctg

SEQ ID NO: 149923 - DNA, 21 bp, Homo sapiens
tgtatatatacacgtgtgcat

SEQ ID NO: 149924 - DNA, 21 bp, Homo sapiens
tatgtgtatatgtatatatgt

SEQ ID NO: 149925 - DNA, 23 bp, Homo sapiens
agtaattgtatttgtcatggatt

SEQ ID NO: 149926 - DNA, 23 bp, Homo sapiens
atatgaatttttgaagcttactg

SEQ ID NO: 149927 - DNA, 23 bp, Homo sapiens
tctctgagaacttgatgaaagct

SEQ ID NO: 149928 - DNA, 22 bp, Homo sapiens
agtaaagttgcatcacattgtg

SEQ ID NO: 149929 - DNA, 23 bp, Homo sapiens
gtcaggaattcagacagagcaca

SEQ ID NO: 149930 - DNA, 23 bp, Homo sapiens
tatatacgtgtgtgtgtgtgtgt

SEQ ID NO: 149931 - DNA, 22 bp, Homo sapiens
ggtactcgtgcaggatgtgcag

SEQ ID NO: 149932 - DNA, 23 bp, Homo sapiens
tgggcatggtggtgtgtgcctgt

SEQ ID NO: 149933 - DNA, 23 bp, Homo sapiens
ctgaggtagaagaatcacttgag

SEQ ID NO: 149934 - DNA, 19 bp, Homo sapiens
acatttacatatgcaatat

SEQ ID NO: 149935 - DNA, 23 bp, Homo sapiens
tatgtgtatatatacatatgtat

SEQ ID NO: 149936 - DNA, 22 bp, Homo sapiens
tgagatggagatttactcttgt

SEQ ID NO: 149937 - DNA, 22 bp, Homo sapiens
ttctgtgaagaaagttaatggt

SEQ ID NO: 149938 - DNA, 20 bp, Homo sapiens
tgccagtagtgtgaggcctc

SEQ ID NO: 149939 - DNA, 23 bp, Homo sapiens
cttgggtatgactttatcagctg

SEQ ID NO: 149940 - DNA, 23 bp, Homo sapiens
cttcattcagcatcaggatctgt

SEQ ID NO: 149941 - DNA, 22 bp, Homo sapiens
tatatacatgtatatatgtata

SEQ ID NO: 149942 - DNA, 23 bp, Homo sapiens
tcatagtgccatgtttgcagata

SEQ ID NO: 149943 - DNA, 23 bp, Homo sapiens
caaacccaagagatgagattgga

SEQ ID NO: 149944 - DNA, 21 bp, Homo sapiens
ttttgagacggagtcttgctc

SEQ ID NO: 149945 - DNA, 23 bp, Homo sapiens
cacagctgctctgattcttcaga

SEQ ID NO: 149946 - DNA, 20 bp, Homo sapiens
gtttactatagaaatctgag

SEQ ID NO: 149947 - DNA, 21 bp, Homo sapiens
tttgataatttatataagtga

SEQ ID NO: 149948 - DNA, 22 bp, Homo sapiens
aaaaacttcaatatgtaattca

SEQ ID NO: 149949 - DNA, 23 bp, Homo sapiens
tcttctaagtgattgtttgtttt

SEQ ID NO: 149950 - DNA, 23 bp, Homo sapiens
ctctctgtatttctgtctcattc

SEQ ID NO: 149951 - DNA, 22 bp, Homo sapiens
agagtaactccttcatgagacg

SEQ ID NO: 149952 - DNA, 23 bp, Homo sapiens
ttgagacagagtctcactctgtc

SEQ ID NO: 149953 - DNA, 23 bp, Homo sapiens
attattgtgaggattagatgagc

SEQ ID NO: 149954 - DNA, 22 bp, Homo sapiens
agtgcattgtcaaagcacaaag

SEQ ID NO: 149955 - DNA, 18 bp, Homo sapiens
gattgagacgaagtctca

SEQ ID NO: 149956 - DNA, 19 bp, Homo sapiens
caacatggtgaaaccttgt

SEQ ID NO: 149957 - DNA, 23 bp, Homo sapiens
cagacagtgtagtgtgattgttg

SEQ ID NO: 149958 - DNA, 23 bp, Homo sapiens
tgagttcattgtagattctggat

SEQ ID NO: 149959 - DNA, 23 bp, Homo sapiens
tgagttcattgtagattctggat

SEQ ID NO: 149960 - DNA, 23 bp, Homo sapiens
tgcagtggcttgatcttggctca

SEQ ID NO: 149961 - DNA, 23 bp, Homo sapiens
agggtctcactctgtcactcagg

SEQ ID NO: 149962 - DNA, 23 bp, Homo sapiens
tgagttcattgtagattctggat

SEQ ID NO: 149963 - DNA, 23 bp, Homo sapiens
tgagttcattgtagattctggat

SEQ ID NO: 149964 - DNA, 23 bp, Homo sapiens
gggtctcactctgtcactcaggc

SEQ ID NO: 149965 - DNA, 23 bp, Homo sapiens
tgtctcctttttcatatctgatt

SEQ ID NO: 149966 - DNA, 20 bp, Homo sapiens
atcaatgaaatttagataac

SEQ ID NO: 149967 - DNA, 23 bp, Homo sapiens
gagactgcagccactcctcccac

SEQ ID NO: 149968 - DNA, 23 bp, Homo sapiens
tctgtccctgagtctctggctgg

SEQ ID NO: 149969 - DNA, 23 bp, Homo sapiens
atatgtatgtatgtatatgtatg

SEQ ID NO: 149970 - DNA, 22 bp, Homo sapiens
aaagtgagatgctgtctctttt

SEQ ID NO: 149971 - DNA, 23 bp, Homo sapiens
tgagatggaatctcactcttgtt

SEQ ID NO: 149972 - DNA, 23 bp, Homo sapiens
aatgtgtgtgtctctctctctat

SEQ ID NO: 149973 - DNA, 21 bp, Homo sapiens
atacacagagagaaaaaacac

SEQ ID NO: 149974 - DNA, 23 bp, Homo sapiens
atgtgagattctcctactcattt

SEQ ID NO: 149975 - DNA, 19 bp, Homo sapiens
tgagacagagtctcactct

SEQ ID NO: 149976 - DNA, 23 bp, Homo sapiens
tttgagacggagtctcactctgt

SEQ ID NO: 149977 - DNA, 23 bp, Homo sapiens
tatgacactggaagataaaactg

SEQ ID NO: 149978 - DNA, 23 bp, Homo sapiens
gttagtatacttccagtggaaga

SEQ ID NO: 149979 - DNA, 22 bp, Homo sapiens
tttcagggggctgtatgcatat

SEQ ID NO: 149980 - DNA, 21 bp, Homo sapiens
tatgtatgtatataggagtgg

SEQ ID NO: 149981 - DNA, 18 bp, Homo sapiens
ctttccttatcttagcta

SEQ ID NO: 149982 - DNA, 23 bp, Homo sapiens
ttgactctcaactctgaggtgaa

SEQ ID NO: 149983 - DNA, 20 bp, Homo sapiens
tattgttaatatttttaggt

SEQ ID NO: 149984 - DNA, 22 bp, Homo sapiens
agttctgtgaagaatgatggtg

SEQ ID NO: 149985 - DNA, 23 bp, Homo sapiens
tttcaggcagccgttgagcagag

SEQ ID NO: 149986 - DNA, 23 bp, Homo sapiens
ctctcactgtttcctattgaagt

SEQ ID NO: 149987 - DNA, 23 bp, Homo sapiens
gatacatgtgcaggatgtgcagg

SEQ ID NO: 149988 - DNA, 20 bp, Homo sapiens
tgtgtgtatatgtgtgtgta

SEQ ID NO: 149989 - DNA, 22 bp, Homo sapiens
ttttggatgcataccaagcagt

SEQ ID NO: 149990 - DNA, 21 bp, Homo sapiens
acatgtgcagaaagtgcaggt

SEQ ID NO: 149991 - DNA, 23 bp, Homo sapiens
gcatgtacaggatgtgcaggttt

SEQ ID NO: 149992 - DNA, 23 bp, Homo sapiens
tgcctggctgcctctgtccctct

SEQ ID NO: 149993 - DNA, 23 bp, Homo sapiens
tgtgtgtgtgtgtgtatgtgcgc

SEQ ID NO: 149994 - DNA, 23 bp, Homo sapiens
agaaagtcagtggcaacttgatg

SEQ ID NO: 149995 - DNA, 23 bp, Homo sapiens
tggagtctcactctgtcacccag

SEQ ID NO: 149996 - DNA, 22 bp, Homo sapiens
acagacagtagacagttgggat

SEQ ID NO: 149997 - DNA, 22 bp, Homo sapiens
ttttgtgaggtggagtttcgct

SEQ ID NO: 149998 - DNA, 20 bp, Homo sapiens
tgcaatggtgtgatctcagc

SEQ ID NO: 149999 - DNA, 23 bp, Homo sapiens
tgagacagagtctggctctgtcg

SEQ ID NO: 150000 - DNA, 19 bp, Homo sapiens
agcctcagacagactctgc

SEQ ID NO: 150001 - DNA, 23 bp, Homo sapiens
gactgagtctcgctctgtcaccc

SEQ ID NO: 150002 - DNA, 21 bp, Homo sapiens
tgagacagagtctcactctgc

SEQ ID NO: 150003 - DNA, 23 bp, Homo sapiens
tgagttcattgtagattctggat

SEQ ID NO: 150004 - DNA, 23 bp, Homo sapiens
tgagttcattgtagattctggat

SEQ ID NO: 150005 - DNA, 23 bp, Homo sapiens
acaccgtctgtgtttgtctcatg

SEQ ID NO: 150006 - DNA, 23 bp, Homo sapiens
ggcttactctgtgtcacactctc

SEQ ID NO: 150007 - DNA, 23 bp, Homo sapiens
tttgtctgtctgtctatctatct

SEQ ID NO: 150008 - DNA, 23 bp, Homo sapiens
tctctgccaggttttgatatcag

SEQ ID NO: 150009 - DNA, 23 bp, Homo sapiens
ttggaaaacattcagcattggaa

SEQ ID NO: 150010 - DNA, 18 bp, Homo sapiens
tctgtggaaataaaagtg

SEQ ID NO: 150011 - DNA, 23 bp, Homo sapiens
aaaagtgtctgaatttgatggaa

SEQ ID NO: 150012 - DNA, 20 bp, Homo sapiens
attttcctgacaatggagga

SEQ ID NO: 150013 - DNA, 23 bp, Homo sapiens
aagaggagtagtgatatagttgt

SEQ ID NO: 150014 - DNA, 23 bp, Homo sapiens
gtctgtcaggctgtctgtcaaca

SEQ ID NO: 150015 - DNA, 23 bp, Homo sapiens
tttaagatggtttatatttagtt

SEQ ID NO: 150016 - DNA, 23 bp, Homo sapiens
tctctgtctctgaatcttaagtg

SEQ ID NO: 150017 - DNA, 23 bp, Homo sapiens
agaccaatagataagagaaaggc

SEQ ID NO: 150018 - DNA, 23 bp, Homo sapiens
tgtgtatacatatatgtgtgtac

SEQ ID NO: 150019 - DNA, 23 bp, Homo sapiens
atgtattatgtatgtatatgtat

SEQ ID NO: 150020 - DNA, 23 bp, Homo sapiens
agctcactgcagtctctgtctcc

SEQ ID NO: 150021 - DNA, 20 bp, Homo sapiens
tgtctcactctgtcacccag

SEQ ID NO: 150022 - DNA, 23 bp, Homo sapiens
tgcctctgtgcctgtctctcagt

SEQ ID NO: 150023 - DNA, 23 bp, Homo sapiens
tgagttcattgtagattctggat

SEQ ID NO: 150024 - DNA, 23 bp, Homo sapiens
tgagttcattgtagattctggat

SEQ ID NO: 150025 - DNA, 23 bp, Homo sapiens
tgtagttctggtacaaaatagat

SEQ ID NO: 150026 - DNA, 22 bp, Homo sapiens
atctctgtgtgcatgtggacag

SEQ ID NO: 150027 - DNA, 23 bp, Homo sapiens
gtgtatacttgtgtgtgtgtgtg

SEQ ID NO: 150028 - DNA, 23 bp, Homo sapiens
agacagaatctcactctgtcacc

SEQ ID NO: 150029 - DNA, 23 bp, Homo sapiens
tgagacagagtctcactctgtca

SEQ ID NO: 150030 - DNA, 23 bp, Homo sapiens
ccgagtctcgctctgtcagccag

SEQ ID NO: 150031 - DNA, 23 bp, Homo sapiens
agtggatggcacacaataggcaa

SEQ ID NO: 150032 - DNA, 23 bp, Homo sapiens
tatgtgtgtatatatgtgtgtgt

SEQ ID NO: 150033 - DNA, 23 bp, Homo sapiens
aaagtatttgttcttccttgtat

SEQ ID NO: 150034 - DNA, 23 bp, Homo sapiens
agagtctcactcactctgttgcc

SEQ ID NO: 150035 - DNA, 23 bp, Homo sapiens
gacagagtctcgctctgtcaccc

SEQ ID NO: 150036 - DNA, 23 bp, Homo sapiens
gatactccattttttttgtttgt

SEQ ID NO: 150037 - DNA, 23 bp, Homo sapiens
tacatgtatgtgtgtgtgtatat

SEQ ID NO: 150038 - DNA, 18 bp, Homo sapiens
ttcgcagaagcagggttt

SEQ ID NO: 150039 - DNA, 22 bp, Homo sapiens
atattagtgagatatatttggg

SEQ ID NO: 150040 - DNA, 19 bp, Homo sapiens
aaggggagagaaagaagaa

SEQ ID NO: 150041 - DNA, 23 bp, Homo sapiens
agacagggtctcactctgtcacc

SEQ ID NO: 150042 - DNA, 20 bp, Homo sapiens
tgagccaccgtgtgcagtct

SEQ ID NO: 150043 - DNA, 23 bp, Homo sapiens
ggagtctcactgtgtcacacagg

SEQ ID NO: 150044 - DNA, 23 bp, Homo sapiens
gtgacagacagagactctgtctc

SEQ ID NO: 150045 - DNA, 23 bp, Homo sapiens
tgagacagagttttgctcttact

SEQ ID NO: 150046 - DNA, 23 bp, Homo sapiens
agagtctcactctgtcacccagg

SEQ ID NO: 150047 - DNA, 20 bp, Homo sapiens
ttattgtagagatggggtct

SEQ ID NO: 150048 - DNA, 22 bp, Homo sapiens
atatgtgatatatactatgtga

SEQ ID NO: 150049 - DNA, 23 bp, Homo sapiens
actgagtctcactctgtcgccca

SEQ ID NO: 150050 - DNA, 20 bp, Homo sapiens
atatggtgaagaaataggtt

SEQ ID NO: 150051 - DNA, 23 bp, Homo sapiens
ggtctcactctgtcacccaggct

SEQ ID NO: 150052 - DNA, 23 bp, Homo sapiens
tgcagtgacatgatcatgactca

SEQ ID NO: 150053 - DNA, 20 bp, Homo sapiens
agagacagtgttttgccatg

SEQ ID NO: 150054 - DNA, 23 bp, Homo sapiens
gagagagtctcgctctgtcaccc

SEQ ID NO: 150055 - DNA, 23 bp, Homo sapiens
gagagtctcgctctgtcacccag

SEQ ID NO: 150056 - DNA, 23 bp, Homo sapiens
gaggtctcactctgtcacccagg

SEQ ID NO: 150057 - DNA, 23 bp, Homo sapiens
tgagttcattgtagattctggat

SEQ ID NO: 150058 - DNA, 23 bp, Homo sapiens
atcagtggatttctttttttaat

SEQ ID NO: 150059 - DNA, 21 bp, Homo sapiens
gcctgagcaacccaatttgtg

SEQ ID NO: 150060 - DNA, 23 bp, Homo sapiens
tctgtcactcagactggaatgcg

SEQ ID NO: 150061 - DNA, 23 bp, Homo sapiens
aaacagaacacagtgagctcaac

SEQ ID NO: 150062 - DNA, 22 bp, Homo sapiens
tcagctggctgctgtacagtta

SEQ ID NO: 150063 - DNA, 23 bp, Homo sapiens
agacagagtctctctctgtcacc

SEQ ID NO: 150064 - DNA, 23 bp, Homo sapiens
tacatgtgcaggatgtgcaggtt

SEQ ID NO: 150065 - DNA, 23 bp, Homo sapiens
tgagttcattgtagattctggat

SEQ ID NO: 150066 - DNA, 23 bp, Homo sapiens
tgagttcattgtagattctggat

SEQ ID NO: 150067 - DNA, 21 bp, Homo sapiens
agtctctctctctctctcacc

SEQ ID NO: 150068 - DNA, 22 bp, Homo sapiens
tttgagacggagtctcgctctg

SEQ ID NO: 150069 - DNA, 21 bp, Homo sapiens
tttatactagatgtatttgat

SEQ ID NO: 150070 - DNA, 23 bp, Homo sapiens
aatgaaacagtttatgatgtatt

SEQ ID NO: 150071 - DNA, 19 bp, Homo sapiens
atttattgtttttcatacc

SEQ ID NO: 150072 - DNA, 23 bp, Homo sapiens
ttatttctttttcttgcctaatt

SEQ ID NO: 150073 - DNA, 21 bp, Homo sapiens
ctagtactaggttgaatagaa

SEQ ID NO: 150074 - DNA, 18 bp, Homo sapiens
tttgtgcttcttatatat

SEQ ID NO: 150075 - DNA, 23 bp, Homo sapiens
tcagtctttgtctgtcatctgcc

SEQ ID NO: 150076 - DNA, 21 bp, Homo sapiens
aggctggagtacagaagcatg

SEQ ID NO: 150077 - DNA, 23 bp, Homo sapiens
tttttttgatgcagtcttgctct

SEQ ID NO: 150078 - DNA, 23 bp, Homo sapiens
ttttgagacagagtcttgctttg

SEQ ID NO: 150079 - DNA, 23 bp, Homo sapiens
attactatgttgaaaagtttttc

SEQ ID NO: 150080 - DNA, 23 bp, Homo sapiens
gggtctcactctgtcacccaggc

SEQ ID NO: 150081 - DNA, 18 bp, Homo sapiens
acagtggtgcgatctcag

SEQ ID NO: 150082 - DNA, 23 bp, Homo sapiens
gattttttctatatttgcatagg

SEQ ID NO: 150083 - DNA, 23 bp, Homo sapiens
tgagctcacagtgcatggtgaat

SEQ ID NO: 150084 - DNA, 22 bp, Homo sapiens
taacagctaacaatctcagtcc

SEQ ID NO: 150085 - DNA, 23 bp, Homo sapiens
tttctagaattgcagctggaatg

SEQ ID NO: 150086 - DNA, 23 bp, Homo sapiens
tactctcacaagattgtgagaag

SEQ ID NO: 150087 - DNA, 22 bp, Homo sapiens
ataccgaggaaaaaacagctgt

SEQ ID NO: 150088 - DNA, 22 bp, Homo sapiens
tttctctctactctttctgtct

SEQ ID NO: 150089 - DNA, 23 bp, Homo sapiens
tgagttcattgtagattctggat

SEQ ID NO: 150090 - DNA, 23 bp, Homo sapiens
tgagttcattgtagattctggat

SEQ ID NO: 150091 - DNA, 23 bp, Homo sapiens
agactgagtctcgctctgtcacc

SEQ ID NO: 150092 - DNA, 23 bp, Homo sapiens
gaaactgtggcatgtgtgtgtgt

SEQ ID NO: 150093 - DNA, 18 bp, Homo sapiens
taccatagaatactactc

SEQ ID NO: 150094 - DNA, 22 bp, Homo sapiens
atatatgtatatgtatatgtat

SEQ ID NO: 150095 - DNA, 22 bp, Homo sapiens
tatgtatgtgtgtggaaatgta

SEQ ID NO: 150096 - DNA, 19 bp, Homo sapiens
ttgattttgtatcctgtaa

SEQ ID NO: 150097 - DNA, 19 bp, Homo sapiens
tatgtgtgtatatatgtat

SEQ ID NO: 150098 - DNA, 21 bp, Homo sapiens
tgtgtatgtgtgcgtgtgtgt

SEQ ID NO: 150099 - DNA, 23 bp, Homo sapiens
acagagtctcgctctgtcaccca

SEQ ID NO: 150100 - DNA, 20 bp, Homo sapiens
tactgttaatatcttattgt

SEQ ID NO: 150101 - DNA, 23 bp, Homo sapiens
atatgtgtgtgtatatgtgtgtc

SEQ ID NO: 150102 - DNA, 21 bp, Homo sapiens
atacacacccatatacacaca

SEQ ID NO: 150103 - DNA, 18 bp, Homo sapiens
aggtaatgatgcaaggag

SEQ ID NO: 150104 - DNA, 23 bp, Homo sapiens
aggtcatgctgttagctagttgt

SEQ ID NO: 150105 - DNA, 22 bp, Homo sapiens
atatgtgtatacacacacacac

SEQ ID NO: 150106 - DNA, 18 bp, Homo sapiens
tcttggctatgcatgtga

SEQ ID NO: 150107 - DNA, 23 bp, Homo sapiens
ttttttggtaccatatgaaattt

SEQ ID NO: 150108 - DNA, 22 bp, Homo sapiens
tcggtgaagaaagtcaatggta

SEQ ID NO: 150109 - DNA, 23 bp, Homo sapiens
gtgtgtgtgtgtatatatatatg

SEQ ID NO: 150110 - DNA, 18 bp, Homo sapiens
attgatggagatttaggt

SEQ ID NO: 150111 - DNA, 19 bp, Homo sapiens
tttgtgaagtttgtgcaca

SEQ ID NO: 150112 - DNA, 23 bp, Homo sapiens
aggattgacactaggtgatttgt

SEQ ID NO: 150113 - DNA, 19 bp, Homo sapiens
tgtatgtgtgtatgtatat

SEQ ID NO: 150114 - DNA, 22 bp, Homo sapiens
tatatgcatatatatacgtgta

SEQ ID NO: 150115 - DNA, 22 bp, Homo sapiens
tatatgcatatatatacgtgta

SEQ ID NO: 150116 - DNA, 23 bp, Homo sapiens
gtgaatatatgtatatatgtgca

SEQ ID NO: 150117 - DNA, 23 bp, Homo sapiens
tgagttcattgtagattctggat

SEQ ID NO: 150118 - DNA, 23 bp, Homo sapiens
atatgtgtatatatatgtgtgtg

SEQ ID NO: 150119 - DNA, 23 bp, Homo sapiens
acacgtatatgtgtgtgtgtgta

SEQ ID NO: 150120 - DNA, 19 bp, Homo sapiens
agagtatatatatgtgtgt

SEQ ID NO: 150121 - DNA, 23 bp, Homo sapiens
acttcacagttatctctctgtga

SEQ ID NO: 150122 - DNA, 21 bp, Homo sapiens
catacatataggctgtacaat

SEQ ID NO: 150123 - DNA, 21 bp, Homo sapiens
tggcctgagcttttgatgtga

SEQ ID NO: 150124 - DNA, 21 bp, Homo sapiens
ataggatatatatactatagt

SEQ ID NO: 150125 - DNA, 23 bp, Homo sapiens
atataggatatatatactatagt

SEQ ID NO: 150126 - DNA, 22 bp, Homo sapiens
ttctgtgagattttcaaggaca

SEQ ID NO: 150127 - DNA, 23 bp, Homo sapiens
gggtctcactctgtcacccaggc

SEQ ID NO: 150128 - DNA, 21 bp, Homo sapiens
atttcatttgtttggtatggt

SEQ ID NO: 150129 - DNA, 23 bp, Homo sapiens
attacattgattttctaaagtga

SEQ ID NO: 150130 - DNA, 20 bp, Homo sapiens
tctcactgtgctgtctgggc

SEQ ID NO: 150131 - DNA, 23 bp, Homo sapiens
ctgtacttggtagactctttttc

SEQ ID NO: 150132 - DNA, 20 bp, Homo sapiens
acagcttttctgatgtgtcc

SEQ ID NO: 150133 - DNA, 21 bp, Homo sapiens
agacacatgtgagagagctga

SEQ ID NO: 150134 - DNA, 22 bp, Homo sapiens
tgagtcacagacagctttcttg

SEQ ID NO: 150135 - DNA, 23 bp, Homo sapiens
tatgtgcatgtatatatatgtgt

SEQ ID NO: 150136 - DNA, 21 bp, Homo sapiens
tgtgaagaaagtcattggtag

SEQ ID NO: 150137 - DNA, 21 bp, Homo sapiens
tgtgaagaaagtcattggtag

SEQ ID NO: 150138 - DNA, 21 bp, Homo sapiens
tgtgaagaaagtcattggtag

SEQ ID NO: 150139 - DNA, 22 bp, Homo sapiens
gtgaatgctttatgtgcactta

SEQ ID NO: 150140 - DNA, 22 bp, Homo sapiens
tgacagtaatctggcaggtgag

SEQ ID NO: 150141 - DNA, 23 bp, Homo sapiens
aattcacagctactttatttcag

SEQ ID NO: 150142 - DNA, 20 bp, Homo sapiens
tgcctatgtgtgatatatgt

SEQ ID NO: 150143 - DNA, 23 bp, Homo sapiens
tgtgtgtatgtatacatgtgtgt

SEQ ID NO: 150144 - DNA, 23 bp, Homo sapiens
atgtgtatatgtatgtatatgta

SEQ ID NO: 150145 - DNA, 23 bp, Homo sapiens
tatatgtgtgtgtatatatacac

SEQ ID NO: 150146 - DNA, 20 bp, Homo sapiens
tatatccttatatatgtgtg

SEQ ID NO: 150147 - DNA, 18 bp, Homo sapiens
tatattacattatatacg

SEQ ID NO: 150148 - DNA, 23 bp, Homo sapiens
gccaaagcaagagaaagagatga

SEQ ID NO: 150149 - DNA, 23 bp, Homo sapiens
tgagttcattgtagattctggat

SEQ ID NO: 150150 - DNA, 23 bp, Homo sapiens
tgagttcattgtagattctggat

SEQ ID NO: 150151 - DNA, 21 bp, Homo sapiens
tgagaatgtttttcttttata

SEQ ID NO: 150152 - DNA, 19 bp, Homo sapiens
tagcttgtttcttaatgaa

SEQ ID NO: 150153 - DNA, 23 bp, Homo sapiens
tctcactctgtcaccctggctga

SEQ ID NO: 150154 - DNA, 23 bp, Homo sapiens
ataagtatgaatacgtatgtgtg

SEQ ID NO: 150155 - DNA, 20 bp, Homo sapiens
tataatgtatatgtaaatat

SEQ ID NO: 150156 - DNA, 23 bp, Homo sapiens
cggagtctcgctctgtctcccag

SEQ ID NO: 150157 - DNA, 22 bp, Homo sapiens
atctatgttttatcatacagct

SEQ ID NO: 150158 - DNA, 23 bp, Homo sapiens
tggatgtgtatttgtaaataagg

SEQ ID NO: 150159 - DNA, 23 bp, Homo sapiens
tatttactgatattgttattgtt

SEQ ID NO: 150160 - DNA, 23 bp, Homo sapiens
aaaggaacacatagatgacagca

SEQ ID NO: 150161 - DNA, 22 bp, Homo sapiens
gaactgtgtttctatatgtgtg

SEQ ID NO: 150162 - DNA, 23 bp, Homo sapiens
acatctatatatgtatatgtgca

SEQ ID NO: 150163 - DNA, 23 bp, Homo sapiens
tgagttcattgtagattctggat

SEQ ID NO: 150164 - DNA, 23 bp, Homo sapiens
tgagttcattgtagattctggat

SEQ ID NO: 150165 - DNA, 18 bp, Homo sapiens
agttatctggataggttt

SEQ ID NO: 150166 - DNA, 23 bp, Homo sapiens
attttcatattattgaggttagg

SEQ ID NO: 150167 - DNA, 23 bp, Homo sapiens
tgagttcattgtagattctggat

SEQ ID NO: 150168 - DNA, 23 bp, Homo sapiens
tgagttcattgtagattctggat

SEQ ID NO: 150169 - DNA, 19 bp, Homo sapiens
ataggtatactatacacgt

SEQ ID NO: 150170 - DNA, 19 bp, Homo sapiens
atacacgtataggtataca

SEQ ID NO: 150171 - DNA, 23 bp, Homo sapiens
ttatgtcagtggtattcaaaagg

SEQ ID NO: 150172 - DNA, 22 bp, Homo sapiens
tgaggtggtttgttatattgcc

SEQ ID NO: 150173 - DNA, 23 bp, Homo sapiens
attctctctggttttgctattgt

SEQ ID NO: 150174 - DNA, 23 bp, Homo sapiens
tgagttcattgtagattctggat

SEQ ID NO: 150175 - DNA, 23 bp, Homo sapiens
tgagttcattgtagattctggat

SEQ ID NO: 150176 - DNA, 21 bp, Homo sapiens
ttaaagtgaagggaaaaggat

SEQ ID NO: 150177 - DNA, 22 bp, Homo sapiens
tatttgtttggtgagctttggt

SEQ ID NO: 150178 - DNA, 23 bp, Homo sapiens
tatgagtttgttcatatgtgtgt

SEQ ID NO: 150179 - DNA, 23 bp, Homo sapiens
atgtacatactgcatgtataaac

SEQ ID NO: 150180 - DNA, 23 bp, Homo sapiens
tgagttcattgtagattctggat

SEQ ID NO: 150181 - DNA, 23 bp, Homo sapiens
tgagttcattgtagattctggat

SEQ ID NO: 150182 - DNA, 23 bp, Homo sapiens
tgagttcattgtagattctggat

SEQ ID NO: 150183 - DNA, 23 bp, Homo sapiens
tgagttcattgtagattctggat

SEQ ID NO: 150184 - DNA, 22 bp, Homo sapiens
agtgggccaagataatttgtct

SEQ ID NO: 150185 - DNA, 23 bp, Homo sapiens
ctttgacagttgagtgtcaccag

SEQ ID NO: 150186 - DNA, 21 bp, Homo sapiens
gacagcttgatttatgagaga

SEQ ID NO: 150187 - DNA, 19 bp, Homo sapiens
tatatatgtatgtatatct

SEQ ID NO: 150188 - DNA, 22 bp, Homo sapiens
ttctgcttgtagttaggacaga

SEQ ID NO: 150189 - DNA, 21 bp, Homo sapiens
ggagctggaacttaaagtggt

SEQ ID NO: 150190 - DNA, 23 bp, Homo sapiens
atacaaagacatttagaagattg

SEQ ID NO: 150191 - DNA, 23 bp, Homo sapiens
ttgagacagtctcattctgtcac

SEQ ID NO: 150192 - DNA, 22 bp, Homo sapiens
atatgtgtatatgtatatatgt

SEQ ID NO: 150193 - DNA, 19 bp, Homo sapiens
tctggaaaataatcccaga

SEQ ID NO: 150194 - DNA, 23 bp, Homo sapiens
tttctttgtttgttttgagacgg

SEQ ID NO: 150195 - DNA, 22 bp, Homo sapiens
acatgtgcagaaagtgcaggtt

SEQ ID NO: 150196 - DNA, 23 bp, Homo sapiens
tactagaggaggccatctctctc

SEQ ID NO: 150197 - DNA, 21 bp, Homo sapiens
aagcttgtcagtaggaatgat

SEQ ID NO: 150198 - DNA, 20 bp, Homo sapiens
atgtgtatatatatatatgt

SEQ ID NO: 150199 - DNA, 20 bp, Homo sapiens
atgtgtatatatgtatatct

SEQ ID NO: 150200 - DNA, 23 bp, Homo sapiens
aaattgaagtctaaagttggaaa

SEQ ID NO: 150201 - DNA, 23 bp, Homo sapiens
taatgtgaatttctagaagtgtg

SEQ ID NO: 150202 - DNA, 21 bp, Homo sapiens
accaggatataaattccatga

SEQ ID NO: 150203 - DNA, 23 bp, Homo sapiens
taggtggtatagtatagagactt

SEQ ID NO: 150204 - DNA, 23 bp, Homo sapiens
ttaatagagtgaaaacagagctc

SEQ ID NO: 150205 - DNA, 23 bp, Homo sapiens
tgtgtatgtatatatatatgtgt

SEQ ID NO: 150206 - DNA, 21 bp, Homo sapiens
tgtatactattataaatgatg

SEQ ID NO: 150207 - DNA, 23 bp, Homo sapiens
aagcacaatactgttatgaagtt

SEQ ID NO: 150208 - DNA, 23 bp, Homo sapiens
ttaaggttaatattgttatgtat

SEQ ID NO: 150209 - DNA, 23 bp, Homo sapiens
tggggtaggtgaaagtatagagt

SEQ ID NO: 150210 - DNA, 22 bp, Homo sapiens
actctagaaattgctcttgtct

SEQ ID NO: 150211 - DNA, 23 bp, Homo sapiens
cactgagaagtgattttgttgtg

SEQ ID NO: 150212 - DNA, 23 bp, Homo sapiens
tttctctctcttagttgttacca

SEQ ID NO: 150213 - DNA, 23 bp, Homo sapiens
gtatatatgtgcatgtatatata

SEQ ID NO: 150214 - DNA, 20 bp, Homo sapiens
atatgcatgtatacaagtat

SEQ ID NO: 150215 - DNA, 20 bp, Homo sapiens
tatatacttgtatacatgca

SEQ ID NO: 150216 - DNA, 22 bp, Homo sapiens
tctgccactctatatcttctaa

SEQ ID NO: 150217 - DNA, 23 bp, Homo sapiens
acaactgagtcagaatcttgtat

SEQ ID NO: 150218 - DNA, 23 bp, Homo sapiens
acagtgttgttctttttgcttag

SEQ ID NO: 150219 - DNA, 19 bp, Homo sapiens
ttctgggaagaaaatcaat

SEQ ID NO: 150220 - DNA, 23 bp, Homo sapiens
tatacagtggttgattatacaga

SEQ ID NO: 150221 - DNA, 23 bp, Homo sapiens
tccatatatatacagatatagtt

SEQ ID NO: 150222 - DNA, 21 bp, Homo sapiens
cagactctgtctctctctctc

SEQ ID NO: 150223 - DNA, 21 bp, Homo sapiens
acatatatatagtctgtgtgt

SEQ ID NO: 150224 - DNA, 23 bp, Homo sapiens
atatacagcatatgtatagttta

SEQ ID NO: 150225 - DNA, 23 bp, Homo sapiens
aactgtctagaagtagtgtttac

SEQ ID NO: 150226 - DNA, 19 bp, Homo sapiens
atgcacacatgcatgtaca

SEQ ID NO: 150227 - DNA, 23 bp, Homo sapiens
tctctctgtcacccagactggag

SEQ ID NO: 150228 - DNA, 22 bp, Homo sapiens
agaggtagtaccttgtgtggtt

SEQ ID NO: 150229 - DNA, 22 bp, Homo sapiens
atgtgtatatatatacttgtgt

SEQ ID NO: 150230 - DNA, 23 bp, Homo sapiens
ttgtgtgtgtgcatgtgcacgtg

SEQ ID NO: 150231 - DNA, 20 bp, Homo sapiens
agtgtggtgtgtgtgcatat

SEQ ID NO: 150232 - DNA, 22 bp, Homo sapiens
aaagttggatttcaaaagaatt

SEQ ID NO: 150233 - DNA, 22 bp, Homo sapiens
gagacactctcactctgttgcc

SEQ ID NO: 150234 - DNA, 23 bp, Homo sapiens
tgtctgtgtttgtgtgcatgttt

SEQ ID NO: 150235 - DNA, 23 bp, Homo sapiens
tttatggtagtaaatggtaaaca

SEQ ID NO: 150236 - DNA, 19 bp, Homo sapiens
tttggttttcacataagcc

SEQ ID NO: 150237 - DNA, 23 bp, Homo sapiens
tttctttgtagatgaattggggt

SEQ ID NO: 150238 - DNA, 23 bp, Homo sapiens
tgagttcattgtagattctggat

SEQ ID NO: 150239 - DNA, 23 bp, Homo sapiens
tgagttcattgtagattctggat

SEQ ID NO: 150240 - DNA, 23 bp, Homo sapiens
tacagatagaggaaatgatagtt

SEQ ID NO: 150241 - DNA, 21 bp, Homo sapiens
tctttctcttatcctattgct

SEQ ID NO: 150242 - DNA, 22 bp, Homo sapiens
ttcggtagtatgttgaatagaa

SEQ ID NO: 150243 - DNA, 20 bp, Homo sapiens
agatgtgagtgcatgtgtct

SEQ ID NO: 150244 - DNA, 19 bp, Homo sapiens
agagatgagagacagcacc

SEQ ID NO: 150245 - DNA, 23 bp, Homo sapiens
gaaatgttttcagcttttgccca

SEQ ID NO: 150246 - DNA, 23 bp, Homo sapiens
atgattgtctgttgaaaagttta

SEQ ID NO: 150247 - DNA, 22 bp, Homo sapiens
tgtgtgtgtatctgtgtatata

SEQ ID NO: 150248 - DNA, 23 bp, Homo sapiens
atacatatgtatgcatatgtgtg

SEQ ID NO: 150249 - DNA, 23 bp, Homo sapiens
tatatatgtatgcatatgtgtgt

SEQ ID NO: 150250 - DNA, 21 bp, Homo sapiens
tacatacacacacacatatac

SEQ ID NO: 150251 - DNA, 23 bp, Homo sapiens
tgagttcattgtagattctggat

SEQ ID NO: 150252 - DNA, 23 bp, Homo sapiens
tgagttcattgtagattctggat

SEQ ID NO: 150253 - DNA, 18 bp, Homo sapiens
tctcttttcctttacttt

SEQ ID NO: 150254 - DNA, 18 bp, Homo sapiens
ttggcataattttctgat

SEQ ID NO: 150255 - DNA, 23 bp, Homo sapiens
atattctgcctgtttttgtttac

SEQ ID NO: 150256 - DNA, 23 bp, Homo sapiens
tgagttcattgtagattctggat

SEQ ID NO: 150257 - DNA, 23 bp, Homo sapiens
tgagttcattgtagattctggat

SEQ ID NO: 150258 - DNA, 23 bp, Homo sapiens
tttgtttagtattgtcttggcta

SEQ ID NO: 150259 - DNA, 22 bp, Homo sapiens
tgtgaagaaagtcaatggtagt

SEQ ID NO: 150260 - DNA, 20 bp, Homo sapiens
aaatgcttggtaatggtgag

SEQ ID NO: 150261 - DNA, 19 bp, Homo sapiens
gtatccatgcatgtgtaca

SEQ ID NO: 150262 - DNA, 23 bp, Homo sapiens
agattgtggtagtttattgtata

SEQ ID NO: 150263 - DNA, 22 bp, Homo sapiens
tctttgctgaatttttcctttg

SEQ ID NO: 150264 - DNA, 20 bp, Homo sapiens
gcatcacagtcagtctctgt

SEQ ID NO: 150265 - DNA, 21 bp, Homo sapiens
ttcttagagggtttgctttca

SEQ ID NO: 150266 - DNA, 23 bp, Homo sapiens
taaagccccagctttttctctga

SEQ ID NO: 150267 - DNA, 20 bp, Homo sapiens
aaatagtagagtgagagctg

SEQ ID NO: 150268 - DNA, 23 bp, Homo sapiens
aatctgcaacaaattagctgtgt

SEQ ID NO: 150269 - DNA, 23 bp, Homo sapiens
tgtgactcagtgtctttgtgtgt

SEQ ID NO: 150270 - DNA, 23 bp, Homo sapiens
tttttctgtaaatctattagaaa

SEQ ID NO: 150271 - DNA, 23 bp, Homo sapiens
tgttggatgaatagtttgcaaat

SEQ ID NO: 150272 - DNA, 19 bp, Homo sapiens
taaaactgattatggttac

SEQ ID NO: 150273 - DNA, 23 bp, Homo sapiens
tcattcaacacactgagcattga

SEQ ID NO: 150274 - DNA, 23 bp, Homo sapiens
gattaggaactccatgatggcaa

SEQ ID NO: 150275 - DNA, 20 bp, Homo sapiens
attctgcatatcttttgagt

SEQ ID NO: 150276 - DNA, 22 bp, Homo sapiens
ttttgagttggaatcttgctct

SEQ ID NO: 150277 - DNA, 23 bp, Homo sapiens
gacagagtctcgctctgtcaccc

SEQ ID NO: 150278 - DNA, 23 bp, Homo sapiens
tgggaataacatagctatgtgct

SEQ ID NO: 150279 - DNA, 23 bp, Homo sapiens
ttactgactactctgtgagttcc

SEQ ID NO: 150280 - DNA, 23 bp, Homo sapiens
tgtaggaatacaatacattttgt

SEQ ID NO: 150281 - DNA, 23 bp, Homo sapiens
tgaacatttgggttgttttcact

SEQ ID NO: 150282 - DNA, 22 bp, Homo sapiens
ctcactgcaacctctgcaccct

SEQ ID NO: 150283 - DNA, 22 bp, Homo sapiens
aaagtcagtgtatacctgctga

SEQ ID NO: 150284 - DNA, 22 bp, Homo sapiens
tgtctgaaattgtcttaccata

SEQ ID NO: 150285 - DNA, 23 bp, Homo sapiens
tgagccaggctttgtggtatgca

SEQ ID NO: 150286 - DNA, 19 bp, Homo sapiens
agtgatagtttttttttgc

SEQ ID NO: 150287 - DNA, 21 bp, Homo sapiens
ttttagtcattctcataggtg

SEQ ID NO: 150288 - DNA, 19 bp, Homo sapiens
tcacagtttttgaactaca

SEQ ID NO: 150289 - DNA, 23 bp, Homo sapiens
attgtacataaatgcagttgaac

SEQ ID NO: 150290 - DNA, 19 bp, Homo sapiens
ctgtgtgaatgcatagtgt

SEQ ID NO: 150291 - DNA, 22 bp, Homo sapiens
tgaattgtatagtagtaacgtc

SEQ ID NO: 150292 - DNA, 23 bp, Homo sapiens
tccagtactatgttgaatggaag

SEQ ID NO: 150293 - DNA, 21 bp, Homo sapiens
tatatctatatctatatctat

SEQ ID NO: 150294 - DNA, 22 bp, Homo sapiens
ttatatctatatctatatggat

SEQ ID NO: 150295 - DNA, 20 bp, Homo sapiens
tatctatatctatatctata

SEQ ID NO: 150296 - DNA, 23 bp, Homo sapiens
tcagcttatgaattctattctat

SEQ ID NO: 150297 - DNA, 21 bp, Homo sapiens
ttgaattgtattctattgcaa

SEQ ID NO: 150298 - DNA, 20 bp, Homo sapiens
agctcactgtgagtgctgga

SEQ ID NO: 150299 - DNA, 22 bp, Homo sapiens
agagatggagtctcactctgtt

SEQ ID NO: 150300 - DNA, 23 bp, Homo sapiens
atgtgtgcatatatatacatata

SEQ ID NO: 150301 - DNA, 23 bp, Homo sapiens
tgagttcattgtagattctggat

SEQ ID NO: 150302 - DNA, 23 bp, Homo sapiens
tgagttcattgtagattctggat

SEQ ID NO: 150303 - DNA, 23 bp, Homo sapiens
tgtgtctatatgtgtgtatatga

SEQ ID NO: 150304 - DNA, 23 bp, Homo sapiens
tgggttcagagtagctcagttct

SEQ ID NO: 150305 - DNA, 23 bp, Homo sapiens
cctgcaatgtgactgtatttgga

SEQ ID NO: 150306 - DNA, 20 bp, Homo sapiens
tcagctacttggaaggttga

SEQ ID NO: 150307 - DNA, 20 bp, Homo sapiens
tcacttgagcctgtcaggtt

SEQ ID NO: 150308 - DNA, 22 bp, Homo sapiens
atacaccatgtatatatgtgtg

SEQ ID NO: 150309 - DNA, 23 bp, Homo sapiens
ctttctctgcctctgtctcacag

SEQ ID NO: 150310 - DNA, 21 bp, Homo sapiens
actgatgttcattcaatgccc

SEQ ID NO: 150311 - DNA, 23 bp, Homo sapiens
gtaagtgtctatcctatgcctgc

SEQ ID NO: 150312 - DNA, 23 bp, Homo sapiens
tttgctctttttaaggggtgact

SEQ ID NO: 150313 - DNA, 20 bp, Homo sapiens
cccaagaagagccagtgatc

SEQ ID NO: 150314 - DNA, 23 bp, Homo sapiens
tcttcctaatgttgctgaatttg

SEQ ID NO: 150315 - DNA, 23 bp, Homo sapiens
cttacaggaactggaagataact

SEQ ID NO: 150316 - DNA, 23 bp, Homo sapiens
tgcctggctgagaacagtgcatt

SEQ ID NO: 150317 - DNA, 20 bp, Homo sapiens
tggagtatagttctattgcc

SEQ ID NO: 150318 - DNA, 23 bp, Homo sapiens
tggctccctctgtggctgtgtct

SEQ ID NO: 150319 - DNA, 23 bp, Homo sapiens
tttggggagcttgtttggaggtt

SEQ ID NO: 150320 - DNA, 20 bp, Homo sapiens
agatatagtttctgcctttg

SEQ ID NO: 150321 - DNA, 23 bp, Homo sapiens
tggagtttcgctcttgttgtcca

SEQ ID NO: 150322 - DNA, 23 bp, Homo sapiens
aaaaatgagataatgaaatggtc

SEQ ID NO: 150323 - DNA, 23 bp, Homo sapiens
ctctctctctgacagcagattgt

SEQ ID NO: 150324 - DNA, 23 bp, Homo sapiens
gtatgtgcatgtacttgtgtgtg

SEQ ID NO: 150325 - DNA, 22 bp, Homo sapiens
taaacagttattgatcttcact

SEQ ID NO: 150326 - DNA, 23 bp, Homo sapiens
tgagttcattgtagattctggat

SEQ ID NO: 150327 - DNA, 23 bp, Homo sapiens
tgagttcattgtagattctggat

SEQ ID NO: 150328 - DNA, 23 bp, Homo sapiens
tctgcctggctttcatttcattc

SEQ ID NO: 150329 - DNA, 23 bp, Homo sapiens
acctatgtatagatgtatacaca

SEQ ID NO: 150330 - DNA, 20 bp, Homo sapiens
atacatagatgtatggtgta

SEQ ID NO: 150331 - DNA, 23 bp, Homo sapiens
tttggctggatatgaaattctag

SEQ ID NO: 150332 - DNA, 21 bp, Homo sapiens
ataaaagatatacaagtagtt

SEQ ID NO: 150333 - DNA, 23 bp, Homo sapiens
tgtcagtgtgcagttagtttgtt

SEQ ID NO: 150334 - DNA, 21 bp, Homo sapiens
tgtttgtatttctctgtcttt

SEQ ID NO: 150335 - DNA, 19 bp, Homo sapiens
agcaatacaaacaagtatg

SEQ ID NO: 150336 - DNA, 21 bp, Homo sapiens
atatgtatatatatatttgag

SEQ ID NO: 150337 - DNA, 21 bp, Homo sapiens
atatgtatatatatatttgag

SEQ ID NO: 150338 - DNA, 23 bp, Homo sapiens
ggagtctcgctcactcagtcctc

SEQ ID NO: 150339 - DNA, 21 bp, Homo sapiens
tcataggtatagtagctatga

SEQ ID NO: 150340 - DNA, 19 bp, Homo sapiens
tattactctaagtaagtca

SEQ ID NO: 150341 - DNA, 18 bp, Homo sapiens
agtgttagcacgatgtat

SEQ ID NO: 150342 - DNA, 21 bp, Homo sapiens
taacatggagttgaatcctat

SEQ ID NO: 150343 - DNA, 23 bp, Homo sapiens
aagtgaacactgtgagcactggt

SEQ ID NO: 150344 - DNA, 20 bp, Homo sapiens
aatgtatatgtatatgtgtg

SEQ ID NO: 150345 - DNA, 22 bp, Homo sapiens
tatatgtatttgtgtgtgcttg

SEQ ID NO: 150346 - DNA, 23 bp, Homo sapiens
tatgtacataaagatgtgtgtgt

SEQ ID NO: 150347 - DNA, 22 bp, Homo sapiens
tgtatctcgtaatatatacatg

SEQ ID NO: 150348 - DNA, 23 bp, Homo sapiens
ttcagtgacaatttattgtgtaa

SEQ ID NO: 150349 - DNA, 19 bp, Homo sapiens
gtgataaaagtaagtgatg

SEQ ID NO: 150350 - DNA, 22 bp, Homo sapiens
tcactccctctgtcactcattt

SEQ ID NO: 150351 - DNA, 18 bp, Homo sapiens
agctattttattataatg

SEQ ID NO: 150352 - DNA, 23 bp, Homo sapiens
attaaatgatgatgttggtgttt

SEQ ID NO: 150353 - DNA, 23 bp, Homo sapiens
taatacagtcatgatgatgatga

SEQ ID NO: 150354 - DNA, 23 bp, Homo sapiens
agataagaggaacttctttttag

SEQ ID NO: 150355 - DNA, 18 bp, Homo sapiens
gaaatacctactcatttc

SEQ ID NO: 150356 - DNA, 23 bp, Homo sapiens
tataagtatatatgtatatgtag

SEQ ID NO: 150357 - DNA, 22 bp, Homo sapiens
tttgtgtatatatatatctgta

SEQ ID NO: 150358 - DNA, 18 bp, Homo sapiens
cacatgcacacatattct

SEQ ID NO: 150359 - DNA, 23 bp, Homo sapiens
tatgtgtgcatgtgactttatgg

SEQ ID NO: 150360 - DNA, 23 bp, Homo sapiens
gatggagtctcactctgtctccc

SEQ ID NO: 150361 - DNA, 22 bp, Homo sapiens
gaacagtactcaatagcatgtg

SEQ ID NO: 150362 - DNA, 22 bp, Homo sapiens
tatcttcctgatgctgagttct

SEQ ID NO: 150363 - DNA, 23 bp, Homo sapiens
agatctcactctgtcactcaggc

SEQ ID NO: 150364 - DNA, 20 bp, Homo sapiens
aggaactgacctttgatcat

SEQ ID NO: 150365 - DNA, 21 bp, Homo sapiens
tctgtgtgaaaattttcactt

SEQ ID NO: 150366 - DNA, 23 bp, Homo sapiens
tcagtttcttggtgagaaataga

SEQ ID NO: 150367 - DNA, 19 bp, Homo sapiens
atatcactttcatattggc

SEQ ID NO: 150368 - DNA, 23 bp, Homo sapiens
accttggttattgtttccattgt

SEQ ID NO: 150369 - DNA, 23 bp, Homo sapiens
gagacagaatctgactctgtcac

SEQ ID NO: 150370 - DNA, 20 bp, Homo sapiens
agtctcgctctgtcgctcag

SEQ ID NO: 150371 - DNA, 21 bp, Homo sapiens
tttgagatggagtctcactct

SEQ ID NO: 150372 - DNA, 22 bp, Homo sapiens
tatttgtatatcatctttggag

SEQ ID NO: 150373 - DNA, 22 bp, Homo sapiens
ttgagcgggagacaaaggggct

SEQ ID NO: 150374 - DNA, 21 bp, Homo sapiens
atatgcagtagtatggagaaa

SEQ ID NO: 150375 - DNA, 23 bp, Homo sapiens
tgagttcattgtagattctggat

SEQ ID NO: 150376 - DNA, 23 bp, Homo sapiens
tgagttcattgtagattctggat

SEQ ID NO: 150377 - DNA, 23 bp, Homo sapiens
tgagttcattgtagattctggat

SEQ ID NO: 150378 - DNA, 23 bp, Homo sapiens
tgagttcattgtagattctggat

SEQ ID NO: 150379 - DNA, 20 bp, Homo sapiens
ttggaccatcttcagtatgc

SEQ ID NO: 150380 - DNA, 23 bp, Homo sapiens
ctcagatctgtctccctgtgctg

SEQ ID NO: 150381 - DNA, 23 bp, Homo sapiens
cagagtctcactctgtcgcccag

SEQ ID NO: 150382 - DNA, 20 bp, Homo sapiens
ccaacataagaaactgtggt

SEQ ID NO: 150383 - DNA, 23 bp, Homo sapiens
ttgttactttctttttcatgtga

SEQ ID NO: 150384 - DNA, 22 bp, Homo sapiens
aacatacatataaattctgttt

SEQ ID NO: 150385 - DNA, 23 bp, Homo sapiens
tgtgtgtgtgtatgagtataccc

SEQ ID NO: 150386 - DNA, 22 bp, Homo sapiens
tgtcactgtttctctctctgga

SEQ ID NO: 150387 - DNA, 23 bp, Homo sapiens
tgagactgagtctcgctctgtcg

SEQ ID NO: 150388 - DNA, 21 bp, Homo sapiens
tatttagtatatgtatacaca

SEQ ID NO: 150389 - DNA, 23 bp, Homo sapiens
tggctttgagctgagcttgatca

SEQ ID NO: 150390 - DNA, 23 bp, Homo sapiens
atatgtgtgtggaaggatatgga

SEQ ID NO: 150391 - DNA, 23 bp, Homo sapiens
tatatatgtatatgtgtatgtgt

SEQ ID NO: 150392 - DNA, 21 bp, Homo sapiens
atatacaccatactgtgttgc

SEQ ID NO: 150393 - DNA, 23 bp, Homo sapiens
tagtagtttgcatatttttacct

SEQ ID NO: 150394 - DNA, 19 bp, Homo sapiens
atgttcctgtagtcccagc

SEQ ID NO: 150395 - DNA, 23 bp, Homo sapiens
tgagttcattgtagattctggat

SEQ ID NO: 150396 - DNA, 23 bp, Homo sapiens
tgagttcattgtagattctggat

SEQ ID NO: 150397 - DNA, 23 bp, Homo sapiens
aaatgtacctatacatatgtatg

SEQ ID NO: 150398 - DNA, 23 bp, Homo sapiens
aaacttgtgccactctccctgac

SEQ ID NO: 150399 - DNA, 22 bp, Homo sapiens
atacacacatatatatatgtgt

SEQ ID NO: 150400 - DNA, 23 bp, Homo sapiens
tgagttcattgtagattctggat

SEQ ID NO: 150401 - DNA, 23 bp, Homo sapiens
tgagttcattgtagattctggat

SEQ ID NO: 150402 - DNA, 23 bp, Homo sapiens
gactgagtctcgctctgtcaccc

SEQ ID NO: 150403 - DNA, 23 bp, Homo sapiens
aaagagctagatctgaacttctg

SEQ ID NO: 150404 - DNA, 20 bp, Homo sapiens
atatatgttttggatcaggt

SEQ ID NO: 150405 - DNA, 19 bp, Homo sapiens
agaactgagcttttttttt

SEQ ID NO: 150406 - DNA, 23 bp, Homo sapiens
cagtctcactcactctgtcactc

SEQ ID NO: 150407 - DNA, 23 bp, Homo sapiens
taacacataatgtaaatctggaa

SEQ ID NO: 150408 - DNA, 21 bp, Homo sapiens
tccatgtgtgtgtgtgtatat

SEQ ID NO: 150409 - DNA, 20 bp, Homo sapiens
taaaatgttgcatatatatg

SEQ ID NO: 150410 - DNA, 22 bp, Homo sapiens
atacacacacatatatagttgt

SEQ ID NO: 150411 - DNA, 23 bp, Homo sapiens
tatttgctcaatgtccagaccct

SEQ ID NO: 150412 - DNA, 23 bp, Homo sapiens
aagactctttgttaatgtgtgag

SEQ ID NO: 150413 - DNA, 23 bp, Homo sapiens
agatagtagtgacagtcttgatc

SEQ ID NO: 150414 - DNA, 23 bp, Homo sapiens
tgagttcattgtagattctggat

SEQ ID NO: 150415 - DNA, 23 bp, Homo sapiens
tgagttcattgtagattctggat

SEQ ID NO: 150416 - DNA, 23 bp, Homo sapiens
tgagttcattgtagattctggat

SEQ ID NO: 150417 - DNA, 18 bp, Homo sapiens
tacatttgtatatgtgta

SEQ ID NO: 150418 - DNA, 18 bp, Homo sapiens
atatgtatatatgtatac

SEQ ID NO: 150419 - DNA, 23 bp, Homo sapiens
ctcccagagcccctggaactctg

SEQ ID NO: 150420 - DNA, 23 bp, Homo sapiens
tcccagagcccctggaactctgg

SEQ ID NO: 150421 - DNA, 23 bp, Homo sapiens
tcccagagcccctggaactctgg

SEQ ID NO: 150422 - DNA, 23 bp, Homo sapiens
tcccagagcccctggaactctgg

SEQ ID NO: 150423 - DNA, 23 bp, Homo sapiens
gactcagtgtgtctgtctgtggc

SEQ ID NO: 150424 - DNA, 23 bp, Homo sapiens
tgaccctctcagagtctctggga

SEQ ID NO: 150425 - DNA, 21 bp, Homo sapiens
tctgtctgtcagactgaaggc

SEQ ID NO: 150426 - DNA, 22 bp, Homo sapiens
agtgactcaagaggctgaggtg

SEQ ID NO: 150427 - DNA, 23 bp, Homo sapiens
acgtagtctctgtgccttattta

SEQ ID NO: 150428 - DNA, 23 bp, Homo sapiens
aactgacatgtagttttctggtg

SEQ ID NO: 150429 - DNA, 19 bp, Homo sapiens
aagcaccttagaaaaatgg

SEQ ID NO: 150430 - DNA, 23 bp, Homo sapiens
gtatctgtatatatgtgtatgtg

SEQ ID NO: 150431 - DNA, 23 bp, Homo sapiens
tatgtatatgtatgtgtgtgtgt

SEQ ID NO: 150432 - DNA, 23 bp, Homo sapiens
caatcagctcttctatgtggatt

SEQ ID NO: 150433 - DNA, 21 bp, Homo sapiens
tgtggatgctctctctcacac

SEQ ID NO: 150434 - DNA, 23 bp, Homo sapiens
agtccctgacgcatagtagtgtc

SEQ ID NO: 150435 - DNA, 21 bp, Homo sapiens
ttagagtgtgtagtaaacatg

SEQ ID NO: 150436 - DNA, 21 bp, Homo sapiens
tcccagactctggaaatcctc

SEQ ID NO: 150437 - DNA, 22 bp, Homo sapiens
tttttgagaggagtctcgctct

SEQ ID NO: 150438 - DNA, 20 bp, Homo sapiens
tggcagggtctcactctgtc

SEQ ID NO: 150439 - DNA, 22 bp, Homo sapiens
tataatatagacacatatgtgt

SEQ ID NO: 150440 - DNA, 22 bp, Homo sapiens
taatgtatacatatttatgtgt

SEQ ID NO: 150441 - DNA, 23 bp, Homo sapiens
tctctctgtctctcagttggatc

SEQ ID NO: 150442 - DNA, 19 bp, Homo sapiens
ctgaggaaagaaaaagaga

SEQ ID NO: 150443 - DNA, 23 bp, Homo sapiens
tctggttcagtctcagtctcaga

SEQ ID NO: 150444 - DNA, 18 bp, Homo sapiens
cagcaaagaacagtccta

SEQ ID NO: 150445 - DNA, 20 bp, Homo sapiens
tttatgatgttcttactgtt

SEQ ID NO: 150446 - DNA, 23 bp, Homo sapiens
gtttaaactgtaggcattagctc

SEQ ID NO: 150447 - DNA, 23 bp, Homo sapiens
tggagtctcactctgtcacccag

SEQ ID NO: 150448 - DNA, 23 bp, Homo sapiens
tgtgtgtatatatgtatatatgt

SEQ ID NO: 150449 - DNA, 23 bp, Homo sapiens
atgtgagtatatgtatatgtgta

SEQ ID NO: 150450 - DNA, 20 bp, Homo sapiens
tatatttgtatatgtatatg

SEQ ID NO: 150451 - DNA, 20 bp, Homo sapiens
ttatttgttgttgttgcttg

SEQ ID NO: 150452 - DNA, 18 bp, Homo sapiens
acagtgcctcattttcaa

SEQ ID NO: 150453 - DNA, 22 bp, Homo sapiens
agagagttgttttattttagtt

SEQ ID NO: 150454 - DNA, 23 bp, Homo sapiens
tatttcagcttctgttacaatgt

SEQ ID NO: 150455 - DNA, 23 bp, Homo sapiens
gatgagctggtatctttttctgt

SEQ ID NO: 150456 - DNA, 19 bp, Homo sapiens
tgtgtgtgtgtatatatat

SEQ ID NO: 150457 - DNA, 23 bp, Homo sapiens
tgagacagtatctcactctgtta

SEQ ID NO: 150458 - DNA, 22 bp, Homo sapiens
taatgtttgtatttttagtaga

SEQ ID NO: 150459 - DNA, 23 bp, Homo sapiens
agattctctgtgtgtttcatctc

SEQ ID NO: 150460 - DNA, 23 bp, Homo sapiens
ttcttaaagccgaatgtcattgt

SEQ ID NO: 150461 - DNA, 23 bp, Homo sapiens
cagtccctgtctccttctctgat

SEQ ID NO: 150462 - DNA, 21 bp, Homo sapiens
tgaggtaggaggatcacttga

SEQ ID NO: 150463 - DNA, 18 bp, Homo sapiens
tgcctgtttgtttatttt

SEQ ID NO: 150464 - DNA, 23 bp, Homo sapiens
tagacacagggtctcactctgtt

SEQ ID NO: 150465 - DNA, 19 bp, Homo sapiens
gagccaccatgcctggtct

SEQ ID NO: 150466 - DNA, 21 bp, Homo sapiens
tccttccatgatgaacaggtt

SEQ ID NO: 150467 - DNA, 20 bp, Homo sapiens
tacaggcgcccataaccacg

SEQ ID NO: 150468 - DNA, 23 bp, Homo sapiens
ttggcttatgtagtggttttttt

SEQ ID NO: 150469 - DNA, 22 bp, Homo sapiens
tctctcagttcccatatggttt

SEQ ID NO: 150470 - DNA, 22 bp, Homo sapiens
tgtctttatatacatatgtgtg

SEQ ID NO: 150471 - DNA, 23 bp, Homo sapiens
tgagttcattgtagattctggat

SEQ ID NO: 150472 - DNA, 23 bp, Homo sapiens
tgagttcattgtagattctggat

SEQ ID NO: 150473 - DNA, 20 bp, Homo sapiens
tatatatgtgtatatgtata

SEQ ID NO: 150474 - DNA, 23 bp, Homo sapiens
tatacatatgtatacatgtatgc

SEQ ID NO: 150475 - DNA, 23 bp, Homo sapiens
tactcactctctctgggtgtgag

SEQ ID NO: 150476 - DNA, 23 bp, Homo sapiens
tgagttcattgtagattctggat

SEQ ID NO: 150477 - DNA, 23 bp, Homo sapiens
tgagttcattgtagattctggat

SEQ ID NO: 150478 - DNA, 23 bp, Homo sapiens
tgtgttgtctgtcagttaccagt

SEQ ID NO: 150479 - DNA, 22 bp, Homo sapiens
acacaaatacagatggtatctt

SEQ ID NO: 150480 - DNA, 23 bp, Homo sapiens
cacgttgttgtcaccatcttgaa

SEQ ID NO: 150481 - DNA, 21 bp, Homo sapiens
cagagcaagatggttgaatag

SEQ ID NO: 150482 - DNA, 23 bp, Homo sapiens
ctggcgcagtggttcatgcctgt

SEQ ID NO: 150483 - DNA, 18 bp, Homo sapiens
tgaagaagctctcagcaa

SEQ ID NO: 150484 - DNA, 23 bp, Homo sapiens
actctgtctgccagcagatgatg

SEQ ID NO: 150485 - DNA, 19 bp, Homo sapiens
ctgagatttggcagaggac

SEQ ID NO: 150486 - DNA, 23 bp, Homo sapiens
ccaaaccgtatcagtcagtgtct

SEQ ID NO: 150487 - DNA, 23 bp, Homo sapiens
cagtgcctctcagtgcctctttg

SEQ ID NO: 150488 - DNA, 18 bp, Homo sapiens
agtgctgggattacaggc

SEQ ID NO: 150489 - DNA, 22 bp, Homo sapiens
tgagccaccgtgcctggctgtg

SEQ ID NO: 150490 - DNA, 23 bp, Homo sapiens
acaggctctcactcactctgttg

SEQ ID NO: 150491 - DNA, 21 bp, Homo sapiens
cagtggcatgatcttggctca

SEQ ID NO: 150492 - DNA, 23 bp, Homo sapiens
cgaagtccaacagatttgagtgg

SEQ ID NO: 150493 - DNA, 23 bp, Homo sapiens
ttctctctgtgtatttgattttt

SEQ ID NO: 150494 - DNA, 23 bp, Homo sapiens
gtgagatcatacagtacagaagt

SEQ ID NO: 150495 - DNA, 23 bp, Homo sapiens
taacagcagctaattatagtgct

SEQ ID NO: 150496 - DNA, 23 bp, Homo sapiens
tacatagtttttaattagctgta

SEQ ID NO: 150497 - DNA, 23 bp, Homo sapiens
tggtagcttgatgcagatggcat

SEQ ID NO: 150498 - DNA, 23 bp, Homo sapiens
tgagttcattgtagattctggat

SEQ ID NO: 150499 - DNA, 23 bp, Homo sapiens
tgagttcattgtagattctggat

SEQ ID NO: 150500 - DNA, 23 bp, Homo sapiens
ttcttcttgagtgaggtttagta

SEQ ID NO: 150501 - DNA, 19 bp, Homo sapiens
caacttttatgatgatgca

SEQ ID NO: 150502 - DNA, 22 bp, Homo sapiens
atatgcatttatttagttgatg

SEQ ID NO: 150503 - DNA, 23 bp, Homo sapiens
tgagttcattgtagattctggat

SEQ ID NO: 150504 - DNA, 23 bp, Homo sapiens
tgagttcattgtagattctggat

SEQ ID NO: 150505 - DNA, 23 bp, Homo sapiens
ttttttggttccatatgaaattt

SEQ ID NO: 150506 - DNA, 21 bp, Homo sapiens
aagtgtaaggcttttgtgcct

SEQ ID NO: 150507 - DNA, 23 bp, Homo sapiens
agtctcgcactgtcactcaggct

SEQ ID NO: 150508 - DNA, 19 bp, Homo sapiens
agagggtcagtgtttgtgg

SEQ ID NO: 150509 - DNA, 21 bp, Homo sapiens
tatatgcttgtatatatatgt

SEQ ID NO: 150510 - DNA, 22 bp, Homo sapiens
agtgtatatatgtgtgtgtgtg

SEQ ID NO: 150511 - DNA, 18 bp, Homo sapiens
agagctattttcactctg

SEQ ID NO: 150512 - DNA, 23 bp, Homo sapiens
tatacatataagtggatacaggt

SEQ ID NO: 150513 - DNA, 23 bp, Homo sapiens
tgtgtgtatgtatatgtatatgt

SEQ ID NO: 150514 - DNA, 23 bp, Homo sapiens
gccagagtctcgctctgtcaccc

SEQ ID NO: 150515 - DNA, 21 bp, Homo sapiens
cacagagttcacacaacctgt

SEQ ID NO: 150516 - DNA, 23 bp, Homo sapiens
tgtacaaccatgtgtctgtgtgt

SEQ ID NO: 150517 - DNA, 19 bp, Homo sapiens
tatatgtatgtatatgtat

SEQ ID NO: 150518 - DNA, 22 bp, Homo sapiens
atatgtgtatatgtatacattt

SEQ ID NO: 150519 - DNA, 23 bp, Homo sapiens
agtttttcttctttagtctgaga

SEQ ID NO: 150520 - DNA, 23 bp, Homo sapiens
attgtctatttcttattgtgtga

SEQ ID NO: 150521 - DNA, 23 bp, Homo sapiens
ttatcacatggaaattaaaaaag

SEQ ID NO: 150522 - DNA, 22 bp, Homo sapiens
tcagacagcttattttagccat

SEQ ID NO: 150523 - DNA, 22 bp, Homo sapiens
tgtctctctctctctacattat

SEQ ID NO: 150524 - DNA, 23 bp, Homo sapiens
gccagagtctcgctctgtcaccc

SEQ ID NO: 150525 - DNA, 19 bp, Homo sapiens
attgatgttcatcaagaat

SEQ ID NO: 150526 - DNA, 23 bp, Homo sapiens
atctctgccaggttttgatatca

SEQ ID NO: 150527 - DNA, 22 bp, Homo sapiens
acatgtgcagaatgtgcaggtt

SEQ ID NO: 150528 - DNA, 23 bp, Homo sapiens
tgagttcattgtagattctggat

SEQ ID NO: 150529 - DNA, 23 bp, Homo sapiens
tgagttcattgtagattctggat

SEQ ID NO: 150530 - DNA, 23 bp, Homo sapiens
tatctctctcactctttttaatg

SEQ ID NO: 150531 - DNA, 20 bp, Homo sapiens
atatgtatatatacatatgt

SEQ ID NO: 150532 - DNA, 23 bp, Homo sapiens
actccatgtctcacatttgggtc

SEQ ID NO: 150533 - DNA, 23 bp, Homo sapiens
tatcacagtgggtgtacacacat

SEQ ID NO: 150534 - DNA, 18 bp, Homo sapiens
ttcaattcatttgagtat

SEQ ID NO: 150535 - DNA, 19 bp, Homo sapiens
tataatcagaagtaaaatt

SEQ ID NO: 150536 - DNA, 20 bp, Homo sapiens
tgatttctgagattttgatg

SEQ ID NO: 150537 - DNA, 19 bp, Homo sapiens
aatgctaaataaaactgat

SEQ ID NO: 150538 - DNA, 23 bp, Homo sapiens
aattaacagaagccacttggatt

SEQ ID NO: 150539 - DNA, 23 bp, Homo sapiens
tcaagaccaattagaatatatgt

SEQ ID NO: 150540 - DNA, 23 bp, Homo sapiens
tctctgtctctgtatgttcatgt

SEQ ID NO: 150541 - DNA, 22 bp, Homo sapiens
atacatgtgtatatgtatatat

SEQ ID NO: 150542 - DNA, 23 bp, Homo sapiens
tatgtgtgtgtatatgtatatat

SEQ ID NO: 150543 - DNA, 23 bp, Homo sapiens
atatatgtatatatgtatatgtg

SEQ ID NO: 150544 - DNA, 23 bp, Homo sapiens
tttaagcatgttagtgatatgat

SEQ ID NO: 150545 - DNA, 20 bp, Homo sapiens
ttgagcttcttggatgttta

SEQ ID NO: 150546 - DNA, 23 bp, Homo sapiens
ctcactgcacctccatctcctgg

SEQ ID NO: 150547 - DNA, 23 bp, Homo sapiens
acttcatgtcactaaactgtaca

SEQ ID NO: 150548 - DNA, 20 bp, Homo sapiens
aaaatggttaaaatggtaca

SEQ ID NO: 150549 - DNA, 20 bp, Homo sapiens
ttactgagacggagtctcgc

SEQ ID NO: 150550 - DNA, 22 bp, Homo sapiens
tctgcctgaggaagtgctcagt

SEQ ID NO: 150551 - DNA, 23 bp, Homo sapiens
attcaagtaatccaggataggct

SEQ ID NO: 150552 - DNA, 23 bp, Homo sapiens
tcttgattacttgtttctggagg

SEQ ID NO: 150553 - DNA, 22 bp, Homo sapiens
tgtttgggtcttgaaacaaggt

SEQ ID NO: 150554 - DNA, 23 bp, Homo sapiens
gtatgtgtatatgcatgtgtgtg

SEQ ID NO: 150555 - DNA, 23 bp, Homo sapiens
tgagttcattgtagattctggat

SEQ ID NO: 150556 - DNA, 23 bp, Homo sapiens
tgagttcattgtagattctggat

SEQ ID NO: 150557 - DNA, 20 bp, Homo sapiens
gcatgaatctctggtagcct

SEQ ID NO: 150558 - DNA, 18 bp, Homo sapiens
tgtgtgccaccatgcctg

SEQ ID NO: 150559 - DNA, 23 bp, Homo sapiens
aaacaagagactcagcatagtgg

SEQ ID NO: 150560 - DNA, 22 bp, Homo sapiens
atgcctgtaattccagcacttt

SEQ ID NO: 150561 - DNA, 21 bp, Homo sapiens
tctgtcacctaaggctcagct

SEQ ID NO: 150562 - DNA, 22 bp, Homo sapiens
caacaagagcgagactccgtct

SEQ ID NO: 150563 - DNA, 23 bp, Homo sapiens
tgagatggagtctctctctgtcg

SEQ ID NO: 150564 - DNA, 22 bp, Homo sapiens
tgagtctgctgtgcctggacag

SEQ ID NO: 150565 - DNA, 18 bp, Homo sapiens
ttgtggatttgttttttt

SEQ ID NO: 150566 - DNA, 23 bp, Homo sapiens
ttttgagacggagtctcgctcag

SEQ ID NO: 150567 - DNA, 21 bp, Homo sapiens
taactgtcataagtcatctct

SEQ ID NO: 150568 - DNA, 23 bp, Homo sapiens
gagcagagagatgaagccaggat

SEQ ID NO: 150569 - DNA, 23 bp, Homo sapiens
tgagttcattgtagattctggat

SEQ ID NO: 150570 - DNA, 23 bp, Homo sapiens
tgagttcattgtagattctggat

SEQ ID NO: 150571 - DNA, 23 bp, Homo sapiens
gacagagtctcgctctgtcaccc

SEQ ID NO: 150572 - DNA, 21 bp, Homo sapiens
ttcagaagagagaagagggga

SEQ ID NO: 150573 - DNA, 23 bp, Homo sapiens
tgctctgtcacccagaatgaaga

SEQ ID NO: 150574 - DNA, 23 bp, Homo sapiens
gataagtgaagtatgtatttcaa

SEQ ID NO: 150575 - DNA, 21 bp, Homo sapiens
tttgagatgcagtcttgctct

SEQ ID NO: 150576 - DNA, 23 bp, Homo sapiens
cagaacagatggagcacagcttc

SEQ ID NO: 150577 - DNA, 20 bp, Homo sapiens
tgactgacccccaggtgctc

SEQ ID NO: 150578 - DNA, 21 bp, Homo sapiens
ttttgagacggagtttcaccc

SEQ ID NO: 150579 - DNA, 19 bp, Homo sapiens
atatgcacatatatatgta

SEQ ID NO: 150580 - DNA, 23 bp, Homo sapiens
tgattgagtcttgctctgtcacc

SEQ ID NO: 150581 - DNA, 23 bp, Homo sapiens
agtacagcagtctctcagctctg

SEQ ID NO: 150582 - DNA, 21 bp, Homo sapiens
agacctgcactgtctgtctct

SEQ ID NO: 150583 - DNA, 21 bp, Homo sapiens
atcagtgtgagaaagatcaag

SEQ ID NO: 150584 - DNA, 23 bp, Homo sapiens
tgtaattaatgttaggtagaaat

SEQ ID NO: 150585 - DNA, 23 bp, Homo sapiens
atttaagtagagatggggtctca

SEQ ID NO: 150586 - DNA, 23 bp, Homo sapiens
ttctggatcaggttgatgtcaca

SEQ ID NO: 150587 - DNA, 18 bp, Homo sapiens
tggaatgatgtatagggc

SEQ ID NO: 150588 - DNA, 23 bp, Homo sapiens
tgtatatatgtatgtatatgtat

SEQ ID NO: 150589 - DNA, 23 bp, Homo sapiens
gtatgtgtgcatgtgcatgtgca

SEQ ID NO: 150590 - DNA, 20 bp, Homo sapiens
acacatgtatcagtatctgc

SEQ ID NO: 150591 - DNA, 23 bp, Homo sapiens
aatatcccctccaaaactcatgt

SEQ ID NO: 150592 - DNA, 23 bp, Homo sapiens
tataacagtattgagagaggaga

SEQ ID NO: 150593 - DNA, 19 bp, Homo sapiens
taagaaatagagatggggt

SEQ ID NO: 150594 - DNA, 23 bp, Homo sapiens
agtcagagtctcactctgttgct

SEQ ID NO: 150595 - DNA, 20 bp, Homo sapiens
agtgcagtgacacaatcagg

SEQ ID NO: 150596 - DNA, 23 bp, Homo sapiens
tgtcatttgtatgtcttcctttg

SEQ ID NO: 150597 - DNA, 23 bp, Homo sapiens
gaagtcttttgaggttctataca

SEQ ID NO: 150598 - DNA, 23 bp, Homo sapiens
tgtgaagaatgtcattggtgttt

SEQ ID NO: 150599 - DNA, 23 bp, Homo sapiens
tgagttcattgtagattctggat

SEQ ID NO: 150600 - DNA, 23 bp, Homo sapiens
tgagttcattgtagattctggat

SEQ ID NO: 150601 - DNA, 21 bp, Homo sapiens
gatctctttcactgtctcagt

SEQ ID NO: 150602 - DNA, 20 bp, Homo sapiens
tgagagagccttaggatttg

SEQ ID NO: 150603 - DNA, 19 bp, Homo sapiens
tatgtttatcatatctctt

SEQ ID NO: 150604 - DNA, 22 bp, Homo sapiens
atataatctagagagaagaaga

SEQ ID NO: 150605 - DNA, 21 bp, Homo sapiens
aaaagtctatttcattttttg

SEQ ID NO: 150606 - DNA, 23 bp, Homo sapiens
tattttgttttgttttgagacag

SEQ ID NO: 150607 - DNA, 21 bp, Homo sapiens
tttgtaatgaaatcattgcca

SEQ ID NO: 150608 - DNA, 22 bp, Homo sapiens
actgaagtgtatgtgtttaaat

SEQ ID NO: 150609 - DNA, 22 bp, Homo sapiens
tttatggatatatagataaaca

SEQ ID NO: 150610 - DNA, 19 bp, Homo sapiens
tttaagtcaagtccctacc

SEQ ID NO: 150611 - DNA, 23 bp, Homo sapiens
ctcccagagcccctggaactctg

SEQ ID NO: 150612 - DNA, 21 bp, Homo sapiens
tctgcttaaggtgctctatga

SEQ ID NO: 150613 - DNA, 21 bp, Homo sapiens
agtctcatggattttctttct

SEQ ID NO: 150614 - DNA, 23 bp, Homo sapiens
tgagttcattgtagattctggat

SEQ ID NO: 150615 - DNA, 23 bp, Homo sapiens
tgagttcattgtagattctggat

SEQ ID NO: 150616 - DNA, 23 bp, Homo sapiens
aaatttgatctagtagtaggttc

SEQ ID NO: 150617 - DNA, 23 bp, Homo sapiens
gtctgtctgtctgtctctggtca

SEQ ID NO: 150618 - DNA, 18 bp, Homo sapiens
ttttggtcaggctctagt

SEQ ID NO: 150619 - DNA, 23 bp, Homo sapiens
tcttagtctctctctctctgagc

SEQ ID NO: 150620 - DNA, 21 bp, Homo sapiens
aaggcagtggaagtatggagt

SEQ ID NO: 150621 - DNA, 23 bp, Homo sapiens
gtgtgtatatatgtatatgtgtg

SEQ ID NO: 150622 - DNA, 18 bp, Homo sapiens
atatatatgtatatgtgt

SEQ ID NO: 150623 - DNA, 23 bp, Homo sapiens
ctctctcagactaattgcttcct

SEQ ID NO: 150624 - DNA, 18 bp, Homo sapiens
ggttgcagtgagctatga

SEQ ID NO: 150625 - DNA, 23 bp, Homo sapiens
tgagatggagtctcactctgtcg

SEQ ID NO: 150626 - DNA, 22 bp, Homo sapiens
agacttgagagctgaaatgact

SEQ ID NO: 150627 - DNA, 18 bp, Homo sapiens
caacatagtgagagccca

SEQ ID NO: 150628 - DNA, 23 bp, Homo sapiens
tgagacagagttttcactctgtc

SEQ ID NO: 150629 - DNA, 18 bp, Homo sapiens
agagtacaagattctttt

SEQ ID NO: 150630 - DNA, 23 bp, Homo sapiens
tcagagtctcactctgtcactct

SEQ ID NO: 150631 - DNA, 23 bp, Homo sapiens
agacagagtctcactctgtcgcc

SEQ ID NO: 150632 - DNA, 23 bp, Homo sapiens
gttctaggttcattttcttctct

SEQ ID NO: 150633 - DNA, 23 bp, Homo sapiens
tgagatggagtctggctctgtcg

SEQ ID NO: 150634 - DNA, 23 bp, Homo sapiens
tcacaggggatatggaatgagat

SEQ ID NO: 150635 - DNA, 23 bp, Homo sapiens
tgggtctctgacactgttcctct

SEQ ID NO: 150636 - DNA, 23 bp, Homo sapiens
atatatgtattactgtataacat

SEQ ID NO: 150637 - DNA, 23 bp, Homo sapiens
tgagagtctgtctatgttgaagc

SEQ ID NO: 150638 - DNA, 18 bp, Homo sapiens
cagacacagacactcact

SEQ ID NO: 150639 - DNA, 20 bp, Homo sapiens
gatacagcaaaacttattct

SEQ ID NO: 150640 - DNA, 21 bp, Homo sapiens
tgagatggagtctcgctctgt

SEQ ID NO: 150641 - DNA, 23 bp, Homo sapiens
tttgagaccgagtctcactctgt

SEQ ID NO: 150642 - DNA, 23 bp, Homo sapiens
actgtggctgtgagtccctccca

SEQ ID NO: 150643 - DNA, 23 bp, Homo sapiens
tgagagacagtctctctctgctg

SEQ ID NO: 150644 - DNA, 23 bp, Homo sapiens
ctctagagtctctctgtctcatt

SEQ ID NO: 150645 - DNA, 23 bp, Homo sapiens
cagtctctgtctctgtctctgtg

SEQ ID NO: 150646 - DNA, 23 bp, Homo sapiens
acagagtctcactctgtcgccca

SEQ ID NO: 150647 - DNA, 23 bp, Homo sapiens
tgagacagtctcactttgttgcc

SEQ ID NO: 150648 - DNA, 23 bp, Homo sapiens
tgtagtcccagctattcaggagg

SEQ ID NO: 150649 - DNA, 22 bp, Homo sapiens
taagtcactgcctcattttgcc

SEQ ID NO: 150650 - DNA, 23 bp, Homo sapiens
ctgtctgtgtgtctgtgtgcctc

SEQ ID NO: 150651 - DNA, 23 bp, Homo sapiens
agactgtctcactgtcttgggac

SEQ ID NO: 150652 - DNA, 23 bp, Homo sapiens
aaagatactctctgaaatcatat

SEQ ID NO: 150653 - DNA, 23 bp, Homo sapiens
agaatctcactctgtctcccagg

SEQ ID NO: 150654 - DNA, 18 bp, Homo sapiens
acagtggtgtgatctcag

SEQ ID NO: 150655 - DNA, 22 bp, Homo sapiens
ttggacaggaagaaagttgcat

SEQ ID NO: 150656 - DNA, 23 bp, Homo sapiens
ttttgttttcaatcagtggaagt

SEQ ID NO: 150657 - DNA, 23 bp, Homo sapiens
ctcactgtgcctctgtgtcaccc

SEQ ID NO: 150658 - DNA, 23 bp, Homo sapiens
gtatctcacccagctttggacag

SEQ ID NO: 150659 - DNA, 21 bp, Homo sapiens
agacactagactgtgagctca

SEQ ID NO: 150660 - DNA, 23 bp, Homo sapiens
aagcttctctgggtgagtcagtg

SEQ ID NO: 150661 - DNA, 22 bp, Homo sapiens
agccaggcatggttgtgtgcgc

SEQ ID NO: 150662 - DNA, 23 bp, Homo sapiens
tggagtctcactctgtcacccag

SEQ ID NO: 150663 - DNA, 22 bp, Homo sapiens
ttcattcctccagtatagttta

SEQ ID NO: 150664 - DNA, 19 bp, Homo sapiens
tgtgtaagaatcctgtatg

SEQ ID NO: 150665 - DNA, 23 bp, Homo sapiens
acagagtctcactctgtcgccca

SEQ ID NO: 150666 - DNA, 19 bp, Homo sapiens
aaaaaagttgaaggagtag

SEQ ID NO: 150667 - DNA, 23 bp, Homo sapiens
gggtgacagagtgagactctgtc

SEQ ID NO: 150668 - DNA, 21 bp, Homo sapiens
tctcaccctgtcacccaggct

SEQ ID NO: 150669 - DNA, 19 bp, Homo sapiens
attgctagatcaaagaata

SEQ ID NO: 150670 - DNA, 23 bp, Homo sapiens
taggaggcagaagttgcagtgag

SEQ ID NO: 150671 - DNA, 20 bp, Homo sapiens
tacatgtgtgtttatgtata

SEQ ID NO: 150672 - DNA, 23 bp, Homo sapiens
tcgctctgtcactcagactggag

SEQ ID NO: 150673 - DNA, 21 bp, Homo sapiens
agagtctcaagtgttttcctt

SEQ ID NO: 150674 - DNA, 22 bp, Homo sapiens
gacagggtgttgctctgtgacc

SEQ ID NO: 150675 - DNA, 23 bp, Homo sapiens
aacttctattaggatcttgctca

SEQ ID NO: 150676 - DNA, 23 bp, Homo sapiens
cactgcaacctctgtctgtctcc

SEQ ID NO: 150677 - DNA, 23 bp, Homo sapiens
agtctgaccataaaaaagcctga

SEQ ID NO: 150678 - DNA, 23 bp, Homo sapiens
catgtgtggacaagagtgtgtct

SEQ ID NO: 150679 - DNA, 23 bp, Homo sapiens
tgagttggagttttgctcttgtc

SEQ ID NO: 150680 - DNA, 23 bp, Homo sapiens
aatctcggctcactgtttcctct

SEQ ID NO: 150681 - DNA, 23 bp, Homo sapiens
tgtctctgtctctgcctcagacc

SEQ ID NO: 150682 - DNA, 23 bp, Homo sapiens
tcggtgtctcaggctctctttct

SEQ ID NO: 150683 - DNA, 23 bp, Homo sapiens
agagtctcactctgtcacccagg

SEQ ID NO: 150684 - DNA, 23 bp, Homo sapiens
tgactatctctctctctgactct

SEQ ID NO: 150685 - DNA, 23 bp, Homo sapiens
attgagcatgttctttgctgttc

SEQ ID NO: 150686 - DNA, 23 bp, Homo sapiens
acagtaacagctaatatttattg

SEQ ID NO: 150687 - DNA, 23 bp, Homo sapiens
tttctctctctctctgtcatcag

SEQ ID NO: 150688 - DNA, 21 bp, Homo sapiens
tgacctctctctctctctcct

SEQ ID NO: 150689 - DNA, 22 bp, Homo sapiens
gagacagtctcgctgtgtcact

SEQ ID NO: 150690 - DNA, 23 bp, Homo sapiens
tgagacacagctatgtttcaagg

SEQ ID NO: 150691 - DNA, 23 bp, Homo sapiens
acagagtctcgcactgtcaccca

SEQ ID NO: 150692 - DNA, 23 bp, Homo sapiens
agtcacgctgttgatcaggttgt

SEQ ID NO: 150693 - DNA, 21 bp, Homo sapiens
tctgtctgtctgtctgtctgt

SEQ ID NO: 150694 - DNA, 21 bp, Homo sapiens
taggtgggcatggtgcacctg

SEQ ID NO: 150695 - DNA, 21 bp, Homo sapiens
tttctcagtctgtcagtctct

SEQ ID NO: 150696 - DNA, 23 bp, Homo sapiens
tgcagacactgtgcacacaggtg

SEQ ID NO: 150697 - DNA, 21 bp, Homo sapiens
aacacctgtgtgtcctgtgtg

SEQ ID NO: 150698 - DNA, 20 bp, Homo sapiens
tatagcatgagtgtatgttt

SEQ ID NO: 150699 - DNA, 18 bp, Homo sapiens
agtctcgctctgtcaccc

SEQ ID NO: 150700 - DNA, 23 bp, Homo sapiens
tggagtctcactgtgtctcccag

SEQ ID NO: 150701 - DNA, 23 bp, Homo sapiens
gagtctcactctgtcacccaggc

SEQ ID NO: 150702 - DNA, 23 bp, Homo sapiens
tacatgtatatatgtatatgtga

SEQ ID NO: 150703 - DNA, 23 bp, Homo sapiens
ctcactcagcaagtggatgtgtt

SEQ ID NO: 150704 - DNA, 23 bp, Homo sapiens
gagtgtgcatgtgcatgtgtgtg

SEQ ID NO: 150705 - DNA, 23 bp, Homo sapiens
atgtatgtgtgcatatgcatgta

SEQ ID NO: 150706 - DNA, 22 bp, Homo sapiens
tatagtacaatgtttaatagaa

SEQ ID NO: 150707 - DNA, 23 bp, Homo sapiens
tgagttcattgtagattctggat

SEQ ID NO: 150708 - DNA, 21 bp, Homo sapiens
tatattctgtttctataatga

SEQ ID NO: 150709 - DNA, 19 bp, Homo sapiens
tgagatggagtctcactct

SEQ ID NO: 150710 - DNA, 23 bp, Homo sapiens
ttggtctgactggtatctccatc

SEQ ID NO: 150711 - DNA, 23 bp, Homo sapiens
tatttctctcactcactgtgggc

SEQ ID NO: 150712 - DNA, 23 bp, Homo sapiens
agctgtggctctcagggtctctg

SEQ ID NO: 150713 - DNA, 23 bp, Homo sapiens
gaggctctctgacaatctgtctc

SEQ ID NO: 150714 - DNA, 23 bp, Homo sapiens
ctgtgtgtctgtccgtctgtctg

SEQ ID NO: 150715 - DNA, 19 bp, Homo sapiens
tcacttcctctctgattac

SEQ ID NO: 150716 - DNA, 23 bp, Homo sapiens
agagaggaagtgacatgtccaag

SEQ ID NO: 150717 - DNA, 23 bp, Homo sapiens
tgtctggctctgtgcctgtctct

SEQ ID NO: 150718 - DNA, 22 bp, Homo sapiens
aaggggttgatttgattctgtg

SEQ ID NO: 150719 - DNA, 19 bp, Homo sapiens
atacacacatatgtgtaaa

SEQ ID NO: 150720 - DNA, 21 bp, Homo sapiens
atacacatacatatatatgtg

SEQ ID NO: 150721 - DNA, 19 bp, Homo sapiens
ttggtttatttgttaagct

SEQ ID NO: 150722 - DNA, 23 bp, Homo sapiens
tgttattgtgtatatctttatgt

SEQ ID NO: 150723 - DNA, 22 bp, Homo sapiens
tctcagatgagactgtggactt

SEQ ID NO: 150724 - DNA, 23 bp, Homo sapiens
ttatgtcactcagattttgacag

SEQ ID NO: 150725 - DNA, 22 bp, Homo sapiens
tttcttttgacaggattggaat

SEQ ID NO: 150726 - DNA, 23 bp, Homo sapiens
tgtgctgcataacatttcagtat

SEQ ID NO: 150727 - DNA, 19 bp, Homo sapiens
tgattagtttgaaaattta

SEQ ID NO: 150728 - DNA, 21 bp, Homo sapiens
ttgagagatggagtctcactc

SEQ ID NO: 150729 - DNA, 22 bp, Homo sapiens
tgagatggagtttcacttttgt

SEQ ID NO: 150730 - DNA, 23 bp, Homo sapiens
atctatgtatatctgtatatgta

SEQ ID NO: 150731 - DNA, 19 bp, Homo sapiens
tatacacacagacacatac

SEQ ID NO: 150732 - DNA, 20 bp, Homo sapiens
taatgatcctgttttggaaa

SEQ ID NO: 150733 - DNA, 23 bp, Homo sapiens
tggctctctgtttgtctgtctgt

SEQ ID NO: 150734 - DNA, 23 bp, Homo sapiens
cggttttgagtgagtttcttttt

SEQ ID NO: 150735 - DNA, 23 bp, Homo sapiens
tgaggcggagtctcactctatca

SEQ ID NO: 150736 - DNA, 23 bp, Homo sapiens
ttttgaagttgttgatctgcact

SEQ ID NO: 150737 - DNA, 18 bp, Homo sapiens
aggagtttgagataggtc

SEQ ID NO: 150738 - DNA, 23 bp, Homo sapiens
tattacaggttataatatcttct

SEQ ID NO: 150739 - DNA, 22 bp, Homo sapiens
tatgtatacacatgtacatgta

SEQ ID NO: 150740 - DNA, 23 bp, Homo sapiens
tagtttactgagtttcttgtttt

SEQ ID NO: 150741 - DNA, 20 bp, Homo sapiens
acacacacatatgtgtgtgt

SEQ ID NO: 150742 - DNA, 18 bp, Homo sapiens
ttcacttttttttttgga

SEQ ID NO: 150743 - DNA, 23 bp, Homo sapiens
tgctgctctcaagatttcctcct

SEQ ID NO: 150744 - DNA, 23 bp, Homo sapiens
tttttcttgttcagcatctgaag

SEQ ID NO: 150745 - DNA, 22 bp, Homo sapiens
aggattcctcatgagtggcttg

SEQ ID NO: 150746 - DNA, 23 bp, Homo sapiens
ttctctctggatcttgctctttg

SEQ ID NO: 150747 - DNA, 22 bp, Homo sapiens
tttcacagagtagatgacgtgc

SEQ ID NO: 150748 - DNA, 21 bp, Homo sapiens
tctgagaccatatagtttcca

SEQ ID NO: 150749 - DNA, 18 bp, Homo sapiens
acagactttggtatctgg

SEQ ID NO: 150750 - DNA, 23 bp, Homo sapiens
ataggagcttggactctattgtg

SEQ ID NO: 150751 - DNA, 23 bp, Homo sapiens
tttgaatctatgtgtgtgtgtgt

SEQ ID NO: 150752 - DNA, 23 bp, Homo sapiens
taatgtagtctctccttgtcttt

SEQ ID NO: 150753 - DNA, 23 bp, Homo sapiens
tgagttcattgtagattctggat

SEQ ID NO: 150754 - DNA, 23 bp, Homo sapiens
tgagttcattgtagattctggat

SEQ ID NO: 150755 - DNA, 23 bp, Homo sapiens
tctgtgaagaaagtcaatggtag

SEQ ID NO: 150756 - DNA, 23 bp, Homo sapiens
ttttattgagattttcttgaatc

SEQ ID NO: 150757 - DNA, 23 bp, Homo sapiens
aataagaactatatgtatctgtg

SEQ ID NO: 150758 - DNA, 23 bp, Homo sapiens
atatgtgtatatgtatacacgta

SEQ ID NO: 150759 - DNA, 21 bp, Homo sapiens
aaagattttctttatctgaga

SEQ ID NO: 150760 - DNA, 20 bp, Homo sapiens
ttcaacagatagagaattct

SEQ ID NO: 150761 - DNA, 23 bp, Homo sapiens
tgtgtgtgtatgtgtgtgcgtgt

SEQ ID NO: 150762 - DNA, 23 bp, Homo sapiens
attgattgtagattcaggcttgt

SEQ ID NO: 150763 - DNA, 21 bp, Homo sapiens
tcatagtatgtctgtatagga

SEQ ID NO: 150764 - DNA, 23 bp, Homo sapiens
atgcaaaaatagatttctgtgct

SEQ ID NO: 150765 - DNA, 23 bp, Homo sapiens
tttgtgagggatattggtctgta

SEQ ID NO: 150766 - DNA, 23 bp, Homo sapiens
ttcttgtgatgtctttatgtagt

SEQ ID NO: 150767 - DNA, 23 bp, Homo sapiens
tatacttgtctatttcttgacct

SEQ ID NO: 150768 - DNA, 21 bp, Homo sapiens
cttattagaaaaggaagacta

SEQ ID NO: 150769 - DNA, 23 bp, Homo sapiens
cagggtctcactctgtctcccag

SEQ ID NO: 150770 - DNA, 21 bp, Homo sapiens
agaaatgaaaggaagtctgac

SEQ ID NO: 150771 - DNA, 21 bp, Homo sapiens
agagggatacatttctgacat

SEQ ID NO: 150772 - DNA, 23 bp, Homo sapiens
ttggaccttcaagaatgcataga

SEQ ID NO: 150773 - DNA, 18 bp, Homo sapiens
tttcagggggtacatgtg

SEQ ID NO: 150774 - DNA, 20 bp, Homo sapiens
tcttttttagttttaaggag

SEQ ID NO: 150775 - DNA, 23 bp, Homo sapiens
tctgttactgtgtggttatctaa

SEQ ID NO: 150776 - DNA, 23 bp, Homo sapiens
tgagttcattgtagattctggat

SEQ ID NO: 150777 - DNA, 23 bp, Homo sapiens
tgagttcattgtagattctggat

SEQ ID NO: 150778 - DNA, 23 bp, Homo sapiens
tgagttcattgtagattctggat

SEQ ID NO: 150779 - DNA, 23 bp, Homo sapiens
tgagttcattgtagattctggat

SEQ ID NO: 150780 - DNA, 18 bp, Homo sapiens
tgtgcattatatatgtag

SEQ ID NO: 150781 - DNA, 23 bp, Homo sapiens
taatctttgaatgcacacatttt

SEQ ID NO: 150782 - DNA, 21 bp, Homo sapiens
tgtcctaatagttacttttct

SEQ ID NO: 150783 - DNA, 23 bp, Homo sapiens
tattagagatgagcttctcaagt

SEQ ID NO: 150784 - DNA, 23 bp, Homo sapiens
tttaaagatgataacgttgtctt

SEQ ID NO: 150785 - DNA, 23 bp, Homo sapiens
tagaaggagaagatgtttctgag

SEQ ID NO: 150786 - DNA, 21 bp, Homo sapiens
ctctggcactgactggctgtg

SEQ ID NO: 150787 - DNA, 23 bp, Homo sapiens
tttgactgagaaggtagttttat

SEQ ID NO: 150788 - DNA, 23 bp, Homo sapiens
actgacagcactacttgttttat

SEQ ID NO: 150789 - DNA, 23 bp, Homo sapiens
tgacaagagtgactgatcacatg

SEQ ID NO: 150790 - DNA, 23 bp, Homo sapiens
tgtatgtgtgtgtgtgtagagtc

SEQ ID NO: 150791 - DNA, 20 bp, Homo sapiens
tacctcctttcacagttcaa

SEQ ID NO: 150792 - DNA, 23 bp, Homo sapiens
tttgacaggcaatttgaggggat

SEQ ID NO: 150793 - DNA, 23 bp, Homo sapiens
tgagacagagtctcgctctgtca

SEQ ID NO: 150794 - DNA, 22 bp, Homo sapiens
tgagacagggtctcactctgtt

SEQ ID NO: 150795 - DNA, 18 bp, Homo sapiens
tatgtgtgtatgcatgtg

SEQ ID NO: 150796 - DNA, 23 bp, Homo sapiens
accctagataaaggtctctctct

SEQ ID NO: 150797 - DNA, 22 bp, Homo sapiens
aaactctcccacagtgcctttc

SEQ ID NO: 150798 - DNA, 22 bp, Homo sapiens
gagtgtctctcttctgcaggga

SEQ ID NO: 150799 - DNA, 19 bp, Homo sapiens
tttttccaccactggatgg

SEQ ID NO: 150800 - DNA, 23 bp, Homo sapiens
ctttgcacttctgtgaattttca

SEQ ID NO: 150801 - DNA, 23 bp, Homo sapiens
ccctctctggctgtgagagccac

SEQ ID NO: 150802 - DNA, 23 bp, Homo sapiens
tatgaagaatggaactgtactga

SEQ ID NO: 150803 - DNA, 18 bp, Homo sapiens
tacactgtgtgtgtatat

SEQ ID NO: 150804 - DNA, 23 bp, Homo sapiens
tttgtagttcttgaggaggtcct

SEQ ID NO: 150805 - DNA, 19 bp, Homo sapiens
agtttgctcatgatttggc

SEQ ID NO: 150806 - DNA, 23 bp, Homo sapiens
ttcaccagttttgtgatagcatt

SEQ ID NO: 150807 - DNA, 23 bp, Homo sapiens
tgagttcattgtagattctggat

SEQ ID NO: 150808 - DNA, 23 bp, Homo sapiens
tgagttcattgtagattctggat

SEQ ID NO: 150809 - DNA, 23 bp, Homo sapiens
aaacatgtgcatttgatattctg

SEQ ID NO: 150810 - DNA, 18 bp, Homo sapiens
aggtagacagataaagag

SEQ ID NO: 150811 - DNA, 23 bp, Homo sapiens
actaaagttgaacattgtctact

SEQ ID NO: 150812 - DNA, 23 bp, Homo sapiens
agagtctcaccctgtcacccagg

SEQ ID NO: 150813 - DNA, 23 bp, Homo sapiens
aagtaggactgtgtgatacaact

SEQ ID NO: 150814 - DNA, 21 bp, Homo sapiens
atctttctttttgttattcac

SEQ ID NO: 150815 - DNA, 22 bp, Homo sapiens
tttgtgcacattgagaatgtct

SEQ ID NO: 150816 - DNA, 22 bp, Homo sapiens
taacagtacattgtgaggtcaa

SEQ ID NO: 150817 - DNA, 23 bp, Homo sapiens
atgtatgcatgtatatatgtaag

SEQ ID NO: 150818 - DNA, 22 bp, Homo sapiens
tttttggttgtttttgaaggca

SEQ ID NO: 150819 - DNA, 20 bp, Homo sapiens
tgggatgtgaatgccaatgg

SEQ ID NO: 150820 - DNA, 23 bp, Homo sapiens
tgagttcattgtagattctggat

SEQ ID NO: 150821 - DNA, 23 bp, Homo sapiens
tgagttcattgtagattctggat

SEQ ID NO: 150822 - DNA, 23 bp, Homo sapiens
tactgattctgtgttagttgtat

SEQ ID NO: 150823 - DNA, 20 bp, Homo sapiens
atagtgtctgatatagaata

SEQ ID NO: 150824 - DNA, 22 bp, Homo sapiens
attatggtagattattctcttt

SEQ ID NO: 150825 - DNA, 22 bp, Homo sapiens
atggttacatattcatatctat

SEQ ID NO: 150826 - DNA, 23 bp, Homo sapiens
tgagttcattgtagattctggat

SEQ ID NO: 150827 - DNA, 23 bp, Homo sapiens
tgagttcattgtagattctggat

SEQ ID NO: 150828 - DNA, 21 bp, Homo sapiens
tacaggtatataaacatatgt

SEQ ID NO: 150829 - DNA, 21 bp, Homo sapiens
atacatacaggtatatataca

SEQ ID NO: 150830 - DNA, 20 bp, Homo sapiens
atatacaggtatatatacag

SEQ ID NO: 150831 - DNA, 21 bp, Homo sapiens
cttcaatttaatagtagaaag

SEQ ID NO: 150832 - DNA, 20 bp, Homo sapiens
aatctgatttttttttaatc

SEQ ID NO: 150833 - DNA, 23 bp, Homo sapiens
aagctgtggaattgtgttgttga

SEQ ID NO: 150834 - DNA, 18 bp, Homo sapiens
tatacacatatatatgta

SEQ ID NO: 150835 - DNA, 23 bp, Homo sapiens
aatgacattacatgaaattacat

SEQ ID NO: 150836 - DNA, 21 bp, Homo sapiens
tcatgtcatgttattaacctc

SEQ ID NO: 150837 - DNA, 21 bp, Homo sapiens
aatgtgcagattactaacaag

SEQ ID NO: 150838 - DNA, 23 bp, Homo sapiens
ttctgtatagattttgatctttc

SEQ ID NO: 150839 - DNA, 21 bp, Homo sapiens
attacttttaggaaggtctag

SEQ ID NO: 150840 - DNA, 22 bp, Homo sapiens
ttttgagacagagtctcactct

SEQ ID NO: 150841 - DNA, 23 bp, Homo sapiens
catgcctctggtagaattcagct

SEQ ID NO: 150842 - DNA, 23 bp, Homo sapiens
tgagttcattgtagattctggat

SEQ ID NO: 150843 - DNA, 23 bp, Homo sapiens
tgagttcattgtagattctggat

SEQ ID NO: 150844 - DNA, 23 bp, Homo sapiens
aaatcattcctatacttctcact

SEQ ID NO: 150845 - DNA, 23 bp, Homo sapiens
gtctcactctgtctgtcacccag

SEQ ID NO: 150846 - DNA, 23 bp, Homo sapiens
tgactgagtgataaacttatcct

SEQ ID NO: 150847 - DNA, 19 bp, Homo sapiens
tgagagagaggtatgtttc

SEQ ID NO: 150848 - DNA, 19 bp, Homo sapiens
agtgatggaattgccatgt

SEQ ID NO: 150849 - DNA, 23 bp, Homo sapiens
tatgtattgttatcttattgtag

SEQ ID NO: 150850 - DNA, 21 bp, Homo sapiens
tcactgcctgtgtctatggca

SEQ ID NO: 150851 - DNA, 23 bp, Homo sapiens
catatatatgctatatattatgt

SEQ ID NO: 150852 - DNA, 21 bp, Homo sapiens
tattatggtgaaaaaggaaat

SEQ ID NO: 150853 - DNA, 22 bp, Homo sapiens
aaagtgctaggattacaggagt

SEQ ID NO: 150854 - DNA, 18 bp, Homo sapiens
aaattgtatatgttaggc

SEQ ID NO: 150855 - DNA, 22 bp, Homo sapiens
ttggaaagaaatcaagtgtgta

SEQ ID NO: 150856 - DNA, 22 bp, Homo sapiens
tgacttgtttttgtctaagaca

SEQ ID NO: 150857 - DNA, 21 bp, Homo sapiens
atgtggaattccagcaccttg

SEQ ID NO: 150858 - DNA, 23 bp, Homo sapiens
tgtatgtggatatattaagttgt

SEQ ID NO: 150859 - DNA, 22 bp, Homo sapiens
acctcaacagattgtatcctca

SEQ ID NO: 150860 - DNA, 20 bp, Homo sapiens
atgcatatatacgtgtatat

SEQ ID NO: 150861 - DNA, 20 bp, Homo sapiens
acacgtatatatatgtgtat

SEQ ID NO: 150862 - DNA, 23 bp, Homo sapiens
tctcacagagttaaacctctctt

SEQ ID NO: 150863 - DNA, 23 bp, Homo sapiens
agcttcagataaaaactagaaag

SEQ ID NO: 150864 - DNA, 23 bp, Homo sapiens
tctcacagacttaaacttctttt

SEQ ID NO: 150865 - DNA, 23 bp, Homo sapiens
gacagactgtcactgtgtcaacc

SEQ ID NO: 150866 - DNA, 23 bp, Homo sapiens
atgttgagcatttttatttatgt

SEQ ID NO: 150867 - DNA, 18 bp, Homo sapiens
tgccatctgtatatcttt

SEQ ID NO: 150868 - DNA, 22 bp, Homo sapiens
acatgtgcagaatgtgcaggtt

SEQ ID NO: 150869 - DNA, 22 bp, Homo sapiens
atcactcccaacttagctcttt

SEQ ID NO: 150870 - DNA, 23 bp, Homo sapiens
gtgaagtgtgtttcttgtaggca

SEQ ID NO: 150871 - DNA, 22 bp, Homo sapiens
agagactacatggaaaaaactt

SEQ ID NO: 150872 - DNA, 20 bp, Homo sapiens
acacacacacacacatacgt

SEQ ID NO: 150873 - DNA, 21 bp, Homo sapiens
aattctttagtatatttagta

SEQ ID NO: 150874 - DNA, 23 bp, Homo sapiens
gctggaagatgaggccaaagctg

SEQ ID NO: 150875 - DNA, 22 bp, Homo sapiens
gcgtcagcacctcaatctggat

SEQ ID NO: 150876 - DNA, 21 bp, Homo sapiens
gagtctcactctgtcgcacag

SEQ ID NO: 150877 - DNA, 23 bp, Homo sapiens
tggagtctcactctgtcacccag

SEQ ID NO: 150878 - DNA, 21 bp, Homo sapiens
agttttacagaaacattactg

SEQ ID NO: 150879 - DNA, 23 bp, Homo sapiens
tgtgtgtctgtgtcacattttgg

SEQ ID NO: 150880 - DNA, 23 bp, Homo sapiens
acagagtctcactctgtcgccca

SEQ ID NO: 150881 - DNA, 23 bp, Homo sapiens
gacagagtctcactctctcgccc

SEQ ID NO: 150882 - DNA, 21 bp, Homo sapiens
tgtgacatttcagcttttttt

SEQ ID NO: 150883 - DNA, 23 bp, Homo sapiens
tgagaaggagtctggctctgtcg

SEQ ID NO: 150884 - DNA, 23 bp, Homo sapiens
tgtgtaggaggatgtgagtaggt

SEQ ID NO: 150885 - DNA, 19 bp, Homo sapiens
aacagagtagtaatctctt

SEQ ID NO: 150886 - DNA, 22 bp, Homo sapiens
aggagtctcgctctgtcacccg

SEQ ID NO: 150887 - DNA, 18 bp, Homo sapiens
tggcgtgatctcggctta

SEQ ID NO: 150888 - DNA, 21 bp, Homo sapiens
cagtctggagagtatgtgatt

SEQ ID NO: 150889 - DNA, 23 bp, Homo sapiens
tgagacggagtctcgctcagtca

SEQ ID NO: 150890 - DNA, 23 bp, Homo sapiens
attcaactttgtcaggttacaaa

SEQ ID NO: 150891 - DNA, 18 bp, Homo sapiens
tttcttctggaatgccta

SEQ ID NO: 150892 - DNA, 23 bp, Homo sapiens
ttattgcttctgcttctcatgtg

SEQ ID NO: 150893 - DNA, 21 bp, Homo sapiens
ttttgagacggagtctcactc

SEQ ID NO: 150894 - DNA, 22 bp, Homo sapiens
atgtgtaaattgtggagtgagc

SEQ ID NO: 150895 - DNA, 23 bp, Homo sapiens
ttgtgtgctcattgtgtggttaa

SEQ ID NO: 150896 - DNA, 22 bp, Homo sapiens
atagtcaaacatatatgtgtgt

SEQ ID NO: 150897 - DNA, 23 bp, Homo sapiens
taatcactctggaagacaccact

SEQ ID NO: 150898 - DNA, 21 bp, Homo sapiens
tggtttggttctgtgtccccc

SEQ ID NO: 150899 - DNA, 23 bp, Homo sapiens
acagctttgtgtgtctctgtcat

SEQ ID NO: 150900 - DNA, 23 bp, Homo sapiens
aagacagatgagtgactgcaatg

SEQ ID NO: 150901 - DNA, 22 bp, Homo sapiens
tgtctgtatatgtatatgtatg

SEQ ID NO: 150902 - DNA, 19 bp, Homo sapiens
cacatgtatgtgtatgtgt

SEQ ID NO: 150903 - DNA, 23 bp, Homo sapiens
ggtggatttaagaaacttgctca

SEQ ID NO: 150904 - DNA, 23 bp, Homo sapiens
agagctagtaagttgtacatttg

SEQ ID NO: 150905 - DNA, 21 bp, Homo sapiens
gtaaaactttctacaaatgaa

SEQ ID NO: 150906 - DNA, 19 bp, Homo sapiens
caatccttagttgcagttg

SEQ ID NO: 150907 - DNA, 22 bp, Homo sapiens
cagaatatgcactaagtgaata

SEQ ID NO: 150908 - DNA, 21 bp, Homo sapiens
agcacagtttcatttgtttac

SEQ ID NO: 150909 - DNA, 20 bp, Homo sapiens
aaaacatcctgctcaggatc

SEQ ID NO: 150910 - DNA, 23 bp, Homo sapiens
aatggccattttgattggtgtaa

SEQ ID NO: 150911 - DNA, 23 bp, Homo sapiens
tgagttcattgtagattctggat

SEQ ID NO: 150912 - DNA, 23 bp, Homo sapiens
tgagttcattgtagattctggat

SEQ ID NO: 150913 - DNA, 23 bp, Homo sapiens
tgagttcattgtagattctggat

SEQ ID NO: 150914 - DNA, 23 bp, Homo sapiens
tgagttcattgtagattctggat

SEQ ID NO: 150915 - DNA, 23 bp, Homo sapiens
tgagaccaagttttgctcttgtt

SEQ ID NO: 150916 - DNA, 23 bp, Homo sapiens
tgagttcattgtagattctggat

SEQ ID NO: 150917 - DNA, 23 bp, Homo sapiens
tgagttcattgtagattctggat

SEQ ID NO: 150918 - DNA, 21 bp, Homo sapiens
attagtgctgagtgtgttctg

SEQ ID NO: 150919 - DNA, 20 bp, Homo sapiens
tttagcttttcaagatataa

SEQ ID NO: 150920 - DNA, 23 bp, Homo sapiens
agcacaatcaggacaatagtctg

SEQ ID NO: 150921 - DNA, 23 bp, Homo sapiens
tgaaagaagaaagtgctaagtgc

SEQ ID NO: 150922 - DNA, 20 bp, Homo sapiens
aaatattttctaggtatgac

SEQ ID NO: 150923 - DNA, 22 bp, Homo sapiens
gcatgatgtgttcttatgatga

SEQ ID NO: 150924 - DNA, 20 bp, Homo sapiens
tttggaaacatattccaatg

SEQ ID NO: 150925 - DNA, 22 bp, Homo sapiens
atgtaagatagaagagggtgtg

SEQ ID NO: 150926 - DNA, 23 bp, Homo sapiens
agcatctcccagattttgatatg

SEQ ID NO: 150927 - DNA, 20 bp, Homo sapiens
gtatatatccaggagtggga

SEQ ID NO: 150928 - DNA, 22 bp, Homo sapiens
ttacacaccaaagttacagtgt

SEQ ID NO: 150929 - DNA, 22 bp, Homo sapiens
aatactctgtatttttctgtgt

SEQ ID NO: 150930 - DNA, 23 bp, Homo sapiens
tgtcttcaccaacatttgttatc

SEQ ID NO: 150931 - DNA, 21 bp, Homo sapiens
tttaatggatgatatgtgaat

SEQ ID NO: 150932 - DNA, 22 bp, Homo sapiens
taattgtatatctatatgggta

SEQ ID NO: 150933 - DNA, 21 bp, Homo sapiens
gattcaggggctacaaggtgc

SEQ ID NO: 150934 - DNA, 22 bp, Homo sapiens
ggctgaggtaggaggatcactt

SEQ ID NO: 150935 - DNA, 23 bp, Homo sapiens
atcactcacctctgtgtctctga

SEQ ID NO: 150936 - DNA, 23 bp, Homo sapiens
atacacacatagtaaatatgtgc

SEQ ID NO: 150937 - DNA, 20 bp, Homo sapiens
atgtatgtatgtgtgaatac

SEQ ID NO: 150938 - DNA, 20 bp, Homo sapiens
tgcttcttttagttagcatg

SEQ ID NO: 150939 - DNA, 23 bp, Homo sapiens
tggcagtacagtctgtgctgaga

SEQ ID NO: 150940 - DNA, 19 bp, Homo sapiens
agactagtagattcactct

SEQ ID NO: 150941 - DNA, 22 bp, Homo sapiens
cagtgagaagaaagtttgctga

SEQ ID NO: 150942 - DNA, 23 bp, Homo sapiens
tctgacaggagactgagctcagt

SEQ ID NO: 150943 - DNA, 23 bp, Homo sapiens
tcccgagtagttgggactacaga

SEQ ID NO: 150944 - DNA, 23 bp, Homo sapiens
agacaaggttttgctgtgttgcc

SEQ ID NO: 150945 - DNA, 21 bp, Homo sapiens
tatctgtagactgtgagctct

SEQ ID NO: 150946 - DNA, 23 bp, Homo sapiens
aaaagagggatgggagttggaaa

SEQ ID NO: 150947 - DNA, 23 bp, Homo sapiens
ttcatgtggaatgtaaagttgga

SEQ ID NO: 150948 - DNA, 21 bp, Homo sapiens
agtgctttaactttgagcatt

SEQ ID NO: 150949 - DNA, 22 bp, Homo sapiens
ctagtacagtgtgctctccatg

SEQ ID NO: 150950 - DNA, 19 bp, Homo sapiens
aggggcatgcagtttggct

SEQ ID NO: 150951 - DNA, 19 bp, Homo sapiens
gagaagtcagtgaggattg

SEQ ID NO: 150952 - DNA, 23 bp, Homo sapiens
gtgacagagtgagtgagtgagac

SEQ ID NO: 150953 - DNA, 20 bp, Homo sapiens
cagtcttagctactctggag

SEQ ID NO: 150954 - DNA, 21 bp, Homo sapiens
gcagtgatctcagctcattgc

SEQ ID NO: 150955 - DNA, 22 bp, Homo sapiens
tattctctgtgttacctgagcg

SEQ ID NO: 150956 - DNA, 23 bp, Homo sapiens
aagatttgtgatattgttggaga

SEQ ID NO: 150957 - DNA, 23 bp, Homo sapiens
tgagttcattgtagattctggat

SEQ ID NO: 150958 - DNA, 23 bp, Homo sapiens
tgagttcattgtagattctggat

SEQ ID NO: 150959 - DNA, 18 bp, Homo sapiens
ttctaaataagcatatgt

SEQ ID NO: 150960 - DNA, 23 bp, Homo sapiens
catgtctggaatttgattgaggg

SEQ ID NO: 150961 - DNA, 23 bp, Homo sapiens
ttcaaactttttgttaagctatg

SEQ ID NO: 150962 - DNA, 23 bp, Homo sapiens
tttcagtggtagtattgagtatg

SEQ ID NO: 150963 - DNA, 23 bp, Homo sapiens
atatgatgtggtatatatatgaa

SEQ ID NO: 150964 - DNA, 23 bp, Homo sapiens
ctgtgaatccatctggttctgga

SEQ ID NO: 150965 - DNA, 23 bp, Homo sapiens
ctcagttgcattttccatggttt

SEQ ID NO: 150966 - DNA, 23 bp, Homo sapiens
aattttgtagagactgggtctct

SEQ ID NO: 150967 - DNA, 23 bp, Homo sapiens
gtctctgtctgacagtggctcac

SEQ ID NO: 150968 - DNA, 23 bp, Homo sapiens
tccctttctacatgggcatctct

SEQ ID NO: 150969 - DNA, 23 bp, Homo sapiens
tggtgagatcttggctcactgaa

SEQ ID NO: 150970 - DNA, 23 bp, Homo sapiens
tctctgtccatctgtcactcctt

SEQ ID NO: 150971 - DNA, 23 bp, Homo sapiens
aatatgtttgcaattggaaagat

SEQ ID NO: 150972 - DNA, 23 bp, Homo sapiens
gtcagagtctcgctctgtcaccc

SEQ ID NO: 150973 - DNA, 23 bp, Homo sapiens
tgctatttcacagtgattaccta

SEQ ID NO: 150974 - DNA, 18 bp, Homo sapiens
agggtccttcactcctat

SEQ ID NO: 150975 - DNA, 22 bp, Homo sapiens
tctctctcactgtttcttgtat

SEQ ID NO: 150976 - DNA, 22 bp, Homo sapiens
tgtgtgtgtgcatgtgttataa

SEQ ID NO: 150977 - DNA, 23 bp, Homo sapiens
attctggtagaaagattagatgt

SEQ ID NO: 150978 - DNA, 23 bp, Homo sapiens
tgtctgtctgtctgtctgtctgg

SEQ ID NO: 150979 - DNA, 21 bp, Homo sapiens
tagagctagatatggaacaca

SEQ ID NO: 150980 - DNA, 23 bp, Homo sapiens
cttggctctagattggtttgtga

SEQ ID NO: 150981 - DNA, 23 bp, Homo sapiens
taaatggaatttcagattggaga

SEQ ID NO: 150982 - DNA, 23 bp, Homo sapiens
agactgagatatatgtgtgtgtt

SEQ ID NO: 150983 - DNA, 21 bp, Homo sapiens
atgtatatatgtatatgtgta

SEQ ID NO: 150984 - DNA, 20 bp, Homo sapiens
aacaggtttatgtatttctg

SEQ ID NO: 150985 - DNA, 23 bp, Homo sapiens
tgtcagtgacattctgtgtgtga

SEQ ID NO: 150986 - DNA, 21 bp, Homo sapiens
tggagtctggctctgtcgctc

SEQ ID NO: 150987 - DNA, 21 bp, Homo sapiens
aggcttgagattttcttcatg

SEQ ID NO: 150988 - DNA, 23 bp, Homo sapiens
tgatcataggaaattctccataa

SEQ ID NO: 150989 - DNA, 23 bp, Homo sapiens
gtactcactcactcacttgctcc

SEQ ID NO: 150990 - DNA, 23 bp, Homo sapiens
ctatatttctataggatattcta

SEQ ID NO: 150991 - DNA, 23 bp, Homo sapiens
tcagaagaatatgaatgctccac

SEQ ID NO: 150992 - DNA, 18 bp, Homo sapiens
gtaagcacacgtatgctt

SEQ ID NO: 150993 - DNA, 19 bp, Homo sapiens
ttttgatgaagtgatgaag

SEQ ID NO: 150994 - DNA, 23 bp, Homo sapiens
gctgacaatacagagagagcaaa

SEQ ID NO: 150995 - DNA, 23 bp, Homo sapiens
tgtgtatttatgtgtttctcttg

SEQ ID NO: 150996 - DNA, 23 bp, Homo sapiens
tgagttcattgtagattctggat

SEQ ID NO: 150997 - DNA, 23 bp, Homo sapiens
tgagttcattgtagattctggat

SEQ ID NO: 150998 - DNA, 22 bp, Homo sapiens
ttgcaagagaatgtttatagcc

SEQ ID NO: 150999 - DNA, 22 bp, Homo sapiens
tttgagacagattctcactgtg

SEQ ID NO: 151000 - DNA, 23 bp, Homo sapiens
atttcattctatatgtatgtgaa

SEQ ID NO: 151001 - DNA, 22 bp, Homo sapiens
tatttacatacatatataatgt

SEQ ID NO: 151002 - DNA, 23 bp, Homo sapiens
tacatgtgcacaatgtgcaggtt

SEQ ID NO: 151003 - DNA, 23 bp, Homo sapiens
tgtgtcatgttggtgtgctgcac

SEQ ID NO: 151004 - DNA, 23 bp, Homo sapiens
cctccctccctgtgtggtcacct

SEQ ID NO: 151005 - DNA, 23 bp, Homo sapiens
agcagtgttttttaattctcatt

SEQ ID NO: 151006 - DNA, 21 bp, Homo sapiens
ttagctgtatttctatatatg

SEQ ID NO: 151007 - DNA, 23 bp, Homo sapiens
tgagtagttgctctgaggatcag

SEQ ID NO: 151008 - DNA, 20 bp, Homo sapiens
aaacctgacagttaatgtag

SEQ ID NO: 151009 - DNA, 23 bp, Homo sapiens
tgagatgactgtgatgatttcag

SEQ ID NO: 151010 - DNA, 23 bp, Homo sapiens
tgagttcattgtagattctggat

SEQ ID NO: 151011 - DNA, 23 bp, Homo sapiens
tgagttcattgtagattctggat

SEQ ID NO: 151012 - DNA, 23 bp, Homo sapiens
gtgcttagtaaatttctatatct

SEQ ID NO: 151013 - DNA, 21 bp, Homo sapiens
agcatcacctgatttttgtct

SEQ ID NO: 151014 - DNA, 23 bp, Homo sapiens
tccctgtgtgtgtgtctctgtga

SEQ ID NO: 151015 - DNA, 23 bp, Homo sapiens
tgagttcattgtagattctggat

SEQ ID NO: 151016 - DNA, 23 bp, Homo sapiens
tgagttcattgtagattctggat

SEQ ID NO: 151017 - DNA, 23 bp, Homo sapiens
acagtctctctctctattctgag

SEQ ID NO: 151018 - DNA, 18 bp, Homo sapiens
tgaaaatagatattgtag

SEQ ID NO: 151019 - DNA, 21 bp, Homo sapiens
aattatgcatattttgatgta

SEQ ID NO: 151020 - DNA, 22 bp, Homo sapiens
tctctcagtgtcacttcatgtt

SEQ ID NO: 151021 - DNA, 21 bp, Homo sapiens
tatatatactatgtgtacaca

SEQ ID NO: 151022 - DNA, 22 bp, Homo sapiens
aagctgcttcaccttttgtgac

SEQ ID NO: 151023 - DNA, 23 bp, Homo sapiens
tcacatgtatacagtgtgtgcca

SEQ ID NO: 151024 - DNA, 21 bp, Homo sapiens
tcacagacagtctcagaaata

SEQ ID NO: 151025 - DNA, 23 bp, Homo sapiens
tttttgagtctcgctctgttgcc

SEQ ID NO: 151026 - DNA, 23 bp, Homo sapiens
aaatacactgtggttgtgaggct

SEQ ID NO: 151027 - DNA, 23 bp, Homo sapiens
cagggtctcactctgtcacccag

SEQ ID NO: 151028 - DNA, 21 bp, Homo sapiens
atatatttagatgaagtagaa

SEQ ID NO: 151029 - DNA, 23 bp, Homo sapiens
tgtatgaatgaagaaactgtagt

SEQ ID NO: 151030 - DNA, 23 bp, Homo sapiens
agagtctcactcactctgttggc

SEQ ID NO: 151031 - DNA, 22 bp, Homo sapiens
agagaacagccagcactgaact

SEQ ID NO: 151032 - DNA, 23 bp, Homo sapiens
gggtcactctctgtcactcaggc

SEQ ID NO: 151033 - DNA, 23 bp, Homo sapiens
ttttgagtttggttatcataatg

SEQ ID NO: 151034 - DNA, 21 bp, Homo sapiens
actgtctgtgggtctctcagc

SEQ ID NO: 151035 - DNA, 22 bp, Homo sapiens
atatagctacctatataaagct

SEQ ID NO: 151036 - DNA, 23 bp, Homo sapiens
tctgtcttgtttactgttatatc

SEQ ID NO: 151037 - DNA, 21 bp, Homo sapiens
tgtcaatatgaatatctttgc

SEQ ID NO: 151038 - DNA, 20 bp, Homo sapiens
tggcagaaaaagatgactat

SEQ ID NO: 151039 - DNA, 22 bp, Homo sapiens
ttggcagattgagttttataga

SEQ ID NO: 151040 - DNA, 21 bp, Homo sapiens
atacacacacacataaatgtg

SEQ ID NO: 151041 - DNA, 19 bp, Homo sapiens
agaccatatatatatatat

SEQ ID NO: 151042 - DNA, 18 bp, Homo sapiens
tatatataaatgtgtaga

SEQ ID NO: 151043 - DNA, 18 bp, Homo sapiens
atgtatgtatatatgtgt

SEQ ID NO: 151044 - DNA, 22 bp, Homo sapiens
acatatacacacatgtatactt

SEQ ID NO: 151045 - DNA, 22 bp, Homo sapiens
atatatgtatatgtatacgtgt

SEQ ID NO: 151046 - DNA, 20 bp, Homo sapiens
tgtgtgtgtgtgtgtgtata

SEQ ID NO: 151047 - DNA, 21 bp, Homo sapiens
tggatagaactggtgaaagtg

SEQ ID NO: 151048 - DNA, 23 bp, Homo sapiens
cttttccctattcagtatgatgt

SEQ ID NO: 151049 - DNA, 22 bp, Homo sapiens
ctgcctgcctgcctgcctctgt

SEQ ID NO: 151050 - DNA, 23 bp, Homo sapiens
tactgagagcagaatgtgtgctc

SEQ ID NO: 151051 - DNA, 23 bp, Homo sapiens
tttgctaagcttttgaagctgta

SEQ ID NO: 151052 - DNA, 23 bp, Homo sapiens
tgagttcattgtagattctggat

SEQ ID NO: 151053 - DNA, 23 bp, Homo sapiens
tgagttcattgtagattctggat

SEQ ID NO: 151054 - DNA, 23 bp, Homo sapiens
tacatgcacacacatatacatat

SEQ ID NO: 151055 - DNA, 21 bp, Homo sapiens
tatgtggatgtatgtatatat

SEQ ID NO: 151056 - DNA, 23 bp, Homo sapiens
tttttggttccatatgaatttta

SEQ ID NO: 151057 - DNA, 18 bp, Homo sapiens
aagtagctcagagaaaat

SEQ ID NO: 151058 - DNA, 23 bp, Homo sapiens
ctcactcagaccctctgtgcttc

SEQ ID NO: 151059 - DNA, 21 bp, Homo sapiens
tatgtattcttgatatagatg

SEQ ID NO: 151060 - DNA, 23 bp, Homo sapiens
ttctgtttatatgttgatgtagg

SEQ ID NO: 151061 - DNA, 23 bp, Homo sapiens
atgtatccattcttttgtattag

SEQ ID NO: 151062 - DNA, 23 bp, Homo sapiens
tgagttcattgtagattctggat

SEQ ID NO: 151063 - DNA, 23 bp, Homo sapiens
tgagttcattgtagattctggat

SEQ ID NO: 151064 - DNA, 22 bp, Homo sapiens
tatatggcacattttcttcatc

SEQ ID NO: 151065 - DNA, 21 bp, Homo sapiens
gatagagtttcgctcttgttg

SEQ ID NO: 151066 - DNA, 23 bp, Homo sapiens
aattaagattgcatatgatggca

SEQ ID NO: 151067 - DNA, 23 bp, Homo sapiens
ttatatgctttagaaatgagtaa

SEQ ID NO: 151068 - DNA, 22 bp, Homo sapiens
ttagacactatagtgtgcatct

SEQ ID NO: 151069 - DNA, 21 bp, Homo sapiens
tttggatggcttccttttgag

SEQ ID NO: 151070 - DNA, 20 bp, Homo sapiens
tatacattatatgtatatat

SEQ ID NO: 151071 - DNA, 23 bp, Homo sapiens
atgtatagcagcattggaattgt

SEQ ID NO: 151072 - DNA, 23 bp, Homo sapiens
tacatagtcatagatttttggag

SEQ ID NO: 151073 - DNA, 21 bp, Homo sapiens
atggcagactaagcatataca

SEQ ID NO: 151074 - DNA, 23 bp, Homo sapiens
tgagatagggtctcgctctgttg

SEQ ID NO: 151075 - DNA, 23 bp, Homo sapiens
atatgtttatatatatgtgtgtg

SEQ ID NO: 151076 - DNA, 23 bp, Homo sapiens
actgagtctcactctgtcgccca

SEQ ID NO: 151077 - DNA, 20 bp, Homo sapiens
tactggtatatgtttcaata

SEQ ID NO: 151078 - DNA, 18 bp, Homo sapiens
agaggaacacagaacact

SEQ ID NO: 151079 - DNA, 23 bp, Homo sapiens
tgagttcattgtagattctggat

SEQ ID NO: 151080 - DNA, 23 bp, Homo sapiens
tgagttcattgtagattctggat

SEQ ID NO: 151081 - DNA, 18 bp, Homo sapiens
aaacgtactaaaagaaag

SEQ ID NO: 151082 - DNA, 22 bp, Homo sapiens
gagaattgctctgtatgaattg

SEQ ID NO: 151083 - DNA, 22 bp, Homo sapiens
gtgtatatatatgaatgtgtgt

SEQ ID NO: 151084 - DNA, 23 bp, Homo sapiens
tgagacggagtctccctctgtca

SEQ ID NO: 151085 - DNA, 20 bp, Homo sapiens
gtagagttataagctgattg

SEQ ID NO: 151086 - DNA, 22 bp, Homo sapiens
tgttgtgctggtaggaactgca

SEQ ID NO: 151087 - DNA, 22 bp, Homo sapiens
aatgtaagggtttttcaccagt

SEQ ID NO: 151088 - DNA, 23 bp, Homo sapiens
cttgctcctcagcttgcagacag

SEQ ID NO: 151089 - DNA, 23 bp, Homo sapiens
tgagacagagtctggctctgttg

SEQ ID NO: 151090 - DNA, 23 bp, Homo sapiens
tgagatggagtctcactctgtca

SEQ ID NO: 151091 - DNA, 21 bp, Homo sapiens
gggcctcactctgtcactcag

SEQ ID NO: 151092 - DNA, 23 bp, Homo sapiens
tatgtatgcatatatatgtgtgt

SEQ ID NO: 151093 - DNA, 23 bp, Homo sapiens
gagacagagtctggctctgttgc

SEQ ID NO: 151094 - DNA, 20 bp, Homo sapiens
atgcatgtatacatgtatgt

SEQ ID NO: 151095 - DNA, 23 bp, Homo sapiens
caaggtctcactctgtcacccag

SEQ ID NO: 151096 - DNA, 23 bp, Homo sapiens
aacagtgaagatagagagagggt

SEQ ID NO: 151097 - DNA, 23 bp, Homo sapiens
tggagtctcactctgtcacccag

SEQ ID NO: 151098 - DNA, 20 bp, Homo sapiens
cagtctctgtgaggctgtga

SEQ ID NO: 151099 - DNA, 23 bp, Homo sapiens
gccgctcactgtgtggaagagcc

SEQ ID NO: 151100 - DNA, 23 bp, Homo sapiens
actcttcttgatgtttctgtggc

SEQ ID NO: 151101 - DNA, 20 bp, Homo sapiens
tctgccactcacagtgtctc

SEQ ID NO: 151102 - DNA, 21 bp, Homo sapiens
tatctggctgcaaacgatttc

SEQ ID NO: 151103 - DNA, 20 bp, Homo sapiens
aggctgtttcccatttttct

SEQ ID NO: 151104 - DNA, 20 bp, Homo sapiens
ttatgattatttcattagga

SEQ ID NO: 151105 - DNA, 23 bp, Homo sapiens
ctctgtgtgtgaatatcatgttt

SEQ ID NO: 151106 - DNA, 23 bp, Homo sapiens
acagaaattcatgagattctgtt

SEQ ID NO: 151107 - DNA, 20 bp, Homo sapiens
atgtgtatgtgtatatatgt

SEQ ID NO: 151108 - DNA, 23 bp, Homo sapiens
tgtgtgtatatatgtatatatgt

SEQ ID NO: 151109 - DNA, 18 bp, Homo sapiens
agacaaagtctcgctctg

SEQ ID NO: 151110 - DNA, 20 bp, Homo sapiens
tagctgggattacaggcact

SEQ ID NO: 151111 - DNA, 18 bp, Homo sapiens
atgctgcagcctttgttt

SEQ ID NO: 151112 - DNA, 21 bp, Homo sapiens
tttgtcacccagactggctgg

SEQ ID NO: 151113 - DNA, 23 bp, Homo sapiens
aatggcctcagagtttctttttt

SEQ ID NO: 151114 - DNA, 19 bp, Homo sapiens
agacagtttagcattgtgc

SEQ ID NO: 151115 - DNA, 23 bp, Homo sapiens
ctccctgtgtgtcagcctctgtg

SEQ ID NO: 151116 - DNA, 23 bp, Homo sapiens
gggagactctgtgactctggctc

SEQ ID NO: 151117 - DNA, 22 bp, Homo sapiens
tgcaaagacttttatttgtcca

SEQ ID NO: 151118 - DNA, 23 bp, Homo sapiens
gtcatttgaaatctagctccatc

SEQ ID NO: 151119 - DNA, 23 bp, Homo sapiens
aagtctcactctgtcacccaggc

SEQ ID NO: 151120 - DNA, 23 bp, Homo sapiens
tgcagtggcatgatcttggctca

SEQ ID NO: 151121 - DNA, 23 bp, Homo sapiens
atgtgctatatatatgtgtgtgc

SEQ ID NO: 151122 - DNA, 22 bp, Homo sapiens
tatcttactgaagccattgttt

SEQ ID NO: 151123 - DNA, 21 bp, Homo sapiens
attgaacatggtagctttgtt

SEQ ID NO: 151124 - DNA, 19 bp, Homo sapiens
tctctggcagccttgcacc

SEQ ID NO: 151125 - DNA, 23 bp, Homo sapiens
tttgagacagggtcttgctctgt

SEQ ID NO: 151126 - DNA, 23 bp, Homo sapiens
catatatcacagtacgaaatcat

SEQ ID NO: 151127 - DNA, 19 bp, Homo sapiens
tgtttgtttgtttgttttc

SEQ ID NO: 151128 - DNA, 23 bp, Homo sapiens
ggctctcactctgtcacccaggc

SEQ ID NO: 151129 - DNA, 23 bp, Homo sapiens
atcttgttctggttctgttctgg

SEQ ID NO: 151130 - DNA, 22 bp, Homo sapiens
gagtgagaccctgtctctagaa

SEQ ID NO: 151131 - DNA, 23 bp, Homo sapiens
ttatatgtctgcttttgagaaat

SEQ ID NO: 151132 - DNA, 23 bp, Homo sapiens
tggaaaagttgcaggtgtagtag

SEQ ID NO: 151133 - DNA, 23 bp, Homo sapiens
aatgtgcatatgctccaggatgt

SEQ ID NO: 151134 - DNA, 23 bp, Homo sapiens
cacgcacacactctctctctcac

SEQ ID NO: 151135 - DNA, 23 bp, Homo sapiens
ctctctgactgactccttctcag

SEQ ID NO: 151136 - DNA, 18 bp, Homo sapiens
tatctctcagaaatggca

SEQ ID NO: 151137 - DNA, 23 bp, Homo sapiens
gtgtgtgtgtgtgtgtatgctca

SEQ ID NO: 151138 - DNA, 21 bp, Homo sapiens
tatatgctcacatatatatgt

SEQ ID NO: 151139 - DNA, 23 bp, Homo sapiens
tgagttcattgtagattctggat

SEQ ID NO: 151140 - DNA, 23 bp, Homo sapiens
tgagttcattgtagattctggat

SEQ ID NO: 151141 - DNA, 21 bp, Homo sapiens
tatatatcttgatgagtttgg

SEQ ID NO: 151142 - DNA, 22 bp, Homo sapiens
aggaactgtttaatttatcatg

SEQ ID NO: 151143 - DNA, 23 bp, Homo sapiens
ttaaagaggttctgttttgatgt

SEQ ID NO: 151144 - DNA, 23 bp, Homo sapiens
tgtaaagaaccatcagcagtagt

SEQ ID NO: 151145 - DNA, 23 bp, Homo sapiens
gtggagctgtggttgagatgctc

SEQ ID NO: 151146 - DNA, 21 bp, Homo sapiens
acattttgagatccagtgctg

SEQ ID NO: 151147 - DNA, 23 bp, Homo sapiens
tcagtcacagtgtctccttcagc

SEQ ID NO: 151148 - DNA, 21 bp, Homo sapiens
gtggttgtgtgtggtgagatc

SEQ ID NO: 151149 - DNA, 23 bp, Homo sapiens
tatatgtgagatatatatatgtg

SEQ ID NO: 151150 - DNA, 23 bp, Homo sapiens
ctgtagttggttgagtctgtgga

SEQ ID NO: 151151 - DNA, 23 bp, Homo sapiens
tatatcctcttgctgaattgacc

SEQ ID NO: 151152 - DNA, 23 bp, Homo sapiens
ggagtctcactctgtcacccagg

SEQ ID NO: 151153 - DNA, 23 bp, Homo sapiens
tttctgcttctgtcttaattttt

SEQ ID NO: 151154 - DNA, 23 bp, Homo sapiens
tgtgtgtatatatacatgtgtgt

SEQ ID NO: 151155 - DNA, 18 bp, Homo sapiens
tgtgtatatatatgtatg

SEQ ID NO: 151156 - DNA, 23 bp, Homo sapiens
acttcacagccaggtttgttgac

SEQ ID NO: 151157 - DNA, 22 bp, Homo sapiens
tctgtgcatttgaaagagcaga

SEQ ID NO: 151158 - DNA, 22 bp, Homo sapiens
gtctcgctgtgtcacacccagg

SEQ ID NO: 151159 - DNA, 20 bp, Homo sapiens
actgactcagctattctttt

SEQ ID NO: 151160 - DNA, 21 bp, Homo sapiens
atagcttcatttacattttca

SEQ ID NO: 151161 - DNA, 19 bp, Homo sapiens
atctgaggggttttggatg

SEQ ID NO: 151162 - DNA, 22 bp, Homo sapiens
tgtgggtgttatgactgcagac

SEQ ID NO: 151163 - DNA, 23 bp, Homo sapiens
agcttttcacagacttcttacca

SEQ ID NO: 151164 - DNA, 18 bp, Homo sapiens
tgtctcagtgctggttct

SEQ ID NO: 151165 - DNA, 23 bp, Homo sapiens
tgtatttcctattgatatgttgg

SEQ ID NO: 151166 - DNA, 23 bp, Homo sapiens
ctgtctgtgtgtgtgtccgagac

SEQ ID NO: 151167 - DNA, 22 bp, Homo sapiens
tctctctcatcctctgtgtgaa

SEQ ID NO: 151168 - DNA, 22 bp, Homo sapiens
aatagcagaggctgaagacaga

SEQ ID NO: 151169 - DNA, 22 bp, Homo sapiens
tgcctgcctgcctgtctgagac

SEQ ID NO: 151170 - DNA, 19 bp, Homo sapiens
tcagccaggtacagtggtt

SEQ ID NO: 151171 - DNA, 18 bp, Homo sapiens
ttttgctgagtttgctga

SEQ ID NO: 151172 - DNA, 23 bp, Homo sapiens
acacacagagtggatgaggatga

SEQ ID NO: 151173 - DNA, 21 bp, Homo sapiens
tttctctcagtctctgcctcg

SEQ ID NO: 151174 - DNA, 22 bp, Homo sapiens
ttctgtagaggtgggggtctca

SEQ ID NO: 151175 - DNA, 23 bp, Homo sapiens
ggtctctgactcttaatactctg

SEQ ID NO: 151176 - DNA, 23 bp, Homo sapiens
tgcaatgaaaagatctaagtaag

SEQ ID NO: 151177 - DNA, 23 bp, Homo sapiens
cagggtctcactctgtcacccag

SEQ ID NO: 151178 - DNA, 20 bp, Homo sapiens
gcaatggtgtgatcttggct

SEQ ID NO: 151179 - DNA, 23 bp, Homo sapiens
tgtctgtgtgtgtgtgaaagggc

SEQ ID NO: 151180 - DNA, 22 bp, Homo sapiens
ttttgagatggagtctcactct

SEQ ID NO: 151181 - DNA, 20 bp, Homo sapiens
tacactttatatgtagtaca

SEQ ID NO: 151182 - DNA, 20 bp, Homo sapiens
tgactcagctgggttcagtg

SEQ ID NO: 151183 - DNA, 21 bp, Homo sapiens
tgtacatgtatacagtgcctg

SEQ ID NO: 151184 - DNA, 23 bp, Homo sapiens
ctctgtcacccaggctgagtaca

SEQ ID NO: 151185 - DNA, 23 bp, Homo sapiens
tgtgtctctgtgactcggcgtgt

SEQ ID NO: 151186 - DNA, 22 bp, Homo sapiens
agcgtctctccctcactctgcc

SEQ ID NO: 151187 - DNA, 23 bp, Homo sapiens
aaaaatgtgtccttgagttctat

SEQ ID NO: 151188 - DNA, 23 bp, Homo sapiens
gtgtgtgcctttgcatgtgtttg

SEQ ID NO: 151189 - DNA, 19 bp, Homo sapiens
ctcagtttctctctgtcta

SEQ ID NO: 151190 - DNA, 22 bp, Homo sapiens
ttgctccaaatgaatactttct

SEQ ID NO: 151191 - DNA, 23 bp, Homo sapiens
agaaagtatttcaagtggaagga

SEQ ID NO: 151192 - DNA, 22 bp, Homo sapiens
ctgaggtaagaggatcacttga

SEQ ID NO: 151193 - DNA, 23 bp, Homo sapiens
tggtgagagaggaagaaaacagg

SEQ ID NO: 151194 - DNA, 21 bp, Homo sapiens
atgtgcaggttttgcatagac

SEQ ID NO: 151195 - DNA, 22 bp, Homo sapiens
tacatgtgcacaatgtgcaggt

SEQ ID NO: 151196 - DNA, 18 bp, Homo sapiens
tgtatatatgtacatgta

SEQ ID NO: 151197 - DNA, 23 bp, Homo sapiens
atatgtatatgtatatgtgtacg

SEQ ID NO: 151198 - DNA, 22 bp, Homo sapiens
atatatgtatatgtatatatgt

SEQ ID NO: 151199 - DNA, 23 bp, Homo sapiens
atatacacgtatatatatatatg

SEQ ID NO: 151200 - DNA, 20 bp, Homo sapiens
tgaggtaagaggatcacttg

SEQ ID NO: 151201 - DNA, 22 bp, Homo sapiens
atatctatatatacatatgtgt

SEQ ID NO: 151202 - DNA, 23 bp, Homo sapiens
cacatatgtatatatgtatctag

SEQ ID NO: 151203 - DNA, 18 bp, Homo sapiens
attctgtgctttttttct

SEQ ID NO: 151204 - DNA, 23 bp, Homo sapiens
atatgcatacatatgtagtcatt

SEQ ID NO: 151205 - DNA, 22 bp, Homo sapiens
ttgagagatgagtcagaggaca

SEQ ID NO: 151206 - DNA, 23 bp, Homo sapiens
agacagagtctcactctgtcacc

SEQ ID NO: 151207 - DNA, 20 bp, Homo sapiens
agagccccagctggtgcagg

SEQ ID NO: 151208 - DNA, 23 bp, Homo sapiens
ccagtctccctgcctccctggct

SEQ ID NO: 151209 - DNA, 21 bp, Homo sapiens
tgtaaagttgtttcattcagg

SEQ ID NO: 151210 - DNA, 23 bp, Homo sapiens
agacggagtctcgctgtgtcacc

SEQ ID NO: 151211 - DNA, 18 bp, Homo sapiens
atggagtttcaccatgtt

SEQ ID NO: 151212 - DNA, 20 bp, Homo sapiens
tatacacatattttatatgt

SEQ ID NO: 151213 - DNA, 23 bp, Homo sapiens
tcactgtttactctttgatactt

SEQ ID NO: 151214 - DNA, 23 bp, Homo sapiens
catctggcccacagtctctccct

SEQ ID NO: 151215 - DNA, 23 bp, Homo sapiens
gacagagtctcagtctgtcgccc

SEQ ID NO: 151216 - DNA, 18 bp, Homo sapiens
tctccctctgtcacggta

SEQ ID NO: 151217 - DNA, 23 bp, Homo sapiens
gcagtcaaactctgtccctctgt

SEQ ID NO: 151218 - DNA, 22 bp, Homo sapiens
tgttttgcaaggttttgttttg

SEQ ID NO: 151219 - DNA, 19 bp, Homo sapiens
tctgtgtttcctggtgctt

SEQ ID NO: 151220 - DNA, 21 bp, Homo sapiens
ttttgagacggagtcttgctc

SEQ ID NO: 151221 - DNA, 23 bp, Homo sapiens
cgtgtgtctcagtgtgtggcaaa

SEQ ID NO: 151222 - DNA, 21 bp, Homo sapiens
aactgtgccgctgctttgctg

SEQ ID NO: 151223 - DNA, 23 bp, Homo sapiens
cactcagtgtctgaattcatttt

SEQ ID NO: 151224 - DNA, 23 bp, Homo sapiens
tatatgtatatgtgtgtgtgtgt

SEQ ID NO: 151225 - DNA, 20 bp, Homo sapiens
acacacacacatatatatgt

SEQ ID NO: 151226 - DNA, 21 bp, Homo sapiens
tcagagcgggaaagtagagga

SEQ ID NO: 151227 - DNA, 23 bp, Homo sapiens
tgtgtgtgagtgtgtgtgtgcat

SEQ ID NO: 151228 - DNA, 22 bp, Homo sapiens
tgagctagatacttttattatt

SEQ ID NO: 151229 - DNA, 18 bp, Homo sapiens
cagaggaaagttaaatag

SEQ ID NO: 151230 - DNA, 20 bp, Homo sapiens
acagagtgattttctctggc

SEQ ID NO: 151231 - DNA, 19 bp, Homo sapiens
gggaaggatgacaagggga

SEQ ID NO: 151232 - DNA, 23 bp, Homo sapiens
tatgtgtgtctgtgtgtgagtgt

SEQ ID NO: 151233 - DNA, 18 bp, Homo sapiens
gtatatgtatgcatgtgt

SEQ ID NO: 151234 - DNA, 23 bp, Homo sapiens
tttttgtgtgtgcatgtgcatgt

SEQ ID NO: 151235 - DNA, 21 bp, Homo sapiens
tagtttatcacatgccatttc

SEQ ID NO: 151236 - DNA, 23 bp, Homo sapiens
ctgaagtccatgtggtcctgaga

SEQ ID NO: 151237 - DNA, 23 bp, Homo sapiens
cagtctctctctgtccctataga

SEQ ID NO: 151238 - DNA, 19 bp, Homo sapiens
ccctctgttactcactctc

SEQ ID NO: 151239 - DNA, 18 bp, Homo sapiens
atacagtcatatagatat

SEQ ID NO: 151240 - DNA, 22 bp, Homo sapiens
tatatgctttttctgtatacac

SEQ ID NO: 151241 - DNA, 23 bp, Homo sapiens
tcctctgtcactctctgctcctg

SEQ ID NO: 151242 - DNA, 23 bp, Homo sapiens
tctgcttatgatctagaagtcca

SEQ ID NO: 151243 - DNA, 23 bp, Homo sapiens
tgttctttttgcttaggattgtc

SEQ ID NO: 151244 - DNA, 23 bp, Homo sapiens
tgagttcattgtagattctggat

SEQ ID NO: 151245 - DNA, 23 bp, Homo sapiens
tgagttcattgtagattctggat

SEQ ID NO: 151246 - DNA, 23 bp, Homo sapiens
acagagtctcgctctgtcaccca

SEQ ID NO: 151247 - DNA, 21 bp, Homo sapiens
accacattttctttatccagt

SEQ ID NO: 151248 - DNA, 23 bp, Homo sapiens
acagagtctcactctgtcgccca

SEQ ID NO: 151249 - DNA, 23 bp, Homo sapiens
gacggagtctcactgtcactcag

SEQ ID NO: 151250 - DNA, 19 bp, Homo sapiens
atactatatgtatatatgt

SEQ ID NO: 151251 - DNA, 19 bp, Homo sapiens
atttgttagtatcacagtt

SEQ ID NO: 151252 - DNA, 23 bp, Homo sapiens
taattgagtgcctataacataac

SEQ ID NO: 151253 - DNA, 20 bp, Homo sapiens
tttgagacccttatgattct

SEQ ID NO: 151254 - DNA, 22 bp, Homo sapiens
atacacacacatatatatgtgt

SEQ ID NO: 151255 - DNA, 23 bp, Homo sapiens
catgtgtctgcttatggatttct

SEQ ID NO: 151256 - DNA, 20 bp, Homo sapiens
gtagttgctcatgtgtacat

SEQ ID NO: 151257 - DNA, 19 bp, Homo sapiens
aggttcatccagactgtgt

SEQ ID NO: 151258 - DNA, 18 bp, Homo sapiens
ctcaggggaattctaccc

SEQ ID NO: 151259 - DNA, 23 bp, Homo sapiens
tctgtgcctcagtctccccatgt

SEQ ID NO: 151260 - DNA, 23 bp, Homo sapiens
atctgactagctccctctcagtc

SEQ ID NO: 151261 - DNA, 23 bp, Homo sapiens
ggattacagatgtgagccaccac

SEQ ID NO: 151262 - DNA, 23 bp, Homo sapiens
ttttgagacggagtctcgctctg

SEQ ID NO: 151263 - DNA, 23 bp, Homo sapiens
tcaaactgcaactgctattatat

SEQ ID NO: 151264 - DNA, 23 bp, Homo sapiens
tctggctctcagtggctgtggag

SEQ ID NO: 151265 - DNA, 22 bp, Homo sapiens
tgactcagagtcataaagatgt

SEQ ID NO: 151266 - DNA, 23 bp, Homo sapiens
gtagagatgaggtcttgctatgt

SEQ ID NO: 151267 - DNA, 20 bp, Homo sapiens
aaaatgagtcctgactttgg

SEQ ID NO: 151268 - DNA, 23 bp, Homo sapiens
tgtctgtctgtctgtttacgtgc

SEQ ID NO: 151269 - DNA, 23 bp, Homo sapiens
tctgtattgaactgcaagcttta

SEQ ID NO: 151270 - DNA, 23 bp, Homo sapiens
actgagaaagttgaggaagttgt

SEQ ID NO: 151271 - DNA, 23 bp, Homo sapiens
ggctctgtctgactgggctgttt

SEQ ID NO: 151272 - DNA, 21 bp, Homo sapiens
ctgagggacaagattgtgttt

SEQ ID NO: 151273 - DNA, 21 bp, Homo sapiens
ttatctgaaagctctgcctcc

SEQ ID NO: 151274 - DNA, 22 bp, Homo sapiens
actcacagagagcaatccagga

SEQ ID NO: 151275 - DNA, 23 bp, Homo sapiens
gtcactgtggctgtgactgcccc

SEQ ID NO: 151276 - DNA, 23 bp, Homo sapiens
aggctgacacggtaactagagcc

SEQ ID NO: 151277 - DNA, 22 bp, Homo sapiens
ccttggggttttgtttatctgt

SEQ ID NO: 151278 - DNA, 22 bp, Homo sapiens
gtgagtctcgctctgtcaccca

SEQ ID NO: 151279 - DNA, 19 bp, Homo sapiens
ttcagcatctgagttgagg

SEQ ID NO: 151280 - DNA, 23 bp, Homo sapiens
attcctgaccctcagtcactgtg

SEQ ID NO: 151281 - DNA, 18 bp, Homo sapiens
acacacacactttttttt

SEQ ID NO: 151282 - DNA, 20 bp, Homo sapiens
atacctatttactaagtgct

SEQ ID NO: 151283 - DNA, 18 bp, Homo sapiens
ttcagtaaagttgcagaa

SEQ ID NO: 151284 - DNA, 18 bp, Homo sapiens
atttttgtatacaactgg

SEQ ID NO: 151285 - DNA, 23 bp, Homo sapiens
tatgtatgcttgtgtgtgtttat

SEQ ID NO: 151286 - DNA, 19 bp, Homo sapiens
atacacacacacatatata

SEQ ID NO: 151287 - DNA, 21 bp, Homo sapiens
acacagtgagactctgtctct

SEQ ID NO: 151288 - DNA, 23 bp, Homo sapiens
agagtctcactctgtcacccagg

SEQ ID NO: 151289 - DNA, 23 bp, Homo sapiens
tttttgagacggagtctcactct

SEQ ID NO: 151290 - DNA, 19 bp, Homo sapiens
agataaggtctggctctgt

SEQ ID NO: 151291 - DNA, 18 bp, Homo sapiens
tgcagtgacgtaatcttg

SEQ ID NO: 151292 - DNA, 23 bp, Homo sapiens
gttgagacttcctgttctccagt

SEQ ID NO: 151293 - DNA, 23 bp, Homo sapiens
agggtctctctctgtcatgcagg

SEQ ID NO: 151294 - DNA, 23 bp, Homo sapiens
acagagtctcactctgtcgccca

SEQ ID NO: 151295 - DNA, 18 bp, Homo sapiens
acttgttggtataggagt

SEQ ID NO: 151296 - DNA, 23 bp, Homo sapiens
tggagtctcactctgtcacccag

SEQ ID NO: 151297 - DNA, 18 bp, Homo sapiens
cagtggtatgatctcagc

SEQ ID NO: 151298 - DNA, 23 bp, Homo sapiens
tcagactgtctggaaataatgac

SEQ ID NO: 151299 - DNA, 22 bp, Homo sapiens
tccatgactctttcctccctgt

SEQ ID NO: 151300 - DNA, 19 bp, Homo sapiens
ttccacccatagaagtacc

SEQ ID NO: 151301 - DNA, 23 bp, Homo sapiens
aggtcagagagcagagagaggtg

SEQ ID NO: 151302 - DNA, 23 bp, Homo sapiens
tctgtctgtcacccacactggag

SEQ ID NO: 151303 - DNA, 21 bp, Homo sapiens
tgtgtgtgtatatatatgtgt

SEQ ID NO: 151304 - DNA, 20 bp, Homo sapiens
tatatacacacacacttatg

SEQ ID NO: 151305 - DNA, 20 bp, Homo sapiens
acagtgggcacacaggggga

SEQ ID NO: 151306 - DNA, 21 bp, Homo sapiens
tttatctttatttgcatacga

SEQ ID NO: 151307 - DNA, 18 bp, Homo sapiens
tatgtgtatatgtgtatg

SEQ ID NO: 151308 - DNA, 23 bp, Homo sapiens
tgagtctcactctgtcacccagg

SEQ ID NO: 151309 - DNA, 23 bp, Homo sapiens
tgagtctcactctgtcacccagg

SEQ ID NO: 151310 - DNA, 22 bp, Homo sapiens
tgtattccttgatatcgcatgg

SEQ ID NO: 151311 - DNA, 23 bp, Homo sapiens
tgcatgagtgtatgttatgtgta

SEQ ID NO: 151312 - DNA, 23 bp, Homo sapiens
taattaggagtttttgttctact

SEQ ID NO: 151313 - DNA, 19 bp, Homo sapiens
cagaggttgcaagtgtgtg

SEQ ID NO: 151314 - DNA, 23 bp, Homo sapiens
tgtgactgtctgactcccacagt

SEQ ID NO: 151315 - DNA, 22 bp, Homo sapiens
tgtgtatatatatcagtgtgta

SEQ ID NO: 151316 - DNA, 23 bp, Homo sapiens
atatcagtgtgtgtatatatata

SEQ ID NO: 151317 - DNA, 23 bp, Homo sapiens
gacagagtctcgctctgtcaccc

SEQ ID NO: 151318 - DNA, 23 bp, Homo sapiens
gattgaggttgcagtgagctatg

SEQ ID NO: 151319 - DNA, 23 bp, Homo sapiens
ctatttcagtctggttgagttct

SEQ ID NO: 151320 - DNA, 23 bp, Homo sapiens
agcttaaatatagagttaccatt

SEQ ID NO: 151321 - DNA, 22 bp, Homo sapiens
aagtagaaacggagcactctgg

SEQ ID NO: 151322 - DNA, 23 bp, Homo sapiens
gggcctctgtctgtgtctgcctg

SEQ ID NO: 151323 - DNA, 18 bp, Homo sapiens
tgagcattgaagtgaggc

SEQ ID NO: 151324 - DNA, 22 bp, Homo sapiens
tcagcctctgtgtggctggctt

SEQ ID NO: 151325 - DNA, 23 bp, Homo sapiens
atgtatatgtatatgtgtatacg

SEQ ID NO: 151326 - DNA, 23 bp, Homo sapiens
acgtatatgtatatgtgtatacg

SEQ ID NO: 151327 - DNA, 23 bp, Homo sapiens
tgatgagcatttctaaagaatag

SEQ ID NO: 151328 - DNA, 22 bp, Homo sapiens
tagaaataatgttgtatatgga

SEQ ID NO: 151329 - DNA, 18 bp, Homo sapiens
gtatatatgtattgaata

SEQ ID NO: 151330 - DNA, 22 bp, Homo sapiens
atatatgtgtatttcattattt

SEQ ID NO: 151331 - DNA, 23 bp, Homo sapiens
agtgcatttcttctatttatgta

SEQ ID NO: 151332 - DNA, 23 bp, Homo sapiens
tgagaggatgtgcaactggaggt

SEQ ID NO: 151333 - DNA, 19 bp, Homo sapiens
gactgaagtctgccagcag

SEQ ID NO: 151334 - DNA, 23 bp, Homo sapiens
tgagttcattgtagattctggat

SEQ ID NO: 151335 - DNA, 23 bp, Homo sapiens
tgagttcattgtagattctggat

SEQ ID NO: 151336 - DNA, 22 bp, Homo sapiens
atatgtctgtatatatatatgt

SEQ ID NO: 151337 - DNA, 18 bp, Homo sapiens
tctacataggtatctgtg

SEQ ID NO: 151338 - DNA, 18 bp, Homo sapiens
tgcagtggcacaatcgtg

SEQ ID NO: 151339 - DNA, 23 bp, Homo sapiens
gtgtgtgtgtgtctgtgtatata

SEQ ID NO: 151340 - DNA, 23 bp, Homo sapiens
tttctatgtttttgaaatcttag

SEQ ID NO: 151341 - DNA, 23 bp, Homo sapiens
tgagttcattgtagattctggat

SEQ ID NO: 151342 - DNA, 23 bp, Homo sapiens
tgagttcattgtagattctggat

SEQ ID NO: 151343 - DNA, 23 bp, Homo sapiens
tgagttcattgtagattctggat

SEQ ID NO: 151344 - DNA, 23 bp, Homo sapiens
tgagttcattgtagattctggat

SEQ ID NO: 151345 - DNA, 23 bp, Homo sapiens
actctctgtgtgggtctcttaag

SEQ ID NO: 151346 - DNA, 23 bp, Homo sapiens
gagacagtctcgctctgtcaccc

SEQ ID NO: 151347 - DNA, 20 bp, Homo sapiens
acttgaactagggctcctca

SEQ ID NO: 151348 - DNA, 21 bp, Homo sapiens
cagtttctctctctgcctgtg

SEQ ID NO: 151349 - DNA, 23 bp, Homo sapiens
tctatatatctatatctgtatct

SEQ ID NO: 151350 - DNA, 22 bp, Homo sapiens
agcaatggattgaattgtagtt

SEQ ID NO: 151351 - DNA, 23 bp, Homo sapiens
cacttgtgtatatacacatacac

SEQ ID NO: 151352 - DNA, 23 bp, Homo sapiens
tggtctcactctgtgactcaggc

SEQ ID NO: 151353 - DNA, 21 bp, Homo sapiens
tgcctctctctgtctctaggg

SEQ ID NO: 151354 - DNA, 21 bp, Homo sapiens
tgaggtagcaggatgacctga

SEQ ID NO: 151355 - DNA, 18 bp, Homo sapiens
tctagtaagacagattga

SEQ ID NO: 151356 - DNA, 23 bp, Homo sapiens
acagaagttttgtatagctaggt

SEQ ID NO: 151357 - DNA, 23 bp, Homo sapiens
ttctgtctgtttctgctttaaat

SEQ ID NO: 151358 - DNA, 20 bp, Homo sapiens
tcagtgacagattgttggct

SEQ ID NO: 151359 - DNA, 23 bp, Homo sapiens
gacatgatctcgctctgtcactc

SEQ ID NO: 151360 - DNA, 22 bp, Homo sapiens
ttctagacagtgatctctgacg

SEQ ID NO: 151361 - DNA, 23 bp, Homo sapiens
agggtctcactctgtcacccagg

SEQ ID NO: 151362 - DNA, 23 bp, Homo sapiens
taagcattacatagtctttcaaa

SEQ ID NO: 151363 - DNA, 19 bp, Homo sapiens
gagtctcactctgtcaccc

SEQ ID NO: 151364 - DNA, 23 bp, Homo sapiens
gctctctgtcactgactaaggag

SEQ ID NO: 151365 - DNA, 23 bp, Homo sapiens
tgcttctcagtgcatcagtttcc

SEQ ID NO: 151366 - DNA, 23 bp, Homo sapiens
cagagtctcactctgtcatccag

SEQ ID NO: 151367 - DNA, 23 bp, Homo sapiens
tgtagtctcgctctgtcactcag

SEQ ID NO: 151368 - DNA, 23 bp, Homo sapiens
gaaaagagaggagactgtgggga

SEQ ID NO: 151369 - DNA, 21 bp, Homo sapiens
tgactgtctctccctctccca

SEQ ID NO: 151370 - DNA, 23 bp, Homo sapiens
ttctctgtagttgtgatcttgtg

SEQ ID NO: 151371 - DNA, 23 bp, Homo sapiens
tgtctctcctagtagtgtaatag

SEQ ID NO: 151372 - DNA, 23 bp, Homo sapiens
tactgacactctgacttagaaca

SEQ ID NO: 151373 - DNA, 23 bp, Homo sapiens
gtagagttgtctcactgtgtcac

SEQ ID NO: 151374 - DNA, 22 bp, Homo sapiens
tcacatctctccatatgcactt

SEQ ID NO: 151375 - DNA, 23 bp, Homo sapiens
atgactgtttgaagaatgcttct

SEQ ID NO: 151376 - DNA, 23 bp, Homo sapiens
tgattgtgttgtgtaattcttgt

SEQ ID NO: 151377 - DNA, 23 bp, Homo sapiens
acacagtgtatatataatgtgta

SEQ ID NO: 151378 - DNA, 23 bp, Homo sapiens
acacagtgtatatataatgtgta

SEQ ID NO: 151379 - DNA, 23 bp, Homo sapiens
acacagtgtatatataatgtgta

SEQ ID NO: 151380 - DNA, 23 bp, Homo sapiens
acacagtgtatatataatgtgta

SEQ ID NO: 151381 - DNA, 23 bp, Homo sapiens
acacagtgtatatataatgtgta

SEQ ID NO: 151382 - DNA, 23 bp, Homo sapiens
acacagtgtatatataatgtgta

SEQ ID NO: 151383 - DNA, 21 bp, Homo sapiens
atacacacacatatatatatg

SEQ ID NO: 151384 - DNA, 21 bp, Homo sapiens
tacagtatagtgtaagcataa

SEQ ID NO: 151385 - DNA, 22 bp, Homo sapiens
gtctcactgtgttgcctaggct

SEQ ID NO: 151386 - DNA, 20 bp, Homo sapiens
tacatgcatatgtatatatt

SEQ ID NO: 151387 - DNA, 23 bp, Homo sapiens
atttatgtacatatgtatacatg

SEQ ID NO: 151388 - DNA, 19 bp, Homo sapiens
gtgtgtgcgtgtatttata

SEQ ID NO: 151389 - DNA, 23 bp, Homo sapiens
cagtgagactctgtgtctctcta

SEQ ID NO: 151390 - DNA, 23 bp, Homo sapiens
atatgacggatatatatgtgtat

SEQ ID NO: 151391 - DNA, 22 bp, Homo sapiens
tatatgtatatacatgttggag

SEQ ID NO: 151392 - DNA, 21 bp, Homo sapiens
tcttgagatagaaagctgaaa

SEQ ID NO: 151393 - DNA, 19 bp, Homo sapiens
ttttttcttgagatggagt

SEQ ID NO: 151394 - DNA, 19 bp, Homo sapiens
gtatatatatatgtgtaca

SEQ ID NO: 151395 - DNA, 23 bp, Homo sapiens
atatatatctgtatgtgtatatg

SEQ ID NO: 151396 - DNA, 22 bp, Homo sapiens
ttactggtgtttatctgggaca

SEQ ID NO: 151397 - DNA, 22 bp, Homo sapiens
tgagactgggttagttatcaca

SEQ ID NO: 151398 - DNA, 21 bp, Homo sapiens
aagattctagctgagcctgtg

SEQ ID NO: 151399 - DNA, 23 bp, Homo sapiens
ttttgagacagggtctcactctg

SEQ ID NO: 151400 - DNA, 22 bp, Homo sapiens
ttgaatgaattgatgaatgtac

SEQ ID NO: 151401 - DNA, 23 bp, Homo sapiens
tttgttatccatcaggtagtgta

SEQ ID NO: 151402 - DNA, 23 bp, Homo sapiens
gcttctgggactcttgcgtgctc

SEQ ID NO: 151403 - DNA, 18 bp, Homo sapiens
atgcctgtagttccagct

SEQ ID NO: 151404 - DNA, 23 bp, Homo sapiens
tgacactgtcactgcctggcagg

SEQ ID NO: 151405 - DNA, 22 bp, Homo sapiens
tgactcactcactctgacatcc

SEQ ID NO: 151406 - DNA, 23 bp, Homo sapiens
tctctggctgtgtgactgtggtc

SEQ ID NO: 151407 - DNA, 23 bp, Homo sapiens
agtctgtctgagctttagtcatg

SEQ ID NO: 151408 - DNA, 23 bp, Homo sapiens
tgagttcattgtagattctggat

SEQ ID NO: 151409 - DNA, 23 bp, Homo sapiens
tgagttcattgtagattctggat

SEQ ID NO: 151410 - DNA, 23 bp, Homo sapiens
ttctgtgaagaaagtcaatggta

SEQ ID NO: 151411 - DNA, 23 bp, Homo sapiens
aaacacctagctatgctttgaaa

SEQ ID NO: 151412 - DNA, 20 bp, Homo sapiens
tatacgtatatatgtatatg

SEQ ID NO: 151413 - DNA, 23 bp, Homo sapiens
atgtgtgtatatgtatatacata

SEQ ID NO: 151414 - DNA, 19 bp, Homo sapiens
atatgtgtgtatatgtata

SEQ ID NO: 151415 - DNA, 23 bp, Homo sapiens
acagagtctcactctgtcaccca

SEQ ID NO: 151416 - DNA, 20 bp, Homo sapiens
agtctcgctctgtcgctcag

SEQ ID NO: 151417 - DNA, 23 bp, Homo sapiens
tgagttcattgtagattctggat

SEQ ID NO: 151418 - DNA, 23 bp, Homo sapiens
tgagttcattgtagattctggat

SEQ ID NO: 151419 - DNA, 23 bp, Homo sapiens
gggtctcacagtctcaggctctc

SEQ ID NO: 151420 - DNA, 21 bp, Homo sapiens
tgcgttttcttgttgatctgt

SEQ ID NO: 151421 - DNA, 23 bp, Homo sapiens
agagcactgtcctaggtgagagt

SEQ ID NO: 151422 - DNA, 20 bp, Homo sapiens
agtgtagtcattttcatgat

SEQ ID NO: 151423 - DNA, 23 bp, Homo sapiens
agtccttctctgtctcagaaatt

SEQ ID NO: 151424 - DNA, 23 bp, Homo sapiens
gtatatgtatatgtatatgtgtg

SEQ ID NO: 151425 - DNA, 23 bp, Homo sapiens
tagacaaagaacatgagcctcag

SEQ ID NO: 151426 - DNA, 23 bp, Homo sapiens
tcagtctttctctggctctgtgc

SEQ ID NO: 151427 - DNA, 23 bp, Homo sapiens
tatattgagtgcataagaaaaca

SEQ ID NO: 151428 - DNA, 23 bp, Homo sapiens
cactctctccaaggtattcagtc

SEQ ID NO: 151429 - DNA, 19 bp, Homo sapiens
agaggtagaaggatcacct

SEQ ID NO: 151430 - DNA, 22 bp, Homo sapiens
tctctctcagaatatcatccga

SEQ ID NO: 151431 - DNA, 23 bp, Homo sapiens
cggagtctcactctgtcacccag

SEQ ID NO: 151432 - DNA, 21 bp, Homo sapiens
ggtagtagatagtgcaaggtt

SEQ ID NO: 151433 - DNA, 23 bp, Homo sapiens
tgagttcattgtagattctggat

SEQ ID NO: 151434 - DNA, 23 bp, Homo sapiens
tgagttcattgtagattctggat

SEQ ID NO: 151435 - DNA, 22 bp, Homo sapiens
ctccctctctctctctgcatgt

SEQ ID NO: 151436 - DNA, 23 bp, Homo sapiens
atacgtgtatatatatatgtgtg

SEQ ID NO: 151437 - DNA, 23 bp, Homo sapiens
acaggatggaaatatttgccaaa

SEQ ID NO: 151438 - DNA, 22 bp, Homo sapiens
tgtcactatctcatttgtgata

SEQ ID NO: 151439 - DNA, 23 bp, Homo sapiens
gttatgcaagacattacaattgg

SEQ ID NO: 151440 - DNA, 23 bp, Homo sapiens
gagtctcactctgtcactcaggc

SEQ ID NO: 151441 - DNA, 23 bp, Homo sapiens
tgtgtatatgtaggcatgtgtgt

SEQ ID NO: 151442 - DNA, 21 bp, Homo sapiens
tgggcatgtttatatgcatgt

SEQ ID NO: 151443 - DNA, 23 bp, Homo sapiens
tatatgcatatacacataggtgt

SEQ ID NO: 151444 - DNA, 20 bp, Homo sapiens
atatgagtgtgcatgtacat

SEQ ID NO: 151445 - DNA, 23 bp, Homo sapiens
ctctctgtgtgactccctcgctc

SEQ ID NO: 151446 - DNA, 23 bp, Homo sapiens
cagactgtgtgtgtgtgtgtata

SEQ ID NO: 151447 - DNA, 23 bp, Homo sapiens
caaatactgagtggttttgaatt

SEQ ID NO: 151448 - DNA, 23 bp, Homo sapiens
atttctggagtacaagcatttca

SEQ ID NO: 151449 - DNA, 19 bp, Homo sapiens
ctggacatttctgggtagg

SEQ ID NO: 151450 - DNA, 23 bp, Homo sapiens
tgagttcattgtagattctggat

SEQ ID NO: 151451 - DNA, 23 bp, Homo sapiens
tgagttcattgtagattctggat

SEQ ID NO: 151452 - DNA, 20 bp, Homo sapiens
cacagctcagccttcagagt

SEQ ID NO: 151453 - DNA, 20 bp, Homo sapiens
tagtgaagacagaaagcaga

SEQ ID NO: 151454 - DNA, 23 bp, Homo sapiens
agtctcactctgtcacccaggct

SEQ ID NO: 151455 - DNA, 20 bp, Homo sapiens
tctgcatgtctgagtggctg

SEQ ID NO: 151456 - DNA, 20 bp, Homo sapiens
aaggagcatattcaccagaa

SEQ ID NO: 151457 - DNA, 23 bp, Homo sapiens
tctcagactgtctgacagcattc

SEQ ID NO: 151458 - DNA, 23 bp, Homo sapiens
tgagttcattgtagattctggat

SEQ ID NO: 151459 - DNA, 23 bp, Homo sapiens
tgagttcattgtagattctggat

SEQ ID NO: 151460 - DNA, 23 bp, Homo sapiens
atgtctatatatgtgtgtgtgtg

SEQ ID NO: 151461 - DNA, 23 bp, Homo sapiens
agagtctcactctgtcacccagg

SEQ ID NO: 151462 - DNA, 23 bp, Homo sapiens
ctcccagagcccctggaactctg

SEQ ID NO: 151463 - DNA, 23 bp, Homo sapiens
tcccagagcccctggaactctgg

SEQ ID NO: 151464 - DNA, 23 bp, Homo sapiens
tcccagagcccctggaactctgg

SEQ ID NO: 151465 - DNA, 23 bp, Homo sapiens
tcccagagcccctggaactctgg

SEQ ID NO: 151466 - DNA, 22 bp, Homo sapiens
tttttagttgatgaagaacgtt

SEQ ID NO: 151467 - DNA, 23 bp, Homo sapiens
tgtataacattctgttattgcgt

SEQ ID NO: 151468 - DNA, 23 bp, Homo sapiens
gtgagaagtttgagtggagaaat

SEQ ID NO: 151469 - DNA, 23 bp, Homo sapiens
cagcttttgtcttggaaagtact

SEQ ID NO: 151470 - DNA, 18 bp, Homo sapiens
tctggaatatttaaggtt

SEQ ID NO: 151471 - DNA, 23 bp, Homo sapiens
aaagtgtctagggatctgtctga

SEQ ID NO: 151472 - DNA, 18 bp, Homo sapiens
acccaggctggaatgcag

SEQ ID NO: 151473 - DNA, 19 bp, Homo sapiens
tctctctatgtacttagaa

SEQ ID NO: 151474 - DNA, 23 bp, Homo sapiens
tggtcagagtatatagtgagctg

SEQ ID NO: 151475 - DNA, 23 bp, Homo sapiens
taaatctgcaactccatgttttt

SEQ ID NO: 151476 - DNA, 18 bp, Homo sapiens
tacatatatataaagtgt

SEQ ID NO: 151477 - DNA, 18 bp, Homo sapiens
tcacacacacacagaact

SEQ ID NO: 151478 - DNA, 23 bp, Homo sapiens
tggagtctcactctgtcacccag

SEQ ID NO: 151479 - DNA, 22 bp, Homo sapiens
atattttgacaaattctattga

SEQ ID NO: 151480 - DNA, 23 bp, Homo sapiens
tgaggtcagtgtgcagacttgca

SEQ ID NO: 151481 - DNA, 22 bp, Homo sapiens
tgtgtgggcgtgtatatacact

SEQ ID NO: 151482 - DNA, 23 bp, Homo sapiens
agtgcttactgaatctcttttgc

SEQ ID NO: 151483 - DNA, 23 bp, Homo sapiens
tccgtgtcagataaaaatcacca

SEQ ID NO: 151484 - DNA, 21 bp, Homo sapiens
tgagttatgtgcataccatca

SEQ ID NO: 151485 - DNA, 23 bp, Homo sapiens
gtctctctctctgccagttttgt

SEQ ID NO: 151486 - DNA, 22 bp, Homo sapiens
ttaatggcacataaaccattgt

SEQ ID NO: 151487 - DNA, 21 bp, Homo sapiens
taatgatgataatgctctaaa

SEQ ID NO: 151488 - DNA, 23 bp, Homo sapiens
cggagtctcactctgtcaccccg

SEQ ID NO: 151489 - DNA, 23 bp, Homo sapiens
tgagttcattgtagattctggat

SEQ ID NO: 151490 - DNA, 23 bp, Homo sapiens
tgagttcattgtagattctggat

SEQ ID NO: 151491 - DNA, 23 bp, Homo sapiens
agagagtttcactgactttgcct

SEQ ID NO: 151492 - DNA, 23 bp, Homo sapiens
cagggtctcactctgtcacccag

SEQ ID NO: 151493 - DNA, 20 bp, Homo sapiens
tttggagtcagtgtctcact

SEQ ID NO: 151494 - DNA, 20 bp, Homo sapiens
acacactcacatatacatat

SEQ ID NO: 151495 - DNA, 23 bp, Homo sapiens
tatgtgtatatatatgtatgtgt

SEQ ID NO: 151496 - DNA, 23 bp, Homo sapiens
aatttgagctatagttaggtgtg

SEQ ID NO: 151497 - DNA, 20 bp, Homo sapiens
acacacacacaaatccatcc

SEQ ID NO: 151498 - DNA, 22 bp, Homo sapiens
tgtgagagtaatgtgagaggtg

SEQ ID NO: 151499 - DNA, 23 bp, Homo sapiens
tgagaacaaagtgaggagagagg

SEQ ID NO: 151500 - DNA, 23 bp, Homo sapiens
actctctctgaaccgaaactgtt

SEQ ID NO: 151501 - DNA, 23 bp, Homo sapiens
gacagggtctctgtcagtgagac

SEQ ID NO: 151502 - DNA, 20 bp, Homo sapiens
tttggtatacgtgctgctga

SEQ ID NO: 151503 - DNA, 23 bp, Homo sapiens
attttgtagtaggtagataagta

SEQ ID NO: 151504 - DNA, 23 bp, Homo sapiens
agagtctcactctgtcacccagg

SEQ ID NO: 151505 - DNA, 23 bp, Homo sapiens
gagtctcactctgtcacccaggc

SEQ ID NO: 151506 - DNA, 20 bp, Homo sapiens
aatgcctgtgctaccaacct

SEQ ID NO: 151507 - DNA, 23 bp, Homo sapiens
tgagttcattgtagattctggat

SEQ ID NO: 151508 - DNA, 23 bp, Homo sapiens
tgagttcattgtagattctggat

SEQ ID NO: 151509 - DNA, 23 bp, Homo sapiens
tgagagcaattttctctgtatgc

SEQ ID NO: 151510 - DNA, 22 bp, Homo sapiens
aatgacttcactgacacctgtt

SEQ ID NO: 151511 - DNA, 23 bp, Homo sapiens
aggtagtttgttattctcttagg

SEQ ID NO: 151512 - DNA, 23 bp, Homo sapiens
actgtcgctgtcacacagttcta

SEQ ID NO: 151513 - DNA, 23 bp, Homo sapiens
aagatgagtgaatttgatgtttg

SEQ ID NO: 151514 - DNA, 18 bp, Homo sapiens
ataatcatttcatacctt

SEQ ID NO: 151515 - DNA, 23 bp, Homo sapiens
cattaagcttcactgtttgtgtt

SEQ ID NO: 151516 - DNA, 22 bp, Homo sapiens
catttcctcgttcagttagcca

SEQ ID NO: 151517 - DNA, 23 bp, Homo sapiens
ctgaaactggaactggaactgca

SEQ ID NO: 151518 - DNA, 21 bp, Homo sapiens
tttgttctttttgcttaggat

SEQ ID NO: 151519 - DNA, 21 bp, Homo sapiens
ttctgtgaagaaagtcaatgg

SEQ ID NO: 151520 - DNA, 23 bp, Homo sapiens
atgtgtgtatatatatgtgtgtg

SEQ ID NO: 151521 - DNA, 23 bp, Homo sapiens
ctgcatgactctagttgttgttt

SEQ ID NO: 151522 - DNA, 22 bp, Homo sapiens
acagtccctcagtctctgcctg

SEQ ID NO: 151523 - DNA, 23 bp, Homo sapiens
tcagtccccactctctctctgtc

SEQ ID NO: 151524 - DNA, 23 bp, Homo sapiens
ggagtctcactctgtcacccagg

SEQ ID NO: 151525 - DNA, 21 bp, Homo sapiens
tgcaatggtgagatcttggct

SEQ ID NO: 151526 - DNA, 23 bp, Homo sapiens
actcacagagaacagagatggtg

SEQ ID NO: 151527 - DNA, 23 bp, Homo sapiens
ttagcagaacattttggagttca

SEQ ID NO: 151528 - DNA, 23 bp, Homo sapiens
atatgtatatatgtatacattac

SEQ ID NO: 151529 - DNA, 23 bp, Homo sapiens
tacatatgtatatgtatatatgt

SEQ ID NO: 151530 - DNA, 21 bp, Homo sapiens
tttctatatttgttaatgtaa

SEQ ID NO: 151531 - DNA, 22 bp, Homo sapiens
tataagctagttttctacagtg

SEQ ID NO: 151532 - DNA, 18 bp, Homo sapiens
tggaaatgtcttcctagg

SEQ ID NO: 151533 - DNA, 23 bp, Homo sapiens
tgagttcattgtagattctggat

SEQ ID NO: 151534 - DNA, 23 bp, Homo sapiens
tgagttcattgtagattctggat

SEQ ID NO: 151535 - DNA, 23 bp, Homo sapiens
tgcatatacatgcacagacatat

SEQ ID NO: 151536 - DNA, 23 bp, Homo sapiens
cgatgtaggatgtttagtagtat

SEQ ID NO: 151537 - DNA, 23 bp, Homo sapiens
tgagttcattgtagattctggat

SEQ ID NO: 151538 - DNA, 19 bp, Homo sapiens
tgaatgaagaaactgaggt

SEQ ID NO: 151539 - DNA, 23 bp, Homo sapiens
ttttgagacggagtcttgctctg

SEQ ID NO: 151540 - DNA, 18 bp, Homo sapiens
gagttctttgttccttgc

SEQ ID NO: 151541 - DNA, 18 bp, Homo sapiens
cagtggaatgatgagtgc

SEQ ID NO: 151542 - DNA, 23 bp, Homo sapiens
ccgagtctcactctgtctcccag

SEQ ID NO: 151543 - DNA, 22 bp, Homo sapiens
taagggccaggcatagtggctt

SEQ ID NO: 151544 - DNA, 23 bp, Homo sapiens
cagggtctcactctgtcacccag

SEQ ID NO: 151545 - DNA, 20 bp, Homo sapiens
tgcaatggtgagatcatggc

SEQ ID NO: 151546 - DNA, 23 bp, Homo sapiens
aagagtctcgctctgtcacccag

SEQ ID NO: 151547 - DNA, 22 bp, Homo sapiens
gagacactgactccctcagttg

SEQ ID NO: 151548 - DNA, 19 bp, Homo sapiens
agacacacaatgcggtgtg

SEQ ID NO: 151549 - DNA, 23 bp, Homo sapiens
ctgtacaaagtagtgtgtctgct

SEQ ID NO: 151550 - DNA, 20 bp, Homo sapiens
tgtctttctactttttactg

SEQ ID NO: 151551 - DNA, 18 bp, Homo sapiens
atcagtactgagtcctgg

SEQ ID NO: 151552 - DNA, 23 bp, Homo sapiens
gccaggatgtgtgtatgacatat

SEQ ID NO: 151553 - DNA, 23 bp, Homo sapiens
ttcgttctttttgcttaggattg

SEQ ID NO: 151554 - DNA, 23 bp, Homo sapiens
actactaggctgagggtctctaa

SEQ ID NO: 151555 - DNA, 23 bp, Homo sapiens
acagggtctccctctgtcactca

SEQ ID NO: 151556 - DNA, 21 bp, Homo sapiens
acatagagtatagtttttgtt

SEQ ID NO: 151557 - DNA, 22 bp, Homo sapiens
gctctctctctcaatagacaga

SEQ ID NO: 151558 - DNA, 22 bp, Homo sapiens
agatctatatatagagagaggt

SEQ ID NO: 151559 - DNA, 23 bp, Homo sapiens
tctgagctttgttaatctatagt

SEQ ID NO: 151560 - DNA, 23 bp, Homo sapiens
tgagttcattgtagattctggat

SEQ ID NO: 151561 - DNA, 23 bp, Homo sapiens
tgagttcattgtagattctggat

SEQ ID NO: 151562 - DNA, 18 bp, Homo sapiens
tatatgtgtatatatagt

SEQ ID NO: 151563 - DNA, 23 bp, Homo sapiens
gagtctcactctgtctgccaggc

SEQ ID NO: 151564 - DNA, 23 bp, Homo sapiens
tgtctccctgggtgtatgcctca

SEQ ID NO: 151565 - DNA, 19 bp, Homo sapiens
tttattcttcagttggaca

SEQ ID NO: 151566 - DNA, 19 bp, Homo sapiens
caactgatctctctggagt

SEQ ID NO: 151567 - DNA, 23 bp, Homo sapiens
attctgcaatagtaaatgtgaac

SEQ ID NO: 151568 - DNA, 23 bp, Homo sapiens
gagagaagactgaatgctcttct

SEQ ID NO: 151569 - DNA, 23 bp, Homo sapiens
tgagttcattgtagattctggat

SEQ ID NO: 151570 - DNA, 23 bp, Homo sapiens
tgagttcattgtagattctggat

SEQ ID NO: 151571 - DNA, 23 bp, Homo sapiens
gtgggtctcagtgtctgtccact

SEQ ID NO: 151572 - DNA, 20 bp, Homo sapiens
acagaaaaatatgaagtaag

SEQ ID NO: 151573 - DNA, 22 bp, Homo sapiens
ttatttggtgttcttgtagttg

SEQ ID NO: 151574 - DNA, 23 bp, Homo sapiens
agagtctcactctgtcacccagg

SEQ ID NO: 151575 - DNA, 23 bp, Homo sapiens
tttgacactgcaacttctttctc

SEQ ID NO: 151576 - DNA, 19 bp, Homo sapiens
ttttgattccatacgaatt

SEQ ID NO: 151577 - DNA, 23 bp, Homo sapiens
tgagttcattgtagattctggat

SEQ ID NO: 151578 - DNA, 23 bp, Homo sapiens
tgagttcattgtagattctggat

SEQ ID NO: 151579 - DNA, 22 bp, Homo sapiens
acaggttgcatgtaatgataat

SEQ ID NO: 151580 - DNA, 19 bp, Homo sapiens
atatgtgtgtatatgtata

SEQ ID NO: 151581 - DNA, 22 bp, Homo sapiens
taaacgttgtagttctaaacat

SEQ ID NO: 151582 - DNA, 20 bp, Homo sapiens
tatgtttatacaataggggt

SEQ ID NO: 151583 - DNA, 19 bp, Homo sapiens
tgcattcagtgttgaatgt

SEQ ID NO: 151584 - DNA, 22 bp, Homo sapiens
tttggacctcatacagaacaac

SEQ ID NO: 151585 - DNA, 23 bp, Homo sapiens
tgtgagggcaggatgttggtgtg

SEQ ID NO: 151586 - DNA, 23 bp, Homo sapiens
cagcagggtctcactgtctcgct

SEQ ID NO: 151587 - DNA, 23 bp, Homo sapiens
tgtgtcagaagtttgctccttct

SEQ ID NO: 151588 - DNA, 23 bp, Homo sapiens
tggagtctcactctgtcacccag

SEQ ID NO: 151589 - DNA, 23 bp, Homo sapiens
tgagtctcactctgtcacccagg

SEQ ID NO: 151590 - DNA, 23 bp, Homo sapiens
atgaatgaatgtgtgtgtgtgta

SEQ ID NO: 151591 - DNA, 23 bp, Homo sapiens
agacagtctcactgtgtcgccta

SEQ ID NO: 151592 - DNA, 18 bp, Homo sapiens
tggcatgatctcggctca

SEQ ID NO: 151593 - DNA, 21 bp, Homo sapiens
tgagagtagggactgtggtga

SEQ ID NO: 151594 - DNA, 23 bp, Homo sapiens
atctgtgtatatgttacatgtgt

SEQ ID NO: 151595 - DNA, 22 bp, Homo sapiens
actctgtttataaaaatgtgac

SEQ ID NO: 151596 - DNA, 23 bp, Homo sapiens
tgtgttgtttttgaatcctgcaa

SEQ ID NO: 151597 - DNA, 20 bp, Homo sapiens
tcagactataacagtcaggt

SEQ ID NO: 151598 - DNA, 22 bp, Homo sapiens
gcaagtgtgtgtgtgtggatcc

SEQ ID NO: 151599 - DNA, 22 bp, Homo sapiens
ctttcctgtttatagctgaatg

SEQ ID NO: 151600 - DNA, 23 bp, Homo sapiens
atcagtatttatctatgtgtgtg

SEQ ID NO: 151601 - DNA, 23 bp, Homo sapiens
atcaggcacactgagtcactcaa

SEQ ID NO: 151602 - DNA, 22 bp, Homo sapiens
acacacacacactttgtataca

SEQ ID NO: 151603 - DNA, 23 bp, Homo sapiens
cttcagtgtcacaaagctgtttc

SEQ ID NO: 151604 - DNA, 23 bp, Homo sapiens
tggagtctcactctgtcacccag

SEQ ID NO: 151605 - DNA, 22 bp, Homo sapiens
atctgtctgtctgtctatctat

SEQ ID NO: 151606 - DNA, 20 bp, Homo sapiens
gatagatctccagctggtct

SEQ ID NO: 151607 - DNA, 23 bp, Homo sapiens
tgagttcattgtagattctggat

SEQ ID NO: 151608 - DNA, 23 bp, Homo sapiens
tgagttcattgtagattctggat

SEQ ID NO: 151609 - DNA, 23 bp, Homo sapiens
atatatgtacataaagatatgta

SEQ ID NO: 151610 - DNA, 23 bp, Homo sapiens
atatatgcacatatagatatatg

SEQ ID NO: 151611 - DNA, 23 bp, Homo sapiens
tggagtctcgctctgtcgctcag

SEQ ID NO: 151612 - DNA, 20 bp, Homo sapiens
cagtggtgtgatcctggctc

SEQ ID NO: 151613 - DNA, 21 bp, Homo sapiens
ttctcctgcctcagcctcctg

SEQ ID NO: 151614 - DNA, 22 bp, Homo sapiens
ttttttgtatttttagacgaga

SEQ ID NO: 151615 - DNA, 23 bp, Homo sapiens
gttctgtgtgtcactctgggaga

SEQ ID NO: 151616 - DNA, 23 bp, Homo sapiens
actactgatttacatgttgtctt

SEQ ID NO: 151617 - DNA, 23 bp, Homo sapiens
tgagttcattgtagattctggat

SEQ ID NO: 151618 - DNA, 23 bp, Homo sapiens
tgagttcattgtagattctggat

SEQ ID NO: 151619 - DNA, 23 bp, Homo sapiens
ttcattgtggttttgatttgcat

SEQ ID NO: 151620 - DNA, 23 bp, Homo sapiens
tgagttcattgtagattctggat

SEQ ID NO: 151621 - DNA, 23 bp, Homo sapiens
tgagttcattgtagattctggat

SEQ ID NO: 151622 - DNA, 19 bp, Homo sapiens
attggatatttctgccaaa

SEQ ID NO: 151623 - DNA, 23 bp, Homo sapiens
agagtctcactctgtcacccagg

SEQ ID NO: 151624 - DNA, 18 bp, Homo sapiens
agtggggagatcttggct

SEQ ID NO: 151625 - DNA, 18 bp, Homo sapiens
tatgtatgtacttatgtt

SEQ ID NO: 151626 - DNA, 22 bp, Homo sapiens
tatgtatgtatgtatgtatgta

SEQ ID NO: 151627 - DNA, 23 bp, Homo sapiens
aagcagagagacataattgtgtc

SEQ ID NO: 151628 - DNA, 23 bp, Homo sapiens
tgtgtctgtctgtctgtctgtct

SEQ ID NO: 151629 - DNA, 18 bp, Homo sapiens
tttctcagacaaaacatg

SEQ ID NO: 151630 - DNA, 21 bp, Homo sapiens
ttttcatttcacaatcttgat

SEQ ID NO: 151631 - DNA, 20 bp, Homo sapiens
cacacacacacacacgtgtt

SEQ ID NO: 151632 - DNA, 21 bp, Homo sapiens
tgtgtgtgtgtgtttgtgcag

SEQ ID NO: 151633 - DNA, 21 bp, Homo sapiens
ttacaatgaacttggtggctt

SEQ ID NO: 151634 - DNA, 18 bp, Homo sapiens
agtttattaagctagctc

SEQ ID NO: 151635 - DNA, 22 bp, Homo sapiens
acacaaagtctatgaatactga

SEQ ID NO: 151636 - DNA, 21 bp, Homo sapiens
tgtgtgtatatatatatgtca

SEQ ID NO: 151637 - DNA, 23 bp, Homo sapiens
tgtgtctgagtctagctgagtct

SEQ ID NO: 151638 - DNA, 22 bp, Homo sapiens
atggactcagaatggaggaagt

SEQ ID NO: 151639 - DNA, 23 bp, Homo sapiens
tgtgtatatatatgtgtgtgttt

SEQ ID NO: 151640 - DNA, 20 bp, Homo sapiens
ttacggagtaattgaaatca

SEQ ID NO: 151641 - DNA, 22 bp, Homo sapiens
agcttgtttttgacttcacagg

SEQ ID NO: 151642 - DNA, 20 bp, Homo sapiens
tctcagatgagactgtggac

SEQ ID NO: 151643 - DNA, 22 bp, Homo sapiens
atacatctacatatttatacat

SEQ ID NO: 151644 - DNA, 23 bp, Homo sapiens
gacagagtctcgctctgtcaccc

SEQ ID NO: 151645 - DNA, 18 bp, Homo sapiens
tgtgaaggaagtcaatgg

SEQ ID NO: 151646 - DNA, 22 bp, Homo sapiens
aaactcagagatgacagtgacc

SEQ ID NO: 151647 - DNA, 20 bp, Homo sapiens
ttatctgtttatatgatagg

SEQ ID NO: 151648 - DNA, 19 bp, Homo sapiens
gtctcgctctgtcacccag

SEQ ID NO: 151649 - DNA, 22 bp, Homo sapiens
atatacacacatatatatgtgt

SEQ ID NO: 151650 - DNA, 21 bp, Homo sapiens
atatatatgtatatgtattca

SEQ ID NO: 151651 - DNA, 23 bp, Homo sapiens
ttgtttacagtttttcatgttgg

SEQ ID NO: 151652 - DNA, 22 bp, Homo sapiens
atttgtaccacagtagagggta

SEQ ID NO: 151653 - DNA, 18 bp, Homo sapiens
acaaaagaaactaaatta

SEQ ID NO: 151654 - DNA, 19 bp, Homo sapiens
atatgtgtatatatgtaca

SEQ ID NO: 151655 - DNA, 23 bp, Homo sapiens
tcagagtctcgctctgtcaccca

SEQ ID NO: 151656 - DNA, 23 bp, Homo sapiens
tcagttggagtctcactctgtca

SEQ ID NO: 151657 - DNA, 19 bp, Homo sapiens
tatatgtatatatgtatac

SEQ ID NO: 151658 - DNA, 23 bp, Homo sapiens
tgagttcattgtagattctggat

SEQ ID NO: 151659 - DNA, 23 bp, Homo sapiens
tgagttcattgtagattctggat

SEQ ID NO: 151660 - DNA, 23 bp, Homo sapiens
tgagttcattgtagattctggat

SEQ ID NO: 151661 - DNA, 23 bp, Homo sapiens
tgagttcattgtagattctggat

SEQ ID NO: 151662 - DNA, 22 bp, Homo sapiens
aatgtgcaaatgtaagaagatt

SEQ ID NO: 151663 - DNA, 23 bp, Homo sapiens
gatccagtaagttgatgatcact

SEQ ID NO: 151664 - DNA, 19 bp, Homo sapiens
tgacatcaatatgattcat

SEQ ID NO: 151665 - DNA, 23 bp, Homo sapiens
ttagagaaagctaattttgtgca

SEQ ID NO: 151666 - DNA, 22 bp, Homo sapiens
tcagaagtgattatgttgtatt

SEQ ID NO: 151667 - DNA, 22 bp, Homo sapiens
agtcaggtacttctttccaagt

SEQ ID NO: 151668 - DNA, 23 bp, Homo sapiens
tgcaatggaagtaaaagtacact

SEQ ID NO: 151669 - DNA, 23 bp, Homo sapiens
tgagttcattgtagattctggat

SEQ ID NO: 151670 - DNA, 23 bp, Homo sapiens
tgagttcattgtagattctggat

SEQ ID NO: 151671 - DNA, 21 bp, Homo sapiens
atagagcaagtctattggtac

SEQ ID NO: 151672 - DNA, 21 bp, Homo sapiens
tcaatttttggctttttgttg

SEQ ID NO: 151673 - DNA, 23 bp, Homo sapiens
tggagtctcactctgtcacccag

SEQ ID NO: 151674 - DNA, 23 bp, Homo sapiens
tgagttcattgtagattctggat

SEQ ID NO: 151675 - DNA, 23 bp, Homo sapiens
tgagttcattgtagattctggat

SEQ ID NO: 151676 - DNA, 23 bp, Homo sapiens
ttactgcatccttatcttctctg

SEQ ID NO: 151677 - DNA, 23 bp, Homo sapiens
ctctctggttcttattctgtctg

SEQ ID NO: 151678 - DNA, 23 bp, Homo sapiens
atactggcagggatacatgccag

SEQ ID NO: 151679 - DNA, 23 bp, Homo sapiens
tctctgtctctctgggtctgttt

SEQ ID NO: 151680 - DNA, 18 bp, Homo sapiens
agtcaagatagtcagaac

SEQ ID NO: 151681 - DNA, 23 bp, Homo sapiens
agtctcactcccactgtctcccc

SEQ ID NO: 151682 - DNA, 23 bp, Homo sapiens
tcaccctgagtgactctctgtga

SEQ ID NO: 151683 - DNA, 23 bp, Homo sapiens
tgtgtctttatctctctgtattc

SEQ ID NO: 151684 - DNA, 23 bp, Homo sapiens
tctgagaggctgtgtctcaattg

SEQ ID NO: 151685 - DNA, 23 bp, Homo sapiens
tgagttcattgtagattctggat

SEQ ID NO: 151686 - DNA, 23 bp, Homo sapiens
tgagttcattgtagattctggat

SEQ ID NO: 151687 - DNA, 23 bp, Homo sapiens
agtgtcaacttgtttggattgaa

SEQ ID NO: 151688 - DNA, 22 bp, Homo sapiens
taaccatttgtgggtcatgaaa

SEQ ID NO: 151689 - DNA, 23 bp, Homo sapiens
tagagtctcactctgtctcccag

SEQ ID NO: 151690 - DNA, 23 bp, Homo sapiens
cggagtctcactctgtcacccag

SEQ ID NO: 151691 - DNA, 23 bp, Homo sapiens
tgagttcattgtagattctggat

SEQ ID NO: 151692 - DNA, 23 bp, Homo sapiens
tgagttcattgtagattctggat

SEQ ID NO: 151693 - DNA, 19 bp, Homo sapiens
gttatgtgaggttacatat

SEQ ID NO: 151694 - DNA, 23 bp, Homo sapiens
tgagttcattgtagattctggat

SEQ ID NO: 151695 - DNA, 23 bp, Homo sapiens
tgagttcattgtagattctggat

SEQ ID NO: 151696 - DNA, 23 bp, Homo sapiens
tgagttcattgtagattctggat

SEQ ID NO: 151697 - DNA, 23 bp, Homo sapiens
tgagttcattgtagattctggat

SEQ ID NO: 151698 - DNA, 20 bp, Homo sapiens
aacaagtaagtattatactt

SEQ ID NO: 151699 - DNA, 23 bp, Homo sapiens
acacacacacacatatatatgtg

SEQ ID NO: 151700 - DNA, 23 bp, Homo sapiens
tgtatacatgtatgtgtgtatac

SEQ ID NO: 151701 - DNA, 23 bp, Homo sapiens
tgtatacatgtatgtgtgtatac

SEQ ID NO: 151702 - DNA, 23 bp, Homo sapiens
tgtatacatgtatgtgtgtatac

SEQ ID NO: 151703 - DNA, 22 bp, Homo sapiens
atatgtatatatgtatgtgtgt

SEQ ID NO: 151704 - DNA, 21 bp, Homo sapiens
atatgtatatatgtatgtgtg

SEQ ID NO: 151705 - DNA, 21 bp, Homo sapiens
tatgtgtatatgtatatgtat

SEQ ID NO: 151706 - DNA, 21 bp, Homo sapiens
tatgtatatatgtttgtgtgt

SEQ ID NO: 151707 - DNA, 22 bp, Homo sapiens
ctacagtaggcctttgctactt

SEQ ID NO: 151708 - DNA, 23 bp, Homo sapiens
tgggggctctctctctctctctc

SEQ ID NO: 151709 - DNA, 23 bp, Homo sapiens
gtgtgtgtctgtgtgtgtataca

SEQ ID NO: 151710 - DNA, 23 bp, Homo sapiens
tctctctttctgtctttcaatag

SEQ ID NO: 151711 - DNA, 21 bp, Homo sapiens
gtttagctctctctctctctc

SEQ ID NO: 151712 - DNA, 23 bp, Homo sapiens
tgagttcattgtagattctggat

SEQ ID NO: 151713 - DNA, 23 bp, Homo sapiens
tgagttcattgtagattctggat

SEQ ID NO: 151714 - DNA, 20 bp, Homo sapiens
ttttttcttcccatttgaat

SEQ ID NO: 151715 - DNA, 22 bp, Homo sapiens
actgacagatcagagagagagg

SEQ ID NO: 151716 - DNA, 22 bp, Homo sapiens
acaataactgcttcacacattt

SEQ ID NO: 151717 - DNA, 23 bp, Homo sapiens
taaaagggtcatcaatgaggtca

SEQ ID NO: 151718 - DNA, 18 bp, Homo sapiens
agtagtttattgttgcag

SEQ ID NO: 151719 - DNA, 23 bp, Homo sapiens
gggtttcactctgtcactcaggc

SEQ ID NO: 151720 - DNA, 19 bp, Homo sapiens
aggttatatatccagaaaa

SEQ ID NO: 151721 - DNA, 23 bp, Homo sapiens
ttgtatgtgtgcatgtatttatg

SEQ ID NO: 151722 - DNA, 23 bp, Homo sapiens
tgtctgcatgtatgtatgtatct

SEQ ID NO: 151723 - DNA, 23 bp, Homo sapiens
cacatgcacatacactgtagaca

SEQ ID NO: 151724 - DNA, 23 bp, Homo sapiens
tctctgagagcatttggacatac

SEQ ID NO: 151725 - DNA, 22 bp, Homo sapiens
ggtacattgttgtatagtttcc

SEQ ID NO: 151726 - DNA, 18 bp, Homo sapiens
tgagtatatatatactga

SEQ ID NO: 151727 - DNA, 19 bp, Homo sapiens
gagtgagttaagactttgg

SEQ ID NO: 151728 - DNA, 23 bp, Homo sapiens
ctactaggctgagggtctctaag

SEQ ID NO: 151729 - DNA, 23 bp, Homo sapiens
cctctgtgtctcaggcagttctt

SEQ ID NO: 151730 - DNA, 19 bp, Homo sapiens
gtgaatatatatatatgtg

SEQ ID NO: 151731 - DNA, 23 bp, Homo sapiens
cagtcattttgtagaaaggtgta

SEQ ID NO: 151732 - DNA, 23 bp, Homo sapiens
ttagaaaactgattttgttcttc

SEQ ID NO: 151733 - DNA, 22 bp, Homo sapiens
tttgtgtgccaggattctaagt

SEQ ID NO: 151734 - DNA, 23 bp, Homo sapiens
ttttgtgaccatggcatacatca

SEQ ID NO: 151735 - DNA, 19 bp, Homo sapiens
tatatactacttagtgtag

SEQ ID NO: 151736 - DNA, 23 bp, Homo sapiens
tattaccttattctaagtgtgtg

SEQ ID NO: 151737 - DNA, 22 bp, Homo sapiens
atatatctatatgtagaaatca

SEQ ID NO: 151738 - DNA, 23 bp, Homo sapiens
tctcactgactcacactgtggtt

SEQ ID NO: 151739 - DNA, 21 bp, Homo sapiens
ttgttatttgagcctgtcaga

SEQ ID NO: 151740 - DNA, 23 bp, Homo sapiens
ggctgtgtgtagtgagtgtccag

SEQ ID NO: 151741 - DNA, 23 bp, Homo sapiens
tcactcactcacacaccacttgc

SEQ ID NO: 151742 - DNA, 23 bp, Homo sapiens
ggagtctcactctgtcacccagg

SEQ ID NO: 151743 - DNA, 18 bp, Homo sapiens
caggagcacaaaaccatg

SEQ ID NO: 151744 - DNA, 23 bp, Homo sapiens
tatgtgtgtgtatatgtacatac

SEQ ID NO: 151745 - DNA, 21 bp, Homo sapiens
atttacctagtagtcattcag

SEQ ID NO: 151746 - DNA, 22 bp, Homo sapiens
tttgtactatttaaatgttgat

SEQ ID NO: 151747 - DNA, 23 bp, Homo sapiens
tttaaatgtggtatagtatacta

SEQ ID NO: 151748 - DNA, 19 bp, Homo sapiens
tatgtgtgtatatatgtgt

SEQ ID NO: 151749 - DNA, 19 bp, Homo sapiens
tagtgtctagaatgagaag

SEQ ID NO: 151750 - DNA, 23 bp, Homo sapiens
tgtgtgtatatatatatgtgtgt

SEQ ID NO: 151751 - DNA, 22 bp, Homo sapiens
tatgtatacacacacaaaatgt

SEQ ID NO: 151752 - DNA, 22 bp, Homo sapiens
ggttctcttttagtgtgcagaa

SEQ ID NO: 151753 - DNA, 23 bp, Homo sapiens
aacaaagtgaagagacagtccac

SEQ ID NO: 151754 - DNA, 23 bp, Homo sapiens
attgtatatatacatatgtgtat

SEQ ID NO: 151755 - DNA, 22 bp, Homo sapiens
tcaggaccctatatttgtcttt

SEQ ID NO: 151756 - DNA, 23 bp, Homo sapiens
atatatatgtgttatgtgtgtgt

SEQ ID NO: 151757 - DNA, 23 bp, Homo sapiens
atacacacacacgtaatgtaagt

SEQ ID NO: 151758 - DNA, 23 bp, Homo sapiens
tgtatgcatgtatttaagtatgt

SEQ ID NO: 151759 - DNA, 20 bp, Homo sapiens
ttaacttcatatatatgtac

SEQ ID NO: 151760 - DNA, 21 bp, Homo sapiens
taaatgtatgtatatatgtgt

SEQ ID NO: 151761 - DNA, 21 bp, Homo sapiens
ggtacttagtgagtgtcagtg

SEQ ID NO: 151762 - DNA, 23 bp, Homo sapiens
tcaaactgcatatccaagtggaa

SEQ ID NO: 151763 - DNA, 23 bp, Homo sapiens
taggatgtgtctcagtcacacac

SEQ ID NO: 151764 - DNA, 19 bp, Homo sapiens
aattttccagtttttccaa

SEQ ID NO: 151765 - DNA, 23 bp, Homo sapiens
atatgtatatgtgtatatgtgta

SEQ ID NO: 151766 - DNA, 23 bp, Homo sapiens
tcaaatgttagtctcatttggca

SEQ ID NO: 151767 - DNA, 23 bp, Homo sapiens
tgtctgtctctgtcttagttgcc

SEQ ID NO: 151768 - DNA, 22 bp, Homo sapiens
tatatattgagcatctactttg

SEQ ID NO: 151769 - DNA, 19 bp, Homo sapiens
gtgtatatatatacagata

SEQ ID NO: 151770 - DNA, 23 bp, Homo sapiens
tgagttcattgtagattctggat

SEQ ID NO: 151771 - DNA, 23 bp, Homo sapiens
tgagttcattgtagattctggat

SEQ ID NO: 151772 - DNA, 19 bp, Homo sapiens
tatatatatgttgttgttg

SEQ ID NO: 151773 - DNA, 19 bp, Homo sapiens
gtatgtatgtttgtctctc

SEQ ID NO: 151774 - DNA, 23 bp, Homo sapiens
cactcactcacactttcctgtgt

SEQ ID NO: 151775 - DNA, 23 bp, Homo sapiens
ttgctccttatgatatcactctt

SEQ ID NO: 151776 - DNA, 22 bp, Homo sapiens
atgtgtatacatacatatgtgt

SEQ ID NO: 151777 - DNA, 20 bp, Homo sapiens
atgtgtataaatatatatgt

SEQ ID NO: 151778 - DNA, 23 bp, Homo sapiens
gagtctcactctgtcactcaggc

SEQ ID NO: 151779 - DNA, 18 bp, Homo sapiens
agtctagtgactttcttg

SEQ ID NO: 151780 - DNA, 18 bp, Homo sapiens
catgactgtatatgttca

SEQ ID NO: 151781 - DNA, 23 bp, Homo sapiens
agagaagacagagattctgctgt

SEQ ID NO: 151782 - DNA, 23 bp, Homo sapiens
acactagtgaattgagctctttg

SEQ ID NO: 151783 - DNA, 23 bp, Homo sapiens
acactctgtacctgtgtgtgtgt

SEQ ID NO: 151784 - DNA, 18 bp, Homo sapiens
atacatacaagtatacat

SEQ ID NO: 151785 - DNA, 20 bp, Homo sapiens
atcagaggagaatacttgtt

SEQ ID NO: 151786 - DNA, 23 bp, Homo sapiens
ttgtccagttttctaggttaagg

SEQ ID NO: 151787 - DNA, 18 bp, Homo sapiens
attgagctgagactgcgc

SEQ ID NO: 151788 - DNA, 21 bp, Homo sapiens
attgtctgcctttctgcaggg

SEQ ID NO: 151789 - DNA, 20 bp, Homo sapiens
tgagagaagatagaaaggac

SEQ ID NO: 151790 - DNA, 21 bp, Homo sapiens
actgcatttcctgtagctaga

SEQ ID NO: 151791 - DNA, 23 bp, Homo sapiens
cagagtctcactctgtcacccag

SEQ ID NO: 151792 - DNA, 23 bp, Homo sapiens
tctctcactatatctatgtgtgt

SEQ ID NO: 151793 - DNA, 23 bp, Homo sapiens
aggtgatactagtggatatgata

SEQ ID NO: 151794 - DNA, 23 bp, Homo sapiens
ctttgctgttattctgtctccta

SEQ ID NO: 151795 - DNA, 19 bp, Homo sapiens
tggtgtgatctccgcttac

SEQ ID NO: 151796 - DNA, 21 bp, Homo sapiens
acaggtacatgtgtgtatata

SEQ ID NO: 151797 - DNA, 23 bp, Homo sapiens
ttgtttagatattgttgctgttt

SEQ ID NO: 151798 - DNA, 21 bp, Homo sapiens
tgaggtaggaggttgcagtga

SEQ ID NO: 151799 - DNA, 20 bp, Homo sapiens
ttaccatttaaaatcctgag

SEQ ID NO: 151800 - DNA, 18 bp, Homo sapiens
tgatttatcattatggag

SEQ ID NO: 151801 - DNA, 23 bp, Homo sapiens
aatctctctctgtgtggattagt

SEQ ID NO: 151802 - DNA, 23 bp, Homo sapiens
cagctccaggtgctgactgtcat

SEQ ID NO: 151803 - DNA, 23 bp, Homo sapiens
gacggtctcactctgtcacccag

SEQ ID NO: 151804 - DNA, 20 bp, Homo sapiens
agtatatatatgtatgtgtg

SEQ ID NO: 151805 - DNA, 23 bp, Homo sapiens
atgtatgtatgcatgtatatgtg

SEQ ID NO: 151806 - DNA, 20 bp, Homo sapiens
aggatcctctgaagaatgta

SEQ ID NO: 151807 - DNA, 20 bp, Homo sapiens
tttgagacggagtctcgctc

SEQ ID NO: 151808 - DNA, 19 bp, Homo sapiens
tttgacacttaggtcttct

SEQ ID NO: 151809 - DNA, 23 bp, Homo sapiens
atacatgtgtatgtgtgtgtata

SEQ ID NO: 151810 - DNA, 23 bp, Homo sapiens
tatgtgtatatatatgtgtgtgt

SEQ ID NO: 151811 - DNA, 23 bp, Homo sapiens
agccagagtctcactctgttacc

SEQ ID NO: 151812 - DNA, 22 bp, Homo sapiens
atttcagtgatcttatgatagc

SEQ ID NO: 151813 - DNA, 23 bp, Homo sapiens
gagacagtctcgctctgtcaccc

SEQ ID NO: 151814 - DNA, 20 bp, Homo sapiens
tctgattctgtctctctcaa

SEQ ID NO: 151815 - DNA, 18 bp, Homo sapiens
cctgtgatcccagttact

SEQ ID NO: 151816 - DNA, 23 bp, Homo sapiens
tgatacactctctatgtttaagt

SEQ ID NO: 151817 - DNA, 23 bp, Homo sapiens
attaagccagcttttatagatgt

SEQ ID NO: 151818 - DNA, 22 bp, Homo sapiens
caaaatgattggggtgtctgag

SEQ ID NO: 151819 - DNA, 22 bp, Homo sapiens
agtgtagtgatttagaacaact

SEQ ID NO: 151820 - DNA, 22 bp, Homo sapiens
tgcttttcattctactgtgtat

SEQ ID NO: 151821 - DNA, 19 bp, Homo sapiens
agaggtaaaaatatgtttt

SEQ ID NO: 151822 - DNA, 23 bp, Homo sapiens
tgagttcattgtagattctggat

SEQ ID NO: 151823 - DNA, 23 bp, Homo sapiens
tgagttcattgtagattctggat

SEQ ID NO: 151824 - DNA, 23 bp, Homo sapiens
cagggtctcactctgtcacccag

SEQ ID NO: 151825 - DNA, 23 bp, Homo sapiens
agtctcactctgtcacccaggct

SEQ ID NO: 151826 - DNA, 23 bp, Homo sapiens
gtgtgtgtgtgtgtgtacaggcc

SEQ ID NO: 151827 - DNA, 18 bp, Homo sapiens
tctgtaattacagcactt

SEQ ID NO: 151828 - DNA, 23 bp, Homo sapiens
tgaagtcagtagttagagaccag

SEQ ID NO: 151829 - DNA, 23 bp, Homo sapiens
atgtgtgtgtgtgtatatgtata

SEQ ID NO: 151830 - DNA, 23 bp, Homo sapiens
tgagttcattgtagattctggat

SEQ ID NO: 151831 - DNA, 23 bp, Homo sapiens
tgagttcattgtagattctggat

SEQ ID NO: 151832 - DNA, 23 bp, Homo sapiens
atgtatatagacacatctatact

SEQ ID NO: 151833 - DNA, 22 bp, Homo sapiens
tatgtaaatttgtatgtatgtg

SEQ ID NO: 151834 - DNA, 23 bp, Homo sapiens
aacaattagaagtggctgctttc

SEQ ID NO: 151835 - DNA, 22 bp, Homo sapiens
tatgtcattttctttatttgtt

SEQ ID NO: 151836 - DNA, 23 bp, Homo sapiens
ctgggactctccttctgtgtctc

SEQ ID NO: 151837 - DNA, 23 bp, Homo sapiens
attgtaaaactgctggttctgtt

SEQ ID NO: 151838 - DNA, 20 bp, Homo sapiens
tctgtctctgctgttggcac

SEQ ID NO: 151839 - DNA, 23 bp, Homo sapiens
agtgtgtgtgtgcatatgtgtgt

SEQ ID NO: 151840 - DNA, 23 bp, Homo sapiens
tctggaagacttgggtttttgta

SEQ ID NO: 151841 - DNA, 23 bp, Homo sapiens
gtagcaccatatgataggggaga

SEQ ID NO: 151842 - DNA, 23 bp, Homo sapiens
attcactgctgtcatcgcaggtg

SEQ ID NO: 151843 - DNA, 23 bp, Homo sapiens
ttaaagtacttgaggtgcagact

SEQ ID NO: 151844 - DNA, 23 bp, Homo sapiens
cggagtctcactctgtcacccag

SEQ ID NO: 151845 - DNA, 18 bp, Homo sapiens
aaagagtccatttttttt

SEQ ID NO: 151846 - DNA, 23 bp, Homo sapiens
gtacagagaaaagagaatgaact

SEQ ID NO: 151847 - DNA, 21 bp, Homo sapiens
tctctcttgagactttctgtt

SEQ ID NO: 151848 - DNA, 22 bp, Homo sapiens
tggttatatatagacatttgta

SEQ ID NO: 151849 - DNA, 20 bp, Homo sapiens
ctctctctctctcagaaggc

SEQ ID NO: 151850 - DNA, 22 bp, Homo sapiens
tgtctggagctgtaggaggagt

SEQ ID NO: 151851 - DNA, 23 bp, Homo sapiens
tgtgtgtatatatatatgtgtgt

SEQ ID NO: 151852 - DNA, 23 bp, Homo sapiens
tgtgagtatatgtgcatgtgtgt

SEQ ID NO: 151853 - DNA, 23 bp, Homo sapiens
tgagttcattgtagattctggat

SEQ ID NO: 151854 - DNA, 23 bp, Homo sapiens
tgagttcattgtagattctggat

SEQ ID NO: 151855 - DNA, 23 bp, Homo sapiens
ataacacattttgtttatctgtc

SEQ ID NO: 151856 - DNA, 22 bp, Homo sapiens
tgtgtatatatgtgtgtgtgta

SEQ ID NO: 151857 - DNA, 19 bp, Homo sapiens
gggcagagtctgaaatatc

SEQ ID NO: 151858 - DNA, 23 bp, Homo sapiens
agacagcacagtgtgagtaattg

SEQ ID NO: 151859 - DNA, 20 bp, Homo sapiens
tgcctccctctctgccactg

SEQ ID NO: 151860 - DNA, 19 bp, Homo sapiens
ttctatgtatatatctctg

SEQ ID NO: 151861 - DNA, 22 bp, Homo sapiens
atagatccatctgtataggtat

SEQ ID NO: 151862 - DNA, 19 bp, Homo sapiens
agtcgcacaatattcccaa

SEQ ID NO: 151863 - DNA, 20 bp, Homo sapiens
cagtgatgtttggtgttact

SEQ ID NO: 151864 - DNA, 20 bp, Homo sapiens
tctagattacttcaaatacc

SEQ ID NO: 151865 - DNA, 22 bp, Homo sapiens
attaactgctgattcaacttat

SEQ ID NO: 151866 - DNA, 22 bp, Homo sapiens
ttgcctatttatttttgtgtga

SEQ ID NO: 151867 - DNA, 21 bp, Homo sapiens
gagtgcatgttcagtttagga

SEQ ID NO: 151868 - DNA, 23 bp, Homo sapiens
atgtgtgtgtgtgtatatataca

SEQ ID NO: 151869 - DNA, 18 bp, Homo sapiens
acacgtatatatgcatac

SEQ ID NO: 151870 - DNA, 18 bp, Homo sapiens
acacgtatatatgcatac

SEQ ID NO: 151871 - DNA, 20 bp, Homo sapiens
atgcctatgtatatctatct

SEQ ID NO: 151872 - DNA, 19 bp, Homo sapiens
tgcagtgttatttaggaca

SEQ ID NO: 151873 - DNA, 23 bp, Homo sapiens
actgtgtcacattttgtttatct

SEQ ID NO: 151874 - DNA, 19 bp, Homo sapiens
tgaattttcatgtagcatg

SEQ ID NO: 151875 - DNA, 23 bp, Homo sapiens
gagagagaacagactttggagtt

SEQ ID NO: 151876 - DNA, 20 bp, Homo sapiens
gtatttgctgtctttccaga

SEQ ID NO: 151877 - DNA, 23 bp, Homo sapiens
aagaaagaacagatttggagtag

SEQ ID NO: 151878 - DNA, 23 bp, Homo sapiens
tatatgtatatatacatatgtgt

SEQ ID NO: 151879 - DNA, 23 bp, Homo sapiens
agtatgcttattgtttgtgctaa

SEQ ID NO: 151880 - DNA, 23 bp, Homo sapiens
gaaaaacagagatatatagacag

SEQ ID NO: 151881 - DNA, 23 bp, Homo sapiens
tctcagctttccttgaagtaaca

SEQ ID NO: 151882 - DNA, 23 bp, Homo sapiens
agactcagatttctagtccaagc

SEQ ID NO: 151883 - DNA, 23 bp, Homo sapiens
acttctttatttgtaattctgag

SEQ ID NO: 151884 - DNA, 21 bp, Homo sapiens
ttagctttgtggagttttgtg

SEQ ID NO: 151885 - DNA, 23 bp, Homo sapiens
tgaatccaattcaaactctaagt

SEQ ID NO: 151886 - DNA, 23 bp, Homo sapiens
ttgcttgtctacatattgctgtc

SEQ ID NO: 151887 - DNA, 23 bp, Homo sapiens
acatctctgtgactgatggttct

SEQ ID NO: 151888 - DNA, 23 bp, Homo sapiens
taagtcctactgattttatttct

SEQ ID NO: 151889 - DNA, 22 bp, Homo sapiens
tatgtctctggtttgggacagt

SEQ ID NO: 151890 - DNA, 23 bp, Homo sapiens
attgtcatatataaggtatgtaa

SEQ ID NO: 151891 - DNA, 23 bp, Homo sapiens
tatttccttgctctgtcaactga

SEQ ID NO: 151892 - DNA, 23 bp, Homo sapiens
tctatgtatgtatgtttgcatgt

SEQ ID NO: 151893 - DNA, 23 bp, Homo sapiens
tctctctctcaattggttccttc

SEQ ID NO: 151894 - DNA, 23 bp, Homo sapiens
tatgtgtgtggatatatacacat

SEQ ID NO: 151895 - DNA, 23 bp, Homo sapiens
taaatgtatgtttatgtatacat

SEQ ID NO: 151896 - DNA, 18 bp, Homo sapiens
ggttcagtgtatctatgc

SEQ ID NO: 151897 - DNA, 19 bp, Homo sapiens
tcacactcagaagctatac

SEQ ID NO: 151898 - DNA, 18 bp, Homo sapiens
actatattaaatgactat

SEQ ID NO: 151899 - DNA, 20 bp, Homo sapiens
aatactttatttgaatttca

SEQ ID NO: 151900 - DNA, 21 bp, Homo sapiens
tgtgtatatatatatctgtgt

SEQ ID NO: 151901 - DNA, 21 bp, Homo sapiens
atgtgtatacatgtatatgta

SEQ ID NO: 151902 - DNA, 21 bp, Homo sapiens
tgtgtatatatgtgtatgtat

SEQ ID NO: 151903 - DNA, 23 bp, Homo sapiens
gtctctttcagtgacttttatga

SEQ ID NO: 151904 - DNA, 23 bp, Homo sapiens
tagaaggtacagtgtgacctgag

SEQ ID NO: 151905 - DNA, 23 bp, Homo sapiens
tctctggctctgaaacaccacat

SEQ ID NO: 151906 - DNA, 18 bp, Homo sapiens
aatatagagtgggagcag

SEQ ID NO: 151907 - DNA, 23 bp, Homo sapiens
tgagttcattgtagattctggat

SEQ ID NO: 151908 - DNA, 23 bp, Homo sapiens
tgagttcattgtagattctggat

SEQ ID NO: 151909 - DNA, 23 bp, Homo sapiens
tgtgtgtctgtgtgtgtgtatac

SEQ ID NO: 151910 - DNA, 23 bp, Homo sapiens
ggatctgagatttgagagaggcc

SEQ ID NO: 151911 - DNA, 21 bp, Homo sapiens
tatatctaaaggatattgttg

SEQ ID NO: 151912 - DNA, 23 bp, Homo sapiens
tgttcacagaacatagtctactg

SEQ ID NO: 151913 - DNA, 22 bp, Homo sapiens
atgaatatgtacatgtataagt

SEQ ID NO: 151914 - DNA, 22 bp, Homo sapiens
acagaaatatttatgaggtcca

SEQ ID NO: 151915 - DNA, 23 bp, Homo sapiens
ctctcggtctctgtgtctctgtc

SEQ ID NO: 151916 - DNA, 23 bp, Homo sapiens
tatgaatgtatatgtatgtgtgt

SEQ ID NO: 151917 - DNA, 22 bp, Homo sapiens
ataaatatgtatgcatttgtgt

SEQ ID NO: 151918 - DNA, 21 bp, Homo sapiens
tattcacacacacatacaagt

SEQ ID NO: 151919 - DNA, 23 bp, Homo sapiens
gacagagtctcactctgtcgccc

SEQ ID NO: 151920 - DNA, 20 bp, Homo sapiens
tgcagcagtgtgattttggc

SEQ ID NO: 151921 - DNA, 22 bp, Homo sapiens
tgtcacttgaaattttcttttt

SEQ ID NO: 151922 - DNA, 23 bp, Homo sapiens
ttctatgtatttgttattgtgaa

SEQ ID NO: 151923 - DNA, 20 bp, Homo sapiens
gagtccatgtgtcttgttgg

SEQ ID NO: 151924 - DNA, 18 bp, Homo sapiens
tcaagtttctctcctctt

SEQ ID NO: 151925 - DNA, 23 bp, Homo sapiens
tacacacacacacacatacgcat

SEQ ID NO: 151926 - DNA, 23 bp, Homo sapiens
ttgaatgcatagatgaatgtgct

SEQ ID NO: 151927 - DNA, 18 bp, Homo sapiens
taagtgtatgcatatata

SEQ ID NO: 151928 - DNA, 23 bp, Homo sapiens
catgtgtgtgcatgatatatgca

SEQ ID NO: 151929 - DNA, 18 bp, Homo sapiens
tgtggaatccatccaaat

SEQ ID NO: 151930 - DNA, 21 bp, Homo sapiens
cctgggtcccagtttcttctg

SEQ ID NO: 151931 - DNA, 22 bp, Homo sapiens
tatgtatatatatatgtgtaca

SEQ ID NO: 151932 - DNA, 23 bp, Homo sapiens
atatgtatatatatatgtgtaca

SEQ ID NO: 151933 - DNA, 23 bp, Homo sapiens
gatggagtctcactctgtcaccc

SEQ ID NO: 151934 - DNA, 19 bp, Homo sapiens
tgaggaagtaggatcactt

SEQ ID NO: 151935 - DNA, 23 bp, Homo sapiens
agaacatctgctttacatttgga

SEQ ID NO: 151936 - DNA, 23 bp, Homo sapiens
tgagttcattgtagattctggat

SEQ ID NO: 151937 - DNA, 23 bp, Homo sapiens
tgagttcattgtagattctggat

SEQ ID NO: 151938 - DNA, 20 bp, Homo sapiens
tcacattatatatatatgta

SEQ ID NO: 151939 - DNA, 20 bp, Homo sapiens
tctcaattaaatatgtagac

SEQ ID NO: 151940 - DNA, 23 bp, Homo sapiens
agtagatgtcttcttgtttatac

SEQ ID NO: 151941 - DNA, 23 bp, Homo sapiens
ctcccagagcccctggaactctg

SEQ ID NO: 151942 - DNA, 23 bp, Homo sapiens
tcccagagcccctggaactctgg

SEQ ID NO: 151943 - DNA, 23 bp, Homo sapiens
tcccagagcccctggaactctgg

SEQ ID NO: 151944 - DNA, 23 bp, Homo sapiens
tcccagagcccctggaactctgg

SEQ ID NO: 151945 - DNA, 23 bp, Homo sapiens
tatgtatgtatatgtgtgtgtgt

SEQ ID NO: 151946 - DNA, 21 bp, Homo sapiens
atatatgtatgtatatgtgtg

SEQ ID NO: 151947 - DNA, 23 bp, Homo sapiens
gtgactgcctgactgcctgactg

SEQ ID NO: 151948 - DNA, 21 bp, Homo sapiens
ttaaacatatgtgtgtgtata

SEQ ID NO: 151949 - DNA, 21 bp, Homo sapiens
tgtatatatttaatgtgtaga

SEQ ID NO: 151950 - DNA, 20 bp, Homo sapiens
atccctatatatgtatgtgt

SEQ ID NO: 151951 - DNA, 23 bp, Homo sapiens
tacggagaagaaagtgaagagga

SEQ ID NO: 151952 - DNA, 20 bp, Homo sapiens
ttaccatttttctgtgtgct

SEQ ID NO: 151953 - DNA, 22 bp, Homo sapiens
tattgtatatttacaatagaca

SEQ ID NO: 151954 - DNA, 23 bp, Homo sapiens
ttctctacatatatgtgtgtgtg

SEQ ID NO: 151955 - DNA, 23 bp, Homo sapiens
tgtctcattatctcactcattta

SEQ ID NO: 151956 - DNA, 23 bp, Homo sapiens
ttgaaactcgtggatttgtgggc

SEQ ID NO: 151957 - DNA, 21 bp, Homo sapiens
tacaaacatcatgttttcgct

SEQ ID NO: 151958 - DNA, 21 bp, Homo sapiens
taaaactgcataaatgtaaga

SEQ ID NO: 151959 - DNA, 23 bp, Homo sapiens
acggactctcactctgtcgccca

SEQ ID NO: 151960 - DNA, 23 bp, Homo sapiens
ggagtctcactctgtctcccagg

SEQ ID NO: 151961 - DNA, 18 bp, Homo sapiens
cagtggtgagatttctgt

SEQ ID NO: 151962 - DNA, 19 bp, Homo sapiens
tgtatgtatgtatatatgt

SEQ ID NO: 151963 - DNA, 19 bp, Homo sapiens
tgtgcttgatatattatat

SEQ ID NO: 151964 - DNA, 18 bp, Homo sapiens
gagagagagagagggaga

SEQ ID NO: 151965 - DNA, 23 bp, Homo sapiens
tatgcaacaggaggaattagtaa

SEQ ID NO: 151966 - DNA, 23 bp, Homo sapiens
atttgtgcatctatatgtataga

SEQ ID NO: 151967 - DNA, 20 bp, Homo sapiens
atatatatgtacatgtacat

SEQ ID NO: 151968 - DNA, 23 bp, Homo sapiens
gagtctcgctcactcagtgctca

SEQ ID NO: 151969 - DNA, 23 bp, Homo sapiens
tgtgtgtgtgtgtatatatattg

SEQ ID NO: 151970 - DNA, 18 bp, Homo sapiens
gtgtatatatatacacat

SEQ ID NO: 151971 - DNA, 23 bp, Homo sapiens
tctggttgttggttgtataatgt

SEQ ID NO: 151972 - DNA, 23 bp, Homo sapiens
cttgtcagaaaggagattgatta

SEQ ID NO: 151973 - DNA, 23 bp, Homo sapiens
tcttcagagtggcagttcattat

SEQ ID NO: 151974 - DNA, 23 bp, Homo sapiens
tatctagtacctgaaagcaagtt

SEQ ID NO: 151975 - DNA, 23 bp, Homo sapiens
tatagagttcttggtattctgaa

SEQ ID NO: 151976 - DNA, 23 bp, Homo sapiens
aattgcaagataatcatctgtgt

SEQ ID NO: 151977 - DNA, 23 bp, Homo sapiens
ttacagtagcaatagaaaactaa

SEQ ID NO: 151978 - DNA, 23 bp, Homo sapiens
attatgagtactgattttgttat

SEQ ID NO: 151979 - DNA, 23 bp, Homo sapiens
atatatgtatgtgtgtgtgtgtg

SEQ ID NO: 151980 - DNA, 19 bp, Homo sapiens
ttattccctttgtgatctg

SEQ ID NO: 151981 - DNA, 23 bp, Homo sapiens
tctctctgtgtgtatatgtgtgt

SEQ ID NO: 151982 - DNA, 23 bp, Homo sapiens
tgaggtaggaggatcagttgggt

SEQ ID NO: 151983 - DNA, 21 bp, Homo sapiens
tattgaagtagttagagatgt

SEQ ID NO: 151984 - DNA, 23 bp, Homo sapiens
tatatacacacatatatatgact

SEQ ID NO: 151985 - DNA, 22 bp, Homo sapiens
tagtccataaacattctggact

SEQ ID NO: 151986 - DNA, 23 bp, Homo sapiens
atatggctttgctagctctttgt

SEQ ID NO: 151987 - DNA, 18 bp, Homo sapiens
agagttggaagattggag

SEQ ID NO: 151988 - DNA, 22 bp, Homo sapiens
taaacttaagtctagccagcca

SEQ ID NO: 151989 - DNA, 20 bp, Homo sapiens
tgtagtgtttggtagcacaa

SEQ ID NO: 151990 - DNA, 23 bp, Homo sapiens
tgaggctgataatgcgtatgtct

SEQ ID NO: 151991 - DNA, 23 bp, Homo sapiens
aacacacacagcatgtattgact

SEQ ID NO: 151992 - DNA, 22 bp, Homo sapiens
tggaggagtgaatctcagggta

SEQ ID NO: 151993 - DNA, 18 bp, Homo sapiens
atagtcacagaatcctca

SEQ ID NO: 151994 - DNA, 23 bp, Homo sapiens
tgagctaggaggatgatttgagc

SEQ ID NO: 151995 - DNA, 23 bp, Homo sapiens
acgtatatatatgtgtgtgtgtt

SEQ ID NO: 151996 - DNA, 18 bp, Homo sapiens
tatgtatatatatgtgtg

SEQ ID NO: 151997 - DNA, 23 bp, Homo sapiens
tagcatctactgccctaagtgct

SEQ ID NO: 151998 - DNA, 23 bp, Homo sapiens
tgtgcaaatctatgcaaaactga

SEQ ID NO: 151999 - DNA, 19 bp, Homo sapiens
tgtgacagcttctgtagca

SEQ ID NO: 152000 - DNA, 23 bp, Homo sapiens
taaagtgcttatagtgcaggtag

SEQ ID NO: 152001 - DNA, 22 bp, Homo sapiens
tactgcattatgagcacttaaa

SEQ ID NO: 152002 - DNA, 20 bp, Homo sapiens
aacactgttctatggttagt

SEQ ID NO: 152003 - DNA, 23 bp, Homo sapiens
tgtgcaaatccatgcaaaactga

SEQ ID NO: 152004 - DNA, 22 bp, Homo sapiens
tattgcacttgtcccggcctgt

SEQ ID NO: 152005 - DNA, 23 bp, Homo sapiens
atatgtgtgtatatatgtgtgtg

SEQ ID NO: 152006 - DNA, 23 bp, Homo sapiens
tgtgaaggtgttgcagcctttct

SEQ ID NO: 152007 - DNA, 23 bp, Homo sapiens
aaactctcactggctgtttttgg

SEQ ID NO: 152008 - DNA, 19 bp, Homo sapiens
gtcagctgagctaatgtgt

SEQ ID NO: 152009 - DNA, 19 bp, Homo sapiens
gacttttctaggtcatggt

SEQ ID NO: 152010 - DNA, 22 bp, Homo sapiens
tgtgtatatatgtatatatgtg

SEQ ID NO: 152011 - DNA, 22 bp, Homo sapiens
acacacacacagaaactgcaca

SEQ ID NO: 152012 - DNA, 21 bp, Homo sapiens
taataggatgttttgtggtaa

SEQ ID NO: 152013 - DNA, 22 bp, Homo sapiens
tgagacagagtctcactctttc

SEQ ID NO: 152014 - DNA, 21 bp, Homo sapiens
tggtgtgatcttggctcactg

SEQ ID NO: 152015 - DNA, 18 bp, Homo sapiens
atacgtatatatacatat

SEQ ID NO: 152016 - DNA, 23 bp, Homo sapiens
cacagttcattaggcagtcttca

SEQ ID NO: 152017 - DNA, 23 bp, Homo sapiens
tggctttgagaaacttgagggat

SEQ ID NO: 152018 - DNA, 23 bp, Homo sapiens
tgagttcattgtagattctggat

SEQ ID NO: 152019 - DNA, 23 bp, Homo sapiens
tgagttcattgtagattctggat

SEQ ID NO: 152020 - DNA, 20 bp, Homo sapiens
tcaattttaaagttgcagaa

SEQ ID NO: 152021 - DNA, 23 bp, Homo sapiens
ttccatctggaatttgtttctaa

SEQ ID NO: 152022 - DNA, 23 bp, Homo sapiens
agacagagtctcactctttctcc

SEQ ID NO: 152023 - DNA, 19 bp, Homo sapiens
cagaaatacaaaagatcat

SEQ ID NO: 152024 - DNA, 22 bp, Homo sapiens
agatcattttttgtatttctgt

SEQ ID NO: 152025 - DNA, 18 bp, Homo sapiens
gagcaaagacacataaga

SEQ ID NO: 152026 - DNA, 21 bp, Homo sapiens
atgtatgtatatatgtataca

SEQ ID NO: 152027 - DNA, 23 bp, Homo sapiens
tgagttcattgtagattctggat

SEQ ID NO: 152028 - DNA, 23 bp, Homo sapiens
tgagttcattgtagattctggat

SEQ ID NO: 152029 - DNA, 23 bp, Homo sapiens
tgagttcattgtagattctggat

SEQ ID NO: 152030 - DNA, 23 bp, Homo sapiens
tgagttcattgtagattctggat

SEQ ID NO: 152031 - DNA, 20 bp, Homo sapiens
tggactctgagattcttttt

SEQ ID NO: 152032 - DNA, 22 bp, Homo sapiens
ttatgtatgtatgtgtttatgt

SEQ ID NO: 152033 - DNA, 20 bp, Homo sapiens
tatgtgtgatatatacgtgt

SEQ ID NO: 152034 - DNA, 23 bp, Homo sapiens
ctgagactcactctgtctctcag

SEQ ID NO: 152035 - DNA, 20 bp, Homo sapiens
gcttgagtgtgttgttggct

SEQ ID NO: 152036 - DNA, 22 bp, Homo sapiens
tcagtagaacatgagggggtga

SEQ ID NO: 152037 - DNA, 23 bp, Homo sapiens
acagatctcactctgtcacccag

SEQ ID NO: 152038 - DNA, 20 bp, Homo sapiens
tctgtcacccagactggagt

SEQ ID NO: 152039 - DNA, 23 bp, Homo sapiens
cagggtctcactctgtcacccag

SEQ ID NO: 152040 - DNA, 22 bp, Homo sapiens
ctgaggtaggaggatcacttga

SEQ ID NO: 152041 - DNA, 23 bp, Homo sapiens
acacttgattgttgtgtgagtcc

SEQ ID NO: 152042 - DNA, 22 bp, Homo sapiens
aaccactctcagcttaagtgtc

SEQ ID NO: 152043 - DNA, 22 bp, Homo sapiens
ggtctctctgtcactcaggctg

SEQ ID NO: 152044 - DNA, 23 bp, Homo sapiens
tcactctgtcacccaggctgagt

SEQ ID NO: 152045 - DNA, 18 bp, Homo sapiens
tggcacaatctcggctca

SEQ ID NO: 152046 - DNA, 23 bp, Homo sapiens
tgcgtgcgtgtgtgtgtctgtct

SEQ ID NO: 152047 - DNA, 23 bp, Homo sapiens
tggctcactgaaagctctgcctc

SEQ ID NO: 152048 - DNA, 23 bp, Homo sapiens
tgagttcattgtagattctggat

SEQ ID NO: 152049 - DNA, 23 bp, Homo sapiens
tgagttcattgtagattctggat

SEQ ID NO: 152050 - DNA, 22 bp, Homo sapiens
agttgtgtctggtgtcttcagc

SEQ ID NO: 152051 - DNA, 23 bp, Homo sapiens
acaccgtcctctgtgtgtgtcag

SEQ ID NO: 152052 - DNA, 23 bp, Homo sapiens
attgtgacagaaaaaaggcagac

SEQ ID NO: 152053 - DNA, 23 bp, Homo sapiens
tgagttcattgtagattctggat

SEQ ID NO: 152054 - DNA, 23 bp, Homo sapiens
tgagttcattgtagattctggat

SEQ ID NO: 152055 - DNA, 23 bp, Homo sapiens
tgtgactcagtgactctatggcc

SEQ ID NO: 152056 - DNA, 23 bp, Homo sapiens
attagattactttactttaaaaa

SEQ ID NO: 152057 - DNA, 19 bp, Homo sapiens
tatataggtgtgcatgcat

SEQ ID NO: 152058 - DNA, 23 bp, Homo sapiens
atgtatgtgtttatgtgtatagt

SEQ ID NO: 152059 - DNA, 19 bp, Homo sapiens
ggaattaggtagaattgta

SEQ ID NO: 152060 - DNA, 19 bp, Homo sapiens
agatgaatatatatatgtg

SEQ ID NO: 152061 - DNA, 21 bp, Homo sapiens
tgtgaacatatatgtatgcat

SEQ ID NO: 152062 - DNA, 23 bp, Homo sapiens
tatattctaggttctctaggtgc

SEQ ID NO: 152063 - DNA, 23 bp, Homo sapiens
tgagacggagtctcgctctgtcg

SEQ ID NO: 152064 - DNA, 23 bp, Homo sapiens
tatgtagctggttttgatggaaa

SEQ ID NO: 152065 - DNA, 23 bp, Homo sapiens
tctcagtcactctctccttcaga

SEQ ID NO: 152066 - DNA, 23 bp, Homo sapiens
catgagagtgtgtcttgttgctc

SEQ ID NO: 152067 - DNA, 19 bp, Homo sapiens
tctcactctgtcaccaggc

SEQ ID NO: 152068 - DNA, 23 bp, Homo sapiens
aagctgcagcaaaaactggagta

SEQ ID NO: 152069 - DNA, 23 bp, Homo sapiens
aattctcattttgttttgctgtg

SEQ ID NO: 152070 - DNA, 23 bp, Homo sapiens
cggagtctcgctctgtctcccag

SEQ ID NO: 152071 - DNA, 23 bp, Homo sapiens
tgagttcattgtagattctggat

SEQ ID NO: 152072 - DNA, 23 bp, Homo sapiens
tgagttcattgtagattctggat

SEQ ID NO: 152073 - DNA, 23 bp, Homo sapiens
gacagagtctcgctctgtcaccc

SEQ ID NO: 152074 - DNA, 23 bp, Homo sapiens
acagagtctcgctctgtcaccca

SEQ ID NO: 152075 - DNA, 23 bp, Homo sapiens
tgttttagtgtcagattttgaaa

SEQ ID NO: 152076 - DNA, 23 bp, Homo sapiens
tcgttgtcagatacatgatttgc

SEQ ID NO: 152077 - DNA, 21 bp, Homo sapiens
gtgtgtgaacttagagagctc

SEQ ID NO: 152078 - DNA, 22 bp, Homo sapiens
aggcaacatggtgaaaccttgt

SEQ ID NO: 152079 - DNA, 23 bp, Homo sapiens
aggcagagtctcgctctgtcacc

SEQ ID NO: 152080 - DNA, 21 bp, Homo sapiens
gtgtctctctcacagccagtc

SEQ ID NO: 152081 - DNA, 23 bp, Homo sapiens
ttttgtgaagatatggagctctc

SEQ ID NO: 152082 - DNA, 20 bp, Homo sapiens
tgcagccccagttcatgctg

SEQ ID NO: 152083 - DNA, 23 bp, Homo sapiens
atgtgcgctctctgtctctctct

SEQ ID NO: 152084 - DNA, 23 bp, Homo sapiens
gagtctcactctgtcacccaggc

SEQ ID NO: 152085 - DNA, 22 bp, Homo sapiens
gcctggatgagtgagaaggaga

SEQ ID NO: 152086 - DNA, 23 bp, Homo sapiens
atatatgcatatatatactatgt

SEQ ID NO: 152087 - DNA, 22 bp, Homo sapiens
tatatgcatatatatacaatgt

SEQ ID NO: 152088 - DNA, 18 bp, Homo sapiens
ggataagaataggccaac

SEQ ID NO: 152089 - DNA, 23 bp, Homo sapiens
tctgtcagtgtctctatcactat

SEQ ID NO: 152090 - DNA, 23 bp, Homo sapiens
atgtgactcagcagagtgaggag

SEQ ID NO: 152091 - DNA, 23 bp, Homo sapiens
ttgcagactggttattttgagtg

SEQ ID NO: 152092 - DNA, 23 bp, Homo sapiens
ggagtctcactctgtcacccagg

SEQ ID NO: 152093 - DNA, 23 bp, Homo sapiens
gcagttcaaagtctattgccaat

SEQ ID NO: 152094 - DNA, 22 bp, Homo sapiens
cagagtctcactgtgtcgccca

SEQ ID NO: 152095 - DNA, 23 bp, Homo sapiens
aatgctcttcaagtatagtgttt

SEQ ID NO: 152096 - DNA, 19 bp, Homo sapiens
cttatataagaaaacagtg

SEQ ID NO: 152097 - DNA, 23 bp, Homo sapiens
agaggtagatggatgattagatg

SEQ ID NO: 152098 - DNA, 21 bp, Homo sapiens
ctgaggtaggaggatcacttg

SEQ ID NO: 152099 - DNA, 21 bp, Homo sapiens
atttgagcaaagtctcgaggt

SEQ ID NO: 152100 - DNA, 23 bp, Homo sapiens
agtgagtcagtgagtcagtggag

SEQ ID NO: 152101 - DNA, 23 bp, Homo sapiens
cacagtatgtctctgtcccagtc

SEQ ID NO: 152102 - DNA, 23 bp, Homo sapiens
gggtctcacactgtcacccaggc

SEQ ID NO: 152103 - DNA, 20 bp, Homo sapiens
tggttaatactgagtgtcag

SEQ ID NO: 152104 - DNA, 23 bp, Homo sapiens
atcctgggtgtgtctgtgagggt

SEQ ID NO: 152105 - DNA, 20 bp, Homo sapiens
agagagaagacagtgcagat

SEQ ID NO: 152106 - DNA, 23 bp, Homo sapiens
aagaggtgtcaatggtgatggac

SEQ ID NO: 152107 - DNA, 23 bp, Homo sapiens
gactgagtctcgctctgtcaccc

SEQ ID NO: 152108 - DNA, 23 bp, Homo sapiens
tgcagtggcatgatcttggctca

SEQ ID NO: 152109 - DNA, 19 bp, Homo sapiens
tatacacacatatacattt

SEQ ID NO: 152110 - DNA, 22 bp, Homo sapiens
tatgtgtgtatatataaatatg

SEQ ID NO: 152111 - DNA, 23 bp, Homo sapiens
atgtgtatgtgtaatgtgtatat

SEQ ID NO: 152112 - DNA, 18 bp, Homo sapiens
tgtgatatacatataacc

SEQ ID NO: 152113 - DNA, 23 bp, Homo sapiens
tatatgtttatatgtatgtgtat

SEQ ID NO: 152114 - DNA, 18 bp, Homo sapiens
tgaggtaagtgtctctct

SEQ ID NO: 152115 - DNA, 21 bp, Homo sapiens
agataagtgccttgtctgagg

SEQ ID NO: 152116 - DNA, 23 bp, Homo sapiens
atatgtatatatgtttatgtgtg

SEQ ID NO: 152117 - DNA, 23 bp, Homo sapiens
tatacacacgtgtacatatgtgt

SEQ ID NO: 152118 - DNA, 18 bp, Homo sapiens
tacatgtgtatatgtata

SEQ ID NO: 152119 - DNA, 18 bp, Homo sapiens
tatatgtgtatatgtata

SEQ ID NO: 152120 - DNA, 23 bp, Homo sapiens
atatgtgtatatgtgtatatgtg

SEQ ID NO: 152121 - DNA, 23 bp, Homo sapiens
tatgtgtatatatgtatatgtgt

SEQ ID NO: 152122 - DNA, 23 bp, Homo sapiens
gtgactgtgtatgttttatatat

SEQ ID NO: 152123 - DNA, 23 bp, Homo sapiens
tgtatgtatatgtataattcaga

SEQ ID NO: 152124 - DNA, 22 bp, Homo sapiens
cagtaaggaagaagagaggcac

SEQ ID NO: 152125 - DNA, 22 bp, Homo sapiens
attgctcatttgtatgatgaaa

SEQ ID NO: 152126 - DNA, 23 bp, Homo sapiens
tgcagatgattccaaaactatcc

SEQ ID NO: 152127 - DNA, 23 bp, Homo sapiens
gctacactaatgattttgttttt

SEQ ID NO: 152128 - DNA, 23 bp, Homo sapiens
ggagtctcactctgtctcccagg

SEQ ID NO: 152129 - DNA, 23 bp, Homo sapiens
agttttcactctgtctcttatgc

SEQ ID NO: 152130 - DNA, 23 bp, Homo sapiens
ttatctagctagagattgggatt

SEQ ID NO: 152131 - DNA, 22 bp, Homo sapiens
gagagagaaaaatgagagctga

SEQ ID NO: 152132 - DNA, 19 bp, Homo sapiens
ttcattccacctctggaag

SEQ ID NO: 152133 - DNA, 18 bp, Homo sapiens
caaaatatgcatatgtgt

SEQ ID NO: 152134 - DNA, 21 bp, Homo sapiens
tgtgtatatacatacacatat

SEQ ID NO: 152135 - DNA, 22 bp, Homo sapiens
aatcacagctttctaactcagg

SEQ ID NO: 152136 - DNA, 21 bp, Homo sapiens
agactacggtttttaagggtt

SEQ ID NO: 152137 - DNA, 23 bp, Homo sapiens
gtgtgaagattgttgactggttg

SEQ ID NO: 152138 - DNA, 22 bp, Homo sapiens
tctctccctgtcacccaggctg

SEQ ID NO: 152139 - DNA, 22 bp, Homo sapiens
tattctagcttatgcaatgttt

SEQ ID NO: 152140 - DNA, 23 bp, Homo sapiens
tttagatgtatttatgtatagat

SEQ ID NO: 152141 - DNA, 19 bp, Homo sapiens
attgtatatatttgtgtac

SEQ ID NO: 152142 - DNA, 23 bp, Homo sapiens
tataaaactgaggtttagaaaac

SEQ ID NO: 152143 - DNA, 23 bp, Homo sapiens
agcaagtgcaactgcatctggtt

SEQ ID NO: 152144 - DNA, 23 bp, Homo sapiens
tagtggtccagcaagtgcaactg

SEQ ID NO: 152145 - DNA, 19 bp, Homo sapiens
tgagtgctgccagtttctg

SEQ ID NO: 152146 - DNA, 23 bp, Homo sapiens
tgtgcaatgcaaatgaaatgtta

SEQ ID NO: 152147 - DNA, 23 bp, Homo sapiens
ttagagctcagagagaagacaga

SEQ ID NO: 152148 - DNA, 18 bp, Homo sapiens
ttagtgtcaggcattttg

SEQ ID NO: 152149 - DNA, 20 bp, Homo sapiens
tgaggtagaaggattacttg

SEQ ID NO: 152150 - DNA, 23 bp, Homo sapiens
aaatccactttgaccaagctctt

SEQ ID NO: 152151 - DNA, 23 bp, Homo sapiens
tggcagtgtctgcaaagcctaaa

SEQ ID NO: 152152 - DNA, 19 bp, Homo sapiens
ttgagagagtctcactctg

SEQ ID NO: 152153 - DNA, 23 bp, Homo sapiens
aagctcattggtcttgagttgtt

SEQ ID NO: 152154 - DNA, 23 bp, Homo sapiens
gttcacagtagagtttgtgctct

SEQ ID NO: 152155 - DNA, 20 bp, Homo sapiens
tctaatgctgctgctgatct

SEQ ID NO: 152156 - DNA, 18 bp, Homo sapiens
tttatggtagttttgttt

SEQ ID NO: 152157 - DNA, 18 bp, Homo sapiens
aatcatgagtactggttt

SEQ ID NO: 152158 - DNA, 20 bp, Homo sapiens
tgataagaatgtcaattgct

SEQ ID NO: 152159 - DNA, 23 bp, Homo sapiens
ctctatgcaaatgttatgtatta

SEQ ID NO: 152160 - DNA, 23 bp, Homo sapiens
gtctcgctctgtcacccaggctg

SEQ ID NO: 152161 - DNA, 23 bp, Homo sapiens
cagggtctctctgtgtctcccag

SEQ ID NO: 152162 - DNA, 18 bp, Homo sapiens
attaagcaggcatatctt

SEQ ID NO: 152163 - DNA, 23 bp, Homo sapiens
tgagttcattgtagattctggat

SEQ ID NO: 152164 - DNA, 23 bp, Homo sapiens
tgagttcattgtagattctggat

SEQ ID NO: 152165 - DNA, 23 bp, Homo sapiens
tgagttcattgtagattctggat

SEQ ID NO: 152166 - DNA, 23 bp, Homo sapiens
tgagttcattgtagattctggat

SEQ ID NO: 152167 - DNA, 23 bp, Homo sapiens
tatgtatatgtatatgtatacgt

SEQ ID NO: 152168 - DNA, 23 bp, Homo sapiens
tgagttcattgtagattctggat

SEQ ID NO: 152169 - DNA, 23 bp, Homo sapiens
tgagttcattgtagattctggat

SEQ ID NO: 152170 - DNA, 23 bp, Homo sapiens
tatataggtacagatacacatgt

SEQ ID NO: 152171 - DNA, 20 bp, Homo sapiens
atgcgtatacatatatatgc

SEQ ID NO: 152172 - DNA, 22 bp, Homo sapiens
tcactgccactgagtctctatc

SEQ ID NO: 152173 - DNA, 18 bp, Homo sapiens
acctttgatttcagatca

SEQ ID NO: 152174 - DNA, 22 bp, Homo sapiens
aaagtggaaattctaatcttct

SEQ ID NO: 152175 - DNA, 20 bp, Homo sapiens
tgtatgtatgtatatgtata

SEQ ID NO: 152176 - DNA, 23 bp, Homo sapiens
agagtgtttctacttgtgtactc

SEQ ID NO: 152177 - DNA, 20 bp, Homo sapiens
atgagactagaggatggtca

SEQ ID NO: 152178 - DNA, 23 bp, Homo sapiens
acagtctctctctgtcactcagg

SEQ ID NO: 152179 - DNA, 23 bp, Homo sapiens
ttgttggttccatatgaaattta

SEQ ID NO: 152180 - DNA, 23 bp, Homo sapiens
ttctatgaagaaagtcaatggta

SEQ ID NO: 152181 - DNA, 23 bp, Homo sapiens
atactctctctttctcctaacgt

SEQ ID NO: 152182 - DNA, 23 bp, Homo sapiens
agaagggctatatattcaggtgc

SEQ ID NO: 152183 - DNA, 22 bp, Homo sapiens
atatgtgtatatatatgtgtgt

SEQ ID NO: 152184 - DNA, 22 bp, Homo sapiens
tgtgtatatatgtatatatgtg

SEQ ID NO: 152185 - DNA, 23 bp, Homo sapiens
tatgtatgtatgtatatatgtgt

SEQ ID NO: 152186 - DNA, 18 bp, Homo sapiens
tatgtatatatgtgtgtg

SEQ ID NO: 152187 - DNA, 22 bp, Homo sapiens
atatatgtgtgtatatatatgt

SEQ ID NO: 152188 - DNA, 23 bp, Homo sapiens
atatgtatgtatatgtgtgtgta

SEQ ID NO: 152189 - DNA, 21 bp, Homo sapiens
tcactctgtcactgaggctgg

SEQ ID NO: 152190 - DNA, 18 bp, Homo sapiens
actgcactccagcctggg

SEQ ID NO: 152191 - DNA, 23 bp, Homo sapiens
ggagtctcactctgtcacccagg

SEQ ID NO: 152192 - DNA, 23 bp, Homo sapiens
tagtgagcaaatacgtttctatt

SEQ ID NO: 152193 - DNA, 23 bp, Homo sapiens
tgcgtctgtgtatatttatggta

SEQ ID NO: 152194 - DNA, 19 bp, Homo sapiens
atgtgtatatatgtatatg

SEQ ID NO: 152195 - DNA, 18 bp, Homo sapiens
tggcagaagaaattccta

SEQ ID NO: 152196 - DNA, 23 bp, Homo sapiens
tgtgactgtgtcttgcttgtcag

SEQ ID NO: 152197 - DNA, 21 bp, Homo sapiens
tgacaacaagcagcattgttc

SEQ ID NO: 152198 - DNA, 23 bp, Homo sapiens
tgagttcattgtagattctggat

SEQ ID NO: 152199 - DNA, 23 bp, Homo sapiens
tgagttcattgtagattctggat

SEQ ID NO: 152200 - DNA, 23 bp, Homo sapiens
tctgtctctgtgactttgagtcc

SEQ ID NO: 152201 - DNA, 22 bp, Homo sapiens
cctcatctgtctggagtcatac

SEQ ID NO: 152202 - DNA, 23 bp, Homo sapiens
tctggaatagttatgtttgatat

SEQ ID NO: 152203 - DNA, 19 bp, Homo sapiens
tttctagtgactttgaatt

SEQ ID NO: 152204 - DNA, 22 bp, Homo sapiens
tgtgtgtgtatgtatatgtata

SEQ ID NO: 152205 - DNA, 20 bp, Homo sapiens
aagtgcaccctttatcagag

SEQ ID NO: 152206 - DNA, 23 bp, Homo sapiens
tcctgacttcatggctgatgctg

SEQ ID NO: 152207 - DNA, 22 bp, Homo sapiens
ctggctccctccctctaggcca

SEQ ID NO: 152208 - DNA, 22 bp, Homo sapiens
tgtgtgtgcatgtgcatgtgtg

SEQ ID NO: 152209 - DNA, 23 bp, Homo sapiens
tgtgtggctgtgtcactgcctgc

SEQ ID NO: 152210 - DNA, 21 bp, Homo sapiens
atttagcaagtttaagaagtg

SEQ ID NO: 152211 - DNA, 23 bp, Homo sapiens
attcagtggctcactcactgcca

SEQ ID NO: 152212 - DNA, 22 bp, Homo sapiens
tgtgcgtgcgtctctctgggtg

SEQ ID NO: 152213 - DNA, 23 bp, Homo sapiens
tctctctctgtgagacaggcgca

SEQ ID NO: 152214 - DNA, 23 bp, Homo sapiens
tctgagtcacaagagacactgca

SEQ ID NO: 152215 - DNA, 21 bp, Homo sapiens
tgtgggagctgactcaggctc

SEQ ID NO: 152216 - DNA, 20 bp, Homo sapiens
tcacagatgctactgaggtc

SEQ ID NO: 152217 - DNA, 23 bp, Homo sapiens
aaatgtgttctgagagcagcagc

SEQ ID NO: 152218 - DNA, 23 bp, Homo sapiens
cactcgctctgtgagccacgtga

SEQ ID NO: 152219 - DNA, 18 bp, Homo sapiens
aaatgttgaaactggggc

SEQ ID NO: 152220 - DNA, 18 bp, Homo sapiens
ttcacgtttaatttttgt

SEQ ID NO: 152221 - DNA, 21 bp, Homo sapiens
tcacatctgttcttctagtac

SEQ ID NO: 152222 - DNA, 23 bp, Homo sapiens
tccctgactgtgtccctgggtcc

SEQ ID NO: 152223 - DNA, 22 bp, Homo sapiens
cttagaaatctgctctttggtt

SEQ ID NO: 152224 - DNA, 23 bp, Homo sapiens
acacagaatatgggtctctgagg

SEQ ID NO: 152225 - DNA, 23 bp, Homo sapiens
ctctagatcagtctgtctgtgtg

SEQ ID NO: 152226 - DNA, 23 bp, Homo sapiens
gactgtgcttagagtcctggctc

SEQ ID NO: 152227 - DNA, 23 bp, Homo sapiens
tgactgtgcttagagtcctggct

SEQ ID NO: 152228 - DNA, 23 bp, Homo sapiens
agatggagtctcactctgtcacc

SEQ ID NO: 152229 - DNA, 23 bp, Homo sapiens
aaatgtgaatatgtactaattac

SEQ ID NO: 152230 - DNA, 21 bp, Homo sapiens
tgagcaattctttttgagtgt

SEQ ID NO: 152231 - DNA, 18 bp, Homo sapiens
actctgtcaatctaatgg

SEQ ID NO: 152232 - DNA, 23 bp, Homo sapiens
aggttggttctgagggagattgt

SEQ ID NO: 152233 - DNA, 23 bp, Homo sapiens
atgtgtatgtgtgcatgtgggtg

SEQ ID NO: 152234 - DNA, 21 bp, Homo sapiens
agggtctggagctggtgctga

SEQ ID NO: 152235 - DNA, 23 bp, Homo sapiens
gggcgtgtctcagaccctctgag

SEQ ID NO: 152236 - DNA, 23 bp, Homo sapiens
ttaaagtgattttcttcatcttt

SEQ ID NO: 152237 - DNA, 23 bp, Homo sapiens
cttagcagtgtgagaatggacta

SEQ ID NO: 152238 - DNA, 23 bp, Homo sapiens
acacatgagccaacagtggagga

SEQ ID NO: 152239 - DNA, 23 bp, Homo sapiens
tgtgagtgcctctgtgactggct

SEQ ID NO: 152240 - DNA, 23 bp, Homo sapiens
tgagacagtgtctcactgtgttg

SEQ ID NO: 152241 - DNA, 23 bp, Homo sapiens
cagcctctgtgtgtgtctgtggt

SEQ ID NO: 152242 - DNA, 19 bp, Homo sapiens
tttttttttgagatggagt

SEQ ID NO: 152243 - DNA, 23 bp, Homo sapiens
cggagtctcgctctgtcgctcag

SEQ ID NO: 152244 - DNA, 23 bp, Homo sapiens
atctgaaagatgtatggttgtgc

SEQ ID NO: 152245 - DNA, 23 bp, Homo sapiens
ctgaccgtcactgcctcactcca

SEQ ID NO: 152246 - DNA, 23 bp, Homo sapiens
gggcttttcttatctgtctcttt

SEQ ID NO: 152247 - DNA, 23 bp, Homo sapiens
ataaaggtagagaagcttttaaa

SEQ ID NO: 152248 - DNA, 22 bp, Homo sapiens
atgtgtctgtgtgatgtgtgta

SEQ ID NO: 152249 - DNA, 23 bp, Homo sapiens
gtcgctgggtccatgcgtgggtc

SEQ ID NO: 152250 - DNA, 23 bp, Homo sapiens
tgtgcatgttcacatgtgtgtgc

SEQ ID NO: 152251 - DNA, 23 bp, Homo sapiens
tctgtgcctgtgtgcatgcctgt

SEQ ID NO: 152252 - DNA, 21 bp, Homo sapiens
acagaggagagagagtggtca

SEQ ID NO: 152253 - DNA, 22 bp, Homo sapiens
atgacactttatatgttttgtc

SEQ ID NO: 152254 - DNA, 23 bp, Homo sapiens
agagagtgaccttttgttgtctg

SEQ ID NO: 152255 - DNA, 19 bp, Homo sapiens
tgtgcatatgtgtgcgtgt

SEQ ID NO: 152256 - DNA, 23 bp, Homo sapiens
cctctgtgtctgtgtcttcacat

SEQ ID NO: 152257 - DNA, 20 bp, Homo sapiens
tcagagaagagagtcagcct

SEQ ID NO: 152258 - DNA, 22 bp, Homo sapiens
agacaggcattgatttctcctc

SEQ ID NO: 152259 - DNA, 18 bp, Homo sapiens
gtctctgtgtgagtgtgt

SEQ ID NO: 152260 - DNA, 21 bp, Homo sapiens
tggcacactgtgagtcagctc

SEQ ID NO: 152261 - DNA, 20 bp, Homo sapiens
ctgccacagtgagggtattt

SEQ ID NO: 152262 - DNA, 23 bp, Homo sapiens
tgacagactcagactgaccctct

SEQ ID NO: 152263 - DNA, 23 bp, Homo sapiens
tgagtgtgtctatacacatgtat

SEQ ID NO: 152264 - DNA, 23 bp, Homo sapiens
actcacgcactcagagttcacag

SEQ ID NO: 152265 - DNA, 21 bp, Homo sapiens
tatagatatatatagatatgt

SEQ ID NO: 152266 - DNA, 19 bp, Homo sapiens
atatctatatatatagatg

SEQ ID NO: 152267 - DNA, 21 bp, Homo sapiens
atatgtatatatgtatatgta

SEQ ID NO: 152268 - DNA, 23 bp, Homo sapiens
tgagatggtgtctcactctgtcg

SEQ ID NO: 152269 - DNA, 23 bp, Homo sapiens
cagtggcacagtctcagttcact

SEQ ID NO: 152270 - DNA, 23 bp, Homo sapiens
ctgtgtgtctctgtgtcttcaga

SEQ ID NO: 152271 - DNA, 23 bp, Homo sapiens
caggttttttgatttggcatgct

SEQ ID NO: 152272 - DNA, 23 bp, Homo sapiens
ggctgaggtagaagaatcacttg

SEQ ID NO: 152273 - DNA, 21 bp, Homo sapiens
tcctaactctcattgctgttc

SEQ ID NO: 152274 - DNA, 23 bp, Homo sapiens
gtgagggcatgatttgtgcagca

SEQ ID NO: 152275 - DNA, 23 bp, Homo sapiens
gttatctgtatatgtaatacata

SEQ ID NO: 152276 - DNA, 21 bp, Homo sapiens
tatgtatatgtatgtatgtgt

SEQ ID NO: 152277 - DNA, 23 bp, Homo sapiens
cactgactgtgacccatccttga

SEQ ID NO: 152278 - DNA, 23 bp, Homo sapiens
taacttgtgggatgactaagtca

SEQ ID NO: 152279 - DNA, 23 bp, Homo sapiens
tcacagaaccgagtgtgcacaga

SEQ ID NO: 152280 - DNA, 23 bp, Homo sapiens
gtccctgtgacgtctggctgatg

SEQ ID NO: 152281 - DNA, 20 bp, Homo sapiens
agagagaagtttgagggctc

SEQ ID NO: 152282 - DNA, 23 bp, Homo sapiens
tgggtggatccctgagtggctct

SEQ ID NO: 152283 - DNA, 20 bp, Homo sapiens
acactatatatatcgtgtat

SEQ ID NO: 152284 - DNA, 23 bp, Homo sapiens
ttgaataacagaaactgaaaaac

SEQ ID NO: 152285 - DNA, 19 bp, Homo sapiens
tagaggtttatttatcaat

SEQ ID NO: 152286 - DNA, 23 bp, Homo sapiens
tatatatctgtgcgtgtgtatat

SEQ ID NO: 152287 - DNA, 23 bp, Homo sapiens
aggttatttcactgttgacgtat

SEQ ID NO: 152288 - DNA, 23 bp, Homo sapiens
tgtatgtatgtatatatgtatac

SEQ ID NO: 152289 - DNA, 23 bp, Homo sapiens
tgtatatatgtatatatgtatgt

SEQ ID NO: 152290 - DNA, 18 bp, Homo sapiens
aggagtatatatatgtgt

SEQ ID NO: 152291 - DNA, 23 bp, Homo sapiens
tgcagtgagccaagatcgtgcca

SEQ ID NO: 152292 - DNA, 23 bp, Homo sapiens
cggagtctcactctatcactcag

SEQ ID NO: 152293 - DNA, 18 bp, Homo sapiens
tgtaacaggttcagcctg

SEQ ID NO: 152294 - DNA, 22 bp, Homo sapiens
acacagtgatgagtcagcgggt

SEQ ID NO: 152295 - DNA, 23 bp, Homo sapiens
tcactgctctctgtgtctctaag

SEQ ID NO: 152296 - DNA, 23 bp, Homo sapiens
ggtctcgatttctttgcaaaaca

SEQ ID NO: 152297 - DNA, 23 bp, Homo sapiens
tgtctatctgtctatctatctat

SEQ ID NO: 152298 - DNA, 18 bp, Homo sapiens
tgatgtcttttgatgaac

SEQ ID NO: 152299 - DNA, 19 bp, Homo sapiens
tgcatcattacaatactgt

SEQ ID NO: 152300 - DNA, 18 bp, Homo sapiens
aatgctttctggaaagtt

SEQ ID NO: 152301 - DNA, 22 bp, Homo sapiens
tacacacatatatagtatagga

SEQ ID NO: 152302 - DNA, 21 bp, Homo sapiens
gaacggtctgtgggtctctca

SEQ ID NO: 152303 - DNA, 23 bp, Homo sapiens
gtctcactcactgtgtcacccag

SEQ ID NO: 152304 - DNA, 21 bp, Homo sapiens
atatgtatgatgtatagatat

SEQ ID NO: 152305 - DNA, 23 bp, Homo sapiens
tctctccaactctctgatatctt

SEQ ID NO: 152306 - DNA, 20 bp, Homo sapiens
aaatgtagaatatgcatata

SEQ ID NO: 152307 - DNA, 21 bp, Homo sapiens
tacatatgtttacatagtgta

SEQ ID NO: 152308 - DNA, 20 bp, Homo sapiens
ttcttacaacctgatggagt

SEQ ID NO: 152309 - DNA, 20 bp, Homo sapiens
tgacaggtggagaataacag

SEQ ID NO: 152310 - DNA, 23 bp, Homo sapiens
catgtatctagtgagttgctatg

SEQ ID NO: 152311 - DNA, 23 bp, Homo sapiens
cagtctcactctgtcacccaggc

SEQ ID NO: 152312 - DNA, 23 bp, Homo sapiens
tgagttcattgtagattctggat

SEQ ID NO: 152313 - DNA, 23 bp, Homo sapiens
tgagttcattgtagattctggat

SEQ ID NO: 152314 - DNA, 21 bp, Homo sapiens
tctcgccctgtcactcaggct

SEQ ID NO: 152315 - DNA, 23 bp, Homo sapiens
tccacacagcaactatttttgtt

SEQ ID NO: 152316 - DNA, 23 bp, Homo sapiens
tctctcactacatttcttatgca

SEQ ID NO: 152317 - DNA, 21 bp, Homo sapiens
tctcatctctgcatgttgtca

SEQ ID NO: 152318 - DNA, 23 bp, Homo sapiens
aaatcttggatctcacagtgcac

SEQ ID NO: 152319 - DNA, 23 bp, Homo sapiens
tttgtcatgttccaggtcttaga

SEQ ID NO: 152320 - DNA, 23 bp, Homo sapiens
tatatgtgtatgcataaaatgac

SEQ ID NO: 152321 - DNA, 19 bp, Homo sapiens
tgagactggttctccagtg

SEQ ID NO: 152322 - DNA, 19 bp, Homo sapiens
gtctgagtttcattcttct

SEQ ID NO: 152323 - DNA, 23 bp, Homo sapiens
tgaaactgggtctcactctgtca

SEQ ID NO: 152324 - DNA, 23 bp, Homo sapiens
agtggtgtgatcgcagttcactg

SEQ ID NO: 152325 - DNA, 23 bp, Homo sapiens
tctaccaacactctgaaaattga

SEQ ID NO: 152326 - DNA, 19 bp, Homo sapiens
aatctgtttattataatgt

SEQ ID NO: 152327 - DNA, 23 bp, Homo sapiens
tccctcactctcagctaggacat

SEQ ID NO: 152328 - DNA, 23 bp, Homo sapiens
atatgtgtgtatacgtatatgtg

SEQ ID NO: 152329 - DNA, 18 bp, Homo sapiens
tgaatgcaaatgtcattg

SEQ ID NO: 152330 - DNA, 23 bp, Homo sapiens
agtaactcagtagcgttttctgc

SEQ ID NO: 152331 - DNA, 23 bp, Homo sapiens
tatgtatttttgaaatagatgtg

SEQ ID NO: 152332 - DNA, 23 bp, Homo sapiens
aggctgttgtacaggtactgatg

SEQ ID NO: 152333 - DNA, 23 bp, Homo sapiens
cacagtgtctctgtcacaattac

SEQ ID NO: 152334 - DNA, 23 bp, Homo sapiens
agaatattcatgttgtagcatgt

SEQ ID NO: 152335 - DNA, 18 bp, Homo sapiens
aagtcaccgagctttcca

SEQ ID NO: 152336 - DNA, 23 bp, Homo sapiens
tctcactcccacactgatgtggt

SEQ ID NO: 152337 - DNA, 19 bp, Homo sapiens
aaagaagtgagtgagctca

SEQ ID NO: 152338 - DNA, 22 bp, Homo sapiens
tatgtgtgtatatatatgtgtg

SEQ ID NO: 152339 - DNA, 19 bp, Homo sapiens
atgtctttaaagttatgtt

SEQ ID NO: 152340 - DNA, 23 bp, Homo sapiens
acaccacacagtgcacacagggg

SEQ ID NO: 152341 - DNA, 21 bp, Homo sapiens
atgggagtgggtttgtttcct

SEQ ID NO: 152342 - DNA, 23 bp, Homo sapiens
tgagttcattgtagattctggat

SEQ ID NO: 152343 - DNA, 23 bp, Homo sapiens
tgagttcattgtagattctggat

SEQ ID NO: 152344 - DNA, 18 bp, Homo sapiens
atatgtgtgtgtgtgtat

SEQ ID NO: 152345 - DNA, 21 bp, Homo sapiens
gtctctctctgttttcccagg

SEQ ID NO: 152346 - DNA, 23 bp, Homo sapiens
atgtgtatatatgtatatatgtg

SEQ ID NO: 152347 - DNA, 23 bp, Homo sapiens
tgtacatatgtgtgtatatatgt

SEQ ID NO: 152348 - DNA, 23 bp, Homo sapiens
gtatgtatgtatgtatatgtgtg

SEQ ID NO: 152349 - DNA, 23 bp, Homo sapiens
tgaaacataattcagggagaggt

SEQ ID NO: 152350 - DNA, 23 bp, Homo sapiens
tttcttgtggattaggtttgttt

SEQ ID NO: 152351 - DNA, 21 bp, Homo sapiens
tatgtgtatatgtatatatgt

SEQ ID NO: 152352 - DNA, 23 bp, Homo sapiens
tgagttcattgtagattctggat

SEQ ID NO: 152353 - DNA, 23 bp, Homo sapiens
tgagttcattgtagattctggat

SEQ ID NO: 152354 - DNA, 23 bp, Homo sapiens
ctctcctaaggctttctctgaag

SEQ ID NO: 152355 - DNA, 23 bp, Homo sapiens
atatgtagtctattgaaatgtgt

SEQ ID NO: 152356 - DNA, 23 bp, Homo sapiens
tgagatggagtctcgctcagtca

SEQ ID NO: 152357 - DNA, 21 bp, Homo sapiens
atctatatacatgttgatttt

SEQ ID NO: 152358 - DNA, 22 bp, Homo sapiens
aacaatatgaggaggaatagca

SEQ ID NO: 152359 - DNA, 22 bp, Homo sapiens
atgacaaaatttatctttgtgt

SEQ ID NO: 152360 - DNA, 23 bp, Homo sapiens
tctctctgtgtgcgtgtggatgt

SEQ ID NO: 152361 - DNA, 23 bp, Homo sapiens
atgtgcactgagaagacggtgag

SEQ ID NO: 152362 - DNA, 21 bp, Homo sapiens
gagagaaatgaagcattcctg

SEQ ID NO: 152363 - DNA, 23 bp, Homo sapiens
tttccactaactgaaagcagaag

SEQ ID NO: 152364 - DNA, 19 bp, Homo sapiens
tgggatgaaatagttgtga

SEQ ID NO: 152365 - DNA, 23 bp, Homo sapiens
ggctgtgagttgagactgtggtc

SEQ ID NO: 152366 - DNA, 20 bp, Homo sapiens
tttgttggctttgagataga

SEQ ID NO: 152367 - DNA, 22 bp, Homo sapiens
tatgcatgtatgtacatatgta

SEQ ID NO: 152368 - DNA, 22 bp, Homo sapiens
tctctcacccagtctagagtgc

SEQ ID NO: 152369 - DNA, 21 bp, Homo sapiens
tgatctgccatgtgaatcata

SEQ ID NO: 152370 - DNA, 22 bp, Homo sapiens
tctatgcaaagtaattttgcag

SEQ ID NO: 152371 - DNA, 23 bp, Homo sapiens
tgtgtattgttttctagtttatg

SEQ ID NO: 152372 - DNA, 22 bp, Homo sapiens
tttgtatgcctgcatgactctg

SEQ ID NO: 152373 - DNA, 23 bp, Homo sapiens
tttaagaagaaatacgtttgctt

SEQ ID NO: 152374 - DNA, 23 bp, Homo sapiens
tgttgtcttaagaacttcttaag

SEQ ID NO: 152375 - DNA, 19 bp, Homo sapiens
ggagtctcgctctgtcacc

SEQ ID NO: 152376 - DNA, 22 bp, Homo sapiens
tcatgtccaacatattttcaga

SEQ ID NO: 152377 - DNA, 20 bp, Homo sapiens
tatatgtatatatctatatg

SEQ ID NO: 152378 - DNA, 23 bp, Homo sapiens
acagatatgaatatctgtttgtg

SEQ ID NO: 152379 - DNA, 23 bp, Homo sapiens
atatgtatacatgtttgtatgtg

SEQ ID NO: 152380 - DNA, 23 bp, Homo sapiens
tgtgtgcatatatgtgtgtgtgt

SEQ ID NO: 152381 - DNA, 18 bp, Homo sapiens
gcattcatttgtctgaga

SEQ ID NO: 152382 - DNA, 19 bp, Homo sapiens
tttctatgctaatgtgacc

SEQ ID NO: 152383 - DNA, 23 bp, Homo sapiens
ttcatgaatgtgtctgattacca

SEQ ID NO: 152384 - DNA, 23 bp, Homo sapiens
tgtgtgcctgtctctgtctctgt

SEQ ID NO: 152385 - DNA, 23 bp, Homo sapiens
tgatagtccatttgctatctata

SEQ ID NO: 152386 - DNA, 23 bp, Homo sapiens
tgcctcactcattctctggacag

SEQ ID NO: 152387 - DNA, 23 bp, Homo sapiens
agtgagctcttgtttgggtatga

SEQ ID NO: 152388 - DNA, 22 bp, Homo sapiens
aaagcataagaaaagtatatgt

SEQ ID NO: 152389 - DNA, 20 bp, Homo sapiens
tacatgcacgtgtgtgtata

SEQ ID NO: 152390 - DNA, 20 bp, Homo sapiens
tgatttttatgaaaacacat

SEQ ID NO: 152391 - DNA, 21 bp, Homo sapiens
atgtgtgtgtatatatacaca

SEQ ID NO: 152392 - DNA, 23 bp, Homo sapiens
tatgtgtgtatatgtatatgtgt

SEQ ID NO: 152393 - DNA, 22 bp, Homo sapiens
tgtatatatgtatatatgtgtg

SEQ ID NO: 152394 - DNA, 23 bp, Homo sapiens
tctcagtctgtgtcattggtgaa

SEQ ID NO: 152395 - DNA, 22 bp, Homo sapiens
aaatgacactactagttcgata

SEQ ID NO: 152396 - DNA, 22 bp, Homo sapiens
tatgtgtgcatgtatatgtttg

SEQ ID NO: 152397 - DNA, 23 bp, Homo sapiens
atgtgtgtatgtgtatatgtgtg

SEQ ID NO: 152398 - DNA, 20 bp, Homo sapiens
tcacacagactaaatcatca

SEQ ID NO: 152399 - DNA, 23 bp, Homo sapiens
tgtgtctctgtctttatggggct

SEQ ID NO: 152400 - DNA, 20 bp, Homo sapiens
tgtgcctccaaatccccagt

SEQ ID NO: 152401 - DNA, 23 bp, Homo sapiens
atatgtgtatatgtatatacgtg

SEQ ID NO: 152402 - DNA, 18 bp, Homo sapiens
agaccctcagacttcctg

SEQ ID NO: 152403 - DNA, 20 bp, Homo sapiens
ttcgagaccaagtcttgctc

SEQ ID NO: 152404 - DNA, 23 bp, Homo sapiens
aacagaggtagagaaatggaaag

SEQ ID NO: 152405 - DNA, 23 bp, Homo sapiens
ctgtacatttctgattgctttgt

SEQ ID NO: 152406 - DNA, 23 bp, Homo sapiens
actgttcaaagctgttgtgcgct

SEQ ID NO: 152407 - DNA, 23 bp, Homo sapiens
ctgagtctctctctgtcacccag

SEQ ID NO: 152408 - DNA, 23 bp, Homo sapiens
ttatgtagtactcattgaaacac

SEQ ID NO: 152409 - DNA, 23 bp, Homo sapiens
gacagggtctcactgtgtcgccc

SEQ ID NO: 152410 - DNA, 23 bp, Homo sapiens
tctttctgtggctctgtctatgg

SEQ ID NO: 152411 - DNA, 18 bp, Homo sapiens
gagtctcactctgtcgcc

SEQ ID NO: 152412 - DNA, 23 bp, Homo sapiens
tacacacacatatatgtatgtaa

SEQ ID NO: 152413 - DNA, 20 bp, Homo sapiens
atgtgtatatatatatatgt

SEQ ID NO: 152414 - DNA, 23 bp, Homo sapiens
cagtccctctgtctcacataaag

SEQ ID NO: 152415 - DNA, 23 bp, Homo sapiens
tggatgtcatcacaagagttgtt

SEQ ID NO: 152416 - DNA, 23 bp, Homo sapiens
gtgtctgtgtgagtgtgcgaata

SEQ ID NO: 152417 - DNA, 23 bp, Homo sapiens
gggtgtgtgtagtgtgtgtgcac

SEQ ID NO: 152418 - DNA, 18 bp, Homo sapiens
atgatctgctcttgggag

SEQ ID NO: 152419 - DNA, 21 bp, Homo sapiens
taagacgagacacacattctc

SEQ ID NO: 152420 - DNA, 23 bp, Homo sapiens
taaatagatatagatatctgttt

SEQ ID NO: 152421 - DNA, 21 bp, Homo sapiens
aaacactttatttttctaagt

SEQ ID NO: 152422 - DNA, 22 bp, Homo sapiens
tctggctctgtcactcaggctg

SEQ ID NO: 152423 - DNA, 21 bp, Homo sapiens
attctgtcacccagtctggag

SEQ ID NO: 152424 - DNA, 19 bp, Homo sapiens
gaacactagtgataaagca

SEQ ID NO: 152425 - DNA, 23 bp, Homo sapiens
aaaaaggtttactactagtttta

SEQ ID NO: 152426 - DNA, 22 bp, Homo sapiens
ttttacttgaaaccccaagctc

SEQ ID NO: 152427 - DNA, 18 bp, Homo sapiens
tacatgatgatgatcatc

SEQ ID NO: 152428 - DNA, 20 bp, Homo sapiens
tttgagatggagtcttgctc

SEQ ID NO: 152429 - DNA, 21 bp, Homo sapiens
agagacaagtttttactctgt

SEQ ID NO: 152430 - DNA, 23 bp, Homo sapiens
tacatgactgtgtgtctgtaggc

SEQ ID NO: 152431 - DNA, 23 bp, Homo sapiens
gtgtctctgactctgtggaggtg

SEQ ID NO: 152432 - DNA, 23 bp, Homo sapiens
ttcagagagctagtagaatgatg

SEQ ID NO: 152433 - DNA, 23 bp, Homo sapiens
gcaagtagagtgaagagtgtgtg

SEQ ID NO: 152434 - DNA, 23 bp, Homo sapiens
ttcatatacagcttgtgagtatt

SEQ ID NO: 152435 - DNA, 23 bp, Homo sapiens
tttgagatggaatctcactctgt

SEQ ID NO: 152436 - DNA, 21 bp, Homo sapiens
tgtgtgactgtgtgtctctga

SEQ ID NO: 152437 - DNA, 21 bp, Homo sapiens
caaatgtttgtggtctgaaga

SEQ ID NO: 152438 - DNA, 22 bp, Homo sapiens
ttaagaaggagtctccctctgt

SEQ ID NO: 152439 - DNA, 21 bp, Homo sapiens
atactgtatatgatatgtata

SEQ ID NO: 152440 - DNA, 20 bp, Homo sapiens
atcactatatatatatatga

SEQ ID NO: 152441 - DNA, 23 bp, Homo sapiens
tggtgtgactcatagctctcagt

SEQ ID NO: 152442 - DNA, 23 bp, Homo sapiens
gtcagagtctcactctgtcgccc

SEQ ID NO: 152443 - DNA, 23 bp, Homo sapiens
gggtctcactctgtcactcaggc

SEQ ID NO: 152444 - DNA, 23 bp, Homo sapiens
ttacctgtgagcatctaatcaga

SEQ ID NO: 152445 - DNA, 23 bp, Homo sapiens
tgtctatatgtctatatctatct

SEQ ID NO: 152446 - DNA, 23 bp, Homo sapiens
cacatatgtatatatgtatatgt

SEQ ID NO: 152447 - DNA, 23 bp, Homo sapiens
tgtgtgtttgcatgttgtattag

SEQ ID NO: 152448 - DNA, 23 bp, Homo sapiens
tctaatgcaaagtcaggtttgag

SEQ ID NO: 152449 - DNA, 21 bp, Homo sapiens
taacaacaacaaaaagctacc

SEQ ID NO: 152450 - DNA, 18 bp, Homo sapiens
ttgtttgtttgttttttg

SEQ ID NO: 152451 - DNA, 18 bp, Homo sapiens
acacattttcaaatgtgg

SEQ ID NO: 152452 - DNA, 23 bp, Homo sapiens
gggtctcactctgtcacccaggc

SEQ ID NO: 152453 - DNA, 23 bp, Homo sapiens
atgtccattcttattttgtaaac

SEQ ID NO: 152454 - DNA, 23 bp, Homo sapiens
ttgagaccatgagttttggtgtc

SEQ ID NO: 152455 - DNA, 23 bp, Homo sapiens
tccattcctttacttccagttta

SEQ ID NO: 152456 - DNA, 21 bp, Homo sapiens
tctttctagcgttttgatgtg

SEQ ID NO: 152457 - DNA, 23 bp, Homo sapiens
tctctctcagtgtgctgaggctg

SEQ ID NO: 152458 - DNA, 20 bp, Homo sapiens
acacacgcacgcatcctaat

SEQ ID NO: 152459 - DNA, 23 bp, Homo sapiens
tgtacatggatgtgtgtgtatga

SEQ ID NO: 152460 - DNA, 19 bp, Homo sapiens
tgagacagagtctcgctct

SEQ ID NO: 152461 - DNA, 23 bp, Homo sapiens
ttctaagtatttcaacatagctt

SEQ ID NO: 152462 - DNA, 23 bp, Homo sapiens
taattttttgtagaggtggggtt

SEQ ID NO: 152463 - DNA, 23 bp, Homo sapiens
gggtctcactctgtcactcaggc

SEQ ID NO: 152464 - DNA, 18 bp, Homo sapiens
ttctccagcattttcctg

SEQ ID NO: 152465 - DNA, 21 bp, Homo sapiens
ttaaagctatttttatttcac

SEQ ID NO: 152466 - DNA, 23 bp, Homo sapiens
agagtgaaactctgtctcaaaaa

SEQ ID NO: 152467 - DNA, 23 bp, Homo sapiens
atttgattagttgttgcattcca

SEQ ID NO: 152468 - DNA, 19 bp, Homo sapiens
tgacactggctgtgattat

SEQ ID NO: 152469 - DNA, 23 bp, Homo sapiens
ttttgagacggagtcttgctctg

SEQ ID NO: 152470 - DNA, 23 bp, Homo sapiens
tcaagtctcactctgtcacccag

SEQ ID NO: 152471 - DNA, 23 bp, Homo sapiens
agacctgagaatggtctgtcaat

SEQ ID NO: 152472 - DNA, 19 bp, Homo sapiens
ttactttatccagaggatg

SEQ ID NO: 152473 - DNA, 23 bp, Homo sapiens
gggtgtactgtaaagtaggtagg

SEQ ID NO: 152474 - DNA, 19 bp, Homo sapiens
tcgtgtgtttgtttgtttt

SEQ ID NO: 152475 - DNA, 21 bp, Homo sapiens
ttagtgtcagctggctaactg

SEQ ID NO: 152476 - DNA, 23 bp, Homo sapiens
ttgattatgttaatgataggtga

SEQ ID NO: 152477 - DNA, 23 bp, Homo sapiens
gatggcagtggtagaaaagtctg

SEQ ID NO: 152478 - DNA, 23 bp, Homo sapiens
tgagttcattgtagattctggat

SEQ ID NO: 152479 - DNA, 23 bp, Homo sapiens
tgagttcattgtagattctggat

SEQ ID NO: 152480 - DNA, 23 bp, Homo sapiens
agaggaatgtgtgtgtgtgtgta

SEQ ID NO: 152481 - DNA, 22 bp, Homo sapiens
aaaggtggctcaagttctgttc

SEQ ID NO: 152482 - DNA, 23 bp, Homo sapiens
ttctcagtgtgatagaagacctc

SEQ ID NO: 152483 - DNA, 21 bp, Homo sapiens
tatatcacacatatatatatg

SEQ ID NO: 152484 - DNA, 18 bp, Homo sapiens
acgtatatatatgtgtga

SEQ ID NO: 152485 - DNA, 19 bp, Homo sapiens
atacgtatatatatgtgtg

SEQ ID NO: 152486 - DNA, 23 bp, Homo sapiens
tgctttttaaagatgttgaattg

SEQ ID NO: 152487 - DNA, 21 bp, Homo sapiens
ttggtacacacattttgtggt

SEQ ID NO: 152488 - DNA, 21 bp, Homo sapiens
tgaggttgcagtgtgttatga

SEQ ID NO: 152489 - DNA, 19 bp, Homo sapiens
tgacacactgaaactctgt

SEQ ID NO: 152490 - DNA, 23 bp, Homo sapiens
gagtctcactctgtcactcaggc

SEQ ID NO: 152491 - DNA, 18 bp, Homo sapiens
gtgtatatatatgtgtgt

SEQ ID NO: 152492 - DNA, 19 bp, Homo sapiens
atgagctaaaacatgagct

SEQ ID NO: 152493 - DNA, 22 bp, Homo sapiens
gggtctcactctgtcgctcagg

SEQ ID NO: 152494 - DNA, 22 bp, Homo sapiens
gacatgcatcagttttctttca

SEQ ID NO: 152495 - DNA, 22 bp, Homo sapiens
attggcattaaatttgtttgtc

SEQ ID NO: 152496 - DNA, 23 bp, Homo sapiens
atatgtatgtacctgtgtatgtg

SEQ ID NO: 152497 - DNA, 20 bp, Homo sapiens
acacacacacacaaatatgt

SEQ ID NO: 152498 - DNA, 23 bp, Homo sapiens
tgtatgtgtatgtgtgtaaaatg

SEQ ID NO: 152499 - DNA, 21 bp, Homo sapiens
acgagttagagtgttggttga

SEQ ID NO: 152500 - DNA, 23 bp, Homo sapiens
agaatttatttgtatagtttctg

SEQ ID NO: 152501 - DNA, 23 bp, Homo sapiens
gtgtgtgtatatatatgtgtgtg

SEQ ID NO: 152502 - DNA, 23 bp, Homo sapiens
attttttgtagagacagcgtctt

SEQ ID NO: 152503 - DNA, 21 bp, Homo sapiens
attgtctctactcttggcctc

SEQ ID NO: 152504 - DNA, 23 bp, Homo sapiens
gagacagagtctggctctgtggc

SEQ ID NO: 152505 - DNA, 23 bp, Homo sapiens
ctctaatctatgttgctttgaaa

SEQ ID NO: 152506 - DNA, 22 bp, Homo sapiens
tgagtaactgcagagtgagtat

SEQ ID NO: 152507 - DNA, 22 bp, Homo sapiens
actcactctgtgatattgttat

SEQ ID NO: 152508 - DNA, 18 bp, Homo sapiens
tttagggagaatagggta

SEQ ID NO: 152509 - DNA, 18 bp, Homo sapiens
caactagctgggactact

SEQ ID NO: 152510 - DNA, 23 bp, Homo sapiens
agtgtctcactgtgtcatccagg

SEQ ID NO: 152511 - DNA, 23 bp, Homo sapiens
aaggaatgtattgaagtgagatg

SEQ ID NO: 152512 - DNA, 21 bp, Homo sapiens
tctgtgtcaggtattgtgctg

SEQ ID NO: 152513 - DNA, 20 bp, Homo sapiens
agagtgaatatacagtgtgt

SEQ ID NO: 152514 - DNA, 21 bp, Homo sapiens
ttatagataatactgatcagg

SEQ ID NO: 152515 - DNA, 23 bp, Homo sapiens
caattttcagtgtagaagaattg

SEQ ID NO: 152516 - DNA, 23 bp, Homo sapiens
tatgtaagtatatatatgtgtgt

SEQ ID NO: 152517 - DNA, 21 bp, Homo sapiens
atgtatatatacatgtatgtg

SEQ ID NO: 152518 - DNA, 23 bp, Homo sapiens
atgtatgtgtgtatatgtttata

SEQ ID NO: 152519 - DNA, 23 bp, Homo sapiens
acagatagttagatgtatatgtt

SEQ ID NO: 152520 - DNA, 21 bp, Homo sapiens
acatgtgcacattgtgcaggt

SEQ ID NO: 152521 - DNA, 23 bp, Homo sapiens
tacagacacatactgtatgtatc

SEQ ID NO: 152522 - DNA, 23 bp, Homo sapiens
tctcactctgtcactctgcccta

SEQ ID NO: 152523 - DNA, 22 bp, Homo sapiens
tacatgtatatatgtatatatg

SEQ ID NO: 152524 - DNA, 23 bp, Homo sapiens
tgtgtatgtatatgtatatgtgt

SEQ ID NO: 152525 - DNA, 21 bp, Homo sapiens
tatgtatatatgcatatatgt

SEQ ID NO: 152526 - DNA, 21 bp, Homo sapiens
atatgtatatatgtatatatg

SEQ ID NO: 152527 - DNA, 21 bp, Homo sapiens
atacatatacaacatgtacat

SEQ ID NO: 152528 - DNA, 22 bp, Homo sapiens
tatatatacgttgtatatgtat

SEQ ID NO: 152529 - DNA, 21 bp, Homo sapiens
attttccttctgttgctgatt

SEQ ID NO: 152530 - DNA, 23 bp, Homo sapiens
tgctttggtattcttgaagattt

SEQ ID NO: 152531 - DNA, 23 bp, Homo sapiens
aatggagtctcactctgtcaccc

SEQ ID NO: 152532 - DNA, 23 bp, Homo sapiens
tgagttcattgtagattctggat

SEQ ID NO: 152533 - DNA, 23 bp, Homo sapiens
tgagttcattgtagattctggat

SEQ ID NO: 152534 - DNA, 21 bp, Homo sapiens
tttgtatttatgtattacaga

SEQ ID NO: 152535 - DNA, 22 bp, Homo sapiens
tagcaagtccatatccatttga

SEQ ID NO: 152536 - DNA, 22 bp, Homo sapiens
cctgaagagagtctggaagggc

SEQ ID NO: 152537 - DNA, 20 bp, Homo sapiens
attctgtcacccagactgga

SEQ ID NO: 152538 - DNA, 19 bp, Homo sapiens
ttaaagcaactggatgtat

SEQ ID NO: 152539 - DNA, 23 bp, Homo sapiens
atcatgttaaatgttgtagatca

SEQ ID NO: 152540 - DNA, 18 bp, Homo sapiens
tttactcaatttgggatt

SEQ ID NO: 152541 - DNA, 23 bp, Homo sapiens
atgtgcttatatatgtgtgtgta

SEQ ID NO: 152542 - DNA, 23 bp, Homo sapiens
atatatgtatgtgtatatgggta

SEQ ID NO: 152543 - DNA, 22 bp, Homo sapiens
tttctcaaggtctgtatggggt

SEQ ID NO: 152544 - DNA, 19 bp, Homo sapiens
atatatatatgtggtccca

SEQ ID NO: 152545 - DNA, 22 bp, Homo sapiens
ctctgaagaaagccaatggtag

SEQ ID NO: 152546 - DNA, 23 bp, Homo sapiens
gactgagtctcgctctgtcaccc

SEQ ID NO: 152547 - DNA, 23 bp, Homo sapiens
tgagttcattgtagattctggat

SEQ ID NO: 152548 - DNA, 23 bp, Homo sapiens
tgagttcattgtagattctggat

SEQ ID NO: 152549 - DNA, 19 bp, Homo sapiens
ttctgagaggatgagctgt

SEQ ID NO: 152550 - DNA, 21 bp, Homo sapiens
agatggtcctggtccctttct

SEQ ID NO: 152551 - DNA, 21 bp, Homo sapiens
tgtttcaccatatgctattgt

SEQ ID NO: 152552 - DNA, 22 bp, Homo sapiens
attgacattggctgttgtgaga

SEQ ID NO: 152553 - DNA, 23 bp, Homo sapiens
atgtatatacatctgtaagtgtg

SEQ ID NO: 152554 - DNA, 18 bp, Homo sapiens
tactggaggaggttcagg

SEQ ID NO: 152555 - DNA, 22 bp, Homo sapiens
ttactagattttgttggagata

SEQ ID NO: 152556 - DNA, 22 bp, Homo sapiens
ttaggaattgctttgaggaaga

SEQ ID NO: 152557 - DNA, 23 bp, Homo sapiens
tggagtctcactctgtcacccac

SEQ ID NO: 152558 - DNA, 19 bp, Homo sapiens
tgtgtgtgtgtgtatacac

SEQ ID NO: 152559 - DNA, 20 bp, Homo sapiens
tatatgtgtggtttatatat

SEQ ID NO: 152560 - DNA, 23 bp, Homo sapiens
atcaacagtagacaatttgtagt

SEQ ID NO: 152561 - DNA, 19 bp, Homo sapiens
aatattctactgtatggag

SEQ ID NO: 152562 - DNA, 19 bp, Homo sapiens
agagattggcaggctttgg

SEQ ID NO: 152563 - DNA, 23 bp, Homo sapiens
tgtctatatatgtatatatgtgt

SEQ ID NO: 152564 - DNA, 22 bp, Homo sapiens
ccaagagataagtgtaaggtgt

SEQ ID NO: 152565 - DNA, 23 bp, Homo sapiens
tatatgtacattaatcttgtgag

SEQ ID NO: 152566 - DNA, 22 bp, Homo sapiens
agagaacactatttgattgtgt

SEQ ID NO: 152567 - DNA, 23 bp, Homo sapiens
tggagtctcactctgtcacccag

SEQ ID NO: 152568 - DNA, 23 bp, Homo sapiens
ttcaaacttaagtactctgtgga

SEQ ID NO: 152569 - DNA, 23 bp, Homo sapiens
gcagtgtgtgtatgtgtctgtgt

SEQ ID NO: 152570 - DNA, 21 bp, Homo sapiens
tgtgtgtgtgtgtgcacacat

SEQ ID NO: 152571 - DNA, 23 bp, Homo sapiens
tgtgcatatatgtgtgtgtgtgc

SEQ ID NO: 152572 - DNA, 23 bp, Homo sapiens
tatatgtgcatatatatgtataa

SEQ ID NO: 152573 - DNA, 21 bp, Homo sapiens
atgtgtttatatatatatgtg

SEQ ID NO: 152574 - DNA, 23 bp, Homo sapiens
ggtatgcagaagtatcagaattt

SEQ ID NO: 152575 - DNA, 23 bp, Homo sapiens
tggtgcaagaaactcagttttca

SEQ ID NO: 152576 - DNA, 23 bp, Homo sapiens
tcagaatttcatgtcctatttat

SEQ ID NO: 152577 - DNA, 23 bp, Homo sapiens
ctgaaaaagtgggacaacttttt

SEQ ID NO: 152578 - DNA, 23 bp, Homo sapiens
tatgtgtgtgtgtgtctgtgtat

SEQ ID NO: 152579 - DNA, 19 bp, Homo sapiens
gtgtgtgtgtgtatatata

SEQ ID NO: 152580 - DNA, 21 bp, Homo sapiens
tgtatgtatgtgtatatacgt

SEQ ID NO: 152581 - DNA, 20 bp, Homo sapiens
tatgtgtgtgtatgtatata

SEQ ID NO: 152582 - DNA, 23 bp, Homo sapiens
tacatgtgcaggatgtgcaggtt

SEQ ID NO: 152583 - DNA, 23 bp, Homo sapiens
tttataaccatttgataagaaat

SEQ ID NO: 152584 - DNA, 23 bp, Homo sapiens
aggtgtgtatatatgtatatgta

SEQ ID NO: 152585 - DNA, 19 bp, Homo sapiens
gtctcgctctgtcacccag

SEQ ID NO: 152586 - DNA, 19 bp, Homo sapiens
agaatttatacatatgtgt

SEQ ID NO: 152587 - DNA, 19 bp, Homo sapiens
atatatgtgtgtatatgta

SEQ ID NO: 152588 - DNA, 22 bp, Homo sapiens
tatgtgtacatatatatgtgta

SEQ ID NO: 152589 - DNA, 23 bp, Homo sapiens
atatgtatacatatatatgtgta

SEQ ID NO: 152590 - DNA, 23 bp, Homo sapiens
atgtgtatatatgtatatatgtg

SEQ ID NO: 152591 - DNA, 23 bp, Homo sapiens
tatgtatacatgtatatatatac

SEQ ID NO: 152592 - DNA, 23 bp, Homo sapiens
taatggctgaggtagtagtttct

SEQ ID NO: 152593 - DNA, 23 bp, Homo sapiens
tgtgtgtgtctgtgtgtgtatat

SEQ ID NO: 152594 - DNA, 21 bp, Homo sapiens
tatatgtatatgtatatatgt

SEQ ID NO: 152595 - DNA, 20 bp, Homo sapiens
atatgtatatgtatatatgt

SEQ ID NO: 152596 - DNA, 18 bp, Homo sapiens
acacatatatgtatgtgt

SEQ ID NO: 152597 - DNA, 23 bp, Homo sapiens
tgtgtgtatatatatacaattgt

SEQ ID NO: 152598 - DNA, 22 bp, Homo sapiens
ttgcttcttgagagtgagcact

SEQ ID NO: 152599 - DNA, 20 bp, Homo sapiens
tactgtagtgtttaatttga

SEQ ID NO: 152600 - DNA, 23 bp, Homo sapiens
ctcccagagcccctggaactctg

SEQ ID NO: 152601 - DNA, 23 bp, Homo sapiens
tcccagagcccctggaactctgg

SEQ ID NO: 152602 - DNA, 23 bp, Homo sapiens
tcccagagcccctggaactctgg

SEQ ID NO: 152603 - DNA, 23 bp, Homo sapiens
tcccagagcccctggaactctgg

SEQ ID NO: 152604 - DNA, 18 bp, Homo sapiens
tctccatatatgtacatt

SEQ ID NO: 152605 - DNA, 23 bp, Homo sapiens
atgactaaatatttttgtgatga

SEQ ID NO: 152606 - DNA, 23 bp, Homo sapiens
agacggtgtctctcgctctgtcg

SEQ ID NO: 152607 - DNA, 23 bp, Homo sapiens
tgttttacatgcaggtctgtgag

SEQ ID NO: 152608 - DNA, 22 bp, Homo sapiens
tttgtttggttgtcatgtctcc

SEQ ID NO: 152609 - DNA, 21 bp, Homo sapiens
agggagtgaatggtgttgcca

SEQ ID NO: 152610 - DNA, 18 bp, Homo sapiens
ttatccatattatatgta

SEQ ID NO: 152611 - DNA, 21 bp, Homo sapiens
acatatattcatgaatatgca

SEQ ID NO: 152612 - DNA, 23 bp, Homo sapiens
tgtatgtatacatgtatttgtgt

SEQ ID NO: 152613 - DNA, 23 bp, Homo sapiens
aatggtaaatgatctggcacctc

SEQ ID NO: 152614 - DNA, 20 bp, Homo sapiens
tctgtcacccagtctggagt

SEQ ID NO: 152615 - DNA, 22 bp, Homo sapiens
atatttctatatgtatatatgt

SEQ ID NO: 152616 - DNA, 21 bp, Homo sapiens
atttgtatacatatactatat

SEQ ID NO: 152617 - DNA, 23 bp, Homo sapiens
tgagttcattgtagattctggat

SEQ ID NO: 152618 - DNA, 23 bp, Homo sapiens
tgagttcattgtagattctggat

SEQ ID NO: 152619 - DNA, 23 bp, Homo sapiens
ctctcaaagttctaggattactg

SEQ ID NO: 152620 - DNA, 23 bp, Homo sapiens
agttcactgcaattgatctcttg

SEQ ID NO: 152621 - DNA, 23 bp, Homo sapiens
attacatattatatatttgtgtg

SEQ ID NO: 152622 - DNA, 23 bp, Homo sapiens
accagcatctgttatttttgact

SEQ ID NO: 152623 - DNA, 22 bp, Homo sapiens
ctggagctctcagctgatcaag

SEQ ID NO: 152624 - DNA, 22 bp, Homo sapiens
cagatgtatagatgtatgtaca

SEQ ID NO: 152625 - DNA, 22 bp, Homo sapiens
atgccaatatatatgtatgtgt

SEQ ID NO: 152626 - DNA, 22 bp, Homo sapiens
tgcgtatgtgtgtgtgtgtgta

SEQ ID NO: 152627 - DNA, 22 bp, Homo sapiens
tgtaatgtaattcagtatgtgg

SEQ ID NO: 152628 - DNA, 19 bp, Homo sapiens
tagacatagatatgtgtat

SEQ ID NO: 152629 - DNA, 23 bp, Homo sapiens
ctacttgtgtctggtacactagt

SEQ ID NO: 152630 - DNA, 21 bp, Homo sapiens
ttatgtccttactgtcagcat

SEQ ID NO: 152631 - DNA, 22 bp, Homo sapiens
aaatttctaattgaaattgaat

SEQ ID NO: 152632 - DNA, 23 bp, Homo sapiens
tgacactaaagagtgtgcacctg

SEQ ID NO: 152633 - DNA, 21 bp, Homo sapiens
tagatagaacatagtaagcac

SEQ ID NO: 152634 - DNA, 22 bp, Homo sapiens
aatttgctaatgttgtcaaggc

SEQ ID NO: 152635 - DNA, 23 bp, Homo sapiens
tgtatgtatgtatgtgtgtgtgt

SEQ ID NO: 152636 - DNA, 23 bp, Homo sapiens
catttctttgaaaaactcaatgc

SEQ ID NO: 152637 - DNA, 22 bp, Homo sapiens
ttgtatgtgtgtgtgaatatat

SEQ ID NO: 152638 - DNA, 23 bp, Homo sapiens
atctttatgtccatgtgtaccca

SEQ ID NO: 152639 - DNA, 22 bp, Homo sapiens
tttatggtgtacaacatgatgt

SEQ ID NO: 152640 - DNA, 18 bp, Homo sapiens
tatgtatatctctatgta

SEQ ID NO: 152641 - DNA, 23 bp, Homo sapiens
tgagttcattgtagattctggat

SEQ ID NO: 152642 - DNA, 23 bp, Homo sapiens
tgagttcattgtagattctggat

SEQ ID NO: 152643 - DNA, 23 bp, Homo sapiens
ctcccagagcccctggaactctg

SEQ ID NO: 152644 - DNA, 23 bp, Homo sapiens
tcccagagcccctggaactctgg

SEQ ID NO: 152645 - DNA, 23 bp, Homo sapiens
tcccagagcccctggaactctgg

SEQ ID NO: 152646 - DNA, 23 bp, Homo sapiens
tcccagagcccctggaactctgg

SEQ ID NO: 152647 - DNA, 22 bp, Homo sapiens
tatcataggaatagaaatgata

SEQ ID NO: 152648 - DNA, 23 bp, Homo sapiens
tgtgagactcaattactaatgct

SEQ ID NO: 152649 - DNA, 23 bp, Homo sapiens
cataaacaatatgtaaatgaagg

SEQ ID NO: 152650 - DNA, 23 bp, Homo sapiens
tgtgtgcatttgtatgtgttcat

SEQ ID NO: 152651 - DNA, 21 bp, Homo sapiens
tgtgtgcatatataaatgtgt

SEQ ID NO: 152652 - DNA, 21 bp, Homo sapiens
acacacacacattatttggga

SEQ ID NO: 152653 - DNA, 23 bp, Homo sapiens
ttgaatttcagagtagaatcatg

SEQ ID NO: 152654 - DNA, 22 bp, Homo sapiens
tgcgtgtgtctctgtgtgtgtg

SEQ ID NO: 152655 - DNA, 22 bp, Homo sapiens
aggtagatttagaaatgtgtct

SEQ ID NO: 152656 - DNA, 20 bp, Homo sapiens
attcactgtatcatattgcc

SEQ ID NO: 152657 - DNA, 22 bp, Homo sapiens
tgtgacagtagagagtgggaaa

SEQ ID NO: 152658 - DNA, 21 bp, Homo sapiens
aatgacaatatatatactgtg

SEQ ID NO: 152659 - DNA, 22 bp, Homo sapiens
tatgtgtatatatatagactat

SEQ ID NO: 152660 - DNA, 21 bp, Homo sapiens
tatgtgtatatatatagacta

SEQ ID NO: 152661 - DNA, 23 bp, Homo sapiens
ttattaatgatttagataaggtt

SEQ ID NO: 152662 - DNA, 23 bp, Homo sapiens
tatatgtatatgtgtgtgtatac

SEQ ID NO: 152663 - DNA, 23 bp, Homo sapiens
tatatgtatatatacatatgtgt

SEQ ID NO: 152664 - DNA, 23 bp, Homo sapiens
tatgtgtatatacacatgtgtgt

SEQ ID NO: 152665 - DNA, 20 bp, Homo sapiens
atgtgtacatatgtatatgt

SEQ ID NO: 152666 - DNA, 22 bp, Homo sapiens
taatatgtatatgtatacatgt

SEQ ID NO: 152667 - DNA, 23 bp, Homo sapiens
tgtaaatgtatatgtatacgtat

SEQ ID NO: 152668 - DNA, 21 bp, Homo sapiens
aaacacatctatattttatgt

SEQ ID NO: 152669 - DNA, 20 bp, Homo sapiens
gagttgaaggtcactcttgt

SEQ ID NO: 152670 - DNA, 23 bp, Homo sapiens
tgagttcattgtagattctggat

SEQ ID NO: 152671 - DNA, 23 bp, Homo sapiens
tgagttcattgtagattctggat

SEQ ID NO: 152672 - DNA, 20 bp, Homo sapiens
ttgtgcattagaaaagtttc

SEQ ID NO: 152673 - DNA, 23 bp, Homo sapiens
agatagaggagattctactgtat

SEQ ID NO: 152674 - DNA, 23 bp, Homo sapiens
tgagttctgtttttcttcatttg

SEQ ID NO: 152675 - DNA, 22 bp, Homo sapiens
tacatagaagatcatgccatct

SEQ ID NO: 152676 - DNA, 23 bp, Homo sapiens
acatgttttctgattttgttcat

SEQ ID NO: 152677 - DNA, 23 bp, Homo sapiens
gttctctctctgtcttctggagc

SEQ ID NO: 152678 - DNA, 21 bp, Homo sapiens
atgtatatatgtatatgtatg

SEQ ID NO: 152679 - DNA, 21 bp, Homo sapiens
tgtgtatatatatacatatgt

SEQ ID NO: 152680 - DNA, 23 bp, Homo sapiens
tttgtgtggttttcattgctgtg

SEQ ID NO: 152681 - DNA, 23 bp, Homo sapiens
tgagttcattgtagattctggat

SEQ ID NO: 152682 - DNA, 23 bp, Homo sapiens
tgagttcattgtagattctggat

SEQ ID NO: 152683 - DNA, 22 bp, Homo sapiens
aaatgcagagtggatgctgagt

SEQ ID NO: 152684 - DNA, 23 bp, Homo sapiens
tatatgactgctttgcatgtcca

SEQ ID NO: 152685 - DNA, 19 bp, Homo sapiens
tcaatacttctatttatgc

SEQ ID NO: 152686 - DNA, 23 bp, Homo sapiens
aacagatgagtatttcttcttca

SEQ ID NO: 152687 - DNA, 23 bp, Homo sapiens
tcacatccaacactgaggcttgt

SEQ ID NO: 152688 - DNA, 23 bp, Homo sapiens
aactagtttttcaggtttgcttt

SEQ ID NO: 152689 - DNA, 23 bp, Homo sapiens
gtgacatatcagagtctattggt

SEQ ID NO: 152690 - DNA, 22 bp, Homo sapiens
ttgaatgtgtgcatgtgtatgt

SEQ ID NO: 152691 - DNA, 23 bp, Homo sapiens
tgagtacatatttattgctgtat

SEQ ID NO: 152692 - DNA, 23 bp, Homo sapiens
tctagctcattagatattgtact

SEQ ID NO: 152693 - DNA, 19 bp, Homo sapiens
agtcagaggtgggttcttt

SEQ ID NO: 152694 - DNA, 23 bp, Homo sapiens
agttgtgtgcatgtgtatttcaa

SEQ ID NO: 152695 - DNA, 23 bp, Homo sapiens
gtgtgacagcaacttgttacgcc

SEQ ID NO: 152696 - DNA, 19 bp, Homo sapiens
ttattagtttggaatttta

SEQ ID NO: 152697 - DNA, 23 bp, Homo sapiens
tgagttcattgtagattctggat

SEQ ID NO: 152698 - DNA, 23 bp, Homo sapiens
tgagttcattgtagattctggat

SEQ ID NO: 152699 - DNA, 22 bp, Homo sapiens
cttttaatggtgcttatgtaat

SEQ ID NO: 152700 - DNA, 23 bp, Homo sapiens
agtatacatgtatatgtataagt

SEQ ID NO: 152701 - DNA, 23 bp, Homo sapiens
gtatgcttgtatatgtacgtgta

SEQ ID NO: 152702 - DNA, 23 bp, Homo sapiens
atatatgtttatgtataagtgca

SEQ ID NO: 152703 - DNA, 22 bp, Homo sapiens
taaatgtatttattttcctgtg

SEQ ID NO: 152704 - DNA, 18 bp, Homo sapiens
agtttttaaaaacagtta

SEQ ID NO: 152705 - DNA, 23 bp, Homo sapiens
gattggatttagaaagggggtag

SEQ ID NO: 152706 - DNA, 23 bp, Homo sapiens
cggagtctcactctgtcacccag

SEQ ID NO: 152707 - DNA, 23 bp, Homo sapiens
gagtctcactctgtcacccaggc

SEQ ID NO: 152708 - DNA, 20 bp, Homo sapiens
taatgtatatatgtatttgt

SEQ ID NO: 152709 - DNA, 23 bp, Homo sapiens
tagtttggtattcgaggtaacag

SEQ ID NO: 152710 - DNA, 21 bp, Homo sapiens
tatgcatatatatacatatat

SEQ ID NO: 152711 - DNA, 19 bp, Homo sapiens
tgaagtgtttgttagtttt

SEQ ID NO: 152712 - DNA, 23 bp, Homo sapiens
acactgtatgtctgtgatctttc

SEQ ID NO: 152713 - DNA, 20 bp, Homo sapiens
atatacgtgtatatacgtgt

SEQ ID NO: 152714 - DNA, 19 bp, Homo sapiens
tatatgtatatatacgtgt

SEQ ID NO: 152715 - DNA, 23 bp, Homo sapiens
atatgtatgcatatatacgtgta

SEQ ID NO: 152716 - DNA, 23 bp, Homo sapiens
atatgtatgcatatatacgtgta

SEQ ID NO: 152717 - DNA, 23 bp, Homo sapiens
actgggctctctctgtggcactg

SEQ ID NO: 152718 - DNA, 23 bp, Homo sapiens
gggcaacatagtgagactcactc

SEQ ID NO: 152719 - DNA, 23 bp, Homo sapiens
agattggtctctccaaaagaaga

SEQ ID NO: 152720 - DNA, 19 bp, Homo sapiens
ttagtgaaacagtctgtgg

SEQ ID NO: 152721 - DNA, 23 bp, Homo sapiens
attactgattttgattactgatt

SEQ ID NO: 152722 - DNA, 19 bp, Homo sapiens
gtggaaatgtcttgagtat

SEQ ID NO: 152723 - DNA, 19 bp, Homo sapiens
ataagtatgtatatgttat

SEQ ID NO: 152724 - DNA, 20 bp, Homo sapiens
tatatgtatgtgtgtgtgtg

SEQ ID NO: 152725 - DNA, 23 bp, Homo sapiens
ctgagtctgtctctgtcacccag

SEQ ID NO: 152726 - DNA, 23 bp, Homo sapiens
tctcagtttgtatatgtcagtct

SEQ ID NO: 152727 - DNA, 20 bp, Homo sapiens
ctaaatatatatatgtgtgt

SEQ ID NO: 152728 - DNA, 19 bp, Homo sapiens
tatgtgtatacatatacac

SEQ ID NO: 152729 - DNA, 20 bp, Homo sapiens
cacagttgtgtgccaccaca

SEQ ID NO: 152730 - DNA, 22 bp, Homo sapiens
taagtagaagttcttgttatgt

SEQ ID NO: 152731 - DNA, 18 bp, Homo sapiens
tacaggtctttgaacttg

SEQ ID NO: 152732 - DNA, 20 bp, Homo sapiens
tatatacgtatatgtgtatg

SEQ ID NO: 152733 - DNA, 23 bp, Homo sapiens
tatgtatatatatacgtatatgt

SEQ ID NO: 152734 - DNA, 21 bp, Homo sapiens
tatatgtatatgtatacgtat

SEQ ID NO: 152735 - DNA, 22 bp, Homo sapiens
aggcttggagaagatttacact

SEQ ID NO: 152736 - DNA, 23 bp, Homo sapiens
tgactcaagaatgtgagcttttg

SEQ ID NO: 152737 - DNA, 23 bp, Homo sapiens
aagattcttgtgtgtgtgtgtgt

SEQ ID NO: 152738 - DNA, 20 bp, Homo sapiens
agagttgtttttttgttgtt

SEQ ID NO: 152739 - DNA, 23 bp, Homo sapiens
ttgagacagacactgtcacccag

SEQ ID NO: 152740 - DNA, 19 bp, Homo sapiens
tctggggttcaacaacctg

SEQ ID NO: 152741 - DNA, 23 bp, Homo sapiens
ttacaagttgactggacttcaga

SEQ ID NO: 152742 - DNA, 19 bp, Homo sapiens
tgttctactcacggcaaat

SEQ ID NO: 152743 - DNA, 22 bp, Homo sapiens
attgccagtgaagttttgctag

SEQ ID NO: 152744 - DNA, 21 bp, Homo sapiens
aagcttctttttattgttgtt

SEQ ID NO: 152745 - DNA, 21 bp, Homo sapiens
tatgtgtgtatatatatgtct

SEQ ID NO: 152746 - DNA, 21 bp, Homo sapiens
tgcctgactgcagaggctggc

SEQ ID NO: 152747 - DNA, 21 bp, Homo sapiens
atatgtatatatatatgtgtg

SEQ ID NO: 152748 - DNA, 18 bp, Homo sapiens
tgcaatgtatccatgtaa

SEQ ID NO: 152749 - DNA, 23 bp, Homo sapiens
gaatggtagttctaagttctttg

SEQ ID NO: 152750 - DNA, 22 bp, Homo sapiens
tttcacagtggctgaactaatt

SEQ ID NO: 152751 - DNA, 20 bp, Homo sapiens
tatacatataaaacctatgt

SEQ ID NO: 152752 - DNA, 20 bp, Homo sapiens
atgtacatatattttctatg

SEQ ID NO: 152753 - DNA, 23 bp, Homo sapiens
tgctgagtgtgtgtgtgtgtgtg

SEQ ID NO: 152754 - DNA, 23 bp, Homo sapiens
tctgtgtctctgtgtgtgtgtat

SEQ ID NO: 152755 - DNA, 23 bp, Homo sapiens
tctagacagaaggaagagaggag

SEQ ID NO: 152756 - DNA, 23 bp, Homo sapiens
gagttgagcaagtctgttggcat

SEQ ID NO: 152757 - DNA, 23 bp, Homo sapiens
atacttactagtaattggctttt

SEQ ID NO: 152758 - DNA, 23 bp, Homo sapiens
tataatctgtgtgggtatgtatt

SEQ ID NO: 152759 - DNA, 20 bp, Homo sapiens
tatatatgtacatagtggca

SEQ ID NO: 152760 - DNA, 23 bp, Homo sapiens
tacgtacctaatgttgtaccaca

SEQ ID NO: 152761 - DNA, 23 bp, Homo sapiens
tcaggagtagtaggaagttttgt

SEQ ID NO: 152762 - DNA, 23 bp, Homo sapiens
cataattttagaaccactttcac

SEQ ID NO: 152763 - DNA, 23 bp, Homo sapiens
ctgtgggtgtgtctgtgcctctc

SEQ ID NO: 152764 - DNA, 23 bp, Homo sapiens
agtaaatggtctgtatctccaag

SEQ ID NO: 152765 - DNA, 19 bp, Homo sapiens
tgagaggtgagagagatca

SEQ ID NO: 152766 - DNA, 23 bp, Homo sapiens
ttttgtcgttgctaatgatatcc

SEQ ID NO: 152767 - DNA, 23 bp, Homo sapiens
aactgctgctattacaggtatga

SEQ ID NO: 152768 - DNA, 19 bp, Homo sapiens
agtatgtatgtttcttatg

SEQ ID NO: 152769 - DNA, 23 bp, Homo sapiens
acaacagagggtgaacatcaggt

SEQ ID NO: 152770 - DNA, 19 bp, Homo sapiens
tcagtctctgagtagctgg

SEQ ID NO: 152771 - DNA, 21 bp, Homo sapiens
atgatagaagctctttatcag

SEQ ID NO: 152772 - DNA, 23 bp, Homo sapiens
tggacattgctatgggacaagta

SEQ ID NO: 152773 - DNA, 21 bp, Homo sapiens
tataccttaagttttagggta

SEQ ID NO: 152774 - DNA, 23 bp, Homo sapiens
ctattccttcttcaggctgtgag

SEQ ID NO: 152775 - DNA, 23 bp, Homo sapiens
ctgggtctgaatatgtgtgtgta

SEQ ID NO: 152776 - DNA, 23 bp, Homo sapiens
tgtgtatatatatatatgtgtgt

SEQ ID NO: 152777 - DNA, 22 bp, Homo sapiens
atatacgtatatatatatatgt

SEQ ID NO: 152778 - DNA, 23 bp, Homo sapiens
gtgtctgtgtgtgcatgtgcatg

SEQ ID NO: 152779 - DNA, 21 bp, Homo sapiens
acaagtcacgtgttgcttagg

SEQ ID NO: 152780 - DNA, 23 bp, Homo sapiens
tgtgtgtgtgtatgtgcgtgtgt

SEQ ID NO: 152781 - DNA, 20 bp, Homo sapiens
tggcacagtagagaagcaac

SEQ ID NO: 152782 - DNA, 23 bp, Homo sapiens
ccttgtgcttagagtggaagttg

SEQ ID NO: 152783 - DNA, 22 bp, Homo sapiens
ttcaatgctcttgttccactct

SEQ ID NO: 152784 - DNA, 22 bp, Homo sapiens
actgtttttatatatgtgtgtg

SEQ ID NO: 152785 - DNA, 22 bp, Homo sapiens
agagttgttgctcagtaagtat

SEQ ID NO: 152786 - DNA, 21 bp, Homo sapiens
acatgtgcacgatgtgcaggt

SEQ ID NO: 152787 - DNA, 23 bp, Homo sapiens
tgagttcattgtagattctggat

SEQ ID NO: 152788 - DNA, 23 bp, Homo sapiens
tgagttcattgtagattctggat

SEQ ID NO: 152789 - DNA, 22 bp, Homo sapiens
acatatatatacacattaggta

SEQ ID NO: 152790 - DNA, 23 bp, Homo sapiens
agtcttactctgtcacccaagct

SEQ ID NO: 152791 - DNA, 18 bp, Homo sapiens
tagtgcatgtatatatat

SEQ ID NO: 152792 - DNA, 20 bp, Homo sapiens
gatgtagtgtgtgtgcacag

SEQ ID NO: 152793 - DNA, 22 bp, Homo sapiens
tatgcatgtgtgtatatatgta

SEQ ID NO: 152794 - DNA, 23 bp, Homo sapiens
tatgtatacatgcatgtgtgtgt

SEQ ID NO: 152795 - DNA, 23 bp, Homo sapiens
tgagttcattgtagattctggat

SEQ ID NO: 152796 - DNA, 23 bp, Homo sapiens
tgagttcattgtagattctggat

SEQ ID NO: 152797 - DNA, 23 bp, Homo sapiens
agagtctcactctgtcacccagg

SEQ ID NO: 152798 - DNA, 23 bp, Homo sapiens
gtgtgtgtatatccatgtgtata

SEQ ID NO: 152799 - DNA, 23 bp, Homo sapiens
tgtgtgtatatgtatgtatacat

SEQ ID NO: 152800 - DNA, 20 bp, Homo sapiens
ctctatttgtcaatgtcagt

SEQ ID NO: 152801 - DNA, 19 bp, Homo sapiens
ttactagtgtttttgttga

SEQ ID NO: 152802 - DNA, 23 bp, Homo sapiens
tggagtctcactctgtcacccag

SEQ ID NO: 152803 - DNA, 20 bp, Homo sapiens
gagtgcaggggagatcttgg

SEQ ID NO: 152804 - DNA, 23 bp, Homo sapiens
tgaggtctcactctgtcacccag

SEQ ID NO: 152805 - DNA, 19 bp, Homo sapiens
agtggcatcatcatagctc

SEQ ID NO: 152806 - DNA, 23 bp, Homo sapiens
tgtgtgtgtgtgtgtgtctccta

SEQ ID NO: 152807 - DNA, 18 bp, Homo sapiens
tttcttgtagataatctt

SEQ ID NO: 152808 - DNA, 23 bp, Homo sapiens
cagatacagagtaatatacatat

SEQ ID NO: 152809 - DNA, 19 bp, Homo sapiens
tctctctctgtatacatag

SEQ ID NO: 152810 - DNA, 23 bp, Homo sapiens
tgcccctctctctgacccagtgc

SEQ ID NO: 152811 - DNA, 23 bp, Homo sapiens
gggggtgacagtgagactctgtc

SEQ ID NO: 152812 - DNA, 21 bp, Homo sapiens
tacacacacacgtatatatgt

SEQ ID NO: 152813 - DNA, 18 bp, Homo sapiens
atgtatgtatatattcct

SEQ ID NO: 152814 - DNA, 21 bp, Homo sapiens
atgatcagtgatattgaactt

SEQ ID NO: 152815 - DNA, 21 bp, Homo sapiens
ttatacaacacataggcagac

SEQ ID NO: 152816 - DNA, 23 bp, Homo sapiens
tgtgtgtatatatatgtgtgtgt

SEQ ID NO: 152817 - DNA, 23 bp, Homo sapiens
atatgtacacatacatatatgtg

SEQ ID NO: 152818 - DNA, 19 bp, Homo sapiens
ttttctgtacttattgcta

SEQ ID NO: 152819 - DNA, 23 bp, Homo sapiens
agtctgtctctgaatttcttgcc

SEQ ID NO: 152820 - DNA, 20 bp, Homo sapiens
tgaacagctaacagaatctg

SEQ ID NO: 152821 - DNA, 19 bp, Homo sapiens
atgtgcattagtttacttt

SEQ ID NO: 152822 - DNA, 23 bp, Homo sapiens
acacgaaatatatatgtatatgt

SEQ ID NO: 152823 - DNA, 23 bp, Homo sapiens
atgaaatgtaaggtttgcatggg

SEQ ID NO: 152824 - DNA, 22 bp, Homo sapiens
cagatgtactagcaggcacagt

SEQ ID NO: 152825 - DNA, 23 bp, Homo sapiens
agtcgctgactcagaaaactcat

SEQ ID NO: 152826 - DNA, 20 bp, Homo sapiens
agagttgtctccttctgatg

SEQ ID NO: 152827 - DNA, 21 bp, Homo sapiens
actgttagaagatacagagga

SEQ ID NO: 152828 - DNA, 20 bp, Homo sapiens
acccagagttgtcatattct

SEQ ID NO: 152829 - DNA, 18 bp, Homo sapiens
ctatatatattctgtata

SEQ ID NO: 152830 - DNA, 23 bp, Homo sapiens
atattctatatatattctgtata

SEQ ID NO: 152831 - DNA, 22 bp, Homo sapiens
attctgtatatatattctgtat

SEQ ID NO: 152832 - DNA, 20 bp, Homo sapiens
atatgtgtatatatatatgt

SEQ ID NO: 152833 - DNA, 23 bp, Homo sapiens
attaagagctgctatatgttttt

SEQ ID NO: 152834 - DNA, 23 bp, Homo sapiens
tcagaaaggcagatcagagagtg

SEQ ID NO: 152835 - DNA, 21 bp, Homo sapiens
tatcttgtggttttcatctga

SEQ ID NO: 152836 - DNA, 22 bp, Homo sapiens
atatctgtatatttaatagaga

SEQ ID NO: 152837 - DNA, 23 bp, Homo sapiens
tggagtctcactctgtcacccag

SEQ ID NO: 152838 - DNA, 23 bp, Homo sapiens
caccctaagatttctggaaattg

SEQ ID NO: 152839 - DNA, 18 bp, Homo sapiens
attagaaatgagtttcca

SEQ ID NO: 152840 - DNA, 18 bp, Homo sapiens
taaagtaagaattcgcat

SEQ ID NO: 152841 - DNA, 19 bp, Homo sapiens
acatagctttttaaaactg

SEQ ID NO: 152842 - DNA, 22 bp, Homo sapiens
tgacttcactgtctctcatcta

SEQ ID NO: 152843 - DNA, 23 bp, Homo sapiens
tgagttcattgtagattctggat

SEQ ID NO: 152844 - DNA, 23 bp, Homo sapiens
tgagttcattgtagattctggat

SEQ ID NO: 152845 - DNA, 23 bp, Homo sapiens
tcacagaagtcagtgagcagatg

SEQ ID NO: 152846 - DNA, 22 bp, Homo sapiens
tgacaactactttctgtgatgt

SEQ ID NO: 152847 - DNA, 23 bp, Homo sapiens
aacagttctgagagagcacagga

SEQ ID NO: 152848 - DNA, 23 bp, Homo sapiens
tgtacatgtatatgaatatgtgt

SEQ ID NO: 152849 - DNA, 20 bp, Homo sapiens
atatatgtatatatgtatgt

SEQ ID NO: 152850 - DNA, 22 bp, Homo sapiens
tctgacctctagaactgtgaga

SEQ ID NO: 152851 - DNA, 23 bp, Homo sapiens
ctgagacggagtctttctctgtc

SEQ ID NO: 152852 - DNA, 19 bp, Homo sapiens
aatgcagtgagcagaagtg

SEQ ID NO: 152853 - DNA, 23 bp, Homo sapiens
ctgtgaactgtgtctctcaggaa

SEQ ID NO: 152854 - DNA, 20 bp, Homo sapiens
atatatgtgtgatatatatg

SEQ ID NO: 152855 - DNA, 19 bp, Homo sapiens
tgagatgaagtctctctct

SEQ ID NO: 152856 - DNA, 22 bp, Homo sapiens
tgtgtatatatgtatatatgtg

SEQ ID NO: 152857 - DNA, 18 bp, Homo sapiens
aaaagtttgagataaaga

SEQ ID NO: 152858 - DNA, 18 bp, Homo sapiens
tatttttgtctttaactt

SEQ ID NO: 152859 - DNA, 23 bp, Homo sapiens
ttgaaatagtggctgcaaatgaa

SEQ ID NO: 152860 - DNA, 22 bp, Homo sapiens
tccccgagactgaaagttgtct

SEQ ID NO: 152861 - DNA, 23 bp, Homo sapiens
gacatatctcgttctcattggaa

SEQ ID NO: 152862 - DNA, 23 bp, Homo sapiens
gtctttctctctctgtgccactg

SEQ ID NO: 152863 - DNA, 23 bp, Homo sapiens
tatgtgtgtgcatatatatatgt

SEQ ID NO: 152864 - DNA, 23 bp, Homo sapiens
gtatatatagatgcagttatcat

SEQ ID NO: 152865 - DNA, 18 bp, Homo sapiens
tatgtatgtctaatatgc

SEQ ID NO: 152866 - DNA, 21 bp, Homo sapiens
tctatctatatctatctgtct

SEQ ID NO: 152867 - DNA, 18 bp, Homo sapiens
tccacctgtttatttggg

SEQ ID NO: 152868 - DNA, 23 bp, Homo sapiens
atggtagttatgggaccacttta

SEQ ID NO: 152869 - DNA, 23 bp, Homo sapiens
atatttgtgttagctactcatca

SEQ ID NO: 152870 - DNA, 23 bp, Homo sapiens
aatttgaatgaatatcagaatag

SEQ ID NO: 152871 - DNA, 18 bp, Homo sapiens
tgaccacaatatttggag

SEQ ID NO: 152872 - DNA, 23 bp, Homo sapiens
attggtgcttatacaagacttca

SEQ ID NO: 152873 - DNA, 22 bp, Homo sapiens
actatgtgtgtgtatgtagtgt

SEQ ID NO: 152874 - DNA, 23 bp, Homo sapiens
atatgtgtgtatatgaatacatg

SEQ ID NO: 152875 - DNA, 21 bp, Homo sapiens
tctctatatatatatatgtgt

SEQ ID NO: 152876 - DNA, 21 bp, Homo sapiens
agacttctttctgtatcctca

SEQ ID NO: 152877 - DNA, 19 bp, Homo sapiens
tcgtgtatctgtctgtatt

SEQ ID NO: 152878 - DNA, 23 bp, Homo sapiens
aaggaataacaaaatggctactt

SEQ ID NO: 152879 - DNA, 22 bp, Homo sapiens
tatgtttatttcttgattacat

SEQ ID NO: 152880 - DNA, 23 bp, Homo sapiens
taaggtatacaacatgatgtttt

SEQ ID NO: 152881 - DNA, 22 bp, Homo sapiens
ctctgtctctctctctctatat

SEQ ID NO: 152882 - DNA, 23 bp, Homo sapiens
ttcagtcaccaaatgtgtatttg

SEQ ID NO: 152883 - DNA, 23 bp, Homo sapiens
tttgttctttttgcttaggattt

SEQ ID NO: 152884 - DNA, 23 bp, Homo sapiens
atgaggaagatagagaaggtttt

SEQ ID NO: 152885 - DNA, 23 bp, Homo sapiens
tattatagacaaattcatgttta

SEQ ID NO: 152886 - DNA, 21 bp, Homo sapiens
tgattttgaatgtagcataat

SEQ ID NO: 152887 - DNA, 22 bp, Homo sapiens
tttacgattatgagcttgctga

SEQ ID NO: 152888 - DNA, 23 bp, Homo sapiens
tatgtgtatacatgtatacacat

SEQ ID NO: 152889 - DNA, 23 bp, Homo sapiens
acacacaggtatatatatatgta

SEQ ID NO: 152890 - DNA, 19 bp, Homo sapiens
tattaggaaatctaggttt

SEQ ID NO: 152891 - DNA, 19 bp, Homo sapiens
tgtataaatatctatgtgt

SEQ ID NO: 152892 - DNA, 23 bp, Homo sapiens
tgtttctatttttatctgtgtat

SEQ ID NO: 152893 - DNA, 23 bp, Homo sapiens
tattttggttaatattgcgttgt

SEQ ID NO: 152894 - DNA, 18 bp, Homo sapiens
tgtgtcaccaaggctaga

SEQ ID NO: 152895 - DNA, 23 bp, Homo sapiens
tggagtctcactctgtcacccag

SEQ ID NO: 152896 - DNA, 19 bp, Homo sapiens
tgcatacacacatatatgt

SEQ ID NO: 152897 - DNA, 19 bp, Homo sapiens
acatgtatgtatttatatg

SEQ ID NO: 152898 - DNA, 23 bp, Homo sapiens
gacagagtctcgctctgtcaccc

SEQ ID NO: 152899 - DNA, 23 bp, Homo sapiens
aatgagtctggaaagcataccat

SEQ ID NO: 152900 - DNA, 23 bp, Homo sapiens
agatggagtctcactctgtcacc

SEQ ID NO: 152901 - DNA, 23 bp, Homo sapiens
aggatgagttctgtatttgttgc

SEQ ID NO: 152902 - DNA, 21 bp, Homo sapiens
tatctgtatatataatgtgtg

SEQ ID NO: 152903 - DNA, 19 bp, Homo sapiens
tacgttatgtatatctatg

SEQ ID NO: 152904 - DNA, 19 bp, Homo sapiens
aagaatgtgaggaatgttt

SEQ ID NO: 152905 - DNA, 20 bp, Homo sapiens
aaaatacttagcaaatgtgc

SEQ ID NO: 152906 - DNA, 22 bp, Homo sapiens
tatatgtatgtatacgtatgtg

SEQ ID NO: 152907 - DNA, 23 bp, Homo sapiens
tgtgtatgtatatgtatgtatac

SEQ ID NO: 152908 - DNA, 19 bp, Homo sapiens
ttactctctccagaaaggc

SEQ ID NO: 152909 - DNA, 19 bp, Homo sapiens
agtgatcaagtatgtatca

SEQ ID NO: 152910 - DNA, 23 bp, Homo sapiens
tactctgtacatggaattttcat

SEQ ID NO: 152911 - DNA, 22 bp, Homo sapiens
attttgcttgtttacgattttt

SEQ ID NO: 152912 - DNA, 21 bp, Homo sapiens
tagcaggcatgtaaacatgta

SEQ ID NO: 152913 - DNA, 23 bp, Homo sapiens
gagcttcattgtatatgtctgtc

SEQ ID NO: 152914 - DNA, 23 bp, Homo sapiens
tagataaagactcaaaagtcata

SEQ ID NO: 152915 - DNA, 22 bp, Homo sapiens
tcaaaggagaaactgattctca

SEQ ID NO: 152916 - DNA, 20 bp, Homo sapiens
tgtgtaaatgtatatgtatg

SEQ ID NO: 152917 - DNA, 23 bp, Homo sapiens
cggagtctcactctgtcacccag

SEQ ID NO: 152918 - DNA, 23 bp, Homo sapiens
tgctaactggttatcttgcccat

SEQ ID NO: 152919 - DNA, 23 bp, Homo sapiens
gtattctctgctactaatactat

SEQ ID NO: 152920 - DNA, 22 bp, Homo sapiens
taagagacacatgtttgtatgt

SEQ ID NO: 152921 - DNA, 19 bp, Homo sapiens
atggcatatgtagtatata

SEQ ID NO: 152922 - DNA, 20 bp, Homo sapiens
aaggaggtagttttgcagct

SEQ ID NO: 152923 - DNA, 23 bp, Homo sapiens
atatcttgagataaaagctgaaa

SEQ ID NO: 152924 - DNA, 23 bp, Homo sapiens
gtttcactgagcggattcttttt

SEQ ID NO: 152925 - DNA, 23 bp, Homo sapiens
ctatgattagtgattttgaacat

SEQ ID NO: 152926 - DNA, 23 bp, Homo sapiens
ttaacagatatatgtatggagaa

SEQ ID NO: 152927 - DNA, 23 bp, Homo sapiens
tactgcatgtgtgtgtgtgtgta

SEQ ID NO: 152928 - DNA, 23 bp, Homo sapiens
tgtggtagaagtgagtgggtgca

SEQ ID NO: 152929 - DNA, 22 bp, Homo sapiens
atatgtgaatatgtatatatca

SEQ ID NO: 152930 - DNA, 21 bp, Homo sapiens
ttattggttttcatataagac

SEQ ID NO: 152931 - DNA, 19 bp, Homo sapiens
agtagcttgtgtaaaggca

SEQ ID NO: 152932 - DNA, 19 bp, Homo sapiens
tgttgtggtcttgttaatc

SEQ ID NO: 152933 - DNA, 21 bp, Homo sapiens
tatatacatgctacatagtgt

SEQ ID NO: 152934 - DNA, 23 bp, Homo sapiens
tgtgtatatatatacgtgtgtgt

SEQ ID NO: 152935 - DNA, 23 bp, Homo sapiens
tgagttcattgtagattctggat

SEQ ID NO: 152936 - DNA, 23 bp, Homo sapiens
tgagttcattgtagattctggat

SEQ ID NO: 152937 - DNA, 23 bp, Homo sapiens
tgagttcattgtagattctggat

SEQ ID NO: 152938 - DNA, 23 bp, Homo sapiens
tgagttcattgtagattctggat

SEQ ID NO: 152939 - DNA, 23 bp, Homo sapiens
gtaaagaaactggacagagagaa

SEQ ID NO: 152940 - DNA, 21 bp, Homo sapiens
tgtgtatatatatatgtgtgt

SEQ ID NO: 152941 - DNA, 23 bp, Homo sapiens
tgagttcattgtagattctggat

SEQ ID NO: 152942 - DNA, 23 bp, Homo sapiens
tgagttcattgtagattctggat

SEQ ID NO: 152943 - DNA, 23 bp, Homo sapiens
tgagttcattgtagattctggat

SEQ ID NO: 152944 - DNA, 23 bp, Homo sapiens
tgagttcattgtagattctggat

SEQ ID NO: 152945 - DNA, 22 bp, Homo sapiens
cttcatgaatatgtaaatgtgt

SEQ ID NO: 152946 - DNA, 19 bp, Homo sapiens
gagtgagagaaaagtctat

SEQ ID NO: 152947 - DNA, 22 bp, Homo sapiens
tctttccaaatcttctagtatt

SEQ ID NO: 152948 - DNA, 22 bp, Homo sapiens
attaggctgtgatacttggaag

SEQ ID NO: 152949 - DNA, 23 bp, Homo sapiens
tgcagtgccatgatcttggctta

SEQ ID NO: 152950 - DNA, 23 bp, Homo sapiens
gtattgttcctgtgtgtgtctgt

SEQ ID NO: 152951 - DNA, 22 bp, Homo sapiens
atcacctccaatatgctggcaa

SEQ ID NO: 152952 - DNA, 18 bp, Homo sapiens
tgcctggatgacagatgt

SEQ ID NO: 152953 - DNA, 22 bp, Homo sapiens
agatatgttagatatatatgga

SEQ ID NO: 152954 - DNA, 22 bp, Homo sapiens
agatatgctagatatattagat

SEQ ID NO: 152955 - DNA, 23 bp, Homo sapiens
gttgaatattttggaagatcata

SEQ ID NO: 152956 - DNA, 19 bp, Homo sapiens
tgtgtatatatatacgtat

SEQ ID NO: 152957 - DNA, 21 bp, Homo sapiens
tcagagactcactcaaatccc

SEQ ID NO: 152958 - DNA, 20 bp, Homo sapiens
tagtgcatctgttttacact

SEQ ID NO: 152959 - DNA, 22 bp, Homo sapiens
tcagatgttggtgtcaaaatat

SEQ ID NO: 152960 - DNA, 23 bp, Homo sapiens
actattgtagttgttttgggatg

SEQ ID NO: 152961 - DNA, 20 bp, Homo sapiens
tatgttgattttgtgttctg

SEQ ID NO: 152962 - DNA, 19 bp, Homo sapiens
ttgagtactcatattgaag

SEQ ID NO: 152963 - DNA, 21 bp, Homo sapiens
tatggatcttgtatatgcaca

SEQ ID NO: 152964 - DNA, 23 bp, Homo sapiens
tcctgtgtctcaatagtctttga

SEQ ID NO: 152965 - DNA, 22 bp, Homo sapiens
agagagtagagtgtgtggatat

SEQ ID NO: 152966 - DNA, 23 bp, Homo sapiens
gttgatttgtttcacagcagtag

SEQ ID NO: 152967 - DNA, 22 bp, Homo sapiens
atatatacacatatagatgatg

SEQ ID NO: 152968 - DNA, 23 bp, Homo sapiens
ttttcagagtatttgttaagact

SEQ ID NO: 152969 - DNA, 21 bp, Homo sapiens
tggtagattctttaggttttt

SEQ ID NO: 152970 - DNA, 21 bp, Homo sapiens
aatatgaatttaaggataggg

SEQ ID NO: 152971 - DNA, 23 bp, Homo sapiens
tctctgtttatatgtctgtctct

SEQ ID NO: 152972 - DNA, 22 bp, Homo sapiens
aaaaaccatcctttagttaaga

SEQ ID NO: 152973 - DNA, 22 bp, Homo sapiens
ttactgagacattctgttctgt

SEQ ID NO: 152974 - DNA, 23 bp, Homo sapiens
tatgacagtgttctaagcattat

SEQ ID NO: 152975 - DNA, 19 bp, Homo sapiens
agtgtatatatatagtata

SEQ ID NO: 152976 - DNA, 19 bp, Homo sapiens
atatatatatagtatagtg

SEQ ID NO: 152977 - DNA, 18 bp, Homo sapiens
agatgtgtgagtggagag

SEQ ID NO: 152978 - DNA, 22 bp, Homo sapiens
atatatgcacgtatatgtatgt

SEQ ID NO: 152979 - DNA, 23 bp, Homo sapiens
atatatgtgtgcatgtgtatatg

SEQ ID NO: 152980 - DNA, 23 bp, Homo sapiens
tatatatgtatatgtatatgtaa

SEQ ID NO: 152981 - DNA, 20 bp, Homo sapiens
taatgaatatatatatgtgt

SEQ ID NO: 152982 - DNA, 23 bp, Homo sapiens
tatgcatatgtataatatattca

SEQ ID NO: 152983 - DNA, 20 bp, Homo sapiens
atctgggttgagaccccctt

SEQ ID NO: 152984 - DNA, 22 bp, Homo sapiens
agtgtctgaagctgttctcagg

SEQ ID NO: 152985 - DNA, 20 bp, Homo sapiens
ttttccaggtgtaagctgtc

SEQ ID NO: 152986 - DNA, 23 bp, Homo sapiens
atatatgtgtgtgtgttttctga

SEQ ID NO: 152987 - DNA, 22 bp, Homo sapiens
gaatccaaatgtagaagtatgt

SEQ ID NO: 152988 - DNA, 23 bp, Homo sapiens
ataaagacttgttcaaatgaaag

SEQ ID NO: 152989 - DNA, 23 bp, Homo sapiens
tgagttgcttgtagattctgaat

SEQ ID NO: 152990 - DNA, 23 bp, Homo sapiens
ttgttggatgtatagattaacaa

SEQ ID NO: 152991 - DNA, 18 bp, Homo sapiens
ggaatgtctgcaaagagt

SEQ ID NO: 152992 - DNA, 23 bp, Homo sapiens
acattagtcaattagtagttagg

SEQ ID NO: 152993 - DNA, 22 bp, Homo sapiens
atttgagaaggagtctggctct

SEQ ID NO: 152994 - DNA, 21 bp, Homo sapiens
ttatggaatttttaatgtgga

SEQ ID NO: 152995 - DNA, 22 bp, Homo sapiens
aaactgtatatgtatatgtgtt

SEQ ID NO: 152996 - DNA, 23 bp, Homo sapiens
taacacatatacatatgcagttg

SEQ ID NO: 152997 - DNA, 18 bp, Homo sapiens
atacacaatatattgtgt

SEQ ID NO: 152998 - DNA, 23 bp, Homo sapiens
ttaacatatcatgttggcaatgt

SEQ ID NO: 152999 - DNA, 23 bp, Homo sapiens
tggtccttgttcttctgagtgta

SEQ ID NO: 153000 - DNA, 23 bp, Homo sapiens
aaaattctgctggacaaagtttg

SEQ ID NO: 153001 - DNA, 23 bp, Homo sapiens
tgcttatactccacattgcttca

SEQ ID NO: 153002 - DNA, 20 bp, Homo sapiens
aatgagcatgaacaattaaa

SEQ ID NO: 153003 - DNA, 20 bp, Homo sapiens
aaaaggaaagaattcagaag

SEQ ID NO: 153004 - DNA, 20 bp, Homo sapiens
tgtatgtgtgttaatgtata

SEQ ID NO: 153005 - DNA, 23 bp, Homo sapiens
tcagcccctggatatgtagaata

SEQ ID NO: 153006 - DNA, 21 bp, Homo sapiens
acatgtgtgtgtatatgtatg

SEQ ID NO: 153007 - DNA, 23 bp, Homo sapiens
tttagtggtacatgtgcaggttt

SEQ ID NO: 153008 - DNA, 21 bp, Homo sapiens
tatatatatgtagagagagag

SEQ ID NO: 153009 - DNA, 21 bp, Homo sapiens
atatgtatatatgtatatatg

SEQ ID NO: 153010 - DNA, 23 bp, Homo sapiens
tatgtgtatatatatgtgtgtgt

SEQ ID NO: 153011 - DNA, 20 bp, Homo sapiens
aattttcaagtgccagggtg

SEQ ID NO: 153012 - DNA, 23 bp, Homo sapiens
ataatctctatattttttagtta

SEQ ID NO: 153013 - DNA, 23 bp, Homo sapiens
tatatgtccttatgtatatatgt

SEQ ID NO: 153014 - DNA, 23 bp, Homo sapiens
tgtacatatctatgaaaatcttt

SEQ ID NO: 153015 - DNA, 23 bp, Homo sapiens
catatatatatatatgtatgcat

SEQ ID NO: 153016 - DNA, 23 bp, Homo sapiens
cttgagagtgttaaagtaggtat

SEQ ID NO: 153017 - DNA, 23 bp, Homo sapiens
gtgtgtgtatatgtatgtatatg

SEQ ID NO: 153018 - DNA, 21 bp, Homo sapiens
tagtgtctagaaatgcaactg

SEQ ID NO: 153019 - DNA, 23 bp, Homo sapiens
tgtgtgtgtctttgcacatgaga

SEQ ID NO: 153020 - DNA, 23 bp, Homo sapiens
tacagaacactgacaggtcttga

SEQ ID NO: 153021 - DNA, 23 bp, Homo sapiens
tgagttcattgtagattctggat

SEQ ID NO: 153022 - DNA, 23 bp, Homo sapiens
tgagttcattgtagattctggat

SEQ ID NO: 153023 - DNA, 20 bp, Homo sapiens
atgacttgtcttgctctctc

SEQ ID NO: 153024 - DNA, 21 bp, Homo sapiens
aagtgcaatttataaatttgt

SEQ ID NO: 153025 - DNA, 23 bp, Homo sapiens
ttcctgtgtgtgctaagctagtc

SEQ ID NO: 153026 - DNA, 23 bp, Homo sapiens
tgaagtctgtcaacacacctgga

SEQ ID NO: 153027 - DNA, 23 bp, Homo sapiens
tggagtctcactctgtcacccag

SEQ ID NO: 153028 - DNA, 21 bp, Homo sapiens
tcagaatgggagagtacatgc

SEQ ID NO: 153029 - DNA, 23 bp, Homo sapiens
aaaacatgatttacagcacttag

SEQ ID NO: 153030 - DNA, 23 bp, Homo sapiens
aacagtgaagactggtgggccta

SEQ ID NO: 153031 - DNA, 23 bp, Homo sapiens
ttctcttgttcattatttttgaa

SEQ ID NO: 153032 - DNA, 23 bp, Homo sapiens
tgaatatatgtatatatgtgtac

SEQ ID NO: 153033 - DNA, 22 bp, Homo sapiens
tttgtgagccatatatttcagt

SEQ ID NO: 153034 - DNA, 23 bp, Homo sapiens
ttcccacaccctgacactctgac

SEQ ID NO: 153035 - DNA, 23 bp, Homo sapiens
atacacataggtatatatgggtg

SEQ ID NO: 153036 - DNA, 23 bp, Homo sapiens
tttcgctgttattcatctctgtt

SEQ ID NO: 153037 - DNA, 22 bp, Homo sapiens
tggttgatgtagtaaaaggcaa

SEQ ID NO: 153038 - DNA, 22 bp, Homo sapiens
agacacacacactcaaacttca

SEQ ID NO: 153039 - DNA, 23 bp, Homo sapiens
tatgtatatatgtgtgtgtgtga

SEQ ID NO: 153040 - DNA, 23 bp, Homo sapiens
atgagacttgagactgtggagat

SEQ ID NO: 153041 - DNA, 23 bp, Homo sapiens
atatgtgtgtgtatatgtgtgtg

SEQ ID NO: 153042 - DNA, 21 bp, Homo sapiens
tgtgtatgttaaaaagtgttg

SEQ ID NO: 153043 - DNA, 20 bp, Homo sapiens
tatatgtgtgtgtatgtgtg

SEQ ID NO: 153044 - DNA, 22 bp, Homo sapiens
aaggaggacacattgtgtctga

SEQ ID NO: 153045 - DNA, 18 bp, Homo sapiens
cagtgagctctctacaga

SEQ ID NO: 153046 - DNA, 23 bp, Homo sapiens
tttattccgtggtaaagaagtgt

SEQ ID NO: 153047 - DNA, 23 bp, Homo sapiens
acactgtctctgaatttactgtg

SEQ ID NO: 153048 - DNA, 23 bp, Homo sapiens
atggctatatatatctatatgtt

SEQ ID NO: 153049 - DNA, 23 bp, Homo sapiens
aattgtatgtatttactgtgaac

SEQ ID NO: 153050 - DNA, 23 bp, Homo sapiens
tgtattgttttgaagtatataca

SEQ ID NO: 153051 - DNA, 20 bp, Homo sapiens
gtacatatatatacagtttg

SEQ ID NO: 153052 - DNA, 23 bp, Homo sapiens
acatgtccttaagttcctctgag

SEQ ID NO: 153053 - DNA, 23 bp, Homo sapiens
gaagagactgattgatagttgtt

SEQ ID NO: 153054 - DNA, 19 bp, Homo sapiens
gagtctgtcagtgtctgtc

SEQ ID NO: 153055 - DNA, 23 bp, Homo sapiens
gtgtgttaagtctatttagtcta

SEQ ID NO: 153056 - DNA, 23 bp, Homo sapiens
tgagttcattgtagattctggat

SEQ ID NO: 153057 - DNA, 23 bp, Homo sapiens
tgagttcattgtagattctggat

SEQ ID NO: 153058 - DNA, 21 bp, Homo sapiens
tataccttatgtattaggtta

SEQ ID NO: 153059 - DNA, 18 bp, Homo sapiens
atatgctcatatgtaggt

SEQ ID NO: 153060 - DNA, 21 bp, Homo sapiens
tcagatgagactcagcacatt

SEQ ID NO: 153061 - DNA, 19 bp, Homo sapiens
atgtttgaattatagtact

SEQ ID NO: 153062 - DNA, 19 bp, Homo sapiens
tatgtcacaggatcccttg

SEQ ID NO: 153063 - DNA, 19 bp, Homo sapiens
ttctttcctcttatgtctg

SEQ ID NO: 153064 - DNA, 23 bp, Homo sapiens
ttttctgtaatagtgtttatgag

SEQ ID NO: 153065 - DNA, 23 bp, Homo sapiens
cttattgtcagtgcatgtaaaca

SEQ ID NO: 153066 - DNA, 23 bp, Homo sapiens
tgtttttgcttggtttttaagtg

SEQ ID NO: 153067 - DNA, 21 bp, Homo sapiens
ttctcttgattttctagttct

SEQ ID NO: 153068 - DNA, 18 bp, Homo sapiens
agagctgtaaaatccctt

SEQ ID NO: 153069 - DNA, 18 bp, Homo sapiens
aattaaatatgaaaatga

SEQ ID NO: 153070 - DNA, 23 bp, Homo sapiens
aactctggcttatgaatgagaac

SEQ ID NO: 153071 - DNA, 23 bp, Homo sapiens
tcactcatccagactagaatgca

SEQ ID NO: 153072 - DNA, 21 bp, Homo sapiens
atgtgtatttatgtatttgtg

SEQ ID NO: 153073 - DNA, 23 bp, Homo sapiens
tctatgacctctgccaatagtca

SEQ ID NO: 153074 - DNA, 23 bp, Homo sapiens
tacacatgtgtttatgtacatat

SEQ ID NO: 153075 - DNA, 22 bp, Homo sapiens
ttgtttccagatatttgtgttc

SEQ ID NO: 153076 - DNA, 23 bp, Homo sapiens
tgcatcactgagtttttttgaag

SEQ ID NO: 153077 - DNA, 19 bp, Homo sapiens
atgctggtcttttagaata

SEQ ID NO: 153078 - DNA, 20 bp, Homo sapiens
ttaagcttcagtagacttga

SEQ ID NO: 153079 - DNA, 18 bp, Homo sapiens
tatgtgtgtgtatgtata

SEQ ID NO: 153080 - DNA, 22 bp, Homo sapiens
aaggtgcatgagttgttttgag

SEQ ID NO: 153081 - DNA, 23 bp, Homo sapiens
atatgacattttctttatctgtt

SEQ ID NO: 153082 - DNA, 20 bp, Homo sapiens
ttacactagagtgtgtccac

SEQ ID NO: 153083 - DNA, 23 bp, Homo sapiens
gtgtgtgtgtgtgtgtgtctatg

SEQ ID NO: 153084 - DNA, 23 bp, Homo sapiens
gtgatgatactctcaagcctctc

SEQ ID NO: 153085 - DNA, 23 bp, Homo sapiens
aggttagttctgggtaagatctc

SEQ ID NO: 153086 - DNA, 21 bp, Homo sapiens
agagcaaaattatactcttgt

SEQ ID NO: 153087 - DNA, 21 bp, Homo sapiens
ttatttgaatatcattttgtg

SEQ ID NO: 153088 - DNA, 22 bp, Homo sapiens
aacctagtagttgtaatgtgtt

SEQ ID NO: 153089 - DNA, 23 bp, Homo sapiens
acagtaacaagtttcagtaggac

SEQ ID NO: 153090 - DNA, 23 bp, Homo sapiens
ttggtatgatattgtaaaggtaa

SEQ ID NO: 153091 - DNA, 22 bp, Homo sapiens
attttgaatgttattgataaca

SEQ ID NO: 153092 - DNA, 20 bp, Homo sapiens
aagctgaacacagttgcatt

SEQ ID NO: 153093 - DNA, 22 bp, Homo sapiens
atatgcatgtatatatatgtat

SEQ ID NO: 153094 - DNA, 23 bp, Homo sapiens
cagagtctcactctgtcacccag

SEQ ID NO: 153095 - DNA, 20 bp, Homo sapiens
taactcactaaggaaagagg

SEQ ID NO: 153096 - DNA, 22 bp, Homo sapiens
atgtgtgtatatatatgtgtat

SEQ ID NO: 153097 - DNA, 23 bp, Homo sapiens
atgtgtgtgtatatatatgtgtg

SEQ ID NO: 153098 - DNA, 23 bp, Homo sapiens
gtgtgtgtgtatatctatatcta

SEQ ID NO: 153099 - DNA, 22 bp, Homo sapiens
ttgtctatatatgtttatgaat

SEQ ID NO: 153100 - DNA, 23 bp, Homo sapiens
tcataagtgtgcatgcatataag

SEQ ID NO: 153101 - DNA, 19 bp, Homo sapiens
tgagtgggtaatctgtgag

SEQ ID NO: 153102 - DNA, 22 bp, Homo sapiens
actgaatggtcatattgtttct

SEQ ID NO: 153103 - DNA, 23 bp, Homo sapiens
atgtatgatcttggactcaggct

SEQ ID NO: 153104 - DNA, 23 bp, Homo sapiens
tgtatctatgtatatatgtatgt

SEQ ID NO: 153105 - DNA, 23 bp, Homo sapiens
cctgtgtgacagtgagactcagt

SEQ ID NO: 153106 - DNA, 23 bp, Homo sapiens
ataacagtttatgtaaatgtcca

SEQ ID NO: 153107 - DNA, 23 bp, Homo sapiens
tcatttaagataggatatgattg

SEQ ID NO: 153108 - DNA, 23 bp, Homo sapiens
ttcaagagccactaattctttac

SEQ ID NO: 153109 - DNA, 22 bp, Homo sapiens
gcatctctgcctctttgactct

SEQ ID NO: 153110 - DNA, 23 bp, Homo sapiens
aatttattggatatcttttcatc

SEQ ID NO: 153111 - DNA, 23 bp, Homo sapiens
tgagttcattgtagattctggat

SEQ ID NO: 153112 - DNA, 23 bp, Homo sapiens
tgagttcattgtagattctggat

SEQ ID NO: 153113 - DNA, 23 bp, Homo sapiens
taatgtttgtgataatgttgttg

SEQ ID NO: 153114 - DNA, 21 bp, Homo sapiens
tgtgtgtatatatacatgtgt

SEQ ID NO: 153115 - DNA, 23 bp, Homo sapiens
tatatgtgtatatgtatacacat

SEQ ID NO: 153116 - DNA, 21 bp, Homo sapiens
tatacgtgtatatatgtgtat

SEQ ID NO: 153117 - DNA, 23 bp, Homo sapiens
atatgtgtgtatatatatatgtg

SEQ ID NO: 153118 - DNA, 23 bp, Homo sapiens
tatatgtatgtatgtatgtgtgt

SEQ ID NO: 153119 - DNA, 23 bp, Homo sapiens
tatatgttaatttctttacattt

SEQ ID NO: 153120 - DNA, 23 bp, Homo sapiens
agggtctcgctctgtcacacagg

SEQ ID NO: 153121 - DNA, 21 bp, Homo sapiens
tgcagtggcgtgatcttggct

SEQ ID NO: 153122 - DNA, 18 bp, Homo sapiens
ttatactttaagttctgg

SEQ ID NO: 153123 - DNA, 23 bp, Homo sapiens
gtgaagttttgttacataggtgt

SEQ ID NO: 153124 - DNA, 23 bp, Homo sapiens
atatatgtacataaagatatgta

SEQ ID NO: 153125 - DNA, 23 bp, Homo sapiens
atatatgcacatatagatatatg

SEQ ID NO: 153126 - DNA, 23 bp, Homo sapiens
ttctgagttgttgttgctggtat

SEQ ID NO: 153127 - DNA, 21 bp, Homo sapiens
attctgcattcggaaaacttg

SEQ ID NO: 153128 - DNA, 23 bp, Homo sapiens
tgtgtatatatgtgtatgtgtgt

SEQ ID NO: 153129 - DNA, 22 bp, Homo sapiens
atatgtgtgcatatatgtgtgt

SEQ ID NO: 153130 - DNA, 23 bp, Homo sapiens
tatgtgtgcatatatatgtgtat

SEQ ID NO: 153131 - DNA, 23 bp, Homo sapiens
atatgtgtgtatatatatgtgtg

SEQ ID NO: 153132 - DNA, 23 bp, Homo sapiens
caatgtctttagtttgctgagag

SEQ ID NO: 153133 - DNA, 22 bp, Homo sapiens
atagaaataatgttgtatatgc

SEQ ID NO: 153134 - DNA, 23 bp, Homo sapiens
tgatatcagagtctggttctcag

SEQ ID NO: 153135 - DNA, 21 bp, Homo sapiens
tgagatggagtctggctctgt

SEQ ID NO: 153136 - DNA, 23 bp, Homo sapiens
tgagttcattgtagattctggat

SEQ ID NO: 153137 - DNA, 23 bp, Homo sapiens
tgagttcattgtagattctggat

SEQ ID NO: 153138 - DNA, 20 bp, Homo sapiens
gtgagccactgtgcctgcct

SEQ ID NO: 153139 - DNA, 23 bp, Homo sapiens
taggatacacagtgatgtttcaa

SEQ ID NO: 153140 - DNA, 23 bp, Homo sapiens
acagggtctcgctctgtctgtcg

SEQ ID NO: 153141 - DNA, 22 bp, Homo sapiens
acagtggcgtgatcttggctta

SEQ ID NO: 153142 - DNA, 23 bp, Homo sapiens
tcagctcctctctgtccctgtgt

SEQ ID NO: 153143 - DNA, 23 bp, Homo sapiens
taaaagtatatgtatacaaagtg

SEQ ID NO: 153144 - DNA, 23 bp, Homo sapiens
tgagggtagaagactgtgtccac

SEQ ID NO: 153145 - DNA, 21 bp, Homo sapiens
atgtgcacaatgtgcagattt

SEQ ID NO: 153146 - DNA, 23 bp, Homo sapiens
tcactctgagttttagttctctc

SEQ ID NO: 153147 - DNA, 23 bp, Homo sapiens
aatgacaaaaacaacacgaagtg

SEQ ID NO: 153148 - DNA, 23 bp, Homo sapiens
tgtattgcataacagttggagat

SEQ ID NO: 153149 - DNA, 23 bp, Homo sapiens
tatgtgacttgttttcatgtgtt

SEQ ID NO: 153150 - DNA, 23 bp, Homo sapiens
agagtagtgatgatgatcatgat

SEQ ID NO: 153151 - DNA, 23 bp, Homo sapiens
ggagtctcactctgtcacccagg

SEQ ID NO: 153152 - DNA, 23 bp, Homo sapiens
tgagttcattgtagattctggat

SEQ ID NO: 153153 - DNA, 23 bp, Homo sapiens
tgagttcattgtagattctggat

SEQ ID NO: 153154 - DNA, 23 bp, Homo sapiens
tgcctggctgtgtccctgggtcc

SEQ ID NO: 153155 - DNA, 23 bp, Homo sapiens
ggactgacagtggccaacaagtg

SEQ ID NO: 153156 - DNA, 22 bp, Homo sapiens
gaagtctcactctgtcgctcag

SEQ ID NO: 153157 - DNA, 21 bp, Homo sapiens
aacctctgcctcccatattca

SEQ ID NO: 153158 - DNA, 23 bp, Homo sapiens
gactgagtctcactccgtgtccc

SEQ ID NO: 153159 - DNA, 19 bp, Homo sapiens
ttttgagagggagtctagc

SEQ ID NO: 153160 - DNA, 23 bp, Homo sapiens
agttgactgagataggagtgagc

SEQ ID NO: 153161 - DNA, 23 bp, Homo sapiens
tgagttcattgtagattctggat

SEQ ID NO: 153162 - DNA, 23 bp, Homo sapiens
tgagttcattgtagattctggat

SEQ ID NO: 153163 - DNA, 23 bp, Homo sapiens
actgtggtacttaaaagattctt

SEQ ID NO: 153164 - DNA, 21 bp, Homo sapiens
ttaaagagcttaaagtagttg

SEQ ID NO: 153165 - DNA, 23 bp, Homo sapiens
gtagcagcacataatggtttgtg

SEQ ID NO: 153166 - DNA, 23 bp, Homo sapiens
tggagtctcactctgtcacccag

SEQ ID NO: 153167 - DNA, 21 bp, Homo sapiens
attgcactccagcctgggtga

SEQ ID NO: 153168 - DNA, 23 bp, Homo sapiens
acagagtctcactctgtcgccca

SEQ ID NO: 153169 - DNA, 20 bp, Homo sapiens
tgacttcaggcattactgca

SEQ ID NO: 153170 - DNA, 21 bp, Homo sapiens
atacatgtgcagaatgtgcag

SEQ ID NO: 153171 - DNA, 20 bp, Homo sapiens
aatggagtctcgccatgttg

SEQ ID NO: 153172 - DNA, 22 bp, Homo sapiens
tttgttgaggattttatatcta

SEQ ID NO: 153173 - DNA, 19 bp, Homo sapiens
tctgtggttttcttgcaat

SEQ ID NO: 153174 - DNA, 21 bp, Homo sapiens
tgctctgtttgattggtagtg

SEQ ID NO: 153175 - DNA, 23 bp, Homo sapiens
ctcgctcagtgggacagaatggc

SEQ ID NO: 153176 - DNA, 23 bp, Homo sapiens
agacagagttttgatcttgttgc

SEQ ID NO: 153177 - DNA, 23 bp, Homo sapiens
attgaacacacttggtggtggtg

SEQ ID NO: 153178 - DNA, 23 bp, Homo sapiens
cgcactctcactcactcgcactg

SEQ ID NO: 153179 - DNA, 23 bp, Homo sapiens
agaggctggttaggcttagggtt

SEQ ID NO: 153180 - DNA, 23 bp, Homo sapiens
tggagtctcactctgtcacccag

SEQ ID NO: 153181 - DNA, 18 bp, Homo sapiens
cagtggtatgatctcagc

SEQ ID NO: 153182 - DNA, 18 bp, Homo sapiens
tactccagcagtatccat

SEQ ID NO: 153183 - DNA, 21 bp, Homo sapiens
agcaatgtaagcatgtatgtg

SEQ ID NO: 153184 - DNA, 23 bp, Homo sapiens
tgagttcattgtagattctggat

SEQ ID NO: 153185 - DNA, 23 bp, Homo sapiens
tgagttcattgtagattctggat

SEQ ID NO: 153186 - DNA, 21 bp, Homo sapiens
agaatggttaggcaactgttg

SEQ ID NO: 153187 - DNA, 23 bp, Homo sapiens
aggcagagtagattttccctaat

SEQ ID NO: 153188 - DNA, 22 bp, Homo sapiens
attaaagtattctagtttgcag

SEQ ID NO: 153189 - DNA, 20 bp, Homo sapiens
atgtgtataatatatattgt

SEQ ID NO: 153190 - DNA, 23 bp, Homo sapiens
atctgagtggttatgatcagaat

SEQ ID NO: 153191 - DNA, 18 bp, Homo sapiens
agtactctgtgaatctct

SEQ ID NO: 153192 - DNA, 22 bp, Homo sapiens
tggatcctactgaactgtcaaa

SEQ ID NO: 153193 - DNA, 23 bp, Homo sapiens
aatctaaaagtatgagatgaagt

SEQ ID NO: 153194 - DNA, 23 bp, Homo sapiens
ttatggcttatgtttgtggtgtc

SEQ ID NO: 153195 - DNA, 23 bp, Homo sapiens
ctagtctctagttgtgggccact

SEQ ID NO: 153196 - DNA, 23 bp, Homo sapiens
tgatgaggtctttggtcttgcag

SEQ ID NO: 153197 - DNA, 22 bp, Homo sapiens
tctctgtcagttactcaaaacc

SEQ ID NO: 153198 - DNA, 23 bp, Homo sapiens
atacagtgtgtgtatatatagag

SEQ ID NO: 153199 - DNA, 21 bp, Homo sapiens
tatgtgtgtgtatatatgtgt

SEQ ID NO: 153200 - DNA, 23 bp, Homo sapiens
actatgcttgcttttctaggttt

SEQ ID NO: 153201 - DNA, 23 bp, Homo sapiens
agacacagtctcactctgttgcc

SEQ ID NO: 153202 - DNA, 23 bp, Homo sapiens
tggagtctcactctgtcacccag

SEQ ID NO: 153203 - DNA, 23 bp, Homo sapiens
gatacatgtgcaggatgtgcagg

SEQ ID NO: 153204 - DNA, 20 bp, Homo sapiens
tgtatgcatgcatgtatgta

SEQ ID NO: 153205 - DNA, 23 bp, Homo sapiens
cttgtctctgtctcagtcttccc

SEQ ID NO: 153206 - DNA, 23 bp, Homo sapiens
tctgccaggcacagtggctcaca

SEQ ID NO: 153207 - DNA, 23 bp, Homo sapiens
atatatgtaattgtatatgtgtt

SEQ ID NO: 153208 - DNA, 22 bp, Homo sapiens
agagatgagattaagatcttgt

SEQ ID NO: 153209 - DNA, 22 bp, Homo sapiens
tatgattttatactgttttggg

SEQ ID NO: 153210 - DNA, 19 bp, Homo sapiens
tttagattgtcatttgtca

SEQ ID NO: 153211 - DNA, 23 bp, Homo sapiens
tcagtctctgcctgtctctgtct

SEQ ID NO: 153212 - DNA, 23 bp, Homo sapiens
tctctcactggttttgttgttgc

SEQ ID NO: 153213 - DNA, 23 bp, Homo sapiens
tgagttcattgtagattctggat

SEQ ID NO: 153214 - DNA, 23 bp, Homo sapiens
tgagttcattgtagattctggat

SEQ ID NO: 153215 - DNA, 21 bp, Homo sapiens
tgaggtaggaggatggattga

SEQ ID NO: 153216 - DNA, 23 bp, Homo sapiens
tctgagacagagtctggctctgt

SEQ ID NO: 153217 - DNA, 18 bp, Homo sapiens
tatacgtatatatacgta

SEQ ID NO: 153218 - DNA, 19 bp, Homo sapiens
agaccttgtctctttatta

SEQ ID NO: 153219 - DNA, 23 bp, Homo sapiens
gacacggtctcgctctgtcaccc

SEQ ID NO: 153220 - DNA, 21 bp, Homo sapiens
aaacggtcagggagatttccc

SEQ ID NO: 153221 - DNA, 19 bp, Homo sapiens
tgagatggagtctcgctct

SEQ ID NO: 153222 - DNA, 22 bp, Homo sapiens
tgacactagtaatgctgaggga

SEQ ID NO: 153223 - DNA, 22 bp, Homo sapiens
cagacagggtctcactctgtca

SEQ ID NO: 153224 - DNA, 23 bp, Homo sapiens
tatcactcctctctcactctgtc

SEQ ID NO: 153225 - DNA, 18 bp, Homo sapiens
atttgagctgcttacagt

SEQ ID NO: 153226 - DNA, 22 bp, Homo sapiens
taggtgggtatatatacatata

SEQ ID NO: 153227 - DNA, 23 bp, Homo sapiens
tctatatctatatctatatgtgt

SEQ ID NO: 153228 - DNA, 23 bp, Homo sapiens
tggagtctcactctgtcacccag

SEQ ID NO: 153229 - DNA, 23 bp, Homo sapiens
tgtctgactgtgtgtattggctg

SEQ ID NO: 153230 - DNA, 23 bp, Homo sapiens
tccctggctgcctgcctggcaga

SEQ ID NO: 153231 - DNA, 22 bp, Homo sapiens
tatatgtgtgtgtgcatatata

SEQ ID NO: 153232 - DNA, 23 bp, Homo sapiens
atatctgcacgtgtgtgtgtgtg

SEQ ID NO: 153233 - DNA, 21 bp, Homo sapiens
attgagcacctactttgtgtc

SEQ ID NO: 153234 - DNA, 23 bp, Homo sapiens
cagtatctaacatgtaataagtg

SEQ ID NO: 153235 - DNA, 19 bp, Homo sapiens
attatttatagtggatagt

SEQ ID NO: 153236 - DNA, 23 bp, Homo sapiens
ttattgctctttctcttcctgtt

SEQ ID NO: 153237 - DNA, 23 bp, Homo sapiens
tgtgtatatatgtatatatgtgt

SEQ ID NO: 153238 - DNA, 22 bp, Homo sapiens
atatgtgtatatatacatatgt

SEQ ID NO: 153239 - DNA, 22 bp, Homo sapiens
tgatagctttagttctttttcg

SEQ ID NO: 153240 - DNA, 23 bp, Homo sapiens
tgatttcgtgagggagactaagc

SEQ ID NO: 153241 - DNA, 19 bp, Homo sapiens
aacacaggagtgtgaggac

SEQ ID NO: 153242 - DNA, 20 bp, Homo sapiens
atatatgtgtgcatttacat

SEQ ID NO: 153243 - DNA, 22 bp, Homo sapiens
tatatgtttatgcatatatgtg

SEQ ID NO: 153244 - DNA, 23 bp, Homo sapiens
aatagctgtgtttttgttgaaga

SEQ ID NO: 153245 - DNA, 23 bp, Homo sapiens
tcttctatttcaccttttgatgt

SEQ ID NO: 153246 - DNA, 23 bp, Homo sapiens
tgagttcattgtagattctggat

SEQ ID NO: 153247 - DNA, 23 bp, Homo sapiens
tgagttcattgtagattctggat

SEQ ID NO: 153248 - DNA, 22 bp, Homo sapiens
tgagtggtatttcagaagggga

SEQ ID NO: 153249 - DNA, 23 bp, Homo sapiens
tatgtgtttgtatggtgagagtg

SEQ ID NO: 153250 - DNA, 22 bp, Homo sapiens
gtctcactgtgtcactcaggct

SEQ ID NO: 153251 - DNA, 19 bp, Homo sapiens
agtggcatgatcttggctc

SEQ ID NO: 153252 - DNA, 23 bp, Homo sapiens
ctcccatggaattctttctcaaa

SEQ ID NO: 153253 - DNA, 23 bp, Homo sapiens
tcctcacagatcaaagagaggag

SEQ ID NO: 153254 - DNA, 23 bp, Homo sapiens
tttcctcatgatgtaatagtgag

SEQ ID NO: 153255 - DNA, 23 bp, Homo sapiens
ctcccagagcccctggaactctg

SEQ ID NO: 153256 - DNA, 23 bp, Homo sapiens
tcccagagcccctggaactctgg

SEQ ID NO: 153257 - DNA, 23 bp, Homo sapiens
tcccagagcccctggaactctgg

SEQ ID NO: 153258 - DNA, 23 bp, Homo sapiens
tcccagagcccctggaactctgg

SEQ ID NO: 153259 - DNA, 23 bp, Homo sapiens
ctctctcagtgtttctcaacgtg

SEQ ID NO: 153260 - DNA, 22 bp, Homo sapiens
aactggtgaatcattgggctga

SEQ ID NO: 153261 - DNA, 23 bp, Homo sapiens
cacagcatggctccctgtgtccc

SEQ ID NO: 153262 - DNA, 23 bp, Homo sapiens
aggtcagtacttgggaaaggctg

SEQ ID NO: 153263 - DNA, 23 bp, Homo sapiens
tgagttcattgtagattctggat

SEQ ID NO: 153264 - DNA, 23 bp, Homo sapiens
tgagttcattgtagattctggat

SEQ ID NO: 153265 - DNA, 23 bp, Homo sapiens
atgtatatgtgtatgtatgtata

SEQ ID NO: 153266 - DNA, 23 bp, Homo sapiens
atatgtgtatatgtatatatctg

SEQ ID NO: 153267 - DNA, 19 bp, Homo sapiens
agcattgtctgaattttga

SEQ ID NO: 153268 - DNA, 20 bp, Homo sapiens
agaccttgtcaaaattcaga

SEQ ID NO: 153269 - DNA, 23 bp, Homo sapiens
ttggcagtggaaaccttttctct

SEQ ID NO: 153270 - DNA, 23 bp, Homo sapiens
gacaagatctcactctgtcaccc

SEQ ID NO: 153271 - DNA, 20 bp, Homo sapiens
aagacagttaagttgagtta

SEQ ID NO: 153272 - DNA, 23 bp, Homo sapiens
atggagcttcttggattttgtga

SEQ ID NO: 153273 - DNA, 23 bp, Homo sapiens
tcaggctctgtgacttactggct

SEQ ID NO: 153274 - DNA, 21 bp, Homo sapiens
tatagctacatatagagttac

SEQ ID NO: 153275 - DNA, 23 bp, Homo sapiens
gtggcagagtgagaccctgtctc

SEQ ID NO: 153276 - DNA, 20 bp, Homo sapiens
agtgagacagaggtcaattt

SEQ ID NO: 153277 - DNA, 23 bp, Homo sapiens
tattttagtagagacagggtttc

SEQ ID NO: 153278 - DNA, 20 bp, Homo sapiens
acaacagtaaacagagtagg

SEQ ID NO: 153279 - DNA, 23 bp, Homo sapiens
ttttggttccatatgaattgtaa

SEQ ID NO: 153280 - DNA, 23 bp, Homo sapiens
tgagttcattgtagattctggat

SEQ ID NO: 153281 - DNA, 23 bp, Homo sapiens
tgagttcattgtagattctggat

SEQ ID NO: 153282 - DNA, 23 bp, Homo sapiens
tatttctttttcagaaagtctgt

SEQ ID NO: 153283 - DNA, 21 bp, Homo sapiens
tatgcgtatatatagaggtgt

SEQ ID NO: 153284 - DNA, 23 bp, Homo sapiens
tacttagtgactgtgagtgttca

SEQ ID NO: 153285 - DNA, 23 bp, Homo sapiens
cggagtctcgctctgtcactcag

SEQ ID NO: 153286 - DNA, 22 bp, Homo sapiens
ttgaagtgattcacctgcctca

SEQ ID NO: 153287 - DNA, 23 bp, Homo sapiens
acagagtctcgctctgtcaccca

SEQ ID NO: 153288 - DNA, 23 bp, Homo sapiens
aggtccatggcagaagtgtgagt

SEQ ID NO: 153289 - DNA, 23 bp, Homo sapiens
ttcactcactcacactttccctg

SEQ ID NO: 153290 - DNA, 19 bp, Homo sapiens
gaatagtaagggattgtga

SEQ ID NO: 153291 - DNA, 22 bp, Homo sapiens
tcttcttttgagaagtgactgt

SEQ ID NO: 153292 - DNA, 23 bp, Homo sapiens
ttggctctagaagaactgtcagt

SEQ ID NO: 153293 - DNA, 23 bp, Homo sapiens
cagggtctcactgtgtctcccac

SEQ ID NO: 153294 - DNA, 18 bp, Homo sapiens
gtggcgtgatcttggctc

SEQ ID NO: 153295 - DNA, 23 bp, Homo sapiens
tggttatgcaggtgtgtgtgtgt

SEQ ID NO: 153296 - DNA, 23 bp, Homo sapiens
tgttagaacagactctgctaaag

SEQ ID NO: 153297 - DNA, 22 bp, Homo sapiens
agatggagtctcgctctgtcac

SEQ ID NO: 153298 - DNA, 21 bp, Homo sapiens
tgaggcagagtctagctttgt

SEQ ID NO: 153299 - DNA, 21 bp, Homo sapiens
agagctaccaagataagggtt

SEQ ID NO: 153300 - DNA, 23 bp, Homo sapiens
tttcttcttagctacatcttgga

SEQ ID NO: 153301 - DNA, 23 bp, Homo sapiens
tattgtcctaattttgtagttga

SEQ ID NO: 153302 - DNA, 19 bp, Homo sapiens
agtttactttactaggaaa

SEQ ID NO: 153303 - DNA, 23 bp, Homo sapiens
atgaagactggacatgttgttct

SEQ ID NO: 153304 - DNA, 19 bp, Homo sapiens
ggaactaggtggtctggac

SEQ ID NO: 153305 - DNA, 23 bp, Homo sapiens
taacacagcttctgtggctccca

SEQ ID NO: 153306 - DNA, 23 bp, Homo sapiens
tggagtctcactctgtcacccag

SEQ ID NO: 153307 - DNA, 19 bp, Homo sapiens
gtctccctctgtcacccag

SEQ ID NO: 153308 - DNA, 21 bp, Homo sapiens
tatgtgtatatatgtatatgt

SEQ ID NO: 153309 - DNA, 23 bp, Homo sapiens
ctttaggttatcttaagctacct

SEQ ID NO: 153310 - DNA, 21 bp, Homo sapiens
cagaggattgttgtgagaatc

SEQ ID NO: 153311 - DNA, 23 bp, Homo sapiens
cagtctctcactctgtcacccag

SEQ ID NO: 153312 - DNA, 22 bp, Homo sapiens
tacatgtatatatgcatatgtg

SEQ ID NO: 153313 - DNA, 23 bp, Homo sapiens
aacctgtgcctatgtgtgtctat

SEQ ID NO: 153314 - DNA, 23 bp, Homo sapiens
agagtctcactctgtcacccagg

SEQ ID NO: 153315 - DNA, 23 bp, Homo sapiens
ttatcacagtggttttgttgcat

SEQ ID NO: 153316 - DNA, 23 bp, Homo sapiens
atttctataggatctgtagcata

SEQ ID NO: 153317 - DNA, 23 bp, Homo sapiens
actggcttttgattggggaaagt

SEQ ID NO: 153318 - DNA, 23 bp, Homo sapiens
ttataatatatgtacaatatgca

SEQ ID NO: 153319 - DNA, 23 bp, Homo sapiens
tctgtctcactcaggatgtggtg

SEQ ID NO: 153320 - DNA, 20 bp, Homo sapiens
tctctggggtcattttgtca

SEQ ID NO: 153321 - DNA, 19 bp, Homo sapiens
atgacagatcaaagagatc

SEQ ID NO: 153322 - DNA, 23 bp, Homo sapiens
gaaatgtgtatatgtttatgtat

SEQ ID NO: 153323 - DNA, 23 bp, Homo sapiens
atggagtctcactctgtcaccca

SEQ ID NO: 153324 - DNA, 19 bp, Homo sapiens
tatcctgaactttcactgc

SEQ ID NO: 153325 - DNA, 23 bp, Homo sapiens
cagactctctgaggctctgcacc

SEQ ID NO: 153326 - DNA, 23 bp, Homo sapiens
aggacacagtgagaagagggttg

SEQ ID NO: 153327 - DNA, 22 bp, Homo sapiens
tattgtttatatatgtatgtgt

SEQ ID NO: 153328 - DNA, 23 bp, Homo sapiens
atagttctgtgtgtgtgtgaact

SEQ ID NO: 153329 - DNA, 23 bp, Homo sapiens
ctcccagagcccctggaactctg

SEQ ID NO: 153330 - DNA, 23 bp, Homo sapiens
tcccagagcccctggaactctgg

SEQ ID NO: 153331 - DNA, 23 bp, Homo sapiens
tcccagagcccctggaactctgg

SEQ ID NO: 153332 - DNA, 23 bp, Homo sapiens
tcccagagcccctggaactctgg

SEQ ID NO: 153333 - DNA, 18 bp, Homo sapiens
gtatatataagtgtgtgt

SEQ ID NO: 153334 - DNA, 23 bp, Homo sapiens
tctgtctgtctgtctttcttatc

SEQ ID NO: 153335 - DNA, 23 bp, Homo sapiens
attggcacatagagatttctgga

SEQ ID NO: 153336 - DNA, 22 bp, Homo sapiens
tcacagtagtctctgagggcat

SEQ ID NO: 153337 - DNA, 23 bp, Homo sapiens
ttttgtatttctttgagattagt

SEQ ID NO: 153338 - DNA, 23 bp, Homo sapiens
ttccctttgtcattcctgattgt

SEQ ID NO: 153339 - DNA, 19 bp, Homo sapiens
gaggggagcaagtgtgtgc

SEQ ID NO: 153340 - DNA, 22 bp, Homo sapiens
tgtgagagacatgagagtctgg

SEQ ID NO: 153341 - DNA, 21 bp, Homo sapiens
aatgtgtgcttttatgttctc

SEQ ID NO: 153342 - DNA, 23 bp, Homo sapiens
gtgtctctgttctgctgctacag

SEQ ID NO: 153343 - DNA, 18 bp, Homo sapiens
aagctaaaaaagaaaaca

SEQ ID NO: 153344 - DNA, 19 bp, Homo sapiens
agtggtttctttatgtgta

SEQ ID NO: 153345 - DNA, 23 bp, Homo sapiens
actcagtgttgtaaagaagtctg

SEQ ID NO: 153346 - DNA, 23 bp, Homo sapiens
caatgctctctgtttctctcaca

SEQ ID NO: 153347 - DNA, 18 bp, Homo sapiens
ttgagtgctaaatacgtg

SEQ ID NO: 153348 - DNA, 23 bp, Homo sapiens
aggttggactgagacaaatgtgt

SEQ ID NO: 153349 - DNA, 23 bp, Homo sapiens
agtatatgtacatatacttgttc

SEQ ID NO: 153350 - DNA, 22 bp, Homo sapiens
atagagactgcatcgaatctgt

SEQ ID NO: 153351 - DNA, 21 bp, Homo sapiens
actcttctgtctagtggttcc

SEQ ID NO: 153352 - DNA, 23 bp, Homo sapiens
tcctgtttcacctaattattctc

SEQ ID NO: 153353 - DNA, 23 bp, Homo sapiens
tgtttagagaagtagctgtgttt

SEQ ID NO: 153354 - DNA, 23 bp, Homo sapiens
agaggattgtgtggacacagggc

SEQ ID NO: 153355 - DNA, 22 bp, Homo sapiens
gaacagtactttttttgatgtt

SEQ ID NO: 153356 - DNA, 21 bp, Homo sapiens
tttggaaatgctgcacaatct

SEQ ID NO: 153357 - DNA, 19 bp, Homo sapiens
cctgcctatagttccagtt

SEQ ID NO: 153358 - DNA, 21 bp, Homo sapiens
ctctgcctcccagatttaagt

SEQ ID NO: 153359 - DNA, 18 bp, Homo sapiens
tgtgtgtgtatgtgtgtg

SEQ ID NO: 153360 - DNA, 22 bp, Homo sapiens
atgtgagcaaagccactgtaga

SEQ ID NO: 153361 - DNA, 23 bp, Homo sapiens
tgtcactgtgtggcttagaggtt

SEQ ID NO: 153362 - DNA, 23 bp, Homo sapiens
aggaacaaagctcaggctctctg

SEQ ID NO: 153363 - DNA, 23 bp, Homo sapiens
tcatttgtccttcatgaactgca

SEQ ID NO: 153364 - DNA, 23 bp, Homo sapiens
aaataatatgtgtacataagtag

SEQ ID NO: 153365 - DNA, 22 bp, Homo sapiens
tgacctccaacttgtgatggtt

SEQ ID NO: 153366 - DNA, 22 bp, Homo sapiens
tcataagttgaggagcacctga

SEQ ID NO: 153367 - DNA, 23 bp, Homo sapiens
taaacctctgattgctttccaaa

SEQ ID NO: 153368 - DNA, 23 bp, Homo sapiens
tgattactagtgaagcaaaacag

SEQ ID NO: 153369 - DNA, 23 bp, Homo sapiens
tgagttcattgtagattctggat

SEQ ID NO: 153370 - DNA, 23 bp, Homo sapiens
tgagttcattgtagattctggat

SEQ ID NO: 153371 - DNA, 20 bp, Homo sapiens
attatgctatctttggtaag

SEQ ID NO: 153372 - DNA, 20 bp, Homo sapiens
tgaggtaggaggatcacttg

SEQ ID NO: 153373 - DNA, 18 bp, Homo sapiens
gtgaatattaattttgta

SEQ ID NO: 153374 - DNA, 23 bp, Homo sapiens
gagatggagtctcactgtgtcac

SEQ ID NO: 153375 - DNA, 23 bp, Homo sapiens
attctgcttcaattccacaaata

SEQ ID NO: 153376 - DNA, 23 bp, Homo sapiens
attttttgtctggaaatgttaga

SEQ ID NO: 153377 - DNA, 23 bp, Homo sapiens
cggagtctcgctctgtctcccag

SEQ ID NO: 153378 - DNA, 18 bp, Homo sapiens
tccccattatatatgtat

SEQ ID NO: 153379 - DNA, 18 bp, Homo sapiens
acaggacttataagtccc

SEQ ID NO: 153380 - DNA, 19 bp, Homo sapiens
tgtatacatgcatgtgtgt

SEQ ID NO: 153381 - DNA, 22 bp, Homo sapiens
agaagcactgtaaggaattgag

SEQ ID NO: 153382 - DNA, 23 bp, Homo sapiens
ttgctctgggtgagtcagtgagt

SEQ ID NO: 153383 - DNA, 22 bp, Homo sapiens
acatgtgcacactgtgcaggtt

SEQ ID NO: 153384 - DNA, 23 bp, Homo sapiens
ttgggttttgaagcagagtggta

SEQ ID NO: 153385 - DNA, 23 bp, Homo sapiens
tatttattcttttctttagaaat

SEQ ID NO: 153386 - DNA, 23 bp, Homo sapiens
gacagagtctcgctctgtcaccc

SEQ ID NO: 153387 - DNA, 23 bp, Homo sapiens
aatttggatttgaaatgcattga

SEQ ID NO: 153388 - DNA, 20 bp, Homo sapiens
gtgaagaggtacaatatttt

SEQ ID NO: 153389 - DNA, 23 bp, Homo sapiens
tgagttcattgtagattctggat

SEQ ID NO: 153390 - DNA, 23 bp, Homo sapiens
tgagttcattgtagattctggat

SEQ ID NO: 153391 - DNA, 23 bp, Homo sapiens
tacttccatatgtgtgtatatat

SEQ ID NO: 153392 - DNA, 23 bp, Homo sapiens
attctgttattctatttctgttt

SEQ ID NO: 153393 - DNA, 23 bp, Homo sapiens
tgtatatagtacactatgtatgt

SEQ ID NO: 153394 - DNA, 23 bp, Homo sapiens
tatattcttgatgtatttatgtg

SEQ ID NO: 153395 - DNA, 23 bp, Homo sapiens
tggagaaggtggtagtagttggc

SEQ ID NO: 153396 - DNA, 23 bp, Homo sapiens
gacggagtctcactgtctcccag

SEQ ID NO: 153397 - DNA, 21 bp, Homo sapiens
tctgtgaaaaatgatgttggt

SEQ ID NO: 153398 - DNA, 23 bp, Homo sapiens
gagtctcactctgtcacccaggc

SEQ ID NO: 153399 - DNA, 22 bp, Homo sapiens
tctgtggcaggcattctagcag

SEQ ID NO: 153400 - DNA, 20 bp, Homo sapiens
ttctgcttcatgttggctta

SEQ ID NO: 153401 - DNA, 20 bp, Homo sapiens
atgacttatgtatttgatta

SEQ ID NO: 153402 - DNA, 18 bp, Homo sapiens
agtgactttgcagtgtgt

SEQ ID NO: 153403 - DNA, 19 bp, Homo sapiens
tgtgtgtgtatatatatag

SEQ ID NO: 153404 - DNA, 22 bp, Homo sapiens
ccactgagcacaggtgatacag

SEQ ID NO: 153405 - DNA, 21 bp, Homo sapiens
atatacaggtacagatgagtg

SEQ ID NO: 153406 - DNA, 23 bp, Homo sapiens
tgagacagagtctcattctgtca

SEQ ID NO: 153407 - DNA, 23 bp, Homo sapiens
gagtgcactgaatttgatgttct

SEQ ID NO: 153408 - DNA, 22 bp, Homo sapiens
tctcagtttttaattgtgtcag

SEQ ID NO: 153409 - DNA, 19 bp, Homo sapiens
cagatcttgttgaaagctg

SEQ ID NO: 153410 - DNA, 21 bp, Homo sapiens
gtgcatgcctgtggttccagc

SEQ ID NO: 153411 - DNA, 22 bp, Homo sapiens
ttcacaccattctcctgcctca

SEQ ID NO: 153412 - DNA, 18 bp, Homo sapiens
ggcttatatatggcatgt

SEQ ID NO: 153413 - DNA, 23 bp, Homo sapiens
tgagttcattgtagattctggat

SEQ ID NO: 153414 - DNA, 23 bp, Homo sapiens
tgagttcattgtagattctggat

SEQ ID NO: 153415 - DNA, 23 bp, Homo sapiens
aaatggcacacacagacttgtgt

SEQ ID NO: 153416 - DNA, 20 bp, Homo sapiens
agagtgacactcctatttct

SEQ ID NO: 153417 - DNA, 23 bp, Homo sapiens
atgactgggaagtgttcatgtgc

SEQ ID NO: 153418 - DNA, 23 bp, Homo sapiens
ttttaagtgtgcaatactttccc

SEQ ID NO: 153419 - DNA, 23 bp, Homo sapiens
tgtgggtgactctgtgtgtgtgt

SEQ ID NO: 153420 - DNA, 23 bp, Homo sapiens
aatgaagaggtgcgtgtctccga

SEQ ID NO: 153421 - DNA, 19 bp, Homo sapiens
taagccaccaagtctaagg

SEQ ID NO: 153422 - DNA, 19 bp, Homo sapiens
tgaaacggagtctcgctct

SEQ ID NO: 153423 - DNA, 22 bp, Homo sapiens
actgtaaggattttactctgag

SEQ ID NO: 153424 - DNA, 23 bp, Homo sapiens
ctgagattctgaatgagaagaca

SEQ ID NO: 153425 - DNA, 20 bp, Homo sapiens
tcgctgcagccttgaatccc

SEQ ID NO: 153426 - DNA, 23 bp, Homo sapiens
agagtagtgacaataatgatgaa

SEQ ID NO: 153427 - DNA, 18 bp, Homo sapiens
actgagtgttgtgcactt

SEQ ID NO: 153428 - DNA, 22 bp, Homo sapiens
ttttgctcaacactgggtctct

SEQ ID NO: 153429 - DNA, 22 bp, Homo sapiens
tcaggtggacaaataaagctgt

SEQ ID NO: 153430 - DNA, 21 bp, Homo sapiens
aaagtgtaagaagtttgaagt

SEQ ID NO: 153431 - DNA, 23 bp, Homo sapiens
tgagttcattgtagattctggat

SEQ ID NO: 153432 - DNA, 23 bp, Homo sapiens
tgagttcattgtagattctggat

SEQ ID NO: 153433 - DNA, 23 bp, Homo sapiens
tttgagacggaatctcactctgt

SEQ ID NO: 153434 - DNA, 23 bp, Homo sapiens
gccctgactcactgtgacccata

SEQ ID NO: 153435 - DNA, 21 bp, Homo sapiens
tgagtggctggctgtgcagtg

SEQ ID NO: 153436 - DNA, 23 bp, Homo sapiens
tctctgtgcctcagttttctcat

SEQ ID NO: 153437 - DNA, 23 bp, Homo sapiens
gacagtagtgtgtgaggtgggcc

SEQ ID NO: 153438 - DNA, 21 bp, Homo sapiens
tacacgttatatatgatatgt

SEQ ID NO: 153439 - DNA, 22 bp, Homo sapiens
tttaggactagttgtaatcacc

SEQ ID NO: 153440 - DNA, 22 bp, Homo sapiens
tccttgagagccactgtgttga

SEQ ID NO: 153441 - DNA, 23 bp, Homo sapiens
tccctgtgtgtgtctgagtccaa

SEQ ID NO: 153442 - DNA, 21 bp, Homo sapiens
ttttgagacggagtcttgctc

SEQ ID NO: 153443 - DNA, 21 bp, Homo sapiens
tctgtctcactgtctcttgag

SEQ ID NO: 153444 - DNA, 23 bp, Homo sapiens
tgagttcattgtagattctggat

SEQ ID NO: 153445 - DNA, 23 bp, Homo sapiens
tgagttcattgtagattctggat

SEQ ID NO: 153446 - DNA, 23 bp, Homo sapiens
tatgtgtacatatacgtatgtgt

SEQ ID NO: 153447 - DNA, 22 bp, Homo sapiens
atacacatacatgtatgtgtat

SEQ ID NO: 153448 - DNA, 20 bp, Homo sapiens
atacgtatatatatatatgt

SEQ ID NO: 153449 - DNA, 23 bp, Homo sapiens
tgagttcattgtagattctggat

SEQ ID NO: 153450 - DNA, 23 bp, Homo sapiens
tgagttcattgtagattctggat

SEQ ID NO: 153451 - DNA, 22 bp, Homo sapiens
tatctactttggttaacatggg

SEQ ID NO: 153452 - DNA, 23 bp, Homo sapiens
tggcaagctctgcctctctacag

SEQ ID NO: 153453 - DNA, 21 bp, Homo sapiens
tgcaattcttccaccagatga

SEQ ID NO: 153454 - DNA, 23 bp, Homo sapiens
agagtctcactctgtcatccagg

SEQ ID NO: 153455 - DNA, 21 bp, Homo sapiens
agttcagtagtgtgatcttgg

SEQ ID NO: 153456 - DNA, 23 bp, Homo sapiens
atatatgtatgtgtgcatgtgta

SEQ ID NO: 153457 - DNA, 21 bp, Homo sapiens
cacacacatacgcacacatat

SEQ ID NO: 153458 - DNA, 22 bp, Homo sapiens
atgtatgtatttaagacagagg

SEQ ID NO: 153459 - DNA, 20 bp, Homo sapiens
caggatgtatgtatgtatgt

SEQ ID NO: 153460 - DNA, 23 bp, Homo sapiens
tgagtgtcaacctgattggattg

SEQ ID NO: 153461 - DNA, 23 bp, Homo sapiens
catctactaagcagaaattggta

SEQ ID NO: 153462 - DNA, 20 bp, Homo sapiens
agtctcgctgactcccaggc

SEQ ID NO: 153463 - DNA, 22 bp, Homo sapiens
aaacttaatttgtaaatgtgta

SEQ ID NO: 153464 - DNA, 23 bp, Homo sapiens
ttagatggagtctccctctgtca

SEQ ID NO: 153465 - DNA, 21 bp, Homo sapiens
tttctctgtctggttaacaag

SEQ ID NO: 153466 - DNA, 23 bp, Homo sapiens
acttgtctgtctgcctgtttgcc

SEQ ID NO: 153467 - DNA, 23 bp, Homo sapiens
ttttatgtattctaaacatatgt

SEQ ID NO: 153468 - DNA, 18 bp, Homo sapiens
taggacctctgattgaat

SEQ ID NO: 153469 - DNA, 23 bp, Homo sapiens
tatacattttatgtatatgtgtg

SEQ ID NO: 153470 - DNA, 23 bp, Homo sapiens
actcactctctcgttctcttttc

SEQ ID NO: 153471 - DNA, 23 bp, Homo sapiens
agagtctcactctgtcacccagg

SEQ ID NO: 153472 - DNA, 19 bp, Homo sapiens
actctaattgtattgagta

SEQ ID NO: 153473 - DNA, 23 bp, Homo sapiens
tggcatgctcctgtagtcgcagc

SEQ ID NO: 153474 - DNA, 23 bp, Homo sapiens
cctcccaaagtgctgggattaca

SEQ ID NO: 153475 - DNA, 18 bp, Homo sapiens
tctcaccctgtcacccag

SEQ ID NO: 153476 - DNA, 23 bp, Homo sapiens
gtgtgtgtatatatatgtgtgtg

SEQ ID NO: 153477 - DNA, 22 bp, Homo sapiens
aaatacagcatgggcttgagca

SEQ ID NO: 153478 - DNA, 23 bp, Homo sapiens
atgagactcactctgtgtggctg

SEQ ID NO: 153479 - DNA, 22 bp, Homo sapiens
tcaatcagagactaagttgttc

SEQ ID NO: 153480 - DNA, 23 bp, Homo sapiens
agacagggtctctctgtcaccca

SEQ ID NO: 153481 - DNA, 21 bp, Homo sapiens
aacatagtgagatcccatctc

SEQ ID NO: 153482 - DNA, 23 bp, Homo sapiens
gacagagtctcactctgtcaccc

SEQ ID NO: 153483 - DNA, 23 bp, Homo sapiens
atttttgtgggtctcgctgtgtt

SEQ ID NO: 153484 - DNA, 23 bp, Homo sapiens
actgagtctccctctgtcaccca

SEQ ID NO: 153485 - DNA, 18 bp, Homo sapiens
acagtggcgtgatcttgg

SEQ ID NO: 153486 - DNA, 23 bp, Homo sapiens
tcactgattttgaaatggtgatt

SEQ ID NO: 153487 - DNA, 23 bp, Homo sapiens
tgtatgtatatgtatatgtgcat

SEQ ID NO: 153488 - DNA, 21 bp, Homo sapiens
tgagacaaggtctcactctgt

SEQ ID NO: 153489 - DNA, 23 bp, Homo sapiens
actgtgagagagattcttcttct

SEQ ID NO: 153490 - DNA, 23 bp, Homo sapiens
ttttgagacagagtgtcactctg

SEQ ID NO: 153491 - DNA, 18 bp, Homo sapiens
agcagtgactccaaggag

SEQ ID NO: 153492 - DNA, 23 bp, Homo sapiens
tgtgaaatctaggtatatagcgc

SEQ ID NO: 153493 - DNA, 23 bp, Homo sapiens
tatgtgtgtgtccatgcgtgtgt

SEQ ID NO: 153494 - DNA, 22 bp, Homo sapiens
agggtctcactctgtcaccccg

SEQ ID NO: 153495 - DNA, 22 bp, Homo sapiens
tagatatcacattttgtttatc

SEQ ID NO: 153496 - DNA, 19 bp, Homo sapiens
tcacgcctcacgctctcac

SEQ ID NO: 153497 - DNA, 20 bp, Homo sapiens
aagtgccaattgtgttgtat

SEQ ID NO: 153498 - DNA, 23 bp, Homo sapiens
agcttctcactgcaagatttggc

SEQ ID NO: 153499 - DNA, 23 bp, Homo sapiens
tgaatgtccataatgattgatga

SEQ ID NO: 153500 - DNA, 23 bp, Homo sapiens
acagtctcactcactctgtcgcc

SEQ ID NO: 153501 - DNA, 23 bp, Homo sapiens
gtagtgctccctctgtatgggct

SEQ ID NO: 153502 - DNA, 23 bp, Homo sapiens
tttctctctcagatcaggagcca

SEQ ID NO: 153503 - DNA, 23 bp, Homo sapiens
tgtgtgtgcattgtgtgtctctg

SEQ ID NO: 153504 - DNA, 23 bp, Homo sapiens
ggctgaaaagtaagctgttctga

SEQ ID NO: 153505 - DNA, 20 bp, Homo sapiens
tcagtgtgcatggctgtgtt

SEQ ID NO: 153506 - DNA, 22 bp, Homo sapiens
tctctctctgtgagttggggct

SEQ ID NO: 153507 - DNA, 23 bp, Homo sapiens
atgtatgtgcatgtatatgtgtg

SEQ ID NO: 153508 - DNA, 22 bp, Homo sapiens
tcagaagtgaattactagattc

SEQ ID NO: 153509 - DNA, 23 bp, Homo sapiens
gacatgatctcgctctgtcactc

SEQ ID NO: 153510 - DNA, 23 bp, Homo sapiens
ggagtctcactctgacacccagg

SEQ ID NO: 153511 - DNA, 18 bp, Homo sapiens
atctatatatagatgtat

SEQ ID NO: 153512 - DNA, 20 bp, Homo sapiens
ttgagatgaagtcttgctgt

SEQ ID NO: 153513 - DNA, 22 bp, Homo sapiens
tcatgatctttgtagagtcaga

SEQ ID NO: 153514 - DNA, 23 bp, Homo sapiens
gcctgcctgcctgcctctgtaga

SEQ ID NO: 153515 - DNA, 20 bp, Homo sapiens
tgtctgcctcactctttgtc

SEQ ID NO: 153516 - DNA, 18 bp, Homo sapiens
cccacgctcactcactgc

SEQ ID NO: 153517 - DNA, 23 bp, Homo sapiens
tattgcatatttaaacatgtatg

SEQ ID NO: 153518 - DNA, 23 bp, Homo sapiens
tatattgcatatttaaacatgta

SEQ ID NO: 153519 - DNA, 20 bp, Homo sapiens
gcacaagagaaaggcactgg

SEQ ID NO: 153520 - DNA, 19 bp, Homo sapiens
agaaaatctcatggtctac

SEQ ID NO: 153521 - DNA, 23 bp, Homo sapiens
agcatcatctctgggtgtgtctg

SEQ ID NO: 153522 - DNA, 23 bp, Homo sapiens
tatttgaagaaaatcaatggtag

SEQ ID NO: 153523 - DNA, 23 bp, Homo sapiens
gagacagagtctccctctgtcgc

SEQ ID NO: 153524 - DNA, 21 bp, Homo sapiens
aggctagagaatacagtggtg

SEQ ID NO: 153525 - DNA, 19 bp, Homo sapiens
tatagatacagatatagat

SEQ ID NO: 153526 - DNA, 23 bp, Homo sapiens
tctgttgaagttctagtttgtca

SEQ ID NO: 153527 - DNA, 22 bp, Homo sapiens
tgaggtaggaggatcacttgaa

SEQ ID NO: 153528 - DNA, 22 bp, Homo sapiens
tgtaacagcttcttgatctgtc

SEQ ID NO: 153529 - DNA, 23 bp, Homo sapiens
gaatgtgtgtatggtgtatgtga

SEQ ID NO: 153530 - DNA, 23 bp, Homo sapiens
gtgatgagtgtgtggtgtgcatg

SEQ ID NO: 153531 - DNA, 23 bp, Homo sapiens
atatgtgtgtgcatgtatatata

SEQ ID NO: 153532 - DNA, 23 bp, Homo sapiens
tgtggctgtctgtgtctctaagt

SEQ ID NO: 153533 - DNA, 23 bp, Homo sapiens
ttgatgtcagtacagactgtgca

SEQ ID NO: 153534 - DNA, 23 bp, Homo sapiens
taccgtttgcaattgatgtctat

SEQ ID NO: 153535 - DNA, 23 bp, Homo sapiens
tgcctatgtcatagcttgttgta

SEQ ID NO: 153536 - DNA, 19 bp, Homo sapiens
tgagatggagtctcactct

SEQ ID NO: 153537 - DNA, 23 bp, Homo sapiens
aaatatgtctatgttctaatgtt

SEQ ID NO: 153538 - DNA, 22 bp, Homo sapiens
attgggactgtgttagttgact

SEQ ID NO: 153539 - DNA, 23 bp, Homo sapiens
gtgtgtgtatctgtgtctgtgtg

SEQ ID NO: 153540 - DNA, 22 bp, Homo sapiens
agtgtggtagaagattgtttag

SEQ ID NO: 153541 - DNA, 19 bp, Homo sapiens
tgacaacagtgatatcagt

SEQ ID NO: 153542 - DNA, 23 bp, Homo sapiens
cagagtctcactctgtcgctcag

SEQ ID NO: 153543 - DNA, 21 bp, Homo sapiens
tagtctttttaattatatcag

SEQ ID NO: 153544 - DNA, 19 bp, Homo sapiens
ttggctttcaacatgcctt

SEQ ID NO: 153545 - DNA, 20 bp, Homo sapiens
cagagaccctcacttctttg

SEQ ID NO: 153546 - DNA, 23 bp, Homo sapiens
tgagtcagagtctcactctgttg

SEQ ID NO: 153547 - DNA, 23 bp, Homo sapiens
tgtgtgtgtgtctgaatttgggc

SEQ ID NO: 153548 - DNA, 23 bp, Homo sapiens
tttgagacggagtctcactctgt

SEQ ID NO: 153549 - DNA, 23 bp, Homo sapiens
tccctgactcccacagttcttcc

SEQ ID NO: 153550 - DNA, 23 bp, Homo sapiens
caagctagagaacagaaaatgct

SEQ ID NO: 153551 - DNA, 23 bp, Homo sapiens
tgagacagagtctcaccctgtca

SEQ ID NO: 153552 - DNA, 19 bp, Homo sapiens
tgaggtaggaggatcactt

SEQ ID NO: 153553 - DNA, 19 bp, Homo sapiens
tagacagatgtagatatga

SEQ ID NO: 153554 - DNA, 23 bp, Homo sapiens
attgatctgtctgtgtcactgca

SEQ ID NO: 153555 - DNA, 19 bp, Homo sapiens
agtaaatagcttaaagtag

SEQ ID NO: 153556 - DNA, 18 bp, Homo sapiens
attgcagtgagctgagat

SEQ ID NO: 153557 - DNA, 23 bp, Homo sapiens
tgaaagtgcaagtgcatctgtct

SEQ ID NO: 153558 - DNA, 23 bp, Homo sapiens
ttgaaatgtatatagatttgtat

SEQ ID NO: 153559 - DNA, 23 bp, Homo sapiens
acttcctcagtgcctcactgcac

SEQ ID NO: 153560 - DNA, 23 bp, Homo sapiens
tgtcactctcagtcactgccacc

SEQ ID NO: 153561 - DNA, 21 bp, Homo sapiens
tgtcacagggttgcctgaagg

SEQ ID NO: 153562 - DNA, 23 bp, Homo sapiens
cggagtctcgctctgtctcccag

SEQ ID NO: 153563 - DNA, 23 bp, Homo sapiens
tgtcagcatcccactctgtttcc

SEQ ID NO: 153564 - DNA, 19 bp, Homo sapiens
tgagatggagtttggctct

SEQ ID NO: 153565 - DNA, 21 bp, Homo sapiens
tgtctcagtgtgcctcccagg

SEQ ID NO: 153566 - DNA, 20 bp, Homo sapiens
attggcagtgggatgcattt

SEQ ID NO: 153567 - DNA, 23 bp, Homo sapiens
ttttgagacggagtctcactctg

SEQ ID NO: 153568 - DNA, 23 bp, Homo sapiens
tgagcatttctaaagaatagaag

SEQ ID NO: 153569 - DNA, 23 bp, Homo sapiens
tttggatcttgtagaaataatgt

SEQ ID NO: 153570 - DNA, 23 bp, Homo sapiens
tatgagcatgtgtatatatatgt

SEQ ID NO: 153571 - DNA, 23 bp, Homo sapiens
agacatgatctcgctctgtcact

SEQ ID NO: 153572 - DNA, 23 bp, Homo sapiens
acagaatctcactctgtcgctga

SEQ ID NO: 153573 - DNA, 19 bp, Homo sapiens
ttttgagacagggtctcat

SEQ ID NO: 153574 - DNA, 23 bp, Homo sapiens
tgtattctgtcccattaatctgt

SEQ ID NO: 153575 - DNA, 21 bp, Homo sapiens
acatgtgcacaatgtgcaggt

SEQ ID NO: 153576 - DNA, 23 bp, Homo sapiens
tgagatggagtctcactctgttg

SEQ ID NO: 153577 - DNA, 23 bp, Homo sapiens
agtgtgggtgacagacagactct

SEQ ID NO: 153578 - DNA, 23 bp, Homo sapiens
tatgtgtatatgtatgtatgtgt

SEQ ID NO: 153579 - DNA, 21 bp, Homo sapiens
tcatgtctctgtgtcagcatt

SEQ ID NO: 153580 - DNA, 23 bp, Homo sapiens
agagtctcactctgtcacccagg

SEQ ID NO: 153581 - DNA, 20 bp, Homo sapiens
tacttcactttttttcttct

SEQ ID NO: 153582 - DNA, 20 bp, Homo sapiens
tggtgaagcctcgcactctc

SEQ ID NO: 153583 - DNA, 20 bp, Homo sapiens
acattctatctttttttgtt

SEQ ID NO: 153584 - DNA, 23 bp, Homo sapiens
tgagttcattgtagattctggat

SEQ ID NO: 153585 - DNA, 23 bp, Homo sapiens
tgagttcattgtagattctggat

SEQ ID NO: 153586 - DNA, 23 bp, Homo sapiens
tgagttcattgtagattctggat

SEQ ID NO: 153587 - DNA, 18 bp, Homo sapiens
aatgtggaagttatattt

SEQ ID NO: 153588 - DNA, 21 bp, Homo sapiens
cagtgttctgaaaccctttgg

SEQ ID NO: 153589 - DNA, 23 bp, Homo sapiens
tggatagatgctagtttatagtc

SEQ ID NO: 153590 - DNA, 23 bp, Homo sapiens
gagtctcacactgtcacccaggc

SEQ ID NO: 153591 - DNA, 19 bp, Homo sapiens
tgagacagagtctccctgt

SEQ ID NO: 153592 - DNA, 23 bp, Homo sapiens
tatgtccttttaaaagtactttg

SEQ ID NO: 153593 - DNA, 22 bp, Homo sapiens
tacatgtgcacaatgtgcaggt

SEQ ID NO: 153594 - DNA, 22 bp, Homo sapiens
tatctcagcatacaataactca

SEQ ID NO: 153595 - DNA, 21 bp, Homo sapiens
tttactgccacgtttagagga

SEQ ID NO: 153596 - DNA, 22 bp, Homo sapiens
tgcttgccattctaactggtgt

SEQ ID NO: 153597 - DNA, 23 bp, Homo sapiens
tgagttcattgtagattctggat

SEQ ID NO: 153598 - DNA, 23 bp, Homo sapiens
tgagttcattgtagattctggat

SEQ ID NO: 153599 - DNA, 23 bp, Homo sapiens
caggattgaacagggcattgaag

SEQ ID NO: 153600 - DNA, 23 bp, Homo sapiens
atccataatgagcatgatgtgag

SEQ ID NO: 153601 - DNA, 23 bp, Homo sapiens
tggagtctcactctgtcacccag

SEQ ID NO: 153602 - DNA, 21 bp, Homo sapiens
tgtgtatatatatatgtgtat

SEQ ID NO: 153603 - DNA, 22 bp, Homo sapiens
atatgtgtatatatatgtgtgt

SEQ ID NO: 153604 - DNA, 23 bp, Homo sapiens
tatatgtatatatatatgtgtgt

SEQ ID NO: 153605 - DNA, 23 bp, Homo sapiens
tatatgtatatatatatgtgtgt

SEQ ID NO: 153606 - DNA, 22 bp, Homo sapiens
agtctgcctgtaaatcaaggga

SEQ ID NO: 153607 - DNA, 23 bp, Homo sapiens
gtctcactctgtcactcagactg

SEQ ID NO: 153608 - DNA, 23 bp, Homo sapiens
tctggctctgacactctgtgcca

SEQ ID NO: 153609 - DNA, 23 bp, Homo sapiens
aagaaaactctcccagagtttaa

SEQ ID NO: 153610 - DNA, 23 bp, Homo sapiens
tcccagagcccctggaattctgg

SEQ ID NO: 153611 - DNA, 23 bp, Homo sapiens
ttcatgtgtgattttgtatatgt

SEQ ID NO: 153612 - DNA, 20 bp, Homo sapiens
tccctgtaatcagttgcaga

SEQ ID NO: 153613 - DNA, 23 bp, Homo sapiens
ctgtctgtctgcatctcattacc

SEQ ID NO: 153614 - DNA, 21 bp, Homo sapiens
atagtcctagctatttgaggg

SEQ ID NO: 153615 - DNA, 19 bp, Homo sapiens
acagtgagctatggtggtg

SEQ ID NO: 153616 - DNA, 23 bp, Homo sapiens
tatatgtgtgcgtatgtatatac

SEQ ID NO: 153617 - DNA, 19 bp, Homo sapiens
atatgttatggaggtgtgt

SEQ ID NO: 153618 - DNA, 21 bp, Homo sapiens
tatgtgtatatatatgtgtgt

SEQ ID NO: 153619 - DNA, 21 bp, Homo sapiens
tggaataacaaaaagtgttga

SEQ ID NO: 153620 - DNA, 23 bp, Homo sapiens
gagacagtgtctcactctgttgt

SEQ ID NO: 153621 - DNA, 23 bp, Homo sapiens
ttaatagttgaaactgccacaca

SEQ ID NO: 153622 - DNA, 19 bp, Homo sapiens
tgtcctttgatgtctcaga

SEQ ID NO: 153623 - DNA, 23 bp, Homo sapiens
gttctctctcagatttcggagct

SEQ ID NO: 153624 - DNA, 20 bp, Homo sapiens
ttgagtgtcgtgggaagggc

SEQ ID NO: 153625 - DNA, 21 bp, Homo sapiens
ttctctgtctgactgctgtct

SEQ ID NO: 153626 - DNA, 21 bp, Homo sapiens
gttgtctaatgattttgatca

SEQ ID NO: 153627 - DNA, 22 bp, Homo sapiens
aacatgaatgtatatttgtaat

SEQ ID NO: 153628 - DNA, 20 bp, Homo sapiens
tcaatagcacagtatggtga

SEQ ID NO: 153629 - DNA, 20 bp, Homo sapiens
atactgtatgtatatgatta

SEQ ID NO: 153630 - DNA, 18 bp, Homo sapiens
tgtgtcttttagttgtag

SEQ ID NO: 153631 - DNA, 23 bp, Homo sapiens
atcactctgtgtctgtttctcca

SEQ ID NO: 153632 - DNA, 23 bp, Homo sapiens
acagagtctcactctgtcgccca

SEQ ID NO: 153633 - DNA, 23 bp, Homo sapiens
tgcctggctctctgtttccttat

SEQ ID NO: 153634 - DNA, 23 bp, Homo sapiens
agacaaggtctcactctgtcacc

SEQ ID NO: 153635 - DNA, 23 bp, Homo sapiens
actctgtgtctgtgtgtgcgtgt

SEQ ID NO: 153636 - DNA, 23 bp, Homo sapiens
actgcctcagaccctgcctctca

SEQ ID NO: 153637 - DNA, 20 bp, Homo sapiens
tttctctctggctgttatca

SEQ ID NO: 153638 - DNA, 23 bp, Homo sapiens
agactgagtctcactctgtctcc

SEQ ID NO: 153639 - DNA, 23 bp, Homo sapiens
tgagttcattgtagattctggat

SEQ ID NO: 153640 - DNA, 23 bp, Homo sapiens
tgagttcattgtagattctggat

SEQ ID NO: 153641 - DNA, 20 bp, Homo sapiens
agagatgtgagggtgctcac

SEQ ID NO: 153642 - DNA, 22 bp, Homo sapiens
acggtctctgcctctttgcagc

SEQ ID NO: 153643 - DNA, 23 bp, Homo sapiens
tgagttcattgtagattctggat

SEQ ID NO: 153644 - DNA, 23 bp, Homo sapiens
tgagttcattgtagattctggat

SEQ ID NO: 153645 - DNA, 18 bp, Homo sapiens
tcttttgttgctttctga

SEQ ID NO: 153646 - DNA, 22 bp, Homo sapiens
tctcacagacagactgggaggt

SEQ ID NO: 153647 - DNA, 23 bp, Homo sapiens
tgagttcattgtagattctggat

SEQ ID NO: 153648 - DNA, 23 bp, Homo sapiens
tgagttcattgtagattctggat

SEQ ID NO: 153649 - DNA, 19 bp, Homo sapiens
atacatacacacaaagggg

SEQ ID NO: 153650 - DNA, 22 bp, Homo sapiens
aatttttttgtagctatcctct

SEQ ID NO: 153651 - DNA, 23 bp, Homo sapiens
tgagttcattgtagattctggat

SEQ ID NO: 153652 - DNA, 19 bp, Homo sapiens
tgtgtgtgtatatatatac

SEQ ID NO: 153653 - DNA, 23 bp, Homo sapiens
atatgtatgtatatatgtgtata

SEQ ID NO: 153654 - DNA, 20 bp, Homo sapiens
atatgtgtatatatatgtat

SEQ ID NO: 153655 - DNA, 23 bp, Homo sapiens
tgagttcattgtagattctggat

SEQ ID NO: 153656 - DNA, 23 bp, Homo sapiens
tgagttcattgtagattctggat

SEQ ID NO: 153657 - DNA, 20 bp, Homo sapiens
tgatgtatcatatatgtgta

SEQ ID NO: 153658 - DNA, 18 bp, Homo sapiens
tgagatatgtgtgtgtat

SEQ ID NO: 153659 - DNA, 22 bp, Homo sapiens
tagacactagagagacatcagt

SEQ ID NO: 153660 - DNA, 23 bp, Homo sapiens
gtgtgtgtctgtgtgtgtgtata

SEQ ID NO: 153661 - DNA, 22 bp, Homo sapiens
acacataccacctgataaggta

SEQ ID NO: 153662 - DNA, 23 bp, Homo sapiens
tgagttcattgtagattctggat

SEQ ID NO: 153663 - DNA, 23 bp, Homo sapiens
tgagttcattgtagattctggat

SEQ ID NO: 153664 - DNA, 23 bp, Homo sapiens
atggctgtggcattgtacacagt

SEQ ID NO: 153665 - DNA, 23 bp, Homo sapiens
tatgccattgtatagatatacca

SEQ ID NO: 153666 - DNA, 23 bp, Homo sapiens
ttaagtgtgcatgtcttgtcatt

SEQ ID NO: 153667 - DNA, 23 bp, Homo sapiens
ggatgtgcatatgtttggtcatt

SEQ ID NO: 153668 - DNA, 20 bp, Homo sapiens
ttcagagaagaaagtgacta

SEQ ID NO: 153669 - DNA, 23 bp, Homo sapiens
tgtttgtgtatatatgtatatgt

SEQ ID NO: 153670 - DNA, 20 bp, Homo sapiens
ttgagagaagtgactgtgga

SEQ ID NO: 153671 - DNA, 23 bp, Homo sapiens
gatctggtagtttaaaagtgtgt

SEQ ID NO: 153672 - DNA, 21 bp, Homo sapiens
agcatgcaggcttgattgtag

SEQ ID NO: 153673 - DNA, 23 bp, Homo sapiens
cagtgaggatgcaggatgtttgg

SEQ ID NO: 153674 - DNA, 23 bp, Homo sapiens
ttcagtgtgtgttgaagttctgt

SEQ ID NO: 153675 - DNA, 23 bp, Homo sapiens
gggtctcactctgtcacccaggc

SEQ ID NO: 153676 - DNA, 19 bp, Homo sapiens
ttgtttgctaaaaagtctg

SEQ ID NO: 153677 - DNA, 23 bp, Homo sapiens
gacagagtctctctctgttaccc

SEQ ID NO: 153678 - DNA, 23 bp, Homo sapiens
tgagttcattgtagattctggat

SEQ ID NO: 153679 - DNA, 23 bp, Homo sapiens
tgagttcattgtagattctggat

SEQ ID NO: 153680 - DNA, 23 bp, Homo sapiens
tgagttcattgtagattctggat

SEQ ID NO: 153681 - DNA, 23 bp, Homo sapiens
tgagttcattgtagattctggat

SEQ ID NO: 153682 - DNA, 19 bp, Homo sapiens
aaatccaggtattccaaag

SEQ ID NO: 153683 - DNA, 23 bp, Homo sapiens
aggaggctgaggtaggaggatca

SEQ ID NO: 153684 - DNA, 23 bp, Homo sapiens
atgtgtatatatgtatgtgtata

SEQ ID NO: 153685 - DNA, 20 bp, Homo sapiens
tatatatgtatgtgtatatg

SEQ ID NO: 153686 - DNA, 23 bp, Homo sapiens
ttgtctctgcatggaaatctgaa

SEQ ID NO: 153687 - DNA, 23 bp, Homo sapiens
tgtgtatatatatgtatatgtgt

SEQ ID NO: 153688 - DNA, 21 bp, Homo sapiens
tgtatatgtatatgtctgtat

SEQ ID NO: 153689 - DNA, 20 bp, Homo sapiens
tgtctacatacatatgtgtg

SEQ ID NO: 153690 - DNA, 20 bp, Homo sapiens
atgcatacacatatatgtgt

SEQ ID NO: 153691 - DNA, 20 bp, Homo sapiens
tgtgtgtatatatatacatg

SEQ ID NO: 153692 - DNA, 23 bp, Homo sapiens
agtgaagtgattttcttctttat

SEQ ID NO: 153693 - DNA, 21 bp, Homo sapiens
attcaaactgaaaagggatat

SEQ ID NO: 153694 - DNA, 23 bp, Homo sapiens
cttgagattagtgtgtaggcagt

SEQ ID NO: 153695 - DNA, 19 bp, Homo sapiens
catcttcctatctatgtct

SEQ ID NO: 153696 - DNA, 20 bp, Homo sapiens
tatacacacatatatatgtg

SEQ ID NO: 153697 - DNA, 23 bp, Homo sapiens
tatatgtaccacattttctttat

SEQ ID NO: 153698 - DNA, 22 bp, Homo sapiens
agtctcactgaatatcttctta

SEQ ID NO: 153699 - DNA, 22 bp, Homo sapiens
tataggatgatgcagtgaaaac

SEQ ID NO: 153700 - DNA, 22 bp, Homo sapiens
aaaatgcaaattctcatttatg

SEQ ID NO: 153701 - DNA, 20 bp, Homo sapiens
tatatcaagattagcatttg

SEQ ID NO: 153702 - DNA, 23 bp, Homo sapiens
tcttcagtgcaacctgctggaat

SEQ ID NO: 153703 - DNA, 19 bp, Homo sapiens
tctgctcatcaatttctgc

SEQ ID NO: 153704 - DNA, 23 bp, Homo sapiens
tgtgtctcagactctttcaggta

SEQ ID NO: 153705 - DNA, 23 bp, Homo sapiens
tgagttcattgtagattctggat

SEQ ID NO: 153706 - DNA, 23 bp, Homo sapiens
tgagttcattgtagattctggat

SEQ ID NO: 153707 - DNA, 23 bp, Homo sapiens
atgtaaagaattgaattcactta

SEQ ID NO: 153708 - DNA, 23 bp, Homo sapiens
atagatgacagaagtgacactgc

SEQ ID NO: 153709 - DNA, 23 bp, Homo sapiens
aggtagtggtatacttttcaata

SEQ ID NO: 153710 - DNA, 23 bp, Homo sapiens
cgtctcactcactcactttaggg

SEQ ID NO: 153711 - DNA, 23 bp, Homo sapiens
cggagtctcactgtgtcacccag

SEQ ID NO: 153712 - DNA, 23 bp, Homo sapiens
agatagagtctcgctctgttgcc

SEQ ID NO: 153713 - DNA, 23 bp, Homo sapiens
gtgccagctgaagcaggtggttg

SEQ ID NO: 153714 - DNA, 22 bp, Homo sapiens
gtgctgaagtttggaatggctg

SEQ ID NO: 153715 - DNA, 23 bp, Homo sapiens
gctgagcatgtagtcacagcagc

SEQ ID NO: 153716 - DNA, 19 bp, Homo sapiens
tcacagagcaatccttttt

SEQ ID NO: 153717 - DNA, 23 bp, Homo sapiens
tttttgttccatatgaaatgtaa

SEQ ID NO: 153718 - DNA, 23 bp, Homo sapiens
tgagttcattgtagattctggat

SEQ ID NO: 153719 - DNA, 23 bp, Homo sapiens
tgagttcattgtagattctggat

SEQ ID NO: 153720 - DNA, 22 bp, Homo sapiens
ttgatttgcatatgttggacca

SEQ ID NO: 153721 - DNA, 23 bp, Homo sapiens
tgtgtctgtgacagtctctcagc

SEQ ID NO: 153722 - DNA, 22 bp, Homo sapiens
tgactaggagacgatgtgctca

SEQ ID NO: 153723 - DNA, 23 bp, Homo sapiens
atatgtatatatgtatatatgtg

SEQ ID NO: 153724 - DNA, 22 bp, Homo sapiens
tgtgtatatatgtatatgtgtg

SEQ ID NO: 153725 - DNA, 23 bp, Homo sapiens
tgagttcattgtagattctggat

SEQ ID NO: 153726 - DNA, 23 bp, Homo sapiens
tgagttcattgtagattctggat

SEQ ID NO: 153727 - DNA, 23 bp, Homo sapiens
ctttggaaaacagtttttgatta

SEQ ID NO: 153728 - DNA, 23 bp, Homo sapiens
agttaatagcttgtttttcacag

SEQ ID NO: 153729 - DNA, 23 bp, Homo sapiens
cttctaagtgtattctgacttgt

SEQ ID NO: 153730 - DNA, 23 bp, Homo sapiens
acagaactgacagtagaaactgt

SEQ ID NO: 153731 - DNA, 23 bp, Homo sapiens
agcttacttgaatcagtgctgta

SEQ ID NO: 153732 - DNA, 23 bp, Homo sapiens
tttgaaagtgtaggtcaatgagg

SEQ ID NO: 153733 - DNA, 23 bp, Homo sapiens
attcagaatttcatgatctgtgt

SEQ ID NO: 153734 - DNA, 21 bp, Homo sapiens
agcctctctttagcattattt

SEQ ID NO: 153735 - DNA, 22 bp, Homo sapiens
gtttctccaactgatgtgtttc

SEQ ID NO: 153736 - DNA, 23 bp, Homo sapiens
tctgtgtcactgagactgttagc

SEQ ID NO: 153737 - DNA, 23 bp, Homo sapiens
tgcagacagcatgagataagctg

SEQ ID NO: 153738 - DNA, 23 bp, Homo sapiens
tctgggagcctttgactgtgtgg

SEQ ID NO: 153739 - DNA, 23 bp, Homo sapiens
gacagagtctcgctctgtcaccc

SEQ ID NO: 153740 - DNA, 22 bp, Homo sapiens
ctgtggctctctgcctgtggtc

SEQ ID NO: 153741 - DNA, 20 bp, Homo sapiens
ttcgatgtacatagtgttat

SEQ ID NO: 153742 - DNA, 21 bp, Homo sapiens
atggctaatgagtatgatgtt

SEQ ID NO: 153743 - DNA, 23 bp, Homo sapiens
gcactgttgtcagcacttaggat

SEQ ID NO: 153744 - DNA, 23 bp, Homo sapiens
tctggagagaactctgtgaggag

SEQ ID NO: 153745 - DNA, 22 bp, Homo sapiens
tgggactagttctgagtctttt

SEQ ID NO: 153746 - DNA, 21 bp, Homo sapiens
tgagaagaactgcctctctac

SEQ ID NO: 153747 - DNA, 23 bp, Homo sapiens
tcaatgagagcaaatcttcagat

SEQ ID NO: 153748 - DNA, 23 bp, Homo sapiens
tgagagtagcaggcaatcagatc

SEQ ID NO: 153749 - DNA, 23 bp, Homo sapiens
gtctggctgaagagtgtgaggtc

SEQ ID NO: 153750 - DNA, 23 bp, Homo sapiens
gtttctctgactctgtttcctct

SEQ ID NO: 153751 - DNA, 21 bp, Homo sapiens
agtctagagaaacattgaggt

SEQ ID NO: 153752 - DNA, 18 bp, Homo sapiens
tgtcatgacttccaaacc

SEQ ID NO: 153753 - DNA, 23 bp, Homo sapiens
agagcaagtgacttgatgggtgg

SEQ ID NO: 153754 - DNA, 23 bp, Homo sapiens
agtctgtgcatctgtctgtctct

SEQ ID NO: 153755 - DNA, 23 bp, Homo sapiens
ccgagtctcgctctgtcacccag

SEQ ID NO: 153756 - DNA, 23 bp, Homo sapiens
cagagtctcgctctgtcgctcag

SEQ ID NO: 153757 - DNA, 19 bp, Homo sapiens
tatgtatgtgtatgtgtgt

SEQ ID NO: 153758 - DNA, 23 bp, Homo sapiens
cttttttagaagtagattctgta

SEQ ID NO: 153759 - DNA, 23 bp, Homo sapiens
aaagagcatcttgatgccaactt

SEQ ID NO: 153760 - DNA, 23 bp, Homo sapiens
tcatgtggcctttgtgtgtgtgt

SEQ ID NO: 153761 - DNA, 23 bp, Homo sapiens
tagagagcttttgttttttgttt

SEQ ID NO: 153762 - DNA, 23 bp, Homo sapiens
agagatgacatcttggtgtttcc

SEQ ID NO: 153763 - DNA, 23 bp, Homo sapiens
gagatggagtctcactctgtcac

SEQ ID NO: 153764 - DNA, 23 bp, Homo sapiens
tcacttgagcctgggagatcagt

SEQ ID NO: 153765 - DNA, 22 bp, Homo sapiens
atacacacacatatatatgtgt

SEQ ID NO: 153766 - DNA, 21 bp, Homo sapiens
ggctcactctctctctgggca

SEQ ID NO: 153767 - DNA, 20 bp, Homo sapiens
tgactctcccagattaattt

SEQ ID NO: 153768 - DNA, 19 bp, Homo sapiens
cttcttgattatggaaaaa

SEQ ID NO: 153769 - DNA, 18 bp, Homo sapiens
agtgtgtctgttgatttt

SEQ ID NO: 153770 - DNA, 23 bp, Homo sapiens
taacatgtgctcttggtttcttt

SEQ ID NO: 153771 - DNA, 23 bp, Homo sapiens
tgcaaagtgcttcagcttatgtg

SEQ ID NO: 153772 - DNA, 23 bp, Homo sapiens
tgagttcattgtagattctggat

SEQ ID NO: 153773 - DNA, 23 bp, Homo sapiens
tgagttcattgtagattctggat

SEQ ID NO: 153774 - DNA, 18 bp, Homo sapiens
aatattttaaagtccaga

SEQ ID NO: 153775 - DNA, 19 bp, Homo sapiens
ttaagatggagtctcactc

SEQ ID NO: 153776 - DNA, 23 bp, Homo sapiens
tgagttcattgtagattctggat

SEQ ID NO: 153777 - DNA, 23 bp, Homo sapiens
tgagttcattgtagattctggat

SEQ ID NO: 153778 - DNA, 23 bp, Homo sapiens
ctcccagagcccctggaactctg

SEQ ID NO: 153779 - DNA, 23 bp, Homo sapiens
tcccagagcccctggaactctgg

SEQ ID NO: 153780 - DNA, 23 bp, Homo sapiens
tcccagagcccctggaactctgg

SEQ ID NO: 153781 - DNA, 23 bp, Homo sapiens
tcccagagcccctggaactctgg

SEQ ID NO: 153782 - DNA, 23 bp, Homo sapiens
taatttcattttatataagtgtg

SEQ ID NO: 153783 - DNA, 22 bp, Homo sapiens
attgtcagagttatatacctct

SEQ ID NO: 153784 - DNA, 23 bp, Homo sapiens
taagcagaaacattctctctgtg

SEQ ID NO: 153785 - DNA, 23 bp, Homo sapiens
gacagagtctcgctctgtcaccc

SEQ ID NO: 153786 - DNA, 18 bp, Homo sapiens
aagcagaattatatgtag

SEQ ID NO: 153787 - DNA, 22 bp, Homo sapiens
tttttgaaatacattttctgtc

SEQ ID NO: 153788 - DNA, 23 bp, Homo sapiens
tcccttgatatgtagtttcattc

SEQ ID NO: 153789 - DNA, 19 bp, Homo sapiens
aagtctatgttagtatttg

SEQ ID NO: 153790 - DNA, 18 bp, Homo sapiens
agagcgagattctgtctc

SEQ ID NO: 153791 - DNA, 23 bp, Homo sapiens
tgagacaagagtctcgctctgtc

SEQ ID NO: 153792 - DNA, 22 bp, Homo sapiens
aggcaaacagtgttatgagtag

SEQ ID NO: 153793 - DNA, 19 bp, Homo sapiens
aactgtttggattacaagc

SEQ ID NO: 153794 - DNA, 23 bp, Homo sapiens
agaggttgcagtgagtctcacac

SEQ ID NO: 153795 - DNA, 20 bp, Homo sapiens
ggttgatggacagtcagctt

SEQ ID NO: 153796 - DNA, 23 bp, Homo sapiens
tttgagacggactctcgctctgt

SEQ ID NO: 153797 - DNA, 23 bp, Homo sapiens
tgggtgacagactcagtccctgt

SEQ ID NO: 153798 - DNA, 18 bp, Homo sapiens
aaagaagtcttccagccc

SEQ ID NO: 153799 - DNA, 23 bp, Homo sapiens
ttggttctggtttttaattcact

SEQ ID NO: 153800 - DNA, 19 bp, Homo sapiens
tgtgagaagaaagtcacca

SEQ ID NO: 153801 - DNA, 22 bp, Homo sapiens
atccactgacagcatgcaatgt

SEQ ID NO: 153802 - DNA, 23 bp, Homo sapiens
tgagttcattgtagattctggat

SEQ ID NO: 153803 - DNA, 23 bp, Homo sapiens
tgagttcattgtagattctggat

SEQ ID NO: 153804 - DNA, 23 bp, Homo sapiens
tgagttcattgtagattctggat

SEQ ID NO: 153805 - DNA, 23 bp, Homo sapiens
tgagttcattgtagattctggat

SEQ ID NO: 153806 - DNA, 23 bp, Homo sapiens
ttggaatgtaaagaactggctct

SEQ ID NO: 153807 - DNA, 23 bp, Homo sapiens
tgagttcattgtagattctggat

SEQ ID NO: 153808 - DNA, 23 bp, Homo sapiens
tgagttcattgtagattctggat

SEQ ID NO: 153809 - DNA, 21 bp, Homo sapiens
atatatcacattttctttttg

SEQ ID NO: 153810 - DNA, 22 bp, Homo sapiens
tgtgtatatatgtatatatgtg

SEQ ID NO: 153811 - DNA, 23 bp, Homo sapiens
acagagtctcactctgtcgccca

SEQ ID NO: 153812 - DNA, 23 bp, Homo sapiens
actgagtctctctctgtcgccca

SEQ ID NO: 153813 - DNA, 18 bp, Homo sapiens
ttcttcatttgtatgtca

SEQ ID NO: 153814 - DNA, 23 bp, Homo sapiens
cccagctctgtcaatatctgtgt

SEQ ID NO: 153815 - DNA, 23 bp, Homo sapiens
gagacaaggtctctctctgtcac

SEQ ID NO: 153816 - DNA, 23 bp, Homo sapiens
attgctgaattaggtttgctagt

SEQ ID NO: 153817 - DNA, 23 bp, Homo sapiens
tatttattgtagaacagctgttt

SEQ ID NO: 153818 - DNA, 23 bp, Homo sapiens
caatatgtatatctgtatatgaa

SEQ ID NO: 153819 - DNA, 22 bp, Homo sapiens
tgagttcacagcatttcatgtg

SEQ ID NO: 153820 - DNA, 22 bp, Homo sapiens
tatgtaacagagcatcccaaat

SEQ ID NO: 153821 - DNA, 23 bp, Homo sapiens
ttctgtgaagaaagtcaatggta

SEQ ID NO: 153822 - DNA, 23 bp, Homo sapiens
tgagttcattgtagattctggat

SEQ ID NO: 153823 - DNA, 23 bp, Homo sapiens
tgagttcattgtagattctggat

SEQ ID NO: 153824 - DNA, 22 bp, Homo sapiens
cctatatatatgaatatgtata

SEQ ID NO: 153825 - DNA, 21 bp, Homo sapiens
atatgtatatatacgtgtgtg

SEQ ID NO: 153826 - DNA, 22 bp, Homo sapiens
atatgtatatatacgtgtgtgt

SEQ ID NO: 153827 - DNA, 21 bp, Homo sapiens
tctgaataaggtgtctcatta

SEQ ID NO: 153828 - DNA, 23 bp, Homo sapiens
ctcccagagcccctggaactctg

SEQ ID NO: 153829 - DNA, 23 bp, Homo sapiens
tcccagagcccctggaactctgg

SEQ ID NO: 153830 - DNA, 23 bp, Homo sapiens
tcccagagcccctggaactctgg

SEQ ID NO: 153831 - DNA, 23 bp, Homo sapiens
tcccagagcccctggaactctgg

SEQ ID NO: 153832 - DNA, 23 bp, Homo sapiens
cggagtctcgctctgtctcccag

SEQ ID NO: 153833 - DNA, 20 bp, Homo sapiens
ggctgtgtttgatgggtgtt

SEQ ID NO: 153834 - DNA, 20 bp, Homo sapiens
tgtgtatatgtatatatgcg

SEQ ID NO: 153835 - DNA, 23 bp, Homo sapiens
tgagttcattgtagattctggat

SEQ ID NO: 153836 - DNA, 23 bp, Homo sapiens
tgagttcattgtagattctggat

SEQ ID NO: 153837 - DNA, 23 bp, Homo sapiens
tgtttgcatcattactggcctga

SEQ ID NO: 153838 - DNA, 22 bp, Homo sapiens
gatataggttaagttttccata

SEQ ID NO: 153839 - DNA, 21 bp, Homo sapiens
atacacacatatatacacgta

SEQ ID NO: 153840 - DNA, 19 bp, Homo sapiens
tgagaatgatctatgtgct

SEQ ID NO: 153841 - DNA, 23 bp, Homo sapiens
tatgtgcatatgtatatatattc

SEQ ID NO: 153842 - DNA, 22 bp, Homo sapiens
atatatgtatatgaagatacag

SEQ ID NO: 153843 - DNA, 19 bp, Homo sapiens
tatacaaagatgtatatat

SEQ ID NO: 153844 - DNA, 23 bp, Homo sapiens
gtatatatgtgtacatgcaaaga

SEQ ID NO: 153845 - DNA, 18 bp, Homo sapiens
tggtgcaatctcagctca

SEQ ID NO: 153846 - DNA, 22 bp, Homo sapiens
tatgtgtatatatgtatatgtg

SEQ ID NO: 153847 - DNA, 23 bp, Homo sapiens
tgagttcattgtagattctggat

SEQ ID NO: 153848 - DNA, 23 bp, Homo sapiens
tgagttcattgtagattctggat

SEQ ID NO: 153849 - DNA, 23 bp, Homo sapiens
aagagacccattgtggatagctc

SEQ ID NO: 153850 - DNA, 23 bp, Homo sapiens
atctcagctcactgtaacctctg

SEQ ID NO: 153851 - DNA, 23 bp, Homo sapiens
ggacagacagaatagtgtgtgga

SEQ ID NO: 153852 - DNA, 23 bp, Homo sapiens
ttttagctccagaatgactgcag

SEQ ID NO: 153853 - DNA, 23 bp, Homo sapiens
ttatggtagttttccagaatcta

SEQ ID NO: 153854 - DNA, 23 bp, Homo sapiens
tgtacaatggttactcttcctgg

SEQ ID NO: 153855 - DNA, 23 bp, Homo sapiens
gacagagtctcgctctgtcaccc

SEQ ID NO: 153856 - DNA, 20 bp, Homo sapiens
aaattgcttttctatcagat

SEQ ID NO: 153857 - DNA, 23 bp, Homo sapiens
tctgtgttttactgtctgctctt

SEQ ID NO: 153858 - DNA, 19 bp, Homo sapiens
tagaaagggagctggaact

SEQ ID NO: 153859 - DNA, 21 bp, Homo sapiens
atgtgtatagtatatgtacat

SEQ ID NO: 153860 - DNA, 23 bp, Homo sapiens
tatgtatatatgtatgtgtgtgt

SEQ ID NO: 153861 - DNA, 23 bp, Homo sapiens
tgagttcattgtagattctggat

SEQ ID NO: 153862 - DNA, 23 bp, Homo sapiens
tgagttcattgtagattctggat

SEQ ID NO: 153863 - DNA, 23 bp, Homo sapiens
ttgaagctggattttgaatgcat

SEQ ID NO: 153864 - DNA, 22 bp, Homo sapiens
gataacagtctgaagtttagaa

SEQ ID NO: 153865 - DNA, 23 bp, Homo sapiens
tcccagttcctacttttgagtgt

SEQ ID NO: 153866 - DNA, 22 bp, Homo sapiens
gtgcatgcctgtagttccagct

SEQ ID NO: 153867 - DNA, 23 bp, Homo sapiens
tgagttcattgtagattctggat

SEQ ID NO: 153868 - DNA, 23 bp, Homo sapiens
tgagttcattgtagattctggat

SEQ ID NO: 153869 - DNA, 22 bp, Homo sapiens
tttctgcttcatttttcacttt

SEQ ID NO: 153870 - DNA, 23 bp, Homo sapiens
tgagtgggtggaaaggagcttca

SEQ ID NO: 153871 - DNA, 23 bp, Homo sapiens
tgtctcgctctgtcacacaggct

SEQ ID NO: 153872 - DNA, 18 bp, Homo sapiens
gtgtgatcatggctcact

SEQ ID NO: 153873 - DNA, 23 bp, Homo sapiens
tgagttcattgtagattctggat

SEQ ID NO: 153874 - DNA, 23 bp, Homo sapiens
tgagttcattgtagattctggat

SEQ ID NO: 153875 - DNA, 23 bp, Homo sapiens
tgtcaaatacaatttatgtgagc

SEQ ID NO: 153876 - DNA, 23 bp, Homo sapiens
tatgtttatatatatgtgtgtgt

SEQ ID NO: 153877 - DNA, 22 bp, Homo sapiens
tatagtgtatatatacatatgt

SEQ ID NO: 153878 - DNA, 23 bp, Homo sapiens
tgtgtgtgtgtaagtggctgcta

SEQ ID NO: 153879 - DNA, 23 bp, Homo sapiens
ggctctctgactgactccttggc

SEQ ID NO: 153880 - DNA, 23 bp, Homo sapiens
tgagttcattgtagattctggat

SEQ ID NO: 153881 - DNA, 23 bp, Homo sapiens
tgagttcattgtagattctggat

SEQ ID NO: 153882 - DNA, 19 bp, Homo sapiens
tatatatatatgtgtgtgc

SEQ ID NO: 153883 - DNA, 22 bp, Homo sapiens
agattttttttcaagcttcccg

SEQ ID NO: 153884 - DNA, 23 bp, Homo sapiens
atgtctgtatgtatgtgtgtgta

SEQ ID NO: 153885 - DNA, 23 bp, Homo sapiens
ttcattttatatgtatatgtgta

SEQ ID NO: 153886 - DNA, 22 bp, Homo sapiens
tggatttgattaaggtttgccc

SEQ ID NO: 153887 - DNA, 22 bp, Homo sapiens
gattgagctttcaggatcttaa

SEQ ID NO: 153888 - DNA, 23 bp, Homo sapiens
tgagttcattgtagattctggat

SEQ ID NO: 153889 - DNA, 23 bp, Homo sapiens
actcagaagacactcagaagcga

SEQ ID NO: 153890 - DNA, 23 bp, Homo sapiens
agatttgagtgaggacacagcca

SEQ ID NO: 153891 - DNA, 23 bp, Homo sapiens
tcagagagagaaaacagtgtgct

SEQ ID NO: 153892 - DNA, 23 bp, Homo sapiens
tgccagtgtctattgtgtttctg

SEQ ID NO: 153893 - DNA, 23 bp, Homo sapiens
tgtacagatgtatgtatttgtgt

SEQ ID NO: 153894 - DNA, 23 bp, Homo sapiens
tatctatatgtatatatatctgt

SEQ ID NO: 153895 - DNA, 21 bp, Homo sapiens
tagagatatatgtatatatgt

SEQ ID NO: 153896 - DNA, 23 bp, Homo sapiens
tgtgtgtgcatgtgcatgtgtat

SEQ ID NO: 153897 - DNA, 23 bp, Homo sapiens
agagtctcactctgtcacccagg

SEQ ID NO: 153898 - DNA, 22 bp, Homo sapiens
tattccctgctcatctttggat

SEQ ID NO: 153899 - DNA, 22 bp, Homo sapiens
aaagacctggtagttgagtgtg

SEQ ID NO: 153900 - DNA, 21 bp, Homo sapiens
aggcatgaagacagtgtctga

SEQ ID NO: 153901 - DNA, 23 bp, Homo sapiens
gtcagtgtcattgttcttgtata

SEQ ID NO: 153902 - DNA, 21 bp, Homo sapiens
agtaattaccaagctcttatt

SEQ ID NO: 153903 - DNA, 23 bp, Homo sapiens
agagagaagattgtgtacaaatt

SEQ ID NO: 153904 - DNA, 21 bp, Homo sapiens
agcatgaaaattaaggataga

SEQ ID NO: 153905 - DNA, 21 bp, Homo sapiens
ttttttgtacttctgttagtc

SEQ ID NO: 153906 - DNA, 22 bp, Homo sapiens
ttagagcatatagttgccaaca

SEQ ID NO: 153907 - DNA, 22 bp, Homo sapiens
atcagagagttttgggaactca

SEQ ID NO: 153908 - DNA, 23 bp, Homo sapiens
tgtctgtatgtgtatctacatgt

SEQ ID NO: 153909 - DNA, 23 bp, Homo sapiens
tgtgaagatattcaatggtagct

SEQ ID NO: 153910 - DNA, 23 bp, Homo sapiens
tgagttctgtatttgttgctgaa

SEQ ID NO: 153911 - DNA, 18 bp, Homo sapiens
acctatatataggtgtat

SEQ ID NO: 153912 - DNA, 18 bp, Homo sapiens
tgtgtatatatataccta

SEQ ID NO: 153913 - DNA, 22 bp, Homo sapiens
ttgttgttgttgttttgagaca

SEQ ID NO: 153914 - DNA, 22 bp, Homo sapiens
aacacaacttactgcaacctca

SEQ ID NO: 153915 - DNA, 18 bp, Homo sapiens
agagctagactctgtctc

SEQ ID NO: 153916 - DNA, 21 bp, Homo sapiens
tttttgacagagtctcgctct

SEQ ID NO: 153917 - DNA, 23 bp, Homo sapiens
tggagtctcactctgtcacccag

SEQ ID NO: 153918 - DNA, 23 bp, Homo sapiens
actgagtctcactgtgtcgccca

SEQ ID NO: 153919 - DNA, 23 bp, Homo sapiens
tctcactctgtcacccaggctca

SEQ ID NO: 153920 - DNA, 23 bp, Homo sapiens
tggagtctcacactctgtcgccc

SEQ ID NO: 153921 - DNA, 22 bp, Homo sapiens
tgacagtagaaagtctgcctac

SEQ ID NO: 153922 - DNA, 23 bp, Homo sapiens
ctcccagagcccctggaactctg

SEQ ID NO: 153923 - DNA, 23 bp, Homo sapiens
tcccagagcccctggaactctgg

SEQ ID NO: 153924 - DNA, 23 bp, Homo sapiens
tcccagagcccctggaactctgg

SEQ ID NO: 153925 - DNA, 23 bp, Homo sapiens
tcccagagcccctggaactctgg

SEQ ID NO: 153926 - DNA, 19 bp, Homo sapiens
tctatctggaaaggaggca

SEQ ID NO: 153927 - DNA, 18 bp, Homo sapiens
ttatatccaggttttgtt

SEQ ID NO: 153928 - DNA, 23 bp, Homo sapiens
tacacacatatatatatgtgtgt

SEQ ID NO: 153929 - DNA, 19 bp, Homo sapiens
gtgaatagagtaccactct

SEQ ID NO: 153930 - DNA, 22 bp, Homo sapiens
ggcagggtctcactctgtggca

SEQ ID NO: 153931 - DNA, 23 bp, Homo sapiens
agaggtatacaattgtcttagct

SEQ ID NO: 153932 - DNA, 23 bp, Homo sapiens
ctcacagtgactcagtgactgtg

SEQ ID NO: 153933 - DNA, 23 bp, Homo sapiens
tgtctggcagttgatgttgactg

SEQ ID NO: 153934 - DNA, 23 bp, Homo sapiens
tgagttcattgtagattctggat

SEQ ID NO: 153935 - DNA, 23 bp, Homo sapiens
tgagttcattgtagattctggat

SEQ ID NO: 153936 - DNA, 23 bp, Homo sapiens
agagtgtctcgctctgtcaccca

SEQ ID NO: 153937 - DNA, 20 bp, Homo sapiens
attagtatatataccaatct

SEQ ID NO: 153938 - DNA, 21 bp, Homo sapiens
tatatacatcatttagtagta

SEQ ID NO: 153939 - DNA, 18 bp, Homo sapiens
tctcactctgtcaccagg

SEQ ID NO: 153940 - DNA, 23 bp, Homo sapiens
tgcttatgactagagacagaaac

SEQ ID NO: 153941 - DNA, 22 bp, Homo sapiens
tatgtctctgtgtattagaaga

SEQ ID NO: 153942 - DNA, 20 bp, Homo sapiens
caagactctgtctcaaaaaa

SEQ ID NO: 153943 - DNA, 23 bp, Homo sapiens
gacagagtctcgctctgtcaccc

SEQ ID NO: 153944 - DNA, 23 bp, Homo sapiens
ctgatgattgacaaagcagtttc

SEQ ID NO: 153945 - DNA, 23 bp, Homo sapiens
tggagtctcactctgtcacccag

SEQ ID NO: 153946 - DNA, 23 bp, Homo sapiens
aacagacttgttctcttggcatc

SEQ ID NO: 153947 - DNA, 21 bp, Homo sapiens
tagctcagagccaaatttgtg

SEQ ID NO: 153948 - DNA, 23 bp, Homo sapiens
tcagcagctctcttacactgtct

SEQ ID NO: 153949 - DNA, 23 bp, Homo sapiens
ctctgggtgtgagtgtgcctgta

SEQ ID NO: 153950 - DNA, 23 bp, Homo sapiens
taaggctttcaattggtatggga

SEQ ID NO: 153951 - DNA, 23 bp, Homo sapiens
tccaagagacacagatgggatga

SEQ ID NO: 153952 - DNA, 22 bp, Homo sapiens
tacaaatagtactggtattggc

SEQ ID NO: 153953 - DNA, 23 bp, Homo sapiens
tgagacagagtctcactctgtca

SEQ ID NO: 153954 - DNA, 23 bp, Homo sapiens
tgagttcattgtagattctggat

SEQ ID NO: 153955 - DNA, 23 bp, Homo sapiens
tgagttcattgtagattctggat

SEQ ID NO: 153956 - DNA, 22 bp, Homo sapiens
tagagactggaagagttctgag

SEQ ID NO: 153957 - DNA, 22 bp, Homo sapiens
ccttaaggatgaattctggtta

SEQ ID NO: 153958 - DNA, 23 bp, Homo sapiens
attgctttgtacagagtttacca

SEQ ID NO: 153959 - DNA, 18 bp, Homo sapiens
tgaaatgaataaatgtat

SEQ ID NO: 153960 - DNA, 19 bp, Homo sapiens
atactgtatgtatatatat

SEQ ID NO: 153961 - DNA, 22 bp, Homo sapiens
agactacatcctgtctgtattt

SEQ ID NO: 153962 - DNA, 20 bp, Homo sapiens
atagtcctgaggtttgctgt

SEQ ID NO: 153963 - DNA, 23 bp, Homo sapiens
gtcctggtggtacagactcggtt

SEQ ID NO: 153964 - DNA, 23 bp, Homo sapiens
ggcagaagagagtgatgtctgca

SEQ ID NO: 153965 - DNA, 20 bp, Homo sapiens
ttttgatcaggctcagctgc

SEQ ID NO: 153966 - DNA, 23 bp, Homo sapiens
ctctgacagtcacacccatttac

SEQ ID NO: 153967 - DNA, 22 bp, Homo sapiens
tattcaagttagtagttatctt

SEQ ID NO: 153968 - DNA, 21 bp, Homo sapiens
tttgagacagagtctcactct

SEQ ID NO: 153969 - DNA, 23 bp, Homo sapiens
tacaactagtgcttcaatgaaca

SEQ ID NO: 153970 - DNA, 23 bp, Homo sapiens
gtctgtctgcctctgtgtgatgc

SEQ ID NO: 153971 - DNA, 22 bp, Homo sapiens
gcagtttcaccatgttggccag

SEQ ID NO: 153972 - DNA, 23 bp, Homo sapiens
caagggtagattggaggttagaa

SEQ ID NO: 153973 - DNA, 23 bp, Homo sapiens
tctctcactgtcataattttctc

SEQ ID NO: 153974 - DNA, 23 bp, Homo sapiens
tgagttcattgtagattctggat

SEQ ID NO: 153975 - DNA, 23 bp, Homo sapiens
tgagttcattgtagattctggat

SEQ ID NO: 153976 - DNA, 22 bp, Homo sapiens
attattcttgttcatttgaggc

SEQ ID NO: 153977 - DNA, 23 bp, Homo sapiens
agacagggtctcactctctcacc

SEQ ID NO: 153978 - DNA, 23 bp, Homo sapiens
tcagggaggctgactggctggtg

SEQ ID NO: 153979 - DNA, 23 bp, Homo sapiens
agagcttcttcatcatcctcctt

SEQ ID NO: 153980 - DNA, 19 bp, Homo sapiens
aacagtctccttctgtgtg

SEQ ID NO: 153981 - DNA, 23 bp, Homo sapiens
gccagagttcagtttctgtctgc

SEQ ID NO: 153982 - DNA, 23 bp, Homo sapiens
agtcacagtaaagattatctgaa

SEQ ID NO: 153983 - DNA, 23 bp, Homo sapiens
atatcaggtttttctttcttggt

SEQ ID NO: 153984 - DNA, 23 bp, Homo sapiens
agaccgagtctctcgctctgtcg

SEQ ID NO: 153985 - DNA, 23 bp, Homo sapiens
taggtgtgtgcgtgtgcgtgtgc

SEQ ID NO: 153986 - DNA, 22 bp, Homo sapiens
tgtgtgtatatatatatatgtg

SEQ ID NO: 153987 - DNA, 23 bp, Homo sapiens
gctttctctctctctgcatgtgc

SEQ ID NO: 153988 - DNA, 19 bp, Homo sapiens
tgtgtgtatatatacgtat

SEQ ID NO: 153989 - DNA, 22 bp, Homo sapiens
atgtgtgtgtgtatatatatac

SEQ ID NO: 153990 - DNA, 23 bp, Homo sapiens
tctgaaatctatgctatgtaaat

SEQ ID NO: 153991 - DNA, 23 bp, Homo sapiens
aaaagctacatttgcatttacag

SEQ ID NO: 153992 - DNA, 20 bp, Homo sapiens
tatgtgcccctgcatgtcat

SEQ ID NO: 153993 - DNA, 23 bp, Homo sapiens
gagacagagtctcgctctgtcac

SEQ ID NO: 153994 - DNA, 20 bp, Homo sapiens
tagtgactttcacattttag

SEQ ID NO: 153995 - DNA, 23 bp, Homo sapiens
tctagagaaaatagattctggtg

SEQ ID NO: 153996 - DNA, 23 bp, Homo sapiens
acacactaactctattcttccct

SEQ ID NO: 153997 - DNA, 23 bp, Homo sapiens
tatgcttgaagtatttggtgaaa

SEQ ID NO: 153998 - DNA, 23 bp, Homo sapiens
gacagagtctcgctctgtcaccc

SEQ ID NO: 153999 - DNA, 23 bp, Homo sapiens
ctgtgtgtatactgtatgtatat

SEQ ID NO: 154000 - DNA, 21 bp, Homo sapiens
agaaaagagaacctgctctcg

SEQ ID NO: 154001 - DNA, 20 bp, Homo sapiens
attgtcagtgttatagtgca

SEQ ID NO: 154002 - DNA, 23 bp, Homo sapiens
gtgcatgtgtatgtgtgtgtgtg

SEQ ID NO: 154003 - DNA, 22 bp, Homo sapiens
acctcttaacctcctgtagcct

SEQ ID NO: 154004 - DNA, 19 bp, Homo sapiens
atatatctagatatctata

SEQ ID NO: 154005 - DNA, 18 bp, Homo sapiens
tatctagatatatataga

SEQ ID NO: 154006 - DNA, 21 bp, Homo sapiens
tgtatctgtatatagatatgt

SEQ ID NO: 154007 - DNA, 23 bp, Homo sapiens
gacagagtctcgctctgtcaccc

SEQ ID NO: 154008 - DNA, 23 bp, Homo sapiens
actctggctctgtcagtcactgg

SEQ ID NO: 154009 - DNA, 22 bp, Homo sapiens
actatccaacttttttgcaaag

SEQ ID NO: 154010 - DNA, 23 bp, Homo sapiens
ctcattgtggttttgatttgcat

SEQ ID NO: 154011 - DNA, 23 bp, Homo sapiens
ctctctctctctctctgtgatga

SEQ ID NO: 154012 - DNA, 21 bp, Homo sapiens
tatcacagtttatatacacat

SEQ ID NO: 154013 - DNA, 23 bp, Homo sapiens
tatgatcataatcatttctatat

SEQ ID NO: 154014 - DNA, 23 bp, Homo sapiens
tgagttcattgtagattctggat

SEQ ID NO: 154015 - DNA, 23 bp, Homo sapiens
tgagttcattgtagattctggat

SEQ ID NO: 154016 - DNA, 18 bp, Homo sapiens
atgtatatatatatatgt

SEQ ID NO: 154017 - DNA, 18 bp, Homo sapiens
atgtatatatatatatgt

SEQ ID NO: 154018 - DNA, 21 bp, Homo sapiens
ttaataacagtatgaatgcag

SEQ ID NO: 154019 - DNA, 23 bp, Homo sapiens
tcatggttgaagctcagattgtc

SEQ ID NO: 154020 - DNA, 23 bp, Homo sapiens
catggtctcactctgtcacccag

SEQ ID NO: 154021 - DNA, 23 bp, Homo sapiens
tgtgtatatatatgtctgtgtgt

SEQ ID NO: 154022 - DNA, 23 bp, Homo sapiens
gacagagtctcgctctgtcaccc

SEQ ID NO: 154023 - DNA, 23 bp, Homo sapiens
agcagtgtgaagtgatgacagtc

SEQ ID NO: 154024 - DNA, 23 bp, Homo sapiens
tgagttcattgtagattctggat

SEQ ID NO: 154025 - DNA, 23 bp, Homo sapiens
tgagttcattgtagattctggat

SEQ ID NO: 154026 - DNA, 20 bp, Homo sapiens
tgtctgactccctctttgcg

SEQ ID NO: 154027 - DNA, 23 bp, Homo sapiens
gtgtgtgtgtgtctgtctgtata

SEQ ID NO: 154028 - DNA, 21 bp, Homo sapiens
ctcaagtagctgggactgtag

SEQ ID NO: 154029 - DNA, 19 bp, Homo sapiens
agcttagttctgttggaga

SEQ ID NO: 154030 - DNA, 23 bp, Homo sapiens
ccagtctcagtctctgtagcagg

SEQ ID NO: 154031 - DNA, 23 bp, Homo sapiens
tttggtaaacacaatcttttttt

SEQ ID NO: 154032 - DNA, 23 bp, Homo sapiens
tgagttcattgtagattctggat

SEQ ID NO: 154033 - DNA, 23 bp, Homo sapiens
tgagttcattgtagattctggat

SEQ ID NO: 154034 - DNA, 23 bp, Homo sapiens
tatctctatgtatatatgtgtat

SEQ ID NO: 154035 - DNA, 19 bp, Homo sapiens
tgtatagatatatatagat

SEQ ID NO: 154036 - DNA, 22 bp, Homo sapiens
tttctctctgcttcaaatgtct

SEQ ID NO: 154037 - DNA, 23 bp, Homo sapiens
tcactctctcacacacaggcact

SEQ ID NO: 154038 - DNA, 21 bp, Homo sapiens
tctgtgtatatctgtgtccga

SEQ ID NO: 154039 - DNA, 23 bp, Homo sapiens
gcatggttctgtgaatcttcttt

SEQ ID NO: 154040 - DNA, 23 bp, Homo sapiens
tgagttcattgtagattctggat

SEQ ID NO: 154041 - DNA, 23 bp, Homo sapiens
tgagttcattgtagattctggat

SEQ ID NO: 154042 - DNA, 21 bp, Homo sapiens
atcaccattctaactggtgtg

SEQ ID NO: 154043 - DNA, 21 bp, Homo sapiens
tactctctttgtatatctgag

SEQ ID NO: 154044 - DNA, 22 bp, Homo sapiens
tgtgtagataattgctcagtta

SEQ ID NO: 154045 - DNA, 22 bp, Homo sapiens
actgagtctccctctgtcaccc

SEQ ID NO: 154046 - DNA, 23 bp, Homo sapiens
aaggtctcactctgtctcccagg

SEQ ID NO: 154047 - DNA, 23 bp, Homo sapiens
acagtctcactctgtcacccagg

SEQ ID NO: 154048 - DNA, 23 bp, Homo sapiens
gggagtctcactctgtcacccag

SEQ ID NO: 154049 - DNA, 23 bp, Homo sapiens
acaaggtctcactctgtcaccca

SEQ ID NO: 154050 - DNA, 23 bp, Homo sapiens
cagtggcttgatcatggctcact

SEQ ID NO: 154051 - DNA, 21 bp, Homo sapiens
tgtgtatatatatatgtgtgt

SEQ ID NO: 154052 - DNA, 23 bp, Homo sapiens
taagagtcctttaaatttgtctt

SEQ ID NO: 154053 - DNA, 23 bp, Homo sapiens
gtccgtgtgtgtgtgtgtatgtg

SEQ ID NO: 154054 - DNA, 20 bp, Homo sapiens
tgaactgtgagcctgtttgc

SEQ ID NO: 154055 - DNA, 21 bp, Homo sapiens
ttactgcaagatcttaactat

SEQ ID NO: 154056 - DNA, 23 bp, Homo sapiens
caaggttaagaatggttttcaga

SEQ ID NO: 154057 - DNA, 23 bp, Homo sapiens
gacagagtctcgctctgtcaccc

SEQ ID NO: 154058 - DNA, 19 bp, Homo sapiens
atatatatttgcaagctgt

SEQ ID NO: 154059 - DNA, 20 bp, Homo sapiens
atatatatatatgcaagctg

SEQ ID NO: 154060 - DNA, 20 bp, Homo sapiens
atatatatatatgcaagctg

SEQ ID NO: 154061 - DNA, 20 bp, Homo sapiens
atatatatatatgcaagctg

SEQ ID NO: 154062 - DNA, 18 bp, Homo sapiens
atatatatatatgcaagc

SEQ ID NO: 154063 - DNA, 19 bp, Homo sapiens
agctgggcagtcggggaga

SEQ ID NO: 154064 - DNA, 23 bp, Homo sapiens
ctatctctgtccctcactgcctg

SEQ ID NO: 154065 - DNA, 23 bp, Homo sapiens
gatttttgtttatctagaaaagt

SEQ ID NO: 154066 - DNA, 23 bp, Homo sapiens
cggagtctcactctgtcacccag

SEQ ID NO: 154067 - DNA, 20 bp, Homo sapiens
agtcctagctactcaggagg

SEQ ID NO: 154068 - DNA, 19 bp, Homo sapiens
tacagtgctgtgatcatag

SEQ ID NO: 154069 - DNA, 20 bp, Homo sapiens
tctgagaggcagaggttgca

SEQ ID NO: 154070 - DNA, 23 bp, Homo sapiens
tgaggtaggagaatgtcatgaac

SEQ ID NO: 154071 - DNA, 23 bp, Homo sapiens
gagtctctcactgtgtcacccag

SEQ ID NO: 154072 - DNA, 22 bp, Homo sapiens
ttgtatagtttagtaaaagcta

SEQ ID NO: 154073 - DNA, 23 bp, Homo sapiens
cagaatctcactctgtcactcag

SEQ ID NO: 154074 - DNA, 23 bp, Homo sapiens
ggagtctcactctgtcacccagg

SEQ ID NO: 154075 - DNA, 22 bp, Homo sapiens
tgagtagactgtaataattgtt

SEQ ID NO: 154076 - DNA, 23 bp, Homo sapiens
acaagagtctcgctctgtcaccc

SEQ ID NO: 154077 - DNA, 23 bp, Homo sapiens
agtgtagtggcgtgatcttggct

SEQ ID NO: 154078 - DNA, 22 bp, Homo sapiens
ttaagacctgagtgaggagaca

SEQ ID NO: 154079 - DNA, 23 bp, Homo sapiens
tgagttcattgtagattctggat

SEQ ID NO: 154080 - DNA, 23 bp, Homo sapiens
tgagttcattgtagattctggat

SEQ ID NO: 154081 - DNA, 23 bp, Homo sapiens
atgtgtgtgtatatatatatgtg

SEQ ID NO: 154082 - DNA, 22 bp, Homo sapiens
tatgtatgcatatatatacata

SEQ ID NO: 154083 - DNA, 20 bp, Homo sapiens
agtctctgggatatggtgtg

SEQ ID NO: 154084 - DNA, 20 bp, Homo sapiens
cagtggagtctttctgtctg

SEQ ID NO: 154085 - DNA, 23 bp, Homo sapiens
ccagagtctcactctgtcaccag

SEQ ID NO: 154086 - DNA, 21 bp, Homo sapiens
gactggtaagataaagggctg

SEQ ID NO: 154087 - DNA, 23 bp, Homo sapiens
tcagctccagaatttctgcttga

SEQ ID NO: 154088 - DNA, 18 bp, Homo sapiens
tcagtctcttagttaaat

SEQ ID NO: 154089 - DNA, 23 bp, Homo sapiens
atctgatatgattctgagttcat

SEQ ID NO: 154090 - DNA, 23 bp, Homo sapiens
tgagttcattgtagattctggat

SEQ ID NO: 154091 - DNA, 23 bp, Homo sapiens
tgagttcattgtagattctggat

SEQ ID NO: 154092 - DNA, 23 bp, Homo sapiens
tctcagtcagtctctcattaacc

SEQ ID NO: 154093 - DNA, 23 bp, Homo sapiens
aggctcgctgtgtggctctgctt

SEQ ID NO: 154094 - DNA, 21 bp, Homo sapiens
cagacagccttatacctggca

SEQ ID NO: 154095 - DNA, 23 bp, Homo sapiens
agtcagtgtctcactctgttgcc

SEQ ID NO: 154096 - DNA, 23 bp, Homo sapiens
tgcatatgttctcctgaggaaca

SEQ ID NO: 154097 - DNA, 22 bp, Homo sapiens
actatggttctagatagaagaa

SEQ ID NO: 154098 - DNA, 23 bp, Homo sapiens
tgagttcattgtagattctggat

SEQ ID NO: 154099 - DNA, 23 bp, Homo sapiens
tgagttcattgtagattctggat

SEQ ID NO: 154100 - DNA, 23 bp, Homo sapiens
ttcagttggagaaaacctggaga

SEQ ID NO: 154101 - DNA, 23 bp, Homo sapiens
acagagtctcactctgtcgccca

SEQ ID NO: 154102 - DNA, 23 bp, Homo sapiens
atacacgtatatatacgtgtgtg

SEQ ID NO: 154103 - DNA, 23 bp, Homo sapiens
tctgtatttgttgtagagatggg

SEQ ID NO: 154104 - DNA, 21 bp, Homo sapiens
taacagagcgagactctgtct

SEQ ID NO: 154105 - DNA, 23 bp, Homo sapiens
aggtctcactctgtcactcagct

SEQ ID NO: 154106 - DNA, 18 bp, Homo sapiens
tatgtatgtatatatgta

SEQ ID NO: 154107 - DNA, 23 bp, Homo sapiens
agtagtcagcaggagcttcatgg

SEQ ID NO: 154108 - DNA, 21 bp, Homo sapiens
aggctggctgcctggttgcca

SEQ ID NO: 154109 - DNA, 20 bp, Homo sapiens
attgatccgacactctcacc

SEQ ID NO: 154110 - DNA, 22 bp, Homo sapiens
caaagtgactctgaactctgtt

SEQ ID NO: 154111 - DNA, 19 bp, Homo sapiens
agaggtctatgaccttgga

SEQ ID NO: 154112 - DNA, 23 bp, Homo sapiens
tgtatgtgtatatgtatatgtgt

SEQ ID NO: 154113 - DNA, 23 bp, Homo sapiens
gggtctcactctgtcacccaggc

SEQ ID NO: 154114 - DNA, 20 bp, Homo sapiens
cattctttttacttgtagtt

SEQ ID NO: 154115 - DNA, 22 bp, Homo sapiens
ccctgactgcctccctcattgc

SEQ ID NO: 154116 - DNA, 23 bp, Homo sapiens
agagtgtcactctgtcacccagg

SEQ ID NO: 154117 - DNA, 20 bp, Homo sapiens
tgtgtgtgtgtgtgtgtgtg

SEQ ID NO: 154118 - DNA, 23 bp, Homo sapiens
atacagtatatatatgtatgtat

SEQ ID NO: 154119 - DNA, 23 bp, Homo sapiens
tacagtatatatgtatgtatagt

SEQ ID NO: 154120 - DNA, 23 bp, Homo sapiens
atacagtatatatatgtatgtat

SEQ ID NO: 154121 - DNA, 23 bp, Homo sapiens
atacagtatatatatgtatgtat

SEQ ID NO: 154122 - DNA, 23 bp, Homo sapiens
tttaattttcaagttcttgctgc

SEQ ID NO: 154123 - DNA, 23 bp, Homo sapiens
tatgtgtatatgtattacagtgc

SEQ ID NO: 154124 - DNA, 23 bp, Homo sapiens
atgtgtatgtatacatgtatgta

SEQ ID NO: 154125 - DNA, 19 bp, Homo sapiens
tacacgtatgtatagaatg

SEQ ID NO: 154126 - DNA, 18 bp, Homo sapiens
gtcactctttcactcagc

SEQ ID NO: 154127 - DNA, 23 bp, Homo sapiens
tagtcagagcagtgacaggtcag

SEQ ID NO: 154128 - DNA, 23 bp, Homo sapiens
cccaaagtgctgggattacaggc

SEQ ID NO: 154129 - DNA, 22 bp, Homo sapiens
gtgcatgcctgtagttccagct

SEQ ID NO: 154130 - DNA, 23 bp, Homo sapiens
gatgactaatgatattgaacatc

SEQ ID NO: 154131 - DNA, 23 bp, Homo sapiens
tgagttcattgtagattctggat

SEQ ID NO: 154132 - DNA, 23 bp, Homo sapiens
tgagttcattgtagattctggat

SEQ ID NO: 154133 - DNA, 22 bp, Homo sapiens
gtatgtatgtactatgtggtat

SEQ ID NO: 154134 - DNA, 22 bp, Homo sapiens
aactcctatagatttgggtaac

SEQ ID NO: 154135 - DNA, 23 bp, Homo sapiens
agagacaggggtctcgctctgtc

SEQ ID NO: 154136 - DNA, 23 bp, Homo sapiens
atatgtatatatgtatgtatatg

SEQ ID NO: 154137 - DNA, 23 bp, Homo sapiens
tgtctgtgagtgtgtgtgtgtct

SEQ ID NO: 154138 - DNA, 18 bp, Homo sapiens
acaggaagtggttgctcc

SEQ ID NO: 154139 - DNA, 20 bp, Homo sapiens
atggggtttcaccatgttgg

SEQ ID NO: 154140 - DNA, 18 bp, Homo sapiens
agctagctgagattacag

SEQ ID NO: 154141 - DNA, 23 bp, Homo sapiens
agacagaatctcactctgtcacc

SEQ ID NO: 154142 - DNA, 23 bp, Homo sapiens
tgagttcattgtagattctggat

SEQ ID NO: 154143 - DNA, 23 bp, Homo sapiens
tgagttcattgtagattctggat

SEQ ID NO: 154144 - DNA, 19 bp, Homo sapiens
atgccttttatttctcttt

SEQ ID NO: 154145 - DNA, 23 bp, Homo sapiens
ttcctgtactaggttgaatagaa

SEQ ID NO: 154146 - DNA, 21 bp, Homo sapiens
tatgtgtatatacatatgtgt

SEQ ID NO: 154147 - DNA, 23 bp, Homo sapiens
ttggaagagtttgggaaatctgg

SEQ ID NO: 154148 - DNA, 22 bp, Homo sapiens
agtaaaagtcagtagtaaagac

SEQ ID NO: 154149 - DNA, 19 bp, Homo sapiens
tgcctggctgcctcaaggc

SEQ ID NO: 154150 - DNA, 20 bp, Homo sapiens
tctttagtcagtttgtggtg

SEQ ID NO: 154151 - DNA, 21 bp, Homo sapiens
agagcaaggagtttgatctgt

SEQ ID NO: 154152 - DNA, 23 bp, Homo sapiens
tgcaactttactgaatttgttta

SEQ ID NO: 154153 - DNA, 21 bp, Homo sapiens
taatgataaatgtttaaggtg

SEQ ID NO: 154154 - DNA, 23 bp, Homo sapiens
tgctttaggtagccagacagaac

SEQ ID NO: 154155 - DNA, 23 bp, Homo sapiens
actcactgtgttaatgtattaat

SEQ ID NO: 154156 - DNA, 18 bp, Homo sapiens
tgaattaatatgttgtat

SEQ ID NO: 154157 - DNA, 20 bp, Homo sapiens
tgtattgcttaggagacaca

SEQ ID NO: 154158 - DNA, 22 bp, Homo sapiens
tgatatctttgttgaaattgat

SEQ ID NO: 154159 - DNA, 18 bp, Homo sapiens
tagcatacttactaaagt

SEQ ID NO: 154160 - DNA, 21 bp, Homo sapiens
tgatattgatgaggaatgcat

SEQ ID NO: 154161 - DNA, 21 bp, Homo sapiens
actttctcagcaacacagtga

SEQ ID NO: 154162 - DNA, 23 bp, Homo sapiens
gacagagtctcgctctgtcaccc

SEQ ID NO: 154163 - DNA, 23 bp, Homo sapiens
gacagagtctcgctctgtcaccc

SEQ ID NO: 154164 - DNA, 18 bp, Homo sapiens
tgagatggagtctcactc

SEQ ID NO: 154165 - DNA, 19 bp, Homo sapiens
tgcaaggggtttgagtgtg

SEQ ID NO: 154166 - DNA, 19 bp, Homo sapiens
acaagactttgcctctaca

SEQ ID NO: 154167 - DNA, 23 bp, Homo sapiens
cagggtctcactctgtcgctctg

SEQ ID NO: 154168 - DNA, 18 bp, Homo sapiens
tgtgatcatggctcactg

SEQ ID NO: 154169 - DNA, 23 bp, Homo sapiens
tgggagacacagtgactctgtct

SEQ ID NO: 154170 - DNA, 19 bp, Homo sapiens
agtctcactctgtctccgc

SEQ ID NO: 154171 - DNA, 18 bp, Homo sapiens
tcacaacagcctgatgag

SEQ ID NO: 154172 - DNA, 20 bp, Homo sapiens
agagtgagaccttgtgttga

SEQ ID NO: 154173 - DNA, 20 bp, Homo sapiens
ctcacacctgtaatctcagc

SEQ ID NO: 154174 - DNA, 23 bp, Homo sapiens
gacagagtctcgctctgtcaccc

SEQ ID NO: 154175 - DNA, 23 bp, Homo sapiens
acagagtctcgctctgtcaccca

SEQ ID NO: 154176 - DNA, 21 bp, Homo sapiens
tgagtgggtgcagagtgtgaa

SEQ ID NO: 154177 - DNA, 23 bp, Homo sapiens
tggagtctcactctgtcacccag

SEQ ID NO: 154178 - DNA, 23 bp, Homo sapiens
agacagggtctcactctgtcacc

SEQ ID NO: 154179 - DNA, 23 bp, Homo sapiens
tgagacagagtcacgctctgtca

SEQ ID NO: 154180 - DNA, 23 bp, Homo sapiens
acggagtctcagtctgtcaccca

SEQ ID NO: 154181 - DNA, 23 bp, Homo sapiens
tatttgtttttctgcattctgtt

SEQ ID NO: 154182 - DNA, 23 bp, Homo sapiens
tggagtctcactctgtcacccag

SEQ ID NO: 154183 - DNA, 23 bp, Homo sapiens
cggtctcactctgtcacccaggc

SEQ ID NO: 154184 - DNA, 20 bp, Homo sapiens
tatctgatttttttcctgga

SEQ ID NO: 154185 - DNA, 22 bp, Homo sapiens
aaaaggcagagggtctattgag

SEQ ID NO: 154186 - DNA, 19 bp, Homo sapiens
atctgtatttctatatctg

SEQ ID NO: 154187 - DNA, 23 bp, Homo sapiens
tttgttttctgagagtattgaga

SEQ ID NO: 154188 - DNA, 19 bp, Homo sapiens
ttttgagacggagtctcac

SEQ ID NO: 154189 - DNA, 23 bp, Homo sapiens
tctgtgggcactgtgtgtctgtc

SEQ ID NO: 154190 - DNA, 23 bp, Homo sapiens
cagtctcactcactgctctgtct

SEQ ID NO: 154191 - DNA, 23 bp, Homo sapiens
agcacagagaacagagtctgctg

SEQ ID NO: 154192 - DNA, 23 bp, Homo sapiens
ttctgtgccaggccttgttctga

SEQ ID NO: 154193 - DNA, 23 bp, Homo sapiens
ctgtgggagtcacagattcagca

SEQ ID NO: 154194 - DNA, 18 bp, Homo sapiens
tgagtggattgagtgtgg

SEQ ID NO: 154195 - DNA, 19 bp, Homo sapiens
tgcctagtgacttgcttct

SEQ ID NO: 154196 - DNA, 23 bp, Homo sapiens
tctctctttctctctgctagttt

SEQ ID NO: 154197 - DNA, 22 bp, Homo sapiens
agaggaaggggaatcactcact

SEQ ID NO: 154198 - DNA, 23 bp, Homo sapiens
gacagagtctcgctctgtcaccc

SEQ ID NO: 154199 - DNA, 23 bp, Homo sapiens
acagtagagaccttggggtgtgt

SEQ ID NO: 154200 - DNA, 23 bp, Homo sapiens
actccctcagtctctcactgtgc

SEQ ID NO: 154201 - DNA, 23 bp, Homo sapiens
ccgagtctcgctctgtcacccag

SEQ ID NO: 154202 - DNA, 23 bp, Homo sapiens
tcacttgagcccaagagttagag

SEQ ID NO: 154203 - DNA, 22 bp, Homo sapiens
ttccatcttcaaagcctgcaat

SEQ ID NO: 154204 - DNA, 23 bp, Homo sapiens
ctgtgacactgactcttttgcct

SEQ ID NO: 154205 - DNA, 21 bp, Homo sapiens
acagtcagggagttctttctc

SEQ ID NO: 154206 - DNA, 18 bp, Homo sapiens
actctgcctttctgtcac

SEQ ID NO: 154207 - DNA, 23 bp, Homo sapiens
tgagagatctcactgtccagacg

SEQ ID NO: 154208 - DNA, 20 bp, Homo sapiens
ttacagtgttaagttacccg

SEQ ID NO: 154209 - DNA, 23 bp, Homo sapiens
atcacagagaccacacatggaga

SEQ ID NO: 154210 - DNA, 23 bp, Homo sapiens
gttttgtaatctccatgcattcg

SEQ ID NO: 154211 - DNA, 21 bp, Homo sapiens
cagaaaggatttgtctgtggg

SEQ ID NO: 154212 - DNA, 22 bp, Homo sapiens
gtgcgggtgtggcagggtctgt

SEQ ID NO: 154213 - DNA, 20 bp, Homo sapiens
ggcagggagggaggctggct

SEQ ID NO: 154214 - DNA, 23 bp, Homo sapiens
acagaatctcactctgtcaccca

SEQ ID NO: 154215 - DNA, 18 bp, Homo sapiens
cagtggaaagatcttgtc

SEQ ID NO: 154216 - DNA, 22 bp, Homo sapiens
tgtgtgtgagtccttttttttt

SEQ ID NO: 154217 - DNA, 23 bp, Homo sapiens
gacagagtctcgctctgtcaccc

SEQ ID NO: 154218 - DNA, 19 bp, Homo sapiens
agagaacagagagagccct

SEQ ID NO: 154219 - DNA, 23 bp, Homo sapiens
acactgtctctgtctctgtccca

SEQ ID NO: 154220 - DNA, 21 bp, Homo sapiens
tgctccaaaagtatagtcata

SEQ ID NO: 154221 - DNA, 20 bp, Homo sapiens
aacatgtttgtatttcatta

SEQ ID NO: 154222 - DNA, 22 bp, Homo sapiens
atatatggacatgttctggatc

SEQ ID NO: 154223 - DNA, 23 bp, Homo sapiens
tgtgtgtatatgtatgtgtctgt

SEQ ID NO: 154224 - DNA, 20 bp, Homo sapiens
tatatgcacacacacatagg

SEQ ID NO: 154225 - DNA, 23 bp, Homo sapiens
tatatagctgtatatatagttat

SEQ ID NO: 154226 - DNA, 22 bp, Homo sapiens
atatgtgtatatatatatgtag

SEQ ID NO: 154227 - DNA, 22 bp, Homo sapiens
atactacatatgtatacatgtg

SEQ ID NO: 154228 - DNA, 21 bp, Homo sapiens
atttatctgtgtatatgtata

SEQ ID NO: 154229 - DNA, 23 bp, Homo sapiens
tcagaggattgatgtttgagtaa

SEQ ID NO: 154230 - DNA, 19 bp, Homo sapiens
atggctctagttctttatt

SEQ ID NO: 154231 - DNA, 23 bp, Homo sapiens
tgcctcactctctctcttcaagc

SEQ ID NO: 154232 - DNA, 19 bp, Homo sapiens
tgtgtgcatgtatgtatat

SEQ ID NO: 154233 - DNA, 23 bp, Homo sapiens
tacatatgtgtgcgtatatgtat

SEQ ID NO: 154234 - DNA, 23 bp, Homo sapiens
gtgtatatgtatgtgtatgtata

SEQ ID NO: 154235 - DNA, 23 bp, Homo sapiens
tatgtgtatatatatgtgtgtgt

SEQ ID NO: 154236 - DNA, 23 bp, Homo sapiens
atatgtatatatatatatgtgtg

SEQ ID NO: 154237 - DNA, 22 bp, Homo sapiens
tctgggtctagtgttttctgtt

SEQ ID NO: 154238 - DNA, 23 bp, Homo sapiens
tagtgattttcttcttatatcac

SEQ ID NO: 154239 - DNA, 20 bp, Homo sapiens
tatgaacagatttcctagcc

SEQ ID NO: 154240 - DNA, 23 bp, Homo sapiens
tacacatacacatatacatgttt

SEQ ID NO: 154241 - DNA, 23 bp, Homo sapiens
tggagtctcactctgtcacccag

SEQ ID NO: 154242 - DNA, 23 bp, Homo sapiens
tgacagagtgagactctgtctct

SEQ ID NO: 154243 - DNA, 19 bp, Homo sapiens
tgtgttgaaaataaactgt

SEQ ID NO: 154244 - DNA, 23 bp, Homo sapiens
atgtatgctcagtgtgtattggg

SEQ ID NO: 154245 - DNA, 23 bp, Homo sapiens
agcatgcttgaacaggactcact

SEQ ID NO: 154246 - DNA, 23 bp, Homo sapiens
gtctgcctgcctgtctgccactc

SEQ ID NO: 154247 - DNA, 23 bp, Homo sapiens
tatcacaggatgatttgaagtcg

SEQ ID NO: 154248 - DNA, 23 bp, Homo sapiens
aattctgggagtaaaactgttgt

SEQ ID NO: 154249 - DNA, 23 bp, Homo sapiens
actggagtataattatctgttgt

SEQ ID NO: 154250 - DNA, 18 bp, Homo sapiens
tcagtagtgctgactgag

SEQ ID NO: 154251 - DNA, 22 bp, Homo sapiens
tagtttgtaatcaagattccag

SEQ ID NO: 154252 - DNA, 23 bp, Homo sapiens
gggtgtctctggatgggattagc

SEQ ID NO: 154253 - DNA, 19 bp, Homo sapiens
gtgtgttgtgtgtatgtgt

SEQ ID NO: 154254 - DNA, 23 bp, Homo sapiens
acacatacacacacacatatggg

SEQ ID NO: 154255 - DNA, 23 bp, Homo sapiens
tataactgagtatagatgttgga

SEQ ID NO: 154256 - DNA, 23 bp, Homo sapiens
atatatgtgtatatgtatatatg

SEQ ID NO: 154257 - DNA, 23 bp, Homo sapiens
atatgtatgtatacatgtatatg

SEQ ID NO: 154258 - DNA, 20 bp, Homo sapiens
ttgggtgtagttgtaggtca

SEQ ID NO: 154259 - DNA, 23 bp, Homo sapiens
actgaattctaatgtatgaatat

SEQ ID NO: 154260 - DNA, 23 bp, Homo sapiens
taagtgtgtatatgtatatgtgt

SEQ ID NO: 154261 - DNA, 20 bp, Homo sapiens
agtctcgctctgtcgctcag

SEQ ID NO: 154262 - DNA, 23 bp, Homo sapiens
cggagtctcgctctgtcgctcag

SEQ ID NO: 154263 - DNA, 18 bp, Homo sapiens
tgagtgatagtgagaggt

SEQ ID NO: 154264 - DNA, 20 bp, Homo sapiens
tggcagtcctcacagacctc

SEQ ID NO: 154265 - DNA, 23 bp, Homo sapiens
ttatgtgtgtaagtgtatatgta

SEQ ID NO: 154266 - DNA, 23 bp, Homo sapiens
tatgtgcatatatatatgtgtgt

SEQ ID NO: 154267 - DNA, 20 bp, Homo sapiens
aaggacagtgagttacatct

SEQ ID NO: 154268 - DNA, 20 bp, Homo sapiens
tgtatgtatgtatatatgta

SEQ ID NO: 154269 - DNA, 23 bp, Homo sapiens
aagtcacagaagagagtctggag

SEQ ID NO: 154270 - DNA, 22 bp, Homo sapiens
tatatgatatatatgatatcat

SEQ ID NO: 154271 - DNA, 23 bp, Homo sapiens
tatacacacacatatatatctgt

SEQ ID NO: 154272 - DNA, 23 bp, Homo sapiens
tatgtgtgtgtatatatatacac

SEQ ID NO: 154273 - DNA, 23 bp, Homo sapiens
catatgtgtatatatatacacat

SEQ ID NO: 154274 - DNA, 21 bp, Homo sapiens
tatgtatatatacatatgtgt

SEQ ID NO: 154275 - DNA, 22 bp, Homo sapiens
tgaaaggttgatttttggtctt

SEQ ID NO: 154276 - DNA, 20 bp, Homo sapiens
tttcaatttggcattgattt

SEQ ID NO: 154277 - DNA, 23 bp, Homo sapiens
tgtacttgtcagaagatggagag

SEQ ID NO: 154278 - DNA, 23 bp, Homo sapiens
acagagtaggtgctcaataaatg

SEQ ID NO: 154279 - DNA, 22 bp, Homo sapiens
gagtgtcactccgtcactcagg

SEQ ID NO: 154280 - DNA, 23 bp, Homo sapiens
tagagtgaagtggcagggtcata

SEQ ID NO: 154281 - DNA, 23 bp, Homo sapiens
gtttgcctctgtccttacgtggt

SEQ ID NO: 154282 - DNA, 21 bp, Homo sapiens
tgtgtgggagtgtattatctt

SEQ ID NO: 154283 - DNA, 23 bp, Homo sapiens
atatatctatatgtacatgtatc

SEQ ID NO: 154284 - DNA, 18 bp, Homo sapiens
agagagaagagactgagg

SEQ ID NO: 154285 - DNA, 23 bp, Homo sapiens
tattctttgaataagaaaagaaa

SEQ ID NO: 154286 - DNA, 23 bp, Homo sapiens
tcaagtctggaaattgattgagg

SEQ ID NO: 154287 - DNA, 23 bp, Homo sapiens
attcaagttagacttgtgttcac

SEQ ID NO: 154288 - DNA, 22 bp, Homo sapiens
tatctcaatgtttatgtatgaa

SEQ ID NO: 154289 - DNA, 23 bp, Homo sapiens
gtatgtatgtatgtatgtatgta

SEQ ID NO: 154290 - DNA, 22 bp, Homo sapiens
agagtctcgctctgtcacccag

SEQ ID NO: 154291 - DNA, 23 bp, Homo sapiens
atacacacacacgcgtgtgtgca

SEQ ID NO: 154292 - DNA, 21 bp, Homo sapiens
aaaaccagggcatttcttgtt

SEQ ID NO: 154293 - DNA, 23 bp, Homo sapiens
gtggttcctgagtgagaaaggtg

SEQ ID NO: 154294 - DNA, 20 bp, Homo sapiens
acacagctattaactggaaa

SEQ ID NO: 154295 - DNA, 23 bp, Homo sapiens
ggagactctgcattatgattcaa

SEQ ID NO: 154296 - DNA, 20 bp, Homo sapiens
tatgtatatatacatgtaca

SEQ ID NO: 154297 - DNA, 23 bp, Homo sapiens
cggagtctcgctctgtcgctcag

SEQ ID NO: 154298 - DNA, 20 bp, Homo sapiens
tgtatgtatatatatgtatg

SEQ ID NO: 154299 - DNA, 18 bp, Homo sapiens
tatgtgtgtgtatacaca

SEQ ID NO: 154300 - DNA, 23 bp, Homo sapiens
tgagttcattgtagattctggat

SEQ ID NO: 154301 - DNA, 23 bp, Homo sapiens
tgagttcattgtagattctggat

SEQ ID NO: 154302 - DNA, 20 bp, Homo sapiens
catggttttgaaatgtaaaa

SEQ ID NO: 154303 - DNA, 18 bp, Homo sapiens
agagaccctggaagtggg

SEQ ID NO: 154304 - DNA, 23 bp, Homo sapiens
gaaatgaagtctgaaattctttt

SEQ ID NO: 154305 - DNA, 22 bp, Homo sapiens
tcacagtactcatacagagctt

SEQ ID NO: 154306 - DNA, 23 bp, Homo sapiens
tgcttggcacagtttgtggtgtg

SEQ ID NO: 154307 - DNA, 23 bp, Homo sapiens
acggagtctcgctctgtcaccca

SEQ ID NO: 154308 - DNA, 22 bp, Homo sapiens
taggatgtagaatgtcagctgt

SEQ ID NO: 154309 - DNA, 21 bp, Homo sapiens
tcaagcaacgttaagaagtct

SEQ ID NO: 154310 - DNA, 23 bp, Homo sapiens
tcacagttgattctgagcacctt

SEQ ID NO: 154311 - DNA, 21 bp, Homo sapiens
aaggtgtcagcttctcttctg

SEQ ID NO: 154312 - DNA, 22 bp, Homo sapiens
atgtgcatatatgtatatatgt

SEQ ID NO: 154313 - DNA, 22 bp, Homo sapiens
tgagatcaaggtgtcagcaggt

SEQ ID NO: 154314 - DNA, 23 bp, Homo sapiens
aaagctctctctgaacacaggga

SEQ ID NO: 154315 - DNA, 18 bp, Homo sapiens
tgcattgttcctgtgtct

SEQ ID NO: 154316 - DNA, 20 bp, Homo sapiens
atctgactgaagcctgagag

SEQ ID NO: 154317 - DNA, 21 bp, Homo sapiens
aattgtctagtcccaggtctg

SEQ ID NO: 154318 - DNA, 22 bp, Homo sapiens
agtgaaccatgatcatgccact

SEQ ID NO: 154319 - DNA, 21 bp, Homo sapiens
agacaactaacagtgtacctc

SEQ ID NO: 154320 - DNA, 23 bp, Homo sapiens
tctctctggaattgttttggaag

SEQ ID NO: 154321 - DNA, 23 bp, Homo sapiens
atagagcagactgagctcacaga

SEQ ID NO: 154322 - DNA, 23 bp, Homo sapiens
tgttgcagtggctctctctggct

SEQ ID NO: 154323 - DNA, 22 bp, Homo sapiens
atcttgcaaataaagcagtaac

SEQ ID NO: 154324 - DNA, 23 bp, Homo sapiens
ctgtcattctgtgtctctctgcc

SEQ ID NO: 154325 - DNA, 23 bp, Homo sapiens
gtgaggctctgactgtggctctg

SEQ ID NO: 154326 - DNA, 23 bp, Homo sapiens
actgagtctcactctgtcgccca

SEQ ID NO: 154327 - DNA, 23 bp, Homo sapiens
atttcagaacagtgacagcagag

SEQ ID NO: 154328 - DNA, 21 bp, Homo sapiens
tatgtaggaggatgtatagat

SEQ ID NO: 154329 - DNA, 21 bp, Homo sapiens
tagctctgtgaacactgtgag

SEQ ID NO: 154330 - DNA, 23 bp, Homo sapiens
gggtctcactctgtcacccaggc

SEQ ID NO: 154331 - DNA, 23 bp, Homo sapiens
tgagttcattgtagattctggat

SEQ ID NO: 154332 - DNA, 23 bp, Homo sapiens
tgagttcattgtagattctggat

SEQ ID NO: 154333 - DNA, 23 bp, Homo sapiens
tgagttcattgtagattctggat

SEQ ID NO: 154334 - DNA, 23 bp, Homo sapiens
tgagttcattgtagattctggat

SEQ ID NO: 154335 - DNA, 21 bp, Homo sapiens
actgtgaggagagacagagaa

SEQ ID NO: 154336 - DNA, 20 bp, Homo sapiens
tgtctgtgtttgtgtctccc

SEQ ID NO: 154337 - DNA, 19 bp, Homo sapiens
tgactgaagaaacagaggc

SEQ ID NO: 154338 - DNA, 23 bp, Homo sapiens
gccagggtcactgtgtcactcag

SEQ ID NO: 154339 - DNA, 23 bp, Homo sapiens
agtacttactctgggccagacag

SEQ ID NO: 154340 - DNA, 23 bp, Homo sapiens
agactctcaccctgtcttccagg

SEQ ID NO: 154341 - DNA, 23 bp, Homo sapiens
tctctgtgcctctgtgtcttcac

SEQ ID NO: 154342 - DNA, 23 bp, Homo sapiens
tggagtctcactctgtcacccag

SEQ ID NO: 154343 - DNA, 20 bp, Homo sapiens
tctgcttggcttagtggctg

SEQ ID NO: 154344 - DNA, 23 bp, Homo sapiens
gactgagtctcgctctgtcaccc

SEQ ID NO: 154345 - DNA, 23 bp, Homo sapiens
tgcagtggcatgatcttggctca

SEQ ID NO: 154346 - DNA, 18 bp, Homo sapiens
catgtccaggcactgcac

SEQ ID NO: 154347 - DNA, 18 bp, Homo sapiens
ttggagtgcagaggcatc

SEQ ID NO: 154348 - DNA, 19 bp, Homo sapiens
tttgatcatgaatcctctt

SEQ ID NO: 154349 - DNA, 21 bp, Homo sapiens
atggagagtggaaaagacgat

SEQ ID NO: 154350 - DNA, 23 bp, Homo sapiens
tgtatgtctctgtggaatacacg

SEQ ID NO: 154351 - DNA, 21 bp, Homo sapiens
tgtcactcaggctgaagtgtg

SEQ ID NO: 154352 - DNA, 19 bp, Homo sapiens
tatggatatgtatatatat

SEQ ID NO: 154353 - DNA, 18 bp, Homo sapiens
tatccatatatatagata

SEQ ID NO: 154354 - DNA, 19 bp, Homo sapiens
tttcacaatgatgagactt

SEQ ID NO: 154355 - DNA, 23 bp, Homo sapiens
tgaatttagagctgtgtgccttt

SEQ ID NO: 154356 - DNA, 22 bp, Homo sapiens
taacagagcctttaggataaat

SEQ ID NO: 154357 - DNA, 22 bp, Homo sapiens
agcacctgcttctgctgggtga

SEQ ID NO: 154358 - DNA, 23 bp, Homo sapiens
ggctctctctgtctctctcatga

SEQ ID NO: 154359 - DNA, 23 bp, Homo sapiens
gtcaggctctctgtttcatagtt

SEQ ID NO: 154360 - DNA, 22 bp, Homo sapiens
caggggtagaagaagcagcaga

SEQ ID NO: 154361 - DNA, 23 bp, Homo sapiens
attgctaatgtatagaaatacaa

SEQ ID NO: 154362 - DNA, 23 bp, Homo sapiens
agacggagtctctgtctgtcacc

SEQ ID NO: 154363 - DNA, 23 bp, Homo sapiens
acagagaagtcagtgtgcttctg

SEQ ID NO: 154364 - DNA, 22 bp, Homo sapiens
aaggaccacacgtagttccaca

SEQ ID NO: 154365 - DNA, 22 bp, Homo sapiens
gcatcagacagtgggaccatgt

SEQ ID NO: 154366 - DNA, 20 bp, Homo sapiens
cacacgcagcttagaagtgg

SEQ ID NO: 154367 - DNA, 22 bp, Homo sapiens
ttgtgtctccttagggtcctct

SEQ ID NO: 154368 - DNA, 21 bp, Homo sapiens
tggactacttgtttctttatt

SEQ ID NO: 154369 - DNA, 20 bp, Homo sapiens
tcaggtggagtaaaatagca

SEQ ID NO: 154370 - DNA, 21 bp, Homo sapiens
aaactgttggatttggcacag

SEQ ID NO: 154371 - DNA, 18 bp, Homo sapiens
gctgacaggctaagctga

SEQ ID NO: 154372 - DNA, 23 bp, Homo sapiens
gacagttgagagggagctgattc

SEQ ID NO: 154373 - DNA, 22 bp, Homo sapiens
ttgacatgtgtatctgttcatg

SEQ ID NO: 154374 - DNA, 23 bp, Homo sapiens
atatatatgtgtatatgtatgta

SEQ ID NO: 154375 - DNA, 18 bp, Homo sapiens
tatgtgtgtgtatatata

SEQ ID NO: 154376 - DNA, 23 bp, Homo sapiens
agcagagtgaagacggtgtccac

SEQ ID NO: 154377 - DNA, 23 bp, Homo sapiens
accatgtgtggttagctcagttg

SEQ ID NO: 154378 - DNA, 21 bp, Homo sapiens
tttttgagacaggaactcact

SEQ ID NO: 154379 - DNA, 21 bp, Homo sapiens
tttcatagagatgggtgtctt

SEQ ID NO: 154380 - DNA, 23 bp, Homo sapiens
tgtgtctgtgtggatctgatttc

SEQ ID NO: 154381 - DNA, 20 bp, Homo sapiens
tgtgagttcacagccagcag

SEQ ID NO: 154382 - DNA, 23 bp, Homo sapiens
gtgtgcctgtagtctcagctact

SEQ ID NO: 154383 - DNA, 23 bp, Homo sapiens
tgagttcattgtagattctggat

SEQ ID NO: 154384 - DNA, 23 bp, Homo sapiens
tgagttcattgtagattctggat

SEQ ID NO: 154385 - DNA, 23 bp, Homo sapiens
gtttctctgtctctgaaatgggt

SEQ ID NO: 154386 - DNA, 20 bp, Homo sapiens
gctgtatctacagggctttg

SEQ ID NO: 154387 - DNA, 23 bp, Homo sapiens
ctctctgtctgactgctgatcgt

SEQ ID NO: 154388 - DNA, 22 bp, Homo sapiens
tcactgccactcacagggcctg

SEQ ID NO: 154389 - DNA, 21 bp, Homo sapiens
aatgtgacaaggtttaaagtc

SEQ ID NO: 154390 - DNA, 22 bp, Homo sapiens
gaaagattacatgttttcctgt

SEQ ID NO: 154391 - DNA, 21 bp, Homo sapiens
atgtcagaagaaagtgagccc

SEQ ID NO: 154392 - DNA, 18 bp, Homo sapiens
atgtatgtatagatgtat

SEQ ID NO: 154393 - DNA, 19 bp, Homo sapiens
tttgcttatatatatgtgt

SEQ ID NO: 154394 - DNA, 23 bp, Homo sapiens
agtctgaagacagtctagaggca

SEQ ID NO: 154395 - DNA, 23 bp, Homo sapiens
taagtgtgagaaaaagctgttcc

SEQ ID NO: 154396 - DNA, 23 bp, Homo sapiens
cgggtctcactctcagcctctgc

SEQ ID NO: 154397 - DNA, 22 bp, Homo sapiens
gacgctcactcagtggctctcc

SEQ ID NO: 154398 - DNA, 18 bp, Homo sapiens
gaacttgaagaaggctga

SEQ ID NO: 154399 - DNA, 23 bp, Homo sapiens
gtgtgtgtgtgtatgtgtctgtg

SEQ ID NO: 154400 - DNA, 23 bp, Homo sapiens
caggtatggaaatcagagcaata

SEQ ID NO: 154401 - DNA, 23 bp, Homo sapiens
ccactctcactgaactgagtgag

SEQ ID NO: 154402 - DNA, 19 bp, Homo sapiens
tctcactctgtcatccagg

SEQ ID NO: 154403 - DNA, 23 bp, Homo sapiens
tctcacacagaaatcgcacccgt

SEQ ID NO: 154404 - DNA, 23 bp, Homo sapiens
tcagtctccatctgtaaggcatc

SEQ ID NO: 154405 - DNA, 23 bp, Homo sapiens
tgggagacttctcattttgttct

SEQ ID NO: 154406 - DNA, 23 bp, Homo sapiens
atctatggttttatatctggtgg

SEQ ID NO: 154407 - DNA, 23 bp, Homo sapiens
gacagtctcgctctgtcacccag

SEQ ID NO: 154408 - DNA, 23 bp, Homo sapiens
agagtctcactctgtcacccagg

SEQ ID NO: 154409 - DNA, 22 bp, Homo sapiens
agtgagccatatttttgttttg

SEQ ID NO: 154410 - DNA, 23 bp, Homo sapiens
taagtgaatcttgtgcctcagcc

SEQ ID NO: 154411 - DNA, 23 bp, Homo sapiens
tctgcaactgtgtctctctcagc

SEQ ID NO: 154412 - DNA, 23 bp, Homo sapiens
tccagctcctatatgatgccttt

SEQ ID NO: 154413 - DNA, 23 bp, Homo sapiens
aaaaggtctcgctgtgatcactg

SEQ ID NO: 154414 - DNA, 23 bp, Homo sapiens
tcggatccgtctgagcttggctg

SEQ ID NO: 154415 - DNA, 23 bp, Homo sapiens
actccatttgttttgatgatgga

SEQ ID NO: 154416 - DNA, 21 bp, Homo sapiens
tccatcatcgtctcaaatgag

SEQ ID NO: 154417 - DNA, 23 bp, Homo sapiens
tggtttaccgtcccacatacatt

SEQ ID NO: 154418 - DNA, 22 bp, Homo sapiens
gcacattacacggtcgacctct

SEQ ID NO: 154419 - DNA, 21 bp, Homo sapiens
taggttatccgtgttgccttc

SEQ ID NO: 154420 - DNA, 23 bp, Homo sapiens
actctgtctctctctctgccacc

SEQ ID NO: 154421 - DNA, 23 bp, Homo sapiens
acttgtctgtctctctctgggat

SEQ ID NO: 154422 - DNA, 23 bp, Homo sapiens
tccctgtgtgcgtgtctgtgtcc

SEQ ID NO: 154423 - DNA, 22 bp, Homo sapiens
tggcactggtttctctctgtct

SEQ ID NO: 154424 - DNA, 23 bp, Homo sapiens
gacagagtctcgctctgtcaccc

SEQ ID NO: 154425 - DNA, 23 bp, Homo sapiens
ctggctgtctcgctgagtcgcgg

SEQ ID NO: 154426 - DNA, 23 bp, Homo sapiens
gcgtcagactctcgctcagtcgt

SEQ ID NO: 154427 - DNA, 23 bp, Homo sapiens
gctcaaatctgtctctctgtgct

SEQ ID NO: 154428 - DNA, 19 bp, Homo sapiens
tcacttcaccaacttgtat

SEQ ID NO: 154429 - DNA, 23 bp, Homo sapiens
tctgatgctctctctctctctct

SEQ ID NO: 154430 - DNA, 20 bp, Homo sapiens
tggcatgatctcggcttact

SEQ ID NO: 154431 - DNA, 23 bp, Homo sapiens
tgatgacagtgcagagagtcctg

SEQ ID NO: 154432 - DNA, 21 bp, Homo sapiens
acagcctctgtcactctctcg

SEQ ID NO: 154433 - DNA, 22 bp, Homo sapiens
tgtgtgtgtgtttgtacagact

SEQ ID NO: 154434 - DNA, 23 bp, Homo sapiens
cggagtctcactctgtcacccag

SEQ ID NO: 154435 - DNA, 23 bp, Homo sapiens
gagtctcactctgtcacccaggc

SEQ ID NO: 154436 - DNA, 22 bp, Homo sapiens
agtctcgctctgtcactcaggc

SEQ ID NO: 154437 - DNA, 23 bp, Homo sapiens
gtgcacacttgtcagagtgtgtc

SEQ ID NO: 154438 - DNA, 18 bp, Homo sapiens
tggctgcctgaagttctg

SEQ ID NO: 154439 - DNA, 23 bp, Homo sapiens
tgtcaccctcactgcctggtttc

SEQ ID NO: 154440 - DNA, 23 bp, Homo sapiens
tgaatgagcagcttgtcctgggt

SEQ ID NO: 154441 - DNA, 23 bp, Homo sapiens
agacggagtctcgctctgtcact

SEQ ID NO: 154442 - DNA, 23 bp, Homo sapiens
ctgagtctcgcactgtctcccag

SEQ ID NO: 154443 - DNA, 20 bp, Homo sapiens
tatatgcatattttatgtat

SEQ ID NO: 154444 - DNA, 23 bp, Homo sapiens
tccgtggtagtcacctgagtgtc

SEQ ID NO: 154445 - DNA, 22 bp, Homo sapiens
atggagtctcactctgtcaccc

SEQ ID NO: 154446 - DNA, 23 bp, Homo sapiens
acacagtgagacttaattgctac

SEQ ID NO: 154447 - DNA, 23 bp, Homo sapiens
tggagtctcactctgtcacccag

SEQ ID NO: 154448 - DNA, 23 bp, Homo sapiens
gacacggagtctcactctgtcgc

SEQ ID NO: 154449 - DNA, 18 bp, Homo sapiens
tcactgtgtgcacttggg

SEQ ID NO: 154450 - DNA, 22 bp, Homo sapiens
ggagtctcactctgtcacccag

SEQ ID NO: 154451 - DNA, 23 bp, Homo sapiens
actctgtcacccagactagagtg

SEQ ID NO: 154452 - DNA, 23 bp, Homo sapiens
tgagacagtctcattctgtcacc

SEQ ID NO: 154453 - DNA, 23 bp, Homo sapiens
tctgtgtgtgtctctgtagggtg

SEQ ID NO: 154454 - DNA, 23 bp, Homo sapiens
ctgagactcactctgtgccagac

SEQ ID NO: 154455 - DNA, 22 bp, Homo sapiens
taaattgtggtaatgaactgaa

SEQ ID NO: 154456 - DNA, 22 bp, Homo sapiens
tcttacagcaactgcttttgta

SEQ ID NO: 154457 - DNA, 18 bp, Homo sapiens
tgtgtgaggctttgtttt

SEQ ID NO: 154458 - DNA, 23 bp, Homo sapiens
ttggactgtgcagagtgtgcact

SEQ ID NO: 154459 - DNA, 23 bp, Homo sapiens
ctcgctctctctgagcctgtcat

SEQ ID NO: 154460 - DNA, 20 bp, Homo sapiens
tgtggtccctctccagactg

SEQ ID NO: 154461 - DNA, 19 bp, Homo sapiens
cagcttcagtatcctcagt

SEQ ID NO: 154462 - DNA, 23 bp, Homo sapiens
tgctcttttctctgtctctgagt

SEQ ID NO: 154463 - DNA, 22 bp, Homo sapiens
tattgactaggaccagagctca

SEQ ID NO: 154464 - DNA, 23 bp, Homo sapiens
ttttctctgtctctgagtccctg

SEQ ID NO: 154465 - DNA, 23 bp, Homo sapiens
ccgtggctctgtgactccgtggc

SEQ ID NO: 154466 - DNA, 23 bp, Homo sapiens
actgtgtctctcgcacagtaata

SEQ ID NO: 154467 - DNA, 20 bp, Homo sapiens
tgcaggagaccttcactgag

SEQ ID NO: 154468 - DNA, 23 bp, Homo sapiens
acagaggatttctctctcagtgt

SEQ ID NO: 154469 - DNA, 23 bp, Homo sapiens
tcaggggcagtttttgaactttg

SEQ ID NO: 154470 - DNA, 23 bp, Homo sapiens
actgtgtctctcgcacagtaata

SEQ ID NO: 154471 - DNA, 22 bp, Homo sapiens
tttgttctttttccttaggatt

SEQ ID NO: 154472 - DNA, 23 bp, Homo sapiens
cacacacagtgcctatattcccc

SEQ ID NO: 154473 - DNA, 23 bp, Homo sapiens
ttgttcacagaagacagagtcaa

SEQ ID NO: 154474 - DNA, 23 bp, Homo sapiens
ttgttcacagaagacagagtcaa

SEQ ID NO: 154475 - DNA, 23 bp, Homo sapiens
atgtttgcttgtctgagagaaga

SEQ ID NO: 154476 - DNA, 23 bp, Homo sapiens
ctgtgtctctcgcacagtaatac

SEQ ID NO: 154477 - DNA, 23 bp, Homo sapiens
gaggaatgtggttgttatgtgat

SEQ ID NO: 154478 - DNA, 23 bp, Homo sapiens
tgcctgtgtcactctctgccatt

SEQ ID NO: 154479 - DNA, 23 bp, Homo sapiens
tgactgttgagacagagctgaag

SEQ ID NO: 154480 - DNA, 22 bp, Homo sapiens
tgtcattgtgagtgaatcctgg

SEQ ID NO: 154481 - DNA, 23 bp, Homo sapiens
agagggatgtctcctggaattga

SEQ ID NO: 154482 - DNA, 21 bp, Homo sapiens
tacagttgtgtgatcatagct

SEQ ID NO: 154483 - DNA, 23 bp, Homo sapiens
actgtgggtctctctgttcacag

SEQ ID NO: 154484 - DNA, 23 bp, Homo sapiens
actgtgggtctctctgttcacag

SEQ ID NO: 154485 - DNA, 23 bp, Homo sapiens
cagggctcactgtgtgtctctct

SEQ ID NO: 154486 - DNA, 22 bp, Homo sapiens
gtcctgtcccaggtgcagctgc

SEQ ID NO: 154487 - DNA, 21 bp, Homo sapiens
ttgtgagaaggctttagtttt

SEQ ID NO: 154488 - DNA, 23 bp, Homo sapiens
agatctttttgtctgctcacagg

SEQ ID NO: 154489 - DNA, 22 bp, Homo sapiens
cagagtctttagaattttctat

SEQ ID NO: 154490 - DNA, 23 bp, Homo sapiens
ggtgtgtctgtgtgtctgtaacc

SEQ ID NO: 154491 - DNA, 22 bp, Homo sapiens
ggatgaagatgccgcggtgtgt

SEQ ID NO: 154492 - DNA, 23 bp, Homo sapiens
aaaagttctgtcacaggggcaga

SEQ ID NO: 154493 - DNA, 18 bp, Homo sapiens
atgtgtgtgtgcatatat

SEQ ID NO: 154494 - DNA, 21 bp, Homo sapiens
atgtgtgcttgtatgtattat

SEQ ID NO: 154495 - DNA, 23 bp, Homo sapiens
actgtgggtctctctgttcacag

SEQ ID NO: 154496 - DNA, 18 bp, Homo sapiens
tgtccacctggatcaaag

SEQ ID NO: 154497 - DNA, 22 bp, Homo sapiens
aggtgggaggatgacttgatcc

SEQ ID NO: 154498 - DNA, 23 bp, Homo sapiens
tgcagtgagtcatggctgtacca

SEQ ID NO: 154499 - DNA, 23 bp, Homo sapiens
actgggtctcactcactctgtgg

SEQ ID NO: 154500 - DNA, 20 bp, Homo sapiens
tctagttggacctctgtgac

SEQ ID NO: 154501 - DNA, 23 bp, Homo sapiens
gtgtgcatcacacaacctggatg

SEQ ID NO: 154502 - DNA, 23 bp, Homo sapiens
tatcccactgcatgaatagacca

SEQ ID NO: 154503 - DNA, 19 bp, Homo sapiens
gtggcatgatcttggctca

SEQ ID NO: 154504 - DNA, 21 bp, Homo sapiens
tcagctgagtgtgagcacagt

SEQ ID NO: 154505 - DNA, 23 bp, Homo sapiens
ctcactctgtctttcctgcctca

SEQ ID NO: 154506 - DNA, 22 bp, Homo sapiens
tgcctggctccctgcctggctc

SEQ ID NO: 154507 - DNA, 23 bp, Homo sapiens
tgagaccctgtgaccctcagagt

SEQ ID NO: 154508 - DNA, 18 bp, Homo sapiens
tcacagtgaagggcacac

SEQ ID NO: 154509 - DNA, 18 bp, Homo sapiens
cctgcctctcactctctc

SEQ ID NO: 154510 - DNA, 23 bp, Homo sapiens
ctgtgtgactctgagtccctggg

SEQ ID NO: 154511 - DNA, 23 bp, Homo sapiens
ggcacagtgttactctgatttct

SEQ ID NO: 154512 - DNA, 21 bp, Homo sapiens
acatgtgcacaatgtgcaggt

SEQ ID NO: 154513 - DNA, 21 bp, Homo sapiens
agattctgtctccaaaaaaaa

SEQ ID NO: 154514 - DNA, 23 bp, Homo sapiens
tgagacagtctcgctctgttgtc

SEQ ID NO: 154515 - DNA, 23 bp, Homo sapiens
tctgaagggtagtttgcagtatc

SEQ ID NO: 154516 - DNA, 23 bp, Homo sapiens
aaggtctctctctgtcacccagg

SEQ ID NO: 154517 - DNA, 21 bp, Homo sapiens
tgtgtgtatatatgtgtgtat

SEQ ID NO: 154518 - DNA, 23 bp, Homo sapiens
tttcaagatggagtctcgctctg

SEQ ID NO: 154519 - DNA, 18 bp, Homo sapiens
agtctcgctctgtcaccc

SEQ ID NO: 154520 - DNA, 23 bp, Homo sapiens
agatggagtctcgctctgtcacc

SEQ ID NO: 154521 - DNA, 23 bp, Homo sapiens
aagactagagattgagtttcttt

SEQ ID NO: 154522 - DNA, 23 bp, Homo sapiens
gaggcagagtctcactctgtcgc

SEQ ID NO: 154523 - DNA, 23 bp, Homo sapiens
tggatgtcacagtctctcattta

SEQ ID NO: 154524 - DNA, 23 bp, Homo sapiens
tgtctgtggctctgtgtcctggc

SEQ ID NO: 154525 - DNA, 23 bp, Homo sapiens
gcagtggcatgatcttggctcat

SEQ ID NO: 154526 - DNA, 23 bp, Homo sapiens
agggtctgagcttagcttgtgca

SEQ ID NO: 154527 - DNA, 23 bp, Homo sapiens
gagacggagtctggctctgtcac

SEQ ID NO: 154528 - DNA, 21 bp, Homo sapiens
tgccaggctcactgcttgcca

SEQ ID NO: 154529 - DNA, 19 bp, Homo sapiens
aaaagaattcagagaggga

SEQ ID NO: 154530 - DNA, 23 bp, Homo sapiens
gggtctcactctgtcacccaggc

SEQ ID NO: 154531 - DNA, 19 bp, Homo sapiens
agtctcactctgtcaccca

SEQ ID NO: 154532 - DNA, 23 bp, Homo sapiens
tggctgtgaccctggctgtctgg

SEQ ID NO: 154533 - DNA, 23 bp, Homo sapiens
gaggctcagtctgtgcctctggc

SEQ ID NO: 154534 - DNA, 23 bp, Homo sapiens
agagtctcgctcgctctgttgtc

SEQ ID NO: 154535 - DNA, 23 bp, Homo sapiens
ggagtctccctctgtcactaggc

SEQ ID NO: 154536 - DNA, 23 bp, Homo sapiens
ataaggttcttgtggtgctgatt

SEQ ID NO: 154537 - DNA, 22 bp, Homo sapiens
agtctcttggtccctgtgtctg

SEQ ID NO: 154538 - DNA, 23 bp, Homo sapiens
tttgagacggagtctcgctctgt

SEQ ID NO: 154539 - DNA, 23 bp, Homo sapiens
cgctctgtcacccagactggagt

SEQ ID NO: 154540 - DNA, 21 bp, Homo sapiens
tgaccctctctgggcctcaca

SEQ ID NO: 154541 - DNA, 19 bp, Homo sapiens
taggtgcatctgaatctgg

SEQ ID NO: 154542 - DNA, 21 bp, Homo sapiens
tgaggtaggagaatgttgtga

SEQ ID NO: 154543 - DNA, 23 bp, Homo sapiens
acagagtctcactctgtcgccca

SEQ ID NO: 154544 - DNA, 23 bp, Homo sapiens
tgtatgtatatatatatgtgtgt

SEQ ID NO: 154545 - DNA, 23 bp, Homo sapiens
ggtagagtctcactctgtcaccc

SEQ ID NO: 154546 - DNA, 19 bp, Homo sapiens
tcaggctggatgtcatggc

SEQ ID NO: 154547 - DNA, 23 bp, Homo sapiens
tgaggtagcaggatcacttgtgt

SEQ ID NO: 154548 - DNA, 18 bp, Homo sapiens
tcacacctgtaatctcag

SEQ ID NO: 154549 - DNA, 23 bp, Homo sapiens
tctgtctggttatctatctgatc

SEQ ID NO: 154550 - DNA, 23 bp, Homo sapiens
tcatctgccatctgtctgtctca

SEQ ID NO: 154551 - DNA, 23 bp, Homo sapiens
tggagtctcactctgtcacccag

SEQ ID NO: 154552 - DNA, 20 bp, Homo sapiens
tgggtgtgaagcttggtggt

SEQ ID NO: 154553 - DNA, 23 bp, Homo sapiens
tctctctccctgcctgagctgtc

SEQ ID NO: 154554 - DNA, 23 bp, Homo sapiens
acctgtctattgatgtatggact

SEQ ID NO: 154555 - DNA, 22 bp, Homo sapiens
acatgtgcacaatgtgcaggtt

SEQ ID NO: 154556 - DNA, 22 bp, Homo sapiens
agtgacagatgactgtcaggtg

SEQ ID NO: 154557 - DNA, 20 bp, Homo sapiens
tctgtcagggactgtgccct

SEQ ID NO: 154558 - DNA, 23 bp, Homo sapiens
tgagttcattgtagattctggat

SEQ ID NO: 154559 - DNA, 23 bp, Homo sapiens
tgagttcattgtagattctggat

SEQ ID NO: 154560 - DNA, 22 bp, Homo sapiens
tcagagaagtcacagaccaggg

SEQ ID NO: 154561 - DNA, 23 bp, Homo sapiens
ctcacactctctctggcatttgt

SEQ ID NO: 154562 - DNA, 19 bp, Homo sapiens
cagggtctctctctgccac

SEQ ID NO: 154563 - DNA, 23 bp, Homo sapiens
agatggtgtctcgctctgtcacc

SEQ ID NO: 154564 - DNA, 23 bp, Homo sapiens
tatatgtgtgtgtatgtgtatgt

SEQ ID NO: 154565 - DNA, 20 bp, Homo sapiens
tacacacacacacatatacg

SEQ ID NO: 154566 - DNA, 22 bp, Homo sapiens
atgtgtgaccctgagcaactgc

SEQ ID NO: 154567 - DNA, 23 bp, Homo sapiens
taaagaagtcattttcttgtcct

SEQ ID NO: 154568 - DNA, 20 bp, Homo sapiens
ttttcgagccaatgacttgc

SEQ ID NO: 154569 - DNA, 22 bp, Homo sapiens
tctctgagtctcagattcttga

SEQ ID NO: 154570 - DNA, 18 bp, Homo sapiens
actcccactgagtggctg

SEQ ID NO: 154571 - DNA, 23 bp, Homo sapiens
tgcctgcctgcctgcctggctct

SEQ ID NO: 154572 - DNA, 23 bp, Homo sapiens
agagtctcactctgtcgctcagg

SEQ ID NO: 154573 - DNA, 23 bp, Homo sapiens
ggctgcctctgtgcctggctgcc

SEQ ID NO: 154574 - DNA, 22 bp, Homo sapiens
acacaggctctcactatgttgt

SEQ ID NO: 154575 - DNA, 23 bp, Homo sapiens
atgtgtgtgtctctgtaacttga

SEQ ID NO: 154576 - DNA, 19 bp, Homo sapiens
ttccctgttcatgttgaga

SEQ ID NO: 154577 - DNA, 23 bp, Homo sapiens
gagacagggtctcgctctgttga

SEQ ID NO: 154578 - DNA, 23 bp, Homo sapiens
tctactccactgactgcaggatc

SEQ ID NO: 154579 - DNA, 22 bp, Homo sapiens
aggcacaagagagagagcactg

SEQ ID NO: 154580 - DNA, 23 bp, Homo sapiens
gtgagtcagtgagtgagtggtga

SEQ ID NO: 154581 - DNA, 23 bp, Homo sapiens
attactgcacgctaatgtagact

SEQ ID NO: 154582 - DNA, 22 bp, Homo sapiens
ggactccctctgacagacactg

SEQ ID NO: 154583 - DNA, 19 bp, Homo sapiens
tacctggaattgatatggc

SEQ ID NO: 154584 - DNA, 18 bp, Homo sapiens
agaggattttctatattt

SEQ ID NO: 154585 - DNA, 23 bp, Homo sapiens
aaactctcacattgtatttctca

SEQ ID NO: 154586 - DNA, 23 bp, Homo sapiens
tacatgtgcacaatgtgcaggtt

SEQ ID NO: 154587 - DNA, 23 bp, Homo sapiens
gcatgtcagaactcagtgacctc

SEQ ID NO: 154588 - DNA, 23 bp, Homo sapiens
gtgtcttcttatggtaatgaagt

SEQ ID NO: 154589 - DNA, 23 bp, Homo sapiens
gtcactgtgccagagccagggcc

SEQ ID NO: 154590 - DNA, 23 bp, Homo sapiens
tctggctggctgagtgcttggct

SEQ ID NO: 154591 - DNA, 22 bp, Homo sapiens
atcttacctgttcagtgtgggg

SEQ ID NO: 154592 - DNA, 23 bp, Homo sapiens
tccactgaatggtagatgaacca

SEQ ID NO: 154593 - DNA, 21 bp, Homo sapiens
tatgttcatctctctctctct

SEQ ID NO: 154594 - DNA, 22 bp, Homo sapiens
acacctgcaggattgatgcaat

SEQ ID NO: 154595 - DNA, 23 bp, Homo sapiens
gaattcactggatttcaaagcaa

SEQ ID NO: 154596 - DNA, 18 bp, Homo sapiens
acatctatacatatgtaa

SEQ ID NO: 154597 - DNA, 23 bp, Homo sapiens
atatgtgtatatttatatgtgtg

SEQ ID NO: 154598 - DNA, 23 bp, Homo sapiens
gtactaatctctctctctctctc

SEQ ID NO: 154599 - DNA, 23 bp, Homo sapiens
catgacacactcacttcctctga

SEQ ID NO: 154600 - DNA, 21 bp, Homo sapiens
gcatcttcagggtgaggtcac

SEQ ID NO: 154601 - DNA, 23 bp, Homo sapiens
aatatcagtctgcattgtgtgcc

SEQ ID NO: 154602 - DNA, 23 bp, Homo sapiens
agtcagcaacatcatttctctct

SEQ ID NO: 154603 - DNA, 20 bp, Homo sapiens
tgaactcagccaggaatggt

SEQ ID NO: 154604 - DNA, 19 bp, Homo sapiens
ttctactaagatgatgatg

SEQ ID NO: 154605 - DNA, 23 bp, Homo sapiens
atgcatttgcttgaactcagagg

SEQ ID NO: 154606 - DNA, 23 bp, Homo sapiens
tttgcgtatgtatatatgtgtgt

SEQ ID NO: 154607 - DNA, 21 bp, Homo sapiens
atatatatgtatatcaagtgt

SEQ ID NO: 154608 - DNA, 21 bp, Homo sapiens
cacaggtagctttctatgact

SEQ ID NO: 154609 - DNA, 23 bp, Homo sapiens
tgtgcttttaaattgtgtttcca

SEQ ID NO: 154610 - DNA, 23 bp, Homo sapiens
tcagactgacactctggttacca

SEQ ID NO: 154611 - DNA, 23 bp, Homo sapiens
gtgagatcattgtgaagactgga

SEQ ID NO: 154612 - DNA, 18 bp, Homo sapiens
aaacagaggcttcataca

SEQ ID NO: 154613 - DNA, 23 bp, Homo sapiens
ggtgataatgtctacccttttga

SEQ ID NO: 154614 - DNA, 20 bp, Homo sapiens
tgagatggagtctcactctt

SEQ ID NO: 154615 - DNA, 23 bp, Homo sapiens
atctcagctcactacaacctcca

SEQ ID NO: 154616 - DNA, 23 bp, Homo sapiens
tgtgcaagtgtgtgctatacatg

SEQ ID NO: 154617 - DNA, 22 bp, Homo sapiens
tatgtgtgcatgtgtacacgtg

SEQ ID NO: 154618 - DNA, 22 bp, Homo sapiens
tatgtgtgtgtactgtgtgtgt

SEQ ID NO: 154619 - DNA, 23 bp, Homo sapiens
catctcagtctctcaactttctc

SEQ ID NO: 154620 - DNA, 20 bp, Homo sapiens
aaatctagtctgcactttgc

SEQ ID NO: 154621 - DNA, 23 bp, Homo sapiens
cactgcccctgatcagaagtaga

SEQ ID NO: 154622 - DNA, 20 bp, Homo sapiens
tttggtcttgtttgaggaat

SEQ ID NO: 154623 - DNA, 18 bp, Homo sapiens
acagtggtgcgatctctg

SEQ ID NO: 154624 - DNA, 23 bp, Homo sapiens
cagggtctcactatgtttgttgc

SEQ ID NO: 154625 - DNA, 22 bp, Homo sapiens
tgtgtgaatatatatacgtgtg

SEQ ID NO: 154626 - DNA, 23 bp, Homo sapiens
tgtggtgtatatgtgtatgtggt

SEQ ID NO: 154627 - DNA, 18 bp, Homo sapiens
aagttagactttaggcat

SEQ ID NO: 154628 - DNA, 23 bp, Homo sapiens
ttaagacttcagagagaatgtcc

SEQ ID NO: 154629 - DNA, 19 bp, Homo sapiens
ttcttttctccatcaagtt

SEQ ID NO: 154630 - DNA, 22 bp, Homo sapiens
tgggtctctgcctgtctctccc

SEQ ID NO: 154631 - DNA, 23 bp, Homo sapiens
ttacactgtctggttatgtctgc

SEQ ID NO: 154632 - DNA, 22 bp, Homo sapiens
ttggtcagtctagttaggtgtt

SEQ ID NO: 154633 - DNA, 20 bp, Homo sapiens
aaagagtcagactttttttt

SEQ ID NO: 154634 - DNA, 18 bp, Homo sapiens
tactgcaacctctgcttc

SEQ ID NO: 154635 - DNA, 19 bp, Homo sapiens
tttctgcatctatagagag

SEQ ID NO: 154636 - DNA, 22 bp, Homo sapiens
tatatatgtacatatacatgta

SEQ ID NO: 154637 - DNA, 23 bp, Homo sapiens
aaatatgtatatgtatatgtgta

SEQ ID NO: 154638 - DNA, 23 bp, Homo sapiens
tctgtgactgtctgtgcctgctt

SEQ ID NO: 154639 - DNA, 20 bp, Homo sapiens
cagatcatgagagtcggagt

SEQ ID NO: 154640 - DNA, 23 bp, Homo sapiens
gctgcatttgttttctaaagaat

SEQ ID NO: 154641 - DNA, 23 bp, Homo sapiens
atatgtgtatatatatatgtgtg

SEQ ID NO: 154642 - DNA, 23 bp, Homo sapiens
gtgtgtggctgtcagtggggttg

SEQ ID NO: 154643 - DNA, 22 bp, Homo sapiens
acattgtatataatactgtgtg

SEQ ID NO: 154644 - DNA, 18 bp, Homo sapiens
agagggggagtgatttgc

SEQ ID NO: 154645 - DNA, 23 bp, Homo sapiens
gccacactgcctggctctcttga

SEQ ID NO: 154646 - DNA, 23 bp, Homo sapiens
agtgagttgagagaggtgagaca

SEQ ID NO: 154647 - DNA, 23 bp, Homo sapiens
agtctgagatcaaggtgtcagct

SEQ ID NO: 154648 - DNA, 23 bp, Homo sapiens
tctgttgaggcctctctccttgg

SEQ ID NO: 154649 - DNA, 20 bp, Homo sapiens
tgggtgtgagctagtgtggt

SEQ ID NO: 154650 - DNA, 23 bp, Homo sapiens
gacagagtctcgctctgtcaccc

SEQ ID NO: 154651 - DNA, 23 bp, Homo sapiens
tgtgctataatcttaatggattc

SEQ ID NO: 154652 - DNA, 23 bp, Homo sapiens
tccattatatagtcatagcataa

SEQ ID NO: 154653 - DNA, 23 bp, Homo sapiens
tgtgtgtgtgtgtgtatatatat

SEQ ID NO: 154654 - DNA, 23 bp, Homo sapiens
tccctccctcattgctctctgat

SEQ ID NO: 154655 - DNA, 22 bp, Homo sapiens
ttagagtgcagtcttgataggg

SEQ ID NO: 154656 - DNA, 19 bp, Homo sapiens
atgagggagggtctcaggt

SEQ ID NO: 154657 - DNA, 22 bp, Homo sapiens
tgtctggcactctgttaccctg

SEQ ID NO: 154658 - DNA, 21 bp, Homo sapiens
tgtctgagacactcaccgaga

SEQ ID NO: 154659 - DNA, 19 bp, Homo sapiens
atgtgtgtgcatgtatata

SEQ ID NO: 154660 - DNA, 19 bp, Homo sapiens
tgtgcgtgtgtgcatggga

SEQ ID NO: 154661 - DNA, 23 bp, Homo sapiens
tatgtgtatatatatatgtgtgt

SEQ ID NO: 154662 - DNA, 23 bp, Homo sapiens
tgagatggagtctcactctgtcg

SEQ ID NO: 154663 - DNA, 23 bp, Homo sapiens
tgagatacatgcatgtgggtttg

SEQ ID NO: 154664 - DNA, 23 bp, Homo sapiens
gttcatgtacttgctgactcact

SEQ ID NO: 154665 - DNA, 23 bp, Homo sapiens
tctctctatgtgtgtgtgtgtat

SEQ ID NO: 154666 - DNA, 22 bp, Homo sapiens
cagtaatgagttagctctcact

SEQ ID NO: 154667 - DNA, 22 bp, Homo sapiens
tggtcagagatcatgctgttag

SEQ ID NO: 154668 - DNA, 22 bp, Homo sapiens
cactgaactgagagtccagagc

SEQ ID NO: 154669 - DNA, 22 bp, Homo sapiens
tgtctggctgtgtgtgtgcctg

SEQ ID NO: 154670 - DNA, 20 bp, Homo sapiens
tgaggtaggaggatcacttg

SEQ ID NO: 154671 - DNA, 19 bp, Homo sapiens
acagggtggaaattttcag

SEQ ID NO: 154672 - DNA, 23 bp, Homo sapiens
ttttgagacggagtcttgctctg

SEQ ID NO: 154673 - DNA, 21 bp, Homo sapiens
agcctcttgaacgccttggct

SEQ ID NO: 154674 - DNA, 19 bp, Homo sapiens
tatggatatatatagatat

SEQ ID NO: 154675 - DNA, 19 bp, Homo sapiens
tatggatatatatagatat

SEQ ID NO: 154676 - DNA, 19 bp, Homo sapiens
ttttgtagagacaggtctc

SEQ ID NO: 154677 - DNA, 23 bp, Homo sapiens
ttttgagatggagtctagctctg

SEQ ID NO: 154678 - DNA, 23 bp, Homo sapiens
acacttaacacaatggaaatgtt

SEQ ID NO: 154679 - DNA, 23 bp, Homo sapiens
acagagtctcgctctgtcaccca

SEQ ID NO: 154680 - DNA, 23 bp, Homo sapiens
tcttgttctgtctgtctcacagg

SEQ ID NO: 154681 - DNA, 23 bp, Homo sapiens
tgtgtgagacagagtctccctct

SEQ ID NO: 154682 - DNA, 23 bp, Homo sapiens
agagatgggggtctcactgtgtc

SEQ ID NO: 154683 - DNA, 23 bp, Homo sapiens
tgcctgcctgcctgcctgccaca

SEQ ID NO: 154684 - DNA, 23 bp, Homo sapiens
tctctctaggtgtctctgtgtcc

SEQ ID NO: 154685 - DNA, 23 bp, Homo sapiens
tctgtctgtctgtcttttgtgtc

SEQ ID NO: 154686 - DNA, 18 bp, Homo sapiens
ttgcctgtagttgcggct

SEQ ID NO: 154687 - DNA, 23 bp, Homo sapiens
cagacagtagacttttctttcca

SEQ ID NO: 154688 - DNA, 23 bp, Homo sapiens
cgggtgacagacagagactctgt

SEQ ID NO: 154689 - DNA, 20 bp, Homo sapiens
tgccagagagctgtcctgtc

SEQ ID NO: 154690 - DNA, 22 bp, Homo sapiens
atacgtatatatacgtgtgtgt

SEQ ID NO: 154691 - DNA, 18 bp, Homo sapiens
tatacacacacgtatata

SEQ ID NO: 154692 - DNA, 23 bp, Homo sapiens
tggagtctcactctgtcacccag

SEQ ID NO: 154693 - DNA, 23 bp, Homo sapiens
ttgtcacactgagatttttgttg

SEQ ID NO: 154694 - DNA, 20 bp, Homo sapiens
agatggctttgagtttctga

SEQ ID NO: 154695 - DNA, 23 bp, Homo sapiens
tctctgtgtctctggctcaggaa

SEQ ID NO: 154696 - DNA, 19 bp, Homo sapiens
tatgtgtatgaatgtgtat

SEQ ID NO: 154697 - DNA, 23 bp, Homo sapiens
tgtatgtatgtgtatatgtatat

SEQ ID NO: 154698 - DNA, 22 bp, Homo sapiens
tgtgcttgtagtctcagatact

SEQ ID NO: 154699 - DNA, 22 bp, Homo sapiens
gatagtacttatctgtgtgttt

SEQ ID NO: 154700 - DNA, 18 bp, Homo sapiens
tacagctttaggtctttt

SEQ ID NO: 154701 - DNA, 20 bp, Homo sapiens
cacagaagagacagaggaga

SEQ ID NO: 154702 - DNA, 22 bp, Homo sapiens
tccagttctgaagtctgttagc

SEQ ID NO: 154703 - DNA, 20 bp, Homo sapiens
tctcattatttttatgtgtg

SEQ ID NO: 154704 - DNA, 23 bp, Homo sapiens
tcactacctagtttattgagact

SEQ ID NO: 154705 - DNA, 22 bp, Homo sapiens
atgtcaccctgctttgaacagt

SEQ ID NO: 154706 - DNA, 23 bp, Homo sapiens
attctctgcttctgtcagtgaca

SEQ ID NO: 154707 - DNA, 23 bp, Homo sapiens
tcactgtgaatctgtgtgagaag

SEQ ID NO: 154708 - DNA, 23 bp, Homo sapiens
tccatgtctcactgactgtttta

SEQ ID NO: 154709 - DNA, 23 bp, Homo sapiens
atcactgtctctgtcacagtgcc

SEQ ID NO: 154710 - DNA, 19 bp, Homo sapiens
ataggtgtggaaggagatt

SEQ ID NO: 154711 - DNA, 23 bp, Homo sapiens
agacagggtctggctctgttgtc

SEQ ID NO: 154712 - DNA, 23 bp, Homo sapiens
atggagtctcactctgtcaccca

SEQ ID NO: 154713 - DNA, 23 bp, Homo sapiens
tggagtctcactctgtcacccag

SEQ ID NO: 154714 - DNA, 23 bp, Homo sapiens
tggagtctcactctgtcacccag

SEQ ID NO: 154715 - DNA, 23 bp, Homo sapiens
atggagtctcactctgtcaccca

SEQ ID NO: 154716 - DNA, 23 bp, Homo sapiens
ttgagacagagtctcactctgtc

SEQ ID NO: 154717 - DNA, 21 bp, Homo sapiens
ttttgagtcaggttctcactc

SEQ ID NO: 154718 - DNA, 20 bp, Homo sapiens
tcagtgaagactctgaggtt

SEQ ID NO: 154719 - DNA, 23 bp, Homo sapiens
tcagagcagctatcacagttgca

SEQ ID NO: 154720 - DNA, 23 bp, Homo sapiens
tgtcacactagattgtaagctct

SEQ ID NO: 154721 - DNA, 23 bp, Homo sapiens
caaggtctcactctgtcacccag

SEQ ID NO: 154722 - DNA, 18 bp, Homo sapiens
cagtggtgtgatcatagc

SEQ ID NO: 154723 - DNA, 23 bp, Homo sapiens
tgaaatgtctgttcaaaactttt

SEQ ID NO: 154724 - DNA, 23 bp, Homo sapiens
ttcagtcagtcaggcatactttt

SEQ ID NO: 154725 - DNA, 19 bp, Homo sapiens
tcgacaattaaatgcacat

SEQ ID NO: 154726 - DNA, 23 bp, Homo sapiens
gtctgaatagcttacagaggttt

SEQ ID NO: 154727 - DNA, 21 bp, Homo sapiens
tgtattatttttgcataagtg

SEQ ID NO: 154728 - DNA, 23 bp, Homo sapiens
tcagagtggtactggtttgcagt

SEQ ID NO: 154729 - DNA, 23 bp, Homo sapiens
cctggctgtctgactgtgtcaca

SEQ ID NO: 154730 - DNA, 21 bp, Homo sapiens
tgggaacaggcttcatccggg

SEQ ID NO: 154731 - DNA, 19 bp, Homo sapiens
tgattcaggctgagcttga

SEQ ID NO: 154732 - DNA, 23 bp, Homo sapiens
ggagtctcgctctgtcaccgaga

SEQ ID NO: 154733 - DNA, 22 bp, Homo sapiens
tagacaaaatgctgcagtttct

SEQ ID NO: 154734 - DNA, 23 bp, Homo sapiens
agaacacagaatttgatcttctg

SEQ ID NO: 154735 - DNA, 23 bp, Homo sapiens
cagagactgaagacagacacctc

SEQ ID NO: 154736 - DNA, 19 bp, Homo sapiens
ccagtaattacccttcaga

SEQ ID NO: 154737 - DNA, 22 bp, Homo sapiens
tagggtccaactactgctgtta

SEQ ID NO: 154738 - DNA, 22 bp, Homo sapiens
ttggtaatgagagagaaatcaa

SEQ ID NO: 154739 - DNA, 20 bp, Homo sapiens
aactgctagatcatatggca

SEQ ID NO: 154740 - DNA, 23 bp, Homo sapiens
aggacacagtgagaagtcagcag

SEQ ID NO: 154741 - DNA, 20 bp, Homo sapiens
ttttgagacggagtctcact

SEQ ID NO: 154742 - DNA, 23 bp, Homo sapiens
agcctgagtccctgaatgactgt

SEQ ID NO: 154743 - DNA, 21 bp, Homo sapiens
ttatttcattatgtattgcaa

SEQ ID NO: 154744 - DNA, 20 bp, Homo sapiens
ttttgagacggagtcttgct

SEQ ID NO: 154745 - DNA, 19 bp, Homo sapiens
ttttttccagacggagtct

SEQ ID NO: 154746 - DNA, 23 bp, Homo sapiens
ctgtaattgtgcaagccagttct

SEQ ID NO: 154747 - DNA, 23 bp, Homo sapiens
gtctgtacatctgctggttctgt

SEQ ID NO: 154748 - DNA, 23 bp, Homo sapiens
tggagtctcactctgtcacccag

SEQ ID NO: 154749 - DNA, 23 bp, Homo sapiens
catggaatgcatatgtataagta

SEQ ID NO: 154750 - DNA, 23 bp, Homo sapiens
tgggtgtgtataaataatgtcat

SEQ ID NO: 154751 - DNA, 23 bp, Homo sapiens
agtgaagaagatgtgttactata

SEQ ID NO: 154752 - DNA, 22 bp, Homo sapiens
gagtgctacaaagaattatgca

SEQ ID NO: 154753 - DNA, 19 bp, Homo sapiens
ctttctagtactttactgt

SEQ ID NO: 154754 - DNA, 23 bp, Homo sapiens
tgtggtttttaaatgatgtttca

SEQ ID NO: 154755 - DNA, 22 bp, Homo sapiens
tttaagattctcaggattgcgt

SEQ ID NO: 154756 - DNA, 21 bp, Homo sapiens
agactgagtggcttaaataac

SEQ ID NO: 154757 - DNA, 23 bp, Homo sapiens
atcttctcacagttctggaggct

SEQ ID NO: 154758 - DNA, 23 bp, Homo sapiens
gtactgtgagaaagctgtttttt

SEQ ID NO: 154759 - DNA, 23 bp, Homo sapiens
gagtgtttctctctctgtctgcc

SEQ ID NO: 154760 - DNA, 23 bp, Homo sapiens
tttagcagtagtcaaaggatgtg

SEQ ID NO: 154761 - DNA, 23 bp, Homo sapiens
attttggttccatatgatgtctt

SEQ ID NO: 154762 - DNA, 23 bp, Homo sapiens
atatcagtggtagtttaatggga

SEQ ID NO: 154763 - DNA, 23 bp, Homo sapiens
tacatgtgcaggatgtgcaggtt

SEQ ID NO: 154764 - DNA, 23 bp, Homo sapiens
gcaggaagtgtttagtctgtatg

SEQ ID NO: 154765 - DNA, 23 bp, Homo sapiens
ttggtagttttgagcacagaaag

SEQ ID NO: 154766 - DNA, 21 bp, Homo sapiens
ttttgagacggagtcttgctc

SEQ ID NO: 154767 - DNA, 23 bp, Homo sapiens
agtgatctgtctgcctcagtctc

SEQ ID NO: 154768 - DNA, 23 bp, Homo sapiens
ataaaatgagtttggaggtattc

SEQ ID NO: 154769 - DNA, 18 bp, Homo sapiens
tttaagaaggactggtgc

SEQ ID NO: 154770 - DNA, 23 bp, Homo sapiens
cattggcattgcttgatttgtgg

SEQ ID NO: 154771 - DNA, 22 bp, Homo sapiens
cacacacacaaatgtatcttgt

SEQ ID NO: 154772 - DNA, 23 bp, Homo sapiens
atatatgtacatatgtatgtgtg

SEQ ID NO: 154773 - DNA, 23 bp, Homo sapiens
tatctccctagtttatttgttgt

SEQ ID NO: 154774 - DNA, 23 bp, Homo sapiens
cttcaggagctctgatagtttta

SEQ ID NO: 154775 - DNA, 23 bp, Homo sapiens
ttctctttccatttgtaagcaca

SEQ ID NO: 154776 - DNA, 23 bp, Homo sapiens
tgtgatactgcttcttcatgttc

SEQ ID NO: 154777 - DNA, 18 bp, Homo sapiens
tatgtgtatatatatatg

SEQ ID NO: 154778 - DNA, 18 bp, Homo sapiens
tatgtgtatatatatatg

SEQ ID NO: 154779 - DNA, 18 bp, Homo sapiens
tatgtgtatatatatatg

SEQ ID NO: 154780 - DNA, 22 bp, Homo sapiens
agagggggtgagaaaacggtca

SEQ ID NO: 154781 - DNA, 23 bp, Homo sapiens
tgagttcattgtagattctggat

SEQ ID NO: 154782 - DNA, 23 bp, Homo sapiens
tgagttcattgtagattctggat

SEQ ID NO: 154783 - DNA, 23 bp, Homo sapiens
tatatgtatgtgtatatgtgtgc

SEQ ID NO: 154784 - DNA, 22 bp, Homo sapiens
atatgtatatgtgtgtgtatga

SEQ ID NO: 154785 - DNA, 23 bp, Homo sapiens
cggagtctcgctctgtcgctcag

SEQ ID NO: 154786 - DNA, 22 bp, Homo sapiens
agattcatggatgagggagtgt

SEQ ID NO: 154787 - DNA, 23 bp, Homo sapiens
ctttcagtgagtctgagttgggt

SEQ ID NO: 154788 - DNA, 23 bp, Homo sapiens
atgtatgaatatatagatatgtg

SEQ ID NO: 154789 - DNA, 23 bp, Homo sapiens
tatgtatatatgtatgtatatgt

SEQ ID NO: 154790 - DNA, 21 bp, Homo sapiens
tagcaagtatatatatatgtc

SEQ ID NO: 154791 - DNA, 22 bp, Homo sapiens
tcactctggaatccttcctgag

SEQ ID NO: 154792 - DNA, 19 bp, Homo sapiens
agtgtttttcatcttggga

SEQ ID NO: 154793 - DNA, 23 bp, Homo sapiens
tgtgtgtgtgtgtgcatgtgaat

SEQ ID NO: 154794 - DNA, 23 bp, Homo sapiens
atgtatgtgtgtatgtatatatg

SEQ ID NO: 154795 - DNA, 22 bp, Homo sapiens
tttttttgagacggagtcttgc

SEQ ID NO: 154796 - DNA, 19 bp, Homo sapiens
atatgtttaacttttggag

SEQ ID NO: 154797 - DNA, 19 bp, Homo sapiens
cacaaaaatgcacatatgt

SEQ ID NO: 154798 - DNA, 23 bp, Homo sapiens
tgacaagttttccaggattggct

SEQ ID NO: 154799 - DNA, 23 bp, Homo sapiens
tgtgtgtgtctgtgtgtatatac

SEQ ID NO: 154800 - DNA, 22 bp, Homo sapiens
tgtatacacacacatatatgtg

SEQ ID NO: 154801 - DNA, 23 bp, Homo sapiens
tagtcttgtagtacattgcagat

SEQ ID NO: 154802 - DNA, 23 bp, Homo sapiens
tgagttcattgtagattctggat

SEQ ID NO: 154803 - DNA, 23 bp, Homo sapiens
tgagttcattgtagattctggat

SEQ ID NO: 154804 - DNA, 18 bp, Homo sapiens
tgcacagaaagcattgtg

SEQ ID NO: 154805 - DNA, 23 bp, Homo sapiens
cacacacatatatatatgtgtgt

SEQ ID NO: 154806 - DNA, 23 bp, Homo sapiens
atactgagctttccaattcatga

SEQ ID NO: 154807 - DNA, 21 bp, Homo sapiens
tattgctatatttatttaagt

SEQ ID NO: 154808 - DNA, 22 bp, Homo sapiens
tatactgacagagttgtcaggg

SEQ ID NO: 154809 - DNA, 22 bp, Homo sapiens
taagtagatagatatcagtaga

SEQ ID NO: 154810 - DNA, 23 bp, Homo sapiens
tgagttcattgtagattctggat

SEQ ID NO: 154811 - DNA, 23 bp, Homo sapiens
tgagttcattgtagattctggat

SEQ ID NO: 154812 - DNA, 19 bp, Homo sapiens
tatccatatatatggatat

SEQ ID NO: 154813 - DNA, 20 bp, Homo sapiens
aatccatatatatggattta

SEQ ID NO: 154814 - DNA, 18 bp, Homo sapiens
tatggatttatatggata

SEQ ID NO: 154815 - DNA, 19 bp, Homo sapiens
tatggatttatatggatat

SEQ ID NO: 154816 - DNA, 20 bp, Homo sapiens
tatggatatatataatgtgt

SEQ ID NO: 154817 - DNA, 23 bp, Homo sapiens
atatgtgtgtatatatatatgtg

SEQ ID NO: 154818 - DNA, 20 bp, Homo sapiens
tgctgagtgtatatttacag

SEQ ID NO: 154819 - DNA, 23 bp, Homo sapiens
gtattggtctgtgttaatgtatt

SEQ ID NO: 154820 - DNA, 23 bp, Homo sapiens
atacaagtttatttgattagaac

SEQ ID NO: 154821 - DNA, 18 bp, Homo sapiens
taattgtgattccaaaac

SEQ ID NO: 154822 - DNA, 23 bp, Homo sapiens
gagacggagtctcactctgtcac

SEQ ID NO: 154823 - DNA, 22 bp, Homo sapiens
tatcacctattagttctgtgtc

SEQ ID NO: 154824 - DNA, 20 bp, Homo sapiens
atacacacatgtgagcgtgc

SEQ ID NO: 154825 - DNA, 18 bp, Homo sapiens
tgaagaagggttttgctg

SEQ ID NO: 154826 - DNA, 21 bp, Homo sapiens
agacagagtctttctctgtca

SEQ ID NO: 154827 - DNA, 23 bp, Homo sapiens
ctcacagggtctgtaattgtgct

SEQ ID NO: 154828 - DNA, 23 bp, Homo sapiens
atgtatgtagtatgtatgtatgt

SEQ ID NO: 154829 - DNA, 23 bp, Homo sapiens
tatgtatgtatgtatgtatgtat

SEQ ID NO: 154830 - DNA, 21 bp, Homo sapiens
agtgtttgattatatttctct

SEQ ID NO: 154831 - DNA, 22 bp, Homo sapiens
tactgactcagtgactctttcg

SEQ ID NO: 154832 - DNA, 23 bp, Homo sapiens
gacacagtctcgctctgtcaccc

SEQ ID NO: 154833 - DNA, 21 bp, Homo sapiens
tgtgtgtatatatatatgtgt

SEQ ID NO: 154834 - DNA, 18 bp, Homo sapiens
atgtgctatatatatata

SEQ ID NO: 154835 - DNA, 21 bp, Homo sapiens
tgtgtatatatgtatatgtgt

SEQ ID NO: 154836 - DNA, 23 bp, Homo sapiens
atatgtgtatatatgtatatgtg

SEQ ID NO: 154837 - DNA, 22 bp, Homo sapiens
tgtgtatatatgtatatatgtg

SEQ ID NO: 154838 - DNA, 18 bp, Homo sapiens
tttgagagctatggttat

SEQ ID NO: 154839 - DNA, 23 bp, Homo sapiens
aactaaggctcctaaagttttta

SEQ ID NO: 154840 - DNA, 23 bp, Homo sapiens
ttgagatgaagtctcgctctgtc

SEQ ID NO: 154841 - DNA, 23 bp, Homo sapiens
agagtctcactctgtcacccagg

SEQ ID NO: 154842 - DNA, 21 bp, Homo sapiens
tctcacagaaataaaggaggg

SEQ ID NO: 154843 - DNA, 22 bp, Homo sapiens
tttgagaggtttatatttcata

SEQ ID NO: 154844 - DNA, 22 bp, Homo sapiens
aaggagtctagtatggtggttg

SEQ ID NO: 154845 - DNA, 21 bp, Homo sapiens
ttctcattttgtttatgagtg

SEQ ID NO: 154846 - DNA, 22 bp, Homo sapiens
cagccactcagtctgaagaatt

SEQ ID NO: 154847 - DNA, 22 bp, Homo sapiens
atatgtatatatacatatgtgt

SEQ ID NO: 154848 - DNA, 22 bp, Homo sapiens
tgtgtatatatgtatatgtgta

SEQ ID NO: 154849 - DNA, 22 bp, Homo sapiens
tatgtgcatatatatacacata

SEQ ID NO: 154850 - DNA, 23 bp, Homo sapiens
tgtgtatatatgtatatgtgtac

SEQ ID NO: 154851 - DNA, 22 bp, Homo sapiens
tatgtgcatatatatacacata

SEQ ID NO: 154852 - DNA, 23 bp, Homo sapiens
aatagcagtagcacatttttttt

SEQ ID NO: 154853 - DNA, 23 bp, Homo sapiens
ttgtttcatggaatcattgcaac

SEQ ID NO: 154854 - DNA, 23 bp, Homo sapiens
aactgaagtctatagatgttaag

SEQ ID NO: 154855 - DNA, 23 bp, Homo sapiens
aactgtgcctggcagaaatgtga

SEQ ID NO: 154856 - DNA, 23 bp, Homo sapiens
tgtattagcttgaatctgggata

SEQ ID NO: 154857 - DNA, 22 bp, Homo sapiens
agtggttgtatattcatttggg

SEQ ID NO: 154858 - DNA, 21 bp, Homo sapiens
tatatgtgtttgcaataatat

SEQ ID NO: 154859 - DNA, 23 bp, Homo sapiens
gtcagagtctcgctctgtcaccc

SEQ ID NO: 154860 - DNA, 23 bp, Homo sapiens
actattctgtatgctattctaca

SEQ ID NO: 154861 - DNA, 23 bp, Homo sapiens
atacacacacatatgtatgtgtg

SEQ ID NO: 154862 - DNA, 23 bp, Homo sapiens
tatatatgtgtatatgtatatat

SEQ ID NO: 154863 - DNA, 20 bp, Homo sapiens
agtctgaagacagtctggag

SEQ ID NO: 154864 - DNA, 21 bp, Homo sapiens
tataagaatcaaattttagct

SEQ ID NO: 154865 - DNA, 23 bp, Homo sapiens
tacatgtgcacaatgtgcaggtt

SEQ ID NO: 154866 - DNA, 23 bp, Homo sapiens
tgtgtgtctgtgagtgtgtgtgc

SEQ ID NO: 154867 - DNA, 23 bp, Homo sapiens
tatatgcatatatacgtgtgtgt

SEQ ID NO: 154868 - DNA, 19 bp, Homo sapiens
acaggtgtgtgcctccact

SEQ ID NO: 154869 - DNA, 21 bp, Homo sapiens
cacctctcactatcactcact

SEQ ID NO: 154870 - DNA, 22 bp, Homo sapiens
acaggtggtgtttggttcatga

SEQ ID NO: 154871 - DNA, 23 bp, Homo sapiens
tatgtatgcatatgtatacatgt

SEQ ID NO: 154872 - DNA, 23 bp, Homo sapiens
ggtctcactctgtctctctacct

SEQ ID NO: 154873 - DNA, 21 bp, Homo sapiens
actgtctgttgtttcaaggta

SEQ ID NO: 154874 - DNA, 20 bp, Homo sapiens
atgtgcacaacgtgcaggtt

SEQ ID NO: 154875 - DNA, 23 bp, Homo sapiens
ttattgctggtcacattggagca

SEQ ID NO: 154876 - DNA, 23 bp, Homo sapiens
tgagttcattgtagattctggat

SEQ ID NO: 154877 - DNA, 23 bp, Homo sapiens
tgagttcattgtagattctggat

SEQ ID NO: 154878 - DNA, 23 bp, Homo sapiens
tgtgtatatatatatatgtgtat

SEQ ID NO: 154879 - DNA, 23 bp, Homo sapiens
actactgtcactgtctctcatct

SEQ ID NO: 154880 - DNA, 23 bp, Homo sapiens
atctgtcactgtctctcatcacc

SEQ ID NO: 154881 - DNA, 23 bp, Homo sapiens
tgagttcattgtagattctggat

SEQ ID NO: 154882 - DNA, 23 bp, Homo sapiens
tgagttcattgtagattctggat

SEQ ID NO: 154883 - DNA, 23 bp, Homo sapiens
acatgtacatgtatgtggaaatg

SEQ ID NO: 154884 - DNA, 23 bp, Homo sapiens
agagtctcactctgtcacccagg

SEQ ID NO: 154885 - DNA, 23 bp, Homo sapiens
ccaagtgagaacagtgagtggag

SEQ ID NO: 154886 - DNA, 22 bp, Homo sapiens
atactgtgttgaataggagtgg

SEQ ID NO: 154887 - DNA, 23 bp, Homo sapiens
tgcttccagcttttgcccattca

SEQ ID NO: 154888 - DNA, 22 bp, Homo sapiens
tctcactctgtcactcaggctg

SEQ ID NO: 154889 - DNA, 22 bp, Homo sapiens
gagagagagagagagagatcag

SEQ ID NO: 154890 - DNA, 23 bp, Homo sapiens
tctcagagtattctgtgtgtgtt

SEQ ID NO: 154891 - DNA, 23 bp, Homo sapiens
ttttggtaccatgagatactgtt

SEQ ID NO: 154892 - DNA, 23 bp, Homo sapiens
agactagattgcagagtgaattg

SEQ ID NO: 154893 - DNA, 23 bp, Homo sapiens
tggagtctcactctgtcacccag

SEQ ID NO: 154894 - DNA, 22 bp, Homo sapiens
attgatgatgtcgctctgttgt

SEQ ID NO: 154895 - DNA, 23 bp, Homo sapiens
tgagttcattgtagattctggat

SEQ ID NO: 154896 - DNA, 21 bp, Homo sapiens
tctagcacagtgcctggcacc

SEQ ID NO: 154897 - DNA, 19 bp, Homo sapiens
tcccgagtagttgggatta

SEQ ID NO: 154898 - DNA, 23 bp, Homo sapiens
gtgagaacatgtgatgtttgcct

SEQ ID NO: 154899 - DNA, 23 bp, Homo sapiens
tatatatgtgataatggacttct

SEQ ID NO: 154900 - DNA, 23 bp, Homo sapiens
gtatgtatgtatagatgtgtgtg

SEQ ID NO: 154901 - DNA, 23 bp, Homo sapiens
tatgtgtgcgtctgtaatatata

SEQ ID NO: 154902 - DNA, 22 bp, Homo sapiens
tttccctctcagtgtctttaag

SEQ ID NO: 154903 - DNA, 23 bp, Homo sapiens
tgagttcattgtagattctggat

SEQ ID NO: 154904 - DNA, 23 bp, Homo sapiens
tgagttcattgtagattctggat

SEQ ID NO: 154905 - DNA, 22 bp, Homo sapiens
aagtttggtgttcatgcagtaa

SEQ ID NO: 154906 - DNA, 23 bp, Homo sapiens
agacagaggaatgttgtctccta

SEQ ID NO: 154907 - DNA, 23 bp, Homo sapiens
tagagaagatgtggctctgaact

SEQ ID NO: 154908 - DNA, 19 bp, Homo sapiens
tttcagtgtctactatgta

SEQ ID NO: 154909 - DNA, 21 bp, Homo sapiens
tgacttgatatccatgtgatt

SEQ ID NO: 154910 - DNA, 22 bp, Homo sapiens
ttaaagtccatttggatattct

SEQ ID NO: 154911 - DNA, 23 bp, Homo sapiens
attgactctggataagcctgtga

SEQ ID NO: 154912 - DNA, 23 bp, Homo sapiens
tgtgtgtatatatatgtgtgtgt

SEQ ID NO: 154913 - DNA, 21 bp, Homo sapiens
gagaaggttcagagggggaaa

SEQ ID NO: 154914 - DNA, 22 bp, Homo sapiens
tctctcactgattgcttttcct

SEQ ID NO: 154915 - DNA, 23 bp, Homo sapiens
tgggactcagtctgtcatcttcc

SEQ ID NO: 154916 - DNA, 23 bp, Homo sapiens
tgagatggagttttgctcttgtc

SEQ ID NO: 154917 - DNA, 21 bp, Homo sapiens
tatagctatctatagataact

SEQ ID NO: 154918 - DNA, 21 bp, Homo sapiens
tatagctatatatagataact

SEQ ID NO: 154919 - DNA, 21 bp, Homo sapiens
tatagctatatatagataact

SEQ ID NO: 154920 - DNA, 23 bp, Homo sapiens
aaagtagaacaacattttgaccc

SEQ ID NO: 154921 - DNA, 18 bp, Homo sapiens
atgtgcacaatgtgcagg

SEQ ID NO: 154922 - DNA, 18 bp, Homo sapiens
tgtgtgtgtgtgtgcgcg

SEQ ID NO: 154923 - DNA, 23 bp, Homo sapiens
tgctctgtcgctctgtcacccag

SEQ ID NO: 154924 - DNA, 20 bp, Homo sapiens
tacagtggcgcaatcttggc

SEQ ID NO: 154925 - DNA, 23 bp, Homo sapiens
tctctgtatctctcaatgcctga

SEQ ID NO: 154926 - DNA, 21 bp, Homo sapiens
ctctgtgtgcctgagtggctc

SEQ ID NO: 154927 - DNA, 22 bp, Homo sapiens
tttctatagcagctgcaccatt

SEQ ID NO: 154928 - DNA, 23 bp, Homo sapiens
aagctgtgtgaccttctctctct

SEQ ID NO: 154929 - DNA, 18 bp, Homo sapiens
actgcagtgagctgagat

SEQ ID NO: 154930 - DNA, 23 bp, Homo sapiens
tgtgagttctacaactttcctct

SEQ ID NO: 154931 - DNA, 21 bp, Homo sapiens
gtggcttacatcactttggga

SEQ ID NO: 154932 - DNA, 22 bp, Homo sapiens
ttcagtgaagtgtgtgtgaact

SEQ ID NO: 154933 - DNA, 19 bp, Homo sapiens
tcacaccctaaaaaagccc

SEQ ID NO: 154934 - DNA, 21 bp, Homo sapiens
cccagacagtctcactctgtc

SEQ ID NO: 154935 - DNA, 23 bp, Homo sapiens
tttctgagtcttatagttttata

SEQ ID NO: 154936 - DNA, 23 bp, Homo sapiens
cggagtctcactctgtcacccag

SEQ ID NO: 154937 - DNA, 23 bp, Homo sapiens
gagtctcactctgtcacccaggc

SEQ ID NO: 154938 - DNA, 22 bp, Homo sapiens
tgactgtgaagcgatgagtatt

SEQ ID NO: 154939 - DNA, 23 bp, Homo sapiens
tgggggggtctcactgtgtgtcc

SEQ ID NO: 154940 - DNA, 23 bp, Homo sapiens
agagtctcactctgtcacccagg

SEQ ID NO: 154941 - DNA, 23 bp, Homo sapiens
atgaggtctcattatgttgtcca

SEQ ID NO: 154942 - DNA, 23 bp, Homo sapiens
agactgagtcttgctctgtcacc

SEQ ID NO: 154943 - DNA, 19 bp, Homo sapiens
ttccagtctagcctgctcg

SEQ ID NO: 154944 - DNA, 23 bp, Homo sapiens
tcgcagacaggttatggtctctg

SEQ ID NO: 154945 - DNA, 23 bp, Homo sapiens
tgctgtagcagaagagtgacccc

SEQ ID NO: 154946 - DNA, 22 bp, Homo sapiens
tattagctgggtgtggtagcat

SEQ ID NO: 154947 - DNA, 23 bp, Homo sapiens
cagagtctcccactgtcacccag

SEQ ID NO: 154948 - DNA, 23 bp, Homo sapiens
actgtgtgtgtgtgtgtgtgcac

SEQ ID NO: 154949 - DNA, 23 bp, Homo sapiens
gggcttctctgggtctctcaggg

SEQ ID NO: 154950 - DNA, 23 bp, Homo sapiens
tggagtctcgctctgtctcccag

SEQ ID NO: 154951 - DNA, 23 bp, Homo sapiens
tgagacggagtctcactctgtca

SEQ ID NO: 154952 - DNA, 23 bp, Homo sapiens
gttttgtctccctaagttttcag

SEQ ID NO: 154953 - DNA, 22 bp, Homo sapiens
acagtctttctctctccttgcc

SEQ ID NO: 154954 - DNA, 22 bp, Homo sapiens
agagagagagagagaaaggtct

SEQ ID NO: 154955 - DNA, 23 bp, Homo sapiens
gggtctcactctgtcacccaggc

SEQ ID NO: 154956 - DNA, 22 bp, Homo sapiens
acagagagagcagacattgcag

SEQ ID NO: 154957 - DNA, 20 bp, Homo sapiens
aaatttgaactcattccttc

SEQ ID NO: 154958 - DNA, 23 bp, Homo sapiens
gatattgtggttctgatttgcat

SEQ ID NO: 154959 - DNA, 20 bp, Homo sapiens
tatattttgcatatccattc

SEQ ID NO: 154960 - DNA, 23 bp, Homo sapiens
atgtctgagtcagtgcctctgtc

SEQ ID NO: 154961 - DNA, 19 bp, Homo sapiens
tggtgatctttgatcagtg

SEQ ID NO: 154962 - DNA, 22 bp, Homo sapiens
tttgaaacggagtctcgctctg

SEQ ID NO: 154963 - DNA, 23 bp, Homo sapiens
cttactgcaacctctgcttcctg

SEQ ID NO: 154964 - DNA, 23 bp, Homo sapiens
tagacagaacacagactgcaact

SEQ ID NO: 154965 - DNA, 19 bp, Homo sapiens
atgatgtagggtatgacag

SEQ ID NO: 154966 - DNA, 23 bp, Homo sapiens
cggagtctcactctgtcacccag

SEQ ID NO: 154967 - DNA, 23 bp, Homo sapiens
gagtctcactctgtcacccaggc

SEQ ID NO: 154968 - DNA, 20 bp, Homo sapiens
tgcaaaagagttccaatgtc

SEQ ID NO: 154969 - DNA, 23 bp, Homo sapiens
tctgacagtggttttgatttgta

SEQ ID NO: 154970 - DNA, 23 bp, Homo sapiens
tgagacaaggtctcgctctgttg

SEQ ID NO: 154971 - DNA, 19 bp, Homo sapiens
tgtgtatatgtatgtatat

SEQ ID NO: 154972 - DNA, 19 bp, Homo sapiens
ttttgtaagtatgtatatg

SEQ ID NO: 154973 - DNA, 22 bp, Homo sapiens
cagggtctctctcactctgtcg

SEQ ID NO: 154974 - DNA, 23 bp, Homo sapiens
ggctcactattgcttattgatag

SEQ ID NO: 154975 - DNA, 20 bp, Homo sapiens
ttgaacaactgttttgtgtt

SEQ ID NO: 154976 - DNA, 20 bp, Homo sapiens
caacagagtgagactccatc

SEQ ID NO: 154977 - DNA, 21 bp, Homo sapiens
tgagatggagtctcgctctgt

SEQ ID NO: 154978 - DNA, 20 bp, Homo sapiens
gtacatgtacacatgcacat

SEQ ID NO: 154979 - DNA, 23 bp, Homo sapiens
atgtgtgtgtatatgtatgtgtg

SEQ ID NO: 154980 - DNA, 23 bp, Homo sapiens
aggttctgtgactcactcactgc

SEQ ID NO: 154981 - DNA, 23 bp, Homo sapiens
tgagcgacagagtgagactctct

SEQ ID NO: 154982 - DNA, 23 bp, Homo sapiens
atggggtttcaccatgttggcca

SEQ ID NO: 154983 - DNA, 23 bp, Homo sapiens
caacatagtgagaccctatctct

SEQ ID NO: 154984 - DNA, 23 bp, Homo sapiens
attctgtcacccagactggagtg

SEQ ID NO: 154985 - DNA, 18 bp, Homo sapiens
tgtgggaggttgtgaact

SEQ ID NO: 154986 - DNA, 22 bp, Homo sapiens
agtcactctgcctctcacactc

SEQ ID NO: 154987 - DNA, 23 bp, Homo sapiens
tgtctgtgtctatctgtctgcag

SEQ ID NO: 154988 - DNA, 23 bp, Homo sapiens
gacagagtctcgctctgtcaccc

SEQ ID NO: 154989 - DNA, 23 bp, Homo sapiens
ctctgtgtgtcagtctccttatc

SEQ ID NO: 154990 - DNA, 23 bp, Homo sapiens
ttattcaggtattgtttgtgttc

SEQ ID NO: 154991 - DNA, 23 bp, Homo sapiens
tcactcactgagtgcctattgag

SEQ ID NO: 154992 - DNA, 22 bp, Homo sapiens
atggtgtgatcttggctcactg

SEQ ID NO: 154993 - DNA, 23 bp, Homo sapiens
aggagtgtactcacaagtattct

SEQ ID NO: 154994 - DNA, 23 bp, Homo sapiens
tcagagtctgagttgaacctcat

SEQ ID NO: 154995 - DNA, 23 bp, Homo sapiens
agccactcactagctctgtgact

SEQ ID NO: 154996 - DNA, 23 bp, Homo sapiens
cagagattctctctctctcttca

SEQ ID NO: 154997 - DNA, 19 bp, Homo sapiens
tgtgaggagggcaaagtga

SEQ ID NO: 154998 - DNA, 22 bp, Homo sapiens
tgagtctcactctgtcacccag

SEQ ID NO: 154999 - DNA, 23 bp, Homo sapiens
ttttcaggaggtggaaactgcat

SEQ ID NO: 155000 - DNA, 23 bp, Homo sapiens
agacggagtctcacactgtcact

SEQ ID NO: 155001 - DNA, 18 bp, Homo sapiens
tgactagctgcaggacag

SEQ ID NO: 155002 - DNA, 22 bp, Homo sapiens
tgagctagatatagagtgtggg

SEQ ID NO: 155003 - DNA, 20 bp, Homo sapiens
tcacactgaacgcccactct

SEQ ID NO: 155004 - DNA, 23 bp, Homo sapiens
tatggatatctatagatatatgg

SEQ ID NO: 155005 - DNA, 23 bp, Homo sapiens
tatatatggatatctatagatat

SEQ ID NO: 155006 - DNA, 23 bp, Homo sapiens
tatgagattgagatatacagctt

SEQ ID NO: 155007 - DNA, 20 bp, Homo sapiens
tgtgtgtgtgtatgtgtata

SEQ ID NO: 155008 - DNA, 23 bp, Homo sapiens
tatctatatgtatgcatgtgtgt

SEQ ID NO: 155009 - DNA, 21 bp, Homo sapiens
ttgaagttgccctggatgtat

SEQ ID NO: 155010 - DNA, 23 bp, Homo sapiens
tcactgagtacctaactgtgtca

SEQ ID NO: 155011 - DNA, 23 bp, Homo sapiens
cttctcactgtgtgtgtacttgg

SEQ ID NO: 155012 - DNA, 23 bp, Homo sapiens
tcacttgagactcatacagcagg

SEQ ID NO: 155013 - DNA, 23 bp, Homo sapiens
ctcagcctctcacagcctctcag

SEQ ID NO: 155014 - DNA, 19 bp, Homo sapiens
cagagggaacagagaagct

SEQ ID NO: 155015 - DNA, 19 bp, Homo sapiens
tctgtcaatgtctctctct

SEQ ID NO: 155016 - DNA, 23 bp, Homo sapiens
actctctgtgcctcagtttgcca

SEQ ID NO: 155017 - DNA, 23 bp, Homo sapiens
gacagagtctcgctctgtcaccc

SEQ ID NO: 155018 - DNA, 23 bp, Homo sapiens
tgctgcactcacagcctcagttc

SEQ ID NO: 155019 - DNA, 21 bp, Homo sapiens
gagacagagagagatcttgtt

SEQ ID NO: 155020 - DNA, 23 bp, Homo sapiens
taaagcagatgatgtcactctca

SEQ ID NO: 155021 - DNA, 22 bp, Homo sapiens
tatcaagctctctcagtgtttc

SEQ ID NO: 155022 - DNA, 23 bp, Homo sapiens
cgtgtgtgtgtcactgagtgtgc

SEQ ID NO: 155023 - DNA, 23 bp, Homo sapiens
ttgatgataagtgattttcttga

SEQ ID NO: 155024 - DNA, 22 bp, Homo sapiens
aatagataacttgttagaggca

SEQ ID NO: 155025 - DNA, 23 bp, Homo sapiens
ttagatggagtcgctctctgtca

SEQ ID NO: 155026 - DNA, 23 bp, Homo sapiens
tatcactgcgattattttcaagg

SEQ ID NO: 155027 - DNA, 20 bp, Homo sapiens
agcatatatgtatatatgat

SEQ ID NO: 155028 - DNA, 23 bp, Homo sapiens
tgtggtgcttcagagtggggctc

SEQ ID NO: 155029 - DNA, 20 bp, Homo sapiens
tatgctagtctattcatgta

SEQ ID NO: 155030 - DNA, 23 bp, Homo sapiens
tgtgtgtatatatgtgtgtgtgt

SEQ ID NO: 155031 - DNA, 19 bp, Homo sapiens
tttatttctgtttttctgg

SEQ ID NO: 155032 - DNA, 23 bp, Homo sapiens
atatatgtactactgaaagccat

SEQ ID NO: 155033 - DNA, 23 bp, Homo sapiens
tgagtcactcaccttctcttgag

SEQ ID NO: 155034 - DNA, 23 bp, Homo sapiens
tatatgcatgtatatgttcacat

SEQ ID NO: 155035 - DNA, 23 bp, Homo sapiens
atacactgaggttctggatgata

SEQ ID NO: 155036 - DNA, 23 bp, Homo sapiens
tgagttcattgtagattctggat

SEQ ID NO: 155037 - DNA, 23 bp, Homo sapiens
tgagttcattgtagattctggat

SEQ ID NO: 155038 - DNA, 22 bp, Homo sapiens
ttcttcactgcttgaatcctct

SEQ ID NO: 155039 - DNA, 23 bp, Homo sapiens
tctctgtctctatatctgtattt

SEQ ID NO: 155040 - DNA, 23 bp, Homo sapiens
ggagtgtctccctctgtcacccg

SEQ ID NO: 155041 - DNA, 23 bp, Homo sapiens
tgagttcattgtagattctggat

SEQ ID NO: 155042 - DNA, 23 bp, Homo sapiens
tgagttcattgtagattctggat

SEQ ID NO: 155043 - DNA, 23 bp, Homo sapiens
tgagttcattgtagattctggat

SEQ ID NO: 155044 - DNA, 23 bp, Homo sapiens
tgagttcattgtagattctggat

SEQ ID NO: 155045 - DNA, 21 bp, Homo sapiens
atatgtgtatgtatatgtata

SEQ ID NO: 155046 - DNA, 19 bp, Homo sapiens
gtgtgtgtgtatgtatata

SEQ ID NO: 155047 - DNA, 23 bp, Homo sapiens
taagatgtggatttcttttgttt

SEQ ID NO: 155048 - DNA, 23 bp, Homo sapiens
tgtctttggtttagaaggttatt

SEQ ID NO: 155049 - DNA, 22 bp, Homo sapiens
tctctgacaaaggatatttttt

SEQ ID NO: 155050 - DNA, 21 bp, Homo sapiens
agagaacagagtttgcagtgg

SEQ ID NO: 155051 - DNA, 23 bp, Homo sapiens
tcacacactctgtctttcatcct

SEQ ID NO: 155052 - DNA, 23 bp, Homo sapiens
gacagagtctcgctctgtcaccc

SEQ ID NO: 155053 - DNA, 20 bp, Homo sapiens
ctgaagatccctgtttctct

SEQ ID NO: 155054 - DNA, 23 bp, Homo sapiens
ttttttccaaatgaaaacagtga

SEQ ID NO: 155055 - DNA, 23 bp, Homo sapiens
tctctcaccctctctttgcctgt

SEQ ID NO: 155056 - DNA, 18 bp, Homo sapiens
atgcaacaagaaggtcct

SEQ ID NO: 155057 - DNA, 23 bp, Homo sapiens
acagagtctcgctctgtcaccca

SEQ ID NO: 155058 - DNA, 19 bp, Homo sapiens
aatttgctgacaatacaga

SEQ ID NO: 155059 - DNA, 23 bp, Homo sapiens
ctctctcagtctctctgagactg

SEQ ID NO: 155060 - DNA, 21 bp, Homo sapiens
agagtgagacctcatctctct

SEQ ID NO: 155061 - DNA, 22 bp, Homo sapiens
tgagacagagtctcgctctgtt

SEQ ID NO: 155062 - DNA, 23 bp, Homo sapiens
tgagacagtctctctctgttgcc

SEQ ID NO: 155063 - DNA, 20 bp, Homo sapiens
aatcacagtgtgatgctttg

SEQ ID NO: 155064 - DNA, 23 bp, Homo sapiens
gggtctcactctgtcacccaggc

SEQ ID NO: 155065 - DNA, 23 bp, Homo sapiens
gggtctcactctgtcacccaggc

SEQ ID NO: 155066 - DNA, 23 bp, Homo sapiens
gacagagtctcgctctgtcaccc

SEQ ID NO: 155067 - DNA, 23 bp, Homo sapiens
gggtctcactctgtcacccaagc

SEQ ID NO: 155068 - DNA, 23 bp, Homo sapiens
aacacagtgttcagtgtagctct

SEQ ID NO: 155069 - DNA, 23 bp, Homo sapiens
aaggtctcactctgtcacccagg

SEQ ID NO: 155070 - DNA, 22 bp, Homo sapiens
tatgtgtgtgcatgtatatata

SEQ ID NO: 155071 - DNA, 19 bp, Homo sapiens
tgtgtatatatatatacgt

SEQ ID NO: 155072 - DNA, 22 bp, Homo sapiens
tatatgacactatatgaataca

SEQ ID NO: 155073 - DNA, 21 bp, Homo sapiens
acatgtgcacattgtgcaggt

SEQ ID NO: 155074 - DNA, 19 bp, Homo sapiens
agagagtctccctctgtca

SEQ ID NO: 155075 - DNA, 19 bp, Homo sapiens
agcaattcagaagtttcag

SEQ ID NO: 155076 - DNA, 21 bp, Homo sapiens
tcaagacagggtctggctctg

SEQ ID NO: 155077 - DNA, 20 bp, Homo sapiens
gagagcgagactctgtctcc

SEQ ID NO: 155078 - DNA, 23 bp, Homo sapiens
acagagtctcactctgtcaccca

SEQ ID NO: 155079 - DNA, 22 bp, Homo sapiens
tgaaagagtctggctttttttt

SEQ ID NO: 155080 - DNA, 23 bp, Homo sapiens
agacaaggtctcactctgtcatc

SEQ ID NO: 155081 - DNA, 23 bp, Homo sapiens
tttcacttgattaccaatgcatg

SEQ ID NO: 155082 - DNA, 23 bp, Homo sapiens
aaaatggagattataggaatatg

SEQ ID NO: 155083 - DNA, 23 bp, Homo sapiens
aacaaaaatgagtttgtagtatc

SEQ ID NO: 155084 - DNA, 23 bp, Homo sapiens
tatatctagatatcgatatctag

SEQ ID NO: 155085 - DNA, 19 bp, Homo sapiens
tctgtacatatagatatct

SEQ ID NO: 155086 - DNA, 23 bp, Homo sapiens
tcttttttggttccatatgaact

SEQ ID NO: 155087 - DNA, 23 bp, Homo sapiens
tttttgagacagagtcttgtctc

SEQ ID NO: 155088 - DNA, 23 bp, Homo sapiens
gtgtttgcacatatgtatgtatg

SEQ ID NO: 155089 - DNA, 22 bp, Homo sapiens
tacatatacaaacacatgtgca

SEQ ID NO: 155090 - DNA, 20 bp, Homo sapiens
tcacaggaatttttacgaaa

SEQ ID NO: 155091 - DNA, 23 bp, Homo sapiens
tattgcttcaggatctaatgtga

SEQ ID NO: 155092 - DNA, 23 bp, Homo sapiens
gttgtgatttgaattgtctctct

SEQ ID NO: 155093 - DNA, 20 bp, Homo sapiens
atgacaggattttattcttt

SEQ ID NO: 155094 - DNA, 20 bp, Homo sapiens
tgtggatagactatactact

SEQ ID NO: 155095 - DNA, 18 bp, Homo sapiens
aggtatttatatgtgtat

SEQ ID NO: 155096 - DNA, 23 bp, Homo sapiens
gtagctcagcctctctcagtctc

SEQ ID NO: 155097 - DNA, 22 bp, Homo sapiens
aaacatcacaatttctttttct

SEQ ID NO: 155098 - DNA, 22 bp, Homo sapiens
ttctgagatggaatttcactct

SEQ ID NO: 155099 - DNA, 22 bp, Homo sapiens
aatgcgaggccctttgtttgaa

SEQ ID NO: 155100 - DNA, 23 bp, Homo sapiens
tgagtgagaacacatttgctgtt

SEQ ID NO: 155101 - DNA, 23 bp, Homo sapiens
aagctctctctgtgtctctaggg

SEQ ID NO: 155102 - DNA, 22 bp, Homo sapiens
atacagcttgcatatatatata

SEQ ID NO: 155103 - DNA, 21 bp, Homo sapiens
atacagcttgcatatatatat

SEQ ID NO: 155104 - DNA, 22 bp, Homo sapiens
atacagcttgcatatatatata

SEQ ID NO: 155105 - DNA, 23 bp, Homo sapiens
gtcaggctgagtgtgtgcctgtg

SEQ ID NO: 155106 - DNA, 23 bp, Homo sapiens
agcaagggtgaggcatttcgagt

SEQ ID NO: 155107 - DNA, 23 bp, Homo sapiens
attgaggagggtacacagcagct

SEQ ID NO: 155108 - DNA, 23 bp, Homo sapiens
agaaaagagactagtctcattat

SEQ ID NO: 155109 - DNA, 21 bp, Homo sapiens
tgagacaaggtctcgctctgt

SEQ ID NO: 155110 - DNA, 23 bp, Homo sapiens
ataacactttgcaatatttctaa

SEQ ID NO: 155111 - DNA, 23 bp, Homo sapiens
actattgtaattgttttggggtg

SEQ ID NO: 155112 - DNA, 23 bp, Homo sapiens
ttacttcagatttcatatgaagc

SEQ ID NO: 155113 - DNA, 20 bp, Homo sapiens
taaagtctgccaagctattc

SEQ ID NO: 155114 - DNA, 23 bp, Homo sapiens
tatctacatctatatctgtttat

SEQ ID NO: 155115 - DNA, 19 bp, Homo sapiens
ctccagtatatatgtgtat

SEQ ID NO: 155116 - DNA, 23 bp, Homo sapiens
atcataactgagtaatctgaatt

SEQ ID NO: 155117 - DNA, 23 bp, Homo sapiens
tgcagtggcatgatcatggctca

SEQ ID NO: 155118 - DNA, 23 bp, Homo sapiens
atatatgtgcatatatatggata

SEQ ID NO: 155119 - DNA, 23 bp, Homo sapiens
tatatatgtggatgtatatatgg

SEQ ID NO: 155120 - DNA, 19 bp, Homo sapiens
ttttgagacggagtctcac

SEQ ID NO: 155121 - DNA, 23 bp, Homo sapiens
tgtttggttaaccagctggttgt

SEQ ID NO: 155122 - DNA, 22 bp, Homo sapiens
ctctgtcacccagacttgagtg

SEQ ID NO: 155123 - DNA, 23 bp, Homo sapiens
ctactgtcagaagtgagtgagaa

SEQ ID NO: 155124 - DNA, 23 bp, Homo sapiens
cacaggtaagtcaaacagcagtt

SEQ ID NO: 155125 - DNA, 23 bp, Homo sapiens
ctgtctgtctgtctgtctgtcta

SEQ ID NO: 155126 - DNA, 23 bp, Homo sapiens
atgccatagacttttagtgtctc

SEQ ID NO: 155127 - DNA, 19 bp, Homo sapiens
aaacagttggatgtatggt

SEQ ID NO: 155128 - DNA, 23 bp, Homo sapiens
ttttgagacgtagtctcgctctg

SEQ ID NO: 155129 - DNA, 21 bp, Homo sapiens
aatcaggtagtttaggtaggg

SEQ ID NO: 155130 - DNA, 23 bp, Homo sapiens
gactgagtctcgctctgtcaccc

SEQ ID NO: 155131 - DNA, 23 bp, Homo sapiens
taacactgtgaaactctgtctct

SEQ ID NO: 155132 - DNA, 23 bp, Homo sapiens
ttatatgtatatgtatgtatgtg

SEQ ID NO: 155133 - DNA, 20 bp, Homo sapiens
tattcctagaatatatatag

SEQ ID NO: 155134 - DNA, 22 bp, Homo sapiens
gttagcagttctcactgatgaa

SEQ ID NO: 155135 - DNA, 23 bp, Homo sapiens
gagactgagtcttgctctgtcac

SEQ ID NO: 155136 - DNA, 23 bp, Homo sapiens
tgagatggagtttcactcttgtc

SEQ ID NO: 155137 - DNA, 18 bp, Homo sapiens
ttcctgcacactgtgatt

SEQ ID NO: 155138 - DNA, 20 bp, Homo sapiens
tgtctcgctctgtcacccag

SEQ ID NO: 155139 - DNA, 23 bp, Homo sapiens
aaatctgaatttttattagagtg

SEQ ID NO: 155140 - DNA, 23 bp, Homo sapiens
ttaagcaccttttcatgtgcctg

SEQ ID NO: 155141 - DNA, 23 bp, Homo sapiens
gcatgtgtctgtgtgtgtagagt

SEQ ID NO: 155142 - DNA, 23 bp, Homo sapiens
tgagttcattgtagattctggat

SEQ ID NO: 155143 - DNA, 23 bp, Homo sapiens
tgagttcattgtagattctggat

SEQ ID NO: 155144 - DNA, 23 bp, Homo sapiens
tttgagacggagtctcactctgt

SEQ ID NO: 155145 - DNA, 19 bp, Homo sapiens
tatgcatgtgtacgtgtgt

SEQ ID NO: 155146 - DNA, 23 bp, Homo sapiens
agagtctcactctgtctcccagg

SEQ ID NO: 155147 - DNA, 23 bp, Homo sapiens
ttttttgtttttcaaaacggaat

SEQ ID NO: 155148 - DNA, 18 bp, Homo sapiens
agttcaaggctgatcagt

SEQ ID NO: 155149 - DNA, 23 bp, Homo sapiens
gtacatgtgcaggatgtgcaggt

SEQ ID NO: 155150 - DNA, 23 bp, Homo sapiens
atcacactgtgggaacttgctga

SEQ ID NO: 155151 - DNA, 23 bp, Homo sapiens
tattgagcatctgtattagttag

SEQ ID NO: 155152 - DNA, 23 bp, Homo sapiens
acagagcaagaccctgtctcaaa

SEQ ID NO: 155153 - DNA, 23 bp, Homo sapiens
gagacagagtctcgctctgttgt

SEQ ID NO: 155154 - DNA, 21 bp, Homo sapiens
aagcaggatttgagtaattac

SEQ ID NO: 155155 - DNA, 23 bp, Homo sapiens
atgtatatgtttctcttcaggcg

SEQ ID NO: 155156 - DNA, 23 bp, Homo sapiens
atacacacaccatatatatatgt

SEQ ID NO: 155157 - DNA, 21 bp, Homo sapiens
aaactctccgaataaagtgtg

SEQ ID NO: 155158 - DNA, 23 bp, Homo sapiens
tggaagaggaattgaattgtttg

SEQ ID NO: 155159 - DNA, 23 bp, Homo sapiens
gcatgaggaaatcttttgcttgg

SEQ ID NO: 155160 - DNA, 22 bp, Homo sapiens
taagtatatatgtatatatgta

SEQ ID NO: 155161 - DNA, 20 bp, Homo sapiens
tatgtatacatatatgtgtg

SEQ ID NO: 155162 - DNA, 23 bp, Homo sapiens
tcagactcattctctgtccagtt

SEQ ID NO: 155163 - DNA, 20 bp, Homo sapiens
atatgtgtgtatatatatgt

SEQ ID NO: 155164 - DNA, 23 bp, Homo sapiens
atgtgtatatatgtatatgtata

SEQ ID NO: 155165 - DNA, 23 bp, Homo sapiens
tgtgtatatatatgcatatgtgt

SEQ ID NO: 155166 - DNA, 21 bp, Homo sapiens
gacaaagtggagatgggcgag

SEQ ID NO: 155167 - DNA, 22 bp, Homo sapiens
tattttgttctttactaaaggt

SEQ ID NO: 155168 - DNA, 21 bp, Homo sapiens
tatatagatagatatagatag

SEQ ID NO: 155169 - DNA, 23 bp, Homo sapiens
tctgtctgtccgtgtgtgtgcct

SEQ ID NO: 155170 - DNA, 18 bp, Homo sapiens
ttaagtcagcttgttctt

SEQ ID NO: 155171 - DNA, 21 bp, Homo sapiens
caggatgaaggttgtatagtt

SEQ ID NO: 155172 - DNA, 19 bp, Homo sapiens
atgtgtatgtatatgtaca

SEQ ID NO: 155173 - DNA, 22 bp, Homo sapiens
tggagatgagatcttcctctgt

SEQ ID NO: 155174 - DNA, 21 bp, Homo sapiens
tgtgtctttttctctgtgcaa

SEQ ID NO: 155175 - DNA, 23 bp, Homo sapiens
agatttcattcaaggtgtcaaac

SEQ ID NO: 155176 - DNA, 23 bp, Homo sapiens
cggagtctcgctctgtcgctcag

SEQ ID NO: 155177 - DNA, 20 bp, Homo sapiens
tatagatatctagatatatc

SEQ ID NO: 155178 - DNA, 23 bp, Homo sapiens
aatgcctgcctctcactatctct

SEQ ID NO: 155179 - DNA, 19 bp, Homo sapiens
ttatgaggtccaataagat

SEQ ID NO: 155180 - DNA, 23 bp, Homo sapiens
tgtcagtgtgtttttgtagtggc

SEQ ID NO: 155181 - DNA, 23 bp, Homo sapiens
tgcagcaattgaattttgacagg

SEQ ID NO: 155182 - DNA, 23 bp, Homo sapiens
tatgtgtactgtaggcaatggga

SEQ ID NO: 155183 - DNA, 20 bp, Homo sapiens
acagcaaatccatgtggtac

SEQ ID NO: 155184 - DNA, 23 bp, Homo sapiens
tttcctcagaagacactgtggac

SEQ ID NO: 155185 - DNA, 22 bp, Homo sapiens
accctctgcttctgattttctg

SEQ ID NO: 155186 - DNA, 20 bp, Homo sapiens
aaacacgtatgagtatacat

SEQ ID NO: 155187 - DNA, 20 bp, Homo sapiens
ctcagtctctcactgtccag

SEQ ID NO: 155188 - DNA, 19 bp, Homo sapiens
gcatctccatgttttcttt

SEQ ID NO: 155189 - DNA, 23 bp, Homo sapiens
tctgtgaagaaagtcattggtag

SEQ ID NO: 155190 - DNA, 19 bp, Homo sapiens
aaagaggctaagtaatgtg

SEQ ID NO: 155191 - DNA, 20 bp, Homo sapiens
gtgtgccaccatgcctggct

SEQ ID NO: 155192 - DNA, 23 bp, Homo sapiens
tgagttcattgtagattctggat

SEQ ID NO: 155193 - DNA, 23 bp, Homo sapiens
tgagttcattgtagattctggat

SEQ ID NO: 155194 - DNA, 20 bp, Homo sapiens
atctgtgtgttaggattttc

SEQ ID NO: 155195 - DNA, 23 bp, Homo sapiens
atcagagtggctgttcagcagct

SEQ ID NO: 155196 - DNA, 22 bp, Homo sapiens
ttttttcaggcagagtgttgtt

SEQ ID NO: 155197 - DNA, 20 bp, Homo sapiens
tgtctcgctctgtcacccag

SEQ ID NO: 155198 - DNA, 20 bp, Homo sapiens
acagtggcatgatcatggct

SEQ ID NO: 155199 - DNA, 23 bp, Homo sapiens
tttgattgggaatgcattgaatt

SEQ ID NO: 155200 - DNA, 23 bp, Homo sapiens
aactctgtttggttatggtgtat

SEQ ID NO: 155201 - DNA, 23 bp, Homo sapiens
gtgtgtgtatatatatacatatg

SEQ ID NO: 155202 - DNA, 23 bp, Homo sapiens
tgagttcattgtagattctggat

SEQ ID NO: 155203 - DNA, 23 bp, Homo sapiens
tgagttcattgtagattctggat

SEQ ID NO: 155204 - DNA, 23 bp, Homo sapiens
gagagacctagagttttgttttt

SEQ ID NO: 155205 - DNA, 23 bp, Homo sapiens
tagctttgctctgtcaccaggct

SEQ ID NO: 155206 - DNA, 23 bp, Homo sapiens
aacacttcttttggtgctgattt

SEQ ID NO: 155207 - DNA, 23 bp, Homo sapiens
ctgttctccatgtctatgaattt

SEQ ID NO: 155208 - DNA, 23 bp, Homo sapiens
tgctatatatgcacaatgtatat

SEQ ID NO: 155209 - DNA, 23 bp, Homo sapiens
atgtatgtgtgtatatgtgtgtg

SEQ ID NO: 155210 - DNA, 22 bp, Homo sapiens
ttggtccattgcaaaagtctcc

SEQ ID NO: 155211 - DNA, 21 bp, Homo sapiens
gtgtgagtctgtgtctgtgtg

SEQ ID NO: 155212 - DNA, 18 bp, Homo sapiens
ttgtggttctatatcaat

SEQ ID NO: 155213 - DNA, 23 bp, Homo sapiens
tgagttcattgtagattctggat

SEQ ID NO: 155214 - DNA, 23 bp, Homo sapiens
tgagttcattgtagattctggat

SEQ ID NO: 155215 - DNA, 23 bp, Homo sapiens
atagtgcttgtcattaccagcta

SEQ ID NO: 155216 - DNA, 18 bp, Homo sapiens
ccacaccctctctgtgtc

SEQ ID NO: 155217 - DNA, 23 bp, Homo sapiens
attaatgtatttgtataagtata

SEQ ID NO: 155218 - DNA, 22 bp, Homo sapiens
aaagctaccttaagaaatcaga

SEQ ID NO: 155219 - DNA, 22 bp, Homo sapiens
gtcaagttatatgtgtgtgtgt

SEQ ID NO: 155220 - DNA, 22 bp, Homo sapiens
tcattgtggtctgagaggagat

SEQ ID NO: 155221 - DNA, 23 bp, Homo sapiens
gtatatttcaactgccagaggtc

SEQ ID NO: 155222 - DNA, 23 bp, Homo sapiens
cacatagtaaatgttgagtgaat

SEQ ID NO: 155223 - DNA, 19 bp, Homo sapiens
agactgacacttttagtag

SEQ ID NO: 155224 - DNA, 23 bp, Homo sapiens
ctggttcaggcagtgagtagtgt

SEQ ID NO: 155225 - DNA, 21 bp, Homo sapiens
tggctcgctgcctgtttccgt

SEQ ID NO: 155226 - DNA, 23 bp, Homo sapiens
gacagagtctcgctctgtcaccc

SEQ ID NO: 155227 - DNA, 23 bp, Homo sapiens
gacagagtctcgctctgtcaccc

SEQ ID NO: 155228 - DNA, 23 bp, Homo sapiens
catatcagtgattatctagacat

SEQ ID NO: 155229 - DNA, 23 bp, Homo sapiens
ctctctcggtctcagctgaaatg

SEQ ID NO: 155230 - DNA, 23 bp, Homo sapiens
cggagtctcactctgtcacccag

SEQ ID NO: 155231 - DNA, 23 bp, Homo sapiens
gagtctcactctgtcacccaggc

SEQ ID NO: 155232 - DNA, 22 bp, Homo sapiens
agaaactgtcttcttccttact

SEQ ID NO: 155233 - DNA, 20 bp, Homo sapiens
gagtcctaatcgttagtcat

SEQ ID NO: 155234 - DNA, 23 bp, Homo sapiens
gggtctcactctgtcacccaggc

SEQ ID NO: 155235 - DNA, 23 bp, Homo sapiens
gagtctcactctgtcacccaggc

SEQ ID NO: 155236 - DNA, 23 bp, Homo sapiens
cgagtctcactctgtctcccagg

SEQ ID NO: 155237 - DNA, 23 bp, Homo sapiens
tgagtcggagtctcactctgtcg

SEQ ID NO: 155238 - DNA, 22 bp, Homo sapiens
tctcagtgggttaggtttctcc

SEQ ID NO: 155239 - DNA, 22 bp, Homo sapiens
agctcccacatgtagctgcagt

SEQ ID NO: 155240 - DNA, 23 bp, Homo sapiens
tgtccctgtgtctgagagtcacc

SEQ ID NO: 155241 - DNA, 21 bp, Homo sapiens
tagaaacagtctagtatgtca

SEQ ID NO: 155242 - DNA, 23 bp, Homo sapiens
agccgagatcatgccattgcact

SEQ ID NO: 155243 - DNA, 21 bp, Homo sapiens
gtgtgagaaatgagattgata

SEQ ID NO: 155244 - DNA, 22 bp, Homo sapiens
ttgagatagctgagagtggaga

SEQ ID NO: 155245 - DNA, 23 bp, Homo sapiens
atcattcaatttcactcttatgt

SEQ ID NO: 155246 - DNA, 19 bp, Homo sapiens
ctgagacctaaggtggttt

SEQ ID NO: 155247 - DNA, 23 bp, Homo sapiens
ttttcactgtagattctgtggac

SEQ ID NO: 155248 - DNA, 23 bp, Homo sapiens
tatggattctgtcagatggcaaa

SEQ ID NO: 155249 - DNA, 21 bp, Homo sapiens
atatgtatatatgaatatctt

SEQ ID NO: 155250 - DNA, 19 bp, Homo sapiens
taattagtgattttgaata

SEQ ID NO: 155251 - DNA, 23 bp, Homo sapiens
agatatgtatgtatgtatgtatc

SEQ ID NO: 155252 - DNA, 22 bp, Homo sapiens
tatctatatatatatgtgtgtg

SEQ ID NO: 155253 - DNA, 23 bp, Homo sapiens
tgagttcattgtagattctggat

SEQ ID NO: 155254 - DNA, 23 bp, Homo sapiens
tgagttcattgtagattctggat

SEQ ID NO: 155255 - DNA, 23 bp, Homo sapiens
tagccattctgattggtgtgaga

SEQ ID NO: 155256 - DNA, 23 bp, Homo sapiens
atagtggatgtatatatttatgt

SEQ ID NO: 155257 - DNA, 23 bp, Homo sapiens
actgagtctccctctgtctcttc

SEQ ID NO: 155258 - DNA, 19 bp, Homo sapiens
aagtgagctatgattgcac

SEQ ID NO: 155259 - DNA, 22 bp, Homo sapiens
tgacatgatgctgaaaggatat

SEQ ID NO: 155260 - DNA, 22 bp, Homo sapiens
tctgtgtgagaattcaagaagt

SEQ ID NO: 155261 - DNA, 23 bp, Homo sapiens
tgagttcattgtagattctggat

SEQ ID NO: 155262 - DNA, 23 bp, Homo sapiens
tgagttcattgtagattctggat

SEQ ID NO: 155263 - DNA, 23 bp, Homo sapiens
gcatatgacaggaattctttctt

SEQ ID NO: 155264 - DNA, 20 bp, Homo sapiens
atattcctttacatgcatat

SEQ ID NO: 155265 - DNA, 23 bp, Homo sapiens
agtgcctaacacagtgcctgccc

SEQ ID NO: 155266 - DNA, 23 bp, Homo sapiens
ttcagacagtggagagagagcag

SEQ ID NO: 155267 - DNA, 19 bp, Homo sapiens
tgacctcagcctccagggt

SEQ ID NO: 155268 - DNA, 23 bp, Homo sapiens
agacagtgtctctctatgttgtc

SEQ ID NO: 155269 - DNA, 22 bp, Homo sapiens
gtctcgctcactcagtgctcaa

SEQ ID NO: 155270 - DNA, 18 bp, Homo sapiens
agtagacagatgcatgtt

SEQ ID NO: 155271 - DNA, 19 bp, Homo sapiens
atgtgtgtatatatatgtg

SEQ ID NO: 155272 - DNA, 23 bp, Homo sapiens
agagtctctgtgtctttattcca

SEQ ID NO: 155273 - DNA, 19 bp, Homo sapiens
tccaaatgaaatttgtaac

SEQ ID NO: 155274 - DNA, 22 bp, Homo sapiens
tactggaataaagacaccctga

SEQ ID NO: 155275 - DNA, 22 bp, Homo sapiens
gtctcgctcactcagtgctcaa

SEQ ID NO: 155276 - DNA, 23 bp, Homo sapiens
tgagttcattgtagattctggat

SEQ ID NO: 155277 - DNA, 23 bp, Homo sapiens
tgagttcattgtagattctggat

SEQ ID NO: 155278 - DNA, 23 bp, Homo sapiens
actatggatttgtatggaatact

SEQ ID NO: 155279 - DNA, 23 bp, Homo sapiens
tgaataggttgttgtttaaggtg

SEQ ID NO: 155280 - DNA, 22 bp, Homo sapiens
gtgtgtgcctgtggtcctggct

SEQ ID NO: 155281 - DNA, 23 bp, Homo sapiens
ctgagtctcactctgtcgctcag

SEQ ID NO: 155282 - DNA, 20 bp, Homo sapiens
cagtggtatgatcttggctc

SEQ ID NO: 155283 - DNA, 23 bp, Homo sapiens
ggagtctcactctgtcacccagc

SEQ ID NO: 155284 - DNA, 21 bp, Homo sapiens
ttcaagtgattctcctgcctc

SEQ ID NO: 155285 - DNA, 23 bp, Homo sapiens
gggtctcactctgtcacccaggc

SEQ ID NO: 155286 - DNA, 23 bp, Homo sapiens
gggtctcactctgtcacccaggc

SEQ ID NO: 155287 - DNA, 19 bp, Homo sapiens
gtaagttgtaagcttcatg

SEQ ID NO: 155288 - DNA, 23 bp, Homo sapiens
gcctggcacagtggctcacactt

SEQ ID NO: 155289 - DNA, 23 bp, Homo sapiens
tggaactggataagtattgagaa

SEQ ID NO: 155290 - DNA, 23 bp, Homo sapiens
tggagtgagtctctcagagtctc

SEQ ID NO: 155291 - DNA, 22 bp, Homo sapiens
accagaagagggaggtgaggat

SEQ ID NO: 155292 - DNA, 23 bp, Homo sapiens
ccaggctgcctgcctgcctcact

SEQ ID NO: 155293 - DNA, 23 bp, Homo sapiens
cacatgcatgtgtgtgtacacac

SEQ ID NO: 155294 - DNA, 20 bp, Homo sapiens
atgtgtatatatatatatgt

SEQ ID NO: 155295 - DNA, 22 bp, Homo sapiens
taatgtagcaagtatttatgtt

SEQ ID NO: 155296 - DNA, 23 bp, Homo sapiens
atatactctgtactttttatctt

SEQ ID NO: 155297 - DNA, 19 bp, Homo sapiens
tttttttggagacagagtc

SEQ ID NO: 155298 - DNA, 18 bp, Homo sapiens
tgagacagagtctcactc

SEQ ID NO: 155299 - DNA, 20 bp, Homo sapiens
tatatatcttgagacagagt

SEQ ID NO: 155300 - DNA, 19 bp, Homo sapiens
gtgtgtgtgtgtgtgtatg

SEQ ID NO: 155301 - DNA, 22 bp, Homo sapiens
agtattgatcctggtgtgtctg

SEQ ID NO: 155302 - DNA, 22 bp, Homo sapiens
atacagtcagtgaaatactctt

SEQ ID NO: 155303 - DNA, 23 bp, Homo sapiens
tgagatggagtctcactctgtca

SEQ ID NO: 155304 - DNA, 23 bp, Homo sapiens
tatgtctgtctgtgtgtgtggca

SEQ ID NO: 155305 - DNA, 21 bp, Homo sapiens
atccaccagacaggccctgat

SEQ ID NO: 155306 - DNA, 23 bp, Homo sapiens
tgagttcattgtagattctggat

SEQ ID NO: 155307 - DNA, 23 bp, Homo sapiens
tgagttcattgtagattctggat

SEQ ID NO: 155308 - DNA, 22 bp, Homo sapiens
atatgtgcagaatgtgcaggtt

SEQ ID NO: 155309 - DNA, 23 bp, Homo sapiens
ttttttccttttgaagacaccca

SEQ ID NO: 155310 - DNA, 23 bp, Homo sapiens
agagtctcactctgtcacccagg

SEQ ID NO: 155311 - DNA, 23 bp, Homo sapiens
gagtctcactctgtcacccaggc

SEQ ID NO: 155312 - DNA, 23 bp, Homo sapiens
aatgctcacctgtaagattctct

SEQ ID NO: 155313 - DNA, 22 bp, Homo sapiens
attgcatatatattatttgtgt

SEQ ID NO: 155314 - DNA, 23 bp, Homo sapiens
agcagtagttcacactctttctc

SEQ ID NO: 155315 - DNA, 22 bp, Homo sapiens
cttagtagactttgcttgttca

SEQ ID NO: 155316 - DNA, 23 bp, Homo sapiens
gccttaggttttcttttccatgc

SEQ ID NO: 155317 - DNA, 23 bp, Homo sapiens
ttttttgctaccatatgaaattt

SEQ ID NO: 155318 - DNA, 21 bp, Homo sapiens
atttgcatatcatctttggag

SEQ ID NO: 155319 - DNA, 21 bp, Homo sapiens
tggaatcattagtctgtctta

SEQ ID NO: 155320 - DNA, 23 bp, Homo sapiens
tatgtatatatgcatacgtatac

SEQ ID NO: 155321 - DNA, 22 bp, Homo sapiens
tgtaagtatatatatatgtgtg

SEQ ID NO: 155322 - DNA, 23 bp, Homo sapiens
tgagttcattgtagattctggat

SEQ ID NO: 155323 - DNA, 23 bp, Homo sapiens
tgagttcattgtagattctggat

SEQ ID NO: 155324 - DNA, 18 bp, Homo sapiens
tgattttgtatcctgaga

SEQ ID NO: 155325 - DNA, 21 bp, Homo sapiens
cttgacttgttccagttctca

SEQ ID NO: 155326 - DNA, 21 bp, Homo sapiens
aatcacagggtgctatggttt

SEQ ID NO: 155327 - DNA, 23 bp, Homo sapiens
gtgtgtgtatatatatgtgtgtg

SEQ ID NO: 155328 - DNA, 22 bp, Homo sapiens
tatttcactgtgtctatgtacc

SEQ ID NO: 155329 - DNA, 23 bp, Homo sapiens
ttacatttgcaggtttgttacct

SEQ ID NO: 155330 - DNA, 19 bp, Homo sapiens
tgaggaagaattttaggct

SEQ ID NO: 155331 - DNA, 22 bp, Homo sapiens
tctctgtctctctggctcatct

SEQ ID NO: 155332 - DNA, 23 bp, Homo sapiens
ctactgagctgatgattgtaatg

SEQ ID NO: 155333 - DNA, 23 bp, Homo sapiens
cagtgcctgtgacagcctctgtg

SEQ ID NO: 155334 - DNA, 23 bp, Homo sapiens
ttactatttatgattgtctagtt

SEQ ID NO: 155335 - DNA, 23 bp, Homo sapiens
actctcagtgtgaatgctgggcc

SEQ ID NO: 155336 - DNA, 23 bp, Homo sapiens
atatatatgtgtgtgtatatgta

SEQ ID NO: 155337 - DNA, 23 bp, Homo sapiens
tatgtatgtgtgggtatgtatac

SEQ ID NO: 155338 - DNA, 19 bp, Homo sapiens
acagggactatatagacaa

SEQ ID NO: 155339 - DNA, 23 bp, Homo sapiens
tttcactgtggttgttgtctatg

SEQ ID NO: 155340 - DNA, 23 bp, Homo sapiens
acagagtctcactctgtccccca

SEQ ID NO: 155341 - DNA, 23 bp, Homo sapiens
gtgtgtgtgtgtgtatatataca

SEQ ID NO: 155342 - DNA, 21 bp, Homo sapiens
agcaaaacataatcaaatgta

SEQ ID NO: 155343 - DNA, 23 bp, Homo sapiens
attttgtgaatgtagattgtggt

SEQ ID NO: 155344 - DNA, 23 bp, Homo sapiens
ttactgaacaaaactgaaacaac

SEQ ID NO: 155345 - DNA, 22 bp, Homo sapiens
tgtacacatatgtatatgtgta

SEQ ID NO: 155346 - DNA, 23 bp, Homo sapiens
aatgcaagttgaaagtagtttgc

SEQ ID NO: 155347 - DNA, 21 bp, Homo sapiens
tgtgcttttttgatgtaaagt

SEQ ID NO: 155348 - DNA, 23 bp, Homo sapiens
tgagttcattgtagattctggat

SEQ ID NO: 155349 - DNA, 23 bp, Homo sapiens
tgagttcattgtagattctggat

SEQ ID NO: 155350 - DNA, 23 bp, Homo sapiens
tgtatgtgtgattaaaatgtgtg

SEQ ID NO: 155351 - DNA, 22 bp, Homo sapiens
taacaactctcattatgttgta

SEQ ID NO: 155352 - DNA, 23 bp, Homo sapiens
acagctctagatagctttggctt

SEQ ID NO: 155353 - DNA, 23 bp, Homo sapiens
tcagagcaatcttgtctgtgtga

SEQ ID NO: 155354 - DNA, 21 bp, Homo sapiens
ctgtcagtggatactgtctct

SEQ ID NO: 155355 - DNA, 21 bp, Homo sapiens
agactctctctatatatagag

SEQ ID NO: 155356 - DNA, 21 bp, Homo sapiens
tatagctatatatagatagct

SEQ ID NO: 155357 - DNA, 23 bp, Homo sapiens
agagtcagggtctcgctgtgttg

SEQ ID NO: 155358 - DNA, 23 bp, Homo sapiens
tgagttcattgtagattctggat

SEQ ID NO: 155359 - DNA, 23 bp, Homo sapiens
tgagttcattgtagattctggat

SEQ ID NO: 155360 - DNA, 19 bp, Homo sapiens
atctctctgtgaatggagt

SEQ ID NO: 155361 - DNA, 19 bp, Homo sapiens
tttgcccattcagtatgac

SEQ ID NO: 155362 - DNA, 23 bp, Homo sapiens
ctcccagagcccctggaactctg

SEQ ID NO: 155363 - DNA, 23 bp, Homo sapiens
tcccagagcccctggaactctgg

SEQ ID NO: 155364 - DNA, 23 bp, Homo sapiens
tcccagagcccctggaactctgg

SEQ ID NO: 155365 - DNA, 23 bp, Homo sapiens
tcccagagcccctggaactctgg

SEQ ID NO: 155366 - DNA, 23 bp, Homo sapiens
gatggagtctcactctgtcaccc

SEQ ID NO: 155367 - DNA, 23 bp, Homo sapiens
ttttctgtctggaagatttgtca

SEQ ID NO: 155368 - DNA, 21 bp, Homo sapiens
tctgtcccactctgtcaccca

SEQ ID NO: 155369 - DNA, 21 bp, Homo sapiens
tgaggtaggaggatcacttga

SEQ ID NO: 155370 - DNA, 20 bp, Homo sapiens
atgtttacacactaaagtgt

SEQ ID NO: 155371 - DNA, 23 bp, Homo sapiens
gtgtatcattgtggtaatgttct

SEQ ID NO: 155372 - DNA, 23 bp, Homo sapiens
tacacagtgtatatatgtgtgtg

SEQ ID NO: 155373 - DNA, 23 bp, Homo sapiens
tgtttgctatactattgtgttag

SEQ ID NO: 155374 - DNA, 20 bp, Homo sapiens
tgtgactgaagcgtttgaaa

SEQ ID NO: 155375 - DNA, 18 bp, Homo sapiens
tttgttttttgttttcag

SEQ ID NO: 155376 - DNA, 23 bp, Homo sapiens
catcattctactcagtgtgtcta

SEQ ID NO: 155377 - DNA, 23 bp, Homo sapiens
tgtctgtccctgtctctgtggct

SEQ ID NO: 155378 - DNA, 20 bp, Homo sapiens
agtggtgatatttcagttta

SEQ ID NO: 155379 - DNA, 23 bp, Homo sapiens
atgttctctgagaaaatctccct

SEQ ID NO: 155380 - DNA, 23 bp, Homo sapiens
aaatagctgggattacaggtgca

SEQ ID NO: 155381 - DNA, 23 bp, Homo sapiens
atatgtgtatatgtacatatatg

SEQ ID NO: 155382 - DNA, 23 bp, Homo sapiens
attgtcagtttgtcatttactaa

SEQ ID NO: 155383 - DNA, 23 bp, Homo sapiens
tgagacaagagacagagggtagg

SEQ ID NO: 155384 - DNA, 23 bp, Homo sapiens
agctctcaggttaactctttcag

SEQ ID NO: 155385 - DNA, 20 bp, Homo sapiens
tgtatgtatatgtgtgtgta

SEQ ID NO: 155386 - DNA, 20 bp, Homo sapiens
atactcacacacaaaaatgt

SEQ ID NO: 155387 - DNA, 23 bp, Homo sapiens
tctgagtgacgtactcttttttt

SEQ ID NO: 155388 - DNA, 23 bp, Homo sapiens
tgagttcattgtagattctggat

SEQ ID NO: 155389 - DNA, 23 bp, Homo sapiens
tgagttcattgtagattctggat

SEQ ID NO: 155390 - DNA, 19 bp, Homo sapiens
tatgtatttcttttaagct

SEQ ID NO: 155391 - DNA, 23 bp, Homo sapiens
agagacacaagtgaaggctgggt

SEQ ID NO: 155392 - DNA, 23 bp, Homo sapiens
ttttggtttcatatgaaatttaa

SEQ ID NO: 155393 - DNA, 22 bp, Homo sapiens
tagatagatatagatatagata

SEQ ID NO: 155394 - DNA, 19 bp, Homo sapiens
atatagatagatatagata

SEQ ID NO: 155395 - DNA, 20 bp, Homo sapiens
tattgcttaatctttagcct

SEQ ID NO: 155396 - DNA, 23 bp, Homo sapiens
aggaaatctttattaattaaagt

SEQ ID NO: 155397 - DNA, 23 bp, Homo sapiens
gggtagtacaaagtgtatacaga

SEQ ID NO: 155398 - DNA, 18 bp, Homo sapiens
atatattgaaaaagaaag

SEQ ID NO: 155399 - DNA, 21 bp, Homo sapiens
atgtatgtatacatgtgtgta

SEQ ID NO: 155400 - DNA, 22 bp, Homo sapiens
tatctatatatctatttgtctc

SEQ ID NO: 155401 - DNA, 19 bp, Homo sapiens
tgagtgtttgtgttccagg

SEQ ID NO: 155402 - DNA, 21 bp, Homo sapiens
atatttacatgcaaatatgtg

SEQ ID NO: 155403 - DNA, 23 bp, Homo sapiens
tacacacacatatatatatgtgt

SEQ ID NO: 155404 - DNA, 23 bp, Homo sapiens
agacacagtctctttctgatgag

SEQ ID NO: 155405 - DNA, 22 bp, Homo sapiens
tattctgcatatataatcatat

SEQ ID NO: 155406 - DNA, 23 bp, Homo sapiens
aatgttcagtaggaacactggcc

SEQ ID NO: 155407 - DNA, 23 bp, Homo sapiens
ctgtgtctgtctggttttggtat

SEQ ID NO: 155408 - DNA, 19 bp, Homo sapiens
aagtctatgctcttagcat

SEQ ID NO: 155409 - DNA, 23 bp, Homo sapiens
tattttagttttggatgtcaggt

SEQ ID NO: 155410 - DNA, 23 bp, Homo sapiens
tgaaacacattttgtacttctga

SEQ ID NO: 155411 - DNA, 18 bp, Homo sapiens
ttacaaaagtatacagtg

SEQ ID NO: 155412 - DNA, 23 bp, Homo sapiens
agcatctgaagctgcactgcaag

SEQ ID NO: 155413 - DNA, 19 bp, Homo sapiens
tatgtatgtatatatttga

SEQ ID NO: 155414 - DNA, 23 bp, Homo sapiens
tatatgcatatatattctgcttt

SEQ ID NO: 155415 - DNA, 21 bp, Homo sapiens
tatgtgtgcatgtgcatgtgc

SEQ ID NO: 155416 - DNA, 21 bp, Homo sapiens
atatgtatatatacgtgtgtg

SEQ ID NO: 155417 - DNA, 23 bp, Homo sapiens
agacagtgactcactctgtcatc

SEQ ID NO: 155418 - DNA, 23 bp, Homo sapiens
aatgagagttcacagtgtgctca

SEQ ID NO: 155419 - DNA, 20 bp, Homo sapiens
tttgtcaatgatattttgta

SEQ ID NO: 155420 - DNA, 23 bp, Homo sapiens
tgagttcattgtagattctggat

SEQ ID NO: 155421 - DNA, 23 bp, Homo sapiens
tgagttcattgtagattctggat

SEQ ID NO: 155422 - DNA, 23 bp, Homo sapiens
tatgtgtatatatacgtgtgtgt

SEQ ID NO: 155423 - DNA, 22 bp, Homo sapiens
tgtgagagaggtatgtagcttt

SEQ ID NO: 155424 - DNA, 23 bp, Homo sapiens
atacactacatacacatatgtag

SEQ ID NO: 155425 - DNA, 23 bp, Homo sapiens
aatgtctgtgtatatatatgtgt

SEQ ID NO: 155426 - DNA, 23 bp, Homo sapiens
tgagttcattgtagattctggat

SEQ ID NO: 155427 - DNA, 23 bp, Homo sapiens
tgagttcattgtagattctggat

SEQ ID NO: 155428 - DNA, 23 bp, Homo sapiens
actttactgaatttgtttatcag

SEQ ID NO: 155429 - DNA, 23 bp, Homo sapiens
ttcctctctcgctcattttgagg

SEQ ID NO: 155430 - DNA, 23 bp, Homo sapiens
tgcatgtgtatatgtatgtgtgt

SEQ ID NO: 155431 - DNA, 23 bp, Homo sapiens
aaatatgcatatatattcacaaa

SEQ ID NO: 155432 - DNA, 23 bp, Homo sapiens
tacagacacttattctagctgaa

SEQ ID NO: 155433 - DNA, 23 bp, Homo sapiens
aagagacaagtctctgggttagt

SEQ ID NO: 155434 - DNA, 18 bp, Homo sapiens
atgagccacagtgtctgg

SEQ ID NO: 155435 - DNA, 23 bp, Homo sapiens
agtgtctcactctgtcatcctgg

SEQ ID NO: 155436 - DNA, 21 bp, Homo sapiens
tgacagagcgagactcttgtc

SEQ ID NO: 155437 - DNA, 22 bp, Homo sapiens
agacagaatctcgctctgtctc

SEQ ID NO: 155438 - DNA, 21 bp, Homo sapiens
tctgacttggttacatacacc

SEQ ID NO: 155439 - DNA, 21 bp, Homo sapiens
ttatttgtagttaactagtgt

SEQ ID NO: 155440 - DNA, 23 bp, Homo sapiens
caggatgtgtctatttattaact

SEQ ID NO: 155441 - DNA, 22 bp, Homo sapiens
tatcagtgtgattgtacttttt

SEQ ID NO: 155442 - DNA, 18 bp, Homo sapiens
tctgaataataaatggag

SEQ ID NO: 155443 - DNA, 23 bp, Homo sapiens
aggtacatgtgcaggatgtgcag

SEQ ID NO: 155444 - DNA, 22 bp, Homo sapiens
aaatctctccttttcaattttt

SEQ ID NO: 155445 - DNA, 22 bp, Homo sapiens
ttttatgtaaatgcacatattg

SEQ ID NO: 155446 - DNA, 23 bp, Homo sapiens
tggagtctcactctgtcacccag

SEQ ID NO: 155447 - DNA, 23 bp, Homo sapiens
tggagtctcactctgtcacccag

SEQ ID NO: 155448 - DNA, 18 bp, Homo sapiens
ttcacttatgatttggct

SEQ ID NO: 155449 - DNA, 23 bp, Homo sapiens
aaggttaatattgatatgtgagt

SEQ ID NO: 155450 - DNA, 23 bp, Homo sapiens
ttttgttatgactgatttattag

SEQ ID NO: 155451 - DNA, 19 bp, Homo sapiens
tcagagactgacaatacgc

SEQ ID NO: 155452 - DNA, 23 bp, Homo sapiens
atttggataagaaataggattgt

SEQ ID NO: 155453 - DNA, 21 bp, Homo sapiens
tttggatttttttctaagtga

SEQ ID NO: 155454 - DNA, 21 bp, Homo sapiens
ttgcttgtttgtttaattgtg

SEQ ID NO: 155455 - DNA, 23 bp, Homo sapiens
tgagttcattgtagattctggat

SEQ ID NO: 155456 - DNA, 23 bp, Homo sapiens
tgagttcattgtagattctggat

SEQ ID NO: 155457 - DNA, 19 bp, Homo sapiens
agtgcatttattatcacaa

SEQ ID NO: 155458 - DNA, 21 bp, Homo sapiens
tatacacacacatacaaatgt

SEQ ID NO: 155459 - DNA, 23 bp, Homo sapiens
atatatgtctgtgtgtgcgtgcg

SEQ ID NO: 155460 - DNA, 19 bp, Homo sapiens
gtgtgtgtaagtgaatggc

SEQ ID NO: 155461 - DNA, 23 bp, Homo sapiens
gtaaatatttatctttagagtat

SEQ ID NO: 155462 - DNA, 23 bp, Homo sapiens
tgagatttagaagattttcttct

SEQ ID NO: 155463 - DNA, 18 bp, Homo sapiens
tgtctgaaagttttattg

SEQ ID NO: 155464 - DNA, 23 bp, Homo sapiens
catgagacagattgaggtgggtt

SEQ ID NO: 155465 - DNA, 23 bp, Homo sapiens
aatgtgtatgtatatatgtatct

SEQ ID NO: 155466 - DNA, 20 bp, Homo sapiens
tacctggttcatctcattgg

SEQ ID NO: 155467 - DNA, 18 bp, Homo sapiens
atatatgtgcaggattct

SEQ ID NO: 155468 - DNA, 21 bp, Homo sapiens
acatgtgcacaatgtgcaggt

SEQ ID NO: 155469 - DNA, 19 bp, Homo sapiens
tctgcaatgagctctgatt

SEQ ID NO: 155470 - DNA, 19 bp, Homo sapiens
tgagagagaacagcaggga

SEQ ID NO: 155471 - DNA, 23 bp, Homo sapiens
tctctggctccctgtgtggctga

SEQ ID NO: 155472 - DNA, 23 bp, Homo sapiens
tgttacagctcttgactgtgggt

SEQ ID NO: 155473 - DNA, 22 bp, Homo sapiens
ggcaagagcatgtgctttggag

SEQ ID NO: 155474 - DNA, 21 bp, Homo sapiens
tcactgagtgtatgctgtagg

SEQ ID NO: 155475 - DNA, 23 bp, Homo sapiens
tgttaagtttaggtccatagtaa

SEQ ID NO: 155476 - DNA, 20 bp, Homo sapiens
ttgactattaatatgattgt

SEQ ID NO: 155477 - DNA, 23 bp, Homo sapiens
tttctcagtaaagtaggatggtt

SEQ ID NO: 155478 - DNA, 23 bp, Homo sapiens
ggttcactcctgtaatctcagca

SEQ ID NO: 155479 - DNA, 20 bp, Homo sapiens
tgaggtaggaggatcacttg

SEQ ID NO: 155480 - DNA, 22 bp, Homo sapiens
tttcagcatattttttcccact

SEQ ID NO: 155481 - DNA, 18 bp, Homo sapiens
tgccaggctcggtgtttg

SEQ ID NO: 155482 - DNA, 21 bp, Homo sapiens
atcaccttcgtactggctctg

SEQ ID NO: 155483 - DNA, 19 bp, Homo sapiens
atatatagtattgtttggc

SEQ ID NO: 155484 - DNA, 18 bp, Homo sapiens
aaagtgctgggattacag

SEQ ID NO: 155485 - DNA, 23 bp, Homo sapiens
cggagtctcactctgtcacccag

SEQ ID NO: 155486 - DNA, 23 bp, Homo sapiens
ggcctcactcagtcacccagact

SEQ ID NO: 155487 - DNA, 18 bp, Homo sapiens
tttatgtagacataactt

SEQ ID NO: 155488 - DNA, 22 bp, Homo sapiens
gagttatgagcatctctatttt

SEQ ID NO: 155489 - DNA, 21 bp, Homo sapiens
gagtctcactcactctgttgc

SEQ ID NO: 155490 - DNA, 21 bp, Homo sapiens
ctctgtgcctctgtggggctg

SEQ ID NO: 155491 - DNA, 20 bp, Homo sapiens
atatgtatatgtatatatgt

SEQ ID NO: 155492 - DNA, 20 bp, Homo sapiens
atacacacatatgtatatgt

SEQ ID NO: 155493 - DNA, 19 bp, Homo sapiens
atacacacacatatataca

SEQ ID NO: 155494 - DNA, 21 bp, Homo sapiens
atatgtgtatatgtatatgta

SEQ ID NO: 155495 - DNA, 23 bp, Homo sapiens
ttctttttctgtctcttaccaga

SEQ ID NO: 155496 - DNA, 18 bp, Homo sapiens
aaacaggtgagtatgctg

SEQ ID NO: 155497 - DNA, 21 bp, Homo sapiens
ttgagacagagtctcgctctg

SEQ ID NO: 155498 - DNA, 22 bp, Homo sapiens
ttatttcaaaaagaaaatgaca

SEQ ID NO: 155499 - DNA, 23 bp, Homo sapiens
attttgagatggcgtttcactct

SEQ ID NO: 155500 - DNA, 21 bp, Homo sapiens
agccactattagcaaaattgt

SEQ ID NO: 155501 - DNA, 23 bp, Homo sapiens
gagtctcactctgtcacccaggc

SEQ ID NO: 155502 - DNA, 23 bp, Homo sapiens
tgaaacagagtctctgtgttgcc

SEQ ID NO: 155503 - DNA, 23 bp, Homo sapiens
cagagtctcagtctgtcacccag

SEQ ID NO: 155504 - DNA, 21 bp, Homo sapiens
tgagtatatttatatatgtgt

SEQ ID NO: 155505 - DNA, 23 bp, Homo sapiens
tatatgtgtgtgtatatgtatag

SEQ ID NO: 155506 - DNA, 19 bp, Homo sapiens
aactccatctcaaaaaaag

SEQ ID NO: 155507 - DNA, 23 bp, Homo sapiens
tctggaaaagaaagaaataccta

SEQ ID NO: 155508 - DNA, 23 bp, Homo sapiens
ttttgagacagtctctcgctctg

SEQ ID NO: 155509 - DNA, 23 bp, Homo sapiens
tgtatgtatgtgtgcgtgtgtgt

SEQ ID NO: 155510 - DNA, 23 bp, Homo sapiens
cacacacgcacacatatacatat

SEQ ID NO: 155511 - DNA, 23 bp, Homo sapiens
tttaggtactctgaggaaatcac

SEQ ID NO: 155512 - DNA, 23 bp, Homo sapiens
tgagttcattgtagattctggat

SEQ ID NO: 155513 - DNA, 23 bp, Homo sapiens
tgagttcattgtagattctggat

SEQ ID NO: 155514 - DNA, 19 bp, Homo sapiens
tgtatatatgtatacatgt

SEQ ID NO: 155515 - DNA, 23 bp, Homo sapiens
ctgtgacacatttgagaggcagc

SEQ ID NO: 155516 - DNA, 21 bp, Homo sapiens
gatctggatgaaaaaggaaaa

SEQ ID NO: 155517 - DNA, 22 bp, Homo sapiens
tgaagacagaactttgtgtcca

SEQ ID NO: 155518 - DNA, 23 bp, Homo sapiens
cagaatctcactgtgtctcccag

SEQ ID NO: 155519 - DNA, 19 bp, Homo sapiens
tgaccttgtttgaaatttt

SEQ ID NO: 155520 - DNA, 18 bp, Homo sapiens
tatacgtagaatatattt

SEQ ID NO: 155521 - DNA, 20 bp, Homo sapiens
agtgacacagtcttggctct

SEQ ID NO: 155522 - DNA, 18 bp, Homo sapiens
ttttgttgtgaatttgat

SEQ ID NO: 155523 - DNA, 23 bp, Homo sapiens
tttgtctatttctctctgctaga

SEQ ID NO: 155524 - DNA, 23 bp, Homo sapiens
taaacagtgtatatatatgtgtg

SEQ ID NO: 155525 - DNA, 23 bp, Homo sapiens
gactcagagaagacagagtggag

SEQ ID NO: 155526 - DNA, 22 bp, Homo sapiens
ttacctgttgtatgtgaggctg

SEQ ID NO: 155527 - DNA, 23 bp, Homo sapiens
agaccattgaagataaagaagac

SEQ ID NO: 155528 - DNA, 23 bp, Homo sapiens
gacaaggtctcactctgtcaccc

SEQ ID NO: 155529 - DNA, 22 bp, Homo sapiens
tagagagcagtgagtgaagaga

SEQ ID NO: 155530 - DNA, 23 bp, Homo sapiens
tttactgttgtttcatgatctgt

SEQ ID NO: 155531 - DNA, 23 bp, Homo sapiens
tgttctttttgcttagaattgtc

SEQ ID NO: 155532 - DNA, 23 bp, Homo sapiens
tctgtgaagaaagtcaatggtag

SEQ ID NO: 155533 - DNA, 23 bp, Homo sapiens
actatagacatgtgctaccacac

SEQ ID NO: 155534 - DNA, 22 bp, Homo sapiens
aaatgctgtctgcttatggttt

SEQ ID NO: 155535 - DNA, 22 bp, Homo sapiens
aaactagccagacacagtggct

SEQ ID NO: 155536 - DNA, 21 bp, Homo sapiens
tatttttaaagaggcagcctg

SEQ ID NO: 155537 - DNA, 23 bp, Homo sapiens
tggagtctcactctgtcacccag

SEQ ID NO: 155538 - DNA, 22 bp, Homo sapiens
cagagtgagactccagcttttt

SEQ ID NO: 155539 - DNA, 23 bp, Homo sapiens
ttgagacagagtctcgctctgtc

SEQ ID NO: 155540 - DNA, 23 bp, Homo sapiens
gacagagtctcgctctgtcaccc

SEQ ID NO: 155541 - DNA, 23 bp, Homo sapiens
cggagtctcactctgtcacccag

SEQ ID NO: 155542 - DNA, 23 bp, Homo sapiens
gagtctcactctgtcacccaggc

SEQ ID NO: 155543 - DNA, 21 bp, Homo sapiens
cagagcctcactctgtctccc

SEQ ID NO: 155544 - DNA, 23 bp, Homo sapiens
gtggagtacagagtgtagtggca

SEQ ID NO: 155545 - DNA, 21 bp, Homo sapiens
tgaggtaggaggatcacttga

SEQ ID NO: 155546 - DNA, 21 bp, Homo sapiens
taaagtgcattttgcttaact

SEQ ID NO: 155547 - DNA, 23 bp, Homo sapiens
gggtctgtctctgtcacccaggc

SEQ ID NO: 155548 - DNA, 23 bp, Homo sapiens
ctgcgtctgcctgtcccactgtg

SEQ ID NO: 155549 - DNA, 18 bp, Homo sapiens
tgattttgtaacctgaga

SEQ ID NO: 155550 - DNA, 23 bp, Homo sapiens
acagtgagaacagagtgagtgga

SEQ ID NO: 155551 - DNA, 23 bp, Homo sapiens
tgagttcattgtagattctggat

SEQ ID NO: 155552 - DNA, 23 bp, Homo sapiens
tgagttcattgtagattctggat

SEQ ID NO: 155553 - DNA, 23 bp, Homo sapiens
tagtgtttccatatgaattgtag

SEQ ID NO: 155554 - DNA, 23 bp, Homo sapiens
tctgtgaagaatgtgattggcat

SEQ ID NO: 155555 - DNA, 22 bp, Homo sapiens
gaactaagaagagtgagagctc

SEQ ID NO: 155556 - DNA, 23 bp, Homo sapiens
tgaggatgaaggtagaatggcaa

SEQ ID NO: 155557 - DNA, 22 bp, Homo sapiens
attttagatgttttggtaagaa

SEQ ID NO: 155558 - DNA, 23 bp, Homo sapiens
atgtgtgtatatgtatatatttg

SEQ ID NO: 155559 - DNA, 21 bp, Homo sapiens
tatgaaattgaaattggttga

SEQ ID NO: 155560 - DNA, 23 bp, Homo sapiens
atgtgtgtgtatatgtatgtata

SEQ ID NO: 155561 - DNA, 19 bp, Homo sapiens
gaatttatcagttaatgtt

SEQ ID NO: 155562 - DNA, 22 bp, Homo sapiens
tatctgagacagagtttcaaga

SEQ ID NO: 155563 - DNA, 23 bp, Homo sapiens
tgtataaatgtatgcatatcact

SEQ ID NO: 155564 - DNA, 23 bp, Homo sapiens
tatgttccctttcctacaggttg

SEQ ID NO: 155565 - DNA, 23 bp, Homo sapiens
tttatatgtacatttatatgtac

SEQ ID NO: 155566 - DNA, 21 bp, Homo sapiens
atatacatacatgtttatatg

SEQ ID NO: 155567 - DNA, 21 bp, Homo sapiens
agacacaacacacagggtgct

SEQ ID NO: 155568 - DNA, 20 bp, Homo sapiens
acactacaaggttctctcag

SEQ ID NO: 155569 - DNA, 23 bp, Homo sapiens
ataaagtgtgtgtgtgtatatac

SEQ ID NO: 155570 - DNA, 23 bp, Homo sapiens
gagatatatgtatgtgtgcatgc

SEQ ID NO: 155571 - DNA, 23 bp, Homo sapiens
atgtgtgtgtgtgtatatatata

SEQ ID NO: 155572 - DNA, 23 bp, Homo sapiens
tgagttcattgtagattctggat

SEQ ID NO: 155573 - DNA, 23 bp, Homo sapiens
tgagttcattgtagattctggat

SEQ ID NO: 155574 - DNA, 23 bp, Homo sapiens
tatgtaaatatatacgtgtgtgt

SEQ ID NO: 155575 - DNA, 23 bp, Homo sapiens
tttagtgaaaagttatgaagata

SEQ ID NO: 155576 - DNA, 20 bp, Homo sapiens
aagatgagaaaatttgctgt

SEQ ID NO: 155577 - DNA, 23 bp, Homo sapiens
aagagagagtggagatagtggtg

SEQ ID NO: 155578 - DNA, 20 bp, Homo sapiens
tctaaatttctatatctgta

SEQ ID NO: 155579 - DNA, 22 bp, Homo sapiens
tttttgacagtcatagaagttt

SEQ ID NO: 155580 - DNA, 23 bp, Homo sapiens
tgagttcattgtagattctggat

SEQ ID NO: 155581 - DNA, 23 bp, Homo sapiens
tgagttcattgtagattctggat

SEQ ID NO: 155582 - DNA, 20 bp, Homo sapiens
agttatattatatatgtgtg

SEQ ID NO: 155583 - DNA, 18 bp, Homo sapiens
tatacccatatgatatca

SEQ ID NO: 155584 - DNA, 23 bp, Homo sapiens
ataaatctatatatgtatgtgtg

SEQ ID NO: 155585 - DNA, 23 bp, Homo sapiens
gtgtgtgtatatatatatgtgtg

SEQ ID NO: 155586 - DNA, 23 bp, Homo sapiens
gttaaaggaagagatttcccttt

SEQ ID NO: 155587 - DNA, 23 bp, Homo sapiens
tgtgtgtgtatatatgtgtgtat

SEQ ID NO: 155588 - DNA, 23 bp, Homo sapiens
gctctgtcacccagactggagtg

SEQ ID NO: 155589 - DNA, 23 bp, Homo sapiens
caaagaagtatctgtgcagctgc

SEQ ID NO: 155590 - DNA, 21 bp, Homo sapiens
atgtgtatttgtatagataga

SEQ ID NO: 155591 - DNA, 23 bp, Homo sapiens
tatattattgtctgtacttgaag

SEQ ID NO: 155592 - DNA, 20 bp, Homo sapiens
attctccctttttgtagtgt

SEQ ID NO: 155593 - DNA, 23 bp, Homo sapiens
acactctctccctgtgtcctcac

SEQ ID NO: 155594 - DNA, 22 bp, Homo sapiens
tgtccagtgcattagttgtgtg

SEQ ID NO: 155595 - DNA, 18 bp, Homo sapiens
acacaagatgcagtgtat

SEQ ID NO: 155596 - DNA, 23 bp, Homo sapiens
tgagttcattgtagattctggat

SEQ ID NO: 155597 - DNA, 23 bp, Homo sapiens
tgagttcattgtagattctggat

SEQ ID NO: 155598 - DNA, 21 bp, Homo sapiens
ataggctttttatttttttgt

SEQ ID NO: 155599 - DNA, 23 bp, Homo sapiens
tgagttcattgtagattctggat

SEQ ID NO: 155600 - DNA, 23 bp, Homo sapiens
tgagttcattgtagattctggat

SEQ ID NO: 155601 - DNA, 21 bp, Homo sapiens
gatgagaatttttctttatcc

SEQ ID NO: 155602 - DNA, 23 bp, Homo sapiens
actgagtctctctctgtcgccca

SEQ ID NO: 155603 - DNA, 23 bp, Homo sapiens
agagtctcactctgtcacccagg

SEQ ID NO: 155604 - DNA, 23 bp, Homo sapiens
atatgtatatatatatatgtgtg

SEQ ID NO: 155605 - DNA, 19 bp, Homo sapiens
acacacacatatctcatat

SEQ ID NO: 155606 - DNA, 21 bp, Homo sapiens
catgtgtatgcatatatacgt

SEQ ID NO: 155607 - DNA, 23 bp, Homo sapiens
tctctgtgtgtctttacagatga

SEQ ID NO: 155608 - DNA, 23 bp, Homo sapiens
attggcactggctgaattctgcc

SEQ ID NO: 155609 - DNA, 23 bp, Homo sapiens
tgagttcattgtagattctggat

SEQ ID NO: 155610 - DNA, 23 bp, Homo sapiens
tgagttcattgtagattctggat

SEQ ID NO: 155611 - DNA, 23 bp, Homo sapiens
tagagaggcaactgaagtggtga

SEQ ID NO: 155612 - DNA, 21 bp, Homo sapiens
cactcagtgtgtcacggtata

SEQ ID NO: 155613 - DNA, 23 bp, Homo sapiens
agtgttaatttgattacagatga

SEQ ID NO: 155614 - DNA, 23 bp, Homo sapiens
ggttcactgaacatggcaatgtg

SEQ ID NO: 155615 - DNA, 23 bp, Homo sapiens
tacatgtgcagaatgtgcaggtt

SEQ ID NO: 155616 - DNA, 21 bp, Homo sapiens
ctttttaatgaattgagtgtc

SEQ ID NO: 155617 - DNA, 22 bp, Homo sapiens
tatgtgtatatatatgtgtgtg

SEQ ID NO: 155618 - DNA, 19 bp, Homo sapiens
acacacacatatatatatt

SEQ ID NO: 155619 - DNA, 22 bp, Homo sapiens
ggatgacatgactatatctttt

SEQ ID NO: 155620 - DNA, 21 bp, Homo sapiens
tttctctctcacacattttgg

SEQ ID NO: 155621 - DNA, 23 bp, Homo sapiens
tgagaagttgatttgttagtttg

SEQ ID NO: 155622 - DNA, 23 bp, Homo sapiens
tggagtctcactctgtcacccag

SEQ ID NO: 155623 - DNA, 23 bp, Homo sapiens
ctcctgtctcactctctgcccat

SEQ ID NO: 155624 - DNA, 23 bp, Homo sapiens
agctgtctctctgtctctggctg

SEQ ID NO: 155625 - DNA, 20 bp, Homo sapiens
agggggagaaaataggaaat

SEQ ID NO: 155626 - DNA, 23 bp, Homo sapiens
acagtgactcacacctgtaatct

SEQ ID NO: 155627 - DNA, 23 bp, Homo sapiens
tgagacggagtctccctctgtct

SEQ ID NO: 155628 - DNA, 23 bp, Homo sapiens
tgagttcattgtagattctggat

SEQ ID NO: 155629 - DNA, 23 bp, Homo sapiens
tgagttcattgtagattctggat

SEQ ID NO: 155630 - DNA, 19 bp, Homo sapiens
tgcttatgatttccttggc

SEQ ID NO: 155631 - DNA, 21 bp, Homo sapiens
attctgtgaggaaagtcagtg

SEQ ID NO: 155632 - DNA, 23 bp, Homo sapiens
gtgctgtgctaatacattctgat

SEQ ID NO: 155633 - DNA, 23 bp, Homo sapiens
tgagacagaatctcactctgtct

SEQ ID NO: 155634 - DNA, 23 bp, Homo sapiens
tcagtctcccgctcatcagttgc

SEQ ID NO: 155635 - DNA, 23 bp, Homo sapiens
ctctggatctgtatctcttctga

SEQ ID NO: 155636 - DNA, 22 bp, Homo sapiens
tagcaggcgctgatagtcttga

SEQ ID NO: 155637 - DNA, 18 bp, Homo sapiens
tggctctttgtttagatt

SEQ ID NO: 155638 - DNA, 19 bp, Homo sapiens
aacagaagtatgagagccc

SEQ ID NO: 155639 - DNA, 20 bp, Homo sapiens
gttttgttttgtacctcata

SEQ ID NO: 155640 - DNA, 22 bp, Homo sapiens
agaagtccagaatgaattgttt

SEQ ID NO: 155641 - DNA, 18 bp, Homo sapiens
tgtgagacaggaagtcca

SEQ ID NO: 155642 - DNA, 23 bp, Homo sapiens
ccactctcactgcctcaccctct

SEQ ID NO: 155643 - DNA, 23 bp, Homo sapiens
tgagacggagtctcactctgtca

SEQ ID NO: 155644 - DNA, 23 bp, Homo sapiens
ctctgagtgtcagtcagtcagcc

SEQ ID NO: 155645 - DNA, 23 bp, Homo sapiens
aggtctcactctgtcacccaggc

SEQ ID NO: 155646 - DNA, 23 bp, Homo sapiens
actgtctcagggtctctaccctc

SEQ ID NO: 155647 - DNA, 20 bp, Homo sapiens
tgaggttggaggatcacttg

SEQ ID NO: 155648 - DNA, 23 bp, Homo sapiens
gatggagtctcactgtgtcaccc

SEQ ID NO: 155649 - DNA, 23 bp, Homo sapiens
ttctcagtggctctgtgtggctg

SEQ ID NO: 155650 - DNA, 23 bp, Homo sapiens
tggcacagagagttcagagtgac

SEQ ID NO: 155651 - DNA, 22 bp, Homo sapiens
tggtacttgatcttctaagcca

SEQ ID NO: 155652 - DNA, 19 bp, Homo sapiens
gtctgcctgtgtgcgcgtg

SEQ ID NO: 155653 - DNA, 23 bp, Homo sapiens
catctcactgtgattttgatttg

SEQ ID NO: 155654 - DNA, 23 bp, Homo sapiens
tgaatgagtgtgtgcctctcatt

SEQ ID NO: 155655 - DNA, 23 bp, Homo sapiens
ttttgttctactggggtaagcag

SEQ ID NO: 155656 - DNA, 20 bp, Homo sapiens
atatatatatgtatatgtgt

SEQ ID NO: 155657 - DNA, 21 bp, Homo sapiens
aggttgaaggactgaatgaaa

SEQ ID NO: 155658 - DNA, 23 bp, Homo sapiens
tcactgccactctcttcagctac

SEQ ID NO: 155659 - DNA, 18 bp, Homo sapiens
agtctcactctgtctcca

SEQ ID NO: 155660 - DNA, 23 bp, Homo sapiens
ctggggcagagatacatgagcta

SEQ ID NO: 155661 - DNA, 21 bp, Homo sapiens
tttgcctattcttgatttttc

SEQ ID NO: 155662 - DNA, 23 bp, Homo sapiens
atattggtagctaatacagagtg

SEQ ID NO: 155663 - DNA, 23 bp, Homo sapiens
tgagacagtctcgctctgtttcc

SEQ ID NO: 155664 - DNA, 23 bp, Homo sapiens
attattttagtagctggacagca

SEQ ID NO: 155665 - DNA, 22 bp, Homo sapiens
acgctctgtctcactctacgtg

SEQ ID NO: 155666 - DNA, 23 bp, Homo sapiens
tttgtctctttctgtgtatctgt

SEQ ID NO: 155667 - DNA, 20 bp, Homo sapiens
tatgtagctcaggctggttt

SEQ ID NO: 155668 - DNA, 23 bp, Homo sapiens
ctcagcctctgagagtcactggg

SEQ ID NO: 155669 - DNA, 23 bp, Homo sapiens
atgaactctgattttcttaagta

SEQ ID NO: 155670 - DNA, 21 bp, Homo sapiens
tgtttttgagatagagtctgg

SEQ ID NO: 155671 - DNA, 23 bp, Homo sapiens
gactgagtctcgctctgtcaccc

SEQ ID NO: 155672 - DNA, 23 bp, Homo sapiens
ttttgagacggagtcttgctctg

SEQ ID NO: 155673 - DNA, 23 bp, Homo sapiens
tgagtcactgtctctctgtgctg

SEQ ID NO: 155674 - DNA, 21 bp, Homo sapiens
tatgtgcataatatatgtaat

SEQ ID NO: 155675 - DNA, 19 bp, Homo sapiens
tgcaaaaatattgtaaaat

SEQ ID NO: 155676 - DNA, 21 bp, Homo sapiens
aagtctatttgtattactcag

SEQ ID NO: 155677 - DNA, 22 bp, Homo sapiens
tttgtggctatacagatgcaga

SEQ ID NO: 155678 - DNA, 23 bp, Homo sapiens
cggagtctcactctgtcacccag

SEQ ID NO: 155679 - DNA, 23 bp, Homo sapiens
gagtctcactctgtcacccaggc

SEQ ID NO: 155680 - DNA, 23 bp, Homo sapiens
tatatgttgattttgtaacctgc

SEQ ID NO: 155681 - DNA, 23 bp, Homo sapiens
tttggtggagtttttaggtcttt

SEQ ID NO: 155682 - DNA, 23 bp, Homo sapiens
tatgtccttttaaaagtactttg

SEQ ID NO: 155683 - DNA, 22 bp, Homo sapiens
tacatgtgcacaatgtgcaggt

SEQ ID NO: 155684 - DNA, 22 bp, Homo sapiens
tatctcagcatacaataactca

SEQ ID NO: 155685 - DNA, 21 bp, Homo sapiens
cacccggtccagagacagcag

SEQ ID NO: 155686 - DNA, 19 bp, Homo sapiens
agaacacacctgctgggtt

SEQ ID NO: 155687 - DNA, 23 bp, Homo sapiens
tggagtctcactctgtcacccag

SEQ ID NO: 155688 - DNA, 22 bp, Homo sapiens
actagtcagtgcctcagtgggg

SEQ ID NO: 155689 - DNA, 23 bp, Homo sapiens
tgagttcattgtagattctggat

SEQ ID NO: 155690 - DNA, 23 bp, Homo sapiens
tgagttcattgtagattctggat

SEQ ID NO: 155691 - DNA, 23 bp, Homo sapiens
atatatgtgtacatgtgtacata

SEQ ID NO: 155692 - DNA, 18 bp, Homo sapiens
gacactctcaggatgtgg

SEQ ID NO: 155693 - DNA, 21 bp, Homo sapiens
aggctgggtggctgtctggct

SEQ ID NO: 155694 - DNA, 21 bp, Homo sapiens
ttttgtacttatatgctgtgt

SEQ ID NO: 155695 - DNA, 22 bp, Homo sapiens
atgccccatccgttttctgaga

SEQ ID NO: 155696 - DNA, 23 bp, Homo sapiens
aaagtcaatggtagcttgatgga

SEQ ID NO: 155697 - DNA, 22 bp, Homo sapiens
ttgagacggagtctcactctgt

SEQ ID NO: 155698 - DNA, 23 bp, Homo sapiens
ctgagagacatgagacagaggac

SEQ ID NO: 155699 - DNA, 23 bp, Homo sapiens
tgtttactttgttgaatgtgttt

SEQ ID NO: 155700 - DNA, 23 bp, Homo sapiens
cctgtgtgcgtgagtgcgtgggt

SEQ ID NO: 155701 - DNA, 20 bp, Homo sapiens
tgggattgtgtgtgttgatg

SEQ ID NO: 155702 - DNA, 23 bp, Homo sapiens
tgagttcattgtagattctggat

SEQ ID NO: 155703 - DNA, 23 bp, Homo sapiens
tgagttcattgtagattctggat

SEQ ID NO: 155704 - DNA, 23 bp, Homo sapiens
tacatagtatatgtatatgtgta

SEQ ID NO: 155705 - DNA, 23 bp, Homo sapiens
tctgtcactgtctcactttgccc

SEQ ID NO: 155706 - DNA, 21 bp, Homo sapiens
aggctgggtggctgtctggct

SEQ ID NO: 155707 - DNA, 21 bp, Homo sapiens
ttttgtacttatatgctgtgt

SEQ ID NO: 155708 - DNA, 22 bp, Homo sapiens
atgccccatccgttttctgaga

SEQ ID NO: 155709 - DNA, 23 bp, Homo sapiens
tgagttcattgtagattctggat

SEQ ID NO: 155710 - DNA, 23 bp, Homo sapiens
tgagttcattgtagattctggat

SEQ ID NO: 155711 - DNA, 23 bp, Homo sapiens
tttcacagtagaatttttgtttt

SEQ ID NO: 155712 - DNA, 23 bp, Homo sapiens
tatgaattttttttcctaagaca

SEQ ID NO: 155713 - DNA, 19 bp, Homo sapiens
agtgtgatgagactgtagt

SEQ ID NO: 155714 - DNA, 23 bp, Homo sapiens
atgagattatggttagagagaaa

SEQ ID NO: 155715 - DNA, 22 bp, Homo sapiens
attgagtctcgctctgtcaccc

SEQ ID NO: 155716 - DNA, 23 bp, Homo sapiens
ggtctcactctgtcactgaggct

SEQ ID NO: 155717 - DNA, 23 bp, Homo sapiens
tacatagtatatgtatatgtgta

SEQ ID NO: 155718 - DNA, 23 bp, Homo sapiens
tacatagtatatgtatatgtgta

SEQ ID NO: 155719 - DNA, 22 bp, Homo sapiens
tgagaagatgctggggtttgtg

SEQ ID NO: 155720 - DNA, 23 bp, Homo sapiens
gtcttcactctcagtatctttgg

SEQ ID NO: 155721 - DNA, 21 bp, Homo sapiens
tatgtgcatatatatgtatat

SEQ ID NO: 155722 - DNA, 23 bp, Homo sapiens
tgtgacagcttcttgatctgtcc

SEQ ID NO: 155723 - DNA, 23 bp, Homo sapiens
tgcaaatgagattttattcttct

SEQ ID NO: 155724 - DNA, 21 bp, Homo sapiens
ttatggatgaacaatatttca

SEQ ID NO: 155725 - DNA, 18 bp, Homo sapiens
tgcctgacactgggccag

SEQ ID NO: 155726 - DNA, 19 bp, Homo sapiens
ttagactagggatatggat

SEQ ID NO: 155727 - DNA, 23 bp, Homo sapiens
atccctgttgttgcaaatgactg

SEQ ID NO: 155728 - DNA, 20 bp, Homo sapiens
tctagtatatagaagtatgt

SEQ ID NO: 155729 - DNA, 21 bp, Homo sapiens
tgtgtactggaactgtattga

SEQ ID NO: 155730 - DNA, 23 bp, Homo sapiens
tatatatatatgtatacgtatac

SEQ ID NO: 155731 - DNA, 23 bp, Homo sapiens
tatatatgtatatgtatacgtat

SEQ ID NO: 155732 - DNA, 23 bp, Homo sapiens
tatatgtatacgtatatgtatac

SEQ ID NO: 155733 - DNA, 20 bp, Homo sapiens
tgtctatatatagatatatg

SEQ ID NO: 155734 - DNA, 23 bp, Homo sapiens
cttggtctcactctgtcacccag

SEQ ID NO: 155735 - DNA, 19 bp, Homo sapiens
tgtctgtcaaagagcagca

SEQ ID NO: 155736 - DNA, 23 bp, Homo sapiens
tgactggctctgtgtctgggaga

SEQ ID NO: 155737 - DNA, 23 bp, Homo sapiens
gcagagtctcactctgtggccca

SEQ ID NO: 155738 - DNA, 23 bp, Homo sapiens
atatactgtatgaattgtgtgtg

SEQ ID NO: 155739 - DNA, 20 bp, Homo sapiens
agtctcgctctgtcgctcag

SEQ ID NO: 155740 - DNA, 20 bp, Homo sapiens
agactgtagacagtgtcttt

SEQ ID NO: 155741 - DNA, 19 bp, Homo sapiens
tctctgagcaatagtttcc

SEQ ID NO: 155742 - DNA, 22 bp, Homo sapiens
aattgcttagaaagtattgaat

SEQ ID NO: 155743 - DNA, 18 bp, Homo sapiens
atagtttctatatatagg

SEQ ID NO: 155744 - DNA, 23 bp, Homo sapiens
gacagagtctcgctctgtcaccc

SEQ ID NO: 155745 - DNA, 23 bp, Homo sapiens
tggagtctcacactgtcaccctg

SEQ ID NO: 155746 - DNA, 18 bp, Homo sapiens
gtgtttaatgtgaaagag

SEQ ID NO: 155747 - DNA, 23 bp, Homo sapiens
cagaccagttgatttctgtcaca

SEQ ID NO: 155748 - DNA, 21 bp, Homo sapiens
ctgggattacttgaagtacta

SEQ ID NO: 155749 - DNA, 18 bp, Homo sapiens
tctgttgtgagtccacca

SEQ ID NO: 155750 - DNA, 23 bp, Homo sapiens
agggtctctctgtgtcacccagg

SEQ ID NO: 155751 - DNA, 20 bp, Homo sapiens
aatgagagttgagagtgggc

SEQ ID NO: 155752 - DNA, 23 bp, Homo sapiens
ttttagcttcttcagttccaaat

SEQ ID NO: 155753 - DNA, 23 bp, Homo sapiens
tgagttcattgtagattctggat

SEQ ID NO: 155754 - DNA, 23 bp, Homo sapiens
tgagttcattgtagattctggat

SEQ ID NO: 155755 - DNA, 23 bp, Homo sapiens
tccatctgtctcactctgtcacc

SEQ ID NO: 155756 - DNA, 23 bp, Homo sapiens
ggggtctcactctgtcactcagg

SEQ ID NO: 155757 - DNA, 23 bp, Homo sapiens
atatgtgtgtatatgtagataat

SEQ ID NO: 155758 - DNA, 23 bp, Homo sapiens
tgtgcatatatttatatatgtgt

SEQ ID NO: 155759 - DNA, 23 bp, Homo sapiens
tgttttactgtctctctttctgg

SEQ ID NO: 155760 - DNA, 23 bp, Homo sapiens
atatgtatatgtttacacatact

SEQ ID NO: 155761 - DNA, 23 bp, Homo sapiens
actgacagggttagtgtgtgatt

SEQ ID NO: 155762 - DNA, 19 bp, Homo sapiens
ttacagcagcatgaatgga

SEQ ID NO: 155763 - DNA, 22 bp, Homo sapiens
acatagtataagtatatgtgta

SEQ ID NO: 155764 - DNA, 23 bp, Homo sapiens
aatgagattatggttagagagaa

SEQ ID NO: 155765 - DNA, 21 bp, Homo sapiens
aaatggttgaaaacagatata

SEQ ID NO: 155766 - DNA, 18 bp, Homo sapiens
tttctgcttccatgttta

SEQ ID NO: 155767 - DNA, 23 bp, Homo sapiens
tcttctgttagttacattaatct

SEQ ID NO: 155768 - DNA, 23 bp, Homo sapiens
tttaaagagcttggtgagtcaat

SEQ ID NO: 155769 - DNA, 23 bp, Homo sapiens
gacagagtctcgctctgtcaccc

SEQ ID NO: 155770 - DNA, 23 bp, Homo sapiens
tgtatatatgtatgtgtatatgt

SEQ ID NO: 155771 - DNA, 20 bp, Homo sapiens
ttgacagaatgaaagttttt

SEQ ID NO: 155772 - DNA, 20 bp, Homo sapiens
aggctgggtggtttggagga

SEQ ID NO: 155773 - DNA, 22 bp, Homo sapiens
aggctgacacctctacttctgt

SEQ ID NO: 155774 - DNA, 19 bp, Homo sapiens
tccggcagggactgtacag

SEQ ID NO: 155775 - DNA, 21 bp, Homo sapiens
actgtgctactgaatctgtga

SEQ ID NO: 155776 - DNA, 23 bp, Homo sapiens
gatgagaggaagtgtcttttttt

SEQ ID NO: 155777 - DNA, 23 bp, Homo sapiens
gagacagtctcgctctgtcaccc

SEQ ID NO: 155778 - DNA, 23 bp, Homo sapiens
gccagagtctcgctctgtctccc

SEQ ID NO: 155779 - DNA, 23 bp, Homo sapiens
tgagtccctcggtcactcactgt

SEQ ID NO: 155780 - DNA, 21 bp, Homo sapiens
cagagtggatgctgtcagaaa

SEQ ID NO: 155781 - DNA, 23 bp, Homo sapiens
gacagagtctcgctctgtcaccc

SEQ ID NO: 155782 - DNA, 23 bp, Homo sapiens
acagagtctcgctctgtcaccca

SEQ ID NO: 155783 - DNA, 23 bp, Homo sapiens
tcactgactgcatatctagtctc

SEQ ID NO: 155784 - DNA, 22 bp, Homo sapiens
tagtacttcatttgcattcaat

SEQ ID NO: 155785 - DNA, 22 bp, Homo sapiens
ctgatgtagtagattgttaaga

SEQ ID NO: 155786 - DNA, 23 bp, Homo sapiens
tacatttgtaactctccctttgt

SEQ ID NO: 155787 - DNA, 21 bp, Homo sapiens
aagagatctgtgccaggagac

SEQ ID NO: 155788 - DNA, 23 bp, Homo sapiens
tcaatgagtctcagtgtctcagt

SEQ ID NO: 155789 - DNA, 23 bp, Homo sapiens
cagagtctcactcactctgtcgc

SEQ ID NO: 155790 - DNA, 21 bp, Homo sapiens
aagagatctgtgccaggagac

SEQ ID NO: 155791 - DNA, 23 bp, Homo sapiens
tcaatgagtctcagtgtctcagt

SEQ ID NO: 155792 - DNA, 23 bp, Homo sapiens
tcaccctcacactctcagtagtt

SEQ ID NO: 155793 - DNA, 23 bp, Homo sapiens
tgtgcatgtgtgtgtgtgtttat

SEQ ID NO: 155794 - DNA, 23 bp, Homo sapiens
tatacacattgtatatatgtgtg

SEQ ID NO: 155795 - DNA, 22 bp, Homo sapiens
tatacacatcatatatatgtgt

SEQ ID NO: 155796 - DNA, 23 bp, Homo sapiens
acagagtctcactgtgtcgccca

SEQ ID NO: 155797 - DNA, 21 bp, Homo sapiens
ttctatttatatgaaatgccc

SEQ ID NO: 155798 - DNA, 21 bp, Homo sapiens
aagagatctgtgccaggagac

SEQ ID NO: 155799 - DNA, 23 bp, Homo sapiens
tcaatgagtctcagtgtctcagt

SEQ ID NO: 155800 - DNA, 23 bp, Homo sapiens
cagagtctcactcactctgtcgc

SEQ ID NO: 155801 - DNA, 21 bp, Homo sapiens
aagagatctgtgccaggagac

SEQ ID NO: 155802 - DNA, 23 bp, Homo sapiens
tcaatgagtctcagtgtctcagt

SEQ ID NO: 155803 - DNA, 23 bp, Homo sapiens
ctaagtctcattcttctgaaacc

SEQ ID NO: 155804 - DNA, 23 bp, Homo sapiens
agaggatgtaaatggttttgtat

SEQ ID NO: 155805 - DNA, 23 bp, Homo sapiens
aaacttctgactgccacttgttt

SEQ ID NO: 155806 - DNA, 23 bp, Homo sapiens
ggtctcactctgtcactgaggct

SEQ ID NO: 155807 - DNA, 19 bp, Homo sapiens
tacagtggggtgatcttgg

SEQ ID NO: 155808 - DNA, 23 bp, Homo sapiens
gacagactctcgctctgttgcac

SEQ ID NO: 155809 - DNA, 23 bp, Homo sapiens
gacagagtctcgctctgtcaccc

SEQ ID NO: 155810 - DNA, 21 bp, Homo sapiens
tctcactctgtcactcaggct

SEQ ID NO: 155811 - DNA, 19 bp, Homo sapiens
agtgagctaagattgcacc

SEQ ID NO: 155812 - DNA, 23 bp, Homo sapiens
attcctctcactctctgactctc

SEQ ID NO: 155813 - DNA, 23 bp, Homo sapiens
tgagtctcactctgtcacccagg

SEQ ID NO: 155814 - DNA, 18 bp, Homo sapiens
tcagtggtgtgatctcag

SEQ ID NO: 155815 - DNA, 21 bp, Homo sapiens
atatgtatatctatatgtaac

SEQ ID NO: 155816 - DNA, 20 bp, Homo sapiens
atatgtatatctatatgtaa

SEQ ID NO: 155817 - DNA, 22 bp, Homo sapiens
tatatgtatatctatatgtaac

SEQ ID NO: 155818 - DNA, 22 bp, Homo sapiens
tatatgtatatctatatgtaac

SEQ ID NO: 155819 - DNA, 22 bp, Homo sapiens
tatatgtatatctatatgtaac

SEQ ID NO: 155820 - DNA, 20 bp, Homo sapiens
tatgtatatctatatgtaac

SEQ ID NO: 155821 - DNA, 19 bp, Homo sapiens
tatgtatatctatatgtaa

SEQ ID NO: 155822 - DNA, 22 bp, Homo sapiens
tatatgtatatctatatgtaac

SEQ ID NO: 155823 - DNA, 21 bp, Homo sapiens
atatgtatatctatatgtaac

SEQ ID NO: 155824 - DNA, 20 bp, Homo sapiens
atatgtatatctatatgtaa

SEQ ID NO: 155825 - DNA, 23 bp, Homo sapiens
tatatgtatatctatatgtaaca

SEQ ID NO: 155826 - DNA, 23 bp, Homo sapiens
tatatgtatatctatatgtaaca

SEQ ID NO: 155827 - DNA, 23 bp, Homo sapiens
tatatgtatatctatatgtaaca

SEQ ID NO: 155828 - DNA, 23 bp, Homo sapiens
tatatgtatatctatatgtaaca

SEQ ID NO: 155829 - DNA, 23 bp, Homo sapiens
atatatgtatatctatatgtaac

SEQ ID NO: 155830 - DNA, 23 bp, Homo sapiens
tgcatgtgtgtatgtatatatgt

SEQ ID NO: 155831 - DNA, 21 bp, Homo sapiens
tcactcggtctgtctctcagg

SEQ ID NO: 155832 - DNA, 20 bp, Homo sapiens
tctgtggcacagtctcatca

SEQ ID NO: 155833 - DNA, 22 bp, Homo sapiens
tctctcactggggattctctgt

SEQ ID NO: 155834 - DNA, 23 bp, Homo sapiens
ctcttggagtgggtgaccctgta

SEQ ID NO: 155835 - DNA, 23 bp, Homo sapiens
tgagttcattgtagattctggat

SEQ ID NO: 155836 - DNA, 23 bp, Homo sapiens
tgagttcattgtagattctggat

SEQ ID NO: 155837 - DNA, 23 bp, Homo sapiens
actgagtctggctctgtctccca

SEQ ID NO: 155838 - DNA, 20 bp, Homo sapiens
ttactcactgttcttagaag

SEQ ID NO: 155839 - DNA, 20 bp, Homo sapiens
tacacatatatatgatgtgt

SEQ ID NO: 155840 - DNA, 23 bp, Homo sapiens
atacacacatatatacaatgtgt

SEQ ID NO: 155841 - DNA, 23 bp, Homo sapiens
tgaatgagtgttggattgtgtca

SEQ ID NO: 155842 - DNA, 21 bp, Homo sapiens
ttctatttatatgaaatgccc

SEQ ID NO: 155843 - DNA, 23 bp, Homo sapiens
attggaagtccatctttttagat

SEQ ID NO: 155844 - DNA, 21 bp, Homo sapiens
aagagatctgtgccaggagac

SEQ ID NO: 155845 - DNA, 23 bp, Homo sapiens
tcaatgagtctcagtgtctcagt

SEQ ID NO: 155846 - DNA, 23 bp, Homo sapiens
ctctctcgctgcctggctggctc

SEQ ID NO: 155847 - DNA, 23 bp, Homo sapiens
aatcacagggaggtttgaagagc

SEQ ID NO: 155848 - DNA, 19 bp, Homo sapiens
agagagagaccttgtctca

SEQ ID NO: 155849 - DNA, 23 bp, Homo sapiens
gagagtgttttgacatgattttt

SEQ ID NO: 155850 - DNA, 23 bp, Homo sapiens
ctgtgtctgtctgtctgtctgtc

SEQ ID NO: 155851 - DNA, 23 bp, Homo sapiens
agagtctcactctgtcacccagg

SEQ ID NO: 155852 - DNA, 23 bp, Homo sapiens
acagagtctcactctgtcgccca

SEQ ID NO: 155853 - DNA, 21 bp, Homo sapiens
atactgaagtccttttgttgt

SEQ ID NO: 155854 - DNA, 23 bp, Homo sapiens
gacagagtctcgctctgtcaccc

SEQ ID NO: 155855 - DNA, 23 bp, Homo sapiens
cactggctttgagaaacttcagg

SEQ ID NO: 155856 - DNA, 22 bp, Homo sapiens
ttattcattttaattgctgaat

SEQ ID NO: 155857 - DNA, 23 bp, Homo sapiens
attgagctattctattgctgatg

SEQ ID NO: 155858 - DNA, 23 bp, Homo sapiens
atgtctgttgtatagttcatgat

SEQ ID NO: 155859 - DNA, 23 bp, Homo sapiens
gacagagtctcgctctgtcactc

SEQ ID NO: 155860 - DNA, 19 bp, Homo sapiens
aaagtgctaggattacagg

SEQ ID NO: 155861 - DNA, 23 bp, Homo sapiens
tatggtaactttttgctttgtga

SEQ ID NO: 155862 - DNA, 20 bp, Homo sapiens
tctcaccgcttctatccagt

SEQ ID NO: 155863 - DNA, 23 bp, Homo sapiens
tacttgtctcaatggttgtctct

SEQ ID NO: 155864 - DNA, 23 bp, Homo sapiens
gagggagtaggatgtatggttgt

SEQ ID NO: 155865 - DNA, 23 bp, Homo sapiens
atcttttctcacaacagacagag

SEQ ID NO: 155866 - DNA, 20 bp, Homo sapiens
acaccaatactttggtaaaa

SEQ ID NO: 155867 - DNA, 22 bp, Homo sapiens
aaaggtactattccaaaccaaa

SEQ ID NO: 155868 - DNA, 19 bp, Homo sapiens
agacaaggtctcactctct

SEQ ID NO: 155869 - DNA, 23 bp, Homo sapiens
tgacagagaacagtggggactgt

SEQ ID NO: 155870 - DNA, 18 bp, Homo sapiens
tgtcaccctttctcctgc

SEQ ID NO: 155871 - DNA, 19 bp, Homo sapiens
tgagagagaggagagagag

SEQ ID NO: 155872 - DNA, 23 bp, Homo sapiens
tgctgcttacctgttttgaccct

SEQ ID NO: 155873 - DNA, 23 bp, Homo sapiens
tatgtgtgtgtatatatatgtgt

SEQ ID NO: 155874 - DNA, 23 bp, Homo sapiens
tgccagtcttcactagttttcat

SEQ ID NO: 155875 - DNA, 20 bp, Homo sapiens
acagagtctcacactgtcat

SEQ ID NO: 155876 - DNA, 22 bp, Homo sapiens
tgtgtgtagtgtgtgtgtatat

SEQ ID NO: 155877 - DNA, 21 bp, Homo sapiens
tgggcatggtgattcacacct

SEQ ID NO: 155878 - DNA, 23 bp, Homo sapiens
tgagttcattgtagattctggat

SEQ ID NO: 155879 - DNA, 23 bp, Homo sapiens
tgagttcattgtagattctggat

SEQ ID NO: 155880 - DNA, 21 bp, Homo sapiens
tgacactctttctcactcact

SEQ ID NO: 155881 - DNA, 22 bp, Homo sapiens
aagtggccagaaaaagtagagt

SEQ ID NO: 155882 - DNA, 23 bp, Homo sapiens
acagccactgataagaaggtgta

SEQ ID NO: 155883 - DNA, 22 bp, Homo sapiens
tgtgctgtggatttcatttggt

SEQ ID NO: 155884 - DNA, 23 bp, Homo sapiens
gaccctctttctgtctctcttat

SEQ ID NO: 155885 - DNA, 19 bp, Homo sapiens
tcactcacagatttcacag

SEQ ID NO: 155886 - DNA, 20 bp, Homo sapiens
attgtgaatgggagttcttt

SEQ ID NO: 155887 - DNA, 19 bp, Homo sapiens
tgccacagtctcaatgctc

SEQ ID NO: 155888 - DNA, 20 bp, Homo sapiens
ctatgtatttatttctgtta

SEQ ID NO: 155889 - DNA, 23 bp, Homo sapiens
ggattgtatatcttcttttgaga

SEQ ID NO: 155890 - DNA, 23 bp, Homo sapiens
tgagtctctccattacataagct

SEQ ID NO: 155891 - DNA, 23 bp, Homo sapiens
atgtatgtatgtatgtgtatgtg

SEQ ID NO: 155892 - DNA, 21 bp, Homo sapiens
atgtacatacacacacatata

SEQ ID NO: 155893 - DNA, 23 bp, Homo sapiens
catgtaagtacaagccttagtct

SEQ ID NO: 155894 - DNA, 21 bp, Homo sapiens
tgtcagcctgactctctgagc

SEQ ID NO: 155895 - DNA, 23 bp, Homo sapiens
ttgatagtatttctaatccttac

SEQ ID NO: 155896 - DNA, 23 bp, Homo sapiens
atggcatgcacctgtagtcccag

SEQ ID NO: 155897 - DNA, 23 bp, Homo sapiens
ggtggtgtctcactctgtcgctc

SEQ ID NO: 155898 - DNA, 23 bp, Homo sapiens
ggagtctcactctgtctctcagg

SEQ ID NO: 155899 - DNA, 23 bp, Homo sapiens
tcccaggctgcctctgaggctgc

SEQ ID NO: 155900 - DNA, 19 bp, Homo sapiens
tactggaaaaactatgagc

SEQ ID NO: 155901 - DNA, 21 bp, Homo sapiens
tgagtcacttagtctctcctt

SEQ ID NO: 155902 - DNA, 20 bp, Homo sapiens
ctagtgctacctcacaggct

SEQ ID NO: 155903 - DNA, 23 bp, Homo sapiens
ctgggtgtctgtttctctgtgtc

SEQ ID NO: 155904 - DNA, 23 bp, Homo sapiens
agccagcctctctgcctgtctaa

SEQ ID NO: 155905 - DNA, 22 bp, Homo sapiens
aattctatgtttaaatgtttga

SEQ ID NO: 155906 - DNA, 18 bp, Homo sapiens
atgttctctgcctccaga

SEQ ID NO: 155907 - DNA, 23 bp, Homo sapiens
cagggtctcactctgtcacccag

SEQ ID NO: 155908 - DNA, 23 bp, Homo sapiens
cagagtctgtctctgtcacccag

SEQ ID NO: 155909 - DNA, 18 bp, Homo sapiens
tggtgcaatttcagctca

SEQ ID NO: 155910 - DNA, 23 bp, Homo sapiens
cggagtctcactctgtcacccag

SEQ ID NO: 155911 - DNA, 22 bp, Homo sapiens
agagttttagaagcatttcata

SEQ ID NO: 155912 - DNA, 23 bp, Homo sapiens
gtgaagttgagtgagaggagttg

SEQ ID NO: 155913 - DNA, 23 bp, Homo sapiens
cctagtctcgctctgtcacccag

SEQ ID NO: 155914 - DNA, 20 bp, Homo sapiens
tatgtgtatatatatgtatg

SEQ ID NO: 155915 - DNA, 23 bp, Homo sapiens
tgttttactgcctgctctttctg

SEQ ID NO: 155916 - DNA, 23 bp, Homo sapiens
gctggaacttagagtggtggtgt

SEQ ID NO: 155917 - DNA, 23 bp, Homo sapiens
gggtctcactctgtcacccaggc

SEQ ID NO: 155918 - DNA, 21 bp, Homo sapiens
tgactcagtgaatgtgtacac

SEQ ID NO: 155919 - DNA, 20 bp, Homo sapiens
cactgcaatgatgtagggag

SEQ ID NO: 155920 - DNA, 23 bp, Homo sapiens
tgacatgtaccagtagtctcagc

SEQ ID NO: 155921 - DNA, 23 bp, Homo sapiens
gggtctcactctgtcactcaggc

SEQ ID NO: 155922 - DNA, 23 bp, Homo sapiens
tcactctgtcagccagtcttgag

SEQ ID NO: 155923 - DNA, 23 bp, Homo sapiens
cttctctgtctcactctttcggt

SEQ ID NO: 155924 - DNA, 23 bp, Homo sapiens
cagggtctcactctgtcacccag

SEQ ID NO: 155925 - DNA, 21 bp, Homo sapiens
acagtggtatgatcttggctc

SEQ ID NO: 155926 - DNA, 18 bp, Homo sapiens
agcagtatatgagcagtg

SEQ ID NO: 155927 - DNA, 23 bp, Homo sapiens
aattatgtatgcttatgtatata

SEQ ID NO: 155928 - DNA, 23 bp, Homo sapiens
atacatgcttatgtatgctgaat

SEQ ID NO: 155929 - DNA, 23 bp, Homo sapiens
tgagttcattgtagattctggat

SEQ ID NO: 155930 - DNA, 23 bp, Homo sapiens
tgagttcattgtagattctggat

SEQ ID NO: 155931 - DNA, 23 bp, Homo sapiens
tggagtctcgctctgtctcccag

SEQ ID NO: 155932 - DNA, 20 bp, Homo sapiens
agaggtaaaagtgtgtgtga

SEQ ID NO: 155933 - DNA, 19 bp, Homo sapiens
acttcagcctctgattggt

SEQ ID NO: 155934 - DNA, 23 bp, Homo sapiens
ctgagttcatcctgtaacctgca

SEQ ID NO: 155935 - DNA, 23 bp, Homo sapiens
tgagatggagtctcgctctgtcg

SEQ ID NO: 155936 - DNA, 23 bp, Homo sapiens
atttctatgcttgttttgagaga

SEQ ID NO: 155937 - DNA, 23 bp, Homo sapiens
ttgagacggtgtctcactctgtc

SEQ ID NO: 155938 - DNA, 23 bp, Homo sapiens
aagctctcactcactgaccctct

SEQ ID NO: 155939 - DNA, 23 bp, Homo sapiens
tgagttcattgtagattctggat

SEQ ID NO: 155940 - DNA, 23 bp, Homo sapiens
tgagttcattgtagattctggat

SEQ ID NO: 155941 - DNA, 23 bp, Homo sapiens
agaactgagttgagagagaggag

SEQ ID NO: 155942 - DNA, 23 bp, Homo sapiens
tgataaatcagtttgagttcctg

SEQ ID NO: 155943 - DNA, 21 bp, Homo sapiens
tttcagtgtctgtgaatttgc

SEQ ID NO: 155944 - DNA, 23 bp, Homo sapiens
agagtgaagttgcaggtctagaa

SEQ ID NO: 155945 - DNA, 23 bp, Homo sapiens
tggttagagaggaggagactgac

SEQ ID NO: 155946 - DNA, 18 bp, Homo sapiens
ctctcctctgtctcactg

SEQ ID NO: 155947 - DNA, 19 bp, Homo sapiens
gattccacattatggtgaa

SEQ ID NO: 155948 - DNA, 20 bp, Homo sapiens
tcattcactgggttgatgac

SEQ ID NO: 155949 - DNA, 21 bp, Homo sapiens
tggctcagtgtctggcacaca

SEQ ID NO: 155950 - DNA, 19 bp, Homo sapiens
tctgtgaaattgttaccat

SEQ ID NO: 155951 - DNA, 23 bp, Homo sapiens
tcaccctccctctgtctggacac

SEQ ID NO: 155952 - DNA, 19 bp, Homo sapiens
cagtggcgtgatcttggct

SEQ ID NO: 155953 - DNA, 23 bp, Homo sapiens
gttctgtctgtctgtctgtctat

SEQ ID NO: 155954 - DNA, 23 bp, Homo sapiens
cactgtttggttttctaggacta

SEQ ID NO: 155955 - DNA, 19 bp, Homo sapiens
tgactctagactgtgagca

SEQ ID NO: 155956 - DNA, 19 bp, Homo sapiens
tatgcgtatatatacctat

SEQ ID NO: 155957 - DNA, 23 bp, Homo sapiens
atgtgtgtggatgtgagaaggat

SEQ ID NO: 155958 - DNA, 23 bp, Homo sapiens
ctatattgaattattgtagatgt

SEQ ID NO: 155959 - DNA, 23 bp, Homo sapiens
tgcaactttactgaatttgttca

SEQ ID NO: 155960 - DNA, 22 bp, Homo sapiens
gtatacatgaatgtgtgtgtat

SEQ ID NO: 155961 - DNA, 22 bp, Homo sapiens
tgtatacatatgtatatgtatg

SEQ ID NO: 155962 - DNA, 19 bp, Homo sapiens
caagcaagtctgttggtac

SEQ ID NO: 155963 - DNA, 19 bp, Homo sapiens
tatatgcatacagttgatt

SEQ ID NO: 155964 - DNA, 21 bp, Homo sapiens
aggaatacttttcctatgagt

SEQ ID NO: 155965 - DNA, 23 bp, Homo sapiens
atgtatgtgtgcatgtatatata

SEQ ID NO: 155966 - DNA, 19 bp, Homo sapiens
tttccagcagtgtctggca

SEQ ID NO: 155967 - DNA, 19 bp, Homo sapiens
taaagaattgttagacttg

SEQ ID NO: 155968 - DNA, 19 bp, Homo sapiens
tcttgataatactgagtct

SEQ ID NO: 155969 - DNA, 23 bp, Homo sapiens
tatgctgaatttgtaaatgtgaa

SEQ ID NO: 155970 - DNA, 23 bp, Homo sapiens
ttggagtctcagctttctttttg

SEQ ID NO: 155971 - DNA, 20 bp, Homo sapiens
tgaactgtgctcttatctgg

SEQ ID NO: 155972 - DNA, 21 bp, Homo sapiens
actgtctcagactgttggtag

SEQ ID NO: 155973 - DNA, 23 bp, Homo sapiens
tctgcaagtctatggaattcttt

SEQ ID NO: 155974 - DNA, 23 bp, Homo sapiens
acacacaaatgagaatgtgtata

SEQ ID NO: 155975 - DNA, 23 bp, Homo sapiens
acaggcatgagccactgtgcctg

SEQ ID NO: 155976 - DNA, 23 bp, Homo sapiens
acagagtctcactctgtcgccca

SEQ ID NO: 155977 - DNA, 23 bp, Homo sapiens
acagtggcttcttattgaggatg

SEQ ID NO: 155978 - DNA, 22 bp, Homo sapiens
tctttggtcatcttgctctatc

SEQ ID NO: 155979 - DNA, 23 bp, Homo sapiens
atatgtgtatatatatgtgtgtg

SEQ ID NO: 155980 - DNA, 23 bp, Homo sapiens
gggtctcactctgtgcctgggtt

SEQ ID NO: 155981 - DNA, 23 bp, Homo sapiens
agagactcactctgtcacccagg

SEQ ID NO: 155982 - DNA, 23 bp, Homo sapiens
tgagagtctcactctgtcgccca

SEQ ID NO: 155983 - DNA, 23 bp, Homo sapiens
acagagtctcactctgtcgccca

SEQ ID NO: 155984 - DNA, 22 bp, Homo sapiens
tatgtgtatgcatgtatatata

SEQ ID NO: 155985 - DNA, 20 bp, Homo sapiens
attgttgtggggaaagttgt

SEQ ID NO: 155986 - DNA, 23 bp, Homo sapiens
tatatacacgtatacatatatat

SEQ ID NO: 155987 - DNA, 23 bp, Homo sapiens
tgtgtatatatatgtgtgtgtat

SEQ ID NO: 155988 - DNA, 23 bp, Homo sapiens
agagaacagtgtgttcaaaggcc

SEQ ID NO: 155989 - DNA, 20 bp, Homo sapiens
tgagggaggcaatgttctta

SEQ ID NO: 155990 - DNA, 23 bp, Homo sapiens
acagggacgtgaacttggctctg

SEQ ID NO: 155991 - DNA, 23 bp, Homo sapiens
aaatctaagtggaagtgttctgt

SEQ ID NO: 155992 - DNA, 23 bp, Homo sapiens
tgagttcattgtagattctggat

SEQ ID NO: 155993 - DNA, 23 bp, Homo sapiens
tgagttcattgtagattctggat

SEQ ID NO: 155994 - DNA, 20 bp, Homo sapiens
taggcagtggtagtggagac

SEQ ID NO: 155995 - DNA, 23 bp, Homo sapiens
tgagttcattgtagattctggat

SEQ ID NO: 155996 - DNA, 23 bp, Homo sapiens
tgagttcattgtagattctggat

SEQ ID NO: 155997 - DNA, 20 bp, Homo sapiens
tctgtgtgtgcatatatagt

SEQ ID NO: 155998 - DNA, 22 bp, Homo sapiens
ttgaatgttgaaccagccttgt

SEQ ID NO: 155999 - DNA, 22 bp, Homo sapiens
tgagagtctcactaagctgtga

SEQ ID NO: 156000 - DNA, 23 bp, Homo sapiens
agagtctcactctgtcacccagg

SEQ ID NO: 156001 - DNA, 20 bp, Homo sapiens
gtgagccactgtgcctagca

SEQ ID NO: 156002 - DNA, 21 bp, Homo sapiens
tgcagtggcataatcttggct

SEQ ID NO: 156003 - DNA, 18 bp, Homo sapiens
tctgtctcaaaaaaaacc

SEQ ID NO: 156004 - DNA, 23 bp, Homo sapiens
gagacggagtctcactctgtcac

SEQ ID NO: 156005 - DNA, 23 bp, Homo sapiens
cggagtctcactctgtcacccag

SEQ ID NO: 156006 - DNA, 23 bp, Homo sapiens
atacacacacatttatatatgta

SEQ ID NO: 156007 - DNA, 18 bp, Homo sapiens
acacatttatatatgtat

SEQ ID NO: 156008 - DNA, 23 bp, Homo sapiens
tgagtctcgctctgtctcccaag

SEQ ID NO: 156009 - DNA, 18 bp, Homo sapiens
tacttttgaggttgtagt

SEQ ID NO: 156010 - DNA, 19 bp, Homo sapiens
tatttattttagtaagccc

SEQ ID NO: 156011 - DNA, 23 bp, Homo sapiens
cagtgtcactccctgagaacacc

SEQ ID NO: 156012 - DNA, 23 bp, Homo sapiens
aagcaccacatattttcactcat

SEQ ID NO: 156013 - DNA, 23 bp, Homo sapiens
ctgtgcctctgtgagcctctctg

SEQ ID NO: 156014 - DNA, 23 bp, Homo sapiens
tgagttcattgtagattctggat

SEQ ID NO: 156015 - DNA, 23 bp, Homo sapiens
tgagttcattgtagattctggat

SEQ ID NO: 156016 - DNA, 23 bp, Homo sapiens
tgagttcattgtagattctggat

SEQ ID NO: 156017 - DNA, 23 bp, Homo sapiens
tgagttcattgtagattctggat

SEQ ID NO: 156018 - DNA, 23 bp, Homo sapiens
gagagagagaattgagtgtgttc

SEQ ID NO: 156019 - DNA, 22 bp, Homo sapiens
tgtgggagagaataagggcaga

SEQ ID NO: 156020 - DNA, 23 bp, Homo sapiens
tgagttcattgtagattctggat

SEQ ID NO: 156021 - DNA, 23 bp, Homo sapiens
tgagttcattgtagattctggat

SEQ ID NO: 156022 - DNA, 23 bp, Homo sapiens
tgagttcattgtagattctggat

SEQ ID NO: 156023 - DNA, 23 bp, Homo sapiens
tgagttcattgtagattctggat

SEQ ID NO: 156024 - DNA, 23 bp, Homo sapiens
ttactctgtggctgagaccctgg

SEQ ID NO: 156025 - DNA, 23 bp, Homo sapiens
agtcagtgtctgatgagggttct

SEQ ID NO: 156026 - DNA, 22 bp, Homo sapiens
aggaatgaatagaagaatgtga

SEQ ID NO: 156027 - DNA, 23 bp, Homo sapiens
tcaatatgtatatatgtgtaatt

SEQ ID NO: 156028 - DNA, 20 bp, Homo sapiens
tgtcttggctatgctggctc

SEQ ID NO: 156029 - DNA, 23 bp, Homo sapiens
actgatcagttgagagtgaggag

SEQ ID NO: 156030 - DNA, 19 bp, Homo sapiens
agtggaagaaatatgtcat

SEQ ID NO: 156031 - DNA, 23 bp, Homo sapiens
tgagttcattgtagattctggat

SEQ ID NO: 156032 - DNA, 23 bp, Homo sapiens
tgagttcattgtagattctggat

SEQ ID NO: 156033 - DNA, 23 bp, Homo sapiens
actgagtctcgctctgtcacccc

SEQ ID NO: 156034 - DNA, 21 bp, Homo sapiens
agaggcaatcctttgtgactg

SEQ ID NO: 156035 - DNA, 23 bp, Homo sapiens
acatggtgagactctgtcactac

SEQ ID NO: 156036 - DNA, 23 bp, Homo sapiens
agacagagcctcactgtgtcact

SEQ ID NO: 156037 - DNA, 23 bp, Homo sapiens
tggagtctcactctgtcacccag

SEQ ID NO: 156038 - DNA, 22 bp, Homo sapiens
tcccaagtgtgtgttggcttgc

SEQ ID NO: 156039 - DNA, 23 bp, Homo sapiens
agacactctcacagacatagctg

SEQ ID NO: 156040 - DNA, 21 bp, Homo sapiens
gatacttcttcctgtagacat

SEQ ID NO: 156041 - DNA, 23 bp, Homo sapiens
tgagttcattgtagattctggat

SEQ ID NO: 156042 - DNA, 23 bp, Homo sapiens
tgagttcattgtagattctggat

SEQ ID NO: 156043 - DNA, 23 bp, Homo sapiens
cggagtctcgctctgtctcccag

SEQ ID NO: 156044 - DNA, 23 bp, Homo sapiens
catctctctctctcaggttcctc

SEQ ID NO: 156045 - DNA, 23 bp, Homo sapiens
tgcttagtacaaagtctggtgca

SEQ ID NO: 156046 - DNA, 22 bp, Homo sapiens
tattgtgctctgggaccacaat

SEQ ID NO: 156047 - DNA, 23 bp, Homo sapiens
tgagttcattgtagattctggat

SEQ ID NO: 156048 - DNA, 23 bp, Homo sapiens
tgagttcattgtagattctggat

SEQ ID NO: 156049 - DNA, 23 bp, Homo sapiens
tctctgcctgactctgccaaagg

SEQ ID NO: 156050 - DNA, 23 bp, Homo sapiens
tggagtcagagattgcagtgagc

SEQ ID NO: 156051 - DNA, 23 bp, Homo sapiens
agtgagactggttaacatatgaa

SEQ ID NO: 156052 - DNA, 23 bp, Homo sapiens
tatgtgtatatatgtgtgtgtat

SEQ ID NO: 156053 - DNA, 23 bp, Homo sapiens
attagcaggttaaatattgcata

SEQ ID NO: 156054 - DNA, 18 bp, Homo sapiens
cagttctgtaaagctctg

SEQ ID NO: 156055 - DNA, 23 bp, Homo sapiens
tgtggcaagtattgttttgcttc

SEQ ID NO: 156056 - DNA, 20 bp, Homo sapiens
cctacatcaaatactgttat

SEQ ID NO: 156057 - DNA, 19 bp, Homo sapiens
tgtgtatgtatatatgtgt

SEQ ID NO: 156058 - DNA, 23 bp, Homo sapiens
tgtctatatatgtatgtgtgtgt

SEQ ID NO: 156059 - DNA, 19 bp, Homo sapiens
tcacagaacaaagtcagga

SEQ ID NO: 156060 - DNA, 22 bp, Homo sapiens
tcatatcttctctatctgtcag

SEQ ID NO: 156061 - DNA, 23 bp, Homo sapiens
tcaagctctgggactcactgtgt

SEQ ID NO: 156062 - DNA, 19 bp, Homo sapiens
aaagtctcactctgtcacc

SEQ ID NO: 156063 - DNA, 23 bp, Homo sapiens
acagagctgaggtaggaggttca

SEQ ID NO: 156064 - DNA, 23 bp, Homo sapiens
ctcagtgactcagtgcctgaaag

SEQ ID NO: 156065 - DNA, 23 bp, Homo sapiens
tgagtcggagtctcactctgtct

SEQ ID NO: 156066 - DNA, 23 bp, Homo sapiens
tggagtctcactctgtcacccag

SEQ ID NO: 156067 - DNA, 23 bp, Homo sapiens
aggtgagtctctctgcctgcctg

SEQ ID NO: 156068 - DNA, 22 bp, Homo sapiens
tcagatcagcctctctctgtct

SEQ ID NO: 156069 - DNA, 22 bp, Homo sapiens
taggttgaactagaagacctct

SEQ ID NO: 156070 - DNA, 22 bp, Homo sapiens
taagagtttatgtgtgtgtgtg

SEQ ID NO: 156071 - DNA, 21 bp, Homo sapiens
tcacacactttctcactcttt

SEQ ID NO: 156072 - DNA, 23 bp, Homo sapiens
tgagtctcactctgtcacccagg

SEQ ID NO: 156073 - DNA, 23 bp, Homo sapiens
tgagtctctctctgtcacctagg

SEQ ID NO: 156074 - DNA, 19 bp, Homo sapiens
cgtagttgtaccactgcac

SEQ ID NO: 156075 - DNA, 20 bp, Homo sapiens
tcacactgctctgctggctc

SEQ ID NO: 156076 - DNA, 23 bp, Homo sapiens
aatctcactctgtctcccaagct

SEQ ID NO: 156077 - DNA, 20 bp, Homo sapiens
tgtatatatgtatatatgtg

SEQ ID NO: 156078 - DNA, 18 bp, Homo sapiens
tatatgtgtgcatatata

SEQ ID NO: 156079 - DNA, 19 bp, Homo sapiens
acagttacattcaaaatgg

SEQ ID NO: 156080 - DNA, 23 bp, Homo sapiens
ttttgaaagtatttgtaaacccc

SEQ ID NO: 156081 - DNA, 22 bp, Homo sapiens
ctctcacagcctctctctgctg

SEQ ID NO: 156082 - DNA, 20 bp, Homo sapiens
acaagagtgaacagcttgcc

SEQ ID NO: 156083 - DNA, 23 bp, Homo sapiens
gacagagtctcgctctgtcaccc

SEQ ID NO: 156084 - DNA, 22 bp, Homo sapiens
aggctgagtaagtacatgagtg

SEQ ID NO: 156085 - DNA, 23 bp, Homo sapiens
tgtccagttcgaagacaatgacc

SEQ ID NO: 156086 - DNA, 23 bp, Homo sapiens
gggtctcactctgtcacccaggc

SEQ ID NO: 156087 - DNA, 22 bp, Homo sapiens
acaggatctcacagagaaactt

SEQ ID NO: 156088 - DNA, 22 bp, Homo sapiens
taagaggaaaagttaacttcag

SEQ ID NO: 156089 - DNA, 23 bp, Homo sapiens
tctcagtgcctctctgtatcaca

SEQ ID NO: 156090 - DNA, 23 bp, Homo sapiens
aaacagtatatgtatactgtaaa

SEQ ID NO: 156091 - DNA, 23 bp, Homo sapiens
agatgtctctctaaatgtctctc

SEQ ID NO: 156092 - DNA, 23 bp, Homo sapiens
tgtgtctgtgtatacgtgtgtgt

SEQ ID NO: 156093 - DNA, 23 bp, Homo sapiens
tatgtatgtgtgcatgtgtgtgt

SEQ ID NO: 156094 - DNA, 23 bp, Homo sapiens
acagcatagaattcagagtgcag

SEQ ID NO: 156095 - DNA, 20 bp, Homo sapiens
ctactctgtctgtgtctgtg

SEQ ID NO: 156096 - DNA, 23 bp, Homo sapiens
tcagttcagattttgctgccaaa

SEQ ID NO: 156097 - DNA, 20 bp, Homo sapiens
tttggttttcagagccttct

SEQ ID NO: 156098 - DNA, 22 bp, Homo sapiens
tgtgtatatatatgtatgtgta

SEQ ID NO: 156099 - DNA, 23 bp, Homo sapiens
tatatgtgtgtatatgtatgtgt

SEQ ID NO: 156100 - DNA, 22 bp, Homo sapiens
tatgtgtatatatatgtgtgtg

SEQ ID NO: 156101 - DNA, 23 bp, Homo sapiens
tgagttcattgtagattctggat

SEQ ID NO: 156102 - DNA, 23 bp, Homo sapiens
tgagttcattgtagattctggat

SEQ ID NO: 156103 - DNA, 22 bp, Homo sapiens
tatgtgtatgtatgtatatatg

SEQ ID NO: 156104 - DNA, 18 bp, Homo sapiens
ttcctgtttcttttgtac

SEQ ID NO: 156105 - DNA, 19 bp, Homo sapiens
tttcagactgtgctctggt

SEQ ID NO: 156106 - DNA, 19 bp, Homo sapiens
cagagatctgagtgggcag

SEQ ID NO: 156107 - DNA, 21 bp, Homo sapiens
attctcactgtcagacaaagg

SEQ ID NO: 156108 - DNA, 18 bp, Homo sapiens
atctccccggtaatcctg

SEQ ID NO: 156109 - DNA, 23 bp, Homo sapiens
tgatatgtttgatatattaggtt

SEQ ID NO: 156110 - DNA, 23 bp, Homo sapiens
tgtctccgtgtgtgtctgcgtct

SEQ ID NO: 156111 - DNA, 23 bp, Homo sapiens
tgtgtgcgtgggtctgtgtctat

SEQ ID NO: 156112 - DNA, 23 bp, Homo sapiens
gtctctgcatatctttgcatatc

SEQ ID NO: 156113 - DNA, 22 bp, Homo sapiens
ttttggagtccctggttttcta

SEQ ID NO: 156114 - DNA, 23 bp, Homo sapiens
agtcacatcacagtctgctcagc

SEQ ID NO: 156115 - DNA, 22 bp, Homo sapiens
tgttaaggacttggaataagga

SEQ ID NO: 156116 - DNA, 22 bp, Homo sapiens
tttcagcattgaatatgaagtg

SEQ ID NO: 156117 - DNA, 23 bp, Homo sapiens
cactctgtcacccagtctggagt

SEQ ID NO: 156118 - DNA, 22 bp, Homo sapiens
agagatagaaagtagattagta

SEQ ID NO: 156119 - DNA, 23 bp, Homo sapiens
tatggttattttgttatacagca

SEQ ID NO: 156120 - DNA, 23 bp, Homo sapiens
gagacagagtctcactctgtcac

SEQ ID NO: 156121 - DNA, 23 bp, Homo sapiens
agctcactgcagtctcagtctcc

SEQ ID NO: 156122 - DNA, 23 bp, Homo sapiens
ccaaaatgctgggattacaggca

SEQ ID NO: 156123 - DNA, 23 bp, Homo sapiens
ttagtagtagggcttcagtacat

SEQ ID NO: 156124 - DNA, 22 bp, Homo sapiens
aactattaagttctgggacagt

SEQ ID NO: 156125 - DNA, 22 bp, Homo sapiens
agaggtagtagcatgtagagtt

SEQ ID NO: 156126 - DNA, 23 bp, Homo sapiens
gtgtgtgagaacagattgagatc

SEQ ID NO: 156127 - DNA, 23 bp, Homo sapiens
tcactgcctgcctgtaatcccag

SEQ ID NO: 156128 - DNA, 23 bp, Homo sapiens
actgcctgcctgtgtgcctggca

SEQ ID NO: 156129 - DNA, 20 bp, Homo sapiens
tcacagactgggtaatttct

SEQ ID NO: 156130 - DNA, 23 bp, Homo sapiens
agaaggagtctcactctgtcacc

SEQ ID NO: 156131 - DNA, 23 bp, Homo sapiens
aagcttccacgttttgcactaag

SEQ ID NO: 156132 - DNA, 22 bp, Homo sapiens
cagtgtcactctgtgggtggca

SEQ ID NO: 156133 - DNA, 23 bp, Homo sapiens
ggagtctcactctgtcacccagg

SEQ ID NO: 156134 - DNA, 23 bp, Homo sapiens
agagtctcactctgtcacccagg

SEQ ID NO: 156135 - DNA, 23 bp, Homo sapiens
gagtctcactctgtcacccaggc

SEQ ID NO: 156136 - DNA, 23 bp, Homo sapiens
aagatcacacactgtcactcagg

SEQ ID NO: 156137 - DNA, 23 bp, Homo sapiens
tgaggttggaggatctcttgagc

SEQ ID NO: 156138 - DNA, 23 bp, Homo sapiens
gatgacactggaagttacttgag

SEQ ID NO: 156139 - DNA, 21 bp, Homo sapiens
ttttttcatgctacagttacc

SEQ ID NO: 156140 - DNA, 23 bp, Homo sapiens
agggtctcactctgtcacccagg

SEQ ID NO: 156141 - DNA, 20 bp, Homo sapiens
cagtggtgtgatcctggctc

SEQ ID NO: 156142 - DNA, 23 bp, Homo sapiens
gggtctcactctgtcacccaggc

SEQ ID NO: 156143 - DNA, 23 bp, Homo sapiens
acctgcctcactgagtcactcac

SEQ ID NO: 156144 - DNA, 23 bp, Homo sapiens
tcgagaaagagtctcactctgtc

SEQ ID NO: 156145 - DNA, 19 bp, Homo sapiens
tgtgcctgtagtaccagct

SEQ ID NO: 156146 - DNA, 22 bp, Homo sapiens
ttgaggttgcagtgagccatga

SEQ ID NO: 156147 - DNA, 22 bp, Homo sapiens
tcccactcaggctctgtgcttg

SEQ ID NO: 156148 - DNA, 18 bp, Homo sapiens
gagaccacatctgttcat

SEQ ID NO: 156149 - DNA, 20 bp, Homo sapiens
agttaagttgtctagctcta

SEQ ID NO: 156150 - DNA, 18 bp, Homo sapiens
agaggaagggtatgatca

SEQ ID NO: 156151 - DNA, 23 bp, Homo sapiens
tctgttcacactggctgttcagt

SEQ ID NO: 156152 - DNA, 23 bp, Homo sapiens
tttttactgcatcctgtcacagg

SEQ ID NO: 156153 - DNA, 23 bp, Homo sapiens
tttcacaggctgcaaacaagatg

SEQ ID NO: 156154 - DNA, 23 bp, Homo sapiens
accgagtctcgctctgtcaccca

SEQ ID NO: 156155 - DNA, 23 bp, Homo sapiens
ttatatgcttggaaaaggaacgt

SEQ ID NO: 156156 - DNA, 23 bp, Homo sapiens
cccagcctgtctcagtggctcag

SEQ ID NO: 156157 - DNA, 23 bp, Homo sapiens
tctgtgaggatgtgcttggagca

SEQ ID NO: 156158 - DNA, 19 bp, Homo sapiens
taactgggacatttagccc

SEQ ID NO: 156159 - DNA, 23 bp, Homo sapiens
tctgggcctctcagtgtcaccca

SEQ ID NO: 156160 - DNA, 23 bp, Homo sapiens
actgcctgactctttctttcaag

SEQ ID NO: 156161 - DNA, 23 bp, Homo sapiens
aagtaagaactacaggcctaaca

SEQ ID NO: 156162 - DNA, 23 bp, Homo sapiens
gtctctctcagtgactctgtagt

SEQ ID NO: 156163 - DNA, 22 bp, Homo sapiens
acagaaagaaaggtagtgagcg

SEQ ID NO: 156164 - DNA, 23 bp, Homo sapiens
agagtctcactctgtcacccagg

SEQ ID NO: 156165 - DNA, 23 bp, Homo sapiens
tgagttcattgtagattctggat

SEQ ID NO: 156166 - DNA, 23 bp, Homo sapiens
tgagttcattgtagattctggat

SEQ ID NO: 156167 - DNA, 20 bp, Homo sapiens
atgagacctgtctctgaaga

SEQ ID NO: 156168 - DNA, 23 bp, Homo sapiens
atctttgagacagagtctcgctc

SEQ ID NO: 156169 - DNA, 23 bp, Homo sapiens
tgagttcattgtagattctggat

SEQ ID NO: 156170 - DNA, 23 bp, Homo sapiens
tgagttcattgtagattctggat

SEQ ID NO: 156171 - DNA, 23 bp, Homo sapiens
tatactatgtatatgtatgcatg

SEQ ID NO: 156172 - DNA, 23 bp, Homo sapiens
atatactatgtatatgtatgcat

SEQ ID NO: 156173 - DNA, 23 bp, Homo sapiens
ttgaagtcagtagggtctgagca

SEQ ID NO: 156174 - DNA, 23 bp, Homo sapiens
ttttggtgattagaaactgcctg

SEQ ID NO: 156175 - DNA, 22 bp, Homo sapiens
tcacacagacgttgctcagaga

SEQ ID NO: 156176 - DNA, 23 bp, Homo sapiens
ctgggcctctctattcactacct

SEQ ID NO: 156177 - DNA, 23 bp, Homo sapiens
tctcagcctcagtttccccatct

SEQ ID NO: 156178 - DNA, 19 bp, Homo sapiens
tgcctgagtgcatgccaca

SEQ ID NO: 156179 - DNA, 21 bp, Homo sapiens
aagatgtattttccctggtct

SEQ ID NO: 156180 - DNA, 23 bp, Homo sapiens
acagagtctcactctgtcgccca

SEQ ID NO: 156181 - DNA, 20 bp, Homo sapiens
ttcaaagtaaatatgaaatg

SEQ ID NO: 156182 - DNA, 23 bp, Homo sapiens
aaagcatgacgctcacatttcat

SEQ ID NO: 156183 - DNA, 23 bp, Homo sapiens
aatatatagagcaggcagtggta

SEQ ID NO: 156184 - DNA, 21 bp, Homo sapiens
tttctctgtatctgtctctct

SEQ ID NO: 156185 - DNA, 23 bp, Homo sapiens
atttgtgactggatttagagtcc

SEQ ID NO: 156186 - DNA, 19 bp, Homo sapiens
ctcactgtctgagagctga

SEQ ID NO: 156187 - DNA, 23 bp, Homo sapiens
aatgtgtgtatatgtatatgttt

SEQ ID NO: 156188 - DNA, 22 bp, Homo sapiens
tcaaaggctctgtctctccctg

SEQ ID NO: 156189 - DNA, 22 bp, Homo sapiens
atgggagtctctctgtgtgtct

SEQ ID NO: 156190 - DNA, 23 bp, Homo sapiens
ctcaagttgttggttgaattcat

SEQ ID NO: 156191 - DNA, 23 bp, Homo sapiens
tctctgtgtcagtcagtcattgg

SEQ ID NO: 156192 - DNA, 23 bp, Homo sapiens
tgtgagtctgcatatgttgtctg

SEQ ID NO: 156193 - DNA, 23 bp, Homo sapiens
gtctgacaccatgtggatgtggt

SEQ ID NO: 156194 - DNA, 23 bp, Homo sapiens
accctgggtccctaactcctctg

SEQ ID NO: 156195 - DNA, 22 bp, Homo sapiens
ttctgacacattgtcctgtaag

SEQ ID NO: 156196 - DNA, 23 bp, Homo sapiens
acagggtgtcactctgtctgtca

SEQ ID NO: 156197 - DNA, 23 bp, Homo sapiens
gtgtgtatatgtctacctataca

SEQ ID NO: 156198 - DNA, 23 bp, Homo sapiens
tatatgcatgtatacatatgtgt

SEQ ID NO: 156199 - DNA, 23 bp, Homo sapiens
gattgtgtgaagactgtgagctg

SEQ ID NO: 156200 - DNA, 19 bp, Homo sapiens
gtagcacgatcacagctca

SEQ ID NO: 156201 - DNA, 20 bp, Homo sapiens
atgtctgtgcagcccattga

SEQ ID NO: 156202 - DNA, 21 bp, Homo sapiens
tagtcccaggtattcgagagg

SEQ ID NO: 156203 - DNA, 19 bp, Homo sapiens
tggtgcctctgtctgtctc

SEQ ID NO: 156204 - DNA, 18 bp, Homo sapiens
acattaaatccactgcta

SEQ ID NO: 156205 - DNA, 18 bp, Homo sapiens
agaggtagaagcatggat

SEQ ID NO: 156206 - DNA, 21 bp, Homo sapiens
tatatgtatacatgtatacac

SEQ ID NO: 156207 - DNA, 22 bp, Homo sapiens
atatatgtatacataacatgtg

SEQ ID NO: 156208 - DNA, 23 bp, Homo sapiens
tttctgagagtttaccatgtgct

SEQ ID NO: 156209 - DNA, 22 bp, Homo sapiens
tgacacagtcagagaggtatta

SEQ ID NO: 156210 - DNA, 23 bp, Homo sapiens
acatctgtatatgtatttctgtt

SEQ ID NO: 156211 - DNA, 21 bp, Homo sapiens
gtcatctgcatggtatggagc

SEQ ID NO: 156212 - DNA, 22 bp, Homo sapiens
tttcttgtggcttaagatggct

SEQ ID NO: 156213 - DNA, 23 bp, Homo sapiens
caaggtctcactctgtcacccag

SEQ ID NO: 156214 - DNA, 23 bp, Homo sapiens
taggctctgactcactccctccc

SEQ ID NO: 156215 - DNA, 23 bp, Homo sapiens
agagtctcactctgtcacccagg

SEQ ID NO: 156216 - DNA, 23 bp, Homo sapiens
gagtctcactctgtcacccaggc

SEQ ID NO: 156217 - DNA, 23 bp, Homo sapiens
gggtctcactctgtcacccaggc

SEQ ID NO: 156218 - DNA, 23 bp, Homo sapiens
gggtctcactctgtcacccaggc

SEQ ID NO: 156219 - DNA, 23 bp, Homo sapiens
ctctgtgactgcgtcactcaggg

SEQ ID NO: 156220 - DNA, 23 bp, Homo sapiens
tttgactccaaaagtaatgctga

SEQ ID NO: 156221 - DNA, 22 bp, Homo sapiens
gttttgtagatggatctatagt

SEQ ID NO: 156222 - DNA, 21 bp, Homo sapiens
ctgttgcagaccctgagatga

SEQ ID NO: 156223 - DNA, 21 bp, Homo sapiens
aattctttccatggtgattgt

SEQ ID NO: 156224 - DNA, 23 bp, Homo sapiens
acagagtctcgctctgtcgctca

SEQ ID NO: 156225 - DNA, 18 bp, Homo sapiens
aggaagtgttctatcctg

SEQ ID NO: 156226 - DNA, 23 bp, Homo sapiens
agtttagatgtggaacttcaaaa

SEQ ID NO: 156227 - DNA, 23 bp, Homo sapiens
agagtctcactctgtcacccagg

SEQ ID NO: 156228 - DNA, 23 bp, Homo sapiens
ctgtgtctctgtgtccttctggg

SEQ ID NO: 156229 - DNA, 23 bp, Homo sapiens
accgagtctcgctctgtcaccca

SEQ ID NO: 156230 - DNA, 23 bp, Homo sapiens
cggagtctcgctctgtctcccag

SEQ ID NO: 156231 - DNA, 23 bp, Homo sapiens
tcagccttgactctgtctcactg

SEQ ID NO: 156232 - DNA, 23 bp, Homo sapiens
gtctcagtctctgtgaccctgac

SEQ ID NO: 156233 - DNA, 22 bp, Homo sapiens
tgcctggccatggtgactctga

SEQ ID NO: 156234 - DNA, 23 bp, Homo sapiens
ctcagtctgtcactgtgtctcac

SEQ ID NO: 156235 - DNA, 23 bp, Homo sapiens
tggaattttgtctggatctagga

SEQ ID NO: 156236 - DNA, 23 bp, Homo sapiens
cctctctgtgggtctcactgtcc

SEQ ID NO: 156237 - DNA, 19 bp, Homo sapiens
ctggtgctcactggccttg

SEQ ID NO: 156238 - DNA, 23 bp, Homo sapiens
tgtgtgcatatagatgtgtatat

SEQ ID NO: 156239 - DNA, 19 bp, Homo sapiens
gatctatgtatatgtgagc

SEQ ID NO: 156240 - DNA, 21 bp, Homo sapiens
agaggttacagtgagccaaga

SEQ ID NO: 156241 - DNA, 20 bp, Homo sapiens
caccttcctcatctgttaga

SEQ ID NO: 156242 - DNA, 22 bp, Homo sapiens
tgggagagatctgatgtgtctg

SEQ ID NO: 156243 - DNA, 23 bp, Homo sapiens
aagacagaccttgccctctcagg

SEQ ID NO: 156244 - DNA, 23 bp, Homo sapiens
tgagacagagtctcactctgtca

SEQ ID NO: 156245 - DNA, 21 bp, Homo sapiens
aagtgctgggattacaggcag

SEQ ID NO: 156246 - DNA, 23 bp, Homo sapiens
gtgagtctgtgagttctagctca

SEQ ID NO: 156247 - DNA, 22 bp, Homo sapiens
tcactgacagtgtagacagtgg

SEQ ID NO: 156248 - DNA, 23 bp, Homo sapiens
tgagtcattttgtaaatgtcaag

SEQ ID NO: 156249 - DNA, 23 bp, Homo sapiens
tgcctctgtctctgccactgtag

SEQ ID NO: 156250 - DNA, 18 bp, Homo sapiens
tagtaccagcactaggtg

SEQ ID NO: 156251 - DNA, 23 bp, Homo sapiens
acagagtctcgctctgtcaccca

SEQ ID NO: 156252 - DNA, 21 bp, Homo sapiens
gagttggctctctgtttgtct

SEQ ID NO: 156253 - DNA, 22 bp, Homo sapiens
aaccagcattaaatatctatct

SEQ ID NO: 156254 - DNA, 22 bp, Homo sapiens
aaggaccattttaattcacaga

SEQ ID NO: 156255 - DNA, 21 bp, Homo sapiens
tggaagtgagtaataatggaa

SEQ ID NO: 156256 - DNA, 23 bp, Homo sapiens
tatatgtgtatgtgtatatgtgt

SEQ ID NO: 156257 - DNA, 23 bp, Homo sapiens
gacagagtctcgctctgtcaccc

SEQ ID NO: 156258 - DNA, 22 bp, Homo sapiens
tctcatgataatgcaatgatca

SEQ ID NO: 156259 - DNA, 23 bp, Homo sapiens
cgctgaggtaggaggatcacttg

SEQ ID NO: 156260 - DNA, 23 bp, Homo sapiens
ttatgatgatgatgatgatgatg

SEQ ID NO: 156261 - DNA, 23 bp, Homo sapiens
taggatgaaatgttatgttgttt

SEQ ID NO: 156262 - DNA, 22 bp, Homo sapiens
tctgtgtggctaagtccagttc

SEQ ID NO: 156263 - DNA, 23 bp, Homo sapiens
aattcatgtccatctggaacctc

SEQ ID NO: 156264 - DNA, 23 bp, Homo sapiens
gggtctcactctgtcacccaggc

SEQ ID NO: 156265 - DNA, 19 bp, Homo sapiens
gtcgccctctctgcctgtg

SEQ ID NO: 156266 - DNA, 23 bp, Homo sapiens
cagcctgtgtagtctgtgtgttc

SEQ ID NO: 156267 - DNA, 23 bp, Homo sapiens
ttagtctcagtctgtcactgtgt

SEQ ID NO: 156268 - DNA, 18 bp, Homo sapiens
tggttttgatttgcattt

SEQ ID NO: 156269 - DNA, 23 bp, Homo sapiens
ttcatatacttgttcttttgaga

SEQ ID NO: 156270 - DNA, 23 bp, Homo sapiens
tcaattacatttcctgaatttga

SEQ ID NO: 156271 - DNA, 21 bp, Homo sapiens
aaacttgataaggaaggcaga

SEQ ID NO: 156272 - DNA, 23 bp, Homo sapiens
agtgtctgtgtgtcttattctgg

SEQ ID NO: 156273 - DNA, 23 bp, Homo sapiens
gagccagtgtctttctctgtcac

SEQ ID NO: 156274 - DNA, 23 bp, Homo sapiens
tgagacagtttcactctgtcacc

SEQ ID NO: 156275 - DNA, 23 bp, Homo sapiens
cggagtctcactctgtcacccag

SEQ ID NO: 156276 - DNA, 23 bp, Homo sapiens
gagtctcactctgtcacccaggc

SEQ ID NO: 156277 - DNA, 23 bp, Homo sapiens
ttttttgcactatagggtgatga

SEQ ID NO: 156278 - DNA, 23 bp, Homo sapiens
gggtgcactcactctctctctgc

SEQ ID NO: 156279 - DNA, 23 bp, Homo sapiens
atctcttagtctctgtttctgta

SEQ ID NO: 156280 - DNA, 23 bp, Homo sapiens
aactgtactgatttagttggatt

SEQ ID NO: 156281 - DNA, 23 bp, Homo sapiens
gacagagtctcgctctgtcaccc

SEQ ID NO: 156282 - DNA, 23 bp, Homo sapiens
gtgctgctgacaatcttgtcttg

SEQ ID NO: 156283 - DNA, 23 bp, Homo sapiens
tgagaagacacagatacagctga

SEQ ID NO: 156284 - DNA, 23 bp, Homo sapiens
gttggacggagaactgataaggg

SEQ ID NO: 156285 - DNA, 22 bp, Homo sapiens
atctgtctgactctcatcctgg

SEQ ID NO: 156286 - DNA, 23 bp, Homo sapiens
tgagttcattgtagattctggat

SEQ ID NO: 156287 - DNA, 23 bp, Homo sapiens
tgagttcattgtagattctggat

SEQ ID NO: 156288 - DNA, 22 bp, Homo sapiens
cactctgtgtcaatgtgtcacc

SEQ ID NO: 156289 - DNA, 23 bp, Homo sapiens
ttttactgtgtatatatatgtgt

SEQ ID NO: 156290 - DNA, 23 bp, Homo sapiens
tactctctgtctctggatttgtg

SEQ ID NO: 156291 - DNA, 22 bp, Homo sapiens
agagtcaggagagtgagctctg

SEQ ID NO: 156292 - DNA, 23 bp, Homo sapiens
tcacacacattggtttacctttg

SEQ ID NO: 156293 - DNA, 23 bp, Homo sapiens
acaatatttctagaaagcagttt

SEQ ID NO: 156294 - DNA, 23 bp, Homo sapiens
cacctgtctgatggagtctttgc

SEQ ID NO: 156295 - DNA, 23 bp, Homo sapiens
tctgtctcactctcagaaagggc

SEQ ID NO: 156296 - DNA, 18 bp, Homo sapiens
tcctacctactcaggagg

SEQ ID NO: 156297 - DNA, 23 bp, Homo sapiens
ctgtctgtcactggctgaccctc

SEQ ID NO: 156298 - DNA, 23 bp, Homo sapiens
ttaaagtgaagggtatagaaaag

SEQ ID NO: 156299 - DNA, 23 bp, Homo sapiens
tatggatatatatacatatatat

SEQ ID NO: 156300 - DNA, 22 bp, Homo sapiens
tacacatatatataatatgtgt

SEQ ID NO: 156301 - DNA, 19 bp, Homo sapiens
tcaatctctctgtatatgt

SEQ ID NO: 156302 - DNA, 23 bp, Homo sapiens
tctgtgtttctctcaatgagttg

SEQ ID NO: 156303 - DNA, 23 bp, Homo sapiens
ttgtctcttacagtgtcagactg

SEQ ID NO: 156304 - DNA, 23 bp, Homo sapiens
gtcagtccaatgttgactgggca

SEQ ID NO: 156305 - DNA, 23 bp, Homo sapiens
tggtgggagaattctgaggcagg

SEQ ID NO: 156306 - DNA, 23 bp, Homo sapiens
tcaggcacacactgtccctcatc

SEQ ID NO: 156307 - DNA, 20 bp, Homo sapiens
tttggactcaagtccctctg

SEQ ID NO: 156308 - DNA, 18 bp, Homo sapiens
ttctttccatgtgtgtgc

SEQ ID NO: 156309 - DNA, 22 bp, Homo sapiens
tattacacctctgcctttcaca

SEQ ID NO: 156310 - DNA, 19 bp, Homo sapiens
tacaacttcagacggtcag

SEQ ID NO: 156311 - DNA, 23 bp, Homo sapiens
gataatggagtttcaggatgatg

SEQ ID NO: 156312 - DNA, 23 bp, Homo sapiens
cctgggtccctgagtgactgtat

SEQ ID NO: 156313 - DNA, 23 bp, Homo sapiens
taagtgaacagtgtttgtcaggt

SEQ ID NO: 156314 - DNA, 22 bp, Homo sapiens
gagtctaatgatgaaagagcta

SEQ ID NO: 156315 - DNA, 23 bp, Homo sapiens
tgagttcattgtagattctggat

SEQ ID NO: 156316 - DNA, 23 bp, Homo sapiens
tgagttcattgtagattctggat

SEQ ID NO: 156317 - DNA, 23 bp, Homo sapiens
tgagttcattgtagattctggat

SEQ ID NO: 156318 - DNA, 23 bp, Homo sapiens
tgagttcattgtagattctggat

SEQ ID NO: 156319 - DNA, 20 bp, Homo sapiens
aagatatttgatattgaaca

SEQ ID NO: 156320 - DNA, 22 bp, Homo sapiens
atttagaaagcaattgcttgga

SEQ ID NO: 156321 - DNA, 21 bp, Homo sapiens
gtccaaggctccctctatctg

SEQ ID NO: 156322 - DNA, 22 bp, Homo sapiens
ttttttctatttgtatacgtat

SEQ ID NO: 156323 - DNA, 23 bp, Homo sapiens
ttatatgtatatctatatcgaga

SEQ ID NO: 156324 - DNA, 21 bp, Homo sapiens
gtccaaggctccctctatctg

SEQ ID NO: 156325 - DNA, 23 bp, Homo sapiens
cagagaacacagccagcagaaga

SEQ ID NO: 156326 - DNA, 23 bp, Homo sapiens
tatatatatcatatgatatcata

SEQ ID NO: 156327 - DNA, 22 bp, Homo sapiens
ttttttctatttgtatacgtat

SEQ ID NO: 156328 - DNA, 23 bp, Homo sapiens
ttatatgtatatctatatcgaga

SEQ ID NO: 156329 - DNA, 23 bp, Homo sapiens
acacagtgaccacagaatgtctc

SEQ ID NO: 156330 - DNA, 23 bp, Homo sapiens
acagactctctcactctgttgcc

SEQ ID NO: 156331 - DNA, 23 bp, Homo sapiens
caccatgatcaatgctggtgtct

SEQ ID NO: 156332 - DNA, 19 bp, Homo sapiens
tcactcacatggctgttgg

SEQ ID NO: 156333 - DNA, 22 bp, Homo sapiens
gtatcagcttcttgttacatgg

SEQ ID NO: 156334 - DNA, 23 bp, Homo sapiens
gacagagtctcgctctgtcaccc

SEQ ID NO: 156335 - DNA, 23 bp, Homo sapiens
tgctctgtgtctctcacggtggc

SEQ ID NO: 156336 - DNA, 21 bp, Homo sapiens
ttctcctcagaaatggcttac

SEQ ID NO: 156337 - DNA, 23 bp, Homo sapiens
tcttaagagctgaaatttcaggt

SEQ ID NO: 156338 - DNA, 20 bp, Homo sapiens
gtctcactttgtcactcagg

SEQ ID NO: 156339 - DNA, 23 bp, Homo sapiens
tggagtctcactctgtcacccag

SEQ ID NO: 156340 - DNA, 23 bp, Homo sapiens
ttttgtggttccatatgaatttt

SEQ ID NO: 156341 - DNA, 23 bp, Homo sapiens
ttgaatttgtagatcactttgga

SEQ ID NO: 156342 - DNA, 23 bp, Homo sapiens
gtggctgagtggctgagtggctg

SEQ ID NO: 156343 - DNA, 23 bp, Homo sapiens
tgtgtgactgcatcggcatctga

SEQ ID NO: 156344 - DNA, 23 bp, Homo sapiens
atgtctgtgtcactgagtctggg

SEQ ID NO: 156345 - DNA, 23 bp, Homo sapiens
tttttttctatttgtatacgtat

SEQ ID NO: 156346 - DNA, 22 bp, Homo sapiens
ttttttctatttgtatacgtat

SEQ ID NO: 156347 - DNA, 23 bp, Homo sapiens
ttatatgtatatctatatcgaga

SEQ ID NO: 156348 - DNA, 21 bp, Homo sapiens
taggagttggacagaatggag

SEQ ID NO: 156349 - DNA, 23 bp, Homo sapiens
cagagaacacagccagcagaaga

SEQ ID NO: 156350 - DNA, 20 bp, Homo sapiens
gtgtatgtgtaaatatgtgc

SEQ ID NO: 156351 - DNA, 23 bp, Homo sapiens
tgccactggttgaaggttgtgtt

SEQ ID NO: 156352 - DNA, 23 bp, Homo sapiens
tgaggtctcactctgtcacccag

SEQ ID NO: 156353 - DNA, 23 bp, Homo sapiens
tttttttctatttgtatacgtat

SEQ ID NO: 156354 - DNA, 22 bp, Homo sapiens
ttttttctatttgtatacgtat

SEQ ID NO: 156355 - DNA, 23 bp, Homo sapiens
ttatatgtatatctatatcgaga

SEQ ID NO: 156356 - DNA, 23 bp, Homo sapiens
agagtctcactctgtcacccagg

SEQ ID NO: 156357 - DNA, 19 bp, Homo sapiens
gactcgctctgtcacccag

SEQ ID NO: 156358 - DNA, 23 bp, Homo sapiens
gagacagagtctcactctgtcgc

SEQ ID NO: 156359 - DNA, 23 bp, Homo sapiens
tgtctgtggttgtacctataatt

SEQ ID NO: 156360 - DNA, 23 bp, Homo sapiens
gtaaagattgtggatgtcttcag

SEQ ID NO: 156361 - DNA, 23 bp, Homo sapiens
tgctagagagcagagactgatgt

SEQ ID NO: 156362 - DNA, 23 bp, Homo sapiens
agacagtgtctctctctgtcacc

SEQ ID NO: 156363 - DNA, 23 bp, Homo sapiens
aacattccattgtcaggatgtag

SEQ ID NO: 156364 - DNA, 23 bp, Homo sapiens
gattccatatcttttctattgtg

SEQ ID NO: 156365 - DNA, 23 bp, Homo sapiens
agtgaatgtgcaactgcatgtgt

SEQ ID NO: 156366 - DNA, 21 bp, Homo sapiens
tatgcatatatatatgtatgt

SEQ ID NO: 156367 - DNA, 23 bp, Homo sapiens
agggtcagtagtgattatgatga

SEQ ID NO: 156368 - DNA, 21 bp, Homo sapiens
tgtgagtgggtgtggatgtga

SEQ ID NO: 156369 - DNA, 21 bp, Homo sapiens
atttctgcatttgtatatgtg

SEQ ID NO: 156370 - DNA, 21 bp, Homo sapiens
tatgcttatatatctgtagta

SEQ ID NO: 156371 - DNA, 18 bp, Homo sapiens
atgtatatatatatgtgt

SEQ ID NO: 156372 - DNA, 23 bp, Homo sapiens
atgtatatgtatatgtatacata

SEQ ID NO: 156373 - DNA, 22 bp, Homo sapiens
tgagttctgtcacaaagatttt

SEQ ID NO: 156374 - DNA, 19 bp, Homo sapiens
aaatggtacgtatgctaag

SEQ ID NO: 156375 - DNA, 23 bp, Homo sapiens
gacagagtctcgctctgtcaccc

SEQ ID NO: 156376 - DNA, 23 bp, Homo sapiens
atctgtgtgtctgtgtgtagttt

SEQ ID NO: 156377 - DNA, 18 bp, Homo sapiens
atatgtgcatatacatgt

SEQ ID NO: 156378 - DNA, 20 bp, Homo sapiens
atggagccagcatatcttgg

SEQ ID NO: 156379 - DNA, 23 bp, Homo sapiens
cggagtctcactctgtcacccag

SEQ ID NO: 156380 - DNA, 23 bp, Homo sapiens
gagtctcactctgtcacccaggc

SEQ ID NO: 156381 - DNA, 23 bp, Homo sapiens
tatatatacacgtatatatgtgt

SEQ ID NO: 156382 - DNA, 23 bp, Homo sapiens
tgtgtatatatatacacgtatat

SEQ ID NO: 156383 - DNA, 22 bp, Homo sapiens
tatatacacgtatatatgtgtg

SEQ ID NO: 156384 - DNA, 21 bp, Homo sapiens
tatatatacacgtatatatgt

SEQ ID NO: 156385 - DNA, 21 bp, Homo sapiens
acagtttgctatactcttacc

SEQ ID NO: 156386 - DNA, 23 bp, Homo sapiens
tggaagactagtgattttgttgt

SEQ ID NO: 156387 - DNA, 22 bp, Homo sapiens
caacaaatcccagtctacctaa

SEQ ID NO: 156388 - DNA, 23 bp, Homo sapiens
tctctgtgtgtgtccaaacttcc

SEQ ID NO: 156389 - DNA, 23 bp, Homo sapiens
tctgacatctctgtgtctgacca

SEQ ID NO: 156390 - DNA, 21 bp, Homo sapiens
ttagcaatgttgggagacatt

SEQ ID NO: 156391 - DNA, 23 bp, Homo sapiens
taagtgtagatccagccatgcac

SEQ ID NO: 156392 - DNA, 21 bp, Homo sapiens
atagcatggatgtcagagcca

SEQ ID NO: 156393 - DNA, 22 bp, Homo sapiens
ttgagactagatagagtactct

SEQ ID NO: 156394 - DNA, 21 bp, Homo sapiens
ctgttggtaatgtatttggta

SEQ ID NO: 156395 - DNA, 23 bp, Homo sapiens
cttctgacagacacctctggctc

SEQ ID NO: 156396 - DNA, 23 bp, Homo sapiens
cacactctcaatctctctctcct

SEQ ID NO: 156397 - DNA, 21 bp, Homo sapiens
tgaggttggaggatcacttga

SEQ ID NO: 156398 - DNA, 19 bp, Homo sapiens
tcagaagtgactgagcttg

SEQ ID NO: 156399 - DNA, 23 bp, Homo sapiens
actctatctgtgcctccatctga

SEQ ID NO: 156400 - DNA, 23 bp, Homo sapiens
gacactcagtttctgtctgtaaa

SEQ ID NO: 156401 - DNA, 23 bp, Homo sapiens
ggcagagtctcactctgtcaccc

SEQ ID NO: 156402 - DNA, 23 bp, Homo sapiens
gggtctcactctgtcacccaggc

SEQ ID NO: 156403 - DNA, 23 bp, Homo sapiens
tggcttgaagccaggagttggag

SEQ ID NO: 156404 - DNA, 23 bp, Homo sapiens
tggagtctcactctgtcacccag

SEQ ID NO: 156405 - DNA, 23 bp, Homo sapiens
tctttggttatctagctgtatga

SEQ ID NO: 156406 - DNA, 22 bp, Homo sapiens
ataaagctagataaccgaaagt

SEQ ID NO: 156407 - DNA, 23 bp, Homo sapiens
agagtctcactcactctgtctcc

SEQ ID NO: 156408 - DNA, 23 bp, Homo sapiens
tcactcagtgtcactgaactatc

SEQ ID NO: 156409 - DNA, 21 bp, Homo sapiens
tacgtgtgtgtgtgtgtgtgt

SEQ ID NO: 156410 - DNA, 23 bp, Homo sapiens
gggtctcactctgttactcaggc

SEQ ID NO: 156411 - DNA, 23 bp, Homo sapiens
gtacagtggtgcagtcatagctc

SEQ ID NO: 156412 - DNA, 23 bp, Homo sapiens
tctgcttctttctctcaatcact

SEQ ID NO: 156413 - DNA, 23 bp, Homo sapiens
tatgagccactgctcctggcctt

SEQ ID NO: 156414 - DNA, 23 bp, Homo sapiens
agtggcagaaagttcttctgatg

SEQ ID NO: 156415 - DNA, 23 bp, Homo sapiens
ttctgtctgtctctctatcactc

SEQ ID NO: 156416 - DNA, 21 bp, Homo sapiens
cacagcctctctgtgtctcct

SEQ ID NO: 156417 - DNA, 23 bp, Homo sapiens
tggttgtggtcagtggtagcaga

SEQ ID NO: 156418 - DNA, 20 bp, Homo sapiens
tcccaagtctgcacatttga

SEQ ID NO: 156419 - DNA, 23 bp, Homo sapiens
ggcaaagaattcacagcattctg

SEQ ID NO: 156420 - DNA, 21 bp, Homo sapiens
cataggagaagaaaatgctga

SEQ ID NO: 156421 - DNA, 23 bp, Homo sapiens
gttacagactctcactctctaga

SEQ ID NO: 156422 - DNA, 23 bp, Homo sapiens
tttctttatcgtgcagtttatgg

SEQ ID NO: 156423 - DNA, 23 bp, Homo sapiens
cagttctgtctccctcaggaccc

SEQ ID NO: 156424 - DNA, 23 bp, Homo sapiens
tgtgtgaactgagtgagagcaca

SEQ ID NO: 156425 - DNA, 23 bp, Homo sapiens
tggtgacagtctagtcagtgtgg

SEQ ID NO: 156426 - DNA, 23 bp, Homo sapiens
agtcacacgcatttctctgactc

SEQ ID NO: 156427 - DNA, 23 bp, Homo sapiens
tagatgctcacagggattgctgt

SEQ ID NO: 156428 - DNA, 23 bp, Homo sapiens
cagagtctcgctctgtctcccag

SEQ ID NO: 156429 - DNA, 23 bp, Homo sapiens
tggagtctcactctgtcacccag

SEQ ID NO: 156430 - DNA, 23 bp, Homo sapiens
gagagagagaagctagagagctc

SEQ ID NO: 156431 - DNA, 23 bp, Homo sapiens
tagtggtcattcatgttccttgt

SEQ ID NO: 156432 - DNA, 19 bp, Homo sapiens
aagaggagcctgtgtcttt

SEQ ID NO: 156433 - DNA, 23 bp, Homo sapiens
acagagtctcgctctgtcaccca

SEQ ID NO: 156434 - DNA, 22 bp, Homo sapiens
atatgtgtgtatatatatgtgt

SEQ ID NO: 156435 - DNA, 22 bp, Homo sapiens
tgaggctctgttctgaagactc

SEQ ID NO: 156436 - DNA, 20 bp, Homo sapiens
tctgagacagagtctcactc

SEQ ID NO: 156437 - DNA, 23 bp, Homo sapiens
tgagttcattgtagattctggat

SEQ ID NO: 156438 - DNA, 23 bp, Homo sapiens
tgagttcattgtagattctggat

SEQ ID NO: 156439 - DNA, 20 bp, Homo sapiens
tgggtgtgaatgttgtcaca

SEQ ID NO: 156440 - DNA, 23 bp, Homo sapiens
tagtatttctataagtgaattac

SEQ ID NO: 156441 - DNA, 23 bp, Homo sapiens
tttgcatttataatcatatgtaa

SEQ ID NO: 156442 - DNA, 23 bp, Homo sapiens
gttttacaatgtttacagatgaa

SEQ ID NO: 156443 - DNA, 23 bp, Homo sapiens
tctctcactcacatttttgcttg

SEQ ID NO: 156444 - DNA, 23 bp, Homo sapiens
atgtatacacatgcatatgtgta

SEQ ID NO: 156445 - DNA, 21 bp, Homo sapiens
aaatgcacatctctgagcccc

SEQ ID NO: 156446 - DNA, 22 bp, Homo sapiens
ctgagtctcgctctgtcaccca

SEQ ID NO: 156447 - DNA, 23 bp, Homo sapiens
tttccctatgaatagatttgtaa

SEQ ID NO: 156448 - DNA, 23 bp, Homo sapiens
tgtctcactctgtcacccaggct

SEQ ID NO: 156449 - DNA, 19 bp, Homo sapiens
tacagtggtgcagtcatgg

SEQ ID NO: 156450 - DNA, 19 bp, Homo sapiens
taaggacactagttacgtc

SEQ ID NO: 156451 - DNA, 23 bp, Homo sapiens
ttctgtggcactgactgtgtgtg

SEQ ID NO: 156452 - DNA, 20 bp, Homo sapiens
acacacacacatatatatgt

SEQ ID NO: 156453 - DNA, 23 bp, Homo sapiens
atatgtgtgtatatatatatgtg

SEQ ID NO: 156454 - DNA, 23 bp, Homo sapiens
cattgtctctctctttttcatga

SEQ ID NO: 156455 - DNA, 19 bp, Homo sapiens
tatctatatgtatatgtgt

SEQ ID NO: 156456 - DNA, 23 bp, Homo sapiens
aatgtcaggccttgtactgagct

SEQ ID NO: 156457 - DNA, 19 bp, Homo sapiens
tgtgtatatatatacacat

SEQ ID NO: 156458 - DNA, 23 bp, Homo sapiens
tcactggctcactggctcactgc

SEQ ID NO: 156459 - DNA, 23 bp, Homo sapiens
caggagcatttgtgtgtgtatat

SEQ ID NO: 156460 - DNA, 22 bp, Homo sapiens
tgaccttctctctgtcactaag

SEQ ID NO: 156461 - DNA, 23 bp, Homo sapiens
tgagaaactcagaacagatgaac

SEQ ID NO: 156462 - DNA, 23 bp, Homo sapiens
accgtctgtcactctccgctgac

SEQ ID NO: 156463 - DNA, 23 bp, Homo sapiens
tctgcagagcgcgtgtcagcccg

SEQ ID NO: 156464 - DNA, 21 bp, Homo sapiens
cttcagcgtctctgtttctat

SEQ ID NO: 156465 - DNA, 23 bp, Homo sapiens
aacttctcaatttgatttagtgt

SEQ ID NO: 156466 - DNA, 20 bp, Homo sapiens
tgatagggttgataagtgag

SEQ ID NO: 156467 - DNA, 23 bp, Homo sapiens
aacatgtgttatgttgaagactt

SEQ ID NO: 156468 - DNA, 23 bp, Homo sapiens
cagacagaagatggacttctctg

SEQ ID NO: 156469 - DNA, 23 bp, Homo sapiens
gactttggtctctctgtgtctca

SEQ ID NO: 156470 - DNA, 23 bp, Homo sapiens
agagagaagagagtgagacttga

SEQ ID NO: 156471 - DNA, 18 bp, Homo sapiens
agcctgagttctccagga

SEQ ID NO: 156472 - DNA, 23 bp, Homo sapiens
tgtgacagcaagctgaaagctag

SEQ ID NO: 156473 - DNA, 19 bp, Homo sapiens
ttaggttttctagtagtag

SEQ ID NO: 156474 - DNA, 18 bp, Homo sapiens
agagcaaggcactcttat

SEQ ID NO: 156475 - DNA, 23 bp, Homo sapiens
tgagttcattgtagattctggat

SEQ ID NO: 156476 - DNA, 23 bp, Homo sapiens
tgagttcattgtagattctggat

SEQ ID NO: 156477 - DNA, 23 bp, Homo sapiens
tcagtttgaatgctgacactgac

SEQ ID NO: 156478 - DNA, 23 bp, Homo sapiens
tcactgacagtgtgacttcaagc

SEQ ID NO: 156479 - DNA, 23 bp, Homo sapiens
ctgagtgcctctgtgactgtttc

SEQ ID NO: 156480 - DNA, 20 bp, Homo sapiens
tacacacacacacatatatg

SEQ ID NO: 156481 - DNA, 23 bp, Homo sapiens
atatatgtatatatatgtgtgtg

SEQ ID NO: 156482 - DNA, 22 bp, Homo sapiens
atacacacatatatatgtgtgt

SEQ ID NO: 156483 - DNA, 18 bp, Homo sapiens
tctccaactccttacctt

SEQ ID NO: 156484 - DNA, 21 bp, Homo sapiens
agtctcactgtgtctccaggc

SEQ ID NO: 156485 - DNA, 23 bp, Homo sapiens
tttgactttgagaaagtttaggt

SEQ ID NO: 156486 - DNA, 23 bp, Homo sapiens
cttctctgtctcagtttcttctt

SEQ ID NO: 156487 - DNA, 23 bp, Homo sapiens
tgagttcattgtagattctggat

SEQ ID NO: 156488 - DNA, 23 bp, Homo sapiens
tgagttcattgtagattctggat

SEQ ID NO: 156489 - DNA, 23 bp, Homo sapiens
tgagttcattgtagattctggat

SEQ ID NO: 156490 - DNA, 23 bp, Homo sapiens
tgagttcattgtagattctggat

SEQ ID NO: 156491 - DNA, 22 bp, Homo sapiens
atgtgtgcttagtatggagact

SEQ ID NO: 156492 - DNA, 23 bp, Homo sapiens
tgtgtgtgtgtatatatacacgt

SEQ ID NO: 156493 - DNA, 20 bp, Homo sapiens
actcacacacacatataccc

SEQ ID NO: 156494 - DNA, 23 bp, Homo sapiens
tctgtgtctgtgtctctgtgagt

SEQ ID NO: 156495 - DNA, 23 bp, Homo sapiens
gggtctcactctgtcacccaggc

SEQ ID NO: 156496 - DNA, 23 bp, Homo sapiens
tgatcagaaattcttcatgtgag

SEQ ID NO: 156497 - DNA, 23 bp, Homo sapiens
gaatgtgcaatctgtgttttcac

SEQ ID NO: 156498 - DNA, 21 bp, Homo sapiens
tgtctccctctctcccacgca

SEQ ID NO: 156499 - DNA, 22 bp, Homo sapiens
cctctgcctctgtgtgcctctg

SEQ ID NO: 156500 - DNA, 23 bp, Homo sapiens
tggagtctcactctgtcacccag

SEQ ID NO: 156501 - DNA, 20 bp, Homo sapiens
acacacgcacacatactgca

SEQ ID NO: 156502 - DNA, 23 bp, Homo sapiens
gtgtgcacctgtagttccagtta

SEQ ID NO: 156503 - DNA, 23 bp, Homo sapiens
gagacagagattgcagtgagcca

SEQ ID NO: 156504 - DNA, 22 bp, Homo sapiens
attgtcagctcttgacttctct

SEQ ID NO: 156505 - DNA, 20 bp, Homo sapiens
ttttgagagggaatctcact

SEQ ID NO: 156506 - DNA, 23 bp, Homo sapiens
tgggagagggagaaatcacagtg

SEQ ID NO: 156507 - DNA, 19 bp, Homo sapiens
gactttccttgttttacgt

SEQ ID NO: 156508 - DNA, 22 bp, Homo sapiens
tctgtctccatgtcttccctgg

SEQ ID NO: 156509 - DNA, 18 bp, Homo sapiens
ttggtagaactatatatt

SEQ ID NO: 156510 - DNA, 23 bp, Homo sapiens
tactttcttcttcagatttgagt

SEQ ID NO: 156511 - DNA, 23 bp, Homo sapiens
tgactgaggagagactgctgttc

SEQ ID NO: 156512 - DNA, 21 bp, Homo sapiens
atctcgtttcactgcaacctc

SEQ ID NO: 156513 - DNA, 23 bp, Homo sapiens
tgagatggagtcccactctgtca

SEQ ID NO: 156514 - DNA, 19 bp, Homo sapiens
agtggtgtgatcgcagctc

SEQ ID NO: 156515 - DNA, 22 bp, Homo sapiens
gcctggctccctcaatcacagg

SEQ ID NO: 156516 - DNA, 19 bp, Homo sapiens
tatagtgtatatatacaca

SEQ ID NO: 156517 - DNA, 23 bp, Homo sapiens
acagtagacagtcaggagatgtt

SEQ ID NO: 156518 - DNA, 23 bp, Homo sapiens
tcatgacagaagacagagaaccc

SEQ ID NO: 156519 - DNA, 19 bp, Homo sapiens
attcaagcatcagactccc

SEQ ID NO: 156520 - DNA, 23 bp, Homo sapiens
gagtgtctgaggcagtggttctg

SEQ ID NO: 156521 - DNA, 23 bp, Homo sapiens
aatatgcatatctatagatatga

SEQ ID NO: 156522 - DNA, 23 bp, Homo sapiens
ctgagtctcacactgtcacccag

SEQ ID NO: 156523 - DNA, 18 bp, Homo sapiens
accaactgtagtgtgtgt

SEQ ID NO: 156524 - DNA, 19 bp, Homo sapiens
agtgtgcaagtattttaat

SEQ ID NO: 156525 - DNA, 23 bp, Homo sapiens
tcaatggtagcttgatggggata

SEQ ID NO: 156526 - DNA, 23 bp, Homo sapiens
acacagtcagtctctgtctcttc

SEQ ID NO: 156527 - DNA, 23 bp, Homo sapiens
gaatagctggtagaaagtattga

SEQ ID NO: 156528 - DNA, 23 bp, Homo sapiens
atgtatgtatgtatgtatatatg

SEQ ID NO: 156529 - DNA, 23 bp, Homo sapiens
gtatgtatgtatgtatatatgtg

SEQ ID NO: 156530 - DNA, 23 bp, Homo sapiens
acagtgtcactcgctctgtccct

SEQ ID NO: 156531 - DNA, 23 bp, Homo sapiens
ggtagagaactgacttagatctt

SEQ ID NO: 156532 - DNA, 23 bp, Homo sapiens
agagtctcactctgtcacccagg

SEQ ID NO: 156533 - DNA, 23 bp, Homo sapiens
ttgatgatttgtgcccccttttc

SEQ ID NO: 156534 - DNA, 21 bp, Homo sapiens
tgtgtgtccatgtgcatgtct

SEQ ID NO: 156535 - DNA, 21 bp, Homo sapiens
tttgtgtgtgtatacatatac

SEQ ID NO: 156536 - DNA, 23 bp, Homo sapiens
tgagacggagttttgttcttctt

SEQ ID NO: 156537 - DNA, 22 bp, Homo sapiens
aggggtgtgtgtgtgcatggtt

SEQ ID NO: 156538 - DNA, 20 bp, Homo sapiens
tcacagaggagtgtgggctc

SEQ ID NO: 156539 - DNA, 18 bp, Homo sapiens
catctgttgaatggacgt

SEQ ID NO: 156540 - DNA, 23 bp, Homo sapiens
tgagatggagtctcactctgtcg

SEQ ID NO: 156541 - DNA, 21 bp, Homo sapiens
tttgatggagtgccccaggct

SEQ ID NO: 156542 - DNA, 21 bp, Homo sapiens
tgcctccctcgctgtctgtgc

SEQ ID NO: 156543 - DNA, 23 bp, Homo sapiens
tcagtctctgtcactgaaatccc

SEQ ID NO: 156544 - DNA, 23 bp, Homo sapiens
aaactgacaaactagtttccagc

SEQ ID NO: 156545 - DNA, 23 bp, Homo sapiens
gtagtgtcactgtctctttttct

SEQ ID NO: 156546 - DNA, 21 bp, Homo sapiens
aggctgcctgtgagccagaga

SEQ ID NO: 156547 - DNA, 23 bp, Homo sapiens
tggagtctcactctgtcacccag

SEQ ID NO: 156548 - DNA, 23 bp, Homo sapiens
acaggagtctcactctgtcaccc

SEQ ID NO: 156549 - DNA, 21 bp, Homo sapiens
ttgacagatgactgtgtgcac

SEQ ID NO: 156550 - DNA, 23 bp, Homo sapiens
tgagttcattgtagattctggat

SEQ ID NO: 156551 - DNA, 23 bp, Homo sapiens
tgagttcattgtagattctggat

SEQ ID NO: 156552 - DNA, 22 bp, Homo sapiens
tatgtatgatagtaataaattg

SEQ ID NO: 156553 - DNA, 23 bp, Homo sapiens
tcccactgtattgaacatctcct

SEQ ID NO: 156554 - DNA, 23 bp, Homo sapiens
tcagtagagagtgttgagtgcct

SEQ ID NO: 156555 - DNA, 23 bp, Homo sapiens
ttctctgtcatgatgatgtacgt

SEQ ID NO: 156556 - DNA, 20 bp, Homo sapiens
atatgttttttcattggcag

SEQ ID NO: 156557 - DNA, 18 bp, Homo sapiens
tatacactatatgtatat

SEQ ID NO: 156558 - DNA, 23 bp, Homo sapiens
ggagtctcactctgtctcccagg

SEQ ID NO: 156559 - DNA, 23 bp, Homo sapiens
tgaggtagaaggatcacttgagc

SEQ ID NO: 156560 - DNA, 18 bp, Homo sapiens
accaactgtagtgtgtgt

SEQ ID NO: 156561 - DNA, 23 bp, Homo sapiens
tgagtctcactctgtcactcagg

SEQ ID NO: 156562 - DNA, 18 bp, Homo sapiens
ttggacctgcttttcctg

SEQ ID NO: 156563 - DNA, 22 bp, Homo sapiens
agctaagtatacaagaaacgag

SEQ ID NO: 156564 - DNA, 19 bp, Homo sapiens
gctctccatgttctctggc

SEQ ID NO: 156565 - DNA, 22 bp, Homo sapiens
acagggtccttctctgctctct

SEQ ID NO: 156566 - DNA, 23 bp, Homo sapiens
tcctctgtgtctgtgagtggctg

SEQ ID NO: 156567 - DNA, 21 bp, Homo sapiens
atctgtaagggctgtgacact

SEQ ID NO: 156568 - DNA, 23 bp, Homo sapiens
ctgagtctgtttttgagctactg

SEQ ID NO: 156569 - DNA, 20 bp, Homo sapiens
tatgtgtatatatatgtgtg

SEQ ID NO: 156570 - DNA, 23 bp, Homo sapiens
tatatgtgtatatatatacatgt

SEQ ID NO: 156571 - DNA, 23 bp, Homo sapiens
atatgtatactatacatatgtgt

SEQ ID NO: 156572 - DNA, 23 bp, Homo sapiens
ttctctgtctctctgttagccta

SEQ ID NO: 156573 - DNA, 23 bp, Homo sapiens
cacggtctgtgactctgacagga

SEQ ID NO: 156574 - DNA, 23 bp, Homo sapiens
ccagcctgtgtctctgtggctct

SEQ ID NO: 156575 - DNA, 20 bp, Homo sapiens
cagtcctcacagcccttgct

SEQ ID NO: 156576 - DNA, 19 bp, Homo sapiens
tgtgtatatatacacgtgt

SEQ ID NO: 156577 - DNA, 23 bp, Homo sapiens
atatgtgtatatatacacgtgtg

SEQ ID NO: 156578 - DNA, 23 bp, Homo sapiens
tatgtgtatatatacacgtgtgt

SEQ ID NO: 156579 - DNA, 23 bp, Homo sapiens
tatgtgtatatatacacgtgtgt

SEQ ID NO: 156580 - DNA, 23 bp, Homo sapiens
atatgtgtatatatacacgtgtg

SEQ ID NO: 156581 - DNA, 22 bp, Homo sapiens
atatgtgtatatatacacgtgt

SEQ ID NO: 156582 - DNA, 20 bp, Homo sapiens
tatgtatatatatacacgtg

SEQ ID NO: 156583 - DNA, 19 bp, Homo sapiens
gactgtctctctggccctc

SEQ ID NO: 156584 - DNA, 23 bp, Homo sapiens
tctgagctaggtgtgacatatgt

SEQ ID NO: 156585 - DNA, 23 bp, Homo sapiens
aaacttgaatcaggttttgtttt

SEQ ID NO: 156586 - DNA, 21 bp, Homo sapiens
ttatgtgtatatatgtgtgtg

SEQ ID NO: 156587 - DNA, 23 bp, Homo sapiens
agcagagttgtaatctattccaa

SEQ ID NO: 156588 - DNA, 19 bp, Homo sapiens
tgggatggtcatgggttag

SEQ ID NO: 156589 - DNA, 23 bp, Homo sapiens
cattgctatggaattctctgaac

SEQ ID NO: 156590 - DNA, 23 bp, Homo sapiens
tgagatggagtttctctctgtca

SEQ ID NO: 156591 - DNA, 21 bp, Homo sapiens
tgcatatctatgggcatgaca

SEQ ID NO: 156592 - DNA, 23 bp, Homo sapiens
acagaactatgagtgcagtgggt

SEQ ID NO: 156593 - DNA, 23 bp, Homo sapiens
ggccgactagaagcagcagtggt

SEQ ID NO: 156594 - DNA, 21 bp, Homo sapiens
atatatgtatgtatatgaata

SEQ ID NO: 156595 - DNA, 21 bp, Homo sapiens
tatgaatgttcatgtaatgac

SEQ ID NO: 156596 - DNA, 23 bp, Homo sapiens
atgtgtgtagtgtctgtgtgtgt

SEQ ID NO: 156597 - DNA, 20 bp, Homo sapiens
tctccagataaatgaaacca

SEQ ID NO: 156598 - DNA, 23 bp, Homo sapiens
aatgtgagagacatacttttctg

SEQ ID NO: 156599 - DNA, 23 bp, Homo sapiens
tatcgatatatatgtattgtaca

SEQ ID NO: 156600 - DNA, 20 bp, Homo sapiens
agagttcttgatatacctac

SEQ ID NO: 156601 - DNA, 23 bp, Homo sapiens
catggtgtgtgtatatatatatg

SEQ ID NO: 156602 - DNA, 20 bp, Homo sapiens
tactgtagtgttgtaatagg

SEQ ID NO: 156603 - DNA, 23 bp, Homo sapiens
tgtgattctatttgtatgagttt

SEQ ID NO: 156604 - DNA, 23 bp, Homo sapiens
cctgtctctctgtttctagattc

SEQ ID NO: 156605 - DNA, 18 bp, Homo sapiens
gaagagacttatgcttgt

SEQ ID NO: 156606 - DNA, 23 bp, Homo sapiens
ctctgacagaaaatagtaagcac

SEQ ID NO: 156607 - DNA, 23 bp, Homo sapiens
agacaggatctctctctgtcacc

SEQ ID NO: 156608 - DNA, 23 bp, Homo sapiens
tttgaagtggagtctcgctctgt

SEQ ID NO: 156609 - DNA, 23 bp, Homo sapiens
attgtgtgtgtgtgtagagaggg

SEQ ID NO: 156610 - DNA, 21 bp, Homo sapiens
taggtgggttgacatggccta

SEQ ID NO: 156611 - DNA, 20 bp, Homo sapiens
tgtgtgtgtgtgtgtgtgtg

SEQ ID NO: 156612 - DNA, 23 bp, Homo sapiens
tacccagtcttgggtatgtctct

SEQ ID NO: 156613 - DNA, 23 bp, Homo sapiens
actctggtctttgtactgggagc

SEQ ID NO: 156614 - DNA, 21 bp, Homo sapiens
tctctgagagctagactattg

SEQ ID NO: 156615 - DNA, 23 bp, Homo sapiens
gagtgtgagaaatcacagacagc

SEQ ID NO: 156616 - DNA, 21 bp, Homo sapiens
tgtgaagaaggtgttcgcttc

SEQ ID NO: 156617 - DNA, 23 bp, Homo sapiens
tgtgctttcaggatctatacttt

SEQ ID NO: 156618 - DNA, 23 bp, Homo sapiens
catatgtacatgcattagataca

SEQ ID NO: 156619 - DNA, 23 bp, Homo sapiens
tatatagatcatattgtagtaca

SEQ ID NO: 156620 - DNA, 20 bp, Homo sapiens
atgtgtatatatatgtgtgt

SEQ ID NO: 156621 - DNA, 19 bp, Homo sapiens
aggacactgggaaagatga

SEQ ID NO: 156622 - DNA, 18 bp, Homo sapiens
gtttattaatttatctga

SEQ ID NO: 156623 - DNA, 23 bp, Homo sapiens
gtaaagcaccaatttagacctgt

SEQ ID NO: 156624 - DNA, 23 bp, Homo sapiens
gtatgtatatatatatgtatgtg

SEQ ID NO: 156625 - DNA, 23 bp, Homo sapiens
gtgagcgcctctctgtccctctg

SEQ ID NO: 156626 - DNA, 20 bp, Homo sapiens
aattccaaattatgaagttc

SEQ ID NO: 156627 - DNA, 23 bp, Homo sapiens
ggagtctctctctgtcacccagg

SEQ ID NO: 156628 - DNA, 23 bp, Homo sapiens
tccctctgtgactcactttccac

SEQ ID NO: 156629 - DNA, 23 bp, Homo sapiens
tgtctgtctctgtatctttatgt

SEQ ID NO: 156630 - DNA, 21 bp, Homo sapiens
atcctgcctcatgtaggtctc

SEQ ID NO: 156631 - DNA, 23 bp, Homo sapiens
acttggttcttgaagctggaatg

SEQ ID NO: 156632 - DNA, 23 bp, Homo sapiens
tgtgtgtatatatatggagataa

SEQ ID NO: 156633 - DNA, 22 bp, Homo sapiens
atatgtatatatacatatgtgt

SEQ ID NO: 156634 - DNA, 23 bp, Homo sapiens
agagttctgagaccttaatctct

SEQ ID NO: 156635 - DNA, 22 bp, Homo sapiens
gaagcaggtcacagtctattat

SEQ ID NO: 156636 - DNA, 23 bp, Homo sapiens
cagaatctcactctgtcacccag

SEQ ID NO: 156637 - DNA, 23 bp, Homo sapiens
atttgtcaaagtgtcaaatcaca

SEQ ID NO: 156638 - DNA, 23 bp, Homo sapiens
attgcatgtttattgtgcatttc

SEQ ID NO: 156639 - DNA, 23 bp, Homo sapiens
cttttctctgcagactcaccagt

SEQ ID NO: 156640 - DNA, 23 bp, Homo sapiens
tgagttcattgtagattctggat

SEQ ID NO: 156641 - DNA, 23 bp, Homo sapiens
tgagttcattgtagattctggat

SEQ ID NO: 156642 - DNA, 21 bp, Homo sapiens
agtcagactcacatactcgct

SEQ ID NO: 156643 - DNA, 23 bp, Homo sapiens
tctcaaactgtgtctccattggt

SEQ ID NO: 156644 - DNA, 23 bp, Homo sapiens
atatagaaggtagaagtattgat

SEQ ID NO: 156645 - DNA, 22 bp, Homo sapiens
gagatggagtctcactctgtca

SEQ ID NO: 156646 - DNA, 23 bp, Homo sapiens
aaacaccagctgctaagttgctg

SEQ ID NO: 156647 - DNA, 18 bp, Homo sapiens
gagtcttgcttttgttgc

SEQ ID NO: 156648 - DNA, 22 bp, Homo sapiens
tcactgggaggtagattgggct

SEQ ID NO: 156649 - DNA, 22 bp, Homo sapiens
tgtgagcatctaagttactcac

SEQ ID NO: 156650 - DNA, 21 bp, Homo sapiens
tttagtctttatagtgaagat

SEQ ID NO: 156651 - DNA, 23 bp, Homo sapiens
acattctgatctgattttgatgt

SEQ ID NO: 156652 - DNA, 23 bp, Homo sapiens
ggtgtgcttgtatgtatacatga

SEQ ID NO: 156653 - DNA, 21 bp, Homo sapiens
tatacatgttttgtatatcta

SEQ ID NO: 156654 - DNA, 23 bp, Homo sapiens
tgactcactctctgtgcttacca

SEQ ID NO: 156655 - DNA, 22 bp, Homo sapiens
tctttgttgttgttgttgaaat

SEQ ID NO: 156656 - DNA, 21 bp, Homo sapiens
tgagacagagtctcgctctgt

SEQ ID NO: 156657 - DNA, 23 bp, Homo sapiens
ttttaaggctaggttagaatagg

SEQ ID NO: 156658 - DNA, 23 bp, Homo sapiens
gtcactgcctcattaatgcctat

SEQ ID NO: 156659 - DNA, 20 bp, Homo sapiens
taagagagtttaactcctgt

SEQ ID NO: 156660 - DNA, 23 bp, Homo sapiens
cttgtgcatatcttttgatgagc

SEQ ID NO: 156661 - DNA, 23 bp, Homo sapiens
agggtctgtctctgtcacccagg

SEQ ID NO: 156662 - DNA, 20 bp, Homo sapiens
tttaatggatcgttttggct

SEQ ID NO: 156663 - DNA, 20 bp, Homo sapiens
gacagactttctcactcttt

SEQ ID NO: 156664 - DNA, 23 bp, Homo sapiens
gacaagagtctcgctctgtcacc

SEQ ID NO: 156665 - DNA, 23 bp, Homo sapiens
accaggtgctcactcagtagtag

SEQ ID NO: 156666 - DNA, 23 bp, Homo sapiens
tttctgagatggagtcttgctct

SEQ ID NO: 156667 - DNA, 23 bp, Homo sapiens
agtctctcagtgtctctgatgtc

SEQ ID NO: 156668 - DNA, 20 bp, Homo sapiens
tatggtctttttttcttttt

SEQ ID NO: 156669 - DNA, 23 bp, Homo sapiens
tcagtccctctgcctcagttcag

SEQ ID NO: 156670 - DNA, 23 bp, Homo sapiens
gagtctcgctctgtcactcagac

SEQ ID NO: 156671 - DNA, 23 bp, Homo sapiens
tttctggaaatgtttacaacaag

SEQ ID NO: 156672 - DNA, 20 bp, Homo sapiens
aaagaagagaaagtgtagag

SEQ ID NO: 156673 - DNA, 21 bp, Homo sapiens
agtgtctgtgtcacatcttgc

SEQ ID NO: 156674 - DNA, 23 bp, Homo sapiens
gcacacacatgtagttccagcta

SEQ ID NO: 156675 - DNA, 20 bp, Homo sapiens
tcttgtgtgtgataatgtgg

SEQ ID NO: 156676 - DNA, 23 bp, Homo sapiens
acagacaacagacacagcacaga

SEQ ID NO: 156677 - DNA, 23 bp, Homo sapiens
ttgggtgtgtctggctctgatgt

SEQ ID NO: 156678 - DNA, 23 bp, Homo sapiens
tttgaaggtctcactctgtcacc

SEQ ID NO: 156679 - DNA, 23 bp, Homo sapiens
agacagggtctcactctgtcatc

SEQ ID NO: 156680 - DNA, 19 bp, Homo sapiens
agtctcgctctgtctgccc

SEQ ID NO: 156681 - DNA, 22 bp, Homo sapiens
cccagagtgtgtgtgttgtggg

SEQ ID NO: 156682 - DNA, 23 bp, Homo sapiens
ccctcactctctgtctgcctggc

SEQ ID NO: 156683 - DNA, 23 bp, Homo sapiens
ctgcttcttgatggctttctttg

SEQ ID NO: 156684 - DNA, 23 bp, Homo sapiens
tgagacagcatgtcactctgttg

SEQ ID NO: 156685 - DNA, 22 bp, Homo sapiens
attgctgcataggatttcatta

SEQ ID NO: 156686 - DNA, 22 bp, Homo sapiens
tgactgatggaattagattgtt

SEQ ID NO: 156687 - DNA, 23 bp, Homo sapiens
tatttgtatatgatatgaggttg

SEQ ID NO: 156688 - DNA, 23 bp, Homo sapiens
agacagagtctcgctctgtcacc

SEQ ID NO: 156689 - DNA, 18 bp, Homo sapiens
agtgagtcatgattgcac

SEQ ID NO: 156690 - DNA, 23 bp, Homo sapiens
tctgactgtcagttttctccttc

SEQ ID NO: 156691 - DNA, 21 bp, Homo sapiens
tagacccaaaagtagaattgt

SEQ ID NO: 156692 - DNA, 23 bp, Homo sapiens
ttgaggagctatattattgagtt

SEQ ID NO: 156693 - DNA, 22 bp, Homo sapiens
tgtgctagatgcttctttacat

SEQ ID NO: 156694 - DNA, 20 bp, Homo sapiens
acatctgtgatgtaagcatt

SEQ ID NO: 156695 - DNA, 19 bp, Homo sapiens
atgatgtggcctcaggtct

SEQ ID NO: 156696 - DNA, 23 bp, Homo sapiens
tggttctgtctgggtaacatgtg

SEQ ID NO: 156697 - DNA, 23 bp, Homo sapiens
agagtctcactctgtcacccagg

SEQ ID NO: 156698 - DNA, 23 bp, Homo sapiens
cggagtctcactctgtcacccag

SEQ ID NO: 156699 - DNA, 23 bp, Homo sapiens
aggatcacttgagtctaggaggt

SEQ ID NO: 156700 - DNA, 21 bp, Homo sapiens
tgaggtaggaggatcatttga

SEQ ID NO: 156701 - DNA, 22 bp, Homo sapiens
tggtgaccgtgtcatgaaagga

SEQ ID NO: 156702 - DNA, 20 bp, Homo sapiens
acacactgtaggctcagcta

SEQ ID NO: 156703 - DNA, 18 bp, Homo sapiens
gagcaaaactctgtctca

SEQ ID NO: 156704 - DNA, 19 bp, Homo sapiens
tggatgggtctataggtga

SEQ ID NO: 156705 - DNA, 21 bp, Homo sapiens
tctatggctcagtccatgcct

SEQ ID NO: 156706 - DNA, 23 bp, Homo sapiens
gtctatggctgggagtgtggctg

SEQ ID NO: 156707 - DNA, 23 bp, Homo sapiens
tcccagagcccctggaactctgg

SEQ ID NO: 156708 - DNA, 23 bp, Homo sapiens
tcccagagcccctggaactctgg

SEQ ID NO: 156709 - DNA, 23 bp, Homo sapiens
tcccagagcccctggaactctgg

SEQ ID NO: 156710 - DNA, 23 bp, Homo sapiens
tcccagagcccctggaactctgg

SEQ ID NO: 156711 - DNA, 23 bp, Homo sapiens
tatattctttcctgtgggtttga

SEQ ID NO: 156712 - DNA, 20 bp, Homo sapiens
aattctctgggtccttgtag

SEQ ID NO: 156713 - DNA, 23 bp, Homo sapiens
tcacactgactcacaaattcccg

SEQ ID NO: 156714 - DNA, 23 bp, Homo sapiens
gctctgggtcacaggcagggtgt

SEQ ID NO: 156715 - DNA, 23 bp, Homo sapiens
tgagatctctctcactgaggcag

SEQ ID NO: 156716 - DNA, 23 bp, Homo sapiens
agttgattctgtctttctctgtc

SEQ ID NO: 156717 - DNA, 23 bp, Homo sapiens
tatctccctgaagttggaggaga

SEQ ID NO: 156718 - DNA, 22 bp, Homo sapiens
ttaaggtagtctaggctagttg

SEQ ID NO: 156719 - DNA, 18 bp, Homo sapiens
tgagctgagtgtgagcac

SEQ ID NO: 156720 - DNA, 18 bp, Homo sapiens
tgggattgagttcataat

SEQ ID NO: 156721 - DNA, 18 bp, Homo sapiens
aacactggcgatggtcca

SEQ ID NO: 156722 - DNA, 19 bp, Homo sapiens
tccaggatcaaaaatctat

SEQ ID NO: 156723 - DNA, 23 bp, Homo sapiens
tgtcagcttctagtttggtgtta

SEQ ID NO: 156724 - DNA, 18 bp, Homo sapiens
agcactctccctgtactg

SEQ ID NO: 156725 - DNA, 23 bp, Homo sapiens
tggggaacaggtagtgtttggtt

SEQ ID NO: 156726 - DNA, 23 bp, Homo sapiens
tatatgcacatgtacatgtatat

SEQ ID NO: 156727 - DNA, 23 bp, Homo sapiens
atcatgttatgcattgtgtgtat

SEQ ID NO: 156728 - DNA, 22 bp, Homo sapiens
acatgtgcacaatgtgcaggtt

SEQ ID NO: 156729 - DNA, 20 bp, Homo sapiens
tgtatgtgtgcatatgcatg

SEQ ID NO: 156730 - DNA, 22 bp, Homo sapiens
tatatgcatgtatatatgtatg

SEQ ID NO: 156731 - DNA, 23 bp, Homo sapiens
attgaggatcatcttagaattct

SEQ ID NO: 156732 - DNA, 19 bp, Homo sapiens
atttatagtttatctacag

SEQ ID NO: 156733 - DNA, 23 bp, Homo sapiens
tgtcagtttctgttattaatgga

SEQ ID NO: 156734 - DNA, 23 bp, Homo sapiens
tgcaattattgataagataggat

SEQ ID NO: 156735 - DNA, 23 bp, Homo sapiens
tgagttcattgtagattctggat

SEQ ID NO: 156736 - DNA, 23 bp, Homo sapiens
tgagttcattgtagattctggat

SEQ ID NO: 156737 - DNA, 23 bp, Homo sapiens
tatgtgtgtgtgtgtatatacat

SEQ ID NO: 156738 - DNA, 23 bp, Homo sapiens
tgagttcattgtagattctggat

SEQ ID NO: 156739 - DNA, 23 bp, Homo sapiens
tgagttcattgtagattctggat

SEQ ID NO: 156740 - DNA, 21 bp, Homo sapiens
tgagagcaggacagaatttgg

SEQ ID NO: 156741 - DNA, 23 bp, Homo sapiens
tgtcagaagtgagagtggtctta

SEQ ID NO: 156742 - DNA, 22 bp, Homo sapiens
atgtgtgcatatatatgtgtat

SEQ ID NO: 156743 - DNA, 23 bp, Homo sapiens
atatatgtacatatacatacctg

SEQ ID NO: 156744 - DNA, 23 bp, Homo sapiens
tgactcggacactctgtctcctc

SEQ ID NO: 156745 - DNA, 21 bp, Homo sapiens
cacaggctgtgtgtgttgtca

SEQ ID NO: 156746 - DNA, 23 bp, Homo sapiens
tgggtgacagtccacagtgccca

SEQ ID NO: 156747 - DNA, 20 bp, Homo sapiens
tataggtatgtatacatgta

SEQ ID NO: 156748 - DNA, 18 bp, Homo sapiens
acacgcacacacaaactt

SEQ ID NO: 156749 - DNA, 23 bp, Homo sapiens
tttgtgtgtgcctatgttgttgc

SEQ ID NO: 156750 - DNA, 22 bp, Homo sapiens
tgtagagttttgttgcatttat

SEQ ID NO: 156751 - DNA, 23 bp, Homo sapiens
tgcctcattcatagcaggcactt

SEQ ID NO: 156752 - DNA, 23 bp, Homo sapiens
taaatgaatgagtgaataaagag

SEQ ID NO: 156753 - DNA, 23 bp, Homo sapiens
agggtctcactctgtcacctagg

SEQ ID NO: 156754 - DNA, 23 bp, Homo sapiens
tatatgtatgtatacatgtgtgt

SEQ ID NO: 156755 - DNA, 23 bp, Homo sapiens
ccatctctgagtctgtgtcactg

SEQ ID NO: 156756 - DNA, 22 bp, Homo sapiens
tatacacaaatacaaattttga

SEQ ID NO: 156757 - DNA, 23 bp, Homo sapiens
ttttgtatatatgtatatgtgtg

SEQ ID NO: 156758 - DNA, 23 bp, Homo sapiens
gtctctctctgtcacccaggctg

SEQ ID NO: 156759 - DNA, 22 bp, Homo sapiens
gggtctctcactctctcgccca

SEQ ID NO: 156760 - DNA, 23 bp, Homo sapiens
cagagaacacagccagcagaaga

SEQ ID NO: 156761 - DNA, 23 bp, Homo sapiens
gggtgacagagtgagacctcatc

SEQ ID NO: 156762 - DNA, 23 bp, Homo sapiens
gagatgaagcctcactctgtcac

SEQ ID NO: 156763 - DNA, 18 bp, Homo sapiens
acagtaagcagtgagggg

SEQ ID NO: 156764 - DNA, 23 bp, Homo sapiens
tgagatggagtttcactcttgtt

SEQ ID NO: 156765 - DNA, 23 bp, Homo sapiens
gttagctacttggttgtttagat

SEQ ID NO: 156766 - DNA, 23 bp, Homo sapiens
cagagaacacagccagcagaaga

SEQ ID NO: 156767 - DNA, 20 bp, Homo sapiens
ggatatatttcatgtgtata

SEQ ID NO: 156768 - DNA, 23 bp, Homo sapiens
atatgtgtatatgtatatgtctg

SEQ ID NO: 156769 - DNA, 20 bp, Homo sapiens
tatatgcatgtgtatactta

SEQ ID NO: 156770 - DNA, 23 bp, Homo sapiens
actgagtctcgctctgtcaccca

SEQ ID NO: 156771 - DNA, 23 bp, Homo sapiens
tgagttcattgtagattctggat

SEQ ID NO: 156772 - DNA, 23 bp, Homo sapiens
tgagttcattgtagattctggat

SEQ ID NO: 156773 - DNA, 23 bp, Homo sapiens
tgctggctgtcgtgagtgagcag

SEQ ID NO: 156774 - DNA, 23 bp, Homo sapiens
tgcaggtcagcctctctgactgc

SEQ ID NO: 156775 - DNA, 21 bp, Homo sapiens
tgaaatgtggctagtgtgacc

SEQ ID NO: 156776 - DNA, 23 bp, Homo sapiens
agatggagtctcactctgtcacc

SEQ ID NO: 156777 - DNA, 19 bp, Homo sapiens
agtagtattcaattgagtg

SEQ ID NO: 156778 - DNA, 18 bp, Homo sapiens
ttttctactttttggcta

SEQ ID NO: 156779 - DNA, 23 bp, Homo sapiens
cagagtctcactctgtcactcag

SEQ ID NO: 156780 - DNA, 19 bp, Homo sapiens
tgtgtggaaagaagtagac

SEQ ID NO: 156781 - DNA, 23 bp, Homo sapiens
aaataacagctatagaagtcagt

SEQ ID NO: 156782 - DNA, 20 bp, Homo sapiens
agtgctggtttttattggca

SEQ ID NO: 156783 - DNA, 23 bp, Homo sapiens
cagagaacacagccagcagaaga

SEQ ID NO: 156784 - DNA, 22 bp, Homo sapiens
ttttttctatttgtatacgtat

SEQ ID NO: 156785 - DNA, 23 bp, Homo sapiens
ttatatgtatatctatatcgaga

SEQ ID NO: 156786 - DNA, 23 bp, Homo sapiens
tccgtctgtctgtctgtatcctc

SEQ ID NO: 156787 - DNA, 23 bp, Homo sapiens
cagagaacacagccagcagaaga

SEQ ID NO: 156788 - DNA, 23 bp, Homo sapiens
tccgtctgtctgtctgtatcctc

SEQ ID NO: 156789 - DNA, 23 bp, Homo sapiens
agggagagagtttgttaattcga

SEQ ID NO: 156790 - DNA, 18 bp, Homo sapiens
agtggtgtgaattcaggt

SEQ ID NO: 156791 - DNA, 23 bp, Homo sapiens
gctacgtgctgtgtaagtatctt

SEQ ID NO: 156792 - DNA, 20 bp, Homo sapiens
acatctatattttaggtgat

SEQ ID NO: 156793 - DNA, 23 bp, Homo sapiens
gtacatgtgcacattgtgcaggt

SEQ ID NO: 156794 - DNA, 18 bp, Homo sapiens
actgtactttgctccttt

SEQ ID NO: 156795 - DNA, 23 bp, Homo sapiens
tgggaggagtgagagagctctct

SEQ ID NO: 156796 - DNA, 19 bp, Homo sapiens
tagtagagtgatttctgtt

SEQ ID NO: 156797 - DNA, 23 bp, Homo sapiens
tgtttggttttctatctctttgt

SEQ ID NO: 156798 - DNA, 20 bp, Homo sapiens
cagaagaggagccttctagg

SEQ ID NO: 156799 - DNA, 18 bp, Homo sapiens
tggttctagacacagcag

SEQ ID NO: 156800 - DNA, 23 bp, Homo sapiens
aactcaggtcttcagagggcctg

SEQ ID NO: 156801 - DNA, 23 bp, Homo sapiens
tcagaagtgaaattgctggcttt

SEQ ID NO: 156802 - DNA, 20 bp, Homo sapiens
acagtggatgcacagacaga

SEQ ID NO: 156803 - DNA, 20 bp, Homo sapiens
cacagtgagggctgttctac

SEQ ID NO: 156804 - DNA, 23 bp, Homo sapiens
gttcctgaaggaggccacctcca

SEQ ID NO: 156805 - DNA, 23 bp, Homo sapiens
agacactgtctcgctctgtcgcc

SEQ ID NO: 156806 - DNA, 22 bp, Homo sapiens
tcagaggagttaagtgagtggc

SEQ ID NO: 156807 - DNA, 23 bp, Homo sapiens
atcacttgagcctcggagtttga

SEQ ID NO: 156808 - DNA, 20 bp, Homo sapiens
ggcagtctctcagtgcgtgt

SEQ ID NO: 156809 - DNA, 23 bp, Homo sapiens
agagagagactagaaaatgggaa

SEQ ID NO: 156810 - DNA, 23 bp, Homo sapiens
catcacagtgtgtcagtctgtgc

SEQ ID NO: 156811 - DNA, 23 bp, Homo sapiens
taagtctgtggcacatttctctg

SEQ ID NO: 156812 - DNA, 23 bp, Homo sapiens
gtatacagggagagaaaataagg

SEQ ID NO: 156813 - DNA, 23 bp, Homo sapiens
gacatgtattctctctctgtctt

SEQ ID NO: 156814 - DNA, 23 bp, Homo sapiens
tgagttcattgtagattctggat

SEQ ID NO: 156815 - DNA, 23 bp, Homo sapiens
tgagttcattgtagattctggat

SEQ ID NO: 156816 - DNA, 19 bp, Homo sapiens
atatatagttgagacagag

SEQ ID NO: 156817 - DNA, 23 bp, Homo sapiens
caaaatagtggttctagtagaat

SEQ ID NO: 156818 - DNA, 22 bp, Homo sapiens
tatctaacactgtctgttattg

SEQ ID NO: 156819 - DNA, 22 bp, Homo sapiens
actgcaccttgtgctgctgctc

SEQ ID NO: 156820 - DNA, 21 bp, Homo sapiens
tgtgagccactgcgcctggct

SEQ ID NO: 156821 - DNA, 22 bp, Homo sapiens
tctttatggtcaggcacagtgg

SEQ ID NO: 156822 - DNA, 23 bp, Homo sapiens
tgagtctcgctctgtcgctggct

SEQ ID NO: 156823 - DNA, 23 bp, Homo sapiens
gagtcagagtctcgctctgtcat

SEQ ID NO: 156824 - DNA, 21 bp, Homo sapiens
gtccaaggctccctctatctg

SEQ ID NO: 156825 - DNA, 23 bp, Homo sapiens
gcagctcacaggcagttttgtag

SEQ ID NO: 156826 - DNA, 23 bp, Homo sapiens
gacggagtcttgctctgttgctc

SEQ ID NO: 156827 - DNA, 23 bp, Homo sapiens
cggagtctcactctgtcacccag

SEQ ID NO: 156828 - DNA, 23 bp, Homo sapiens
gagtctcactctgtcacccaggc

SEQ ID NO: 156829 - DNA, 23 bp, Homo sapiens
tctttggagacagtgtcactctg

SEQ ID NO: 156830 - DNA, 20 bp, Homo sapiens
tatctgtgtggctgtgtgtc

SEQ ID NO: 156831 - DNA, 23 bp, Homo sapiens
ctcacagtagaaacactgctcct

SEQ ID NO: 156832 - DNA, 22 bp, Homo sapiens
agtcctctagacacacagtcac

SEQ ID NO: 156833 - DNA, 23 bp, Homo sapiens
tgagttcattgtagattctggat

SEQ ID NO: 156834 - DNA, 23 bp, Homo sapiens
tgagttcattgtagattctggat

SEQ ID NO: 156835 - DNA, 23 bp, Homo sapiens
atcacagagcacagtgagctgga

SEQ ID NO: 156836 - DNA, 23 bp, Homo sapiens
gagactgagacagcaagtccagt

SEQ ID NO: 156837 - DNA, 23 bp, Homo sapiens
attgttctctggggaaactggtt

SEQ ID NO: 156838 - DNA, 23 bp, Homo sapiens
tgaggcagagtctggctctgttg

SEQ ID NO: 156839 - DNA, 19 bp, Homo sapiens
ttcagtggcttcaatctag

SEQ ID NO: 156840 - DNA, 20 bp, Homo sapiens
gttcatctctaagtctctgt

SEQ ID NO: 156841 - DNA, 23 bp, Homo sapiens
gaaccctcactcactctgtcgcc

SEQ ID NO: 156842 - DNA, 23 bp, Homo sapiens
tctgtgaggctctgttcactgtg

SEQ ID NO: 156843 - DNA, 23 bp, Homo sapiens
cctcagtctgtgaggctgtggca

SEQ ID NO: 156844 - DNA, 23 bp, Homo sapiens
tcactgacagactctctggagaa

SEQ ID NO: 156845 - DNA, 23 bp, Homo sapiens
ataaagacttctgcctttgtctt

SEQ ID NO: 156846 - DNA, 22 bp, Homo sapiens
gtgtctatatgtatatatgtgt

SEQ ID NO: 156847 - DNA, 22 bp, Homo sapiens
tgtgtatatatgtatatatgtg

SEQ ID NO: 156848 - DNA, 22 bp, Homo sapiens
atctatgcatgtatgtgtatat

SEQ ID NO: 156849 - DNA, 22 bp, Homo sapiens
atgtgtatatgtgtacgtgtgt

SEQ ID NO: 156850 - DNA, 23 bp, Homo sapiens
tatgtgtatatatgtatatgtgt

SEQ ID NO: 156851 - DNA, 21 bp, Homo sapiens
tgtgtatatatgtatatatgt

SEQ ID NO: 156852 - DNA, 23 bp, Homo sapiens
cggagtctcgctctgtctcccag

SEQ ID NO: 156853 - DNA, 23 bp, Homo sapiens
ggagtctcactcactctgttgcc

SEQ ID NO: 156854 - DNA, 23 bp, Homo sapiens
agctgagactaaagacacaagcc

SEQ ID NO: 156855 - DNA, 21 bp, Homo sapiens
attctgtgagctacctatgag

SEQ ID NO: 156856 - DNA, 21 bp, Homo sapiens
acacatatatgtatatatgta

SEQ ID NO: 156857 - DNA, 23 bp, Homo sapiens
aaactatgcttttgtttgccaga

SEQ ID NO: 156858 - DNA, 22 bp, Homo sapiens
tttctgttttgaattgctgttg

SEQ ID NO: 156859 - DNA, 22 bp, Homo sapiens
tcattgtggttttgttttgaga

SEQ ID NO: 156860 - DNA, 23 bp, Homo sapiens
ttctgtgaagaaagtcaatggta

SEQ ID NO: 156861 - DNA, 23 bp, Homo sapiens
gtgacagagactgactgtaattt

SEQ ID NO: 156862 - DNA, 23 bp, Homo sapiens
ttttgagatggagtctcactctg

SEQ ID NO: 156863 - DNA, 23 bp, Homo sapiens
tgactgagtctcgctctgtcacc

SEQ ID NO: 156864 - DNA, 18 bp, Homo sapiens
tggcatgatctcggctca

SEQ ID NO: 156865 - DNA, 23 bp, Homo sapiens
acaggtgaaatggtgtctgatca

SEQ ID NO: 156866 - DNA, 21 bp, Homo sapiens
gagtgcatctcaagctgtgtg

SEQ ID NO: 156867 - DNA, 23 bp, Homo sapiens
aggcttcaaggaactgtgattgt

SEQ ID NO: 156868 - DNA, 23 bp, Homo sapiens
tgcagtcaggcagttgttttgat

SEQ ID NO: 156869 - DNA, 18 bp, Homo sapiens
ttggagtacagtggctct

SEQ ID NO: 156870 - DNA, 18 bp, Homo sapiens
gtggaaggatcacttgag

SEQ ID NO: 156871 - DNA, 23 bp, Homo sapiens
tttgagacggagtctggctctgt

SEQ ID NO: 156872 - DNA, 22 bp, Homo sapiens
tgacacagcctctcaaagtgct

SEQ ID NO: 156873 - DNA, 22 bp, Homo sapiens
gatgactatagttaataatgta

SEQ ID NO: 156874 - DNA, 23 bp, Homo sapiens
cacagcagagagataggacagag

SEQ ID NO: 156875 - DNA, 23 bp, Homo sapiens
tggagacagggtctcactctgtt

SEQ ID NO: 156876 - DNA, 20 bp, Homo sapiens
actttttgttttgagacagg

SEQ ID NO: 156877 - DNA, 20 bp, Homo sapiens
atttctatatgtaactatgt

SEQ ID NO: 156878 - DNA, 19 bp, Homo sapiens
cagtgtagagactgtgccc

SEQ ID NO: 156879 - DNA, 23 bp, Homo sapiens
ttgtctgtctctgtgtctgtcgg

SEQ ID NO: 156880 - DNA, 23 bp, Homo sapiens
tgaggctctgagtctgtcccttc

SEQ ID NO: 156881 - DNA, 23 bp, Homo sapiens
ccctgtctcagtcagacggtccc

SEQ ID NO: 156882 - DNA, 23 bp, Homo sapiens
tctgtagaaagtgtgcactgcct

SEQ ID NO: 156883 - DNA, 23 bp, Homo sapiens
gctctctgtctctgtctcactcc

SEQ ID NO: 156884 - DNA, 23 bp, Homo sapiens
tgagccactgtgcctggctgctt

SEQ ID NO: 156885 - DNA, 20 bp, Homo sapiens
cttagggacatgtctgtgct

SEQ ID NO: 156886 - DNA, 18 bp, Homo sapiens
tgacctctgtctgtgtca

SEQ ID NO: 156887 - DNA, 23 bp, Homo sapiens
tgttaagacacctaaggctggtc

SEQ ID NO: 156888 - DNA, 21 bp, Homo sapiens
atgaatgaatgaatgaataga

SEQ ID NO: 156889 - DNA, 23 bp, Homo sapiens
tttgactccaaaagtaatgctga

SEQ ID NO: 156890 - DNA, 20 bp, Homo sapiens
aactgggggctaaagtggga

SEQ ID NO: 156891 - DNA, 22 bp, Homo sapiens
actattgatcactttctatgtt

SEQ ID NO: 156892 - DNA, 23 bp, Homo sapiens
ctcaatggctgtctggctggctg

SEQ ID NO: 156893 - DNA, 22 bp, Homo sapiens
agtcagcctaggtctaagcttg

SEQ ID NO: 156894 - DNA, 20 bp, Homo sapiens
ttgcagtgaactgagatcat

SEQ ID NO: 156895 - DNA, 23 bp, Homo sapiens
tgagaagtagtttgctttgtcac

SEQ ID NO: 156896 - DNA, 19 bp, Homo sapiens
tgtgaagtcagtgtgctga

SEQ ID NO: 156897 - DNA, 23 bp, Homo sapiens
cgctgtcagagtctctgtcacag

SEQ ID NO: 156898 - DNA, 23 bp, Homo sapiens
tcacagcctctgtcacagcctct

SEQ ID NO: 156899 - DNA, 23 bp, Homo sapiens
gcctctgtcacagcctctgtcac

SEQ ID NO: 156900 - DNA, 23 bp, Homo sapiens
gtcacagcctctgtcacagcctc

SEQ ID NO: 156901 - DNA, 23 bp, Homo sapiens
tcacagcctctgtcgcagcccct

SEQ ID NO: 156902 - DNA, 23 bp, Homo sapiens
gcctctgtcacagcctctgtcac

SEQ ID NO: 156903 - DNA, 23 bp, Homo sapiens
tgtcacagcctctgtcacagcct

SEQ ID NO: 156904 - DNA, 22 bp, Homo sapiens
tcacagcctctgtcacagcctc

SEQ ID NO: 156905 - DNA, 22 bp, Homo sapiens
cacagcctctgtcacagcctct

SEQ ID NO: 156906 - DNA, 23 bp, Homo sapiens
tcacagcctctgtcacagtctct

SEQ ID NO: 156907 - DNA, 20 bp, Homo sapiens
tactcttgtgattttctaca

SEQ ID NO: 156908 - DNA, 18 bp, Homo sapiens
acagttagtgctcctggt

SEQ ID NO: 156909 - DNA, 22 bp, Homo sapiens
ttctcacattctaaaacagtgc

SEQ ID NO: 156910 - DNA, 20 bp, Homo sapiens
tgtgtatatatatatgtgta

SEQ ID NO: 156911 - DNA, 19 bp, Homo sapiens
tgagtacacacagtgctga

SEQ ID NO: 156912 - DNA, 21 bp, Homo sapiens
tctcggacagttgctgtgtgt

SEQ ID NO: 156913 - DNA, 23 bp, Homo sapiens
tgtggtagttggttggataactc

SEQ ID NO: 156914 - DNA, 23 bp, Homo sapiens
attttgaggttgtagtttgactt

SEQ ID NO: 156915 - DNA, 23 bp, Homo sapiens
agaggttgcagtgagccaagatc

SEQ ID NO: 156916 - DNA, 22 bp, Homo sapiens
tgcctggccatggtgactctga

SEQ ID NO: 156917 - DNA, 23 bp, Homo sapiens
ctcagtctgtcactgtgtctcac

SEQ ID NO: 156918 - DNA, 23 bp, Homo sapiens
atgtgtggtgtatatatgtgtat

SEQ ID NO: 156919 - DNA, 21 bp, Homo sapiens
tgtatatatgtatgtgtgtat

SEQ ID NO: 156920 - DNA, 23 bp, Homo sapiens
agtacttagctgtgagaattgag

SEQ ID NO: 156921 - DNA, 18 bp, Homo sapiens
ttagtttaagggcaggaa

SEQ ID NO: 156922 - DNA, 23 bp, Homo sapiens
attgtacttcatgatgactgtgg

SEQ ID NO: 156923 - DNA, 19 bp, Homo sapiens
atagggtttacattcctat

SEQ ID NO: 156924 - DNA, 22 bp, Homo sapiens
aaagttttttctttttgaggtc

SEQ ID NO: 156925 - DNA, 23 bp, Homo sapiens
atatgtatatatgtatatatgtg

SEQ ID NO: 156926 - DNA, 20 bp, Homo sapiens
atgtgtatatatacacatgt

SEQ ID NO: 156927 - DNA, 22 bp, Homo sapiens
tatatgtgtatatatacacatg

SEQ ID NO: 156928 - DNA, 23 bp, Homo sapiens
agtcagtgtctcgctctgtcacc

SEQ ID NO: 156929 - DNA, 23 bp, Homo sapiens
agagtctcactctgtcacccagg

SEQ ID NO: 156930 - DNA, 19 bp, Homo sapiens
taatttgaggtttacttta

SEQ ID NO: 156931 - DNA, 22 bp, Homo sapiens
tctcactctgtcacccaggctg

SEQ ID NO: 156932 - DNA, 23 bp, Homo sapiens
actggcagatgtaagctatttga

SEQ ID NO: 156933 - DNA, 23 bp, Homo sapiens
gactgaatggttttgttgctgtt

SEQ ID NO: 156934 - DNA, 23 bp, Homo sapiens
tctctgttacagcttctcctggg

SEQ ID NO: 156935 - DNA, 18 bp, Homo sapiens
tctgcagaactagctgct

SEQ ID NO: 156936 - DNA, 23 bp, Homo sapiens
ttacacagccagctttgctatgg

SEQ ID NO: 156937 - DNA, 21 bp, Homo sapiens
tgagaacatttagaatctact

SEQ ID NO: 156938 - DNA, 20 bp, Homo sapiens
tagcaactttgaaatataca

SEQ ID NO: 156939 - DNA, 23 bp, Homo sapiens
tgagttcattgtagattctggat

SEQ ID NO: 156940 - DNA, 23 bp, Homo sapiens
tgagttcattgtagattctggat

SEQ ID NO: 156941 - DNA, 23 bp, Homo sapiens
atagagatgacagagaggagtac

SEQ ID NO: 156942 - DNA, 23 bp, Homo sapiens
ttttttggttccatatgaaattt

SEQ ID NO: 156943 - DNA, 21 bp, Homo sapiens
ttctatgaagaaagtcagtgg

SEQ ID NO: 156944 - DNA, 23 bp, Homo sapiens
tgagttcattgtagattctggat

SEQ ID NO: 156945 - DNA, 23 bp, Homo sapiens
tgagttcattgtagattctggat

SEQ ID NO: 156946 - DNA, 21 bp, Homo sapiens
tgtggaatgtaaaaagggaga

SEQ ID NO: 156947 - DNA, 23 bp, Homo sapiens
cagttaatactttagagtctgtc

SEQ ID NO: 156948 - DNA, 19 bp, Homo sapiens
taagtgataggggtttcca

SEQ ID NO: 156949 - DNA, 21 bp, Homo sapiens
gagtacctggcttgaacttgt

SEQ ID NO: 156950 - DNA, 20 bp, Homo sapiens
agtgacttgagagtgaggac

SEQ ID NO: 156951 - DNA, 22 bp, Homo sapiens
tagagacagtgtctggctgtgt

SEQ ID NO: 156952 - DNA, 22 bp, Homo sapiens
attctgtcagccagactggagt

SEQ ID NO: 156953 - DNA, 23 bp, Homo sapiens
tcatagagacgaggtctcaccat

SEQ ID NO: 156954 - DNA, 23 bp, Homo sapiens
tgtctgtctgctccaactttgga

SEQ ID NO: 156955 - DNA, 23 bp, Homo sapiens
agacagtctggctgtgtccctgc

SEQ ID NO: 156956 - DNA, 23 bp, Homo sapiens
atggagtctcactctgtcaccca

SEQ ID NO: 156957 - DNA, 23 bp, Homo sapiens
tggagtctcactctgtcacccag

SEQ ID NO: 156958 - DNA, 23 bp, Homo sapiens
ttgcagtttgtaaatgttggcaa

SEQ ID NO: 156959 - DNA, 19 bp, Homo sapiens
gctagtggatcctgtgcag

SEQ ID NO: 156960 - DNA, 23 bp, Homo sapiens
gggtctcactctgtcacccaggc

SEQ ID NO: 156961 - DNA, 21 bp, Homo sapiens
tctcacactctcaataaaccc

SEQ ID NO: 156962 - DNA, 22 bp, Homo sapiens
ttttttctgggggtggaagtgt

SEQ ID NO: 156963 - DNA, 22 bp, Homo sapiens
gacattgtggttaagatcagca

SEQ ID NO: 156964 - DNA, 23 bp, Homo sapiens
gtctctgtgtgtctgtgtcctct

SEQ ID NO: 156965 - DNA, 23 bp, Homo sapiens
agaacagcagtcactggagtcag

SEQ ID NO: 156966 - DNA, 23 bp, Homo sapiens
tgagacggagtctcactctgtca

SEQ ID NO: 156967 - DNA, 23 bp, Homo sapiens
actcagtgagtgtgtccttggca

SEQ ID NO: 156968 - DNA, 23 bp, Homo sapiens
tgtctccatcctgtttctcaagc

SEQ ID NO: 156969 - DNA, 23 bp, Homo sapiens
tgcctgcctgtgcctttctgtgc

SEQ ID NO: 156970 - DNA, 23 bp, Homo sapiens
ttttgagacagagtctcactctg

SEQ ID NO: 156971 - DNA, 22 bp, Homo sapiens
tcttagaaaggagtgaaaaatg

SEQ ID NO: 156972 - DNA, 23 bp, Homo sapiens
ggcaggctgagtccctgactggc

SEQ ID NO: 156973 - DNA, 23 bp, Homo sapiens
ctccgagagatgtcagtgagcag

SEQ ID NO: 156974 - DNA, 23 bp, Homo sapiens
gctctgtgtacatgcagcaggta

SEQ ID NO: 156975 - DNA, 23 bp, Homo sapiens
tttgagacagtgtctcactctgt

SEQ ID NO: 156976 - DNA, 23 bp, Homo sapiens
atggaggatacacactattgaga

SEQ ID NO: 156977 - DNA, 23 bp, Homo sapiens
tatacgtgtgtgtgtgttgtgta

SEQ ID NO: 156978 - DNA, 21 bp, Homo sapiens
ttgcttcttctgggtgccagg

SEQ ID NO: 156979 - DNA, 23 bp, Homo sapiens
tgtcagtcagtgtctggttagga

SEQ ID NO: 156980 - DNA, 22 bp, Homo sapiens
tgagaagttcgtgtttgcgtcc

SEQ ID NO: 156981 - DNA, 23 bp, Homo sapiens
tctctgtgggtcaggaacagctt

SEQ ID NO: 156982 - DNA, 23 bp, Homo sapiens
acttagtcctgtttgtccacaca

SEQ ID NO: 156983 - DNA, 23 bp, Homo sapiens
atttgagagtgagtttatcaagt

SEQ ID NO: 156984 - DNA, 23 bp, Homo sapiens
gggtctcactctgtcacccaggc

SEQ ID NO: 156985 - DNA, 18 bp, Homo sapiens
gacacagtctcgctctgt

SEQ ID NO: 156986 - DNA, 22 bp, Homo sapiens
tgtataagcatatgtgtgtgta

SEQ ID NO: 156987 - DNA, 23 bp, Homo sapiens
cggagtctcactctgtcacccag

SEQ ID NO: 156988 - DNA, 22 bp, Homo sapiens
agactggacctttctatgttgc

SEQ ID NO: 156989 - DNA, 20 bp, Homo sapiens
tgagatggagtttcactctg

SEQ ID NO: 156990 - DNA, 23 bp, Homo sapiens
gagtgcctctgtgtgtgtgtatt

SEQ ID NO: 156991 - DNA, 23 bp, Homo sapiens
tacagacacacattggtgtaatt

SEQ ID NO: 156992 - DNA, 22 bp, Homo sapiens
agtgtgactggattatctttgt

SEQ ID NO: 156993 - DNA, 23 bp, Homo sapiens
cacgtctctctcagacagtgcct

SEQ ID NO: 156994 - DNA, 20 bp, Homo sapiens
acacacacacacacatatat

SEQ ID NO: 156995 - DNA, 21 bp, Homo sapiens
ttagatcatctggaatgatgg

SEQ ID NO: 156996 - DNA, 21 bp, Homo sapiens
ctctgactttcttttatcttt

SEQ ID NO: 156997 - DNA, 23 bp, Homo sapiens
aaaggactgtggctgctggctct

SEQ ID NO: 156998 - DNA, 23 bp, Homo sapiens
ctcctgaaaaacctgcagtgact

SEQ ID NO: 156999 - DNA, 20 bp, Homo sapiens
tctcagatctctgactgtga

SEQ ID NO: 157000 - DNA, 23 bp, Homo sapiens
cacctcgctctctctgtccctgt

SEQ ID NO: 157001 - DNA, 23 bp, Homo sapiens
tctagttctgactgcctgtgacc

SEQ ID NO: 157002 - DNA, 23 bp, Homo sapiens
ccactgggtacacggactgctct

SEQ ID NO: 157003 - DNA, 22 bp, Homo sapiens
ttttccaagcatataactctgt

SEQ ID NO: 157004 - DNA, 23 bp, Homo sapiens
agcatgtcagtgacaattgtgtg

SEQ ID NO: 157005 - DNA, 23 bp, Homo sapiens
tcattatacatcatcatgttggt

SEQ ID NO: 157006 - DNA, 18 bp, Homo sapiens
ttagacagaattggtaat

SEQ ID NO: 157007 - DNA, 23 bp, Homo sapiens
tcctgactctcattctctctctc

SEQ ID NO: 157008 - DNA, 21 bp, Homo sapiens
aattgattgttaagtgcagtg

SEQ ID NO: 157009 - DNA, 23 bp, Homo sapiens
tgagtctcactctgtcacccagg

SEQ ID NO: 157010 - DNA, 19 bp, Homo sapiens
gagggtagaaaggagcaaa

SEQ ID NO: 157011 - DNA, 20 bp, Homo sapiens
cactcactctcagggtctgc

SEQ ID NO: 157012 - DNA, 18 bp, Homo sapiens
gtcagcatctgagagtgc

SEQ ID NO: 157013 - DNA, 23 bp, Homo sapiens
cagagtctggctgtcacccaggc

SEQ ID NO: 157014 - DNA, 21 bp, Homo sapiens
ttaggctgggtgtgctggctc

SEQ ID NO: 157015 - DNA, 18 bp, Homo sapiens
gcctgtaattctagcatt

SEQ ID NO: 157016 - DNA, 23 bp, Homo sapiens
tctctggctgggtccctgattcg

SEQ ID NO: 157017 - DNA, 23 bp, Homo sapiens
cagtctctcagtcacagcctccc

SEQ ID NO: 157018 - DNA, 21 bp, Homo sapiens
tatacccacagtttggactca

SEQ ID NO: 157019 - DNA, 21 bp, Homo sapiens
aatacaacttttccttgccag

SEQ ID NO: 157020 - DNA, 23 bp, Homo sapiens
acagtggtaagagtgtatactgt

SEQ ID NO: 157021 - DNA, 22 bp, Homo sapiens
tttaagggagtctatgtttttt

SEQ ID NO: 157022 - DNA, 19 bp, Homo sapiens
tgtagctgccagcatcttg

SEQ ID NO: 157023 - DNA, 23 bp, Homo sapiens
gggtctcactctgtcacccaggc

SEQ ID NO: 157024 - DNA, 23 bp, Homo sapiens
gacagggtctcactctgtcatcc

SEQ ID NO: 157025 - DNA, 20 bp, Homo sapiens
ttgcaaacactttaaagtga

SEQ ID NO: 157026 - DNA, 21 bp, Homo sapiens
ccttcttttagtgctggaggt

SEQ ID NO: 157027 - DNA, 21 bp, Homo sapiens
tgtgtatatatatgtatgtat

SEQ ID NO: 157028 - DNA, 23 bp, Homo sapiens
tctgactctgactctgagccagt

SEQ ID NO: 157029 - DNA, 23 bp, Homo sapiens
gacaagatctgactctgttgcct

SEQ ID NO: 157030 - DNA, 23 bp, Homo sapiens
cactgtgcataatgacctgggtg

SEQ ID NO: 157031 - DNA, 23 bp, Homo sapiens
tgtctctatcactgtgttctaga

SEQ ID NO: 157032 - DNA, 23 bp, Homo sapiens
acagagtctcactctgtcgccca

SEQ ID NO: 157033 - DNA, 23 bp, Homo sapiens
tcaatggatcatgtttctggtgt

SEQ ID NO: 157034 - DNA, 19 bp, Homo sapiens
gtttattacattgtctcct

SEQ ID NO: 157035 - DNA, 23 bp, Homo sapiens
tcactcagtgtcctcatctattc

SEQ ID NO: 157036 - DNA, 20 bp, Homo sapiens
ctgtggctcacagaggggca

SEQ ID NO: 157037 - DNA, 22 bp, Homo sapiens
tagggtctcactctgtcaccta

SEQ ID NO: 157038 - DNA, 22 bp, Homo sapiens
aggagctgagaccatttttttt

SEQ ID NO: 157039 - DNA, 23 bp, Homo sapiens
tgagacagtctcgctctgttgcc

SEQ ID NO: 157040 - DNA, 22 bp, Homo sapiens
tctcagagtatatacacacaga

SEQ ID NO: 157041 - DNA, 19 bp, Homo sapiens
tatgtatgtatttgtgtgt

SEQ ID NO: 157042 - DNA, 18 bp, Homo sapiens
tcacatttgtagtcccag

SEQ ID NO: 157043 - DNA, 21 bp, Homo sapiens
ttttgagacggaatcttgctc

SEQ ID NO: 157044 - DNA, 21 bp, Homo sapiens
tcaagcatatgagatgagaat

SEQ ID NO: 157045 - DNA, 20 bp, Homo sapiens
tgaggtaggtggatcacttg

SEQ ID NO: 157046 - DNA, 23 bp, Homo sapiens
tatctctgtcatttttttcagga

SEQ ID NO: 157047 - DNA, 23 bp, Homo sapiens
gacagagtctcgctctgtcaccc

SEQ ID NO: 157048 - DNA, 18 bp, Homo sapiens
ataaggaagatagaggaa

SEQ ID NO: 157049 - DNA, 23 bp, Homo sapiens
cttttctgacccacacatatatc

SEQ ID NO: 157050 - DNA, 23 bp, Homo sapiens
gacagagaccctgtctctaagat

SEQ ID NO: 157051 - DNA, 22 bp, Homo sapiens
ttttgagacagggtctcattct

SEQ ID NO: 157052 - DNA, 23 bp, Homo sapiens
ggagtctcactctgtcactcagg

SEQ ID NO: 157053 - DNA, 23 bp, Homo sapiens
ctttagagtcagatggttctgag

SEQ ID NO: 157054 - DNA, 23 bp, Homo sapiens
gggtctcactctgtcacccaggc

SEQ ID NO: 157055 - DNA, 23 bp, Homo sapiens
ttatctccttctgctgctatttc

SEQ ID NO: 157056 - DNA, 23 bp, Homo sapiens
ctcagagcctcagtgtgtgcctg

SEQ ID NO: 157057 - DNA, 23 bp, Homo sapiens
gtgggtacatagtaggtgtatat

SEQ ID NO: 157058 - DNA, 23 bp, Homo sapiens
atatctcagaaggttttctgtga

SEQ ID NO: 157059 - DNA, 23 bp, Homo sapiens
atttgagaggctctctgaaagcc

SEQ ID NO: 157060 - DNA, 18 bp, Homo sapiens
tccatgatgattccaggt

SEQ ID NO: 157061 - DNA, 22 bp, Homo sapiens
tctgtgcctctgtgtttctcat

SEQ ID NO: 157062 - DNA, 19 bp, Homo sapiens
tttgctagtttgttatttt

SEQ ID NO: 157063 - DNA, 21 bp, Homo sapiens
gtctagaagcagtctctcact

SEQ ID NO: 157064 - DNA, 23 bp, Homo sapiens
tctctgtgtgactgtcatgaagg

SEQ ID NO: 157065 - DNA, 19 bp, Homo sapiens
tgtctgtgtgactatcagg

SEQ ID NO: 157066 - DNA, 23 bp, Homo sapiens
agtgtctgagcatgtccaactgg

SEQ ID NO: 157067 - DNA, 23 bp, Homo sapiens
atggaagaaggtgaggttgagta

SEQ ID NO: 157068 - DNA, 22 bp, Homo sapiens
tgtttgtagagttgctacagag

SEQ ID NO: 157069 - DNA, 23 bp, Homo sapiens
tctgacagtcactaacttgtggg

SEQ ID NO: 157070 - DNA, 23 bp, Homo sapiens
acagtagacagtgtgtgtctgta

SEQ ID NO: 157071 - DNA, 23 bp, Homo sapiens
gagcagtttagtgaggaatttta

SEQ ID NO: 157072 - DNA, 22 bp, Homo sapiens
ttcaattcactgtctagctttt

SEQ ID NO: 157073 - DNA, 23 bp, Homo sapiens
aaacaaggtgaaatacttctgtt

SEQ ID NO: 157074 - DNA, 20 bp, Homo sapiens
ttatagtcctaactctaact

SEQ ID NO: 157075 - DNA, 21 bp, Homo sapiens
taagctagataataattttga

SEQ ID NO: 157076 - DNA, 22 bp, Homo sapiens
ttactctgtggttcaagtatgt

SEQ ID NO: 157077 - DNA, 22 bp, Homo sapiens
agtagttgttgcaggtcacttt

SEQ ID NO: 157078 - DNA, 23 bp, Homo sapiens
cacctctctcagtctgtctcctt

SEQ ID NO: 157079 - DNA, 23 bp, Homo sapiens
atgtttgtccttggtgaaatgca

SEQ ID NO: 157080 - DNA, 22 bp, Homo sapiens
tgtgtatatatatatgtgtgtg

SEQ ID NO: 157081 - DNA, 23 bp, Homo sapiens
agaatctcactctgtcacttagg

SEQ ID NO: 157082 - DNA, 21 bp, Homo sapiens
taagtaattgcatgtgtgtgt

SEQ ID NO: 157083 - DNA, 23 bp, Homo sapiens
atatgtacatcaacatggaatta

SEQ ID NO: 157084 - DNA, 21 bp, Homo sapiens
tagagcttctataccatagat

SEQ ID NO: 157085 - DNA, 22 bp, Homo sapiens
ttatgtaagaagtgagagtgga

SEQ ID NO: 157086 - DNA, 21 bp, Homo sapiens
ctgggacagagtaggtgcttg

SEQ ID NO: 157087 - DNA, 23 bp, Homo sapiens
tctgagtcgcattttcatctcta

SEQ ID NO: 157088 - DNA, 19 bp, Homo sapiens
taagagtgtgaggtaatga

SEQ ID NO: 157089 - DNA, 18 bp, Homo sapiens
tgtgcatacacagtgtgt

SEQ ID NO: 157090 - DNA, 23 bp, Homo sapiens
ccctgtccctgataaccttgtgt

SEQ ID NO: 157091 - DNA, 23 bp, Homo sapiens
atgtgagttcttattgtgttgaa

SEQ ID NO: 157092 - DNA, 19 bp, Homo sapiens
atttagcatcttttgaaaa

SEQ ID NO: 157093 - DNA, 23 bp, Homo sapiens
tgagttcattgtagattctggat

SEQ ID NO: 157094 - DNA, 23 bp, Homo sapiens
tgagttcattgtagattctggat

SEQ ID NO: 157095 - DNA, 23 bp, Homo sapiens
tactgaatgctctgtctgactgg

SEQ ID NO: 157096 - DNA, 21 bp, Homo sapiens
tctccatctcactctctgtct

SEQ ID NO: 157097 - DNA, 22 bp, Homo sapiens
aatgggagacataatcttttct

SEQ ID NO: 157098 - DNA, 23 bp, Homo sapiens
aagagttctgttgctccacatct

SEQ ID NO: 157099 - DNA, 23 bp, Homo sapiens
atgagagcctggtctgtagctgt

SEQ ID NO: 157100 - DNA, 23 bp, Homo sapiens
attacatgcatatctgtaagttt

SEQ ID NO: 157101 - DNA, 23 bp, Homo sapiens
tcaaacacagccaggtatgtaat

SEQ ID NO: 157102 - DNA, 22 bp, Homo sapiens
tgtcattgtatttcatacttgt

SEQ ID NO: 157103 - DNA, 20 bp, Homo sapiens
attttggtacattatctttt

SEQ ID NO: 157104 - DNA, 20 bp, Homo sapiens
tttttgtttattttattttg

SEQ ID NO: 157105 - DNA, 21 bp, Homo sapiens
cagcctgggtgacagagcgag

SEQ ID NO: 157106 - DNA, 23 bp, Homo sapiens
cagacaggggtttctctctgtca

SEQ ID NO: 157107 - DNA, 23 bp, Homo sapiens
accctgtcgctgaagctggaatg

SEQ ID NO: 157108 - DNA, 19 bp, Homo sapiens
tgtgtgaccagagagagcc

SEQ ID NO: 157109 - DNA, 23 bp, Homo sapiens
gttctcattggaaaggcatcaga

SEQ ID NO: 157110 - DNA, 23 bp, Homo sapiens
aagacagcctgatttttttcttt

SEQ ID NO: 157111 - DNA, 23 bp, Homo sapiens
gggtctcactctgtcacccaggc

SEQ ID NO: 157112 - DNA, 21 bp, Homo sapiens
ttagtttttgaaaaagagtct

SEQ ID NO: 157113 - DNA, 23 bp, Homo sapiens
agcctctggggatataatctgtc

SEQ ID NO: 157114 - DNA, 19 bp, Homo sapiens
cagtgagctgagactgctg

SEQ ID NO: 157115 - DNA, 23 bp, Homo sapiens
acagtctcactgtgtcacccagg

SEQ ID NO: 157116 - DNA, 23 bp, Homo sapiens
aatatttgagctagaaatagaaa

SEQ ID NO: 157117 - DNA, 18 bp, Homo sapiens
agtcttcatgttttagga

SEQ ID NO: 157118 - DNA, 18 bp, Homo sapiens
tatgtatgtatgtatgta

SEQ ID NO: 157119 - DNA, 23 bp, Homo sapiens
tacatgtgcacaacgtgcaggtt

SEQ ID NO: 157120 - DNA, 23 bp, Homo sapiens
tagagctgggatttgaaggtgct

SEQ ID NO: 157121 - DNA, 21 bp, Homo sapiens
tgagttctgactctgtcatca

SEQ ID NO: 157122 - DNA, 18 bp, Homo sapiens
tgaatctgggtgctcctg

SEQ ID NO: 157123 - DNA, 21 bp, Homo sapiens
tggtagggtcacttgagccca

SEQ ID NO: 157124 - DNA, 23 bp, Homo sapiens
acagagtctcactctgtcgccca

SEQ ID NO: 157125 - DNA, 23 bp, Homo sapiens
tgtgtctctttttctgattatgt

SEQ ID NO: 157126 - DNA, 23 bp, Homo sapiens
tgagacggagtctcgctctgtca

SEQ ID NO: 157127 - DNA, 22 bp, Homo sapiens
atatgcgtatataacatatgca

SEQ ID NO: 157128 - DNA, 22 bp, Homo sapiens
acacacatattatatatatgtg

SEQ ID NO: 157129 - DNA, 22 bp, Homo sapiens
tacacacatattatatatgtgt

SEQ ID NO: 157130 - DNA, 20 bp, Homo sapiens
acacatattatatatatgtg

SEQ ID NO: 157131 - DNA, 22 bp, Homo sapiens
acacacatattatatatatgtg

SEQ ID NO: 157132 - DNA, 22 bp, Homo sapiens
tacacacatattatatatgtgt

SEQ ID NO: 157133 - DNA, 20 bp, Homo sapiens
aatctgttaggtttagagtc

SEQ ID NO: 157134 - DNA, 23 bp, Homo sapiens
taagcttagtgctttctatgttg

SEQ ID NO: 157135 - DNA, 21 bp, Homo sapiens
ttgctcctaagaattattctt

SEQ ID NO: 157136 - DNA, 23 bp, Homo sapiens
tttgcatgggcagggtctctttt

SEQ ID NO: 157137 - DNA, 23 bp, Homo sapiens
gagacagagtctcgctctgtccc

SEQ ID NO: 157138 - DNA, 21 bp, Homo sapiens
gatctgtagagagtgtgcact

SEQ ID NO: 157139 - DNA, 23 bp, Homo sapiens
ttaaaaggatgtatatggaaggt

SEQ ID NO: 157140 - DNA, 23 bp, Homo sapiens
ctataagcagtactattctgtta

SEQ ID NO: 157141 - DNA, 18 bp, Homo sapiens
attgactttgtatcctgt

SEQ ID NO: 157142 - DNA, 23 bp, Homo sapiens
aatatttgagcacctactgtgtg

SEQ ID NO: 157143 - DNA, 23 bp, Homo sapiens
tttcatttttagtagaaagtaca

SEQ ID NO: 157144 - DNA, 18 bp, Homo sapiens
ttcttactttttttgtta

SEQ ID NO: 157145 - DNA, 22 bp, Homo sapiens
tgagatcagcctctgaagctta

SEQ ID NO: 157146 - DNA, 22 bp, Homo sapiens
tgatctctgtctgtgtgtgctg

SEQ ID NO: 157147 - DNA, 22 bp, Homo sapiens
ttctttgatgatctttctcacc

SEQ ID NO: 157148 - DNA, 23 bp, Homo sapiens
ttattccttcagaatgggtttgt

SEQ ID NO: 157149 - DNA, 22 bp, Homo sapiens
tgagatacacagtgaataagaa

SEQ ID NO: 157150 - DNA, 23 bp, Homo sapiens
agagagatgtgagtcagcaatca

SEQ ID NO: 157151 - DNA, 23 bp, Homo sapiens
aatattttacctggaaatactta

SEQ ID NO: 157152 - DNA, 23 bp, Homo sapiens
aagttgtattcatggaagtctga

SEQ ID NO: 157153 - DNA, 21 bp, Homo sapiens
agcctgaagagtctgtgcact

SEQ ID NO: 157154 - DNA, 19 bp, Homo sapiens
taatgatgatagtcgagtg

SEQ ID NO: 157155 - DNA, 23 bp, Homo sapiens
aactgctctgactttaacatgag

SEQ ID NO: 157156 - DNA, 20 bp, Homo sapiens
aagtgcttgtatgtacatac

SEQ ID NO: 157157 - DNA, 19 bp, Homo sapiens
tgagatggagtctcactct

SEQ ID NO: 157158 - DNA, 23 bp, Homo sapiens
tcaagtgtatttgtttagctgga

SEQ ID NO: 157159 - DNA, 23 bp, Homo sapiens
acatgtacagtatgtatatgtat

SEQ ID NO: 157160 - DNA, 23 bp, Homo sapiens
tacatactgtatatgtatatgat

SEQ ID NO: 157161 - DNA, 23 bp, Homo sapiens
gctgagactgaagtgagctgtga

SEQ ID NO: 157162 - DNA, 21 bp, Homo sapiens
caggagcgaaactctgtctca

SEQ ID NO: 157163 - DNA, 19 bp, Homo sapiens
ctgcatcccataagttttg

SEQ ID NO: 157164 - DNA, 23 bp, Homo sapiens
gacagagtctcgctctgtcaccc

SEQ ID NO: 157165 - DNA, 19 bp, Homo sapiens
tttttgtagtgacagagtc

SEQ ID NO: 157166 - DNA, 21 bp, Homo sapiens
tcacacaatcactcactgctt

SEQ ID NO: 157167 - DNA, 18 bp, Homo sapiens
tctcagtgtcacttcatg

SEQ ID NO: 157168 - DNA, 18 bp, Homo sapiens
tccaccctacaaacaggc

SEQ ID NO: 157169 - DNA, 23 bp, Homo sapiens
ttaatgagatagctagttgtttt

SEQ ID NO: 157170 - DNA, 19 bp, Homo sapiens
tacatacacacatatgtgt

SEQ ID NO: 157171 - DNA, 21 bp, Homo sapiens
tatatgtgtatatgtatatgt

SEQ ID NO: 157172 - DNA, 23 bp, Homo sapiens
gagtcactgtctcggtgtctgct

SEQ ID NO: 157173 - DNA, 23 bp, Homo sapiens
tgagttcattgtagattctggat

SEQ ID NO: 157174 - DNA, 23 bp, Homo sapiens
tgagttcattgtagattctggat

SEQ ID NO: 157175 - DNA, 22 bp, Homo sapiens
taacacaatgcctgttcatttt

SEQ ID NO: 157176 - DNA, 22 bp, Homo sapiens
gtcttctgtgtctctcacgctg

SEQ ID NO: 157177 - DNA, 23 bp, Homo sapiens
tgtggatcttttgtggttccata

SEQ ID NO: 157178 - DNA, 23 bp, Homo sapiens
ctccctctgtctcccagactgga

SEQ ID NO: 157179 - DNA, 20 bp, Homo sapiens
atgacatattatatatatgt

SEQ ID NO: 157180 - DNA, 23 bp, Homo sapiens
acatgtgtatatctatatgtgtg

SEQ ID NO: 157181 - DNA, 18 bp, Homo sapiens
cggtaaatgtaccaggag

SEQ ID NO: 157182 - DNA, 23 bp, Homo sapiens
tgagttcattgtagattctggat

SEQ ID NO: 157183 - DNA, 23 bp, Homo sapiens
tgagttcattgtagattctggat

SEQ ID NO: 157184 - DNA, 23 bp, Homo sapiens
gagatggagtcccactctgacac

SEQ ID NO: 157185 - DNA, 21 bp, Homo sapiens
tttgtgcatctattaggataa

SEQ ID NO: 157186 - DNA, 23 bp, Homo sapiens
aatatgatacgttatgttaatgg

SEQ ID NO: 157187 - DNA, 23 bp, Homo sapiens
tgagttcattgtagattctggat

SEQ ID NO: 157188 - DNA, 23 bp, Homo sapiens
tgagttcattgtagattctggat

SEQ ID NO: 157189 - DNA, 20 bp, Homo sapiens
taaattagatgtgtgtgtgt

SEQ ID NO: 157190 - DNA, 22 bp, Homo sapiens
ctgaaagagtattttttttggt

SEQ ID NO: 157191 - DNA, 19 bp, Homo sapiens
tgagagctgagtgtatgtg

SEQ ID NO: 157192 - DNA, 23 bp, Homo sapiens
ttcagtggagtgatgtatgggaa

SEQ ID NO: 157193 - DNA, 23 bp, Homo sapiens
agggtacatgtgcacattgtgca

SEQ ID NO: 157194 - DNA, 23 bp, Homo sapiens
tgagttcattgtagattctggat

SEQ ID NO: 157195 - DNA, 23 bp, Homo sapiens
tgagttcattgtagattctggat

SEQ ID NO: 157196 - DNA, 22 bp, Homo sapiens
tattgcagtccagcctgggtga

SEQ ID NO: 157197 - DNA, 23 bp, Homo sapiens
agatggagtcccactctgtctcc

SEQ ID NO: 157198 - DNA, 23 bp, Homo sapiens
ttttcttcttgagacggagtctc

SEQ ID NO: 157199 - DNA, 23 bp, Homo sapiens
acattgtatcttggagttggtgt

SEQ ID NO: 157200 - DNA, 23 bp, Homo sapiens
gacagagtctcgctctgtcaccc

SEQ ID NO: 157201 - DNA, 23 bp, Homo sapiens
ttctctgtcttttgagtcctggt

SEQ ID NO: 157202 - DNA, 23 bp, Homo sapiens
agtttggtttacagaaagcttga

SEQ ID NO: 157203 - DNA, 21 bp, Homo sapiens
tgtgtgtgtagggagagggtt

SEQ ID NO: 157204 - DNA, 22 bp, Homo sapiens
ttctcaccctgtcacccaggct

SEQ ID NO: 157205 - DNA, 18 bp, Homo sapiens
tgtatatatatacacata

SEQ ID NO: 157206 - DNA, 22 bp, Homo sapiens
cagcctctgtgataaagtgaca

SEQ ID NO: 157207 - DNA, 21 bp, Homo sapiens
tgagatggagtctcactctat

SEQ ID NO: 157208 - DNA, 23 bp, Homo sapiens
agattgagcaagagattggagac

SEQ ID NO: 157209 - DNA, 19 bp, Homo sapiens
atccaatgtacggtcttct

SEQ ID NO: 157210 - DNA, 23 bp, Homo sapiens
tatgtgtgtacatatatgtgagc

SEQ ID NO: 157211 - DNA, 20 bp, Homo sapiens
atatacacacatttacatct

SEQ ID NO: 157212 - DNA, 21 bp, Homo sapiens
atcagcaagtatatgaagata

SEQ ID NO: 157213 - DNA, 19 bp, Homo sapiens
tgagatggagtctctctct

SEQ ID NO: 157214 - DNA, 21 bp, Homo sapiens
tgacaccaaaataaagtgagt

SEQ ID NO: 157215 - DNA, 23 bp, Homo sapiens
agtctctgtctgtatgatgagtg

SEQ ID NO: 157216 - DNA, 23 bp, Homo sapiens
gtcagagtctcactgtgtccccc

SEQ ID NO: 157217 - DNA, 23 bp, Homo sapiens
taacagtgaagtgatattcttgt

SEQ ID NO: 157218 - DNA, 22 bp, Homo sapiens
gacagggtctcactctgttacc

SEQ ID NO: 157219 - DNA, 23 bp, Homo sapiens
tgagatggagtctccctctgtct

SEQ ID NO: 157220 - DNA, 22 bp, Homo sapiens
ggattacagacgtgagccaccg

SEQ ID NO: 157221 - DNA, 23 bp, Homo sapiens
agtctcactctgtcacccaggct

SEQ ID NO: 157222 - DNA, 21 bp, Homo sapiens
aatggcacatcatcattatct

SEQ ID NO: 157223 - DNA, 20 bp, Homo sapiens
tttgcttagagtgaaatgtg

SEQ ID NO: 157224 - DNA, 19 bp, Homo sapiens
tttgtttgtaactgtttgg

SEQ ID NO: 157225 - DNA, 19 bp, Homo sapiens
actactgccataagccaga

SEQ ID NO: 157226 - DNA, 23 bp, Homo sapiens
tggactctggctctgtcacccag

SEQ ID NO: 157227 - DNA, 19 bp, Homo sapiens
tctgccagagaagaaaggc

SEQ ID NO: 157228 - DNA, 23 bp, Homo sapiens
aagagagtcctgagtgagcacac

SEQ ID NO: 157229 - DNA, 23 bp, Homo sapiens
tgtcgctctgtgaccctcagaag

SEQ ID NO: 157230 - DNA, 18 bp, Homo sapiens
actcacaggtttttttgt

SEQ ID NO: 157231 - DNA, 23 bp, Homo sapiens
tcgctctgacacccagtctggac

SEQ ID NO: 157232 - DNA, 23 bp, Homo sapiens
tgagttcattgtagattctggat

SEQ ID NO: 157233 - DNA, 23 bp, Homo sapiens
tgagttcattgtagattctggat

SEQ ID NO: 157234 - DNA, 23 bp, Homo sapiens
acagagtctcgctctgtcaccca

SEQ ID NO: 157235 - DNA, 23 bp, Homo sapiens
tacagtggcaagatcttggctca

SEQ ID NO: 157236 - DNA, 21 bp, Homo sapiens
tctgtctgtgtctctgtactt

SEQ ID NO: 157237 - DNA, 23 bp, Homo sapiens
ctgggtgacagagtgagtctctg

SEQ ID NO: 157238 - DNA, 20 bp, Homo sapiens
atccatcaatacattagctt

SEQ ID NO: 157239 - DNA, 22 bp, Homo sapiens
gacagcacagagtgtggtgagt

SEQ ID NO: 157240 - DNA, 20 bp, Homo sapiens
tatgtatgtatatatacacg

SEQ ID NO: 157241 - DNA, 20 bp, Homo sapiens
agtctcgctctgtcacccag

SEQ ID NO: 157242 - DNA, 23 bp, Homo sapiens
aaaggtgctatctctctgtgtgt

SEQ ID NO: 157243 - DNA, 23 bp, Homo sapiens
tgactccctctctcactgcagcc

SEQ ID NO: 157244 - DNA, 23 bp, Homo sapiens
ttgtctttgctataggtgtgtgt

SEQ ID NO: 157245 - DNA, 20 bp, Homo sapiens
tatacacatatacatataca

SEQ ID NO: 157246 - DNA, 22 bp, Homo sapiens
tttgttctttttgcttaggatt

SEQ ID NO: 157247 - DNA, 23 bp, Homo sapiens
tctgtgaagaaagtcaatggtag

SEQ ID NO: 157248 - DNA, 20 bp, Homo sapiens
aatccatttccaacagatcg

SEQ ID NO: 157249 - DNA, 23 bp, Homo sapiens
tttgagacggagttttgctcttg

SEQ ID NO: 157250 - DNA, 23 bp, Homo sapiens
gtttacataccacattttctttt

SEQ ID NO: 157251 - DNA, 23 bp, Homo sapiens
attcattcactcactcaccctcc

SEQ ID NO: 157252 - DNA, 23 bp, Homo sapiens
tatttctcagaggttttgttcat

SEQ ID NO: 157253 - DNA, 23 bp, Homo sapiens
tgtgtgactgagttatttctgag

SEQ ID NO: 157254 - DNA, 23 bp, Homo sapiens
atgtctgttgtctgcctggtgca

SEQ ID NO: 157255 - DNA, 22 bp, Homo sapiens
tgatgagggaggatcacttgag

SEQ ID NO: 157256 - DNA, 23 bp, Homo sapiens
agagacagggtctcagtctgtca

SEQ ID NO: 157257 - DNA, 23 bp, Homo sapiens
tatgtgtatatatatgtgtgtgt

SEQ ID NO: 157258 - DNA, 23 bp, Homo sapiens
tttctctctctctttctctagag

SEQ ID NO: 157259 - DNA, 20 bp, Homo sapiens
gtgctgatgatatggatggt

SEQ ID NO: 157260 - DNA, 23 bp, Homo sapiens
tgattgctcaattttggtttatc

SEQ ID NO: 157261 - DNA, 23 bp, Homo sapiens
tgagtagattaaaaacagcaaac

SEQ ID NO: 157262 - DNA, 19 bp, Homo sapiens
tgttttcttggatccccta

SEQ ID NO: 157263 - DNA, 23 bp, Homo sapiens
tgagactgagtctggctctgttg

SEQ ID NO: 157264 - DNA, 23 bp, Homo sapiens
tatctagagccttgtctcttcct

SEQ ID NO: 157265 - DNA, 23 bp, Homo sapiens
tgaggtggagtctcgctctgtca

SEQ ID NO: 157266 - DNA, 23 bp, Homo sapiens
agagagagtcagaaatcccaggc

SEQ ID NO: 157267 - DNA, 20 bp, Homo sapiens
tcatttattgtaaatcagag

SEQ ID NO: 157268 - DNA, 23 bp, Homo sapiens
tccatccttgtttaggcagtgca

SEQ ID NO: 157269 - DNA, 23 bp, Homo sapiens
ttctattctaccaacacagtgtc

SEQ ID NO: 157270 - DNA, 21 bp, Homo sapiens
aggatgattagtttagaaatt

SEQ ID NO: 157271 - DNA, 20 bp, Homo sapiens
agagtacacagtaagtgctg

SEQ ID NO: 157272 - DNA, 22 bp, Homo sapiens
atttgagacagagtctgtcgcc

SEQ ID NO: 157273 - DNA, 22 bp, Homo sapiens
gagcctctgtccctgtgacaga

SEQ ID NO: 157274 - DNA, 18 bp, Homo sapiens
ccatatatatgtatgtgt

SEQ ID NO: 157275 - DNA, 21 bp, Homo sapiens
ataagaattgttggtgcttgg

SEQ ID NO: 157276 - DNA, 23 bp, Homo sapiens
tatgcattatgtatatgtatatg

SEQ ID NO: 157277 - DNA, 23 bp, Homo sapiens
tatgtgtatatgtatgtgtgtgt

SEQ ID NO: 157278 - DNA, 23 bp, Homo sapiens
tattcatttgctacttgagcaag

SEQ ID NO: 157279 - DNA, 22 bp, Homo sapiens
tgagatactatatatatatgta

SEQ ID NO: 157280 - DNA, 22 bp, Homo sapiens
ttgtgcatttcctatgtatggt

SEQ ID NO: 157281 - DNA, 21 bp, Homo sapiens
tcagaccctcagtggctggga

SEQ ID NO: 157282 - DNA, 23 bp, Homo sapiens
ctactctcagtgtctctgatata

SEQ ID NO: 157283 - DNA, 23 bp, Homo sapiens
tgagttcattgtagattctggat

SEQ ID NO: 157284 - DNA, 23 bp, Homo sapiens
tgagttcattgtagattctggat

SEQ ID NO: 157285 - DNA, 19 bp, Homo sapiens
aacatgaaactttttgttc

SEQ ID NO: 157286 - DNA, 18 bp, Homo sapiens
gtgatcttaagcttcact

SEQ ID NO: 157287 - DNA, 22 bp, Homo sapiens
gacagtaaaaaggcatgagttt

SEQ ID NO: 157288 - DNA, 23 bp, Homo sapiens
tgacctttttgtttgttgagcga

SEQ ID NO: 157289 - DNA, 23 bp, Homo sapiens
aggatgtcatttgccagagctac

SEQ ID NO: 157290 - DNA, 22 bp, Homo sapiens
tgagagtcagagaaagaagaga

SEQ ID NO: 157291 - DNA, 23 bp, Homo sapiens
gagtctggatgtattcagaagtt

SEQ ID NO: 157292 - DNA, 21 bp, Homo sapiens
tcactgtaacctctgcctcct

SEQ ID NO: 157293 - DNA, 23 bp, Homo sapiens
cggagtctcactctgtcacccag

SEQ ID NO: 157294 - DNA, 23 bp, Homo sapiens
tatatataactgcaataactgca

SEQ ID NO: 157295 - DNA, 18 bp, Homo sapiens
agtgcactttcctttttt

SEQ ID NO: 157296 - DNA, 23 bp, Homo sapiens
tctcagatgagactctggacttc

SEQ ID NO: 157297 - DNA, 21 bp, Homo sapiens
tttcagtgtctgtgaatttgc

SEQ ID NO: 157298 - DNA, 23 bp, Homo sapiens
agacagagtctcgctctgtcacc

SEQ ID NO: 157299 - DNA, 23 bp, Homo sapiens
tgagacggagtctcacgctgtca

SEQ ID NO: 157300 - DNA, 19 bp, Homo sapiens
gtctcgctctgtcacccag

SEQ ID NO: 157301 - DNA, 20 bp, Homo sapiens
tgtgtgtgtgtggttttgtt

SEQ ID NO: 157302 - DNA, 23 bp, Homo sapiens
gagacggagtctcgctctgtcac

SEQ ID NO: 157303 - DNA, 23 bp, Homo sapiens
tacatatattctgtatatgtata

SEQ ID NO: 157304 - DNA, 23 bp, Homo sapiens
gtctcagtctctccctgtgtcca

SEQ ID NO: 157305 - DNA, 23 bp, Homo sapiens
gacagagtctcactctgtcttgc

SEQ ID NO: 157306 - DNA, 23 bp, Homo sapiens
tgagttcattgtagattctggat

SEQ ID NO: 157307 - DNA, 23 bp, Homo sapiens
tgagttcattgtagattctggat

SEQ ID NO: 157308 - DNA, 20 bp, Homo sapiens
ctgacctctctaagtctcag

SEQ ID NO: 157309 - DNA, 23 bp, Homo sapiens
gacagagtctcgctctgtcaccc

SEQ ID NO: 157310 - DNA, 23 bp, Homo sapiens
agacagagtctcgctctgtcacc

SEQ ID NO: 157311 - DNA, 21 bp, Homo sapiens
acagtggcgtgatcttggctc

SEQ ID NO: 157312 - DNA, 19 bp, Homo sapiens
ataaatgtaaagcacttga

SEQ ID NO: 157313 - DNA, 22 bp, Homo sapiens
aggattttgcttggatttccta

SEQ ID NO: 157314 - DNA, 21 bp, Homo sapiens
cacagagtctcgctctgtcgc

SEQ ID NO: 157315 - DNA, 23 bp, Homo sapiens
agacagagtctcgctctgtcacc

SEQ ID NO: 157316 - DNA, 23 bp, Homo sapiens
cacagtctcactctgtcacccag

SEQ ID NO: 157317 - DNA, 23 bp, Homo sapiens
atatgtgcatctatatacacata

SEQ ID NO: 157318 - DNA, 21 bp, Homo sapiens
taatacacttttgcaagcaga

SEQ ID NO: 157319 - DNA, 23 bp, Homo sapiens
acatgtctttttgttgttatttc

SEQ ID NO: 157320 - DNA, 23 bp, Homo sapiens
agacagagtctcgctctgtcacc

SEQ ID NO: 157321 - DNA, 23 bp, Homo sapiens
atatgtgcatctatatacacata

SEQ ID NO: 157322 - DNA, 21 bp, Homo sapiens
taatacacttttgcaagcaga

SEQ ID NO: 157323 - DNA, 23 bp, Homo sapiens
acatgtctttttgttgttatttc

SEQ ID NO: 157324 - DNA, 19 bp, Homo sapiens
agtgaaggtttaggtgtga

SEQ ID NO: 157325 - DNA, 23 bp, Homo sapiens
ttgagacagggtctcactctgtc

SEQ ID NO: 157326 - DNA, 20 bp, Homo sapiens
tctgtgcatgtatatgcatg

SEQ ID NO: 157327 - DNA, 22 bp, Homo sapiens
aaattcacactgggtatgattt

SEQ ID NO: 157328 - DNA, 23 bp, Homo sapiens
ctgaggctctctgactcacccaa

SEQ ID NO: 157329 - DNA, 18 bp, Homo sapiens
agacactgttcccacctc

SEQ ID NO: 157330 - DNA, 23 bp, Homo sapiens
acaccctgtgttattctacagtt

SEQ ID NO: 157331 - DNA, 23 bp, Homo sapiens
ctcagtcttgactgcacattgga

SEQ ID NO: 157332 - DNA, 23 bp, Homo sapiens
acagagtctcgcactgtcaccca

SEQ ID NO: 157333 - DNA, 23 bp, Homo sapiens
acagagtctcgcactgtcaccca

SEQ ID NO: 157334 - DNA, 22 bp, Homo sapiens
tcagttcttccattttctgtgt

SEQ ID NO: 157335 - DNA, 23 bp, Homo sapiens
atgcctgtacttctagcactttg

SEQ ID NO: 157336 - DNA, 22 bp, Homo sapiens
ttttgagatggagtgttgctct

SEQ ID NO: 157337 - DNA, 23 bp, Homo sapiens
gtgagttaacatggttgaaagat

SEQ ID NO: 157338 - DNA, 23 bp, Homo sapiens
tgaaactccatctgaaaaaagag

SEQ ID NO: 157339 - DNA, 23 bp, Homo sapiens
gggtctcactctgtcacccaggc

SEQ ID NO: 157340 - DNA, 23 bp, Homo sapiens
gggtctcactctgtcacccaggc

SEQ ID NO: 157341 - DNA, 23 bp, Homo sapiens
gtgcagtgggctatgattgtgcc

SEQ ID NO: 157342 - DNA, 23 bp, Homo sapiens
tattagtctgattttgtagtagt

SEQ ID NO: 157343 - DNA, 23 bp, Homo sapiens
tatagtcatgtctgagcatttat

SEQ ID NO: 157344 - DNA, 23 bp, Homo sapiens
ctgtgtgactgtgtgtgtggctg

SEQ ID NO: 157345 - DNA, 21 bp, Homo sapiens
tgaggtagtaggttccaggct

SEQ ID NO: 157346 - DNA, 23 bp, Homo sapiens
gagtctcactctgtcacccaggc

SEQ ID NO: 157347 - DNA, 23 bp, Homo sapiens
tctcaccctgtctgcctgtctat

SEQ ID NO: 157348 - DNA, 21 bp, Homo sapiens
atatatgtatacttggttcta

SEQ ID NO: 157349 - DNA, 21 bp, Homo sapiens
agagtctcattctgtctccca

SEQ ID NO: 157350 - DNA, 23 bp, Homo sapiens
tttgagatggagtcttgctctgt

SEQ ID NO: 157351 - DNA, 23 bp, Homo sapiens
cagggtctcgctctgtcactccg

SEQ ID NO: 157352 - DNA, 23 bp, Homo sapiens
tgagacagagttttgtttttgtt

SEQ ID NO: 157353 - DNA, 21 bp, Homo sapiens
tctgtctctgtttcactgagc

SEQ ID NO: 157354 - DNA, 23 bp, Homo sapiens
agacagagtctcgctctgttgtc

SEQ ID NO: 157355 - DNA, 23 bp, Homo sapiens
tgagacagagtctggctctgttg

SEQ ID NO: 157356 - DNA, 21 bp, Homo sapiens
ttagtatatttataccggtat

SEQ ID NO: 157357 - DNA, 22 bp, Homo sapiens
acagagtctctcactgtcgccc

SEQ ID NO: 157358 - DNA, 23 bp, Homo sapiens
tgaaacagagtctcgctgtgtca

SEQ ID NO: 157359 - DNA, 23 bp, Homo sapiens
ttttttttgagacggagtcttgc

SEQ ID NO: 157360 - DNA, 23 bp, Homo sapiens
tgtgtgtatgtgtatatgtgtat

SEQ ID NO: 157361 - DNA, 23 bp, Homo sapiens
agagtctatttctgtcacctagg

SEQ ID NO: 157362 - DNA, 21 bp, Homo sapiens
acacacactgttaatgtagga

SEQ ID NO: 157363 - DNA, 19 bp, Homo sapiens
ctgtgaatttatatatgtg

SEQ ID NO: 157364 - DNA, 23 bp, Homo sapiens
gggagtaaacagccaggacctgt

SEQ ID NO: 157365 - DNA, 23 bp, Homo sapiens
tggctgatgatttgttatggtgc

SEQ ID NO: 157366 - DNA, 23 bp, Homo sapiens
acagagtctcgctctgtcaccca

SEQ ID NO: 157367 - DNA, 23 bp, Homo sapiens
tgaatcactgcctcctttgagga

SEQ ID NO: 157368 - DNA, 23 bp, Homo sapiens
tgagacggagtctggctctgtca

SEQ ID NO: 157369 - DNA, 22 bp, Homo sapiens
tcagtatttgcttaggcagaga

SEQ ID NO: 157370 - DNA, 20 bp, Homo sapiens
agaagttctagtctgatggt

SEQ ID NO: 157371 - DNA, 22 bp, Homo sapiens
ctttagactatggaattcatgt

SEQ ID NO: 157372 - DNA, 23 bp, Homo sapiens
agagtctcactctgtcactcagg

SEQ ID NO: 157373 - DNA, 23 bp, Homo sapiens
ttgactgcaagttgtccaggttc

SEQ ID NO: 157374 - DNA, 23 bp, Homo sapiens
agacagagtctcactctgtcgcc

SEQ ID NO: 157375 - DNA, 22 bp, Homo sapiens
tctgaagtagctgggactacag

SEQ ID NO: 157376 - DNA, 23 bp, Homo sapiens
tcctaggctcaagtgattctcct

SEQ ID NO: 157377 - DNA, 23 bp, Homo sapiens
agtataggcagtgagtgaggtca

SEQ ID NO: 157378 - DNA, 23 bp, Homo sapiens
tgaatttcacttccttctgtaag

SEQ ID NO: 157379 - DNA, 22 bp, Homo sapiens
cactgtctctgtctgggaacca

SEQ ID NO: 157380 - DNA, 18 bp, Homo sapiens
tcctgaaggtgtgtccca

SEQ ID NO: 157381 - DNA, 23 bp, Homo sapiens
attgtctcagtgtaagcagtatt

SEQ ID NO: 157382 - DNA, 23 bp, Homo sapiens
tctggttgtttgaaagtgtgtag

SEQ ID NO: 157383 - DNA, 23 bp, Homo sapiens
tggaggaagaaacagttctactc

SEQ ID NO: 157384 - DNA, 23 bp, Homo sapiens
acactgggtccctcttctctctc

SEQ ID NO: 157385 - DNA, 20 bp, Homo sapiens
caaatgattatagacactgg

SEQ ID NO: 157386 - DNA, 19 bp, Homo sapiens
caaagcacagacccaggtc

SEQ ID NO: 157387 - DNA, 23 bp, Homo sapiens
acactcacacagtttactattac

SEQ ID NO: 157388 - DNA, 23 bp, Homo sapiens
ttccatgtatatgtatacgtata

SEQ ID NO: 157389 - DNA, 23 bp, Homo sapiens
tatgtatatgtatatgtatgtgt

SEQ ID NO: 157390 - DNA, 21 bp, Homo sapiens
atatatgtgtgtgtatgtaca

SEQ ID NO: 157391 - DNA, 23 bp, Homo sapiens
ccaacatctactgtttttgattt

SEQ ID NO: 157392 - DNA, 23 bp, Homo sapiens
ttgcactgtggttttgatttgca

SEQ ID NO: 157393 - DNA, 22 bp, Homo sapiens
gttatcaattacatagcaggaa

SEQ ID NO: 157394 - DNA, 21 bp, Homo sapiens
tatgtgcaggatgtgcaggtt

SEQ ID NO: 157395 - DNA, 22 bp, Homo sapiens
cagtgtgactctgtgtgcctgt

SEQ ID NO: 157396 - DNA, 22 bp, Homo sapiens
agacagaccacagtgtgtgcac

SEQ ID NO: 157397 - DNA, 23 bp, Homo sapiens
atgacttagattgaagttgtttt

SEQ ID NO: 157398 - DNA, 22 bp, Homo sapiens
atcacagaagtgagtgagcgat

SEQ ID NO: 157399 - DNA, 20 bp, Homo sapiens
aagacatgtgaacttgatga

SEQ ID NO: 157400 - DNA, 21 bp, Homo sapiens
tagactttgatattgttgact

SEQ ID NO: 157401 - DNA, 21 bp, Homo sapiens
gtagtttttttccaattctgt

SEQ ID NO: 157402 - DNA, 23 bp, Homo sapiens
tggtatttcaggaagttgctgga

SEQ ID NO: 157403 - DNA, 23 bp, Homo sapiens
aatagtccattgtctggatgtac

SEQ ID NO: 157404 - DNA, 21 bp, Homo sapiens
tattagtgtctactggctctc

SEQ ID NO: 157405 - DNA, 18 bp, Homo sapiens
atatgtatattcaaacca

SEQ ID NO: 157406 - DNA, 22 bp, Homo sapiens
ttggagcatttaataacagtta

SEQ ID NO: 157407 - DNA, 23 bp, Homo sapiens
tgtatactagtatgtacatttgt

SEQ ID NO: 157408 - DNA, 18 bp, Homo sapiens
ttgctttatgaccaagca

SEQ ID NO: 157409 - DNA, 23 bp, Homo sapiens
tgagttcattgtagattctggat

SEQ ID NO: 157410 - DNA, 23 bp, Homo sapiens
tgagttcattgtagattctggat

SEQ ID NO: 157411 - DNA, 23 bp, Homo sapiens
tgaatttgtattcccatgagatt

SEQ ID NO: 157412 - DNA, 23 bp, Homo sapiens
tttggcaaaataagcaattgtag

SEQ ID NO: 157413 - DNA, 23 bp, Homo sapiens
aatagagtcagctatgcttaagt

SEQ ID NO: 157414 - DNA, 21 bp, Homo sapiens
tgctggttttgtatcctaaaa

SEQ ID NO: 157415 - DNA, 20 bp, Homo sapiens
tatctagatatatatactat

SEQ ID NO: 157416 - DNA, 21 bp, Homo sapiens
tatttgtatatatacatatgt

SEQ ID NO: 157417 - DNA, 23 bp, Homo sapiens
taacagtgttcagacaaggtgat

SEQ ID NO: 157418 - DNA, 23 bp, Homo sapiens
atctgcctccaacatcactggcc

SEQ ID NO: 157419 - DNA, 21 bp, Homo sapiens
cttagagtgagttgattccat

SEQ ID NO: 157420 - DNA, 23 bp, Homo sapiens
tgagtttggtttgtgtgagtcta

SEQ ID NO: 157421 - DNA, 23 bp, Homo sapiens
agacagagtctcgctctgtcacc

SEQ ID NO: 157422 - DNA, 18 bp, Homo sapiens
agtacagtggcgcagtct

SEQ ID NO: 157423 - DNA, 23 bp, Homo sapiens
atggtctctctctctgagccctt

SEQ ID NO: 157424 - DNA, 21 bp, Homo sapiens
taattagttaactagctaaca

SEQ ID NO: 157425 - DNA, 23 bp, Homo sapiens
tgagagactactcattttggtga

SEQ ID NO: 157426 - DNA, 23 bp, Homo sapiens
ttgtagcaacatgttcactttct

SEQ ID NO: 157427 - DNA, 21 bp, Homo sapiens
tttgttcttgttctagttcct

SEQ ID NO: 157428 - DNA, 21 bp, Homo sapiens
tatttctaactttttgatgtg

SEQ ID NO: 157429 - DNA, 22 bp, Homo sapiens
tttggggcacaaatactcctga

SEQ ID NO: 157430 - DNA, 20 bp, Homo sapiens
atgtgtatgtgtgtactata

SEQ ID NO: 157431 - DNA, 23 bp, Homo sapiens
tgactgtgttatatgtatgtgtt

SEQ ID NO: 157432 - DNA, 18 bp, Homo sapiens
tgagcatttttttttttt

SEQ ID NO: 157433 - DNA, 19 bp, Homo sapiens
aggcccagtgtgactacat

SEQ ID NO: 157434 - DNA, 21 bp, Homo sapiens
ttttgcaagttctacctctgt

SEQ ID NO: 157435 - DNA, 23 bp, Homo sapiens
agatggagtctcactctgtcacc

SEQ ID NO: 157436 - DNA, 21 bp, Homo sapiens
agaaagtggagagtgagcaca

SEQ ID NO: 157437 - DNA, 20 bp, Homo sapiens
acttccagacctcctgcagg

SEQ ID NO: 157438 - DNA, 23 bp, Homo sapiens
cggagtctcactctgtcacccag

SEQ ID NO: 157439 - DNA, 23 bp, Homo sapiens
atagttacagatacagaaatcct

SEQ ID NO: 157440 - DNA, 23 bp, Homo sapiens
aaaggatcatatgtaatgtctaa

SEQ ID NO: 157441 - DNA, 21 bp, Homo sapiens
acgtatatatatgtgtgtata

SEQ ID NO: 157442 - DNA, 23 bp, Homo sapiens
tatgtgtatatgtgtatatgtgt

SEQ ID NO: 157443 - DNA, 23 bp, Homo sapiens
ttgctctgttgagctggaaggaa

SEQ ID NO: 157444 - DNA, 23 bp, Homo sapiens
gagggagtctcactctgtcaccc

SEQ ID NO: 157445 - DNA, 23 bp, Homo sapiens
catatatatctgtctcgtactga

SEQ ID NO: 157446 - DNA, 23 bp, Homo sapiens
ttgctctgttgagctggaaggaa

SEQ ID NO: 157447 - DNA, 21 bp, Homo sapiens
attgtggccacactttttgtc

SEQ ID NO: 157448 - DNA, 23 bp, Homo sapiens
gttagttttagaagtgctgtttg

SEQ ID NO: 157449 - DNA, 23 bp, Homo sapiens
tatatgtccatatatatggatat

SEQ ID NO: 157450 - DNA, 18 bp, Homo sapiens
tcacacctggaatcccag

SEQ ID NO: 157451 - DNA, 23 bp, Homo sapiens
tcagtgtctattagtattgtaag

SEQ ID NO: 157452 - DNA, 22 bp, Homo sapiens
aagtctgttgttttgttgatct

SEQ ID NO: 157453 - DNA, 23 bp, Homo sapiens
gactgagtctcactctgtcgccc

SEQ ID NO: 157454 - DNA, 23 bp, Homo sapiens
tgagacagtctcgctctgtcacc

SEQ ID NO: 157455 - DNA, 23 bp, Homo sapiens
tatgtgtatatatatgtgtgtgt

SEQ ID NO: 157456 - DNA, 23 bp, Homo sapiens
tatatagtagtattccatgtgtg

SEQ ID NO: 157457 - DNA, 23 bp, Homo sapiens
tgagaagatagaggactgggagt

SEQ ID NO: 157458 - DNA, 23 bp, Homo sapiens
ttttttggttccatatgaaattt

SEQ ID NO: 157459 - DNA, 23 bp, Homo sapiens
tgagctctgaaaacacagagcag

SEQ ID NO: 157460 - DNA, 21 bp, Homo sapiens
tctgtggacttcaaactcaag

SEQ ID NO: 157461 - DNA, 23 bp, Homo sapiens
ccagtctctctctctcagaaagg

SEQ ID NO: 157462 - DNA, 23 bp, Homo sapiens
aaaggacatgacacaggatgtag

SEQ ID NO: 157463 - DNA, 23 bp, Homo sapiens
gactggctcagtggatggacttt

SEQ ID NO: 157464 - DNA, 21 bp, Homo sapiens
tataagcaagataaccatgga

SEQ ID NO: 157465 - DNA, 23 bp, Homo sapiens
tattttgtgtcaggctttgtgat

SEQ ID NO: 157466 - DNA, 23 bp, Homo sapiens
tactgactgtttgtgaacactcc

SEQ ID NO: 157467 - DNA, 21 bp, Homo sapiens
atgttaacataaagttctggt

SEQ ID NO: 157468 - DNA, 23 bp, Homo sapiens
cagtgaagagtgagaagaaagca

SEQ ID NO: 157469 - DNA, 19 bp, Homo sapiens
cactctcctggagcagctc

SEQ ID NO: 157470 - DNA, 19 bp, Homo sapiens
gcatgtatgtatgtatgta

SEQ ID NO: 157471 - DNA, 23 bp, Homo sapiens
attgagcaatatcttagcgctca

SEQ ID NO: 157472 - DNA, 20 bp, Homo sapiens
tgtgtatatatatgtgtgtg

SEQ ID NO: 157473 - DNA, 23 bp, Homo sapiens
atgagctagtaccttggtttgtt

SEQ ID NO: 157474 - DNA, 21 bp, Homo sapiens
agaggacagagcctgcagtca

SEQ ID NO: 157475 - DNA, 23 bp, Homo sapiens
tttaagcaaagataccaatactt

SEQ ID NO: 157476 - DNA, 21 bp, Homo sapiens
ttctatttatatgaaatgccc

SEQ ID NO: 157477 - DNA, 21 bp, Homo sapiens
aagagatctgtgccaggagac

SEQ ID NO: 157478 - DNA, 23 bp, Homo sapiens
tcaatgagtctcagtgtctcagt

SEQ ID NO: 157479 - DNA, 23 bp, Homo sapiens
cagagtctcactcactctgtcgc

SEQ ID NO: 157480 - DNA, 22 bp, Homo sapiens
tgagtctcgctctgtcacccac

SEQ ID NO: 157481 - DNA, 21 bp, Homo sapiens
aagagatctgtgccaggagac

SEQ ID NO: 157482 - DNA, 23 bp, Homo sapiens
tcaatgagtctcagtgtctcagt

SEQ ID NO: 157483 - DNA, 23 bp, Homo sapiens
tcaccctcacactctcagtagtt

SEQ ID NO: 157484 - DNA, 23 bp, Homo sapiens
tcaagcagtctctctgtttccca

SEQ ID NO: 157485 - DNA, 23 bp, Homo sapiens
agagagacagagagatagtgctg

SEQ ID NO: 157486 - DNA, 23 bp, Homo sapiens
tgtgcatgtgtgtgtgtgtttat

SEQ ID NO: 157487 - DNA, 23 bp, Homo sapiens
tatacacattgtatatatgtgtg

SEQ ID NO: 157488 - DNA, 22 bp, Homo sapiens
tatacacatcatatatatgtgt

SEQ ID NO: 157489 - DNA, 23 bp, Homo sapiens
acagagtctcactgtgtcgccca

SEQ ID NO: 157490 - DNA, 19 bp, Homo sapiens
atacatatttttcatatgt

SEQ ID NO: 157491 - DNA, 23 bp, Homo sapiens
tgagcctgcctcactgaatgtgt

SEQ ID NO: 157492 - DNA, 23 bp, Homo sapiens
gcctgcctggctgccagtctgtt

SEQ ID NO: 157493 - DNA, 23 bp, Homo sapiens
aatgatgcttgaagtatggttta

SEQ ID NO: 157494 - DNA, 19 bp, Homo sapiens
tggcacatgaatgtgcagt

SEQ ID NO: 157495 - DNA, 22 bp, Homo sapiens
tgtgtgtgagtgtgcatgtaca

SEQ ID NO: 157496 - DNA, 22 bp, Homo sapiens
aggcatgcatttggactgaatt

SEQ ID NO: 157497 - DNA, 22 bp, Homo sapiens
agacaaggcctcgctctgtctc

SEQ ID NO: 157498 - DNA, 22 bp, Homo sapiens
tatggtgagaagtgtgggtcca

SEQ ID NO: 157499 - DNA, 22 bp, Homo sapiens
tttttctggggtaagggttagt

SEQ ID NO: 157500 - DNA, 23 bp, Homo sapiens
agtcacactcagtcacttctacc

SEQ ID NO: 157501 - DNA, 22 bp, Homo sapiens
tcagagaacacactttgcatta

SEQ ID NO: 157502 - DNA, 23 bp, Homo sapiens
ggctgcctggctcccagcatgcc

SEQ ID NO: 157503 - DNA, 22 bp, Homo sapiens
cttacgtgcagttagtggagtt

SEQ ID NO: 157504 - DNA, 22 bp, Homo sapiens
ttccctttgtcatccttcgcct

SEQ ID NO: 157505 - DNA, 23 bp, Homo sapiens
ggtgtcactctgtcactcaggac

SEQ ID NO: 157506 - DNA, 20 bp, Homo sapiens
tggaaggatcacttgaaccc

SEQ ID NO: 157507 - DNA, 23 bp, Homo sapiens
tctatctatctgtctgtctatct

SEQ ID NO: 157508 - DNA, 20 bp, Homo sapiens
tgcagtgagccgagactgtg

SEQ ID NO: 157509 - DNA, 23 bp, Homo sapiens
tgtgtgtttctgtgtatgtgtat

SEQ ID NO: 157510 - DNA, 21 bp, Homo sapiens
tcactcggtctgtctctcagg

SEQ ID NO: 157511 - DNA, 21 bp, Homo sapiens
ttctatttatatgaaatgccc

SEQ ID NO: 157512 - DNA, 23 bp, Homo sapiens
attggaagtccatctttttagat

SEQ ID NO: 157513 - DNA, 23 bp, Homo sapiens
gaaagagatctgtgccaggagac

SEQ ID NO: 157514 - DNA, 23 bp, Homo sapiens
gtgagtctcagtgtctcagtgtc

SEQ ID NO: 157515 - DNA, 23 bp, Homo sapiens
cagagtctcactcactctgtcgc

SEQ ID NO: 157516 - DNA, 20 bp, Homo sapiens
tacacatatatatgatgtgt

SEQ ID NO: 157517 - DNA, 23 bp, Homo sapiens
atacacacatatatacaatgtgt

SEQ ID NO: 157518 - DNA, 23 bp, Homo sapiens
tgaatgagtgttggattgtgtca

SEQ ID NO: 157519 - DNA, 21 bp, Homo sapiens
tttgatagaaataatgctgaa

SEQ ID NO: 157520 - DNA, 23 bp, Homo sapiens
acactgagactcattgagatgac

SEQ ID NO: 157521 - DNA, 21 bp, Homo sapiens
tgtgtatatatgtatatatgt

SEQ ID NO: 157522 - DNA, 23 bp, Homo sapiens
tgatattgatcttgtatcctgaa

SEQ ID NO: 157523 - DNA, 19 bp, Homo sapiens
gtaaagacaggattagata

SEQ ID NO: 157524 - DNA, 23 bp, Homo sapiens
catatgacactctttctgtgggt

SEQ ID NO: 157525 - DNA, 19 bp, Homo sapiens
aaaacatgatagagagagc

SEQ ID NO: 157526 - DNA, 22 bp, Homo sapiens
tatctgtatggagtggctctgt

SEQ ID NO: 157527 - DNA, 20 bp, Homo sapiens
tattctgtatttatatatga

SEQ ID NO: 157528 - DNA, 23 bp, Homo sapiens
tgtggctggtgctgattgcgatg

SEQ ID NO: 157529 - DNA, 21 bp, Homo sapiens
tatgtgtgtatatatatgtgt

SEQ ID NO: 157530 - DNA, 23 bp, Homo sapiens
cttatgaaatgtataaatgtatg

SEQ ID NO: 157531 - DNA, 23 bp, Homo sapiens
tggagtctcactctgtcacccag

SEQ ID NO: 157532 - DNA, 22 bp, Homo sapiens
tttacgttgaaatctgaagaag

SEQ ID NO: 157533 - DNA, 23 bp, Homo sapiens
tccctggctccctcattccatta

SEQ ID NO: 157534 - DNA, 23 bp, Homo sapiens
accgcagggacactctgacactc

SEQ ID NO: 157535 - DNA, 23 bp, Homo sapiens
tgggagacttctcattttgttct

SEQ ID NO: 157536 - DNA, 19 bp, Homo sapiens
tatgcatatatatacatat

SEQ ID NO: 157537 - DNA, 21 bp, Homo sapiens
aagagatctgtgccaggagac

SEQ ID NO: 157538 - DNA, 23 bp, Homo sapiens
tcaatgagtctcagtgtctcagt

SEQ ID NO: 157539 - DNA, 23 bp, Homo sapiens
tacatagtatatgtatatgtgta

SEQ ID NO: 157540 - DNA, 21 bp, Homo sapiens
atatgtgtacatatatgtatg

SEQ ID NO: 157541 - DNA, 23 bp, Homo sapiens
aatgagattatggttagagagaa

SEQ ID NO: 157542 - DNA, 21 bp, Homo sapiens
aaatggttgaaaacagatata

SEQ ID NO: 157543 - DNA, 18 bp, Homo sapiens
tttctgcttccatgttta

SEQ ID NO: 157544 - DNA, 20 bp, Homo sapiens
tctgtgcctcagtttccttg

SEQ ID NO: 157545 - DNA, 20 bp, Homo sapiens
ttgtgagatgagaggctgca

SEQ ID NO: 157546 - DNA, 23 bp, Homo sapiens
tcttctgttagttacattaatct

SEQ ID NO: 157547 - DNA, 23 bp, Homo sapiens
gcactcactcactgtgtctgctt

SEQ ID NO: 157548 - DNA, 23 bp, Homo sapiens
aactgtcaaactgctttccagag

SEQ ID NO: 157549 - DNA, 21 bp, Homo sapiens
ttcattgtgtatctttttggg

SEQ ID NO: 157550 - DNA, 23 bp, Homo sapiens
ggtgagcgatactggtctgtcat

SEQ ID NO: 157551 - DNA, 23 bp, Homo sapiens
gtcacttgtctgtgtcctgagga

SEQ ID NO: 157552 - DNA, 21 bp, Homo sapiens
tatacatacatatgcgtaagt

SEQ ID NO: 157553 - DNA, 21 bp, Homo sapiens
tatatgtgtgtagataggtag

SEQ ID NO: 157554 - DNA, 23 bp, Homo sapiens
atatgtgcatatgtatatatgtg

SEQ ID NO: 157555 - DNA, 23 bp, Homo sapiens
atatagatacatatacatatgta

SEQ ID NO: 157556 - DNA, 23 bp, Homo sapiens
gtcagattcaagtgagtgtccag

SEQ ID NO: 157557 - DNA, 23 bp, Homo sapiens
taaaacagaattgagagtctaga

SEQ ID NO: 157558 - DNA, 21 bp, Homo sapiens
atgtatgtgtacgtgtatatg

SEQ ID NO: 157559 - DNA, 20 bp, Homo sapiens
tggatatataaacatatatg

SEQ ID NO: 157560 - DNA, 23 bp, Homo sapiens
tgtttggatgtataaacatatat

SEQ ID NO: 157561 - DNA, 23 bp, Homo sapiens
atgtttggatgtataaacatata

SEQ ID NO: 157562 - DNA, 18 bp, Homo sapiens
atacacacacggatatat

SEQ ID NO: 157563 - DNA, 23 bp, Homo sapiens
tgagcacataaatgttagtatct

SEQ ID NO: 157564 - DNA, 23 bp, Homo sapiens
gtgtgtgcgtgtgtgtgcgcctg

SEQ ID NO: 157565 - DNA, 19 bp, Homo sapiens
agatatgtatgatatatat

SEQ ID NO: 157566 - DNA, 20 bp, Homo sapiens
ttaacactgggactcatggg

SEQ ID NO: 157567 - DNA, 23 bp, Homo sapiens
ttttttggttccatatgaaattt

SEQ ID NO: 157568 - DNA, 21 bp, Homo sapiens
tgtgtatatacatatttgtgt

SEQ ID NO: 157569 - DNA, 23 bp, Homo sapiens
tttttgtgtggttgtgagagagg

SEQ ID NO: 157570 - DNA, 23 bp, Homo sapiens
tctagcttcaataaagcaatgta

SEQ ID NO: 157571 - DNA, 23 bp, Homo sapiens
atgacatgactctgtgtgtgtgt

SEQ ID NO: 157572 - DNA, 23 bp, Homo sapiens
ctgagtctcgcactgtctcccag

SEQ ID NO: 157573 - DNA, 23 bp, Homo sapiens
agagagtgcagcaccagcactct

SEQ ID NO: 157574 - DNA, 23 bp, Homo sapiens
tttgagacggagttttgctcttg

SEQ ID NO: 157575 - DNA, 22 bp, Homo sapiens
agagttggtttacttgaggcct

SEQ ID NO: 157576 - DNA, 23 bp, Homo sapiens
tgcacatatgtaaagctgtgcat

SEQ ID NO: 157577 - DNA, 21 bp, Homo sapiens
atgtgcatcattaatgcatta

SEQ ID NO: 157578 - DNA, 23 bp, Homo sapiens
tttggaatagtgagcacacatgt

SEQ ID NO: 157579 - DNA, 20 bp, Homo sapiens
atatatgcacaaatacattt

SEQ ID NO: 157580 - DNA, 23 bp, Homo sapiens
tctgcagttagttgaatccagga

SEQ ID NO: 157581 - DNA, 23 bp, Homo sapiens
tacatgagagtagaattgatggg

SEQ ID NO: 157582 - DNA, 23 bp, Homo sapiens
gtggaagacagaacaaactcagg

SEQ ID NO: 157583 - DNA, 22 bp, Homo sapiens
atgttaatcatgttgagcttga

SEQ ID NO: 157584 - DNA, 22 bp, Homo sapiens
cacagtggatgtgttgtgattc

SEQ ID NO: 157585 - DNA, 20 bp, Homo sapiens
tcctggttgatgtggtgata

SEQ ID NO: 157586 - DNA, 18 bp, Homo sapiens
atactttaagttttaggg

SEQ ID NO: 157587 - DNA, 23 bp, Homo sapiens
aaccaactacaaccagcactgga

SEQ ID NO: 157588 - DNA, 20 bp, Homo sapiens
tctgtttcaatgaactagtt

SEQ ID NO: 157589 - DNA, 20 bp, Homo sapiens
tagatagatatatagatatg

SEQ ID NO: 157590 - DNA, 23 bp, Homo sapiens
acagagtctcactctgtcgccca

SEQ ID NO: 157591 - DNA, 23 bp, Homo sapiens
agagtctcactctgtcacccagg

SEQ ID NO: 157592 - DNA, 23 bp, Homo sapiens
gagtctcactctgtcacccaggc

SEQ ID NO: 157593 - DNA, 23 bp, Homo sapiens
ttcatgcatatgtatatgtgtgt

SEQ ID NO: 157594 - DNA, 19 bp, Homo sapiens
acacacacccatatacatg

SEQ ID NO: 157595 - DNA, 18 bp, Homo sapiens
atatgttacatatatatg

SEQ ID NO: 157596 - DNA, 23 bp, Homo sapiens
ttaatgtcactatgcaatcgttg

SEQ ID NO: 157597 - DNA, 23 bp, Homo sapiens
ttcttgtcaaatgggaatagatg

SEQ ID NO: 157598 - DNA, 23 bp, Homo sapiens
taaaatcttccttgtgtttgtga

SEQ ID NO: 157599 - DNA, 23 bp, Homo sapiens
gggtctcactctgtcacccaggc

SEQ ID NO: 157600 - DNA, 23 bp, Homo sapiens
gggtctcactctgtcacccaggc

SEQ ID NO: 157601 - DNA, 21 bp, Homo sapiens
tttttcttcttttcctagcca

SEQ ID NO: 157602 - DNA, 20 bp, Homo sapiens
atgtatatatatacgtatac

SEQ ID NO: 157603 - DNA, 23 bp, Homo sapiens
tatatgtatatgtatacgtatac

SEQ ID NO: 157604 - DNA, 23 bp, Homo sapiens
gagacggagtctcgctctgtccc

SEQ ID NO: 157605 - DNA, 23 bp, Homo sapiens
gggtctcactctgtcacccaggc

SEQ ID NO: 157606 - DNA, 23 bp, Homo sapiens
gggtctcactctgtcacccaggc

SEQ ID NO: 157607 - DNA, 18 bp, Homo sapiens
gagaaggagtctctctct

SEQ ID NO: 157608 - DNA, 18 bp, Homo sapiens
tccccagtagttgggatt

SEQ ID NO: 157609 - DNA, 23 bp, Homo sapiens
gtgacagagcgagactctgtctc

SEQ ID NO: 157610 - DNA, 21 bp, Homo sapiens
aactcagcacacagagctcat

SEQ ID NO: 157611 - DNA, 23 bp, Homo sapiens
aatttctgtttttctacatctgt

SEQ ID NO: 157612 - DNA, 23 bp, Homo sapiens
gggagtctcactctgtcacccag

SEQ ID NO: 157613 - DNA, 22 bp, Homo sapiens
acgcatgtatacatatatgtgt

SEQ ID NO: 157614 - DNA, 23 bp, Homo sapiens
tgtgcgtgtaaatggtactgtta

SEQ ID NO: 157615 - DNA, 23 bp, Homo sapiens
tgtttatacacattgggttgggt

SEQ ID NO: 157616 - DNA, 23 bp, Homo sapiens
tgagatggagtctcactctgtcg

SEQ ID NO: 157617 - DNA, 23 bp, Homo sapiens
atgagattatggttagagagaaa

SEQ ID NO: 157618 - DNA, 21 bp, Homo sapiens
tgagaagaaagtcaatggtag

SEQ ID NO: 157619 - DNA, 23 bp, Homo sapiens
atgagattatggttagagagaaa

SEQ ID NO: 157620 - DNA, 21 bp, Homo sapiens
aaatggttgaaaacagatata

SEQ ID NO: 157621 - DNA, 18 bp, Homo sapiens
tttctgcttccatgttta

SEQ ID NO: 157622 - DNA, 23 bp, Homo sapiens
tcttctgttagttacattaatct

SEQ ID NO: 157623 - DNA, 23 bp, Homo sapiens
tttaaagagcttggtgagtcaat

SEQ ID NO: 157624 - DNA, 19 bp, Homo sapiens
tgaggaaatgagttggact

SEQ ID NO: 157625 - DNA, 19 bp, Homo sapiens
agtgcagtagtatgatctt

SEQ ID NO: 157626 - DNA, 22 bp, Homo sapiens
taatctgtatatatatatgtat

SEQ ID NO: 157627 - DNA, 23 bp, Homo sapiens
tatgtatatatgtatgtgtatat

SEQ ID NO: 157628 - DNA, 21 bp, Homo sapiens
tatgtatatatgtatatgtgt

SEQ ID NO: 157629 - DNA, 23 bp, Homo sapiens
gataaagtctcgctctgtcaccc

SEQ ID NO: 157630 - DNA, 23 bp, Homo sapiens
tgtctctgtgcacctgcatctgc

SEQ ID NO: 157631 - DNA, 18 bp, Homo sapiens
acagatgctggactgaag

SEQ ID NO: 157632 - DNA, 23 bp, Homo sapiens
agagcagtctccccagaaattat

SEQ ID NO: 157633 - DNA, 23 bp, Homo sapiens
cttttctgaggtttgttgtgtgt

SEQ ID NO: 157634 - DNA, 22 bp, Homo sapiens
taacagtgagagggtaggcttt

SEQ ID NO: 157635 - DNA, 23 bp, Homo sapiens
tgtgtgtgtgtatatatgctctc

SEQ ID NO: 157636 - DNA, 23 bp, Homo sapiens
ctctctctatatatggtgtatgt

SEQ ID NO: 157637 - DNA, 23 bp, Homo sapiens
tacatagtatatgtatatgtgta

SEQ ID NO: 157638 - DNA, 21 bp, Homo sapiens
atatgtgtacatatatgtatg

SEQ ID NO: 157639 - DNA, 23 bp, Homo sapiens
tacatagtatatgtatatgtgta

SEQ ID NO: 157640 - DNA, 23 bp, Homo sapiens
tgtgtgtgtgcacgtgcatgtgt

SEQ ID NO: 157641 - DNA, 20 bp, Homo sapiens
tgtcccaggtgcagctgcag

SEQ ID NO: 157642 - DNA, 23 bp, Homo sapiens
actgtgggtctctctgttcacag

SEQ ID NO: 157643 - DNA, 20 bp, Homo sapiens
tgtgtgtgtgtgtgtatata

SEQ ID NO: 157644 - DNA, 23 bp, Homo sapiens
tatatgttgattttgtatcctgc

SEQ ID NO: 157645 - DNA, 23 bp, Homo sapiens
ttctgctctgtgcaaatgcttgt

SEQ ID NO: 157646 - DNA, 20 bp, Homo sapiens
aagagtcttgctctgtcacc

SEQ ID NO: 157647 - DNA, 21 bp, Homo sapiens
taaagaaaagtttgtagaatg

SEQ ID NO: 157648 - DNA, 23 bp, Homo sapiens
tcactctgttgctcagactgggg

SEQ ID NO: 157649 - DNA, 21 bp, Homo sapiens
tgagaagaaagtcaatggtag

SEQ ID NO: 157650 - DNA, 23 bp, Homo sapiens
atgagattatggttagagagaaa

SEQ ID NO: 157651 - DNA, 23 bp, Homo sapiens
tcttctgttagttacattaatct

SEQ ID NO: 157652 - DNA, 23 bp, Homo sapiens
tttaaagagcttggtgagtcaat

SEQ ID NO: 157653 - DNA, 19 bp, Homo sapiens
tgaggaaatgagttggact

SEQ ID NO: 157654 - DNA, 22 bp, Homo sapiens
tcactcactgagcttttcctca

SEQ ID NO: 157655 - DNA, 23 bp, Homo sapiens
agacagtctcgctctgtcaccca

SEQ ID NO: 157656 - DNA, 22 bp, Homo sapiens
aaattcttgcttgttttcagag

SEQ ID NO: 157657 - DNA, 21 bp, Homo sapiens
ttcacagtgtgattttgtttt

SEQ ID NO: 157658 - DNA, 20 bp, Homo sapiens
agagacaggggtctcagtat

SEQ ID NO: 157659 - DNA, 23 bp, Homo sapiens
ttgggtcaaagagaaaattggca

SEQ ID NO: 157660 - DNA, 21 bp, Homo sapiens
aaagacaggctggtttgcagt

SEQ ID NO: 157661 - DNA, 23 bp, Homo sapiens
tgttttttgttttgagacacagt

SEQ ID NO: 157662 - DNA, 21 bp, Homo sapiens
agggatgaagatgccgcggtg

SEQ ID NO: 157663 - DNA, 20 bp, Homo sapiens
tatagcatgtctatacttat

SEQ ID NO: 157664 - DNA, 22 bp, Homo sapiens
atgtagtgtgtatgtatatatg

SEQ ID NO: 157665 - DNA, 19 bp, Homo sapiens
aggaaatcagagtgggcat

SEQ ID NO: 157666 - DNA, 23 bp, Homo sapiens
tctatctgacactcagttccctg

SEQ ID NO: 157667 - DNA, 19 bp, Homo sapiens
tgagactggacacaggggc

SEQ ID NO: 157668 - DNA, 23 bp, Homo sapiens
actggccactggctctcttctgc

SEQ ID NO: 157669 - DNA, 19 bp, Homo sapiens
ccggctctgacagtgcctg

SEQ ID NO: 157670 - DNA, 18 bp, Homo sapiens
agaatttcctttgccagt

SEQ ID NO: 157671 - DNA, 23 bp, Homo sapiens
agatggagtctcactctgtcacc

SEQ ID NO: 157672 - DNA, 23 bp, Homo sapiens
tggagtctcactctgtcacccag

SEQ ID NO: 157673 - DNA, 21 bp, Homo sapiens
atgacacgcagcattgtggag

SEQ ID NO: 157674 - DNA, 23 bp, Homo sapiens
ttgggagggtccctgtctgcctg

SEQ ID NO: 157675 - DNA, 23 bp, Homo sapiens
tgggtctctgtctcagtgctcag

SEQ ID NO: 157676 - DNA, 18 bp, Homo sapiens
acagaagccagtgaggag

SEQ ID NO: 157677 - DNA, 21 bp, Homo sapiens
tgtcagtgaactccagggact

SEQ ID NO: 157678 - DNA, 23 bp, Homo sapiens
gagtgtttgttgttctcacactg

SEQ ID NO: 157679 - DNA, 23 bp, Homo sapiens
gacagagtctcgctctgtcaccc

SEQ ID NO: 157680 - DNA, 23 bp, Homo sapiens
gagaccctgtctctaaatgtatt

SEQ ID NO: 157681 - DNA, 23 bp, Homo sapiens
ccagagtctcgctctgtcacccg

SEQ ID NO: 157682 - DNA, 23 bp, Homo sapiens
agagagtctcgctctgtcaccca

SEQ ID NO: 157683 - DNA, 23 bp, Homo sapiens
aggctctctctgtctctgttcgc

SEQ ID NO: 157684 - DNA, 23 bp, Homo sapiens
ctctgtgtctctgtccctgtgtc

SEQ ID NO: 157685 - DNA, 23 bp, Homo sapiens
acaggatctctcactctgtcgcc

SEQ ID NO: 157686 - DNA, 22 bp, Homo sapiens
aatcggtttgcttcttgttaga

SEQ ID NO: 157687 - DNA, 18 bp, Homo sapiens
tggcaccatcttaggtca

SEQ ID NO: 157688 - DNA, 23 bp, Homo sapiens
tgagtctcactctgtcacccagg

SEQ ID NO: 157689 - DNA, 23 bp, Homo sapiens
tcctccagctctgtgacaggaca

SEQ ID NO: 157690 - DNA, 23 bp, Homo sapiens
ttatttctgacattttgatctga

SEQ ID NO: 157691 - DNA, 23 bp, Homo sapiens
tgtgatggagcttgtctgtagtc

SEQ ID NO: 157692 - DNA, 23 bp, Homo sapiens
ttgtttgttttggtagagatggg

SEQ ID NO: 157693 - DNA, 23 bp, Homo sapiens
tccacccagagtgtctgctgtgt

SEQ ID NO: 157694 - DNA, 18 bp, Homo sapiens
cagccacacacaccctca

SEQ ID NO: 157695 - DNA, 23 bp, Homo sapiens
ccctctgagaggctcactgggtc

SEQ ID NO: 157696 - DNA, 23 bp, Homo sapiens
gcccctctgtctgcctgtgtccc

SEQ ID NO: 157697 - DNA, 23 bp, Homo sapiens
ctctgtctgtctgtctgtctgcc

SEQ ID NO: 157698 - DNA, 22 bp, Homo sapiens
agatggggtctctctctgtcac

SEQ ID NO: 157699 - DNA, 22 bp, Homo sapiens
gacccacagactgtgactgtgt

SEQ ID NO: 157700 - DNA, 23 bp, Homo sapiens
gagctctgtgactctgtcacatc

SEQ ID NO: 157701 - DNA, 23 bp, Homo sapiens
tttgttacttttagtagaggcag

SEQ ID NO: 157702 - DNA, 23 bp, Homo sapiens
attcctgtaactgcagctacttg

SEQ ID NO: 157703 - DNA, 22 bp, Homo sapiens
ctgaggtaagaggatcacttga

SEQ ID NO: 157704 - DNA, 23 bp, Homo sapiens
tcggtgggtctctccctgtgtgt

SEQ ID NO: 157705 - DNA, 19 bp, Homo sapiens
gtatgatgtctgactccag

SEQ ID NO: 157706 - DNA, 23 bp, Homo sapiens
tggtctgtctgtctgtgccacag

SEQ ID NO: 157707 - DNA, 23 bp, Homo sapiens
gagtctcccactgtcacccaggc

SEQ ID NO: 157708 - DNA, 23 bp, Homo sapiens
ataaatcagtacgtttttctatg

SEQ ID NO: 157709 - DNA, 23 bp, Homo sapiens
tgcagtctcgctctgtcacccag

SEQ ID NO: 157710 - DNA, 23 bp, Homo sapiens
ccatctgtgacagcttcttgatc

SEQ ID NO: 157711 - DNA, 23 bp, Homo sapiens
gggtctcactcagtcacccaggc

SEQ ID NO: 157712 - DNA, 23 bp, Homo sapiens
aagtaagttggagtccaggtgca

SEQ ID NO: 157713 - DNA, 19 bp, Homo sapiens
atgcctgtaatcccagcac

SEQ ID NO: 157714 - DNA, 23 bp, Homo sapiens
cctgtctcactgtctctgtctct

SEQ ID NO: 157715 - DNA, 23 bp, Homo sapiens
agtccttcactctctgtctctaa

SEQ ID NO: 157716 - DNA, 18 bp, Homo sapiens
atatacatgtatgcacat

SEQ ID NO: 157717 - DNA, 23 bp, Homo sapiens
ctcactctgtcacccagactgga

SEQ ID NO: 157718 - DNA, 23 bp, Homo sapiens
gtttttatttcttttggaaggag

SEQ ID NO: 157719 - DNA, 23 bp, Homo sapiens
agagtctcactctgtcacccagg

SEQ ID NO: 157720 - DNA, 23 bp, Homo sapiens
aggtacatatttgtatgtgtata

SEQ ID NO: 157721 - DNA, 23 bp, Homo sapiens
agagtctcactctgtcacccagg

SEQ ID NO: 157722 - DNA, 21 bp, Homo sapiens
tcagcctctgagtaactggga

SEQ ID NO: 157723 - DNA, 23 bp, Homo sapiens
tggagtctcactctgtcacccag

SEQ ID NO: 157724 - DNA, 18 bp, Homo sapiens
acagtggtgcgatctcag

SEQ ID NO: 157725 - DNA, 23 bp, Homo sapiens
ggtcagtcactagctctgtgcct

SEQ ID NO: 157726 - DNA, 23 bp, Homo sapiens
atggtgctgctcactgcccaagc

SEQ ID NO: 157727 - DNA, 22 bp, Homo sapiens
tgtgagtcagcacacactgagg

SEQ ID NO: 157728 - DNA, 23 bp, Homo sapiens
cagagtctcactctgtcatccag

SEQ ID NO: 157729 - DNA, 23 bp, Homo sapiens
agctgagagaggtgagtgagcag

SEQ ID NO: 157730 - DNA, 21 bp, Homo sapiens
tgaggtggaaggatgacttgt

SEQ ID NO: 157731 - DNA, 19 bp, Homo sapiens
acagtctcactctgtcacc

SEQ ID NO: 157732 - DNA, 23 bp, Homo sapiens
tgtctgtctgtctgtctgtttct

SEQ ID NO: 157733 - DNA, 22 bp, Homo sapiens
tgggtccctccctggctgcctg

SEQ ID NO: 157734 - DNA, 23 bp, Homo sapiens
tggagtctcactctgtcacccag

SEQ ID NO: 157735 - DNA, 22 bp, Homo sapiens
tatatatgtgtatatctagtag

SEQ ID NO: 157736 - DNA, 21 bp, Homo sapiens
atcagcagctgcacctggctg

SEQ ID NO: 157737 - DNA, 23 bp, Homo sapiens
gagctgagtctcactctgtcgcc

SEQ ID NO: 157738 - DNA, 19 bp, Homo sapiens
gcgagactctctgtctcag

SEQ ID NO: 157739 - DNA, 19 bp, Homo sapiens
actttcagacagagtctca

SEQ ID NO: 157740 - DNA, 23 bp, Homo sapiens
agacagtctccctctgtcaccca

SEQ ID NO: 157741 - DNA, 19 bp, Homo sapiens
aagacagacatggaacgtg

SEQ ID NO: 157742 - DNA, 23 bp, Homo sapiens
ttatgtgtttagtagatgtgtac

SEQ ID NO: 157743 - DNA, 23 bp, Homo sapiens
tccctgtgtgagtgtctgtgtcc

SEQ ID NO: 157744 - DNA, 23 bp, Homo sapiens
tataaatatgtatgtatatgtgt

SEQ ID NO: 157745 - DNA, 23 bp, Homo sapiens
ctgtccctctctctgaatgtggt

SEQ ID NO: 157746 - DNA, 23 bp, Homo sapiens
gcatgtctctagattgtgagctc

SEQ ID NO: 157747 - DNA, 20 bp, Homo sapiens
tggatgtcaactgaaggtgt

SEQ ID NO: 157748 - DNA, 23 bp, Homo sapiens
tgtgtatgtgcatgtgcatgtgt

SEQ ID NO: 157749 - DNA, 20 bp, Homo sapiens
tatatgtaagtagtatagtt

SEQ ID NO: 157750 - DNA, 18 bp, Homo sapiens
atatctatatatgtatat

SEQ ID NO: 157751 - DNA, 20 bp, Homo sapiens
gagtctcattcactgtctca

SEQ ID NO: 157752 - DNA, 23 bp, Homo sapiens
aatcttcatgaaagtggtttgcc

SEQ ID NO: 157753 - DNA, 22 bp, Homo sapiens
aagggtctgggtgacttggctg

SEQ ID NO: 157754 - DNA, 23 bp, Homo sapiens
gacagagtctcgctctgtcaccc

SEQ ID NO: 157755 - DNA, 23 bp, Homo sapiens
ccgctcactgtgacctctgcctc

SEQ ID NO: 157756 - DNA, 22 bp, Homo sapiens
tgtgtatatatgtgtgtgtata

SEQ ID NO: 157757 - DNA, 23 bp, Homo sapiens
atatatgtgtatatatatgtgtg

SEQ ID NO: 157758 - DNA, 18 bp, Homo sapiens
tgttctgacattgatgtt

SEQ ID NO: 157759 - DNA, 23 bp, Homo sapiens
tgcatgtgtgtgtgtgtgtgtgt

SEQ ID NO: 157760 - DNA, 19 bp, Homo sapiens
agatgaatgcatagcctgt

SEQ ID NO: 157761 - DNA, 23 bp, Homo sapiens
gagagtctcgctctgtcacccag

SEQ ID NO: 157762 - DNA, 23 bp, Homo sapiens
atatactatcctatacaatagaa

SEQ ID NO: 157763 - DNA, 23 bp, Homo sapiens
aatccacagatgagtgtgtccag

SEQ ID NO: 157764 - DNA, 22 bp, Homo sapiens
ctgtcagggtgaaaccctgtct

SEQ ID NO: 157765 - DNA, 23 bp, Homo sapiens
gtctctctgagtttatggagttg

SEQ ID NO: 157766 - DNA, 23 bp, Homo sapiens
cgtgcatgtgtgtgtgtgtgcac

SEQ ID NO: 157767 - DNA, 23 bp, Homo sapiens
tctgcgtgtgtgcatgtgcatgt

SEQ ID NO: 157768 - DNA, 23 bp, Homo sapiens
gtatgtgcttgtgtatatgtgtg

SEQ ID NO: 157769 - DNA, 23 bp, Homo sapiens
agatggagtctcactctgtcacc

SEQ ID NO: 157770 - DNA, 23 bp, Homo sapiens
tattttgtgacggaatcttgctc

SEQ ID NO: 157771 - DNA, 19 bp, Homo sapiens
actcttgctctgtcactca

SEQ ID NO: 157772 - DNA, 19 bp, Homo sapiens
cagactcactgtgtcgccc

SEQ ID NO: 157773 - DNA, 20 bp, Homo sapiens
tatgcatgtatatatgtatc

SEQ ID NO: 157774 - DNA, 18 bp, Homo sapiens
taagttcttgacatctgt

SEQ ID NO: 157775 - DNA, 23 bp, Homo sapiens
tgagttcattgtagattctggat

SEQ ID NO: 157776 - DNA, 23 bp, Homo sapiens
tgagttcattgtagattctggat

SEQ ID NO: 157777 - DNA, 23 bp, Homo sapiens
ttttggttccatatgaattgttt

SEQ ID NO: 157778 - DNA, 22 bp, Homo sapiens
tgatatgatatatatatgtgta

SEQ ID NO: 157779 - DNA, 22 bp, Homo sapiens
attctctaaggaagattggtct

SEQ ID NO: 157780 - DNA, 23 bp, Homo sapiens
tagttcaagagattctcctgcct

SEQ ID NO: 157781 - DNA, 21 bp, Homo sapiens
tctctgggtctcagagttccc

SEQ ID NO: 157782 - DNA, 19 bp, Homo sapiens
gaactggggctggtgctga

SEQ ID NO: 157783 - DNA, 22 bp, Homo sapiens
tttgtcactgggtgaactatta

SEQ ID NO: 157784 - DNA, 23 bp, Homo sapiens
tatgtgtatatatatgtgtgtgt

SEQ ID NO: 157785 - DNA, 22 bp, Homo sapiens
tggctcacacctgtaatcccag

SEQ ID NO: 157786 - DNA, 18 bp, Homo sapiens
tgaaacactgcacctggt

SEQ ID NO: 157787 - DNA, 23 bp, Homo sapiens
tggagtctcgctctgtctcccag

SEQ ID NO: 157788 - DNA, 23 bp, Homo sapiens
cagttgagtgccatcactcctgg

SEQ ID NO: 157789 - DNA, 22 bp, Homo sapiens
tatatgcatattatatgagttt

SEQ ID NO: 157790 - DNA, 23 bp, Homo sapiens
tctcagtgaccctgtgaggcaga

SEQ ID NO: 157791 - DNA, 23 bp, Homo sapiens
tgtgtgtatatatatatgtgtgt

SEQ ID NO: 157792 - DNA, 20 bp, Homo sapiens
tgtatatatgtatacatgtg

SEQ ID NO: 157793 - DNA, 23 bp, Homo sapiens
gcctgtagtcccagctgcttaag

SEQ ID NO: 157794 - DNA, 22 bp, Homo sapiens
caacacagtgatcagagagcac

SEQ ID NO: 157795 - DNA, 22 bp, Homo sapiens
aatggaaagaagagagatgtat

SEQ ID NO: 157796 - DNA, 19 bp, Homo sapiens
tgagacagagtctcactct

SEQ ID NO: 157797 - DNA, 23 bp, Homo sapiens
agtctcactcactctgtcgcctt

SEQ ID NO: 157798 - DNA, 18 bp, Homo sapiens
ttgagatttagaagttgt

SEQ ID NO: 157799 - DNA, 22 bp, Homo sapiens
ttgagcccaggaattcaaggct

SEQ ID NO: 157800 - DNA, 23 bp, Homo sapiens
agctagagtctccctctgtcacc

SEQ ID NO: 157801 - DNA, 22 bp, Homo sapiens
caatggctctgtctcagctcac

SEQ ID NO: 157802 - DNA, 23 bp, Homo sapiens
gagacagagtctcgctctgtcac

SEQ ID NO: 157803 - DNA, 22 bp, Homo sapiens
tttctctgatgactgtgaggac

SEQ ID NO: 157804 - DNA, 23 bp, Homo sapiens
tatagtagtatgttgaatagaag

SEQ ID NO: 157805 - DNA, 23 bp, Homo sapiens
tctgtgacagcttcttgatctgt

SEQ ID NO: 157806 - DNA, 23 bp, Homo sapiens
acagattctcactctgtctccca

SEQ ID NO: 157807 - DNA, 23 bp, Homo sapiens
tgtgtgtctctgtgggtctctcc

SEQ ID NO: 157808 - DNA, 19 bp, Homo sapiens
ctgtgacattagaagtaat

SEQ ID NO: 157809 - DNA, 23 bp, Homo sapiens
atatgtgtatatatgaatgtgta

SEQ ID NO: 157810 - DNA, 22 bp, Homo sapiens
agcagcacaacctcaagtcagt

SEQ ID NO: 157811 - DNA, 23 bp, Homo sapiens
tcagtttccatgttgagggtgag

SEQ ID NO: 157812 - DNA, 23 bp, Homo sapiens
gggtctcactctgtcactcaggc

SEQ ID NO: 157813 - DNA, 23 bp, Homo sapiens
agtacatatgtatgtatatatgt

SEQ ID NO: 157814 - DNA, 23 bp, Homo sapiens
gccagagtctcgctctgtcaccc

SEQ ID NO: 157815 - DNA, 23 bp, Homo sapiens
gacagagagaacagaatgtggag

SEQ ID NO: 157816 - DNA, 23 bp, Homo sapiens
acagggtctcgctctgtcgctca

SEQ ID NO: 157817 - DNA, 18 bp, Homo sapiens
cctgtagtcccagctact

SEQ ID NO: 157818 - DNA, 19 bp, Homo sapiens
cacctgtagtctcagctac

SEQ ID NO: 157819 - DNA, 23 bp, Homo sapiens
agggactgtctctctctgttgcc

SEQ ID NO: 157820 - DNA, 18 bp, Homo sapiens
aggatcgtgatcatggcc

SEQ ID NO: 157821 - DNA, 23 bp, Homo sapiens
ttttagtctgttcagattctgat

SEQ ID NO: 157822 - DNA, 23 bp, Homo sapiens
tttagttgctaggttgagattta

SEQ ID NO: 157823 - DNA, 23 bp, Homo sapiens
caggaatttgaagctatagtgcg

SEQ ID NO: 157824 - DNA, 22 bp, Homo sapiens
tcagtctcacagtaacttctca

SEQ ID NO: 157825 - DNA, 23 bp, Homo sapiens
gaccagtctgataccctattttg

SEQ ID NO: 157826 - DNA, 20 bp, Homo sapiens
atcagaggctggattgcagg

SEQ ID NO: 157827 - DNA, 19 bp, Homo sapiens
gagctccagtctgtgcatg

SEQ ID NO: 157828 - DNA, 23 bp, Homo sapiens
gctctgagcttgggtctgtgcat

SEQ ID NO: 157829 - DNA, 23 bp, Homo sapiens
ttcccctggctgaatgctctcac

SEQ ID NO: 157830 - DNA, 21 bp, Homo sapiens
actctgtcacccagaatagag

SEQ ID NO: 157831 - DNA, 23 bp, Homo sapiens
aaatgacacgattctttttcttt

SEQ ID NO: 157832 - DNA, 21 bp, Homo sapiens
actctgtcacccagactagag

SEQ ID NO: 157833 - DNA, 23 bp, Homo sapiens
cactctgtcactcagactgcagt

SEQ ID NO: 157834 - DNA, 18 bp, Homo sapiens
actgcaacctctgcgtct

SEQ ID NO: 157835 - DNA, 23 bp, Homo sapiens
cagggtctctctctgtcacccag

SEQ ID NO: 157836 - DNA, 22 bp, Homo sapiens
cacatatgtgtacatatgcatg

SEQ ID NO: 157837 - DNA, 22 bp, Homo sapiens
tatatgtgtgtacatgcaatgt

SEQ ID NO: 157838 - DNA, 23 bp, Homo sapiens
tctctctctctgtacatacacac

SEQ ID NO: 157839 - DNA, 23 bp, Homo sapiens
tgagttcattgtagattctggat

SEQ ID NO: 157840 - DNA, 23 bp, Homo sapiens
tgagttcattgtagattctggat

SEQ ID NO: 157841 - DNA, 19 bp, Homo sapiens
gactgcaggctgtttgttc

SEQ ID NO: 157842 - DNA, 18 bp, Homo sapiens
aatagtctgggtttgtag

SEQ ID NO: 157843 - DNA, 23 bp, Homo sapiens
tctgcctcttactagctatgggt

SEQ ID NO: 157844 - DNA, 23 bp, Homo sapiens
cagtccctgacacagtgcctgtc

SEQ ID NO: 157845 - DNA, 23 bp, Homo sapiens
ataggtagtagcagattccatct

SEQ ID NO: 157846 - DNA, 23 bp, Homo sapiens
acactagttattatgtttctgtg

SEQ ID NO: 157847 - DNA, 23 bp, Homo sapiens
ctctctctcagtctgtgtggccg

SEQ ID NO: 157848 - DNA, 21 bp, Homo sapiens
tctctggcagagagactgggt

SEQ ID NO: 157849 - DNA, 23 bp, Homo sapiens
gacactaacactgtctcttaaaa

SEQ ID NO: 157850 - DNA, 23 bp, Homo sapiens
tagacactgtgtgctatggaaga

SEQ ID NO: 157851 - DNA, 23 bp, Homo sapiens
tgaggtaggaggatcacttgagc

SEQ ID NO: 157852 - DNA, 21 bp, Homo sapiens
gggcgacagtcagactctgtc

SEQ ID NO: 157853 - DNA, 23 bp, Homo sapiens
ggattacaggagtgagtcaccac

SEQ ID NO: 157854 - DNA, 22 bp, Homo sapiens
cgcagtggtacgtgcttgtaat

SEQ ID NO: 157855 - DNA, 19 bp, Homo sapiens
gtgagacactgtgcccggc

SEQ ID NO: 157856 - DNA, 23 bp, Homo sapiens
gacagggtaaatccagagataga

SEQ ID NO: 157857 - DNA, 21 bp, Homo sapiens
tgagacagagtctcgctctgt

SEQ ID NO: 157858 - DNA, 21 bp, Homo sapiens
atcacagagggagtacaccct

SEQ ID NO: 157859 - DNA, 23 bp, Homo sapiens
tatcacagtgggtgtacactctg

SEQ ID NO: 157860 - DNA, 22 bp, Homo sapiens
tatcacagtgggtgtacaccct

SEQ ID NO: 157861 - DNA, 21 bp, Homo sapiens
agagtctcattctgtcactca

SEQ ID NO: 157862 - DNA, 22 bp, Homo sapiens
atgcctgtagtcccagcagttt

SEQ ID NO: 157863 - DNA, 22 bp, Homo sapiens
tcagtctgtgtgaattacatct

SEQ ID NO: 157864 - DNA, 23 bp, Homo sapiens
tcctggcactctctgtatctgtc

SEQ ID NO: 157865 - DNA, 23 bp, Homo sapiens
gagacacagtctggctctgtcgc

SEQ ID NO: 157866 - DNA, 22 bp, Homo sapiens
gggtgtggtggtgcacctcagt

SEQ ID NO: 157867 - DNA, 23 bp, Homo sapiens
gggtctcactctgtcacccaggc

SEQ ID NO: 157868 - DNA, 23 bp, Homo sapiens
ttagagtcagggtctcactctgt

SEQ ID NO: 157869 - DNA, 22 bp, Homo sapiens
tctcgctctgtctcccaggctg

SEQ ID NO: 157870 - DNA, 18 bp, Homo sapiens
ttcagtggtgtgatctca

SEQ ID NO: 157871 - DNA, 19 bp, Homo sapiens
ttgagacagtcttgctctg

SEQ ID NO: 157872 - DNA, 23 bp, Homo sapiens
ctgccactctcagactgtctctg

SEQ ID NO: 157873 - DNA, 23 bp, Homo sapiens
gccagagtctcgctctgtcaccc

SEQ ID NO: 157874 - DNA, 18 bp, Homo sapiens
ggcagtgtgtgatcttgg

SEQ ID NO: 157875 - DNA, 20 bp, Homo sapiens
aacagctgatggtggaggtt

SEQ ID NO: 157876 - DNA, 23 bp, Homo sapiens
tgtatgtatctatgaatttgtct

SEQ ID NO: 157877 - DNA, 19 bp, Homo sapiens
ataaagcatctggtatagt

SEQ ID NO: 157878 - DNA, 23 bp, Homo sapiens
gggactgagtctcactctgtcac

SEQ ID NO: 157879 - DNA, 23 bp, Homo sapiens
atgacagaggaatgtttgtttca

SEQ ID NO: 157880 - DNA, 23 bp, Homo sapiens
tgagatggagtctcactctgtca

SEQ ID NO: 157881 - DNA, 22 bp, Homo sapiens
tatcacagtgggtgtacaccct

SEQ ID NO: 157882 - DNA, 22 bp, Homo sapiens
cagagcaagacactgtctctgt

SEQ ID NO: 157883 - DNA, 23 bp, Homo sapiens
tgacactgcatctgcttctggtg

SEQ ID NO: 157884 - DNA, 23 bp, Homo sapiens
cttgtctgtgacagtttttcatt

SEQ ID NO: 157885 - DNA, 23 bp, Homo sapiens
gttttgactattatttaaagtgt

SEQ ID NO: 157886 - DNA, 22 bp, Homo sapiens
tgcctggctccaagtaaggtct

SEQ ID NO: 157887 - DNA, 23 bp, Homo sapiens
tccgtgaagaaagtcaatggtag

SEQ ID NO: 157888 - DNA, 23 bp, Homo sapiens
tgagttcattgtagattctggat

SEQ ID NO: 157889 - DNA, 23 bp, Homo sapiens
tgagttcattgtagattctggat

SEQ ID NO: 157890 - DNA, 18 bp, Homo sapiens
tgtggcagtgaataagtc

SEQ ID NO: 157891 - DNA, 23 bp, Homo sapiens
tgtgtgtatatatatatatgtgt

SEQ ID NO: 157892 - DNA, 22 bp, Homo sapiens
tatgtgtatatatatatgtata

SEQ ID NO: 157893 - DNA, 22 bp, Homo sapiens
atatgtgtatatacatatgtgt

SEQ ID NO: 157894 - DNA, 23 bp, Homo sapiens
tatgtgtatatacatatatgtgt

SEQ ID NO: 157895 - DNA, 23 bp, Homo sapiens
tgtgtgtatatatatatgtgtgt

SEQ ID NO: 157896 - DNA, 23 bp, Homo sapiens
tggagtctcactctgtcacccag

SEQ ID NO: 157897 - DNA, 23 bp, Homo sapiens
attggtgatacagcaaaggatct

SEQ ID NO: 157898 - DNA, 22 bp, Homo sapiens
tatctctggctgacaaatgggg

SEQ ID NO: 157899 - DNA, 23 bp, Homo sapiens
tggagtctcactctgtcacccag

SEQ ID NO: 157900 - DNA, 21 bp, Homo sapiens
taactcactcaatttctagtc

SEQ ID NO: 157901 - DNA, 22 bp, Homo sapiens
gatgtatgtatgtatgtatgta

SEQ ID NO: 157902 - DNA, 22 bp, Homo sapiens
tatgcacatgtacgtgtacaca

SEQ ID NO: 157903 - DNA, 23 bp, Homo sapiens
atgtgtgtacatgtacatatgta

SEQ ID NO: 157904 - DNA, 23 bp, Homo sapiens
tttgagaccgagtctcgctctcg

SEQ ID NO: 157905 - DNA, 23 bp, Homo sapiens
tcctggcactctctgtatctgtc

SEQ ID NO: 157906 - DNA, 18 bp, Homo sapiens
agagttttgaatttcatt

SEQ ID NO: 157907 - DNA, 23 bp, Homo sapiens
taagatggagtctcgctctgtca

SEQ ID NO: 157908 - DNA, 21 bp, Homo sapiens
agtgactgagcaaacagtcct

SEQ ID NO: 157909 - DNA, 23 bp, Homo sapiens
aaacatggtggttaagaactctt

SEQ ID NO: 157910 - DNA, 23 bp, Homo sapiens
tgtgtctgtgtctgtgtctgtgt

SEQ ID NO: 157911 - DNA, 19 bp, Homo sapiens
taggacctgtgtgaatttg

SEQ ID NO: 157912 - DNA, 22 bp, Homo sapiens
tgagtctccctctgtcacccag

SEQ ID NO: 157913 - DNA, 23 bp, Homo sapiens
tgagttcattgtagattctggat

SEQ ID NO: 157914 - DNA, 23 bp, Homo sapiens
tgagttcattgtagattctggat

SEQ ID NO: 157915 - DNA, 23 bp, Homo sapiens
tgtctgtgtagaaagtagaagac

SEQ ID NO: 157916 - DNA, 23 bp, Homo sapiens
ttttctctgcctcagctagggtc

SEQ ID NO: 157917 - DNA, 23 bp, Homo sapiens
tggagtctcactctgtcacccag

SEQ ID NO: 157918 - DNA, 23 bp, Homo sapiens
gacaaggtctcactctgtcaccc

SEQ ID NO: 157919 - DNA, 23 bp, Homo sapiens
tctctctatttctctgtcaccca

SEQ ID NO: 157920 - DNA, 21 bp, Homo sapiens
cagtggcatgatcatggctca

SEQ ID NO: 157921 - DNA, 23 bp, Homo sapiens
tgtgactgtctctcaggttttgc

SEQ ID NO: 157922 - DNA, 20 bp, Homo sapiens
tctaacaccatgtccatgtg

SEQ ID NO: 157923 - DNA, 18 bp, Homo sapiens
gaagagagagaatgggga

SEQ ID NO: 157924 - DNA, 20 bp, Homo sapiens
tctcatattaactcactcac

SEQ ID NO: 157925 - DNA, 22 bp, Homo sapiens
tgtgtccctactgtttgctttg

SEQ ID NO: 157926 - DNA, 23 bp, Homo sapiens
ttctctgtcactctgggactcct

SEQ ID NO: 157927 - DNA, 19 bp, Homo sapiens
actggagtcaagggagcag

SEQ ID NO: 157928 - DNA, 23 bp, Homo sapiens
acacatctactacaaatatgaat

SEQ ID NO: 157929 - DNA, 18 bp, Homo sapiens
ctctcactgtcacgccct

SEQ ID NO: 157930 - DNA, 18 bp, Homo sapiens
gtgaggctggatggcagg

SEQ ID NO: 157931 - DNA, 22 bp, Homo sapiens
tgtctggctgagaggctgcctg

SEQ ID NO: 157932 - DNA, 23 bp, Homo sapiens
gtggctgcctggctgagaggctg

SEQ ID NO: 157933 - DNA, 23 bp, Homo sapiens
tctcactctcttactctgtcacc

SEQ ID NO: 157934 - DNA, 23 bp, Homo sapiens
tgagttcattgtagattctggat

SEQ ID NO: 157935 - DNA, 23 bp, Homo sapiens
tgagttcattgtagattctggat

SEQ ID NO: 157936 - DNA, 23 bp, Homo sapiens
agagagtctcgctctgtcaccca

SEQ ID NO: 157937 - DNA, 21 bp, Homo sapiens
gatatgtatatgtatctatgt

SEQ ID NO: 157938 - DNA, 20 bp, Homo sapiens
atatgtatatatatatgtgt

SEQ ID NO: 157939 - DNA, 23 bp, Homo sapiens
gtacccttctctccctgtctggc

SEQ ID NO: 157940 - DNA, 23 bp, Homo sapiens
agacagaagacagtcttgaggga

SEQ ID NO: 157941 - DNA, 23 bp, Homo sapiens
gtggtggtgcacctgtagtccca

SEQ ID NO: 157942 - DNA, 23 bp, Homo sapiens
tggagtctcactctgtcacccag

SEQ ID NO: 157943 - DNA, 23 bp, Homo sapiens
atagatatacatgtattcttttc

SEQ ID NO: 157944 - DNA, 19 bp, Homo sapiens
ggtaggaggatcgcttgaa

SEQ ID NO: 157945 - DNA, 23 bp, Homo sapiens
ttgcagtgagccaagatcgtgcc

SEQ ID NO: 157946 - DNA, 23 bp, Homo sapiens
tgaacaacaatgtgaatgcactt

SEQ ID NO: 157947 - DNA, 23 bp, Homo sapiens
cagagcaagaccctgtctctact

SEQ ID NO: 157948 - DNA, 19 bp, Homo sapiens
atacctgtagtcccagcta

SEQ ID NO: 157949 - DNA, 22 bp, Homo sapiens
gggtgacagagtgagatcctgt

SEQ ID NO: 157950 - DNA, 23 bp, Homo sapiens
gacagagtctcactctgtcaccc

SEQ ID NO: 157951 - DNA, 23 bp, Homo sapiens
tgagttcattgtagattctggat

SEQ ID NO: 157952 - DNA, 23 bp, Homo sapiens
tgagttcattgtagattctggat

SEQ ID NO: 157953 - DNA, 19 bp, Homo sapiens
tcagtggaagactttctgt

SEQ ID NO: 157954 - DNA, 20 bp, Homo sapiens
tgaatttcagatgaataaca

SEQ ID NO: 157955 - DNA, 23 bp, Homo sapiens
tcattgtttatctgacatttaca

SEQ ID NO: 157956 - DNA, 21 bp, Homo sapiens
tacttctggaggaggtgttat

SEQ ID NO: 157957 - DNA, 23 bp, Homo sapiens
ttgagtgtagagtcagaccactt

SEQ ID NO: 157958 - DNA, 23 bp, Homo sapiens
ggagtctcactctgtcactcagg

SEQ ID NO: 157959 - DNA, 18 bp, Homo sapiens
tgcaacttctgcctcctg

SEQ ID NO: 157960 - DNA, 19 bp, Homo sapiens
tgtatgtacatacgtatat

SEQ ID NO: 157961 - DNA, 23 bp, Homo sapiens
ctgtctcagcctctcaaagtgct

SEQ ID NO: 157962 - DNA, 23 bp, Homo sapiens
ttgagtcagagtttctctctgtc

SEQ ID NO: 157963 - DNA, 21 bp, Homo sapiens
tctctctgtctgtgggtggca

SEQ ID NO: 157964 - DNA, 20 bp, Homo sapiens
tgtctttcttcttacgctgt

SEQ ID NO: 157965 - DNA, 22 bp, Homo sapiens
cagagagacaagagagacacct

SEQ ID NO: 157966 - DNA, 22 bp, Homo sapiens
acacaggttctctctctctctc

SEQ ID NO: 157967 - DNA, 22 bp, Homo sapiens
aagatgcatctcacattgggtg

SEQ ID NO: 157968 - DNA, 23 bp, Homo sapiens
ggcacagagaaatgagtgtgcac

SEQ ID NO: 157969 - DNA, 20 bp, Homo sapiens
caagagggaaactctgtctc

SEQ ID NO: 157970 - DNA, 23 bp, Homo sapiens
acagagtctcgctgtgtcactca

SEQ ID NO: 157971 - DNA, 18 bp, Homo sapiens
tgaggttggaggatcact

SEQ ID NO: 157972 - DNA, 23 bp, Homo sapiens
gactgagtctcgctctgtcaccc

SEQ ID NO: 157973 - DNA, 23 bp, Homo sapiens
tttcatgtgccagattaacattt

SEQ ID NO: 157974 - DNA, 23 bp, Homo sapiens
tatatctggatatatatggttat

SEQ ID NO: 157975 - DNA, 23 bp, Homo sapiens
cagggtctcactctgtcactcag

SEQ ID NO: 157976 - DNA, 19 bp, Homo sapiens
agtgcagtgcagatcattg

SEQ ID NO: 157977 - DNA, 19 bp, Homo sapiens
gtttctccttttttattct

SEQ ID NO: 157978 - DNA, 23 bp, Homo sapiens
atttcaacgtatgaaaagctgtt

SEQ ID NO: 157979 - DNA, 23 bp, Homo sapiens
agtggttcaacgttgtaatctca

SEQ ID NO: 157980 - DNA, 23 bp, Homo sapiens
cacactcacactcagggaaaagc

SEQ ID NO: 157981 - DNA, 23 bp, Homo sapiens
tgcctctgagtttttgatgaaag

SEQ ID NO: 157982 - DNA, 23 bp, Homo sapiens
ttttcctagctagttcttacagg

SEQ ID NO: 157983 - DNA, 23 bp, Homo sapiens
gcaagtatcacaaacagcttggg

SEQ ID NO: 157984 - DNA, 19 bp, Homo sapiens
ttgagacagagtcttgctc

SEQ ID NO: 157985 - DNA, 23 bp, Homo sapiens
tctgtttcatgctgtttgcctca

SEQ ID NO: 157986 - DNA, 23 bp, Homo sapiens
gggtctcactctgtcacccaggc

SEQ ID NO: 157987 - DNA, 22 bp, Homo sapiens
tatttcacagtatgtatattcc

SEQ ID NO: 157988 - DNA, 22 bp, Homo sapiens
ttgagagtctgggaatgaggaa

SEQ ID NO: 157989 - DNA, 23 bp, Homo sapiens
ctgtgcagagagaacagagaatg

SEQ ID NO: 157990 - DNA, 23 bp, Homo sapiens
tgagacagagaagtcagaggcca

SEQ ID NO: 157991 - DNA, 18 bp, Homo sapiens
catccaggatttgaaaag

SEQ ID NO: 157992 - DNA, 23 bp, Homo sapiens
gagtctcactctgtcacccaggc

SEQ ID NO: 157993 - DNA, 21 bp, Homo sapiens
tcagtgactgttacattatag

SEQ ID NO: 157994 - DNA, 23 bp, Homo sapiens
ataggaagacattcacatcatga

SEQ ID NO: 157995 - DNA, 19 bp, Homo sapiens
tggttagaaaagaagtgat

SEQ ID NO: 157996 - DNA, 23 bp, Homo sapiens
acaggatctcgctctgtcaccca

SEQ ID NO: 157997 - DNA, 21 bp, Homo sapiens
tccagaattgttcatgctctt

SEQ ID NO: 157998 - DNA, 23 bp, Homo sapiens
gtgtgtgtgtgtgtatacacaca

SEQ ID NO: 157999 - DNA, 20 bp, Homo sapiens
ctctctcactcacatgctcc

SEQ ID NO: 158000 - DNA, 21 bp, Homo sapiens
agaagcaggtgctgagacaga

SEQ ID NO: 158001 - DNA, 23 bp, Homo sapiens
tgactccgtgagattctgcttct

SEQ ID NO: 158002 - DNA, 23 bp, Homo sapiens
gtgagaggttagggaaagtaaag

SEQ ID NO: 158003 - DNA, 21 bp, Homo sapiens
tgtcatagatgaggagcccta

SEQ ID NO: 158004 - DNA, 22 bp, Homo sapiens
agactcactgggagaatagagg

SEQ ID NO: 158005 - DNA, 23 bp, Homo sapiens
tgtgtgtgtctgtgtcctaatct

SEQ ID NO: 158006 - DNA, 23 bp, Homo sapiens
ttgagatggtgagaggatttttt

SEQ ID NO: 158007 - DNA, 23 bp, Homo sapiens
agacagtgtctcactctgtcacc

SEQ ID NO: 158008 - DNA, 22 bp, Homo sapiens
tgtatatatatacacatacata

SEQ ID NO: 158009 - DNA, 21 bp, Homo sapiens
tatgtgtgtgtatatatatac

SEQ ID NO: 158010 - DNA, 22 bp, Homo sapiens
ctgcctgcctgtctgcctgtga

SEQ ID NO: 158011 - DNA, 20 bp, Homo sapiens
agcagctctctaagcttccc

SEQ ID NO: 158012 - DNA, 23 bp, Homo sapiens
tatttggtagttgtttactgtct

SEQ ID NO: 158013 - DNA, 23 bp, Homo sapiens
aggttgcagtgagccaaggttgt

SEQ ID NO: 158014 - DNA, 19 bp, Homo sapiens
tattcaatatatgtatatg

SEQ ID NO: 158015 - DNA, 22 bp, Homo sapiens
tgagccaccgtgcctggctgag

SEQ ID NO: 158016 - DNA, 23 bp, Homo sapiens
agacagattctcactctgtcacc

SEQ ID NO: 158017 - DNA, 23 bp, Homo sapiens
tgagcctcactctgtcacccagg

SEQ ID NO: 158018 - DNA, 20 bp, Homo sapiens
atcacagcttattgcagcct

SEQ ID NO: 158019 - DNA, 23 bp, Homo sapiens
gactgagtctggctctgtcaccc

SEQ ID NO: 158020 - DNA, 23 bp, Homo sapiens
cagggtctcactctgtcacccag

SEQ ID NO: 158021 - DNA, 23 bp, Homo sapiens
tgagtctcactctgtcacccagg

SEQ ID NO: 158022 - DNA, 22 bp, Homo sapiens
agagtctcgctctgtcacccag

SEQ ID NO: 158023 - DNA, 23 bp, Homo sapiens
gactgagtctggctctgtcaccc

SEQ ID NO: 158024 - DNA, 23 bp, Homo sapiens
cagggtctcactctgtcacccag

SEQ ID NO: 158025 - DNA, 23 bp, Homo sapiens
tgagtctcactctgtcacccagg

SEQ ID NO: 158026 - DNA, 22 bp, Homo sapiens
agagtctcgctctgtcacccag

SEQ ID NO: 158027 - DNA, 21 bp, Homo sapiens
gggtctcgctctgtcgctcag

SEQ ID NO: 158028 - DNA, 22 bp, Homo sapiens
agagtctcgctctgtcacccag

SEQ ID NO: 158029 - DNA, 23 bp, Homo sapiens
tcatctcagaactttgtgaggcc

SEQ ID NO: 158030 - DNA, 23 bp, Homo sapiens
acagagtctcactctgtcgccca

SEQ ID NO: 158031 - DNA, 23 bp, Homo sapiens
acagagtctccctctgtcactca

SEQ ID NO: 158032 - DNA, 23 bp, Homo sapiens
agaggtgtgttttacttgttcac

SEQ ID NO: 158033 - DNA, 20 bp, Homo sapiens
tcacgggcctgtagtcccag

SEQ ID NO: 158034 - DNA, 23 bp, Homo sapiens
actggctctctgactggtaaggt

SEQ ID NO: 158035 - DNA, 23 bp, Homo sapiens
ggctgaggtaggaggatcacttg

SEQ ID NO: 158036 - DNA, 23 bp, Homo sapiens
ctctgtgtcactgtggctcagag

SEQ ID NO: 158037 - DNA, 23 bp, Homo sapiens
ctgtgtgtccgtgtgtcttggcc

SEQ ID NO: 158038 - DNA, 23 bp, Homo sapiens
actctcggtcagtaccgtgtaga

SEQ ID NO: 158039 - DNA, 21 bp, Homo sapiens
tgctgcatcacactgacactc

SEQ ID NO: 158040 - DNA, 23 bp, Homo sapiens
gtacccttctctccctgtctggc

SEQ ID NO: 158041 - DNA, 23 bp, Homo sapiens
gacagaagacagtcttgagggac

SEQ ID NO: 158042 - DNA, 23 bp, Homo sapiens
gtggtggtgcacctgtagtccca

SEQ ID NO: 158043 - DNA, 23 bp, Homo sapiens
aggcactctgagtaaggggaagc

SEQ ID NO: 158044 - DNA, 23 bp, Homo sapiens
gactgagtctcgctctgtcaccc

SEQ ID NO: 158045 - DNA, 23 bp, Homo sapiens
tacagtggcatgatcttggctta

SEQ ID NO: 158046 - DNA, 23 bp, Homo sapiens
ctggctctgtgtgtctctctctc

SEQ ID NO: 158047 - DNA, 21 bp, Homo sapiens
tctgcagttattttctttttc

SEQ ID NO: 158048 - DNA, 23 bp, Homo sapiens
gtctgtctgtctgtctgtctgtc

SEQ ID NO: 158049 - DNA, 23 bp, Homo sapiens
tctcagtctcccaaagtgctggg

SEQ ID NO: 158050 - DNA, 23 bp, Homo sapiens
atctcaactcactgcaacctctg

SEQ ID NO: 158051 - DNA, 23 bp, Homo sapiens
acagagtctcactctgtcgccca

SEQ ID NO: 158052 - DNA, 21 bp, Homo sapiens
tggagtctcactctgtcaccc

SEQ ID NO: 158053 - DNA, 23 bp, Homo sapiens
tccctcggtctctctctgccttt

SEQ ID NO: 158054 - DNA, 23 bp, Homo sapiens
caggtgagtgtgaggtgaggttc

SEQ ID NO: 158055 - DNA, 19 bp, Homo sapiens
tcaatagatgaggaactgg

SEQ ID NO: 158056 - DNA, 23 bp, Homo sapiens
tctctctgattctctctgtctct

SEQ ID NO: 158057 - DNA, 23 bp, Homo sapiens
tgagcctctcagtccctccgtct

SEQ ID NO: 158058 - DNA, 18 bp, Homo sapiens
acagaaggaagtgagcac

SEQ ID NO: 158059 - DNA, 23 bp, Homo sapiens
ggagtcagtagagtgtgacctga

SEQ ID NO: 158060 - DNA, 20 bp, Homo sapiens
agattacttaccttgaaaaa

SEQ ID NO: 158061 - DNA, 23 bp, Homo sapiens
tcatgtcagaagtgtgtgaggag

SEQ ID NO: 158062 - DNA, 23 bp, Homo sapiens
acaaagtatatttataggttagg

SEQ ID NO: 158063 - DNA, 22 bp, Homo sapiens
agtgtcagcatctgcttgtggt

SEQ ID NO: 158064 - DNA, 21 bp, Homo sapiens
tttgtctgtgttcattgggtc

SEQ ID NO: 158065 - DNA, 22 bp, Homo sapiens
tcagagctgtagctggagaagg

SEQ ID NO: 158066 - DNA, 22 bp, Homo sapiens
tctgtctgtcagtttgtctctc

SEQ ID NO: 158067 - DNA, 23 bp, Homo sapiens
gtatgtgtgtgtaaatgtaactg

SEQ ID NO: 158068 - DNA, 23 bp, Homo sapiens
tctcactctgccactcagtctgc

SEQ ID NO: 158069 - DNA, 20 bp, Homo sapiens
atgtgtgcttgtatctatta

SEQ ID NO: 158070 - DNA, 23 bp, Homo sapiens
acaaagtatatttataggttagg

SEQ ID NO: 158071 - DNA, 22 bp, Homo sapiens
agtgtcagcatctgcttgtggt

SEQ ID NO: 158072 - DNA, 23 bp, Homo sapiens
agacagtctcgctctgtcaccca

SEQ ID NO: 158073 - DNA, 19 bp, Homo sapiens
gagacacagtctcactgtg

SEQ ID NO: 158074 - DNA, 23 bp, Homo sapiens
ttcacagtgtgattttgttttat

SEQ ID NO: 158075 - DNA, 20 bp, Homo sapiens
agagacaggggtctcagtat

SEQ ID NO: 158076 - DNA, 23 bp, Homo sapiens
ttctgtgaagaaagtcaatggta

SEQ ID NO: 158077 - DNA, 23 bp, Homo sapiens
acactcacacagtgtgaccttgc

SEQ ID NO: 158078 - DNA, 23 bp, Homo sapiens
tgagttcattgtagattctggat

SEQ ID NO: 158079 - DNA, 23 bp, Homo sapiens
tgagttcattgtagattctggat

SEQ ID NO: 158080 - DNA, 22 bp, Homo sapiens
ttctgacactctcaggatgtgg

SEQ ID NO: 158081 - DNA, 23 bp, Homo sapiens
tgagttcattgtagattctggat

SEQ ID NO: 158082 - DNA, 23 bp, Homo sapiens
tgagttcattgtagattctggat

SEQ ID NO: 158083 - DNA, 23 bp, Homo sapiens
gccagagcctcagttcagctgct

SEQ ID NO: 158084 - DNA, 23 bp, Homo sapiens
tttgagacagaatctcactctat

SEQ ID NO: 158085 - DNA, 23 bp, Homo sapiens
ttttagttccatatgaaatttaa

SEQ ID NO: 158086 - DNA, 23 bp, Homo sapiens
ttctttgaagaaagtcagtggtg

SEQ ID NO: 158087 - DNA, 23 bp, Homo sapiens
tcagatgttaggcaaaggtatgt

SEQ ID NO: 158088 - DNA, 20 bp, Homo sapiens
acagagtctcactctatcac

SEQ ID NO: 158089 - DNA, 23 bp, Homo sapiens
tgagttcattgtagattctggat

SEQ ID NO: 158090 - DNA, 23 bp, Homo sapiens
tgagttcattgtagattctggat

SEQ ID NO: 158091 - DNA, 22 bp, Homo sapiens
atgaagctggaaaggcagctga

SEQ ID NO: 158092 - DNA, 23 bp, Homo sapiens
tgagttcattgtagattctggat

SEQ ID NO: 158093 - DNA, 23 bp, Homo sapiens
tgagttcattgtagattctggat

SEQ ID NO: 158094 - DNA, 23 bp, Homo sapiens
tgagttcattgtagattctggat

SEQ ID NO: 158095 - DNA, 23 bp, Homo sapiens
tgagttcattgtagattctggat

SEQ ID NO: 158096 - DNA, 23 bp, Homo sapiens
tgagttcattgtagattctggat

SEQ ID NO: 158097 - DNA, 23 bp, Homo sapiens
tgagttcattgtagattctggat

SEQ ID NO: 158098 - DNA, 23 bp, Homo sapiens
atgtgtgtatatatatatgtgtg

SEQ ID NO: 158099 - DNA, 23 bp, Homo sapiens
tatgtgtatatatatgtgtgtgt

SEQ ID NO: 158100 - DNA, 23 bp, Homo sapiens
aagtggtaaagaatactatatgg

SEQ ID NO: 158101 - DNA, 23 bp, Homo sapiens
tggaatttatgcagaactcaagg

SEQ ID NO: 158102 - DNA, 23 bp, Homo sapiens
cagtgcttttgtatacattcact

SEQ ID NO: 158103 - DNA, 23 bp, Homo sapiens
tttagtagctatggattcagaat

SEQ ID NO: 158104 - DNA, 23 bp, Homo sapiens
tgagttcattgtagattctggat

SEQ ID NO: 158105 - DNA, 23 bp, Homo sapiens
tgagttcattgtagattctggat

SEQ ID NO: 158106 - DNA, 23 bp, Homo sapiens
actttgtctctgactctttctga

SEQ ID NO: 158107 - DNA, 20 bp, Homo sapiens
gaaagaacattgggcaagga

SEQ ID NO: 158108 - DNA, 23 bp, Homo sapiens
caactctctctcttactttctgc

SEQ ID NO: 158109 - DNA, 18 bp, Homo sapiens
gagagatgtcagcgagga

SEQ ID NO: 158110 - DNA, 23 bp, Homo sapiens
ctgtgtttcactctgtggctcag

SEQ ID NO: 158111 - DNA, 23 bp, Homo sapiens
agcatgagttctgattctgtcag

SEQ ID NO: 158112 - DNA, 23 bp, Homo sapiens
ggaagagagtgaggttaggatat

SEQ ID NO: 158113 - DNA, 19 bp, Homo sapiens
gctgtctccgtgcttccct

SEQ ID NO: 158114 - DNA, 23 bp, Homo sapiens
tggagtctcactctgtcacccag

SEQ ID NO: 158115 - DNA, 19 bp, Homo sapiens
tgcgcatctagtatcaggt

SEQ ID NO: 158116 - DNA, 20 bp, Homo sapiens
cccttgaactaggagaccag

SEQ ID NO: 158117 - DNA, 23 bp, Homo sapiens
tttctgagcctcagtaaaaactg

SEQ ID NO: 158118 - DNA, 23 bp, Homo sapiens
gtcccagctactcaaaaggctga

SEQ ID NO: 158119 - DNA, 20 bp, Homo sapiens
agctatgtagtgagctaagt

SEQ ID NO: 158120 - DNA, 23 bp, Homo sapiens
ttacttctacaacttggatattg

SEQ ID NO: 158121 - DNA, 23 bp, Homo sapiens
tccttgtatgtatgtatgtatgt

SEQ ID NO: 158122 - DNA, 23 bp, Homo sapiens
actcacctgtagtctcagctact

SEQ ID NO: 158123 - DNA, 21 bp, Homo sapiens
tgaggtaggaggatcacttga

SEQ ID NO: 158124 - DNA, 23 bp, Homo sapiens
ttgcacattggttttctatagaa

SEQ ID NO: 158125 - DNA, 22 bp, Homo sapiens
tctctgggcctgagtttcccca

SEQ ID NO: 158126 - DNA, 22 bp, Homo sapiens
agagggaggaggactgttagtt

SEQ ID NO: 158127 - DNA, 23 bp, Homo sapiens
caggtactcactgacactgtctg

SEQ ID NO: 158128 - DNA, 23 bp, Homo sapiens
acactgcctctcactgtctgagc

SEQ ID NO: 158129 - DNA, 20 bp, Homo sapiens
ggactgtggttggtgggaga

SEQ ID NO: 158130 - DNA, 22 bp, Homo sapiens
cggcctgcctgtgagcctctgt

SEQ ID NO: 158131 - DNA, 23 bp, Homo sapiens
tacatgtccattttgggtcagtt

SEQ ID NO: 158132 - DNA, 22 bp, Homo sapiens
ttctctgtctctataatctggc

SEQ ID NO: 158133 - DNA, 23 bp, Homo sapiens
tgttcttgcttctaagtgagagt

SEQ ID NO: 158134 - DNA, 23 bp, Homo sapiens
tctgtgcctcactctgtcccata

SEQ ID NO: 158135 - DNA, 23 bp, Homo sapiens
agtggcatgatcatagctgactg

SEQ ID NO: 158136 - DNA, 18 bp, Homo sapiens
agagtgaggtgattgcag

SEQ ID NO: 158137 - DNA, 23 bp, Homo sapiens
ctctcactctctgcctgacattc

SEQ ID NO: 158138 - DNA, 21 bp, Homo sapiens
ttttagcatccttgtattttg

SEQ ID NO: 158139 - DNA, 23 bp, Homo sapiens
agagagatctgtgagtgaagatg

SEQ ID NO: 158140 - DNA, 20 bp, Homo sapiens
actatgtatgtattatagtt

SEQ ID NO: 158141 - DNA, 23 bp, Homo sapiens
tatgtattacagttacatacatt

SEQ ID NO: 158142 - DNA, 23 bp, Homo sapiens
caagtctagtcttcatgttcttc

SEQ ID NO: 158143 - DNA, 20 bp, Homo sapiens
aagtgctgggattacaggca

SEQ ID NO: 158144 - DNA, 23 bp, Homo sapiens
actgtgcctgactcccaccctca

SEQ ID NO: 158145 - DNA, 19 bp, Homo sapiens
ctcaggaaattttgatgtt

SEQ ID NO: 158146 - DNA, 23 bp, Homo sapiens
cagagtctcactctgtggcccag

SEQ ID NO: 158147 - DNA, 21 bp, Homo sapiens
tacagtggcacaatcttgtct

SEQ ID NO: 158148 - DNA, 22 bp, Homo sapiens
tgtcagagtgagactctgcctc

SEQ ID NO: 158149 - DNA, 21 bp, Homo sapiens
tagacacagggtctcactctg

SEQ ID NO: 158150 - DNA, 23 bp, Homo sapiens
gagatggtctcactctgtcaccc

SEQ ID NO: 158151 - DNA, 19 bp, Homo sapiens
cagtggtagatctcagctt

SEQ ID NO: 158152 - DNA, 23 bp, Homo sapiens
acagagtctcgcactgtcaccca

SEQ ID NO: 158153 - DNA, 23 bp, Homo sapiens
gagtctcactctgtcacccaggc

SEQ ID NO: 158154 - DNA, 19 bp, Homo sapiens
actgtataacatacagtta

SEQ ID NO: 158155 - DNA, 23 bp, Homo sapiens
cctagtgacacaagtcactgagg

SEQ ID NO: 158156 - DNA, 20 bp, Homo sapiens
tttgagacagagtctcactc

SEQ ID NO: 158157 - DNA, 23 bp, Homo sapiens
gattctcactctgtcacccaggc

SEQ ID NO: 158158 - DNA, 20 bp, Homo sapiens
atacatgtgtatatgtatct

SEQ ID NO: 158159 - DNA, 23 bp, Homo sapiens
attctgcctctggttctgcctct

SEQ ID NO: 158160 - DNA, 23 bp, Homo sapiens
agtctcttcctctctctgggact

SEQ ID NO: 158161 - DNA, 23 bp, Homo sapiens
aaggtgtttctgcatctggatgt

SEQ ID NO: 158162 - DNA, 21 bp, Homo sapiens
tatataacaggatgcatatat

SEQ ID NO: 158163 - DNA, 22 bp, Homo sapiens
ttatccagagctcccgggctgt

SEQ ID NO: 158164 - DNA, 20 bp, Homo sapiens
ttggtccatctggagctgtt

SEQ ID NO: 158165 - DNA, 23 bp, Homo sapiens
tgtctgtcagcctgtgtgcttgc

SEQ ID NO: 158166 - DNA, 23 bp, Homo sapiens
ttactgagagaaaatcatgactc

SEQ ID NO: 158167 - DNA, 23 bp, Homo sapiens
ggctctgagtctctgtgcctcag

SEQ ID NO: 158168 - DNA, 23 bp, Homo sapiens
tacccctttgtggttaccttgtt

SEQ ID NO: 158169 - DNA, 23 bp, Homo sapiens
atatgtgtatatatatgtgtgta

SEQ ID NO: 158170 - DNA, 22 bp, Homo sapiens
atgtgtatatatatgtgtgtat

SEQ ID NO: 158171 - DNA, 19 bp, Homo sapiens
ctcgactcactgtaacctc

SEQ ID NO: 158172 - DNA, 23 bp, Homo sapiens
tcacttggacctttatagttgag

SEQ ID NO: 158173 - DNA, 19 bp, Homo sapiens
acatacctgtagtcccagc

SEQ ID NO: 158174 - DNA, 23 bp, Homo sapiens
agtgagcggagatcacactgctg

SEQ ID NO: 158175 - DNA, 23 bp, Homo sapiens
acttgagtgaacaaagggaggac

SEQ ID NO: 158176 - DNA, 22 bp, Homo sapiens
ccctctgaccttaccagctctg

SEQ ID NO: 158177 - DNA, 23 bp, Homo sapiens
tgggtagaggttgggttagtata

SEQ ID NO: 158178 - DNA, 23 bp, Homo sapiens
gtctttctttccagacagtctgt

SEQ ID NO: 158179 - DNA, 23 bp, Homo sapiens
ttttgagcacctactgtatgcta

SEQ ID NO: 158180 - DNA, 23 bp, Homo sapiens
tctctgtgagtgatttagcagag

SEQ ID NO: 158181 - DNA, 20 bp, Homo sapiens
atatgtatatgtatatgtat

SEQ ID NO: 158182 - DNA, 23 bp, Homo sapiens
cgagtctctctctgtcactcagg

SEQ ID NO: 158183 - DNA, 23 bp, Homo sapiens
gatagggtcagtacatgcctctg

SEQ ID NO: 158184 - DNA, 23 bp, Homo sapiens
tgaggcagattctcactctgtca

SEQ ID NO: 158185 - DNA, 19 bp, Homo sapiens
caccaattctaatctcacc

SEQ ID NO: 158186 - DNA, 23 bp, Homo sapiens
cagagtctcactctgtcactcag

SEQ ID NO: 158187 - DNA, 21 bp, Homo sapiens
tacagtggtgtgatctcagct

SEQ ID NO: 158188 - DNA, 22 bp, Homo sapiens
ttatttttgataaagtgttgat

SEQ ID NO: 158189 - DNA, 23 bp, Homo sapiens
tgtctctctctctcattgcccct

SEQ ID NO: 158190 - DNA, 23 bp, Homo sapiens
agtgtgaggatgacttcagatag

SEQ ID NO: 158191 - DNA, 23 bp, Homo sapiens
aggctgtttttggatcactattc

SEQ ID NO: 158192 - DNA, 23 bp, Homo sapiens
tcagtctctgggtctgtgagatg

SEQ ID NO: 158193 - DNA, 23 bp, Homo sapiens
tcaccaggtgctatgaagaggga

SEQ ID NO: 158194 - DNA, 23 bp, Homo sapiens
atcacagactgaggcttcctact

SEQ ID NO: 158195 - DNA, 23 bp, Homo sapiens
gacttctcagtttcttcatctgc

SEQ ID NO: 158196 - DNA, 19 bp, Homo sapiens
gagagtgataatgtcttcc

SEQ ID NO: 158197 - DNA, 23 bp, Homo sapiens
ctgagtctcactctgtcgctcag

SEQ ID NO: 158198 - DNA, 23 bp, Homo sapiens
taaaaggtgcataataatggcat

SEQ ID NO: 158199 - DNA, 22 bp, Homo sapiens
ttatccatatgtagaagatagc

SEQ ID NO: 158200 - DNA, 21 bp, Homo sapiens
atcgtgtgactgcaacctctg

SEQ ID NO: 158201 - DNA, 23 bp, Homo sapiens
aatgtctcagcccttttcctgtc

SEQ ID NO: 158202 - DNA, 23 bp, Homo sapiens
acctgtgtgaactctgtgagccc

SEQ ID NO: 158203 - DNA, 22 bp, Homo sapiens
cactcactgtgggtgacacctg

SEQ ID NO: 158204 - DNA, 23 bp, Homo sapiens
gggtctcactctgtcacccaggc

SEQ ID NO: 158205 - DNA, 23 bp, Homo sapiens
tctcacagtctcactatgttgcc

SEQ ID NO: 158206 - DNA, 22 bp, Homo sapiens
tggaaggctgtgtcacagtctc

SEQ ID NO: 158207 - DNA, 23 bp, Homo sapiens
cggagtctcactctgtcacccag

SEQ ID NO: 158208 - DNA, 19 bp, Homo sapiens
tgtgtgtatatgtgtctgt

SEQ ID NO: 158209 - DNA, 23 bp, Homo sapiens
tgaatctctctgtgcctcaggat

SEQ ID NO: 158210 - DNA, 20 bp, Homo sapiens
agggatggatctgatgccct

SEQ ID NO: 158211 - DNA, 23 bp, Homo sapiens
ctcagttctccctctgtcaggtg

SEQ ID NO: 158212 - DNA, 20 bp, Homo sapiens
ctcagagagaagaatgagca

SEQ ID NO: 158213 - DNA, 23 bp, Homo sapiens
agggtctcgctctgtcacacagg

SEQ ID NO: 158214 - DNA, 23 bp, Homo sapiens
ctcagactccacgtgtgttctcc

SEQ ID NO: 158215 - DNA, 23 bp, Homo sapiens
gtctcagtttctgtctgtgtcac

SEQ ID NO: 158216 - DNA, 22 bp, Homo sapiens
aagaccaacccagatttgatga

SEQ ID NO: 158217 - DNA, 18 bp, Homo sapiens
gccaacagtgaaacctgt

SEQ ID NO: 158218 - DNA, 23 bp, Homo sapiens
ccactctgtgtctgtctgttctg

SEQ ID NO: 158219 - DNA, 21 bp, Homo sapiens
catatatgtatacatgtacgt

SEQ ID NO: 158220 - DNA, 23 bp, Homo sapiens
tctctctctctctggctatcttg

SEQ ID NO: 158221 - DNA, 23 bp, Homo sapiens
ggtgacagagcaagaccctgtct

SEQ ID NO: 158222 - DNA, 23 bp, Homo sapiens
attgagacggagttttgctcttg

SEQ ID NO: 158223 - DNA, 23 bp, Homo sapiens
gtgtgtgtatatatatatgtgtg

SEQ ID NO: 158224 - DNA, 23 bp, Homo sapiens
atacgtatatatatatatgtata

SEQ ID NO: 158225 - DNA, 23 bp, Homo sapiens
ttcactctgccgcacatcacagg

SEQ ID NO: 158226 - DNA, 23 bp, Homo sapiens
tgagttcattgtagattctggat

SEQ ID NO: 158227 - DNA, 23 bp, Homo sapiens
tgagttcattgtagattctggat

SEQ ID NO: 158228 - DNA, 23 bp, Homo sapiens
cggagtctcactctgtcaccccg

SEQ ID NO: 158229 - DNA, 23 bp, Homo sapiens
agtgcaagggtgtgatcttggct

SEQ ID NO: 158230 - DNA, 23 bp, Homo sapiens
agacagagatgacacattgtatt

SEQ ID NO: 158231 - DNA, 20 bp, Homo sapiens
caagacaggcattcaactca

SEQ ID NO: 158232 - DNA, 23 bp, Homo sapiens
tgagttcattgtagattctggat

SEQ ID NO: 158233 - DNA, 23 bp, Homo sapiens
tgagttcattgtagattctggat

SEQ ID NO: 158234 - DNA, 18 bp, Homo sapiens
cagatatatggataaatg

SEQ ID NO: 158235 - DNA, 23 bp, Homo sapiens
tttatccatatctatctttatgt

SEQ ID NO: 158236 - DNA, 19 bp, Homo sapiens
ctttggttttgttaatatt

SEQ ID NO: 158237 - DNA, 22 bp, Homo sapiens
gagtgttcagtgtttctggatt

SEQ ID NO: 158238 - DNA, 23 bp, Homo sapiens
atgtgtgtgtatgtgtatatatg

SEQ ID NO: 158239 - DNA, 21 bp, Homo sapiens
atgtgtatatatatgtgtgtg

SEQ ID NO: 158240 - DNA, 23 bp, Homo sapiens
tgttgatcatggtgaatgcttgt

SEQ ID NO: 158241 - DNA, 23 bp, Homo sapiens
tgagttcattgtagattctggat

SEQ ID NO: 158242 - DNA, 23 bp, Homo sapiens
tgagttcattgtagattctggat

SEQ ID NO: 158243 - DNA, 23 bp, Homo sapiens
tgggaggcagagtttgcagtgag

SEQ ID NO: 158244 - DNA, 22 bp, Homo sapiens
ctcagcctctgagtcactggga

SEQ ID NO: 158245 - DNA, 23 bp, Homo sapiens
tggagtctcactgtgtcgctcag

SEQ ID NO: 158246 - DNA, 21 bp, Homo sapiens
tgtgtatgtatacgtgtgtgt

SEQ ID NO: 158247 - DNA, 21 bp, Homo sapiens
tactggttttattgtacttca

SEQ ID NO: 158248 - DNA, 23 bp, Homo sapiens
tttttggttccatatgaaattta

SEQ ID NO: 158249 - DNA, 20 bp, Homo sapiens
tgtatacatgtatatatgtg

SEQ ID NO: 158250 - DNA, 23 bp, Homo sapiens
atgtgtgtatataagtgtgtgta

SEQ ID NO: 158251 - DNA, 23 bp, Homo sapiens
ggaatgtaaagatcttcgtgtat

SEQ ID NO: 158252 - DNA, 23 bp, Homo sapiens
aggatatgatatgtattggtgag

SEQ ID NO: 158253 - DNA, 22 bp, Homo sapiens
atgcagtatatatatactgtat

SEQ ID NO: 158254 - DNA, 23 bp, Homo sapiens
tgagtgtggaacatgtttcttgt

SEQ ID NO: 158255 - DNA, 19 bp, Homo sapiens
tatgtgaggattaaacaga

SEQ ID NO: 158256 - DNA, 23 bp, Homo sapiens
gtgtgagagagagagacagagac

SEQ ID NO: 158257 - DNA, 22 bp, Homo sapiens
agtattgttttctagctcatag

SEQ ID NO: 158258 - DNA, 23 bp, Homo sapiens
gggtctcactctgtcacccaggc

SEQ ID NO: 158259 - DNA, 23 bp, Homo sapiens
tgggatgcacttccctgtcttct

SEQ ID NO: 158260 - DNA, 23 bp, Homo sapiens
gacagtctcgctctgtcacccag

SEQ ID NO: 158261 - DNA, 23 bp, Homo sapiens
gtaagacagtagtggcaggggac

SEQ ID NO: 158262 - DNA, 21 bp, Homo sapiens
ttgtgttatgtagatgaaaat

SEQ ID NO: 158263 - DNA, 23 bp, Homo sapiens
tatagagtatatgaatatatgta

SEQ ID NO: 158264 - DNA, 21 bp, Homo sapiens
ataatctgtttggtacttatg

SEQ ID NO: 158265 - DNA, 19 bp, Homo sapiens
ctctcgctctgtcacccag

SEQ ID NO: 158266 - DNA, 21 bp, Homo sapiens
ttcagtatatatatatatgta

SEQ ID NO: 158267 - DNA, 23 bp, Homo sapiens
tgtgtgtgcatatatattctata

SEQ ID NO: 158268 - DNA, 23 bp, Homo sapiens
tgatagaagtgtatgcaaaactc

SEQ ID NO: 158269 - DNA, 23 bp, Homo sapiens
tataattgtgattttgttcattt

SEQ ID NO: 158270 - DNA, 20 bp, Homo sapiens
agttagatggttgtatagaa

SEQ ID NO: 158271 - DNA, 23 bp, Homo sapiens
atctatcagccatttcaatttca

SEQ ID NO: 158272 - DNA, 20 bp, Homo sapiens
atatatgtatatgtatatgt

SEQ ID NO: 158273 - DNA, 21 bp, Homo sapiens
acatgcacacacacatatgtg

SEQ ID NO: 158274 - DNA, 19 bp, Homo sapiens
tgaagtgtatttcttgtag

SEQ ID NO: 158275 - DNA, 22 bp, Homo sapiens
ttcagccactctgtgtctttca

SEQ ID NO: 158276 - DNA, 23 bp, Homo sapiens
tctcattggttatctagcagctt

SEQ ID NO: 158277 - DNA, 23 bp, Homo sapiens
tgttggctgtgcatgatttcacc

SEQ ID NO: 158278 - DNA, 22 bp, Homo sapiens
tagagaatttcttgttgtccat

SEQ ID NO: 158279 - DNA, 22 bp, Homo sapiens
tatgtgtatatatatatgtatg

SEQ ID NO: 158280 - DNA, 22 bp, Homo sapiens
ttcctttttatagctgcatagt

SEQ ID NO: 158281 - DNA, 22 bp, Homo sapiens
gtgtggtataaaatgaagtatg

SEQ ID NO: 158282 - DNA, 23 bp, Homo sapiens
gttagtcgatgtagctagaaaag

SEQ ID NO: 158283 - DNA, 23 bp, Homo sapiens
tgtacatatatgtgtgtgtgtat

SEQ ID NO: 158284 - DNA, 23 bp, Homo sapiens
ttttctgtcagacattctttttt

SEQ ID NO: 158285 - DNA, 23 bp, Homo sapiens
tatgtcagagagaatgtgttaag

SEQ ID NO: 158286 - DNA, 23 bp, Homo sapiens
gacagagtctcgctctgtcaccc

SEQ ID NO: 158287 - DNA, 23 bp, Homo sapiens
ttgaatactgtttttgtagatga

SEQ ID NO: 158288 - DNA, 19 bp, Homo sapiens
atagatagatatctataga

SEQ ID NO: 158289 - DNA, 23 bp, Homo sapiens
tgagttcattgtagattctggat

SEQ ID NO: 158290 - DNA, 20 bp, Homo sapiens
tgcctgactgcttttgagct

SEQ ID NO: 158291 - DNA, 23 bp, Homo sapiens
tgtgtgtgcatgtgtatctgtgt

SEQ ID NO: 158292 - DNA, 19 bp, Homo sapiens
tcagctctatccatgttct

SEQ ID NO: 158293 - DNA, 21 bp, Homo sapiens
tatacgtgtctatatctacat

SEQ ID NO: 158294 - DNA, 23 bp, Homo sapiens
tatatgtgtgtgtatatgtagat

SEQ ID NO: 158295 - DNA, 23 bp, Homo sapiens
tatactctttatatatatctctc

SEQ ID NO: 158296 - DNA, 21 bp, Homo sapiens
agacatatatacatgtatatg

SEQ ID NO: 158297 - DNA, 21 bp, Homo sapiens
acacacgtatgtatatgtata

SEQ ID NO: 158298 - DNA, 23 bp, Homo sapiens
atatgtatatatgtatatgtgtg

SEQ ID NO: 158299 - DNA, 21 bp, Homo sapiens
tcagaatcacttttttttgtc

SEQ ID NO: 158300 - DNA, 23 bp, Homo sapiens
ccactgtctgtctgctcacctgc

SEQ ID NO: 158301 - DNA, 21 bp, Homo sapiens
gaggaggtgttgtactgaaga

SEQ ID NO: 158302 - DNA, 23 bp, Homo sapiens
atatgtatatatgtatatatgtg

SEQ ID NO: 158303 - DNA, 23 bp, Homo sapiens
agagtctcactctgtcacccagg

SEQ ID NO: 158304 - DNA, 23 bp, Homo sapiens
gagtctcactctgtcacccaggc

SEQ ID NO: 158305 - DNA, 23 bp, Homo sapiens
aaggtctctctctctctctccag

SEQ ID NO: 158306 - DNA, 23 bp, Homo sapiens
ttcaagagtttctcctgcctcag

SEQ ID NO: 158307 - DNA, 23 bp, Homo sapiens
gacagtctcgctctgtcacccag

SEQ ID NO: 158308 - DNA, 18 bp, Homo sapiens
gtgtatatacgtatatgt

SEQ ID NO: 158309 - DNA, 23 bp, Homo sapiens
acaggaaagagtgtctgcacaga

SEQ ID NO: 158310 - DNA, 19 bp, Homo sapiens
aaaatgtgtgcatgtgcat

SEQ ID NO: 158311 - DNA, 23 bp, Homo sapiens
tgtatgtgcatgtgcatgtgtgt

SEQ ID NO: 158312 - DNA, 23 bp, Homo sapiens
tatgtatgagcatatgaatggat
